United States Patent 8,822,426 (PREVENTION AND TREATMENT OF NOSEMA DISEASE IN BEES) - sequence listing, part 5

SEQ ID NO: 130430 - DNA, 21 bp, Artificial sequence
  SiRNA target sequence
gatttaattggtatagtagct

SEQ ID NO: 130431 - DNA, 21 bp, Artificial sequence
  SiRNA target sequence
atttaattggtatagtagctg

SEQ ID NO: 130432 - DNA, 21 bp, Artificial sequence
  SiRNA target sequence
tttaattggtatagtagctga

SEQ ID NO: 130433 - DNA, 21 bp, Artificial sequence
  SiRNA target sequence
ttaattggtatagtagctgaa

SEQ ID NO: 130434 - DNA, 21 bp, Artificial sequence
  SiRNA target sequence
taattggtatagtagctgaag

SEQ ID NO: 130435 - DNA, 21 bp, Artificial sequence
  SiRNA target sequence
aattggtatagtagctgaagt

SEQ ID NO: 130436 - DNA, 21 bp, Artificial sequence
  SiRNA target sequence
attggtatagtagctgaagta

SEQ ID NO: 130437 - DNA, 21 bp, Artificial sequence
  SiRNA target sequence
ttggtatagtagctgaagtaa

SEQ ID NO: 130438 - DNA, 21 bp, Artificial sequence
  SiRNA target sequence
tggtatagtagctgaagtaat

SEQ ID NO: 130439 - DNA, 21 bp, Artificial sequence
  SiRNA target sequence
ggtatagtagctgaagtaatg

SEQ ID NO: 130440 - DNA, 21 bp, Artificial sequence
  SiRNA target sequence
gtatagtagctgaagtaatga

SEQ ID NO: 130441 - DNA, 21 bp, Artificial sequence
  SiRNA target sequence
tatagtagctgaagtaatgaa

SEQ ID NO: 130442 - DNA, 21 bp, Artificial sequence
  SiRNA target sequence
atagtagctgaagtaatgaaa

SEQ ID NO: 130443 - DNA, 21 bp, Artificial sequence
  SiRNA target sequence
tagtagctgaagtaatgaaag

SEQ ID NO: 130444 - DNA, 21 bp, Artificial sequence
  SiRNA target sequence
agtagctgaagtaatgaaaga

SEQ ID NO: 130445 - DNA, 21 bp, Artificial sequence
  SiRNA target sequence
gtagctgaagtaatgaaagac

SEQ ID NO: 130446 - DNA, 21 bp, Artificial sequence
  SiRNA target sequence
tagctgaagtaatgaaagact

SEQ ID NO: 130447 - DNA, 21 bp, Artificial sequence
  SiRNA target sequence
agctgaagtaatgaaagacta

SEQ ID NO: 130448 - DNA, 21 bp, Artificial sequence
  SiRNA target sequence
gctgaagtaatgaaagactat

SEQ ID NO: 130449 - DNA, 21 bp, Artificial sequence
  SiRNA target sequence
ctgaagtaatgaaagactatt

SEQ ID NO: 130450 - DNA, 21 bp, Artificial sequence
  SiRNA target sequence
tgaagtaatgaaagactatta

SEQ ID NO: 130451 - DNA, 21 bp, Artificial sequence
  SiRNA target sequence
gaagtaatgaaagactattac

SEQ ID NO: 130452 - DNA, 21 bp, Artificial sequence
  SiRNA target sequence
aagtaatgaaagactattacg

SEQ ID NO: 130453 - DNA, 21 bp, Artificial sequence
  SiRNA target sequence
agtaatgaaagactattacgg

SEQ ID NO: 130454 - DNA, 21 bp, Artificial sequence
  SiRNA target sequence
gtaatgaaagactattacgga

SEQ ID NO: 130455 - DNA, 21 bp, Artificial sequence
  SiRNA target sequence
taatgaaagactattacggat

SEQ ID NO: 130456 - DNA, 21 bp, Artificial sequence
  SiRNA target sequence
aatgaaagactattacggatg

SEQ ID NO: 130457 - DNA, 21 bp, Artificial sequence
  SiRNA target sequence
atgaaagactattacggatgg

SEQ ID NO: 130458 - DNA, 21 bp, Artificial sequence
  SiRNA target sequence
tgaaagactattacggatggg

SEQ ID NO: 130459 - DNA, 21 bp, Artificial sequence
  SiRNA target sequence
gaaagactattacggatggga

SEQ ID NO: 130460 - DNA, 21 bp, Artificial sequence
  SiRNA target sequence
aaagactattacggatgggat

SEQ ID NO: 130461 - DNA, 21 bp, Artificial sequence
  SiRNA target sequence
aagactattacggatgggatc

SEQ ID NO: 130462 - DNA, 21 bp, Artificial sequence
  SiRNA target sequence
agactattacggatgggatca

SEQ ID NO: 130463 - DNA, 21 bp, Artificial sequence
  SiRNA target sequence
gactattacggatgggatcag

SEQ ID NO: 130464 - DNA, 21 bp, Artificial sequence
  SiRNA target sequence
actattacggatgggatcagc

SEQ ID NO: 130465 - DNA, 21 bp, Artificial sequence
  SiRNA target sequence
ctattacggatgggatcagca

SEQ ID NO: 130466 - DNA, 21 bp, Artificial sequence
  SiRNA target sequence
tattacggatgggatcagcaa

SEQ ID NO: 130467 - DNA, 21 bp, Artificial sequence
  SiRNA target sequence
attacggatgggatcagcaaa

SEQ ID NO: 130468 - DNA, 21 bp, Artificial sequence
  SiRNA target sequence
ttacggatgggatcagcaaag

SEQ ID NO: 130469 - DNA, 21 bp, Artificial sequence
  SiRNA target sequence
tacggatgggatcagcaaaga

SEQ ID NO: 130470 - DNA, 21 bp, Artificial sequence
  SiRNA target sequence
acggatgggatcagcaaagat

SEQ ID NO: 130471 - DNA, 21 bp, Artificial sequence
  SiRNA target sequence
cggatgggatcagcaaagata

SEQ ID NO: 130472 - DNA, 21 bp, Artificial sequence
  SiRNA target sequence
ggatgggatcagcaaagatat

SEQ ID NO: 130473 - DNA, 21 bp, Artificial sequence
  SiRNA target sequence
gatgggatcagcaaagatata

SEQ ID NO: 130474 - DNA, 21 bp, Artificial sequence
  SiRNA target sequence
atgggatcagcaaagatataa

SEQ ID NO: 130475 - DNA, 21 bp, Artificial sequence
  SiRNA target sequence
tgggatcagcaaagatataat

SEQ ID NO: 130476 - DNA, 21 bp, Artificial sequence
  SiRNA target sequence
gggatcagcaaagatataatg

SEQ ID NO: 130477 - DNA, 21 bp, Artificial sequence
  SiRNA target sequence
ggatcagcaaagatataatga

SEQ ID NO: 130478 - DNA, 21 bp, Artificial sequence
  SiRNA target sequence
gatcagcaaagatataatgaa

SEQ ID NO: 130479 - DNA, 21 bp, Artificial sequence
  SiRNA target sequence
atcagcaaagatataatgaag

SEQ ID NO: 130480 - DNA, 21 bp, Artificial sequence
  SiRNA target sequence
tcagcaaagatataatgaaga

SEQ ID NO: 130481 - DNA, 21 bp, Artificial sequence
  SiRNA target sequence
cagcaaagatataatgaagaa

SEQ ID NO: 130482 - DNA, 21 bp, Artificial sequence
  SiRNA target sequence
agcaaagatataatgaagaaa

SEQ ID NO: 130483 - DNA, 21 bp, Artificial sequence
  SiRNA target sequence
gcaaagatataatgaagaaac

SEQ ID NO: 130484 - DNA, 21 bp, Artificial sequence
  SiRNA target sequence
caaagatataatgaagaaaca

SEQ ID NO: 130485 - DNA, 21 bp, Artificial sequence
  SiRNA target sequence
aaagatataatgaagaaacaa

SEQ ID NO: 130486 - DNA, 21 bp, Artificial sequence
  SiRNA target sequence
aagatataatgaagaaacaaa

SEQ ID NO: 130487 - DNA, 21 bp, Artificial sequence
  SiRNA target sequence
agatataatgaagaaacaaaa

SEQ ID NO: 130488 - DNA, 21 bp, Artificial sequence
  SiRNA target sequence
gatataatgaagaaacaaaat

SEQ ID NO: 130489 - DNA, 21 bp, Artificial sequence
  SiRNA target sequence
atataatgaagaaacaaaatt

SEQ ID NO: 130490 - DNA, 21 bp, Artificial sequence
  SiRNA target sequence
tataatgaagaaacaaaatta

SEQ ID NO: 130491 - DNA, 21 bp, Artificial sequence
  SiRNA target sequence
ataatgaagaaacaaaattat

SEQ ID NO: 130492 - DNA, 21 bp, Artificial sequence
  SiRNA target sequence
taatgaagaaacaaaattatg

SEQ ID NO: 130493 - DNA, 21 bp, Artificial sequence
  SiRNA target sequence
aatgaagaaacaaaattatgc

SEQ ID NO: 130494 - DNA, 21 bp, Artificial sequence
  SiRNA target sequence
atgaagaaacaaaattatgca

SEQ ID NO: 130495 - DNA, 21 bp, Artificial sequence
  SiRNA target sequence
tgaagaaacaaaattatgcat

SEQ ID NO: 130496 - DNA, 21 bp, Artificial sequence
  SiRNA target sequence
gaagaaacaaaattatgcatg

SEQ ID NO: 130497 - DNA, 21 bp, Artificial sequence
  SiRNA target sequence
aagaaacaaaattatgcatgg

SEQ ID NO: 130498 - DNA, 21 bp, Artificial sequence
  SiRNA target sequence
agaaacaaaattatgcatgga

SEQ ID NO: 130499 - DNA, 21 bp, Artificial sequence
  SiRNA target sequence
gaaacaaaattatgcatggaa

SEQ ID NO: 130500 - DNA, 21 bp, Artificial sequence
  SiRNA target sequence
aaacaaaattatgcatggaaa

SEQ ID NO: 130501 - DNA, 21 bp, Artificial sequence
  SiRNA target sequence
aacaaaattatgcatggaaat

SEQ ID NO: 130502 - DNA, 21 bp, Artificial sequence
  SiRNA target sequence
acaaaattatgcatggaaatg

SEQ ID NO: 130503 - DNA, 21 bp, Artificial sequence
  SiRNA target sequence
caaaattatgcatggaaatga

SEQ ID NO: 130504 - DNA, 21 bp, Artificial sequence
  SiRNA target sequence
aaaattatgcatggaaatgat

SEQ ID NO: 130505 - DNA, 21 bp, Artificial sequence
  SiRNA target sequence
aaattatgcatggaaatgatg

SEQ ID NO: 130506 - DNA, 21 bp, Artificial sequence
  SiRNA target sequence
aattatgcatggaaatgatgg

SEQ ID NO: 130507 - DNA, 21 bp, Artificial sequence
  SiRNA target sequence
attatgcatggaaatgatgga

SEQ ID NO: 130508 - DNA, 21 bp, Artificial sequence
  SiRNA target sequence
ttatgcatggaaatgatggaa

SEQ ID NO: 130509 - DNA, 21 bp, Artificial sequence
  SiRNA target sequence
tatgcatggaaatgatggaaa

SEQ ID NO: 130510 - DNA, 21 bp, Artificial sequence
  SiRNA target sequence
atgcatggaaatgatggaaac

SEQ ID NO: 130511 - DNA, 21 bp, Artificial sequence
  SiRNA target sequence
tgcatggaaatgatggaaact

SEQ ID NO: 130512 - DNA, 21 bp, Artificial sequence
  SiRNA target sequence
gcatggaaatgatggaaactt

SEQ ID NO: 130513 - DNA, 21 bp, Artificial sequence
  SiRNA target sequence
catggaaatgatggaaacttg

SEQ ID NO: 130514 - DNA, 21 bp, Artificial sequence
  SiRNA target sequence
atggaaatgatggaaacttgt

SEQ ID NO: 130515 - DNA, 21 bp, Artificial sequence
  SiRNA target sequence
tggaaatgatggaaacttgtg

SEQ ID NO: 130516 - DNA, 21 bp, Artificial sequence
  SiRNA target sequence
ggaaatgatggaaacttgtgg

SEQ ID NO: 130517 - DNA, 21 bp, Artificial sequence
  SiRNA target sequence
gaaatgatggaaacttgtggt

SEQ ID NO: 130518 - DNA, 21 bp, Artificial sequence
  SiRNA target sequence
aaatgatggaaacttgtggtt

SEQ ID NO: 130519 - DNA, 21 bp, Artificial sequence
  SiRNA target sequence
aatgatggaaacttgtggtta

SEQ ID NO: 130520 - DNA, 21 bp, Artificial sequence
  SiRNA target sequence
atgatggaaacttgtggttat

SEQ ID NO: 130521 - DNA, 21 bp, Artificial sequence
  SiRNA target sequence
tgatggaaacttgtggttata

SEQ ID NO: 130522 - DNA, 21 bp, Artificial sequence
  SiRNA target sequence
gatggaaacttgtggttatag

SEQ ID NO: 130523 - DNA, 21 bp, Artificial sequence
  SiRNA target sequence
atggaaacttgtggttatagt

SEQ ID NO: 130524 - DNA, 21 bp, Artificial sequence
  SiRNA target sequence
tggaaacttgtggttatagtt

SEQ ID NO: 130525 - DNA, 21 bp, Artificial sequence
  SiRNA target sequence
ggaaacttgtggttatagttt

SEQ ID NO: 130526 - DNA, 21 bp, Artificial sequence
  SiRNA target sequence
gaaacttgtggttatagttta

SEQ ID NO: 130527 - DNA, 21 bp, Artificial sequence
  SiRNA target sequence
aaacttgtggttatagtttat

SEQ ID NO: 130528 - DNA, 21 bp, Artificial sequence
  SiRNA target sequence
aacttgtggttatagtttatt

SEQ ID NO: 130529 - DNA, 21 bp, Artificial sequence
  SiRNA target sequence
acttgtggttatagtttatta

SEQ ID NO: 130530 - DNA, 21 bp, Artificial sequence
  SiRNA target sequence
cttgtggttatagtttattaa

SEQ ID NO: 130531 - DNA, 21 bp, Artificial sequence
  SiRNA target sequence
ttgtggttatagtttattaaa

SEQ ID NO: 130532 - DNA, 21 bp, Artificial sequence
  SiRNA target sequence
tgtggttatagtttattaaaa

SEQ ID NO: 130533 - DNA, 21 bp, Artificial sequence
  SiRNA target sequence
gtggttatagtttattaaaaa

SEQ ID NO: 130534 - DNA, 21 bp, Artificial sequence
  SiRNA target sequence
tggttatagtttattaaaaaa

SEQ ID NO: 130535 - DNA, 21 bp, Artificial sequence
  SiRNA target sequence
ggttatagtttattaaaaaat

SEQ ID NO: 130536 - DNA, 21 bp, Artificial sequence
  SiRNA target sequence
gttatagtttattaaaaaatt

SEQ ID NO: 130537 - DNA, 21 bp, Artificial sequence
  SiRNA target sequence
ttatagtttattaaaaaatta

SEQ ID NO: 130538 - DNA, 21 bp, Artificial sequence
  SiRNA target sequence
tatagtttattaaaaaattaa

SEQ ID NO: 130539 - DNA, 22 bp, Artificial sequence
  SiRNA target sequence
atggtgtataaggttttattta

SEQ ID NO: 130540 - DNA, 22 bp, Artificial sequence
  SiRNA target sequence
tggtgtataaggttttatttac

SEQ ID NO: 130541 - DNA, 22 bp, Artificial sequence
  SiRNA target sequence
ggtgtataaggttttatttaca

SEQ ID NO: 130542 - DNA, 22 bp, Artificial sequence
  SiRNA target sequence
gtgtataaggttttatttacag

SEQ ID NO: 130543 - DNA, 22 bp, Artificial sequence
  SiRNA target sequence
tgtataaggttttatttacagt

SEQ ID NO: 130544 - DNA, 22 bp, Artificial sequence
  SiRNA target sequence
gtataaggttttatttacagta

SEQ ID NO: 130545 - DNA, 22 bp, Artificial sequence
  SiRNA target sequence
tataaggttttatttacagtaa

SEQ ID NO: 130546 - DNA, 22 bp, Artificial sequence
  SiRNA target sequence
ataaggttttatttacagtaat

SEQ ID NO: 130547 - DNA, 22 bp, Artificial sequence
  SiRNA target sequence
taaggttttatttacagtaata

SEQ ID NO: 130548 - DNA, 22 bp, Artificial sequence
  SiRNA target sequence
aaggttttatttacagtaatag

SEQ ID NO: 130549 - DNA, 22 bp, Artificial sequence
  SiRNA target sequence
aggttttatttacagtaatagg

SEQ ID NO: 130550 - DNA, 22 bp, Artificial sequence
  SiRNA target sequence
ggttttatttacagtaatagga

SEQ ID NO: 130551 - DNA, 22 bp, Artificial sequence
  SiRNA target sequence
gttttatttacagtaataggat

SEQ ID NO: 130552 - DNA, 22 bp, Artificial sequence
  SiRNA target sequence
ttttatttacagtaataggatt

SEQ ID NO: 130553 - DNA, 22 bp, Artificial sequence
  SiRNA target sequence
tttatttacagtaataggatta

SEQ ID NO: 130554 - DNA, 22 bp, Artificial sequence
  SiRNA target sequence
ttatttacagtaataggattaa

SEQ ID NO: 130555 - DNA, 22 bp, Artificial sequence
  SiRNA target sequence
tatttacagtaataggattaat

SEQ ID NO: 130556 - DNA, 22 bp, Artificial sequence
  SiRNA target sequence
atttacagtaataggattaata

SEQ ID NO: 130557 - DNA, 22 bp, Artificial sequence
  SiRNA target sequence
tttacagtaataggattaatat

SEQ ID NO: 130558 - DNA, 22 bp, Artificial sequence
  SiRNA target sequence
ttacagtaataggattaatatg

SEQ ID NO: 130559 - DNA, 22 bp, Artificial sequence
  SiRNA target sequence
tacagtaataggattaatatgt

SEQ ID NO: 130560 - DNA, 22 bp, Artificial sequence
  SiRNA target sequence
acagtaataggattaatatgtg

SEQ ID NO: 130561 - DNA, 22 bp, Artificial sequence
  SiRNA target sequence
cagtaataggattaatatgtgg

SEQ ID NO: 130562 - DNA, 22 bp, Artificial sequence
  SiRNA target sequence
agtaataggattaatatgtggt

SEQ ID NO: 130563 - DNA, 22 bp, Artificial sequence
  SiRNA target sequence
gtaataggattaatatgtggta

SEQ ID NO: 130564 - DNA, 22 bp, Artificial sequence
  SiRNA target sequence
taataggattaatatgtggtat

SEQ ID NO: 130565 - DNA, 22 bp, Artificial sequence
  SiRNA target sequence
aataggattaatatgtggtata

SEQ ID NO: 130566 - DNA, 22 bp, Artificial sequence
  SiRNA target sequence
ataggattaatatgtggtatac

SEQ ID NO: 130567 - DNA, 22 bp, Artificial sequence
  SiRNA target sequence
taggattaatatgtggtatact

SEQ ID NO: 130568 - DNA, 22 bp, Artificial sequence
  SiRNA target sequence
aggattaatatgtggtatactt

SEQ ID NO: 130569 - DNA, 22 bp, Artificial sequence
  SiRNA target sequence
ggattaatatgtggtatactta

SEQ ID NO: 130570 - DNA, 22 bp, Artificial sequence
  SiRNA target sequence
gattaatatgtggtatacttac

SEQ ID NO: 130571 - DNA, 22 bp, Artificial sequence
  SiRNA target sequence
attaatatgtggtatacttaca

SEQ ID NO: 130572 - DNA, 22 bp, Artificial sequence
  SiRNA target sequence
ttaatatgtggtatacttacaa

SEQ ID NO: 130573 - DNA, 22 bp, Artificial sequence
  SiRNA target sequence
taatatgtggtatacttacaat

SEQ ID NO: 130574 - DNA, 22 bp, Artificial sequence
  SiRNA target sequence
aatatgtggtatacttacaata

SEQ ID NO: 130575 - DNA, 22 bp, Artificial sequence
  SiRNA target sequence
atatgtggtatacttacaataa

SEQ ID NO: 130576 - DNA, 22 bp, Artificial sequence
  SiRNA target sequence
tatgtggtatacttacaataat

SEQ ID NO: 130577 - DNA, 22 bp, Artificial sequence
  SiRNA target sequence
atgtggtatacttacaataatt

SEQ ID NO: 130578 - DNA, 22 bp, Artificial sequence
  SiRNA target sequence
tgtggtatacttacaataatta

SEQ ID NO: 130579 - DNA, 22 bp, Artificial sequence
  SiRNA target sequence
gtggtatacttacaataattaa

SEQ ID NO: 130580 - DNA, 22 bp, Artificial sequence
  SiRNA target sequence
tggtatacttacaataattaaa

SEQ ID NO: 130581 - DNA, 22 bp, Artificial sequence
  SiRNA target sequence
ggtatacttacaataattaaac

SEQ ID NO: 130582 - DNA, 22 bp, Artificial sequence
  SiRNA target sequence
gtatacttacaataattaaacg

SEQ ID NO: 130583 - DNA, 22 bp, Artificial sequence
  SiRNA target sequence
tatacttacaataattaaacga

SEQ ID NO: 130584 - DNA, 22 bp, Artificial sequence
  SiRNA target sequence
atacttacaataattaaacgat

SEQ ID NO: 130585 - DNA, 22 bp, Artificial sequence
  SiRNA target sequence
tacttacaataattaaacgata

SEQ ID NO: 130586 - DNA, 22 bp, Artificial sequence
  SiRNA target sequence
acttacaataattaaacgatac

SEQ ID NO: 130587 - DNA, 22 bp, Artificial sequence
  SiRNA target sequence
cttacaataattaaacgataca

SEQ ID NO: 130588 - DNA, 22 bp, Artificial sequence
  SiRNA target sequence
ttacaataattaaacgatacaa

SEQ ID NO: 130589 - DNA, 22 bp, Artificial sequence
  SiRNA target sequence
tacaataattaaacgatacaag

SEQ ID NO: 130590 - DNA, 22 bp, Artificial sequence
  SiRNA target sequence
acaataattaaacgatacaagt

SEQ ID NO: 130591 - DNA, 22 bp, Artificial sequence
  SiRNA target sequence
caataattaaacgatacaagta

SEQ ID NO: 130592 - DNA, 22 bp, Artificial sequence
  SiRNA target sequence
aataattaaacgatacaagtat

SEQ ID NO: 130593 - DNA, 22 bp, Artificial sequence
  SiRNA target sequence
ataattaaacgatacaagtatt

SEQ ID NO: 130594 - DNA, 22 bp, Artificial sequence
  SiRNA target sequence
taattaaacgatacaagtattt

SEQ ID NO: 130595 - DNA, 22 bp, Artificial sequence
  SiRNA target sequence
aattaaacgatacaagtatttt

SEQ ID NO: 130596 - DNA, 22 bp, Artificial sequence
  SiRNA target sequence
attaaacgatacaagtatttta

SEQ ID NO: 130597 - DNA, 22 bp, Artificial sequence
  SiRNA target sequence
ttaaacgatacaagtattttaa

SEQ ID NO: 130598 - DNA, 22 bp, Artificial sequence
  SiRNA target sequence
taaacgatacaagtattttaag

SEQ ID NO: 130599 - DNA, 22 bp, Artificial sequence
  SiRNA target sequence
aaacgatacaagtattttaaga

SEQ ID NO: 130600 - DNA, 22 bp, Artificial sequence
  SiRNA target sequence
aacgatacaagtattttaagat

SEQ ID NO: 130601 - DNA, 22 bp, Artificial sequence
  SiRNA target sequence
acgatacaagtattttaagata

SEQ ID NO: 130602 - DNA, 22 bp, Artificial sequence
  SiRNA target sequence
cgatacaagtattttaagataa

SEQ ID NO: 130603 - DNA, 22 bp, Artificial sequence
  SiRNA target sequence
gatacaagtattttaagataaa

SEQ ID NO: 130604 - DNA, 22 bp, Artificial sequence
  SiRNA target sequence
atacaagtattttaagataaaa

SEQ ID NO: 130605 - DNA, 22 bp, Artificial sequence
  SiRNA target sequence
tacaagtattttaagataaaaa

SEQ ID NO: 130606 - DNA, 22 bp, Artificial sequence
  SiRNA target sequence
acaagtattttaagataaaaaa

SEQ ID NO: 130607 - DNA, 22 bp, Artificial sequence
  SiRNA target sequence
caagtattttaagataaaaaaa

SEQ ID NO: 130608 - DNA, 22 bp, Artificial sequence
  SiRNA target sequence
aagtattttaagataaaaaaat

SEQ ID NO: 130609 - DNA, 22 bp, Artificial sequence
  SiRNA target sequence
agtattttaagataaaaaaatt

SEQ ID NO: 130610 - DNA, 22 bp, Artificial sequence
  SiRNA target sequence
gtattttaagataaaaaaattg

SEQ ID NO: 130611 - DNA, 22 bp, Artificial sequence
  SiRNA target sequence
tattttaagataaaaaaattgg

SEQ ID NO: 130612 - DNA, 22 bp, Artificial sequence
  SiRNA target sequence
attttaagataaaaaaattggc

SEQ ID NO: 130613 - DNA, 22 bp, Artificial sequence
  SiRNA target sequence
ttttaagataaaaaaattggcc

SEQ ID NO: 130614 - DNA, 22 bp, Artificial sequence
  SiRNA target sequence
tttaagataaaaaaattggcct

SEQ ID NO: 130615 - DNA, 22 bp, Artificial sequence
  SiRNA target sequence
ttaagataaaaaaattggcctt

SEQ ID NO: 130616 - DNA, 22 bp, Artificial sequence
  SiRNA target sequence
taagataaaaaaattggcctta

SEQ ID NO: 130617 - DNA, 22 bp, Artificial sequence
  SiRNA target sequence
aagataaaaaaattggccttaa

SEQ ID NO: 130618 - DNA, 22 bp, Artificial sequence
  SiRNA target sequence
agataaaaaaattggccttaac

SEQ ID NO: 130619 - DNA, 22 bp, Artificial sequence
  SiRNA target sequence
gataaaaaaattggccttaact

SEQ ID NO: 130620 - DNA, 22 bp, Artificial sequence
  SiRNA target sequence
ataaaaaaattggccttaactt

SEQ ID NO: 130621 - DNA, 22 bp, Artificial sequence
  SiRNA target sequence
taaaaaaattggccttaactta

SEQ ID NO: 130622 - DNA, 22 bp, Artificial sequence
  SiRNA target sequence
aaaaaaattggccttaacttac

SEQ ID NO: 130623 - DNA, 22 bp, Artificial sequence
  SiRNA target sequence
aaaaaattggccttaacttact

SEQ ID NO: 130624 - DNA, 22 bp, Artificial sequence
  SiRNA target sequence
aaaaattggccttaacttactt

SEQ ID NO: 130625 - DNA, 22 bp, Artificial sequence
  SiRNA target sequence
aaaattggccttaacttacttc

SEQ ID NO: 130626 - DNA, 22 bp, Artificial sequence
  SiRNA target sequence
aaattggccttaacttacttcg

SEQ ID NO: 130627 - DNA, 22 bp, Artificial sequence
  SiRNA target sequence
aattggccttaacttacttcgg

SEQ ID NO: 130628 - DNA, 22 bp, Artificial sequence
  SiRNA target sequence
attggccttaacttacttcggg

SEQ ID NO: 130629 - DNA, 22 bp, Artificial sequence
  SiRNA target sequence
ttggccttaacttacttcggga

SEQ ID NO: 130630 - DNA, 22 bp, Artificial sequence
  SiRNA target sequence
tggccttaacttacttcgggaa

SEQ ID NO: 130631 - DNA, 22 bp, Artificial sequence
  SiRNA target sequence
ggccttaacttacttcgggaaa

SEQ ID NO: 130632 - DNA, 22 bp, Artificial sequence
  SiRNA target sequence
gccttaacttacttcgggaaac

SEQ ID NO: 130633 - DNA, 22 bp, Artificial sequence
  SiRNA target sequence
ccttaacttacttcgggaaaca

SEQ ID NO: 130634 - DNA, 22 bp, Artificial sequence
  SiRNA target sequence
cttaacttacttcgggaaacaa

SEQ ID NO: 130635 - DNA, 22 bp, Artificial sequence
  SiRNA target sequence
ttaacttacttcgggaaacaag

SEQ ID NO: 130636 - DNA, 22 bp, Artificial sequence
  SiRNA target sequence
taacttacttcgggaaacaaga

SEQ ID NO: 130637 - DNA, 22 bp, Artificial sequence
  SiRNA target sequence
aacttacttcgggaaacaagac

SEQ ID NO: 130638 - DNA, 22 bp, Artificial sequence
  SiRNA target sequence
acttacttcgggaaacaagact

SEQ ID NO: 130639 - DNA, 22 bp, Artificial sequence
  SiRNA target sequence
cttacttcgggaaacaagactt

SEQ ID NO: 130640 - DNA, 22 bp, Artificial sequence
  SiRNA target sequence
ttacttcgggaaacaagacttg

SEQ ID NO: 130641 - DNA, 22 bp, Artificial sequence
  SiRNA target sequence
tacttcgggaaacaagacttgc

SEQ ID NO: 130642 - DNA, 22 bp, Artificial sequence
  SiRNA target sequence
acttcgggaaacaagacttgca

SEQ ID NO: 130643 - DNA, 22 bp, Artificial sequence
  SiRNA target sequence
cttcgggaaacaagacttgcaa

SEQ ID NO: 130644 - DNA, 22 bp, Artificial sequence
  SiRNA target sequence
ttcgggaaacaagacttgcaat

SEQ ID NO: 130645 - DNA, 22 bp, Artificial sequence
  SiRNA target sequence
tcgggaaacaagacttgcaatg

SEQ ID NO: 130646 - DNA, 22 bp, Artificial sequence
  SiRNA target sequence
cgggaaacaagacttgcaatgg

SEQ ID NO: 130647 - DNA, 22 bp, Artificial sequence
  SiRNA target sequence
gggaaacaagacttgcaatgga

SEQ ID NO: 130648 - DNA, 22 bp, Artificial sequence
  SiRNA target sequence
ggaaacaagacttgcaatggaa

SEQ ID NO: 130649 - DNA, 22 bp, Artificial sequence
  SiRNA target sequence
gaaacaagacttgcaatggaaa

SEQ ID NO: 130650 - DNA, 22 bp, Artificial sequence
  SiRNA target sequence
aaacaagacttgcaatggaaac

SEQ ID NO: 130651 - DNA, 22 bp, Artificial sequence
  SiRNA target sequence
aacaagacttgcaatggaaacc

SEQ ID NO: 130652 - DNA, 22 bp, Artificial sequence
  SiRNA target sequence
acaagacttgcaatggaaacct

SEQ ID NO: 130653 - DNA, 22 bp, Artificial sequence
  SiRNA target sequence
caagacttgcaatggaaaccta

SEQ ID NO: 130654 - DNA, 22 bp, Artificial sequence
  SiRNA target sequence
aagacttgcaatggaaacctaa

SEQ ID NO: 130655 - DNA, 22 bp, Artificial sequence
  SiRNA target sequence
agacttgcaatggaaacctaaa

SEQ ID NO: 130656 - DNA, 22 bp, Artificial sequence
  SiRNA target sequence
gacttgcaatggaaacctaaaa

SEQ ID NO: 130657 - DNA, 22 bp, Artificial sequence
  SiRNA target sequence
acttgcaatggaaacctaaaag

SEQ ID NO: 130658 - DNA, 22 bp, Artificial sequence
  SiRNA target sequence
cttgcaatggaaacctaaaagt

SEQ ID NO: 130659 - DNA, 22 bp, Artificial sequence
  SiRNA target sequence
ttgcaatggaaacctaaaagtc

SEQ ID NO: 130660 - DNA, 22 bp, Artificial sequence
  SiRNA target sequence
tgcaatggaaacctaaaagtcg

SEQ ID NO: 130661 - DNA, 22 bp, Artificial sequence
  SiRNA target sequence
gcaatggaaacctaaaagtcgg

SEQ ID NO: 130662 - DNA, 22 bp, Artificial sequence
  SiRNA target sequence
caatggaaacctaaaagtcggt

SEQ ID NO: 130663 - DNA, 22 bp, Artificial sequence
  SiRNA target sequence
aatggaaacctaaaagtcggtc

SEQ ID NO: 130664 - DNA, 22 bp, Artificial sequence
  SiRNA target sequence
atggaaacctaaaagtcggtca

SEQ ID NO: 130665 - DNA, 22 bp, Artificial sequence
  SiRNA target sequence
tggaaacctaaaagtcggtcag

SEQ ID NO: 130666 - DNA, 22 bp, Artificial sequence
  SiRNA target sequence
ggaaacctaaaagtcggtcaga

SEQ ID NO: 130667 - DNA, 22 bp, Artificial sequence
  SiRNA target sequence
gaaacctaaaagtcggtcagaa

SEQ ID NO: 130668 - DNA, 22 bp, Artificial sequence
  SiRNA target sequence
aaacctaaaagtcggtcagaaa

SEQ ID NO: 130669 - DNA, 22 bp, Artificial sequence
  SiRNA target sequence
aacctaaaagtcggtcagaaat

SEQ ID NO: 130670 - DNA, 22 bp, Artificial sequence
  SiRNA target sequence
acctaaaagtcggtcagaaatt

SEQ ID NO: 130671 - DNA, 22 bp, Artificial sequence
  SiRNA target sequence
cctaaaagtcggtcagaaatta

SEQ ID NO: 130672 - DNA, 22 bp, Artificial sequence
  SiRNA target sequence
ctaaaagtcggtcagaaattat

SEQ ID NO: 130673 - DNA, 22 bp, Artificial sequence
  SiRNA target sequence
taaaagtcggtcagaaattatt

SEQ ID NO: 130674 - DNA, 22 bp, Artificial sequence
  SiRNA target sequence
aaaagtcggtcagaaattatta

SEQ ID NO: 130675 - DNA, 22 bp, Artificial sequence
  SiRNA target sequence
aaagtcggtcagaaattattaa

SEQ ID NO: 130676 - DNA, 22 bp, Artificial sequence
  SiRNA target sequence
aagtcggtcagaaattattaac

SEQ ID NO: 130677 - DNA, 22 bp, Artificial sequence
  SiRNA target sequence
agtcggtcagaaattattaacg

SEQ ID NO: 130678 - DNA, 22 bp, Artificial sequence
  SiRNA target sequence
gtcggtcagaaattattaacga

SEQ ID NO: 130679 - DNA, 22 bp, Artificial sequence
  SiRNA target sequence
tcggtcagaaattattaacgat

SEQ ID NO: 130680 - DNA, 22 bp, Artificial sequence
  SiRNA target sequence
cggtcagaaattattaacgatt

SEQ ID NO: 130681 - DNA, 22 bp, Artificial sequence
  SiRNA target sequence
ggtcagaaattattaacgattt

SEQ ID NO: 130682 - DNA, 22 bp, Artificial sequence
  SiRNA target sequence
gtcagaaattattaacgattta

SEQ ID NO: 130683 - DNA, 22 bp, Artificial sequence
  SiRNA target sequence
tcagaaattattaacgatttaa

SEQ ID NO: 130684 - DNA, 22 bp, Artificial sequence
  SiRNA target sequence
cagaaattattaacgatttaaa

SEQ ID NO: 130685 - DNA, 22 bp, Artificial sequence
  SiRNA target sequence
agaaattattaacgatttaaaa

SEQ ID NO: 130686 - DNA, 22 bp, Artificial sequence
  SiRNA target sequence
gaaattattaacgatttaaaaa

SEQ ID NO: 130687 - DNA, 22 bp, Artificial sequence
  SiRNA target sequence
aaattattaacgatttaaaaaa

SEQ ID NO: 130688 - DNA, 22 bp, Artificial sequence
  SiRNA target sequence
aattattaacgatttaaaaaat

SEQ ID NO: 130689 - DNA, 22 bp, Artificial sequence
  SiRNA target sequence
attattaacgatttaaaaaata

SEQ ID NO: 130690 - DNA, 22 bp, Artificial sequence
  SiRNA target sequence
ttattaacgatttaaaaaatac

SEQ ID NO: 130691 - DNA, 22 bp, Artificial sequence
  SiRNA target sequence
tattaacgatttaaaaaataca

SEQ ID NO: 130692 - DNA, 22 bp, Artificial sequence
  SiRNA target sequence
attaacgatttaaaaaatacaa

SEQ ID NO: 130693 - DNA, 22 bp, Artificial sequence
  SiRNA target sequence
ttaacgatttaaaaaatacaaa

SEQ ID NO: 130694 - DNA, 22 bp, Artificial sequence
  SiRNA target sequence
taacgatttaaaaaatacaaac

SEQ ID NO: 130695 - DNA, 22 bp, Artificial sequence
  SiRNA target sequence
aacgatttaaaaaatacaaact

SEQ ID NO: 130696 - DNA, 22 bp, Artificial sequence
  SiRNA target sequence
acgatttaaaaaatacaaactt

SEQ ID NO: 130697 - DNA, 22 bp, Artificial sequence
  SiRNA target sequence
cgatttaaaaaatacaaacttt

SEQ ID NO: 130698 - DNA, 22 bp, Artificial sequence
  SiRNA target sequence
gatttaaaaaatacaaactttg

SEQ ID NO: 130699 - DNA, 22 bp, Artificial sequence
  SiRNA target sequence
atttaaaaaatacaaactttga

SEQ ID NO: 130700 - DNA, 22 bp, Artificial sequence
  SiRNA target sequence
tttaaaaaatacaaactttgac

SEQ ID NO: 130701 - DNA, 22 bp, Artificial sequence
  SiRNA target sequence
ttaaaaaatacaaactttgaca

SEQ ID NO: 130702 - DNA, 22 bp, Artificial sequence
  SiRNA target sequence
taaaaaatacaaactttgacat

SEQ ID NO: 130703 - DNA, 22 bp, Artificial sequence
  SiRNA target sequence
aaaaaatacaaactttgacata

SEQ ID NO: 130704 - DNA, 22 bp, Artificial sequence
  SiRNA target sequence
aaaaatacaaactttgacatat

SEQ ID NO: 130705 - DNA, 22 bp, Artificial sequence
  SiRNA target sequence
aaaatacaaactttgacatatt

SEQ ID NO: 130706 - DNA, 22 bp, Artificial sequence
  SiRNA target sequence
aaatacaaactttgacatattg

SEQ ID NO: 130707 - DNA, 22 bp, Artificial sequence
  SiRNA target sequence
aatacaaactttgacatattga

SEQ ID NO: 130708 - DNA, 22 bp, Artificial sequence
  SiRNA target sequence
atacaaactttgacatattgat

SEQ ID NO: 130709 - DNA, 22 bp, Artificial sequence
  SiRNA target sequence
tacaaactttgacatattgatt

SEQ ID NO: 130710 - DNA, 22 bp, Artificial sequence
  SiRNA target sequence
acaaactttgacatattgatta

SEQ ID NO: 130711 - DNA, 22 bp, Artificial sequence
  SiRNA target sequence
caaactttgacatattgattat

SEQ ID NO: 130712 - DNA, 22 bp, Artificial sequence
  SiRNA target sequence
aaactttgacatattgattatt

SEQ ID NO: 130713 - DNA, 22 bp, Artificial sequence
  SiRNA target sequence
aactttgacatattgattattg

SEQ ID NO: 130714 - DNA, 22 bp, Artificial sequence
  SiRNA target sequence
actttgacatattgattattgg

SEQ ID NO: 130715 - DNA, 22 bp, Artificial sequence
  SiRNA target sequence
ctttgacatattgattattggt

SEQ ID NO: 130716 - DNA, 22 bp, Artificial sequence
  SiRNA target sequence
tttgacatattgattattggtg

SEQ ID NO: 130717 - DNA, 22 bp, Artificial sequence
  SiRNA target sequence
ttgacatattgattattggtgg

SEQ ID NO: 130718 - DNA, 22 bp, Artificial sequence
  SiRNA target sequence
tgacatattgattattggtggc

SEQ ID NO: 130719 - DNA, 22 bp, Artificial sequence
  SiRNA target sequence
gacatattgattattggtggcg

SEQ ID NO: 130720 - DNA, 22 bp, Artificial sequence
  SiRNA target sequence
acatattgattattggtggcgg

SEQ ID NO: 130721 - DNA, 22 bp, Artificial sequence
  SiRNA target sequence
catattgattattggtggcggt

SEQ ID NO: 130722 - DNA, 22 bp, Artificial sequence
  SiRNA target sequence
atattgattattggtggcggtt

SEQ ID NO: 130723 - DNA, 22 bp, Artificial sequence
  SiRNA target sequence
tattgattattggtggcggttc

SEQ ID NO: 130724 - DNA, 22 bp, Artificial sequence
  SiRNA target sequence
attgattattggtggcggttca

SEQ ID NO: 130725 - DNA, 22 bp, Artificial sequence
  SiRNA target sequence
ttgattattggtggcggttcaa

SEQ ID NO: 130726 - DNA, 22 bp, Artificial sequence
  SiRNA target sequence
tgattattggtggcggttcaac

SEQ ID NO: 130727 - DNA, 22 bp, Artificial sequence
  SiRNA target sequence
gattattggtggcggttcaacg

SEQ ID NO: 130728 - DNA, 22 bp, Artificial sequence
  SiRNA target sequence
attattggtggcggttcaacgg

SEQ ID NO: 130729 - DNA, 22 bp, Artificial sequence
  SiRNA target sequence
ttattggtggcggttcaacggg

SEQ ID NO: 130730 - DNA, 22 bp, Artificial sequence
  SiRNA target sequence
tattggtggcggttcaacggga

SEQ ID NO: 130731 - DNA, 22 bp, Artificial sequence
  SiRNA target sequence
attggtggcggttcaacgggaa

SEQ ID NO: 130732 - DNA, 22 bp, Artificial sequence
  SiRNA target sequence
ttggtggcggttcaacgggaat

SEQ ID NO: 130733 - DNA, 22 bp, Artificial sequence
  SiRNA target sequence
tggtggcggttcaacgggaatg

SEQ ID NO: 130734 - DNA, 22 bp, Artificial sequence
  SiRNA target sequence
ggtggcggttcaacgggaatgg

SEQ ID NO: 130735 - DNA, 22 bp, Artificial sequence
  SiRNA target sequence
gtggcggttcaacgggaatggg

SEQ ID NO: 130736 - DNA, 22 bp, Artificial sequence
  SiRNA target sequence
tggcggttcaacgggaatggga

SEQ ID NO: 130737 - DNA, 22 bp, Artificial sequence
  SiRNA target sequence
ggcggttcaacgggaatgggat

SEQ ID NO: 130738 - DNA, 22 bp, Artificial sequence
  SiRNA target sequence
gcggttcaacgggaatgggatg

SEQ ID NO: 130739 - DNA, 22 bp, Artificial sequence
  SiRNA target sequence
cggttcaacgggaatgggatgt

SEQ ID NO: 130740 - DNA, 22 bp, Artificial sequence
  SiRNA target sequence
ggttcaacgggaatgggatgtg

SEQ ID NO: 130741 - DNA, 22 bp, Artificial sequence
  SiRNA target sequence
gttcaacgggaatgggatgtgc

SEQ ID NO: 130742 - DNA, 22 bp, Artificial sequence
  SiRNA target sequence
ttcaacgggaatgggatgtgca

SEQ ID NO: 130743 - DNA, 22 bp, Artificial sequence
  SiRNA target sequence
tcaacgggaatgggatgtgcaa

SEQ ID NO: 130744 - DNA, 22 bp, Artificial sequence
  SiRNA target sequence
caacgggaatgggatgtgcaat

SEQ ID NO: 130745 - DNA, 22 bp, Artificial sequence
  SiRNA target sequence
aacgggaatgggatgtgcaatc

SEQ ID NO: 130746 - DNA, 22 bp, Artificial sequence
  SiRNA target sequence
acgggaatgggatgtgcaatcg

SEQ ID NO: 130747 - DNA, 22 bp, Artificial sequence
  SiRNA target sequence
cgggaatgggatgtgcaatcga

SEQ ID NO: 130748 - DNA, 22 bp, Artificial sequence
  SiRNA target sequence
gggaatgggatgtgcaatcgaa

SEQ ID NO: 130749 - DNA, 22 bp, Artificial sequence
  SiRNA target sequence
ggaatgggatgtgcaatcgaag

SEQ ID NO: 130750 - DNA, 22 bp, Artificial sequence
  SiRNA target sequence
gaatgggatgtgcaatcgaagc

SEQ ID NO: 130751 - DNA, 22 bp, Artificial sequence
  SiRNA target sequence
aatgggatgtgcaatcgaagca

SEQ ID NO: 130752 - DNA, 22 bp, Artificial sequence
  SiRNA target sequence
atgggatgtgcaatcgaagcag

SEQ ID NO: 130753 - DNA, 22 bp, Artificial sequence
  SiRNA target sequence
tgggatgtgcaatcgaagcagc

SEQ ID NO: 130754 - DNA, 22 bp, Artificial sequence
  SiRNA target sequence
gggatgtgcaatcgaagcagct

SEQ ID NO: 130755 - DNA, 22 bp, Artificial sequence
  SiRNA target sequence
ggatgtgcaatcgaagcagcta

SEQ ID NO: 130756 - DNA, 22 bp, Artificial sequence
  SiRNA target sequence
gatgtgcaatcgaagcagctac

SEQ ID NO: 130757 - DNA, 22 bp, Artificial sequence
  SiRNA target sequence
atgtgcaatcgaagcagctaca

SEQ ID NO: 130758 - DNA, 22 bp, Artificial sequence
  SiRNA target sequence
tgtgcaatcgaagcagctacac

SEQ ID NO: 130759 - DNA, 22 bp, Artificial sequence
  SiRNA target sequence
gtgcaatcgaagcagctacacg

SEQ ID NO: 130760 - DNA, 22 bp, Artificial sequence
  SiRNA target sequence
tgcaatcgaagcagctacacga

SEQ ID NO: 130761 - DNA, 22 bp, Artificial sequence
  SiRNA target sequence
gcaatcgaagcagctacacgag

SEQ ID NO: 130762 - DNA, 22 bp, Artificial sequence
  SiRNA target sequence
caatcgaagcagctacacgagg

SEQ ID NO: 130763 - DNA, 22 bp, Artificial sequence
  SiRNA target sequence
aatcgaagcagctacacgaggt

SEQ ID NO: 130764 - DNA, 22 bp, Artificial sequence
  SiRNA target sequence
atcgaagcagctacacgaggta

SEQ ID NO: 130765 - DNA, 22 bp, Artificial sequence
  SiRNA target sequence
tcgaagcagctacacgaggtat

SEQ ID NO: 130766 - DNA, 22 bp, Artificial sequence
  SiRNA target sequence
cgaagcagctacacgaggtata

SEQ ID NO: 130767 - DNA, 22 bp, Artificial sequence
  SiRNA target sequence
gaagcagctacacgaggtataa

SEQ ID NO: 130768 - DNA, 22 bp, Artificial sequence
  SiRNA target sequence
aagcagctacacgaggtataag

SEQ ID NO: 130769 - DNA, 22 bp, Artificial sequence
  SiRNA target sequence
agcagctacacgaggtataagt

SEQ ID NO: 130770 - DNA, 22 bp, Artificial sequence
  SiRNA target sequence
gcagctacacgaggtataagtg

SEQ ID NO: 130771 - DNA, 22 bp, Artificial sequence
  SiRNA target sequence
cagctacacgaggtataagtgt

SEQ ID NO: 130772 - DNA, 22 bp, Artificial sequence
  SiRNA target sequence
agctacacgaggtataagtgtt

SEQ ID NO: 130773 - DNA, 22 bp, Artificial sequence
  SiRNA target sequence
gctacacgaggtataagtgttg

SEQ ID NO: 130774 - DNA, 22 bp, Artificial sequence
  SiRNA target sequence
ctacacgaggtataagtgttgg

SEQ ID NO: 130775 - DNA, 22 bp, Artificial sequence
  SiRNA target sequence
tacacgaggtataagtgttggc

SEQ ID NO: 130776 - DNA, 22 bp, Artificial sequence
  SiRNA target sequence
acacgaggtataagtgttggcc

SEQ ID NO: 130777 - DNA, 22 bp, Artificial sequence
  SiRNA target sequence
cacgaggtataagtgttggcct

SEQ ID NO: 130778 - DNA, 22 bp, Artificial sequence
  SiRNA target sequence
acgaggtataagtgttggcctg

SEQ ID NO: 130779 - DNA, 22 bp, Artificial sequence
  SiRNA target sequence
cgaggtataagtgttggcctga

SEQ ID NO: 130780 - DNA, 22 bp, Artificial sequence
  SiRNA target sequence
gaggtataagtgttggcctgat

SEQ ID NO: 130781 - DNA, 22 bp, Artificial sequence
  SiRNA target sequence
aggtataagtgttggcctgata

SEQ ID NO: 130782 - DNA, 22 bp, Artificial sequence
  SiRNA target sequence
ggtataagtgttggcctgatag

SEQ ID NO: 130783 - DNA, 22 bp, Artificial sequence
  SiRNA target sequence
gtataagtgttggcctgataga

SEQ ID NO: 130784 - DNA, 22 bp, Artificial sequence
  SiRNA target sequence
tataagtgttggcctgatagaa

SEQ ID NO: 130785 - DNA, 22 bp, Artificial sequence
  SiRNA target sequence
ataagtgttggcctgatagaag

SEQ ID NO: 130786 - DNA, 22 bp, Artificial sequence
  SiRNA target sequence
taagtgttggcctgatagaagc

SEQ ID NO: 130787 - DNA, 22 bp, Artificial sequence
  SiRNA target sequence
aagtgttggcctgatagaagca

SEQ ID NO: 130788 - DNA, 22 bp, Artificial sequence
  SiRNA target sequence
agtgttggcctgatagaagcac

SEQ ID NO: 130789 - DNA, 22 bp, Artificial sequence
  SiRNA target sequence
gtgttggcctgatagaagcaca

SEQ ID NO: 130790 - DNA, 22 bp, Artificial sequence
  SiRNA target sequence
tgttggcctgatagaagcacat

SEQ ID NO: 130791 - DNA, 22 bp, Artificial sequence
  SiRNA target sequence
gttggcctgatagaagcacatg

SEQ ID NO: 130792 - DNA, 22 bp, Artificial sequence
  SiRNA target sequence
ttggcctgatagaagcacatga

SEQ ID NO: 130793 - DNA, 22 bp, Artificial sequence
  SiRNA target sequence
tggcctgatagaagcacatgat

SEQ ID NO: 130794 - DNA, 22 bp, Artificial sequence
  SiRNA target sequence
ggcctgatagaagcacatgatt

SEQ ID NO: 130795 - DNA, 22 bp, Artificial sequence
  SiRNA target sequence
gcctgatagaagcacatgattt

SEQ ID NO: 130796 - DNA, 22 bp, Artificial sequence
  SiRNA target sequence
cctgatagaagcacatgatttt

SEQ ID NO: 130797 - DNA, 22 bp, Artificial sequence
  SiRNA target sequence
ctgatagaagcacatgattttg

SEQ ID NO: 130798 - DNA, 22 bp, Artificial sequence
  SiRNA target sequence
tgatagaagcacatgattttgg

SEQ ID NO: 130799 - DNA, 22 bp, Artificial sequence
  SiRNA target sequence
gatagaagcacatgattttggt

SEQ ID NO: 130800 - DNA, 22 bp, Artificial sequence
  SiRNA target sequence
atagaagcacatgattttggtt

SEQ ID NO: 130801 - DNA, 22 bp, Artificial sequence
  SiRNA target sequence
tagaagcacatgattttggttc

SEQ ID NO: 130802 - DNA, 22 bp, Artificial sequence
  SiRNA target sequence
agaagcacatgattttggttcg

SEQ ID NO: 130803 - DNA, 22 bp, Artificial sequence
  SiRNA target sequence
gaagcacatgattttggttcgg

SEQ ID NO: 130804 - DNA, 22 bp, Artificial sequence
  SiRNA target sequence
aagcacatgattttggttcggg

SEQ ID NO: 130805 - DNA, 22 bp, Artificial sequence
  SiRNA target sequence
agcacatgattttggttcgggc

SEQ ID NO: 130806 - DNA, 22 bp, Artificial sequence
  SiRNA target sequence
gcacatgattttggttcgggca

SEQ ID NO: 130807 - DNA, 22 bp, Artificial sequence
  SiRNA target sequence
cacatgattttggttcgggcac

SEQ ID NO: 130808 - DNA, 22 bp, Artificial sequence
  SiRNA target sequence
acatgattttggttcgggcacg

SEQ ID NO: 130809 - DNA, 22 bp, Artificial sequence
  SiRNA target sequence
catgattttggttcgggcacga

SEQ ID NO: 130810 - DNA, 22 bp, Artificial sequence
  SiRNA target sequence
atgattttggttcgggcacgag

SEQ ID NO: 130811 - DNA, 22 bp, Artificial sequence
  SiRNA target sequence
tgattttggttcgggcacgagt

SEQ ID NO: 130812 - DNA, 22 bp, Artificial sequence
  SiRNA target sequence
gattttggttcgggcacgagtt

SEQ ID NO: 130813 - DNA, 22 bp, Artificial sequence
  SiRNA target sequence
attttggttcgggcacgagttc

SEQ ID NO: 130814 - DNA, 22 bp, Artificial sequence
  SiRNA target sequence
ttttggttcgggcacgagttca

SEQ ID NO: 130815 - DNA, 22 bp, Artificial sequence
  SiRNA target sequence
tttggttcgggcacgagttcaa

SEQ ID NO: 130816 - DNA, 22 bp, Artificial sequence
  SiRNA target sequence
ttggttcgggcacgagttcaaa

SEQ ID NO: 130817 - DNA, 22 bp, Artificial sequence
  SiRNA target sequence
tggttcgggcacgagttcaaaa

SEQ ID NO: 130818 - DNA, 22 bp, Artificial sequence
  SiRNA target sequence
ggttcgggcacgagttcaaaat

SEQ ID NO: 130819 - DNA, 22 bp, Artificial sequence
  SiRNA target sequence
gttcgggcacgagttcaaaatc

SEQ ID NO: 130820 - DNA, 22 bp, Artificial sequence
  SiRNA target sequence
ttcgggcacgagttcaaaatct

SEQ ID NO: 130821 - DNA, 22 bp, Artificial sequence
  SiRNA target sequence
tcgggcacgagttcaaaatcta

SEQ ID NO: 130822 - DNA, 22 bp, Artificial sequence
  SiRNA target sequence
cgggcacgagttcaaaatctac

SEQ ID NO: 130823 - DNA, 22 bp, Artificial sequence
  SiRNA target sequence
gggcacgagttcaaaatctaca

SEQ ID NO: 130824 - DNA, 22 bp, Artificial sequence
  SiRNA target sequence
ggcacgagttcaaaatctacaa

SEQ ID NO: 130825 - DNA, 22 bp, Artificial sequence
  SiRNA target sequence
gcacgagttcaaaatctacaaa

SEQ ID NO: 130826 - DNA, 22 bp, Artificial sequence
  SiRNA target sequence
cacgagttcaaaatctacaaaa

SEQ ID NO: 130827 - DNA, 22 bp, Artificial sequence
  SiRNA target sequence
acgagttcaaaatctacaaaac

SEQ ID NO: 130828 - DNA, 22 bp, Artificial sequence
  SiRNA target sequence
cgagttcaaaatctacaaaact

SEQ ID NO: 130829 - DNA, 22 bp, Artificial sequence
  SiRNA target sequence
gagttcaaaatctacaaaactt

SEQ ID NO: 130830 - DNA, 22 bp, Artificial sequence
  SiRNA target sequence
agttcaaaatctacaaaacttt

SEQ ID NO: 130831 - DNA, 22 bp, Artificial sequence
  SiRNA target sequence
gttcaaaatctacaaaactttt

SEQ ID NO: 130832 - DNA, 22 bp, Artificial sequence
  SiRNA target sequence
ttcaaaatctacaaaacttttt

SEQ ID NO: 130833 - DNA, 22 bp, Artificial sequence
  SiRNA target sequence
tcaaaatctacaaaactttttc

SEQ ID NO: 130834 - DNA, 22 bp, Artificial sequence
  SiRNA target sequence
caaaatctacaaaactttttca

SEQ ID NO: 130835 - DNA, 22 bp, Artificial sequence
  SiRNA target sequence
aaaatctacaaaactttttcat

SEQ ID NO: 130836 - DNA, 22 bp, Artificial sequence
  SiRNA target sequence
aaatctacaaaactttttcatg

SEQ ID NO: 130837 - DNA, 22 bp, Artificial sequence
  SiRNA target sequence
aatctacaaaactttttcatgg

SEQ ID NO: 130838 - DNA, 22 bp, Artificial sequence
  SiRNA target sequence
atctacaaaactttttcatggc

SEQ ID NO: 130839 - DNA, 22 bp, Artificial sequence
  SiRNA target sequence
tctacaaaactttttcatggcg

SEQ ID NO: 130840 - DNA, 22 bp, Artificial sequence
  SiRNA target sequence
ctacaaaactttttcatggcgg

SEQ ID NO: 130841 - DNA, 22 bp, Artificial sequence
  SiRNA target sequence
tacaaaactttttcatggcggt

SEQ ID NO: 130842 - DNA, 22 bp, Artificial sequence
  SiRNA target sequence
acaaaactttttcatggcggtg

SEQ ID NO: 130843 - DNA, 22 bp, Artificial sequence
  SiRNA target sequence
caaaactttttcatggcggtgt

SEQ ID NO: 130844 - DNA, 22 bp, Artificial sequence
  SiRNA target sequence
aaaactttttcatggcggtgta

SEQ ID NO: 130845 - DNA, 22 bp, Artificial sequence
  SiRNA target sequence
aaactttttcatggcggtgtac

SEQ ID NO: 130846 - DNA, 22 bp, Artificial sequence
  SiRNA target sequence
aactttttcatggcggtgtacg

SEQ ID NO: 130847 - DNA, 22 bp, Artificial sequence
  SiRNA target sequence
actttttcatggcggtgtacgc

SEQ ID NO: 130848 - DNA, 22 bp, Artificial sequence
  SiRNA target sequence
ctttttcatggcggtgtacgct

SEQ ID NO: 130849 - DNA, 22 bp, Artificial sequence
  SiRNA target sequence
tttttcatggcggtgtacgcta

SEQ ID NO: 130850 - DNA, 22 bp, Artificial sequence
  SiRNA target sequence
ttttcatggcggtgtacgctac

SEQ ID NO: 130851 - DNA, 22 bp, Artificial sequence
  SiRNA target sequence
tttcatggcggtgtacgctacc

SEQ ID NO: 130852 - DNA, 22 bp, Artificial sequence
  SiRNA target sequence
ttcatggcggtgtacgctacct

SEQ ID NO: 130853 - DNA, 22 bp, Artificial sequence
  SiRNA target sequence
tcatggcggtgtacgctacctt

SEQ ID NO: 130854 - DNA, 22 bp, Artificial sequence
  SiRNA target sequence
catggcggtgtacgctaccttg

SEQ ID NO: 130855 - DNA, 22 bp, Artificial sequence
  SiRNA target sequence
atggcggtgtacgctaccttga

SEQ ID NO: 130856 - DNA, 22 bp, Artificial sequence
  SiRNA target sequence
tggcggtgtacgctaccttgaa

SEQ ID NO: 130857 - DNA, 22 bp, Artificial sequence
  SiRNA target sequence
ggcggtgtacgctaccttgaaa

SEQ ID NO: 130858 - DNA, 22 bp, Artificial sequence
  SiRNA target sequence
gcggtgtacgctaccttgaaaa

SEQ ID NO: 130859 - DNA, 22 bp, Artificial sequence
  SiRNA target sequence
cggtgtacgctaccttgaaaaa

SEQ ID NO: 130860 - DNA, 22 bp, Artificial sequence
  SiRNA target sequence
ggtgtacgctaccttgaaaaag

SEQ ID NO: 130861 - DNA, 22 bp, Artificial sequence
  SiRNA target sequence
gtgtacgctaccttgaaaaagc

SEQ ID NO: 130862 - DNA, 22 bp, Artificial sequence
  SiRNA target sequence
tgtacgctaccttgaaaaagct

SEQ ID NO: 130863 - DNA, 22 bp, Artificial sequence
  SiRNA target sequence
gtacgctaccttgaaaaagctg

SEQ ID NO: 130864 - DNA, 22 bp, Artificial sequence
  SiRNA target sequence
tacgctaccttgaaaaagctgt

SEQ ID NO: 130865 - DNA, 22 bp, Artificial sequence
  SiRNA target sequence
acgctaccttgaaaaagctgtt

SEQ ID NO: 130866 - DNA, 22 bp, Artificial sequence
  SiRNA target sequence
cgctaccttgaaaaagctgtta

SEQ ID NO: 130867 - DNA, 22 bp, Artificial sequence
  SiRNA target sequence
gctaccttgaaaaagctgttaa

SEQ ID NO: 130868 - DNA, 22 bp, Artificial sequence
  SiRNA target sequence
ctaccttgaaaaagctgttaat

SEQ ID NO: 130869 - DNA, 22 bp, Artificial sequence
  SiRNA target sequence
taccttgaaaaagctgttaatg

SEQ ID NO: 130870 - DNA, 22 bp, Artificial sequence
  SiRNA target sequence
accttgaaaaagctgttaatga

SEQ ID NO: 130871 - DNA, 22 bp, Artificial sequence
  SiRNA target sequence
ccttgaaaaagctgttaatgat

SEQ ID NO: 130872 - DNA, 22 bp, Artificial sequence
  SiRNA target sequence
cttgaaaaagctgttaatgatt

SEQ ID NO: 130873 - DNA, 22 bp, Artificial sequence
  SiRNA target sequence
ttgaaaaagctgttaatgattt

SEQ ID NO: 130874 - DNA, 22 bp, Artificial sequence
  SiRNA target sequence
tgaaaaagctgttaatgattta

SEQ ID NO: 130875 - DNA, 22 bp, Artificial sequence
  SiRNA target sequence
gaaaaagctgttaatgatttag

SEQ ID NO: 130876 - DNA, 22 bp, Artificial sequence
  SiRNA target sequence
aaaaagctgttaatgatttaga

SEQ ID NO: 130877 - DNA, 22 bp, Artificial sequence
  SiRNA target sequence
aaaagctgttaatgatttagat

SEQ ID NO: 130878 - DNA, 22 bp, Artificial sequence
  SiRNA target sequence
aaagctgttaatgatttagata

SEQ ID NO: 130879 - DNA, 22 bp, Artificial sequence
  SiRNA target sequence
aagctgttaatgatttagatag

SEQ ID NO: 130880 - DNA, 22 bp, Artificial sequence
  SiRNA target sequence
agctgttaatgatttagataga

SEQ ID NO: 130881 - DNA, 22 bp, Artificial sequence
  SiRNA target sequence
gctgttaatgatttagatagat

SEQ ID NO: 130882 - DNA, 22 bp, Artificial sequence
  SiRNA target sequence
ctgttaatgatttagatagatc

SEQ ID NO: 130883 - DNA, 22 bp, Artificial sequence
  SiRNA target sequence
tgttaatgatttagatagatct

SEQ ID NO: 130884 - DNA, 22 bp, Artificial sequence
  SiRNA target sequence
gttaatgatttagatagatctc

SEQ ID NO: 130885 - DNA, 22 bp, Artificial sequence
  SiRNA target sequence
ttaatgatttagatagatctca

SEQ ID NO: 130886 - DNA, 22 bp, Artificial sequence
  SiRNA target sequence
taatgatttagatagatctcag

SEQ ID NO: 130887 - DNA, 22 bp, Artificial sequence
  SiRNA target sequence
aatgatttagatagatctcagt

SEQ ID NO: 130888 - DNA, 22 bp, Artificial sequence
  SiRNA target sequence
atgatttagatagatctcagtt

SEQ ID NO: 130889 - DNA, 22 bp, Artificial sequence
  SiRNA target sequence
tgatttagatagatctcagttt

SEQ ID NO: 130890 - DNA, 22 bp, Artificial sequence
  SiRNA target sequence
gatttagatagatctcagtttg

SEQ ID NO: 130891 - DNA, 22 bp, Artificial sequence
  SiRNA target sequence
atttagatagatctcagtttga

SEQ ID NO: 130892 - DNA, 22 bp, Artificial sequence
  SiRNA target sequence
tttagatagatctcagtttgac

SEQ ID NO: 130893 - DNA, 22 bp, Artificial sequence
  SiRNA target sequence
ttagatagatctcagtttgact

SEQ ID NO: 130894 - DNA, 22 bp, Artificial sequence
  SiRNA target sequence
tagatagatctcagtttgactt

SEQ ID NO: 130895 - DNA, 22 bp, Artificial sequence
  SiRNA target sequence
agatagatctcagtttgacttg

SEQ ID NO: 130896 - DNA, 22 bp, Artificial sequence
  SiRNA target sequence
gatagatctcagtttgacttgg

SEQ ID NO: 130897 - DNA, 22 bp, Artificial sequence
  SiRNA target sequence
atagatctcagtttgacttggt

SEQ ID NO: 130898 - DNA, 22 bp, Artificial sequence
  SiRNA target sequence
tagatctcagtttgacttggta

SEQ ID NO: 130899 - DNA, 22 bp, Artificial sequence
  SiRNA target sequence
agatctcagtttgacttggtat

SEQ ID NO: 130900 - DNA, 22 bp, Artificial sequence
  SiRNA target sequence
gatctcagtttgacttggtatc

SEQ ID NO: 130901 - DNA, 22 bp, Artificial sequence
  SiRNA target sequence
atctcagtttgacttggtatct

SEQ ID NO: 130902 - DNA, 22 bp, Artificial sequence
  SiRNA target sequence
tctcagtttgacttggtatctg

SEQ ID NO: 130903 - DNA, 22 bp, Artificial sequence
  SiRNA target sequence
ctcagtttgacttggtatctga

SEQ ID NO: 130904 - DNA, 22 bp, Artificial sequence
  SiRNA target sequence
tcagtttgacttggtatctgaa

SEQ ID NO: 130905 - DNA, 22 bp, Artificial sequence
  SiRNA target sequence
cagtttgacttggtatctgaag

SEQ ID NO: 130906 - DNA, 22 bp, Artificial sequence
  SiRNA target sequence
agtttgacttggtatctgaagc

SEQ ID NO: 130907 - DNA, 22 bp, Artificial sequence
  SiRNA target sequence
gtttgacttggtatctgaagca

SEQ ID NO: 130908 - DNA, 22 bp, Artificial sequence
  SiRNA target sequence
tttgacttggtatctgaagcat

SEQ ID NO: 130909 - DNA, 22 bp, Artificial sequence
  SiRNA target sequence
ttgacttggtatctgaagcatt

SEQ ID NO: 130910 - DNA, 22 bp, Artificial sequence
  SiRNA target sequence
tgacttggtatctgaagcatta

SEQ ID NO: 130911 - DNA, 22 bp, Artificial sequence
  SiRNA target sequence
gacttggtatctgaagcattaa

SEQ ID NO: 130912 - DNA, 22 bp, Artificial sequence
  SiRNA target sequence
acttggtatctgaagcattaag

SEQ ID NO: 130913 - DNA, 22 bp, Artificial sequence
  SiRNA target sequence
cttggtatctgaagcattaagt

SEQ ID NO: 130914 - DNA, 22 bp, Artificial sequence
  SiRNA target sequence
ttggtatctgaagcattaagtg

SEQ ID NO: 130915 - DNA, 22 bp, Artificial sequence
  SiRNA target sequence
tggtatctgaagcattaagtga

SEQ ID NO: 130916 - DNA, 22 bp, Artificial sequence
  SiRNA target sequence
ggtatctgaagcattaagtgaa

SEQ ID NO: 130917 - DNA, 22 bp, Artificial sequence
  SiRNA target sequence
gtatctgaagcattaagtgaac

SEQ ID NO: 130918 - DNA, 22 bp, Artificial sequence
  SiRNA target sequence
tatctgaagcattaagtgaacg

SEQ ID NO: 130919 - DNA, 22 bp, Artificial sequence
  SiRNA target sequence
atctgaagcattaagtgaacga

SEQ ID NO: 130920 - DNA, 22 bp, Artificial sequence
  SiRNA target sequence
tctgaagcattaagtgaacgaa

SEQ ID NO: 130921 - DNA, 22 bp, Artificial sequence
  SiRNA target sequence
ctgaagcattaagtgaacgaaa

SEQ ID NO: 130922 - DNA, 22 bp, Artificial sequence
  SiRNA target sequence
tgaagcattaagtgaacgaaaa

SEQ ID NO: 130923 - DNA, 22 bp, Artificial sequence
  SiRNA target sequence
gaagcattaagtgaacgaaaaa

SEQ ID NO: 130924 - DNA, 22 bp, Artificial sequence
  SiRNA target sequence
aagcattaagtgaacgaaaaat

SEQ ID NO: 130925 - DNA, 22 bp, Artificial sequence
  SiRNA target sequence
agcattaagtgaacgaaaaatt

SEQ ID NO: 130926 - DNA, 22 bp, Artificial sequence
  SiRNA target sequence
gcattaagtgaacgaaaaattg

SEQ ID NO: 130927 - DNA, 22 bp, Artificial sequence
  SiRNA target sequence
cattaagtgaacgaaaaattgt

SEQ ID NO: 130928 - DNA, 22 bp, Artificial sequence
  SiRNA target sequence
attaagtgaacgaaaaattgtt

SEQ ID NO: 130929 - DNA, 22 bp, Artificial sequence
  SiRNA target sequence
ttaagtgaacgaaaaattgtta

SEQ ID NO: 130930 - DNA, 22 bp, Artificial sequence
  SiRNA target sequence
taagtgaacgaaaaattgttat

SEQ ID NO: 130931 - DNA, 22 bp, Artificial sequence
  SiRNA target sequence
aagtgaacgaaaaattgttatg

SEQ ID NO: 130932 - DNA, 22 bp, Artificial sequence
  SiRNA target sequence
agtgaacgaaaaattgttatga

SEQ ID NO: 130933 - DNA, 22 bp, Artificial sequence
  SiRNA target sequence
gtgaacgaaaaattgttatgaa

SEQ ID NO: 130934 - DNA, 22 bp, Artificial sequence
  SiRNA target sequence
tgaacgaaaaattgttatgaat

SEQ ID NO: 130935 - DNA, 22 bp, Artificial sequence
  SiRNA target sequence
gaacgaaaaattgttatgaata

SEQ ID NO: 130936 - DNA, 22 bp, Artificial sequence
  SiRNA target sequence
aacgaaaaattgttatgaatat

SEQ ID NO: 130937 - DNA, 22 bp, Artificial sequence
  SiRNA target sequence
acgaaaaattgttatgaatatg

SEQ ID NO: 130938 - DNA, 22 bp, Artificial sequence
  SiRNA target sequence
cgaaaaattgttatgaatatgt

SEQ ID NO: 130939 - DNA, 22 bp, Artificial sequence
  SiRNA target sequence
gaaaaattgttatgaatatgtg

SEQ ID NO: 130940 - DNA, 22 bp, Artificial sequence
  SiRNA target sequence
aaaaattgttatgaatatgtgt

SEQ ID NO: 130941 - DNA, 22 bp, Artificial sequence
  SiRNA target sequence
aaaattgttatgaatatgtgtc

SEQ ID NO: 130942 - DNA, 22 bp, Artificial sequence
  SiRNA target sequence
aaattgttatgaatatgtgtcc

SEQ ID NO: 130943 - DNA, 22 bp, Artificial sequence
  SiRNA target sequence
aattgttatgaatatgtgtcct

SEQ ID NO: 130944 - DNA, 22 bp, Artificial sequence
  SiRNA target sequence
attgttatgaatatgtgtcctt

SEQ ID NO: 130945 - DNA, 22 bp, Artificial sequence
  SiRNA target sequence
ttgttatgaatatgtgtccttt

SEQ ID NO: 130946 - DNA, 22 bp, Artificial sequence
  SiRNA target sequence
tgttatgaatatgtgtcctttt

SEQ ID NO: 130947 - DNA, 22 bp, Artificial sequence
  SiRNA target sequence
gttatgaatatgtgtccttttc

SEQ ID NO: 130948 - DNA, 22 bp, Artificial sequence
  SiRNA target sequence
ttatgaatatgtgtccttttct

SEQ ID NO: 130949 - DNA, 22 bp, Artificial sequence
  SiRNA target sequence
tatgaatatgtgtccttttcta

SEQ ID NO: 130950 - DNA, 22 bp, Artificial sequence
  SiRNA target sequence
atgaatatgtgtccttttctag

SEQ ID NO: 130951 - DNA, 22 bp, Artificial sequence
  SiRNA target sequence
tgaatatgtgtccttttctagt

SEQ ID NO: 130952 - DNA, 22 bp, Artificial sequence
  SiRNA target sequence
gaatatgtgtccttttctagta

SEQ ID NO: 130953 - DNA, 22 bp, Artificial sequence
  SiRNA target sequence
aatatgtgtccttttctagtaa

SEQ ID NO: 130954 - DNA, 22 bp, Artificial sequence
  SiRNA target sequence
atatgtgtccttttctagtaag

SEQ ID NO: 130955 - DNA, 22 bp, Artificial sequence
  SiRNA target sequence
tatgtgtccttttctagtaagg

SEQ ID NO: 130956 - DNA, 22 bp, Artificial sequence
  SiRNA target sequence
atgtgtccttttctagtaaggt

SEQ ID NO: 130957 - DNA, 22 bp, Artificial sequence
  SiRNA target sequence
tgtgtccttttctagtaaggtc

SEQ ID NO: 130958 - DNA, 22 bp, Artificial sequence
  SiRNA target sequence
gtgtccttttctagtaaggtcg

SEQ ID NO: 130959 - DNA, 22 bp, Artificial sequence
  SiRNA target sequence
tgtccttttctagtaaggtcga

SEQ ID NO: 130960 - DNA, 22 bp, Artificial sequence
  SiRNA target sequence
gtccttttctagtaaggtcgat

SEQ ID NO: 130961 - DNA, 22 bp, Artificial sequence
  SiRNA target sequence
tccttttctagtaaggtcgatg

SEQ ID NO: 130962 - DNA, 22 bp, Artificial sequence
  SiRNA target sequence
ccttttctagtaaggtcgatgg

SEQ ID NO: 130963 - DNA, 22 bp, Artificial sequence
  SiRNA target sequence
cttttctagtaaggtcgatgga

SEQ ID NO: 130964 - DNA, 22 bp, Artificial sequence
  SiRNA target sequence
ttttctagtaaggtcgatggaa

SEQ ID NO: 130965 - DNA, 22 bp, Artificial sequence
  SiRNA target sequence
tttctagtaaggtcgatggaaa

SEQ ID NO: 130966 - DNA, 22 bp, Artificial sequence
  SiRNA target sequence
ttctagtaaggtcgatggaaat

SEQ ID NO: 130967 - DNA, 22 bp, Artificial sequence
  SiRNA target sequence
tctagtaaggtcgatggaaata

SEQ ID NO: 130968 - DNA, 22 bp, Artificial sequence
  SiRNA target sequence
ctagtaaggtcgatggaaatat

SEQ ID NO: 130969 - DNA, 22 bp, Artificial sequence
  SiRNA target sequence
tagtaaggtcgatggaaatatt

SEQ ID NO: 130970 - DNA, 22 bp, Artificial sequence
  SiRNA target sequence
agtaaggtcgatggaaatatta

SEQ ID NO: 130971 - DNA, 22 bp, Artificial sequence
  SiRNA target sequence
gtaaggtcgatggaaatattat

SEQ ID NO: 130972 - DNA, 22 bp, Artificial sequence
  SiRNA target sequence
taaggtcgatggaaatattatt

SEQ ID NO: 130973 - DNA, 22 bp, Artificial sequence
  SiRNA target sequence
aaggtcgatggaaatattattt

SEQ ID NO: 130974 - DNA, 22 bp, Artificial sequence
  SiRNA target sequence
aggtcgatggaaatattatttc

SEQ ID NO: 130975 - DNA, 22 bp, Artificial sequence
  SiRNA target sequence
ggtcgatggaaatattatttcc

SEQ ID NO: 130976 - DNA, 22 bp, Artificial sequence
  SiRNA target sequence
gtcgatggaaatattatttccg

SEQ ID NO: 130977 - DNA, 22 bp, Artificial sequence
  SiRNA target sequence
tcgatggaaatattatttccgg

SEQ ID NO: 130978 - DNA, 22 bp, Artificial sequence
  SiRNA target sequence
cgatggaaatattatttccggt

SEQ ID NO: 130979 - DNA, 22 bp, Artificial sequence
  SiRNA target sequence
gatggaaatattatttccggtt

SEQ ID NO: 130980 - DNA, 22 bp, Artificial sequence
  SiRNA target sequence
atggaaatattatttccggttt

SEQ ID NO: 130981 - DNA, 22 bp, Artificial sequence
  SiRNA target sequence
tggaaatattatttccggttta

SEQ ID NO: 130982 - DNA, 22 bp, Artificial sequence
  SiRNA target sequence
ggaaatattatttccggtttat

SEQ ID NO: 130983 - DNA, 22 bp, Artificial sequence
  SiRNA target sequence
gaaatattatttccggtttata

SEQ ID NO: 130984 - DNA, 22 bp, Artificial sequence
  SiRNA target sequence
aaatattatttccggtttataa

SEQ ID NO: 130985 - DNA, 22 bp, Artificial sequence
  SiRNA target sequence
aatattatttccggtttataaa

SEQ ID NO: 130986 - DNA, 22 bp, Artificial sequence
  SiRNA target sequence
atattatttccggtttataaaa

SEQ ID NO: 130987 - DNA, 22 bp, Artificial sequence
  SiRNA target sequence
tattatttccggtttataaaag

SEQ ID NO: 130988 - DNA, 22 bp, Artificial sequence
  SiRNA target sequence
attatttccggtttataaaagg

SEQ ID NO: 130989 - DNA, 22 bp, Artificial sequence
  SiRNA target sequence
ttatttccggtttataaaaggc

SEQ ID NO: 130990 - DNA, 22 bp, Artificial sequence
  SiRNA target sequence
tatttccggtttataaaaggct

SEQ ID NO: 130991 - DNA, 22 bp, Artificial sequence
  SiRNA target sequence
atttccggtttataaaaggctt

SEQ ID NO: 130992 - DNA, 22 bp, Artificial sequence
  SiRNA target sequence
tttccggtttataaaaggcttt

SEQ ID NO: 130993 - DNA, 22 bp, Artificial sequence
  SiRNA target sequence
ttccggtttataaaaggctttt

SEQ ID NO: 130994 - DNA, 22 bp, Artificial sequence
  SiRNA target sequence
tccggtttataaaaggctttta

SEQ ID NO: 130995 - DNA, 22 bp, Artificial sequence
  SiRNA target sequence
ccggtttataaaaggcttttaa

SEQ ID NO: 130996 - DNA, 22 bp, Artificial sequence
  SiRNA target sequence
cggtttataaaaggcttttaat

SEQ ID NO: 130997 - DNA, 22 bp, Artificial sequence
  SiRNA target sequence
ggtttataaaaggcttttaatt

SEQ ID NO: 130998 - DNA, 22 bp, Artificial sequence
  SiRNA target sequence
gtttataaaaggcttttaattc

SEQ ID NO: 130999 - DNA, 22 bp, Artificial sequence
  SiRNA target sequence
tttataaaaggcttttaattcc

SEQ ID NO: 131000 - DNA, 22 bp, Artificial sequence
  SiRNA target sequence
ttataaaaggcttttaattcct

SEQ ID NO: 131001 - DNA, 22 bp, Artificial sequence
  SiRNA target sequence
tataaaaggcttttaattcctt

SEQ ID NO: 131002 - DNA, 22 bp, Artificial sequence
  SiRNA target sequence
ataaaaggcttttaattcctta

SEQ ID NO: 131003 - DNA, 22 bp, Artificial sequence
  SiRNA target sequence
taaaaggcttttaattccttac

SEQ ID NO: 131004 - DNA, 22 bp, Artificial sequence
  SiRNA target sequence
aaaaggcttttaattccttact

SEQ ID NO: 131005 - DNA, 22 bp, Artificial sequence
  SiRNA target sequence
aaaggcttttaattccttacta

SEQ ID NO: 131006 - DNA, 22 bp, Artificial sequence
  SiRNA target sequence
aaggcttttaattccttactac

SEQ ID NO: 131007 - DNA, 22 bp, Artificial sequence
  SiRNA target sequence
aggcttttaattccttactact

SEQ ID NO: 131008 - DNA, 22 bp, Artificial sequence
  SiRNA target sequence
ggcttttaattccttactacta

SEQ ID NO: 131009 - DNA, 22 bp, Artificial sequence
  SiRNA target sequence
gcttttaattccttactactat

SEQ ID NO: 131010 - DNA, 22 bp, Artificial sequence
  SiRNA target sequence
cttttaattccttactactata

SEQ ID NO: 131011 - DNA, 22 bp, Artificial sequence
  SiRNA target sequence
ttttaattccttactactatat

SEQ ID NO: 131012 - DNA, 22 bp, Artificial sequence
  SiRNA target sequence
tttaattccttactactatatt

SEQ ID NO: 131013 - DNA, 22 bp, Artificial sequence
  SiRNA target sequence
ttaattccttactactatattg

SEQ ID NO: 131014 - DNA, 22 bp, Artificial sequence
  SiRNA target sequence
taattccttactactatattgg

SEQ ID NO: 131015 - DNA, 22 bp, Artificial sequence
  SiRNA target sequence
aattccttactactatattggc

SEQ ID NO: 131016 - DNA, 22 bp, Artificial sequence
  SiRNA target sequence
attccttactactatattggcc

SEQ ID NO: 131017 - DNA, 22 bp, Artificial sequence
  SiRNA target sequence
ttccttactactatattggcct

SEQ ID NO: 131018 - DNA, 22 bp, Artificial sequence
  SiRNA target sequence
tccttactactatattggcctt

SEQ ID NO: 131019 - DNA, 22 bp, Artificial sequence
  SiRNA target sequence
ccttactactatattggcctta

SEQ ID NO: 131020 - DNA, 22 bp, Artificial sequence
  SiRNA target sequence
cttactactatattggccttaa

SEQ ID NO: 131021 - DNA, 22 bp, Artificial sequence
  SiRNA target sequence
ttactactatattggccttaaa

SEQ ID NO: 131022 - DNA, 22 bp, Artificial sequence
  SiRNA target sequence
tactactatattggccttaaat

SEQ ID NO: 131023 - DNA, 22 bp, Artificial sequence
  SiRNA target sequence
actactatattggccttaaatt

SEQ ID NO: 131024 - DNA, 22 bp, Artificial sequence
  SiRNA target sequence
ctactatattggccttaaattt

SEQ ID NO: 131025 - DNA, 22 bp, Artificial sequence
  SiRNA target sequence
tactatattggccttaaatttt

SEQ ID NO: 131026 - DNA, 22 bp, Artificial sequence
  SiRNA target sequence
actatattggccttaaatttta

SEQ ID NO: 131027 - DNA, 22 bp, Artificial sequence
  SiRNA target sequence
ctatattggccttaaattttat

SEQ ID NO: 131028 - DNA, 22 bp, Artificial sequence
  SiRNA target sequence
tatattggccttaaattttatg

SEQ ID NO: 131029 - DNA, 22 bp, Artificial sequence
  SiRNA target sequence
atattggccttaaattttatga

SEQ ID NO: 131030 - DNA, 22 bp, Artificial sequence
  SiRNA target sequence
tattggccttaaattttatgat

SEQ ID NO: 131031 - DNA, 22 bp, Artificial sequence
  SiRNA target sequence
attggccttaaattttatgatt

SEQ ID NO: 131032 - DNA, 22 bp, Artificial sequence
  SiRNA target sequence
ttggccttaaattttatgattg

SEQ ID NO: 131033 - DNA, 22 bp, Artificial sequence
  SiRNA target sequence
tggccttaaattttatgattgg

SEQ ID NO: 131034 - DNA, 22 bp, Artificial sequence
  SiRNA target sequence
ggccttaaattttatgattgga

SEQ ID NO: 131035 - DNA, 22 bp, Artificial sequence
  SiRNA target sequence
gccttaaattttatgattggat

SEQ ID NO: 131036 - DNA, 22 bp, Artificial sequence
  SiRNA target sequence
ccttaaattttatgattggatt

SEQ ID NO: 131037 - DNA, 22 bp, Artificial sequence
  SiRNA target sequence
cttaaattttatgattggattt

SEQ ID NO: 131038 - DNA, 22 bp, Artificial sequence
  SiRNA target sequence
ttaaattttatgattggatttc

SEQ ID NO: 131039 - DNA, 22 bp, Artificial sequence
  SiRNA target sequence
taaattttatgattggatttct

SEQ ID NO: 131040 - DNA, 22 bp, Artificial sequence
  SiRNA target sequence
aaattttatgattggatttctg

SEQ ID NO: 131041 - DNA, 22 bp, Artificial sequence
  SiRNA target sequence
aattttatgattggatttctgg

SEQ ID NO: 131042 - DNA, 22 bp, Artificial sequence
  SiRNA target sequence
attttatgattggatttctggg

SEQ ID NO: 131043 - DNA, 22 bp, Artificial sequence
  SiRNA target sequence
ttttatgattggatttctgggc

SEQ ID NO: 131044 - DNA, 22 bp, Artificial sequence
  SiRNA target sequence
tttatgattggatttctgggca

SEQ ID NO: 131045 - DNA, 22 bp, Artificial sequence
  SiRNA target sequence
ttatgattggatttctgggcaa

SEQ ID NO: 131046 - DNA, 22 bp, Artificial sequence
  SiRNA target sequence
tatgattggatttctgggcaac

SEQ ID NO: 131047 - DNA, 22 bp, Artificial sequence
  SiRNA target sequence
atgattggatttctgggcaacg

SEQ ID NO: 131048 - DNA, 22 bp, Artificial sequence
  SiRNA target sequence
tgattggatttctgggcaacgg

SEQ ID NO: 131049 - DNA, 22 bp, Artificial sequence
  SiRNA target sequence
gattggatttctgggcaacggt

SEQ ID NO: 131050 - DNA, 22 bp, Artificial sequence
  SiRNA target sequence
attggatttctgggcaacggtc

SEQ ID NO: 131051 - DNA, 22 bp, Artificial sequence
  SiRNA target sequence
ttggatttctgggcaacggtcc

SEQ ID NO: 131052 - DNA, 22 bp, Artificial sequence
  SiRNA target sequence
tggatttctgggcaacggtccc

SEQ ID NO: 131053 - DNA, 22 bp, Artificial sequence
  SiRNA target sequence
ggatttctgggcaacggtccct

SEQ ID NO: 131054 - DNA, 22 bp, Artificial sequence
  SiRNA target sequence
gatttctgggcaacggtccctt

SEQ ID NO: 131055 - DNA, 22 bp, Artificial sequence
  SiRNA target sequence
atttctgggcaacggtcccttg

SEQ ID NO: 131056 - DNA, 22 bp, Artificial sequence
  SiRNA target sequence
tttctgggcaacggtcccttgg

SEQ ID NO: 131057 - DNA, 22 bp, Artificial sequence
  SiRNA target sequence
ttctgggcaacggtcccttggg

SEQ ID NO: 131058 - DNA, 22 bp, Artificial sequence
  SiRNA target sequence
tctgggcaacggtcccttgggc

SEQ ID NO: 131059 - DNA, 22 bp, Artificial sequence
  SiRNA target sequence
ctgggcaacggtcccttgggcg

SEQ ID NO: 131060 - DNA, 22 bp, Artificial sequence
  SiRNA target sequence
tgggcaacggtcccttgggcga

SEQ ID NO: 131061 - DNA, 22 bp, Artificial sequence
  SiRNA target sequence
gggcaacggtcccttgggcgaa

SEQ ID NO: 131062 - DNA, 22 bp, Artificial sequence
  SiRNA target sequence
ggcaacggtcccttgggcgaag

SEQ ID NO: 131063 - DNA, 22 bp, Artificial sequence
  SiRNA target sequence
gcaacggtcccttgggcgaagt

SEQ ID NO: 131064 - DNA, 22 bp, Artificial sequence
  SiRNA target sequence
caacggtcccttgggcgaagta

SEQ ID NO: 131065 - DNA, 22 bp, Artificial sequence
  SiRNA target sequence
aacggtcccttgggcgaagtaa

SEQ ID NO: 131066 - DNA, 22 bp, Artificial sequence
  SiRNA target sequence
acggtcccttgggcgaagtaaa

SEQ ID NO: 131067 - DNA, 22 bp, Artificial sequence
  SiRNA target sequence
cggtcccttgggcgaagtaaat

SEQ ID NO: 131068 - DNA, 22 bp, Artificial sequence
  SiRNA target sequence
ggtcccttgggcgaagtaaatt

SEQ ID NO: 131069 - DNA, 22 bp, Artificial sequence
  SiRNA target sequence
gtcccttgggcgaagtaaattt

SEQ ID NO: 131070 - DNA, 22 bp, Artificial sequence
  SiRNA target sequence
tcccttgggcgaagtaaatttt

SEQ ID NO: 131071 - DNA, 22 bp, Artificial sequence
  SiRNA target sequence
cccttgggcgaagtaaattttt

SEQ ID NO: 131072 - DNA, 22 bp, Artificial sequence
  SiRNA target sequence
ccttgggcgaagtaaatttttg

SEQ ID NO: 131073 - DNA, 22 bp, Artificial sequence
  SiRNA target sequence
cttgggcgaagtaaatttttgt

SEQ ID NO: 131074 - DNA, 22 bp, Artificial sequence
  SiRNA target sequence
ttgggcgaagtaaatttttgtc

SEQ ID NO: 131075 - DNA, 22 bp, Artificial sequence
  SiRNA target sequence
tgggcgaagtaaatttttgtcg

SEQ ID NO: 131076 - DNA, 22 bp, Artificial sequence
  SiRNA target sequence
gggcgaagtaaatttttgtcgc

SEQ ID NO: 131077 - DNA, 22 bp, Artificial sequence
  SiRNA target sequence
ggcgaagtaaatttttgtcgcg

SEQ ID NO: 131078 - DNA, 22 bp, Artificial sequence
  SiRNA target sequence
gcgaagtaaatttttgtcgcgg

SEQ ID NO: 131079 - DNA, 22 bp, Artificial sequence
  SiRNA target sequence
cgaagtaaatttttgtcgcggc

SEQ ID NO: 131080 - DNA, 22 bp, Artificial sequence
  SiRNA target sequence
gaagtaaatttttgtcgcggca

SEQ ID NO: 131081 - DNA, 22 bp, Artificial sequence
  SiRNA target sequence
aagtaaatttttgtcgcggcaa

SEQ ID NO: 131082 - DNA, 22 bp, Artificial sequence
  SiRNA target sequence
agtaaatttttgtcgcggcaac

SEQ ID NO: 131083 - DNA, 22 bp, Artificial sequence
  SiRNA target sequence
gtaaatttttgtcgcggcaaca

SEQ ID NO: 131084 - DNA, 22 bp, Artificial sequence
  SiRNA target sequence
taaatttttgtcgcggcaacaa

SEQ ID NO: 131085 - DNA, 22 bp, Artificial sequence
  SiRNA target sequence
aaatttttgtcgcggcaacaaa

SEQ ID NO: 131086 - DNA, 22 bp, Artificial sequence
  SiRNA target sequence
aatttttgtcgcggcaacaaac

SEQ ID NO: 131087 - DNA, 22 bp, Artificial sequence
  SiRNA target sequence
atttttgtcgcggcaacaaact

SEQ ID NO: 131088 - DNA, 22 bp, Artificial sequence
  SiRNA target sequence
tttttgtcgcggcaacaaacta

SEQ ID NO: 131089 - DNA, 22 bp, Artificial sequence
  SiRNA target sequence
ttttgtcgcggcaacaaactat

SEQ ID NO: 131090 - DNA, 22 bp, Artificial sequence
  SiRNA target sequence
tttgtcgcggcaacaaactatt

SEQ ID NO: 131091 - DNA, 22 bp, Artificial sequence
  SiRNA target sequence
ttgtcgcggcaacaaactatta

SEQ ID NO: 131092 - DNA, 22 bp, Artificial sequence
  SiRNA target sequence
tgtcgcggcaacaaactattac

SEQ ID NO: 131093 - DNA, 22 bp, Artificial sequence
  SiRNA target sequence
gtcgcggcaacaaactattaca

SEQ ID NO: 131094 - DNA, 22 bp, Artificial sequence
  SiRNA target sequence
tcgcggcaacaaactattacaa

SEQ ID NO: 131095 - DNA, 22 bp, Artificial sequence
  SiRNA target sequence
cgcggcaacaaactattacaaa

SEQ ID NO: 131096 - DNA, 22 bp, Artificial sequence
  SiRNA target sequence
gcggcaacaaactattacaaaa

SEQ ID NO: 131097 - DNA, 22 bp, Artificial sequence
  SiRNA target sequence
cggcaacaaactattacaaaat

SEQ ID NO: 131098 - DNA, 22 bp, Artificial sequence
  SiRNA target sequence
ggcaacaaactattacaaaatt

SEQ ID NO: 131099 - DNA, 22 bp, Artificial sequence
  SiRNA target sequence
gcaacaaactattacaaaattt

SEQ ID NO: 131100 - DNA, 22 bp, Artificial sequence
  SiRNA target sequence
caacaaactattacaaaatttc

SEQ ID NO: 131101 - DNA, 22 bp, Artificial sequence
  SiRNA target sequence
aacaaactattacaaaatttcc

SEQ ID NO: 131102 - DNA, 22 bp, Artificial sequence
  SiRNA target sequence
acaaactattacaaaatttcct

SEQ ID NO: 131103 - DNA, 22 bp, Artificial sequence
  SiRNA target sequence
caaactattacaaaatttccta

SEQ ID NO: 131104 - DNA, 22 bp, Artificial sequence
  SiRNA target sequence
aaactattacaaaatttcctaa

SEQ ID NO: 131105 - DNA, 22 bp, Artificial sequence
  SiRNA target sequence
aactattacaaaatttcctaat

SEQ ID NO: 131106 - DNA, 22 bp, Artificial sequence
  SiRNA target sequence
actattacaaaatttcctaatg

SEQ ID NO: 131107 - DNA, 22 bp, Artificial sequence
  SiRNA target sequence
ctattacaaaatttcctaatgt

SEQ ID NO: 131108 - DNA, 22 bp, Artificial sequence
  SiRNA target sequence
tattacaaaatttcctaatgtg

SEQ ID NO: 131109 - DNA, 22 bp, Artificial sequence
  SiRNA target sequence
attacaaaatttcctaatgtga

SEQ ID NO: 131110 - DNA, 22 bp, Artificial sequence
  SiRNA target sequence
ttacaaaatttcctaatgtgag

SEQ ID NO: 131111 - DNA, 22 bp, Artificial sequence
  SiRNA target sequence
tacaaaatttcctaatgtgaga

SEQ ID NO: 131112 - DNA, 22 bp, Artificial sequence
  SiRNA target sequence
acaaaatttcctaatgtgagaa

SEQ ID NO: 131113 - DNA, 22 bp, Artificial sequence
  SiRNA target sequence
caaaatttcctaatgtgagaaa

SEQ ID NO: 131114 - DNA, 22 bp, Artificial sequence
  SiRNA target sequence
aaaatttcctaatgtgagaaaa

SEQ ID NO: 131115 - DNA, 22 bp, Artificial sequence
  SiRNA target sequence
aaatttcctaatgtgagaaaaa

SEQ ID NO: 131116 - DNA, 22 bp, Artificial sequence
  SiRNA target sequence
aatttcctaatgtgagaaaaat

SEQ ID NO: 131117 - DNA, 22 bp, Artificial sequence
  SiRNA target sequence
atttcctaatgtgagaaaaatc

SEQ ID NO: 131118 - DNA, 22 bp, Artificial sequence
  SiRNA target sequence
tttcctaatgtgagaaaaatcg

SEQ ID NO: 131119 - DNA, 22 bp, Artificial sequence
  SiRNA target sequence
ttcctaatgtgagaaaaatcga

SEQ ID NO: 131120 - DNA, 22 bp, Artificial sequence
  SiRNA target sequence
tcctaatgtgagaaaaatcgac

SEQ ID NO: 131121 - DNA, 22 bp, Artificial sequence
  SiRNA target sequence
cctaatgtgagaaaaatcgacc

SEQ ID NO: 131122 - DNA, 22 bp, Artificial sequence
  SiRNA target sequence
ctaatgtgagaaaaatcgacct

SEQ ID NO: 131123 - DNA, 22 bp, Artificial sequence
  SiRNA target sequence
taatgtgagaaaaatcgacctt

SEQ ID NO: 131124 - DNA, 22 bp, Artificial sequence
  SiRNA target sequence
aatgtgagaaaaatcgaccttg

SEQ ID NO: 131125 - DNA, 22 bp, Artificial sequence
  SiRNA target sequence
atgtgagaaaaatcgaccttgt

SEQ ID NO: 131126 - DNA, 22 bp, Artificial sequence
  SiRNA target sequence
tgtgagaaaaatcgaccttgta

SEQ ID NO: 131127 - DNA, 22 bp, Artificial sequence
  SiRNA target sequence
gtgagaaaaatcgaccttgtag

SEQ ID NO: 131128 - DNA, 22 bp, Artificial sequence
  SiRNA target sequence
tgagaaaaatcgaccttgtagg

SEQ ID NO: 131129 - DNA, 22 bp, Artificial sequence
  SiRNA target sequence
gagaaaaatcgaccttgtagga

SEQ ID NO: 131130 - DNA, 22 bp, Artificial sequence
  SiRNA target sequence
agaaaaatcgaccttgtaggat

SEQ ID NO: 131131 - DNA, 22 bp, Artificial sequence
  SiRNA target sequence
gaaaaatcgaccttgtaggatc

SEQ ID NO: 131132 - DNA, 22 bp, Artificial sequence
  SiRNA target sequence
aaaaatcgaccttgtaggatcc

SEQ ID NO: 131133 - DNA, 22 bp, Artificial sequence
  SiRNA target sequence
aaaatcgaccttgtaggatccg

SEQ ID NO: 131134 - DNA, 22 bp, Artificial sequence
  SiRNA target sequence
aaatcgaccttgtaggatccgt

SEQ ID NO: 131135 - DNA, 22 bp, Artificial sequence
  SiRNA target sequence
aatcgaccttgtaggatccgtt

SEQ ID NO: 131136 - DNA, 22 bp, Artificial sequence
  SiRNA target sequence
atcgaccttgtaggatccgttt

SEQ ID NO: 131137 - DNA, 22 bp, Artificial sequence
  SiRNA target sequence
tcgaccttgtaggatccgtttc

SEQ ID NO: 131138 - DNA, 22 bp, Artificial sequence
  SiRNA target sequence
cgaccttgtaggatccgtttcg

SEQ ID NO: 131139 - DNA, 22 bp, Artificial sequence
  SiRNA target sequence
gaccttgtaggatccgtttcgt

SEQ ID NO: 131140 - DNA, 22 bp, Artificial sequence
  SiRNA target sequence
accttgtaggatccgtttcgta

SEQ ID NO: 131141 - DNA, 22 bp, Artificial sequence
  SiRNA target sequence
ccttgtaggatccgtttcgtat

SEQ ID NO: 131142 - DNA, 22 bp, Artificial sequence
  SiRNA target sequence
cttgtaggatccgtttcgtatc

SEQ ID NO: 131143 - DNA, 22 bp, Artificial sequence
  SiRNA target sequence
ttgtaggatccgtttcgtatcg

SEQ ID NO: 131144 - DNA, 22 bp, Artificial sequence
  SiRNA target sequence
tgtaggatccgtttcgtatcgt

SEQ ID NO: 131145 - DNA, 22 bp, Artificial sequence
  SiRNA target sequence
gtaggatccgtttcgtatcgtg

SEQ ID NO: 131146 - DNA, 22 bp, Artificial sequence
  SiRNA target sequence
taggatccgtttcgtatcgtga

SEQ ID NO: 131147 - DNA, 22 bp, Artificial sequence
  SiRNA target sequence
aggatccgtttcgtatcgtgat

SEQ ID NO: 131148 - DNA, 22 bp, Artificial sequence
  SiRNA target sequence
ggatccgtttcgtatcgtgatg

SEQ ID NO: 131149 - DNA, 22 bp, Artificial sequence
  SiRNA target sequence
gatccgtttcgtatcgtgatgg

SEQ ID NO: 131150 - DNA, 22 bp, Artificial sequence
  SiRNA target sequence
atccgtttcgtatcgtgatggc

SEQ ID NO: 131151 - DNA, 22 bp, Artificial sequence
  SiRNA target sequence
tccgtttcgtatcgtgatggcc

SEQ ID NO: 131152 - DNA, 22 bp, Artificial sequence
  SiRNA target sequence
ccgtttcgtatcgtgatggcca

SEQ ID NO: 131153 - DNA, 22 bp, Artificial sequence
  SiRNA target sequence
cgtttcgtatcgtgatggccaa

SEQ ID NO: 131154 - DNA, 22 bp, Artificial sequence
  SiRNA target sequence
gtttcgtatcgtgatggccaat

SEQ ID NO: 131155 - DNA, 22 bp, Artificial sequence
  SiRNA target sequence
tttcgtatcgtgatggccaatt

SEQ ID NO: 131156 - DNA, 22 bp, Artificial sequence
  SiRNA target sequence
ttcgtatcgtgatggccaattt

SEQ ID NO: 131157 - DNA, 22 bp, Artificial sequence
  SiRNA target sequence
tcgtatcgtgatggccaatttt

SEQ ID NO: 131158 - DNA, 22 bp, Artificial sequence
  SiRNA target sequence
cgtatcgtgatggccaatttta

SEQ ID NO: 131159 - DNA, 22 bp, Artificial sequence
  SiRNA target sequence
gtatcgtgatggccaattttat

SEQ ID NO: 131160 - DNA, 22 bp, Artificial sequence
  SiRNA target sequence
tatcgtgatggccaattttatg

SEQ ID NO: 131161 - DNA, 22 bp, Artificial sequence
  SiRNA target sequence
atcgtgatggccaattttatga

SEQ ID NO: 131162 - DNA, 22 bp, Artificial sequence
  SiRNA target sequence
tcgtgatggccaattttatgat

SEQ ID NO: 131163 - DNA, 22 bp, Artificial sequence
  SiRNA target sequence
cgtgatggccaattttatgatg

SEQ ID NO: 131164 - DNA, 22 bp, Artificial sequence
  SiRNA target sequence
gtgatggccaattttatgatgc

SEQ ID NO: 131165 - DNA, 22 bp, Artificial sequence
  SiRNA target sequence
tgatggccaattttatgatgct

SEQ ID NO: 131166 - DNA, 22 bp, Artificial sequence
  SiRNA target sequence
gatggccaattttatgatgcta

SEQ ID NO: 131167 - DNA, 22 bp, Artificial sequence
  SiRNA target sequence
atggccaattttatgatgctaa

SEQ ID NO: 131168 - DNA, 22 bp, Artificial sequence
  SiRNA target sequence
tggccaattttatgatgctaaa

SEQ ID NO: 131169 - DNA, 22 bp, Artificial sequence
  SiRNA target sequence
ggccaattttatgatgctaaat

SEQ ID NO: 131170 - DNA, 22 bp, Artificial sequence
  SiRNA target sequence
gccaattttatgatgctaaata

SEQ ID NO: 131171 - DNA, 22 bp, Artificial sequence
  SiRNA target sequence
ccaattttatgatgctaaatac

SEQ ID NO: 131172 - DNA, 22 bp, Artificial sequence
  SiRNA target sequence
caattttatgatgctaaataca

SEQ ID NO: 131173 - DNA, 22 bp, Artificial sequence
  SiRNA target sequence
aattttatgatgctaaatacaa

SEQ ID NO: 131174 - DNA, 22 bp, Artificial sequence
  SiRNA target sequence
attttatgatgctaaatacaat

SEQ ID NO: 131175 - DNA, 22 bp, Artificial sequence
  SiRNA target sequence
ttttatgatgctaaatacaatg

SEQ ID NO: 131176 - DNA, 22 bp, Artificial sequence
  SiRNA target sequence
tttatgatgctaaatacaatgt

SEQ ID NO: 131177 - DNA, 22 bp, Artificial sequence
  SiRNA target sequence
ttatgatgctaaatacaatgtt

SEQ ID NO: 131178 - DNA, 22 bp, Artificial sequence
  SiRNA target sequence
tatgatgctaaatacaatgttc

SEQ ID NO: 131179 - DNA, 22 bp, Artificial sequence
  SiRNA target sequence
atgatgctaaatacaatgttct

SEQ ID NO: 131180 - DNA, 22 bp, Artificial sequence
  SiRNA target sequence
tgatgctaaatacaatgttcta

SEQ ID NO: 131181 - DNA, 22 bp, Artificial sequence
  SiRNA target sequence
gatgctaaatacaatgttctat

SEQ ID NO: 131182 - DNA, 22 bp, Artificial sequence
  SiRNA target sequence
atgctaaatacaatgttctatt

SEQ ID NO: 131183 - DNA, 22 bp, Artificial sequence
  SiRNA target sequence
tgctaaatacaatgttctattg

SEQ ID NO: 131184 - DNA, 22 bp, Artificial sequence
  SiRNA target sequence
gctaaatacaatgttctattgg

SEQ ID NO: 131185 - DNA, 22 bp, Artificial sequence
  SiRNA target sequence
ctaaatacaatgttctattggg

SEQ ID NO: 131186 - DNA, 22 bp, Artificial sequence
  SiRNA target sequence
taaatacaatgttctattgggt

SEQ ID NO: 131187 - DNA, 22 bp, Artificial sequence
  SiRNA target sequence
aaatacaatgttctattgggtg

SEQ ID NO: 131188 - DNA, 22 bp, Artificial sequence
  SiRNA target sequence
aatacaatgttctattgggtgt

SEQ ID NO: 131189 - DNA, 22 bp, Artificial sequence
  SiRNA target sequence
atacaatgttctattgggtgtc

SEQ ID NO: 131190 - DNA, 22 bp, Artificial sequence
  SiRNA target sequence
tacaatgttctattgggtgtca

SEQ ID NO: 131191 - DNA, 22 bp, Artificial sequence
  SiRNA target sequence
acaatgttctattgggtgtcac

SEQ ID NO: 131192 - DNA, 22 bp, Artificial sequence
  SiRNA target sequence
caatgttctattgggtgtcaca

SEQ ID NO: 131193 - DNA, 22 bp, Artificial sequence
  SiRNA target sequence
aatgttctattgggtgtcacag

SEQ ID NO: 131194 - DNA, 22 bp, Artificial sequence
  SiRNA target sequence
atgttctattgggtgtcacagc

SEQ ID NO: 131195 - DNA, 22 bp, Artificial sequence
  SiRNA target sequence
tgttctattgggtgtcacagct

SEQ ID NO: 131196 - DNA, 22 bp, Artificial sequence
  SiRNA target sequence
gttctattgggtgtcacagcta

SEQ ID NO: 131197 - DNA, 22 bp, Artificial sequence
  SiRNA target sequence
ttctattgggtgtcacagctac

SEQ ID NO: 131198 - DNA, 22 bp, Artificial sequence
  SiRNA target sequence
tctattgggtgtcacagctacc

SEQ ID NO: 131199 - DNA, 22 bp, Artificial sequence
  SiRNA target sequence
ctattgggtgtcacagctacct

SEQ ID NO: 131200 - DNA, 22 bp, Artificial sequence
  SiRNA target sequence
tattgggtgtcacagctaccta

SEQ ID NO: 131201 - DNA, 22 bp, Artificial sequence
  SiRNA target sequence
attgggtgtcacagctacctac

SEQ ID NO: 131202 - DNA, 22 bp, Artificial sequence
  SiRNA target sequence
ttgggtgtcacagctacctact

SEQ ID NO: 131203 - DNA, 22 bp, Artificial sequence
  SiRNA target sequence
tgggtgtcacagctacctacta

SEQ ID NO: 131204 - DNA, 22 bp, Artificial sequence
  SiRNA target sequence
gggtgtcacagctacctactat

SEQ ID NO: 131205 - DNA, 22 bp, Artificial sequence
  SiRNA target sequence
ggtgtcacagctacctactatg

SEQ ID NO: 131206 - DNA, 22 bp, Artificial sequence
  SiRNA target sequence
gtgtcacagctacctactatgg

SEQ ID NO: 131207 - DNA, 22 bp, Artificial sequence
  SiRNA target sequence
tgtcacagctacctactatgga

SEQ ID NO: 131208 - DNA, 22 bp, Artificial sequence
  SiRNA target sequence
gtcacagctacctactatggag

SEQ ID NO: 131209 - DNA, 22 bp, Artificial sequence
  SiRNA target sequence
tcacagctacctactatggagc

SEQ ID NO: 131210 - DNA, 22 bp, Artificial sequence
  SiRNA target sequence
cacagctacctactatggagct

SEQ ID NO: 131211 - DNA, 22 bp, Artificial sequence
  SiRNA target sequence
acagctacctactatggagctg

SEQ ID NO: 131212 - DNA, 22 bp, Artificial sequence
  SiRNA target sequence
cagctacctactatggagctgt

SEQ ID NO: 131213 - DNA, 22 bp, Artificial sequence
  SiRNA target sequence
agctacctactatggagctgtt

SEQ ID NO: 131214 - DNA, 22 bp, Artificial sequence
  SiRNA target sequence
gctacctactatggagctgttg

SEQ ID NO: 131215 - DNA, 22 bp, Artificial sequence
  SiRNA target sequence
ctacctactatggagctgttgt

SEQ ID NO: 131216 - DNA, 22 bp, Artificial sequence
  SiRNA target sequence
tacctactatggagctgttgta

SEQ ID NO: 131217 - DNA, 22 bp, Artificial sequence
  SiRNA target sequence
acctactatggagctgttgtat

SEQ ID NO: 131218 - DNA, 22 bp, Artificial sequence
  SiRNA target sequence
cctactatggagctgttgtatt

SEQ ID NO: 131219 - DNA, 22 bp, Artificial sequence
  SiRNA target sequence
ctactatggagctgttgtatta

SEQ ID NO: 131220 - DNA, 22 bp, Artificial sequence
  SiRNA target sequence
tactatggagctgttgtattaa

SEQ ID NO: 131221 - DNA, 22 bp, Artificial sequence
  SiRNA target sequence
actatggagctgttgtattaaa

SEQ ID NO: 131222 - DNA, 22 bp, Artificial sequence
  SiRNA target sequence
ctatggagctgttgtattaaat

SEQ ID NO: 131223 - DNA, 22 bp, Artificial sequence
  SiRNA target sequence
tatggagctgttgtattaaatc

SEQ ID NO: 131224 - DNA, 22 bp, Artificial sequence
  SiRNA target sequence
atggagctgttgtattaaatca

SEQ ID NO: 131225 - DNA, 22 bp, Artificial sequence
  SiRNA target sequence
tggagctgttgtattaaatcat

SEQ ID NO: 131226 - DNA, 22 bp, Artificial sequence
  SiRNA target sequence
ggagctgttgtattaaatcatg

SEQ ID NO: 131227 - DNA, 22 bp, Artificial sequence
  SiRNA target sequence
gagctgttgtattaaatcatgc

SEQ ID NO: 131228 - DNA, 22 bp, Artificial sequence
  SiRNA target sequence
agctgttgtattaaatcatgca

SEQ ID NO: 131229 - DNA, 22 bp, Artificial sequence
  SiRNA target sequence
gctgttgtattaaatcatgcaa

SEQ ID NO: 131230 - DNA, 22 bp, Artificial sequence
  SiRNA target sequence
ctgttgtattaaatcatgcaaa

SEQ ID NO: 131231 - DNA, 22 bp, Artificial sequence
  SiRNA target sequence
tgttgtattaaatcatgcaaaa

SEQ ID NO: 131232 - DNA, 22 bp, Artificial sequence
  SiRNA target sequence
gttgtattaaatcatgcaaaat

SEQ ID NO: 131233 - DNA, 22 bp, Artificial sequence
  SiRNA target sequence
ttgtattaaatcatgcaaaatt

SEQ ID NO: 131234 - DNA, 22 bp, Artificial sequence
  SiRNA target sequence
tgtattaaatcatgcaaaattc

SEQ ID NO: 131235 - DNA, 22 bp, Artificial sequence
  SiRNA target sequence
gtattaaatcatgcaaaattct

SEQ ID NO: 131236 - DNA, 22 bp, Artificial sequence
  SiRNA target sequence
tattaaatcatgcaaaattctt

SEQ ID NO: 131237 - DNA, 22 bp, Artificial sequence
  SiRNA target sequence
attaaatcatgcaaaattcttg

SEQ ID NO: 131238 - DNA, 22 bp, Artificial sequence
  SiRNA target sequence
ttaaatcatgcaaaattcttgt

SEQ ID NO: 131239 - DNA, 22 bp, Artificial sequence
  SiRNA target sequence
taaatcatgcaaaattcttgtc

SEQ ID NO: 131240 - DNA, 22 bp, Artificial sequence
  SiRNA target sequence
aaatcatgcaaaattcttgtca

SEQ ID NO: 131241 - DNA, 22 bp, Artificial sequence
  SiRNA target sequence
aatcatgcaaaattcttgtcag

SEQ ID NO: 131242 - DNA, 22 bp, Artificial sequence
  SiRNA target sequence
atcatgcaaaattcttgtcagt

SEQ ID NO: 131243 - DNA, 22 bp, Artificial sequence
  SiRNA target sequence
tcatgcaaaattcttgtcagta

SEQ ID NO: 131244 - DNA, 22 bp, Artificial sequence
  SiRNA target sequence
catgcaaaattcttgtcagtaa

SEQ ID NO: 131245 - DNA, 22 bp, Artificial sequence
  SiRNA target sequence
atgcaaaattcttgtcagtaac

SEQ ID NO: 131246 - DNA, 22 bp, Artificial sequence
  SiRNA target sequence
tgcaaaattcttgtcagtaaca

SEQ ID NO: 131247 - DNA, 22 bp, Artificial sequence
  SiRNA target sequence
gcaaaattcttgtcagtaacaa

SEQ ID NO: 131248 - DNA, 22 bp, Artificial sequence
  SiRNA target sequence
caaaattcttgtcagtaacaaa

SEQ ID NO: 131249 - DNA, 22 bp, Artificial sequence
  SiRNA target sequence
aaaattcttgtcagtaacaaaa

SEQ ID NO: 131250 - DNA, 22 bp, Artificial sequence
  SiRNA target sequence
aaattcttgtcagtaacaaaag

SEQ ID NO: 131251 - DNA, 22 bp, Artificial sequence
  SiRNA target sequence
aattcttgtcagtaacaaaaga

SEQ ID NO: 131252 - DNA, 22 bp, Artificial sequence
  SiRNA target sequence
attcttgtcagtaacaaaagat

SEQ ID NO: 131253 - DNA, 22 bp, Artificial sequence
  SiRNA target sequence
ttcttgtcagtaacaaaagatg

SEQ ID NO: 131254 - DNA, 22 bp, Artificial sequence
  SiRNA target sequence
tcttgtcagtaacaaaagatgg

SEQ ID NO: 131255 - DNA, 22 bp, Artificial sequence
  SiRNA target sequence
cttgtcagtaacaaaagatggc

SEQ ID NO: 131256 - DNA, 22 bp, Artificial sequence
  SiRNA target sequence
ttgtcagtaacaaaagatggcg

SEQ ID NO: 131257 - DNA, 22 bp, Artificial sequence
  SiRNA target sequence
tgtcagtaacaaaagatggcga

SEQ ID NO: 131258 - DNA, 22 bp, Artificial sequence
  SiRNA target sequence
gtcagtaacaaaagatggcgat

SEQ ID NO: 131259 - DNA, 22 bp, Artificial sequence
  SiRNA target sequence
tcagtaacaaaagatggcgata

SEQ ID NO: 131260 - DNA, 22 bp, Artificial sequence
  SiRNA target sequence
cagtaacaaaagatggcgataa

SEQ ID NO: 131261 - DNA, 22 bp, Artificial sequence
  SiRNA target sequence
agtaacaaaagatggcgataaa

SEQ ID NO: 131262 - DNA, 22 bp, Artificial sequence
  SiRNA target sequence
gtaacaaaagatggcgataaaa

SEQ ID NO: 131263 - DNA, 22 bp, Artificial sequence
  SiRNA target sequence
taacaaaagatggcgataaaat

SEQ ID NO: 131264 - DNA, 22 bp, Artificial sequence
  SiRNA target sequence
aacaaaagatggcgataaaatt

SEQ ID NO: 131265 - DNA, 22 bp, Artificial sequence
  SiRNA target sequence
acaaaagatggcgataaaatta

SEQ ID NO: 131266 - DNA, 22 bp, Artificial sequence
  SiRNA target sequence
caaaagatggcgataaaattaa

SEQ ID NO: 131267 - DNA, 22 bp, Artificial sequence
  SiRNA target sequence
aaaagatggcgataaaattaat

SEQ ID NO: 131268 - DNA, 22 bp, Artificial sequence
  SiRNA target sequence
aaagatggcgataaaattaatg

SEQ ID NO: 131269 - DNA, 22 bp, Artificial sequence
  SiRNA target sequence
aagatggcgataaaattaatgg

SEQ ID NO: 131270 - DNA, 22 bp, Artificial sequence
  SiRNA target sequence
agatggcgataaaattaatgga

SEQ ID NO: 131271 - DNA, 22 bp, Artificial sequence
  SiRNA target sequence
gatggcgataaaattaatggaa

SEQ ID NO: 131272 - DNA, 22 bp, Artificial sequence
  SiRNA target sequence
atggcgataaaattaatggaat

SEQ ID NO: 131273 - DNA, 22 bp, Artificial sequence
  SiRNA target sequence
tggcgataaaattaatggaatt

SEQ ID NO: 131274 - DNA, 22 bp, Artificial sequence
  SiRNA target sequence
ggcgataaaattaatggaatta

SEQ ID NO: 131275 - DNA, 22 bp, Artificial sequence
  SiRNA target sequence
gcgataaaattaatggaattaa

SEQ ID NO: 131276 - DNA, 22 bp, Artificial sequence
  SiRNA target sequence
cgataaaattaatggaattaaa

SEQ ID NO: 131277 - DNA, 22 bp, Artificial sequence
  SiRNA target sequence
gataaaattaatggaattaaat

SEQ ID NO: 131278 - DNA, 22 bp, Artificial sequence
  SiRNA target sequence
ataaaattaatggaattaaatg

SEQ ID NO: 131279 - DNA, 22 bp, Artificial sequence
  SiRNA target sequence
taaaattaatggaattaaatgt

SEQ ID NO: 131280 - DNA, 22 bp, Artificial sequence
  SiRNA target sequence
aaaattaatggaattaaatgtc

SEQ ID NO: 131281 - DNA, 22 bp, Artificial sequence
  SiRNA target sequence
aaattaatggaattaaatgtca

SEQ ID NO: 131282 - DNA, 22 bp, Artificial sequence
  SiRNA target sequence
aattaatggaattaaatgtcaa

SEQ ID NO: 131283 - DNA, 22 bp, Artificial sequence
  SiRNA target sequence
attaatggaattaaatgtcaag

SEQ ID NO: 131284 - DNA, 22 bp, Artificial sequence
  SiRNA target sequence
ttaatggaattaaatgtcaaga

SEQ ID NO: 131285 - DNA, 22 bp, Artificial sequence
  SiRNA target sequence
taatggaattaaatgtcaagat

SEQ ID NO: 131286 - DNA, 22 bp, Artificial sequence
  SiRNA target sequence
aatggaattaaatgtcaagatt

SEQ ID NO: 131287 - DNA, 22 bp, Artificial sequence
  SiRNA target sequence
atggaattaaatgtcaagattc

SEQ ID NO: 131288 - DNA, 22 bp, Artificial sequence
  SiRNA target sequence
tggaattaaatgtcaagattca

SEQ ID NO: 131289 - DNA, 22 bp, Artificial sequence
  SiRNA target sequence
ggaattaaatgtcaagattcaa

SEQ ID NO: 131290 - DNA, 22 bp, Artificial sequence
  SiRNA target sequence
gaattaaatgtcaagattcaat

SEQ ID NO: 131291 - DNA, 22 bp, Artificial sequence
  SiRNA target sequence
aattaaatgtcaagattcaata

SEQ ID NO: 131292 - DNA, 22 bp, Artificial sequence
  SiRNA target sequence
attaaatgtcaagattcaataa

SEQ ID NO: 131293 - DNA, 22 bp, Artificial sequence
  SiRNA target sequence
ttaaatgtcaagattcaataaa

SEQ ID NO: 131294 - DNA, 22 bp, Artificial sequence
  SiRNA target sequence
taaatgtcaagattcaataaat

SEQ ID NO: 131295 - DNA, 22 bp, Artificial sequence
  SiRNA target sequence
aaatgtcaagattcaataaata

SEQ ID NO: 131296 - DNA, 22 bp, Artificial sequence
  SiRNA target sequence
aatgtcaagattcaataaataa

SEQ ID NO: 131297 - DNA, 22 bp, Artificial sequence
  SiRNA target sequence
atgtcaagattcaataaataat

SEQ ID NO: 131298 - DNA, 22 bp, Artificial sequence
  SiRNA target sequence
tgtcaagattcaataaataatg

SEQ ID NO: 131299 - DNA, 22 bp, Artificial sequence
  SiRNA target sequence
gtcaagattcaataaataatga

SEQ ID NO: 131300 - DNA, 22 bp, Artificial sequence
  SiRNA target sequence
tcaagattcaataaataatgaa

SEQ ID NO: 131301 - DNA, 22 bp, Artificial sequence
  SiRNA target sequence
caagattcaataaataatgaaa

SEQ ID NO: 131302 - DNA, 22 bp, Artificial sequence
  SiRNA target sequence
aagattcaataaataatgaaaa

SEQ ID NO: 131303 - DNA, 22 bp, Artificial sequence
  SiRNA target sequence
agattcaataaataatgaaaaa

SEQ ID NO: 131304 - DNA, 22 bp, Artificial sequence
  SiRNA target sequence
gattcaataaataatgaaaaat

SEQ ID NO: 131305 - DNA, 22 bp, Artificial sequence
  SiRNA target sequence
attcaataaataatgaaaaatt

SEQ ID NO: 131306 - DNA, 22 bp, Artificial sequence
  SiRNA target sequence
ttcaataaataatgaaaaattt

SEQ ID NO: 131307 - DNA, 22 bp, Artificial sequence
  SiRNA target sequence
tcaataaataatgaaaaatttt

SEQ ID NO: 131308 - DNA, 22 bp, Artificial sequence
  SiRNA target sequence
caataaataatgaaaaattttt

SEQ ID NO: 131309 - DNA, 22 bp, Artificial sequence
  SiRNA target sequence
aataaataatgaaaaattttta

SEQ ID NO: 131310 - DNA, 22 bp, Artificial sequence
  SiRNA target sequence
ataaataatgaaaaatttttaa

SEQ ID NO: 131311 - DNA, 22 bp, Artificial sequence
  SiRNA target sequence
taaataatgaaaaatttttaat

SEQ ID NO: 131312 - DNA, 22 bp, Artificial sequence
  SiRNA target sequence
aaataatgaaaaatttttaatt

SEQ ID NO: 131313 - DNA, 22 bp, Artificial sequence
  SiRNA target sequence
aataatgaaaaatttttaatta

SEQ ID NO: 131314 - DNA, 22 bp, Artificial sequence
  SiRNA target sequence
ataatgaaaaatttttaattag

SEQ ID NO: 131315 - DNA, 22 bp, Artificial sequence
  SiRNA target sequence
taatgaaaaatttttaattagg

SEQ ID NO: 131316 - DNA, 22 bp, Artificial sequence
  SiRNA target sequence
aatgaaaaatttttaattaggt

SEQ ID NO: 131317 - DNA, 22 bp, Artificial sequence
  SiRNA target sequence
atgaaaaatttttaattaggtg

SEQ ID NO: 131318 - DNA, 22 bp, Artificial sequence
  SiRNA target sequence
tgaaaaatttttaattaggtgt

SEQ ID NO: 131319 - DNA, 22 bp, Artificial sequence
  SiRNA target sequence
gaaaaatttttaattaggtgta

SEQ ID NO: 131320 - DNA, 22 bp, Artificial sequence
  SiRNA target sequence
aaaaatttttaattaggtgtaa

SEQ ID NO: 131321 - DNA, 22 bp, Artificial sequence
  SiRNA target sequence
aaaatttttaattaggtgtaaa

SEQ ID NO: 131322 - DNA, 22 bp, Artificial sequence
  SiRNA target sequence
aaatttttaattaggtgtaaag

SEQ ID NO: 131323 - DNA, 22 bp, Artificial sequence
  SiRNA target sequence
aatttttaattaggtgtaaagt

SEQ ID NO: 131324 - DNA, 22 bp, Artificial sequence
  SiRNA target sequence
atttttaattaggtgtaaagtt

SEQ ID NO: 131325 - DNA, 22 bp, Artificial sequence
  SiRNA target sequence
tttttaattaggtgtaaagttt

SEQ ID NO: 131326 - DNA, 22 bp, Artificial sequence
  SiRNA target sequence
ttttaattaggtgtaaagtttt

SEQ ID NO: 131327 - DNA, 22 bp, Artificial sequence
  SiRNA target sequence
tttaattaggtgtaaagtttta

SEQ ID NO: 131328 - DNA, 22 bp, Artificial sequence
  SiRNA target sequence
ttaattaggtgtaaagttttaa

SEQ ID NO: 131329 - DNA, 22 bp, Artificial sequence
  SiRNA target sequence
taattaggtgtaaagttttaat

SEQ ID NO: 131330 - DNA, 22 bp, Artificial sequence
  SiRNA target sequence
aattaggtgtaaagttttaata

SEQ ID NO: 131331 - DNA, 22 bp, Artificial sequence
  SiRNA target sequence
attaggtgtaaagttttaataa

SEQ ID NO: 131332 - DNA, 22 bp, Artificial sequence
  SiRNA target sequence
ttaggtgtaaagttttaataaa

SEQ ID NO: 131333 - DNA, 22 bp, Artificial sequence
  SiRNA target sequence
taggtgtaaagttttaataaat

SEQ ID NO: 131334 - DNA, 22 bp, Artificial sequence
  SiRNA target sequence
aggtgtaaagttttaataaata

SEQ ID NO: 131335 - DNA, 22 bp, Artificial sequence
  SiRNA target sequence
ggtgtaaagttttaataaatac

SEQ ID NO: 131336 - DNA, 22 bp, Artificial sequence
  SiRNA target sequence
gtgtaaagttttaataaatact

SEQ ID NO: 131337 - DNA, 22 bp, Artificial sequence
  SiRNA target sequence
tgtaaagttttaataaatactt

SEQ ID NO: 131338 - DNA, 22 bp, Artificial sequence
  SiRNA target sequence
gtaaagttttaataaatacttc

SEQ ID NO: 131339 - DNA, 22 bp, Artificial sequence
  SiRNA target sequence
taaagttttaataaatacttct

SEQ ID NO: 131340 - DNA, 22 bp, Artificial sequence
  SiRNA target sequence
aaagttttaataaatacttctg

SEQ ID NO: 131341 - DNA, 22 bp, Artificial sequence
  SiRNA target sequence
aagttttaataaatacttctgg

SEQ ID NO: 131342 - DNA, 22 bp, Artificial sequence
  SiRNA target sequence
agttttaataaatacttctggc

SEQ ID NO: 131343 - DNA, 22 bp, Artificial sequence
  SiRNA target sequence
gttttaataaatacttctggcc

SEQ ID NO: 131344 - DNA, 22 bp, Artificial sequence
  SiRNA target sequence
ttttaataaatacttctggccc

SEQ ID NO: 131345 - DNA, 22 bp, Artificial sequence
  SiRNA target sequence
tttaataaatacttctggccct

SEQ ID NO: 131346 - DNA, 22 bp, Artificial sequence
  SiRNA target sequence
ttaataaatacttctggccctt

SEQ ID NO: 131347 - DNA, 22 bp, Artificial sequence
  SiRNA target sequence
taataaatacttctggcccttt

SEQ ID NO: 131348 - DNA, 22 bp, Artificial sequence
  SiRNA target sequence
aataaatacttctggccctttt

SEQ ID NO: 131349 - DNA, 22 bp, Artificial sequence
  SiRNA target sequence
ataaatacttctggcccttttg

SEQ ID NO: 131350 - DNA, 22 bp, Artificial sequence
  SiRNA target sequence
taaatacttctggcccttttgc

SEQ ID NO: 131351 - DNA, 22 bp, Artificial sequence
  SiRNA target sequence
aaatacttctggcccttttgct

SEQ ID NO: 131352 - DNA, 22 bp, Artificial sequence
  SiRNA target sequence
aatacttctggcccttttgctg

SEQ ID NO: 131353 - DNA, 22 bp, Artificial sequence
  SiRNA target sequence
atacttctggcccttttgctga

SEQ ID NO: 131354 - DNA, 22 bp, Artificial sequence
  SiRNA target sequence
tacttctggcccttttgctgac

SEQ ID NO: 131355 - DNA, 22 bp, Artificial sequence
  SiRNA target sequence
acttctggcccttttgctgacg

SEQ ID NO: 131356 - DNA, 22 bp, Artificial sequence
  SiRNA target sequence
cttctggcccttttgctgacga

SEQ ID NO: 131357 - DNA, 22 bp, Artificial sequence
  SiRNA target sequence
ttctggcccttttgctgacgag

SEQ ID NO: 131358 - DNA, 22 bp, Artificial sequence
  SiRNA target sequence
tctggcccttttgctgacgagg

SEQ ID NO: 131359 - DNA, 22 bp, Artificial sequence
  SiRNA target sequence
ctggcccttttgctgacgaggt

SEQ ID NO: 131360 - DNA, 22 bp, Artificial sequence
  SiRNA target sequence
tggcccttttgctgacgaggtt

SEQ ID NO: 131361 - DNA, 22 bp, Artificial sequence
  SiRNA target sequence
ggcccttttgctgacgaggttc

SEQ ID NO: 131362 - DNA, 22 bp, Artificial sequence
  SiRNA target sequence
gcccttttgctgacgaggttcg

SEQ ID NO: 131363 - DNA, 22 bp, Artificial sequence
  SiRNA target sequence
cccttttgctgacgaggttcga

SEQ ID NO: 131364 - DNA, 22 bp, Artificial sequence
  SiRNA target sequence
ccttttgctgacgaggttcgaa

SEQ ID NO: 131365 - DNA, 22 bp, Artificial sequence
  SiRNA target sequence
cttttgctgacgaggttcgaaa

SEQ ID NO: 131366 - DNA, 22 bp, Artificial sequence
  SiRNA target sequence
ttttgctgacgaggttcgaaat

SEQ ID NO: 131367 - DNA, 22 bp, Artificial sequence
  SiRNA target sequence
tttgctgacgaggttcgaaata

SEQ ID NO: 131368 - DNA, 22 bp, Artificial sequence
  SiRNA target sequence
ttgctgacgaggttcgaaatac

SEQ ID NO: 131369 - DNA, 22 bp, Artificial sequence
  SiRNA target sequence
tgctgacgaggttcgaaataca

SEQ ID NO: 131370 - DNA, 22 bp, Artificial sequence
  SiRNA target sequence
gctgacgaggttcgaaatacat

SEQ ID NO: 131371 - DNA, 22 bp, Artificial sequence
  SiRNA target sequence
ctgacgaggttcgaaatacatc

SEQ ID NO: 131372 - DNA, 22 bp, Artificial sequence
  SiRNA target sequence
tgacgaggttcgaaatacatca

SEQ ID NO: 131373 - DNA, 22 bp, Artificial sequence
  SiRNA target sequence
gacgaggttcgaaatacatcaa

SEQ ID NO: 131374 - DNA, 22 bp, Artificial sequence
  SiRNA target sequence
acgaggttcgaaatacatcaat

SEQ ID NO: 131375 - DNA, 22 bp, Artificial sequence
  SiRNA target sequence
cgaggttcgaaatacatcaatt

SEQ ID NO: 131376 - DNA, 22 bp, Artificial sequence
  SiRNA target sequence
gaggttcgaaatacatcaattg

SEQ ID NO: 131377 - DNA, 22 bp, Artificial sequence
  SiRNA target sequence
aggttcgaaatacatcaattga

SEQ ID NO: 131378 - DNA, 22 bp, Artificial sequence
  SiRNA target sequence
ggttcgaaatacatcaattgaa

SEQ ID NO: 131379 - DNA, 22 bp, Artificial sequence
  SiRNA target sequence
gttcgaaatacatcaattgaaa

SEQ ID NO: 131380 - DNA, 22 bp, Artificial sequence
  SiRNA target sequence
ttcgaaatacatcaattgaaaa

SEQ ID NO: 131381 - DNA, 22 bp, Artificial sequence
  SiRNA target sequence
tcgaaatacatcaattgaaaac

SEQ ID NO: 131382 - DNA, 22 bp, Artificial sequence
  SiRNA target sequence
cgaaatacatcaattgaaaact

SEQ ID NO: 131383 - DNA, 22 bp, Artificial sequence
  SiRNA target sequence
gaaatacatcaattgaaaactg

SEQ ID NO: 131384 - DNA, 22 bp, Artificial sequence
  SiRNA target sequence
aaatacatcaattgaaaactgt

SEQ ID NO: 131385 - DNA, 22 bp, Artificial sequence
  SiRNA target sequence
aatacatcaattgaaaactgtc

SEQ ID NO: 131386 - DNA, 22 bp, Artificial sequence
  SiRNA target sequence
atacatcaattgaaaactgtca

SEQ ID NO: 131387 - DNA, 22 bp, Artificial sequence
  SiRNA target sequence
tacatcaattgaaaactgtcaa

SEQ ID NO: 131388 - DNA, 22 bp, Artificial sequence
  SiRNA target sequence
acatcaattgaaaactgtcaac

SEQ ID NO: 131389 - DNA, 22 bp, Artificial sequence
  SiRNA target sequence
catcaattgaaaactgtcaacc

SEQ ID NO: 131390 - DNA, 22 bp, Artificial sequence
  SiRNA target sequence
atcaattgaaaactgtcaacca

SEQ ID NO: 131391 - DNA, 22 bp, Artificial sequence
  SiRNA target sequence
tcaattgaaaactgtcaaccaa

SEQ ID NO: 131392 - DNA, 22 bp, Artificial sequence
  SiRNA target sequence
caattgaaaactgtcaaccaat

SEQ ID NO: 131393 - DNA, 22 bp, Artificial sequence
  SiRNA target sequence
aattgaaaactgtcaaccaata

SEQ ID NO: 131394 - DNA, 22 bp, Artificial sequence
  SiRNA target sequence
attgaaaactgtcaaccaatac

SEQ ID NO: 131395 - DNA, 22 bp, Artificial sequence
  SiRNA target sequence
ttgaaaactgtcaaccaatact

SEQ ID NO: 131396 - DNA, 22 bp, Artificial sequence
  SiRNA target sequence
tgaaaactgtcaaccaatactc

SEQ ID NO: 131397 - DNA, 22 bp, Artificial sequence
  SiRNA target sequence
gaaaactgtcaaccaatactcc

SEQ ID NO: 131398 - DNA, 22 bp, Artificial sequence
  SiRNA target sequence
aaaactgtcaaccaatactcca

SEQ ID NO: 131399 - DNA, 22 bp, Artificial sequence
  SiRNA target sequence
aaactgtcaaccaatactccaa

SEQ ID NO: 131400 - DNA, 22 bp, Artificial sequence
  SiRNA target sequence
aactgtcaaccaatactccaac

SEQ ID NO: 131401 - DNA, 22 bp, Artificial sequence
  SiRNA target sequence
actgtcaaccaatactccaaca

SEQ ID NO: 131402 - DNA, 22 bp, Artificial sequence
  SiRNA target sequence
ctgtcaaccaatactccaacat

SEQ ID NO: 131403 - DNA, 22 bp, Artificial sequence
  SiRNA target sequence
tgtcaaccaatactccaacata

SEQ ID NO: 131404 - DNA, 22 bp, Artificial sequence
  SiRNA target sequence
gtcaaccaatactccaacatag

SEQ ID NO: 131405 - DNA, 22 bp, Artificial sequence
  SiRNA target sequence
tcaaccaatactccaacatagt

SEQ ID NO: 131406 - DNA, 22 bp, Artificial sequence
  SiRNA target sequence
caaccaatactccaacatagtt

SEQ ID NO: 131407 - DNA, 22 bp, Artificial sequence
  SiRNA target sequence
aaccaatactccaacatagtta

SEQ ID NO: 131408 - DNA, 22 bp, Artificial sequence
  SiRNA target sequence
accaatactccaacatagttat

SEQ ID NO: 131409 - DNA, 22 bp, Artificial sequence
  SiRNA target sequence
ccaatactccaacatagttatg

SEQ ID NO: 131410 - DNA, 22 bp, Artificial sequence
  SiRNA target sequence
caatactccaacatagttatgg

SEQ ID NO: 131411 - DNA, 22 bp, Artificial sequence
  SiRNA target sequence
aatactccaacatagttatggt

SEQ ID NO: 131412 - DNA, 22 bp, Artificial sequence
  SiRNA target sequence
atactccaacatagttatggta

SEQ ID NO: 131413 - DNA, 22 bp, Artificial sequence
  SiRNA target sequence
tactccaacatagttatggtac

SEQ ID NO: 131414 - DNA, 22 bp, Artificial sequence
  SiRNA target sequence
actccaacatagttatggtaca

SEQ ID NO: 131415 - DNA, 22 bp, Artificial sequence
  SiRNA target sequence
ctccaacatagttatggtacac

SEQ ID NO: 131416 - DNA, 22 bp, Artificial sequence
  SiRNA target sequence
tccaacatagttatggtacaca

SEQ ID NO: 131417 - DNA, 22 bp, Artificial sequence
  SiRNA target sequence
ccaacatagttatggtacacat

SEQ ID NO: 131418 - DNA, 22 bp, Artificial sequence
  SiRNA target sequence
caacatagttatggtacacata

SEQ ID NO: 131419 - DNA, 22 bp, Artificial sequence
  SiRNA target sequence
aacatagttatggtacacatat

SEQ ID NO: 131420 - DNA, 22 bp, Artificial sequence
  SiRNA target sequence
acatagttatggtacacatatt

SEQ ID NO: 131421 - DNA, 22 bp, Artificial sequence
  SiRNA target sequence
catagttatggtacacatattg

SEQ ID NO: 131422 - DNA, 22 bp, Artificial sequence
  SiRNA target sequence
atagttatggtacacatattgt

SEQ ID NO: 131423 - DNA, 22 bp, Artificial sequence
  SiRNA target sequence
tagttatggtacacatattgta

SEQ ID NO: 131424 - DNA, 22 bp, Artificial sequence
  SiRNA target sequence
agttatggtacacatattgtag

SEQ ID NO: 131425 - DNA, 22 bp, Artificial sequence
  SiRNA target sequence
gttatggtacacatattgtagt

SEQ ID NO: 131426 - DNA, 22 bp, Artificial sequence
  SiRNA target sequence
ttatggtacacatattgtagtt

SEQ ID NO: 131427 - DNA, 22 bp, Artificial sequence
  SiRNA target sequence
tatggtacacatattgtagttc

SEQ ID NO: 131428 - DNA, 22 bp, Artificial sequence
  SiRNA target sequence
atggtacacatattgtagttcc

SEQ ID NO: 131429 - DNA, 22 bp, Artificial sequence
  SiRNA target sequence
tggtacacatattgtagttcct

SEQ ID NO: 131430 - DNA, 22 bp, Artificial sequence
  SiRNA target sequence
ggtacacatattgtagttcctg

SEQ ID NO: 131431 - DNA, 22 bp, Artificial sequence
  SiRNA target sequence
gtacacatattgtagttcctgc

SEQ ID NO: 131432 - DNA, 22 bp, Artificial sequence
  SiRNA target sequence
tacacatattgtagttcctgcg

SEQ ID NO: 131433 - DNA, 22 bp, Artificial sequence
  SiRNA target sequence
acacatattgtagttcctgcga

SEQ ID NO: 131434 - DNA, 22 bp, Artificial sequence
  SiRNA target sequence
cacatattgtagttcctgcgat

SEQ ID NO: 131435 - DNA, 22 bp, Artificial sequence
  SiRNA target sequence
acatattgtagttcctgcgata

SEQ ID NO: 131436 - DNA, 22 bp, Artificial sequence
  SiRNA target sequence
catattgtagttcctgcgatat

SEQ ID NO: 131437 - DNA, 22 bp, Artificial sequence
  SiRNA target sequence
atattgtagttcctgcgatatt

SEQ ID NO: 131438 - DNA, 22 bp, Artificial sequence
  SiRNA target sequence
tattgtagttcctgcgatattt

SEQ ID NO: 131439 - DNA, 22 bp, Artificial sequence
  SiRNA target sequence
attgtagttcctgcgatatttt

SEQ ID NO: 131440 - DNA, 22 bp, Artificial sequence
  SiRNA target sequence
ttgtagttcctgcgatattttc

SEQ ID NO: 131441 - DNA, 22 bp, Artificial sequence
  SiRNA target sequence
tgtagttcctgcgatattttcg

SEQ ID NO: 131442 - DNA, 22 bp, Artificial sequence
  SiRNA target sequence
gtagttcctgcgatattttcgc

SEQ ID NO: 131443 - DNA, 22 bp, Artificial sequence
  SiRNA target sequence
tagttcctgcgatattttcgcc

SEQ ID NO: 131444 - DNA, 22 bp, Artificial sequence
  SiRNA target sequence
agttcctgcgatattttcgcct

SEQ ID NO: 131445 - DNA, 22 bp, Artificial sequence
  SiRNA target sequence
gttcctgcgatattttcgccta

SEQ ID NO: 131446 - DNA, 22 bp, Artificial sequence
  SiRNA target sequence
ttcctgcgatattttcgcctaa

SEQ ID NO: 131447 - DNA, 22 bp, Artificial sequence
  SiRNA target sequence
tcctgcgatattttcgcctaaa

SEQ ID NO: 131448 - DNA, 22 bp, Artificial sequence
  SiRNA target sequence
cctgcgatattttcgcctaaaa

SEQ ID NO: 131449 - DNA, 22 bp, Artificial sequence
  SiRNA target sequence
ctgcgatattttcgcctaaaaa

SEQ ID NO: 131450 - DNA, 22 bp, Artificial sequence
  SiRNA target sequence
tgcgatattttcgcctaaaaat

SEQ ID NO: 131451 - DNA, 22 bp, Artificial sequence
  SiRNA target sequence
gcgatattttcgcctaaaaata

SEQ ID NO: 131452 - DNA, 22 bp, Artificial sequence
  SiRNA target sequence
cgatattttcgcctaaaaatat

SEQ ID NO: 131453 - DNA, 22 bp, Artificial sequence
  SiRNA target sequence
gatattttcgcctaaaaatatg

SEQ ID NO: 131454 - DNA, 22 bp, Artificial sequence
  SiRNA target sequence
atattttcgcctaaaaatatgg

SEQ ID NO: 131455 - DNA, 22 bp, Artificial sequence
  SiRNA target sequence
tattttcgcctaaaaatatggg

SEQ ID NO: 131456 - DNA, 22 bp, Artificial sequence
  SiRNA target sequence
attttcgcctaaaaatatgggc

SEQ ID NO: 131457 - DNA, 22 bp, Artificial sequence
  SiRNA target sequence
ttttcgcctaaaaatatgggct

SEQ ID NO: 131458 - DNA, 22 bp, Artificial sequence
  SiRNA target sequence
tttcgcctaaaaatatgggctt

SEQ ID NO: 131459 - DNA, 22 bp, Artificial sequence
  SiRNA target sequence
ttcgcctaaaaatatgggcttt

SEQ ID NO: 131460 - DNA, 22 bp, Artificial sequence
  SiRNA target sequence
tcgcctaaaaatatgggctttg

SEQ ID NO: 131461 - DNA, 22 bp, Artificial sequence
  SiRNA target sequence
cgcctaaaaatatgggctttgt

SEQ ID NO: 131462 - DNA, 22 bp, Artificial sequence
  SiRNA target sequence
gcctaaaaatatgggctttgtt

SEQ ID NO: 131463 - DNA, 22 bp, Artificial sequence
  SiRNA target sequence
cctaaaaatatgggctttgttg

SEQ ID NO: 131464 - DNA, 22 bp, Artificial sequence
  SiRNA target sequence
ctaaaaatatgggctttgttga

SEQ ID NO: 131465 - DNA, 22 bp, Artificial sequence
  SiRNA target sequence
taaaaatatgggctttgttgat

SEQ ID NO: 131466 - DNA, 22 bp, Artificial sequence
  SiRNA target sequence
aaaaatatgggctttgttgatc

SEQ ID NO: 131467 - DNA, 22 bp, Artificial sequence
  SiRNA target sequence
aaaatatgggctttgttgatcc

SEQ ID NO: 131468 - DNA, 22 bp, Artificial sequence
  SiRNA target sequence
aaatatgggctttgttgatcca

SEQ ID NO: 131469 - DNA, 22 bp, Artificial sequence
  SiRNA target sequence
aatatgggctttgttgatccaa

SEQ ID NO: 131470 - DNA, 22 bp, Artificial sequence
  SiRNA target sequence
atatgggctttgttgatccaag

SEQ ID NO: 131471 - DNA, 22 bp, Artificial sequence
  SiRNA target sequence
tatgggctttgttgatccaagc

SEQ ID NO: 131472 - DNA, 22 bp, Artificial sequence
  SiRNA target sequence
atgggctttgttgatccaagca

SEQ ID NO: 131473 - DNA, 22 bp, Artificial sequence
  SiRNA target sequence
tgggctttgttgatccaagcac

SEQ ID NO: 131474 - DNA, 22 bp, Artificial sequence
  SiRNA target sequence
gggctttgttgatccaagcacg

SEQ ID NO: 131475 - DNA, 22 bp, Artificial sequence
  SiRNA target sequence
ggctttgttgatccaagcacga

SEQ ID NO: 131476 - DNA, 22 bp, Artificial sequence
  SiRNA target sequence
gctttgttgatccaagcacgag

SEQ ID NO: 131477 - DNA, 22 bp, Artificial sequence
  SiRNA target sequence
ctttgttgatccaagcacgagt

SEQ ID NO: 131478 - DNA, 22 bp, Artificial sequence
  SiRNA target sequence
tttgttgatccaagcacgagtg

SEQ ID NO: 131479 - DNA, 22 bp, Artificial sequence
  SiRNA target sequence
ttgttgatccaagcacgagtga

SEQ ID NO: 131480 - DNA, 22 bp, Artificial sequence
  SiRNA target sequence
tgttgatccaagcacgagtgat

SEQ ID NO: 131481 - DNA, 22 bp, Artificial sequence
  SiRNA target sequence
gttgatccaagcacgagtgatg

SEQ ID NO: 131482 - DNA, 22 bp, Artificial sequence
  SiRNA target sequence
ttgatccaagcacgagtgatgg

SEQ ID NO: 131483 - DNA, 22 bp, Artificial sequence
  SiRNA target sequence
tgatccaagcacgagtgatgga

SEQ ID NO: 131484 - DNA, 22 bp, Artificial sequence
  SiRNA target sequence
gatccaagcacgagtgatggaa

SEQ ID NO: 131485 - DNA, 22 bp, Artificial sequence
  SiRNA target sequence
atccaagcacgagtgatggaag

SEQ ID NO: 131486 - DNA, 22 bp, Artificial sequence
  SiRNA target sequence
tccaagcacgagtgatggaaga

SEQ ID NO: 131487 - DNA, 22 bp, Artificial sequence
  SiRNA target sequence
ccaagcacgagtgatggaagaa

SEQ ID NO: 131488 - DNA, 22 bp, Artificial sequence
  SiRNA target sequence
caagcacgagtgatggaagaat

SEQ ID NO: 131489 - DNA, 22 bp, Artificial sequence
  SiRNA target sequence
aagcacgagtgatggaagaatc

SEQ ID NO: 131490 - DNA, 22 bp, Artificial sequence
  SiRNA target sequence
agcacgagtgatggaagaatcg

SEQ ID NO: 131491 - DNA, 22 bp, Artificial sequence
  SiRNA target sequence
gcacgagtgatggaagaatcgc

SEQ ID NO: 131492 - DNA, 22 bp, Artificial sequence
  SiRNA target sequence
cacgagtgatggaagaatcgca

SEQ ID NO: 131493 - DNA, 22 bp, Artificial sequence
  SiRNA target sequence
acgagtgatggaagaatcgcat

SEQ ID NO: 131494 - DNA, 22 bp, Artificial sequence
  SiRNA target sequence
cgagtgatggaagaatcgcatt

SEQ ID NO: 131495 - DNA, 22 bp, Artificial sequence
  SiRNA target sequence
gagtgatggaagaatcgcattt

SEQ ID NO: 131496 - DNA, 22 bp, Artificial sequence
  SiRNA target sequence
agtgatggaagaatcgcatttt

SEQ ID NO: 131497 - DNA, 22 bp, Artificial sequence
  SiRNA target sequence
gtgatggaagaatcgcattttt

SEQ ID NO: 131498 - DNA, 22 bp, Artificial sequence
  SiRNA target sequence
tgatggaagaatcgcatttttt

SEQ ID NO: 131499 - DNA, 22 bp, Artificial sequence
  SiRNA target sequence
gatggaagaatcgcatttttta

SEQ ID NO: 131500 - DNA, 22 bp, Artificial sequence
  SiRNA target sequence
atggaagaatcgcattttttat

SEQ ID NO: 131501 - DNA, 22 bp, Artificial sequence
  SiRNA target sequence
tggaagaatcgcattttttatg

SEQ ID NO: 131502 - DNA, 22 bp, Artificial sequence
  SiRNA target sequence
ggaagaatcgcattttttatga

SEQ ID NO: 131503 - DNA, 22 bp, Artificial sequence
  SiRNA target sequence
gaagaatcgcattttttatgaa

SEQ ID NO: 131504 - DNA, 22 bp, Artificial sequence
  SiRNA target sequence
aagaatcgcattttttatgaat

SEQ ID NO: 131505 - DNA, 22 bp, Artificial sequence
  SiRNA target sequence
agaatcgcattttttatgaatt

SEQ ID NO: 131506 - DNA, 22 bp, Artificial sequence
  SiRNA target sequence
gaatcgcattttttatgaattt

SEQ ID NO: 131507 - DNA, 22 bp, Artificial sequence
  SiRNA target sequence
aatcgcattttttatgaatttt

SEQ ID NO: 131508 - DNA, 22 bp, Artificial sequence
  SiRNA target sequence
atcgcattttttatgaatttta

SEQ ID NO: 131509 - DNA, 22 bp, Artificial sequence
  SiRNA target sequence
tcgcattttttatgaattttaa

SEQ ID NO: 131510 - DNA, 22 bp, Artificial sequence
  SiRNA target sequence
cgcattttttatgaattttaaa

SEQ ID NO: 131511 - DNA, 22 bp, Artificial sequence
  SiRNA target sequence
gcattttttatgaattttaaag

SEQ ID NO: 131512 - DNA, 22 bp, Artificial sequence
  SiRNA target sequence
cattttttatgaattttaaagg

SEQ ID NO: 131513 - DNA, 22 bp, Artificial sequence
  SiRNA target sequence
attttttatgaattttaaaggt

SEQ ID NO: 131514 - DNA, 22 bp, Artificial sequence
  SiRNA target sequence
ttttttatgaattttaaaggta

SEQ ID NO: 131515 - DNA, 22 bp, Artificial sequence
  SiRNA target sequence
tttttatgaattttaaaggtaa

SEQ ID NO: 131516 - DNA, 22 bp, Artificial sequence
  SiRNA target sequence
ttttatgaattttaaaggtaaa

SEQ ID NO: 131517 - DNA, 22 bp, Artificial sequence
  SiRNA target sequence
tttatgaattttaaaggtaaaa

SEQ ID NO: 131518 - DNA, 22 bp, Artificial sequence
  SiRNA target sequence
ttatgaattttaaaggtaaaac

SEQ ID NO: 131519 - DNA, 22 bp, Artificial sequence
  SiRNA target sequence
tatgaattttaaaggtaaaaca

SEQ ID NO: 131520 - DNA, 22 bp, Artificial sequence
  SiRNA target sequence
atgaattttaaaggtaaaacat

SEQ ID NO: 131521 - DNA, 22 bp, Artificial sequence
  SiRNA target sequence
tgaattttaaaggtaaaacatt

SEQ ID NO: 131522 - DNA, 22 bp, Artificial sequence
  SiRNA target sequence
gaattttaaaggtaaaacattg

SEQ ID NO: 131523 - DNA, 22 bp, Artificial sequence
  SiRNA target sequence
aattttaaaggtaaaacattga

SEQ ID NO: 131524 - DNA, 22 bp, Artificial sequence
  SiRNA target sequence
attttaaaggtaaaacattgat

SEQ ID NO: 131525 - DNA, 22 bp, Artificial sequence
  SiRNA target sequence
ttttaaaggtaaaacattgatt

SEQ ID NO: 131526 - DNA, 22 bp, Artificial sequence
  SiRNA target sequence
tttaaaggtaaaacattgattg

SEQ ID NO: 131527 - DNA, 22 bp, Artificial sequence
  SiRNA target sequence
ttaaaggtaaaacattgattgg

SEQ ID NO: 131528 - DNA, 22 bp, Artificial sequence
  SiRNA target sequence
taaaggtaaaacattgattgga

SEQ ID NO: 131529 - DNA, 22 bp, Artificial sequence
  SiRNA target sequence
aaaggtaaaacattgattggag

SEQ ID NO: 131530 - DNA, 22 bp, Artificial sequence
  SiRNA target sequence
aaggtaaaacattgattggagg

SEQ ID NO: 131531 - DNA, 22 bp, Artificial sequence
  SiRNA target sequence
aggtaaaacattgattggagga

SEQ ID NO: 131532 - DNA, 22 bp, Artificial sequence
  SiRNA target sequence
ggtaaaacattgattggaggaa

SEQ ID NO: 131533 - DNA, 22 bp, Artificial sequence
  SiRNA target sequence
gtaaaacattgattggaggaac

SEQ ID NO: 131534 - DNA, 22 bp, Artificial sequence
  SiRNA target sequence
taaaacattgattggaggaaca

SEQ ID NO: 131535 - DNA, 22 bp, Artificial sequence
  SiRNA target sequence
aaaacattgattggaggaacag

SEQ ID NO: 131536 - DNA, 22 bp, Artificial sequence
  SiRNA target sequence
aaacattgattggaggaacaga

SEQ ID NO: 131537 - DNA, 22 bp, Artificial sequence
  SiRNA target sequence
aacattgattggaggaacagat

SEQ ID NO: 131538 - DNA, 22 bp, Artificial sequence
  SiRNA target sequence
acattgattggaggaacagatg

SEQ ID NO: 131539 - DNA, 22 bp, Artificial sequence
  SiRNA target sequence
cattgattggaggaacagatgt

SEQ ID NO: 131540 - DNA, 22 bp, Artificial sequence
  SiRNA target sequence
attgattggaggaacagatgtt

SEQ ID NO: 131541 - DNA, 22 bp, Artificial sequence
  SiRNA target sequence
ttgattggaggaacagatgtta

SEQ ID NO: 131542 - DNA, 22 bp, Artificial sequence
  SiRNA target sequence
tgattggaggaacagatgttaa

SEQ ID NO: 131543 - DNA, 22 bp, Artificial sequence
  SiRNA target sequence
gattggaggaacagatgttaag

SEQ ID NO: 131544 - DNA, 22 bp, Artificial sequence
  SiRNA target sequence
attggaggaacagatgttaagt

SEQ ID NO: 131545 - DNA, 22 bp, Artificial sequence
  SiRNA target sequence
ttggaggaacagatgttaagtg

SEQ ID NO: 131546 - DNA, 22 bp, Artificial sequence
  SiRNA target sequence
tggaggaacagatgttaagtgt

SEQ ID NO: 131547 - DNA, 22 bp, Artificial sequence
  SiRNA target sequence
ggaggaacagatgttaagtgta

SEQ ID NO: 131548 - DNA, 22 bp, Artificial sequence
  SiRNA target sequence
gaggaacagatgttaagtgtaa

SEQ ID NO: 131549 - DNA, 22 bp, Artificial sequence
  SiRNA target sequence
aggaacagatgttaagtgtaaa

SEQ ID NO: 131550 - DNA, 22 bp, Artificial sequence
  SiRNA target sequence
ggaacagatgttaagtgtaaag

SEQ ID NO: 131551 - DNA, 22 bp, Artificial sequence
  SiRNA target sequence
gaacagatgttaagtgtaaagt

SEQ ID NO: 131552 - DNA, 22 bp, Artificial sequence
  SiRNA target sequence
aacagatgttaagtgtaaagtt

SEQ ID NO: 131553 - DNA, 22 bp, Artificial sequence
  SiRNA target sequence
acagatgttaagtgtaaagttg

SEQ ID NO: 131554 - DNA, 22 bp, Artificial sequence
  SiRNA target sequence
cagatgttaagtgtaaagttga

SEQ ID NO: 131555 - DNA, 22 bp, Artificial sequence
  SiRNA target sequence
agatgttaagtgtaaagttgaa

SEQ ID NO: 131556 - DNA, 22 bp, Artificial sequence
  SiRNA target sequence
gatgttaagtgtaaagttgaag

SEQ ID NO: 131557 - DNA, 22 bp, Artificial sequence
  SiRNA target sequence
atgttaagtgtaaagttgaaga

SEQ ID NO: 131558 - DNA, 22 bp, Artificial sequence
  SiRNA target sequence
tgttaagtgtaaagttgaagat

SEQ ID NO: 131559 - DNA, 22 bp, Artificial sequence
  SiRNA target sequence
gttaagtgtaaagttgaagatt

SEQ ID NO: 131560 - DNA, 22 bp, Artificial sequence
  SiRNA target sequence
ttaagtgtaaagttgaagattt

SEQ ID NO: 131561 - DNA, 22 bp, Artificial sequence
  SiRNA target sequence
taagtgtaaagttgaagattta

SEQ ID NO: 131562 - DNA, 22 bp, Artificial sequence
  SiRNA target sequence
aagtgtaaagttgaagatttaa

SEQ ID NO: 131563 - DNA, 22 bp, Artificial sequence
  SiRNA target sequence
agtgtaaagttgaagatttaat

SEQ ID NO: 131564 - DNA, 22 bp, Artificial sequence
  SiRNA target sequence
gtgtaaagttgaagatttaata

SEQ ID NO: 131565 - DNA, 22 bp, Artificial sequence
  SiRNA target sequence
tgtaaagttgaagatttaataa

SEQ ID NO: 131566 - DNA, 22 bp, Artificial sequence
  SiRNA target sequence
gtaaagttgaagatttaataaa

SEQ ID NO: 131567 - DNA, 22 bp, Artificial sequence
  SiRNA target sequence
taaagttgaagatttaataaaa

SEQ ID NO: 131568 - DNA, 22 bp, Artificial sequence
  SiRNA target sequence
aaagttgaagatttaataaaac

SEQ ID NO: 131569 - DNA, 22 bp, Artificial sequence
  SiRNA target sequence
aagttgaagatttaataaaacc

SEQ ID NO: 131570 - DNA, 22 bp, Artificial sequence
  SiRNA target sequence
agttgaagatttaataaaaccg

SEQ ID NO: 131571 - DNA, 22 bp, Artificial sequence
  SiRNA target sequence
gttgaagatttaataaaaccga

SEQ ID NO: 131572 - DNA, 22 bp, Artificial sequence
  SiRNA target sequence
ttgaagatttaataaaaccgac

SEQ ID NO: 131573 - DNA, 22 bp, Artificial sequence
  SiRNA target sequence
tgaagatttaataaaaccgact

SEQ ID NO: 131574 - DNA, 22 bp, Artificial sequence
  SiRNA target sequence
gaagatttaataaaaccgactg

SEQ ID NO: 131575 - DNA, 22 bp, Artificial sequence
  SiRNA target sequence
aagatttaataaaaccgactga

SEQ ID NO: 131576 - DNA, 22 bp, Artificial sequence
  SiRNA target sequence
agatttaataaaaccgactgaa

SEQ ID NO: 131577 - DNA, 22 bp, Artificial sequence
  SiRNA target sequence
gatttaataaaaccgactgaag

SEQ ID NO: 131578 - DNA, 22 bp, Artificial sequence
  SiRNA target sequence
atttaataaaaccgactgaaga

SEQ ID NO: 131579 - DNA, 22 bp, Artificial sequence
  SiRNA target sequence
tttaataaaaccgactgaagaa

SEQ ID NO: 131580 - DNA, 22 bp, Artificial sequence
  SiRNA target sequence
ttaataaaaccgactgaagaag

SEQ ID NO: 131581 - DNA, 22 bp, Artificial sequence
  SiRNA target sequence
taataaaaccgactgaagaaga

SEQ ID NO: 131582 - DNA, 22 bp, Artificial sequence
  SiRNA target sequence
aataaaaccgactgaagaagat

SEQ ID NO: 131583 - DNA, 22 bp, Artificial sequence
  SiRNA target sequence
ataaaaccgactgaagaagatc

SEQ ID NO: 131584 - DNA, 22 bp, Artificial sequence
  SiRNA target sequence
taaaaccgactgaagaagatct

SEQ ID NO: 131585 - DNA, 22 bp, Artificial sequence
  SiRNA target sequence
aaaaccgactgaagaagatcta

SEQ ID NO: 131586 - DNA, 22 bp, Artificial sequence
  SiRNA target sequence
aaaccgactgaagaagatctaa

SEQ ID NO: 131587 - DNA, 22 bp, Artificial sequence
  SiRNA target sequence
aaccgactgaagaagatctaaa

SEQ ID NO: 131588 - DNA, 22 bp, Artificial sequence
  SiRNA target sequence
accgactgaagaagatctaaac

SEQ ID NO: 131589 - DNA, 22 bp, Artificial sequence
  SiRNA target sequence
ccgactgaagaagatctaaact

SEQ ID NO: 131590 - DNA, 22 bp, Artificial sequence
  SiRNA target sequence
cgactgaagaagatctaaactt

SEQ ID NO: 131591 - DNA, 22 bp, Artificial sequence
  SiRNA target sequence
gactgaagaagatctaaacttt

SEQ ID NO: 131592 - DNA, 22 bp, Artificial sequence
  SiRNA target sequence
actgaagaagatctaaactttc

SEQ ID NO: 131593 - DNA, 22 bp, Artificial sequence
  SiRNA target sequence
ctgaagaagatctaaactttct

SEQ ID NO: 131594 - DNA, 22 bp, Artificial sequence
  SiRNA target sequence
tgaagaagatctaaactttctt

SEQ ID NO: 131595 - DNA, 22 bp, Artificial sequence
  SiRNA target sequence
gaagaagatctaaactttctta

SEQ ID NO: 131596 - DNA, 22 bp, Artificial sequence
  SiRNA target sequence
aagaagatctaaactttcttat

SEQ ID NO: 131597 - DNA, 22 bp, Artificial sequence
  SiRNA target sequence
agaagatctaaactttcttatt

SEQ ID NO: 131598 - DNA, 22 bp, Artificial sequence
  SiRNA target sequence
gaagatctaaactttcttattc

SEQ ID NO: 131599 - DNA, 22 bp, Artificial sequence
  SiRNA target sequence
aagatctaaactttcttattca

SEQ ID NO: 131600 - DNA, 22 bp, Artificial sequence
  SiRNA target sequence
agatctaaactttcttattcac

SEQ ID NO: 131601 - DNA, 22 bp, Artificial sequence
  SiRNA target sequence
gatctaaactttcttattcacg

SEQ ID NO: 131602 - DNA, 22 bp, Artificial sequence
  SiRNA target sequence
atctaaactttcttattcacga

SEQ ID NO: 131603 - DNA, 22 bp, Artificial sequence
  SiRNA target sequence
tctaaactttcttattcacgag

SEQ ID NO: 131604 - DNA, 22 bp, Artificial sequence
  SiRNA target sequence
ctaaactttcttattcacgagg

SEQ ID NO: 131605 - DNA, 22 bp, Artificial sequence
  SiRNA target sequence
taaactttcttattcacgaggc

SEQ ID NO: 131606 - DNA, 22 bp, Artificial sequence
  SiRNA target sequence
aaactttcttattcacgaggcc

SEQ ID NO: 131607 - DNA, 22 bp, Artificial sequence
  SiRNA target sequence
aactttcttattcacgaggcca

SEQ ID NO: 131608 - DNA, 22 bp, Artificial sequence
  SiRNA target sequence
actttcttattcacgaggccaa

SEQ ID NO: 131609 - DNA, 22 bp, Artificial sequence
  SiRNA target sequence
ctttcttattcacgaggccaat

SEQ ID NO: 131610 - DNA, 22 bp, Artificial sequence
  SiRNA target sequence
tttcttattcacgaggccaatt

SEQ ID NO: 131611 - DNA, 22 bp, Artificial sequence
  SiRNA target sequence
ttcttattcacgaggccaatta

SEQ ID NO: 131612 - DNA, 22 bp, Artificial sequence
  SiRNA target sequence
tcttattcacgaggccaattat

SEQ ID NO: 131613 - DNA, 22 bp, Artificial sequence
  SiRNA target sequence
cttattcacgaggccaattatt

SEQ ID NO: 131614 - DNA, 22 bp, Artificial sequence
  SiRNA target sequence
ttattcacgaggccaattattt

SEQ ID NO: 131615 - DNA, 22 bp, Artificial sequence
  SiRNA target sequence
tattcacgaggccaattatttt

SEQ ID NO: 131616 - DNA, 22 bp, Artificial sequence
  SiRNA target sequence
attcacgaggccaattatttta

SEQ ID NO: 131617 - DNA, 22 bp, Artificial sequence
  SiRNA target sequence
ttcacgaggccaattattttac

SEQ ID NO: 131618 - DNA, 22 bp, Artificial sequence
  SiRNA target sequence
tcacgaggccaattattttaca

SEQ ID NO: 131619 - DNA, 22 bp, Artificial sequence
  SiRNA target sequence
cacgaggccaattattttacag

SEQ ID NO: 131620 - DNA, 22 bp, Artificial sequence
  SiRNA target sequence
acgaggccaattattttacaga

SEQ ID NO: 131621 - DNA, 22 bp, Artificial sequence
  SiRNA target sequence
cgaggccaattattttacagat

SEQ ID NO: 131622 - DNA, 22 bp, Artificial sequence
  SiRNA target sequence
gaggccaattattttacagatc

SEQ ID NO: 131623 - DNA, 22 bp, Artificial sequence
  SiRNA target sequence
aggccaattattttacagatca

SEQ ID NO: 131624 - DNA, 22 bp, Artificial sequence
  SiRNA target sequence
ggccaattattttacagatcac

SEQ ID NO: 131625 - DNA, 22 bp, Artificial sequence
  SiRNA target sequence
gccaattattttacagatcaca

SEQ ID NO: 131626 - DNA, 22 bp, Artificial sequence
  SiRNA target sequence
ccaattattttacagatcacaa

SEQ ID NO: 131627 - DNA, 22 bp, Artificial sequence
  SiRNA target sequence
caattattttacagatcacaat

SEQ ID NO: 131628 - DNA, 22 bp, Artificial sequence
  SiRNA target sequence
aattattttacagatcacaatt

SEQ ID NO: 131629 - DNA, 22 bp, Artificial sequence
  SiRNA target sequence
attattttacagatcacaattt

SEQ ID NO: 131630 - DNA, 22 bp, Artificial sequence
  SiRNA target sequence
ttattttacagatcacaattta

SEQ ID NO: 131631 - DNA, 22 bp, Artificial sequence
  SiRNA target sequence
tattttacagatcacaatttaa

SEQ ID NO: 131632 - DNA, 22 bp, Artificial sequence
  SiRNA target sequence
attttacagatcacaatttaaa

SEQ ID NO: 131633 - DNA, 22 bp, Artificial sequence
  SiRNA target sequence
ttttacagatcacaatttaaaa

SEQ ID NO: 131634 - DNA, 22 bp, Artificial sequence
  SiRNA target sequence
tttacagatcacaatttaaaat

SEQ ID NO: 131635 - DNA, 22 bp, Artificial sequence
  SiRNA target sequence
ttacagatcacaatttaaaatt

SEQ ID NO: 131636 - DNA, 22 bp, Artificial sequence
  SiRNA target sequence
tacagatcacaatttaaaatta

SEQ ID NO: 131637 - DNA, 22 bp, Artificial sequence
  SiRNA target sequence
acagatcacaatttaaaattaa

SEQ ID NO: 131638 - DNA, 22 bp, Artificial sequence
  SiRNA target sequence
cagatcacaatttaaaattaac

SEQ ID NO: 131639 - DNA, 22 bp, Artificial sequence
  SiRNA target sequence
agatcacaatttaaaattaaca

SEQ ID NO: 131640 - DNA, 22 bp, Artificial sequence
  SiRNA target sequence
gatcacaatttaaaattaacaa

SEQ ID NO: 131641 - DNA, 22 bp, Artificial sequence
  SiRNA target sequence
atcacaatttaaaattaacaaa

SEQ ID NO: 131642 - DNA, 22 bp, Artificial sequence
  SiRNA target sequence
tcacaatttaaaattaacaaaa

SEQ ID NO: 131643 - DNA, 22 bp, Artificial sequence
  SiRNA target sequence
cacaatttaaaattaacaaaaa

SEQ ID NO: 131644 - DNA, 22 bp, Artificial sequence
  SiRNA target sequence
acaatttaaaattaacaaaaaa

SEQ ID NO: 131645 - DNA, 22 bp, Artificial sequence
  SiRNA target sequence
caatttaaaattaacaaaaaaa

SEQ ID NO: 131646 - DNA, 22 bp, Artificial sequence
  SiRNA target sequence
aatttaaaattaacaaaaaaag

SEQ ID NO: 131647 - DNA, 22 bp, Artificial sequence
  SiRNA target sequence
atttaaaattaacaaaaaaaga

SEQ ID NO: 131648 - DNA, 22 bp, Artificial sequence
  SiRNA target sequence
tttaaaattaacaaaaaaagat

SEQ ID NO: 131649 - DNA, 22 bp, Artificial sequence
  SiRNA target sequence
ttaaaattaacaaaaaaagatg

SEQ ID NO: 131650 - DNA, 22 bp, Artificial sequence
  SiRNA target sequence
taaaattaacaaaaaaagatgt

SEQ ID NO: 131651 - DNA, 22 bp, Artificial sequence
  SiRNA target sequence
aaaattaacaaaaaaagatgtt

SEQ ID NO: 131652 - DNA, 22 bp, Artificial sequence
  SiRNA target sequence
aaattaacaaaaaaagatgttt

SEQ ID NO: 131653 - DNA, 22 bp, Artificial sequence
  SiRNA target sequence
aattaacaaaaaaagatgtttt

SEQ ID NO: 131654 - DNA, 22 bp, Artificial sequence
  SiRNA target sequence
attaacaaaaaaagatgttttg

SEQ ID NO: 131655 - DNA, 22 bp, Artificial sequence
  SiRNA target sequence
ttaacaaaaaaagatgttttgt

SEQ ID NO: 131656 - DNA, 22 bp, Artificial sequence
  SiRNA target sequence
taacaaaaaaagatgttttgtc

SEQ ID NO: 131657 - DNA, 22 bp, Artificial sequence
  SiRNA target sequence
aacaaaaaaagatgttttgtct

SEQ ID NO: 131658 - DNA, 22 bp, Artificial sequence
  SiRNA target sequence
acaaaaaaagatgttttgtctg

SEQ ID NO: 131659 - DNA, 22 bp, Artificial sequence
  SiRNA target sequence
caaaaaaagatgttttgtctgt

SEQ ID NO: 131660 - DNA, 22 bp, Artificial sequence
  SiRNA target sequence
aaaaaaagatgttttgtctgtt

SEQ ID NO: 131661 - DNA, 22 bp, Artificial sequence
  SiRNA target sequence
aaaaaagatgttttgtctgttt

SEQ ID NO: 131662 - DNA, 22 bp, Artificial sequence
  SiRNA target sequence
aaaaagatgttttgtctgtttg

SEQ ID NO: 131663 - DNA, 22 bp, Artificial sequence
  SiRNA target sequence
aaaagatgttttgtctgtttgg

SEQ ID NO: 131664 - DNA, 22 bp, Artificial sequence
  SiRNA target sequence
aaagatgttttgtctgtttgga

SEQ ID NO: 131665 - DNA, 22 bp, Artificial sequence
  SiRNA target sequence
aagatgttttgtctgtttggac

SEQ ID NO: 131666 - DNA, 22 bp, Artificial sequence
  SiRNA target sequence
agatgttttgtctgtttggaca

SEQ ID NO: 131667 - DNA, 22 bp, Artificial sequence
  SiRNA target sequence
gatgttttgtctgtttggacag

SEQ ID NO: 131668 - DNA, 22 bp, Artificial sequence
  SiRNA target sequence
atgttttgtctgtttggacagg

SEQ ID NO: 131669 - DNA, 22 bp, Artificial sequence
  SiRNA target sequence
tgttttgtctgtttggacaggt

SEQ ID NO: 131670 - DNA, 22 bp, Artificial sequence
  SiRNA target sequence
gttttgtctgtttggacaggta

SEQ ID NO: 131671 - DNA, 22 bp, Artificial sequence
  SiRNA target sequence
ttttgtctgtttggacaggtat

SEQ ID NO: 131672 - DNA, 22 bp, Artificial sequence
  SiRNA target sequence
tttgtctgtttggacaggtatt

SEQ ID NO: 131673 - DNA, 22 bp, Artificial sequence
  SiRNA target sequence
ttgtctgtttggacaggtatta

SEQ ID NO: 131674 - DNA, 22 bp, Artificial sequence
  SiRNA target sequence
tgtctgtttggacaggtattag

SEQ ID NO: 131675 - DNA, 22 bp, Artificial sequence
  SiRNA target sequence
gtctgtttggacaggtattaga

SEQ ID NO: 131676 - DNA, 22 bp, Artificial sequence
  SiRNA target sequence
tctgtttggacaggtattagac

SEQ ID NO: 131677 - DNA, 22 bp, Artificial sequence
  SiRNA target sequence
ctgtttggacaggtattagacc

SEQ ID NO: 131678 - DNA, 22 bp, Artificial sequence
  SiRNA target sequence
tgtttggacaggtattagaccg

SEQ ID NO: 131679 - DNA, 22 bp, Artificial sequence
  SiRNA target sequence
gtttggacaggtattagaccgt

SEQ ID NO: 131680 - DNA, 22 bp, Artificial sequence
  SiRNA target sequence
tttggacaggtattagaccgtt

SEQ ID NO: 131681 - DNA, 22 bp, Artificial sequence
  SiRNA target sequence
ttggacaggtattagaccgtta

SEQ ID NO: 131682 - DNA, 22 bp, Artificial sequence
  SiRNA target sequence
tggacaggtattagaccgttag

SEQ ID NO: 131683 - DNA, 22 bp, Artificial sequence
  SiRNA target sequence
ggacaggtattagaccgttagt

SEQ ID NO: 131684 - DNA, 22 bp, Artificial sequence
  SiRNA target sequence
gacaggtattagaccgttagtc

SEQ ID NO: 131685 - DNA, 22 bp, Artificial sequence
  SiRNA target sequence
acaggtattagaccgttagtca

SEQ ID NO: 131686 - DNA, 22 bp, Artificial sequence
  SiRNA target sequence
caggtattagaccgttagtcaa

SEQ ID NO: 131687 - DNA, 22 bp, Artificial sequence
  SiRNA target sequence
aggtattagaccgttagtcaag

SEQ ID NO: 131688 - DNA, 22 bp, Artificial sequence
  SiRNA target sequence
ggtattagaccgttagtcaagg

SEQ ID NO: 131689 - DNA, 22 bp, Artificial sequence
  SiRNA target sequence
gtattagaccgttagtcaagga

SEQ ID NO: 131690 - DNA, 22 bp, Artificial sequence
  SiRNA target sequence
tattagaccgttagtcaaggat

SEQ ID NO: 131691 - DNA, 22 bp, Artificial sequence
  SiRNA target sequence
attagaccgttagtcaaggatt

SEQ ID NO: 131692 - DNA, 22 bp, Artificial sequence
  SiRNA target sequence
ttagaccgttagtcaaggattt

SEQ ID NO: 131693 - DNA, 22 bp, Artificial sequence
  SiRNA target sequence
tagaccgttagtcaaggattta

SEQ ID NO: 131694 - DNA, 22 bp, Artificial sequence
  SiRNA target sequence
agaccgttagtcaaggatttat

SEQ ID NO: 131695 - DNA, 22 bp, Artificial sequence
  SiRNA target sequence
gaccgttagtcaaggatttatc

SEQ ID NO: 131696 - DNA, 22 bp, Artificial sequence
  SiRNA target sequence
accgttagtcaaggatttatcg

SEQ ID NO: 131697 - DNA, 22 bp, Artificial sequence
  SiRNA target sequence
ccgttagtcaaggatttatcga

SEQ ID NO: 131698 - DNA, 22 bp, Artificial sequence
  SiRNA target sequence
cgttagtcaaggatttatcgaa

SEQ ID NO: 131699 - DNA, 22 bp, Artificial sequence
  SiRNA target sequence
gttagtcaaggatttatcgaaa

SEQ ID NO: 131700 - DNA, 22 bp, Artificial sequence
  SiRNA target sequence
ttagtcaaggatttatcgaaaa

SEQ ID NO: 131701 - DNA, 22 bp, Artificial sequence
  SiRNA target sequence
tagtcaaggatttatcgaaaag

SEQ ID NO: 131702 - DNA, 22 bp, Artificial sequence
  SiRNA target sequence
agtcaaggatttatcgaaaagt

SEQ ID NO: 131703 - DNA, 22 bp, Artificial sequence
  SiRNA target sequence
gtcaaggatttatcgaaaagtt

SEQ ID NO: 131704 - DNA, 22 bp, Artificial sequence
  SiRNA target sequence
tcaaggatttatcgaaaagttc

SEQ ID NO: 131705 - DNA, 22 bp, Artificial sequence
  SiRNA target sequence
caaggatttatcgaaaagttca

SEQ ID NO: 131706 - DNA, 22 bp, Artificial sequence
  SiRNA target sequence
aaggatttatcgaaaagttcaa

SEQ ID NO: 131707 - DNA, 22 bp, Artificial sequence
  SiRNA target sequence
aggatttatcgaaaagttcaac

SEQ ID NO: 131708 - DNA, 22 bp, Artificial sequence
  SiRNA target sequence
ggatttatcgaaaagttcaaca

SEQ ID NO: 131709 - DNA, 22 bp, Artificial sequence
  SiRNA target sequence
gatttatcgaaaagttcaacag

SEQ ID NO: 131710 - DNA, 22 bp, Artificial sequence
  SiRNA target sequence
atttatcgaaaagttcaacaga

SEQ ID NO: 131711 - DNA, 22 bp, Artificial sequence
  SiRNA target sequence
tttatcgaaaagttcaacagaa

SEQ ID NO: 131712 - DNA, 22 bp, Artificial sequence
  SiRNA target sequence
ttatcgaaaagttcaacagaaa

SEQ ID NO: 131713 - DNA, 22 bp, Artificial sequence
  SiRNA target sequence
tatcgaaaagttcaacagaaaa

SEQ ID NO: 131714 - DNA, 22 bp, Artificial sequence
  SiRNA target sequence
atcgaaaagttcaacagaaaag

SEQ ID NO: 131715 - DNA, 22 bp, Artificial sequence
  SiRNA target sequence
tcgaaaagttcaacagaaaaga

SEQ ID NO: 131716 - DNA, 22 bp, Artificial sequence
  SiRNA target sequence
cgaaaagttcaacagaaaagat

SEQ ID NO: 131717 - DNA, 22 bp, Artificial sequence
  SiRNA target sequence
gaaaagttcaacagaaaagata

SEQ ID NO: 131718 - DNA, 22 bp, Artificial sequence
  SiRNA target sequence
aaaagttcaacagaaaagatat

SEQ ID NO: 131719 - DNA, 22 bp, Artificial sequence
  SiRNA target sequence
aaagttcaacagaaaagatatg

SEQ ID NO: 131720 - DNA, 22 bp, Artificial sequence
  SiRNA target sequence
aagttcaacagaaaagatatgt

SEQ ID NO: 131721 - DNA, 22 bp, Artificial sequence
  SiRNA target sequence
agttcaacagaaaagatatgta

SEQ ID NO: 131722 - DNA, 22 bp, Artificial sequence
  SiRNA target sequence
gttcaacagaaaagatatgtag

SEQ ID NO: 131723 - DNA, 22 bp, Artificial sequence
  SiRNA target sequence
ttcaacagaaaagatatgtaga

SEQ ID NO: 131724 - DNA, 22 bp, Artificial sequence
  SiRNA target sequence
tcaacagaaaagatatgtagaa

SEQ ID NO: 131725 - DNA, 22 bp, Artificial sequence
  SiRNA target sequence
caacagaaaagatatgtagaaa

SEQ ID NO: 131726 - DNA, 22 bp, Artificial sequence
  SiRNA target sequence
aacagaaaagatatgtagaaaa

SEQ ID NO: 131727 - DNA, 22 bp, Artificial sequence
  SiRNA target sequence
acagaaaagatatgtagaaaac

SEQ ID NO: 131728 - DNA, 22 bp, Artificial sequence
  SiRNA target sequence
cagaaaagatatgtagaaaaca

SEQ ID NO: 131729 - DNA, 22 bp, Artificial sequence
  SiRNA target sequence
agaaaagatatgtagaaaacat

SEQ ID NO: 131730 - DNA, 22 bp, Artificial sequence
  SiRNA target sequence
gaaaagatatgtagaaaacata

SEQ ID NO: 131731 - DNA, 22 bp, Artificial sequence
  SiRNA target sequence
aaaagatatgtagaaaacatac

SEQ ID NO: 131732 - DNA, 22 bp, Artificial sequence
  SiRNA target sequence
aaagatatgtagaaaacatact

SEQ ID NO: 131733 - DNA, 22 bp, Artificial sequence
  SiRNA target sequence
aagatatgtagaaaacatacta

SEQ ID NO: 131734 - DNA, 22 bp, Artificial sequence
  SiRNA target sequence
agatatgtagaaaacatactat

SEQ ID NO: 131735 - DNA, 22 bp, Artificial sequence
  SiRNA target sequence
gatatgtagaaaacatactata

SEQ ID NO: 131736 - DNA, 22 bp, Artificial sequence
  SiRNA target sequence
atatgtagaaaacatactataa

SEQ ID NO: 131737 - DNA, 22 bp, Artificial sequence
  SiRNA target sequence
tatgtagaaaacatactataag

SEQ ID NO: 131738 - DNA, 22 bp, Artificial sequence
  SiRNA target sequence
atgtagaaaacatactataaga

SEQ ID NO: 131739 - DNA, 22 bp, Artificial sequence
  SiRNA target sequence
tgtagaaaacatactataagaa

SEQ ID NO: 131740 - DNA, 22 bp, Artificial sequence
  SiRNA target sequence
gtagaaaacatactataagaat

SEQ ID NO: 131741 - DNA, 22 bp, Artificial sequence
  SiRNA target sequence
tagaaaacatactataagaata

SEQ ID NO: 131742 - DNA, 22 bp, Artificial sequence
  SiRNA target sequence
agaaaacatactataagaatag

SEQ ID NO: 131743 - DNA, 22 bp, Artificial sequence
  SiRNA target sequence
gaaaacatactataagaataga

SEQ ID NO: 131744 - DNA, 22 bp, Artificial sequence
  SiRNA target sequence
aaaacatactataagaatagat

SEQ ID NO: 131745 - DNA, 22 bp, Artificial sequence
  SiRNA target sequence
aaacatactataagaatagata

SEQ ID NO: 131746 - DNA, 22 bp, Artificial sequence
  SiRNA target sequence
aacatactataagaatagataa

SEQ ID NO: 131747 - DNA, 22 bp, Artificial sequence
  SiRNA target sequence
acatactataagaatagataaa

SEQ ID NO: 131748 - DNA, 22 bp, Artificial sequence
  SiRNA target sequence
catactataagaatagataaag

SEQ ID NO: 131749 - DNA, 22 bp, Artificial sequence
  SiRNA target sequence
atactataagaatagataaaga

SEQ ID NO: 131750 - DNA, 22 bp, Artificial sequence
  SiRNA target sequence
tactataagaatagataaagac

SEQ ID NO: 131751 - DNA, 22 bp, Artificial sequence
  SiRNA target sequence
actataagaatagataaagaca

SEQ ID NO: 131752 - DNA, 22 bp, Artificial sequence
  SiRNA target sequence
ctataagaatagataaagacaa

SEQ ID NO: 131753 - DNA, 22 bp, Artificial sequence
  SiRNA target sequence
tataagaatagataaagacaat

SEQ ID NO: 131754 - DNA, 22 bp, Artificial sequence
  SiRNA target sequence
ataagaatagataaagacaata

SEQ ID NO: 131755 - DNA, 22 bp, Artificial sequence
  SiRNA target sequence
taagaatagataaagacaatat

SEQ ID NO: 131756 - DNA, 22 bp, Artificial sequence
  SiRNA target sequence
aagaatagataaagacaatatg

SEQ ID NO: 131757 - DNA, 22 bp, Artificial sequence
  SiRNA target sequence
agaatagataaagacaatatgg

SEQ ID NO: 131758 - DNA, 22 bp, Artificial sequence
  SiRNA target sequence
gaatagataaagacaatatggt

SEQ ID NO: 131759 - DNA, 22 bp, Artificial sequence
  SiRNA target sequence
aatagataaagacaatatggta

SEQ ID NO: 131760 - DNA, 22 bp, Artificial sequence
  SiRNA target sequence
atagataaagacaatatggtaa

SEQ ID NO: 131761 - DNA, 22 bp, Artificial sequence
  SiRNA target sequence
tagataaagacaatatggtaac

SEQ ID NO: 131762 - DNA, 22 bp, Artificial sequence
  SiRNA target sequence
agataaagacaatatggtaact

SEQ ID NO: 131763 - DNA, 22 bp, Artificial sequence
  SiRNA target sequence
gataaagacaatatggtaactg

SEQ ID NO: 131764 - DNA, 22 bp, Artificial sequence
  SiRNA target sequence
ataaagacaatatggtaactgt

SEQ ID NO: 131765 - DNA, 22 bp, Artificial sequence
  SiRNA target sequence
taaagacaatatggtaactgta

SEQ ID NO: 131766 - DNA, 22 bp, Artificial sequence
  SiRNA target sequence
aaagacaatatggtaactgtaa

SEQ ID NO: 131767 - DNA, 22 bp, Artificial sequence
  SiRNA target sequence
aagacaatatggtaactgtaac

SEQ ID NO: 131768 - DNA, 22 bp, Artificial sequence
  SiRNA target sequence
agacaatatggtaactgtaaca

SEQ ID NO: 131769 - DNA, 22 bp, Artificial sequence
  SiRNA target sequence
gacaatatggtaactgtaacag

SEQ ID NO: 131770 - DNA, 22 bp, Artificial sequence
  SiRNA target sequence
acaatatggtaactgtaacagg

SEQ ID NO: 131771 - DNA, 22 bp, Artificial sequence
  SiRNA target sequence
caatatggtaactgtaacaggt

SEQ ID NO: 131772 - DNA, 22 bp, Artificial sequence
  SiRNA target sequence
aatatggtaactgtaacaggtg

SEQ ID NO: 131773 - DNA, 22 bp, Artificial sequence
  SiRNA target sequence
atatggtaactgtaacaggtgg

SEQ ID NO: 131774 - DNA, 22 bp, Artificial sequence
  SiRNA target sequence
tatggtaactgtaacaggtggt

SEQ ID NO: 131775 - DNA, 22 bp, Artificial sequence
  SiRNA target sequence
atggtaactgtaacaggtggta

SEQ ID NO: 131776 - DNA, 22 bp, Artificial sequence
  SiRNA target sequence
tggtaactgtaacaggtggtaa

SEQ ID NO: 131777 - DNA, 22 bp, Artificial sequence
  SiRNA target sequence
ggtaactgtaacaggtggtaag

SEQ ID NO: 131778 - DNA, 22 bp, Artificial sequence
  SiRNA target sequence
gtaactgtaacaggtggtaagt

SEQ ID NO: 131779 - DNA, 22 bp, Artificial sequence
  SiRNA target sequence
taactgtaacaggtggtaagtg

SEQ ID NO: 131780 - DNA, 22 bp, Artificial sequence
  SiRNA target sequence
aactgtaacaggtggtaagtgg

SEQ ID NO: 131781 - DNA, 22 bp, Artificial sequence
  SiRNA target sequence
actgtaacaggtggtaagtgga

SEQ ID NO: 131782 - DNA, 22 bp, Artificial sequence
  SiRNA target sequence
ctgtaacaggtggtaagtggac

SEQ ID NO: 131783 - DNA, 22 bp, Artificial sequence
  SiRNA target sequence
tgtaacaggtggtaagtggaca

SEQ ID NO: 131784 - DNA, 22 bp, Artificial sequence
  SiRNA target sequence
gtaacaggtggtaagtggacaa

SEQ ID NO: 131785 - DNA, 22 bp, Artificial sequence
  SiRNA target sequence
taacaggtggtaagtggacaat

SEQ ID NO: 131786 - DNA, 22 bp, Artificial sequence
  SiRNA target sequence
aacaggtggtaagtggacaatt

SEQ ID NO: 131787 - DNA, 22 bp, Artificial sequence
  SiRNA target sequence
acaggtggtaagtggacaattt

SEQ ID NO: 131788 - DNA, 22 bp, Artificial sequence
  SiRNA target sequence
caggtggtaagtggacaatttt

SEQ ID NO: 131789 - DNA, 22 bp, Artificial sequence
  SiRNA target sequence
aggtggtaagtggacaattttt

SEQ ID NO: 131790 - DNA, 22 bp, Artificial sequence
  SiRNA target sequence
ggtggtaagtggacaatttttc

SEQ ID NO: 131791 - DNA, 22 bp, Artificial sequence
  SiRNA target sequence
gtggtaagtggacaatttttcg

SEQ ID NO: 131792 - DNA, 22 bp, Artificial sequence
  SiRNA target sequence
tggtaagtggacaatttttcga

SEQ ID NO: 131793 - DNA, 22 bp, Artificial sequence
  SiRNA target sequence
ggtaagtggacaatttttcgac

SEQ ID NO: 131794 - DNA, 22 bp, Artificial sequence
  SiRNA target sequence
gtaagtggacaatttttcgact

SEQ ID NO: 131795 - DNA, 22 bp, Artificial sequence
  SiRNA target sequence
taagtggacaatttttcgactt

SEQ ID NO: 131796 - DNA, 22 bp, Artificial sequence
  SiRNA target sequence
aagtggacaatttttcgactta

SEQ ID NO: 131797 - DNA, 22 bp, Artificial sequence
  SiRNA target sequence
agtggacaatttttcgacttat

SEQ ID NO: 131798 - DNA, 22 bp, Artificial sequence
  SiRNA target sequence
gtggacaatttttcgacttatg

SEQ ID NO: 131799 - DNA, 22 bp, Artificial sequence
  SiRNA target sequence
tggacaatttttcgacttatgg

SEQ ID NO: 131800 - DNA, 22 bp, Artificial sequence
  SiRNA target sequence
ggacaatttttcgacttatggg

SEQ ID NO: 131801 - DNA, 22 bp, Artificial sequence
  SiRNA target sequence
gacaatttttcgacttatggga

SEQ ID NO: 131802 - DNA, 22 bp, Artificial sequence
  SiRNA target sequence
acaatttttcgacttatgggag

SEQ ID NO: 131803 - DNA, 22 bp, Artificial sequence
  SiRNA target sequence
caatttttcgacttatgggaga

SEQ ID NO: 131804 - DNA, 22 bp, Artificial sequence
  SiRNA target sequence
aatttttcgacttatgggagaa

SEQ ID NO: 131805 - DNA, 22 bp, Artificial sequence
  SiRNA target sequence
atttttcgacttatgggagaac

SEQ ID NO: 131806 - DNA, 22 bp, Artificial sequence
  SiRNA target sequence
tttttcgacttatgggagaaca

SEQ ID NO: 131807 - DNA, 22 bp, Artificial sequence
  SiRNA target sequence
ttttcgacttatgggagaacag

SEQ ID NO: 131808 - DNA, 22 bp, Artificial sequence
  SiRNA target sequence
tttcgacttatgggagaacaga

SEQ ID NO: 131809 - DNA, 22 bp, Artificial sequence
  SiRNA target sequence
ttcgacttatgggagaacagac

SEQ ID NO: 131810 - DNA, 22 bp, Artificial sequence
  SiRNA target sequence
tcgacttatgggagaacagaca

SEQ ID NO: 131811 - DNA, 22 bp, Artificial sequence
  SiRNA target sequence
cgacttatgggagaacagacaa

SEQ ID NO: 131812 - DNA, 22 bp, Artificial sequence
  SiRNA target sequence
gacttatgggagaacagacaat

SEQ ID NO: 131813 - DNA, 22 bp, Artificial sequence
  SiRNA target sequence
acttatgggagaacagacaata

SEQ ID NO: 131814 - DNA, 22 bp, Artificial sequence
  SiRNA target sequence
cttatgggagaacagacaataa

SEQ ID NO: 131815 - DNA, 22 bp, Artificial sequence
  SiRNA target sequence
ttatgggagaacagacaataaa

SEQ ID NO: 131816 - DNA, 22 bp, Artificial sequence
  SiRNA target sequence
tatgggagaacagacaataaat

SEQ ID NO: 131817 - DNA, 22 bp, Artificial sequence
  SiRNA target sequence
atgggagaacagacaataaatc

SEQ ID NO: 131818 - DNA, 22 bp, Artificial sequence
  SiRNA target sequence
tgggagaacagacaataaatca

SEQ ID NO: 131819 - DNA, 22 bp, Artificial sequence
  SiRNA target sequence
gggagaacagacaataaatcaa

SEQ ID NO: 131820 - DNA, 22 bp, Artificial sequence
  SiRNA target sequence
ggagaacagacaataaatcaaa

SEQ ID NO: 131821 - DNA, 22 bp, Artificial sequence
  SiRNA target sequence
gagaacagacaataaatcaaat

SEQ ID NO: 131822 - DNA, 22 bp, Artificial sequence
  SiRNA target sequence
agaacagacaataaatcaaatt

SEQ ID NO: 131823 - DNA, 22 bp, Artificial sequence
  SiRNA target sequence
gaacagacaataaatcaaatta

SEQ ID NO: 131824 - DNA, 22 bp, Artificial sequence
  SiRNA target sequence
aacagacaataaatcaaattat

SEQ ID NO: 131825 - DNA, 22 bp, Artificial sequence
  SiRNA target sequence
acagacaataaatcaaattata

SEQ ID NO: 131826 - DNA, 22 bp, Artificial sequence
  SiRNA target sequence
cagacaataaatcaaattataa

SEQ ID NO: 131827 - DNA, 22 bp, Artificial sequence
  SiRNA target sequence
agacaataaatcaaattataaa

SEQ ID NO: 131828 - DNA, 22 bp, Artificial sequence
  SiRNA target sequence
gacaataaatcaaattataaaa

SEQ ID NO: 131829 - DNA, 22 bp, Artificial sequence
  SiRNA target sequence
acaataaatcaaattataaaag

SEQ ID NO: 131830 - DNA, 22 bp, Artificial sequence
  SiRNA target sequence
caataaatcaaattataaaagt

SEQ ID NO: 131831 - DNA, 22 bp, Artificial sequence
  SiRNA target sequence
aataaatcaaattataaaagtt

SEQ ID NO: 131832 - DNA, 22 bp, Artificial sequence
  SiRNA target sequence
ataaatcaaattataaaagttt

SEQ ID NO: 131833 - DNA, 22 bp, Artificial sequence
  SiRNA target sequence
taaatcaaattataaaagtttt

SEQ ID NO: 131834 - DNA, 22 bp, Artificial sequence
  SiRNA target sequence
aaatcaaattataaaagttttt

SEQ ID NO: 131835 - DNA, 22 bp, Artificial sequence
  SiRNA target sequence
aatcaaattataaaagttttta

SEQ ID NO: 131836 - DNA, 22 bp, Artificial sequence
  SiRNA target sequence
atcaaattataaaagtttttaa

SEQ ID NO: 131837 - DNA, 22 bp, Artificial sequence
  SiRNA target sequence
tcaaattataaaagtttttaat

SEQ ID NO: 131838 - DNA, 22 bp, Artificial sequence
  SiRNA target sequence
caaattataaaagtttttaata

SEQ ID NO: 131839 - DNA, 22 bp, Artificial sequence
  SiRNA target sequence
aaattataaaagtttttaatat

SEQ ID NO: 131840 - DNA, 22 bp, Artificial sequence
  SiRNA target sequence
aattataaaagtttttaatata

SEQ ID NO: 131841 - DNA, 22 bp, Artificial sequence
  SiRNA target sequence
attataaaagtttttaatataa

SEQ ID NO: 131842 - DNA, 22 bp, Artificial sequence
  SiRNA target sequence
ttataaaagtttttaatataaa

SEQ ID NO: 131843 - DNA, 22 bp, Artificial sequence
  SiRNA target sequence
tataaaagtttttaatataaag

SEQ ID NO: 131844 - DNA, 22 bp, Artificial sequence
  SiRNA target sequence
ataaaagtttttaatataaagt

SEQ ID NO: 131845 - DNA, 22 bp, Artificial sequence
  SiRNA target sequence
taaaagtttttaatataaagtc

SEQ ID NO: 131846 - DNA, 22 bp, Artificial sequence
  SiRNA target sequence
aaaagtttttaatataaagtct

SEQ ID NO: 131847 - DNA, 22 bp, Artificial sequence
  SiRNA target sequence
aaagtttttaatataaagtcta

SEQ ID NO: 131848 - DNA, 22 bp, Artificial sequence
  SiRNA target sequence
aagtttttaatataaagtctaa

SEQ ID NO: 131849 - DNA, 22 bp, Artificial sequence
  SiRNA target sequence
agtttttaatataaagtctaat

SEQ ID NO: 131850 - DNA, 22 bp, Artificial sequence
  SiRNA target sequence
gtttttaatataaagtctaata

SEQ ID NO: 131851 - DNA, 22 bp, Artificial sequence
  SiRNA target sequence
tttttaatataaagtctaataa

SEQ ID NO: 131852 - DNA, 22 bp, Artificial sequence
  SiRNA target sequence
ttttaatataaagtctaataaa

SEQ ID NO: 131853 - DNA, 22 bp, Artificial sequence
  SiRNA target sequence
tttaatataaagtctaataaac

SEQ ID NO: 131854 - DNA, 22 bp, Artificial sequence
  SiRNA target sequence
ttaatataaagtctaataaacc

SEQ ID NO: 131855 - DNA, 22 bp, Artificial sequence
  SiRNA target sequence
taatataaagtctaataaacca

SEQ ID NO: 131856 - DNA, 22 bp, Artificial sequence
  SiRNA target sequence
aatataaagtctaataaaccaa

SEQ ID NO: 131857 - DNA, 22 bp, Artificial sequence
  SiRNA target sequence
atataaagtctaataaaccaag

SEQ ID NO: 131858 - DNA, 22 bp, Artificial sequence
  SiRNA target sequence
tataaagtctaataaaccaagt

SEQ ID NO: 131859 - DNA, 22 bp, Artificial sequence
  SiRNA target sequence
ataaagtctaataaaccaagta

SEQ ID NO: 131860 - DNA, 22 bp, Artificial sequence
  SiRNA target sequence
taaagtctaataaaccaagtat

SEQ ID NO: 131861 - DNA, 22 bp, Artificial sequence
  SiRNA target sequence
aaagtctaataaaccaagtata

SEQ ID NO: 131862 - DNA, 22 bp, Artificial sequence
  SiRNA target sequence
aagtctaataaaccaagtataa

SEQ ID NO: 131863 - DNA, 22 bp, Artificial sequence
  SiRNA target sequence
agtctaataaaccaagtataac

SEQ ID NO: 131864 - DNA, 22 bp, Artificial sequence
  SiRNA target sequence
gtctaataaaccaagtataaca

SEQ ID NO: 131865 - DNA, 22 bp, Artificial sequence
  SiRNA target sequence
tctaataaaccaagtataacac

SEQ ID NO: 131866 - DNA, 22 bp, Artificial sequence
  SiRNA target sequence
ctaataaaccaagtataacaca

SEQ ID NO: 131867 - DNA, 22 bp, Artificial sequence
  SiRNA target sequence
taataaaccaagtataacacaa

SEQ ID NO: 131868 - DNA, 22 bp, Artificial sequence
  SiRNA target sequence
aataaaccaagtataacacaat

SEQ ID NO: 131869 - DNA, 22 bp, Artificial sequence
  SiRNA target sequence
ataaaccaagtataacacaata

SEQ ID NO: 131870 - DNA, 22 bp, Artificial sequence
  SiRNA target sequence
taaaccaagtataacacaatat

SEQ ID NO: 131871 - DNA, 22 bp, Artificial sequence
  SiRNA target sequence
aaaccaagtataacacaatatc

SEQ ID NO: 131872 - DNA, 22 bp, Artificial sequence
  SiRNA target sequence
aaccaagtataacacaatatct

SEQ ID NO: 131873 - DNA, 22 bp, Artificial sequence
  SiRNA target sequence
accaagtataacacaatatctt

SEQ ID NO: 131874 - DNA, 22 bp, Artificial sequence
  SiRNA target sequence
ccaagtataacacaatatcttc

SEQ ID NO: 131875 - DNA, 22 bp, Artificial sequence
  SiRNA target sequence
caagtataacacaatatcttcc

SEQ ID NO: 131876 - DNA, 22 bp, Artificial sequence
  SiRNA target sequence
aagtataacacaatatcttcct

SEQ ID NO: 131877 - DNA, 22 bp, Artificial sequence
  SiRNA target sequence
agtataacacaatatcttcctg

SEQ ID NO: 131878 - DNA, 22 bp, Artificial sequence
  SiRNA target sequence
gtataacacaatatcttcctgt

SEQ ID NO: 131879 - DNA, 22 bp, Artificial sequence
  SiRNA target sequence
tataacacaatatcttcctgtt

SEQ ID NO: 131880 - DNA, 22 bp, Artificial sequence
  SiRNA target sequence
ataacacaatatcttcctgttt

SEQ ID NO: 131881 - DNA, 22 bp, Artificial sequence
  SiRNA target sequence
taacacaatatcttcctgtttt

SEQ ID NO: 131882 - DNA, 22 bp, Artificial sequence
  SiRNA target sequence
aacacaatatcttcctgttttg

SEQ ID NO: 131883 - DNA, 22 bp, Artificial sequence
  SiRNA target sequence
acacaatatcttcctgttttgg

SEQ ID NO: 131884 - DNA, 22 bp, Artificial sequence
  SiRNA target sequence
cacaatatcttcctgttttggg

SEQ ID NO: 131885 - DNA, 22 bp, Artificial sequence
  SiRNA target sequence
acaatatcttcctgttttggga

SEQ ID NO: 131886 - DNA, 22 bp, Artificial sequence
  SiRNA target sequence
caatatcttcctgttttgggat

SEQ ID NO: 131887 - DNA, 22 bp, Artificial sequence
  SiRNA target sequence
aatatcttcctgttttgggatc

SEQ ID NO: 131888 - DNA, 22 bp, Artificial sequence
  SiRNA target sequence
atatcttcctgttttgggatca

SEQ ID NO: 131889 - DNA, 22 bp, Artificial sequence
  SiRNA target sequence
tatcttcctgttttgggatcac

SEQ ID NO: 131890 - DNA, 22 bp, Artificial sequence
  SiRNA target sequence
atcttcctgttttgggatcaca

SEQ ID NO: 131891 - DNA, 22 bp, Artificial sequence
  SiRNA target sequence
tcttcctgttttgggatcacag

SEQ ID NO: 131892 - DNA, 22 bp, Artificial sequence
  SiRNA target sequence
cttcctgttttgggatcacagg

SEQ ID NO: 131893 - DNA, 22 bp, Artificial sequence
  SiRNA target sequence
ttcctgttttgggatcacaggg

SEQ ID NO: 131894 - DNA, 22 bp, Artificial sequence
  SiRNA target sequence
tcctgttttgggatcacaggga

SEQ ID NO: 131895 - DNA, 22 bp, Artificial sequence
  SiRNA target sequence
cctgttttgggatcacagggat

SEQ ID NO: 131896 - DNA, 22 bp, Artificial sequence
  SiRNA target sequence
ctgttttgggatcacagggata

SEQ ID NO: 131897 - DNA, 22 bp, Artificial sequence
  SiRNA target sequence
tgttttgggatcacagggatat

SEQ ID NO: 131898 - DNA, 22 bp, Artificial sequence
  SiRNA target sequence
gttttgggatcacagggatata

SEQ ID NO: 131899 - DNA, 22 bp, Artificial sequence
  SiRNA target sequence
ttttgggatcacagggatatac

SEQ ID NO: 131900 - DNA, 22 bp, Artificial sequence
  SiRNA target sequence
tttgggatcacagggatatact

SEQ ID NO: 131901 - DNA, 22 bp, Artificial sequence
  SiRNA target sequence
ttgggatcacagggatatacta

SEQ ID NO: 131902 - DNA, 22 bp, Artificial sequence
  SiRNA target sequence
tgggatcacagggatatactaa

SEQ ID NO: 131903 - DNA, 22 bp, Artificial sequence
  SiRNA target sequence
gggatcacagggatatactaaa

SEQ ID NO: 131904 - DNA, 22 bp, Artificial sequence
  SiRNA target sequence
ggatcacagggatatactaaag

SEQ ID NO: 131905 - DNA, 22 bp, Artificial sequence
  SiRNA target sequence
gatcacagggatatactaaagc

SEQ ID NO: 131906 - DNA, 22 bp, Artificial sequence
  SiRNA target sequence
atcacagggatatactaaagct

SEQ ID NO: 131907 - DNA, 22 bp, Artificial sequence
  SiRNA target sequence
tcacagggatatactaaagcta

SEQ ID NO: 131908 - DNA, 22 bp, Artificial sequence
  SiRNA target sequence
cacagggatatactaaagctac

SEQ ID NO: 131909 - DNA, 22 bp, Artificial sequence
  SiRNA target sequence
acagggatatactaaagctaca

SEQ ID NO: 131910 - DNA, 22 bp, Artificial sequence
  SiRNA target sequence
cagggatatactaaagctacag

SEQ ID NO: 131911 - DNA, 22 bp, Artificial sequence
  SiRNA target sequence
agggatatactaaagctacaga

SEQ ID NO: 131912 - DNA, 22 bp, Artificial sequence
  SiRNA target sequence
gggatatactaaagctacagaa

SEQ ID NO: 131913 - DNA, 22 bp, Artificial sequence
  SiRNA target sequence
ggatatactaaagctacagaat

SEQ ID NO: 131914 - DNA, 22 bp, Artificial sequence
  SiRNA target sequence
gatatactaaagctacagaatt

SEQ ID NO: 131915 - DNA, 22 bp, Artificial sequence
  SiRNA target sequence
atatactaaagctacagaattt

SEQ ID NO: 131916 - DNA, 22 bp, Artificial sequence
  SiRNA target sequence
tatactaaagctacagaatttg

SEQ ID NO: 131917 - DNA, 22 bp, Artificial sequence
  SiRNA target sequence
atactaaagctacagaatttga

SEQ ID NO: 131918 - DNA, 22 bp, Artificial sequence
  SiRNA target sequence
tactaaagctacagaatttgat

SEQ ID NO: 131919 - DNA, 22 bp, Artificial sequence
  SiRNA target sequence
actaaagctacagaatttgatt

SEQ ID NO: 131920 - DNA, 22 bp, Artificial sequence
  SiRNA target sequence
ctaaagctacagaatttgattt

SEQ ID NO: 131921 - DNA, 22 bp, Artificial sequence
  SiRNA target sequence
taaagctacagaatttgatttg

SEQ ID NO: 131922 - DNA, 22 bp, Artificial sequence
  SiRNA target sequence
aaagctacagaatttgatttgg

SEQ ID NO: 131923 - DNA, 22 bp, Artificial sequence
  SiRNA target sequence
aagctacagaatttgatttggc

SEQ ID NO: 131924 - DNA, 22 bp, Artificial sequence
  SiRNA target sequence
agctacagaatttgatttggca

SEQ ID NO: 131925 - DNA, 22 bp, Artificial sequence
  SiRNA target sequence
gctacagaatttgatttggcac

SEQ ID NO: 131926 - DNA, 22 bp, Artificial sequence
  SiRNA target sequence
ctacagaatttgatttggcact

SEQ ID NO: 131927 - DNA, 22 bp, Artificial sequence
  SiRNA target sequence
tacagaatttgatttggcactt

SEQ ID NO: 131928 - DNA, 22 bp, Artificial sequence
  SiRNA target sequence
acagaatttgatttggcactta

SEQ ID NO: 131929 - DNA, 22 bp, Artificial sequence
  SiRNA target sequence
cagaatttgatttggcacttac

SEQ ID NO: 131930 - DNA, 22 bp, Artificial sequence
  SiRNA target sequence
agaatttgatttggcacttact

SEQ ID NO: 131931 - DNA, 22 bp, Artificial sequence
  SiRNA target sequence
gaatttgatttggcacttactt

SEQ ID NO: 131932 - DNA, 22 bp, Artificial sequence
  SiRNA target sequence
aatttgatttggcacttacttt

SEQ ID NO: 131933 - DNA, 22 bp, Artificial sequence
  SiRNA target sequence
atttgatttggcacttacttta

SEQ ID NO: 131934 - DNA, 22 bp, Artificial sequence
  SiRNA target sequence
tttgatttggcacttactttaa

SEQ ID NO: 131935 - DNA, 22 bp, Artificial sequence
  SiRNA target sequence
ttgatttggcacttactttaaa

SEQ ID NO: 131936 - DNA, 22 bp, Artificial sequence
  SiRNA target sequence
tgatttggcacttactttaaat

SEQ ID NO: 131937 - DNA, 22 bp, Artificial sequence
  SiRNA target sequence
gatttggcacttactttaaata

SEQ ID NO: 131938 - DNA, 22 bp, Artificial sequence
  SiRNA target sequence
atttggcacttactttaaatat

SEQ ID NO: 131939 - DNA, 22 bp, Artificial sequence
  SiRNA target sequence
tttggcacttactttaaatatt

SEQ ID NO: 131940 - DNA, 22 bp, Artificial sequence
  SiRNA target sequence
ttggcacttactttaaatattc

SEQ ID NO: 131941 - DNA, 22 bp, Artificial sequence
  SiRNA target sequence
tggcacttactttaaatattcc

SEQ ID NO: 131942 - DNA, 22 bp, Artificial sequence
  SiRNA target sequence
ggcacttactttaaatattcca

SEQ ID NO: 131943 - DNA, 22 bp, Artificial sequence
  SiRNA target sequence
gcacttactttaaatattccag

SEQ ID NO: 131944 - DNA, 22 bp, Artificial sequence
  SiRNA target sequence
cacttactttaaatattccaga

SEQ ID NO: 131945 - DNA, 22 bp, Artificial sequence
  SiRNA target sequence
acttactttaaatattccagaa

SEQ ID NO: 131946 - DNA, 22 bp, Artificial sequence
  SiRNA target sequence
cttactttaaatattccagaag

SEQ ID NO: 131947 - DNA, 22 bp, Artificial sequence
  SiRNA target sequence
ttactttaaatattccagaaga

SEQ ID NO: 131948 - DNA, 22 bp, Artificial sequence
  SiRNA target sequence
tactttaaatattccagaagat

SEQ ID NO: 131949 - DNA, 22 bp, Artificial sequence
  SiRNA target sequence
actttaaatattccagaagata

SEQ ID NO: 131950 - DNA, 22 bp, Artificial sequence
  SiRNA target sequence
ctttaaatattccagaagatat

SEQ ID NO: 131951 - DNA, 22 bp, Artificial sequence
  SiRNA target sequence
tttaaatattccagaagatata

SEQ ID NO: 131952 - DNA, 22 bp, Artificial sequence
  SiRNA target sequence
ttaaatattccagaagatatag

SEQ ID NO: 131953 - DNA, 22 bp, Artificial sequence
  SiRNA target sequence
taaatattccagaagatatagc

SEQ ID NO: 131954 - DNA, 22 bp, Artificial sequence
  SiRNA target sequence
aaatattccagaagatatagct

SEQ ID NO: 131955 - DNA, 22 bp, Artificial sequence
  SiRNA target sequence
aatattccagaagatatagcta

SEQ ID NO: 131956 - DNA, 22 bp, Artificial sequence
  SiRNA target sequence
atattccagaagatatagctaa

SEQ ID NO: 131957 - DNA, 22 bp, Artificial sequence
  SiRNA target sequence
tattccagaagatatagctaag

SEQ ID NO: 131958 - DNA, 22 bp, Artificial sequence
  SiRNA target sequence
attccagaagatatagctaagc

SEQ ID NO: 131959 - DNA, 22 bp, Artificial sequence
  SiRNA target sequence
ttccagaagatatagctaagca

SEQ ID NO: 131960 - DNA, 22 bp, Artificial sequence
  SiRNA target sequence
tccagaagatatagctaagcat

SEQ ID NO: 131961 - DNA, 22 bp, Artificial sequence
  SiRNA target sequence
ccagaagatatagctaagcatt

SEQ ID NO: 131962 - DNA, 22 bp, Artificial sequence
  SiRNA target sequence
cagaagatatagctaagcattt

SEQ ID NO: 131963 - DNA, 22 bp, Artificial sequence
  SiRNA target sequence
agaagatatagctaagcattta

SEQ ID NO: 131964 - DNA, 22 bp, Artificial sequence
  SiRNA target sequence
gaagatatagctaagcatttag

SEQ ID NO: 131965 - DNA, 22 bp, Artificial sequence
  SiRNA target sequence
aagatatagctaagcatttagc

SEQ ID NO: 131966 - DNA, 22 bp, Artificial sequence
  SiRNA target sequence
agatatagctaagcatttagct

SEQ ID NO: 131967 - DNA, 22 bp, Artificial sequence
  SiRNA target sequence
gatatagctaagcatttagcta

SEQ ID NO: 131968 - DNA, 22 bp, Artificial sequence
  SiRNA target sequence
atatagctaagcatttagctac

SEQ ID NO: 131969 - DNA, 22 bp, Artificial sequence
  SiRNA target sequence
tatagctaagcatttagctaca

SEQ ID NO: 131970 - DNA, 22 bp, Artificial sequence
  SiRNA target sequence
atagctaagcatttagctacaa

SEQ ID NO: 131971 - DNA, 22 bp, Artificial sequence
  SiRNA target sequence
tagctaagcatttagctacaac

SEQ ID NO: 131972 - DNA, 22 bp, Artificial sequence
  SiRNA target sequence
agctaagcatttagctacaact

SEQ ID NO: 131973 - DNA, 22 bp, Artificial sequence
  SiRNA target sequence
gctaagcatttagctacaactt

SEQ ID NO: 131974 - DNA, 22 bp, Artificial sequence
  SiRNA target sequence
ctaagcatttagctacaactta

SEQ ID NO: 131975 - DNA, 22 bp, Artificial sequence
  SiRNA target sequence
taagcatttagctacaacttat

SEQ ID NO: 131976 - DNA, 22 bp, Artificial sequence
  SiRNA target sequence
aagcatttagctacaacttatg

SEQ ID NO: 131977 - DNA, 22 bp, Artificial sequence
  SiRNA target sequence
agcatttagctacaacttatgg

SEQ ID NO: 131978 - DNA, 22 bp, Artificial sequence
  SiRNA target sequence
gcatttagctacaacttatggt

SEQ ID NO: 131979 - DNA, 22 bp, Artificial sequence
  SiRNA target sequence
catttagctacaacttatggta

SEQ ID NO: 131980 - DNA, 22 bp, Artificial sequence
  SiRNA target sequence
atttagctacaacttatggtac

SEQ ID NO: 131981 - DNA, 22 bp, Artificial sequence
  SiRNA target sequence
tttagctacaacttatggtacc

SEQ ID NO: 131982 - DNA, 22 bp, Artificial sequence
  SiRNA target sequence
ttagctacaacttatggtacca

SEQ ID NO: 131983 - DNA, 22 bp, Artificial sequence
  SiRNA target sequence
tagctacaacttatggtaccaa

SEQ ID NO: 131984 - DNA, 22 bp, Artificial sequence
  SiRNA target sequence
agctacaacttatggtaccaaa

SEQ ID NO: 131985 - DNA, 22 bp, Artificial sequence
  SiRNA target sequence
gctacaacttatggtaccaaag

SEQ ID NO: 131986 - DNA, 22 bp, Artificial sequence
  SiRNA target sequence
ctacaacttatggtaccaaagc

SEQ ID NO: 131987 - DNA, 22 bp, Artificial sequence
  SiRNA target sequence
tacaacttatggtaccaaagct

SEQ ID NO: 131988 - DNA, 22 bp, Artificial sequence
  SiRNA target sequence
acaacttatggtaccaaagctt

SEQ ID NO: 131989 - DNA, 22 bp, Artificial sequence
  SiRNA target sequence
caacttatggtaccaaagctta

SEQ ID NO: 131990 - DNA, 22 bp, Artificial sequence
  SiRNA target sequence
aacttatggtaccaaagcttac

SEQ ID NO: 131991 - DNA, 22 bp, Artificial sequence
  SiRNA target sequence
acttatggtaccaaagcttaca

SEQ ID NO: 131992 - DNA, 22 bp, Artificial sequence
  SiRNA target sequence
cttatggtaccaaagcttacaa

SEQ ID NO: 131993 - DNA, 22 bp, Artificial sequence
  SiRNA target sequence
ttatggtaccaaagcttacaat

SEQ ID NO: 131994 - DNA, 22 bp, Artificial sequence
  SiRNA target sequence
tatggtaccaaagcttacaatt

SEQ ID NO: 131995 - DNA, 22 bp, Artificial sequence
  SiRNA target sequence
atggtaccaaagcttacaattt

SEQ ID NO: 131996 - DNA, 22 bp, Artificial sequence
  SiRNA target sequence
tggtaccaaagcttacaatttc

SEQ ID NO: 131997 - DNA, 22 bp, Artificial sequence
  SiRNA target sequence
ggtaccaaagcttacaatttct

SEQ ID NO: 131998 - DNA, 22 bp, Artificial sequence
  SiRNA target sequence
gtaccaaagcttacaatttctc

SEQ ID NO: 131999 - DNA, 22 bp, Artificial sequence
  SiRNA target sequence
taccaaagcttacaatttctct

SEQ ID NO: 132000 - DNA, 22 bp, Artificial sequence
  SiRNA target sequence
accaaagcttacaatttctctg

SEQ ID NO: 132001 - DNA, 22 bp, Artificial sequence
  SiRNA target sequence
ccaaagcttacaatttctctga

SEQ ID NO: 132002 - DNA, 22 bp, Artificial sequence
  SiRNA target sequence
caaagcttacaatttctctgaa

SEQ ID NO: 132003 - DNA, 22 bp, Artificial sequence
  SiRNA target sequence
aaagcttacaatttctctgaat

SEQ ID NO: 132004 - DNA, 22 bp, Artificial sequence
  SiRNA target sequence
aagcttacaatttctctgaata

SEQ ID NO: 132005 - DNA, 22 bp, Artificial sequence
  SiRNA target sequence
agcttacaatttctctgaatac

SEQ ID NO: 132006 - DNA, 22 bp, Artificial sequence
  SiRNA target sequence
gcttacaatttctctgaatact

SEQ ID NO: 132007 - DNA, 22 bp, Artificial sequence
  SiRNA target sequence
cttacaatttctctgaatactt

SEQ ID NO: 132008 - DNA, 22 bp, Artificial sequence
  SiRNA target sequence
ttacaatttctctgaatacttt

SEQ ID NO: 132009 - DNA, 22 bp, Artificial sequence
  SiRNA target sequence
tacaatttctctgaatacttta

SEQ ID NO: 132010 - DNA, 22 bp, Artificial sequence
  SiRNA target sequence
acaatttctctgaatactttaa

SEQ ID NO: 132011 - DNA, 22 bp, Artificial sequence
  SiRNA target sequence
caatttctctgaatactttaat

SEQ ID NO: 132012 - DNA, 22 bp, Artificial sequence
  SiRNA target sequence
aatttctctgaatactttaatg

SEQ ID NO: 132013 - DNA, 22 bp, Artificial sequence
  SiRNA target sequence
atttctctgaatactttaatgg

SEQ ID NO: 132014 - DNA, 22 bp, Artificial sequence
  SiRNA target sequence
tttctctgaatactttaatggg

SEQ ID NO: 132015 - DNA, 22 bp, Artificial sequence
  SiRNA target sequence
ttctctgaatactttaatgggt

SEQ ID NO: 132016 - DNA, 22 bp, Artificial sequence
  SiRNA target sequence
tctctgaatactttaatgggtc

SEQ ID NO: 132017 - DNA, 22 bp, Artificial sequence
  SiRNA target sequence
ctctgaatactttaatgggtca

SEQ ID NO: 132018 - DNA, 22 bp, Artificial sequence
  SiRNA target sequence
tctgaatactttaatgggtcat

SEQ ID NO: 132019 - DNA, 22 bp, Artificial sequence
  SiRNA target sequence
ctgaatactttaatgggtcata

SEQ ID NO: 132020 - DNA, 22 bp, Artificial sequence
  SiRNA target sequence
tgaatactttaatgggtcatac

SEQ ID NO: 132021 - DNA, 22 bp, Artificial sequence
  SiRNA target sequence
gaatactttaatgggtcataca

SEQ ID NO: 132022 - DNA, 22 bp, Artificial sequence
  SiRNA target sequence
aatactttaatgggtcatacac

SEQ ID NO: 132023 - DNA, 22 bp, Artificial sequence
  SiRNA target sequence
atactttaatgggtcatacacc

SEQ ID NO: 132024 - DNA, 22 bp, Artificial sequence
  SiRNA target sequence
tactttaatgggtcatacacca

SEQ ID NO: 132025 - DNA, 22 bp, Artificial sequence
  SiRNA target sequence
actttaatgggtcatacaccag

SEQ ID NO: 132026 - DNA, 22 bp, Artificial sequence
  SiRNA target sequence
ctttaatgggtcatacaccaga

SEQ ID NO: 132027 - DNA, 22 bp, Artificial sequence
  SiRNA target sequence
tttaatgggtcatacaccagac

SEQ ID NO: 132028 - DNA, 22 bp, Artificial sequence
  SiRNA target sequence
ttaatgggtcatacaccagact

SEQ ID NO: 132029 - DNA, 22 bp, Artificial sequence
  SiRNA target sequence
taatgggtcatacaccagactt

SEQ ID NO: 132030 - DNA, 22 bp, Artificial sequence
  SiRNA target sequence
aatgggtcatacaccagactta

SEQ ID NO: 132031 - DNA, 22 bp, Artificial sequence
  SiRNA target sequence
atgggtcatacaccagacttac

SEQ ID NO: 132032 - DNA, 22 bp, Artificial sequence
  SiRNA target sequence
tgggtcatacaccagacttaca

SEQ ID NO: 132033 - DNA, 22 bp, Artificial sequence
  SiRNA target sequence
gggtcatacaccagacttacag

SEQ ID NO: 132034 - DNA, 22 bp, Artificial sequence
  SiRNA target sequence
ggtcatacaccagacttacaga

SEQ ID NO: 132035 - DNA, 22 bp, Artificial sequence
  SiRNA target sequence
gtcatacaccagacttacagat

SEQ ID NO: 132036 - DNA, 22 bp, Artificial sequence
  SiRNA target sequence
tcatacaccagacttacagatg

SEQ ID NO: 132037 - DNA, 22 bp, Artificial sequence
  SiRNA target sequence
catacaccagacttacagatgg

SEQ ID NO: 132038 - DNA, 22 bp, Artificial sequence
  SiRNA target sequence
atacaccagacttacagatggt

SEQ ID NO: 132039 - DNA, 22 bp, Artificial sequence
  SiRNA target sequence
tacaccagacttacagatggtt

SEQ ID NO: 132040 - DNA, 22 bp, Artificial sequence
  SiRNA target sequence
acaccagacttacagatggtta

SEQ ID NO: 132041 - DNA, 22 bp, Artificial sequence
  SiRNA target sequence
caccagacttacagatggttat

SEQ ID NO: 132042 - DNA, 22 bp, Artificial sequence
  SiRNA target sequence
accagacttacagatggttatc

SEQ ID NO: 132043 - DNA, 22 bp, Artificial sequence
  SiRNA target sequence
ccagacttacagatggttatcc

SEQ ID NO: 132044 - DNA, 22 bp, Artificial sequence
  SiRNA target sequence
cagacttacagatggttatcct

SEQ ID NO: 132045 - DNA, 22 bp, Artificial sequence
  SiRNA target sequence
agacttacagatggttatcctt

SEQ ID NO: 132046 - DNA, 22 bp, Artificial sequence
  SiRNA target sequence
gacttacagatggttatcctta

SEQ ID NO: 132047 - DNA, 22 bp, Artificial sequence
  SiRNA target sequence
acttacagatggttatccttat

SEQ ID NO: 132048 - DNA, 22 bp, Artificial sequence
  SiRNA target sequence
cttacagatggttatccttata

SEQ ID NO: 132049 - DNA, 22 bp, Artificial sequence
  SiRNA target sequence
ttacagatggttatccttatac

SEQ ID NO: 132050 - DNA, 22 bp, Artificial sequence
  SiRNA target sequence
tacagatggttatccttataca

SEQ ID NO: 132051 - DNA, 22 bp, Artificial sequence
  SiRNA target sequence
acagatggttatccttatacaa

SEQ ID NO: 132052 - DNA, 22 bp, Artificial sequence
  SiRNA target sequence
cagatggttatccttatacaaa

SEQ ID NO: 132053 - DNA, 22 bp, Artificial sequence
  SiRNA target sequence
agatggttatccttatacaaaa

SEQ ID NO: 132054 - DNA, 22 bp, Artificial sequence
  SiRNA target sequence
gatggttatccttatacaaaag

SEQ ID NO: 132055 - DNA, 22 bp, Artificial sequence
  SiRNA target sequence
atggttatccttatacaaaaga

SEQ ID NO: 132056 - DNA, 22 bp, Artificial sequence
  SiRNA target sequence
tggttatccttatacaaaagaa

SEQ ID NO: 132057 - DNA, 22 bp, Artificial sequence
  SiRNA target sequence
ggttatccttatacaaaagaag

SEQ ID NO: 132058 - DNA, 22 bp, Artificial sequence
  SiRNA target sequence
gttatccttatacaaaagaaga

SEQ ID NO: 132059 - DNA, 22 bp, Artificial sequence
  SiRNA target sequence
ttatccttatacaaaagaagaa

SEQ ID NO: 132060 - DNA, 22 bp, Artificial sequence
  SiRNA target sequence
tatccttatacaaaagaagaaa

SEQ ID NO: 132061 - DNA, 22 bp, Artificial sequence
  SiRNA target sequence
atccttatacaaaagaagaaat

SEQ ID NO: 132062 - DNA, 22 bp, Artificial sequence
  SiRNA target sequence
tccttatacaaaagaagaaata

SEQ ID NO: 132063 - DNA, 22 bp, Artificial sequence
  SiRNA target sequence
ccttatacaaaagaagaaatag

SEQ ID NO: 132064 - DNA, 22 bp, Artificial sequence
  SiRNA target sequence
cttatacaaaagaagaaatagt

SEQ ID NO: 132065 - DNA, 22 bp, Artificial sequence
  SiRNA target sequence
ttatacaaaagaagaaatagta

SEQ ID NO: 132066 - DNA, 22 bp, Artificial sequence
  SiRNA target sequence
tatacaaaagaagaaatagtat

SEQ ID NO: 132067 - DNA, 22 bp, Artificial sequence
  SiRNA target sequence
atacaaaagaagaaatagtata

SEQ ID NO: 132068 - DNA, 22 bp, Artificial sequence
  SiRNA target sequence
tacaaaagaagaaatagtatat

SEQ ID NO: 132069 - DNA, 22 bp, Artificial sequence
  SiRNA target sequence
acaaaagaagaaatagtatatt

SEQ ID NO: 132070 - DNA, 22 bp, Artificial sequence
  SiRNA target sequence
caaaagaagaaatagtatattg

SEQ ID NO: 132071 - DNA, 22 bp, Artificial sequence
  SiRNA target sequence
aaaagaagaaatagtatattgt

SEQ ID NO: 132072 - DNA, 22 bp, Artificial sequence
  SiRNA target sequence
aaagaagaaatagtatattgta

SEQ ID NO: 132073 - DNA, 22 bp, Artificial sequence
  SiRNA target sequence
aagaagaaatagtatattgtat

SEQ ID NO: 132074 - DNA, 22 bp, Artificial sequence
  SiRNA target sequence
agaagaaatagtatattgtatc

SEQ ID NO: 132075 - DNA, 22 bp, Artificial sequence
  SiRNA target sequence
gaagaaatagtatattgtatcg

SEQ ID NO: 132076 - DNA, 22 bp, Artificial sequence
  SiRNA target sequence
aagaaatagtatattgtatcga

SEQ ID NO: 132077 - DNA, 22 bp, Artificial sequence
  SiRNA target sequence
agaaatagtatattgtatcgaa

SEQ ID NO: 132078 - DNA, 22 bp, Artificial sequence
  SiRNA target sequence
gaaatagtatattgtatcgaac

SEQ ID NO: 132079 - DNA, 22 bp, Artificial sequence
  SiRNA target sequence
aaatagtatattgtatcgaaca

SEQ ID NO: 132080 - DNA, 22 bp, Artificial sequence
  SiRNA target sequence
aatagtatattgtatcgaacat

SEQ ID NO: 132081 - DNA, 22 bp, Artificial sequence
  SiRNA target sequence
atagtatattgtatcgaacatg

SEQ ID NO: 132082 - DNA, 22 bp, Artificial sequence
  SiRNA target sequence
tagtatattgtatcgaacatga

SEQ ID NO: 132083 - DNA, 22 bp, Artificial sequence
  SiRNA target sequence
agtatattgtatcgaacatgaa

SEQ ID NO: 132084 - DNA, 22 bp, Artificial sequence
  SiRNA target sequence
gtatattgtatcgaacatgaat

SEQ ID NO: 132085 - DNA, 22 bp, Artificial sequence
  SiRNA target sequence
tatattgtatcgaacatgaatt

SEQ ID NO: 132086 - DNA, 22 bp, Artificial sequence
  SiRNA target sequence
atattgtatcgaacatgaattg

SEQ ID NO: 132087 - DNA, 22 bp, Artificial sequence
  SiRNA target sequence
tattgtatcgaacatgaattgg

SEQ ID NO: 132088 - DNA, 22 bp, Artificial sequence
  SiRNA target sequence
attgtatcgaacatgaattggc

SEQ ID NO: 132089 - DNA, 22 bp, Artificial sequence
  SiRNA target sequence
ttgtatcgaacatgaattggct

SEQ ID NO: 132090 - DNA, 22 bp, Artificial sequence
  SiRNA target sequence
tgtatcgaacatgaattggctt

SEQ ID NO: 132091 - DNA, 22 bp, Artificial sequence
  SiRNA target sequence
gtatcgaacatgaattggctta

SEQ ID NO: 132092 - DNA, 22 bp, Artificial sequence
  SiRNA target sequence
tatcgaacatgaattggcttat

SEQ ID NO: 132093 - DNA, 22 bp, Artificial sequence
  SiRNA target sequence
atcgaacatgaattggcttatc

SEQ ID NO: 132094 - DNA, 22 bp, Artificial sequence
  SiRNA target sequence
tcgaacatgaattggcttatcg

SEQ ID NO: 132095 - DNA, 22 bp, Artificial sequence
  SiRNA target sequence
cgaacatgaattggcttatcgc

SEQ ID NO: 132096 - DNA, 22 bp, Artificial sequence
  SiRNA target sequence
gaacatgaattggcttatcgca

SEQ ID NO: 132097 - DNA, 22 bp, Artificial sequence
  SiRNA target sequence
aacatgaattggcttatcgcat

SEQ ID NO: 132098 - DNA, 22 bp, Artificial sequence
  SiRNA target sequence
acatgaattggcttatcgcatc

SEQ ID NO: 132099 - DNA, 22 bp, Artificial sequence
  SiRNA target sequence
catgaattggcttatcgcatca

SEQ ID NO: 132100 - DNA, 22 bp, Artificial sequence
  SiRNA target sequence
atgaattggcttatcgcatcag

SEQ ID NO: 132101 - DNA, 22 bp, Artificial sequence
  SiRNA target sequence
tgaattggcttatcgcatcagt

SEQ ID NO: 132102 - DNA, 22 bp, Artificial sequence
  SiRNA target sequence
gaattggcttatcgcatcagtg

SEQ ID NO: 132103 - DNA, 22 bp, Artificial sequence
  SiRNA target sequence
aattggcttatcgcatcagtga

SEQ ID NO: 132104 - DNA, 22 bp, Artificial sequence
  SiRNA target sequence
attggcttatcgcatcagtgat

SEQ ID NO: 132105 - DNA, 22 bp, Artificial sequence
  SiRNA target sequence
ttggcttatcgcatcagtgata

SEQ ID NO: 132106 - DNA, 22 bp, Artificial sequence
  SiRNA target sequence
tggcttatcgcatcagtgatat

SEQ ID NO: 132107 - DNA, 22 bp, Artificial sequence
  SiRNA target sequence
ggcttatcgcatcagtgatata

SEQ ID NO: 132108 - DNA, 22 bp, Artificial sequence
  SiRNA target sequence
gcttatcgcatcagtgatatat

SEQ ID NO: 132109 - DNA, 22 bp, Artificial sequence
  SiRNA target sequence
cttatcgcatcagtgatatatt

SEQ ID NO: 132110 - DNA, 22 bp, Artificial sequence
  SiRNA target sequence
ttatcgcatcagtgatatatta

SEQ ID NO: 132111 - DNA, 22 bp, Artificial sequence
  SiRNA target sequence
tatcgcatcagtgatatattat

SEQ ID NO: 132112 - DNA, 22 bp, Artificial sequence
  SiRNA target sequence
atcgcatcagtgatatattatt

SEQ ID NO: 132113 - DNA, 22 bp, Artificial sequence
  SiRNA target sequence
tcgcatcagtgatatattattt

SEQ ID NO: 132114 - DNA, 22 bp, Artificial sequence
  SiRNA target sequence
cgcatcagtgatatattattta

SEQ ID NO: 132115 - DNA, 22 bp, Artificial sequence
  SiRNA target sequence
gcatcagtgatatattatttaa

SEQ ID NO: 132116 - DNA, 22 bp, Artificial sequence
  SiRNA target sequence
catcagtgatatattatttaat

SEQ ID NO: 132117 - DNA, 22 bp, Artificial sequence
  SiRNA target sequence
atcagtgatatattatttaata

SEQ ID NO: 132118 - DNA, 22 bp, Artificial sequence
  SiRNA target sequence
tcagtgatatattatttaatag

SEQ ID NO: 132119 - DNA, 22 bp, Artificial sequence
  SiRNA target sequence
cagtgatatattatttaatagg

SEQ ID NO: 132120 - DNA, 22 bp, Artificial sequence
  SiRNA target sequence
agtgatatattatttaatagga

SEQ ID NO: 132121 - DNA, 22 bp, Artificial sequence
  SiRNA target sequence
gtgatatattatttaataggat

SEQ ID NO: 132122 - DNA, 22 bp, Artificial sequence
  SiRNA target sequence
tgatatattatttaataggatg

SEQ ID NO: 132123 - DNA, 22 bp, Artificial sequence
  SiRNA target sequence
gatatattatttaataggatga

SEQ ID NO: 132124 - DNA, 22 bp, Artificial sequence
  SiRNA target sequence
atatattatttaataggatgat

SEQ ID NO: 132125 - DNA, 22 bp, Artificial sequence
  SiRNA target sequence
tatattatttaataggatgatg

SEQ ID NO: 132126 - DNA, 22 bp, Artificial sequence
  SiRNA target sequence
atattatttaataggatgatga

SEQ ID NO: 132127 - DNA, 22 bp, Artificial sequence
  SiRNA target sequence
tattatttaataggatgatgat

SEQ ID NO: 132128 - DNA, 22 bp, Artificial sequence
  SiRNA target sequence
attatttaataggatgatgata

SEQ ID NO: 132129 - DNA, 22 bp, Artificial sequence
  SiRNA target sequence
ttatttaataggatgatgatag

SEQ ID NO: 132130 - DNA, 22 bp, Artificial sequence
  SiRNA target sequence
tatttaataggatgatgatagg

SEQ ID NO: 132131 - DNA, 22 bp, Artificial sequence
  SiRNA target sequence
atttaataggatgatgatagga

SEQ ID NO: 132132 - DNA, 22 bp, Artificial sequence
  SiRNA target sequence
tttaataggatgatgataggat

SEQ ID NO: 132133 - DNA, 22 bp, Artificial sequence
  SiRNA target sequence
ttaataggatgatgataggata

SEQ ID NO: 132134 - DNA, 22 bp, Artificial sequence
  SiRNA target sequence
taataggatgatgataggatac

SEQ ID NO: 132135 - DNA, 22 bp, Artificial sequence
  SiRNA target sequence
aataggatgatgataggataca

SEQ ID NO: 132136 - DNA, 22 bp, Artificial sequence
  SiRNA target sequence
ataggatgatgataggatacat

SEQ ID NO: 132137 - DNA, 22 bp, Artificial sequence
  SiRNA target sequence
taggatgatgataggatacatt

SEQ ID NO: 132138 - DNA, 22 bp, Artificial sequence
  SiRNA target sequence
aggatgatgataggatacattg

SEQ ID NO: 132139 - DNA, 22 bp, Artificial sequence
  SiRNA target sequence
ggatgatgataggatacattga

SEQ ID NO: 132140 - DNA, 22 bp, Artificial sequence
  SiRNA target sequence
gatgatgataggatacattgac

SEQ ID NO: 132141 - DNA, 22 bp, Artificial sequence
  SiRNA target sequence
atgatgataggatacattgacg

SEQ ID NO: 132142 - DNA, 22 bp, Artificial sequence
  SiRNA target sequence
tgatgataggatacattgacgt

SEQ ID NO: 132143 - DNA, 22 bp, Artificial sequence
  SiRNA target sequence
gatgataggatacattgacgtc

SEQ ID NO: 132144 - DNA, 22 bp, Artificial sequence
  SiRNA target sequence
atgataggatacattgacgtca

SEQ ID NO: 132145 - DNA, 22 bp, Artificial sequence
  SiRNA target sequence
tgataggatacattgacgtcag

SEQ ID NO: 132146 - DNA, 22 bp, Artificial sequence
  SiRNA target sequence
gataggatacattgacgtcaga

SEQ ID NO: 132147 - DNA, 22 bp, Artificial sequence
  SiRNA target sequence
ataggatacattgacgtcagaa

SEQ ID NO: 132148 - DNA, 22 bp, Artificial sequence
  SiRNA target sequence
taggatacattgacgtcagaag

SEQ ID NO: 132149 - DNA, 22 bp, Artificial sequence
  SiRNA target sequence
aggatacattgacgtcagaaga

SEQ ID NO: 132150 - DNA, 22 bp, Artificial sequence
  SiRNA target sequence
ggatacattgacgtcagaagag

SEQ ID NO: 132151 - DNA, 22 bp, Artificial sequence
  SiRNA target sequence
gatacattgacgtcagaagagc

SEQ ID NO: 132152 - DNA, 22 bp, Artificial sequence
  SiRNA target sequence
atacattgacgtcagaagagca

SEQ ID NO: 132153 - DNA, 22 bp, Artificial sequence
  SiRNA target sequence
tacattgacgtcagaagagcat

SEQ ID NO: 132154 - DNA, 22 bp, Artificial sequence
  SiRNA target sequence
acattgacgtcagaagagcatt

SEQ ID NO: 132155 - DNA, 22 bp, Artificial sequence
  SiRNA target sequence
cattgacgtcagaagagcattt

SEQ ID NO: 132156 - DNA, 22 bp, Artificial sequence
  SiRNA target sequence
attgacgtcagaagagcatttg

SEQ ID NO: 132157 - DNA, 22 bp, Artificial sequence
  SiRNA target sequence
ttgacgtcagaagagcatttga

SEQ ID NO: 132158 - DNA, 22 bp, Artificial sequence
  SiRNA target sequence
tgacgtcagaagagcatttgat

SEQ ID NO: 132159 - DNA, 22 bp, Artificial sequence
  SiRNA target sequence
gacgtcagaagagcatttgatt

SEQ ID NO: 132160 - DNA, 22 bp, Artificial sequence
  SiRNA target sequence
acgtcagaagagcatttgattt

SEQ ID NO: 132161 - DNA, 22 bp, Artificial sequence
  SiRNA target sequence
cgtcagaagagcatttgattta

SEQ ID NO: 132162 - DNA, 22 bp, Artificial sequence
  SiRNA target sequence
gtcagaagagcatttgatttaa

SEQ ID NO: 132163 - DNA, 22 bp, Artificial sequence
  SiRNA target sequence
tcagaagagcatttgatttaat

SEQ ID NO: 132164 - DNA, 22 bp, Artificial sequence
  SiRNA target sequence
cagaagagcatttgatttaatt

SEQ ID NO: 132165 - DNA, 22 bp, Artificial sequence
  SiRNA target sequence
agaagagcatttgatttaattg

SEQ ID NO: 132166 - DNA, 22 bp, Artificial sequence
  SiRNA target sequence
gaagagcatttgatttaattgg

SEQ ID NO: 132167 - DNA, 22 bp, Artificial sequence
  SiRNA target sequence
aagagcatttgatttaattggt

SEQ ID NO: 132168 - DNA, 22 bp, Artificial sequence
  SiRNA target sequence
agagcatttgatttaattggta

SEQ ID NO: 132169 - DNA, 22 bp, Artificial sequence
  SiRNA target sequence
gagcatttgatttaattggtat

SEQ ID NO: 132170 - DNA, 22 bp, Artificial sequence
  SiRNA target sequence
agcatttgatttaattggtata

SEQ ID NO: 132171 - DNA, 22 bp, Artificial sequence
  SiRNA target sequence
gcatttgatttaattggtatag

SEQ ID NO: 132172 - DNA, 22 bp, Artificial sequence
  SiRNA target sequence
catttgatttaattggtatagt

SEQ ID NO: 132173 - DNA, 22 bp, Artificial sequence
  SiRNA target sequence
atttgatttaattggtatagta

SEQ ID NO: 132174 - DNA, 22 bp, Artificial sequence
  SiRNA target sequence
tttgatttaattggtatagtag

SEQ ID NO: 132175 - DNA, 22 bp, Artificial sequence
  SiRNA target sequence
ttgatttaattggtatagtagc

SEQ ID NO: 132176 - DNA, 22 bp, Artificial sequence
  SiRNA target sequence
tgatttaattggtatagtagct

SEQ ID NO: 132177 - DNA, 22 bp, Artificial sequence
  SiRNA target sequence
gatttaattggtatagtagctg

SEQ ID NO: 132178 - DNA, 22 bp, Artificial sequence
  SiRNA target sequence
atttaattggtatagtagctga

SEQ ID NO: 132179 - DNA, 22 bp, Artificial sequence
  SiRNA target sequence
tttaattggtatagtagctgaa

SEQ ID NO: 132180 - DNA, 22 bp, Artificial sequence
  SiRNA target sequence
ttaattggtatagtagctgaag

SEQ ID NO: 132181 - DNA, 22 bp, Artificial sequence
  SiRNA target sequence
taattggtatagtagctgaagt

SEQ ID NO: 132182 - DNA, 22 bp, Artificial sequence
  SiRNA target sequence
aattggtatagtagctgaagta

SEQ ID NO: 132183 - DNA, 22 bp, Artificial sequence
  SiRNA target sequence
attggtatagtagctgaagtaa

SEQ ID NO: 132184 - DNA, 22 bp, Artificial sequence
  SiRNA target sequence
ttggtatagtagctgaagtaat

SEQ ID NO: 132185 - DNA, 22 bp, Artificial sequence
  SiRNA target sequence
tggtatagtagctgaagtaatg

SEQ ID NO: 132186 - DNA, 22 bp, Artificial sequence
  SiRNA target sequence
ggtatagtagctgaagtaatga

SEQ ID NO: 132187 - DNA, 22 bp, Artificial sequence
  SiRNA target sequence
gtatagtagctgaagtaatgaa

SEQ ID NO: 132188 - DNA, 22 bp, Artificial sequence
  SiRNA target sequence
tatagtagctgaagtaatgaaa

SEQ ID NO: 132189 - DNA, 22 bp, Artificial sequence
  SiRNA target sequence
atagtagctgaagtaatgaaag

SEQ ID NO: 132190 - DNA, 22 bp, Artificial sequence
  SiRNA target sequence
tagtagctgaagtaatgaaaga

SEQ ID NO: 132191 - DNA, 22 bp, Artificial sequence
  SiRNA target sequence
agtagctgaagtaatgaaagac

SEQ ID NO: 132192 - DNA, 22 bp, Artificial sequence
  SiRNA target sequence
gtagctgaagtaatgaaagact

SEQ ID NO: 132193 - DNA, 22 bp, Artificial sequence
  SiRNA target sequence
tagctgaagtaatgaaagacta

SEQ ID NO: 132194 - DNA, 22 bp, Artificial sequence
  SiRNA target sequence
agctgaagtaatgaaagactat

SEQ ID NO: 132195 - DNA, 22 bp, Artificial sequence
  SiRNA target sequence
gctgaagtaatgaaagactatt

SEQ ID NO: 132196 - DNA, 22 bp, Artificial sequence
  SiRNA target sequence
ctgaagtaatgaaagactatta

SEQ ID NO: 132197 - DNA, 22 bp, Artificial sequence
  SiRNA target sequence
tgaagtaatgaaagactattac

SEQ ID NO: 132198 - DNA, 22 bp, Artificial sequence
  SiRNA target sequence
gaagtaatgaaagactattacg

SEQ ID NO: 132199 - DNA, 22 bp, Artificial sequence
  SiRNA target sequence
aagtaatgaaagactattacgg

SEQ ID NO: 132200 - DNA, 22 bp, Artificial sequence
  SiRNA target sequence
agtaatgaaagactattacgga

SEQ ID NO: 132201 - DNA, 22 bp, Artificial sequence
  SiRNA target sequence
gtaatgaaagactattacggat

SEQ ID NO: 132202 - DNA, 22 bp, Artificial sequence
  SiRNA target sequence
taatgaaagactattacggatg

SEQ ID NO: 132203 - DNA, 22 bp, Artificial sequence
  SiRNA target sequence
aatgaaagactattacggatgg

SEQ ID NO: 132204 - DNA, 22 bp, Artificial sequence
  SiRNA target sequence
atgaaagactattacggatggg

SEQ ID NO: 132205 - DNA, 22 bp, Artificial sequence
  SiRNA target sequence
tgaaagactattacggatggga

SEQ ID NO: 132206 - DNA, 22 bp, Artificial sequence
  SiRNA target sequence
gaaagactattacggatgggat

SEQ ID NO: 132207 - DNA, 22 bp, Artificial sequence
  SiRNA target sequence
aaagactattacggatgggatc

SEQ ID NO: 132208 - DNA, 22 bp, Artificial sequence
  SiRNA target sequence
aagactattacggatgggatca

SEQ ID NO: 132209 - DNA, 22 bp, Artificial sequence
  SiRNA target sequence
agactattacggatgggatcag

SEQ ID NO: 132210 - DNA, 22 bp, Artificial sequence
  SiRNA target sequence
gactattacggatgggatcagc

SEQ ID NO: 132211 - DNA, 22 bp, Artificial sequence
  SiRNA target sequence
actattacggatgggatcagca

SEQ ID NO: 132212 - DNA, 22 bp, Artificial sequence
  SiRNA target sequence
ctattacggatgggatcagcaa

SEQ ID NO: 132213 - DNA, 22 bp, Artificial sequence
  SiRNA target sequence
tattacggatgggatcagcaaa

SEQ ID NO: 132214 - DNA, 22 bp, Artificial sequence
  SiRNA target sequence
attacggatgggatcagcaaag

SEQ ID NO: 132215 - DNA, 22 bp, Artificial sequence
  SiRNA target sequence
ttacggatgggatcagcaaaga

SEQ ID NO: 132216 - DNA, 22 bp, Artificial sequence
  SiRNA target sequence
tacggatgggatcagcaaagat

SEQ ID NO: 132217 - DNA, 22 bp, Artificial sequence
  SiRNA target sequence
acggatgggatcagcaaagata

SEQ ID NO: 132218 - DNA, 22 bp, Artificial sequence
  SiRNA target sequence
cggatgggatcagcaaagatat

SEQ ID NO: 132219 - DNA, 22 bp, Artificial sequence
  SiRNA target sequence
ggatgggatcagcaaagatata

SEQ ID NO: 132220 - DNA, 22 bp, Artificial sequence
  SiRNA target sequence
gatgggatcagcaaagatataa

SEQ ID NO: 132221 - DNA, 22 bp, Artificial sequence
  SiRNA target sequence
atgggatcagcaaagatataat

SEQ ID NO: 132222 - DNA, 22 bp, Artificial sequence
  SiRNA target sequence
tgggatcagcaaagatataatg

SEQ ID NO: 132223 - DNA, 22 bp, Artificial sequence
  SiRNA target sequence
gggatcagcaaagatataatga

SEQ ID NO: 132224 - DNA, 22 bp, Artificial sequence
  SiRNA target sequence
ggatcagcaaagatataatgaa

SEQ ID NO: 132225 - DNA, 22 bp, Artificial sequence
  SiRNA target sequence
gatcagcaaagatataatgaag

SEQ ID NO: 132226 - DNA, 22 bp, Artificial sequence
  SiRNA target sequence
atcagcaaagatataatgaaga

SEQ ID NO: 132227 - DNA, 22 bp, Artificial sequence
  SiRNA target sequence
tcagcaaagatataatgaagaa

SEQ ID NO: 132228 - DNA, 22 bp, Artificial sequence
  SiRNA target sequence
cagcaaagatataatgaagaaa

SEQ ID NO: 132229 - DNA, 22 bp, Artificial sequence
  SiRNA target sequence
agcaaagatataatgaagaaac

SEQ ID NO: 132230 - DNA, 22 bp, Artificial sequence
  SiRNA target sequence
gcaaagatataatgaagaaaca

SEQ ID NO: 132231 - DNA, 22 bp, Artificial sequence
  SiRNA target sequence
caaagatataatgaagaaacaa

SEQ ID NO: 132232 - DNA, 22 bp, Artificial sequence
  SiRNA target sequence
aaagatataatgaagaaacaaa

SEQ ID NO: 132233 - DNA, 22 bp, Artificial sequence
  SiRNA target sequence
aagatataatgaagaaacaaaa

SEQ ID NO: 132234 - DNA, 22 bp, Artificial sequence
  SiRNA target sequence
agatataatgaagaaacaaaat

SEQ ID NO: 132235 - DNA, 22 bp, Artificial sequence
  SiRNA target sequence
gatataatgaagaaacaaaatt

SEQ ID NO: 132236 - DNA, 22 bp, Artificial sequence
  SiRNA target sequence
atataatgaagaaacaaaatta

SEQ ID NO: 132237 - DNA, 22 bp, Artificial sequence
  SiRNA target sequence
tataatgaagaaacaaaattat

SEQ ID NO: 132238 - DNA, 22 bp, Artificial sequence
  SiRNA target sequence
ataatgaagaaacaaaattatg

SEQ ID NO: 132239 - DNA, 22 bp, Artificial sequence
  SiRNA target sequence
taatgaagaaacaaaattatgc

SEQ ID NO: 132240 - DNA, 22 bp, Artificial sequence
  SiRNA target sequence
aatgaagaaacaaaattatgca

SEQ ID NO: 132241 - DNA, 22 bp, Artificial sequence
  SiRNA target sequence
atgaagaaacaaaattatgcat

SEQ ID NO: 132242 - DNA, 22 bp, Artificial sequence
  SiRNA target sequence
tgaagaaacaaaattatgcatg

SEQ ID NO: 132243 - DNA, 22 bp, Artificial sequence
  SiRNA target sequence
gaagaaacaaaattatgcatgg

SEQ ID NO: 132244 - DNA, 22 bp, Artificial sequence
  SiRNA target sequence
aagaaacaaaattatgcatgga

SEQ ID NO: 132245 - DNA, 22 bp, Artificial sequence
  SiRNA target sequence
agaaacaaaattatgcatggaa

SEQ ID NO: 132246 - DNA, 22 bp, Artificial sequence
  SiRNA target sequence
gaaacaaaattatgcatggaaa

SEQ ID NO: 132247 - DNA, 22 bp, Artificial sequence
  SiRNA target sequence
aaacaaaattatgcatggaaat

SEQ ID NO: 132248 - DNA, 22 bp, Artificial sequence
  SiRNA target sequence
aacaaaattatgcatggaaatg

SEQ ID NO: 132249 - DNA, 22 bp, Artificial sequence
  SiRNA target sequence
acaaaattatgcatggaaatga

SEQ ID NO: 132250 - DNA, 22 bp, Artificial sequence
  SiRNA target sequence
caaaattatgcatggaaatgat

SEQ ID NO: 132251 - DNA, 22 bp, Artificial sequence
  SiRNA target sequence
aaaattatgcatggaaatgatg

SEQ ID NO: 132252 - DNA, 22 bp, Artificial sequence
  SiRNA target sequence
aaattatgcatggaaatgatgg

SEQ ID NO: 132253 - DNA, 22 bp, Artificial sequence
  SiRNA target sequence
aattatgcatggaaatgatgga

SEQ ID NO: 132254 - DNA, 22 bp, Artificial sequence
  SiRNA target sequence
attatgcatggaaatgatggaa

SEQ ID NO: 132255 - DNA, 22 bp, Artificial sequence
  SiRNA target sequence
ttatgcatggaaatgatggaaa

SEQ ID NO: 132256 - DNA, 22 bp, Artificial sequence
  SiRNA target sequence
tatgcatggaaatgatggaaac

SEQ ID NO: 132257 - DNA, 22 bp, Artificial sequence
  SiRNA target sequence
atgcatggaaatgatggaaact

SEQ ID NO: 132258 - DNA, 22 bp, Artificial sequence
  SiRNA target sequence
tgcatggaaatgatggaaactt

SEQ ID NO: 132259 - DNA, 22 bp, Artificial sequence
  SiRNA target sequence
gcatggaaatgatggaaacttg

SEQ ID NO: 132260 - DNA, 22 bp, Artificial sequence
  SiRNA target sequence
catggaaatgatggaaacttgt

SEQ ID NO: 132261 - DNA, 22 bp, Artificial sequence
  SiRNA target sequence
atggaaatgatggaaacttgtg

SEQ ID NO: 132262 - DNA, 22 bp, Artificial sequence
  SiRNA target sequence
tggaaatgatggaaacttgtgg

SEQ ID NO: 132263 - DNA, 22 bp, Artificial sequence
  SiRNA target sequence
ggaaatgatggaaacttgtggt

SEQ ID NO: 132264 - DNA, 22 bp, Artificial sequence
  SiRNA target sequence
gaaatgatggaaacttgtggtt

SEQ ID NO: 132265 - DNA, 22 bp, Artificial sequence
  SiRNA target sequence
aaatgatggaaacttgtggtta

SEQ ID NO: 132266 - DNA, 22 bp, Artificial sequence
  SiRNA target sequence
aatgatggaaacttgtggttat

SEQ ID NO: 132267 - DNA, 22 bp, Artificial sequence
  SiRNA target sequence
atgatggaaacttgtggttata

SEQ ID NO: 132268 - DNA, 22 bp, Artificial sequence
  SiRNA target sequence
tgatggaaacttgtggttatag

SEQ ID NO: 132269 - DNA, 22 bp, Artificial sequence
  SiRNA target sequence
gatggaaacttgtggttatagt

SEQ ID NO: 132270 - DNA, 22 bp, Artificial sequence
  SiRNA target sequence
atggaaacttgtggttatagtt

SEQ ID NO: 132271 - DNA, 22 bp, Artificial sequence
  SiRNA target sequence
tggaaacttgtggttatagttt

SEQ ID NO: 132272 - DNA, 22 bp, Artificial sequence
  SiRNA target sequence
ggaaacttgtggttatagttta

SEQ ID NO: 132273 - DNA, 22 bp, Artificial sequence
  SiRNA target sequence
gaaacttgtggttatagtttat

SEQ ID NO: 132274 - DNA, 22 bp, Artificial sequence
  SiRNA target sequence
aaacttgtggttatagtttatt

SEQ ID NO: 132275 - DNA, 22 bp, Artificial sequence
  SiRNA target sequence
aacttgtggttatagtttatta

SEQ ID NO: 132276 - DNA, 22 bp, Artificial sequence
  SiRNA target sequence
acttgtggttatagtttattaa

SEQ ID NO: 132277 - DNA, 22 bp, Artificial sequence
  SiRNA target sequence
cttgtggttatagtttattaaa

SEQ ID NO: 132278 - DNA, 22 bp, Artificial sequence
  SiRNA target sequence
ttgtggttatagtttattaaaa

SEQ ID NO: 132279 - DNA, 22 bp, Artificial sequence
  SiRNA target sequence
tgtggttatagtttattaaaaa

SEQ ID NO: 132280 - DNA, 22 bp, Artificial sequence
  SiRNA target sequence
gtggttatagtttattaaaaaa

SEQ ID NO: 132281 - DNA, 22 bp, Artificial sequence
  SiRNA target sequence
tggttatagtttattaaaaaat

SEQ ID NO: 132282 - DNA, 22 bp, Artificial sequence
  SiRNA target sequence
ggttatagtttattaaaaaatt

SEQ ID NO: 132283 - DNA, 22 bp, Artificial sequence
  SiRNA target sequence
gttatagtttattaaaaaatta

SEQ ID NO: 132284 - DNA, 22 bp, Artificial sequence
  SiRNA target sequence
ttatagtttattaaaaaattaa

SEQ ID NO: 132285 - DNA, 23 bp, Artificial sequence
  SiRNA target sequence
atggtgtataaggttttatttac

SEQ ID NO: 132286 - DNA, 23 bp, Artificial sequence
  SiRNA target sequence
tggtgtataaggttttatttaca

SEQ ID NO: 132287 - DNA, 23 bp, Artificial sequence
  SiRNA target sequence
ggtgtataaggttttatttacag

SEQ ID NO: 132288 - DNA, 23 bp, Artificial sequence
  SiRNA target sequence
gtgtataaggttttatttacagt

SEQ ID NO: 132289 - DNA, 23 bp, Artificial sequence
  SiRNA target sequence
tgtataaggttttatttacagta

SEQ ID NO: 132290 - DNA, 23 bp, Artificial sequence
  SiRNA target sequence
gtataaggttttatttacagtaa

SEQ ID NO: 132291 - DNA, 23 bp, Artificial sequence
  SiRNA target sequence
tataaggttttatttacagtaat

SEQ ID NO: 132292 - DNA, 23 bp, Artificial sequence
  SiRNA target sequence
ataaggttttatttacagtaata

SEQ ID NO: 132293 - DNA, 23 bp, Artificial sequence
  SiRNA target sequence
taaggttttatttacagtaatag

SEQ ID NO: 132294 - DNA, 23 bp, Artificial sequence
  SiRNA target sequence
aaggttttatttacagtaatagg

SEQ ID NO: 132295 - DNA, 23 bp, Artificial sequence
  SiRNA target sequence
aggttttatttacagtaatagga

SEQ ID NO: 132296 - DNA, 23 bp, Artificial sequence
  SiRNA target sequence
ggttttatttacagtaataggat

SEQ ID NO: 132297 - DNA, 23 bp, Artificial sequence
  SiRNA target sequence
gttttatttacagtaataggatt

SEQ ID NO: 132298 - DNA, 23 bp, Artificial sequence
  SiRNA target sequence
ttttatttacagtaataggatta

SEQ ID NO: 132299 - DNA, 23 bp, Artificial sequence
  SiRNA target sequence
tttatttacagtaataggattaa

SEQ ID NO: 132300 - DNA, 23 bp, Artificial sequence
  SiRNA target sequence
ttatttacagtaataggattaat

SEQ ID NO: 132301 - DNA, 23 bp, Artificial sequence
  SiRNA target sequence
tatttacagtaataggattaata

SEQ ID NO: 132302 - DNA, 23 bp, Artificial sequence
  SiRNA target sequence
atttacagtaataggattaatat

SEQ ID NO: 132303 - DNA, 23 bp, Artificial sequence
  SiRNA target sequence
tttacagtaataggattaatatg

SEQ ID NO: 132304 - DNA, 23 bp, Artificial sequence
  SiRNA target sequence
ttacagtaataggattaatatgt

SEQ ID NO: 132305 - DNA, 23 bp, Artificial sequence
  SiRNA target sequence
tacagtaataggattaatatgtg

SEQ ID NO: 132306 - DNA, 23 bp, Artificial sequence
  SiRNA target sequence
acagtaataggattaatatgtgg

SEQ ID NO: 132307 - DNA, 23 bp, Artificial sequence
  SiRNA target sequence
cagtaataggattaatatgtggt

SEQ ID NO: 132308 - DNA, 23 bp, Artificial sequence
  SiRNA target sequence
agtaataggattaatatgtggta

SEQ ID NO: 132309 - DNA, 23 bp, Artificial sequence
  SiRNA target sequence
gtaataggattaatatgtggtat

SEQ ID NO: 132310 - DNA, 23 bp, Artificial sequence
  SiRNA target sequence
taataggattaatatgtggtata

SEQ ID NO: 132311 - DNA, 23 bp, Artificial sequence
  SiRNA target sequence
aataggattaatatgtggtatac

SEQ ID NO: 132312 - DNA, 23 bp, Artificial sequence
  SiRNA target sequence
ataggattaatatgtggtatact

SEQ ID NO: 132313 - DNA, 23 bp, Artificial sequence
  SiRNA target sequence
taggattaatatgtggtatactt

SEQ ID NO: 132314 - DNA, 23 bp, Artificial sequence
  SiRNA target sequence
aggattaatatgtggtatactta

SEQ ID NO: 132315 - DNA, 23 bp, Artificial sequence
  SiRNA target sequence
ggattaatatgtggtatacttac

SEQ ID NO: 132316 - DNA, 23 bp, Artificial sequence
  SiRNA target sequence
gattaatatgtggtatacttaca

SEQ ID NO: 132317 - DNA, 23 bp, Artificial sequence
  SiRNA target sequence
attaatatgtggtatacttacaa

SEQ ID NO: 132318 - DNA, 23 bp, Artificial sequence
  SiRNA target sequence
ttaatatgtggtatacttacaat

SEQ ID NO: 132319 - DNA, 23 bp, Artificial sequence
  SiRNA target sequence
taatatgtggtatacttacaata

SEQ ID NO: 132320 - DNA, 23 bp, Artificial sequence
  SiRNA target sequence
aatatgtggtatacttacaataa

SEQ ID NO: 132321 - DNA, 23 bp, Artificial sequence
  SiRNA target sequence
atatgtggtatacttacaataat

SEQ ID NO: 132322 - DNA, 23 bp, Artificial sequence
  SiRNA target sequence
tatgtggtatacttacaataatt

SEQ ID NO: 132323 - DNA, 23 bp, Artificial sequence
  SiRNA target sequence
atgtggtatacttacaataatta

SEQ ID NO: 132324 - DNA, 23 bp, Artificial sequence
  SiRNA target sequence
tgtggtatacttacaataattaa

SEQ ID NO: 132325 - DNA, 23 bp, Artificial sequence
  SiRNA target sequence
gtggtatacttacaataattaaa

SEQ ID NO: 132326 - DNA, 23 bp, Artificial sequence
  SiRNA target sequence
tggtatacttacaataattaaac

SEQ ID NO: 132327 - DNA, 23 bp, Artificial sequence
  SiRNA target sequence
ggtatacttacaataattaaacg

SEQ ID NO: 132328 - DNA, 23 bp, Artificial sequence
  SiRNA target sequence
gtatacttacaataattaaacga

SEQ ID NO: 132329 - DNA, 23 bp, Artificial sequence
  SiRNA target sequence
tatacttacaataattaaacgat

SEQ ID NO: 132330 - DNA, 23 bp, Artificial sequence
  SiRNA target sequence
atacttacaataattaaacgata

SEQ ID NO: 132331 - DNA, 23 bp, Artificial sequence
  SiRNA target sequence
tacttacaataattaaacgatac

SEQ ID NO: 132332 - DNA, 23 bp, Artificial sequence
  SiRNA target sequence
acttacaataattaaacgataca

SEQ ID NO: 132333 - DNA, 23 bp, Artificial sequence
  SiRNA target sequence
cttacaataattaaacgatacaa

SEQ ID NO: 132334 - DNA, 23 bp, Artificial sequence
  SiRNA target sequence
ttacaataattaaacgatacaag

SEQ ID NO: 132335 - DNA, 23 bp, Artificial sequence
  SiRNA target sequence
tacaataattaaacgatacaagt

SEQ ID NO: 132336 - DNA, 23 bp, Artificial sequence
  SiRNA target sequence
acaataattaaacgatacaagta

SEQ ID NO: 132337 - DNA, 23 bp, Artificial sequence
  SiRNA target sequence
caataattaaacgatacaagtat

SEQ ID NO: 132338 - DNA, 23 bp, Artificial sequence
  SiRNA target sequence
aataattaaacgatacaagtatt

SEQ ID NO: 132339 - DNA, 23 bp, Artificial sequence
  SiRNA target sequence
ataattaaacgatacaagtattt

SEQ ID NO: 132340 - DNA, 23 bp, Artificial sequence
  SiRNA target sequence
taattaaacgatacaagtatttt

SEQ ID NO: 132341 - DNA, 23 bp, Artificial sequence
  SiRNA target sequence
aattaaacgatacaagtatttta

SEQ ID NO: 132342 - DNA, 23 bp, Artificial sequence
  SiRNA target sequence
attaaacgatacaagtattttaa

SEQ ID NO: 132343 - DNA, 23 bp, Artificial sequence
  SiRNA target sequence
ttaaacgatacaagtattttaag

SEQ ID NO: 132344 - DNA, 23 bp, Artificial sequence
  SiRNA target sequence
taaacgatacaagtattttaaga

SEQ ID NO: 132345 - DNA, 23 bp, Artificial sequence
  SiRNA target sequence
aaacgatacaagtattttaagat

SEQ ID NO: 132346 - DNA, 23 bp, Artificial sequence
  SiRNA target sequence
aacgatacaagtattttaagata

SEQ ID NO: 132347 - DNA, 23 bp, Artificial sequence
  SiRNA target sequence
acgatacaagtattttaagataa

SEQ ID NO: 132348 - DNA, 23 bp, Artificial sequence
  SiRNA target sequence
cgatacaagtattttaagataaa

SEQ ID NO: 132349 - DNA, 23 bp, Artificial sequence
  SiRNA target sequence
gatacaagtattttaagataaaa

SEQ ID NO: 132350 - DNA, 23 bp, Artificial sequence
  SiRNA target sequence
atacaagtattttaagataaaaa

SEQ ID NO: 132351 - DNA, 23 bp, Artificial sequence
  SiRNA target sequence
tacaagtattttaagataaaaaa

SEQ ID NO: 132352 - DNA, 23 bp, Artificial sequence
  SiRNA target sequence
acaagtattttaagataaaaaaa

SEQ ID NO: 132353 - DNA, 23 bp, Artificial sequence
  SiRNA target sequence
caagtattttaagataaaaaaat

SEQ ID NO: 132354 - DNA, 23 bp, Artificial sequence
  SiRNA target sequence
aagtattttaagataaaaaaatt

SEQ ID NO: 132355 - DNA, 23 bp, Artificial sequence
  SiRNA target sequence
agtattttaagataaaaaaattg

SEQ ID NO: 132356 - DNA, 23 bp, Artificial sequence
  SiRNA target sequence
gtattttaagataaaaaaattgg

SEQ ID NO: 132357 - DNA, 23 bp, Artificial sequence
  SiRNA target sequence
tattttaagataaaaaaattggc

SEQ ID NO: 132358 - DNA, 23 bp, Artificial sequence
  SiRNA target sequence
attttaagataaaaaaattggcc

SEQ ID NO: 132359 - DNA, 23 bp, Artificial sequence
  SiRNA target sequence
ttttaagataaaaaaattggcct

SEQ ID NO: 132360 - DNA, 23 bp, Artificial sequence
  SiRNA target sequence
tttaagataaaaaaattggcctt

SEQ ID NO: 132361 - DNA, 23 bp, Artificial sequence
  SiRNA target sequence
ttaagataaaaaaattggcctta

SEQ ID NO: 132362 - DNA, 23 bp, Artificial sequence
  SiRNA target sequence
taagataaaaaaattggccttaa

SEQ ID NO: 132363 - DNA, 23 bp, Artificial sequence
  SiRNA target sequence
aagataaaaaaattggccttaac

SEQ ID NO: 132364 - DNA, 23 bp, Artificial sequence
  SiRNA target sequence
agataaaaaaattggccttaact

SEQ ID NO: 132365 - DNA, 23 bp, Artificial sequence
  SiRNA target sequence
gataaaaaaattggccttaactt

SEQ ID NO: 132366 - DNA, 23 bp, Artificial sequence
  SiRNA target sequence
ataaaaaaattggccttaactta

SEQ ID NO: 132367 - DNA, 23 bp, Artificial sequence
  SiRNA target sequence
taaaaaaattggccttaacttac

SEQ ID NO: 132368 - DNA, 23 bp, Artificial sequence
  SiRNA target sequence
aaaaaaattggccttaacttact

SEQ ID NO: 132369 - DNA, 23 bp, Artificial sequence
  SiRNA target sequence
aaaaaattggccttaacttactt

SEQ ID NO: 132370 - DNA, 23 bp, Artificial sequence
  SiRNA target sequence
aaaaattggccttaacttacttc

SEQ ID NO: 132371 - DNA, 23 bp, Artificial sequence
  SiRNA target sequence
aaaattggccttaacttacttcg

SEQ ID NO: 132372 - DNA, 23 bp, Artificial sequence
  SiRNA target sequence
aaattggccttaacttacttcgg

SEQ ID NO: 132373 - DNA, 23 bp, Artificial sequence
  SiRNA target sequence
aattggccttaacttacttcggg

SEQ ID NO: 132374 - DNA, 23 bp, Artificial sequence
  SiRNA target sequence
attggccttaacttacttcggga

SEQ ID NO: 132375 - DNA, 23 bp, Artificial sequence
  SiRNA target sequence
ttggccttaacttacttcgggaa

SEQ ID NO: 132376 - DNA, 23 bp, Artificial sequence
  SiRNA target sequence
tggccttaacttacttcgggaaa

SEQ ID NO: 132377 - DNA, 23 bp, Artificial sequence
  SiRNA target sequence
ggccttaacttacttcgggaaac

SEQ ID NO: 132378 - DNA, 23 bp, Artificial sequence
  SiRNA target sequence
gccttaacttacttcgggaaaca

SEQ ID NO: 132379 - DNA, 23 bp, Artificial sequence
  SiRNA target sequence
ccttaacttacttcgggaaacaa

SEQ ID NO: 132380 - DNA, 23 bp, Artificial sequence
  SiRNA target sequence
cttaacttacttcgggaaacaag

SEQ ID NO: 132381 - DNA, 23 bp, Artificial sequence
  SiRNA target sequence
ttaacttacttcgggaaacaaga

SEQ ID NO: 132382 - DNA, 23 bp, Artificial sequence
  SiRNA target sequence
taacttacttcgggaaacaagac

SEQ ID NO: 132383 - DNA, 23 bp, Artificial sequence
  SiRNA target sequence
aacttacttcgggaaacaagact

SEQ ID NO: 132384 - DNA, 23 bp, Artificial sequence
  SiRNA target sequence
acttacttcgggaaacaagactt

SEQ ID NO: 132385 - DNA, 23 bp, Artificial sequence
  SiRNA target sequence
cttacttcgggaaacaagacttg

SEQ ID NO: 132386 - DNA, 23 bp, Artificial sequence
  SiRNA target sequence
ttacttcgggaaacaagacttgc

SEQ ID NO: 132387 - DNA, 23 bp, Artificial sequence
  SiRNA target sequence
tacttcgggaaacaagacttgca

SEQ ID NO: 132388 - DNA, 23 bp, Artificial sequence
  SiRNA target sequence
acttcgggaaacaagacttgcaa

SEQ ID NO: 132389 - DNA, 23 bp, Artificial sequence
  SiRNA target sequence
cttcgggaaacaagacttgcaat

SEQ ID NO: 132390 - DNA, 23 bp, Artificial sequence
  SiRNA target sequence
ttcgggaaacaagacttgcaatg

SEQ ID NO: 132391 - DNA, 23 bp, Artificial sequence
  SiRNA target sequence
tcgggaaacaagacttgcaatgg

SEQ ID NO: 132392 - DNA, 23 bp, Artificial sequence
  SiRNA target sequence
cgggaaacaagacttgcaatgga

SEQ ID NO: 132393 - DNA, 23 bp, Artificial sequence
  SiRNA target sequence
gggaaacaagacttgcaatggaa

SEQ ID NO: 132394 - DNA, 23 bp, Artificial sequence
  SiRNA target sequence
ggaaacaagacttgcaatggaaa

SEQ ID NO: 132395 - DNA, 23 bp, Artificial sequence
  SiRNA target sequence
gaaacaagacttgcaatggaaac

SEQ ID NO: 132396 - DNA, 23 bp, Artificial sequence
  SiRNA target sequence
aaacaagacttgcaatggaaacc

SEQ ID NO: 132397 - DNA, 23 bp, Artificial sequence
  SiRNA target sequence
aacaagacttgcaatggaaacct

SEQ ID NO: 132398 - DNA, 23 bp, Artificial sequence
  SiRNA target sequence
acaagacttgcaatggaaaccta

SEQ ID NO: 132399 - DNA, 23 bp, Artificial sequence
  SiRNA target sequence
caagacttgcaatggaaacctaa

SEQ ID NO: 132400 - DNA, 23 bp, Artificial sequence
  SiRNA target sequence
aagacttgcaatggaaacctaaa

SEQ ID NO: 132401 - DNA, 23 bp, Artificial sequence
  SiRNA target sequence
agacttgcaatggaaacctaaaa

SEQ ID NO: 132402 - DNA, 23 bp, Artificial sequence
  SiRNA target sequence
gacttgcaatggaaacctaaaag

SEQ ID NO: 132403 - DNA, 23 bp, Artificial sequence
  SiRNA target sequence
acttgcaatggaaacctaaaagt

SEQ ID NO: 132404 - DNA, 23 bp, Artificial sequence
  SiRNA target sequence
cttgcaatggaaacctaaaagtc

SEQ ID NO: 132405 - DNA, 23 bp, Artificial sequence
  SiRNA target sequence
ttgcaatggaaacctaaaagtcg

SEQ ID NO: 132406 - DNA, 23 bp, Artificial sequence
  SiRNA target sequence
tgcaatggaaacctaaaagtcgg

SEQ ID NO: 132407 - DNA, 23 bp, Artificial sequence
  SiRNA target sequence
gcaatggaaacctaaaagtcggt

SEQ ID NO: 132408 - DNA, 23 bp, Artificial sequence
  SiRNA target sequence
caatggaaacctaaaagtcggtc

SEQ ID NO: 132409 - DNA, 23 bp, Artificial sequence
  SiRNA target sequence
aatggaaacctaaaagtcggtca

SEQ ID NO: 132410 - DNA, 23 bp, Artificial sequence
  SiRNA target sequence
atggaaacctaaaagtcggtcag

SEQ ID NO: 132411 - DNA, 23 bp, Artificial sequence
  SiRNA target sequence
tggaaacctaaaagtcggtcaga

SEQ ID NO: 132412 - DNA, 23 bp, Artificial sequence
  SiRNA target sequence
ggaaacctaaaagtcggtcagaa

SEQ ID NO: 132413 - DNA, 23 bp, Artificial sequence
  SiRNA target sequence
gaaacctaaaagtcggtcagaaa

SEQ ID NO: 132414 - DNA, 23 bp, Artificial sequence
  SiRNA target sequence
aaacctaaaagtcggtcagaaat

SEQ ID NO: 132415 - DNA, 23 bp, Artificial sequence
  SiRNA target sequence
aacctaaaagtcggtcagaaatt

SEQ ID NO: 132416 - DNA, 23 bp, Artificial sequence
  SiRNA target sequence
acctaaaagtcggtcagaaatta

SEQ ID NO: 132417 - DNA, 23 bp, Artificial sequence
  SiRNA target sequence
cctaaaagtcggtcagaaattat

SEQ ID NO: 132418 - DNA, 23 bp, Artificial sequence
  SiRNA target sequence
ctaaaagtcggtcagaaattatt

SEQ ID NO: 132419 - DNA, 23 bp, Artificial sequence
  SiRNA target sequence
taaaagtcggtcagaaattatta

SEQ ID NO: 132420 - DNA, 23 bp, Artificial sequence
  SiRNA target sequence
aaaagtcggtcagaaattattaa

SEQ ID NO: 132421 - DNA, 23 bp, Artificial sequence
  SiRNA target sequence
aaagtcggtcagaaattattaac

SEQ ID NO: 132422 - DNA, 23 bp, Artificial sequence
  SiRNA target sequence
aagtcggtcagaaattattaacg

SEQ ID NO: 132423 - DNA, 23 bp, Artificial sequence
  SiRNA target sequence
agtcggtcagaaattattaacga

SEQ ID NO: 132424 - DNA, 23 bp, Artificial sequence
  SiRNA target sequence
gtcggtcagaaattattaacgat

SEQ ID NO: 132425 - DNA, 23 bp, Artificial sequence
  SiRNA target sequence
tcggtcagaaattattaacgatt

SEQ ID NO: 132426 - DNA, 23 bp, Artificial sequence
  SiRNA target sequence
cggtcagaaattattaacgattt

SEQ ID NO: 132427 - DNA, 23 bp, Artificial sequence
  SiRNA target sequence
ggtcagaaattattaacgattta

SEQ ID NO: 132428 - DNA, 23 bp, Artificial sequence
  SiRNA target sequence
gtcagaaattattaacgatttaa

SEQ ID NO: 132429 - DNA, 23 bp, Artificial sequence
  SiRNA target sequence
tcagaaattattaacgatttaaa

SEQ ID NO: 132430 - DNA, 23 bp, Artificial sequence
  SiRNA target sequence
cagaaattattaacgatttaaaa

SEQ ID NO: 132431 - DNA, 23 bp, Artificial sequence
  SiRNA target sequence
agaaattattaacgatttaaaaa

SEQ ID NO: 132432 - DNA, 23 bp, Artificial sequence
  SiRNA target sequence
gaaattattaacgatttaaaaaa

SEQ ID NO: 132433 - DNA, 23 bp, Artificial sequence
  SiRNA target sequence
aaattattaacgatttaaaaaat

SEQ ID NO: 132434 - DNA, 23 bp, Artificial sequence
  SiRNA target sequence
aattattaacgatttaaaaaata

SEQ ID NO: 132435 - DNA, 23 bp, Artificial sequence
  SiRNA target sequence
attattaacgatttaaaaaatac

SEQ ID NO: 132436 - DNA, 23 bp, Artificial sequence
  SiRNA target sequence
ttattaacgatttaaaaaataca

SEQ ID NO: 132437 - DNA, 23 bp, Artificial sequence
  SiRNA target sequence
tattaacgatttaaaaaatacaa

SEQ ID NO: 132438 - DNA, 23 bp, Artificial sequence
  SiRNA target sequence
attaacgatttaaaaaatacaaa

SEQ ID NO: 132439 - DNA, 23 bp, Artificial sequence
  SiRNA target sequence
ttaacgatttaaaaaatacaaac

SEQ ID NO: 132440 - DNA, 23 bp, Artificial sequence
  SiRNA target sequence
taacgatttaaaaaatacaaact

SEQ ID NO: 132441 - DNA, 23 bp, Artificial sequence
  SiRNA target sequence
aacgatttaaaaaatacaaactt

SEQ ID NO: 132442 - DNA, 23 bp, Artificial sequence
  SiRNA target sequence
acgatttaaaaaatacaaacttt

SEQ ID NO: 132443 - DNA, 23 bp, Artificial sequence
  SiRNA target sequence
cgatttaaaaaatacaaactttg

SEQ ID NO: 132444 - DNA, 23 bp, Artificial sequence
  SiRNA target sequence
gatttaaaaaatacaaactttga

SEQ ID NO: 132445 - DNA, 23 bp, Artificial sequence
  SiRNA target sequence
atttaaaaaatacaaactttgac

SEQ ID NO: 132446 - DNA, 23 bp, Artificial sequence
  SiRNA target sequence
tttaaaaaatacaaactttgaca

SEQ ID NO: 132447 - DNA, 23 bp, Artificial sequence
  SiRNA target sequence
ttaaaaaatacaaactttgacat

SEQ ID NO: 132448 - DNA, 23 bp, Artificial sequence
  SiRNA target sequence
taaaaaatacaaactttgacata

SEQ ID NO: 132449 - DNA, 23 bp, Artificial sequence
  SiRNA target sequence
aaaaaatacaaactttgacatat

SEQ ID NO: 132450 - DNA, 23 bp, Artificial sequence
  SiRNA target sequence
aaaaatacaaactttgacatatt

SEQ ID NO: 132451 - DNA, 23 bp, Artificial sequence
  SiRNA target sequence
aaaatacaaactttgacatattg

SEQ ID NO: 132452 - DNA, 23 bp, Artificial sequence
  SiRNA target sequence
aaatacaaactttgacatattga

SEQ ID NO: 132453 - DNA, 23 bp, Artificial sequence
  SiRNA target sequence
aatacaaactttgacatattgat

SEQ ID NO: 132454 - DNA, 23 bp, Artificial sequence
  SiRNA target sequence
atacaaactttgacatattgatt

SEQ ID NO: 132455 - DNA, 23 bp, Artificial sequence
  SiRNA target sequence
tacaaactttgacatattgatta

SEQ ID NO: 132456 - DNA, 23 bp, Artificial sequence
  SiRNA target sequence
acaaactttgacatattgattat

SEQ ID NO: 132457 - DNA, 23 bp, Artificial sequence
  SiRNA target sequence
caaactttgacatattgattatt

SEQ ID NO: 132458 - DNA, 23 bp, Artificial sequence
  SiRNA target sequence
aaactttgacatattgattattg

SEQ ID NO: 132459 - DNA, 23 bp, Artificial sequence
  SiRNA target sequence
aactttgacatattgattattgg

SEQ ID NO: 132460 - DNA, 23 bp, Artificial sequence
  SiRNA target sequence
actttgacatattgattattggt

SEQ ID NO: 132461 - DNA, 23 bp, Artificial sequence
  SiRNA target sequence
ctttgacatattgattattggtg

SEQ ID NO: 132462 - DNA, 23 bp, Artificial sequence
  SiRNA target sequence
tttgacatattgattattggtgg

SEQ ID NO: 132463 - DNA, 23 bp, Artificial sequence
  SiRNA target sequence
ttgacatattgattattggtggc

SEQ ID NO: 132464 - DNA, 23 bp, Artificial sequence
  SiRNA target sequence
tgacatattgattattggtggcg

SEQ ID NO: 132465 - DNA, 23 bp, Artificial sequence
  SiRNA target sequence
gacatattgattattggtggcgg

SEQ ID NO: 132466 - DNA, 23 bp, Artificial sequence
  SiRNA target sequence
acatattgattattggtggcggt

SEQ ID NO: 132467 - DNA, 23 bp, Artificial sequence
  SiRNA target sequence
catattgattattggtggcggtt

SEQ ID NO: 132468 - DNA, 23 bp, Artificial sequence
  SiRNA target sequence
atattgattattggtggcggttc

SEQ ID NO: 132469 - DNA, 23 bp, Artificial sequence
  SiRNA target sequence
tattgattattggtggcggttca

SEQ ID NO: 132470 - DNA, 23 bp, Artificial sequence
  SiRNA target sequence
attgattattggtggcggttcaa

SEQ ID NO: 132471 - DNA, 23 bp, Artificial sequence
  SiRNA target sequence
ttgattattggtggcggttcaac

SEQ ID NO: 132472 - DNA, 23 bp, Artificial sequence
  SiRNA target sequence
tgattattggtggcggttcaacg

SEQ ID NO: 132473 - DNA, 23 bp, Artificial sequence
  SiRNA target sequence
gattattggtggcggttcaacgg

SEQ ID NO: 132474 - DNA, 23 bp, Artificial sequence
  SiRNA target sequence
attattggtggcggttcaacggg

SEQ ID NO: 132475 - DNA, 23 bp, Artificial sequence
  SiRNA target sequence
ttattggtggcggttcaacggga

SEQ ID NO: 132476 - DNA, 23 bp, Artificial sequence
  SiRNA target sequence
tattggtggcggttcaacgggaa

SEQ ID NO: 132477 - DNA, 23 bp, Artificial sequence
  SiRNA target sequence
attggtggcggttcaacgggaat

SEQ ID NO: 132478 - DNA, 23 bp, Artificial sequence
  SiRNA target sequence
ttggtggcggttcaacgggaatg

SEQ ID NO: 132479 - DNA, 23 bp, Artificial sequence
  SiRNA target sequence
tggtggcggttcaacgggaatgg

SEQ ID NO: 132480 - DNA, 23 bp, Artificial sequence
  SiRNA target sequence
ggtggcggttcaacgggaatggg

SEQ ID NO: 132481 - DNA, 23 bp, Artificial sequence
  SiRNA target sequence
gtggcggttcaacgggaatggga

SEQ ID NO: 132482 - DNA, 23 bp, Artificial sequence
  SiRNA target sequence
tggcggttcaacgggaatgggat

SEQ ID NO: 132483 - DNA, 23 bp, Artificial sequence
  SiRNA target sequence
ggcggttcaacgggaatgggatg

SEQ ID NO: 132484 - DNA, 23 bp, Artificial sequence
  SiRNA target sequence
gcggttcaacgggaatgggatgt

SEQ ID NO: 132485 - DNA, 23 bp, Artificial sequence
  SiRNA target sequence
cggttcaacgggaatgggatgtg

SEQ ID NO: 132486 - DNA, 23 bp, Artificial sequence
  SiRNA target sequence
ggttcaacgggaatgggatgtgc

SEQ ID NO: 132487 - DNA, 23 bp, Artificial sequence
  SiRNA target sequence
gttcaacgggaatgggatgtgca

SEQ ID NO: 132488 - DNA, 23 bp, Artificial sequence
  SiRNA target sequence
ttcaacgggaatgggatgtgcaa

SEQ ID NO: 132489 - DNA, 23 bp, Artificial sequence
  SiRNA target sequence
tcaacgggaatgggatgtgcaat

SEQ ID NO: 132490 - DNA, 23 bp, Artificial sequence
  SiRNA target sequence
caacgggaatgggatgtgcaatc

SEQ ID NO: 132491 - DNA, 23 bp, Artificial sequence
  SiRNA target sequence
aacgggaatgggatgtgcaatcg

SEQ ID NO: 132492 - DNA, 23 bp, Artificial sequence
  SiRNA target sequence
acgggaatgggatgtgcaatcga

SEQ ID NO: 132493 - DNA, 23 bp, Artificial sequence
  SiRNA target sequence
cgggaatgggatgtgcaatcgaa

SEQ ID NO: 132494 - DNA, 23 bp, Artificial sequence
  SiRNA target sequence
gggaatgggatgtgcaatcgaag

SEQ ID NO: 132495 - DNA, 23 bp, Artificial sequence
  SiRNA target sequence
ggaatgggatgtgcaatcgaagc

SEQ ID NO: 132496 - DNA, 23 bp, Artificial sequence
  SiRNA target sequence
gaatgggatgtgcaatcgaagca

SEQ ID NO: 132497 - DNA, 23 bp, Artificial sequence
  SiRNA target sequence
aatgggatgtgcaatcgaagcag

SEQ ID NO: 132498 - DNA, 23 bp, Artificial sequence
  SiRNA target sequence
atgggatgtgcaatcgaagcagc

SEQ ID NO: 132499 - DNA, 23 bp, Artificial sequence
  SiRNA target sequence
tgggatgtgcaatcgaagcagct

SEQ ID NO: 132500 - DNA, 23 bp, Artificial sequence
  SiRNA target sequence
gggatgtgcaatcgaagcagcta

SEQ ID NO: 132501 - DNA, 23 bp, Artificial sequence
  SiRNA target sequence
ggatgtgcaatcgaagcagctac

SEQ ID NO: 132502 - DNA, 23 bp, Artificial sequence
  SiRNA target sequence
gatgtgcaatcgaagcagctaca

SEQ ID NO: 132503 - DNA, 23 bp, Artificial sequence
  SiRNA target sequence
atgtgcaatcgaagcagctacac

SEQ ID NO: 132504 - DNA, 23 bp, Artificial sequence
  SiRNA target sequence
tgtgcaatcgaagcagctacacg

SEQ ID NO: 132505 - DNA, 23 bp, Artificial sequence
  SiRNA target sequence
gtgcaatcgaagcagctacacga

SEQ ID NO: 132506 - DNA, 23 bp, Artificial sequence
  SiRNA target sequence
tgcaatcgaagcagctacacgag

SEQ ID NO: 132507 - DNA, 23 bp, Artificial sequence
  SiRNA target sequence
gcaatcgaagcagctacacgagg

SEQ ID NO: 132508 - DNA, 23 bp, Artificial sequence
  SiRNA target sequence
caatcgaagcagctacacgaggt

SEQ ID NO: 132509 - DNA, 23 bp, Artificial sequence
  SiRNA target sequence
aatcgaagcagctacacgaggta

SEQ ID NO: 132510 - DNA, 23 bp, Artificial sequence
  SiRNA target sequence
atcgaagcagctacacgaggtat

SEQ ID NO: 132511 - DNA, 23 bp, Artificial sequence
  SiRNA target sequence
tcgaagcagctacacgaggtata

SEQ ID NO: 132512 - DNA, 23 bp, Artificial sequence
  SiRNA target sequence
cgaagcagctacacgaggtataa

SEQ ID NO: 132513 - DNA, 23 bp, Artificial sequence
  SiRNA target sequence
gaagcagctacacgaggtataag

SEQ ID NO: 132514 - DNA, 23 bp, Artificial sequence
  SiRNA target sequence
aagcagctacacgaggtataagt

SEQ ID NO: 132515 - DNA, 23 bp, Artificial sequence
  SiRNA target sequence
agcagctacacgaggtataagtg

SEQ ID NO: 132516 - DNA, 23 bp, Artificial sequence
  SiRNA target sequence
gcagctacacgaggtataagtgt

SEQ ID NO: 132517 - DNA, 23 bp, Artificial sequence
  SiRNA target sequence
cagctacacgaggtataagtgtt

SEQ ID NO: 132518 - DNA, 23 bp, Artificial sequence
  SiRNA target sequence
agctacacgaggtataagtgttg

SEQ ID NO: 132519 - DNA, 23 bp, Artificial sequence
  SiRNA target sequence
gctacacgaggtataagtgttgg

SEQ ID NO: 132520 - DNA, 23 bp, Artificial sequence
  SiRNA target sequence
ctacacgaggtataagtgttggc

SEQ ID NO: 132521 - DNA, 23 bp, Artificial sequence
  SiRNA target sequence
tacacgaggtataagtgttggcc

SEQ ID NO: 132522 - DNA, 23 bp, Artificial sequence
  SiRNA target sequence
acacgaggtataagtgttggcct

SEQ ID NO: 132523 - DNA, 23 bp, Artificial sequence
  SiRNA target sequence
cacgaggtataagtgttggcctg

SEQ ID NO: 132524 - DNA, 23 bp, Artificial sequence
  SiRNA target sequence
acgaggtataagtgttggcctga

SEQ ID NO: 132525 - DNA, 23 bp, Artificial sequence
  SiRNA target sequence
cgaggtataagtgttggcctgat

SEQ ID NO: 132526 - DNA, 23 bp, Artificial sequence
  SiRNA target sequence
gaggtataagtgttggcctgata

SEQ ID NO: 132527 - DNA, 23 bp, Artificial sequence
  SiRNA target sequence
aggtataagtgttggcctgatag

SEQ ID NO: 132528 - DNA, 23 bp, Artificial sequence
  SiRNA target sequence
ggtataagtgttggcctgataga

SEQ ID NO: 132529 - DNA, 23 bp, Artificial sequence
  SiRNA target sequence
gtataagtgttggcctgatagaa

SEQ ID NO: 132530 - DNA, 23 bp, Artificial sequence
  SiRNA target sequence
tataagtgttggcctgatagaag

SEQ ID NO: 132531 - DNA, 23 bp, Artificial sequence
  SiRNA target sequence
ataagtgttggcctgatagaagc

SEQ ID NO: 132532 - DNA, 23 bp, Artificial sequence
  SiRNA target sequence
taagtgttggcctgatagaagca

SEQ ID NO: 132533 - DNA, 23 bp, Artificial sequence
  SiRNA target sequence
aagtgttggcctgatagaagcac

SEQ ID NO: 132534 - DNA, 23 bp, Artificial sequence
  SiRNA target sequence
agtgttggcctgatagaagcaca

SEQ ID NO: 132535 - DNA, 23 bp, Artificial sequence
  SiRNA target sequence
gtgttggcctgatagaagcacat

SEQ ID NO: 132536 - DNA, 23 bp, Artificial sequence
  SiRNA target sequence
tgttggcctgatagaagcacatg

SEQ ID NO: 132537 - DNA, 23 bp, Artificial sequence
  SiRNA target sequence
gttggcctgatagaagcacatga

SEQ ID NO: 132538 - DNA, 23 bp, Artificial sequence
  SiRNA target sequence
ttggcctgatagaagcacatgat

SEQ ID NO: 132539 - DNA, 23 bp, Artificial sequence
  SiRNA target sequence
tggcctgatagaagcacatgatt

SEQ ID NO: 132540 - DNA, 23 bp, Artificial sequence
  SiRNA target sequence
ggcctgatagaagcacatgattt

SEQ ID NO: 132541 - DNA, 23 bp, Artificial sequence
  SiRNA target sequence
gcctgatagaagcacatgatttt

SEQ ID NO: 132542 - DNA, 23 bp, Artificial sequence
  SiRNA target sequence
cctgatagaagcacatgattttg

SEQ ID NO: 132543 - DNA, 23 bp, Artificial sequence
  SiRNA target sequence
ctgatagaagcacatgattttgg

SEQ ID NO: 132544 - DNA, 23 bp, Artificial sequence
  SiRNA target sequence
tgatagaagcacatgattttggt

SEQ ID NO: 132545 - DNA, 23 bp, Artificial sequence
  SiRNA target sequence
gatagaagcacatgattttggtt

SEQ ID NO: 132546 - DNA, 23 bp, Artificial sequence
  SiRNA target sequence
atagaagcacatgattttggttc

SEQ ID NO: 132547 - DNA, 23 bp, Artificial sequence
  SiRNA target sequence
tagaagcacatgattttggttcg

SEQ ID NO: 132548 - DNA, 23 bp, Artificial sequence
  SiRNA target sequence
agaagcacatgattttggttcgg

SEQ ID NO: 132549 - DNA, 23 bp, Artificial sequence
  SiRNA target sequence
gaagcacatgattttggttcggg

SEQ ID NO: 132550 - DNA, 23 bp, Artificial sequence
  SiRNA target sequence
aagcacatgattttggttcgggc

SEQ ID NO: 132551 - DNA, 23 bp, Artificial sequence
  SiRNA target sequence
agcacatgattttggttcgggca

SEQ ID NO: 132552 - DNA, 23 bp, Artificial sequence
  SiRNA target sequence
gcacatgattttggttcgggcac

SEQ ID NO: 132553 - DNA, 23 bp, Artificial sequence
  SiRNA target sequence
cacatgattttggttcgggcacg

SEQ ID NO: 132554 - DNA, 23 bp, Artificial sequence
  SiRNA target sequence
acatgattttggttcgggcacga

SEQ ID NO: 132555 - DNA, 23 bp, Artificial sequence
  SiRNA target sequence
catgattttggttcgggcacgag

SEQ ID NO: 132556 - DNA, 23 bp, Artificial sequence
  SiRNA target sequence
atgattttggttcgggcacgagt

SEQ ID NO: 132557 - DNA, 23 bp, Artificial sequence
  SiRNA target sequence
tgattttggttcgggcacgagtt

SEQ ID NO: 132558 - DNA, 23 bp, Artificial sequence
  SiRNA target sequence
gattttggttcgggcacgagttc

SEQ ID NO: 132559 - DNA, 23 bp, Artificial sequence
  SiRNA target sequence
attttggttcgggcacgagttca

SEQ ID NO: 132560 - DNA, 23 bp, Artificial sequence
  SiRNA target sequence
ttttggttcgggcacgagttcaa

SEQ ID NO: 132561 - DNA, 23 bp, Artificial sequence
  SiRNA target sequence
tttggttcgggcacgagttcaaa

SEQ ID NO: 132562 - DNA, 23 bp, Artificial sequence
  SiRNA target sequence
ttggttcgggcacgagttcaaaa

SEQ ID NO: 132563 - DNA, 23 bp, Artificial sequence
  SiRNA target sequence
tggttcgggcacgagttcaaaat

SEQ ID NO: 132564 - DNA, 23 bp, Artificial sequence
  SiRNA target sequence
ggttcgggcacgagttcaaaatc

SEQ ID NO: 132565 - DNA, 23 bp, Artificial sequence
  SiRNA target sequence
gttcgggcacgagttcaaaatct

SEQ ID NO: 132566 - DNA, 23 bp, Artificial sequence
  SiRNA target sequence
ttcgggcacgagttcaaaatcta

SEQ ID NO: 132567 - DNA, 23 bp, Artificial sequence
  SiRNA target sequence
tcgggcacgagttcaaaatctac

SEQ ID NO: 132568 - DNA, 23 bp, Artificial sequence
  SiRNA target sequence
cgggcacgagttcaaaatctaca

SEQ ID NO: 132569 - DNA, 23 bp, Artificial sequence
  SiRNA target sequence
gggcacgagttcaaaatctacaa

SEQ ID NO: 132570 - DNA, 23 bp, Artificial sequence
  SiRNA target sequence
ggcacgagttcaaaatctacaaa

SEQ ID NO: 132571 - DNA, 23 bp, Artificial sequence
  SiRNA target sequence
gcacgagttcaaaatctacaaaa

SEQ ID NO: 132572 - DNA, 23 bp, Artificial sequence
  SiRNA target sequence
cacgagttcaaaatctacaaaac

SEQ ID NO: 132573 - DNA, 23 bp, Artificial sequence
  SiRNA target sequence
acgagttcaaaatctacaaaact

SEQ ID NO: 132574 - DNA, 23 bp, Artificial sequence
  SiRNA target sequence
cgagttcaaaatctacaaaactt

SEQ ID NO: 132575 - DNA, 23 bp, Artificial sequence
  SiRNA target sequence
gagttcaaaatctacaaaacttt

SEQ ID NO: 132576 - DNA, 23 bp, Artificial sequence
  SiRNA target sequence
agttcaaaatctacaaaactttt

SEQ ID NO: 132577 - DNA, 23 bp, Artificial sequence
  SiRNA target sequence
gttcaaaatctacaaaacttttt

SEQ ID NO: 132578 - DNA, 23 bp, Artificial sequence
  SiRNA target sequence
ttcaaaatctacaaaactttttc

SEQ ID NO: 132579 - DNA, 23 bp, Artificial sequence
  SiRNA target sequence
tcaaaatctacaaaactttttca

SEQ ID NO: 132580 - DNA, 23 bp, Artificial sequence
  SiRNA target sequence
caaaatctacaaaactttttcat

SEQ ID NO: 132581 - DNA, 23 bp, Artificial sequence
  SiRNA target sequence
aaaatctacaaaactttttcatg

SEQ ID NO: 132582 - DNA, 23 bp, Artificial sequence
  SiRNA target sequence
aaatctacaaaactttttcatgg

SEQ ID NO: 132583 - DNA, 23 bp, Artificial sequence
  SiRNA target sequence
aatctacaaaactttttcatggc

SEQ ID NO: 132584 - DNA, 23 bp, Artificial sequence
  SiRNA target sequence
atctacaaaactttttcatggcg

SEQ ID NO: 132585 - DNA, 23 bp, Artificial sequence
  SiRNA target sequence
tctacaaaactttttcatggcgg

SEQ ID NO: 132586 - DNA, 23 bp, Artificial sequence
  SiRNA target sequence
ctacaaaactttttcatggcggt

SEQ ID NO: 132587 - DNA, 23 bp, Artificial sequence
  SiRNA target sequence
tacaaaactttttcatggcggtg

SEQ ID NO: 132588 - DNA, 23 bp, Artificial sequence
  SiRNA target sequence
acaaaactttttcatggcggtgt

SEQ ID NO: 132589 - DNA, 23 bp, Artificial sequence
  SiRNA target sequence
caaaactttttcatggcggtgta

SEQ ID NO: 132590 - DNA, 23 bp, Artificial sequence
  SiRNA target sequence
aaaactttttcatggcggtgtac

SEQ ID NO: 132591 - DNA, 23 bp, Artificial sequence
  SiRNA target sequence
aaactttttcatggcggtgtacg

SEQ ID NO: 132592 - DNA, 23 bp, Artificial sequence
  SiRNA target sequence
aactttttcatggcggtgtacgc

SEQ ID NO: 132593 - DNA, 23 bp, Artificial sequence
  SiRNA target sequence
actttttcatggcggtgtacgct

SEQ ID NO: 132594 - DNA, 23 bp, Artificial sequence
  SiRNA target sequence
ctttttcatggcggtgtacgcta

SEQ ID NO: 132595 - DNA, 23 bp, Artificial sequence
  SiRNA target sequence
tttttcatggcggtgtacgctac

SEQ ID NO: 132596 - DNA, 23 bp, Artificial sequence
  SiRNA target sequence
ttttcatggcggtgtacgctacc

SEQ ID NO: 132597 - DNA, 23 bp, Artificial sequence
  SiRNA target sequence
tttcatggcggtgtacgctacct

SEQ ID NO: 132598 - DNA, 23 bp, Artificial sequence
  SiRNA target sequence
ttcatggcggtgtacgctacctt

SEQ ID NO: 132599 - DNA, 23 bp, Artificial sequence
  SiRNA target sequence
tcatggcggtgtacgctaccttg

SEQ ID NO: 132600 - DNA, 23 bp, Artificial sequence
  SiRNA target sequence
catggcggtgtacgctaccttga

SEQ ID NO: 132601 - DNA, 23 bp, Artificial sequence
  SiRNA target sequence
atggcggtgtacgctaccttgaa

SEQ ID NO: 132602 - DNA, 23 bp, Artificial sequence
  SiRNA target sequence
tggcggtgtacgctaccttgaaa

SEQ ID NO: 132603 - DNA, 23 bp, Artificial sequence
  SiRNA target sequence
ggcggtgtacgctaccttgaaaa

SEQ ID NO: 132604 - DNA, 23 bp, Artificial sequence
  SiRNA target sequence
gcggtgtacgctaccttgaaaaa

SEQ ID NO: 132605 - DNA, 23 bp, Artificial sequence
  SiRNA target sequence
cggtgtacgctaccttgaaaaag

SEQ ID NO: 132606 - DNA, 23 bp, Artificial sequence
  SiRNA target sequence
ggtgtacgctaccttgaaaaagc

SEQ ID NO: 132607 - DNA, 23 bp, Artificial sequence
  SiRNA target sequence
gtgtacgctaccttgaaaaagct

SEQ ID NO: 132608 - DNA, 23 bp, Artificial sequence
  SiRNA target sequence
tgtacgctaccttgaaaaagctg

SEQ ID NO: 132609 - DNA, 23 bp, Artificial sequence
  SiRNA target sequence
gtacgctaccttgaaaaagctgt

SEQ ID NO: 132610 - DNA, 23 bp, Artificial sequence
  SiRNA target sequence
tacgctaccttgaaaaagctgtt

SEQ ID NO: 132611 - DNA, 23 bp, Artificial sequence
  SiRNA target sequence
acgctaccttgaaaaagctgtta

SEQ ID NO: 132612 - DNA, 23 bp, Artificial sequence
  SiRNA target sequence
cgctaccttgaaaaagctgttaa

SEQ ID NO: 132613 - DNA, 23 bp, Artificial sequence
  SiRNA target sequence
gctaccttgaaaaagctgttaat

SEQ ID NO: 132614 - DNA, 23 bp, Artificial sequence
  SiRNA target sequence
ctaccttgaaaaagctgttaatg

SEQ ID NO: 132615 - DNA, 23 bp, Artificial sequence
  SiRNA target sequence
taccttgaaaaagctgttaatga

SEQ ID NO: 132616 - DNA, 23 bp, Artificial sequence
  SiRNA target sequence
accttgaaaaagctgttaatgat

SEQ ID NO: 132617 - DNA, 23 bp, Artificial sequence
  SiRNA target sequence
ccttgaaaaagctgttaatgatt

SEQ ID NO: 132618 - DNA, 23 bp, Artificial sequence
  SiRNA target sequence
cttgaaaaagctgttaatgattt

SEQ ID NO: 132619 - DNA, 23 bp, Artificial sequence
  SiRNA target sequence
ttgaaaaagctgttaatgattta

SEQ ID NO: 132620 - DNA, 23 bp, Artificial sequence
  SiRNA target sequence
tgaaaaagctgttaatgatttag

SEQ ID NO: 132621 - DNA, 23 bp, Artificial sequence
  SiRNA target sequence
gaaaaagctgttaatgatttaga

SEQ ID NO: 132622 - DNA, 23 bp, Artificial sequence
  SiRNA target sequence
aaaaagctgttaatgatttagat

SEQ ID NO: 132623 - DNA, 23 bp, Artificial sequence
  SiRNA target sequence
aaaagctgttaatgatttagata

SEQ ID NO: 132624 - DNA, 23 bp, Artificial sequence
  SiRNA target sequence
aaagctgttaatgatttagatag

SEQ ID NO: 132625 - DNA, 23 bp, Artificial sequence
  SiRNA target sequence
aagctgttaatgatttagataga

SEQ ID NO: 132626 - DNA, 23 bp, Artificial sequence
  SiRNA target sequence
agctgttaatgatttagatagat

SEQ ID NO: 132627 - DNA, 23 bp, Artificial sequence
  SiRNA target sequence
gctgttaatgatttagatagatc

SEQ ID NO: 132628 - DNA, 23 bp, Artificial sequence
  SiRNA target sequence
ctgttaatgatttagatagatct

SEQ ID NO: 132629 - DNA, 23 bp, Artificial sequence
  SiRNA target sequence
tgttaatgatttagatagatctc

SEQ ID NO: 132630 - DNA, 23 bp, Artificial sequence
  SiRNA target sequence
gttaatgatttagatagatctca

SEQ ID NO: 132631 - DNA, 23 bp, Artificial sequence
  SiRNA target sequence
ttaatgatttagatagatctcag

SEQ ID NO: 132632 - DNA, 23 bp, Artificial sequence
  SiRNA target sequence
taatgatttagatagatctcagt

SEQ ID NO: 132633 - DNA, 23 bp, Artificial sequence
  SiRNA target sequence
aatgatttagatagatctcagtt

SEQ ID NO: 132634 - DNA, 23 bp, Artificial sequence
  SiRNA target sequence
atgatttagatagatctcagttt

SEQ ID NO: 132635 - DNA, 23 bp, Artificial sequence
  SiRNA target sequence
tgatttagatagatctcagtttg

SEQ ID NO: 132636 - DNA, 23 bp, Artificial sequence
  SiRNA target sequence
gatttagatagatctcagtttga

SEQ ID NO: 132637 - DNA, 23 bp, Artificial sequence
  SiRNA target sequence
atttagatagatctcagtttgac

SEQ ID NO: 132638 - DNA, 23 bp, Artificial sequence
  SiRNA target sequence
tttagatagatctcagtttgact

SEQ ID NO: 132639 - DNA, 23 bp, Artificial sequence
  SiRNA target sequence
ttagatagatctcagtttgactt

SEQ ID NO: 132640 - DNA, 23 bp, Artificial sequence
  SiRNA target sequence
tagatagatctcagtttgacttg

SEQ ID NO: 132641 - DNA, 23 bp, Artificial sequence
  SiRNA target sequence
agatagatctcagtttgacttgg

SEQ ID NO: 132642 - DNA, 23 bp, Artificial sequence
  SiRNA target sequence
gatagatctcagtttgacttggt

SEQ ID NO: 132643 - DNA, 23 bp, Artificial sequence
  SiRNA target sequence
atagatctcagtttgacttggta

SEQ ID NO: 132644 - DNA, 23 bp, Artificial sequence
  SiRNA target sequence
tagatctcagtttgacttggtat

SEQ ID NO: 132645 - DNA, 23 bp, Artificial sequence
  SiRNA target sequence
agatctcagtttgacttggtatc

SEQ ID NO: 132646 - DNA, 23 bp, Artificial sequence
  SiRNA target sequence
gatctcagtttgacttggtatct

SEQ ID NO: 132647 - DNA, 23 bp, Artificial sequence
  SiRNA target sequence
atctcagtttgacttggtatctg

SEQ ID NO: 132648 - DNA, 23 bp, Artificial sequence
  SiRNA target sequence
tctcagtttgacttggtatctga

SEQ ID NO: 132649 - DNA, 23 bp, Artificial sequence
  SiRNA target sequence
ctcagtttgacttggtatctgaa

SEQ ID NO: 132650 - DNA, 23 bp, Artificial sequence
  SiRNA target sequence
tcagtttgacttggtatctgaag

SEQ ID NO: 132651 - DNA, 23 bp, Artificial sequence
  SiRNA target sequence
cagtttgacttggtatctgaagc

SEQ ID NO: 132652 - DNA, 23 bp, Artificial sequence
  SiRNA target sequence
agtttgacttggtatctgaagca

SEQ ID NO: 132653 - DNA, 23 bp, Artificial sequence
  SiRNA target sequence
gtttgacttggtatctgaagcat

SEQ ID NO: 132654 - DNA, 23 bp, Artificial sequence
  SiRNA target sequence
tttgacttggtatctgaagcatt

SEQ ID NO: 132655 - DNA, 23 bp, Artificial sequence
  SiRNA target sequence
ttgacttggtatctgaagcatta

SEQ ID NO: 132656 - DNA, 23 bp, Artificial sequence
  SiRNA target sequence
tgacttggtatctgaagcattaa

SEQ ID NO: 132657 - DNA, 23 bp, Artificial sequence
  SiRNA target sequence
gacttggtatctgaagcattaag

SEQ ID NO: 132658 - DNA, 23 bp, Artificial sequence
  SiRNA target sequence
acttggtatctgaagcattaagt

SEQ ID NO: 132659 - DNA, 23 bp, Artificial sequence
  SiRNA target sequence
cttggtatctgaagcattaagtg

SEQ ID NO: 132660 - DNA, 23 bp, Artificial sequence
  SiRNA target sequence
ttggtatctgaagcattaagtga

SEQ ID NO: 132661 - DNA, 23 bp, Artificial sequence
  SiRNA target sequence
tggtatctgaagcattaagtgaa

SEQ ID NO: 132662 - DNA, 23 bp, Artificial sequence
  SiRNA target sequence
ggtatctgaagcattaagtgaac

SEQ ID NO: 132663 - DNA, 23 bp, Artificial sequence
  SiRNA target sequence
gtatctgaagcattaagtgaacg

SEQ ID NO: 132664 - DNA, 23 bp, Artificial sequence
  SiRNA target sequence
tatctgaagcattaagtgaacga

SEQ ID NO: 132665 - DNA, 23 bp, Artificial sequence
  SiRNA target sequence
atctgaagcattaagtgaacgaa

SEQ ID NO: 132666 - DNA, 23 bp, Artificial sequence
  SiRNA target sequence
tctgaagcattaagtgaacgaaa

SEQ ID NO: 132667 - DNA, 23 bp, Artificial sequence
  SiRNA target sequence
ctgaagcattaagtgaacgaaaa

SEQ ID NO: 132668 - DNA, 23 bp, Artificial sequence
  SiRNA target sequence
tgaagcattaagtgaacgaaaaa

SEQ ID NO: 132669 - DNA, 23 bp, Artificial sequence
  SiRNA target sequence
gaagcattaagtgaacgaaaaat

SEQ ID NO: 132670 - DNA, 23 bp, Artificial sequence
  SiRNA target sequence
aagcattaagtgaacgaaaaatt

SEQ ID NO: 132671 - DNA, 23 bp, Artificial sequence
  SiRNA target sequence
agcattaagtgaacgaaaaattg

SEQ ID NO: 132672 - DNA, 23 bp, Artificial sequence
  SiRNA target sequence
gcattaagtgaacgaaaaattgt

SEQ ID NO: 132673 - DNA, 23 bp, Artificial sequence
  SiRNA target sequence
cattaagtgaacgaaaaattgtt

SEQ ID NO: 132674 - DNA, 23 bp, Artificial sequence
  SiRNA target sequence
attaagtgaacgaaaaattgtta

SEQ ID NO: 132675 - DNA, 23 bp, Artificial sequence
  SiRNA target sequence
ttaagtgaacgaaaaattgttat

SEQ ID NO: 132676 - DNA, 23 bp, Artificial sequence
  SiRNA target sequence
taagtgaacgaaaaattgttatg

SEQ ID NO: 132677 - DNA, 23 bp, Artificial sequence
  SiRNA target sequence
aagtgaacgaaaaattgttatga

SEQ ID NO: 132678 - DNA, 23 bp, Artificial sequence
  SiRNA target sequence
agtgaacgaaaaattgttatgaa

SEQ ID NO: 132679 - DNA, 23 bp, Artificial sequence
  SiRNA target sequence
gtgaacgaaaaattgttatgaat

SEQ ID NO: 132680 - DNA, 23 bp, Artificial sequence
  SiRNA target sequence
tgaacgaaaaattgttatgaata

SEQ ID NO: 132681 - DNA, 23 bp, Artificial sequence
  SiRNA target sequence
gaacgaaaaattgttatgaatat

SEQ ID NO: 132682 - DNA, 23 bp, Artificial sequence
  SiRNA target sequence
aacgaaaaattgttatgaatatg

SEQ ID NO: 132683 - DNA, 23 bp, Artificial sequence
  SiRNA target sequence
acgaaaaattgttatgaatatgt

SEQ ID NO: 132684 - DNA, 23 bp, Artificial sequence
  SiRNA target sequence
cgaaaaattgttatgaatatgtg

SEQ ID NO: 132685 - DNA, 23 bp, Artificial sequence
  SiRNA target sequence
gaaaaattgttatgaatatgtgt

SEQ ID NO: 132686 - DNA, 23 bp, Artificial sequence
  SiRNA target sequence
aaaaattgttatgaatatgtgtc

SEQ ID NO: 132687 - DNA, 23 bp, Artificial sequence
  SiRNA target sequence
aaaattgttatgaatatgtgtcc

SEQ ID NO: 132688 - DNA, 23 bp, Artificial sequence
  SiRNA target sequence
aaattgttatgaatatgtgtcct

SEQ ID NO: 132689 - DNA, 23 bp, Artificial sequence
  SiRNA target sequence
aattgttatgaatatgtgtcctt

SEQ ID NO: 132690 - DNA, 23 bp, Artificial sequence
  SiRNA target sequence
attgttatgaatatgtgtccttt

SEQ ID NO: 132691 - DNA, 23 bp, Artificial sequence
  SiRNA target sequence
ttgttatgaatatgtgtcctttt

SEQ ID NO: 132692 - DNA, 23 bp, Artificial sequence
  SiRNA target sequence
tgttatgaatatgtgtccttttc

SEQ ID NO: 132693 - DNA, 23 bp, Artificial sequence
  SiRNA target sequence
gttatgaatatgtgtccttttct

SEQ ID NO: 132694 - DNA, 23 bp, Artificial sequence
  SiRNA target sequence
ttatgaatatgtgtccttttcta

SEQ ID NO: 132695 - DNA, 23 bp, Artificial sequence
  SiRNA target sequence
tatgaatatgtgtccttttctag

SEQ ID NO: 132696 - DNA, 23 bp, Artificial sequence
  SiRNA target sequence
atgaatatgtgtccttttctagt

SEQ ID NO: 132697 - DNA, 23 bp, Artificial sequence
  SiRNA target sequence
tgaatatgtgtccttttctagta

SEQ ID NO: 132698 - DNA, 23 bp, Artificial sequence
  SiRNA target sequence
gaatatgtgtccttttctagtaa

SEQ ID NO: 132699 - DNA, 23 bp, Artificial sequence
  SiRNA target sequence
aatatgtgtccttttctagtaag

SEQ ID NO: 132700 - DNA, 23 bp, Artificial sequence
  SiRNA target sequence
atatgtgtccttttctagtaagg

SEQ ID NO: 132701 - DNA, 23 bp, Artificial sequence
  SiRNA target sequence
tatgtgtccttttctagtaaggt

SEQ ID NO: 132702 - DNA, 23 bp, Artificial sequence
  SiRNA target sequence
atgtgtccttttctagtaaggtc

SEQ ID NO: 132703 - DNA, 23 bp, Artificial sequence
  SiRNA target sequence
tgtgtccttttctagtaaggtcg

SEQ ID NO: 132704 - DNA, 23 bp, Artificial sequence
  SiRNA target sequence
gtgtccttttctagtaaggtcga

SEQ ID NO: 132705 - DNA, 23 bp, Artificial sequence
  SiRNA target sequence
tgtccttttctagtaaggtcgat

SEQ ID NO: 132706 - DNA, 23 bp, Artificial sequence
  SiRNA target sequence
gtccttttctagtaaggtcgatg

SEQ ID NO: 132707 - DNA, 23 bp, Artificial sequence
  SiRNA target sequence
tccttttctagtaaggtcgatgg

SEQ ID NO: 132708 - DNA, 23 bp, Artificial sequence
  SiRNA target sequence
ccttttctagtaaggtcgatgga

SEQ ID NO: 132709 - DNA, 23 bp, Artificial sequence
  SiRNA target sequence
cttttctagtaaggtcgatggaa

SEQ ID NO: 132710 - DNA, 23 bp, Artificial sequence
  SiRNA target sequence
ttttctagtaaggtcgatggaaa

SEQ ID NO: 132711 - DNA, 23 bp, Artificial sequence
  SiRNA target sequence
tttctagtaaggtcgatggaaat

SEQ ID NO: 132712 - DNA, 23 bp, Artificial sequence
  SiRNA target sequence
ttctagtaaggtcgatggaaata

SEQ ID NO: 132713 - DNA, 23 bp, Artificial sequence
  SiRNA target sequence
tctagtaaggtcgatggaaatat

SEQ ID NO: 132714 - DNA, 23 bp, Artificial sequence
  SiRNA target sequence
ctagtaaggtcgatggaaatatt

SEQ ID NO: 132715 - DNA, 23 bp, Artificial sequence
  SiRNA target sequence
tagtaaggtcgatggaaatatta

SEQ ID NO: 132716 - DNA, 23 bp, Artificial sequence
  SiRNA target sequence
agtaaggtcgatggaaatattat

SEQ ID NO: 132717 - DNA, 23 bp, Artificial sequence
  SiRNA target sequence
gtaaggtcgatggaaatattatt

SEQ ID NO: 132718 - DNA, 23 bp, Artificial sequence
  SiRNA target sequence
taaggtcgatggaaatattattt

SEQ ID NO: 132719 - DNA, 23 bp, Artificial sequence
  SiRNA target sequence
aaggtcgatggaaatattatttc

SEQ ID NO: 132720 - DNA, 23 bp, Artificial sequence
  SiRNA target sequence
aggtcgatggaaatattatttcc

SEQ ID NO: 132721 - DNA, 23 bp, Artificial sequence
  SiRNA target sequence
ggtcgatggaaatattatttccg

SEQ ID NO: 132722 - DNA, 23 bp, Artificial sequence
  SiRNA target sequence
gtcgatggaaatattatttccgg

SEQ ID NO: 132723 - DNA, 23 bp, Artificial sequence
  SiRNA target sequence
tcgatggaaatattatttccggt

SEQ ID NO: 132724 - DNA, 23 bp, Artificial sequence
  SiRNA target sequence
cgatggaaatattatttccggtt

SEQ ID NO: 132725 - DNA, 23 bp, Artificial sequence
  SiRNA target sequence
gatggaaatattatttccggttt

SEQ ID NO: 132726 - DNA, 23 bp, Artificial sequence
  SiRNA target sequence
atggaaatattatttccggttta

SEQ ID NO: 132727 - DNA, 23 bp, Artificial sequence
  SiRNA target sequence
tggaaatattatttccggtttat

SEQ ID NO: 132728 - DNA, 23 bp, Artificial sequence
  SiRNA target sequence
ggaaatattatttccggtttata

SEQ ID NO: 132729 - DNA, 23 bp, Artificial sequence
  SiRNA target sequence
gaaatattatttccggtttataa

SEQ ID NO: 132730 - DNA, 23 bp, Artificial sequence
  SiRNA target sequence
aaatattatttccggtttataaa

SEQ ID NO: 132731 - DNA, 23 bp, Artificial sequence
  SiRNA target sequence
aatattatttccggtttataaaa

SEQ ID NO: 132732 - DNA, 23 bp, Artificial sequence
  SiRNA target sequence
atattatttccggtttataaaag

SEQ ID NO: 132733 - DNA, 23 bp, Artificial sequence
  SiRNA target sequence
tattatttccggtttataaaagg

SEQ ID NO: 132734 - DNA, 23 bp, Artificial sequence
  SiRNA target sequence
attatttccggtttataaaaggc

SEQ ID NO: 132735 - DNA, 23 bp, Artificial sequence
  SiRNA target sequence
ttatttccggtttataaaaggct

SEQ ID NO: 132736 - DNA, 23 bp, Artificial sequence
  SiRNA target sequence
tatttccggtttataaaaggctt

SEQ ID NO: 132737 - DNA, 23 bp, Artificial sequence
  SiRNA target sequence
atttccggtttataaaaggcttt

SEQ ID NO: 132738 - DNA, 23 bp, Artificial sequence
  SiRNA target sequence
tttccggtttataaaaggctttt

SEQ ID NO: 132739 - DNA, 23 bp, Artificial sequence
  SiRNA target sequence
ttccggtttataaaaggctttta

SEQ ID NO: 132740 - DNA, 23 bp, Artificial sequence
  SiRNA target sequence
tccggtttataaaaggcttttaa

SEQ ID NO: 132741 - DNA, 23 bp, Artificial sequence
  SiRNA target sequence
ccggtttataaaaggcttttaat

SEQ ID NO: 132742 - DNA, 23 bp, Artificial sequence
  SiRNA target sequence
cggtttataaaaggcttttaatt

SEQ ID NO: 132743 - DNA, 23 bp, Artificial sequence
  SiRNA target sequence
ggtttataaaaggcttttaattc

SEQ ID NO: 132744 - DNA, 23 bp, Artificial sequence
  SiRNA target sequence
gtttataaaaggcttttaattcc

SEQ ID NO: 132745 - DNA, 23 bp, Artificial sequence
  SiRNA target sequence
tttataaaaggcttttaattcct

SEQ ID NO: 132746 - DNA, 23 bp, Artificial sequence
  SiRNA target sequence
ttataaaaggcttttaattcctt

SEQ ID NO: 132747 - DNA, 23 bp, Artificial sequence
  SiRNA target sequence
tataaaaggcttttaattcctta

SEQ ID NO: 132748 - DNA, 23 bp, Artificial sequence
  SiRNA target sequence
ataaaaggcttttaattccttac

SEQ ID NO: 132749 - DNA, 23 bp, Artificial sequence
  SiRNA target sequence
taaaaggcttttaattccttact

SEQ ID NO: 132750 - DNA, 23 bp, Artificial sequence
  SiRNA target sequence
aaaaggcttttaattccttacta

SEQ ID NO: 132751 - DNA, 23 bp, Artificial sequence
  SiRNA target sequence
aaaggcttttaattccttactac

SEQ ID NO: 132752 - DNA, 23 bp, Artificial sequence
  SiRNA target sequence
aaggcttttaattccttactact

SEQ ID NO: 132753 - DNA, 23 bp, Artificial sequence
  SiRNA target sequence
aggcttttaattccttactacta

SEQ ID NO: 132754 - DNA, 23 bp, Artificial sequence
  SiRNA target sequence
ggcttttaattccttactactat

SEQ ID NO: 132755 - DNA, 23 bp, Artificial sequence
  SiRNA target sequence
gcttttaattccttactactata

SEQ ID NO: 132756 - DNA, 23 bp, Artificial sequence
  SiRNA target sequence
cttttaattccttactactatat

SEQ ID NO: 132757 - DNA, 23 bp, Artificial sequence
  SiRNA target sequence
ttttaattccttactactatatt

SEQ ID NO: 132758 - DNA, 23 bp, Artificial sequence
  SiRNA target sequence
tttaattccttactactatattg

SEQ ID NO: 132759 - DNA, 23 bp, Artificial sequence
  SiRNA target sequence
ttaattccttactactatattgg

SEQ ID NO: 132760 - DNA, 23 bp, Artificial sequence
  SiRNA target sequence
taattccttactactatattggc

SEQ ID NO: 132761 - DNA, 23 bp, Artificial sequence
  SiRNA target sequence
aattccttactactatattggcc

SEQ ID NO: 132762 - DNA, 23 bp, Artificial sequence
  SiRNA target sequence
attccttactactatattggcct

SEQ ID NO: 132763 - DNA, 23 bp, Artificial sequence
  SiRNA target sequence
ttccttactactatattggcctt

SEQ ID NO: 132764 - DNA, 23 bp, Artificial sequence
  SiRNA target sequence
tccttactactatattggcctta

SEQ ID NO: 132765 - DNA, 23 bp, Artificial sequence
  SiRNA target sequence
ccttactactatattggccttaa

SEQ ID NO: 132766 - DNA, 23 bp, Artificial sequence
  SiRNA target sequence
cttactactatattggccttaaa

SEQ ID NO: 132767 - DNA, 23 bp, Artificial sequence
  SiRNA target sequence
ttactactatattggccttaaat

SEQ ID NO: 132768 - DNA, 23 bp, Artificial sequence
  SiRNA target sequence
tactactatattggccttaaatt

SEQ ID NO: 132769 - DNA, 23 bp, Artificial sequence
  SiRNA target sequence
actactatattggccttaaattt

SEQ ID NO: 132770 - DNA, 23 bp, Artificial sequence
  SiRNA target sequence
ctactatattggccttaaatttt

SEQ ID NO: 132771 - DNA, 23 bp, Artificial sequence
  SiRNA target sequence
tactatattggccttaaatttta

SEQ ID NO: 132772 - DNA, 23 bp, Artificial sequence
  SiRNA target sequence
actatattggccttaaattttat

SEQ ID NO: 132773 - DNA, 23 bp, Artificial sequence
  SiRNA target sequence
ctatattggccttaaattttatg

SEQ ID NO: 132774 - DNA, 23 bp, Artificial sequence
  SiRNA target sequence
tatattggccttaaattttatga

SEQ ID NO: 132775 - DNA, 23 bp, Artificial sequence
  SiRNA target sequence
atattggccttaaattttatgat

SEQ ID NO: 132776 - DNA, 23 bp, Artificial sequence
  SiRNA target sequence
tattggccttaaattttatgatt

SEQ ID NO: 132777 - DNA, 23 bp, Artificial sequence
  SiRNA target sequence
attggccttaaattttatgattg

SEQ ID NO: 132778 - DNA, 23 bp, Artificial sequence
  SiRNA target sequence
ttggccttaaattttatgattgg

SEQ ID NO: 132779 - DNA, 23 bp, Artificial sequence
  SiRNA target sequence
tggccttaaattttatgattgga

SEQ ID NO: 132780 - DNA, 23 bp, Artificial sequence
  SiRNA target sequence
ggccttaaattttatgattggat

SEQ ID NO: 132781 - DNA, 23 bp, Artificial sequence
  SiRNA target sequence
gccttaaattttatgattggatt

SEQ ID NO: 132782 - DNA, 23 bp, Artificial sequence
  SiRNA target sequence
ccttaaattttatgattggattt

SEQ ID NO: 132783 - DNA, 23 bp, Artificial sequence
  SiRNA target sequence
cttaaattttatgattggatttc

SEQ ID NO: 132784 - DNA, 23 bp, Artificial sequence
  SiRNA target sequence
ttaaattttatgattggatttct

SEQ ID NO: 132785 - DNA, 23 bp, Artificial sequence
  SiRNA target sequence
taaattttatgattggatttctg

SEQ ID NO: 132786 - DNA, 23 bp, Artificial sequence
  SiRNA target sequence
aaattttatgattggatttctgg

SEQ ID NO: 132787 - DNA, 23 bp, Artificial sequence
  SiRNA target sequence
aattttatgattggatttctggg

SEQ ID NO: 132788 - DNA, 23 bp, Artificial sequence
  SiRNA target sequence
attttatgattggatttctgggc

SEQ ID NO: 132789 - DNA, 23 bp, Artificial sequence
  SiRNA target sequence
ttttatgattggatttctgggca

SEQ ID NO: 132790 - DNA, 23 bp, Artificial sequence
  SiRNA target sequence
tttatgattggatttctgggcaa

SEQ ID NO: 132791 - DNA, 23 bp, Artificial sequence
  SiRNA target sequence
ttatgattggatttctgggcaac

SEQ ID NO: 132792 - DNA, 23 bp, Artificial sequence
  SiRNA target sequence
tatgattggatttctgggcaacg

SEQ ID NO: 132793 - DNA, 23 bp, Artificial sequence
  SiRNA target sequence
atgattggatttctgggcaacgg

SEQ ID NO: 132794 - DNA, 23 bp, Artificial sequence
  SiRNA target sequence
tgattggatttctgggcaacggt

SEQ ID NO: 132795 - DNA, 23 bp, Artificial sequence
  SiRNA target sequence
gattggatttctgggcaacggtc

SEQ ID NO: 132796 - DNA, 23 bp, Artificial sequence
  SiRNA target sequence
attggatttctgggcaacggtcc

SEQ ID NO: 132797 - DNA, 23 bp, Artificial sequence
  SiRNA target sequence
ttggatttctgggcaacggtccc

SEQ ID NO: 132798 - DNA, 23 bp, Artificial sequence
  SiRNA target sequence
tggatttctgggcaacggtccct

SEQ ID NO: 132799 - DNA, 23 bp, Artificial sequence
  SiRNA target sequence
ggatttctgggcaacggtccctt

SEQ ID NO: 132800 - DNA, 23 bp, Artificial sequence
  SiRNA target sequence
gatttctgggcaacggtcccttg

SEQ ID NO: 132801 - DNA, 23 bp, Artificial sequence
  SiRNA target sequence
atttctgggcaacggtcccttgg

SEQ ID NO: 132802 - DNA, 23 bp, Artificial sequence
  SiRNA target sequence
tttctgggcaacggtcccttggg

SEQ ID NO: 132803 - DNA, 23 bp, Artificial sequence
  SiRNA target sequence
ttctgggcaacggtcccttgggc

SEQ ID NO: 132804 - DNA, 23 bp, Artificial sequence
  SiRNA target sequence
tctgggcaacggtcccttgggcg

SEQ ID NO: 132805 - DNA, 23 bp, Artificial sequence
  SiRNA target sequence
ctgggcaacggtcccttgggcga

SEQ ID NO: 132806 - DNA, 23 bp, Artificial sequence
  SiRNA target sequence
tgggcaacggtcccttgggcgaa

SEQ ID NO: 132807 - DNA, 23 bp, Artificial sequence
  SiRNA target sequence
gggcaacggtcccttgggcgaag

SEQ ID NO: 132808 - DNA, 23 bp, Artificial sequence
  SiRNA target sequence
ggcaacggtcccttgggcgaagt

SEQ ID NO: 132809 - DNA, 23 bp, Artificial sequence
  SiRNA target sequence
gcaacggtcccttgggcgaagta

SEQ ID NO: 132810 - DNA, 23 bp, Artificial sequence
  SiRNA target sequence
caacggtcccttgggcgaagtaa

SEQ ID NO: 132811 - DNA, 23 bp, Artificial sequence
  SiRNA target sequence
aacggtcccttgggcgaagtaaa

SEQ ID NO: 132812 - DNA, 23 bp, Artificial sequence
  SiRNA target sequence
acggtcccttgggcgaagtaaat

SEQ ID NO: 132813 - DNA, 23 bp, Artificial sequence
  SiRNA target sequence
cggtcccttgggcgaagtaaatt

SEQ ID NO: 132814 - DNA, 23 bp, Artificial sequence
  SiRNA target sequence
ggtcccttgggcgaagtaaattt

SEQ ID NO: 132815 - DNA, 23 bp, Artificial sequence
  SiRNA target sequence
gtcccttgggcgaagtaaatttt

SEQ ID NO: 132816 - DNA, 23 bp, Artificial sequence
  SiRNA target sequence
tcccttgggcgaagtaaattttt

SEQ ID NO: 132817 - DNA, 23 bp, Artificial sequence
  SiRNA target sequence
cccttgggcgaagtaaatttttg

SEQ ID NO: 132818 - DNA, 23 bp, Artificial sequence
  SiRNA target sequence
ccttgggcgaagtaaatttttgt

SEQ ID NO: 132819 - DNA, 23 bp, Artificial sequence
  SiRNA target sequence
cttgggcgaagtaaatttttgtc

SEQ ID NO: 132820 - DNA, 23 bp, Artificial sequence
  SiRNA target sequence
ttgggcgaagtaaatttttgtcg

SEQ ID NO: 132821 - DNA, 23 bp, Artificial sequence
  SiRNA target sequence
tgggcgaagtaaatttttgtcgc

SEQ ID NO: 132822 - DNA, 23 bp, Artificial sequence
  SiRNA target sequence
gggcgaagtaaatttttgtcgcg

SEQ ID NO: 132823 - DNA, 23 bp, Artificial sequence
  SiRNA target sequence
ggcgaagtaaatttttgtcgcgg

SEQ ID NO: 132824 - DNA, 23 bp, Artificial sequence
  SiRNA target sequence
gcgaagtaaatttttgtcgcggc

SEQ ID NO: 132825 - DNA, 23 bp, Artificial sequence
  SiRNA target sequence
cgaagtaaatttttgtcgcggca

SEQ ID NO: 132826 - DNA, 23 bp, Artificial sequence
  SiRNA target sequence
gaagtaaatttttgtcgcggcaa

SEQ ID NO: 132827 - DNA, 23 bp, Artificial sequence
  SiRNA target sequence
aagtaaatttttgtcgcggcaac

SEQ ID NO: 132828 - DNA, 23 bp, Artificial sequence
  SiRNA target sequence
agtaaatttttgtcgcggcaaca

SEQ ID NO: 132829 - DNA, 23 bp, Artificial sequence
  SiRNA target sequence
gtaaatttttgtcgcggcaacaa

SEQ ID NO: 132830 - DNA, 23 bp, Artificial sequence
  SiRNA target sequence
taaatttttgtcgcggcaacaaa

SEQ ID NO: 132831 - DNA, 23 bp, Artificial sequence
  SiRNA target sequence
aaatttttgtcgcggcaacaaac

SEQ ID NO: 132832 - DNA, 23 bp, Artificial sequence
  SiRNA target sequence
aatttttgtcgcggcaacaaact

SEQ ID NO: 132833 - DNA, 23 bp, Artificial sequence
  SiRNA target sequence
atttttgtcgcggcaacaaacta

SEQ ID NO: 132834 - DNA, 23 bp, Artificial sequence
  SiRNA target sequence
tttttgtcgcggcaacaaactat

SEQ ID NO: 132835 - DNA, 23 bp, Artificial sequence
  SiRNA target sequence
ttttgtcgcggcaacaaactatt

SEQ ID NO: 132836 - DNA, 23 bp, Artificial sequence
  SiRNA target sequence
tttgtcgcggcaacaaactatta

SEQ ID NO: 132837 - DNA, 23 bp, Artificial sequence
  SiRNA target sequence
ttgtcgcggcaacaaactattac

SEQ ID NO: 132838 - DNA, 23 bp, Artificial sequence
  SiRNA target sequence
tgtcgcggcaacaaactattaca

SEQ ID NO: 132839 - DNA, 23 bp, Artificial sequence
  SiRNA target sequence
gtcgcggcaacaaactattacaa

SEQ ID NO: 132840 - DNA, 23 bp, Artificial sequence
  SiRNA target sequence
tcgcggcaacaaactattacaaa

SEQ ID NO: 132841 - DNA, 23 bp, Artificial sequence
  SiRNA target sequence
cgcggcaacaaactattacaaaa

SEQ ID NO: 132842 - DNA, 23 bp, Artificial sequence
  SiRNA target sequence
gcggcaacaaactattacaaaat

SEQ ID NO: 132843 - DNA, 23 bp, Artificial sequence
  SiRNA target sequence
cggcaacaaactattacaaaatt

SEQ ID NO: 132844 - DNA, 23 bp, Artificial sequence
  SiRNA target sequence
ggcaacaaactattacaaaattt

SEQ ID NO: 132845 - DNA, 23 bp, Artificial sequence
  SiRNA target sequence
gcaacaaactattacaaaatttc

SEQ ID NO: 132846 - DNA, 23 bp, Artificial sequence
  SiRNA target sequence
caacaaactattacaaaatttcc

SEQ ID NO: 132847 - DNA, 23 bp, Artificial sequence
  SiRNA target sequence
aacaaactattacaaaatttcct

SEQ ID NO: 132848 - DNA, 23 bp, Artificial sequence
  SiRNA target sequence
acaaactattacaaaatttccta

SEQ ID NO: 132849 - DNA, 23 bp, Artificial sequence
  SiRNA target sequence
caaactattacaaaatttcctaa

SEQ ID NO: 132850 - DNA, 23 bp, Artificial sequence
  SiRNA target sequence
aaactattacaaaatttcctaat

SEQ ID NO: 132851 - DNA, 23 bp, Artificial sequence
  SiRNA target sequence
aactattacaaaatttcctaatg

SEQ ID NO: 132852 - DNA, 23 bp, Artificial sequence
  SiRNA target sequence
actattacaaaatttcctaatgt

SEQ ID NO: 132853 - DNA, 23 bp, Artificial sequence
  SiRNA target sequence
ctattacaaaatttcctaatgtg

SEQ ID NO: 132854 - DNA, 23 bp, Artificial sequence
  SiRNA target sequence
tattacaaaatttcctaatgtga

SEQ ID NO: 132855 - DNA, 23 bp, Artificial sequence
  SiRNA target sequence
attacaaaatttcctaatgtgag

SEQ ID NO: 132856 - DNA, 23 bp, Artificial sequence
  SiRNA target sequence
ttacaaaatttcctaatgtgaga

SEQ ID NO: 132857 - DNA, 23 bp, Artificial sequence
  SiRNA target sequence
tacaaaatttcctaatgtgagaa

SEQ ID NO: 132858 - DNA, 23 bp, Artificial sequence
  SiRNA target sequence
acaaaatttcctaatgtgagaaa

SEQ ID NO: 132859 - DNA, 23 bp, Artificial sequence
  SiRNA target sequence
caaaatttcctaatgtgagaaaa

SEQ ID NO: 132860 - DNA, 23 bp, Artificial sequence
  SiRNA target sequence
aaaatttcctaatgtgagaaaaa

SEQ ID NO: 132861 - DNA, 23 bp, Artificial sequence
  SiRNA target sequence
aaatttcctaatgtgagaaaaat

SEQ ID NO: 132862 - DNA, 23 bp, Artificial sequence
  SiRNA target sequence
aatttcctaatgtgagaaaaatc

SEQ ID NO: 132863 - DNA, 23 bp, Artificial sequence
  SiRNA target sequence
atttcctaatgtgagaaaaatcg

SEQ ID NO: 132864 - DNA, 23 bp, Artificial sequence
  SiRNA target sequence
tttcctaatgtgagaaaaatcga

SEQ ID NO: 132865 - DNA, 23 bp, Artificial sequence
  SiRNA target sequence
ttcctaatgtgagaaaaatcgac

SEQ ID NO: 132866 - DNA, 23 bp, Artificial sequence
  SiRNA target sequence
tcctaatgtgagaaaaatcgacc

SEQ ID NO: 132867 - DNA, 23 bp, Artificial sequence
  SiRNA target sequence
cctaatgtgagaaaaatcgacct

SEQ ID NO: 132868 - DNA, 23 bp, Artificial sequence
  SiRNA target sequence
ctaatgtgagaaaaatcgacctt

SEQ ID NO: 132869 - DNA, 23 bp, Artificial sequence
  SiRNA target sequence
taatgtgagaaaaatcgaccttg

SEQ ID NO: 132870 - DNA, 23 bp, Artificial sequence
  SiRNA target sequence
aatgtgagaaaaatcgaccttgt

SEQ ID NO: 132871 - DNA, 23 bp, Artificial sequence
  SiRNA target sequence
atgtgagaaaaatcgaccttgta

SEQ ID NO: 132872 - DNA, 23 bp, Artificial sequence
  SiRNA target sequence
tgtgagaaaaatcgaccttgtag

SEQ ID NO: 132873 - DNA, 23 bp, Artificial sequence
  SiRNA target sequence
gtgagaaaaatcgaccttgtagg

SEQ ID NO: 132874 - DNA, 23 bp, Artificial sequence
  SiRNA target sequence
tgagaaaaatcgaccttgtagga

SEQ ID NO: 132875 - DNA, 23 bp, Artificial sequence
  SiRNA target sequence
gagaaaaatcgaccttgtaggat

SEQ ID NO: 132876 - DNA, 23 bp, Artificial sequence
  SiRNA target sequence
agaaaaatcgaccttgtaggatc

SEQ ID NO: 132877 - DNA, 23 bp, Artificial sequence
  SiRNA target sequence
gaaaaatcgaccttgtaggatcc

SEQ ID NO: 132878 - DNA, 23 bp, Artificial sequence
  SiRNA target sequence
aaaaatcgaccttgtaggatccg

SEQ ID NO: 132879 - DNA, 23 bp, Artificial sequence
  SiRNA target sequence
aaaatcgaccttgtaggatccgt

SEQ ID NO: 132880 - DNA, 23 bp, Artificial sequence
  SiRNA target sequence
aaatcgaccttgtaggatccgtt

SEQ ID NO: 132881 - DNA, 23 bp, Artificial sequence
  SiRNA target sequence
aatcgaccttgtaggatccgttt

SEQ ID NO: 132882 - DNA, 23 bp, Artificial sequence
  SiRNA target sequence
atcgaccttgtaggatccgtttc

SEQ ID NO: 132883 - DNA, 23 bp, Artificial sequence
  SiRNA target sequence
tcgaccttgtaggatccgtttcg

SEQ ID NO: 132884 - DNA, 23 bp, Artificial sequence
  SiRNA target sequence
cgaccttgtaggatccgtttcgt

SEQ ID NO: 132885 - DNA, 23 bp, Artificial sequence
  SiRNA target sequence
gaccttgtaggatccgtttcgta

SEQ ID NO: 132886 - DNA, 23 bp, Artificial sequence
  SiRNA target sequence
accttgtaggatccgtttcgtat

SEQ ID NO: 132887 - DNA, 23 bp, Artificial sequence
  SiRNA target sequence
ccttgtaggatccgtttcgtatc

SEQ ID NO: 132888 - DNA, 23 bp, Artificial sequence
  SiRNA target sequence
cttgtaggatccgtttcgtatcg

SEQ ID NO: 132889 - DNA, 23 bp, Artificial sequence
  SiRNA target sequence
ttgtaggatccgtttcgtatcgt

SEQ ID NO: 132890 - DNA, 23 bp, Artificial sequence
  SiRNA target sequence
tgtaggatccgtttcgtatcgtg

SEQ ID NO: 132891 - DNA, 23 bp, Artificial sequence
  SiRNA target sequence
gtaggatccgtttcgtatcgtga

SEQ ID NO: 132892 - DNA, 23 bp, Artificial sequence
  SiRNA target sequence
taggatccgtttcgtatcgtgat

SEQ ID NO: 132893 - DNA, 23 bp, Artificial sequence
  SiRNA target sequence
aggatccgtttcgtatcgtgatg

SEQ ID NO: 132894 - DNA, 23 bp, Artificial sequence
  SiRNA target sequence
ggatccgtttcgtatcgtgatgg

SEQ ID NO: 132895 - DNA, 23 bp, Artificial sequence
  SiRNA target sequence
gatccgtttcgtatcgtgatggc

SEQ ID NO: 132896 - DNA, 23 bp, Artificial sequence
  SiRNA target sequence
atccgtttcgtatcgtgatggcc

SEQ ID NO: 132897 - DNA, 23 bp, Artificial sequence
  SiRNA target sequence
tccgtttcgtatcgtgatggcca

SEQ ID NO: 132898 - DNA, 23 bp, Artificial sequence
  SiRNA target sequence
ccgtttcgtatcgtgatggccaa

SEQ ID NO: 132899 - DNA, 23 bp, Artificial sequence
  SiRNA target sequence
cgtttcgtatcgtgatggccaat

SEQ ID NO: 132900 - DNA, 23 bp, Artificial sequence
  SiRNA target sequence
gtttcgtatcgtgatggccaatt

SEQ ID NO: 132901 - DNA, 23 bp, Artificial sequence
  SiRNA target sequence
tttcgtatcgtgatggccaattt

SEQ ID NO: 132902 - DNA, 23 bp, Artificial sequence
  SiRNA target sequence
ttcgtatcgtgatggccaatttt

SEQ ID NO: 132903 - DNA, 23 bp, Artificial sequence
  SiRNA target sequence
tcgtatcgtgatggccaatttta

SEQ ID NO: 132904 - DNA, 23 bp, Artificial sequence
  SiRNA target sequence
cgtatcgtgatggccaattttat

SEQ ID NO: 132905 - DNA, 23 bp, Artificial sequence
  SiRNA target sequence
gtatcgtgatggccaattttatg

SEQ ID NO: 132906 - DNA, 23 bp, Artificial sequence
  SiRNA target sequence
tatcgtgatggccaattttatga

SEQ ID NO: 132907 - DNA, 23 bp, Artificial sequence
  SiRNA target sequence
atcgtgatggccaattttatgat

SEQ ID NO: 132908 - DNA, 23 bp, Artificial sequence
  SiRNA target sequence
tcgtgatggccaattttatgatg

SEQ ID NO: 132909 - DNA, 23 bp, Artificial sequence
  SiRNA target sequence
cgtgatggccaattttatgatgc

SEQ ID NO: 132910 - DNA, 23 bp, Artificial sequence
  SiRNA target sequence
gtgatggccaattttatgatgct

SEQ ID NO: 132911 - DNA, 23 bp, Artificial sequence
  SiRNA target sequence
tgatggccaattttatgatgcta

SEQ ID NO: 132912 - DNA, 23 bp, Artificial sequence
  SiRNA target sequence
gatggccaattttatgatgctaa

SEQ ID NO: 132913 - DNA, 23 bp, Artificial sequence
  SiRNA target sequence
atggccaattttatgatgctaaa

SEQ ID NO: 132914 - DNA, 23 bp, Artificial sequence
  SiRNA target sequence
tggccaattttatgatgctaaat

SEQ ID NO: 132915 - DNA, 23 bp, Artificial sequence
  SiRNA target sequence
ggccaattttatgatgctaaata

SEQ ID NO: 132916 - DNA, 23 bp, Artificial sequence
  SiRNA target sequence
gccaattttatgatgctaaatac

SEQ ID NO: 132917 - DNA, 23 bp, Artificial sequence
  SiRNA target sequence
ccaattttatgatgctaaataca

SEQ ID NO: 132918 - DNA, 23 bp, Artificial sequence
  SiRNA target sequence
caattttatgatgctaaatacaa

SEQ ID NO: 132919 - DNA, 23 bp, Artificial sequence
  SiRNA target sequence
aattttatgatgctaaatacaat

SEQ ID NO: 132920 - DNA, 23 bp, Artificial sequence
  SiRNA target sequence
attttatgatgctaaatacaatg

SEQ ID NO: 132921 - DNA, 23 bp, Artificial sequence
  SiRNA target sequence
ttttatgatgctaaatacaatgt

SEQ ID NO: 132922 - DNA, 23 bp, Artificial sequence
  SiRNA target sequence
tttatgatgctaaatacaatgtt

SEQ ID NO: 132923 - DNA, 23 bp, Artificial sequence
  SiRNA target sequence
ttatgatgctaaatacaatgttc

SEQ ID NO: 132924 - DNA, 23 bp, Artificial sequence
  SiRNA target sequence
tatgatgctaaatacaatgttct

SEQ ID NO: 132925 - DNA, 23 bp, Artificial sequence
  SiRNA target sequence
atgatgctaaatacaatgttcta

SEQ ID NO: 132926 - DNA, 23 bp, Artificial sequence
  SiRNA target sequence
tgatgctaaatacaatgttctat

SEQ ID NO: 132927 - DNA, 23 bp, Artificial sequence
  SiRNA target sequence
gatgctaaatacaatgttctatt

SEQ ID NO: 132928 - DNA, 23 bp, Artificial sequence
  SiRNA target sequence
atgctaaatacaatgttctattg

SEQ ID NO: 132929 - DNA, 23 bp, Artificial sequence
  SiRNA target sequence
tgctaaatacaatgttctattgg

SEQ ID NO: 132930 - DNA, 23 bp, Artificial sequence
  SiRNA target sequence
gctaaatacaatgttctattggg

SEQ ID NO: 132931 - DNA, 23 bp, Artificial sequence
  SiRNA target sequence
ctaaatacaatgttctattgggt

SEQ ID NO: 132932 - DNA, 23 bp, Artificial sequence
  SiRNA target sequence
taaatacaatgttctattgggtg

SEQ ID NO: 132933 - DNA, 23 bp, Artificial sequence
  SiRNA target sequence
aaatacaatgttctattgggtgt

SEQ ID NO: 132934 - DNA, 23 bp, Artificial sequence
  SiRNA target sequence
aatacaatgttctattgggtgtc

SEQ ID NO: 132935 - DNA, 23 bp, Artificial sequence
  SiRNA target sequence
atacaatgttctattgggtgtca

SEQ ID NO: 132936 - DNA, 23 bp, Artificial sequence
  SiRNA target sequence
tacaatgttctattgggtgtcac

SEQ ID NO: 132937 - DNA, 23 bp, Artificial sequence
  SiRNA target sequence
acaatgttctattgggtgtcaca

SEQ ID NO: 132938 - DNA, 23 bp, Artificial sequence
  SiRNA target sequence
caatgttctattgggtgtcacag

SEQ ID NO: 132939 - DNA, 23 bp, Artificial sequence
  SiRNA target sequence
aatgttctattgggtgtcacagc

SEQ ID NO: 132940 - DNA, 23 bp, Artificial sequence
  SiRNA target sequence
atgttctattgggtgtcacagct

SEQ ID NO: 132941 - DNA, 23 bp, Artificial sequence
  SiRNA target sequence
tgttctattgggtgtcacagcta

SEQ ID NO: 132942 - DNA, 23 bp, Artificial sequence
  SiRNA target sequence
gttctattgggtgtcacagctac

SEQ ID NO: 132943 - DNA, 23 bp, Artificial sequence
  SiRNA target sequence
ttctattgggtgtcacagctacc

SEQ ID NO: 132944 - DNA, 23 bp, Artificial sequence
  SiRNA target sequence
tctattgggtgtcacagctacct

SEQ ID NO: 132945 - DNA, 23 bp, Artificial sequence
  SiRNA target sequence
ctattgggtgtcacagctaccta

SEQ ID NO: 132946 - DNA, 23 bp, Artificial sequence
  SiRNA target sequence
tattgggtgtcacagctacctac

SEQ ID NO: 132947 - DNA, 23 bp, Artificial sequence
  SiRNA target sequence
attgggtgtcacagctacctact

SEQ ID NO: 132948 - DNA, 23 bp, Artificial sequence
  SiRNA target sequence
ttgggtgtcacagctacctacta

SEQ ID NO: 132949 - DNA, 23 bp, Artificial sequence
  SiRNA target sequence
tgggtgtcacagctacctactat

SEQ ID NO: 132950 - DNA, 23 bp, Artificial sequence
  SiRNA target sequence
gggtgtcacagctacctactatg

SEQ ID NO: 132951 - DNA, 23 bp, Artificial sequence
  SiRNA target sequence
ggtgtcacagctacctactatgg

SEQ ID NO: 132952 - DNA, 23 bp, Artificial sequence
  SiRNA target sequence
gtgtcacagctacctactatgga

SEQ ID NO: 132953 - DNA, 23 bp, Artificial sequence
  SiRNA target sequence
tgtcacagctacctactatggag

SEQ ID NO: 132954 - DNA, 23 bp, Artificial sequence
  SiRNA target sequence
gtcacagctacctactatggagc

SEQ ID NO: 132955 - DNA, 23 bp, Artificial sequence
  SiRNA target sequence
tcacagctacctactatggagct

SEQ ID NO: 132956 - DNA, 23 bp, Artificial sequence
  SiRNA target sequence
cacagctacctactatggagctg

SEQ ID NO: 132957 - DNA, 23 bp, Artificial sequence
  SiRNA target sequence
acagctacctactatggagctgt

SEQ ID NO: 132958 - DNA, 23 bp, Artificial sequence
  SiRNA target sequence
cagctacctactatggagctgtt

SEQ ID NO: 132959 - DNA, 23 bp, Artificial sequence
  SiRNA target sequence
agctacctactatggagctgttg

SEQ ID NO: 132960 - DNA, 23 bp, Artificial sequence
  SiRNA target sequence
gctacctactatggagctgttgt

SEQ ID NO: 132961 - DNA, 23 bp, Artificial sequence
  SiRNA target sequence
ctacctactatggagctgttgta

SEQ ID NO: 132962 - DNA, 23 bp, Artificial sequence
  SiRNA target sequence
tacctactatggagctgttgtat

SEQ ID NO: 132963 - DNA, 23 bp, Artificial sequence
  SiRNA target sequence
acctactatggagctgttgtatt

SEQ ID NO: 132964 - DNA, 23 bp, Artificial sequence
  SiRNA target sequence
cctactatggagctgttgtatta

SEQ ID NO: 132965 - DNA, 23 bp, Artificial sequence
  SiRNA target sequence
ctactatggagctgttgtattaa

SEQ ID NO: 132966 - DNA, 23 bp, Artificial sequence
  SiRNA target sequence
tactatggagctgttgtattaaa

SEQ ID NO: 132967 - DNA, 23 bp, Artificial sequence
  SiRNA target sequence
actatggagctgttgtattaaat

SEQ ID NO: 132968 - DNA, 23 bp, Artificial sequence
  SiRNA target sequence
ctatggagctgttgtattaaatc

SEQ ID NO: 132969 - DNA, 23 bp, Artificial sequence
  SiRNA target sequence
tatggagctgttgtattaaatca

SEQ ID NO: 132970 - DNA, 23 bp, Artificial sequence
  SiRNA target sequence
atggagctgttgtattaaatcat

SEQ ID NO: 132971 - DNA, 23 bp, Artificial sequence
  SiRNA target sequence
tggagctgttgtattaaatcatg

SEQ ID NO: 132972 - DNA, 23 bp, Artificial sequence
  SiRNA target sequence
ggagctgttgtattaaatcatgc

SEQ ID NO: 132973 - DNA, 23 bp, Artificial sequence
  SiRNA target sequence
gagctgttgtattaaatcatgca

SEQ ID NO: 132974 - DNA, 23 bp, Artificial sequence
  SiRNA target sequence
agctgttgtattaaatcatgcaa

SEQ ID NO: 132975 - DNA, 23 bp, Artificial sequence
  SiRNA target sequence
gctgttgtattaaatcatgcaaa

SEQ ID NO: 132976 - DNA, 23 bp, Artificial sequence
  SiRNA target sequence
ctgttgtattaaatcatgcaaaa

SEQ ID NO: 132977 - DNA, 23 bp, Artificial sequence
  SiRNA target sequence
tgttgtattaaatcatgcaaaat

SEQ ID NO: 132978 - DNA, 23 bp, Artificial sequence
  SiRNA target sequence
gttgtattaaatcatgcaaaatt

SEQ ID NO: 132979 - DNA, 23 bp, Artificial sequence
  SiRNA target sequence
ttgtattaaatcatgcaaaattc

SEQ ID NO: 132980 - DNA, 23 bp, Artificial sequence
  SiRNA target sequence
tgtattaaatcatgcaaaattct

SEQ ID NO: 132981 - DNA, 23 bp, Artificial sequence
  SiRNA target sequence
gtattaaatcatgcaaaattctt

SEQ ID NO: 132982 - DNA, 23 bp, Artificial sequence
  SiRNA target sequence
tattaaatcatgcaaaattcttg

SEQ ID NO: 132983 - DNA, 23 bp, Artificial sequence
  SiRNA target sequence
attaaatcatgcaaaattcttgt

SEQ ID NO: 132984 - DNA, 23 bp, Artificial sequence
  SiRNA target sequence
ttaaatcatgcaaaattcttgtc

SEQ ID NO: 132985 - DNA, 23 bp, Artificial sequence
  SiRNA target sequence
taaatcatgcaaaattcttgtca

SEQ ID NO: 132986 - DNA, 23 bp, Artificial sequence
  SiRNA target sequence
aaatcatgcaaaattcttgtcag

SEQ ID NO: 132987 - DNA, 23 bp, Artificial sequence
  SiRNA target sequence
aatcatgcaaaattcttgtcagt

SEQ ID NO: 132988 - DNA, 23 bp, Artificial sequence
  SiRNA target sequence
atcatgcaaaattcttgtcagta

SEQ ID NO: 132989 - DNA, 23 bp, Artificial sequence
  SiRNA target sequence
tcatgcaaaattcttgtcagtaa

SEQ ID NO: 132990 - DNA, 23 bp, Artificial sequence
  SiRNA target sequence
catgcaaaattcttgtcagtaac

SEQ ID NO: 132991 - DNA, 23 bp, Artificial sequence
  SiRNA target sequence
atgcaaaattcttgtcagtaaca

SEQ ID NO: 132992 - DNA, 23 bp, Artificial sequence
  SiRNA target sequence
tgcaaaattcttgtcagtaacaa

SEQ ID NO: 132993 - DNA, 23 bp, Artificial sequence
  SiRNA target sequence
gcaaaattcttgtcagtaacaaa

SEQ ID NO: 132994 - DNA, 23 bp, Artificial sequence
  SiRNA target sequence
caaaattcttgtcagtaacaaaa

SEQ ID NO: 132995 - DNA, 23 bp, Artificial sequence
  SiRNA target sequence
aaaattcttgtcagtaacaaaag

SEQ ID NO: 132996 - DNA, 23 bp, Artificial sequence
  SiRNA target sequence
aaattcttgtcagtaacaaaaga

SEQ ID NO: 132997 - DNA, 23 bp, Artificial sequence
  SiRNA target sequence
aattcttgtcagtaacaaaagat

SEQ ID NO: 132998 - DNA, 23 bp, Artificial sequence
  SiRNA target sequence
attcttgtcagtaacaaaagatg

SEQ ID NO: 132999 - DNA, 23 bp, Artificial sequence
  SiRNA target sequence
ttcttgtcagtaacaaaagatgg

SEQ ID NO: 133000 - DNA, 23 bp, Artificial sequence
  SiRNA target sequence
tcttgtcagtaacaaaagatggc

SEQ ID NO: 133001 - DNA, 23 bp, Artificial sequence
  SiRNA target sequence
cttgtcagtaacaaaagatggcg

SEQ ID NO: 133002 - DNA, 23 bp, Artificial sequence
  SiRNA target sequence
ttgtcagtaacaaaagatggcga

SEQ ID NO: 133003 - DNA, 23 bp, Artificial sequence
  SiRNA target sequence
tgtcagtaacaaaagatggcgat

SEQ ID NO: 133004 - DNA, 23 bp, Artificial sequence
  SiRNA target sequence
gtcagtaacaaaagatggcgata

SEQ ID NO: 133005 - DNA, 23 bp, Artificial sequence
  SiRNA target sequence
tcagtaacaaaagatggcgataa

SEQ ID NO: 133006 - DNA, 23 bp, Artificial sequence
  SiRNA target sequence
cagtaacaaaagatggcgataaa

SEQ ID NO: 133007 - DNA, 23 bp, Artificial sequence
  SiRNA target sequence
agtaacaaaagatggcgataaaa

SEQ ID NO: 133008 - DNA, 23 bp, Artificial sequence
  SiRNA target sequence
gtaacaaaagatggcgataaaat

SEQ ID NO: 133009 - DNA, 23 bp, Artificial sequence
  SiRNA target sequence
taacaaaagatggcgataaaatt

SEQ ID NO: 133010 - DNA, 23 bp, Artificial sequence
  SiRNA target sequence
aacaaaagatggcgataaaatta

SEQ ID NO: 133011 - DNA, 23 bp, Artificial sequence
  SiRNA target sequence
acaaaagatggcgataaaattaa

SEQ ID NO: 133012 - DNA, 23 bp, Artificial sequence
  SiRNA target sequence
caaaagatggcgataaaattaat

SEQ ID NO: 133013 - DNA, 23 bp, Artificial sequence
  SiRNA target sequence
aaaagatggcgataaaattaatg

SEQ ID NO: 133014 - DNA, 23 bp, Artificial sequence
  SiRNA target sequence
aaagatggcgataaaattaatgg

SEQ ID NO: 133015 - DNA, 23 bp, Artificial sequence
  SiRNA target sequence
aagatggcgataaaattaatgga

SEQ ID NO: 133016 - DNA, 23 bp, Artificial sequence
  SiRNA target sequence
agatggcgataaaattaatggaa

SEQ ID NO: 133017 - DNA, 23 bp, Artificial sequence
  SiRNA target sequence
gatggcgataaaattaatggaat

SEQ ID NO: 133018 - DNA, 23 bp, Artificial sequence
  SiRNA target sequence
atggcgataaaattaatggaatt

SEQ ID NO: 133019 - DNA, 23 bp, Artificial sequence
  SiRNA target sequence
tggcgataaaattaatggaatta

SEQ ID NO: 133020 - DNA, 23 bp, Artificial sequence
  SiRNA target sequence
ggcgataaaattaatggaattaa

SEQ ID NO: 133021 - DNA, 23 bp, Artificial sequence
  SiRNA target sequence
gcgataaaattaatggaattaaa

SEQ ID NO: 133022 - DNA, 23 bp, Artificial sequence
  SiRNA target sequence
cgataaaattaatggaattaaat

SEQ ID NO: 133023 - DNA, 23 bp, Artificial sequence
  SiRNA target sequence
gataaaattaatggaattaaatg

SEQ ID NO: 133024 - DNA, 23 bp, Artificial sequence
  SiRNA target sequence
ataaaattaatggaattaaatgt

SEQ ID NO: 133025 - DNA, 23 bp, Artificial sequence
  SiRNA target sequence
taaaattaatggaattaaatgtc

SEQ ID NO: 133026 - DNA, 23 bp, Artificial sequence
  SiRNA target sequence
aaaattaatggaattaaatgtca

SEQ ID NO: 133027 - DNA, 23 bp, Artificial sequence
  SiRNA target sequence
aaattaatggaattaaatgtcaa

SEQ ID NO: 133028 - DNA, 23 bp, Artificial sequence
  SiRNA target sequence
aattaatggaattaaatgtcaag

SEQ ID NO: 133029 - DNA, 23 bp, Artificial sequence
  SiRNA target sequence
attaatggaattaaatgtcaaga

SEQ ID NO: 133030 - DNA, 23 bp, Artificial sequence
  SiRNA target sequence
ttaatggaattaaatgtcaagat

SEQ ID NO: 133031 - DNA, 23 bp, Artificial sequence
  SiRNA target sequence
taatggaattaaatgtcaagatt

SEQ ID NO: 133032 - DNA, 23 bp, Artificial sequence
  SiRNA target sequence
aatggaattaaatgtcaagattc

SEQ ID NO: 133033 - DNA, 23 bp, Artificial sequence
  SiRNA target sequence
atggaattaaatgtcaagattca

SEQ ID NO: 133034 - DNA, 23 bp, Artificial sequence
  SiRNA target sequence
tggaattaaatgtcaagattcaa

SEQ ID NO: 133035 - DNA, 23 bp, Artificial sequence
  SiRNA target sequence
ggaattaaatgtcaagattcaat

SEQ ID NO: 133036 - DNA, 23 bp, Artificial sequence
  SiRNA target sequence
gaattaaatgtcaagattcaata

SEQ ID NO: 133037 - DNA, 23 bp, Artificial sequence
  SiRNA target sequence
aattaaatgtcaagattcaataa

SEQ ID NO: 133038 - DNA, 23 bp, Artificial sequence
  SiRNA target sequence
attaaatgtcaagattcaataaa

SEQ ID NO: 133039 - DNA, 23 bp, Artificial sequence
  SiRNA target sequence
ttaaatgtcaagattcaataaat

SEQ ID NO: 133040 - DNA, 23 bp, Artificial sequence
  SiRNA target sequence
taaatgtcaagattcaataaata

SEQ ID NO: 133041 - DNA, 23 bp, Artificial sequence
  SiRNA target sequence
aaatgtcaagattcaataaataa

SEQ ID NO: 133042 - DNA, 23 bp, Artificial sequence
  SiRNA target sequence
aatgtcaagattcaataaataat

SEQ ID NO: 133043 - DNA, 23 bp, Artificial sequence
  SiRNA target sequence
atgtcaagattcaataaataatg

SEQ ID NO: 133044 - DNA, 23 bp, Artificial sequence
  SiRNA target sequence
tgtcaagattcaataaataatga

SEQ ID NO: 133045 - DNA, 23 bp, Artificial sequence
  SiRNA target sequence
gtcaagattcaataaataatgaa

SEQ ID NO: 133046 - DNA, 23 bp, Artificial sequence
  SiRNA target sequence
tcaagattcaataaataatgaaa

SEQ ID NO: 133047 - DNA, 23 bp, Artificial sequence
  SiRNA target sequence
caagattcaataaataatgaaaa

SEQ ID NO: 133048 - DNA, 23 bp, Artificial sequence
  SiRNA target sequence
aagattcaataaataatgaaaaa

SEQ ID NO: 133049 - DNA, 23 bp, Artificial sequence
  SiRNA target sequence
agattcaataaataatgaaaaat

SEQ ID NO: 133050 - DNA, 23 bp, Artificial sequence
  SiRNA target sequence
gattcaataaataatgaaaaatt

SEQ ID NO: 133051 - DNA, 23 bp, Artificial sequence
  SiRNA target sequence
attcaataaataatgaaaaattt

SEQ ID NO: 133052 - DNA, 23 bp, Artificial sequence
  SiRNA target sequence
ttcaataaataatgaaaaatttt

SEQ ID NO: 133053 - DNA, 23 bp, Artificial sequence
  SiRNA target sequence
tcaataaataatgaaaaattttt

SEQ ID NO: 133054 - DNA, 23 bp, Artificial sequence
  SiRNA target sequence
caataaataatgaaaaattttta

SEQ ID NO: 133055 - DNA, 23 bp, Artificial sequence
  SiRNA target sequence
aataaataatgaaaaatttttaa

SEQ ID NO: 133056 - DNA, 23 bp, Artificial sequence
  SiRNA target sequence
ataaataatgaaaaatttttaat

SEQ ID NO: 133057 - DNA, 23 bp, Artificial sequence
  SiRNA target sequence
taaataatgaaaaatttttaatt

SEQ ID NO: 133058 - DNA, 23 bp, Artificial sequence
  SiRNA target sequence
aaataatgaaaaatttttaatta

SEQ ID NO: 133059 - DNA, 23 bp, Artificial sequence
  SiRNA target sequence
aataatgaaaaatttttaattag

SEQ ID NO: 133060 - DNA, 23 bp, Artificial sequence
  SiRNA target sequence
ataatgaaaaatttttaattagg

SEQ ID NO: 133061 - DNA, 23 bp, Artificial sequence
  SiRNA target sequence
taatgaaaaatttttaattaggt

SEQ ID NO: 133062 - DNA, 23 bp, Artificial sequence
  SiRNA target sequence
aatgaaaaatttttaattaggtg

SEQ ID NO: 133063 - DNA, 23 bp, Artificial sequence
  SiRNA target sequence
atgaaaaatttttaattaggtgt

SEQ ID NO: 133064 - DNA, 23 bp, Artificial sequence
  SiRNA target sequence
tgaaaaatttttaattaggtgta

SEQ ID NO: 133065 - DNA, 23 bp, Artificial sequence
  SiRNA target sequence
gaaaaatttttaattaggtgtaa

SEQ ID NO: 133066 - DNA, 23 bp, Artificial sequence
  SiRNA target sequence
aaaaatttttaattaggtgtaaa

SEQ ID NO: 133067 - DNA, 23 bp, Artificial sequence
  SiRNA target sequence
aaaatttttaattaggtgtaaag

SEQ ID NO: 133068 - DNA, 23 bp, Artificial sequence
  SiRNA target sequence
aaatttttaattaggtgtaaagt

SEQ ID NO: 133069 - DNA, 23 bp, Artificial sequence
  SiRNA target sequence
aatttttaattaggtgtaaagtt

SEQ ID NO: 133070 - DNA, 23 bp, Artificial sequence
  SiRNA target sequence
atttttaattaggtgtaaagttt

SEQ ID NO: 133071 - DNA, 23 bp, Artificial sequence
  SiRNA target sequence
tttttaattaggtgtaaagtttt

SEQ ID NO: 133072 - DNA, 23 bp, Artificial sequence
  SiRNA target sequence
ttttaattaggtgtaaagtttta

SEQ ID NO: 133073 - DNA, 23 bp, Artificial sequence
  SiRNA target sequence
tttaattaggtgtaaagttttaa

SEQ ID NO: 133074 - DNA, 23 bp, Artificial sequence
  SiRNA target sequence
ttaattaggtgtaaagttttaat

SEQ ID NO: 133075 - DNA, 23 bp, Artificial sequence
  SiRNA target sequence
taattaggtgtaaagttttaata

SEQ ID NO: 133076 - DNA, 23 bp, Artificial sequence
  SiRNA target sequence
aattaggtgtaaagttttaataa

SEQ ID NO: 133077 - DNA, 23 bp, Artificial sequence
  SiRNA target sequence
attaggtgtaaagttttaataaa

SEQ ID NO: 133078 - DNA, 23 bp, Artificial sequence
  SiRNA target sequence
ttaggtgtaaagttttaataaat

SEQ ID NO: 133079 - DNA, 23 bp, Artificial sequence
  SiRNA target sequence
taggtgtaaagttttaataaata

SEQ ID NO: 133080 - DNA, 23 bp, Artificial sequence
  SiRNA target sequence
aggtgtaaagttttaataaatac

SEQ ID NO: 133081 - DNA, 23 bp, Artificial sequence
  SiRNA target sequence
ggtgtaaagttttaataaatact

SEQ ID NO: 133082 - DNA, 23 bp, Artificial sequence
  SiRNA target sequence
gtgtaaagttttaataaatactt

SEQ ID NO: 133083 - DNA, 23 bp, Artificial sequence
  SiRNA target sequence
tgtaaagttttaataaatacttc

SEQ ID NO: 133084 - DNA, 23 bp, Artificial sequence
  SiRNA target sequence
gtaaagttttaataaatacttct

SEQ ID NO: 133085 - DNA, 23 bp, Artificial sequence
  SiRNA target sequence
taaagttttaataaatacttctg

SEQ ID NO: 133086 - DNA, 23 bp, Artificial sequence
  SiRNA target sequence
aaagttttaataaatacttctgg

SEQ ID NO: 133087 - DNA, 23 bp, Artificial sequence
  SiRNA target sequence
aagttttaataaatacttctggc

SEQ ID NO: 133088 - DNA, 23 bp, Artificial sequence
  SiRNA target sequence
agttttaataaatacttctggcc

SEQ ID NO: 133089 - DNA, 23 bp, Artificial sequence
  SiRNA target sequence
gttttaataaatacttctggccc

SEQ ID NO: 133090 - DNA, 23 bp, Artificial sequence
  SiRNA target sequence
ttttaataaatacttctggccct

SEQ ID NO: 133091 - DNA, 23 bp, Artificial sequence
  SiRNA target sequence
tttaataaatacttctggccctt

SEQ ID NO: 133092 - DNA, 23 bp, Artificial sequence
  SiRNA target sequence
ttaataaatacttctggcccttt

SEQ ID NO: 133093 - DNA, 23 bp, Artificial sequence
  SiRNA target sequence
taataaatacttctggccctttt

SEQ ID NO: 133094 - DNA, 23 bp, Artificial sequence
  SiRNA target sequence
aataaatacttctggcccttttg

SEQ ID NO: 133095 - DNA, 23 bp, Artificial sequence
  SiRNA target sequence
ataaatacttctggcccttttgc

SEQ ID NO: 133096 - DNA, 23 bp, Artificial sequence
  SiRNA target sequence
taaatacttctggcccttttgct

SEQ ID NO: 133097 - DNA, 23 bp, Artificial sequence
  SiRNA target sequence
aaatacttctggcccttttgctg

SEQ ID NO: 133098 - DNA, 23 bp, Artificial sequence
  SiRNA target sequence
aatacttctggcccttttgctga

SEQ ID NO: 133099 - DNA, 23 bp, Artificial sequence
  SiRNA target sequence
atacttctggcccttttgctgac

SEQ ID NO: 133100 - DNA, 23 bp, Artificial sequence
  SiRNA target sequence
tacttctggcccttttgctgacg

SEQ ID NO: 133101 - DNA, 23 bp, Artificial sequence
  SiRNA target sequence
acttctggcccttttgctgacga

SEQ ID NO: 133102 - DNA, 23 bp, Artificial sequence
  SiRNA target sequence
cttctggcccttttgctgacgag

SEQ ID NO: 133103 - DNA, 23 bp, Artificial sequence
  SiRNA target sequence
ttctggcccttttgctgacgagg

SEQ ID NO: 133104 - DNA, 23 bp, Artificial sequence
  SiRNA target sequence
tctggcccttttgctgacgaggt

SEQ ID NO: 133105 - DNA, 23 bp, Artificial sequence
  SiRNA target sequence
ctggcccttttgctgacgaggtt

SEQ ID NO: 133106 - DNA, 23 bp, Artificial sequence
  SiRNA target sequence
tggcccttttgctgacgaggttc

SEQ ID NO: 133107 - DNA, 23 bp, Artificial sequence
  SiRNA target sequence
ggcccttttgctgacgaggttcg

SEQ ID NO: 133108 - DNA, 23 bp, Artificial sequence
  SiRNA target sequence
gcccttttgctgacgaggttcga

SEQ ID NO: 133109 - DNA, 23 bp, Artificial sequence
  SiRNA target sequence
cccttttgctgacgaggttcgaa

SEQ ID NO: 133110 - DNA, 23 bp, Artificial sequence
  SiRNA target sequence
ccttttgctgacgaggttcgaaa

SEQ ID NO: 133111 - DNA, 23 bp, Artificial sequence
  SiRNA target sequence
cttttgctgacgaggttcgaaat

SEQ ID NO: 133112 - DNA, 23 bp, Artificial sequence
  SiRNA target sequence
ttttgctgacgaggttcgaaata

SEQ ID NO: 133113 - DNA, 23 bp, Artificial sequence
  SiRNA target sequence
tttgctgacgaggttcgaaatac

SEQ ID NO: 133114 - DNA, 23 bp, Artificial sequence
  SiRNA target sequence
ttgctgacgaggttcgaaataca

SEQ ID NO: 133115 - DNA, 23 bp, Artificial sequence
  SiRNA target sequence
tgctgacgaggttcgaaatacat

SEQ ID NO: 133116 - DNA, 23 bp, Artificial sequence
  SiRNA target sequence
gctgacgaggttcgaaatacatc

SEQ ID NO: 133117 - DNA, 23 bp, Artificial sequence
  SiRNA target sequence
ctgacgaggttcgaaatacatca

SEQ ID NO: 133118 - DNA, 23 bp, Artificial sequence
  SiRNA target sequence
tgacgaggttcgaaatacatcaa

SEQ ID NO: 133119 - DNA, 23 bp, Artificial sequence
  SiRNA target sequence
gacgaggttcgaaatacatcaat

SEQ ID NO: 133120 - DNA, 23 bp, Artificial sequence
  SiRNA target sequence
acgaggttcgaaatacatcaatt

SEQ ID NO: 133121 - DNA, 23 bp, Artificial sequence
  SiRNA target sequence
cgaggttcgaaatacatcaattg

SEQ ID NO: 133122 - DNA, 23 bp, Artificial sequence
  SiRNA target sequence
gaggttcgaaatacatcaattga

SEQ ID NO: 133123 - DNA, 23 bp, Artificial sequence
  SiRNA target sequence
aggttcgaaatacatcaattgaa

SEQ ID NO: 133124 - DNA, 23 bp, Artificial sequence
  SiRNA target sequence
ggttcgaaatacatcaattgaaa

SEQ ID NO: 133125 - DNA, 23 bp, Artificial sequence
  SiRNA target sequence
gttcgaaatacatcaattgaaaa

SEQ ID NO: 133126 - DNA, 23 bp, Artificial sequence
  SiRNA target sequence
ttcgaaatacatcaattgaaaac

SEQ ID NO: 133127 - DNA, 23 bp, Artificial sequence
  SiRNA target sequence
tcgaaatacatcaattgaaaact

SEQ ID NO: 133128 - DNA, 23 bp, Artificial sequence
  SiRNA target sequence
cgaaatacatcaattgaaaactg

SEQ ID NO: 133129 - DNA, 23 bp, Artificial sequence
  SiRNA target sequence
gaaatacatcaattgaaaactgt

SEQ ID NO: 133130 - DNA, 23 bp, Artificial sequence
  SiRNA target sequence
aaatacatcaattgaaaactgtc

SEQ ID NO: 133131 - DNA, 23 bp, Artificial sequence
  SiRNA target sequence
aatacatcaattgaaaactgtca

SEQ ID NO: 133132 - DNA, 23 bp, Artificial sequence
  SiRNA target sequence
atacatcaattgaaaactgtcaa

SEQ ID NO: 133133 - DNA, 23 bp, Artificial sequence
  SiRNA target sequence
tacatcaattgaaaactgtcaac

SEQ ID NO: 133134 - DNA, 23 bp, Artificial sequence
  SiRNA target sequence
acatcaattgaaaactgtcaacc

SEQ ID NO: 133135 - DNA, 23 bp, Artificial sequence
  SiRNA target sequence
catcaattgaaaactgtcaacca

SEQ ID NO: 133136 - DNA, 23 bp, Artificial sequence
  SiRNA target sequence
atcaattgaaaactgtcaaccaa

SEQ ID NO: 133137 - DNA, 23 bp, Artificial sequence
  SiRNA target sequence
tcaattgaaaactgtcaaccaat

SEQ ID NO: 133138 - DNA, 23 bp, Artificial sequence
  SiRNA target sequence
caattgaaaactgtcaaccaata

SEQ ID NO: 133139 - DNA, 23 bp, Artificial sequence
  SiRNA target sequence
aattgaaaactgtcaaccaatac

SEQ ID NO: 133140 - DNA, 23 bp, Artificial sequence
  SiRNA target sequence
attgaaaactgtcaaccaatact

SEQ ID NO: 133141 - DNA, 23 bp, Artificial sequence
  SiRNA target sequence
ttgaaaactgtcaaccaatactc

SEQ ID NO: 133142 - DNA, 23 bp, Artificial sequence
  SiRNA target sequence
tgaaaactgtcaaccaatactcc

SEQ ID NO: 133143 - DNA, 23 bp, Artificial sequence
  SiRNA target sequence
gaaaactgtcaaccaatactcca

SEQ ID NO: 133144 - DNA, 23 bp, Artificial sequence
  SiRNA target sequence
aaaactgtcaaccaatactccaa

SEQ ID NO: 133145 - DNA, 23 bp, Artificial sequence
  SiRNA target sequence
aaactgtcaaccaatactccaac

SEQ ID NO: 133146 - DNA, 23 bp, Artificial sequence
  SiRNA target sequence
aactgtcaaccaatactccaaca

SEQ ID NO: 133147 - DNA, 23 bp, Artificial sequence
  SiRNA target sequence
actgtcaaccaatactccaacat

SEQ ID NO: 133148 - DNA, 23 bp, Artificial sequence
  SiRNA target sequence
ctgtcaaccaatactccaacata

SEQ ID NO: 133149 - DNA, 23 bp, Artificial sequence
  SiRNA target sequence
tgtcaaccaatactccaacatag

SEQ ID NO: 133150 - DNA, 23 bp, Artificial sequence
  SiRNA target sequence
gtcaaccaatactccaacatagt

SEQ ID NO: 133151 - DNA, 23 bp, Artificial sequence
  SiRNA target sequence
tcaaccaatactccaacatagtt

SEQ ID NO: 133152 - DNA, 23 bp, Artificial sequence
  SiRNA target sequence
caaccaatactccaacatagtta

SEQ ID NO: 133153 - DNA, 23 bp, Artificial sequence
  SiRNA target sequence
aaccaatactccaacatagttat

SEQ ID NO: 133154 - DNA, 23 bp, Artificial sequence
  SiRNA target sequence
accaatactccaacatagttatg

SEQ ID NO: 133155 - DNA, 23 bp, Artificial sequence
  SiRNA target sequence
ccaatactccaacatagttatgg

SEQ ID NO: 133156 - DNA, 23 bp, Artificial sequence
  SiRNA target sequence
caatactccaacatagttatggt

SEQ ID NO: 133157 - DNA, 23 bp, Artificial sequence
  SiRNA target sequence
aatactccaacatagttatggta

SEQ ID NO: 133158 - DNA, 23 bp, Artificial sequence
  SiRNA target sequence
atactccaacatagttatggtac

SEQ ID NO: 133159 - DNA, 23 bp, Artificial sequence
  SiRNA target sequence
tactccaacatagttatggtaca

SEQ ID NO: 133160 - DNA, 23 bp, Artificial sequence
  SiRNA target sequence
actccaacatagttatggtacac

SEQ ID NO: 133161 - DNA, 23 bp, Artificial sequence
  SiRNA target sequence
ctccaacatagttatggtacaca

SEQ ID NO: 133162 - DNA, 23 bp, Artificial sequence
  SiRNA target sequence
tccaacatagttatggtacacat

SEQ ID NO: 133163 - DNA, 23 bp, Artificial sequence
  SiRNA target sequence
ccaacatagttatggtacacata

SEQ ID NO: 133164 - DNA, 23 bp, Artificial sequence
  SiRNA target sequence
caacatagttatggtacacatat

SEQ ID NO: 133165 - DNA, 23 bp, Artificial sequence
  SiRNA target sequence
aacatagttatggtacacatatt

SEQ ID NO: 133166 - DNA, 23 bp, Artificial sequence
  SiRNA target sequence
acatagttatggtacacatattg

SEQ ID NO: 133167 - DNA, 23 bp, Artificial sequence
  SiRNA target sequence
catagttatggtacacatattgt

SEQ ID NO: 133168 - DNA, 23 bp, Artificial sequence
  SiRNA target sequence
atagttatggtacacatattgta

SEQ ID NO: 133169 - DNA, 23 bp, Artificial sequence
  SiRNA target sequence
tagttatggtacacatattgtag

SEQ ID NO: 133170 - DNA, 23 bp, Artificial sequence
  SiRNA target sequence
agttatggtacacatattgtagt

SEQ ID NO: 133171 - DNA, 23 bp, Artificial sequence
  SiRNA target sequence
gttatggtacacatattgtagtt

SEQ ID NO: 133172 - DNA, 23 bp, Artificial sequence
  SiRNA target sequence
ttatggtacacatattgtagttc

SEQ ID NO: 133173 - DNA, 23 bp, Artificial sequence
  SiRNA target sequence
tatggtacacatattgtagttcc

SEQ ID NO: 133174 - DNA, 23 bp, Artificial sequence
  SiRNA target sequence
atggtacacatattgtagttcct

SEQ ID NO: 133175 - DNA, 23 bp, Artificial sequence
  SiRNA target sequence
tggtacacatattgtagttcctg

SEQ ID NO: 133176 - DNA, 23 bp, Artificial sequence
  SiRNA target sequence
ggtacacatattgtagttcctgc

SEQ ID NO: 133177 - DNA, 23 bp, Artificial sequence
  SiRNA target sequence
gtacacatattgtagttcctgcg

SEQ ID NO: 133178 - DNA, 23 bp, Artificial sequence
  SiRNA target sequence
tacacatattgtagttcctgcga

SEQ ID NO: 133179 - DNA, 23 bp, Artificial sequence
  SiRNA target sequence
acacatattgtagttcctgcgat

SEQ ID NO: 133180 - DNA, 23 bp, Artificial sequence
  SiRNA target sequence
cacatattgtagttcctgcgata

SEQ ID NO: 133181 - DNA, 23 bp, Artificial sequence
  SiRNA target sequence
acatattgtagttcctgcgatat

SEQ ID NO: 133182 - DNA, 23 bp, Artificial sequence
  SiRNA target sequence
catattgtagttcctgcgatatt

SEQ ID NO: 133183 - DNA, 23 bp, Artificial sequence
  SiRNA target sequence
atattgtagttcctgcgatattt

SEQ ID NO: 133184 - DNA, 23 bp, Artificial sequence
  SiRNA target sequence
tattgtagttcctgcgatatttt

SEQ ID NO: 133185 - DNA, 23 bp, Artificial sequence
  SiRNA target sequence
attgtagttcctgcgatattttc

SEQ ID NO: 133186 - DNA, 23 bp, Artificial sequence
  SiRNA target sequence
ttgtagttcctgcgatattttcg

SEQ ID NO: 133187 - DNA, 23 bp, Artificial sequence
  SiRNA target sequence
tgtagttcctgcgatattttcgc

SEQ ID NO: 133188 - DNA, 23 bp, Artificial sequence
  SiRNA target sequence
gtagttcctgcgatattttcgcc

SEQ ID NO: 133189 - DNA, 23 bp, Artificial sequence
  SiRNA target sequence
tagttcctgcgatattttcgcct

SEQ ID NO: 133190 - DNA, 23 bp, Artificial sequence
  SiRNA target sequence
agttcctgcgatattttcgccta

SEQ ID NO: 133191 - DNA, 23 bp, Artificial sequence
  SiRNA target sequence
gttcctgcgatattttcgcctaa

SEQ ID NO: 133192 - DNA, 23 bp, Artificial sequence
  SiRNA target sequence
ttcctgcgatattttcgcctaaa

SEQ ID NO: 133193 - DNA, 23 bp, Artificial sequence
  SiRNA target sequence
tcctgcgatattttcgcctaaaa

SEQ ID NO: 133194 - DNA, 23 bp, Artificial sequence
  SiRNA target sequence
cctgcgatattttcgcctaaaaa

SEQ ID NO: 133195 - DNA, 23 bp, Artificial sequence
  SiRNA target sequence
ctgcgatattttcgcctaaaaat

SEQ ID NO: 133196 - DNA, 23 bp, Artificial sequence
  SiRNA target sequence
tgcgatattttcgcctaaaaata

SEQ ID NO: 133197 - DNA, 23 bp, Artificial sequence
  SiRNA target sequence
gcgatattttcgcctaaaaatat

SEQ ID NO: 133198 - DNA, 23 bp, Artificial sequence
  SiRNA target sequence
cgatattttcgcctaaaaatatg

SEQ ID NO: 133199 - DNA, 23 bp, Artificial sequence
  SiRNA target sequence
gatattttcgcctaaaaatatgg

SEQ ID NO: 133200 - DNA, 23 bp, Artificial sequence
  SiRNA target sequence
atattttcgcctaaaaatatggg

SEQ ID NO: 133201 - DNA, 23 bp, Artificial sequence
  SiRNA target sequence
tattttcgcctaaaaatatgggc

SEQ ID NO: 133202 - DNA, 23 bp, Artificial sequence
  SiRNA target sequence
attttcgcctaaaaatatgggct

SEQ ID NO: 133203 - DNA, 23 bp, Artificial sequence
  SiRNA target sequence
ttttcgcctaaaaatatgggctt

SEQ ID NO: 133204 - DNA, 23 bp, Artificial sequence
  SiRNA target sequence
tttcgcctaaaaatatgggcttt

SEQ ID NO: 133205 - DNA, 23 bp, Artificial sequence
  SiRNA target sequence
ttcgcctaaaaatatgggctttg

SEQ ID NO: 133206 - DNA, 23 bp, Artificial sequence
  SiRNA target sequence
tcgcctaaaaatatgggctttgt

SEQ ID NO: 133207 - DNA, 23 bp, Artificial sequence
  SiRNA target sequence
cgcctaaaaatatgggctttgtt

SEQ ID NO: 133208 - DNA, 23 bp, Artificial sequence
  SiRNA target sequence
gcctaaaaatatgggctttgttg

SEQ ID NO: 133209 - DNA, 23 bp, Artificial sequence
  SiRNA target sequence
cctaaaaatatgggctttgttga

SEQ ID NO: 133210 - DNA, 23 bp, Artificial sequence
  SiRNA target sequence
ctaaaaatatgggctttgttgat

SEQ ID NO: 133211 - DNA, 23 bp, Artificial sequence
  SiRNA target sequence
taaaaatatgggctttgttgatc

SEQ ID NO: 133212 - DNA, 23 bp, Artificial sequence
  SiRNA target sequence
aaaaatatgggctttgttgatcc

SEQ ID NO: 133213 - DNA, 23 bp, Artificial sequence
  SiRNA target sequence
aaaatatgggctttgttgatcca

SEQ ID NO: 133214 - DNA, 23 bp, Artificial sequence
  SiRNA target sequence
aaatatgggctttgttgatccaa

SEQ ID NO: 133215 - DNA, 23 bp, Artificial sequence
  SiRNA target sequence
aatatgggctttgttgatccaag

SEQ ID NO: 133216 - DNA, 23 bp, Artificial sequence
  SiRNA target sequence
atatgggctttgttgatccaagc

SEQ ID NO: 133217 - DNA, 23 bp, Artificial sequence
  SiRNA target sequence
tatgggctttgttgatccaagca

SEQ ID NO: 133218 - DNA, 23 bp, Artificial sequence
  SiRNA target sequence
atgggctttgttgatccaagcac

SEQ ID NO: 133219 - DNA, 23 bp, Artificial sequence
  SiRNA target sequence
tgggctttgttgatccaagcacg

SEQ ID NO: 133220 - DNA, 23 bp, Artificial sequence
  SiRNA target sequence
gggctttgttgatccaagcacga

SEQ ID NO: 133221 - DNA, 23 bp, Artificial sequence
  SiRNA target sequence
ggctttgttgatccaagcacgag

SEQ ID NO: 133222 - DNA, 23 bp, Artificial sequence
  SiRNA target sequence
gctttgttgatccaagcacgagt

SEQ ID NO: 133223 - DNA, 23 bp, Artificial sequence
  SiRNA target sequence
ctttgttgatccaagcacgagtg

SEQ ID NO: 133224 - DNA, 23 bp, Artificial sequence
  SiRNA target sequence
tttgttgatccaagcacgagtga

SEQ ID NO: 133225 - DNA, 23 bp, Artificial sequence
  SiRNA target sequence
ttgttgatccaagcacgagtgat

SEQ ID NO: 133226 - DNA, 23 bp, Artificial sequence
  SiRNA target sequence
tgttgatccaagcacgagtgatg

SEQ ID NO: 133227 - DNA, 23 bp, Artificial sequence
  SiRNA target sequence
gttgatccaagcacgagtgatgg

SEQ ID NO: 133228 - DNA, 23 bp, Artificial sequence
  SiRNA target sequence
ttgatccaagcacgagtgatgga

SEQ ID NO: 133229 - DNA, 23 bp, Artificial sequence
  SiRNA target sequence
tgatccaagcacgagtgatggaa

SEQ ID NO: 133230 - DNA, 23 bp, Artificial sequence
  SiRNA target sequence
gatccaagcacgagtgatggaag

SEQ ID NO: 133231 - DNA, 23 bp, Artificial sequence
  SiRNA target sequence
atccaagcacgagtgatggaaga

SEQ ID NO: 133232 - DNA, 23 bp, Artificial sequence
  SiRNA target sequence
tccaagcacgagtgatggaagaa

SEQ ID NO: 133233 - DNA, 23 bp, Artificial sequence
  SiRNA target sequence
ccaagcacgagtgatggaagaat

SEQ ID NO: 133234 - DNA, 23 bp, Artificial sequence
  SiRNA target sequence
caagcacgagtgatggaagaatc

SEQ ID NO: 133235 - DNA, 23 bp, Artificial sequence
  SiRNA target sequence
aagcacgagtgatggaagaatcg

SEQ ID NO: 133236 - DNA, 23 bp, Artificial sequence
  SiRNA target sequence
agcacgagtgatggaagaatcgc

SEQ ID NO: 133237 - DNA, 23 bp, Artificial sequence
  SiRNA target sequence
gcacgagtgatggaagaatcgca

SEQ ID NO: 133238 - DNA, 23 bp, Artificial sequence
  SiRNA target sequence
cacgagtgatggaagaatcgcat

SEQ ID NO: 133239 - DNA, 23 bp, Artificial sequence
  SiRNA target sequence
acgagtgatggaagaatcgcatt

SEQ ID NO: 133240 - DNA, 23 bp, Artificial sequence
  SiRNA target sequence
cgagtgatggaagaatcgcattt

SEQ ID NO: 133241 - DNA, 23 bp, Artificial sequence
  SiRNA target sequence
gagtgatggaagaatcgcatttt

SEQ ID NO: 133242 - DNA, 23 bp, Artificial sequence
  SiRNA target sequence
agtgatggaagaatcgcattttt

SEQ ID NO: 133243 - DNA, 23 bp, Artificial sequence
  SiRNA target sequence
gtgatggaagaatcgcatttttt

SEQ ID NO: 133244 - DNA, 23 bp, Artificial sequence
  SiRNA target sequence
tgatggaagaatcgcatttttta

SEQ ID NO: 133245 - DNA, 23 bp, Artificial sequence
  SiRNA target sequence
gatggaagaatcgcattttttat

SEQ ID NO: 133246 - DNA, 23 bp, Artificial sequence
  SiRNA target sequence
atggaagaatcgcattttttatg

SEQ ID NO: 133247 - DNA, 23 bp, Artificial sequence
  SiRNA target sequence
tggaagaatcgcattttttatga

SEQ ID NO: 133248 - DNA, 23 bp, Artificial sequence
  SiRNA target sequence
ggaagaatcgcattttttatgaa

SEQ ID NO: 133249 - DNA, 23 bp, Artificial sequence
  SiRNA target sequence
gaagaatcgcattttttatgaat

SEQ ID NO: 133250 - DNA, 23 bp, Artificial sequence
  SiRNA target sequence
aagaatcgcattttttatgaatt

SEQ ID NO: 133251 - DNA, 23 bp, Artificial sequence
  SiRNA target sequence
agaatcgcattttttatgaattt

SEQ ID NO: 133252 - DNA, 23 bp, Artificial sequence
  SiRNA target sequence
gaatcgcattttttatgaatttt

SEQ ID NO: 133253 - DNA, 23 bp, Artificial sequence
  SiRNA target sequence
aatcgcattttttatgaatttta

SEQ ID NO: 133254 - DNA, 23 bp, Artificial sequence
  SiRNA target sequence
atcgcattttttatgaattttaa

SEQ ID NO: 133255 - DNA, 23 bp, Artificial sequence
  SiRNA target sequence
tcgcattttttatgaattttaaa

SEQ ID NO: 133256 - DNA, 23 bp, Artificial sequence
  SiRNA target sequence
cgcattttttatgaattttaaag

SEQ ID NO: 133257 - DNA, 23 bp, Artificial sequence
  SiRNA target sequence
gcattttttatgaattttaaagg

SEQ ID NO: 133258 - DNA, 23 bp, Artificial sequence
  SiRNA target sequence
cattttttatgaattttaaaggt

SEQ ID NO: 133259 - DNA, 23 bp, Artificial sequence
  SiRNA target sequence
attttttatgaattttaaaggta

SEQ ID NO: 133260 - DNA, 23 bp, Artificial sequence
  SiRNA target sequence
ttttttatgaattttaaaggtaa

SEQ ID NO: 133261 - DNA, 23 bp, Artificial sequence
  SiRNA target sequence
tttttatgaattttaaaggtaaa

SEQ ID NO: 133262 - DNA, 23 bp, Artificial sequence
  SiRNA target sequence
ttttatgaattttaaaggtaaaa

SEQ ID NO: 133263 - DNA, 23 bp, Artificial sequence
  SiRNA target sequence
tttatgaattttaaaggtaaaac

SEQ ID NO: 133264 - DNA, 23 bp, Artificial sequence
  SiRNA target sequence
ttatgaattttaaaggtaaaaca

SEQ ID NO: 133265 - DNA, 23 bp, Artificial sequence
  SiRNA target sequence
tatgaattttaaaggtaaaacat

SEQ ID NO: 133266 - DNA, 23 bp, Artificial sequence
  SiRNA target sequence
atgaattttaaaggtaaaacatt

SEQ ID NO: 133267 - DNA, 23 bp, Artificial sequence
  SiRNA target sequence
tgaattttaaaggtaaaacattg

SEQ ID NO: 133268 - DNA, 23 bp, Artificial sequence
  SiRNA target sequence
gaattttaaaggtaaaacattga

SEQ ID NO: 133269 - DNA, 23 bp, Artificial sequence
  SiRNA target sequence
aattttaaaggtaaaacattgat

SEQ ID NO: 133270 - DNA, 23 bp, Artificial sequence
  SiRNA target sequence
attttaaaggtaaaacattgatt

SEQ ID NO: 133271 - DNA, 23 bp, Artificial sequence
  SiRNA target sequence
ttttaaaggtaaaacattgattg

SEQ ID NO: 133272 - DNA, 23 bp, Artificial sequence
  SiRNA target sequence
tttaaaggtaaaacattgattgg

SEQ ID NO: 133273 - DNA, 23 bp, Artificial sequence
  SiRNA target sequence
ttaaaggtaaaacattgattgga

SEQ ID NO: 133274 - DNA, 23 bp, Artificial sequence
  SiRNA target sequence
taaaggtaaaacattgattggag

SEQ ID NO: 133275 - DNA, 23 bp, Artificial sequence
  SiRNA target sequence
aaaggtaaaacattgattggagg

SEQ ID NO: 133276 - DNA, 23 bp, Artificial sequence
  SiRNA target sequence
aaggtaaaacattgattggagga

SEQ ID NO: 133277 - DNA, 23 bp, Artificial sequence
  SiRNA target sequence
aggtaaaacattgattggaggaa

SEQ ID NO: 133278 - DNA, 23 bp, Artificial sequence
  SiRNA target sequence
ggtaaaacattgattggaggaac

SEQ ID NO: 133279 - DNA, 23 bp, Artificial sequence
  SiRNA target sequence
gtaaaacattgattggaggaaca

SEQ ID NO: 133280 - DNA, 23 bp, Artificial sequence
  SiRNA target sequence
taaaacattgattggaggaacag

SEQ ID NO: 133281 - DNA, 23 bp, Artificial sequence
  SiRNA target sequence
aaaacattgattggaggaacaga

SEQ ID NO: 133282 - DNA, 23 bp, Artificial sequence
  SiRNA target sequence
aaacattgattggaggaacagat

SEQ ID NO: 133283 - DNA, 23 bp, Artificial sequence
  SiRNA target sequence
aacattgattggaggaacagatg

SEQ ID NO: 133284 - DNA, 23 bp, Artificial sequence
  SiRNA target sequence
acattgattggaggaacagatgt

SEQ ID NO: 133285 - DNA, 23 bp, Artificial sequence
  SiRNA target sequence
cattgattggaggaacagatgtt

SEQ ID NO: 133286 - DNA, 23 bp, Artificial sequence
  SiRNA target sequence
attgattggaggaacagatgtta

SEQ ID NO: 133287 - DNA, 23 bp, Artificial sequence
  SiRNA target sequence
ttgattggaggaacagatgttaa

SEQ ID NO: 133288 - DNA, 23 bp, Artificial sequence
  SiRNA target sequence
tgattggaggaacagatgttaag

SEQ ID NO: 133289 - DNA, 23 bp, Artificial sequence
  SiRNA target sequence
gattggaggaacagatgttaagt

SEQ ID NO: 133290 - DNA, 23 bp, Artificial sequence
  SiRNA target sequence
attggaggaacagatgttaagtg

SEQ ID NO: 133291 - DNA, 23 bp, Artificial sequence
  SiRNA target sequence
ttggaggaacagatgttaagtgt

SEQ ID NO: 133292 - DNA, 23 bp, Artificial sequence
  SiRNA target sequence
tggaggaacagatgttaagtgta

SEQ ID NO: 133293 - DNA, 23 bp, Artificial sequence
  SiRNA target sequence
ggaggaacagatgttaagtgtaa

SEQ ID NO: 133294 - DNA, 23 bp, Artificial sequence
  SiRNA target sequence
gaggaacagatgttaagtgtaaa

SEQ ID NO: 133295 - DNA, 23 bp, Artificial sequence
  SiRNA target sequence
aggaacagatgttaagtgtaaag

SEQ ID NO: 133296 - DNA, 23 bp, Artificial sequence
  SiRNA target sequence
ggaacagatgttaagtgtaaagt

SEQ ID NO: 133297 - DNA, 23 bp, Artificial sequence
  SiRNA target sequence
gaacagatgttaagtgtaaagtt

SEQ ID NO: 133298 - DNA, 23 bp, Artificial sequence
  SiRNA target sequence
aacagatgttaagtgtaaagttg

SEQ ID NO: 133299 - DNA, 23 bp, Artificial sequence
  SiRNA target sequence
acagatgttaagtgtaaagttga

SEQ ID NO: 133300 - DNA, 23 bp, Artificial sequence
  SiRNA target sequence
cagatgttaagtgtaaagttgaa

SEQ ID NO: 133301 - DNA, 23 bp, Artificial sequence
  SiRNA target sequence
agatgttaagtgtaaagttgaag

SEQ ID NO: 133302 - DNA, 23 bp, Artificial sequence
  SiRNA target sequence
gatgttaagtgtaaagttgaaga

SEQ ID NO: 133303 - DNA, 23 bp, Artificial sequence
  SiRNA target sequence
atgttaagtgtaaagttgaagat

SEQ ID NO: 133304 - DNA, 23 bp, Artificial sequence
  SiRNA target sequence
tgttaagtgtaaagttgaagatt

SEQ ID NO: 133305 - DNA, 23 bp, Artificial sequence
  SiRNA target sequence
gttaagtgtaaagttgaagattt

SEQ ID NO: 133306 - DNA, 23 bp, Artificial sequence
  SiRNA target sequence
ttaagtgtaaagttgaagattta

SEQ ID NO: 133307 - DNA, 23 bp, Artificial sequence
  SiRNA target sequence
taagtgtaaagttgaagatttaa

SEQ ID NO: 133308 - DNA, 23 bp, Artificial sequence
  SiRNA target sequence
aagtgtaaagttgaagatttaat

SEQ ID NO: 133309 - DNA, 23 bp, Artificial sequence
  SiRNA target sequence
agtgtaaagttgaagatttaata

SEQ ID NO: 133310 - DNA, 23 bp, Artificial sequence
  SiRNA target sequence
gtgtaaagttgaagatttaataa

SEQ ID NO: 133311 - DNA, 23 bp, Artificial sequence
  SiRNA target sequence
tgtaaagttgaagatttaataaa

SEQ ID NO: 133312 - DNA, 23 bp, Artificial sequence
  SiRNA target sequence
gtaaagttgaagatttaataaaa

SEQ ID NO: 133313 - DNA, 23 bp, Artificial sequence
  SiRNA target sequence
taaagttgaagatttaataaaac

SEQ ID NO: 133314 - DNA, 23 bp, Artificial sequence
  SiRNA target sequence
aaagttgaagatttaataaaacc

SEQ ID NO: 133315 - DNA, 23 bp, Artificial sequence
  SiRNA target sequence
aagttgaagatttaataaaaccg

SEQ ID NO: 133316 - DNA, 23 bp, Artificial sequence
  SiRNA target sequence
agttgaagatttaataaaaccga

SEQ ID NO: 133317 - DNA, 23 bp, Artificial sequence
  SiRNA target sequence
gttgaagatttaataaaaccgac

SEQ ID NO: 133318 - DNA, 23 bp, Artificial sequence
  SiRNA target sequence
ttgaagatttaataaaaccgact

SEQ ID NO: 133319 - DNA, 23 bp, Artificial sequence
  SiRNA target sequence
tgaagatttaataaaaccgactg

SEQ ID NO: 133320 - DNA, 23 bp, Artificial sequence
  SiRNA target sequence
gaagatttaataaaaccgactga

SEQ ID NO: 133321 - DNA, 23 bp, Artificial sequence
  SiRNA target sequence
aagatttaataaaaccgactgaa

SEQ ID NO: 133322 - DNA, 23 bp, Artificial sequence
  SiRNA target sequence
agatttaataaaaccgactgaag

SEQ ID NO: 133323 - DNA, 23 bp, Artificial sequence
  SiRNA target sequence
gatttaataaaaccgactgaaga

SEQ ID NO: 133324 - DNA, 23 bp, Artificial sequence
  SiRNA target sequence
atttaataaaaccgactgaagaa

SEQ ID NO: 133325 - DNA, 23 bp, Artificial sequence
  SiRNA target sequence
tttaataaaaccgactgaagaag

SEQ ID NO: 133326 - DNA, 23 bp, Artificial sequence
  SiRNA target sequence
ttaataaaaccgactgaagaaga

SEQ ID NO: 133327 - DNA, 23 bp, Artificial sequence
  SiRNA target sequence
taataaaaccgactgaagaagat

SEQ ID NO: 133328 - DNA, 23 bp, Artificial sequence
  SiRNA target sequence
aataaaaccgactgaagaagatc

SEQ ID NO: 133329 - DNA, 23 bp, Artificial sequence
  SiRNA target sequence
ataaaaccgactgaagaagatct

SEQ ID NO: 133330 - DNA, 23 bp, Artificial sequence
  SiRNA target sequence
taaaaccgactgaagaagatcta

SEQ ID NO: 133331 - DNA, 23 bp, Artificial sequence
  SiRNA target sequence
aaaaccgactgaagaagatctaa

SEQ ID NO: 133332 - DNA, 23 bp, Artificial sequence
  SiRNA target sequence
aaaccgactgaagaagatctaaa

SEQ ID NO: 133333 - DNA, 23 bp, Artificial sequence
  SiRNA target sequence
aaccgactgaagaagatctaaac

SEQ ID NO: 133334 - DNA, 23 bp, Artificial sequence
  SiRNA target sequence
accgactgaagaagatctaaact

SEQ ID NO: 133335 - DNA, 23 bp, Artificial sequence
  SiRNA target sequence
ccgactgaagaagatctaaactt

SEQ ID NO: 133336 - DNA, 23 bp, Artificial sequence
  SiRNA target sequence
cgactgaagaagatctaaacttt

SEQ ID NO: 133337 - DNA, 23 bp, Artificial sequence
  SiRNA target sequence
gactgaagaagatctaaactttc

SEQ ID NO: 133338 - DNA, 23 bp, Artificial sequence
  SiRNA target sequence
actgaagaagatctaaactttct

SEQ ID NO: 133339 - DNA, 23 bp, Artificial sequence
  SiRNA target sequence
ctgaagaagatctaaactttctt

SEQ ID NO: 133340 - DNA, 23 bp, Artificial sequence
  SiRNA target sequence
tgaagaagatctaaactttctta

SEQ ID NO: 133341 - DNA, 23 bp, Artificial sequence
  SiRNA target sequence
gaagaagatctaaactttcttat

SEQ ID NO: 133342 - DNA, 23 bp, Artificial sequence
  SiRNA target sequence
aagaagatctaaactttcttatt

SEQ ID NO: 133343 - DNA, 23 bp, Artificial sequence
  SiRNA target sequence
agaagatctaaactttcttattc

SEQ ID NO: 133344 - DNA, 23 bp, Artificial sequence
  SiRNA target sequence
gaagatctaaactttcttattca

SEQ ID NO: 133345 - DNA, 23 bp, Artificial sequence
  SiRNA target sequence
aagatctaaactttcttattcac

SEQ ID NO: 133346 - DNA, 23 bp, Artificial sequence
  SiRNA target sequence
agatctaaactttcttattcacg

SEQ ID NO: 133347 - DNA, 23 bp, Artificial sequence
  SiRNA target sequence
gatctaaactttcttattcacga

SEQ ID NO: 133348 - DNA, 23 bp, Artificial sequence
  SiRNA target sequence
atctaaactttcttattcacgag

SEQ ID NO: 133349 - DNA, 23 bp, Artificial sequence
  SiRNA target sequence
tctaaactttcttattcacgagg

SEQ ID NO: 133350 - DNA, 23 bp, Artificial sequence
  SiRNA target sequence
ctaaactttcttattcacgaggc

SEQ ID NO: 133351 - DNA, 23 bp, Artificial sequence
  SiRNA target sequence
taaactttcttattcacgaggcc

SEQ ID NO: 133352 - DNA, 23 bp, Artificial sequence
  SiRNA target sequence
aaactttcttattcacgaggcca

SEQ ID NO: 133353 - DNA, 23 bp, Artificial sequence
  SiRNA target sequence
aactttcttattcacgaggccaa

SEQ ID NO: 133354 - DNA, 23 bp, Artificial sequence
  SiRNA target sequence
actttcttattcacgaggccaat

SEQ ID NO: 133355 - DNA, 23 bp, Artificial sequence
  SiRNA target sequence
ctttcttattcacgaggccaatt

SEQ ID NO: 133356 - DNA, 23 bp, Artificial sequence
  SiRNA target sequence
tttcttattcacgaggccaatta

SEQ ID NO: 133357 - DNA, 23 bp, Artificial sequence
  SiRNA target sequence
ttcttattcacgaggccaattat

SEQ ID NO: 133358 - DNA, 23 bp, Artificial sequence
  SiRNA target sequence
tcttattcacgaggccaattatt

SEQ ID NO: 133359 - DNA, 23 bp, Artificial sequence
  SiRNA target sequence
cttattcacgaggccaattattt

SEQ ID NO: 133360 - DNA, 23 bp, Artificial sequence
  SiRNA target sequence
ttattcacgaggccaattatttt

SEQ ID NO: 133361 - DNA, 23 bp, Artificial sequence
  SiRNA target sequence
tattcacgaggccaattatttta

SEQ ID NO: 133362 - DNA, 23 bp, Artificial sequence
  SiRNA target sequence
attcacgaggccaattattttac

SEQ ID NO: 133363 - DNA, 23 bp, Artificial sequence
  SiRNA target sequence
ttcacgaggccaattattttaca

SEQ ID NO: 133364 - DNA, 23 bp, Artificial sequence
  SiRNA target sequence
tcacgaggccaattattttacag

SEQ ID NO: 133365 - DNA, 23 bp, Artificial sequence
  SiRNA target sequence
cacgaggccaattattttacaga

SEQ ID NO: 133366 - DNA, 23 bp, Artificial sequence
  SiRNA target sequence
acgaggccaattattttacagat

SEQ ID NO: 133367 - DNA, 23 bp, Artificial sequence
  SiRNA target sequence
cgaggccaattattttacagatc

SEQ ID NO: 133368 - DNA, 23 bp, Artificial sequence
  SiRNA target sequence
gaggccaattattttacagatca

SEQ ID NO: 133369 - DNA, 23 bp, Artificial sequence
  SiRNA target sequence
aggccaattattttacagatcac

SEQ ID NO: 133370 - DNA, 23 bp, Artificial sequence
  SiRNA target sequence
ggccaattattttacagatcaca

SEQ ID NO: 133371 - DNA, 23 bp, Artificial sequence
  SiRNA target sequence
gccaattattttacagatcacaa

SEQ ID NO: 133372 - DNA, 23 bp, Artificial sequence
  SiRNA target sequence
ccaattattttacagatcacaat

SEQ ID NO: 133373 - DNA, 23 bp, Artificial sequence
  SiRNA target sequence
caattattttacagatcacaatt

SEQ ID NO: 133374 - DNA, 23 bp, Artificial sequence
  SiRNA target sequence
aattattttacagatcacaattt

SEQ ID NO: 133375 - DNA, 23 bp, Artificial sequence
  SiRNA target sequence
attattttacagatcacaattta

SEQ ID NO: 133376 - DNA, 23 bp, Artificial sequence
  SiRNA target sequence
ttattttacagatcacaatttaa

SEQ ID NO: 133377 - DNA, 23 bp, Artificial sequence
  SiRNA target sequence
tattttacagatcacaatttaaa

SEQ ID NO: 133378 - DNA, 23 bp, Artificial sequence
  SiRNA target sequence
attttacagatcacaatttaaaa

SEQ ID NO: 133379 - DNA, 23 bp, Artificial sequence
  SiRNA target sequence
ttttacagatcacaatttaaaat

SEQ ID NO: 133380 - DNA, 23 bp, Artificial sequence
  SiRNA target sequence
tttacagatcacaatttaaaatt

SEQ ID NO: 133381 - DNA, 23 bp, Artificial sequence
  SiRNA target sequence
ttacagatcacaatttaaaatta

SEQ ID NO: 133382 - DNA, 23 bp, Artificial sequence
  SiRNA target sequence
tacagatcacaatttaaaattaa

SEQ ID NO: 133383 - DNA, 23 bp, Artificial sequence
  SiRNA target sequence
acagatcacaatttaaaattaac

SEQ ID NO: 133384 - DNA, 23 bp, Artificial sequence
  SiRNA target sequence
cagatcacaatttaaaattaaca

SEQ ID NO: 133385 - DNA, 23 bp, Artificial sequence
  SiRNA target sequence
agatcacaatttaaaattaacaa

SEQ ID NO: 133386 - DNA, 23 bp, Artificial sequence
  SiRNA target sequence
gatcacaatttaaaattaacaaa

SEQ ID NO: 133387 - DNA, 23 bp, Artificial sequence
  SiRNA target sequence
atcacaatttaaaattaacaaaa

SEQ ID NO: 133388 - DNA, 23 bp, Artificial sequence
  SiRNA target sequence
tcacaatttaaaattaacaaaaa

SEQ ID NO: 133389 - DNA, 23 bp, Artificial sequence
  SiRNA target sequence
cacaatttaaaattaacaaaaaa

SEQ ID NO: 133390 - DNA, 23 bp, Artificial sequence
  SiRNA target sequence
acaatttaaaattaacaaaaaaa

SEQ ID NO: 133391 - DNA, 23 bp, Artificial sequence
  SiRNA target sequence
caatttaaaattaacaaaaaaag

SEQ ID NO: 133392 - DNA, 23 bp, Artificial sequence
  SiRNA target sequence
aatttaaaattaacaaaaaaaga

SEQ ID NO: 133393 - DNA, 23 bp, Artificial sequence
  SiRNA target sequence
atttaaaattaacaaaaaaagat

SEQ ID NO: 133394 - DNA, 23 bp, Artificial sequence
  SiRNA target sequence
tttaaaattaacaaaaaaagatg

SEQ ID NO: 133395 - DNA, 23 bp, Artificial sequence
  SiRNA target sequence
ttaaaattaacaaaaaaagatgt

SEQ ID NO: 133396 - DNA, 23 bp, Artificial sequence
  SiRNA target sequence
taaaattaacaaaaaaagatgtt

SEQ ID NO: 133397 - DNA, 23 bp, Artificial sequence
  SiRNA target sequence
aaaattaacaaaaaaagatgttt

SEQ ID NO: 133398 - DNA, 23 bp, Artificial sequence
  SiRNA target sequence
aaattaacaaaaaaagatgtttt

SEQ ID NO: 133399 - DNA, 23 bp, Artificial sequence
  SiRNA target sequence
aattaacaaaaaaagatgttttg

SEQ ID NO: 133400 - DNA, 23 bp, Artificial sequence
  SiRNA target sequence
attaacaaaaaaagatgttttgt

SEQ ID NO: 133401 - DNA, 23 bp, Artificial sequence
  SiRNA target sequence
ttaacaaaaaaagatgttttgtc

SEQ ID NO: 133402 - DNA, 23 bp, Artificial sequence
  SiRNA target sequence
taacaaaaaaagatgttttgtct

SEQ ID NO: 133403 - DNA, 23 bp, Artificial sequence
  SiRNA target sequence
aacaaaaaaagatgttttgtctg

SEQ ID NO: 133404 - DNA, 23 bp, Artificial sequence
  SiRNA target sequence
acaaaaaaagatgttttgtctgt

SEQ ID NO: 133405 - DNA, 23 bp, Artificial sequence
  SiRNA target sequence
caaaaaaagatgttttgtctgtt

SEQ ID NO: 133406 - DNA, 23 bp, Artificial sequence
  SiRNA target sequence
aaaaaaagatgttttgtctgttt

SEQ ID NO: 133407 - DNA, 23 bp, Artificial sequence
  SiRNA target sequence
aaaaaagatgttttgtctgtttg

SEQ ID NO: 133408 - DNA, 23 bp, Artificial sequence
  SiRNA target sequence
aaaaagatgttttgtctgtttgg

SEQ ID NO: 133409 - DNA, 23 bp, Artificial sequence
  SiRNA target sequence
aaaagatgttttgtctgtttgga

SEQ ID NO: 133410 - DNA, 23 bp, Artificial sequence
  SiRNA target sequence
aaagatgttttgtctgtttggac

SEQ ID NO: 133411 - DNA, 23 bp, Artificial sequence
  SiRNA target sequence
aagatgttttgtctgtttggaca

SEQ ID NO: 133412 - DNA, 23 bp, Artificial sequence
  SiRNA target sequence
agatgttttgtctgtttggacag

SEQ ID NO: 133413 - DNA, 23 bp, Artificial sequence
  SiRNA target sequence
gatgttttgtctgtttggacagg

SEQ ID NO: 133414 - DNA, 23 bp, Artificial sequence
  SiRNA target sequence
atgttttgtctgtttggacaggt

SEQ ID NO: 133415 - DNA, 23 bp, Artificial sequence
  SiRNA target sequence
tgttttgtctgtttggacaggta

SEQ ID NO: 133416 - DNA, 23 bp, Artificial sequence
  SiRNA target sequence
gttttgtctgtttggacaggtat

SEQ ID NO: 133417 - DNA, 23 bp, Artificial sequence
  SiRNA target sequence
ttttgtctgtttggacaggtatt

SEQ ID NO: 133418 - DNA, 23 bp, Artificial sequence
  SiRNA target sequence
tttgtctgtttggacaggtatta

SEQ ID NO: 133419 - DNA, 23 bp, Artificial sequence
  SiRNA target sequence
ttgtctgtttggacaggtattag

SEQ ID NO: 133420 - DNA, 23 bp, Artificial sequence
  SiRNA target sequence
tgtctgtttggacaggtattaga

SEQ ID NO: 133421 - DNA, 23 bp, Artificial sequence
  SiRNA target sequence
gtctgtttggacaggtattagac

SEQ ID NO: 133422 - DNA, 23 bp, Artificial sequence
  SiRNA target sequence
tctgtttggacaggtattagacc

SEQ ID NO: 133423 - DNA, 23 bp, Artificial sequence
  SiRNA target sequence
ctgtttggacaggtattagaccg

SEQ ID NO: 133424 - DNA, 23 bp, Artificial sequence
  SiRNA target sequence
tgtttggacaggtattagaccgt

SEQ ID NO: 133425 - DNA, 23 bp, Artificial sequence
  SiRNA target sequence
gtttggacaggtattagaccgtt

SEQ ID NO: 133426 - DNA, 23 bp, Artificial sequence
  SiRNA target sequence
tttggacaggtattagaccgtta

SEQ ID NO: 133427 - DNA, 23 bp, Artificial sequence
  SiRNA target sequence
ttggacaggtattagaccgttag

SEQ ID NO: 133428 - DNA, 23 bp, Artificial sequence
  SiRNA target sequence
tggacaggtattagaccgttagt

SEQ ID NO: 133429 - DNA, 23 bp, Artificial sequence
  SiRNA target sequence
ggacaggtattagaccgttagtc

SEQ ID NO: 133430 - DNA, 23 bp, Artificial sequence
  SiRNA target sequence
gacaggtattagaccgttagtca

SEQ ID NO: 133431 - DNA, 23 bp, Artificial sequence
  SiRNA target sequence
acaggtattagaccgttagtcaa

SEQ ID NO: 133432 - DNA, 23 bp, Artificial sequence
  SiRNA target sequence
caggtattagaccgttagtcaag

SEQ ID NO: 133433 - DNA, 23 bp, Artificial sequence
  SiRNA target sequence
aggtattagaccgttagtcaagg

SEQ ID NO: 133434 - DNA, 23 bp, Artificial sequence
  SiRNA target sequence
ggtattagaccgttagtcaagga

SEQ ID NO: 133435 - DNA, 23 bp, Artificial sequence
  SiRNA target sequence
gtattagaccgttagtcaaggat

SEQ ID NO: 133436 - DNA, 23 bp, Artificial sequence
  SiRNA target sequence
tattagaccgttagtcaaggatt

SEQ ID NO: 133437 - DNA, 23 bp, Artificial sequence
  SiRNA target sequence
attagaccgttagtcaaggattt

SEQ ID NO: 133438 - DNA, 23 bp, Artificial sequence
  SiRNA target sequence
ttagaccgttagtcaaggattta

SEQ ID NO: 133439 - DNA, 23 bp, Artificial sequence
  SiRNA target sequence
tagaccgttagtcaaggatttat

SEQ ID NO: 133440 - DNA, 23 bp, Artificial sequence
  SiRNA target sequence
agaccgttagtcaaggatttatc

SEQ ID NO: 133441 - DNA, 23 bp, Artificial sequence
  SiRNA target sequence
gaccgttagtcaaggatttatcg

SEQ ID NO: 133442 - DNA, 23 bp, Artificial sequence
  SiRNA target sequence
accgttagtcaaggatttatcga

SEQ ID NO: 133443 - DNA, 23 bp, Artificial sequence
  SiRNA target sequence
ccgttagtcaaggatttatcgaa

SEQ ID NO: 133444 - DNA, 23 bp, Artificial sequence
  SiRNA target sequence
cgttagtcaaggatttatcgaaa

SEQ ID NO: 133445 - DNA, 23 bp, Artificial sequence
  SiRNA target sequence
gttagtcaaggatttatcgaaaa

SEQ ID NO: 133446 - DNA, 23 bp, Artificial sequence
  SiRNA target sequence
ttagtcaaggatttatcgaaaag

SEQ ID NO: 133447 - DNA, 23 bp, Artificial sequence
  SiRNA target sequence
tagtcaaggatttatcgaaaagt

SEQ ID NO: 133448 - DNA, 23 bp, Artificial sequence
  SiRNA target sequence
agtcaaggatttatcgaaaagtt

SEQ ID NO: 133449 - DNA, 23 bp, Artificial sequence
  SiRNA target sequence
gtcaaggatttatcgaaaagttc

SEQ ID NO: 133450 - DNA, 23 bp, Artificial sequence
  SiRNA target sequence
tcaaggatttatcgaaaagttca

SEQ ID NO: 133451 - DNA, 23 bp, Artificial sequence
  SiRNA target sequence
caaggatttatcgaaaagttcaa

SEQ ID NO: 133452 - DNA, 23 bp, Artificial sequence
  SiRNA target sequence
aaggatttatcgaaaagttcaac

SEQ ID NO: 133453 - DNA, 23 bp, Artificial sequence
  SiRNA target sequence
aggatttatcgaaaagttcaaca

SEQ ID NO: 133454 - DNA, 23 bp, Artificial sequence
  SiRNA target sequence
ggatttatcgaaaagttcaacag

SEQ ID NO: 133455 - DNA, 23 bp, Artificial sequence
  SiRNA target sequence
gatttatcgaaaagttcaacaga

SEQ ID NO: 133456 - DNA, 23 bp, Artificial sequence
  SiRNA target sequence
atttatcgaaaagttcaacagaa

SEQ ID NO: 133457 - DNA, 23 bp, Artificial sequence
  SiRNA target sequence
tttatcgaaaagttcaacagaaa

SEQ ID NO: 133458 - DNA, 23 bp, Artificial sequence
  SiRNA target sequence
ttatcgaaaagttcaacagaaaa

SEQ ID NO: 133459 - DNA, 23 bp, Artificial sequence
  SiRNA target sequence
tatcgaaaagttcaacagaaaag

SEQ ID NO: 133460 - DNA, 23 bp, Artificial sequence
  SiRNA target sequence
atcgaaaagttcaacagaaaaga

SEQ ID NO: 133461 - DNA, 23 bp, Artificial sequence
  SiRNA target sequence
tcgaaaagttcaacagaaaagat

SEQ ID NO: 133462 - DNA, 23 bp, Artificial sequence
  SiRNA target sequence
cgaaaagttcaacagaaaagata

SEQ ID NO: 133463 - DNA, 23 bp, Artificial sequence
  SiRNA target sequence
gaaaagttcaacagaaaagatat

SEQ ID NO: 133464 - DNA, 23 bp, Artificial sequence
  SiRNA target sequence
aaaagttcaacagaaaagatatg

SEQ ID NO: 133465 - DNA, 23 bp, Artificial sequence
  SiRNA target sequence
aaagttcaacagaaaagatatgt

SEQ ID NO: 133466 - DNA, 23 bp, Artificial sequence
  SiRNA target sequence
aagttcaacagaaaagatatgta

SEQ ID NO: 133467 - DNA, 23 bp, Artificial sequence
  SiRNA target sequence
agttcaacagaaaagatatgtag

SEQ ID NO: 133468 - DNA, 23 bp, Artificial sequence
  SiRNA target sequence
gttcaacagaaaagatatgtaga

SEQ ID NO: 133469 - DNA, 23 bp, Artificial sequence
  SiRNA target sequence
ttcaacagaaaagatatgtagaa

SEQ ID NO: 133470 - DNA, 23 bp, Artificial sequence
  SiRNA target sequence
tcaacagaaaagatatgtagaaa

SEQ ID NO: 133471 - DNA, 23 bp, Artificial sequence
  SiRNA target sequence
caacagaaaagatatgtagaaaa

SEQ ID NO: 133472 - DNA, 23 bp, Artificial sequence
  SiRNA target sequence
aacagaaaagatatgtagaaaac

SEQ ID NO: 133473 - DNA, 23 bp, Artificial sequence
  SiRNA target sequence
acagaaaagatatgtagaaaaca

SEQ ID NO: 133474 - DNA, 23 bp, Artificial sequence
  SiRNA target sequence
cagaaaagatatgtagaaaacat

SEQ ID NO: 133475 - DNA, 23 bp, Artificial sequence
  SiRNA target sequence
agaaaagatatgtagaaaacata

SEQ ID NO: 133476 - DNA, 23 bp, Artificial sequence
  SiRNA target sequence
gaaaagatatgtagaaaacatac

SEQ ID NO: 133477 - DNA, 23 bp, Artificial sequence
  SiRNA target sequence
aaaagatatgtagaaaacatact

SEQ ID NO: 133478 - DNA, 23 bp, Artificial sequence
  SiRNA target sequence
aaagatatgtagaaaacatacta

SEQ ID NO: 133479 - DNA, 23 bp, Artificial sequence
  SiRNA target sequence
aagatatgtagaaaacatactat

SEQ ID NO: 133480 - DNA, 23 bp, Artificial sequence
  SiRNA target sequence
agatatgtagaaaacatactata

SEQ ID NO: 133481 - DNA, 23 bp, Artificial sequence
  SiRNA target sequence
gatatgtagaaaacatactataa

SEQ ID NO: 133482 - DNA, 23 bp, Artificial sequence
  SiRNA target sequence
atatgtagaaaacatactataag

SEQ ID NO: 133483 - DNA, 23 bp, Artificial sequence
  SiRNA target sequence
tatgtagaaaacatactataaga

SEQ ID NO: 133484 - DNA, 23 bp, Artificial sequence
  SiRNA target sequence
atgtagaaaacatactataagaa

SEQ ID NO: 133485 - DNA, 23 bp, Artificial sequence
  SiRNA target sequence
tgtagaaaacatactataagaat

SEQ ID NO: 133486 - DNA, 23 bp, Artificial sequence
  SiRNA target sequence
gtagaaaacatactataagaata

SEQ ID NO: 133487 - DNA, 23 bp, Artificial sequence
  SiRNA target sequence
tagaaaacatactataagaatag

SEQ ID NO: 133488 - DNA, 23 bp, Artificial sequence
  SiRNA target sequence
agaaaacatactataagaataga

SEQ ID NO: 133489 - DNA, 23 bp, Artificial sequence
  SiRNA target sequence
gaaaacatactataagaatagat

SEQ ID NO: 133490 - DNA, 23 bp, Artificial sequence
  SiRNA target sequence
aaaacatactataagaatagata

SEQ ID NO: 133491 - DNA, 23 bp, Artificial sequence
  SiRNA target sequence
aaacatactataagaatagataa

SEQ ID NO: 133492 - DNA, 23 bp, Artificial sequence
  SiRNA target sequence
aacatactataagaatagataaa

SEQ ID NO: 133493 - DNA, 23 bp, Artificial sequence
  SiRNA target sequence
acatactataagaatagataaag

SEQ ID NO: 133494 - DNA, 23 bp, Artificial sequence
  SiRNA target sequence
catactataagaatagataaaga

SEQ ID NO: 133495 - DNA, 23 bp, Artificial sequence
  SiRNA target sequence
atactataagaatagataaagac

SEQ ID NO: 133496 - DNA, 23 bp, Artificial sequence
  SiRNA target sequence
tactataagaatagataaagaca

SEQ ID NO: 133497 - DNA, 23 bp, Artificial sequence
  SiRNA target sequence
actataagaatagataaagacaa

SEQ ID NO: 133498 - DNA, 23 bp, Artificial sequence
  SiRNA target sequence
ctataagaatagataaagacaat

SEQ ID NO: 133499 - DNA, 23 bp, Artificial sequence
  SiRNA target sequence
tataagaatagataaagacaata

SEQ ID NO: 133500 - DNA, 23 bp, Artificial sequence
  SiRNA target sequence
ataagaatagataaagacaatat

SEQ ID NO: 133501 - DNA, 23 bp, Artificial sequence
  SiRNA target sequence
taagaatagataaagacaatatg

SEQ ID NO: 133502 - DNA, 23 bp, Artificial sequence
  SiRNA target sequence
aagaatagataaagacaatatgg

SEQ ID NO: 133503 - DNA, 23 bp, Artificial sequence
  SiRNA target sequence
agaatagataaagacaatatggt

SEQ ID NO: 133504 - DNA, 23 bp, Artificial sequence
  SiRNA target sequence
gaatagataaagacaatatggta

SEQ ID NO: 133505 - DNA, 23 bp, Artificial sequence
  SiRNA target sequence
aatagataaagacaatatggtaa

SEQ ID NO: 133506 - DNA, 23 bp, Artificial sequence
  SiRNA target sequence
atagataaagacaatatggtaac

SEQ ID NO: 133507 - DNA, 23 bp, Artificial sequence
  SiRNA target sequence
tagataaagacaatatggtaact

SEQ ID NO: 133508 - DNA, 23 bp, Artificial sequence
  SiRNA target sequence
agataaagacaatatggtaactg

SEQ ID NO: 133509 - DNA, 23 bp, Artificial sequence
  SiRNA target sequence
gataaagacaatatggtaactgt

SEQ ID NO: 133510 - DNA, 23 bp, Artificial sequence
  SiRNA target sequence
ataaagacaatatggtaactgta

SEQ ID NO: 133511 - DNA, 23 bp, Artificial sequence
  SiRNA target sequence
taaagacaatatggtaactgtaa

SEQ ID NO: 133512 - DNA, 23 bp, Artificial sequence
  SiRNA target sequence
aaagacaatatggtaactgtaac

SEQ ID NO: 133513 - DNA, 23 bp, Artificial sequence
  SiRNA target sequence
aagacaatatggtaactgtaaca

SEQ ID NO: 133514 - DNA, 23 bp, Artificial sequence
  SiRNA target sequence
agacaatatggtaactgtaacag

SEQ ID NO: 133515 - DNA, 23 bp, Artificial sequence
  SiRNA target sequence
gacaatatggtaactgtaacagg

SEQ ID NO: 133516 - DNA, 23 bp, Artificial sequence
  SiRNA target sequence
acaatatggtaactgtaacaggt

SEQ ID NO: 133517 - DNA, 23 bp, Artificial sequence
  SiRNA target sequence
caatatggtaactgtaacaggtg

SEQ ID NO: 133518 - DNA, 23 bp, Artificial sequence
  SiRNA target sequence
aatatggtaactgtaacaggtgg

SEQ ID NO: 133519 - DNA, 23 bp, Artificial sequence
  SiRNA target sequence
atatggtaactgtaacaggtggt

SEQ ID NO: 133520 - DNA, 23 bp, Artificial sequence
  SiRNA target sequence
tatggtaactgtaacaggtggta

SEQ ID NO: 133521 - DNA, 23 bp, Artificial sequence
  SiRNA target sequence
atggtaactgtaacaggtggtaa

SEQ ID NO: 133522 - DNA, 23 bp, Artificial sequence
  SiRNA target sequence
tggtaactgtaacaggtggtaag

SEQ ID NO: 133523 - DNA, 23 bp, Artificial sequence
  SiRNA target sequence
ggtaactgtaacaggtggtaagt

SEQ ID NO: 133524 - DNA, 23 bp, Artificial sequence
  SiRNA target sequence
gtaactgtaacaggtggtaagtg

SEQ ID NO: 133525 - DNA, 23 bp, Artificial sequence
  SiRNA target sequence
taactgtaacaggtggtaagtgg

SEQ ID NO: 133526 - DNA, 23 bp, Artificial sequence
  SiRNA target sequence
aactgtaacaggtggtaagtgga

SEQ ID NO: 133527 - DNA, 23 bp, Artificial sequence
  SiRNA target sequence
actgtaacaggtggtaagtggac

SEQ ID NO: 133528 - DNA, 23 bp, Artificial sequence
  SiRNA target sequence
ctgtaacaggtggtaagtggaca

SEQ ID NO: 133529 - DNA, 23 bp, Artificial sequence
  SiRNA target sequence
tgtaacaggtggtaagtggacaa

SEQ ID NO: 133530 - DNA, 23 bp, Artificial sequence
  SiRNA target sequence
gtaacaggtggtaagtggacaat

SEQ ID NO: 133531 - DNA, 23 bp, Artificial sequence
  SiRNA target sequence
taacaggtggtaagtggacaatt

SEQ ID NO: 133532 - DNA, 23 bp, Artificial sequence
  SiRNA target sequence
aacaggtggtaagtggacaattt

SEQ ID NO: 133533 - DNA, 23 bp, Artificial sequence
  SiRNA target sequence
acaggtggtaagtggacaatttt

SEQ ID NO: 133534 - DNA, 23 bp, Artificial sequence
  SiRNA target sequence
caggtggtaagtggacaattttt

SEQ ID NO: 133535 - DNA, 23 bp, Artificial sequence
  SiRNA target sequence
aggtggtaagtggacaatttttc

SEQ ID NO: 133536 - DNA, 23 bp, Artificial sequence
  SiRNA target sequence
ggtggtaagtggacaatttttcg

SEQ ID NO: 133537 - DNA, 23 bp, Artificial sequence
  SiRNA target sequence
gtggtaagtggacaatttttcga

SEQ ID NO: 133538 - DNA, 23 bp, Artificial sequence
  SiRNA target sequence
tggtaagtggacaatttttcgac

SEQ ID NO: 133539 - DNA, 23 bp, Artificial sequence
  SiRNA target sequence
ggtaagtggacaatttttcgact

SEQ ID NO: 133540 - DNA, 23 bp, Artificial sequence
  SiRNA target sequence
gtaagtggacaatttttcgactt

SEQ ID NO: 133541 - DNA, 23 bp, Artificial sequence
  SiRNA target sequence
taagtggacaatttttcgactta

SEQ ID NO: 133542 - DNA, 23 bp, Artificial sequence
  SiRNA target sequence
aagtggacaatttttcgacttat

SEQ ID NO: 133543 - DNA, 23 bp, Artificial sequence
  SiRNA target sequence
agtggacaatttttcgacttatg

SEQ ID NO: 133544 - DNA, 23 bp, Artificial sequence
  SiRNA target sequence
gtggacaatttttcgacttatgg

SEQ ID NO: 133545 - DNA, 23 bp, Artificial sequence
  SiRNA target sequence
tggacaatttttcgacttatggg

SEQ ID NO: 133546 - DNA, 23 bp, Artificial sequence
  SiRNA target sequence
ggacaatttttcgacttatggga

SEQ ID NO: 133547 - DNA, 23 bp, Artificial sequence
  SiRNA target sequence
gacaatttttcgacttatgggag

SEQ ID NO: 133548 - DNA, 23 bp, Artificial sequence
  SiRNA target sequence
acaatttttcgacttatgggaga

SEQ ID NO: 133549 - DNA, 23 bp, Artificial sequence
  SiRNA target sequence
caatttttcgacttatgggagaa

SEQ ID NO: 133550 - DNA, 23 bp, Artificial sequence
  SiRNA target sequence
aatttttcgacttatgggagaac

SEQ ID NO: 133551 - DNA, 23 bp, Artificial sequence
  SiRNA target sequence
atttttcgacttatgggagaaca

SEQ ID NO: 133552 - DNA, 23 bp, Artificial sequence
  SiRNA target sequence
tttttcgacttatgggagaacag

SEQ ID NO: 133553 - DNA, 23 bp, Artificial sequence
  SiRNA target sequence
ttttcgacttatgggagaacaga

SEQ ID NO: 133554 - DNA, 23 bp, Artificial sequence
  SiRNA target sequence
tttcgacttatgggagaacagac

SEQ ID NO: 133555 - DNA, 23 bp, Artificial sequence
  SiRNA target sequence
ttcgacttatgggagaacagaca

SEQ ID NO: 133556 - DNA, 23 bp, Artificial sequence
  SiRNA target sequence
tcgacttatgggagaacagacaa

SEQ ID NO: 133557 - DNA, 23 bp, Artificial sequence
  SiRNA target sequence
cgacttatgggagaacagacaat

SEQ ID NO: 133558 - DNA, 23 bp, Artificial sequence
  SiRNA target sequence
gacttatgggagaacagacaata

SEQ ID NO: 133559 - DNA, 23 bp, Artificial sequence
  SiRNA target sequence
acttatgggagaacagacaataa

SEQ ID NO: 133560 - DNA, 23 bp, Artificial sequence
  SiRNA target sequence
cttatgggagaacagacaataaa

SEQ ID NO: 133561 - DNA, 23 bp, Artificial sequence
  SiRNA target sequence
ttatgggagaacagacaataaat

SEQ ID NO: 133562 - DNA, 23 bp, Artificial sequence
  SiRNA target sequence
tatgggagaacagacaataaatc

SEQ ID NO: 133563 - DNA, 23 bp, Artificial sequence
  SiRNA target sequence
atgggagaacagacaataaatca

SEQ ID NO: 133564 - DNA, 23 bp, Artificial sequence
  SiRNA target sequence
tgggagaacagacaataaatcaa

SEQ ID NO: 133565 - DNA, 23 bp, Artificial sequence
  SiRNA target sequence
gggagaacagacaataaatcaaa

SEQ ID NO: 133566 - DNA, 23 bp, Artificial sequence
  SiRNA target sequence
ggagaacagacaataaatcaaat

SEQ ID NO: 133567 - DNA, 23 bp, Artificial sequence
  SiRNA target sequence
gagaacagacaataaatcaaatt

SEQ ID NO: 133568 - DNA, 23 bp, Artificial sequence
  SiRNA target sequence
agaacagacaataaatcaaatta

SEQ ID NO: 133569 - DNA, 23 bp, Artificial sequence
  SiRNA target sequence
gaacagacaataaatcaaattat

SEQ ID NO: 133570 - DNA, 23 bp, Artificial sequence
  SiRNA target sequence
aacagacaataaatcaaattata

SEQ ID NO: 133571 - DNA, 23 bp, Artificial sequence
  SiRNA target sequence
acagacaataaatcaaattataa

SEQ ID NO: 133572 - DNA, 23 bp, Artificial sequence
  SiRNA target sequence
cagacaataaatcaaattataaa

SEQ ID NO: 133573 - DNA, 23 bp, Artificial sequence
  SiRNA target sequence
agacaataaatcaaattataaaa

SEQ ID NO: 133574 - DNA, 23 bp, Artificial sequence
  SiRNA target sequence
gacaataaatcaaattataaaag

SEQ ID NO: 133575 - DNA, 23 bp, Artificial sequence
  SiRNA target sequence
acaataaatcaaattataaaagt

SEQ ID NO: 133576 - DNA, 23 bp, Artificial sequence
  SiRNA target sequence
caataaatcaaattataaaagtt

SEQ ID NO: 133577 - DNA, 23 bp, Artificial sequence
  SiRNA target sequence
aataaatcaaattataaaagttt

SEQ ID NO: 133578 - DNA, 23 bp, Artificial sequence
  SiRNA target sequence
ataaatcaaattataaaagtttt

SEQ ID NO: 133579 - DNA, 23 bp, Artificial sequence
  SiRNA target sequence
taaatcaaattataaaagttttt

SEQ ID NO: 133580 - DNA, 23 bp, Artificial sequence
  SiRNA target sequence
aaatcaaattataaaagttttta

SEQ ID NO: 133581 - DNA, 23 bp, Artificial sequence
  SiRNA target sequence
aatcaaattataaaagtttttaa

SEQ ID NO: 133582 - DNA, 23 bp, Artificial sequence
  SiRNA target sequence
atcaaattataaaagtttttaat

SEQ ID NO: 133583 - DNA, 23 bp, Artificial sequence
  SiRNA target sequence
tcaaattataaaagtttttaata

SEQ ID NO: 133584 - DNA, 23 bp, Artificial sequence
  SiRNA target sequence
caaattataaaagtttttaatat

SEQ ID NO: 133585 - DNA, 23 bp, Artificial sequence
  SiRNA target sequence
aaattataaaagtttttaatata

SEQ ID NO: 133586 - DNA, 23 bp, Artificial sequence
  SiRNA target sequence
aattataaaagtttttaatataa

SEQ ID NO: 133587 - DNA, 23 bp, Artificial sequence
  SiRNA target sequence
attataaaagtttttaatataaa

SEQ ID NO: 133588 - DNA, 23 bp, Artificial sequence
  SiRNA target sequence
ttataaaagtttttaatataaag

SEQ ID NO: 133589 - DNA, 23 bp, Artificial sequence
  SiRNA target sequence
tataaaagtttttaatataaagt

SEQ ID NO: 133590 - DNA, 23 bp, Artificial sequence
  SiRNA target sequence
ataaaagtttttaatataaagtc

SEQ ID NO: 133591 - DNA, 23 bp, Artificial sequence
  SiRNA target sequence
taaaagtttttaatataaagtct

SEQ ID NO: 133592 - DNA, 23 bp, Artificial sequence
  SiRNA target sequence
aaaagtttttaatataaagtcta

SEQ ID NO: 133593 - DNA, 23 bp, Artificial sequence
  SiRNA target sequence
aaagtttttaatataaagtctaa

SEQ ID NO: 133594 - DNA, 23 bp, Artificial sequence
  SiRNA target sequence
aagtttttaatataaagtctaat

SEQ ID NO: 133595 - DNA, 23 bp, Artificial sequence
  SiRNA target sequence
agtttttaatataaagtctaata

SEQ ID NO: 133596 - DNA, 23 bp, Artificial sequence
  SiRNA target sequence
gtttttaatataaagtctaataa

SEQ ID NO: 133597 - DNA, 23 bp, Artificial sequence
  SiRNA target sequence
tttttaatataaagtctaataaa

SEQ ID NO: 133598 - DNA, 23 bp, Artificial sequence
  SiRNA target sequence
ttttaatataaagtctaataaac

SEQ ID NO: 133599 - DNA, 23 bp, Artificial sequence
  SiRNA target sequence
tttaatataaagtctaataaacc

SEQ ID NO: 133600 - DNA, 23 bp, Artificial sequence
  SiRNA target sequence
ttaatataaagtctaataaacca

SEQ ID NO: 133601 - DNA, 23 bp, Artificial sequence
  SiRNA target sequence
taatataaagtctaataaaccaa

SEQ ID NO: 133602 - DNA, 23 bp, Artificial sequence
  SiRNA target sequence
aatataaagtctaataaaccaag

SEQ ID NO: 133603 - DNA, 23 bp, Artificial sequence
  SiRNA target sequence
atataaagtctaataaaccaagt

SEQ ID NO: 133604 - DNA, 23 bp, Artificial sequence
  SiRNA target sequence
tataaagtctaataaaccaagta

SEQ ID NO: 133605 - DNA, 23 bp, Artificial sequence
  SiRNA target sequence
ataaagtctaataaaccaagtat

SEQ ID NO: 133606 - DNA, 23 bp, Artificial sequence
  SiRNA target sequence
taaagtctaataaaccaagtata

SEQ ID NO: 133607 - DNA, 23 bp, Artificial sequence
  SiRNA target sequence
aaagtctaataaaccaagtataa

SEQ ID NO: 133608 - DNA, 23 bp, Artificial sequence
  SiRNA target sequence
aagtctaataaaccaagtataac

SEQ ID NO: 133609 - DNA, 23 bp, Artificial sequence
  SiRNA target sequence
agtctaataaaccaagtataaca

SEQ ID NO: 133610 - DNA, 23 bp, Artificial sequence
  SiRNA target sequence
gtctaataaaccaagtataacac

SEQ ID NO: 133611 - DNA, 23 bp, Artificial sequence
  SiRNA target sequence
tctaataaaccaagtataacaca

SEQ ID NO: 133612 - DNA, 23 bp, Artificial sequence
  SiRNA target sequence
ctaataaaccaagtataacacaa

SEQ ID NO: 133613 - DNA, 23 bp, Artificial sequence
  SiRNA target sequence
taataaaccaagtataacacaat

SEQ ID NO: 133614 - DNA, 23 bp, Artificial sequence
  SiRNA target sequence
aataaaccaagtataacacaata

SEQ ID NO: 133615 - DNA, 23 bp, Artificial sequence
  SiRNA target sequence
ataaaccaagtataacacaatat

SEQ ID NO: 133616 - DNA, 23 bp, Artificial sequence
  SiRNA target sequence
taaaccaagtataacacaatatc

SEQ ID NO: 133617 - DNA, 23 bp, Artificial sequence
  SiRNA target sequence
aaaccaagtataacacaatatct

SEQ ID NO: 133618 - DNA, 23 bp, Artificial sequence
  SiRNA target sequence
aaccaagtataacacaatatctt

SEQ ID NO: 133619 - DNA, 23 bp, Artificial sequence
  SiRNA target sequence
accaagtataacacaatatcttc

SEQ ID NO: 133620 - DNA, 23 bp, Artificial sequence
  SiRNA target sequence
ccaagtataacacaatatcttcc

SEQ ID NO: 133621 - DNA, 23 bp, Artificial sequence
  SiRNA target sequence
caagtataacacaatatcttcct

SEQ ID NO: 133622 - DNA, 23 bp, Artificial sequence
  SiRNA target sequence
aagtataacacaatatcttcctg

SEQ ID NO: 133623 - DNA, 23 bp, Artificial sequence
  SiRNA target sequence
agtataacacaatatcttcctgt

SEQ ID NO: 133624 - DNA, 23 bp, Artificial sequence
  SiRNA target sequence
gtataacacaatatcttcctgtt

SEQ ID NO: 133625 - DNA, 23 bp, Artificial sequence
  SiRNA target sequence
tataacacaatatcttcctgttt

SEQ ID NO: 133626 - DNA, 23 bp, Artificial sequence
  SiRNA target sequence
ataacacaatatcttcctgtttt

SEQ ID NO: 133627 - DNA, 23 bp, Artificial sequence
  SiRNA target sequence
taacacaatatcttcctgttttg

SEQ ID NO: 133628 - DNA, 23 bp, Artificial sequence
  SiRNA target sequence
aacacaatatcttcctgttttgg

SEQ ID NO: 133629 - DNA, 23 bp, Artificial sequence
  SiRNA target sequence
acacaatatcttcctgttttggg

SEQ ID NO: 133630 - DNA, 23 bp, Artificial sequence
  SiRNA target sequence
cacaatatcttcctgttttggga

SEQ ID NO: 133631 - DNA, 23 bp, Artificial sequence
  SiRNA target sequence
acaatatcttcctgttttgggat

SEQ ID NO: 133632 - DNA, 23 bp, Artificial sequence
  SiRNA target sequence
caatatcttcctgttttgggatc

SEQ ID NO: 133633 - DNA, 23 bp, Artificial sequence
  SiRNA target sequence
aatatcttcctgttttgggatca

SEQ ID NO: 133634 - DNA, 23 bp, Artificial sequence
  SiRNA target sequence
atatcttcctgttttgggatcac

SEQ ID NO: 133635 - DNA, 23 bp, Artificial sequence
  SiRNA target sequence
tatcttcctgttttgggatcaca

SEQ ID NO: 133636 - DNA, 23 bp, Artificial sequence
  SiRNA target sequence
atcttcctgttttgggatcacag

SEQ ID NO: 133637 - DNA, 23 bp, Artificial sequence
  SiRNA target sequence
tcttcctgttttgggatcacagg

SEQ ID NO: 133638 - DNA, 23 bp, Artificial sequence
  SiRNA target sequence
cttcctgttttgggatcacaggg

SEQ ID NO: 133639 - DNA, 23 bp, Artificial sequence
  SiRNA target sequence
ttcctgttttgggatcacaggga

SEQ ID NO: 133640 - DNA, 23 bp, Artificial sequence
  SiRNA target sequence
tcctgttttgggatcacagggat

SEQ ID NO: 133641 - DNA, 23 bp, Artificial sequence
  SiRNA target sequence
cctgttttgggatcacagggata

SEQ ID NO: 133642 - DNA, 23 bp, Artificial sequence
  SiRNA target sequence
ctgttttgggatcacagggatat

SEQ ID NO: 133643 - DNA, 23 bp, Artificial sequence
  SiRNA target sequence
tgttttgggatcacagggatata

SEQ ID NO: 133644 - DNA, 23 bp, Artificial sequence
  SiRNA target sequence
gttttgggatcacagggatatac

SEQ ID NO: 133645 - DNA, 23 bp, Artificial sequence
  SiRNA target sequence
ttttgggatcacagggatatact

SEQ ID NO: 133646 - DNA, 23 bp, Artificial sequence
  SiRNA target sequence
tttgggatcacagggatatacta

SEQ ID NO: 133647 - DNA, 23 bp, Artificial sequence
  SiRNA target sequence
ttgggatcacagggatatactaa

SEQ ID NO: 133648 - DNA, 23 bp, Artificial sequence
  SiRNA target sequence
tgggatcacagggatatactaaa

SEQ ID NO: 133649 - DNA, 23 bp, Artificial sequence
  SiRNA target sequence
gggatcacagggatatactaaag

SEQ ID NO: 133650 - DNA, 23 bp, Artificial sequence
  SiRNA target sequence
ggatcacagggatatactaaagc

SEQ ID NO: 133651 - DNA, 23 bp, Artificial sequence
  SiRNA target sequence
gatcacagggatatactaaagct

SEQ ID NO: 133652 - DNA, 23 bp, Artificial sequence
  SiRNA target sequence
atcacagggatatactaaagcta

SEQ ID NO: 133653 - DNA, 23 bp, Artificial sequence
  SiRNA target sequence
tcacagggatatactaaagctac

SEQ ID NO: 133654 - DNA, 23 bp, Artificial sequence
  SiRNA target sequence
cacagggatatactaaagctaca

SEQ ID NO: 133655 - DNA, 23 bp, Artificial sequence
  SiRNA target sequence
acagggatatactaaagctacag

SEQ ID NO: 133656 - DNA, 23 bp, Artificial sequence
  SiRNA target sequence
cagggatatactaaagctacaga

SEQ ID NO: 133657 - DNA, 23 bp, Artificial sequence
  SiRNA target sequence
agggatatactaaagctacagaa

SEQ ID NO: 133658 - DNA, 23 bp, Artificial sequence
  SiRNA target sequence
gggatatactaaagctacagaat

SEQ ID NO: 133659 - DNA, 23 bp, Artificial sequence
  SiRNA target sequence
ggatatactaaagctacagaatt

SEQ ID NO: 133660 - DNA, 23 bp, Artificial sequence
  SiRNA target sequence
gatatactaaagctacagaattt

SEQ ID NO: 133661 - DNA, 23 bp, Artificial sequence
  SiRNA target sequence
atatactaaagctacagaatttg

SEQ ID NO: 133662 - DNA, 23 bp, Artificial sequence
  SiRNA target sequence
tatactaaagctacagaatttga

SEQ ID NO: 133663 - DNA, 23 bp, Artificial sequence
  SiRNA target sequence
atactaaagctacagaatttgat

SEQ ID NO: 133664 - DNA, 23 bp, Artificial sequence
  SiRNA target sequence
tactaaagctacagaatttgatt

SEQ ID NO: 133665 - DNA, 23 bp, Artificial sequence
  SiRNA target sequence
actaaagctacagaatttgattt

SEQ ID NO: 133666 - DNA, 23 bp, Artificial sequence
  SiRNA target sequence
ctaaagctacagaatttgatttg

SEQ ID NO: 133667 - DNA, 23 bp, Artificial sequence
  SiRNA target sequence
taaagctacagaatttgatttgg

SEQ ID NO: 133668 - DNA, 23 bp, Artificial sequence
  SiRNA target sequence
aaagctacagaatttgatttggc

SEQ ID NO: 133669 - DNA, 23 bp, Artificial sequence
  SiRNA target sequence
aagctacagaatttgatttggca

SEQ ID NO: 133670 - DNA, 23 bp, Artificial sequence
  SiRNA target sequence
agctacagaatttgatttggcac

SEQ ID NO: 133671 - DNA, 23 bp, Artificial sequence
  SiRNA target sequence
gctacagaatttgatttggcact

SEQ ID NO: 133672 - DNA, 23 bp, Artificial sequence
  SiRNA target sequence
ctacagaatttgatttggcactt

SEQ ID NO: 133673 - DNA, 23 bp, Artificial sequence
  SiRNA target sequence
tacagaatttgatttggcactta

SEQ ID NO: 133674 - DNA, 23 bp, Artificial sequence
  SiRNA target sequence
acagaatttgatttggcacttac

SEQ ID NO: 133675 - DNA, 23 bp, Artificial sequence
  SiRNA target sequence
cagaatttgatttggcacttact

SEQ ID NO: 133676 - DNA, 23 bp, Artificial sequence
  SiRNA target sequence
agaatttgatttggcacttactt

SEQ ID NO: 133677 - DNA, 23 bp, Artificial sequence
  SiRNA target sequence
gaatttgatttggcacttacttt

SEQ ID NO: 133678 - DNA, 23 bp, Artificial sequence
  SiRNA target sequence
aatttgatttggcacttacttta

SEQ ID NO: 133679 - DNA, 23 bp, Artificial sequence
  SiRNA target sequence
atttgatttggcacttactttaa

SEQ ID NO: 133680 - DNA, 23 bp, Artificial sequence
  SiRNA target sequence
tttgatttggcacttactttaaa

SEQ ID NO: 133681 - DNA, 23 bp, Artificial sequence
  SiRNA target sequence
ttgatttggcacttactttaaat

SEQ ID NO: 133682 - DNA, 23 bp, Artificial sequence
  SiRNA target sequence
tgatttggcacttactttaaata

SEQ ID NO: 133683 - DNA, 23 bp, Artificial sequence
  SiRNA target sequence
gatttggcacttactttaaatat

SEQ ID NO: 133684 - DNA, 23 bp, Artificial sequence
  SiRNA target sequence
atttggcacttactttaaatatt

SEQ ID NO: 133685 - DNA, 23 bp, Artificial sequence
  SiRNA target sequence
tttggcacttactttaaatattc

SEQ ID NO: 133686 - DNA, 23 bp, Artificial sequence
  SiRNA target sequence
ttggcacttactttaaatattcc

SEQ ID NO: 133687 - DNA, 23 bp, Artificial sequence
  SiRNA target sequence
tggcacttactttaaatattcca

SEQ ID NO: 133688 - DNA, 23 bp, Artificial sequence
  SiRNA target sequence
ggcacttactttaaatattccag

SEQ ID NO: 133689 - DNA, 23 bp, Artificial sequence
  SiRNA target sequence
gcacttactttaaatattccaga

SEQ ID NO: 133690 - DNA, 23 bp, Artificial sequence
  SiRNA target sequence
cacttactttaaatattccagaa

SEQ ID NO: 133691 - DNA, 23 bp, Artificial sequence
  SiRNA target sequence
acttactttaaatattccagaag

SEQ ID NO: 133692 - DNA, 23 bp, Artificial sequence
  SiRNA target sequence
cttactttaaatattccagaaga

SEQ ID NO: 133693 - DNA, 23 bp, Artificial sequence
  SiRNA target sequence
ttactttaaatattccagaagat

SEQ ID NO: 133694 - DNA, 23 bp, Artificial sequence
  SiRNA target sequence
tactttaaatattccagaagata

SEQ ID NO: 133695 - DNA, 23 bp, Artificial sequence
  SiRNA target sequence
actttaaatattccagaagatat

SEQ ID NO: 133696 - DNA, 23 bp, Artificial sequence
  SiRNA target sequence
ctttaaatattccagaagatata

SEQ ID NO: 133697 - DNA, 23 bp, Artificial sequence
  SiRNA target sequence
tttaaatattccagaagatatag

SEQ ID NO: 133698 - DNA, 23 bp, Artificial sequence
  SiRNA target sequence
ttaaatattccagaagatatagc

SEQ ID NO: 133699 - DNA, 23 bp, Artificial sequence
  SiRNA target sequence
taaatattccagaagatatagct

SEQ ID NO: 133700 - DNA, 23 bp, Artificial sequence
  SiRNA target sequence
aaatattccagaagatatagcta

SEQ ID NO: 133701 - DNA, 23 bp, Artificial sequence
  SiRNA target sequence
aatattccagaagatatagctaa

SEQ ID NO: 133702 - DNA, 23 bp, Artificial sequence
  SiRNA target sequence
atattccagaagatatagctaag

SEQ ID NO: 133703 - DNA, 23 bp, Artificial sequence
  SiRNA target sequence
tattccagaagatatagctaagc

SEQ ID NO: 133704 - DNA, 23 bp, Artificial sequence
  SiRNA target sequence
attccagaagatatagctaagca

SEQ ID NO: 133705 - DNA, 23 bp, Artificial sequence
  SiRNA target sequence
ttccagaagatatagctaagcat

SEQ ID NO: 133706 - DNA, 23 bp, Artificial sequence
  SiRNA target sequence
tccagaagatatagctaagcatt

SEQ ID NO: 133707 - DNA, 23 bp, Artificial sequence
  SiRNA target sequence
ccagaagatatagctaagcattt

SEQ ID NO: 133708 - DNA, 23 bp, Artificial sequence
  SiRNA target sequence
cagaagatatagctaagcattta

SEQ ID NO: 133709 - DNA, 23 bp, Artificial sequence
  SiRNA target sequence
agaagatatagctaagcatttag

SEQ ID NO: 133710 - DNA, 23 bp, Artificial sequence
  SiRNA target sequence
gaagatatagctaagcatttagc

SEQ ID NO: 133711 - DNA, 23 bp, Artificial sequence
  SiRNA target sequence
aagatatagctaagcatttagct

SEQ ID NO: 133712 - DNA, 23 bp, Artificial sequence
  SiRNA target sequence
agatatagctaagcatttagcta

SEQ ID NO: 133713 - DNA, 23 bp, Artificial sequence
  SiRNA target sequence
gatatagctaagcatttagctac

SEQ ID NO: 133714 - DNA, 23 bp, Artificial sequence
  SiRNA target sequence
atatagctaagcatttagctaca

SEQ ID NO: 133715 - DNA, 23 bp, Artificial sequence
  SiRNA target sequence
tatagctaagcatttagctacaa

SEQ ID NO: 133716 - DNA, 23 bp, Artificial sequence
  SiRNA target sequence
atagctaagcatttagctacaac

SEQ ID NO: 133717 - DNA, 23 bp, Artificial sequence
  SiRNA target sequence
tagctaagcatttagctacaact

SEQ ID NO: 133718 - DNA, 23 bp, Artificial sequence
  SiRNA target sequence
agctaagcatttagctacaactt

SEQ ID NO: 133719 - DNA, 23 bp, Artificial sequence
  SiRNA target sequence
gctaagcatttagctacaactta

SEQ ID NO: 133720 - DNA, 23 bp, Artificial sequence
  SiRNA target sequence
ctaagcatttagctacaacttat

SEQ ID NO: 133721 - DNA, 23 bp, Artificial sequence
  SiRNA target sequence
taagcatttagctacaacttatg

SEQ ID NO: 133722 - DNA, 23 bp, Artificial sequence
  SiRNA target sequence
aagcatttagctacaacttatgg

SEQ ID NO: 133723 - DNA, 23 bp, Artificial sequence
  SiRNA target sequence
agcatttagctacaacttatggt

SEQ ID NO: 133724 - DNA, 23 bp, Artificial sequence
  SiRNA target sequence
gcatttagctacaacttatggta

SEQ ID NO: 133725 - DNA, 23 bp, Artificial sequence
  SiRNA target sequence
catttagctacaacttatggtac

SEQ ID NO: 133726 - DNA, 23 bp, Artificial sequence
  SiRNA target sequence
atttagctacaacttatggtacc

SEQ ID NO: 133727 - DNA, 23 bp, Artificial sequence
  SiRNA target sequence
tttagctacaacttatggtacca

SEQ ID NO: 133728 - DNA, 23 bp, Artificial sequence
  SiRNA target sequence
ttagctacaacttatggtaccaa

SEQ ID NO: 133729 - DNA, 23 bp, Artificial sequence
  SiRNA target sequence
tagctacaacttatggtaccaaa

SEQ ID NO: 133730 - DNA, 23 bp, Artificial sequence
  SiRNA target sequence
agctacaacttatggtaccaaag

SEQ ID NO: 133731 - DNA, 23 bp, Artificial sequence
  SiRNA target sequence
gctacaacttatggtaccaaagc

SEQ ID NO: 133732 - DNA, 23 bp, Artificial sequence
  SiRNA target sequence
ctacaacttatggtaccaaagct

SEQ ID NO: 133733 - DNA, 23 bp, Artificial sequence
  SiRNA target sequence
tacaacttatggtaccaaagctt

SEQ ID NO: 133734 - DNA, 23 bp, Artificial sequence
  SiRNA target sequence
acaacttatggtaccaaagctta

SEQ ID NO: 133735 - DNA, 23 bp, Artificial sequence
  SiRNA target sequence
caacttatggtaccaaagcttac

SEQ ID NO: 133736 - DNA, 23 bp, Artificial sequence
  SiRNA target sequence
aacttatggtaccaaagcttaca

SEQ ID NO: 133737 - DNA, 23 bp, Artificial sequence
  SiRNA target sequence
acttatggtaccaaagcttacaa

SEQ ID NO: 133738 - DNA, 23 bp, Artificial sequence
  SiRNA target sequence
cttatggtaccaaagcttacaat

SEQ ID NO: 133739 - DNA, 23 bp, Artificial sequence
  SiRNA target sequence
ttatggtaccaaagcttacaatt

SEQ ID NO: 133740 - DNA, 23 bp, Artificial sequence
  SiRNA target sequence
tatggtaccaaagcttacaattt

SEQ ID NO: 133741 - DNA, 23 bp, Artificial sequence
  SiRNA target sequence
atggtaccaaagcttacaatttc

SEQ ID NO: 133742 - DNA, 23 bp, Artificial sequence
  SiRNA target sequence
tggtaccaaagcttacaatttct

SEQ ID NO: 133743 - DNA, 23 bp, Artificial sequence
  SiRNA target sequence
ggtaccaaagcttacaatttctc

SEQ ID NO: 133744 - DNA, 23 bp, Artificial sequence
  SiRNA target sequence
gtaccaaagcttacaatttctct

SEQ ID NO: 133745 - DNA, 23 bp, Artificial sequence
  SiRNA target sequence
taccaaagcttacaatttctctg

SEQ ID NO: 133746 - DNA, 23 bp, Artificial sequence
  SiRNA target sequence
accaaagcttacaatttctctga

SEQ ID NO: 133747 - DNA, 23 bp, Artificial sequence
  SiRNA target sequence
ccaaagcttacaatttctctgaa

SEQ ID NO: 133748 - DNA, 23 bp, Artificial sequence
  SiRNA target sequence
caaagcttacaatttctctgaat

SEQ ID NO: 133749 - DNA, 23 bp, Artificial sequence
  SiRNA target sequence
aaagcttacaatttctctgaata

SEQ ID NO: 133750 - DNA, 23 bp, Artificial sequence
  SiRNA target sequence
aagcttacaatttctctgaatac

SEQ ID NO: 133751 - DNA, 23 bp, Artificial sequence
  SiRNA target sequence
agcttacaatttctctgaatact

SEQ ID NO: 133752 - DNA, 23 bp, Artificial sequence
  SiRNA target sequence
gcttacaatttctctgaatactt

SEQ ID NO: 133753 - DNA, 23 bp, Artificial sequence
  SiRNA target sequence
cttacaatttctctgaatacttt

SEQ ID NO: 133754 - DNA, 23 bp, Artificial sequence
  SiRNA target sequence
ttacaatttctctgaatacttta

SEQ ID NO: 133755 - DNA, 23 bp, Artificial sequence
  SiRNA target sequence
tacaatttctctgaatactttaa

SEQ ID NO: 133756 - DNA, 23 bp, Artificial sequence
  SiRNA target sequence
acaatttctctgaatactttaat

SEQ ID NO: 133757 - DNA, 23 bp, Artificial sequence
  SiRNA target sequence
caatttctctgaatactttaatg

SEQ ID NO: 133758 - DNA, 23 bp, Artificial sequence
  SiRNA target sequence
aatttctctgaatactttaatgg

SEQ ID NO: 133759 - DNA, 23 bp, Artificial sequence
  SiRNA target sequence
atttctctgaatactttaatggg

SEQ ID NO: 133760 - DNA, 23 bp, Artificial sequence
  SiRNA target sequence
tttctctgaatactttaatgggt

SEQ ID NO: 133761 - DNA, 23 bp, Artificial sequence
  SiRNA target sequence
ttctctgaatactttaatgggtc

SEQ ID NO: 133762 - DNA, 23 bp, Artificial sequence
  SiRNA target sequence
tctctgaatactttaatgggtca

SEQ ID NO: 133763 - DNA, 23 bp, Artificial sequence
  SiRNA target sequence
ctctgaatactttaatgggtcat

SEQ ID NO: 133764 - DNA, 23 bp, Artificial sequence
  SiRNA target sequence
tctgaatactttaatgggtcata

SEQ ID NO: 133765 - DNA, 23 bp, Artificial sequence
  SiRNA target sequence
ctgaatactttaatgggtcatac

SEQ ID NO: 133766 - DNA, 23 bp, Artificial sequence
  SiRNA target sequence
tgaatactttaatgggtcataca

SEQ ID NO: 133767 - DNA, 23 bp, Artificial sequence
  SiRNA target sequence
gaatactttaatgggtcatacac

SEQ ID NO: 133768 - DNA, 23 bp, Artificial sequence
  SiRNA target sequence
aatactttaatgggtcatacacc

SEQ ID NO: 133769 - DNA, 23 bp, Artificial sequence
  SiRNA target sequence
atactttaatgggtcatacacca

SEQ ID NO: 133770 - DNA, 23 bp, Artificial sequence
  SiRNA target sequence
tactttaatgggtcatacaccag

SEQ ID NO: 133771 - DNA, 23 bp, Artificial sequence
  SiRNA target sequence
actttaatgggtcatacaccaga

SEQ ID NO: 133772 - DNA, 23 bp, Artificial sequence
  SiRNA target sequence
ctttaatgggtcatacaccagac

SEQ ID NO: 133773 - DNA, 23 bp, Artificial sequence
  SiRNA target sequence
tttaatgggtcatacaccagact

SEQ ID NO: 133774 - DNA, 23 bp, Artificial sequence
  SiRNA target sequence
ttaatgggtcatacaccagactt

SEQ ID NO: 133775 - DNA, 23 bp, Artificial sequence
  SiRNA target sequence
taatgggtcatacaccagactta

SEQ ID NO: 133776 - DNA, 23 bp, Artificial sequence
  SiRNA target sequence
aatgggtcatacaccagacttac

SEQ ID NO: 133777 - DNA, 23 bp, Artificial sequence
  SiRNA target sequence
atgggtcatacaccagacttaca

SEQ ID NO: 133778 - DNA, 23 bp, Artificial sequence
  SiRNA target sequence
tgggtcatacaccagacttacag

SEQ ID NO: 133779 - DNA, 23 bp, Artificial sequence
  SiRNA target sequence
gggtcatacaccagacttacaga

SEQ ID NO: 133780 - DNA, 23 bp, Artificial sequence
  SiRNA target sequence
ggtcatacaccagacttacagat

SEQ ID NO: 133781 - DNA, 23 bp, Artificial sequence
  SiRNA target sequence
gtcatacaccagacttacagatg

SEQ ID NO: 133782 - DNA, 23 bp, Artificial sequence
  SiRNA target sequence
tcatacaccagacttacagatgg

SEQ ID NO: 133783 - DNA, 23 bp, Artificial sequence
  SiRNA target sequence
catacaccagacttacagatggt

SEQ ID NO: 133784 - DNA, 23 bp, Artificial sequence
  SiRNA target sequence
atacaccagacttacagatggtt

SEQ ID NO: 133785 - DNA, 23 bp, Artificial sequence
  SiRNA target sequence
tacaccagacttacagatggtta

SEQ ID NO: 133786 - DNA, 23 bp, Artificial sequence
  SiRNA target sequence
acaccagacttacagatggttat

SEQ ID NO: 133787 - DNA, 23 bp, Artificial sequence
  SiRNA target sequence
caccagacttacagatggttatc

SEQ ID NO: 133788 - DNA, 23 bp, Artificial sequence
  SiRNA target sequence
accagacttacagatggttatcc

SEQ ID NO: 133789 - DNA, 23 bp, Artificial sequence
  SiRNA target sequence
ccagacttacagatggttatcct

SEQ ID NO: 133790 - DNA, 23 bp, Artificial sequence
  SiRNA target sequence
cagacttacagatggttatcctt

SEQ ID NO: 133791 - DNA, 23 bp, Artificial sequence
  SiRNA target sequence
agacttacagatggttatcctta

SEQ ID NO: 133792 - DNA, 23 bp, Artificial sequence
  SiRNA target sequence
gacttacagatggttatccttat

SEQ ID NO: 133793 - DNA, 23 bp, Artificial sequence
  SiRNA target sequence
acttacagatggttatccttata

SEQ ID NO: 133794 - DNA, 23 bp, Artificial sequence
  SiRNA target sequence
cttacagatggttatccttatac

SEQ ID NO: 133795 - DNA, 23 bp, Artificial sequence
  SiRNA target sequence
ttacagatggttatccttataca

SEQ ID NO: 133796 - DNA, 23 bp, Artificial sequence
  SiRNA target sequence
tacagatggttatccttatacaa

SEQ ID NO: 133797 - DNA, 23 bp, Artificial sequence
  SiRNA target sequence
acagatggttatccttatacaaa

SEQ ID NO: 133798 - DNA, 23 bp, Artificial sequence
  SiRNA target sequence
cagatggttatccttatacaaaa

SEQ ID NO: 133799 - DNA, 23 bp, Artificial sequence
  SiRNA target sequence
agatggttatccttatacaaaag

SEQ ID NO: 133800 - DNA, 23 bp, Artificial sequence
  SiRNA target sequence
gatggttatccttatacaaaaga

SEQ ID NO: 133801 - DNA, 23 bp, Artificial sequence
  SiRNA target sequence
atggttatccttatacaaaagaa

SEQ ID NO: 133802 - DNA, 23 bp, Artificial sequence
  SiRNA target sequence
tggttatccttatacaaaagaag

SEQ ID NO: 133803 - DNA, 23 bp, Artificial sequence
  SiRNA target sequence
ggttatccttatacaaaagaaga

SEQ ID NO: 133804 - DNA, 23 bp, Artificial sequence
  SiRNA target sequence
gttatccttatacaaaagaagaa

SEQ ID NO: 133805 - DNA, 23 bp, Artificial sequence
  SiRNA target sequence
ttatccttatacaaaagaagaaa

SEQ ID NO: 133806 - DNA, 23 bp, Artificial sequence
  SiRNA target sequence
tatccttatacaaaagaagaaat

SEQ ID NO: 133807 - DNA, 23 bp, Artificial sequence
  SiRNA target sequence
atccttatacaaaagaagaaata

SEQ ID NO: 133808 - DNA, 23 bp, Artificial sequence
  SiRNA target sequence
tccttatacaaaagaagaaatag

SEQ ID NO: 133809 - DNA, 23 bp, Artificial sequence
  SiRNA target sequence
ccttatacaaaagaagaaatagt

SEQ ID NO: 133810 - DNA, 23 bp, Artificial sequence
  SiRNA target sequence
cttatacaaaagaagaaatagta

SEQ ID NO: 133811 - DNA, 23 bp, Artificial sequence
  SiRNA target sequence
ttatacaaaagaagaaatagtat

SEQ ID NO: 133812 - DNA, 23 bp, Artificial sequence
  SiRNA target sequence
tatacaaaagaagaaatagtata

SEQ ID NO: 133813 - DNA, 23 bp, Artificial sequence
  SiRNA target sequence
atacaaaagaagaaatagtatat

SEQ ID NO: 133814 - DNA, 23 bp, Artificial sequence
  SiRNA target sequence
tacaaaagaagaaatagtatatt

SEQ ID NO: 133815 - DNA, 23 bp, Artificial sequence
  SiRNA target sequence
acaaaagaagaaatagtatattg

SEQ ID NO: 133816 - DNA, 23 bp, Artificial sequence
  SiRNA target sequence
caaaagaagaaatagtatattgt

SEQ ID NO: 133817 - DNA, 23 bp, Artificial sequence
  SiRNA target sequence
aaaagaagaaatagtatattgta

SEQ ID NO: 133818 - DNA, 23 bp, Artificial sequence
  SiRNA target sequence
aaagaagaaatagtatattgtat

SEQ ID NO: 133819 - DNA, 23 bp, Artificial sequence
  SiRNA target sequence
aagaagaaatagtatattgtatc

SEQ ID NO: 133820 - DNA, 23 bp, Artificial sequence
  SiRNA target sequence
agaagaaatagtatattgtatcg

SEQ ID NO: 133821 - DNA, 23 bp, Artificial sequence
  SiRNA target sequence
gaagaaatagtatattgtatcga

SEQ ID NO: 133822 - DNA, 23 bp, Artificial sequence
  SiRNA target sequence
aagaaatagtatattgtatcgaa

SEQ ID NO: 133823 - DNA, 23 bp, Artificial sequence
  SiRNA target sequence
agaaatagtatattgtatcgaac

SEQ ID NO: 133824 - DNA, 23 bp, Artificial sequence
  SiRNA target sequence
gaaatagtatattgtatcgaaca

SEQ ID NO: 133825 - DNA, 23 bp, Artificial sequence
  SiRNA target sequence
aaatagtatattgtatcgaacat

SEQ ID NO: 133826 - DNA, 23 bp, Artificial sequence
  SiRNA target sequence
aatagtatattgtatcgaacatg

SEQ ID NO: 133827 - DNA, 23 bp, Artificial sequence
  SiRNA target sequence
atagtatattgtatcgaacatga

SEQ ID NO: 133828 - DNA, 23 bp, Artificial sequence
  SiRNA target sequence
tagtatattgtatcgaacatgaa

SEQ ID NO: 133829 - DNA, 23 bp, Artificial sequence
  SiRNA target sequence
agtatattgtatcgaacatgaat

SEQ ID NO: 133830 - DNA, 23 bp, Artificial sequence
  SiRNA target sequence
gtatattgtatcgaacatgaatt

SEQ ID NO: 133831 - DNA, 23 bp, Artificial sequence
  SiRNA target sequence
tatattgtatcgaacatgaattg

SEQ ID NO: 133832 - DNA, 23 bp, Artificial sequence
  SiRNA target sequence
atattgtatcgaacatgaattgg

SEQ ID NO: 133833 - DNA, 23 bp, Artificial sequence
  SiRNA target sequence
tattgtatcgaacatgaattggc

SEQ ID NO: 133834 - DNA, 23 bp, Artificial sequence
  SiRNA target sequence
attgtatcgaacatgaattggct

SEQ ID NO: 133835 - DNA, 23 bp, Artificial sequence
  SiRNA target sequence
ttgtatcgaacatgaattggctt

SEQ ID NO: 133836 - DNA, 23 bp, Artificial sequence
  SiRNA target sequence
tgtatcgaacatgaattggctta

SEQ ID NO: 133837 - DNA, 23 bp, Artificial sequence
  SiRNA target sequence
gtatcgaacatgaattggcttat

SEQ ID NO: 133838 - DNA, 23 bp, Artificial sequence
  SiRNA target sequence
tatcgaacatgaattggcttatc

SEQ ID NO: 133839 - DNA, 23 bp, Artificial sequence
  SiRNA target sequence
atcgaacatgaattggcttatcg

SEQ ID NO: 133840 - DNA, 23 bp, Artificial sequence
  SiRNA target sequence
tcgaacatgaattggcttatcgc

SEQ ID NO: 133841 - DNA, 23 bp, Artificial sequence
  SiRNA target sequence
cgaacatgaattggcttatcgca

SEQ ID NO: 133842 - DNA, 23 bp, Artificial sequence
  SiRNA target sequence
gaacatgaattggcttatcgcat

SEQ ID NO: 133843 - DNA, 23 bp, Artificial sequence
  SiRNA target sequence
aacatgaattggcttatcgcatc

SEQ ID NO: 133844 - DNA, 23 bp, Artificial sequence
  SiRNA target sequence
acatgaattggcttatcgcatca

SEQ ID NO: 133845 - DNA, 23 bp, Artificial sequence
  SiRNA target sequence
catgaattggcttatcgcatcag

SEQ ID NO: 133846 - DNA, 23 bp, Artificial sequence
  SiRNA target sequence
atgaattggcttatcgcatcagt

SEQ ID NO: 133847 - DNA, 23 bp, Artificial sequence
  SiRNA target sequence
tgaattggcttatcgcatcagtg

SEQ ID NO: 133848 - DNA, 23 bp, Artificial sequence
  SiRNA target sequence
gaattggcttatcgcatcagtga

SEQ ID NO: 133849 - DNA, 23 bp, Artificial sequence
  SiRNA target sequence
aattggcttatcgcatcagtgat

SEQ ID NO: 133850 - DNA, 23 bp, Artificial sequence
  SiRNA target sequence
attggcttatcgcatcagtgata

SEQ ID NO: 133851 - DNA, 23 bp, Artificial sequence
  SiRNA target sequence
ttggcttatcgcatcagtgatat

SEQ ID NO: 133852 - DNA, 23 bp, Artificial sequence
  SiRNA target sequence
tggcttatcgcatcagtgatata

SEQ ID NO: 133853 - DNA, 23 bp, Artificial sequence
  SiRNA target sequence
ggcttatcgcatcagtgatatat

SEQ ID NO: 133854 - DNA, 23 bp, Artificial sequence
  SiRNA target sequence
gcttatcgcatcagtgatatatt

SEQ ID NO: 133855 - DNA, 23 bp, Artificial sequence
  SiRNA target sequence
cttatcgcatcagtgatatatta

SEQ ID NO: 133856 - DNA, 23 bp, Artificial sequence
  SiRNA target sequence
ttatcgcatcagtgatatattat

SEQ ID NO: 133857 - DNA, 23 bp, Artificial sequence
  SiRNA target sequence
tatcgcatcagtgatatattatt

SEQ ID NO: 133858 - DNA, 23 bp, Artificial sequence
  SiRNA target sequence
atcgcatcagtgatatattattt

SEQ ID NO: 133859 - DNA, 23 bp, Artificial sequence
  SiRNA target sequence
tcgcatcagtgatatattattta

SEQ ID NO: 133860 - DNA, 23 bp, Artificial sequence
  SiRNA target sequence
cgcatcagtgatatattatttaa

SEQ ID NO: 133861 - DNA, 23 bp, Artificial sequence
  SiRNA target sequence
gcatcagtgatatattatttaat

SEQ ID NO: 133862 - DNA, 23 bp, Artificial sequence
  SiRNA target sequence
catcagtgatatattatttaata

SEQ ID NO: 133863 - DNA, 23 bp, Artificial sequence
  SiRNA target sequence
atcagtgatatattatttaatag

SEQ ID NO: 133864 - DNA, 23 bp, Artificial sequence
  SiRNA target sequence
tcagtgatatattatttaatagg

SEQ ID NO: 133865 - DNA, 23 bp, Artificial sequence
  SiRNA target sequence
cagtgatatattatttaatagga

SEQ ID NO: 133866 - DNA, 23 bp, Artificial sequence
  SiRNA target sequence
agtgatatattatttaataggat

SEQ ID NO: 133867 - DNA, 23 bp, Artificial sequence
  SiRNA target sequence
gtgatatattatttaataggatg

SEQ ID NO: 133868 - DNA, 23 bp, Artificial sequence
  SiRNA target sequence
tgatatattatttaataggatga

SEQ ID NO: 133869 - DNA, 23 bp, Artificial sequence
  SiRNA target sequence
gatatattatttaataggatgat

SEQ ID NO: 133870 - DNA, 23 bp, Artificial sequence
  SiRNA target sequence
atatattatttaataggatgatg

SEQ ID NO: 133871 - DNA, 23 bp, Artificial sequence
  SiRNA target sequence
tatattatttaataggatgatga

SEQ ID NO: 133872 - DNA, 23 bp, Artificial sequence
  SiRNA target sequence
atattatttaataggatgatgat

SEQ ID NO: 133873 - DNA, 23 bp, Artificial sequence
  SiRNA target sequence
tattatttaataggatgatgata

SEQ ID NO: 133874 - DNA, 23 bp, Artificial sequence
  SiRNA target sequence
attatttaataggatgatgatag

SEQ ID NO: 133875 - DNA, 23 bp, Artificial sequence
  SiRNA target sequence
ttatttaataggatgatgatagg

SEQ ID NO: 133876 - DNA, 23 bp, Artificial sequence
  SiRNA target sequence
tatttaataggatgatgatagga

SEQ ID NO: 133877 - DNA, 23 bp, Artificial sequence
  SiRNA target sequence
atttaataggatgatgataggat

SEQ ID NO: 133878 - DNA, 23 bp, Artificial sequence
  SiRNA target sequence
tttaataggatgatgataggata

SEQ ID NO: 133879 - DNA, 23 bp, Artificial sequence
  SiRNA target sequence
ttaataggatgatgataggatac

SEQ ID NO: 133880 - DNA, 23 bp, Artificial sequence
  SiRNA target sequence
taataggatgatgataggataca

SEQ ID NO: 133881 - DNA, 23 bp, Artificial sequence
  SiRNA target sequence
aataggatgatgataggatacat

SEQ ID NO: 133882 - DNA, 23 bp, Artificial sequence
  SiRNA target sequence
ataggatgatgataggatacatt

SEQ ID NO: 133883 - DNA, 23 bp, Artificial sequence
  SiRNA target sequence
taggatgatgataggatacattg

SEQ ID NO: 133884 - DNA, 23 bp, Artificial sequence
  SiRNA target sequence
aggatgatgataggatacattga

SEQ ID NO: 133885 - DNA, 23 bp, Artificial sequence
  SiRNA target sequence
ggatgatgataggatacattgac

SEQ ID NO: 133886 - DNA, 23 bp, Artificial sequence
  SiRNA target sequence
gatgatgataggatacattgacg

SEQ ID NO: 133887 - DNA, 23 bp, Artificial sequence
  SiRNA target sequence
atgatgataggatacattgacgt

SEQ ID NO: 133888 - DNA, 23 bp, Artificial sequence
  SiRNA target sequence
tgatgataggatacattgacgtc

SEQ ID NO: 133889 - DNA, 23 bp, Artificial sequence
  SiRNA target sequence
gatgataggatacattgacgtca

SEQ ID NO: 133890 - DNA, 23 bp, Artificial sequence
  SiRNA target sequence
atgataggatacattgacgtcag

SEQ ID NO: 133891 - DNA, 23 bp, Artificial sequence
  SiRNA target sequence
tgataggatacattgacgtcaga

SEQ ID NO: 133892 - DNA, 23 bp, Artificial sequence
  SiRNA target sequence
gataggatacattgacgtcagaa

SEQ ID NO: 133893 - DNA, 23 bp, Artificial sequence
  SiRNA target sequence
ataggatacattgacgtcagaag

SEQ ID NO: 133894 - DNA, 23 bp, Artificial sequence
  SiRNA target sequence
taggatacattgacgtcagaaga

SEQ ID NO: 133895 - DNA, 23 bp, Artificial sequence
  SiRNA target sequence
aggatacattgacgtcagaagag

SEQ ID NO: 133896 - DNA, 23 bp, Artificial sequence
  SiRNA target sequence
ggatacattgacgtcagaagagc

SEQ ID NO: 133897 - DNA, 23 bp, Artificial sequence
  SiRNA target sequence
gatacattgacgtcagaagagca

SEQ ID NO: 133898 - DNA, 23 bp, Artificial sequence
  SiRNA target sequence
atacattgacgtcagaagagcat

SEQ ID NO: 133899 - DNA, 23 bp, Artificial sequence
  SiRNA target sequence
tacattgacgtcagaagagcatt

SEQ ID NO: 133900 - DNA, 23 bp, Artificial sequence
  SiRNA target sequence
acattgacgtcagaagagcattt

SEQ ID NO: 133901 - DNA, 23 bp, Artificial sequence
  SiRNA target sequence
cattgacgtcagaagagcatttg

SEQ ID NO: 133902 - DNA, 23 bp, Artificial sequence
  SiRNA target sequence
attgacgtcagaagagcatttga

SEQ ID NO: 133903 - DNA, 23 bp, Artificial sequence
  SiRNA target sequence
ttgacgtcagaagagcatttgat

SEQ ID NO: 133904 - DNA, 23 bp, Artificial sequence
  SiRNA target sequence
tgacgtcagaagagcatttgatt

SEQ ID NO: 133905 - DNA, 23 bp, Artificial sequence
  SiRNA target sequence
gacgtcagaagagcatttgattt

SEQ ID NO: 133906 - DNA, 23 bp, Artificial sequence
  SiRNA target sequence
acgtcagaagagcatttgattta

SEQ ID NO: 133907 - DNA, 23 bp, Artificial sequence
  SiRNA target sequence
cgtcagaagagcatttgatttaa

SEQ ID NO: 133908 - DNA, 23 bp, Artificial sequence
  SiRNA target sequence
gtcagaagagcatttgatttaat

SEQ ID NO: 133909 - DNA, 23 bp, Artificial sequence
  SiRNA target sequence
tcagaagagcatttgatttaatt

SEQ ID NO: 133910 - DNA, 23 bp, Artificial sequence
  SiRNA target sequence
cagaagagcatttgatttaattg

SEQ ID NO: 133911 - DNA, 23 bp, Artificial sequence
  SiRNA target sequence
agaagagcatttgatttaattgg

SEQ ID NO: 133912 - DNA, 23 bp, Artificial sequence
  SiRNA target sequence
gaagagcatttgatttaattggt

SEQ ID NO: 133913 - DNA, 23 bp, Artificial sequence
  SiRNA target sequence
aagagcatttgatttaattggta

SEQ ID NO: 133914 - DNA, 23 bp, Artificial sequence
  SiRNA target sequence
agagcatttgatttaattggtat

SEQ ID NO: 133915 - DNA, 23 bp, Artificial sequence
  SiRNA target sequence
gagcatttgatttaattggtata

SEQ ID NO: 133916 - DNA, 23 bp, Artificial sequence
  SiRNA target sequence
agcatttgatttaattggtatag

SEQ ID NO: 133917 - DNA, 23 bp, Artificial sequence
  SiRNA target sequence
gcatttgatttaattggtatagt

SEQ ID NO: 133918 - DNA, 23 bp, Artificial sequence
  SiRNA target sequence
catttgatttaattggtatagta

SEQ ID NO: 133919 - DNA, 23 bp, Artificial sequence
  SiRNA target sequence
atttgatttaattggtatagtag

SEQ ID NO: 133920 - DNA, 23 bp, Artificial sequence
  SiRNA target sequence
tttgatttaattggtatagtagc

SEQ ID NO: 133921 - DNA, 23 bp, Artificial sequence
  SiRNA target sequence
ttgatttaattggtatagtagct

SEQ ID NO: 133922 - DNA, 23 bp, Artificial sequence
  SiRNA target sequence
tgatttaattggtatagtagctg

SEQ ID NO: 133923 - DNA, 23 bp, Artificial sequence
  SiRNA target sequence
gatttaattggtatagtagctga

SEQ ID NO: 133924 - DNA, 23 bp, Artificial sequence
  SiRNA target sequence
atttaattggtatagtagctgaa

SEQ ID NO: 133925 - DNA, 23 bp, Artificial sequence
  SiRNA target sequence
tttaattggtatagtagctgaag

SEQ ID NO: 133926 - DNA, 23 bp, Artificial sequence
  SiRNA target sequence
ttaattggtatagtagctgaagt

SEQ ID NO: 133927 - DNA, 23 bp, Artificial sequence
  SiRNA target sequence
taattggtatagtagctgaagta

SEQ ID NO: 133928 - DNA, 23 bp, Artificial sequence
  SiRNA target sequence
aattggtatagtagctgaagtaa

SEQ ID NO: 133929 - DNA, 23 bp, Artificial sequence
  SiRNA target sequence
attggtatagtagctgaagtaat

SEQ ID NO: 133930 - DNA, 23 bp, Artificial sequence
  SiRNA target sequence
ttggtatagtagctgaagtaatg

SEQ ID NO: 133931 - DNA, 23 bp, Artificial sequence
  SiRNA target sequence
tggtatagtagctgaagtaatga

SEQ ID NO: 133932 - DNA, 23 bp, Artificial sequence
  SiRNA target sequence
ggtatagtagctgaagtaatgaa

SEQ ID NO: 133933 - DNA, 23 bp, Artificial sequence
  SiRNA target sequence
gtatagtagctgaagtaatgaaa

SEQ ID NO: 133934 - DNA, 23 bp, Artificial sequence
  SiRNA target sequence
tatagtagctgaagtaatgaaag

SEQ ID NO: 133935 - DNA, 23 bp, Artificial sequence
  SiRNA target sequence
atagtagctgaagtaatgaaaga

SEQ ID NO: 133936 - DNA, 23 bp, Artificial sequence
  SiRNA target sequence
tagtagctgaagtaatgaaagac

SEQ ID NO: 133937 - DNA, 23 bp, Artificial sequence
  SiRNA target sequence
agtagctgaagtaatgaaagact

SEQ ID NO: 133938 - DNA, 23 bp, Artificial sequence
  SiRNA target sequence
gtagctgaagtaatgaaagacta

SEQ ID NO: 133939 - DNA, 23 bp, Artificial sequence
  SiRNA target sequence
tagctgaagtaatgaaagactat

SEQ ID NO: 133940 - DNA, 23 bp, Artificial sequence
  SiRNA target sequence
agctgaagtaatgaaagactatt

SEQ ID NO: 133941 - DNA, 23 bp, Artificial sequence
  SiRNA target sequence
gctgaagtaatgaaagactatta

SEQ ID NO: 133942 - DNA, 23 bp, Artificial sequence
  SiRNA target sequence
ctgaagtaatgaaagactattac

SEQ ID NO: 133943 - DNA, 23 bp, Artificial sequence
  SiRNA target sequence
tgaagtaatgaaagactattacg

SEQ ID NO: 133944 - DNA, 23 bp, Artificial sequence
  SiRNA target sequence
gaagtaatgaaagactattacgg

SEQ ID NO: 133945 - DNA, 23 bp, Artificial sequence
  SiRNA target sequence
aagtaatgaaagactattacgga

SEQ ID NO: 133946 - DNA, 23 bp, Artificial sequence
  SiRNA target sequence
agtaatgaaagactattacggat

SEQ ID NO: 133947 - DNA, 23 bp, Artificial sequence
  SiRNA target sequence
gtaatgaaagactattacggatg

SEQ ID NO: 133948 - DNA, 23 bp, Artificial sequence
  SiRNA target sequence
taatgaaagactattacggatgg

SEQ ID NO: 133949 - DNA, 23 bp, Artificial sequence
  SiRNA target sequence
aatgaaagactattacggatggg

SEQ ID NO: 133950 - DNA, 23 bp, Artificial sequence
  SiRNA target sequence
atgaaagactattacggatggga

SEQ ID NO: 133951 - DNA, 23 bp, Artificial sequence
  SiRNA target sequence
tgaaagactattacggatgggat

SEQ ID NO: 133952 - DNA, 23 bp, Artificial sequence
  SiRNA target sequence
gaaagactattacggatgggatc

SEQ ID NO: 133953 - DNA, 23 bp, Artificial sequence
  SiRNA target sequence
aaagactattacggatgggatca

SEQ ID NO: 133954 - DNA, 23 bp, Artificial sequence
  SiRNA target sequence
aagactattacggatgggatcag

SEQ ID NO: 133955 - DNA, 23 bp, Artificial sequence
  SiRNA target sequence
agactattacggatgggatcagc

SEQ ID NO: 133956 - DNA, 23 bp, Artificial sequence
  SiRNA target sequence
gactattacggatgggatcagca

SEQ ID NO: 133957 - DNA, 23 bp, Artificial sequence
  SiRNA target sequence
actattacggatgggatcagcaa

SEQ ID NO: 133958 - DNA, 23 bp, Artificial sequence
  SiRNA target sequence
ctattacggatgggatcagcaaa

SEQ ID NO: 133959 - DNA, 23 bp, Artificial sequence
  SiRNA target sequence
tattacggatgggatcagcaaag

SEQ ID NO: 133960 - DNA, 23 bp, Artificial sequence
  SiRNA target sequence
attacggatgggatcagcaaaga

SEQ ID NO: 133961 - DNA, 23 bp, Artificial sequence
  SiRNA target sequence
ttacggatgggatcagcaaagat

SEQ ID NO: 133962 - DNA, 23 bp, Artificial sequence
  SiRNA target sequence
tacggatgggatcagcaaagata

SEQ ID NO: 133963 - DNA, 23 bp, Artificial sequence
  SiRNA target sequence
acggatgggatcagcaaagatat

SEQ ID NO: 133964 - DNA, 23 bp, Artificial sequence
  SiRNA target sequence
cggatgggatcagcaaagatata

SEQ ID NO: 133965 - DNA, 23 bp, Artificial sequence
  SiRNA target sequence
ggatgggatcagcaaagatataa

SEQ ID NO: 133966 - DNA, 23 bp, Artificial sequence
  SiRNA target sequence
gatgggatcagcaaagatataat

SEQ ID NO: 133967 - DNA, 23 bp, Artificial sequence
  SiRNA target sequence
atgggatcagcaaagatataatg

SEQ ID NO: 133968 - DNA, 23 bp, Artificial sequence
  SiRNA target sequence
tgggatcagcaaagatataatga

SEQ ID NO: 133969 - DNA, 23 bp, Artificial sequence
  SiRNA target sequence
gggatcagcaaagatataatgaa

SEQ ID NO: 133970 - DNA, 23 bp, Artificial sequence
  SiRNA target sequence
ggatcagcaaagatataatgaag

SEQ ID NO: 133971 - DNA, 23 bp, Artificial sequence
  SiRNA target sequence
gatcagcaaagatataatgaaga

SEQ ID NO: 133972 - DNA, 23 bp, Artificial sequence
  SiRNA target sequence
atcagcaaagatataatgaagaa

SEQ ID NO: 133973 - DNA, 23 bp, Artificial sequence
  SiRNA target sequence
tcagcaaagatataatgaagaaa

SEQ ID NO: 133974 - DNA, 23 bp, Artificial sequence
  SiRNA target sequence
cagcaaagatataatgaagaaac

SEQ ID NO: 133975 - DNA, 23 bp, Artificial sequence
  SiRNA target sequence
agcaaagatataatgaagaaaca

SEQ ID NO: 133976 - DNA, 23 bp, Artificial sequence
  SiRNA target sequence
gcaaagatataatgaagaaacaa

SEQ ID NO: 133977 - DNA, 23 bp, Artificial sequence
  SiRNA target sequence
caaagatataatgaagaaacaaa

SEQ ID NO: 133978 - DNA, 23 bp, Artificial sequence
  SiRNA target sequence
aaagatataatgaagaaacaaaa

SEQ ID NO: 133979 - DNA, 23 bp, Artificial sequence
  SiRNA target sequence
aagatataatgaagaaacaaaat

SEQ ID NO: 133980 - DNA, 23 bp, Artificial sequence
  SiRNA target sequence
agatataatgaagaaacaaaatt

SEQ ID NO: 133981 - DNA, 23 bp, Artificial sequence
  SiRNA target sequence
gatataatgaagaaacaaaatta

SEQ ID NO: 133982 - DNA, 23 bp, Artificial sequence
  SiRNA target sequence
atataatgaagaaacaaaattat

SEQ ID NO: 133983 - DNA, 23 bp, Artificial sequence
  SiRNA target sequence
tataatgaagaaacaaaattatg

SEQ ID NO: 133984 - DNA, 23 bp, Artificial sequence
  SiRNA target sequence
ataatgaagaaacaaaattatgc

SEQ ID NO: 133985 - DNA, 23 bp, Artificial sequence
  SiRNA target sequence
taatgaagaaacaaaattatgca

SEQ ID NO: 133986 - DNA, 23 bp, Artificial sequence
  SiRNA target sequence
aatgaagaaacaaaattatgcat

SEQ ID NO: 133987 - DNA, 23 bp, Artificial sequence
  SiRNA target sequence
atgaagaaacaaaattatgcatg

SEQ ID NO: 133988 - DNA, 23 bp, Artificial sequence
  SiRNA target sequence
tgaagaaacaaaattatgcatgg

SEQ ID NO: 133989 - DNA, 23 bp, Artificial sequence
  SiRNA target sequence
gaagaaacaaaattatgcatgga

SEQ ID NO: 133990 - DNA, 23 bp, Artificial sequence
  SiRNA target sequence
aagaaacaaaattatgcatggaa

SEQ ID NO: 133991 - DNA, 23 bp, Artificial sequence
  SiRNA target sequence
agaaacaaaattatgcatggaaa

SEQ ID NO: 133992 - DNA, 23 bp, Artificial sequence
  SiRNA target sequence
gaaacaaaattatgcatggaaat

SEQ ID NO: 133993 - DNA, 23 bp, Artificial sequence
  SiRNA target sequence
aaacaaaattatgcatggaaatg

SEQ ID NO: 133994 - DNA, 23 bp, Artificial sequence
  SiRNA target sequence
aacaaaattatgcatggaaatga

SEQ ID NO: 133995 - DNA, 23 bp, Artificial sequence
  SiRNA target sequence
acaaaattatgcatggaaatgat

SEQ ID NO: 133996 - DNA, 23 bp, Artificial sequence
  SiRNA target sequence
caaaattatgcatggaaatgatg

SEQ ID NO: 133997 - DNA, 23 bp, Artificial sequence
  SiRNA target sequence
aaaattatgcatggaaatgatgg

SEQ ID NO: 133998 - DNA, 23 bp, Artificial sequence
  SiRNA target sequence
aaattatgcatggaaatgatgga

SEQ ID NO: 133999 - DNA, 23 bp, Artificial sequence
  SiRNA target sequence
aattatgcatggaaatgatggaa

SEQ ID NO: 134000 - DNA, 23 bp, Artificial sequence
  SiRNA target sequence
attatgcatggaaatgatggaaa

SEQ ID NO: 134001 - DNA, 23 bp, Artificial sequence
  SiRNA target sequence
ttatgcatggaaatgatggaaac

SEQ ID NO: 134002 - DNA, 23 bp, Artificial sequence
  SiRNA target sequence
tatgcatggaaatgatggaaact

SEQ ID NO: 134003 - DNA, 23 bp, Artificial sequence
  SiRNA target sequence
atgcatggaaatgatggaaactt

SEQ ID NO: 134004 - DNA, 23 bp, Artificial sequence
  SiRNA target sequence
tgcatggaaatgatggaaacttg

SEQ ID NO: 134005 - DNA, 23 bp, Artificial sequence
  SiRNA target sequence
gcatggaaatgatggaaacttgt

SEQ ID NO: 134006 - DNA, 23 bp, Artificial sequence
  SiRNA target sequence
catggaaatgatggaaacttgtg

SEQ ID NO: 134007 - DNA, 23 bp, Artificial sequence
  SiRNA target sequence
atggaaatgatggaaacttgtgg

SEQ ID NO: 134008 - DNA, 23 bp, Artificial sequence
  SiRNA target sequence
tggaaatgatggaaacttgtggt

SEQ ID NO: 134009 - DNA, 23 bp, Artificial sequence
  SiRNA target sequence
ggaaatgatggaaacttgtggtt

SEQ ID NO: 134010 - DNA, 23 bp, Artificial sequence
  SiRNA target sequence
gaaatgatggaaacttgtggtta

SEQ ID NO: 134011 - DNA, 23 bp, Artificial sequence
  SiRNA target sequence
aaatgatggaaacttgtggttat

SEQ ID NO: 134012 - DNA, 23 bp, Artificial sequence
  SiRNA target sequence
aatgatggaaacttgtggttata

SEQ ID NO: 134013 - DNA, 23 bp, Artificial sequence
  SiRNA target sequence
atgatggaaacttgtggttatag

SEQ ID NO: 134014 - DNA, 23 bp, Artificial sequence
  SiRNA target sequence
tgatggaaacttgtggttatagt

SEQ ID NO: 134015 - DNA, 23 bp, Artificial sequence
  SiRNA target sequence
gatggaaacttgtggttatagtt

SEQ ID NO: 134016 - DNA, 23 bp, Artificial sequence
  SiRNA target sequence
atggaaacttgtggttatagttt

SEQ ID NO: 134017 - DNA, 23 bp, Artificial sequence
  SiRNA target sequence
tggaaacttgtggttatagttta

SEQ ID NO: 134018 - DNA, 23 bp, Artificial sequence
  SiRNA target sequence
ggaaacttgtggttatagtttat

SEQ ID NO: 134019 - DNA, 23 bp, Artificial sequence
  SiRNA target sequence
gaaacttgtggttatagtttatt

SEQ ID NO: 134020 - DNA, 23 bp, Artificial sequence
  SiRNA target sequence
aaacttgtggttatagtttatta

SEQ ID NO: 134021 - DNA, 23 bp, Artificial sequence
  SiRNA target sequence
aacttgtggttatagtttattaa

SEQ ID NO: 134022 - DNA, 23 bp, Artificial sequence
  SiRNA target sequence
acttgtggttatagtttattaaa

SEQ ID NO: 134023 - DNA, 23 bp, Artificial sequence
  SiRNA target sequence
cttgtggttatagtttattaaaa

SEQ ID NO: 134024 - DNA, 23 bp, Artificial sequence
  SiRNA target sequence
ttgtggttatagtttattaaaaa

SEQ ID NO: 134025 - DNA, 23 bp, Artificial sequence
  SiRNA target sequence
tgtggttatagtttattaaaaaa

SEQ ID NO: 134026 - DNA, 23 bp, Artificial sequence
  SiRNA target sequence
gtggttatagtttattaaaaaat

SEQ ID NO: 134027 - DNA, 23 bp, Artificial sequence
  SiRNA target sequence
tggttatagtttattaaaaaatt

SEQ ID NO: 134028 - DNA, 23 bp, Artificial sequence
  SiRNA target sequence
ggttatagtttattaaaaaatta

SEQ ID NO: 134029 - DNA, 23 bp, Artificial sequence
  SiRNA target sequence
gttatagtttattaaaaaattaa

SEQ ID NO: 134030 - DNA, 24 bp, Artificial sequence
  SiRNA target sequence
atggtgtataaggttttatttaca

SEQ ID NO: 134031 - DNA, 24 bp, Artificial sequence
  SiRNA target sequence
tggtgtataaggttttatttacag

SEQ ID NO: 134032 - DNA, 24 bp, Artificial sequence
  SiRNA target sequence
ggtgtataaggttttatttacagt

SEQ ID NO: 134033 - DNA, 24 bp, Artificial sequence
  SiRNA target sequence
gtgtataaggttttatttacagta

SEQ ID NO: 134034 - DNA, 24 bp, Artificial sequence
  SiRNA target sequence
tgtataaggttttatttacagtaa

SEQ ID NO: 134035 - DNA, 24 bp, Artificial sequence
  SiRNA target sequence
gtataaggttttatttacagtaat

SEQ ID NO: 134036 - DNA, 24 bp, Artificial sequence
  SiRNA target sequence
tataaggttttatttacagtaata

SEQ ID NO: 134037 - DNA, 24 bp, Artificial sequence
  SiRNA target sequence
ataaggttttatttacagtaatag

SEQ ID NO: 134038 - DNA, 24 bp, Artificial sequence
  SiRNA target sequence
taaggttttatttacagtaatagg

SEQ ID NO: 134039 - DNA, 24 bp, Artificial sequence
  SiRNA target sequence
aaggttttatttacagtaatagga

SEQ ID NO: 134040 - DNA, 24 bp, Artificial sequence
  SiRNA target sequence
aggttttatttacagtaataggat

SEQ ID NO: 134041 - DNA, 24 bp, Artificial sequence
  SiRNA target sequence
ggttttatttacagtaataggatt

SEQ ID NO: 134042 - DNA, 24 bp, Artificial sequence
  SiRNA target sequence
gttttatttacagtaataggatta

SEQ ID NO: 134043 - DNA, 24 bp, Artificial sequence
  SiRNA target sequence
ttttatttacagtaataggattaa

SEQ ID NO: 134044 - DNA, 24 bp, Artificial sequence
  SiRNA target sequence
tttatttacagtaataggattaat

SEQ ID NO: 134045 - DNA, 24 bp, Artificial sequence
  SiRNA target sequence
ttatttacagtaataggattaata

SEQ ID NO: 134046 - DNA, 24 bp, Artificial sequence
  SiRNA target sequence
tatttacagtaataggattaatat

SEQ ID NO: 134047 - DNA, 24 bp, Artificial sequence
  SiRNA target sequence
atttacagtaataggattaatatg

SEQ ID NO: 134048 - DNA, 24 bp, Artificial sequence
  SiRNA target sequence
tttacagtaataggattaatatgt

SEQ ID NO: 134049 - DNA, 24 bp, Artificial sequence
  SiRNA target sequence
ttacagtaataggattaatatgtg

SEQ ID NO: 134050 - DNA, 24 bp, Artificial sequence
  SiRNA target sequence
tacagtaataggattaatatgtgg

SEQ ID NO: 134051 - DNA, 24 bp, Artificial sequence
  SiRNA target sequence
acagtaataggattaatatgtggt

SEQ ID NO: 134052 - DNA, 24 bp, Artificial sequence
  SiRNA target sequence
cagtaataggattaatatgtggta

SEQ ID NO: 134053 - DNA, 24 bp, Artificial sequence
  SiRNA target sequence
agtaataggattaatatgtggtat

SEQ ID NO: 134054 - DNA, 24 bp, Artificial sequence
  SiRNA target sequence
gtaataggattaatatgtggtata

SEQ ID NO: 134055 - DNA, 24 bp, Artificial sequence
  SiRNA target sequence
taataggattaatatgtggtatac

SEQ ID NO: 134056 - DNA, 24 bp, Artificial sequence
  SiRNA target sequence
aataggattaatatgtggtatact

SEQ ID NO: 134057 - DNA, 24 bp, Artificial sequence
  SiRNA target sequence
ataggattaatatgtggtatactt

SEQ ID NO: 134058 - DNA, 24 bp, Artificial sequence
  SiRNA target sequence
taggattaatatgtggtatactta

SEQ ID NO: 134059 - DNA, 24 bp, Artificial sequence
  SiRNA target sequence
aggattaatatgtggtatacttac

SEQ ID NO: 134060 - DNA, 24 bp, Artificial sequence
  SiRNA target sequence
ggattaatatgtggtatacttaca

SEQ ID NO: 134061 - DNA, 24 bp, Artificial sequence
  SiRNA target sequence
gattaatatgtggtatacttacaa

SEQ ID NO: 134062 - DNA, 24 bp, Artificial sequence
  SiRNA target sequence
attaatatgtggtatacttacaat

SEQ ID NO: 134063 - DNA, 24 bp, Artificial sequence
  SiRNA target sequence
ttaatatgtggtatacttacaata

SEQ ID NO: 134064 - DNA, 24 bp, Artificial sequence
  SiRNA target sequence
taatatgtggtatacttacaataa

SEQ ID NO: 134065 - DNA, 24 bp, Artificial sequence
  SiRNA target sequence
aatatgtggtatacttacaataat

SEQ ID NO: 134066 - DNA, 24 bp, Artificial sequence
  SiRNA target sequence
atatgtggtatacttacaataatt

SEQ ID NO: 134067 - DNA, 24 bp, Artificial sequence
  SiRNA target sequence
tatgtggtatacttacaataatta

SEQ ID NO: 134068 - DNA, 24 bp, Artificial sequence
  SiRNA target sequence
atgtggtatacttacaataattaa

SEQ ID NO: 134069 - DNA, 24 bp, Artificial sequence
  SiRNA target sequence
tgtggtatacttacaataattaaa

SEQ ID NO: 134070 - DNA, 24 bp, Artificial sequence
  SiRNA target sequence
gtggtatacttacaataattaaac

SEQ ID NO: 134071 - DNA, 24 bp, Artificial sequence
  SiRNA target sequence
tggtatacttacaataattaaacg

SEQ ID NO: 134072 - DNA, 24 bp, Artificial sequence
  SiRNA target sequence
ggtatacttacaataattaaacga

SEQ ID NO: 134073 - DNA, 24 bp, Artificial sequence
  SiRNA target sequence
gtatacttacaataattaaacgat

SEQ ID NO: 134074 - DNA, 24 bp, Artificial sequence
  SiRNA target sequence
tatacttacaataattaaacgata

SEQ ID NO: 134075 - DNA, 24 bp, Artificial sequence
  SiRNA target sequence
atacttacaataattaaacgatac

SEQ ID NO: 134076 - DNA, 24 bp, Artificial sequence
  SiRNA target sequence
tacttacaataattaaacgataca

SEQ ID NO: 134077 - DNA, 24 bp, Artificial sequence
  SiRNA target sequence
acttacaataattaaacgatacaa

SEQ ID NO: 134078 - DNA, 24 bp, Artificial sequence
  SiRNA target sequence
cttacaataattaaacgatacaag

SEQ ID NO: 134079 - DNA, 24 bp, Artificial sequence
  SiRNA target sequence
ttacaataattaaacgatacaagt

SEQ ID NO: 134080 - DNA, 24 bp, Artificial sequence
  SiRNA target sequence
tacaataattaaacgatacaagta

SEQ ID NO: 134081 - DNA, 24 bp, Artificial sequence
  SiRNA target sequence
acaataattaaacgatacaagtat

SEQ ID NO: 134082 - DNA, 24 bp, Artificial sequence
  SiRNA target sequence
caataattaaacgatacaagtatt

SEQ ID NO: 134083 - DNA, 24 bp, Artificial sequence
  SiRNA target sequence
aataattaaacgatacaagtattt

SEQ ID NO: 134084 - DNA, 24 bp, Artificial sequence
  SiRNA target sequence
ataattaaacgatacaagtatttt

SEQ ID NO: 134085 - DNA, 24 bp, Artificial sequence
  SiRNA target sequence
taattaaacgatacaagtatttta

SEQ ID NO: 134086 - DNA, 24 bp, Artificial sequence
  SiRNA target sequence
aattaaacgatacaagtattttaa

SEQ ID NO: 134087 - DNA, 24 bp, Artificial sequence
  SiRNA target sequence
attaaacgatacaagtattttaag

SEQ ID NO: 134088 - DNA, 24 bp, Artificial sequence
  SiRNA target sequence
ttaaacgatacaagtattttaaga

SEQ ID NO: 134089 - DNA, 24 bp, Artificial sequence
  SiRNA target sequence
taaacgatacaagtattttaagat

SEQ ID NO: 134090 - DNA, 24 bp, Artificial sequence
  SiRNA target sequence
aaacgatacaagtattttaagata

SEQ ID NO: 134091 - DNA, 24 bp, Artificial sequence
  SiRNA target sequence
aacgatacaagtattttaagataa

SEQ ID NO: 134092 - DNA, 24 bp, Artificial sequence
  SiRNA target sequence
acgatacaagtattttaagataaa

SEQ ID NO: 134093 - DNA, 24 bp, Artificial sequence
  SiRNA target sequence
cgatacaagtattttaagataaaa

SEQ ID NO: 134094 - DNA, 24 bp, Artificial sequence
  SiRNA target sequence
gatacaagtattttaagataaaaa

SEQ ID NO: 134095 - DNA, 24 bp, Artificial sequence
  SiRNA target sequence
atacaagtattttaagataaaaaa

SEQ ID NO: 134096 - DNA, 24 bp, Artificial sequence
  SiRNA target sequence
tacaagtattttaagataaaaaaa

SEQ ID NO: 134097 - DNA, 24 bp, Artificial sequence
  SiRNA target sequence
acaagtattttaagataaaaaaat

SEQ ID NO: 134098 - DNA, 24 bp, Artificial sequence
  SiRNA target sequence
caagtattttaagataaaaaaatt

SEQ ID NO: 134099 - DNA, 24 bp, Artificial sequence
  SiRNA target sequence
aagtattttaagataaaaaaattg

SEQ ID NO: 134100 - DNA, 24 bp, Artificial sequence
  SiRNA target sequence
agtattttaagataaaaaaattgg

SEQ ID NO: 134101 - DNA, 24 bp, Artificial sequence
  SiRNA target sequence
gtattttaagataaaaaaattggc

SEQ ID NO: 134102 - DNA, 24 bp, Artificial sequence
  SiRNA target sequence
tattttaagataaaaaaattggcc

SEQ ID NO: 134103 - DNA, 24 bp, Artificial sequence
  SiRNA target sequence
attttaagataaaaaaattggcct

SEQ ID NO: 134104 - DNA, 24 bp, Artificial sequence
  SiRNA target sequence
ttttaagataaaaaaattggcctt

SEQ ID NO: 134105 - DNA, 24 bp, Artificial sequence
  SiRNA target sequence
tttaagataaaaaaattggcctta

SEQ ID NO: 134106 - DNA, 24 bp, Artificial sequence
  SiRNA target sequence
ttaagataaaaaaattggccttaa

SEQ ID NO: 134107 - DNA, 24 bp, Artificial sequence
  SiRNA target sequence
taagataaaaaaattggccttaac

SEQ ID NO: 134108 - DNA, 24 bp, Artificial sequence
  SiRNA target sequence
aagataaaaaaattggccttaact

SEQ ID NO: 134109 - DNA, 24 bp, Artificial sequence
  SiRNA target sequence
agataaaaaaattggccttaactt

SEQ ID NO: 134110 - DNA, 24 bp, Artificial sequence
  SiRNA target sequence
gataaaaaaattggccttaactta

SEQ ID NO: 134111 - DNA, 24 bp, Artificial sequence
  SiRNA target sequence
ataaaaaaattggccttaacttac

SEQ ID NO: 134112 - DNA, 24 bp, Artificial sequence
  SiRNA target sequence
taaaaaaattggccttaacttact

SEQ ID NO: 134113 - DNA, 24 bp, Artificial sequence
  SiRNA target sequence
aaaaaaattggccttaacttactt

SEQ ID NO: 134114 - DNA, 24 bp, Artificial sequence
  SiRNA target sequence
aaaaaattggccttaacttacttc

SEQ ID NO: 134115 - DNA, 24 bp, Artificial sequence
  SiRNA target sequence
aaaaattggccttaacttacttcg

SEQ ID NO: 134116 - DNA, 24 bp, Artificial sequence
  SiRNA target sequence
aaaattggccttaacttacttcgg

SEQ ID NO: 134117 - DNA, 24 bp, Artificial sequence
  SiRNA target sequence
aaattggccttaacttacttcggg

SEQ ID NO: 134118 - DNA, 24 bp, Artificial sequence
  SiRNA target sequence
aattggccttaacttacttcggga

SEQ ID NO: 134119 - DNA, 24 bp, Artificial sequence
  SiRNA target sequence
attggccttaacttacttcgggaa

SEQ ID NO: 134120 - DNA, 24 bp, Artificial sequence
  SiRNA target sequence
ttggccttaacttacttcgggaaa

SEQ ID NO: 134121 - DNA, 24 bp, Artificial sequence
  SiRNA target sequence
tggccttaacttacttcgggaaac

SEQ ID NO: 134122 - DNA, 24 bp, Artificial sequence
  SiRNA target sequence
ggccttaacttacttcgggaaaca

SEQ ID NO: 134123 - DNA, 24 bp, Artificial sequence
  SiRNA target sequence
gccttaacttacttcgggaaacaa

SEQ ID NO: 134124 - DNA, 24 bp, Artificial sequence
  SiRNA target sequence
ccttaacttacttcgggaaacaag

SEQ ID NO: 134125 - DNA, 24 bp, Artificial sequence
  SiRNA target sequence
cttaacttacttcgggaaacaaga

SEQ ID NO: 134126 - DNA, 24 bp, Artificial sequence
  SiRNA target sequence
ttaacttacttcgggaaacaagac

SEQ ID NO: 134127 - DNA, 24 bp, Artificial sequence
  SiRNA target sequence
taacttacttcgggaaacaagact

SEQ ID NO: 134128 - DNA, 24 bp, Artificial sequence
  SiRNA target sequence
aacttacttcgggaaacaagactt

SEQ ID NO: 134129 - DNA, 24 bp, Artificial sequence
  SiRNA target sequence
acttacttcgggaaacaagacttg

SEQ ID NO: 134130 - DNA, 24 bp, Artificial sequence
  SiRNA target sequence
cttacttcgggaaacaagacttgc

SEQ ID NO: 134131 - DNA, 24 bp, Artificial sequence
  SiRNA target sequence
ttacttcgggaaacaagacttgca

SEQ ID NO: 134132 - DNA, 24 bp, Artificial sequence
  SiRNA target sequence
tacttcgggaaacaagacttgcaa

SEQ ID NO: 134133 - DNA, 24 bp, Artificial sequence
  SiRNA target sequence
acttcgggaaacaagacttgcaat

SEQ ID NO: 134134 - DNA, 24 bp, Artificial sequence
  SiRNA target sequence
cttcgggaaacaagacttgcaatg

SEQ ID NO: 134135 - DNA, 24 bp, Artificial sequence
  SiRNA target sequence
ttcgggaaacaagacttgcaatgg

SEQ ID NO: 134136 - DNA, 24 bp, Artificial sequence
  SiRNA target sequence
tcgggaaacaagacttgcaatgga

SEQ ID NO: 134137 - DNA, 24 bp, Artificial sequence
  SiRNA target sequence
cgggaaacaagacttgcaatggaa

SEQ ID NO: 134138 - DNA, 24 bp, Artificial sequence
  SiRNA target sequence
gggaaacaagacttgcaatggaaa

SEQ ID NO: 134139 - DNA, 24 bp, Artificial sequence
  SiRNA target sequence
ggaaacaagacttgcaatggaaac

SEQ ID NO: 134140 - DNA, 24 bp, Artificial sequence
  SiRNA target sequence
gaaacaagacttgcaatggaaacc

SEQ ID NO: 134141 - DNA, 24 bp, Artificial sequence
  SiRNA target sequence
aaacaagacttgcaatggaaacct

SEQ ID NO: 134142 - DNA, 24 bp, Artificial sequence
  SiRNA target sequence
aacaagacttgcaatggaaaccta

SEQ ID NO: 134143 - DNA, 24 bp, Artificial sequence
  SiRNA target sequence
acaagacttgcaatggaaacctaa

SEQ ID NO: 134144 - DNA, 24 bp, Artificial sequence
  SiRNA target sequence
caagacttgcaatggaaacctaaa

SEQ ID NO: 134145 - DNA, 24 bp, Artificial sequence
  SiRNA target sequence
aagacttgcaatggaaacctaaaa

SEQ ID NO: 134146 - DNA, 24 bp, Artificial sequence
  SiRNA target sequence
agacttgcaatggaaacctaaaag

SEQ ID NO: 134147 - DNA, 24 bp, Artificial sequence
  SiRNA target sequence
gacttgcaatggaaacctaaaagt

SEQ ID NO: 134148 - DNA, 24 bp, Artificial sequence
  SiRNA target sequence
acttgcaatggaaacctaaaagtc

SEQ ID NO: 134149 - DNA, 24 bp, Artificial sequence
  SiRNA target sequence
cttgcaatggaaacctaaaagtcg

SEQ ID NO: 134150 - DNA, 24 bp, Artificial sequence
  SiRNA target sequence
ttgcaatggaaacctaaaagtcgg

SEQ ID NO: 134151 - DNA, 24 bp, Artificial sequence
  SiRNA target sequence
tgcaatggaaacctaaaagtcggt

SEQ ID NO: 134152 - DNA, 24 bp, Artificial sequence
  SiRNA target sequence
gcaatggaaacctaaaagtcggtc

SEQ ID NO: 134153 - DNA, 24 bp, Artificial sequence
  SiRNA target sequence
caatggaaacctaaaagtcggtca

SEQ ID NO: 134154 - DNA, 24 bp, Artificial sequence
  SiRNA target sequence
aatggaaacctaaaagtcggtcag

SEQ ID NO: 134155 - DNA, 24 bp, Artificial sequence
  SiRNA target sequence
atggaaacctaaaagtcggtcaga

SEQ ID NO: 134156 - DNA, 24 bp, Artificial sequence
  SiRNA target sequence
tggaaacctaaaagtcggtcagaa

SEQ ID NO: 134157 - DNA, 24 bp, Artificial sequence
  SiRNA target sequence
ggaaacctaaaagtcggtcagaaa

SEQ ID NO: 134158 - DNA, 24 bp, Artificial sequence
  SiRNA target sequence
gaaacctaaaagtcggtcagaaat

SEQ ID NO: 134159 - DNA, 24 bp, Artificial sequence
  SiRNA target sequence
aaacctaaaagtcggtcagaaatt

SEQ ID NO: 134160 - DNA, 24 bp, Artificial sequence
  SiRNA target sequence
aacctaaaagtcggtcagaaatta

SEQ ID NO: 134161 - DNA, 24 bp, Artificial sequence
  SiRNA target sequence
acctaaaagtcggtcagaaattat

SEQ ID NO: 134162 - DNA, 24 bp, Artificial sequence
  SiRNA target sequence
cctaaaagtcggtcagaaattatt

SEQ ID NO: 134163 - DNA, 24 bp, Artificial sequence
  SiRNA target sequence
ctaaaagtcggtcagaaattatta

SEQ ID NO: 134164 - DNA, 24 bp, Artificial sequence
  SiRNA target sequence
taaaagtcggtcagaaattattaa

SEQ ID NO: 134165 - DNA, 24 bp, Artificial sequence
  SiRNA target sequence
aaaagtcggtcagaaattattaac

SEQ ID NO: 134166 - DNA, 24 bp, Artificial sequence
  SiRNA target sequence
aaagtcggtcagaaattattaacg

SEQ ID NO: 134167 - DNA, 24 bp, Artificial sequence
  SiRNA target sequence
aagtcggtcagaaattattaacga

SEQ ID NO: 134168 - DNA, 24 bp, Artificial sequence
  SiRNA target sequence
agtcggtcagaaattattaacgat

SEQ ID NO: 134169 - DNA, 24 bp, Artificial sequence
  SiRNA target sequence
gtcggtcagaaattattaacgatt

SEQ ID NO: 134170 - DNA, 24 bp, Artificial sequence
  SiRNA target sequence
tcggtcagaaattattaacgattt

SEQ ID NO: 134171 - DNA, 24 bp, Artificial sequence
  SiRNA target sequence
cggtcagaaattattaacgattta

SEQ ID NO: 134172 - DNA, 24 bp, Artificial sequence
  SiRNA target sequence
ggtcagaaattattaacgatttaa

SEQ ID NO: 134173 - DNA, 24 bp, Artificial sequence
  SiRNA target sequence
gtcagaaattattaacgatttaaa

SEQ ID NO: 134174 - DNA, 24 bp, Artificial sequence
  SiRNA target sequence
tcagaaattattaacgatttaaaa

SEQ ID NO: 134175 - DNA, 24 bp, Artificial sequence
  SiRNA target sequence
cagaaattattaacgatttaaaaa

SEQ ID NO: 134176 - DNA, 24 bp, Artificial sequence
  SiRNA target sequence
agaaattattaacgatttaaaaaa

SEQ ID NO: 134177 - DNA, 24 bp, Artificial sequence
  SiRNA target sequence
gaaattattaacgatttaaaaaat

SEQ ID NO: 134178 - DNA, 24 bp, Artificial sequence
  SiRNA target sequence
aaattattaacgatttaaaaaata

SEQ ID NO: 134179 - DNA, 24 bp, Artificial sequence
  SiRNA target sequence
aattattaacgatttaaaaaatac

SEQ ID NO: 134180 - DNA, 24 bp, Artificial sequence
  SiRNA target sequence
attattaacgatttaaaaaataca

SEQ ID NO: 134181 - DNA, 24 bp, Artificial sequence
  SiRNA target sequence
ttattaacgatttaaaaaatacaa

SEQ ID NO: 134182 - DNA, 24 bp, Artificial sequence
  SiRNA target sequence
tattaacgatttaaaaaatacaaa

SEQ ID NO: 134183 - DNA, 24 bp, Artificial sequence
  SiRNA target sequence
attaacgatttaaaaaatacaaac

SEQ ID NO: 134184 - DNA, 24 bp, Artificial sequence
  SiRNA target sequence
ttaacgatttaaaaaatacaaact

SEQ ID NO: 134185 - DNA, 24 bp, Artificial sequence
  SiRNA target sequence
taacgatttaaaaaatacaaactt

SEQ ID NO: 134186 - DNA, 24 bp, Artificial sequence
  SiRNA target sequence
aacgatttaaaaaatacaaacttt

SEQ ID NO: 134187 - DNA, 24 bp, Artificial sequence
  SiRNA target sequence
acgatttaaaaaatacaaactttg

SEQ ID NO: 134188 - DNA, 24 bp, Artificial sequence
  SiRNA target sequence
cgatttaaaaaatacaaactttga

SEQ ID NO: 134189 - DNA, 24 bp, Artificial sequence
  SiRNA target sequence
gatttaaaaaatacaaactttgac

SEQ ID NO: 134190 - DNA, 24 bp, Artificial sequence
  SiRNA target sequence
atttaaaaaatacaaactttgaca

SEQ ID NO: 134191 - DNA, 24 bp, Artificial sequence
  SiRNA target sequence
tttaaaaaatacaaactttgacat

SEQ ID NO: 134192 - DNA, 24 bp, Artificial sequence
  SiRNA target sequence
ttaaaaaatacaaactttgacata

SEQ ID NO: 134193 - DNA, 24 bp, Artificial sequence
  SiRNA target sequence
taaaaaatacaaactttgacatat

SEQ ID NO: 134194 - DNA, 24 bp, Artificial sequence
  SiRNA target sequence
aaaaaatacaaactttgacatatt

SEQ ID NO: 134195 - DNA, 24 bp, Artificial sequence
  SiRNA target sequence
aaaaatacaaactttgacatattg

SEQ ID NO: 134196 - DNA, 24 bp, Artificial sequence
  SiRNA target sequence
aaaatacaaactttgacatattga

SEQ ID NO: 134197 - DNA, 24 bp, Artificial sequence
  SiRNA target sequence
aaatacaaactttgacatattgat

SEQ ID NO: 134198 - DNA, 24 bp, Artificial sequence
  SiRNA target sequence
aatacaaactttgacatattgatt

SEQ ID NO: 134199 - DNA, 24 bp, Artificial sequence
  SiRNA target sequence
atacaaactttgacatattgatta

SEQ ID NO: 134200 - DNA, 24 bp, Artificial sequence
  SiRNA target sequence
tacaaactttgacatattgattat

SEQ ID NO: 134201 - DNA, 24 bp, Artificial sequence
  SiRNA target sequence
acaaactttgacatattgattatt

SEQ ID NO: 134202 - DNA, 24 bp, Artificial sequence
  SiRNA target sequence
caaactttgacatattgattattg

SEQ ID NO: 134203 - DNA, 24 bp, Artificial sequence
  SiRNA target sequence
aaactttgacatattgattattgg

SEQ ID NO: 134204 - DNA, 24 bp, Artificial sequence
  SiRNA target sequence
aactttgacatattgattattggt

SEQ ID NO: 134205 - DNA, 24 bp, Artificial sequence
  SiRNA target sequence
actttgacatattgattattggtg

SEQ ID NO: 134206 - DNA, 24 bp, Artificial sequence
  SiRNA target sequence
ctttgacatattgattattggtgg

SEQ ID NO: 134207 - DNA, 24 bp, Artificial sequence
  SiRNA target sequence
tttgacatattgattattggtggc

SEQ ID NO: 134208 - DNA, 24 bp, Artificial sequence
  SiRNA target sequence
ttgacatattgattattggtggcg

SEQ ID NO: 134209 - DNA, 24 bp, Artificial sequence
  SiRNA target sequence
tgacatattgattattggtggcgg

SEQ ID NO: 134210 - DNA, 24 bp, Artificial sequence
  SiRNA target sequence
gacatattgattattggtggcggt

SEQ ID NO: 134211 - DNA, 24 bp, Artificial sequence
  SiRNA target sequence
acatattgattattggtggcggtt

SEQ ID NO: 134212 - DNA, 24 bp, Artificial sequence
  SiRNA target sequence
catattgattattggtggcggttc

SEQ ID NO: 134213 - DNA, 24 bp, Artificial sequence
  SiRNA target sequence
atattgattattggtggcggttca

SEQ ID NO: 134214 - DNA, 24 bp, Artificial sequence
  SiRNA target sequence
tattgattattggtggcggttcaa

SEQ ID NO: 134215 - DNA, 24 bp, Artificial sequence
  SiRNA target sequence
attgattattggtggcggttcaac

SEQ ID NO: 134216 - DNA, 24 bp, Artificial sequence
  SiRNA target sequence
ttgattattggtggcggttcaacg

SEQ ID NO: 134217 - DNA, 24 bp, Artificial sequence
  SiRNA target sequence
tgattattggtggcggttcaacgg

SEQ ID NO: 134218 - DNA, 24 bp, Artificial sequence
  SiRNA target sequence
gattattggtggcggttcaacggg

SEQ ID NO: 134219 - DNA, 24 bp, Artificial sequence
  SiRNA target sequence
attattggtggcggttcaacggga

SEQ ID NO: 134220 - DNA, 24 bp, Artificial sequence
  SiRNA target sequence
ttattggtggcggttcaacgggaa

SEQ ID NO: 134221 - DNA, 24 bp, Artificial sequence
  SiRNA target sequence
tattggtggcggttcaacgggaat

SEQ ID NO: 134222 - DNA, 24 bp, Artificial sequence
  SiRNA target sequence
attggtggcggttcaacgggaatg

SEQ ID NO: 134223 - DNA, 24 bp, Artificial sequence
  SiRNA target sequence
ttggtggcggttcaacgggaatgg

SEQ ID NO: 134224 - DNA, 24 bp, Artificial sequence
  SiRNA target sequence
tggtggcggttcaacgggaatggg

SEQ ID NO: 134225 - DNA, 24 bp, Artificial sequence
  SiRNA target sequence
ggtggcggttcaacgggaatggga

SEQ ID NO: 134226 - DNA, 24 bp, Artificial sequence
  SiRNA target sequence
gtggcggttcaacgggaatgggat

SEQ ID NO: 134227 - DNA, 24 bp, Artificial sequence
  SiRNA target sequence
tggcggttcaacgggaatgggatg

SEQ ID NO: 134228 - DNA, 24 bp, Artificial sequence
  SiRNA target sequence
ggcggttcaacgggaatgggatgt

SEQ ID NO: 134229 - DNA, 24 bp, Artificial sequence
  SiRNA target sequence
gcggttcaacgggaatgggatgtg

SEQ ID NO: 134230 - DNA, 24 bp, Artificial sequence
  SiRNA target sequence
cggttcaacgggaatgggatgtgc

SEQ ID NO: 134231 - DNA, 24 bp, Artificial sequence
  SiRNA target sequence
ggttcaacgggaatgggatgtgca

SEQ ID NO: 134232 - DNA, 24 bp, Artificial sequence
  SiRNA target sequence
gttcaacgggaatgggatgtgcaa

SEQ ID NO: 134233 - DNA, 24 bp, Artificial sequence
  SiRNA target sequence
ttcaacgggaatgggatgtgcaat

SEQ ID NO: 134234 - DNA, 24 bp, Artificial sequence
  SiRNA target sequence
tcaacgggaatgggatgtgcaatc

SEQ ID NO: 134235 - DNA, 24 bp, Artificial sequence
  SiRNA target sequence
caacgggaatgggatgtgcaatcg

SEQ ID NO: 134236 - DNA, 24 bp, Artificial sequence
  SiRNA target sequence
aacgggaatgggatgtgcaatcga

SEQ ID NO: 134237 - DNA, 24 bp, Artificial sequence
  SiRNA target sequence
acgggaatgggatgtgcaatcgaa

SEQ ID NO: 134238 - DNA, 24 bp, Artificial sequence
  SiRNA target sequence
cgggaatgggatgtgcaatcgaag

SEQ ID NO: 134239 - DNA, 24 bp, Artificial sequence
  SiRNA target sequence
gggaatgggatgtgcaatcgaagc

SEQ ID NO: 134240 - DNA, 24 bp, Artificial sequence
  SiRNA target sequence
ggaatgggatgtgcaatcgaagca

SEQ ID NO: 134241 - DNA, 24 bp, Artificial sequence
  SiRNA target sequence
gaatgggatgtgcaatcgaagcag

SEQ ID NO: 134242 - DNA, 24 bp, Artificial sequence
  SiRNA target sequence
aatgggatgtgcaatcgaagcagc

SEQ ID NO: 134243 - DNA, 24 bp, Artificial sequence
  SiRNA target sequence
atgggatgtgcaatcgaagcagct

SEQ ID NO: 134244 - DNA, 24 bp, Artificial sequence
  SiRNA target sequence
tgggatgtgcaatcgaagcagcta

SEQ ID NO: 134245 - DNA, 24 bp, Artificial sequence
  SiRNA target sequence
gggatgtgcaatcgaagcagctac

SEQ ID NO: 134246 - DNA, 24 bp, Artificial sequence
  SiRNA target sequence
ggatgtgcaatcgaagcagctaca

SEQ ID NO: 134247 - DNA, 24 bp, Artificial sequence
  SiRNA target sequence
gatgtgcaatcgaagcagctacac

SEQ ID NO: 134248 - DNA, 24 bp, Artificial sequence
  SiRNA target sequence
atgtgcaatcgaagcagctacacg

SEQ ID NO: 134249 - DNA, 24 bp, Artificial sequence
  SiRNA target sequence
tgtgcaatcgaagcagctacacga

SEQ ID NO: 134250 - DNA, 24 bp, Artificial sequence
  SiRNA target sequence
gtgcaatcgaagcagctacacgag

SEQ ID NO: 134251 - DNA, 24 bp, Artificial sequence
  SiRNA target sequence
tgcaatcgaagcagctacacgagg

SEQ ID NO: 134252 - DNA, 24 bp, Artificial sequence
  SiRNA target sequence
gcaatcgaagcagctacacgaggt

SEQ ID NO: 134253 - DNA, 24 bp, Artificial sequence
  SiRNA target sequence
caatcgaagcagctacacgaggta

SEQ ID NO: 134254 - DNA, 24 bp, Artificial sequence
  SiRNA target sequence
aatcgaagcagctacacgaggtat

SEQ ID NO: 134255 - DNA, 24 bp, Artificial sequence
  SiRNA target sequence
atcgaagcagctacacgaggtata

SEQ ID NO: 134256 - DNA, 24 bp, Artificial sequence
  SiRNA target sequence
tcgaagcagctacacgaggtataa

SEQ ID NO: 134257 - DNA, 24 bp, Artificial sequence
  SiRNA target sequence
cgaagcagctacacgaggtataag

SEQ ID NO: 134258 - DNA, 24 bp, Artificial sequence
  SiRNA target sequence
gaagcagctacacgaggtataagt

SEQ ID NO: 134259 - DNA, 24 bp, Artificial sequence
  SiRNA target sequence
aagcagctacacgaggtataagtg

SEQ ID NO: 134260 - DNA, 24 bp, Artificial sequence
  SiRNA target sequence
agcagctacacgaggtataagtgt

SEQ ID NO: 134261 - DNA, 24 bp, Artificial sequence
  SiRNA target sequence
gcagctacacgaggtataagtgtt

SEQ ID NO: 134262 - DNA, 24 bp, Artificial sequence
  SiRNA target sequence
cagctacacgaggtataagtgttg

SEQ ID NO: 134263 - DNA, 24 bp, Artificial sequence
  SiRNA target sequence
agctacacgaggtataagtgttgg

SEQ ID NO: 134264 - DNA, 24 bp, Artificial sequence
  SiRNA target sequence
gctacacgaggtataagtgttggc

SEQ ID NO: 134265 - DNA, 24 bp, Artificial sequence
  SiRNA target sequence
ctacacgaggtataagtgttggcc

SEQ ID NO: 134266 - DNA, 24 bp, Artificial sequence
  SiRNA target sequence
tacacgaggtataagtgttggcct

SEQ ID NO: 134267 - DNA, 24 bp, Artificial sequence
  SiRNA target sequence
acacgaggtataagtgttggcctg

SEQ ID NO: 134268 - DNA, 24 bp, Artificial sequence
  SiRNA target sequence
cacgaggtataagtgttggcctga

SEQ ID NO: 134269 - DNA, 24 bp, Artificial sequence
  SiRNA target sequence
acgaggtataagtgttggcctgat

SEQ ID NO: 134270 - DNA, 24 bp, Artificial sequence
  SiRNA target sequence
cgaggtataagtgttggcctgata

SEQ ID NO: 134271 - DNA, 24 bp, Artificial sequence
  SiRNA target sequence
gaggtataagtgttggcctgatag

SEQ ID NO: 134272 - DNA, 24 bp, Artificial sequence
  SiRNA target sequence
aggtataagtgttggcctgataga

SEQ ID NO: 134273 - DNA, 24 bp, Artificial sequence
  SiRNA target sequence
ggtataagtgttggcctgatagaa

SEQ ID NO: 134274 - DNA, 24 bp, Artificial sequence
  SiRNA target sequence
gtataagtgttggcctgatagaag

SEQ ID NO: 134275 - DNA, 24 bp, Artificial sequence
  SiRNA target sequence
tataagtgttggcctgatagaagc

SEQ ID NO: 134276 - DNA, 24 bp, Artificial sequence
  SiRNA target sequence
ataagtgttggcctgatagaagca

SEQ ID NO: 134277 - DNA, 24 bp, Artificial sequence
  SiRNA target sequence
taagtgttggcctgatagaagcac

SEQ ID NO: 134278 - DNA, 24 bp, Artificial sequence
  SiRNA target sequence
aagtgttggcctgatagaagcaca

SEQ ID NO: 134279 - DNA, 24 bp, Artificial sequence
  SiRNA target sequence
agtgttggcctgatagaagcacat

SEQ ID NO: 134280 - DNA, 24 bp, Artificial sequence
  SiRNA target sequence
gtgttggcctgatagaagcacatg

SEQ ID NO: 134281 - DNA, 24 bp, Artificial sequence
  SiRNA target sequence
tgttggcctgatagaagcacatga

SEQ ID NO: 134282 - DNA, 24 bp, Artificial sequence
  SiRNA target sequence
gttggcctgatagaagcacatgat

SEQ ID NO: 134283 - DNA, 24 bp, Artificial sequence
  SiRNA target sequence
ttggcctgatagaagcacatgatt

SEQ ID NO: 134284 - DNA, 24 bp, Artificial sequence
  SiRNA target sequence
tggcctgatagaagcacatgattt

SEQ ID NO: 134285 - DNA, 24 bp, Artificial sequence
  SiRNA target sequence
ggcctgatagaagcacatgatttt

SEQ ID NO: 134286 - DNA, 24 bp, Artificial sequence
  SiRNA target sequence
gcctgatagaagcacatgattttg

SEQ ID NO: 134287 - DNA, 24 bp, Artificial sequence
  SiRNA target sequence
cctgatagaagcacatgattttgg

SEQ ID NO: 134288 - DNA, 24 bp, Artificial sequence
  SiRNA target sequence
ctgatagaagcacatgattttggt

SEQ ID NO: 134289 - DNA, 24 bp, Artificial sequence
  SiRNA target sequence
tgatagaagcacatgattttggtt

SEQ ID NO: 134290 - DNA, 24 bp, Artificial sequence
  SiRNA target sequence
gatagaagcacatgattttggttc

SEQ ID NO: 134291 - DNA, 24 bp, Artificial sequence
  SiRNA target sequence
atagaagcacatgattttggttcg

SEQ ID NO: 134292 - DNA, 24 bp, Artificial sequence
  SiRNA target sequence
tagaagcacatgattttggttcgg

SEQ ID NO: 134293 - DNA, 24 bp, Artificial sequence
  SiRNA target sequence
agaagcacatgattttggttcggg

SEQ ID NO: 134294 - DNA, 24 bp, Artificial sequence
  SiRNA target sequence
gaagcacatgattttggttcgggc

SEQ ID NO: 134295 - DNA, 24 bp, Artificial sequence
  SiRNA target sequence
aagcacatgattttggttcgggca

SEQ ID NO: 134296 - DNA, 24 bp, Artificial sequence
  SiRNA target sequence
agcacatgattttggttcgggcac

SEQ ID NO: 134297 - DNA, 24 bp, Artificial sequence
  SiRNA target sequence
gcacatgattttggttcgggcacg

SEQ ID NO: 134298 - DNA, 24 bp, Artificial sequence
  SiRNA target sequence
cacatgattttggttcgggcacga

SEQ ID NO: 134299 - DNA, 24 bp, Artificial sequence
  SiRNA target sequence
acatgattttggttcgggcacgag

SEQ ID NO: 134300 - DNA, 24 bp, Artificial sequence
  SiRNA target sequence
catgattttggttcgggcacgagt

SEQ ID NO: 134301 - DNA, 24 bp, Artificial sequence
  SiRNA target sequence
atgattttggttcgggcacgagtt

SEQ ID NO: 134302 - DNA, 24 bp, Artificial sequence
  SiRNA target sequence
tgattttggttcgggcacgagttc

SEQ ID NO: 134303 - DNA, 24 bp, Artificial sequence
  SiRNA target sequence
gattttggttcgggcacgagttca

SEQ ID NO: 134304 - DNA, 24 bp, Artificial sequence
  SiRNA target sequence
attttggttcgggcacgagttcaa

SEQ ID NO: 134305 - DNA, 24 bp, Artificial sequence
  SiRNA target sequence
ttttggttcgggcacgagttcaaa

SEQ ID NO: 134306 - DNA, 24 bp, Artificial sequence
  SiRNA target sequence
tttggttcgggcacgagttcaaaa

SEQ ID NO: 134307 - DNA, 24 bp, Artificial sequence
  SiRNA target sequence
ttggttcgggcacgagttcaaaat

SEQ ID NO: 134308 - DNA, 24 bp, Artificial sequence
  SiRNA target sequence
tggttcgggcacgagttcaaaatc

SEQ ID NO: 134309 - DNA, 24 bp, Artificial sequence
  SiRNA target sequence
ggttcgggcacgagttcaaaatct

SEQ ID NO: 134310 - DNA, 24 bp, Artificial sequence
  SiRNA target sequence
gttcgggcacgagttcaaaatcta

SEQ ID NO: 134311 - DNA, 24 bp, Artificial sequence
  SiRNA target sequence
ttcgggcacgagttcaaaatctac

SEQ ID NO: 134312 - DNA, 24 bp, Artificial sequence
  SiRNA target sequence
tcgggcacgagttcaaaatctaca

SEQ ID NO: 134313 - DNA, 24 bp, Artificial sequence
  SiRNA target sequence
cgggcacgagttcaaaatctacaa

SEQ ID NO: 134314 - DNA, 24 bp, Artificial sequence
  SiRNA target sequence
gggcacgagttcaaaatctacaaa

SEQ ID NO: 134315 - DNA, 24 bp, Artificial sequence
  SiRNA target sequence
ggcacgagttcaaaatctacaaaa

SEQ ID NO: 134316 - DNA, 24 bp, Artificial sequence
  SiRNA target sequence
gcacgagttcaaaatctacaaaac

SEQ ID NO: 134317 - DNA, 24 bp, Artificial sequence
  SiRNA target sequence
cacgagttcaaaatctacaaaact

SEQ ID NO: 134318 - DNA, 24 bp, Artificial sequence
  SiRNA target sequence
acgagttcaaaatctacaaaactt

SEQ ID NO: 134319 - DNA, 24 bp, Artificial sequence
  SiRNA target sequence
cgagttcaaaatctacaaaacttt

SEQ ID NO: 134320 - DNA, 24 bp, Artificial sequence
  SiRNA target sequence
gagttcaaaatctacaaaactttt

SEQ ID NO: 134321 - DNA, 24 bp, Artificial sequence
  SiRNA target sequence
agttcaaaatctacaaaacttttt

SEQ ID NO: 134322 - DNA, 24 bp, Artificial sequence
  SiRNA target sequence
gttcaaaatctacaaaactttttc

SEQ ID NO: 134323 - DNA, 24 bp, Artificial sequence
  SiRNA target sequence
ttcaaaatctacaaaactttttca

SEQ ID NO: 134324 - DNA, 24 bp, Artificial sequence
  SiRNA target sequence
tcaaaatctacaaaactttttcat

SEQ ID NO: 134325 - DNA, 24 bp, Artificial sequence
  SiRNA target sequence
caaaatctacaaaactttttcatg

SEQ ID NO: 134326 - DNA, 24 bp, Artificial sequence
  SiRNA target sequence
aaaatctacaaaactttttcatgg

SEQ ID NO: 134327 - DNA, 24 bp, Artificial sequence
  SiRNA target sequence
aaatctacaaaactttttcatggc

SEQ ID NO: 134328 - DNA, 24 bp, Artificial sequence
  SiRNA target sequence
aatctacaaaactttttcatggcg

SEQ ID NO: 134329 - DNA, 24 bp, Artificial sequence
  SiRNA target sequence
atctacaaaactttttcatggcgg

SEQ ID NO: 134330 - DNA, 24 bp, Artificial sequence
  SiRNA target sequence
tctacaaaactttttcatggcggt

SEQ ID NO: 134331 - DNA, 24 bp, Artificial sequence
  SiRNA target sequence
ctacaaaactttttcatggcggtg

SEQ ID NO: 134332 - DNA, 24 bp, Artificial sequence
  SiRNA target sequence
tacaaaactttttcatggcggtgt

SEQ ID NO: 134333 - DNA, 24 bp, Artificial sequence
  SiRNA target sequence
acaaaactttttcatggcggtgta

SEQ ID NO: 134334 - DNA, 24 bp, Artificial sequence
  SiRNA target sequence
caaaactttttcatggcggtgtac

SEQ ID NO: 134335 - DNA, 24 bp, Artificial sequence
  SiRNA target sequence
aaaactttttcatggcggtgtacg

SEQ ID NO: 134336 - DNA, 24 bp, Artificial sequence
  SiRNA target sequence
aaactttttcatggcggtgtacgc

SEQ ID NO: 134337 - DNA, 24 bp, Artificial sequence
  SiRNA target sequence
aactttttcatggcggtgtacgct

SEQ ID NO: 134338 - DNA, 24 bp, Artificial sequence
  SiRNA target sequence
actttttcatggcggtgtacgcta

SEQ ID NO: 134339 - DNA, 24 bp, Artificial sequence
  SiRNA target sequence
ctttttcatggcggtgtacgctac

SEQ ID NO: 134340 - DNA, 24 bp, Artificial sequence
  SiRNA target sequence
tttttcatggcggtgtacgctacc

SEQ ID NO: 134341 - DNA, 24 bp, Artificial sequence
  SiRNA target sequence
ttttcatggcggtgtacgctacct

SEQ ID NO: 134342 - DNA, 24 bp, Artificial sequence
  SiRNA target sequence
tttcatggcggtgtacgctacctt

SEQ ID NO: 134343 - DNA, 24 bp, Artificial sequence
  SiRNA target sequence
ttcatggcggtgtacgctaccttg

SEQ ID NO: 134344 - DNA, 24 bp, Artificial sequence
  SiRNA target sequence
tcatggcggtgtacgctaccttga

SEQ ID NO: 134345 - DNA, 24 bp, Artificial sequence
  SiRNA target sequence
catggcggtgtacgctaccttgaa

SEQ ID NO: 134346 - DNA, 24 bp, Artificial sequence
  SiRNA target sequence
atggcggtgtacgctaccttgaaa

SEQ ID NO: 134347 - DNA, 24 bp, Artificial sequence
  SiRNA target sequence
tggcggtgtacgctaccttgaaaa

SEQ ID NO: 134348 - DNA, 24 bp, Artificial sequence
  SiRNA target sequence
ggcggtgtacgctaccttgaaaaa

SEQ ID NO: 134349 - DNA, 24 bp, Artificial sequence
  SiRNA target sequence
gcggtgtacgctaccttgaaaaag

SEQ ID NO: 134350 - DNA, 24 bp, Artificial sequence
  SiRNA target sequence
cggtgtacgctaccttgaaaaagc

SEQ ID NO: 134351 - DNA, 24 bp, Artificial sequence
  SiRNA target sequence
ggtgtacgctaccttgaaaaagct

SEQ ID NO: 134352 - DNA, 24 bp, Artificial sequence
  SiRNA target sequence
gtgtacgctaccttgaaaaagctg

SEQ ID NO: 134353 - DNA, 24 bp, Artificial sequence
  SiRNA target sequence
tgtacgctaccttgaaaaagctgt

SEQ ID NO: 134354 - DNA, 24 bp, Artificial sequence
  SiRNA target sequence
gtacgctaccttgaaaaagctgtt

SEQ ID NO: 134355 - DNA, 24 bp, Artificial sequence
  SiRNA target sequence
tacgctaccttgaaaaagctgtta

SEQ ID NO: 134356 - DNA, 24 bp, Artificial sequence
  SiRNA target sequence
acgctaccttgaaaaagctgttaa

SEQ ID NO: 134357 - DNA, 24 bp, Artificial sequence
  SiRNA target sequence
cgctaccttgaaaaagctgttaat

SEQ ID NO: 134358 - DNA, 24 bp, Artificial sequence
  SiRNA target sequence
gctaccttgaaaaagctgttaatg

SEQ ID NO: 134359 - DNA, 24 bp, Artificial sequence
  SiRNA target sequence
ctaccttgaaaaagctgttaatga

SEQ ID NO: 134360 - DNA, 24 bp, Artificial sequence
  SiRNA target sequence
taccttgaaaaagctgttaatgat

SEQ ID NO: 134361 - DNA, 24 bp, Artificial sequence
  SiRNA target sequence
accttgaaaaagctgttaatgatt

SEQ ID NO: 134362 - DNA, 24 bp, Artificial sequence
  SiRNA target sequence
ccttgaaaaagctgttaatgattt

SEQ ID NO: 134363 - DNA, 24 bp, Artificial sequence
  SiRNA target sequence
cttgaaaaagctgttaatgattta

SEQ ID NO: 134364 - DNA, 24 bp, Artificial sequence
  SiRNA target sequence
ttgaaaaagctgttaatgatttag

SEQ ID NO: 134365 - DNA, 24 bp, Artificial sequence
  SiRNA target sequence
tgaaaaagctgttaatgatttaga

SEQ ID NO: 134366 - DNA, 24 bp, Artificial sequence
  SiRNA target sequence
gaaaaagctgttaatgatttagat

SEQ ID NO: 134367 - DNA, 24 bp, Artificial sequence
  SiRNA target sequence
aaaaagctgttaatgatttagata

SEQ ID NO: 134368 - DNA, 24 bp, Artificial sequence
  SiRNA target sequence
aaaagctgttaatgatttagatag

SEQ ID NO: 134369 - DNA, 24 bp, Artificial sequence
  SiRNA target sequence
aaagctgttaatgatttagataga

SEQ ID NO: 134370 - DNA, 24 bp, Artificial sequence
  SiRNA target sequence
aagctgttaatgatttagatagat

SEQ ID NO: 134371 - DNA, 24 bp, Artificial sequence
  SiRNA target sequence
agctgttaatgatttagatagatc

SEQ ID NO: 134372 - DNA, 24 bp, Artificial sequence
  SiRNA target sequence
gctgttaatgatttagatagatct

SEQ ID NO: 134373 - DNA, 24 bp, Artificial sequence
  SiRNA target sequence
ctgttaatgatttagatagatctc

SEQ ID NO: 134374 - DNA, 24 bp, Artificial sequence
  SiRNA target sequence
tgttaatgatttagatagatctca

SEQ ID NO: 134375 - DNA, 24 bp, Artificial sequence
  SiRNA target sequence
gttaatgatttagatagatctcag

SEQ ID NO: 134376 - DNA, 24 bp, Artificial sequence
  SiRNA target sequence
ttaatgatttagatagatctcagt

SEQ ID NO: 134377 - DNA, 24 bp, Artificial sequence
  SiRNA target sequence
taatgatttagatagatctcagtt

SEQ ID NO: 134378 - DNA, 24 bp, Artificial sequence
  SiRNA target sequence
aatgatttagatagatctcagttt

SEQ ID NO: 134379 - DNA, 24 bp, Artificial sequence
  SiRNA target sequence
atgatttagatagatctcagtttg

SEQ ID NO: 134380 - DNA, 24 bp, Artificial sequence
  SiRNA target sequence
tgatttagatagatctcagtttga

SEQ ID NO: 134381 - DNA, 24 bp, Artificial sequence
  SiRNA target sequence
gatttagatagatctcagtttgac

SEQ ID NO: 134382 - DNA, 24 bp, Artificial sequence
  SiRNA target sequence
atttagatagatctcagtttgact

SEQ ID NO: 134383 - DNA, 24 bp, Artificial sequence
  SiRNA target sequence
tttagatagatctcagtttgactt

SEQ ID NO: 134384 - DNA, 24 bp, Artificial sequence
  SiRNA target sequence
ttagatagatctcagtttgacttg

SEQ ID NO: 134385 - DNA, 24 bp, Artificial sequence
  SiRNA target sequence
tagatagatctcagtttgacttgg

SEQ ID NO: 134386 - DNA, 24 bp, Artificial sequence
  SiRNA target sequence
agatagatctcagtttgacttggt

SEQ ID NO: 134387 - DNA, 24 bp, Artificial sequence
  SiRNA target sequence
gatagatctcagtttgacttggta

SEQ ID NO: 134388 - DNA, 24 bp, Artificial sequence
  SiRNA target sequence
atagatctcagtttgacttggtat

SEQ ID NO: 134389 - DNA, 24 bp, Artificial sequence
  SiRNA target sequence
tagatctcagtttgacttggtatc

SEQ ID NO: 134390 - DNA, 24 bp, Artificial sequence
  SiRNA target sequence
agatctcagtttgacttggtatct

SEQ ID NO: 134391 - DNA, 24 bp, Artificial sequence
  SiRNA target sequence
gatctcagtttgacttggtatctg

SEQ ID NO: 134392 - DNA, 24 bp, Artificial sequence
  SiRNA target sequence
atctcagtttgacttggtatctga

SEQ ID NO: 134393 - DNA, 24 bp, Artificial sequence
  SiRNA target sequence
tctcagtttgacttggtatctgaa

SEQ ID NO: 134394 - DNA, 24 bp, Artificial sequence
  SiRNA target sequence
ctcagtttgacttggtatctgaag

SEQ ID NO: 134395 - DNA, 24 bp, Artificial sequence
  SiRNA target sequence
tcagtttgacttggtatctgaagc

SEQ ID NO: 134396 - DNA, 24 bp, Artificial sequence
  SiRNA target sequence
cagtttgacttggtatctgaagca

SEQ ID NO: 134397 - DNA, 24 bp, Artificial sequence
  SiRNA target sequence
agtttgacttggtatctgaagcat

SEQ ID NO: 134398 - DNA, 24 bp, Artificial sequence
  SiRNA target sequence
gtttgacttggtatctgaagcatt

SEQ ID NO: 134399 - DNA, 24 bp, Artificial sequence
  SiRNA target sequence
tttgacttggtatctgaagcatta

SEQ ID NO: 134400 - DNA, 24 bp, Artificial sequence
  SiRNA target sequence
ttgacttggtatctgaagcattaa

SEQ ID NO: 134401 - DNA, 24 bp, Artificial sequence
  SiRNA target sequence
tgacttggtatctgaagcattaag

SEQ ID NO: 134402 - DNA, 24 bp, Artificial sequence
  SiRNA target sequence
gacttggtatctgaagcattaagt

SEQ ID NO: 134403 - DNA, 24 bp, Artificial sequence
  SiRNA target sequence
acttggtatctgaagcattaagtg

SEQ ID NO: 134404 - DNA, 24 bp, Artificial sequence
  SiRNA target sequence
cttggtatctgaagcattaagtga

SEQ ID NO: 134405 - DNA, 24 bp, Artificial sequence
  SiRNA target sequence
ttggtatctgaagcattaagtgaa

SEQ ID NO: 134406 - DNA, 24 bp, Artificial sequence
  SiRNA target sequence
tggtatctgaagcattaagtgaac

SEQ ID NO: 134407 - DNA, 24 bp, Artificial sequence
  SiRNA target sequence
ggtatctgaagcattaagtgaacg

SEQ ID NO: 134408 - DNA, 24 bp, Artificial sequence
  SiRNA target sequence
gtatctgaagcattaagtgaacga

SEQ ID NO: 134409 - DNA, 24 bp, Artificial sequence
  SiRNA target sequence
tatctgaagcattaagtgaacgaa

SEQ ID NO: 134410 - DNA, 24 bp, Artificial sequence
  SiRNA target sequence
atctgaagcattaagtgaacgaaa

SEQ ID NO: 134411 - DNA, 24 bp, Artificial sequence
  SiRNA target sequence
tctgaagcattaagtgaacgaaaa

SEQ ID NO: 134412 - DNA, 24 bp, Artificial sequence
  SiRNA target sequence
ctgaagcattaagtgaacgaaaaa

SEQ ID NO: 134413 - DNA, 24 bp, Artificial sequence
  SiRNA target sequence
tgaagcattaagtgaacgaaaaat

SEQ ID NO: 134414 - DNA, 24 bp, Artificial sequence
  SiRNA target sequence
gaagcattaagtgaacgaaaaatt

SEQ ID NO: 134415 - DNA, 24 bp, Artificial sequence
  SiRNA target sequence
aagcattaagtgaacgaaaaattg

SEQ ID NO: 134416 - DNA, 24 bp, Artificial sequence
  SiRNA target sequence
agcattaagtgaacgaaaaattgt

SEQ ID NO: 134417 - DNA, 24 bp, Artificial sequence
  SiRNA target sequence
gcattaagtgaacgaaaaattgtt

SEQ ID NO: 134418 - DNA, 24 bp, Artificial sequence
  SiRNA target sequence
cattaagtgaacgaaaaattgtta

SEQ ID NO: 134419 - DNA, 24 bp, Artificial sequence
  SiRNA target sequence
attaagtgaacgaaaaattgttat

SEQ ID NO: 134420 - DNA, 24 bp, Artificial sequence
  SiRNA target sequence
ttaagtgaacgaaaaattgttatg

SEQ ID NO: 134421 - DNA, 24 bp, Artificial sequence
  SiRNA target sequence
taagtgaacgaaaaattgttatga

SEQ ID NO: 134422 - DNA, 24 bp, Artificial sequence
  SiRNA target sequence
aagtgaacgaaaaattgttatgaa

SEQ ID NO: 134423 - DNA, 24 bp, Artificial sequence
  SiRNA target sequence
agtgaacgaaaaattgttatgaat

SEQ ID NO: 134424 - DNA, 24 bp, Artificial sequence
  SiRNA target sequence
gtgaacgaaaaattgttatgaata

SEQ ID NO: 134425 - DNA, 24 bp, Artificial sequence
  SiRNA target sequence
tgaacgaaaaattgttatgaatat

SEQ ID NO: 134426 - DNA, 24 bp, Artificial sequence
  SiRNA target sequence
gaacgaaaaattgttatgaatatg

SEQ ID NO: 134427 - DNA, 24 bp, Artificial sequence
  SiRNA target sequence
aacgaaaaattgttatgaatatgt

SEQ ID NO: 134428 - DNA, 24 bp, Artificial sequence
  SiRNA target sequence
acgaaaaattgttatgaatatgtg

SEQ ID NO: 134429 - DNA, 24 bp, Artificial sequence
  SiRNA target sequence
cgaaaaattgttatgaatatgtgt

SEQ ID NO: 134430 - DNA, 24 bp, Artificial sequence
  SiRNA target sequence
gaaaaattgttatgaatatgtgtc

SEQ ID NO: 134431 - DNA, 24 bp, Artificial sequence
  SiRNA target sequence
aaaaattgttatgaatatgtgtcc

SEQ ID NO: 134432 - DNA, 24 bp, Artificial sequence
  SiRNA target sequence
aaaattgttatgaatatgtgtcct

SEQ ID NO: 134433 - DNA, 24 bp, Artificial sequence
  SiRNA target sequence
aaattgttatgaatatgtgtcctt

SEQ ID NO: 134434 - DNA, 24 bp, Artificial sequence
  SiRNA target sequence
aattgttatgaatatgtgtccttt

SEQ ID NO: 134435 - DNA, 24 bp, Artificial sequence
  SiRNA target sequence
attgttatgaatatgtgtcctttt

SEQ ID NO: 134436 - DNA, 24 bp, Artificial sequence
  SiRNA target sequence
ttgttatgaatatgtgtccttttc

SEQ ID NO: 134437 - DNA, 24 bp, Artificial sequence
  SiRNA target sequence
tgttatgaatatgtgtccttttct

SEQ ID NO: 134438 - DNA, 24 bp, Artificial sequence
  SiRNA target sequence
gttatgaatatgtgtccttttcta

SEQ ID NO: 134439 - DNA, 24 bp, Artificial sequence
  SiRNA target sequence
ttatgaatatgtgtccttttctag

SEQ ID NO: 134440 - DNA, 24 bp, Artificial sequence
  SiRNA target sequence
tatgaatatgtgtccttttctagt

SEQ ID NO: 134441 - DNA, 24 bp, Artificial sequence
  SiRNA target sequence
atgaatatgtgtccttttctagta

SEQ ID NO: 134442 - DNA, 24 bp, Artificial sequence
  SiRNA target sequence
tgaatatgtgtccttttctagtaa

SEQ ID NO: 134443 - DNA, 24 bp, Artificial sequence
  SiRNA target sequence
gaatatgtgtccttttctagtaag

SEQ ID NO: 134444 - DNA, 24 bp, Artificial sequence
  SiRNA target sequence
aatatgtgtccttttctagtaagg

SEQ ID NO: 134445 - DNA, 24 bp, Artificial sequence
  SiRNA target sequence
atatgtgtccttttctagtaaggt

SEQ ID NO: 134446 - DNA, 24 bp, Artificial sequence
  SiRNA target sequence
tatgtgtccttttctagtaaggtc

SEQ ID NO: 134447 - DNA, 24 bp, Artificial sequence
  SiRNA target sequence
atgtgtccttttctagtaaggtcg

SEQ ID NO: 134448 - DNA, 24 bp, Artificial sequence
  SiRNA target sequence
tgtgtccttttctagtaaggtcga

SEQ ID NO: 134449 - DNA, 24 bp, Artificial sequence
  SiRNA target sequence
gtgtccttttctagtaaggtcgat

SEQ ID NO: 134450 - DNA, 24 bp, Artificial sequence
  SiRNA target sequence
tgtccttttctagtaaggtcgatg

SEQ ID NO: 134451 - DNA, 24 bp, Artificial sequence
  SiRNA target sequence
gtccttttctagtaaggtcgatgg

SEQ ID NO: 134452 - DNA, 24 bp, Artificial sequence
  SiRNA target sequence
tccttttctagtaaggtcgatgga

SEQ ID NO: 134453 - DNA, 24 bp, Artificial sequence
  SiRNA target sequence
ccttttctagtaaggtcgatggaa

SEQ ID NO: 134454 - DNA, 24 bp, Artificial sequence
  SiRNA target sequence
cttttctagtaaggtcgatggaaa

SEQ ID NO: 134455 - DNA, 24 bp, Artificial sequence
  SiRNA target sequence
ttttctagtaaggtcgatggaaat

SEQ ID NO: 134456 - DNA, 24 bp, Artificial sequence
  SiRNA target sequence
tttctagtaaggtcgatggaaata

SEQ ID NO: 134457 - DNA, 24 bp, Artificial sequence
  SiRNA target sequence
ttctagtaaggtcgatggaaatat

SEQ ID NO: 134458 - DNA, 24 bp, Artificial sequence
  SiRNA target sequence
tctagtaaggtcgatggaaatatt

SEQ ID NO: 134459 - DNA, 24 bp, Artificial sequence
  SiRNA target sequence
ctagtaaggtcgatggaaatatta

SEQ ID NO: 134460 - DNA, 24 bp, Artificial sequence
  SiRNA target sequence
tagtaaggtcgatggaaatattat

SEQ ID NO: 134461 - DNA, 24 bp, Artificial sequence
  SiRNA target sequence
agtaaggtcgatggaaatattatt

SEQ ID NO: 134462 - DNA, 24 bp, Artificial sequence
  SiRNA target sequence
gtaaggtcgatggaaatattattt

SEQ ID NO: 134463 - DNA, 24 bp, Artificial sequence
  SiRNA target sequence
taaggtcgatggaaatattatttc

SEQ ID NO: 134464 - DNA, 24 bp, Artificial sequence
  SiRNA target sequence
aaggtcgatggaaatattatttcc

SEQ ID NO: 134465 - DNA, 24 bp, Artificial sequence
  SiRNA target sequence
aggtcgatggaaatattatttccg

SEQ ID NO: 134466 - DNA, 24 bp, Artificial sequence
  SiRNA target sequence
ggtcgatggaaatattatttccgg

SEQ ID NO: 134467 - DNA, 24 bp, Artificial sequence
  SiRNA target sequence
gtcgatggaaatattatttccggt

SEQ ID NO: 134468 - DNA, 24 bp, Artificial sequence
  SiRNA target sequence
tcgatggaaatattatttccggtt

SEQ ID NO: 134469 - DNA, 24 bp, Artificial sequence
  SiRNA target sequence
cgatggaaatattatttccggttt

SEQ ID NO: 134470 - DNA, 24 bp, Artificial sequence
  SiRNA target sequence
gatggaaatattatttccggttta

SEQ ID NO: 134471 - DNA, 24 bp, Artificial sequence
  SiRNA target sequence
atggaaatattatttccggtttat

SEQ ID NO: 134472 - DNA, 24 bp, Artificial sequence
  SiRNA target sequence
tggaaatattatttccggtttata

SEQ ID NO: 134473 - DNA, 24 bp, Artificial sequence
  SiRNA target sequence
ggaaatattatttccggtttataa

SEQ ID NO: 134474 - DNA, 24 bp, Artificial sequence
  SiRNA target sequence
gaaatattatttccggtttataaa

SEQ ID NO: 134475 - DNA, 24 bp, Artificial sequence
  SiRNA target sequence
aaatattatttccggtttataaaa

SEQ ID NO: 134476 - DNA, 24 bp, Artificial sequence
  SiRNA target sequence
aatattatttccggtttataaaag

SEQ ID NO: 134477 - DNA, 24 bp, Artificial sequence
  SiRNA target sequence
atattatttccggtttataaaagg

SEQ ID NO: 134478 - DNA, 24 bp, Artificial sequence
  SiRNA target sequence
tattatttccggtttataaaaggc

SEQ ID NO: 134479 - DNA, 24 bp, Artificial sequence
  SiRNA target sequence
attatttccggtttataaaaggct

SEQ ID NO: 134480 - DNA, 24 bp, Artificial sequence
  SiRNA target sequence
ttatttccggtttataaaaggctt

SEQ ID NO: 134481 - DNA, 24 bp, Artificial sequence
  SiRNA target sequence
tatttccggtttataaaaggcttt

SEQ ID NO: 134482 - DNA, 24 bp, Artificial sequence
  SiRNA target sequence
atttccggtttataaaaggctttt

SEQ ID NO: 134483 - DNA, 24 bp, Artificial sequence
  SiRNA target sequence
tttccggtttataaaaggctttta

SEQ ID NO: 134484 - DNA, 24 bp, Artificial sequence
  SiRNA target sequence
ttccggtttataaaaggcttttaa

SEQ ID NO: 134485 - DNA, 24 bp, Artificial sequence
  SiRNA target sequence
tccggtttataaaaggcttttaat

SEQ ID NO: 134486 - DNA, 24 bp, Artificial sequence
  SiRNA target sequence
ccggtttataaaaggcttttaatt

SEQ ID NO: 134487 - DNA, 24 bp, Artificial sequence
  SiRNA target sequence
cggtttataaaaggcttttaattc

SEQ ID NO: 134488 - DNA, 24 bp, Artificial sequence
  SiRNA target sequence
ggtttataaaaggcttttaattcc

SEQ ID NO: 134489 - DNA, 24 bp, Artificial sequence
  SiRNA target sequence
gtttataaaaggcttttaattcct

SEQ ID NO: 134490 - DNA, 24 bp, Artificial sequence
  SiRNA target sequence
tttataaaaggcttttaattcctt

SEQ ID NO: 134491 - DNA, 24 bp, Artificial sequence
  SiRNA target sequence
ttataaaaggcttttaattcctta

SEQ ID NO: 134492 - DNA, 24 bp, Artificial sequence
  SiRNA target sequence
tataaaaggcttttaattccttac

SEQ ID NO: 134493 - DNA, 24 bp, Artificial sequence
  SiRNA target sequence
ataaaaggcttttaattccttact

SEQ ID NO: 134494 - DNA, 24 bp, Artificial sequence
  SiRNA target sequence
taaaaggcttttaattccttacta

SEQ ID NO: 134495 - DNA, 24 bp, Artificial sequence
  SiRNA target sequence
aaaaggcttttaattccttactac

SEQ ID NO: 134496 - DNA, 24 bp, Artificial sequence
  SiRNA target sequence
aaaggcttttaattccttactact

SEQ ID NO: 134497 - DNA, 24 bp, Artificial sequence
  SiRNA target sequence
aaggcttttaattccttactacta

SEQ ID NO: 134498 - DNA, 24 bp, Artificial sequence
  SiRNA target sequence
aggcttttaattccttactactat

SEQ ID NO: 134499 - DNA, 24 bp, Artificial sequence
  SiRNA target sequence
ggcttttaattccttactactata

SEQ ID NO: 134500 - DNA, 24 bp, Artificial sequence
  SiRNA target sequence
gcttttaattccttactactatat

SEQ ID NO: 134501 - DNA, 24 bp, Artificial sequence
  SiRNA target sequence
cttttaattccttactactatatt

SEQ ID NO: 134502 - DNA, 24 bp, Artificial sequence
  SiRNA target sequence
ttttaattccttactactatattg

SEQ ID NO: 134503 - DNA, 24 bp, Artificial sequence
  SiRNA target sequence
tttaattccttactactatattgg

SEQ ID NO: 134504 - DNA, 24 bp, Artificial sequence
  SiRNA target sequence
ttaattccttactactatattggc

SEQ ID NO: 134505 - DNA, 24 bp, Artificial sequence
  SiRNA target sequence
taattccttactactatattggcc

SEQ ID NO: 134506 - DNA, 24 bp, Artificial sequence
  SiRNA target sequence
aattccttactactatattggcct

SEQ ID NO: 134507 - DNA, 24 bp, Artificial sequence
  SiRNA target sequence
attccttactactatattggcctt

SEQ ID NO: 134508 - DNA, 24 bp, Artificial sequence
  SiRNA target sequence
ttccttactactatattggcctta

SEQ ID NO: 134509 - DNA, 24 bp, Artificial sequence
  SiRNA target sequence
tccttactactatattggccttaa

SEQ ID NO: 134510 - DNA, 24 bp, Artificial sequence
  SiRNA target sequence
ccttactactatattggccttaaa

SEQ ID NO: 134511 - DNA, 24 bp, Artificial sequence
  SiRNA target sequence
cttactactatattggccttaaat

SEQ ID NO: 134512 - DNA, 24 bp, Artificial sequence
  SiRNA target sequence
ttactactatattggccttaaatt

SEQ ID NO: 134513 - DNA, 24 bp, Artificial sequence
  SiRNA target sequence
tactactatattggccttaaattt

SEQ ID NO: 134514 - DNA, 24 bp, Artificial sequence
  SiRNA target sequence
actactatattggccttaaatttt

SEQ ID NO: 134515 - DNA, 24 bp, Artificial sequence
  SiRNA target sequence
ctactatattggccttaaatttta

SEQ ID NO: 134516 - DNA, 24 bp, Artificial sequence
  SiRNA target sequence
tactatattggccttaaattttat

SEQ ID NO: 134517 - DNA, 24 bp, Artificial sequence
  SiRNA target sequence
actatattggccttaaattttatg

SEQ ID NO: 134518 - DNA, 24 bp, Artificial sequence
  SiRNA target sequence
ctatattggccttaaattttatga

SEQ ID NO: 134519 - DNA, 24 bp, Artificial sequence
  SiRNA target sequence
tatattggccttaaattttatgat

SEQ ID NO: 134520 - DNA, 24 bp, Artificial sequence
  SiRNA target sequence
atattggccttaaattttatgatt

SEQ ID NO: 134521 - DNA, 24 bp, Artificial sequence
  SiRNA target sequence
tattggccttaaattttatgattg

SEQ ID NO: 134522 - DNA, 24 bp, Artificial sequence
  SiRNA target sequence
attggccttaaattttatgattgg

SEQ ID NO: 134523 - DNA, 24 bp, Artificial sequence
  SiRNA target sequence
ttggccttaaattttatgattgga

SEQ ID NO: 134524 - DNA, 24 bp, Artificial sequence
  SiRNA target sequence
tggccttaaattttatgattggat

SEQ ID NO: 134525 - DNA, 24 bp, Artificial sequence
  SiRNA target sequence
ggccttaaattttatgattggatt

SEQ ID NO: 134526 - DNA, 24 bp, Artificial sequence
  SiRNA target sequence
gccttaaattttatgattggattt

SEQ ID NO: 134527 - DNA, 24 bp, Artificial sequence
  SiRNA target sequence
ccttaaattttatgattggatttc

SEQ ID NO: 134528 - DNA, 24 bp, Artificial sequence
  SiRNA target sequence
cttaaattttatgattggatttct

SEQ ID NO: 134529 - DNA, 24 bp, Artificial sequence
  SiRNA target sequence
ttaaattttatgattggatttctg

SEQ ID NO: 134530 - DNA, 24 bp, Artificial sequence
  SiRNA target sequence
taaattttatgattggatttctgg

SEQ ID NO: 134531 - DNA, 24 bp, Artificial sequence
  SiRNA target sequence
aaattttatgattggatttctggg

SEQ ID NO: 134532 - DNA, 24 bp, Artificial sequence
  SiRNA target sequence
aattttatgattggatttctgggc

SEQ ID NO: 134533 - DNA, 24 bp, Artificial sequence
  SiRNA target sequence
attttatgattggatttctgggca

SEQ ID NO: 134534 - DNA, 24 bp, Artificial sequence
  SiRNA target sequence
ttttatgattggatttctgggcaa

SEQ ID NO: 134535 - DNA, 24 bp, Artificial sequence
  SiRNA target sequence
tttatgattggatttctgggcaac

SEQ ID NO: 134536 - DNA, 24 bp, Artificial sequence
  SiRNA target sequence
ttatgattggatttctgggcaacg

SEQ ID NO: 134537 - DNA, 24 bp, Artificial sequence
  SiRNA target sequence
tatgattggatttctgggcaacgg

SEQ ID NO: 134538 - DNA, 24 bp, Artificial sequence
  SiRNA target sequence
atgattggatttctgggcaacggt

SEQ ID NO: 134539 - DNA, 24 bp, Artificial sequence
  SiRNA target sequence
tgattggatttctgggcaacggtc

SEQ ID NO: 134540 - DNA, 24 bp, Artificial sequence
  SiRNA target sequence
gattggatttctgggcaacggtcc

SEQ ID NO: 134541 - DNA, 24 bp, Artificial sequence
  SiRNA target sequence
attggatttctgggcaacggtccc

SEQ ID NO: 134542 - DNA, 24 bp, Artificial sequence
  SiRNA target sequence
ttggatttctgggcaacggtccct

SEQ ID NO: 134543 - DNA, 24 bp, Artificial sequence
  SiRNA target sequence
tggatttctgggcaacggtccctt

SEQ ID NO: 134544 - DNA, 24 bp, Artificial sequence
  SiRNA target sequence
ggatttctgggcaacggtcccttg

SEQ ID NO: 134545 - DNA, 24 bp, Artificial sequence
  SiRNA target sequence
gatttctgggcaacggtcccttgg

SEQ ID NO: 134546 - DNA, 24 bp, Artificial sequence
  SiRNA target sequence
atttctgggcaacggtcccttggg

SEQ ID NO: 134547 - DNA, 24 bp, Artificial sequence
  SiRNA target sequence
tttctgggcaacggtcccttgggc

SEQ ID NO: 134548 - DNA, 24 bp, Artificial sequence
  SiRNA target sequence
ttctgggcaacggtcccttgggcg

SEQ ID NO: 134549 - DNA, 24 bp, Artificial sequence
  SiRNA target sequence
tctgggcaacggtcccttgggcga

SEQ ID NO: 134550 - DNA, 24 bp, Artificial sequence
  SiRNA target sequence
ctgggcaacggtcccttgggcgaa

SEQ ID NO: 134551 - DNA, 24 bp, Artificial sequence
  SiRNA target sequence
tgggcaacggtcccttgggcgaag

SEQ ID NO: 134552 - DNA, 24 bp, Artificial sequence
  SiRNA target sequence
gggcaacggtcccttgggcgaagt

SEQ ID NO: 134553 - DNA, 24 bp, Artificial sequence
  SiRNA target sequence
ggcaacggtcccttgggcgaagta

SEQ ID NO: 134554 - DNA, 24 bp, Artificial sequence
  SiRNA target sequence
gcaacggtcccttgggcgaagtaa

SEQ ID NO: 134555 - DNA, 24 bp, Artificial sequence
  SiRNA target sequence
caacggtcccttgggcgaagtaaa

SEQ ID NO: 134556 - DNA, 24 bp, Artificial sequence
  SiRNA target sequence
aacggtcccttgggcgaagtaaat

SEQ ID NO: 134557 - DNA, 24 bp, Artificial sequence
  SiRNA target sequence
acggtcccttgggcgaagtaaatt

SEQ ID NO: 134558 - DNA, 24 bp, Artificial sequence
  SiRNA target sequence
cggtcccttgggcgaagtaaattt

SEQ ID NO: 134559 - DNA, 24 bp, Artificial sequence
  SiRNA target sequence
ggtcccttgggcgaagtaaatttt

SEQ ID NO: 134560 - DNA, 24 bp, Artificial sequence
  SiRNA target sequence
gtcccttgggcgaagtaaattttt

SEQ ID NO: 134561 - DNA, 24 bp, Artificial sequence
  SiRNA target sequence
tcccttgggcgaagtaaatttttg

SEQ ID NO: 134562 - DNA, 24 bp, Artificial sequence
  SiRNA target sequence
cccttgggcgaagtaaatttttgt

SEQ ID NO: 134563 - DNA, 24 bp, Artificial sequence
  SiRNA target sequence
ccttgggcgaagtaaatttttgtc

SEQ ID NO: 134564 - DNA, 24 bp, Artificial sequence
  SiRNA target sequence
cttgggcgaagtaaatttttgtcg

SEQ ID NO: 134565 - DNA, 24 bp, Artificial sequence
  SiRNA target sequence
ttgggcgaagtaaatttttgtcgc

SEQ ID NO: 134566 - DNA, 24 bp, Artificial sequence
  SiRNA target sequence
tgggcgaagtaaatttttgtcgcg

SEQ ID NO: 134567 - DNA, 24 bp, Artificial sequence
  SiRNA target sequence
gggcgaagtaaatttttgtcgcgg

SEQ ID NO: 134568 - DNA, 24 bp, Artificial sequence
  SiRNA target sequence
ggcgaagtaaatttttgtcgcggc

SEQ ID NO: 134569 - DNA, 24 bp, Artificial sequence
  SiRNA target sequence
gcgaagtaaatttttgtcgcggca

SEQ ID NO: 134570 - DNA, 24 bp, Artificial sequence
  SiRNA target sequence
cgaagtaaatttttgtcgcggcaa

SEQ ID NO: 134571 - DNA, 24 bp, Artificial sequence
  SiRNA target sequence
gaagtaaatttttgtcgcggcaac

SEQ ID NO: 134572 - DNA, 24 bp, Artificial sequence
  SiRNA target sequence
aagtaaatttttgtcgcggcaaca

SEQ ID NO: 134573 - DNA, 24 bp, Artificial sequence
  SiRNA target sequence
agtaaatttttgtcgcggcaacaa

SEQ ID NO: 134574 - DNA, 24 bp, Artificial sequence
  SiRNA target sequence
gtaaatttttgtcgcggcaacaaa

SEQ ID NO: 134575 - DNA, 24 bp, Artificial sequence
  SiRNA target sequence
taaatttttgtcgcggcaacaaac

SEQ ID NO: 134576 - DNA, 24 bp, Artificial sequence
  SiRNA target sequence
aaatttttgtcgcggcaacaaact

SEQ ID NO: 134577 - DNA, 24 bp, Artificial sequence
  SiRNA target sequence
aatttttgtcgcggcaacaaacta

SEQ ID NO: 134578 - DNA, 24 bp, Artificial sequence
  SiRNA target sequence
atttttgtcgcggcaacaaactat

SEQ ID NO: 134579 - DNA, 24 bp, Artificial sequence
  SiRNA target sequence
tttttgtcgcggcaacaaactatt

SEQ ID NO: 134580 - DNA, 24 bp, Artificial sequence
  SiRNA target sequence
ttttgtcgcggcaacaaactatta

SEQ ID NO: 134581 - DNA, 24 bp, Artificial sequence
  SiRNA target sequence
tttgtcgcggcaacaaactattac

SEQ ID NO: 134582 - DNA, 24 bp, Artificial sequence
  SiRNA target sequence
ttgtcgcggcaacaaactattaca

SEQ ID NO: 134583 - DNA, 24 bp, Artificial sequence
  SiRNA target sequence
tgtcgcggcaacaaactattacaa

SEQ ID NO: 134584 - DNA, 24 bp, Artificial sequence
  SiRNA target sequence
gtcgcggcaacaaactattacaaa

SEQ ID NO: 134585 - DNA, 24 bp, Artificial sequence
  SiRNA target sequence
tcgcggcaacaaactattacaaaa

SEQ ID NO: 134586 - DNA, 24 bp, Artificial sequence
  SiRNA target sequence
cgcggcaacaaactattacaaaat

SEQ ID NO: 134587 - DNA, 24 bp, Artificial sequence
  SiRNA target sequence
gcggcaacaaactattacaaaatt

SEQ ID NO: 134588 - DNA, 24 bp, Artificial sequence
  SiRNA target sequence
cggcaacaaactattacaaaattt

SEQ ID NO: 134589 - DNA, 24 bp, Artificial sequence
  SiRNA target sequence
ggcaacaaactattacaaaatttc

SEQ ID NO: 134590 - DNA, 24 bp, Artificial sequence
  SiRNA target sequence
gcaacaaactattacaaaatttcc

SEQ ID NO: 134591 - DNA, 24 bp, Artificial sequence
  SiRNA target sequence
caacaaactattacaaaatttcct

SEQ ID NO: 134592 - DNA, 24 bp, Artificial sequence
  SiRNA target sequence
aacaaactattacaaaatttccta

SEQ ID NO: 134593 - DNA, 24 bp, Artificial sequence
  SiRNA target sequence
acaaactattacaaaatttcctaa

SEQ ID NO: 134594 - DNA, 24 bp, Artificial sequence
  SiRNA target sequence
caaactattacaaaatttcctaat

SEQ ID NO: 134595 - DNA, 24 bp, Artificial sequence
  SiRNA target sequence
aaactattacaaaatttcctaatg

SEQ ID NO: 134596 - DNA, 24 bp, Artificial sequence
  SiRNA target sequence
aactattacaaaatttcctaatgt

SEQ ID NO: 134597 - DNA, 24 bp, Artificial sequence
  SiRNA target sequence
actattacaaaatttcctaatgtg

SEQ ID NO: 134598 - DNA, 24 bp, Artificial sequence
  SiRNA target sequence
ctattacaaaatttcctaatgtga

SEQ ID NO: 134599 - DNA, 24 bp, Artificial sequence
  SiRNA target sequence
tattacaaaatttcctaatgtgag

SEQ ID NO: 134600 - DNA, 24 bp, Artificial sequence
  SiRNA target sequence
attacaaaatttcctaatgtgaga

SEQ ID NO: 134601 - DNA, 24 bp, Artificial sequence
  SiRNA target sequence
ttacaaaatttcctaatgtgagaa

SEQ ID NO: 134602 - DNA, 24 bp, Artificial sequence
  SiRNA target sequence
tacaaaatttcctaatgtgagaaa

SEQ ID NO: 134603 - DNA, 24 bp, Artificial sequence
  SiRNA target sequence
acaaaatttcctaatgtgagaaaa

SEQ ID NO: 134604 - DNA, 24 bp, Artificial sequence
  SiRNA target sequence
caaaatttcctaatgtgagaaaaa

SEQ ID NO: 134605 - DNA, 24 bp, Artificial sequence
  SiRNA target sequence
aaaatttcctaatgtgagaaaaat

SEQ ID NO: 134606 - DNA, 24 bp, Artificial sequence
  SiRNA target sequence
aaatttcctaatgtgagaaaaatc

SEQ ID NO: 134607 - DNA, 24 bp, Artificial sequence
  SiRNA target sequence
aatttcctaatgtgagaaaaatcg

SEQ ID NO: 134608 - DNA, 24 bp, Artificial sequence
  SiRNA target sequence
atttcctaatgtgagaaaaatcga

SEQ ID NO: 134609 - DNA, 24 bp, Artificial sequence
  SiRNA target sequence
tttcctaatgtgagaaaaatcgac

SEQ ID NO: 134610 - DNA, 24 bp, Artificial sequence
  SiRNA target sequence
ttcctaatgtgagaaaaatcgacc

SEQ ID NO: 134611 - DNA, 24 bp, Artificial sequence
  SiRNA target sequence
tcctaatgtgagaaaaatcgacct

SEQ ID NO: 134612 - DNA, 24 bp, Artificial sequence
  SiRNA target sequence
cctaatgtgagaaaaatcgacctt

SEQ ID NO: 134613 - DNA, 24 bp, Artificial sequence
  SiRNA target sequence
ctaatgtgagaaaaatcgaccttg

SEQ ID NO: 134614 - DNA, 24 bp, Artificial sequence
  SiRNA target sequence
taatgtgagaaaaatcgaccttgt

SEQ ID NO: 134615 - DNA, 24 bp, Artificial sequence
  SiRNA target sequence
aatgtgagaaaaatcgaccttgta

SEQ ID NO: 134616 - DNA, 24 bp, Artificial sequence
  SiRNA target sequence
atgtgagaaaaatcgaccttgtag

SEQ ID NO: 134617 - DNA, 24 bp, Artificial sequence
  SiRNA target sequence
tgtgagaaaaatcgaccttgtagg

SEQ ID NO: 134618 - DNA, 24 bp, Artificial sequence
  SiRNA target sequence
gtgagaaaaatcgaccttgtagga

SEQ ID NO: 134619 - DNA, 24 bp, Artificial sequence
  SiRNA target sequence
tgagaaaaatcgaccttgtaggat

SEQ ID NO: 134620 - DNA, 24 bp, Artificial sequence
  SiRNA target sequence
gagaaaaatcgaccttgtaggatc

SEQ ID NO: 134621 - DNA, 24 bp, Artificial sequence
  SiRNA target sequence
agaaaaatcgaccttgtaggatcc

SEQ ID NO: 134622 - DNA, 24 bp, Artificial sequence
  SiRNA target sequence
gaaaaatcgaccttgtaggatccg

SEQ ID NO: 134623 - DNA, 24 bp, Artificial sequence
  SiRNA target sequence
aaaaatcgaccttgtaggatccgt

SEQ ID NO: 134624 - DNA, 24 bp, Artificial sequence
  SiRNA target sequence
aaaatcgaccttgtaggatccgtt

SEQ ID NO: 134625 - DNA, 24 bp, Artificial sequence
  SiRNA target sequence
aaatcgaccttgtaggatccgttt

SEQ ID NO: 134626 - DNA, 24 bp, Artificial sequence
  SiRNA target sequence
aatcgaccttgtaggatccgtttc

SEQ ID NO: 134627 - DNA, 24 bp, Artificial sequence
  SiRNA target sequence
atcgaccttgtaggatccgtttcg

SEQ ID NO: 134628 - DNA, 24 bp, Artificial sequence
  SiRNA target sequence
tcgaccttgtaggatccgtttcgt

SEQ ID NO: 134629 - DNA, 24 bp, Artificial sequence
  SiRNA target sequence
cgaccttgtaggatccgtttcgta

SEQ ID NO: 134630 - DNA, 24 bp, Artificial sequence
  SiRNA target sequence
gaccttgtaggatccgtttcgtat

SEQ ID NO: 134631 - DNA, 24 bp, Artificial sequence
  SiRNA target sequence
accttgtaggatccgtttcgtatc

SEQ ID NO: 134632 - DNA, 24 bp, Artificial sequence
  SiRNA target sequence
ccttgtaggatccgtttcgtatcg

SEQ ID NO: 134633 - DNA, 24 bp, Artificial sequence
  SiRNA target sequence
cttgtaggatccgtttcgtatcgt

SEQ ID NO: 134634 - DNA, 24 bp, Artificial sequence
  SiRNA target sequence
ttgtaggatccgtttcgtatcgtg

SEQ ID NO: 134635 - DNA, 24 bp, Artificial sequence
  SiRNA target sequence
tgtaggatccgtttcgtatcgtga

SEQ ID NO: 134636 - DNA, 24 bp, Artificial sequence
  SiRNA target sequence
gtaggatccgtttcgtatcgtgat

SEQ ID NO: 134637 - DNA, 24 bp, Artificial sequence
  SiRNA target sequence
taggatccgtttcgtatcgtgatg

SEQ ID NO: 134638 - DNA, 24 bp, Artificial sequence
  SiRNA target sequence
aggatccgtttcgtatcgtgatgg

SEQ ID NO: 134639 - DNA, 24 bp, Artificial sequence
  SiRNA target sequence
ggatccgtttcgtatcgtgatggc

SEQ ID NO: 134640 - DNA, 24 bp, Artificial sequence
  SiRNA target sequence
gatccgtttcgtatcgtgatggcc

SEQ ID NO: 134641 - DNA, 24 bp, Artificial sequence
  SiRNA target sequence
atccgtttcgtatcgtgatggcca

SEQ ID NO: 134642 - DNA, 24 bp, Artificial sequence
  SiRNA target sequence
tccgtttcgtatcgtgatggccaa

SEQ ID NO: 134643 - DNA, 24 bp, Artificial sequence
  SiRNA target sequence
ccgtttcgtatcgtgatggccaat

SEQ ID NO: 134644 - DNA, 24 bp, Artificial sequence
  SiRNA target sequence
cgtttcgtatcgtgatggccaatt

SEQ ID NO: 134645 - DNA, 24 bp, Artificial sequence
  SiRNA target sequence
gtttcgtatcgtgatggccaattt

SEQ ID NO: 134646 - DNA, 24 bp, Artificial sequence
  SiRNA target sequence
tttcgtatcgtgatggccaatttt

SEQ ID NO: 134647 - DNA, 24 bp, Artificial sequence
  SiRNA target sequence
ttcgtatcgtgatggccaatttta

SEQ ID NO: 134648 - DNA, 24 bp, Artificial sequence
  SiRNA target sequence
tcgtatcgtgatggccaattttat

SEQ ID NO: 134649 - DNA, 24 bp, Artificial sequence
  SiRNA target sequence
cgtatcgtgatggccaattttatg

SEQ ID NO: 134650 - DNA, 24 bp, Artificial sequence
  SiRNA target sequence
gtatcgtgatggccaattttatga

SEQ ID NO: 134651 - DNA, 24 bp, Artificial sequence
  SiRNA target sequence
tatcgtgatggccaattttatgat

SEQ ID NO: 134652 - DNA, 24 bp, Artificial sequence
  SiRNA target sequence
atcgtgatggccaattttatgatg

SEQ ID NO: 134653 - DNA, 24 bp, Artificial sequence
  SiRNA target sequence
tcgtgatggccaattttatgatgc

SEQ ID NO: 134654 - DNA, 24 bp, Artificial sequence
  SiRNA target sequence
cgtgatggccaattttatgatgct

SEQ ID NO: 134655 - DNA, 24 bp, Artificial sequence
  SiRNA target sequence
gtgatggccaattttatgatgcta

SEQ ID NO: 134656 - DNA, 24 bp, Artificial sequence
  SiRNA target sequence
tgatggccaattttatgatgctaa

SEQ ID NO: 134657 - DNA, 24 bp, Artificial sequence
  SiRNA target sequence
gatggccaattttatgatgctaaa

SEQ ID NO: 134658 - DNA, 24 bp, Artificial sequence
  SiRNA target sequence
atggccaattttatgatgctaaat

SEQ ID NO: 134659 - DNA, 24 bp, Artificial sequence
  SiRNA target sequence
tggccaattttatgatgctaaata

SEQ ID NO: 134660 - DNA, 24 bp, Artificial sequence
  SiRNA target sequence
ggccaattttatgatgctaaatac

SEQ ID NO: 134661 - DNA, 24 bp, Artificial sequence
  SiRNA target sequence
gccaattttatgatgctaaataca

SEQ ID NO: 134662 - DNA, 24 bp, Artificial sequence
  SiRNA target sequence
ccaattttatgatgctaaatacaa

SEQ ID NO: 134663 - DNA, 24 bp, Artificial sequence
  SiRNA target sequence
caattttatgatgctaaatacaat

SEQ ID NO: 134664 - DNA, 24 bp, Artificial sequence
  SiRNA target sequence
aattttatgatgctaaatacaatg

SEQ ID NO: 134665 - DNA, 24 bp, Artificial sequence
  SiRNA target sequence
attttatgatgctaaatacaatgt

SEQ ID NO: 134666 - DNA, 24 bp, Artificial sequence
  SiRNA target sequence
ttttatgatgctaaatacaatgtt

SEQ ID NO: 134667 - DNA, 24 bp, Artificial sequence
  SiRNA target sequence
tttatgatgctaaatacaatgttc

SEQ ID NO: 134668 - DNA, 24 bp, Artificial sequence
  SiRNA target sequence
ttatgatgctaaatacaatgttct

SEQ ID NO: 134669 - DNA, 24 bp, Artificial sequence
  SiRNA target sequence
tatgatgctaaatacaatgttcta

SEQ ID NO: 134670 - DNA, 24 bp, Artificial sequence
  SiRNA target sequence
atgatgctaaatacaatgttctat

SEQ ID NO: 134671 - DNA, 24 bp, Artificial sequence
  SiRNA target sequence
tgatgctaaatacaatgttctatt

SEQ ID NO: 134672 - DNA, 24 bp, Artificial sequence
  SiRNA target sequence
gatgctaaatacaatgttctattg

SEQ ID NO: 134673 - DNA, 24 bp, Artificial sequence
  SiRNA target sequence
atgctaaatacaatgttctattgg

SEQ ID NO: 134674 - DNA, 24 bp, Artificial sequence
  SiRNA target sequence
tgctaaatacaatgttctattggg

SEQ ID NO: 134675 - DNA, 24 bp, Artificial sequence
  SiRNA target sequence
gctaaatacaatgttctattgggt

SEQ ID NO: 134676 - DNA, 24 bp, Artificial sequence
  SiRNA target sequence
ctaaatacaatgttctattgggtg

SEQ ID NO: 134677 - DNA, 24 bp, Artificial sequence
  SiRNA target sequence
taaatacaatgttctattgggtgt

SEQ ID NO: 134678 - DNA, 24 bp, Artificial sequence
  SiRNA target sequence
aaatacaatgttctattgggtgtc

SEQ ID NO: 134679 - DNA, 24 bp, Artificial sequence
  SiRNA target sequence
aatacaatgttctattgggtgtca

SEQ ID NO: 134680 - DNA, 24 bp, Artificial sequence
  SiRNA target sequence
atacaatgttctattgggtgtcac

SEQ ID NO: 134681 - DNA, 24 bp, Artificial sequence
  SiRNA target sequence
tacaatgttctattgggtgtcaca

SEQ ID NO: 134682 - DNA, 24 bp, Artificial sequence
  SiRNA target sequence
acaatgttctattgggtgtcacag

SEQ ID NO: 134683 - DNA, 24 bp, Artificial sequence
  SiRNA target sequence
caatgttctattgggtgtcacagc

SEQ ID NO: 134684 - DNA, 24 bp, Artificial sequence
  SiRNA target sequence
aatgttctattgggtgtcacagct

SEQ ID NO: 134685 - DNA, 24 bp, Artificial sequence
  SiRNA target sequence
atgttctattgggtgtcacagcta

SEQ ID NO: 134686 - DNA, 24 bp, Artificial sequence
  SiRNA target sequence
tgttctattgggtgtcacagctac

SEQ ID NO: 134687 - DNA, 24 bp, Artificial sequence
  SiRNA target sequence
gttctattgggtgtcacagctacc

SEQ ID NO: 134688 - DNA, 24 bp, Artificial sequence
  SiRNA target sequence
ttctattgggtgtcacagctacct

SEQ ID NO: 134689 - DNA, 24 bp, Artificial sequence
  SiRNA target sequence
tctattgggtgtcacagctaccta

SEQ ID NO: 134690 - DNA, 24 bp, Artificial sequence
  SiRNA target sequence
ctattgggtgtcacagctacctac

SEQ ID NO: 134691 - DNA, 24 bp, Artificial sequence
  SiRNA target sequence
tattgggtgtcacagctacctact

SEQ ID NO: 134692 - DNA, 24 bp, Artificial sequence
  SiRNA target sequence
attgggtgtcacagctacctacta

SEQ ID NO: 134693 - DNA, 24 bp, Artificial sequence
  SiRNA target sequence
ttgggtgtcacagctacctactat

SEQ ID NO: 134694 - DNA, 24 bp, Artificial sequence
  SiRNA target sequence
tgggtgtcacagctacctactatg

SEQ ID NO: 134695 - DNA, 24 bp, Artificial sequence
  SiRNA target sequence
gggtgtcacagctacctactatgg

SEQ ID NO: 134696 - DNA, 24 bp, Artificial sequence
  SiRNA target sequence
ggtgtcacagctacctactatgga

SEQ ID NO: 134697 - DNA, 24 bp, Artificial sequence
  SiRNA target sequence
gtgtcacagctacctactatggag

SEQ ID NO: 134698 - DNA, 24 bp, Artificial sequence
  SiRNA target sequence
tgtcacagctacctactatggagc

SEQ ID NO: 134699 - DNA, 24 bp, Artificial sequence
  SiRNA target sequence
gtcacagctacctactatggagct

SEQ ID NO: 134700 - DNA, 24 bp, Artificial sequence
  SiRNA target sequence
tcacagctacctactatggagctg

SEQ ID NO: 134701 - DNA, 24 bp, Artificial sequence
  SiRNA target sequence
cacagctacctactatggagctgt

SEQ ID NO: 134702 - DNA, 24 bp, Artificial sequence
  SiRNA target sequence
acagctacctactatggagctgtt

SEQ ID NO: 134703 - DNA, 24 bp, Artificial sequence
  SiRNA target sequence
cagctacctactatggagctgttg

SEQ ID NO: 134704 - DNA, 24 bp, Artificial sequence
  SiRNA target sequence
agctacctactatggagctgttgt

SEQ ID NO: 134705 - DNA, 24 bp, Artificial sequence
  SiRNA target sequence
gctacctactatggagctgttgta

SEQ ID NO: 134706 - DNA, 24 bp, Artificial sequence
  SiRNA target sequence
ctacctactatggagctgttgtat

SEQ ID NO: 134707 - DNA, 24 bp, Artificial sequence
  SiRNA target sequence
tacctactatggagctgttgtatt

SEQ ID NO: 134708 - DNA, 24 bp, Artificial sequence
  SiRNA target sequence
acctactatggagctgttgtatta

SEQ ID NO: 134709 - DNA, 24 bp, Artificial sequence
  SiRNA target sequence
cctactatggagctgttgtattaa

SEQ ID NO: 134710 - DNA, 24 bp, Artificial sequence
  SiRNA target sequence
ctactatggagctgttgtattaaa

SEQ ID NO: 134711 - DNA, 24 bp, Artificial sequence
  SiRNA target sequence
tactatggagctgttgtattaaat

SEQ ID NO: 134712 - DNA, 24 bp, Artificial sequence
  SiRNA target sequence
actatggagctgttgtattaaatc

SEQ ID NO: 134713 - DNA, 24 bp, Artificial sequence
  SiRNA target sequence
ctatggagctgttgtattaaatca

SEQ ID NO: 134714 - DNA, 24 bp, Artificial sequence
  SiRNA target sequence
tatggagctgttgtattaaatcat

SEQ ID NO: 134715 - DNA, 24 bp, Artificial sequence
  SiRNA target sequence
atggagctgttgtattaaatcatg

SEQ ID NO: 134716 - DNA, 24 bp, Artificial sequence
  SiRNA target sequence
tggagctgttgtattaaatcatgc

SEQ ID NO: 134717 - DNA, 24 bp, Artificial sequence
  SiRNA target sequence
ggagctgttgtattaaatcatgca

SEQ ID NO: 134718 - DNA, 24 bp, Artificial sequence
  SiRNA target sequence
gagctgttgtattaaatcatgcaa

SEQ ID NO: 134719 - DNA, 24 bp, Artificial sequence
  SiRNA target sequence
agctgttgtattaaatcatgcaaa

SEQ ID NO: 134720 - DNA, 24 bp, Artificial sequence
  SiRNA target sequence
gctgttgtattaaatcatgcaaaa

SEQ ID NO: 134721 - DNA, 24 bp, Artificial sequence
  SiRNA target sequence
ctgttgtattaaatcatgcaaaat

SEQ ID NO: 134722 - DNA, 24 bp, Artificial sequence
  SiRNA target sequence
tgttgtattaaatcatgcaaaatt

SEQ ID NO: 134723 - DNA, 24 bp, Artificial sequence
  SiRNA target sequence
gttgtattaaatcatgcaaaattc

SEQ ID NO: 134724 - DNA, 24 bp, Artificial sequence
  SiRNA target sequence
ttgtattaaatcatgcaaaattct

SEQ ID NO: 134725 - DNA, 24 bp, Artificial sequence
  SiRNA target sequence
tgtattaaatcatgcaaaattctt

SEQ ID NO: 134726 - DNA, 24 bp, Artificial sequence
  SiRNA target sequence
gtattaaatcatgcaaaattcttg

SEQ ID NO: 134727 - DNA, 24 bp, Artificial sequence
  SiRNA target sequence
tattaaatcatgcaaaattcttgt

SEQ ID NO: 134728 - DNA, 24 bp, Artificial sequence
  SiRNA target sequence
attaaatcatgcaaaattcttgtc

SEQ ID NO: 134729 - DNA, 24 bp, Artificial sequence
  SiRNA target sequence
ttaaatcatgcaaaattcttgtca

SEQ ID NO: 134730 - DNA, 24 bp, Artificial sequence
  SiRNA target sequence
taaatcatgcaaaattcttgtcag

SEQ ID NO: 134731 - DNA, 24 bp, Artificial sequence
  SiRNA target sequence
aaatcatgcaaaattcttgtcagt

SEQ ID NO: 134732 - DNA, 24 bp, Artificial sequence
  SiRNA target sequence
aatcatgcaaaattcttgtcagta

SEQ ID NO: 134733 - DNA, 24 bp, Artificial sequence
  SiRNA target sequence
atcatgcaaaattcttgtcagtaa

SEQ ID NO: 134734 - DNA, 24 bp, Artificial sequence
  SiRNA target sequence
tcatgcaaaattcttgtcagtaac

SEQ ID NO: 134735 - DNA, 24 bp, Artificial sequence
  SiRNA target sequence
catgcaaaattcttgtcagtaaca

SEQ ID NO: 134736 - DNA, 24 bp, Artificial sequence
  SiRNA target sequence
atgcaaaattcttgtcagtaacaa

SEQ ID NO: 134737 - DNA, 24 bp, Artificial sequence
  SiRNA target sequence
tgcaaaattcttgtcagtaacaaa

SEQ ID NO: 134738 - DNA, 24 bp, Artificial sequence
  SiRNA target sequence
gcaaaattcttgtcagtaacaaaa

SEQ ID NO: 134739 - DNA, 24 bp, Artificial sequence
  SiRNA target sequence
caaaattcttgtcagtaacaaaag

SEQ ID NO: 134740 - DNA, 24 bp, Artificial sequence
  SiRNA target sequence
aaaattcttgtcagtaacaaaaga

SEQ ID NO: 134741 - DNA, 24 bp, Artificial sequence
  SiRNA target sequence
aaattcttgtcagtaacaaaagat

SEQ ID NO: 134742 - DNA, 24 bp, Artificial sequence
  SiRNA target sequence
aattcttgtcagtaacaaaagatg

SEQ ID NO: 134743 - DNA, 24 bp, Artificial sequence
  SiRNA target sequence
attcttgtcagtaacaaaagatgg

SEQ ID NO: 134744 - DNA, 24 bp, Artificial sequence
  SiRNA target sequence
ttcttgtcagtaacaaaagatggc

SEQ ID NO: 134745 - DNA, 24 bp, Artificial sequence
  SiRNA target sequence
tcttgtcagtaacaaaagatggcg

SEQ ID NO: 134746 - DNA, 24 bp, Artificial sequence
  SiRNA target sequence
cttgtcagtaacaaaagatggcga

SEQ ID NO: 134747 - DNA, 24 bp, Artificial sequence
  SiRNA target sequence
ttgtcagtaacaaaagatggcgat

SEQ ID NO: 134748 - DNA, 24 bp, Artificial sequence
  SiRNA target sequence
tgtcagtaacaaaagatggcgata

SEQ ID NO: 134749 - DNA, 24 bp, Artificial sequence
  SiRNA target sequence
gtcagtaacaaaagatggcgataa

SEQ ID NO: 134750 - DNA, 24 bp, Artificial sequence
  SiRNA target sequence
tcagtaacaaaagatggcgataaa

SEQ ID NO: 134751 - DNA, 24 bp, Artificial sequence
  SiRNA target sequence
cagtaacaaaagatggcgataaaa

SEQ ID NO: 134752 - DNA, 24 bp, Artificial sequence
  SiRNA target sequence
agtaacaaaagatggcgataaaat

SEQ ID NO: 134753 - DNA, 24 bp, Artificial sequence
  SiRNA target sequence
gtaacaaaagatggcgataaaatt

SEQ ID NO: 134754 - DNA, 24 bp, Artificial sequence
  SiRNA target sequence
taacaaaagatggcgataaaatta

SEQ ID NO: 134755 - DNA, 24 bp, Artificial sequence
  SiRNA target sequence
aacaaaagatggcgataaaattaa

SEQ ID NO: 134756 - DNA, 24 bp, Artificial sequence
  SiRNA target sequence
acaaaagatggcgataaaattaat

SEQ ID NO: 134757 - DNA, 24 bp, Artificial sequence
  SiRNA target sequence
caaaagatggcgataaaattaatg

SEQ ID NO: 134758 - DNA, 24 bp, Artificial sequence
  SiRNA target sequence
aaaagatggcgataaaattaatgg

SEQ ID NO: 134759 - DNA, 24 bp, Artificial sequence
  SiRNA target sequence
aaagatggcgataaaattaatgga

SEQ ID NO: 134760 - DNA, 24 bp, Artificial sequence
  SiRNA target sequence
aagatggcgataaaattaatggaa

SEQ ID NO: 134761 - DNA, 24 bp, Artificial sequence
  SiRNA target sequence
agatggcgataaaattaatggaat

SEQ ID NO: 134762 - DNA, 24 bp, Artificial sequence
  SiRNA target sequence
gatggcgataaaattaatggaatt

SEQ ID NO: 134763 - DNA, 24 bp, Artificial sequence
  SiRNA target sequence
atggcgataaaattaatggaatta

SEQ ID NO: 134764 - DNA, 24 bp, Artificial sequence
  SiRNA target sequence
tggcgataaaattaatggaattaa

SEQ ID NO: 134765 - DNA, 24 bp, Artificial sequence
  SiRNA target sequence
ggcgataaaattaatggaattaaa

SEQ ID NO: 134766 - DNA, 24 bp, Artificial sequence
  SiRNA target sequence
gcgataaaattaatggaattaaat

SEQ ID NO: 134767 - DNA, 24 bp, Artificial sequence
  SiRNA target sequence
cgataaaattaatggaattaaatg

SEQ ID NO: 134768 - DNA, 24 bp, Artificial sequence
  SiRNA target sequence
gataaaattaatggaattaaatgt

SEQ ID NO: 134769 - DNA, 24 bp, Artificial sequence
  SiRNA target sequence
ataaaattaatggaattaaatgtc

SEQ ID NO: 134770 - DNA, 24 bp, Artificial sequence
  SiRNA target sequence
taaaattaatggaattaaatgtca

SEQ ID NO: 134771 - DNA, 24 bp, Artificial sequence
  SiRNA target sequence
aaaattaatggaattaaatgtcaa

SEQ ID NO: 134772 - DNA, 24 bp, Artificial sequence
  SiRNA target sequence
aaattaatggaattaaatgtcaag

SEQ ID NO: 134773 - DNA, 24 bp, Artificial sequence
  SiRNA target sequence
aattaatggaattaaatgtcaaga

SEQ ID NO: 134774 - DNA, 24 bp, Artificial sequence
  SiRNA target sequence
attaatggaattaaatgtcaagat

SEQ ID NO: 134775 - DNA, 24 bp, Artificial sequence
  SiRNA target sequence
ttaatggaattaaatgtcaagatt

SEQ ID NO: 134776 - DNA, 24 bp, Artificial sequence
  SiRNA target sequence
taatggaattaaatgtcaagattc

SEQ ID NO: 134777 - DNA, 24 bp, Artificial sequence
  SiRNA target sequence
aatggaattaaatgtcaagattca

SEQ ID NO: 134778 - DNA, 24 bp, Artificial sequence
  SiRNA target sequence
atggaattaaatgtcaagattcaa

SEQ ID NO: 134779 - DNA, 24 bp, Artificial sequence
  SiRNA target sequence
tggaattaaatgtcaagattcaat

SEQ ID NO: 134780 - DNA, 24 bp, Artificial sequence
  SiRNA target sequence
ggaattaaatgtcaagattcaata

SEQ ID NO: 134781 - DNA, 24 bp, Artificial sequence
  SiRNA target sequence
gaattaaatgtcaagattcaataa

SEQ ID NO: 134782 - DNA, 24 bp, Artificial sequence
  SiRNA target sequence
aattaaatgtcaagattcaataaa

SEQ ID NO: 134783 - DNA, 24 bp, Artificial sequence
  SiRNA target sequence
attaaatgtcaagattcaataaat

SEQ ID NO: 134784 - DNA, 24 bp, Artificial sequence
  SiRNA target sequence
ttaaatgtcaagattcaataaata

SEQ ID NO: 134785 - DNA, 24 bp, Artificial sequence
  SiRNA target sequence
taaatgtcaagattcaataaataa

SEQ ID NO: 134786 - DNA, 24 bp, Artificial sequence
  SiRNA target sequence
aaatgtcaagattcaataaataat

SEQ ID NO: 134787 - DNA, 24 bp, Artificial sequence
  SiRNA target sequence
aatgtcaagattcaataaataatg

SEQ ID NO: 134788 - DNA, 24 bp, Artificial sequence
  SiRNA target sequence
atgtcaagattcaataaataatga

SEQ ID NO: 134789 - DNA, 24 bp, Artificial sequence
  SiRNA target sequence
tgtcaagattcaataaataatgaa

SEQ ID NO: 134790 - DNA, 24 bp, Artificial sequence
  SiRNA target sequence
gtcaagattcaataaataatgaaa

SEQ ID NO: 134791 - DNA, 24 bp, Artificial sequence
  SiRNA target sequence
tcaagattcaataaataatgaaaa

SEQ ID NO: 134792 - DNA, 24 bp, Artificial sequence
  SiRNA target sequence
caagattcaataaataatgaaaaa

SEQ ID NO: 134793 - DNA, 24 bp, Artificial sequence
  SiRNA target sequence
aagattcaataaataatgaaaaat

SEQ ID NO: 134794 - DNA, 24 bp, Artificial sequence
  SiRNA target sequence
agattcaataaataatgaaaaatt

SEQ ID NO: 134795 - DNA, 24 bp, Artificial sequence
  SiRNA target sequence
gattcaataaataatgaaaaattt

SEQ ID NO: 134796 - DNA, 24 bp, Artificial sequence
  SiRNA target sequence
attcaataaataatgaaaaatttt

SEQ ID NO: 134797 - DNA, 24 bp, Artificial sequence
  SiRNA target sequence
ttcaataaataatgaaaaattttt

SEQ ID NO: 134798 - DNA, 24 bp, Artificial sequence
  SiRNA target sequence
tcaataaataatgaaaaattttta

SEQ ID NO: 134799 - DNA, 24 bp, Artificial sequence
  SiRNA target sequence
caataaataatgaaaaatttttaa

SEQ ID NO: 134800 - DNA, 24 bp, Artificial sequence
  SiRNA target sequence
aataaataatgaaaaatttttaat

SEQ ID NO: 134801 - DNA, 24 bp, Artificial sequence
  SiRNA target sequence
ataaataatgaaaaatttttaatt

SEQ ID NO: 134802 - DNA, 24 bp, Artificial sequence
  SiRNA target sequence
taaataatgaaaaatttttaatta

SEQ ID NO: 134803 - DNA, 24 bp, Artificial sequence
  SiRNA target sequence
aaataatgaaaaatttttaattag

SEQ ID NO: 134804 - DNA, 24 bp, Artificial sequence
  SiRNA target sequence
aataatgaaaaatttttaattagg

SEQ ID NO: 134805 - DNA, 24 bp, Artificial sequence
  SiRNA target sequence
ataatgaaaaatttttaattaggt

SEQ ID NO: 134806 - DNA, 24 bp, Artificial sequence
  SiRNA target sequence
taatgaaaaatttttaattaggtg

SEQ ID NO: 134807 - DNA, 24 bp, Artificial sequence
  SiRNA target sequence
aatgaaaaatttttaattaggtgt

SEQ ID NO: 134808 - DNA, 24 bp, Artificial sequence
  SiRNA target sequence
atgaaaaatttttaattaggtgta

SEQ ID NO: 134809 - DNA, 24 bp, Artificial sequence
  SiRNA target sequence
tgaaaaatttttaattaggtgtaa

SEQ ID NO: 134810 - DNA, 24 bp, Artificial sequence
  SiRNA target sequence
gaaaaatttttaattaggtgtaaa

SEQ ID NO: 134811 - DNA, 24 bp, Artificial sequence
  SiRNA target sequence
aaaaatttttaattaggtgtaaag

SEQ ID NO: 134812 - DNA, 24 bp, Artificial sequence
  SiRNA target sequence
aaaatttttaattaggtgtaaagt

SEQ ID NO: 134813 - DNA, 24 bp, Artificial sequence
  SiRNA target sequence
aaatttttaattaggtgtaaagtt

SEQ ID NO: 134814 - DNA, 24 bp, Artificial sequence
  SiRNA target sequence
aatttttaattaggtgtaaagttt

SEQ ID NO: 134815 - DNA, 24 bp, Artificial sequence
  SiRNA target sequence
atttttaattaggtgtaaagtttt

SEQ ID NO: 134816 - DNA, 24 bp, Artificial sequence
  SiRNA target sequence
tttttaattaggtgtaaagtttta

SEQ ID NO: 134817 - DNA, 24 bp, Artificial sequence
  SiRNA target sequence
ttttaattaggtgtaaagttttaa

SEQ ID NO: 134818 - DNA, 24 bp, Artificial sequence
  SiRNA target sequence
tttaattaggtgtaaagttttaat

SEQ ID NO: 134819 - DNA, 24 bp, Artificial sequence
  SiRNA target sequence
ttaattaggtgtaaagttttaata

SEQ ID NO: 134820 - DNA, 24 bp, Artificial sequence
  SiRNA target sequence
taattaggtgtaaagttttaataa

SEQ ID NO: 134821 - DNA, 24 bp, Artificial sequence
  SiRNA target sequence
aattaggtgtaaagttttaataaa

SEQ ID NO: 134822 - DNA, 24 bp, Artificial sequence
  SiRNA target sequence
attaggtgtaaagttttaataaat

SEQ ID NO: 134823 - DNA, 24 bp, Artificial sequence
  SiRNA target sequence
ttaggtgtaaagttttaataaata

SEQ ID NO: 134824 - DNA, 24 bp, Artificial sequence
  SiRNA target sequence
taggtgtaaagttttaataaatac

SEQ ID NO: 134825 - DNA, 24 bp, Artificial sequence
  SiRNA target sequence
aggtgtaaagttttaataaatact

SEQ ID NO: 134826 - DNA, 24 bp, Artificial sequence
  SiRNA target sequence
ggtgtaaagttttaataaatactt

SEQ ID NO: 134827 - DNA, 24 bp, Artificial sequence
  SiRNA target sequence
gtgtaaagttttaataaatacttc

SEQ ID NO: 134828 - DNA, 24 bp, Artificial sequence
  SiRNA target sequence
tgtaaagttttaataaatacttct

SEQ ID NO: 134829 - DNA, 24 bp, Artificial sequence
  SiRNA target sequence
gtaaagttttaataaatacttctg

SEQ ID NO: 134830 - DNA, 24 bp, Artificial sequence
  SiRNA target sequence
taaagttttaataaatacttctgg

SEQ ID NO: 134831 - DNA, 24 bp, Artificial sequence
  SiRNA target sequence
aaagttttaataaatacttctggc

SEQ ID NO: 134832 - DNA, 24 bp, Artificial sequence
  SiRNA target sequence
aagttttaataaatacttctggcc

SEQ ID NO: 134833 - DNA, 24 bp, Artificial sequence
  SiRNA target sequence
agttttaataaatacttctggccc

SEQ ID NO: 134834 - DNA, 24 bp, Artificial sequence
  SiRNA target sequence
gttttaataaatacttctggccct

SEQ ID NO: 134835 - DNA, 24 bp, Artificial sequence
  SiRNA target sequence
ttttaataaatacttctggccctt

SEQ ID NO: 134836 - DNA, 24 bp, Artificial sequence
  SiRNA target sequence
tttaataaatacttctggcccttt

SEQ ID NO: 134837 - DNA, 24 bp, Artificial sequence
  SiRNA target sequence
ttaataaatacttctggccctttt

SEQ ID NO: 134838 - DNA, 24 bp, Artificial sequence
  SiRNA target sequence
taataaatacttctggcccttttg

SEQ ID NO: 134839 - DNA, 24 bp, Artificial sequence
  SiRNA target sequence
aataaatacttctggcccttttgc

SEQ ID NO: 134840 - DNA, 24 bp, Artificial sequence
  SiRNA target sequence
ataaatacttctggcccttttgct

SEQ ID NO: 134841 - DNA, 24 bp, Artificial sequence
  SiRNA target sequence
taaatacttctggcccttttgctg

SEQ ID NO: 134842 - DNA, 24 bp, Artificial sequence
  SiRNA target sequence
aaatacttctggcccttttgctga

SEQ ID NO: 134843 - DNA, 24 bp, Artificial sequence
  SiRNA target sequence
aatacttctggcccttttgctgac

SEQ ID NO: 134844 - DNA, 24 bp, Artificial sequence
  SiRNA target sequence
atacttctggcccttttgctgacg

SEQ ID NO: 134845 - DNA, 24 bp, Artificial sequence
  SiRNA target sequence
tacttctggcccttttgctgacga

SEQ ID NO: 134846 - DNA, 24 bp, Artificial sequence
  SiRNA target sequence
acttctggcccttttgctgacgag

SEQ ID NO: 134847 - DNA, 24 bp, Artificial sequence
  SiRNA target sequence
cttctggcccttttgctgacgagg

SEQ ID NO: 134848 - DNA, 24 bp, Artificial sequence
  SiRNA target sequence
ttctggcccttttgctgacgaggt

SEQ ID NO: 134849 - DNA, 24 bp, Artificial sequence
  SiRNA target sequence
tctggcccttttgctgacgaggtt

SEQ ID NO: 134850 - DNA, 24 bp, Artificial sequence
  SiRNA target sequence
ctggcccttttgctgacgaggttc

SEQ ID NO: 134851 - DNA, 24 bp, Artificial sequence
  SiRNA target sequence
tggcccttttgctgacgaggttcg

SEQ ID NO: 134852 - DNA, 24 bp, Artificial sequence
  SiRNA target sequence
ggcccttttgctgacgaggttcga

SEQ ID NO: 134853 - DNA, 24 bp, Artificial sequence
  SiRNA target sequence
gcccttttgctgacgaggttcgaa

SEQ ID NO: 134854 - DNA, 24 bp, Artificial sequence
  SiRNA target sequence
cccttttgctgacgaggttcgaaa

SEQ ID NO: 134855 - DNA, 24 bp, Artificial sequence
  SiRNA target sequence
ccttttgctgacgaggttcgaaat

SEQ ID NO: 134856 - DNA, 24 bp, Artificial sequence
  SiRNA target sequence
cttttgctgacgaggttcgaaata

SEQ ID NO: 134857 - DNA, 24 bp, Artificial sequence
  SiRNA target sequence
ttttgctgacgaggttcgaaatac

SEQ ID NO: 134858 - DNA, 24 bp, Artificial sequence
  SiRNA target sequence
tttgctgacgaggttcgaaataca

SEQ ID NO: 134859 - DNA, 24 bp, Artificial sequence
  SiRNA target sequence
ttgctgacgaggttcgaaatacat

SEQ ID NO: 134860 - DNA, 24 bp, Artificial sequence
  SiRNA target sequence
tgctgacgaggttcgaaatacatc

SEQ ID NO: 134861 - DNA, 24 bp, Artificial sequence
  SiRNA target sequence
gctgacgaggttcgaaatacatca

SEQ ID NO: 134862 - DNA, 24 bp, Artificial sequence
  SiRNA target sequence
ctgacgaggttcgaaatacatcaa

SEQ ID NO: 134863 - DNA, 24 bp, Artificial sequence
  SiRNA target sequence
tgacgaggttcgaaatacatcaat

SEQ ID NO: 134864 - DNA, 24 bp, Artificial sequence
  SiRNA target sequence
gacgaggttcgaaatacatcaatt

SEQ ID NO: 134865 - DNA, 24 bp, Artificial sequence
  SiRNA target sequence
acgaggttcgaaatacatcaattg

SEQ ID NO: 134866 - DNA, 24 bp, Artificial sequence
  SiRNA target sequence
cgaggttcgaaatacatcaattga

SEQ ID NO: 134867 - DNA, 24 bp, Artificial sequence
  SiRNA target sequence
gaggttcgaaatacatcaattgaa

SEQ ID NO: 134868 - DNA, 24 bp, Artificial sequence
  SiRNA target sequence
aggttcgaaatacatcaattgaaa

SEQ ID NO: 134869 - DNA, 24 bp, Artificial sequence
  SiRNA target sequence
ggttcgaaatacatcaattgaaaa

SEQ ID NO: 134870 - DNA, 24 bp, Artificial sequence
  SiRNA target sequence
gttcgaaatacatcaattgaaaac

SEQ ID NO: 134871 - DNA, 24 bp, Artificial sequence
  SiRNA target sequence
ttcgaaatacatcaattgaaaact

SEQ ID NO: 134872 - DNA, 24 bp, Artificial sequence
  SiRNA target sequence
tcgaaatacatcaattgaaaactg

SEQ ID NO: 134873 - DNA, 24 bp, Artificial sequence
  SiRNA target sequence
cgaaatacatcaattgaaaactgt

SEQ ID NO: 134874 - DNA, 24 bp, Artificial sequence
  SiRNA target sequence
gaaatacatcaattgaaaactgtc

SEQ ID NO: 134875 - DNA, 24 bp, Artificial sequence
  SiRNA target sequence
aaatacatcaattgaaaactgtca

SEQ ID NO: 134876 - DNA, 24 bp, Artificial sequence
  SiRNA target sequence
aatacatcaattgaaaactgtcaa

SEQ ID NO: 134877 - DNA, 24 bp, Artificial sequence
  SiRNA target sequence
atacatcaattgaaaactgtcaac

SEQ ID NO: 134878 - DNA, 24 bp, Artificial sequence
  SiRNA target sequence
tacatcaattgaaaactgtcaacc

SEQ ID NO: 134879 - DNA, 24 bp, Artificial sequence
  SiRNA target sequence
acatcaattgaaaactgtcaacca

SEQ ID NO: 134880 - DNA, 24 bp, Artificial sequence
  SiRNA target sequence
catcaattgaaaactgtcaaccaa

SEQ ID NO: 134881 - DNA, 24 bp, Artificial sequence
  SiRNA target sequence
atcaattgaaaactgtcaaccaat

SEQ ID NO: 134882 - DNA, 24 bp, Artificial sequence
  SiRNA target sequence
tcaattgaaaactgtcaaccaata

SEQ ID NO: 134883 - DNA, 24 bp, Artificial sequence
  SiRNA target sequence
caattgaaaactgtcaaccaatac

SEQ ID NO: 134884 - DNA, 24 bp, Artificial sequence
  SiRNA target sequence
aattgaaaactgtcaaccaatact

SEQ ID NO: 134885 - DNA, 24 bp, Artificial sequence
  SiRNA target sequence
attgaaaactgtcaaccaatactc

SEQ ID NO: 134886 - DNA, 24 bp, Artificial sequence
  SiRNA target sequence
ttgaaaactgtcaaccaatactcc

SEQ ID NO: 134887 - DNA, 24 bp, Artificial sequence
  SiRNA target sequence
tgaaaactgtcaaccaatactcca

SEQ ID NO: 134888 - DNA, 24 bp, Artificial sequence
  SiRNA target sequence
gaaaactgtcaaccaatactccaa

SEQ ID NO: 134889 - DNA, 24 bp, Artificial sequence
  SiRNA target sequence
aaaactgtcaaccaatactccaac

SEQ ID NO: 134890 - DNA, 24 bp, Artificial sequence
  SiRNA target sequence
aaactgtcaaccaatactccaaca

SEQ ID NO: 134891 - DNA, 24 bp, Artificial sequence
  SiRNA target sequence
aactgtcaaccaatactccaacat

SEQ ID NO: 134892 - DNA, 24 bp, Artificial sequence
  SiRNA target sequence
actgtcaaccaatactccaacata

SEQ ID NO: 134893 - DNA, 24 bp, Artificial sequence
  SiRNA target sequence
ctgtcaaccaatactccaacatag

SEQ ID NO: 134894 - DNA, 24 bp, Artificial sequence
  SiRNA target sequence
tgtcaaccaatactccaacatagt

SEQ ID NO: 134895 - DNA, 24 bp, Artificial sequence
  SiRNA target sequence
gtcaaccaatactccaacatagtt

SEQ ID NO: 134896 - DNA, 24 bp, Artificial sequence
  SiRNA target sequence
tcaaccaatactccaacatagtta

SEQ ID NO: 134897 - DNA, 24 bp, Artificial sequence
  SiRNA target sequence
caaccaatactccaacatagttat

SEQ ID NO: 134898 - DNA, 24 bp, Artificial sequence
  SiRNA target sequence
aaccaatactccaacatagttatg

SEQ ID NO: 134899 - DNA, 24 bp, Artificial sequence
  SiRNA target sequence
accaatactccaacatagttatgg

SEQ ID NO: 134900 - DNA, 24 bp, Artificial sequence
  SiRNA target sequence
ccaatactccaacatagttatggt

SEQ ID NO: 134901 - DNA, 24 bp, Artificial sequence
  SiRNA target sequence
caatactccaacatagttatggta

SEQ ID NO: 134902 - DNA, 24 bp, Artificial sequence
  SiRNA target sequence
aatactccaacatagttatggtac

SEQ ID NO: 134903 - DNA, 24 bp, Artificial sequence
  SiRNA target sequence
atactccaacatagttatggtaca

SEQ ID NO: 134904 - DNA, 24 bp, Artificial sequence
  SiRNA target sequence
tactccaacatagttatggtacac

SEQ ID NO: 134905 - DNA, 24 bp, Artificial sequence
  SiRNA target sequence
actccaacatagttatggtacaca

SEQ ID NO: 134906 - DNA, 24 bp, Artificial sequence
  SiRNA target sequence
ctccaacatagttatggtacacat

SEQ ID NO: 134907 - DNA, 24 bp, Artificial sequence
  SiRNA target sequence
tccaacatagttatggtacacata

SEQ ID NO: 134908 - DNA, 24 bp, Artificial sequence
  SiRNA target sequence
ccaacatagttatggtacacatat

SEQ ID NO: 134909 - DNA, 24 bp, Artificial sequence
  SiRNA target sequence
caacatagttatggtacacatatt

SEQ ID NO: 134910 - DNA, 24 bp, Artificial sequence
  SiRNA target sequence
aacatagttatggtacacatattg

SEQ ID NO: 134911 - DNA, 24 bp, Artificial sequence
  SiRNA target sequence
acatagttatggtacacatattgt

SEQ ID NO: 134912 - DNA, 24 bp, Artificial sequence
  SiRNA target sequence
catagttatggtacacatattgta

SEQ ID NO: 134913 - DNA, 24 bp, Artificial sequence
  SiRNA target sequence
atagttatggtacacatattgtag

SEQ ID NO: 134914 - DNA, 24 bp, Artificial sequence
  SiRNA target sequence
tagttatggtacacatattgtagt

SEQ ID NO: 134915 - DNA, 24 bp, Artificial sequence
  SiRNA target sequence
agttatggtacacatattgtagtt

SEQ ID NO: 134916 - DNA, 24 bp, Artificial sequence
  SiRNA target sequence
gttatggtacacatattgtagttc

SEQ ID NO: 134917 - DNA, 24 bp, Artificial sequence
  SiRNA target sequence
ttatggtacacatattgtagttcc

SEQ ID NO: 134918 - DNA, 24 bp, Artificial sequence
  SiRNA target sequence
tatggtacacatattgtagttcct

SEQ ID NO: 134919 - DNA, 24 bp, Artificial sequence
  SiRNA target sequence
atggtacacatattgtagttcctg

SEQ ID NO: 134920 - DNA, 24 bp, Artificial sequence
  SiRNA target sequence
tggtacacatattgtagttcctgc

SEQ ID NO: 134921 - DNA, 24 bp, Artificial sequence
  SiRNA target sequence
ggtacacatattgtagttcctgcg

SEQ ID NO: 134922 - DNA, 24 bp, Artificial sequence
  SiRNA target sequence
gtacacatattgtagttcctgcga

SEQ ID NO: 134923 - DNA, 24 bp, Artificial sequence
  SiRNA target sequence
tacacatattgtagttcctgcgat

SEQ ID NO: 134924 - DNA, 24 bp, Artificial sequence
  SiRNA target sequence
acacatattgtagttcctgcgata

SEQ ID NO: 134925 - DNA, 24 bp, Artificial sequence
  SiRNA target sequence
cacatattgtagttcctgcgatat

SEQ ID NO: 134926 - DNA, 24 bp, Artificial sequence
  SiRNA target sequence
acatattgtagttcctgcgatatt

SEQ ID NO: 134927 - DNA, 24 bp, Artificial sequence
  SiRNA target sequence
catattgtagttcctgcgatattt

SEQ ID NO: 134928 - DNA, 24 bp, Artificial sequence
  SiRNA target sequence
atattgtagttcctgcgatatttt

SEQ ID NO: 134929 - DNA, 24 bp, Artificial sequence
  SiRNA target sequence
tattgtagttcctgcgatattttc

SEQ ID NO: 134930 - DNA, 24 bp, Artificial sequence
  SiRNA target sequence
attgtagttcctgcgatattttcg

SEQ ID NO: 134931 - DNA, 24 bp, Artificial sequence
  SiRNA target sequence
ttgtagttcctgcgatattttcgc

SEQ ID NO: 134932 - DNA, 24 bp, Artificial sequence
  SiRNA target sequence
tgtagttcctgcgatattttcgcc

SEQ ID NO: 134933 - DNA, 24 bp, Artificial sequence
  SiRNA target sequence
gtagttcctgcgatattttcgcct

SEQ ID NO: 134934 - DNA, 24 bp, Artificial sequence
  SiRNA target sequence
tagttcctgcgatattttcgccta

SEQ ID NO: 134935 - DNA, 24 bp, Artificial sequence
  SiRNA target sequence
agttcctgcgatattttcgcctaa

SEQ ID NO: 134936 - DNA, 24 bp, Artificial sequence
  SiRNA target sequence
gttcctgcgatattttcgcctaaa

SEQ ID NO: 134937 - DNA, 24 bp, Artificial sequence
  SiRNA target sequence
ttcctgcgatattttcgcctaaaa

SEQ ID NO: 134938 - DNA, 24 bp, Artificial sequence
  SiRNA target sequence
tcctgcgatattttcgcctaaaaa

SEQ ID NO: 134939 - DNA, 24 bp, Artificial sequence
  SiRNA target sequence
cctgcgatattttcgcctaaaaat

SEQ ID NO: 134940 - DNA, 24 bp, Artificial sequence
  SiRNA target sequence
ctgcgatattttcgcctaaaaata

SEQ ID NO: 134941 - DNA, 24 bp, Artificial sequence
  SiRNA target sequence
tgcgatattttcgcctaaaaatat

SEQ ID NO: 134942 - DNA, 24 bp, Artificial sequence
  SiRNA target sequence
gcgatattttcgcctaaaaatatg

SEQ ID NO: 134943 - DNA, 24 bp, Artificial sequence
  SiRNA target sequence
cgatattttcgcctaaaaatatgg

SEQ ID NO: 134944 - DNA, 24 bp, Artificial sequence
  SiRNA target sequence
gatattttcgcctaaaaatatggg

SEQ ID NO: 134945 - DNA, 24 bp, Artificial sequence
  SiRNA target sequence
atattttcgcctaaaaatatgggc

SEQ ID NO: 134946 - DNA, 24 bp, Artificial sequence
  SiRNA target sequence
tattttcgcctaaaaatatgggct

SEQ ID NO: 134947 - DNA, 24 bp, Artificial sequence
  SiRNA target sequence
attttcgcctaaaaatatgggctt

SEQ ID NO: 134948 - DNA, 24 bp, Artificial sequence
  SiRNA target sequence
ttttcgcctaaaaatatgggcttt

SEQ ID NO: 134949 - DNA, 24 bp, Artificial sequence
  SiRNA target sequence
tttcgcctaaaaatatgggctttg

SEQ ID NO: 134950 - DNA, 24 bp, Artificial sequence
  SiRNA target sequence
ttcgcctaaaaatatgggctttgt

SEQ ID NO: 134951 - DNA, 24 bp, Artificial sequence
  SiRNA target sequence
tcgcctaaaaatatgggctttgtt

SEQ ID NO: 134952 - DNA, 24 bp, Artificial sequence
  SiRNA target sequence
cgcctaaaaatatgggctttgttg

SEQ ID NO: 134953 - DNA, 24 bp, Artificial sequence
  SiRNA target sequence
gcctaaaaatatgggctttgttga

SEQ ID NO: 134954 - DNA, 24 bp, Artificial sequence
  SiRNA target sequence
cctaaaaatatgggctttgttgat

SEQ ID NO: 134955 - DNA, 24 bp, Artificial sequence
  SiRNA target sequence
ctaaaaatatgggctttgttgatc

SEQ ID NO: 134956 - DNA, 24 bp, Artificial sequence
  SiRNA target sequence
taaaaatatgggctttgttgatcc

SEQ ID NO: 134957 - DNA, 24 bp, Artificial sequence
  SiRNA target sequence
aaaaatatgggctttgttgatcca

SEQ ID NO: 134958 - DNA, 24 bp, Artificial sequence
  SiRNA target sequence
aaaatatgggctttgttgatccaa

SEQ ID NO: 134959 - DNA, 24 bp, Artificial sequence
  SiRNA target sequence
aaatatgggctttgttgatccaag

SEQ ID NO: 134960 - DNA, 24 bp, Artificial sequence
  SiRNA target sequence
aatatgggctttgttgatccaagc

SEQ ID NO: 134961 - DNA, 24 bp, Artificial sequence
  SiRNA target sequence
atatgggctttgttgatccaagca

SEQ ID NO: 134962 - DNA, 24 bp, Artificial sequence
  SiRNA target sequence
tatgggctttgttgatccaagcac

SEQ ID NO: 134963 - DNA, 24 bp, Artificial sequence
  SiRNA target sequence
atgggctttgttgatccaagcacg

SEQ ID NO: 134964 - DNA, 24 bp, Artificial sequence
  SiRNA target sequence
tgggctttgttgatccaagcacga

SEQ ID NO: 134965 - DNA, 24 bp, Artificial sequence
  SiRNA target sequence
gggctttgttgatccaagcacgag

SEQ ID NO: 134966 - DNA, 24 bp, Artificial sequence
  SiRNA target sequence
ggctttgttgatccaagcacgagt

SEQ ID NO: 134967 - DNA, 24 bp, Artificial sequence
  SiRNA target sequence
gctttgttgatccaagcacgagtg

SEQ ID NO: 134968 - DNA, 24 bp, Artificial sequence
  SiRNA target sequence
ctttgttgatccaagcacgagtga

SEQ ID NO: 134969 - DNA, 24 bp, Artificial sequence
  SiRNA target sequence
tttgttgatccaagcacgagtgat

SEQ ID NO: 134970 - DNA, 24 bp, Artificial sequence
  SiRNA target sequence
ttgttgatccaagcacgagtgatg

SEQ ID NO: 134971 - DNA, 24 bp, Artificial sequence
  SiRNA target sequence
tgttgatccaagcacgagtgatgg

SEQ ID NO: 134972 - DNA, 24 bp, Artificial sequence
  SiRNA target sequence
gttgatccaagcacgagtgatgga

SEQ ID NO: 134973 - DNA, 24 bp, Artificial sequence
  SiRNA target sequence
ttgatccaagcacgagtgatggaa

SEQ ID NO: 134974 - DNA, 24 bp, Artificial sequence
  SiRNA target sequence
tgatccaagcacgagtgatggaag

SEQ ID NO: 134975 - DNA, 24 bp, Artificial sequence
  SiRNA target sequence
gatccaagcacgagtgatggaaga

SEQ ID NO: 134976 - DNA, 24 bp, Artificial sequence
  SiRNA target sequence
atccaagcacgagtgatggaagaa

SEQ ID NO: 134977 - DNA, 24 bp, Artificial sequence
  SiRNA target sequence
tccaagcacgagtgatggaagaat

SEQ ID NO: 134978 - DNA, 24 bp, Artificial sequence
  SiRNA target sequence
ccaagcacgagtgatggaagaatc

SEQ ID NO: 134979 - DNA, 24 bp, Artificial sequence
  SiRNA target sequence
caagcacgagtgatggaagaatcg

SEQ ID NO: 134980 - DNA, 24 bp, Artificial sequence
  SiRNA target sequence
aagcacgagtgatggaagaatcgc

SEQ ID NO: 134981 - DNA, 24 bp, Artificial sequence
  SiRNA target sequence
agcacgagtgatggaagaatcgca

SEQ ID NO: 134982 - DNA, 24 bp, Artificial sequence
  SiRNA target sequence
gcacgagtgatggaagaatcgcat

SEQ ID NO: 134983 - DNA, 24 bp, Artificial sequence
  SiRNA target sequence
cacgagtgatggaagaatcgcatt

SEQ ID NO: 134984 - DNA, 24 bp, Artificial sequence
  SiRNA target sequence
acgagtgatggaagaatcgcattt

SEQ ID NO: 134985 - DNA, 24 bp, Artificial sequence
  SiRNA target sequence
cgagtgatggaagaatcgcatttt

SEQ ID NO: 134986 - DNA, 24 bp, Artificial sequence
  SiRNA target sequence
gagtgatggaagaatcgcattttt

SEQ ID NO: 134987 - DNA, 24 bp, Artificial sequence
  SiRNA target sequence
agtgatggaagaatcgcatttttt

SEQ ID NO: 134988 - DNA, 24 bp, Artificial sequence
  SiRNA target sequence
gtgatggaagaatcgcatttttta

SEQ ID NO: 134989 - DNA, 24 bp, Artificial sequence
  SiRNA target sequence
tgatggaagaatcgcattttttat

SEQ ID NO: 134990 - DNA, 24 bp, Artificial sequence
  SiRNA target sequence
gatggaagaatcgcattttttatg

SEQ ID NO: 134991 - DNA, 24 bp, Artificial sequence
  SiRNA target sequence
atggaagaatcgcattttttatga

SEQ ID NO: 134992 - DNA, 24 bp, Artificial sequence
  SiRNA target sequence
tggaagaatcgcattttttatgaa

SEQ ID NO: 134993 - DNA, 24 bp, Artificial sequence
  SiRNA target sequence
ggaagaatcgcattttttatgaat

SEQ ID NO: 134994 - DNA, 24 bp, Artificial sequence
  SiRNA target sequence
gaagaatcgcattttttatgaatt

SEQ ID NO: 134995 - DNA, 24 bp, Artificial sequence
  SiRNA target sequence
aagaatcgcattttttatgaattt

SEQ ID NO: 134996 - DNA, 24 bp, Artificial sequence
  SiRNA target sequence
agaatcgcattttttatgaatttt

SEQ ID NO: 134997 - DNA, 24 bp, Artificial sequence
  SiRNA target sequence
gaatcgcattttttatgaatttta

SEQ ID NO: 134998 - DNA, 24 bp, Artificial sequence
  SiRNA target sequence
aatcgcattttttatgaattttaa

SEQ ID NO: 134999 - DNA, 24 bp, Artificial sequence
  SiRNA target sequence
atcgcattttttatgaattttaaa

SEQ ID NO: 135000 - DNA, 24 bp, Artificial sequence
  SiRNA target sequence
tcgcattttttatgaattttaaag

SEQ ID NO: 135001 - DNA, 24 bp, Artificial sequence
  SiRNA target sequence
cgcattttttatgaattttaaagg

SEQ ID NO: 135002 - DNA, 24 bp, Artificial sequence
  SiRNA target sequence
gcattttttatgaattttaaaggt

SEQ ID NO: 135003 - DNA, 24 bp, Artificial sequence
  SiRNA target sequence
cattttttatgaattttaaaggta

SEQ ID NO: 135004 - DNA, 24 bp, Artificial sequence
  SiRNA target sequence
attttttatgaattttaaaggtaa

SEQ ID NO: 135005 - DNA, 24 bp, Artificial sequence
  SiRNA target sequence
ttttttatgaattttaaaggtaaa

SEQ ID NO: 135006 - DNA, 24 bp, Artificial sequence
  SiRNA target sequence
tttttatgaattttaaaggtaaaa

SEQ ID NO: 135007 - DNA, 24 bp, Artificial sequence
  SiRNA target sequence
ttttatgaattttaaaggtaaaac

SEQ ID NO: 135008 - DNA, 24 bp, Artificial sequence
  SiRNA target sequence
tttatgaattttaaaggtaaaaca

SEQ ID NO: 135009 - DNA, 24 bp, Artificial sequence
  SiRNA target sequence
ttatgaattttaaaggtaaaacat

SEQ ID NO: 135010 - DNA, 24 bp, Artificial sequence
  SiRNA target sequence
tatgaattttaaaggtaaaacatt

SEQ ID NO: 135011 - DNA, 24 bp, Artificial sequence
  SiRNA target sequence
atgaattttaaaggtaaaacattg

SEQ ID NO: 135012 - DNA, 24 bp, Artificial sequence
  SiRNA target sequence
tgaattttaaaggtaaaacattga

SEQ ID NO: 135013 - DNA, 24 bp, Artificial sequence
  SiRNA target sequence
gaattttaaaggtaaaacattgat

SEQ ID NO: 135014 - DNA, 24 bp, Artificial sequence
  SiRNA target sequence
aattttaaaggtaaaacattgatt

SEQ ID NO: 135015 - DNA, 24 bp, Artificial sequence
  SiRNA target sequence
attttaaaggtaaaacattgattg

SEQ ID NO: 135016 - DNA, 24 bp, Artificial sequence
  SiRNA target sequence
ttttaaaggtaaaacattgattgg

SEQ ID NO: 135017 - DNA, 24 bp, Artificial sequence
  SiRNA target sequence
tttaaaggtaaaacattgattgga

SEQ ID NO: 135018 - DNA, 24 bp, Artificial sequence
  SiRNA target sequence
ttaaaggtaaaacattgattggag

SEQ ID NO: 135019 - DNA, 24 bp, Artificial sequence
  SiRNA target sequence
taaaggtaaaacattgattggagg

SEQ ID NO: 135020 - DNA, 24 bp, Artificial sequence
  SiRNA target sequence
aaaggtaaaacattgattggagga

SEQ ID NO: 135021 - DNA, 24 bp, Artificial sequence
  SiRNA target sequence
aaggtaaaacattgattggaggaa

SEQ ID NO: 135022 - DNA, 24 bp, Artificial sequence
  SiRNA target sequence
aggtaaaacattgattggaggaac

SEQ ID NO: 135023 - DNA, 24 bp, Artificial sequence
  SiRNA target sequence
ggtaaaacattgattggaggaaca

SEQ ID NO: 135024 - DNA, 24 bp, Artificial sequence
  SiRNA target sequence
gtaaaacattgattggaggaacag

SEQ ID NO: 135025 - DNA, 24 bp, Artificial sequence
  SiRNA target sequence
taaaacattgattggaggaacaga

SEQ ID NO: 135026 - DNA, 24 bp, Artificial sequence
  SiRNA target sequence
aaaacattgattggaggaacagat

SEQ ID NO: 135027 - DNA, 24 bp, Artificial sequence
  SiRNA target sequence
aaacattgattggaggaacagatg

SEQ ID NO: 135028 - DNA, 24 bp, Artificial sequence
  SiRNA target sequence
aacattgattggaggaacagatgt

SEQ ID NO: 135029 - DNA, 24 bp, Artificial sequence
  SiRNA target sequence
acattgattggaggaacagatgtt

SEQ ID NO: 135030 - DNA, 24 bp, Artificial sequence
  SiRNA target sequence
cattgattggaggaacagatgtta

SEQ ID NO: 135031 - DNA, 24 bp, Artificial sequence
  SiRNA target sequence
attgattggaggaacagatgttaa

SEQ ID NO: 135032 - DNA, 24 bp, Artificial sequence
  SiRNA target sequence
ttgattggaggaacagatgttaag

SEQ ID NO: 135033 - DNA, 24 bp, Artificial sequence
  SiRNA target sequence
tgattggaggaacagatgttaagt

SEQ ID NO: 135034 - DNA, 24 bp, Artificial sequence
  SiRNA target sequence
gattggaggaacagatgttaagtg

SEQ ID NO: 135035 - DNA, 24 bp, Artificial sequence
  SiRNA target sequence
attggaggaacagatgttaagtgt

SEQ ID NO: 135036 - DNA, 24 bp, Artificial sequence
  SiRNA target sequence
ttggaggaacagatgttaagtgta

SEQ ID NO: 135037 - DNA, 24 bp, Artificial sequence
  SiRNA target sequence
tggaggaacagatgttaagtgtaa

SEQ ID NO: 135038 - DNA, 24 bp, Artificial sequence
  SiRNA target sequence
ggaggaacagatgttaagtgtaaa

SEQ ID NO: 135039 - DNA, 24 bp, Artificial sequence
  SiRNA target sequence
gaggaacagatgttaagtgtaaag

SEQ ID NO: 135040 - DNA, 24 bp, Artificial sequence
  SiRNA target sequence
aggaacagatgttaagtgtaaagt

SEQ ID NO: 135041 - DNA, 24 bp, Artificial sequence
  SiRNA target sequence
ggaacagatgttaagtgtaaagtt

SEQ ID NO: 135042 - DNA, 24 bp, Artificial sequence
  SiRNA target sequence
gaacagatgttaagtgtaaagttg

SEQ ID NO: 135043 - DNA, 24 bp, Artificial sequence
  SiRNA target sequence
aacagatgttaagtgtaaagttga

SEQ ID NO: 135044 - DNA, 24 bp, Artificial sequence
  SiRNA target sequence
acagatgttaagtgtaaagttgaa

SEQ ID NO: 135045 - DNA, 24 bp, Artificial sequence
  SiRNA target sequence
cagatgttaagtgtaaagttgaag

SEQ ID NO: 135046 - DNA, 24 bp, Artificial sequence
  SiRNA target sequence
agatgttaagtgtaaagttgaaga

SEQ ID NO: 135047 - DNA, 24 bp, Artificial sequence
  SiRNA target sequence
gatgttaagtgtaaagttgaagat

SEQ ID NO: 135048 - DNA, 24 bp, Artificial sequence
  SiRNA target sequence
atgttaagtgtaaagttgaagatt

SEQ ID NO: 135049 - DNA, 24 bp, Artificial sequence
  SiRNA target sequence
tgttaagtgtaaagttgaagattt

SEQ ID NO: 135050 - DNA, 24 bp, Artificial sequence
  SiRNA target sequence
gttaagtgtaaagttgaagattta

SEQ ID NO: 135051 - DNA, 24 bp, Artificial sequence
  SiRNA target sequence
ttaagtgtaaagttgaagatttaa

SEQ ID NO: 135052 - DNA, 24 bp, Artificial sequence
  SiRNA target sequence
taagtgtaaagttgaagatttaat

SEQ ID NO: 135053 - DNA, 24 bp, Artificial sequence
  SiRNA target sequence
aagtgtaaagttgaagatttaata

SEQ ID NO: 135054 - DNA, 24 bp, Artificial sequence
  SiRNA target sequence
agtgtaaagttgaagatttaataa

SEQ ID NO: 135055 - DNA, 24 bp, Artificial sequence
  SiRNA target sequence
gtgtaaagttgaagatttaataaa

SEQ ID NO: 135056 - DNA, 24 bp, Artificial sequence
  SiRNA target sequence
tgtaaagttgaagatttaataaaa

SEQ ID NO: 135057 - DNA, 24 bp, Artificial sequence
  SiRNA target sequence
gtaaagttgaagatttaataaaac

SEQ ID NO: 135058 - DNA, 24 bp, Artificial sequence
  SiRNA target sequence
taaagttgaagatttaataaaacc

SEQ ID NO: 135059 - DNA, 24 bp, Artificial sequence
  SiRNA target sequence
aaagttgaagatttaataaaaccg

SEQ ID NO: 135060 - DNA, 24 bp, Artificial sequence
  SiRNA target sequence
aagttgaagatttaataaaaccga

SEQ ID NO: 135061 - DNA, 24 bp, Artificial sequence
  SiRNA target sequence
agttgaagatttaataaaaccgac

SEQ ID NO: 135062 - DNA, 24 bp, Artificial sequence
  SiRNA target sequence
gttgaagatttaataaaaccgact

SEQ ID NO: 135063 - DNA, 24 bp, Artificial sequence
  SiRNA target sequence
ttgaagatttaataaaaccgactg

SEQ ID NO: 135064 - DNA, 24 bp, Artificial sequence
  SiRNA target sequence
tgaagatttaataaaaccgactga

SEQ ID NO: 135065 - DNA, 24 bp, Artificial sequence
  SiRNA target sequence
gaagatttaataaaaccgactgaa

SEQ ID NO: 135066 - DNA, 24 bp, Artificial sequence
  SiRNA target sequence
aagatttaataaaaccgactgaag

SEQ ID NO: 135067 - DNA, 24 bp, Artificial sequence
  SiRNA target sequence
agatttaataaaaccgactgaaga

SEQ ID NO: 135068 - DNA, 24 bp, Artificial sequence
  SiRNA target sequence
gatttaataaaaccgactgaagaa

SEQ ID NO: 135069 - DNA, 24 bp, Artificial sequence
  SiRNA target sequence
atttaataaaaccgactgaagaag

SEQ ID NO: 135070 - DNA, 24 bp, Artificial sequence
  SiRNA target sequence
tttaataaaaccgactgaagaaga

SEQ ID NO: 135071 - DNA, 24 bp, Artificial sequence
  SiRNA target sequence
ttaataaaaccgactgaagaagat

SEQ ID NO: 135072 - DNA, 24 bp, Artificial sequence
  SiRNA target sequence
taataaaaccgactgaagaagatc

SEQ ID NO: 135073 - DNA, 24 bp, Artificial sequence
  SiRNA target sequence
aataaaaccgactgaagaagatct

SEQ ID NO: 135074 - DNA, 24 bp, Artificial sequence
  SiRNA target sequence
ataaaaccgactgaagaagatcta

SEQ ID NO: 135075 - DNA, 24 bp, Artificial sequence
  SiRNA target sequence
taaaaccgactgaagaagatctaa

SEQ ID NO: 135076 - DNA, 24 bp, Artificial sequence
  SiRNA target sequence
aaaaccgactgaagaagatctaaa

SEQ ID NO: 135077 - DNA, 24 bp, Artificial sequence
  SiRNA target sequence
aaaccgactgaagaagatctaaac

SEQ ID NO: 135078 - DNA, 24 bp, Artificial sequence
  SiRNA target sequence
aaccgactgaagaagatctaaact

SEQ ID NO: 135079 - DNA, 24 bp, Artificial sequence
  SiRNA target sequence
accgactgaagaagatctaaactt

SEQ ID NO: 135080 - DNA, 24 bp, Artificial sequence
  SiRNA target sequence
ccgactgaagaagatctaaacttt

SEQ ID NO: 135081 - DNA, 24 bp, Artificial sequence
  SiRNA target sequence
cgactgaagaagatctaaactttc

SEQ ID NO: 135082 - DNA, 24 bp, Artificial sequence
  SiRNA target sequence
gactgaagaagatctaaactttct

SEQ ID NO: 135083 - DNA, 24 bp, Artificial sequence
  SiRNA target sequence
actgaagaagatctaaactttctt

SEQ ID NO: 135084 - DNA, 24 bp, Artificial sequence
  SiRNA target sequence
ctgaagaagatctaaactttctta

SEQ ID NO: 135085 - DNA, 24 bp, Artificial sequence
  SiRNA target sequence
tgaagaagatctaaactttcttat

SEQ ID NO: 135086 - DNA, 24 bp, Artificial sequence
  SiRNA target sequence
gaagaagatctaaactttcttatt

SEQ ID NO: 135087 - DNA, 24 bp, Artificial sequence
  SiRNA target sequence
aagaagatctaaactttcttattc

SEQ ID NO: 135088 - DNA, 24 bp, Artificial sequence
  SiRNA target sequence
agaagatctaaactttcttattca

SEQ ID NO: 135089 - DNA, 24 bp, Artificial sequence
  SiRNA target sequence
gaagatctaaactttcttattcac

SEQ ID NO: 135090 - DNA, 24 bp, Artificial sequence
  SiRNA target sequence
aagatctaaactttcttattcacg

SEQ ID NO: 135091 - DNA, 24 bp, Artificial sequence
  SiRNA target sequence
agatctaaactttcttattcacga

SEQ ID NO: 135092 - DNA, 24 bp, Artificial sequence
  SiRNA target sequence
gatctaaactttcttattcacgag

SEQ ID NO: 135093 - DNA, 24 bp, Artificial sequence
  SiRNA target sequence
atctaaactttcttattcacgagg

SEQ ID NO: 135094 - DNA, 24 bp, Artificial sequence
  SiRNA target sequence
tctaaactttcttattcacgaggc

SEQ ID NO: 135095 - DNA, 24 bp, Artificial sequence
  SiRNA target sequence
ctaaactttcttattcacgaggcc

SEQ ID NO: 135096 - DNA, 24 bp, Artificial sequence
  SiRNA target sequence
taaactttcttattcacgaggcca

SEQ ID NO: 135097 - DNA, 24 bp, Artificial sequence
  SiRNA target sequence
aaactttcttattcacgaggccaa

SEQ ID NO: 135098 - DNA, 24 bp, Artificial sequence
  SiRNA target sequence
aactttcttattcacgaggccaat

SEQ ID NO: 135099 - DNA, 24 bp, Artificial sequence
  SiRNA target sequence
actttcttattcacgaggccaatt

SEQ ID NO: 135100 - DNA, 24 bp, Artificial sequence
  SiRNA target sequence
ctttcttattcacgaggccaatta

SEQ ID NO: 135101 - DNA, 24 bp, Artificial sequence
  SiRNA target sequence
tttcttattcacgaggccaattat

SEQ ID NO: 135102 - DNA, 24 bp, Artificial sequence
  SiRNA target sequence
ttcttattcacgaggccaattatt

SEQ ID NO: 135103 - DNA, 24 bp, Artificial sequence
  SiRNA target sequence
tcttattcacgaggccaattattt

SEQ ID NO: 135104 - DNA, 24 bp, Artificial sequence
  SiRNA target sequence
cttattcacgaggccaattatttt

SEQ ID NO: 135105 - DNA, 24 bp, Artificial sequence
  SiRNA target sequence
ttattcacgaggccaattatttta

SEQ ID NO: 135106 - DNA, 24 bp, Artificial sequence
  SiRNA target sequence
tattcacgaggccaattattttac

SEQ ID NO: 135107 - DNA, 24 bp, Artificial sequence
  SiRNA target sequence
attcacgaggccaattattttaca

SEQ ID NO: 135108 - DNA, 24 bp, Artificial sequence
  SiRNA target sequence
ttcacgaggccaattattttacag

SEQ ID NO: 135109 - DNA, 24 bp, Artificial sequence
  SiRNA target sequence
tcacgaggccaattattttacaga

SEQ ID NO: 135110 - DNA, 24 bp, Artificial sequence
  SiRNA target sequence
cacgaggccaattattttacagat

SEQ ID NO: 135111 - DNA, 24 bp, Artificial sequence
  SiRNA target sequence
acgaggccaattattttacagatc

SEQ ID NO: 135112 - DNA, 24 bp, Artificial sequence
  SiRNA target sequence
cgaggccaattattttacagatca

SEQ ID NO: 135113 - DNA, 24 bp, Artificial sequence
  SiRNA target sequence
gaggccaattattttacagatcac

SEQ ID NO: 135114 - DNA, 24 bp, Artificial sequence
  SiRNA target sequence
aggccaattattttacagatcaca

SEQ ID NO: 135115 - DNA, 24 bp, Artificial sequence
  SiRNA target sequence
ggccaattattttacagatcacaa

SEQ ID NO: 135116 - DNA, 24 bp, Artificial sequence
  SiRNA target sequence
gccaattattttacagatcacaat

SEQ ID NO: 135117 - DNA, 24 bp, Artificial sequence
  SiRNA target sequence
ccaattattttacagatcacaatt

SEQ ID NO: 135118 - DNA, 24 bp, Artificial sequence
  SiRNA target sequence
caattattttacagatcacaattt

SEQ ID NO: 135119 - DNA, 24 bp, Artificial sequence
  SiRNA target sequence
aattattttacagatcacaattta

SEQ ID NO: 135120 - DNA, 24 bp, Artificial sequence
  SiRNA target sequence
attattttacagatcacaatttaa

SEQ ID NO: 135121 - DNA, 24 bp, Artificial sequence
  SiRNA target sequence
ttattttacagatcacaatttaaa

SEQ ID NO: 135122 - DNA, 24 bp, Artificial sequence
  SiRNA target sequence
tattttacagatcacaatttaaaa

SEQ ID NO: 135123 - DNA, 24 bp, Artificial sequence
  SiRNA target sequence
attttacagatcacaatttaaaat

SEQ ID NO: 135124 - DNA, 24 bp, Artificial sequence
  SiRNA target sequence
ttttacagatcacaatttaaaatt

SEQ ID NO: 135125 - DNA, 24 bp, Artificial sequence
  SiRNA target sequence
tttacagatcacaatttaaaatta

SEQ ID NO: 135126 - DNA, 24 bp, Artificial sequence
  SiRNA target sequence
ttacagatcacaatttaaaattaa

SEQ ID NO: 135127 - DNA, 24 bp, Artificial sequence
  SiRNA target sequence
tacagatcacaatttaaaattaac

SEQ ID NO: 135128 - DNA, 24 bp, Artificial sequence
  SiRNA target sequence
acagatcacaatttaaaattaaca

SEQ ID NO: 135129 - DNA, 24 bp, Artificial sequence
  SiRNA target sequence
cagatcacaatttaaaattaacaa

SEQ ID NO: 135130 - DNA, 24 bp, Artificial sequence
  SiRNA target sequence
agatcacaatttaaaattaacaaa

SEQ ID NO: 135131 - DNA, 24 bp, Artificial sequence
  SiRNA target sequence
gatcacaatttaaaattaacaaaa

SEQ ID NO: 135132 - DNA, 24 bp, Artificial sequence
  SiRNA target sequence
atcacaatttaaaattaacaaaaa

SEQ ID NO: 135133 - DNA, 24 bp, Artificial sequence
  SiRNA target sequence
tcacaatttaaaattaacaaaaaa

SEQ ID NO: 135134 - DNA, 24 bp, Artificial sequence
  SiRNA target sequence
cacaatttaaaattaacaaaaaaa

SEQ ID NO: 135135 - DNA, 24 bp, Artificial sequence
  SiRNA target sequence
acaatttaaaattaacaaaaaaag

SEQ ID NO: 135136 - DNA, 24 bp, Artificial sequence
  SiRNA target sequence
caatttaaaattaacaaaaaaaga

SEQ ID NO: 135137 - DNA, 24 bp, Artificial sequence
  SiRNA target sequence
aatttaaaattaacaaaaaaagat

SEQ ID NO: 135138 - DNA, 24 bp, Artificial sequence
  SiRNA target sequence
atttaaaattaacaaaaaaagatg

SEQ ID NO: 135139 - DNA, 24 bp, Artificial sequence
  SiRNA target sequence
tttaaaattaacaaaaaaagatgt

SEQ ID NO: 135140 - DNA, 24 bp, Artificial sequence
  SiRNA target sequence
ttaaaattaacaaaaaaagatgtt

SEQ ID NO: 135141 - DNA, 24 bp, Artificial sequence
  SiRNA target sequence
taaaattaacaaaaaaagatgttt

SEQ ID NO: 135142 - DNA, 24 bp, Artificial sequence
  SiRNA target sequence
aaaattaacaaaaaaagatgtttt

SEQ ID NO: 135143 - DNA, 24 bp, Artificial sequence
  SiRNA target sequence
aaattaacaaaaaaagatgttttg

SEQ ID NO: 135144 - DNA, 24 bp, Artificial sequence
  SiRNA target sequence
aattaacaaaaaaagatgttttgt

SEQ ID NO: 135145 - DNA, 24 bp, Artificial sequence
  SiRNA target sequence
attaacaaaaaaagatgttttgtc

SEQ ID NO: 135146 - DNA, 24 bp, Artificial sequence
  SiRNA target sequence
ttaacaaaaaaagatgttttgtct

SEQ ID NO: 135147 - DNA, 24 bp, Artificial sequence
  SiRNA target sequence
taacaaaaaaagatgttttgtctg

SEQ ID NO: 135148 - DNA, 24 bp, Artificial sequence
  SiRNA target sequence
aacaaaaaaagatgttttgtctgt

SEQ ID NO: 135149 - DNA, 24 bp, Artificial sequence
  SiRNA target sequence
acaaaaaaagatgttttgtctgtt

SEQ ID NO: 135150 - DNA, 24 bp, Artificial sequence
  SiRNA target sequence
caaaaaaagatgttttgtctgttt

SEQ ID NO: 135151 - DNA, 24 bp, Artificial sequence
  SiRNA target sequence
aaaaaaagatgttttgtctgtttg

SEQ ID NO: 135152 - DNA, 24 bp, Artificial sequence
  SiRNA target sequence
aaaaaagatgttttgtctgtttgg

SEQ ID NO: 135153 - DNA, 24 bp, Artificial sequence
  SiRNA target sequence
aaaaagatgttttgtctgtttgga

SEQ ID NO: 135154 - DNA, 24 bp, Artificial sequence
  SiRNA target sequence
aaaagatgttttgtctgtttggac

SEQ ID NO: 135155 - DNA, 24 bp, Artificial sequence
  SiRNA target sequence
aaagatgttttgtctgtttggaca

SEQ ID NO: 135156 - DNA, 24 bp, Artificial sequence
  SiRNA target sequence
aagatgttttgtctgtttggacag

SEQ ID NO: 135157 - DNA, 24 bp, Artificial sequence
  SiRNA target sequence
agatgttttgtctgtttggacagg

SEQ ID NO: 135158 - DNA, 24 bp, Artificial sequence
  SiRNA target sequence
gatgttttgtctgtttggacaggt

SEQ ID NO: 135159 - DNA, 24 bp, Artificial sequence
  SiRNA target sequence
atgttttgtctgtttggacaggta

SEQ ID NO: 135160 - DNA, 24 bp, Artificial sequence
  SiRNA target sequence
tgttttgtctgtttggacaggtat

SEQ ID NO: 135161 - DNA, 24 bp, Artificial sequence
  SiRNA target sequence
gttttgtctgtttggacaggtatt

SEQ ID NO: 135162 - DNA, 24 bp, Artificial sequence
  SiRNA target sequence
ttttgtctgtttggacaggtatta

SEQ ID NO: 135163 - DNA, 24 bp, Artificial sequence
  SiRNA target sequence
tttgtctgtttggacaggtattag

SEQ ID NO: 135164 - DNA, 24 bp, Artificial sequence
  SiRNA target sequence
ttgtctgtttggacaggtattaga

SEQ ID NO: 135165 - DNA, 24 bp, Artificial sequence
  SiRNA target sequence
tgtctgtttggacaggtattagac

SEQ ID NO: 135166 - DNA, 24 bp, Artificial sequence
  SiRNA target sequence
gtctgtttggacaggtattagacc

SEQ ID NO: 135167 - DNA, 24 bp, Artificial sequence
  SiRNA target sequence
tctgtttggacaggtattagaccg

SEQ ID NO: 135168 - DNA, 24 bp, Artificial sequence
  SiRNA target sequence
ctgtttggacaggtattagaccgt

SEQ ID NO: 135169 - DNA, 24 bp, Artificial sequence
  SiRNA target sequence
tgtttggacaggtattagaccgtt

SEQ ID NO: 135170 - DNA, 24 bp, Artificial sequence
  SiRNA target sequence
gtttggacaggtattagaccgtta

SEQ ID NO: 135171 - DNA, 24 bp, Artificial sequence
  SiRNA target sequence
tttggacaggtattagaccgttag

SEQ ID NO: 135172 - DNA, 24 bp, Artificial sequence
  SiRNA target sequence
ttggacaggtattagaccgttagt

SEQ ID NO: 135173 - DNA, 24 bp, Artificial sequence
  SiRNA target sequence
tggacaggtattagaccgttagtc

SEQ ID NO: 135174 - DNA, 24 bp, Artificial sequence
  SiRNA target sequence
ggacaggtattagaccgttagtca

SEQ ID NO: 135175 - DNA, 24 bp, Artificial sequence
  SiRNA target sequence
gacaggtattagaccgttagtcaa

SEQ ID NO: 135176 - DNA, 24 bp, Artificial sequence
  SiRNA target sequence
acaggtattagaccgttagtcaag

SEQ ID NO: 135177 - DNA, 24 bp, Artificial sequence
  SiRNA target sequence
caggtattagaccgttagtcaagg

SEQ ID NO: 135178 - DNA, 24 bp, Artificial sequence
  SiRNA target sequence
aggtattagaccgttagtcaagga

SEQ ID NO: 135179 - DNA, 24 bp, Artificial sequence
  SiRNA target sequence
ggtattagaccgttagtcaaggat

SEQ ID NO: 135180 - DNA, 24 bp, Artificial sequence
  SiRNA target sequence
gtattagaccgttagtcaaggatt

SEQ ID NO: 135181 - DNA, 24 bp, Artificial sequence
  SiRNA target sequence
tattagaccgttagtcaaggattt

SEQ ID NO: 135182 - DNA, 24 bp, Artificial sequence
  SiRNA target sequence
attagaccgttagtcaaggattta

SEQ ID NO: 135183 - DNA, 24 bp, Artificial sequence
  SiRNA target sequence
ttagaccgttagtcaaggatttat

SEQ ID NO: 135184 - DNA, 24 bp, Artificial sequence
  SiRNA target sequence
tagaccgttagtcaaggatttatc

SEQ ID NO: 135185 - DNA, 24 bp, Artificial sequence
  SiRNA target sequence
agaccgttagtcaaggatttatcg

SEQ ID NO: 135186 - DNA, 24 bp, Artificial sequence
  SiRNA target sequence
gaccgttagtcaaggatttatcga

SEQ ID NO: 135187 - DNA, 24 bp, Artificial sequence
  SiRNA target sequence
accgttagtcaaggatttatcgaa

SEQ ID NO: 135188 - DNA, 24 bp, Artificial sequence
  SiRNA target sequence
ccgttagtcaaggatttatcgaaa

SEQ ID NO: 135189 - DNA, 24 bp, Artificial sequence
  SiRNA target sequence
cgttagtcaaggatttatcgaaaa

SEQ ID NO: 135190 - DNA, 24 bp, Artificial sequence
  SiRNA target sequence
gttagtcaaggatttatcgaaaag

SEQ ID NO: 135191 - DNA, 24 bp, Artificial sequence
  SiRNA target sequence
ttagtcaaggatttatcgaaaagt

SEQ ID NO: 135192 - DNA, 24 bp, Artificial sequence
  SiRNA target sequence
tagtcaaggatttatcgaaaagtt

SEQ ID NO: 135193 - DNA, 24 bp, Artificial sequence
  SiRNA target sequence
agtcaaggatttatcgaaaagttc

SEQ ID NO: 135194 - DNA, 24 bp, Artificial sequence
  SiRNA target sequence
gtcaaggatttatcgaaaagttca

SEQ ID NO: 135195 - DNA, 24 bp, Artificial sequence
  SiRNA target sequence
tcaaggatttatcgaaaagttcaa

SEQ ID NO: 135196 - DNA, 24 bp, Artificial sequence
  SiRNA target sequence
caaggatttatcgaaaagttcaac

SEQ ID NO: 135197 - DNA, 24 bp, Artificial sequence
  SiRNA target sequence
aaggatttatcgaaaagttcaaca

SEQ ID NO: 135198 - DNA, 24 bp, Artificial sequence
  SiRNA target sequence
aggatttatcgaaaagttcaacag

SEQ ID NO: 135199 - DNA, 24 bp, Artificial sequence
  SiRNA target sequence
ggatttatcgaaaagttcaacaga

SEQ ID NO: 135200 - DNA, 24 bp, Artificial sequence
  SiRNA target sequence
gatttatcgaaaagttcaacagaa

SEQ ID NO: 135201 - DNA, 24 bp, Artificial sequence
  SiRNA target sequence
atttatcgaaaagttcaacagaaa

SEQ ID NO: 135202 - DNA, 24 bp, Artificial sequence
  SiRNA target sequence
tttatcgaaaagttcaacagaaaa

SEQ ID NO: 135203 - DNA, 24 bp, Artificial sequence
  SiRNA target sequence
ttatcgaaaagttcaacagaaaag

SEQ ID NO: 135204 - DNA, 24 bp, Artificial sequence
  SiRNA target sequence
tatcgaaaagttcaacagaaaaga

SEQ ID NO: 135205 - DNA, 24 bp, Artificial sequence
  SiRNA target sequence
atcgaaaagttcaacagaaaagat

SEQ ID NO: 135206 - DNA, 24 bp, Artificial sequence
  SiRNA target sequence
tcgaaaagttcaacagaaaagata

SEQ ID NO: 135207 - DNA, 24 bp, Artificial sequence
  SiRNA target sequence
cgaaaagttcaacagaaaagatat

SEQ ID NO: 135208 - DNA, 24 bp, Artificial sequence
  SiRNA target sequence
gaaaagttcaacagaaaagatatg

SEQ ID NO: 135209 - DNA, 24 bp, Artificial sequence
  SiRNA target sequence
aaaagttcaacagaaaagatatgt

SEQ ID NO: 135210 - DNA, 24 bp, Artificial sequence
  SiRNA target sequence
aaagttcaacagaaaagatatgta

SEQ ID NO: 135211 - DNA, 24 bp, Artificial sequence
  SiRNA target sequence
aagttcaacagaaaagatatgtag

SEQ ID NO: 135212 - DNA, 24 bp, Artificial sequence
  SiRNA target sequence
agttcaacagaaaagatatgtaga

SEQ ID NO: 135213 - DNA, 24 bp, Artificial sequence
  SiRNA target sequence
gttcaacagaaaagatatgtagaa

SEQ ID NO: 135214 - DNA, 24 bp, Artificial sequence
  SiRNA target sequence
ttcaacagaaaagatatgtagaaa

SEQ ID NO: 135215 - DNA, 24 bp, Artificial sequence
  SiRNA target sequence
tcaacagaaaagatatgtagaaaa

SEQ ID NO: 135216 - DNA, 24 bp, Artificial sequence
  SiRNA target sequence
caacagaaaagatatgtagaaaac

SEQ ID NO: 135217 - DNA, 24 bp, Artificial sequence
  SiRNA target sequence
aacagaaaagatatgtagaaaaca

SEQ ID NO: 135218 - DNA, 24 bp, Artificial sequence
  SiRNA target sequence
acagaaaagatatgtagaaaacat

SEQ ID NO: 135219 - DNA, 24 bp, Artificial sequence
  SiRNA target sequence
cagaaaagatatgtagaaaacata

SEQ ID NO: 135220 - DNA, 24 bp, Artificial sequence
  SiRNA target sequence
agaaaagatatgtagaaaacatac

SEQ ID NO: 135221 - DNA, 24 bp, Artificial sequence
  SiRNA target sequence
gaaaagatatgtagaaaacatact

SEQ ID NO: 135222 - DNA, 24 bp, Artificial sequence
  SiRNA target sequence
aaaagatatgtagaaaacatacta

SEQ ID NO: 135223 - DNA, 24 bp, Artificial sequence
  SiRNA target sequence
aaagatatgtagaaaacatactat

SEQ ID NO: 135224 - DNA, 24 bp, Artificial sequence
  SiRNA target sequence
aagatatgtagaaaacatactata

SEQ ID NO: 135225 - DNA, 24 bp, Artificial sequence
  SiRNA target sequence
agatatgtagaaaacatactataa

SEQ ID NO: 135226 - DNA, 24 bp, Artificial sequence
  SiRNA target sequence
gatatgtagaaaacatactataag

SEQ ID NO: 135227 - DNA, 24 bp, Artificial sequence
  SiRNA target sequence
atatgtagaaaacatactataaga

SEQ ID NO: 135228 - DNA, 24 bp, Artificial sequence
  SiRNA target sequence
tatgtagaaaacatactataagaa

SEQ ID NO: 135229 - DNA, 24 bp, Artificial sequence
  SiRNA target sequence
atgtagaaaacatactataagaat

SEQ ID NO: 135230 - DNA, 24 bp, Artificial sequence
  SiRNA target sequence
tgtagaaaacatactataagaata

SEQ ID NO: 135231 - DNA, 24 bp, Artificial sequence
  SiRNA target sequence
gtagaaaacatactataagaatag

SEQ ID NO: 135232 - DNA, 24 bp, Artificial sequence
  SiRNA target sequence
tagaaaacatactataagaataga

SEQ ID NO: 135233 - DNA, 24 bp, Artificial sequence
  SiRNA target sequence
agaaaacatactataagaatagat

SEQ ID NO: 135234 - DNA, 24 bp, Artificial sequence
  SiRNA target sequence
gaaaacatactataagaatagata

SEQ ID NO: 135235 - DNA, 24 bp, Artificial sequence
  SiRNA target sequence
aaaacatactataagaatagataa

SEQ ID NO: 135236 - DNA, 24 bp, Artificial sequence
  SiRNA target sequence
aaacatactataagaatagataaa

SEQ ID NO: 135237 - DNA, 24 bp, Artificial sequence
  SiRNA target sequence
aacatactataagaatagataaag

SEQ ID NO: 135238 - DNA, 24 bp, Artificial sequence
  SiRNA target sequence
acatactataagaatagataaaga

SEQ ID NO: 135239 - DNA, 24 bp, Artificial sequence
  SiRNA target sequence
catactataagaatagataaagac

SEQ ID NO: 135240 - DNA, 24 bp, Artificial sequence
  SiRNA target sequence
atactataagaatagataaagaca

SEQ ID NO: 135241 - DNA, 24 bp, Artificial sequence
  SiRNA target sequence
tactataagaatagataaagacaa

SEQ ID NO: 135242 - DNA, 24 bp, Artificial sequence
  SiRNA target sequence
actataagaatagataaagacaat

SEQ ID NO: 135243 - DNA, 24 bp, Artificial sequence
  SiRNA target sequence
ctataagaatagataaagacaata

SEQ ID NO: 135244 - DNA, 24 bp, Artificial sequence
  SiRNA target sequence
tataagaatagataaagacaatat

SEQ ID NO: 135245 - DNA, 24 bp, Artificial sequence
  SiRNA target sequence
ataagaatagataaagacaatatg

SEQ ID NO: 135246 - DNA, 24 bp, Artificial sequence
  SiRNA target sequence
taagaatagataaagacaatatgg

SEQ ID NO: 135247 - DNA, 24 bp, Artificial sequence
  SiRNA target sequence
aagaatagataaagacaatatggt

SEQ ID NO: 135248 - DNA, 24 bp, Artificial sequence
  SiRNA target sequence
agaatagataaagacaatatggta

SEQ ID NO: 135249 - DNA, 24 bp, Artificial sequence
  SiRNA target sequence
gaatagataaagacaatatggtaa

SEQ ID NO: 135250 - DNA, 24 bp, Artificial sequence
  SiRNA target sequence
aatagataaagacaatatggtaac

SEQ ID NO: 135251 - DNA, 24 bp, Artificial sequence
  SiRNA target sequence
atagataaagacaatatggtaact

SEQ ID NO: 135252 - DNA, 24 bp, Artificial sequence
  SiRNA target sequence
tagataaagacaatatggtaactg

SEQ ID NO: 135253 - DNA, 24 bp, Artificial sequence
  SiRNA target sequence
agataaagacaatatggtaactgt

SEQ ID NO: 135254 - DNA, 24 bp, Artificial sequence
  SiRNA target sequence
gataaagacaatatggtaactgta

SEQ ID NO: 135255 - DNA, 24 bp, Artificial sequence
  SiRNA target sequence
ataaagacaatatggtaactgtaa

SEQ ID NO: 135256 - DNA, 24 bp, Artificial sequence
  SiRNA target sequence
taaagacaatatggtaactgtaac

SEQ ID NO: 135257 - DNA, 24 bp, Artificial sequence
  SiRNA target sequence
aaagacaatatggtaactgtaaca

SEQ ID NO: 135258 - DNA, 24 bp, Artificial sequence
  SiRNA target sequence
aagacaatatggtaactgtaacag

SEQ ID NO: 135259 - DNA, 24 bp, Artificial sequence
  SiRNA target sequence
agacaatatggtaactgtaacagg

SEQ ID NO: 135260 - DNA, 24 bp, Artificial sequence
  SiRNA target sequence
gacaatatggtaactgtaacaggt

SEQ ID NO: 135261 - DNA, 24 bp, Artificial sequence
  SiRNA target sequence
acaatatggtaactgtaacaggtg

SEQ ID NO: 135262 - DNA, 24 bp, Artificial sequence
  SiRNA target sequence
caatatggtaactgtaacaggtgg

SEQ ID NO: 135263 - DNA, 24 bp, Artificial sequence
  SiRNA target sequence
aatatggtaactgtaacaggtggt

SEQ ID NO: 135264 - DNA, 24 bp, Artificial sequence
  SiRNA target sequence
atatggtaactgtaacaggtggta

SEQ ID NO: 135265 - DNA, 24 bp, Artificial sequence
  SiRNA target sequence
tatggtaactgtaacaggtggtaa

SEQ ID NO: 135266 - DNA, 24 bp, Artificial sequence
  SiRNA target sequence
atggtaactgtaacaggtggtaag

SEQ ID NO: 135267 - DNA, 24 bp, Artificial sequence
  SiRNA target sequence
tggtaactgtaacaggtggtaagt

SEQ ID NO: 135268 - DNA, 24 bp, Artificial sequence
  SiRNA target sequence
ggtaactgtaacaggtggtaagtg

SEQ ID NO: 135269 - DNA, 24 bp, Artificial sequence
  SiRNA target sequence
gtaactgtaacaggtggtaagtgg

SEQ ID NO: 135270 - DNA, 24 bp, Artificial sequence
  SiRNA target sequence
taactgtaacaggtggtaagtgga

SEQ ID NO: 135271 - DNA, 24 bp, Artificial sequence
  SiRNA target sequence
aactgtaacaggtggtaagtggac

SEQ ID NO: 135272 - DNA, 24 bp, Artificial sequence
  SiRNA target sequence
actgtaacaggtggtaagtggaca

SEQ ID NO: 135273 - DNA, 24 bp, Artificial sequence
  SiRNA target sequence
ctgtaacaggtggtaagtggacaa

SEQ ID NO: 135274 - DNA, 24 bp, Artificial sequence
  SiRNA target sequence
tgtaacaggtggtaagtggacaat

SEQ ID NO: 135275 - DNA, 24 bp, Artificial sequence
  SiRNA target sequence
gtaacaggtggtaagtggacaatt

SEQ ID NO: 135276 - DNA, 24 bp, Artificial sequence
  SiRNA target sequence
taacaggtggtaagtggacaattt

SEQ ID NO: 135277 - DNA, 24 bp, Artificial sequence
  SiRNA target sequence
aacaggtggtaagtggacaatttt

SEQ ID NO: 135278 - DNA, 24 bp, Artificial sequence
  SiRNA target sequence
acaggtggtaagtggacaattttt

SEQ ID NO: 135279 - DNA, 24 bp, Artificial sequence
  SiRNA target sequence
caggtggtaagtggacaatttttc

SEQ ID NO: 135280 - DNA, 24 bp, Artificial sequence
  SiRNA target sequence
aggtggtaagtggacaatttttcg

SEQ ID NO: 135281 - DNA, 24 bp, Artificial sequence
  SiRNA target sequence
ggtggtaagtggacaatttttcga

SEQ ID NO: 135282 - DNA, 24 bp, Artificial sequence
  SiRNA target sequence
gtggtaagtggacaatttttcgac

SEQ ID NO: 135283 - DNA, 24 bp, Artificial sequence
  SiRNA target sequence
tggtaagtggacaatttttcgact

SEQ ID NO: 135284 - DNA, 24 bp, Artificial sequence
  SiRNA target sequence
ggtaagtggacaatttttcgactt

SEQ ID NO: 135285 - DNA, 24 bp, Artificial sequence
  SiRNA target sequence
gtaagtggacaatttttcgactta

SEQ ID NO: 135286 - DNA, 24 bp, Artificial sequence
  SiRNA target sequence
taagtggacaatttttcgacttat

SEQ ID NO: 135287 - DNA, 24 bp, Artificial sequence
  SiRNA target sequence
aagtggacaatttttcgacttatg

SEQ ID NO: 135288 - DNA, 24 bp, Artificial sequence
  SiRNA target sequence
agtggacaatttttcgacttatgg

SEQ ID NO: 135289 - DNA, 24 bp, Artificial sequence
  SiRNA target sequence
gtggacaatttttcgacttatggg

SEQ ID NO: 135290 - DNA, 24 bp, Artificial sequence
  SiRNA target sequence
tggacaatttttcgacttatggga

SEQ ID NO: 135291 - DNA, 24 bp, Artificial sequence
  SiRNA target sequence
ggacaatttttcgacttatgggag

SEQ ID NO: 135292 - DNA, 24 bp, Artificial sequence
  SiRNA target sequence
gacaatttttcgacttatgggaga

SEQ ID NO: 135293 - DNA, 24 bp, Artificial sequence
  SiRNA target sequence
acaatttttcgacttatgggagaa

SEQ ID NO: 135294 - DNA, 24 bp, Artificial sequence
  SiRNA target sequence
caatttttcgacttatgggagaac

SEQ ID NO: 135295 - DNA, 24 bp, Artificial sequence
  SiRNA target sequence
aatttttcgacttatgggagaaca

SEQ ID NO: 135296 - DNA, 24 bp, Artificial sequence
  SiRNA target sequence
atttttcgacttatgggagaacag

SEQ ID NO: 135297 - DNA, 24 bp, Artificial sequence
  SiRNA target sequence
tttttcgacttatgggagaacaga

SEQ ID NO: 135298 - DNA, 24 bp, Artificial sequence
  SiRNA target sequence
ttttcgacttatgggagaacagac

SEQ ID NO: 135299 - DNA, 24 bp, Artificial sequence
  SiRNA target sequence
tttcgacttatgggagaacagaca

SEQ ID NO: 135300 - DNA, 24 bp, Artificial sequence
  SiRNA target sequence
ttcgacttatgggagaacagacaa

SEQ ID NO: 135301 - DNA, 24 bp, Artificial sequence
  SiRNA target sequence
tcgacttatgggagaacagacaat

SEQ ID NO: 135302 - DNA, 24 bp, Artificial sequence
  SiRNA target sequence
cgacttatgggagaacagacaata

SEQ ID NO: 135303 - DNA, 24 bp, Artificial sequence
  SiRNA target sequence
gacttatgggagaacagacaataa

SEQ ID NO: 135304 - DNA, 24 bp, Artificial sequence
  SiRNA target sequence
acttatgggagaacagacaataaa

SEQ ID NO: 135305 - DNA, 24 bp, Artificial sequence
  SiRNA target sequence
cttatgggagaacagacaataaat

SEQ ID NO: 135306 - DNA, 24 bp, Artificial sequence
  SiRNA target sequence
ttatgggagaacagacaataaatc

SEQ ID NO: 135307 - DNA, 24 bp, Artificial sequence
  SiRNA target sequence
tatgggagaacagacaataaatca

SEQ ID NO: 135308 - DNA, 24 bp, Artificial sequence
  SiRNA target sequence
atgggagaacagacaataaatcaa

SEQ ID NO: 135309 - DNA, 24 bp, Artificial sequence
  SiRNA target sequence
tgggagaacagacaataaatcaaa

SEQ ID NO: 135310 - DNA, 24 bp, Artificial sequence
  SiRNA target sequence
gggagaacagacaataaatcaaat

SEQ ID NO: 135311 - DNA, 24 bp, Artificial sequence
  SiRNA target sequence
ggagaacagacaataaatcaaatt

SEQ ID NO: 135312 - DNA, 24 bp, Artificial sequence
  SiRNA target sequence
gagaacagacaataaatcaaatta

SEQ ID NO: 135313 - DNA, 24 bp, Artificial sequence
  SiRNA target sequence
agaacagacaataaatcaaattat

SEQ ID NO: 135314 - DNA, 24 bp, Artificial sequence
  SiRNA target sequence
gaacagacaataaatcaaattata

SEQ ID NO: 135315 - DNA, 24 bp, Artificial sequence
  SiRNA target sequence
aacagacaataaatcaaattataa

SEQ ID NO: 135316 - DNA, 24 bp, Artificial sequence
  SiRNA target sequence
acagacaataaatcaaattataaa

SEQ ID NO: 135317 - DNA, 24 bp, Artificial sequence
  SiRNA target sequence
cagacaataaatcaaattataaaa

SEQ ID NO: 135318 - DNA, 24 bp, Artificial sequence
  SiRNA target sequence
agacaataaatcaaattataaaag

SEQ ID NO: 135319 - DNA, 24 bp, Artificial sequence
  SiRNA target sequence
gacaataaatcaaattataaaagt

SEQ ID NO: 135320 - DNA, 24 bp, Artificial sequence
  SiRNA target sequence
acaataaatcaaattataaaagtt

SEQ ID NO: 135321 - DNA, 24 bp, Artificial sequence
  SiRNA target sequence
caataaatcaaattataaaagttt

SEQ ID NO: 135322 - DNA, 24 bp, Artificial sequence
  SiRNA target sequence
aataaatcaaattataaaagtttt

SEQ ID NO: 135323 - DNA, 24 bp, Artificial sequence
  SiRNA target sequence
ataaatcaaattataaaagttttt

SEQ ID NO: 135324 - DNA, 24 bp, Artificial sequence
  SiRNA target sequence
taaatcaaattataaaagttttta

SEQ ID NO: 135325 - DNA, 24 bp, Artificial sequence
  SiRNA target sequence
aaatcaaattataaaagtttttaa

SEQ ID NO: 135326 - DNA, 24 bp, Artificial sequence
  SiRNA target sequence
aatcaaattataaaagtttttaat

SEQ ID NO: 135327 - DNA, 24 bp, Artificial sequence
  SiRNA target sequence
atcaaattataaaagtttttaata

SEQ ID NO: 135328 - DNA, 24 bp, Artificial sequence
  SiRNA target sequence
tcaaattataaaagtttttaatat

SEQ ID NO: 135329 - DNA, 24 bp, Artificial sequence
  SiRNA target sequence
caaattataaaagtttttaatata

SEQ ID NO: 135330 - DNA, 24 bp, Artificial sequence
  SiRNA target sequence
aaattataaaagtttttaatataa

SEQ ID NO: 135331 - DNA, 24 bp, Artificial sequence
  SiRNA target sequence
aattataaaagtttttaatataaa

SEQ ID NO: 135332 - DNA, 24 bp, Artificial sequence
  SiRNA target sequence
attataaaagtttttaatataaag

SEQ ID NO: 135333 - DNA, 24 bp, Artificial sequence
  SiRNA target sequence
ttataaaagtttttaatataaagt

SEQ ID NO: 135334 - DNA, 24 bp, Artificial sequence
  SiRNA target sequence
tataaaagtttttaatataaagtc

SEQ ID NO: 135335 - DNA, 24 bp, Artificial sequence
  SiRNA target sequence
ataaaagtttttaatataaagtct

SEQ ID NO: 135336 - DNA, 24 bp, Artificial sequence
  SiRNA target sequence
taaaagtttttaatataaagtcta

SEQ ID NO: 135337 - DNA, 24 bp, Artificial sequence
  SiRNA target sequence
aaaagtttttaatataaagtctaa

SEQ ID NO: 135338 - DNA, 24 bp, Artificial sequence
  SiRNA target sequence
aaagtttttaatataaagtctaat

SEQ ID NO: 135339 - DNA, 24 bp, Artificial sequence
  SiRNA target sequence
aagtttttaatataaagtctaata

SEQ ID NO: 135340 - DNA, 24 bp, Artificial sequence
  SiRNA target sequence
agtttttaatataaagtctaataa

SEQ ID NO: 135341 - DNA, 24 bp, Artificial sequence
  SiRNA target sequence
gtttttaatataaagtctaataaa

SEQ ID NO: 135342 - DNA, 24 bp, Artificial sequence
  SiRNA target sequence
tttttaatataaagtctaataaac

SEQ ID NO: 135343 - DNA, 24 bp, Artificial sequence
  SiRNA target sequence
ttttaatataaagtctaataaacc

SEQ ID NO: 135344 - DNA, 24 bp, Artificial sequence
  SiRNA target sequence
tttaatataaagtctaataaacca

SEQ ID NO: 135345 - DNA, 24 bp, Artificial sequence
  SiRNA target sequence
ttaatataaagtctaataaaccaa

SEQ ID NO: 135346 - DNA, 24 bp, Artificial sequence
  SiRNA target sequence
taatataaagtctaataaaccaag

SEQ ID NO: 135347 - DNA, 24 bp, Artificial sequence
  SiRNA target sequence
aatataaagtctaataaaccaagt

SEQ ID NO: 135348 - DNA, 24 bp, Artificial sequence
  SiRNA target sequence
atataaagtctaataaaccaagta

SEQ ID NO: 135349 - DNA, 24 bp, Artificial sequence
  SiRNA target sequence
tataaagtctaataaaccaagtat

SEQ ID NO: 135350 - DNA, 24 bp, Artificial sequence
  SiRNA target sequence
ataaagtctaataaaccaagtata

SEQ ID NO: 135351 - DNA, 24 bp, Artificial sequence
  SiRNA target sequence
taaagtctaataaaccaagtataa

SEQ ID NO: 135352 - DNA, 24 bp, Artificial sequence
  SiRNA target sequence
aaagtctaataaaccaagtataac

SEQ ID NO: 135353 - DNA, 24 bp, Artificial sequence
  SiRNA target sequence
aagtctaataaaccaagtataaca

SEQ ID NO: 135354 - DNA, 24 bp, Artificial sequence
  SiRNA target sequence
agtctaataaaccaagtataacac

SEQ ID NO: 135355 - DNA, 24 bp, Artificial sequence
  SiRNA target sequence
gtctaataaaccaagtataacaca

SEQ ID NO: 135356 - DNA, 24 bp, Artificial sequence
  SiRNA target sequence
tctaataaaccaagtataacacaa

SEQ ID NO: 135357 - DNA, 24 bp, Artificial sequence
  SiRNA target sequence
ctaataaaccaagtataacacaat

SEQ ID NO: 135358 - DNA, 24 bp, Artificial sequence
  SiRNA target sequence
taataaaccaagtataacacaata

SEQ ID NO: 135359 - DNA, 24 bp, Artificial sequence
  SiRNA target sequence
aataaaccaagtataacacaatat

SEQ ID NO: 135360 - DNA, 24 bp, Artificial sequence
  SiRNA target sequence
ataaaccaagtataacacaatatc

SEQ ID NO: 135361 - DNA, 24 bp, Artificial sequence
  SiRNA target sequence
taaaccaagtataacacaatatct

SEQ ID NO: 135362 - DNA, 24 bp, Artificial sequence
  SiRNA target sequence
aaaccaagtataacacaatatctt

SEQ ID NO: 135363 - DNA, 24 bp, Artificial sequence
  SiRNA target sequence
aaccaagtataacacaatatcttc

SEQ ID NO: 135364 - DNA, 24 bp, Artificial sequence
  SiRNA target sequence
accaagtataacacaatatcttcc

SEQ ID NO: 135365 - DNA, 24 bp, Artificial sequence
  SiRNA target sequence
ccaagtataacacaatatcttcct

SEQ ID NO: 135366 - DNA, 24 bp, Artificial sequence
  SiRNA target sequence
caagtataacacaatatcttcctg

SEQ ID NO: 135367 - DNA, 24 bp, Artificial sequence
  SiRNA target sequence
aagtataacacaatatcttcctgt

SEQ ID NO: 135368 - DNA, 24 bp, Artificial sequence
  SiRNA target sequence
agtataacacaatatcttcctgtt

SEQ ID NO: 135369 - DNA, 24 bp, Artificial sequence
  SiRNA target sequence
gtataacacaatatcttcctgttt

SEQ ID NO: 135370 - DNA, 24 bp, Artificial sequence
  SiRNA target sequence
tataacacaatatcttcctgtttt

SEQ ID NO: 135371 - DNA, 24 bp, Artificial sequence
  SiRNA target sequence
ataacacaatatcttcctgttttg

SEQ ID NO: 135372 - DNA, 24 bp, Artificial sequence
  SiRNA target sequence
taacacaatatcttcctgttttgg

SEQ ID NO: 135373 - DNA, 24 bp, Artificial sequence
  SiRNA target sequence
aacacaatatcttcctgttttggg

SEQ ID NO: 135374 - DNA, 24 bp, Artificial sequence
  SiRNA target sequence
acacaatatcttcctgttttggga

SEQ ID NO: 135375 - DNA, 24 bp, Artificial sequence
  SiRNA target sequence
cacaatatcttcctgttttgggat

SEQ ID NO: 135376 - DNA, 24 bp, Artificial sequence
  SiRNA target sequence
acaatatcttcctgttttgggatc

SEQ ID NO: 135377 - DNA, 24 bp, Artificial sequence
  SiRNA target sequence
caatatcttcctgttttgggatca

SEQ ID NO: 135378 - DNA, 24 bp, Artificial sequence
  SiRNA target sequence
aatatcttcctgttttgggatcac

SEQ ID NO: 135379 - DNA, 24 bp, Artificial sequence
  SiRNA target sequence
atatcttcctgttttgggatcaca

SEQ ID NO: 135380 - DNA, 24 bp, Artificial sequence
  SiRNA target sequence
tatcttcctgttttgggatcacag

SEQ ID NO: 135381 - DNA, 24 bp, Artificial sequence
  SiRNA target sequence
atcttcctgttttgggatcacagg

SEQ ID NO: 135382 - DNA, 24 bp, Artificial sequence
  SiRNA target sequence
tcttcctgttttgggatcacaggg

SEQ ID NO: 135383 - DNA, 24 bp, Artificial sequence
  SiRNA target sequence
cttcctgttttgggatcacaggga

SEQ ID NO: 135384 - DNA, 24 bp, Artificial sequence
  SiRNA target sequence
ttcctgttttgggatcacagggat

SEQ ID NO: 135385 - DNA, 24 bp, Artificial sequence
  SiRNA target sequence
tcctgttttgggatcacagggata

SEQ ID NO: 135386 - DNA, 24 bp, Artificial sequence
  SiRNA target sequence
cctgttttgggatcacagggatat

SEQ ID NO: 135387 - DNA, 24 bp, Artificial sequence
  SiRNA target sequence
ctgttttgggatcacagggatata

SEQ ID NO: 135388 - DNA, 24 bp, Artificial sequence
  SiRNA target sequence
tgttttgggatcacagggatatac

SEQ ID NO: 135389 - DNA, 24 bp, Artificial sequence
  SiRNA target sequence
gttttgggatcacagggatatact

SEQ ID NO: 135390 - DNA, 24 bp, Artificial sequence
  SiRNA target sequence
ttttgggatcacagggatatacta

SEQ ID NO: 135391 - DNA, 24 bp, Artificial sequence
  SiRNA target sequence
tttgggatcacagggatatactaa

SEQ ID NO: 135392 - DNA, 24 bp, Artificial sequence
  SiRNA target sequence
ttgggatcacagggatatactaaa

SEQ ID NO: 135393 - DNA, 24 bp, Artificial sequence
  SiRNA target sequence
tgggatcacagggatatactaaag

SEQ ID NO: 135394 - DNA, 24 bp, Artificial sequence
  SiRNA target sequence
gggatcacagggatatactaaagc

SEQ ID NO: 135395 - DNA, 24 bp, Artificial sequence
  SiRNA target sequence
ggatcacagggatatactaaagct

SEQ ID NO: 135396 - DNA, 24 bp, Artificial sequence
  SiRNA target sequence
gatcacagggatatactaaagcta

SEQ ID NO: 135397 - DNA, 24 bp, Artificial sequence
  SiRNA target sequence
atcacagggatatactaaagctac

SEQ ID NO: 135398 - DNA, 24 bp, Artificial sequence
  SiRNA target sequence
tcacagggatatactaaagctaca

SEQ ID NO: 135399 - DNA, 24 bp, Artificial sequence
  SiRNA target sequence
cacagggatatactaaagctacag

SEQ ID NO: 135400 - DNA, 24 bp, Artificial sequence
  SiRNA target sequence
acagggatatactaaagctacaga

SEQ ID NO: 135401 - DNA, 24 bp, Artificial sequence
  SiRNA target sequence
cagggatatactaaagctacagaa

SEQ ID NO: 135402 - DNA, 24 bp, Artificial sequence
  SiRNA target sequence
agggatatactaaagctacagaat

SEQ ID NO: 135403 - DNA, 24 bp, Artificial sequence
  SiRNA target sequence
gggatatactaaagctacagaatt

SEQ ID NO: 135404 - DNA, 24 bp, Artificial sequence
  SiRNA target sequence
ggatatactaaagctacagaattt

SEQ ID NO: 135405 - DNA, 24 bp, Artificial sequence
  SiRNA target sequence
gatatactaaagctacagaatttg

SEQ ID NO: 135406 - DNA, 24 bp, Artificial sequence
  SiRNA target sequence
atatactaaagctacagaatttga

SEQ ID NO: 135407 - DNA, 24 bp, Artificial sequence
  SiRNA target sequence
tatactaaagctacagaatttgat

SEQ ID NO: 135408 - DNA, 24 bp, Artificial sequence
  SiRNA target sequence
atactaaagctacagaatttgatt

SEQ ID NO: 135409 - DNA, 24 bp, Artificial sequence
  SiRNA target sequence
tactaaagctacagaatttgattt

SEQ ID NO: 135410 - DNA, 24 bp, Artificial sequence
  SiRNA target sequence
actaaagctacagaatttgatttg

SEQ ID NO: 135411 - DNA, 24 bp, Artificial sequence
  SiRNA target sequence
ctaaagctacagaatttgatttgg

SEQ ID NO: 135412 - DNA, 24 bp, Artificial sequence
  SiRNA target sequence
taaagctacagaatttgatttggc

SEQ ID NO: 135413 - DNA, 24 bp, Artificial sequence
  SiRNA target sequence
aaagctacagaatttgatttggca

SEQ ID NO: 135414 - DNA, 24 bp, Artificial sequence
  SiRNA target sequence
aagctacagaatttgatttggcac

SEQ ID NO: 135415 - DNA, 24 bp, Artificial sequence
  SiRNA target sequence
agctacagaatttgatttggcact

SEQ ID NO: 135416 - DNA, 24 bp, Artificial sequence
  SiRNA target sequence
gctacagaatttgatttggcactt

SEQ ID NO: 135417 - DNA, 24 bp, Artificial sequence
  SiRNA target sequence
ctacagaatttgatttggcactta

SEQ ID NO: 135418 - DNA, 24 bp, Artificial sequence
  SiRNA target sequence
tacagaatttgatttggcacttac

SEQ ID NO: 135419 - DNA, 24 bp, Artificial sequence
  SiRNA target sequence
acagaatttgatttggcacttact

SEQ ID NO: 135420 - DNA, 24 bp, Artificial sequence
  SiRNA target sequence
cagaatttgatttggcacttactt

SEQ ID NO: 135421 - DNA, 24 bp, Artificial sequence
  SiRNA target sequence
agaatttgatttggcacttacttt

SEQ ID NO: 135422 - DNA, 24 bp, Artificial sequence
  SiRNA target sequence
gaatttgatttggcacttacttta

SEQ ID NO: 135423 - DNA, 24 bp, Artificial sequence
  SiRNA target sequence
aatttgatttggcacttactttaa

SEQ ID NO: 135424 - DNA, 24 bp, Artificial sequence
  SiRNA target sequence
atttgatttggcacttactttaaa

SEQ ID NO: 135425 - DNA, 24 bp, Artificial sequence
  SiRNA target sequence
tttgatttggcacttactttaaat

SEQ ID NO: 135426 - DNA, 24 bp, Artificial sequence
  SiRNA target sequence
ttgatttggcacttactttaaata

SEQ ID NO: 135427 - DNA, 24 bp, Artificial sequence
  SiRNA target sequence
tgatttggcacttactttaaatat

SEQ ID NO: 135428 - DNA, 24 bp, Artificial sequence
  SiRNA target sequence
gatttggcacttactttaaatatt

SEQ ID NO: 135429 - DNA, 24 bp, Artificial sequence
  SiRNA target sequence
atttggcacttactttaaatattc

SEQ ID NO: 135430 - DNA, 24 bp, Artificial sequence
  SiRNA target sequence
tttggcacttactttaaatattcc

SEQ ID NO: 135431 - DNA, 24 bp, Artificial sequence
  SiRNA target sequence
ttggcacttactttaaatattcca

SEQ ID NO: 135432 - DNA, 24 bp, Artificial sequence
  SiRNA target sequence
tggcacttactttaaatattccag

SEQ ID NO: 135433 - DNA, 24 bp, Artificial sequence
  SiRNA target sequence
ggcacttactttaaatattccaga

SEQ ID NO: 135434 - DNA, 24 bp, Artificial sequence
  SiRNA target sequence
gcacttactttaaatattccagaa

SEQ ID NO: 135435 - DNA, 24 bp, Artificial sequence
  SiRNA target sequence
cacttactttaaatattccagaag

SEQ ID NO: 135436 - DNA, 24 bp, Artificial sequence
  SiRNA target sequence
acttactttaaatattccagaaga

SEQ ID NO: 135437 - DNA, 24 bp, Artificial sequence
  SiRNA target sequence
cttactttaaatattccagaagat

SEQ ID NO: 135438 - DNA, 24 bp, Artificial sequence
  SiRNA target sequence
ttactttaaatattccagaagata

SEQ ID NO: 135439 - DNA, 24 bp, Artificial sequence
  SiRNA target sequence
tactttaaatattccagaagatat

SEQ ID NO: 135440 - DNA, 24 bp, Artificial sequence
  SiRNA target sequence
actttaaatattccagaagatata

SEQ ID NO: 135441 - DNA, 24 bp, Artificial sequence
  SiRNA target sequence
ctttaaatattccagaagatatag

SEQ ID NO: 135442 - DNA, 24 bp, Artificial sequence
  SiRNA target sequence
tttaaatattccagaagatatagc

SEQ ID NO: 135443 - DNA, 24 bp, Artificial sequence
  SiRNA target sequence
ttaaatattccagaagatatagct

SEQ ID NO: 135444 - DNA, 24 bp, Artificial sequence
  SiRNA target sequence
taaatattccagaagatatagcta

SEQ ID NO: 135445 - DNA, 24 bp, Artificial sequence
  SiRNA target sequence
aaatattccagaagatatagctaa

SEQ ID NO: 135446 - DNA, 24 bp, Artificial sequence
  SiRNA target sequence
aatattccagaagatatagctaag

SEQ ID NO: 135447 - DNA, 24 bp, Artificial sequence
  SiRNA target sequence
atattccagaagatatagctaagc

SEQ ID NO: 135448 - DNA, 24 bp, Artificial sequence
  SiRNA target sequence
tattccagaagatatagctaagca

SEQ ID NO: 135449 - DNA, 24 bp, Artificial sequence
  SiRNA target sequence
attccagaagatatagctaagcat

SEQ ID NO: 135450 - DNA, 24 bp, Artificial sequence
  SiRNA target sequence
ttccagaagatatagctaagcatt

SEQ ID NO: 135451 - DNA, 24 bp, Artificial sequence
  SiRNA target sequence
tccagaagatatagctaagcattt

SEQ ID NO: 135452 - DNA, 24 bp, Artificial sequence
  SiRNA target sequence
ccagaagatatagctaagcattta

SEQ ID NO: 135453 - DNA, 24 bp, Artificial sequence
  SiRNA target sequence
cagaagatatagctaagcatttag

SEQ ID NO: 135454 - DNA, 24 bp, Artificial sequence
  SiRNA target sequence
agaagatatagctaagcatttagc

SEQ ID NO: 135455 - DNA, 24 bp, Artificial sequence
  SiRNA target sequence
gaagatatagctaagcatttagct

SEQ ID NO: 135456 - DNA, 24 bp, Artificial sequence
  SiRNA target sequence
aagatatagctaagcatttagcta

SEQ ID NO: 135457 - DNA, 24 bp, Artificial sequence
  SiRNA target sequence
agatatagctaagcatttagctac

SEQ ID NO: 135458 - DNA, 24 bp, Artificial sequence
  SiRNA target sequence
gatatagctaagcatttagctaca

SEQ ID NO: 135459 - DNA, 24 bp, Artificial sequence
  SiRNA target sequence
atatagctaagcatttagctacaa

SEQ ID NO: 135460 - DNA, 24 bp, Artificial sequence
  SiRNA target sequence
tatagctaagcatttagctacaac

SEQ ID NO: 135461 - DNA, 24 bp, Artificial sequence
  SiRNA target sequence
atagctaagcatttagctacaact

SEQ ID NO: 135462 - DNA, 24 bp, Artificial sequence
  SiRNA target sequence
tagctaagcatttagctacaactt

SEQ ID NO: 135463 - DNA, 24 bp, Artificial sequence
  SiRNA target sequence
agctaagcatttagctacaactta

SEQ ID NO: 135464 - DNA, 24 bp, Artificial sequence
  SiRNA target sequence
gctaagcatttagctacaacttat

SEQ ID NO: 135465 - DNA, 24 bp, Artificial sequence
  SiRNA target sequence
ctaagcatttagctacaacttatg

SEQ ID NO: 135466 - DNA, 24 bp, Artificial sequence
  SiRNA target sequence
taagcatttagctacaacttatgg

SEQ ID NO: 135467 - DNA, 24 bp, Artificial sequence
  SiRNA target sequence
aagcatttagctacaacttatggt

SEQ ID NO: 135468 - DNA, 24 bp, Artificial sequence
  SiRNA target sequence
agcatttagctacaacttatggta

SEQ ID NO: 135469 - DNA, 24 bp, Artificial sequence
  SiRNA target sequence
gcatttagctacaacttatggtac

SEQ ID NO: 135470 - DNA, 24 bp, Artificial sequence
  SiRNA target sequence
catttagctacaacttatggtacc

SEQ ID NO: 135471 - DNA, 24 bp, Artificial sequence
  SiRNA target sequence
atttagctacaacttatggtacca

SEQ ID NO: 135472 - DNA, 24 bp, Artificial sequence
  SiRNA target sequence
tttagctacaacttatggtaccaa

SEQ ID NO: 135473 - DNA, 24 bp, Artificial sequence
  SiRNA target sequence
ttagctacaacttatggtaccaaa

SEQ ID NO: 135474 - DNA, 24 bp, Artificial sequence
  SiRNA target sequence
tagctacaacttatggtaccaaag

SEQ ID NO: 135475 - DNA, 24 bp, Artificial sequence
  SiRNA target sequence
agctacaacttatggtaccaaagc

SEQ ID NO: 135476 - DNA, 24 bp, Artificial sequence
  SiRNA target sequence
gctacaacttatggtaccaaagct

SEQ ID NO: 135477 - DNA, 24 bp, Artificial sequence
  SiRNA target sequence
ctacaacttatggtaccaaagctt

SEQ ID NO: 135478 - DNA, 24 bp, Artificial sequence
  SiRNA target sequence
tacaacttatggtaccaaagctta

SEQ ID NO: 135479 - DNA, 24 bp, Artificial sequence
  SiRNA target sequence
acaacttatggtaccaaagcttac

SEQ ID NO: 135480 - DNA, 24 bp, Artificial sequence
  SiRNA target sequence
caacttatggtaccaaagcttaca

SEQ ID NO: 135481 - DNA, 24 bp, Artificial sequence
  SiRNA target sequence
aacttatggtaccaaagcttacaa

SEQ ID NO: 135482 - DNA, 24 bp, Artificial sequence
  SiRNA target sequence
acttatggtaccaaagcttacaat

SEQ ID NO: 135483 - DNA, 24 bp, Artificial sequence
  SiRNA target sequence
cttatggtaccaaagcttacaatt

SEQ ID NO: 135484 - DNA, 24 bp, Artificial sequence
  SiRNA target sequence
ttatggtaccaaagcttacaattt

SEQ ID NO: 135485 - DNA, 24 bp, Artificial sequence
  SiRNA target sequence
tatggtaccaaagcttacaatttc

SEQ ID NO: 135486 - DNA, 24 bp, Artificial sequence
  SiRNA target sequence
atggtaccaaagcttacaatttct

SEQ ID NO: 135487 - DNA, 24 bp, Artificial sequence
  SiRNA target sequence
tggtaccaaagcttacaatttctc

SEQ ID NO: 135488 - DNA, 24 bp, Artificial sequence
  SiRNA target sequence
ggtaccaaagcttacaatttctct

SEQ ID NO: 135489 - DNA, 24 bp, Artificial sequence
  SiRNA target sequence
gtaccaaagcttacaatttctctg

SEQ ID NO: 135490 - DNA, 24 bp, Artificial sequence
  SiRNA target sequence
taccaaagcttacaatttctctga

SEQ ID NO: 135491 - DNA, 24 bp, Artificial sequence
  SiRNA target sequence
accaaagcttacaatttctctgaa

SEQ ID NO: 135492 - DNA, 24 bp, Artificial sequence
  SiRNA target sequence
ccaaagcttacaatttctctgaat

SEQ ID NO: 135493 - DNA, 24 bp, Artificial sequence
  SiRNA target sequence
caaagcttacaatttctctgaata

SEQ ID NO: 135494 - DNA, 24 bp, Artificial sequence
  SiRNA target sequence
aaagcttacaatttctctgaatac

SEQ ID NO: 135495 - DNA, 24 bp, Artificial sequence
  SiRNA target sequence
aagcttacaatttctctgaatact

SEQ ID NO: 135496 - DNA, 24 bp, Artificial sequence
  SiRNA target sequence
agcttacaatttctctgaatactt

SEQ ID NO: 135497 - DNA, 24 bp, Artificial sequence
  SiRNA target sequence
gcttacaatttctctgaatacttt

SEQ ID NO: 135498 - DNA, 24 bp, Artificial sequence
  SiRNA target sequence
cttacaatttctctgaatacttta

SEQ ID NO: 135499 - DNA, 24 bp, Artificial sequence
  SiRNA target sequence
ttacaatttctctgaatactttaa

SEQ ID NO: 135500 - DNA, 24 bp, Artificial sequence
  SiRNA target sequence
tacaatttctctgaatactttaat

SEQ ID NO: 135501 - DNA, 24 bp, Artificial sequence
  SiRNA target sequence
acaatttctctgaatactttaatg

SEQ ID NO: 135502 - DNA, 24 bp, Artificial sequence
  SiRNA target sequence
caatttctctgaatactttaatgg

SEQ ID NO: 135503 - DNA, 24 bp, Artificial sequence
  SiRNA target sequence
aatttctctgaatactttaatggg

SEQ ID NO: 135504 - DNA, 24 bp, Artificial sequence
  SiRNA target sequence
atttctctgaatactttaatgggt

SEQ ID NO: 135505 - DNA, 24 bp, Artificial sequence
  SiRNA target sequence
tttctctgaatactttaatgggtc

SEQ ID NO: 135506 - DNA, 24 bp, Artificial sequence
  SiRNA target sequence
ttctctgaatactttaatgggtca

SEQ ID NO: 135507 - DNA, 24 bp, Artificial sequence
  SiRNA target sequence
tctctgaatactttaatgggtcat

SEQ ID NO: 135508 - DNA, 24 bp, Artificial sequence
  SiRNA target sequence
ctctgaatactttaatgggtcata

SEQ ID NO: 135509 - DNA, 24 bp, Artificial sequence
  SiRNA target sequence
tctgaatactttaatgggtcatac

SEQ ID NO: 135510 - DNA, 24 bp, Artificial sequence
  SiRNA target sequence
ctgaatactttaatgggtcataca

SEQ ID NO: 135511 - DNA, 24 bp, Artificial sequence
  SiRNA target sequence
tgaatactttaatgggtcatacac

SEQ ID NO: 135512 - DNA, 24 bp, Artificial sequence
  SiRNA target sequence
gaatactttaatgggtcatacacc

SEQ ID NO: 135513 - DNA, 24 bp, Artificial sequence
  SiRNA target sequence
aatactttaatgggtcatacacca

SEQ ID NO: 135514 - DNA, 24 bp, Artificial sequence
  SiRNA target sequence
atactttaatgggtcatacaccag

SEQ ID NO: 135515 - DNA, 24 bp, Artificial sequence
  SiRNA target sequence
tactttaatgggtcatacaccaga

SEQ ID NO: 135516 - DNA, 24 bp, Artificial sequence
  SiRNA target sequence
actttaatgggtcatacaccagac

SEQ ID NO: 135517 - DNA, 24 bp, Artificial sequence
  SiRNA target sequence
ctttaatgggtcatacaccagact

SEQ ID NO: 135518 - DNA, 24 bp, Artificial sequence
  SiRNA target sequence
tttaatgggtcatacaccagactt

SEQ ID NO: 135519 - DNA, 24 bp, Artificial sequence
  SiRNA target sequence
ttaatgggtcatacaccagactta

SEQ ID NO: 135520 - DNA, 24 bp, Artificial sequence
  SiRNA target sequence
taatgggtcatacaccagacttac

SEQ ID NO: 135521 - DNA, 24 bp, Artificial sequence
  SiRNA target sequence
aatgggtcatacaccagacttaca

SEQ ID NO: 135522 - DNA, 24 bp, Artificial sequence
  SiRNA target sequence
atgggtcatacaccagacttacag

SEQ ID NO: 135523 - DNA, 24 bp, Artificial sequence
  SiRNA target sequence
tgggtcatacaccagacttacaga

SEQ ID NO: 135524 - DNA, 24 bp, Artificial sequence
  SiRNA target sequence
gggtcatacaccagacttacagat

SEQ ID NO: 135525 - DNA, 24 bp, Artificial sequence
  SiRNA target sequence
ggtcatacaccagacttacagatg

SEQ ID NO: 135526 - DNA, 24 bp, Artificial sequence
  SiRNA target sequence
gtcatacaccagacttacagatgg

SEQ ID NO: 135527 - DNA, 24 bp, Artificial sequence
  SiRNA target sequence
tcatacaccagacttacagatggt

SEQ ID NO: 135528 - DNA, 24 bp, Artificial sequence
  SiRNA target sequence
catacaccagacttacagatggtt

SEQ ID NO: 135529 - DNA, 24 bp, Artificial sequence
  SiRNA target sequence
atacaccagacttacagatggtta

SEQ ID NO: 135530 - DNA, 24 bp, Artificial sequence
  SiRNA target sequence
tacaccagacttacagatggttat

SEQ ID NO: 135531 - DNA, 24 bp, Artificial sequence
  SiRNA target sequence
acaccagacttacagatggttatc

SEQ ID NO: 135532 - DNA, 24 bp, Artificial sequence
  SiRNA target sequence
caccagacttacagatggttatcc

SEQ ID NO: 135533 - DNA, 24 bp, Artificial sequence
  SiRNA target sequence
accagacttacagatggttatcct

SEQ ID NO: 135534 - DNA, 24 bp, Artificial sequence
  SiRNA target sequence
ccagacttacagatggttatcctt

SEQ ID NO: 135535 - DNA, 24 bp, Artificial sequence
  SiRNA target sequence
cagacttacagatggttatcctta

SEQ ID NO: 135536 - DNA, 24 bp, Artificial sequence
  SiRNA target sequence
agacttacagatggttatccttat

SEQ ID NO: 135537 - DNA, 24 bp, Artificial sequence
  SiRNA target sequence
gacttacagatggttatccttata

SEQ ID NO: 135538 - DNA, 24 bp, Artificial sequence
  SiRNA target sequence
acttacagatggttatccttatac

SEQ ID NO: 135539 - DNA, 24 bp, Artificial sequence
  SiRNA target sequence
cttacagatggttatccttataca

SEQ ID NO: 135540 - DNA, 24 bp, Artificial sequence
  SiRNA target sequence
ttacagatggttatccttatacaa

SEQ ID NO: 135541 - DNA, 24 bp, Artificial sequence
  SiRNA target sequence
tacagatggttatccttatacaaa

SEQ ID NO: 135542 - DNA, 24 bp, Artificial sequence
  SiRNA target sequence
acagatggttatccttatacaaaa

SEQ ID NO: 135543 - DNA, 24 bp, Artificial sequence
  SiRNA target sequence
cagatggttatccttatacaaaag

SEQ ID NO: 135544 - DNA, 24 bp, Artificial sequence
  SiRNA target sequence
agatggttatccttatacaaaaga

SEQ ID NO: 135545 - DNA, 24 bp, Artificial sequence
  SiRNA target sequence
gatggttatccttatacaaaagaa

SEQ ID NO: 135546 - DNA, 24 bp, Artificial sequence
  SiRNA target sequence
atggttatccttatacaaaagaag

SEQ ID NO: 135547 - DNA, 24 bp, Artificial sequence
  SiRNA target sequence
tggttatccttatacaaaagaaga

SEQ ID NO: 135548 - DNA, 24 bp, Artificial sequence
  SiRNA target sequence
ggttatccttatacaaaagaagaa

SEQ ID NO: 135549 - DNA, 24 bp, Artificial sequence
  SiRNA target sequence
gttatccttatacaaaagaagaaa

SEQ ID NO: 135550 - DNA, 24 bp, Artificial sequence
  SiRNA target sequence
ttatccttatacaaaagaagaaat

SEQ ID NO: 135551 - DNA, 24 bp, Artificial sequence
  SiRNA target sequence
tatccttatacaaaagaagaaata

SEQ ID NO: 135552 - DNA, 24 bp, Artificial sequence
  SiRNA target sequence
atccttatacaaaagaagaaatag

SEQ ID NO: 135553 - DNA, 24 bp, Artificial sequence
  SiRNA target sequence
tccttatacaaaagaagaaatagt

SEQ ID NO: 135554 - DNA, 24 bp, Artificial sequence
  SiRNA target sequence
ccttatacaaaagaagaaatagta

SEQ ID NO: 135555 - DNA, 24 bp, Artificial sequence
  SiRNA target sequence
cttatacaaaagaagaaatagtat

SEQ ID NO: 135556 - DNA, 24 bp, Artificial sequence
  SiRNA target sequence
ttatacaaaagaagaaatagtata

SEQ ID NO: 135557 - DNA, 24 bp, Artificial sequence
  SiRNA target sequence
tatacaaaagaagaaatagtatat

SEQ ID NO: 135558 - DNA, 24 bp, Artificial sequence
  SiRNA target sequence
atacaaaagaagaaatagtatatt

SEQ ID NO: 135559 - DNA, 24 bp, Artificial sequence
  SiRNA target sequence
tacaaaagaagaaatagtatattg

SEQ ID NO: 135560 - DNA, 24 bp, Artificial sequence
  SiRNA target sequence
acaaaagaagaaatagtatattgt

SEQ ID NO: 135561 - DNA, 24 bp, Artificial sequence
  SiRNA target sequence
caaaagaagaaatagtatattgta

SEQ ID NO: 135562 - DNA, 24 bp, Artificial sequence
  SiRNA target sequence
aaaagaagaaatagtatattgtat

SEQ ID NO: 135563 - DNA, 24 bp, Artificial sequence
  SiRNA target sequence
aaagaagaaatagtatattgtatc

SEQ ID NO: 135564 - DNA, 24 bp, Artificial sequence
  SiRNA target sequence
aagaagaaatagtatattgtatcg

SEQ ID NO: 135565 - DNA, 24 bp, Artificial sequence
  SiRNA target sequence
agaagaaatagtatattgtatcga

SEQ ID NO: 135566 - DNA, 24 bp, Artificial sequence
  SiRNA target sequence
gaagaaatagtatattgtatcgaa

SEQ ID NO: 135567 - DNA, 24 bp, Artificial sequence
  SiRNA target sequence
aagaaatagtatattgtatcgaac

SEQ ID NO: 135568 - DNA, 24 bp, Artificial sequence
  SiRNA target sequence
agaaatagtatattgtatcgaaca

SEQ ID NO: 135569 - DNA, 24 bp, Artificial sequence
  SiRNA target sequence
gaaatagtatattgtatcgaacat

SEQ ID NO: 135570 - DNA, 24 bp, Artificial sequence
  SiRNA target sequence
aaatagtatattgtatcgaacatg

SEQ ID NO: 135571 - DNA, 24 bp, Artificial sequence
  SiRNA target sequence
aatagtatattgtatcgaacatga

SEQ ID NO: 135572 - DNA, 24 bp, Artificial sequence
  SiRNA target sequence
atagtatattgtatcgaacatgaa

SEQ ID NO: 135573 - DNA, 24 bp, Artificial sequence
  SiRNA target sequence
tagtatattgtatcgaacatgaat

SEQ ID NO: 135574 - DNA, 24 bp, Artificial sequence
  SiRNA target sequence
agtatattgtatcgaacatgaatt

SEQ ID NO: 135575 - DNA, 24 bp, Artificial sequence
  SiRNA target sequence
gtatattgtatcgaacatgaattg

SEQ ID NO: 135576 - DNA, 24 bp, Artificial sequence
  SiRNA target sequence
tatattgtatcgaacatgaattgg

SEQ ID NO: 135577 - DNA, 24 bp, Artificial sequence
  SiRNA target sequence
atattgtatcgaacatgaattggc

SEQ ID NO: 135578 - DNA, 24 bp, Artificial sequence
  SiRNA target sequence
tattgtatcgaacatgaattggct

SEQ ID NO: 135579 - DNA, 24 bp, Artificial sequence
  SiRNA target sequence
attgtatcgaacatgaattggctt

SEQ ID NO: 135580 - DNA, 24 bp, Artificial sequence
  SiRNA target sequence
ttgtatcgaacatgaattggctta

SEQ ID NO: 135581 - DNA, 24 bp, Artificial sequence
  SiRNA target sequence
tgtatcgaacatgaattggcttat

SEQ ID NO: 135582 - DNA, 24 bp, Artificial sequence
  SiRNA target sequence
gtatcgaacatgaattggcttatc

SEQ ID NO: 135583 - DNA, 24 bp, Artificial sequence
  SiRNA target sequence
tatcgaacatgaattggcttatcg

SEQ ID NO: 135584 - DNA, 24 bp, Artificial sequence
  SiRNA target sequence
atcgaacatgaattggcttatcgc

SEQ ID NO: 135585 - DNA, 24 bp, Artificial sequence
  SiRNA target sequence
tcgaacatgaattggcttatcgca

SEQ ID NO: 135586 - DNA, 24 bp, Artificial sequence
  SiRNA target sequence
cgaacatgaattggcttatcgcat

SEQ ID NO: 135587 - DNA, 24 bp, Artificial sequence
  SiRNA target sequence
gaacatgaattggcttatcgcatc

SEQ ID NO: 135588 - DNA, 24 bp, Artificial sequence
  SiRNA target sequence
aacatgaattggcttatcgcatca

SEQ ID NO: 135589 - DNA, 24 bp, Artificial sequence
  SiRNA target sequence
acatgaattggcttatcgcatcag

SEQ ID NO: 135590 - DNA, 24 bp, Artificial sequence
  SiRNA target sequence
catgaattggcttatcgcatcagt

SEQ ID NO: 135591 - DNA, 24 bp, Artificial sequence
  SiRNA target sequence
atgaattggcttatcgcatcagtg

SEQ ID NO: 135592 - DNA, 24 bp, Artificial sequence
  SiRNA target sequence
tgaattggcttatcgcatcagtga

SEQ ID NO: 135593 - DNA, 24 bp, Artificial sequence
  SiRNA target sequence
gaattggcttatcgcatcagtgat

SEQ ID NO: 135594 - DNA, 24 bp, Artificial sequence
  SiRNA target sequence
aattggcttatcgcatcagtgata

SEQ ID NO: 135595 - DNA, 24 bp, Artificial sequence
  SiRNA target sequence
attggcttatcgcatcagtgatat

SEQ ID NO: 135596 - DNA, 24 bp, Artificial sequence
  SiRNA target sequence
ttggcttatcgcatcagtgatata

SEQ ID NO: 135597 - DNA, 24 bp, Artificial sequence
  SiRNA target sequence
tggcttatcgcatcagtgatatat

SEQ ID NO: 135598 - DNA, 24 bp, Artificial sequence
  SiRNA target sequence
ggcttatcgcatcagtgatatatt

SEQ ID NO: 135599 - DNA, 24 bp, Artificial sequence
  SiRNA target sequence
gcttatcgcatcagtgatatatta

SEQ ID NO: 135600 - DNA, 24 bp, Artificial sequence
  SiRNA target sequence
cttatcgcatcagtgatatattat

SEQ ID NO: 135601 - DNA, 24 bp, Artificial sequence
  SiRNA target sequence
ttatcgcatcagtgatatattatt

SEQ ID NO: 135602 - DNA, 24 bp, Artificial sequence
  SiRNA target sequence
tatcgcatcagtgatatattattt

SEQ ID NO: 135603 - DNA, 24 bp, Artificial sequence
  SiRNA target sequence
atcgcatcagtgatatattattta

SEQ ID NO: 135604 - DNA, 24 bp, Artificial sequence
  SiRNA target sequence
tcgcatcagtgatatattatttaa

SEQ ID NO: 135605 - DNA, 24 bp, Artificial sequence
  SiRNA target sequence
cgcatcagtgatatattatttaat

SEQ ID NO: 135606 - DNA, 24 bp, Artificial sequence
  SiRNA target sequence
gcatcagtgatatattatttaata

SEQ ID NO: 135607 - DNA, 24 bp, Artificial sequence
  SiRNA target sequence
catcagtgatatattatttaatag

SEQ ID NO: 135608 - DNA, 24 bp, Artificial sequence
  SiRNA target sequence
atcagtgatatattatttaatagg

SEQ ID NO: 135609 - DNA, 24 bp, Artificial sequence
  SiRNA target sequence
tcagtgatatattatttaatagga

SEQ ID NO: 135610 - DNA, 24 bp, Artificial sequence
  SiRNA target sequence
cagtgatatattatttaataggat

SEQ ID NO: 135611 - DNA, 24 bp, Artificial sequence
  SiRNA target sequence
agtgatatattatttaataggatg

SEQ ID NO: 135612 - DNA, 24 bp, Artificial sequence
  SiRNA target sequence
gtgatatattatttaataggatga

SEQ ID NO: 135613 - DNA, 24 bp, Artificial sequence
  SiRNA target sequence
tgatatattatttaataggatgat

SEQ ID NO: 135614 - DNA, 24 bp, Artificial sequence
  SiRNA target sequence
gatatattatttaataggatgatg

SEQ ID NO: 135615 - DNA, 24 bp, Artificial sequence
  SiRNA target sequence
atatattatttaataggatgatga

SEQ ID NO: 135616 - DNA, 24 bp, Artificial sequence
  SiRNA target sequence
tatattatttaataggatgatgat

SEQ ID NO: 135617 - DNA, 24 bp, Artificial sequence
  SiRNA target sequence
atattatttaataggatgatgata

SEQ ID NO: 135618 - DNA, 24 bp, Artificial sequence
  SiRNA target sequence
tattatttaataggatgatgatag

SEQ ID NO: 135619 - DNA, 24 bp, Artificial sequence
  SiRNA target sequence
attatttaataggatgatgatagg

SEQ ID NO: 135620 - DNA, 24 bp, Artificial sequence
  SiRNA target sequence
ttatttaataggatgatgatagga

SEQ ID NO: 135621 - DNA, 24 bp, Artificial sequence
  SiRNA target sequence
tatttaataggatgatgataggat

SEQ ID NO: 135622 - DNA, 24 bp, Artificial sequence
  SiRNA target sequence
atttaataggatgatgataggata

SEQ ID NO: 135623 - DNA, 24 bp, Artificial sequence
  SiRNA target sequence
tttaataggatgatgataggatac

SEQ ID NO: 135624 - DNA, 24 bp, Artificial sequence
  SiRNA target sequence
ttaataggatgatgataggataca

SEQ ID NO: 135625 - DNA, 24 bp, Artificial sequence
  SiRNA target sequence
taataggatgatgataggatacat

SEQ ID NO: 135626 - DNA, 24 bp, Artificial sequence
  SiRNA target sequence
aataggatgatgataggatacatt

SEQ ID NO: 135627 - DNA, 24 bp, Artificial sequence
  SiRNA target sequence
ataggatgatgataggatacattg

SEQ ID NO: 135628 - DNA, 24 bp, Artificial sequence
  SiRNA target sequence
taggatgatgataggatacattga

SEQ ID NO: 135629 - DNA, 24 bp, Artificial sequence
  SiRNA target sequence
aggatgatgataggatacattgac

SEQ ID NO: 135630 - DNA, 24 bp, Artificial sequence
  SiRNA target sequence
ggatgatgataggatacattgacg

SEQ ID NO: 135631 - DNA, 24 bp, Artificial sequence
  SiRNA target sequence
gatgatgataggatacattgacgt

SEQ ID NO: 135632 - DNA, 24 bp, Artificial sequence
  SiRNA target sequence
atgatgataggatacattgacgtc

SEQ ID NO: 135633 - DNA, 24 bp, Artificial sequence
  SiRNA target sequence
tgatgataggatacattgacgtca

SEQ ID NO: 135634 - DNA, 24 bp, Artificial sequence
  SiRNA target sequence
gatgataggatacattgacgtcag

SEQ ID NO: 135635 - DNA, 24 bp, Artificial sequence
  SiRNA target sequence
atgataggatacattgacgtcaga

SEQ ID NO: 135636 - DNA, 24 bp, Artificial sequence
  SiRNA target sequence
tgataggatacattgacgtcagaa

SEQ ID NO: 135637 - DNA, 24 bp, Artificial sequence
  SiRNA target sequence
gataggatacattgacgtcagaag

SEQ ID NO: 135638 - DNA, 24 bp, Artificial sequence
  SiRNA target sequence
ataggatacattgacgtcagaaga

SEQ ID NO: 135639 - DNA, 24 bp, Artificial sequence
  SiRNA target sequence
taggatacattgacgtcagaagag

SEQ ID NO: 135640 - DNA, 24 bp, Artificial sequence
  SiRNA target sequence
aggatacattgacgtcagaagagc

SEQ ID NO: 135641 - DNA, 24 bp, Artificial sequence
  SiRNA target sequence
ggatacattgacgtcagaagagca

SEQ ID NO: 135642 - DNA, 24 bp, Artificial sequence
  SiRNA target sequence
gatacattgacgtcagaagagcat

SEQ ID NO: 135643 - DNA, 24 bp, Artificial sequence
  SiRNA target sequence
atacattgacgtcagaagagcatt

SEQ ID NO: 135644 - DNA, 24 bp, Artificial sequence
  SiRNA target sequence
tacattgacgtcagaagagcattt

SEQ ID NO: 135645 - DNA, 24 bp, Artificial sequence
  SiRNA target sequence
acattgacgtcagaagagcatttg

SEQ ID NO: 135646 - DNA, 24 bp, Artificial sequence
  SiRNA target sequence
cattgacgtcagaagagcatttga

SEQ ID NO: 135647 - DNA, 24 bp, Artificial sequence
  SiRNA target sequence
attgacgtcagaagagcatttgat

SEQ ID NO: 135648 - DNA, 24 bp, Artificial sequence
  SiRNA target sequence
ttgacgtcagaagagcatttgatt

SEQ ID NO: 135649 - DNA, 24 bp, Artificial sequence
  SiRNA target sequence
tgacgtcagaagagcatttgattt

SEQ ID NO: 135650 - DNA, 24 bp, Artificial sequence
  SiRNA target sequence
gacgtcagaagagcatttgattta

SEQ ID NO: 135651 - DNA, 24 bp, Artificial sequence
  SiRNA target sequence
acgtcagaagagcatttgatttaa

SEQ ID NO: 135652 - DNA, 24 bp, Artificial sequence
  SiRNA target sequence
cgtcagaagagcatttgatttaat

SEQ ID NO: 135653 - DNA, 24 bp, Artificial sequence
  SiRNA target sequence
gtcagaagagcatttgatttaatt

SEQ ID NO: 135654 - DNA, 24 bp, Artificial sequence
  SiRNA target sequence
tcagaagagcatttgatttaattg

SEQ ID NO: 135655 - DNA, 24 bp, Artificial sequence
  SiRNA target sequence
cagaagagcatttgatttaattgg

SEQ ID NO: 135656 - DNA, 24 bp, Artificial sequence
  SiRNA target sequence
agaagagcatttgatttaattggt

SEQ ID NO: 135657 - DNA, 24 bp, Artificial sequence
  SiRNA target sequence
gaagagcatttgatttaattggta

SEQ ID NO: 135658 - DNA, 24 bp, Artificial sequence
  SiRNA target sequence
aagagcatttgatttaattggtat

SEQ ID NO: 135659 - DNA, 24 bp, Artificial sequence
  SiRNA target sequence
agagcatttgatttaattggtata

SEQ ID NO: 135660 - DNA, 24 bp, Artificial sequence
  SiRNA target sequence
gagcatttgatttaattggtatag

SEQ ID NO: 135661 - DNA, 24 bp, Artificial sequence
  SiRNA target sequence
agcatttgatttaattggtatagt

SEQ ID NO: 135662 - DNA, 24 bp, Artificial sequence
  SiRNA target sequence
gcatttgatttaattggtatagta

SEQ ID NO: 135663 - DNA, 24 bp, Artificial sequence
  SiRNA target sequence
catttgatttaattggtatagtag

SEQ ID NO: 135664 - DNA, 24 bp, Artificial sequence
  SiRNA target sequence
atttgatttaattggtatagtagc

SEQ ID NO: 135665 - DNA, 24 bp, Artificial sequence
  SiRNA target sequence
tttgatttaattggtatagtagct

SEQ ID NO: 135666 - DNA, 24 bp, Artificial sequence
  SiRNA target sequence
ttgatttaattggtatagtagctg

SEQ ID NO: 135667 - DNA, 24 bp, Artificial sequence
  SiRNA target sequence
tgatttaattggtatagtagctga

SEQ ID NO: 135668 - DNA, 24 bp, Artificial sequence
  SiRNA target sequence
gatttaattggtatagtagctgaa

SEQ ID NO: 135669 - DNA, 24 bp, Artificial sequence
  SiRNA target sequence
atttaattggtatagtagctgaag

SEQ ID NO: 135670 - DNA, 24 bp, Artificial sequence
  SiRNA target sequence
tttaattggtatagtagctgaagt

SEQ ID NO: 135671 - DNA, 24 bp, Artificial sequence
  SiRNA target sequence
ttaattggtatagtagctgaagta

SEQ ID NO: 135672 - DNA, 24 bp, Artificial sequence
  SiRNA target sequence
taattggtatagtagctgaagtaa

SEQ ID NO: 135673 - DNA, 24 bp, Artificial sequence
  SiRNA target sequence
aattggtatagtagctgaagtaat

SEQ ID NO: 135674 - DNA, 24 bp, Artificial sequence
  SiRNA target sequence
attggtatagtagctgaagtaatg

SEQ ID NO: 135675 - DNA, 24 bp, Artificial sequence
  SiRNA target sequence
ttggtatagtagctgaagtaatga

SEQ ID NO: 135676 - DNA, 24 bp, Artificial sequence
  SiRNA target sequence
tggtatagtagctgaagtaatgaa

SEQ ID NO: 135677 - DNA, 24 bp, Artificial sequence
  SiRNA target sequence
ggtatagtagctgaagtaatgaaa

SEQ ID NO: 135678 - DNA, 24 bp, Artificial sequence
  SiRNA target sequence
gtatagtagctgaagtaatgaaag

SEQ ID NO: 135679 - DNA, 24 bp, Artificial sequence
  SiRNA target sequence
tatagtagctgaagtaatgaaaga

SEQ ID NO: 135680 - DNA, 24 bp, Artificial sequence
  SiRNA target sequence
atagtagctgaagtaatgaaagac

SEQ ID NO: 135681 - DNA, 24 bp, Artificial sequence
  SiRNA target sequence
tagtagctgaagtaatgaaagact

SEQ ID NO: 135682 - DNA, 24 bp, Artificial sequence
  SiRNA target sequence
agtagctgaagtaatgaaagacta

SEQ ID NO: 135683 - DNA, 24 bp, Artificial sequence
  SiRNA target sequence
gtagctgaagtaatgaaagactat

SEQ ID NO: 135684 - DNA, 24 bp, Artificial sequence
  SiRNA target sequence
tagctgaagtaatgaaagactatt

SEQ ID NO: 135685 - DNA, 24 bp, Artificial sequence
  SiRNA target sequence
agctgaagtaatgaaagactatta

SEQ ID NO: 135686 - DNA, 24 bp, Artificial sequence
  SiRNA target sequence
gctgaagtaatgaaagactattac

SEQ ID NO: 135687 - DNA, 24 bp, Artificial sequence
  SiRNA target sequence
ctgaagtaatgaaagactattacg

SEQ ID NO: 135688 - DNA, 24 bp, Artificial sequence
  SiRNA target sequence
tgaagtaatgaaagactattacgg

SEQ ID NO: 135689 - DNA, 24 bp, Artificial sequence
  SiRNA target sequence
gaagtaatgaaagactattacgga

SEQ ID NO: 135690 - DNA, 24 bp, Artificial sequence
  SiRNA target sequence
aagtaatgaaagactattacggat

SEQ ID NO: 135691 - DNA, 24 bp, Artificial sequence
  SiRNA target sequence
agtaatgaaagactattacggatg

SEQ ID NO: 135692 - DNA, 24 bp, Artificial sequence
  SiRNA target sequence
gtaatgaaagactattacggatgg

SEQ ID NO: 135693 - DNA, 24 bp, Artificial sequence
  SiRNA target sequence
taatgaaagactattacggatggg

SEQ ID NO: 135694 - DNA, 24 bp, Artificial sequence
  SiRNA target sequence
aatgaaagactattacggatggga

SEQ ID NO: 135695 - DNA, 24 bp, Artificial sequence
  SiRNA target sequence
atgaaagactattacggatgggat

SEQ ID NO: 135696 - DNA, 24 bp, Artificial sequence
  SiRNA target sequence
tgaaagactattacggatgggatc

SEQ ID NO: 135697 - DNA, 24 bp, Artificial sequence
  SiRNA target sequence
gaaagactattacggatgggatca

SEQ ID NO: 135698 - DNA, 24 bp, Artificial sequence
  SiRNA target sequence
aaagactattacggatgggatcag

SEQ ID NO: 135699 - DNA, 24 bp, Artificial sequence
  SiRNA target sequence
aagactattacggatgggatcagc

SEQ ID NO: 135700 - DNA, 24 bp, Artificial sequence
  SiRNA target sequence
agactattacggatgggatcagca

SEQ ID NO: 135701 - DNA, 24 bp, Artificial sequence
  SiRNA target sequence
gactattacggatgggatcagcaa

SEQ ID NO: 135702 - DNA, 24 bp, Artificial sequence
  SiRNA target sequence
actattacggatgggatcagcaaa

SEQ ID NO: 135703 - DNA, 24 bp, Artificial sequence
  SiRNA target sequence
ctattacggatgggatcagcaaag

SEQ ID NO: 135704 - DNA, 24 bp, Artificial sequence
  SiRNA target sequence
tattacggatgggatcagcaaaga

SEQ ID NO: 135705 - DNA, 24 bp, Artificial sequence
  SiRNA target sequence
attacggatgggatcagcaaagat

SEQ ID NO: 135706 - DNA, 24 bp, Artificial sequence
  SiRNA target sequence
ttacggatgggatcagcaaagata

SEQ ID NO: 135707 - DNA, 24 bp, Artificial sequence
  SiRNA target sequence
tacggatgggatcagcaaagatat

SEQ ID NO: 135708 - DNA, 24 bp, Artificial sequence
  SiRNA target sequence
acggatgggatcagcaaagatata

SEQ ID NO: 135709 - DNA, 24 bp, Artificial sequence
  SiRNA target sequence
cggatgggatcagcaaagatataa

SEQ ID NO: 135710 - DNA, 24 bp, Artificial sequence
  SiRNA target sequence
ggatgggatcagcaaagatataat

SEQ ID NO: 135711 - DNA, 24 bp, Artificial sequence
  SiRNA target sequence
gatgggatcagcaaagatataatg

SEQ ID NO: 135712 - DNA, 24 bp, Artificial sequence
  SiRNA target sequence
atgggatcagcaaagatataatga

SEQ ID NO: 135713 - DNA, 24 bp, Artificial sequence
  SiRNA target sequence
tgggatcagcaaagatataatgaa

SEQ ID NO: 135714 - DNA, 24 bp, Artificial sequence
  SiRNA target sequence
gggatcagcaaagatataatgaag

SEQ ID NO: 135715 - DNA, 24 bp, Artificial sequence
  SiRNA target sequence
ggatcagcaaagatataatgaaga

SEQ ID NO: 135716 - DNA, 24 bp, Artificial sequence
  SiRNA target sequence
gatcagcaaagatataatgaagaa

SEQ ID NO: 135717 - DNA, 24 bp, Artificial sequence
  SiRNA target sequence
atcagcaaagatataatgaagaaa

SEQ ID NO: 135718 - DNA, 24 bp, Artificial sequence
  SiRNA target sequence
tcagcaaagatataatgaagaaac

SEQ ID NO: 135719 - DNA, 24 bp, Artificial sequence
  SiRNA target sequence
cagcaaagatataatgaagaaaca

SEQ ID NO: 135720 - DNA, 24 bp, Artificial sequence
  SiRNA target sequence
agcaaagatataatgaagaaacaa

SEQ ID NO: 135721 - DNA, 24 bp, Artificial sequence
  SiRNA target sequence
gcaaagatataatgaagaaacaaa

SEQ ID NO: 135722 - DNA, 24 bp, Artificial sequence
  SiRNA target sequence
caaagatataatgaagaaacaaaa

SEQ ID NO: 135723 - DNA, 24 bp, Artificial sequence
  SiRNA target sequence
aaagatataatgaagaaacaaaat

SEQ ID NO: 135724 - DNA, 24 bp, Artificial sequence
  SiRNA target sequence
aagatataatgaagaaacaaaatt

SEQ ID NO: 135725 - DNA, 24 bp, Artificial sequence
  SiRNA target sequence
agatataatgaagaaacaaaatta

SEQ ID NO: 135726 - DNA, 24 bp, Artificial sequence
  SiRNA target sequence
gatataatgaagaaacaaaattat

SEQ ID NO: 135727 - DNA, 24 bp, Artificial sequence
  SiRNA target sequence
atataatgaagaaacaaaattatg

SEQ ID NO: 135728 - DNA, 24 bp, Artificial sequence
  SiRNA target sequence
tataatgaagaaacaaaattatgc

SEQ ID NO: 135729 - DNA, 24 bp, Artificial sequence
  SiRNA target sequence
ataatgaagaaacaaaattatgca

SEQ ID NO: 135730 - DNA, 24 bp, Artificial sequence
  SiRNA target sequence
taatgaagaaacaaaattatgcat

SEQ ID NO: 135731 - DNA, 24 bp, Artificial sequence
  SiRNA target sequence
aatgaagaaacaaaattatgcatg

SEQ ID NO: 135732 - DNA, 24 bp, Artificial sequence
  SiRNA target sequence
atgaagaaacaaaattatgcatgg

SEQ ID NO: 135733 - DNA, 24 bp, Artificial sequence
  SiRNA target sequence
tgaagaaacaaaattatgcatgga

SEQ ID NO: 135734 - DNA, 24 bp, Artificial sequence
  SiRNA target sequence
gaagaaacaaaattatgcatggaa

SEQ ID NO: 135735 - DNA, 24 bp, Artificial sequence
  SiRNA target sequence
aagaaacaaaattatgcatggaaa

SEQ ID NO: 135736 - DNA, 24 bp, Artificial sequence
  SiRNA target sequence
agaaacaaaattatgcatggaaat

SEQ ID NO: 135737 - DNA, 24 bp, Artificial sequence
  SiRNA target sequence
gaaacaaaattatgcatggaaatg

SEQ ID NO: 135738 - DNA, 24 bp, Artificial sequence
  SiRNA target sequence
aaacaaaattatgcatggaaatga

SEQ ID NO: 135739 - DNA, 24 bp, Artificial sequence
  SiRNA target sequence
aacaaaattatgcatggaaatgat

SEQ ID NO: 135740 - DNA, 24 bp, Artificial sequence
  SiRNA target sequence
acaaaattatgcatggaaatgatg

SEQ ID NO: 135741 - DNA, 24 bp, Artificial sequence
  SiRNA target sequence
caaaattatgcatggaaatgatgg

SEQ ID NO: 135742 - DNA, 24 bp, Artificial sequence
  SiRNA target sequence
aaaattatgcatggaaatgatgga

SEQ ID NO: 135743 - DNA, 24 bp, Artificial sequence
  SiRNA target sequence
aaattatgcatggaaatgatggaa

SEQ ID NO: 135744 - DNA, 24 bp, Artificial sequence
  SiRNA target sequence
aattatgcatggaaatgatggaaa

SEQ ID NO: 135745 - DNA, 24 bp, Artificial sequence
  SiRNA target sequence
attatgcatggaaatgatggaaac

SEQ ID NO: 135746 - DNA, 24 bp, Artificial sequence
  SiRNA target sequence
ttatgcatggaaatgatggaaact

SEQ ID NO: 135747 - DNA, 24 bp, Artificial sequence
  SiRNA target sequence
tatgcatggaaatgatggaaactt

SEQ ID NO: 135748 - DNA, 24 bp, Artificial sequence
  SiRNA target sequence
atgcatggaaatgatggaaacttg

SEQ ID NO: 135749 - DNA, 24 bp, Artificial sequence
  SiRNA target sequence
tgcatggaaatgatggaaacttgt

SEQ ID NO: 135750 - DNA, 24 bp, Artificial sequence
  SiRNA target sequence
gcatggaaatgatggaaacttgtg

SEQ ID NO: 135751 - DNA, 24 bp, Artificial sequence
  SiRNA target sequence
catggaaatgatggaaacttgtgg

SEQ ID NO: 135752 - DNA, 24 bp, Artificial sequence
  SiRNA target sequence
atggaaatgatggaaacttgtggt

SEQ ID NO: 135753 - DNA, 24 bp, Artificial sequence
  SiRNA target sequence
tggaaatgatggaaacttgtggtt

SEQ ID NO: 135754 - DNA, 24 bp, Artificial sequence
  SiRNA target sequence
ggaaatgatggaaacttgtggtta

SEQ ID NO: 135755 - DNA, 24 bp, Artificial sequence
  SiRNA target sequence
gaaatgatggaaacttgtggttat

SEQ ID NO: 135756 - DNA, 24 bp, Artificial sequence
  SiRNA target sequence
aaatgatggaaacttgtggttata

SEQ ID NO: 135757 - DNA, 24 bp, Artificial sequence
  SiRNA target sequence
aatgatggaaacttgtggttatag

SEQ ID NO: 135758 - DNA, 24 bp, Artificial sequence
  SiRNA target sequence
atgatggaaacttgtggttatagt

SEQ ID NO: 135759 - DNA, 24 bp, Artificial sequence
  SiRNA target sequence
tgatggaaacttgtggttatagtt

SEQ ID NO: 135760 - DNA, 24 bp, Artificial sequence
  SiRNA target sequence
gatggaaacttgtggttatagttt

SEQ ID NO: 135761 - DNA, 24 bp, Artificial sequence
  SiRNA target sequence
atggaaacttgtggttatagttta

SEQ ID NO: 135762 - DNA, 24 bp, Artificial sequence
  SiRNA target sequence
tggaaacttgtggttatagtttat

SEQ ID NO: 135763 - DNA, 24 bp, Artificial sequence
  SiRNA target sequence
ggaaacttgtggttatagtttatt

SEQ ID NO: 135764 - DNA, 24 bp, Artificial sequence
  SiRNA target sequence
gaaacttgtggttatagtttatta

SEQ ID NO: 135765 - DNA, 24 bp, Artificial sequence
  SiRNA target sequence
aaacttgtggttatagtttattaa

SEQ ID NO: 135766 - DNA, 24 bp, Artificial sequence
  SiRNA target sequence
aacttgtggttatagtttattaaa

SEQ ID NO: 135767 - DNA, 24 bp, Artificial sequence
  SiRNA target sequence
acttgtggttatagtttattaaaa

SEQ ID NO: 135768 - DNA, 24 bp, Artificial sequence
  SiRNA target sequence
cttgtggttatagtttattaaaaa

SEQ ID NO: 135769 - DNA, 24 bp, Artificial sequence
  SiRNA target sequence
ttgtggttatagtttattaaaaaa

SEQ ID NO: 135770 - DNA, 24 bp, Artificial sequence
  SiRNA target sequence
tgtggttatagtttattaaaaaat

SEQ ID NO: 135771 - DNA, 24 bp, Artificial sequence
  SiRNA target sequence
gtggttatagtttattaaaaaatt

SEQ ID NO: 135772 - DNA, 24 bp, Artificial sequence
  SiRNA target sequence
tggttatagtttattaaaaaatta

SEQ ID NO: 135773 - DNA, 24 bp, Artificial sequence
  SiRNA target sequence
ggttatagtttattaaaaaattaa

SEQ ID NO: 135774 - DNA, 25 bp, Artificial sequence
  SiRNA target sequence
atggtgtataaggttttatttacag

SEQ ID NO: 135775 - DNA, 25 bp, Artificial sequence
  SiRNA target sequence
tggtgtataaggttttatttacagt

SEQ ID NO: 135776 - DNA, 25 bp, Artificial sequence
  SiRNA target sequence
ggtgtataaggttttatttacagta

SEQ ID NO: 135777 - DNA, 25 bp, Artificial sequence
  SiRNA target sequence
gtgtataaggttttatttacagtaa

SEQ ID NO: 135778 - DNA, 25 bp, Artificial sequence
  SiRNA target sequence
tgtataaggttttatttacagtaat

SEQ ID NO: 135779 - DNA, 25 bp, Artificial sequence
  SiRNA target sequence
gtataaggttttatttacagtaata

SEQ ID NO: 135780 - DNA, 25 bp, Artificial sequence
  SiRNA target sequence
tataaggttttatttacagtaatag

SEQ ID NO: 135781 - DNA, 25 bp, Artificial sequence
  SiRNA target sequence
ataaggttttatttacagtaatagg

SEQ ID NO: 135782 - DNA, 25 bp, Artificial sequence
  SiRNA target sequence
taaggttttatttacagtaatagga

SEQ ID NO: 135783 - DNA, 25 bp, Artificial sequence
  SiRNA target sequence
aaggttttatttacagtaataggat

SEQ ID NO: 135784 - DNA, 25 bp, Artificial sequence
  SiRNA target sequence
aggttttatttacagtaataggatt

SEQ ID NO: 135785 - DNA, 25 bp, Artificial sequence
  SiRNA target sequence
ggttttatttacagtaataggatta

SEQ ID NO: 135786 - DNA, 25 bp, Artificial sequence
  SiRNA target sequence
gttttatttacagtaataggattaa

SEQ ID NO: 135787 - DNA, 25 bp, Artificial sequence
  SiRNA target sequence
ttttatttacagtaataggattaat

SEQ ID NO: 135788 - DNA, 25 bp, Artificial sequence
  SiRNA target sequence
tttatttacagtaataggattaata

SEQ ID NO: 135789 - DNA, 25 bp, Artificial sequence
  SiRNA target sequence
ttatttacagtaataggattaatat

SEQ ID NO: 135790 - DNA, 25 bp, Artificial sequence
  SiRNA target sequence
tatttacagtaataggattaatatg

SEQ ID NO: 135791 - DNA, 25 bp, Artificial sequence
  SiRNA target sequence
atttacagtaataggattaatatgt

SEQ ID NO: 135792 - DNA, 25 bp, Artificial sequence
  SiRNA target sequence
tttacagtaataggattaatatgtg

SEQ ID NO: 135793 - DNA, 25 bp, Artificial sequence
  SiRNA target sequence
ttacagtaataggattaatatgtgg

SEQ ID NO: 135794 - DNA, 25 bp, Artificial sequence
  SiRNA target sequence
tacagtaataggattaatatgtggt

SEQ ID NO: 135795 - DNA, 25 bp, Artificial sequence
  SiRNA target sequence
acagtaataggattaatatgtggta

SEQ ID NO: 135796 - DNA, 25 bp, Artificial sequence
  SiRNA target sequence
cagtaataggattaatatgtggtat

SEQ ID NO: 135797 - DNA, 25 bp, Artificial sequence
  SiRNA target sequence
agtaataggattaatatgtggtata

SEQ ID NO: 135798 - DNA, 25 bp, Artificial sequence
  SiRNA target sequence
gtaataggattaatatgtggtatac

SEQ ID NO: 135799 - DNA, 25 bp, Artificial sequence
  SiRNA target sequence
taataggattaatatgtggtatact

SEQ ID NO: 135800 - DNA, 25 bp, Artificial sequence
  SiRNA target sequence
aataggattaatatgtggtatactt

SEQ ID NO: 135801 - DNA, 25 bp, Artificial sequence
  SiRNA target sequence
ataggattaatatgtggtatactta

SEQ ID NO: 135802 - DNA, 25 bp, Artificial sequence
  SiRNA target sequence
taggattaatatgtggtatacttac

SEQ ID NO: 135803 - DNA, 25 bp, Artificial sequence
  SiRNA target sequence
aggattaatatgtggtatacttaca

SEQ ID NO: 135804 - DNA, 25 bp, Artificial sequence
  SiRNA target sequence
ggattaatatgtggtatacttacaa

SEQ ID NO: 135805 - DNA, 25 bp, Artificial sequence
  SiRNA target sequence
gattaatatgtggtatacttacaat

SEQ ID NO: 135806 - DNA, 25 bp, Artificial sequence
  SiRNA target sequence
attaatatgtggtatacttacaata

SEQ ID NO: 135807 - DNA, 25 bp, Artificial sequence
  SiRNA target sequence
ttaatatgtggtatacttacaataa

SEQ ID NO: 135808 - DNA, 25 bp, Artificial sequence
  SiRNA target sequence
taatatgtggtatacttacaataat

SEQ ID NO: 135809 - DNA, 25 bp, Artificial sequence
  SiRNA target sequence
aatatgtggtatacttacaataatt

SEQ ID NO: 135810 - DNA, 25 bp, Artificial sequence
  SiRNA target sequence
atatgtggtatacttacaataatta

SEQ ID NO: 135811 - DNA, 25 bp, Artificial sequence
  SiRNA target sequence
tatgtggtatacttacaataattaa

SEQ ID NO: 135812 - DNA, 25 bp, Artificial sequence
  SiRNA target sequence
atgtggtatacttacaataattaaa

SEQ ID NO: 135813 - DNA, 25 bp, Artificial sequence
  SiRNA target sequence
tgtggtatacttacaataattaaac

SEQ ID NO: 135814 - DNA, 25 bp, Artificial sequence
  SiRNA target sequence
gtggtatacttacaataattaaacg

SEQ ID NO: 135815 - DNA, 25 bp, Artificial sequence
  SiRNA target sequence
tggtatacttacaataattaaacga

SEQ ID NO: 135816 - DNA, 25 bp, Artificial sequence
  SiRNA target sequence
ggtatacttacaataattaaacgat

SEQ ID NO: 135817 - DNA, 25 bp, Artificial sequence
  SiRNA target sequence
gtatacttacaataattaaacgata

SEQ ID NO: 135818 - DNA, 25 bp, Artificial sequence
  SiRNA target sequence
tatacttacaataattaaacgatac

SEQ ID NO: 135819 - DNA, 25 bp, Artificial sequence
  SiRNA target sequence
atacttacaataattaaacgataca

SEQ ID NO: 135820 - DNA, 25 bp, Artificial sequence
  SiRNA target sequence
tacttacaataattaaacgatacaa

SEQ ID NO: 135821 - DNA, 25 bp, Artificial sequence
  SiRNA target sequence
acttacaataattaaacgatacaag

SEQ ID NO: 135822 - DNA, 25 bp, Artificial sequence
  SiRNA target sequence
cttacaataattaaacgatacaagt

SEQ ID NO: 135823 - DNA, 25 bp, Artificial sequence
  SiRNA target sequence
ttacaataattaaacgatacaagta

SEQ ID NO: 135824 - DNA, 25 bp, Artificial sequence
  SiRNA target sequence
tacaataattaaacgatacaagtat

SEQ ID NO: 135825 - DNA, 25 bp, Artificial sequence
  SiRNA target sequence
acaataattaaacgatacaagtatt

SEQ ID NO: 135826 - DNA, 25 bp, Artificial sequence
  SiRNA target sequence
caataattaaacgatacaagtattt

SEQ ID NO: 135827 - DNA, 25 bp, Artificial sequence
  SiRNA target sequence
aataattaaacgatacaagtatttt

SEQ ID NO: 135828 - DNA, 25 bp, Artificial sequence
  SiRNA target sequence
ataattaaacgatacaagtatttta

SEQ ID NO: 135829 - DNA, 25 bp, Artificial sequence
  SiRNA target sequence
taattaaacgatacaagtattttaa

SEQ ID NO: 135830 - DNA, 25 bp, Artificial sequence
  SiRNA target sequence
aattaaacgatacaagtattttaag

SEQ ID NO: 135831 - DNA, 25 bp, Artificial sequence
  SiRNA target sequence
attaaacgatacaagtattttaaga

SEQ ID NO: 135832 - DNA, 25 bp, Artificial sequence
  SiRNA target sequence
ttaaacgatacaagtattttaagat

SEQ ID NO: 135833 - DNA, 25 bp, Artificial sequence
  SiRNA target sequence
taaacgatacaagtattttaagata

SEQ ID NO: 135834 - DNA, 25 bp, Artificial sequence
  SiRNA target sequence
aaacgatacaagtattttaagataa

SEQ ID NO: 135835 - DNA, 25 bp, Artificial sequence
  SiRNA target sequence
aacgatacaagtattttaagataaa

SEQ ID NO: 135836 - DNA, 25 bp, Artificial sequence
  SiRNA target sequence
acgatacaagtattttaagataaaa

SEQ ID NO: 135837 - DNA, 25 bp, Artificial sequence
  SiRNA target sequence
cgatacaagtattttaagataaaaa

SEQ ID NO: 135838 - DNA, 25 bp, Artificial sequence
  SiRNA target sequence
gatacaagtattttaagataaaaaa

SEQ ID NO: 135839 - DNA, 25 bp, Artificial sequence
  SiRNA target sequence
atacaagtattttaagataaaaaaa

SEQ ID NO: 135840 - DNA, 25 bp, Artificial sequence
  SiRNA target sequence
tacaagtattttaagataaaaaaat

SEQ ID NO: 135841 - DNA, 25 bp, Artificial sequence
  SiRNA target sequence
acaagtattttaagataaaaaaatt

SEQ ID NO: 135842 - DNA, 25 bp, Artificial sequence
  SiRNA target sequence
caagtattttaagataaaaaaattg

SEQ ID NO: 135843 - DNA, 25 bp, Artificial sequence
  SiRNA target sequence
aagtattttaagataaaaaaattgg

SEQ ID NO: 135844 - DNA, 25 bp, Artificial sequence
  SiRNA target sequence
agtattttaagataaaaaaattggc

SEQ ID NO: 135845 - DNA, 25 bp, Artificial sequence
  SiRNA target sequence
gtattttaagataaaaaaattggcc

SEQ ID NO: 135846 - DNA, 25 bp, Artificial sequence
  SiRNA target sequence
tattttaagataaaaaaattggcct

SEQ ID NO: 135847 - DNA, 25 bp, Artificial sequence
  SiRNA target sequence
attttaagataaaaaaattggcctt

SEQ ID NO: 135848 - DNA, 25 bp, Artificial sequence
  SiRNA target sequence
ttttaagataaaaaaattggcctta

SEQ ID NO: 135849 - DNA, 25 bp, Artificial sequence
  SiRNA target sequence
tttaagataaaaaaattggccttaa

SEQ ID NO: 135850 - DNA, 25 bp, Artificial sequence
  SiRNA target sequence
ttaagataaaaaaattggccttaac

SEQ ID NO: 135851 - DNA, 25 bp, Artificial sequence
  SiRNA target sequence
taagataaaaaaattggccttaact

SEQ ID NO: 135852 - DNA, 25 bp, Artificial sequence
  SiRNA target sequence
aagataaaaaaattggccttaactt

SEQ ID NO: 135853 - DNA, 25 bp, Artificial sequence
  SiRNA target sequence
agataaaaaaattggccttaactta

SEQ ID NO: 135854 - DNA, 25 bp, Artificial sequence
  SiRNA target sequence
gataaaaaaattggccttaacttac

SEQ ID NO: 135855 - DNA, 25 bp, Artificial sequence
  SiRNA target sequence
ataaaaaaattggccttaacttact

SEQ ID NO: 135856 - DNA, 25 bp, Artificial sequence
  SiRNA target sequence
taaaaaaattggccttaacttactt

SEQ ID NO: 135857 - DNA, 25 bp, Artificial sequence
  SiRNA target sequence
aaaaaaattggccttaacttacttc

SEQ ID NO: 135858 - DNA, 25 bp, Artificial sequence
  SiRNA target sequence
aaaaaattggccttaacttacttcg

SEQ ID NO: 135859 - DNA, 25 bp, Artificial sequence
  SiRNA target sequence
aaaaattggccttaacttacttcgg

SEQ ID NO: 135860 - DNA, 25 bp, Artificial sequence
  SiRNA target sequence
aaaattggccttaacttacttcggg

SEQ ID NO: 135861 - DNA, 25 bp, Artificial sequence
  SiRNA target sequence
aaattggccttaacttacttcggga

SEQ ID NO: 135862 - DNA, 25 bp, Artificial sequence
  SiRNA target sequence
aattggccttaacttacttcgggaa

SEQ ID NO: 135863 - DNA, 25 bp, Artificial sequence
  SiRNA target sequence
attggccttaacttacttcgggaaa

SEQ ID NO: 135864 - DNA, 25 bp, Artificial sequence
  SiRNA target sequence
ttggccttaacttacttcgggaaac

SEQ ID NO: 135865 - DNA, 25 bp, Artificial sequence
  SiRNA target sequence
tggccttaacttacttcgggaaaca

SEQ ID NO: 135866 - DNA, 25 bp, Artificial sequence
  SiRNA target sequence
ggccttaacttacttcgggaaacaa

SEQ ID NO: 135867 - DNA, 25 bp, Artificial sequence
  SiRNA target sequence
gccttaacttacttcgggaaacaag

SEQ ID NO: 135868 - DNA, 25 bp, Artificial sequence
  SiRNA target sequence
ccttaacttacttcgggaaacaaga

SEQ ID NO: 135869 - DNA, 25 bp, Artificial sequence
  SiRNA target sequence
cttaacttacttcgggaaacaagac

SEQ ID NO: 135870 - DNA, 25 bp, Artificial sequence
  SiRNA target sequence
ttaacttacttcgggaaacaagact

SEQ ID NO: 135871 - DNA, 25 bp, Artificial sequence
  SiRNA target sequence
taacttacttcgggaaacaagactt

SEQ ID NO: 135872 - DNA, 25 bp, Artificial sequence
  SiRNA target sequence
aacttacttcgggaaacaagacttg

SEQ ID NO: 135873 - DNA, 25 bp, Artificial sequence
  SiRNA target sequence
acttacttcgggaaacaagacttgc

SEQ ID NO: 135874 - DNA, 25 bp, Artificial sequence
  SiRNA target sequence
cttacttcgggaaacaagacttgca

SEQ ID NO: 135875 - DNA, 25 bp, Artificial sequence
  SiRNA target sequence
ttacttcgggaaacaagacttgcaa

SEQ ID NO: 135876 - DNA, 25 bp, Artificial sequence
  SiRNA target sequence
tacttcgggaaacaagacttgcaat

SEQ ID NO: 135877 - DNA, 25 bp, Artificial sequence
  SiRNA target sequence
acttcgggaaacaagacttgcaatg

SEQ ID NO: 135878 - DNA, 25 bp, Artificial sequence
  SiRNA target sequence
cttcgggaaacaagacttgcaatgg

SEQ ID NO: 135879 - DNA, 25 bp, Artificial sequence
  SiRNA target sequence
ttcgggaaacaagacttgcaatgga

SEQ ID NO: 135880 - DNA, 25 bp, Artificial sequence
  SiRNA target sequence
tcgggaaacaagacttgcaatggaa

SEQ ID NO: 135881 - DNA, 25 bp, Artificial sequence
  SiRNA target sequence
cgggaaacaagacttgcaatggaaa

SEQ ID NO: 135882 - DNA, 25 bp, Artificial sequence
  SiRNA target sequence
gggaaacaagacttgcaatggaaac

SEQ ID NO: 135883 - DNA, 25 bp, Artificial sequence
  SiRNA target sequence
ggaaacaagacttgcaatggaaacc

SEQ ID NO: 135884 - DNA, 25 bp, Artificial sequence
  SiRNA target sequence
gaaacaagacttgcaatggaaacct

SEQ ID NO: 135885 - DNA, 25 bp, Artificial sequence
  SiRNA target sequence
aaacaagacttgcaatggaaaccta

SEQ ID NO: 135886 - DNA, 25 bp, Artificial sequence
  SiRNA target sequence
aacaagacttgcaatggaaacctaa

SEQ ID NO: 135887 - DNA, 25 bp, Artificial sequence
  SiRNA target sequence
acaagacttgcaatggaaacctaaa

SEQ ID NO: 135888 - DNA, 25 bp, Artificial sequence
  SiRNA target sequence
caagacttgcaatggaaacctaaaa

SEQ ID NO: 135889 - DNA, 25 bp, Artificial sequence
  SiRNA target sequence
aagacttgcaatggaaacctaaaag

SEQ ID NO: 135890 - DNA, 25 bp, Artificial sequence
  SiRNA target sequence
agacttgcaatggaaacctaaaagt

SEQ ID NO: 135891 - DNA, 25 bp, Artificial sequence
  SiRNA target sequence
gacttgcaatggaaacctaaaagtc

SEQ ID NO: 135892 - DNA, 25 bp, Artificial sequence
  SiRNA target sequence
acttgcaatggaaacctaaaagtcg

SEQ ID NO: 135893 - DNA, 25 bp, Artificial sequence
  SiRNA target sequence
cttgcaatggaaacctaaaagtcgg

SEQ ID NO: 135894 - DNA, 25 bp, Artificial sequence
  SiRNA target sequence
ttgcaatggaaacctaaaagtcggt

SEQ ID NO: 135895 - DNA, 25 bp, Artificial sequence
  SiRNA target sequence
tgcaatggaaacctaaaagtcggtc

SEQ ID NO: 135896 - DNA, 25 bp, Artificial sequence
  SiRNA target sequence
gcaatggaaacctaaaagtcggtca

SEQ ID NO: 135897 - DNA, 25 bp, Artificial sequence
  SiRNA target sequence
caatggaaacctaaaagtcggtcag

SEQ ID NO: 135898 - DNA, 25 bp, Artificial sequence
  SiRNA target sequence
aatggaaacctaaaagtcggtcaga

SEQ ID NO: 135899 - DNA, 25 bp, Artificial sequence
  SiRNA target sequence
atggaaacctaaaagtcggtcagaa

SEQ ID NO: 135900 - DNA, 25 bp, Artificial sequence
  SiRNA target sequence
tggaaacctaaaagtcggtcagaaa

SEQ ID NO: 135901 - DNA, 25 bp, Artificial sequence
  SiRNA target sequence
ggaaacctaaaagtcggtcagaaat

SEQ ID NO: 135902 - DNA, 25 bp, Artificial sequence
  SiRNA target sequence
gaaacctaaaagtcggtcagaaatt

SEQ ID NO: 135903 - DNA, 25 bp, Artificial sequence
  SiRNA target sequence
aaacctaaaagtcggtcagaaatta

SEQ ID NO: 135904 - DNA, 25 bp, Artificial sequence
  SiRNA target sequence
aacctaaaagtcggtcagaaattat

SEQ ID NO: 135905 - DNA, 25 bp, Artificial sequence
  SiRNA target sequence
acctaaaagtcggtcagaaattatt

SEQ ID NO: 135906 - DNA, 25 bp, Artificial sequence
  SiRNA target sequence
cctaaaagtcggtcagaaattatta

SEQ ID NO: 135907 - DNA, 25 bp, Artificial sequence
  SiRNA target sequence
ctaaaagtcggtcagaaattattaa

SEQ ID NO: 135908 - DNA, 25 bp, Artificial sequence
  SiRNA target sequence
taaaagtcggtcagaaattattaac

SEQ ID NO: 135909 - DNA, 25 bp, Artificial sequence
  SiRNA target sequence
aaaagtcggtcagaaattattaacg

SEQ ID NO: 135910 - DNA, 25 bp, Artificial sequence
  SiRNA target sequence
aaagtcggtcagaaattattaacga

SEQ ID NO: 135911 - DNA, 25 bp, Artificial sequence
  SiRNA target sequence
aagtcggtcagaaattattaacgat

SEQ ID NO: 135912 - DNA, 25 bp, Artificial sequence
  SiRNA target sequence
agtcggtcagaaattattaacgatt

SEQ ID NO: 135913 - DNA, 25 bp, Artificial sequence
  SiRNA target sequence
gtcggtcagaaattattaacgattt

SEQ ID NO: 135914 - DNA, 25 bp, Artificial sequence
  SiRNA target sequence
tcggtcagaaattattaacgattta

SEQ ID NO: 135915 - DNA, 25 bp, Artificial sequence
  SiRNA target sequence
cggtcagaaattattaacgatttaa

SEQ ID NO: 135916 - DNA, 25 bp, Artificial sequence
  SiRNA target sequence
ggtcagaaattattaacgatttaaa

SEQ ID NO: 135917 - DNA, 25 bp, Artificial sequence
  SiRNA target sequence
gtcagaaattattaacgatttaaaa

SEQ ID NO: 135918 - DNA, 25 bp, Artificial sequence
  SiRNA target sequence
tcagaaattattaacgatttaaaaa

SEQ ID NO: 135919 - DNA, 25 bp, Artificial sequence
  SiRNA target sequence
cagaaattattaacgatttaaaaaa

SEQ ID NO: 135920 - DNA, 25 bp, Artificial sequence
  SiRNA target sequence
agaaattattaacgatttaaaaaat

SEQ ID NO: 135921 - DNA, 25 bp, Artificial sequence
  SiRNA target sequence
gaaattattaacgatttaaaaaata

SEQ ID NO: 135922 - DNA, 25 bp, Artificial sequence
  SiRNA target sequence
aaattattaacgatttaaaaaatac

SEQ ID NO: 135923 - DNA, 25 bp, Artificial sequence
  SiRNA target sequence
aattattaacgatttaaaaaataca

SEQ ID NO: 135924 - DNA, 25 bp, Artificial sequence
  SiRNA target sequence
attattaacgatttaaaaaatacaa

SEQ ID NO: 135925 - DNA, 25 bp, Artificial sequence
  SiRNA target sequence
ttattaacgatttaaaaaatacaaa

SEQ ID NO: 135926 - DNA, 25 bp, Artificial sequence
  SiRNA target sequence
tattaacgatttaaaaaatacaaac

SEQ ID NO: 135927 - DNA, 25 bp, Artificial sequence
  SiRNA target sequence
attaacgatttaaaaaatacaaact

SEQ ID NO: 135928 - DNA, 25 bp, Artificial sequence
  SiRNA target sequence
ttaacgatttaaaaaatacaaactt

SEQ ID NO: 135929 - DNA, 25 bp, Artificial sequence
  SiRNA target sequence
taacgatttaaaaaatacaaacttt

SEQ ID NO: 135930 - DNA, 25 bp, Artificial sequence
  SiRNA target sequence
aacgatttaaaaaatacaaactttg

SEQ ID NO: 135931 - DNA, 25 bp, Artificial sequence
  SiRNA target sequence
acgatttaaaaaatacaaactttga

SEQ ID NO: 135932 - DNA, 25 bp, Artificial sequence
  SiRNA target sequence
cgatttaaaaaatacaaactttgac

SEQ ID NO: 135933 - DNA, 25 bp, Artificial sequence
  SiRNA target sequence
gatttaaaaaatacaaactttgaca

SEQ ID NO: 135934 - DNA, 25 bp, Artificial sequence
  SiRNA target sequence
atttaaaaaatacaaactttgacat

SEQ ID NO: 135935 - DNA, 25 bp, Artificial sequence
  SiRNA target sequence
tttaaaaaatacaaactttgacata

SEQ ID NO: 135936 - DNA, 25 bp, Artificial sequence
  SiRNA target sequence
ttaaaaaatacaaactttgacatat

SEQ ID NO: 135937 - DNA, 25 bp, Artificial sequence
  SiRNA target sequence
taaaaaatacaaactttgacatatt

SEQ ID NO: 135938 - DNA, 25 bp, Artificial sequence
  SiRNA target sequence
aaaaaatacaaactttgacatattg

SEQ ID NO: 135939 - DNA, 25 bp, Artificial sequence
  SiRNA target sequence
aaaaatacaaactttgacatattga

SEQ ID NO: 135940 - DNA, 25 bp, Artificial sequence
  SiRNA target sequence
aaaatacaaactttgacatattgat

SEQ ID NO: 135941 - DNA, 25 bp, Artificial sequence
  SiRNA target sequence
aaatacaaactttgacatattgatt

SEQ ID NO: 135942 - DNA, 25 bp, Artificial sequence
  SiRNA target sequence
aatacaaactttgacatattgatta

SEQ ID NO: 135943 - DNA, 25 bp, Artificial sequence
  SiRNA target sequence
atacaaactttgacatattgattat

SEQ ID NO: 135944 - DNA, 25 bp, Artificial sequence
  SiRNA target sequence
tacaaactttgacatattgattatt

SEQ ID NO: 135945 - DNA, 25 bp, Artificial sequence
  SiRNA target sequence
acaaactttgacatattgattattg

SEQ ID NO: 135946 - DNA, 25 bp, Artificial sequence
  SiRNA target sequence
caaactttgacatattgattattgg

SEQ ID NO: 135947 - DNA, 25 bp, Artificial sequence
  SiRNA target sequence
aaactttgacatattgattattggt

SEQ ID NO: 135948 - DNA, 25 bp, Artificial sequence
  SiRNA target sequence
aactttgacatattgattattggtg

SEQ ID NO: 135949 - DNA, 25 bp, Artificial sequence
  SiRNA target sequence
actttgacatattgattattggtgg

SEQ ID NO: 135950 - DNA, 25 bp, Artificial sequence
  SiRNA target sequence
ctttgacatattgattattggtggc

SEQ ID NO: 135951 - DNA, 25 bp, Artificial sequence
  SiRNA target sequence
tttgacatattgattattggtggcg

SEQ ID NO: 135952 - DNA, 25 bp, Artificial sequence
  SiRNA target sequence
ttgacatattgattattggtggcgg

SEQ ID NO: 135953 - DNA, 25 bp, Artificial sequence
  SiRNA target sequence
tgacatattgattattggtggcggt

SEQ ID NO: 135954 - DNA, 25 bp, Artificial sequence
  SiRNA target sequence
gacatattgattattggtggcggtt

SEQ ID NO: 135955 - DNA, 25 bp, Artificial sequence
  SiRNA target sequence
acatattgattattggtggcggttc

SEQ ID NO: 135956 - DNA, 25 bp, Artificial sequence
  SiRNA target sequence
catattgattattggtggcggttca

SEQ ID NO: 135957 - DNA, 25 bp, Artificial sequence
  SiRNA target sequence
atattgattattggtggcggttcaa

SEQ ID NO: 135958 - DNA, 25 bp, Artificial sequence
  SiRNA target sequence
tattgattattggtggcggttcaac

SEQ ID NO: 135959 - DNA, 25 bp, Artificial sequence
  SiRNA target sequence
attgattattggtggcggttcaacg

SEQ ID NO: 135960 - DNA, 25 bp, Artificial sequence
  SiRNA target sequence
ttgattattggtggcggttcaacgg

SEQ ID NO: 135961 - DNA, 25 bp, Artificial sequence
  SiRNA target sequence
tgattattggtggcggttcaacggg

SEQ ID NO: 135962 - DNA, 25 bp, Artificial sequence
  SiRNA target sequence
gattattggtggcggttcaacggga

SEQ ID NO: 135963 - DNA, 25 bp, Artificial sequence
  SiRNA target sequence
attattggtggcggttcaacgggaa

SEQ ID NO: 135964 - DNA, 25 bp, Artificial sequence
  SiRNA target sequence
ttattggtggcggttcaacgggaat

SEQ ID NO: 135965 - DNA, 25 bp, Artificial sequence
  SiRNA target sequence
tattggtggcggttcaacgggaatg

SEQ ID NO: 135966 - DNA, 25 bp, Artificial sequence
  SiRNA target sequence
attggtggcggttcaacgggaatgg

SEQ ID NO: 135967 - DNA, 25 bp, Artificial sequence
  SiRNA target sequence
ttggtggcggttcaacgggaatggg

SEQ ID NO: 135968 - DNA, 25 bp, Artificial sequence
  SiRNA target sequence
tggtggcggttcaacgggaatggga

SEQ ID NO: 135969 - DNA, 25 bp, Artificial sequence
  SiRNA target sequence
ggtggcggttcaacgggaatgggat

SEQ ID NO: 135970 - DNA, 25 bp, Artificial sequence
  SiRNA target sequence
gtggcggttcaacgggaatgggatg

SEQ ID NO: 135971 - DNA, 25 bp, Artificial sequence
  SiRNA target sequence
tggcggttcaacgggaatgggatgt

SEQ ID NO: 135972 - DNA, 25 bp, Artificial sequence
  SiRNA target sequence
ggcggttcaacgggaatgggatgtg

SEQ ID NO: 135973 - DNA, 25 bp, Artificial sequence
  SiRNA target sequence
gcggttcaacgggaatgggatgtgc

SEQ ID NO: 135974 - DNA, 25 bp, Artificial sequence
  SiRNA target sequence
cggttcaacgggaatgggatgtgca

SEQ ID NO: 135975 - DNA, 25 bp, Artificial sequence
  SiRNA target sequence
ggttcaacgggaatgggatgtgcaa

SEQ ID NO: 135976 - DNA, 25 bp, Artificial sequence
  SiRNA target sequence
gttcaacgggaatgggatgtgcaat

SEQ ID NO: 135977 - DNA, 25 bp, Artificial sequence
  SiRNA target sequence
ttcaacgggaatgggatgtgcaatc

SEQ ID NO: 135978 - DNA, 25 bp, Artificial sequence
  SiRNA target sequence
tcaacgggaatgggatgtgcaatcg

SEQ ID NO: 135979 - DNA, 25 bp, Artificial sequence
  SiRNA target sequence
caacgggaatgggatgtgcaatcga

SEQ ID NO: 135980 - DNA, 25 bp, Artificial sequence
  SiRNA target sequence
aacgggaatgggatgtgcaatcgaa

SEQ ID NO: 135981 - DNA, 25 bp, Artificial sequence
  SiRNA target sequence
acgggaatgggatgtgcaatcgaag

SEQ ID NO: 135982 - DNA, 25 bp, Artificial sequence
  SiRNA target sequence
cgggaatgggatgtgcaatcgaagc

SEQ ID NO: 135983 - DNA, 25 bp, Artificial sequence
  SiRNA target sequence
gggaatgggatgtgcaatcgaagca

SEQ ID NO: 135984 - DNA, 25 bp, Artificial sequence
  SiRNA target sequence
ggaatgggatgtgcaatcgaagcag

SEQ ID NO: 135985 - DNA, 25 bp, Artificial sequence
  SiRNA target sequence
gaatgggatgtgcaatcgaagcagc

SEQ ID NO: 135986 - DNA, 25 bp, Artificial sequence
  SiRNA target sequence
aatgggatgtgcaatcgaagcagct

SEQ ID NO: 135987 - DNA, 25 bp, Artificial sequence
  SiRNA target sequence
atgggatgtgcaatcgaagcagcta

SEQ ID NO: 135988 - DNA, 25 bp, Artificial sequence
  SiRNA target sequence
tgggatgtgcaatcgaagcagctac

SEQ ID NO: 135989 - DNA, 25 bp, Artificial sequence
  SiRNA target sequence
gggatgtgcaatcgaagcagctaca

SEQ ID NO: 135990 - DNA, 25 bp, Artificial sequence
  SiRNA target sequence
ggatgtgcaatcgaagcagctacac

SEQ ID NO: 135991 - DNA, 25 bp, Artificial sequence
  SiRNA target sequence
gatgtgcaatcgaagcagctacacg

SEQ ID NO: 135992 - DNA, 25 bp, Artificial sequence
  SiRNA target sequence
atgtgcaatcgaagcagctacacga

SEQ ID NO: 135993 - DNA, 25 bp, Artificial sequence
  SiRNA target sequence
tgtgcaatcgaagcagctacacgag

SEQ ID NO: 135994 - DNA, 25 bp, Artificial sequence
  SiRNA target sequence
gtgcaatcgaagcagctacacgagg

SEQ ID NO: 135995 - DNA, 25 bp, Artificial sequence
  SiRNA target sequence
tgcaatcgaagcagctacacgaggt

SEQ ID NO: 135996 - DNA, 25 bp, Artificial sequence
  SiRNA target sequence
gcaatcgaagcagctacacgaggta

SEQ ID NO: 135997 - DNA, 25 bp, Artificial sequence
  SiRNA target sequence
caatcgaagcagctacacgaggtat

SEQ ID NO: 135998 - DNA, 25 bp, Artificial sequence
  SiRNA target sequence
aatcgaagcagctacacgaggtata

SEQ ID NO: 135999 - DNA, 25 bp, Artificial sequence
  SiRNA target sequence
atcgaagcagctacacgaggtataa

SEQ ID NO: 136000 - DNA, 25 bp, Artificial sequence
  SiRNA target sequence
tcgaagcagctacacgaggtataag

SEQ ID NO: 136001 - DNA, 25 bp, Artificial sequence
  SiRNA target sequence
cgaagcagctacacgaggtataagt

SEQ ID NO: 136002 - DNA, 25 bp, Artificial sequence
  SiRNA target sequence
gaagcagctacacgaggtataagtg

SEQ ID NO: 136003 - DNA, 25 bp, Artificial sequence
  SiRNA target sequence
aagcagctacacgaggtataagtgt

SEQ ID NO: 136004 - DNA, 25 bp, Artificial sequence
  SiRNA target sequence
agcagctacacgaggtataagtgtt

SEQ ID NO: 136005 - DNA, 25 bp, Artificial sequence
  SiRNA target sequence
gcagctacacgaggtataagtgttg

SEQ ID NO: 136006 - DNA, 25 bp, Artificial sequence
  SiRNA target sequence
cagctacacgaggtataagtgttgg

SEQ ID NO: 136007 - DNA, 25 bp, Artificial sequence
  SiRNA target sequence
agctacacgaggtataagtgttggc

SEQ ID NO: 136008 - DNA, 25 bp, Artificial sequence
  SiRNA target sequence
gctacacgaggtataagtgttggcc

SEQ ID NO: 136009 - DNA, 25 bp, Artificial sequence
  SiRNA target sequence
ctacacgaggtataagtgttggcct

SEQ ID NO: 136010 - DNA, 25 bp, Artificial sequence
  SiRNA target sequence
tacacgaggtataagtgttggcctg

SEQ ID NO: 136011 - DNA, 25 bp, Artificial sequence
  SiRNA target sequence
acacgaggtataagtgttggcctga

SEQ ID NO: 136012 - DNA, 25 bp, Artificial sequence
  SiRNA target sequence
cacgaggtataagtgttggcctgat

SEQ ID NO: 136013 - DNA, 25 bp, Artificial sequence
  SiRNA target sequence
acgaggtataagtgttggcctgata

SEQ ID NO: 136014 - DNA, 25 bp, Artificial sequence
  SiRNA target sequence
cgaggtataagtgttggcctgatag

SEQ ID NO: 136015 - DNA, 25 bp, Artificial sequence
  SiRNA target sequence
gaggtataagtgttggcctgataga

SEQ ID NO: 136016 - DNA, 25 bp, Artificial sequence
  SiRNA target sequence
aggtataagtgttggcctgatagaa

SEQ ID NO: 136017 - DNA, 25 bp, Artificial sequence
  SiRNA target sequence
ggtataagtgttggcctgatagaag

SEQ ID NO: 136018 - DNA, 25 bp, Artificial sequence
  SiRNA target sequence
gtataagtgttggcctgatagaagc

SEQ ID NO: 136019 - DNA, 25 bp, Artificial sequence
  SiRNA target sequence
tataagtgttggcctgatagaagca

SEQ ID NO: 136020 - DNA, 25 bp, Artificial sequence
  SiRNA target sequence
ataagtgttggcctgatagaagcac

SEQ ID NO: 136021 - DNA, 25 bp, Artificial sequence
  SiRNA target sequence
taagtgttggcctgatagaagcaca

SEQ ID NO: 136022 - DNA, 25 bp, Artificial sequence
  SiRNA target sequence
aagtgttggcctgatagaagcacat

SEQ ID NO: 136023 - DNA, 25 bp, Artificial sequence
  SiRNA target sequence
agtgttggcctgatagaagcacatg

SEQ ID NO: 136024 - DNA, 25 bp, Artificial sequence
  SiRNA target sequence
gtgttggcctgatagaagcacatga

SEQ ID NO: 136025 - DNA, 25 bp, Artificial sequence
  SiRNA target sequence
tgttggcctgatagaagcacatgat

SEQ ID NO: 136026 - DNA, 25 bp, Artificial sequence
  SiRNA target sequence
gttggcctgatagaagcacatgatt

SEQ ID NO: 136027 - DNA, 25 bp, Artificial sequence
  SiRNA target sequence
ttggcctgatagaagcacatgattt

SEQ ID NO: 136028 - DNA, 25 bp, Artificial sequence
  SiRNA target sequence
tggcctgatagaagcacatgatttt

SEQ ID NO: 136029 - DNA, 25 bp, Artificial sequence
  SiRNA target sequence
ggcctgatagaagcacatgattttg

SEQ ID NO: 136030 - DNA, 25 bp, Artificial sequence
  SiRNA target sequence
gcctgatagaagcacatgattttgg

SEQ ID NO: 136031 - DNA, 25 bp, Artificial sequence
  SiRNA target sequence
cctgatagaagcacatgattttggt

SEQ ID NO: 136032 - DNA, 25 bp, Artificial sequence
  SiRNA target sequence
ctgatagaagcacatgattttggtt

SEQ ID NO: 136033 - DNA, 25 bp, Artificial sequence
  SiRNA target sequence
tgatagaagcacatgattttggttc

SEQ ID NO: 136034 - DNA, 25 bp, Artificial sequence
  SiRNA target sequence
gatagaagcacatgattttggttcg

SEQ ID NO: 136035 - DNA, 25 bp, Artificial sequence
  SiRNA target sequence
atagaagcacatgattttggttcgg

SEQ ID NO: 136036 - DNA, 25 bp, Artificial sequence
  SiRNA target sequence
tagaagcacatgattttggttcggg

SEQ ID NO: 136037 - DNA, 25 bp, Artificial sequence
  SiRNA target sequence
agaagcacatgattttggttcgggc

SEQ ID NO: 136038 - DNA, 25 bp, Artificial sequence
  SiRNA target sequence
gaagcacatgattttggttcgggca

SEQ ID NO: 136039 - DNA, 25 bp, Artificial sequence
  SiRNA target sequence
aagcacatgattttggttcgggcac

SEQ ID NO: 136040 - DNA, 25 bp, Artificial sequence
  SiRNA target sequence
agcacatgattttggttcgggcacg

SEQ ID NO: 136041 - DNA, 25 bp, Artificial sequence
  SiRNA target sequence
gcacatgattttggttcgggcacga

SEQ ID NO: 136042 - DNA, 25 bp, Artificial sequence
  SiRNA target sequence
cacatgattttggttcgggcacgag

SEQ ID NO: 136043 - DNA, 25 bp, Artificial sequence
  SiRNA target sequence
acatgattttggttcgggcacgagt

SEQ ID NO: 136044 - DNA, 25 bp, Artificial sequence
  SiRNA target sequence
catgattttggttcgggcacgagtt

SEQ ID NO: 136045 - DNA, 25 bp, Artificial sequence
  SiRNA target sequence
atgattttggttcgggcacgagttc

SEQ ID NO: 136046 - DNA, 25 bp, Artificial sequence
  SiRNA target sequence
tgattttggttcgggcacgagttca

SEQ ID NO: 136047 - DNA, 25 bp, Artificial sequence
  SiRNA target sequence
gattttggttcgggcacgagttcaa

SEQ ID NO: 136048 - DNA, 25 bp, Artificial sequence
  SiRNA target sequence
attttggttcgggcacgagttcaaa

SEQ ID NO: 136049 - DNA, 25 bp, Artificial sequence
  SiRNA target sequence
ttttggttcgggcacgagttcaaaa

SEQ ID NO: 136050 - DNA, 25 bp, Artificial sequence
  SiRNA target sequence
tttggttcgggcacgagttcaaaat

SEQ ID NO: 136051 - DNA, 25 bp, Artificial sequence
  SiRNA target sequence
ttggttcgggcacgagttcaaaatc

SEQ ID NO: 136052 - DNA, 25 bp, Artificial sequence
  SiRNA target sequence
tggttcgggcacgagttcaaaatct

SEQ ID NO: 136053 - DNA, 25 bp, Artificial sequence
  SiRNA target sequence
ggttcgggcacgagttcaaaatcta

SEQ ID NO: 136054 - DNA, 25 bp, Artificial sequence
  SiRNA target sequence
gttcgggcacgagttcaaaatctac

SEQ ID NO: 136055 - DNA, 25 bp, Artificial sequence
  SiRNA target sequence
ttcgggcacgagttcaaaatctaca

SEQ ID NO: 136056 - DNA, 25 bp, Artificial sequence
  SiRNA target sequence
tcgggcacgagttcaaaatctacaa

SEQ ID NO: 136057 - DNA, 25 bp, Artificial sequence
  SiRNA target sequence
cgggcacgagttcaaaatctacaaa

SEQ ID NO: 136058 - DNA, 25 bp, Artificial sequence
  SiRNA target sequence
gggcacgagttcaaaatctacaaaa

SEQ ID NO: 136059 - DNA, 25 bp, Artificial sequence
  SiRNA target sequence
ggcacgagttcaaaatctacaaaac

SEQ ID NO: 136060 - DNA, 25 bp, Artificial sequence
  SiRNA target sequence
gcacgagttcaaaatctacaaaact

SEQ ID NO: 136061 - DNA, 25 bp, Artificial sequence
  SiRNA target sequence
cacgagttcaaaatctacaaaactt

SEQ ID NO: 136062 - DNA, 25 bp, Artificial sequence
  SiRNA target sequence
acgagttcaaaatctacaaaacttt

SEQ ID NO: 136063 - DNA, 25 bp, Artificial sequence
  SiRNA target sequence
cgagttcaaaatctacaaaactttt

SEQ ID NO: 136064 - DNA, 25 bp, Artificial sequence
  SiRNA target sequence
gagttcaaaatctacaaaacttttt

SEQ ID NO: 136065 - DNA, 25 bp, Artificial sequence
  SiRNA target sequence
agttcaaaatctacaaaactttttc

SEQ ID NO: 136066 - DNA, 25 bp, Artificial sequence
  SiRNA target sequence
gttcaaaatctacaaaactttttca

SEQ ID NO: 136067 - DNA, 25 bp, Artificial sequence
  SiRNA target sequence
ttcaaaatctacaaaactttttcat

SEQ ID NO: 136068 - DNA, 25 bp, Artificial sequence
  SiRNA target sequence
tcaaaatctacaaaactttttcatg

SEQ ID NO: 136069 - DNA, 25 bp, Artificial sequence
  SiRNA target sequence
caaaatctacaaaactttttcatgg

SEQ ID NO: 136070 - DNA, 25 bp, Artificial sequence
  SiRNA target sequence
aaaatctacaaaactttttcatggc

SEQ ID NO: 136071 - DNA, 25 bp, Artificial sequence
  SiRNA target sequence
aaatctacaaaactttttcatggcg

SEQ ID NO: 136072 - DNA, 25 bp, Artificial sequence
  SiRNA target sequence
aatctacaaaactttttcatggcgg

SEQ ID NO: 136073 - DNA, 25 bp, Artificial sequence
  SiRNA target sequence
atctacaaaactttttcatggcggt

SEQ ID NO: 136074 - DNA, 25 bp, Artificial sequence
  SiRNA target sequence
tctacaaaactttttcatggcggtg

SEQ ID NO: 136075 - DNA, 25 bp, Artificial sequence
  SiRNA target sequence
ctacaaaactttttcatggcggtgt

SEQ ID NO: 136076 - DNA, 25 bp, Artificial sequence
  SiRNA target sequence
tacaaaactttttcatggcggtgta

SEQ ID NO: 136077 - DNA, 25 bp, Artificial sequence
  SiRNA target sequence
acaaaactttttcatggcggtgtac

SEQ ID NO: 136078 - DNA, 25 bp, Artificial sequence
  SiRNA target sequence
caaaactttttcatggcggtgtacg

SEQ ID NO: 136079 - DNA, 25 bp, Artificial sequence
  SiRNA target sequence
aaaactttttcatggcggtgtacgc

SEQ ID NO: 136080 - DNA, 25 bp, Artificial sequence
  SiRNA target sequence
aaactttttcatggcggtgtacgct

SEQ ID NO: 136081 - DNA, 25 bp, Artificial sequence
  SiRNA target sequence
aactttttcatggcggtgtacgcta

SEQ ID NO: 136082 - DNA, 25 bp, Artificial sequence
  SiRNA target sequence
actttttcatggcggtgtacgctac

SEQ ID NO: 136083 - DNA, 25 bp, Artificial sequence
  SiRNA target sequence
ctttttcatggcggtgtacgctacc

SEQ ID NO: 136084 - DNA, 25 bp, Artificial sequence
  SiRNA target sequence
tttttcatggcggtgtacgctacct

SEQ ID NO: 136085 - DNA, 25 bp, Artificial sequence
  SiRNA target sequence
ttttcatggcggtgtacgctacctt

SEQ ID NO: 136086 - DNA, 25 bp, Artificial sequence
  SiRNA target sequence
tttcatggcggtgtacgctaccttg

SEQ ID NO: 136087 - DNA, 25 bp, Artificial sequence
  SiRNA target sequence
ttcatggcggtgtacgctaccttga

SEQ ID NO: 136088 - DNA, 25 bp, Artificial sequence
  SiRNA target sequence
tcatggcggtgtacgctaccttgaa

SEQ ID NO: 136089 - DNA, 25 bp, Artificial sequence
  SiRNA target sequence
catggcggtgtacgctaccttgaaa

SEQ ID NO: 136090 - DNA, 25 bp, Artificial sequence
  SiRNA target sequence
atggcggtgtacgctaccttgaaaa

SEQ ID NO: 136091 - DNA, 25 bp, Artificial sequence
  SiRNA target sequence
tggcggtgtacgctaccttgaaaaa

SEQ ID NO: 136092 - DNA, 25 bp, Artificial sequence
  SiRNA target sequence
ggcggtgtacgctaccttgaaaaag

SEQ ID NO: 136093 - DNA, 25 bp, Artificial sequence
  SiRNA target sequence
gcggtgtacgctaccttgaaaaagc

SEQ ID NO: 136094 - DNA, 25 bp, Artificial sequence
  SiRNA target sequence
cggtgtacgctaccttgaaaaagct

SEQ ID NO: 136095 - DNA, 25 bp, Artificial sequence
  SiRNA target sequence
ggtgtacgctaccttgaaaaagctg

SEQ ID NO: 136096 - DNA, 25 bp, Artificial sequence
  SiRNA target sequence
gtgtacgctaccttgaaaaagctgt

SEQ ID NO: 136097 - DNA, 25 bp, Artificial sequence
  SiRNA target sequence
tgtacgctaccttgaaaaagctgtt

SEQ ID NO: 136098 - DNA, 25 bp, Artificial sequence
  SiRNA target sequence
gtacgctaccttgaaaaagctgtta

SEQ ID NO: 136099 - DNA, 25 bp, Artificial sequence
  SiRNA target sequence
tacgctaccttgaaaaagctgttaa

SEQ ID NO: 136100 - DNA, 25 bp, Artificial sequence
  SiRNA target sequence
acgctaccttgaaaaagctgttaat

SEQ ID NO: 136101 - DNA, 25 bp, Artificial sequence
  SiRNA target sequence
cgctaccttgaaaaagctgttaatg

SEQ ID NO: 136102 - DNA, 25 bp, Artificial sequence
  SiRNA target sequence
gctaccttgaaaaagctgttaatga

SEQ ID NO: 136103 - DNA, 25 bp, Artificial sequence
  SiRNA target sequence
ctaccttgaaaaagctgttaatgat

SEQ ID NO: 136104 - DNA, 25 bp, Artificial sequence
  SiRNA target sequence
taccttgaaaaagctgttaatgatt

SEQ ID NO: 136105 - DNA, 25 bp, Artificial sequence
  SiRNA target sequence
accttgaaaaagctgttaatgattt

SEQ ID NO: 136106 - DNA, 25 bp, Artificial sequence
  SiRNA target sequence
ccttgaaaaagctgttaatgattta

SEQ ID NO: 136107 - DNA, 25 bp, Artificial sequence
  SiRNA target sequence
cttgaaaaagctgttaatgatttag

SEQ ID NO: 136108 - DNA, 25 bp, Artificial sequence
  SiRNA target sequence
ttgaaaaagctgttaatgatttaga

SEQ ID NO: 136109 - DNA, 25 bp, Artificial sequence
  SiRNA target sequence
tgaaaaagctgttaatgatttagat

SEQ ID NO: 136110 - DNA, 25 bp, Artificial sequence
  SiRNA target sequence
gaaaaagctgttaatgatttagata

SEQ ID NO: 136111 - DNA, 25 bp, Artificial sequence
  SiRNA target sequence
aaaaagctgttaatgatttagatag

SEQ ID NO: 136112 - DNA, 25 bp, Artificial sequence
  SiRNA target sequence
aaaagctgttaatgatttagataga

SEQ ID NO: 136113 - DNA, 25 bp, Artificial sequence
  SiRNA target sequence
aaagctgttaatgatttagatagat

SEQ ID NO: 136114 - DNA, 25 bp, Artificial sequence
  SiRNA target sequence
aagctgttaatgatttagatagatc

SEQ ID NO: 136115 - DNA, 25 bp, Artificial sequence
  SiRNA target sequence
agctgttaatgatttagatagatct

SEQ ID NO: 136116 - DNA, 25 bp, Artificial sequence
  SiRNA target sequence
gctgttaatgatttagatagatctc

SEQ ID NO: 136117 - DNA, 25 bp, Artificial sequence
  SiRNA target sequence
ctgttaatgatttagatagatctca

SEQ ID NO: 136118 - DNA, 25 bp, Artificial sequence
  SiRNA target sequence
tgttaatgatttagatagatctcag

SEQ ID NO: 136119 - DNA, 25 bp, Artificial sequence
  SiRNA target sequence
gttaatgatttagatagatctcagt

SEQ ID NO: 136120 - DNA, 25 bp, Artificial sequence
  SiRNA target sequence
ttaatgatttagatagatctcagtt

SEQ ID NO: 136121 - DNA, 25 bp, Artificial sequence
  SiRNA target sequence
taatgatttagatagatctcagttt

SEQ ID NO: 136122 - DNA, 25 bp, Artificial sequence
  SiRNA target sequence
aatgatttagatagatctcagtttg

SEQ ID NO: 136123 - DNA, 25 bp, Artificial sequence
  SiRNA target sequence
atgatttagatagatctcagtttga

SEQ ID NO: 136124 - DNA, 25 bp, Artificial sequence
  SiRNA target sequence
tgatttagatagatctcagtttgac

SEQ ID NO: 136125 - DNA, 25 bp, Artificial sequence
  SiRNA target sequence
gatttagatagatctcagtttgact

SEQ ID NO: 136126 - DNA, 25 bp, Artificial sequence
  SiRNA target sequence
atttagatagatctcagtttgactt

SEQ ID NO: 136127 - DNA, 25 bp, Artificial sequence
  SiRNA target sequence
tttagatagatctcagtttgacttg

SEQ ID NO: 136128 - DNA, 25 bp, Artificial sequence
  SiRNA target sequence
ttagatagatctcagtttgacttgg

SEQ ID NO: 136129 - DNA, 25 bp, Artificial sequence
  SiRNA target sequence
tagatagatctcagtttgacttggt

SEQ ID NO: 136130 - DNA, 25 bp, Artificial sequence
  SiRNA target sequence
agatagatctcagtttgacttggta

SEQ ID NO: 136131 - DNA, 25 bp, Artificial sequence
  SiRNA target sequence
gatagatctcagtttgacttggtat

SEQ ID NO: 136132 - DNA, 25 bp, Artificial sequence
  SiRNA target sequence
atagatctcagtttgacttggtatc

SEQ ID NO: 136133 - DNA, 25 bp, Artificial sequence
  SiRNA target sequence
tagatctcagtttgacttggtatct

SEQ ID NO: 136134 - DNA, 25 bp, Artificial sequence
  SiRNA target sequence
agatctcagtttgacttggtatctg

SEQ ID NO: 136135 - DNA, 25 bp, Artificial sequence
  SiRNA target sequence
gatctcagtttgacttggtatctga

SEQ ID NO: 136136 - DNA, 25 bp, Artificial sequence
  SiRNA target sequence
atctcagtttgacttggtatctgaa

SEQ ID NO: 136137 - DNA, 25 bp, Artificial sequence
  SiRNA target sequence
tctcagtttgacttggtatctgaag

SEQ ID NO: 136138 - DNA, 25 bp, Artificial sequence
  SiRNA target sequence
ctcagtttgacttggtatctgaagc

SEQ ID NO: 136139 - DNA, 25 bp, Artificial sequence
  SiRNA target sequence
tcagtttgacttggtatctgaagca

SEQ ID NO: 136140 - DNA, 25 bp, Artificial sequence
  SiRNA target sequence
cagtttgacttggtatctgaagcat

SEQ ID NO: 136141 - DNA, 25 bp, Artificial sequence
  SiRNA target sequence
agtttgacttggtatctgaagcatt

SEQ ID NO: 136142 - DNA, 25 bp, Artificial sequence
  SiRNA target sequence
gtttgacttggtatctgaagcatta

SEQ ID NO: 136143 - DNA, 25 bp, Artificial sequence
  SiRNA target sequence
tttgacttggtatctgaagcattaa

SEQ ID NO: 136144 - DNA, 25 bp, Artificial sequence
  SiRNA target sequence
ttgacttggtatctgaagcattaag

SEQ ID NO: 136145 - DNA, 25 bp, Artificial sequence
  SiRNA target sequence
tgacttggtatctgaagcattaagt

SEQ ID NO: 136146 - DNA, 25 bp, Artificial sequence
  SiRNA target sequence
gacttggtatctgaagcattaagtg

SEQ ID NO: 136147 - DNA, 25 bp, Artificial sequence
  SiRNA target sequence
acttggtatctgaagcattaagtga

SEQ ID NO: 136148 - DNA, 25 bp, Artificial sequence
  SiRNA target sequence
cttggtatctgaagcattaagtgaa

SEQ ID NO: 136149 - DNA, 25 bp, Artificial sequence
  SiRNA target sequence
ttggtatctgaagcattaagtgaac

SEQ ID NO: 136150 - DNA, 25 bp, Artificial sequence
  SiRNA target sequence
tggtatctgaagcattaagtgaacg

SEQ ID NO: 136151 - DNA, 25 bp, Artificial sequence
  SiRNA target sequence
ggtatctgaagcattaagtgaacga

SEQ ID NO: 136152 - DNA, 25 bp, Artificial sequence
  SiRNA target sequence
gtatctgaagcattaagtgaacgaa

SEQ ID NO: 136153 - DNA, 25 bp, Artificial sequence
  SiRNA target sequence
tatctgaagcattaagtgaacgaaa

SEQ ID NO: 136154 - DNA, 25 bp, Artificial sequence
  SiRNA target sequence
atctgaagcattaagtgaacgaaaa

SEQ ID NO: 136155 - DNA, 25 bp, Artificial sequence
  SiRNA target sequence
tctgaagcattaagtgaacgaaaaa

SEQ ID NO: 136156 - DNA, 25 bp, Artificial sequence
  SiRNA target sequence
ctgaagcattaagtgaacgaaaaat

SEQ ID NO: 136157 - DNA, 25 bp, Artificial sequence
  SiRNA target sequence
tgaagcattaagtgaacgaaaaatt

SEQ ID NO: 136158 - DNA, 25 bp, Artificial sequence
  SiRNA target sequence
gaagcattaagtgaacgaaaaattg

SEQ ID NO: 136159 - DNA, 25 bp, Artificial sequence
  SiRNA target sequence
aagcattaagtgaacgaaaaattgt

SEQ ID NO: 136160 - DNA, 25 bp, Artificial sequence
  SiRNA target sequence
agcattaagtgaacgaaaaattgtt

SEQ ID NO: 136161 - DNA, 25 bp, Artificial sequence
  SiRNA target sequence
gcattaagtgaacgaaaaattgtta

SEQ ID NO: 136162 - DNA, 25 bp, Artificial sequence
  SiRNA target sequence
cattaagtgaacgaaaaattgttat

SEQ ID NO: 136163 - DNA, 25 bp, Artificial sequence
  SiRNA target sequence
attaagtgaacgaaaaattgttatg

SEQ ID NO: 136164 - DNA, 25 bp, Artificial sequence
  SiRNA target sequence
ttaagtgaacgaaaaattgttatga

SEQ ID NO: 136165 - DNA, 25 bp, Artificial sequence
  SiRNA target sequence
taagtgaacgaaaaattgttatgaa

SEQ ID NO: 136166 - DNA, 25 bp, Artificial sequence
  SiRNA target sequence
aagtgaacgaaaaattgttatgaat

SEQ ID NO: 136167 - DNA, 25 bp, Artificial sequence
  SiRNA target sequence
agtgaacgaaaaattgttatgaata

SEQ ID NO: 136168 - DNA, 25 bp, Artificial sequence
  SiRNA target sequence
gtgaacgaaaaattgttatgaatat

SEQ ID NO: 136169 - DNA, 25 bp, Artificial sequence
  SiRNA target sequence
tgaacgaaaaattgttatgaatatg

SEQ ID NO: 136170 - DNA, 25 bp, Artificial sequence
  SiRNA target sequence
gaacgaaaaattgttatgaatatgt

SEQ ID NO: 136171 - DNA, 25 bp, Artificial sequence
  SiRNA target sequence
aacgaaaaattgttatgaatatgtg

SEQ ID NO: 136172 - DNA, 25 bp, Artificial sequence
  SiRNA target sequence
acgaaaaattgttatgaatatgtgt

SEQ ID NO: 136173 - DNA, 25 bp, Artificial sequence
  SiRNA target sequence
cgaaaaattgttatgaatatgtgtc

SEQ ID NO: 136174 - DNA, 25 bp, Artificial sequence
  SiRNA target sequence
gaaaaattgttatgaatatgtgtcc

SEQ ID NO: 136175 - DNA, 25 bp, Artificial sequence
  SiRNA target sequence
aaaaattgttatgaatatgtgtcct

SEQ ID NO: 136176 - DNA, 25 bp, Artificial sequence
  SiRNA target sequence
aaaattgttatgaatatgtgtcctt

SEQ ID NO: 136177 - DNA, 25 bp, Artificial sequence
  SiRNA target sequence
aaattgttatgaatatgtgtccttt

SEQ ID NO: 136178 - DNA, 25 bp, Artificial sequence
  SiRNA target sequence
aattgttatgaatatgtgtcctttt

SEQ ID NO: 136179 - DNA, 25 bp, Artificial sequence
  SiRNA target sequence
attgttatgaatatgtgtccttttc

SEQ ID NO: 136180 - DNA, 25 bp, Artificial sequence
  SiRNA target sequence
ttgttatgaatatgtgtccttttct

SEQ ID NO: 136181 - DNA, 25 bp, Artificial sequence
  SiRNA target sequence
tgttatgaatatgtgtccttttcta

SEQ ID NO: 136182 - DNA, 25 bp, Artificial sequence
  SiRNA target sequence
gttatgaatatgtgtccttttctag

SEQ ID NO: 136183 - DNA, 25 bp, Artificial sequence
  SiRNA target sequence
ttatgaatatgtgtccttttctagt

SEQ ID NO: 136184 - DNA, 25 bp, Artificial sequence
  SiRNA target sequence
tatgaatatgtgtccttttctagta

SEQ ID NO: 136185 - DNA, 25 bp, Artificial sequence
  SiRNA target sequence
atgaatatgtgtccttttctagtaa

SEQ ID NO: 136186 - DNA, 25 bp, Artificial sequence
  SiRNA target sequence
tgaatatgtgtccttttctagtaag

SEQ ID NO: 136187 - DNA, 25 bp, Artificial sequence
  SiRNA target sequence
gaatatgtgtccttttctagtaagg

SEQ ID NO: 136188 - DNA, 25 bp, Artificial sequence
  SiRNA target sequence
aatatgtgtccttttctagtaaggt

SEQ ID NO: 136189 - DNA, 25 bp, Artificial sequence
  SiRNA target sequence
atatgtgtccttttctagtaaggtc

SEQ ID NO: 136190 - DNA, 25 bp, Artificial sequence
  SiRNA target sequence
tatgtgtccttttctagtaaggtcg

SEQ ID NO: 136191 - DNA, 25 bp, Artificial sequence
  SiRNA target sequence
atgtgtccttttctagtaaggtcga

SEQ ID NO: 136192 - DNA, 25 bp, Artificial sequence
  SiRNA target sequence
tgtgtccttttctagtaaggtcgat

SEQ ID NO: 136193 - DNA, 25 bp, Artificial sequence
  SiRNA target sequence
gtgtccttttctagtaaggtcgatg

SEQ ID NO: 136194 - DNA, 25 bp, Artificial sequence
  SiRNA target sequence
tgtccttttctagtaaggtcgatgg

SEQ ID NO: 136195 - DNA, 25 bp, Artificial sequence
  SiRNA target sequence
gtccttttctagtaaggtcgatgga

SEQ ID NO: 136196 - DNA, 25 bp, Artificial sequence
  SiRNA target sequence
tccttttctagtaaggtcgatggaa

SEQ ID NO: 136197 - DNA, 25 bp, Artificial sequence
  SiRNA target sequence
ccttttctagtaaggtcgatggaaa

SEQ ID NO: 136198 - DNA, 25 bp, Artificial sequence
  SiRNA target sequence
cttttctagtaaggtcgatggaaat

SEQ ID NO: 136199 - DNA, 25 bp, Artificial sequence
  SiRNA target sequence
ttttctagtaaggtcgatggaaata

SEQ ID NO: 136200 - DNA, 25 bp, Artificial sequence
  SiRNA target sequence
tttctagtaaggtcgatggaaatat

SEQ ID NO: 136201 - DNA, 25 bp, Artificial sequence
  SiRNA target sequence
ttctagtaaggtcgatggaaatatt

SEQ ID NO: 136202 - DNA, 25 bp, Artificial sequence
  SiRNA target sequence
tctagtaaggtcgatggaaatatta

SEQ ID NO: 136203 - DNA, 25 bp, Artificial sequence
  SiRNA target sequence
ctagtaaggtcgatggaaatattat

SEQ ID NO: 136204 - DNA, 25 bp, Artificial sequence
  SiRNA target sequence
tagtaaggtcgatggaaatattatt

SEQ ID NO: 136205 - DNA, 25 bp, Artificial sequence
  SiRNA target sequence
agtaaggtcgatggaaatattattt

SEQ ID NO: 136206 - DNA, 25 bp, Artificial sequence
  SiRNA target sequence
gtaaggtcgatggaaatattatttc

SEQ ID NO: 136207 - DNA, 25 bp, Artificial sequence
  SiRNA target sequence
taaggtcgatggaaatattatttcc

SEQ ID NO: 136208 - DNA, 25 bp, Artificial sequence
  SiRNA target sequence
aaggtcgatggaaatattatttccg

SEQ ID NO: 136209 - DNA, 25 bp, Artificial sequence
  SiRNA target sequence
aggtcgatggaaatattatttccgg

SEQ ID NO: 136210 - DNA, 25 bp, Artificial sequence
  SiRNA target sequence
ggtcgatggaaatattatttccggt

SEQ ID NO: 136211 - DNA, 25 bp, Artificial sequence
  SiRNA target sequence
gtcgatggaaatattatttccggtt

SEQ ID NO: 136212 - DNA, 25 bp, Artificial sequence
  SiRNA target sequence
tcgatggaaatattatttccggttt

SEQ ID NO: 136213 - DNA, 25 bp, Artificial sequence
  SiRNA target sequence
cgatggaaatattatttccggttta

SEQ ID NO: 136214 - DNA, 25 bp, Artificial sequence
  SiRNA target sequence
gatggaaatattatttccggtttat

SEQ ID NO: 136215 - DNA, 25 bp, Artificial sequence
  SiRNA target sequence
atggaaatattatttccggtttata

SEQ ID NO: 136216 - DNA, 25 bp, Artificial sequence
  SiRNA target sequence
tggaaatattatttccggtttataa

SEQ ID NO: 136217 - DNA, 25 bp, Artificial sequence
  SiRNA target sequence
ggaaatattatttccggtttataaa

SEQ ID NO: 136218 - DNA, 25 bp, Artificial sequence
  SiRNA target sequence
gaaatattatttccggtttataaaa

SEQ ID NO: 136219 - DNA, 25 bp, Artificial sequence
  SiRNA target sequence
aaatattatttccggtttataaaag

SEQ ID NO: 136220 - DNA, 25 bp, Artificial sequence
  SiRNA target sequence
aatattatttccggtttataaaagg

SEQ ID NO: 136221 - DNA, 25 bp, Artificial sequence
  SiRNA target sequence
atattatttccggtttataaaaggc

SEQ ID NO: 136222 - DNA, 25 bp, Artificial sequence
  SiRNA target sequence
tattatttccggtttataaaaggct

SEQ ID NO: 136223 - DNA, 25 bp, Artificial sequence
  SiRNA target sequence
attatttccggtttataaaaggctt

SEQ ID NO: 136224 - DNA, 25 bp, Artificial sequence
  SiRNA target sequence
ttatttccggtttataaaaggcttt

SEQ ID NO: 136225 - DNA, 25 bp, Artificial sequence
  SiRNA target sequence
tatttccggtttataaaaggctttt

SEQ ID NO: 136226 - DNA, 25 bp, Artificial sequence
  SiRNA target sequence
atttccggtttataaaaggctttta

SEQ ID NO: 136227 - DNA, 25 bp, Artificial sequence
  SiRNA target sequence
tttccggtttataaaaggcttttaa

SEQ ID NO: 136228 - DNA, 25 bp, Artificial sequence
  SiRNA target sequence
ttccggtttataaaaggcttttaat

SEQ ID NO: 136229 - DNA, 25 bp, Artificial sequence
  SiRNA target sequence
tccggtttataaaaggcttttaatt

SEQ ID NO: 136230 - DNA, 25 bp, Artificial sequence
  SiRNA target sequence
ccggtttataaaaggcttttaattc

SEQ ID NO: 136231 - DNA, 25 bp, Artificial sequence
  SiRNA target sequence
cggtttataaaaggcttttaattcc

SEQ ID NO: 136232 - DNA, 25 bp, Artificial sequence
  SiRNA target sequence
ggtttataaaaggcttttaattcct

SEQ ID NO: 136233 - DNA, 25 bp, Artificial sequence
  SiRNA target sequence
gtttataaaaggcttttaattcctt

SEQ ID NO: 136234 - DNA, 25 bp, Artificial sequence
  SiRNA target sequence
tttataaaaggcttttaattcctta

SEQ ID NO: 136235 - DNA, 25 bp, Artificial sequence
  SiRNA target sequence
ttataaaaggcttttaattccttac

SEQ ID NO: 136236 - DNA, 25 bp, Artificial sequence
  SiRNA target sequence
tataaaaggcttttaattccttact

SEQ ID NO: 136237 - DNA, 25 bp, Artificial sequence
  SiRNA target sequence
ataaaaggcttttaattccttacta

SEQ ID NO: 136238 - DNA, 25 bp, Artificial sequence
  SiRNA target sequence
taaaaggcttttaattccttactac

SEQ ID NO: 136239 - DNA, 25 bp, Artificial sequence
  SiRNA target sequence
aaaaggcttttaattccttactact

SEQ ID NO: 136240 - DNA, 25 bp, Artificial sequence
  SiRNA target sequence
aaaggcttttaattccttactacta

SEQ ID NO: 136241 - DNA, 25 bp, Artificial sequence
  SiRNA target sequence
aaggcttttaattccttactactat

SEQ ID NO: 136242 - DNA, 25 bp, Artificial sequence
  SiRNA target sequence
aggcttttaattccttactactata

SEQ ID NO: 136243 - DNA, 25 bp, Artificial sequence
  SiRNA target sequence
ggcttttaattccttactactatat

SEQ ID NO: 136244 - DNA, 25 bp, Artificial sequence
  SiRNA target sequence
gcttttaattccttactactatatt

SEQ ID NO: 136245 - DNA, 25 bp, Artificial sequence
  SiRNA target sequence
cttttaattccttactactatattg

SEQ ID NO: 136246 - DNA, 25 bp, Artificial sequence
  SiRNA target sequence
ttttaattccttactactatattgg

SEQ ID NO: 136247 - DNA, 25 bp, Artificial sequence
  SiRNA target sequence
tttaattccttactactatattggc

SEQ ID NO: 136248 - DNA, 25 bp, Artificial sequence
  SiRNA target sequence
ttaattccttactactatattggcc

SEQ ID NO: 136249 - DNA, 25 bp, Artificial sequence
  SiRNA target sequence
taattccttactactatattggcct

SEQ ID NO: 136250 - DNA, 25 bp, Artificial sequence
  SiRNA target sequence
aattccttactactatattggcctt

SEQ ID NO: 136251 - DNA, 25 bp, Artificial sequence
  SiRNA target sequence
attccttactactatattggcctta

SEQ ID NO: 136252 - DNA, 25 bp, Artificial sequence
  SiRNA target sequence
ttccttactactatattggccttaa

SEQ ID NO: 136253 - DNA, 25 bp, Artificial sequence
  SiRNA target sequence
tccttactactatattggccttaaa

SEQ ID NO: 136254 - DNA, 25 bp, Artificial sequence
  SiRNA target sequence
ccttactactatattggccttaaat

SEQ ID NO: 136255 - DNA, 25 bp, Artificial sequence
  SiRNA target sequence
cttactactatattggccttaaatt

SEQ ID NO: 136256 - DNA, 25 bp, Artificial sequence
  SiRNA target sequence
ttactactatattggccttaaattt

SEQ ID NO: 136257 - DNA, 25 bp, Artificial sequence
  SiRNA target sequence
tactactatattggccttaaatttt

SEQ ID NO: 136258 - DNA, 25 bp, Artificial sequence
  SiRNA target sequence
actactatattggccttaaatttta

SEQ ID NO: 136259 - DNA, 25 bp, Artificial sequence
  SiRNA target sequence
ctactatattggccttaaattttat

SEQ ID NO: 136260 - DNA, 25 bp, Artificial sequence
  SiRNA target sequence
tactatattggccttaaattttatg

SEQ ID NO: 136261 - DNA, 25 bp, Artificial sequence
  SiRNA target sequence
actatattggccttaaattttatga

SEQ ID NO: 136262 - DNA, 25 bp, Artificial sequence
  SiRNA target sequence
ctatattggccttaaattttatgat

SEQ ID NO: 136263 - DNA, 25 bp, Artificial sequence
  SiRNA target sequence
tatattggccttaaattttatgatt

SEQ ID NO: 136264 - DNA, 25 bp, Artificial sequence
  SiRNA target sequence
atattggccttaaattttatgattg

SEQ ID NO: 136265 - DNA, 25 bp, Artificial sequence
  SiRNA target sequence
tattggccttaaattttatgattgg

SEQ ID NO: 136266 - DNA, 25 bp, Artificial sequence
  SiRNA target sequence
attggccttaaattttatgattgga

SEQ ID NO: 136267 - DNA, 25 bp, Artificial sequence
  SiRNA target sequence
ttggccttaaattttatgattggat

SEQ ID NO: 136268 - DNA, 25 bp, Artificial sequence
  SiRNA target sequence
tggccttaaattttatgattggatt

SEQ ID NO: 136269 - DNA, 25 bp, Artificial sequence
  SiRNA target sequence
ggccttaaattttatgattggattt

SEQ ID NO: 136270 - DNA, 25 bp, Artificial sequence
  SiRNA target sequence
gccttaaattttatgattggatttc

SEQ ID NO: 136271 - DNA, 25 bp, Artificial sequence
  SiRNA target sequence
ccttaaattttatgattggatttct

SEQ ID NO: 136272 - DNA, 25 bp, Artificial sequence
  SiRNA target sequence
cttaaattttatgattggatttctg

SEQ ID NO: 136273 - DNA, 25 bp, Artificial sequence
  SiRNA target sequence
ttaaattttatgattggatttctgg

SEQ ID NO: 136274 - DNA, 25 bp, Artificial sequence
  SiRNA target sequence
taaattttatgattggatttctggg

SEQ ID NO: 136275 - DNA, 25 bp, Artificial sequence
  SiRNA target sequence
aaattttatgattggatttctgggc

SEQ ID NO: 136276 - DNA, 25 bp, Artificial sequence
  SiRNA target sequence
aattttatgattggatttctgggca

SEQ ID NO: 136277 - DNA, 25 bp, Artificial sequence
  SiRNA target sequence
attttatgattggatttctgggcaa

SEQ ID NO: 136278 - DNA, 25 bp, Artificial sequence
  SiRNA target sequence
ttttatgattggatttctgggcaac

SEQ ID NO: 136279 - DNA, 25 bp, Artificial sequence
  SiRNA target sequence
tttatgattggatttctgggcaacg

SEQ ID NO: 136280 - DNA, 25 bp, Artificial sequence
  SiRNA target sequence
ttatgattggatttctgggcaacgg

SEQ ID NO: 136281 - DNA, 25 bp, Artificial sequence
  SiRNA target sequence
tatgattggatttctgggcaacggt

SEQ ID NO: 136282 - DNA, 25 bp, Artificial sequence
  SiRNA target sequence
atgattggatttctgggcaacggtc

SEQ ID NO: 136283 - DNA, 25 bp, Artificial sequence
  SiRNA target sequence
tgattggatttctgggcaacggtcc

SEQ ID NO: 136284 - DNA, 25 bp, Artificial sequence
  SiRNA target sequence
gattggatttctgggcaacggtccc

SEQ ID NO: 136285 - DNA, 25 bp, Artificial sequence
  SiRNA target sequence
attggatttctgggcaacggtccct

SEQ ID NO: 136286 - DNA, 25 bp, Artificial sequence
  SiRNA target sequence
ttggatttctgggcaacggtccctt

SEQ ID NO: 136287 - DNA, 25 bp, Artificial sequence
  SiRNA target sequence
tggatttctgggcaacggtcccttg

SEQ ID NO: 136288 - DNA, 25 bp, Artificial sequence
  SiRNA target sequence
ggatttctgggcaacggtcccttgg

SEQ ID NO: 136289 - DNA, 25 bp, Artificial sequence
  SiRNA target sequence
gatttctgggcaacggtcccttggg

SEQ ID NO: 136290 - DNA, 25 bp, Artificial sequence
  SiRNA target sequence
atttctgggcaacggtcccttgggc

SEQ ID NO: 136291 - DNA, 25 bp, Artificial sequence
  SiRNA target sequence
tttctgggcaacggtcccttgggcg

SEQ ID NO: 136292 - DNA, 25 bp, Artificial sequence
  SiRNA target sequence
ttctgggcaacggtcccttgggcga

SEQ ID NO: 136293 - DNA, 25 bp, Artificial sequence
  SiRNA target sequence
tctgggcaacggtcccttgggcgaa

SEQ ID NO: 136294 - DNA, 25 bp, Artificial sequence
  SiRNA target sequence
ctgggcaacggtcccttgggcgaag

SEQ ID NO: 136295 - DNA, 25 bp, Artificial sequence
  SiRNA target sequence
tgggcaacggtcccttgggcgaagt

SEQ ID NO: 136296 - DNA, 25 bp, Artificial sequence
  SiRNA target sequence
gggcaacggtcccttgggcgaagta

SEQ ID NO: 136297 - DNA, 25 bp, Artificial sequence
  SiRNA target sequence
ggcaacggtcccttgggcgaagtaa

SEQ ID NO: 136298 - DNA, 25 bp, Artificial sequence
  SiRNA target sequence
gcaacggtcccttgggcgaagtaaa

SEQ ID NO: 136299 - DNA, 25 bp, Artificial sequence
  SiRNA target sequence
caacggtcccttgggcgaagtaaat

SEQ ID NO: 136300 - DNA, 25 bp, Artificial sequence
  SiRNA target sequence
aacggtcccttgggcgaagtaaatt

SEQ ID NO: 136301 - DNA, 25 bp, Artificial sequence
  SiRNA target sequence
acggtcccttgggcgaagtaaattt

SEQ ID NO: 136302 - DNA, 25 bp, Artificial sequence
  SiRNA target sequence
cggtcccttgggcgaagtaaatttt

SEQ ID NO: 136303 - DNA, 25 bp, Artificial sequence
  SiRNA target sequence
ggtcccttgggcgaagtaaattttt

SEQ ID NO: 136304 - DNA, 25 bp, Artificial sequence
  SiRNA target sequence
gtcccttgggcgaagtaaatttttg

SEQ ID NO: 136305 - DNA, 25 bp, Artificial sequence
  SiRNA target sequence
tcccttgggcgaagtaaatttttgt

SEQ ID NO: 136306 - DNA, 25 bp, Artificial sequence
  SiRNA target sequence
cccttgggcgaagtaaatttttgtc

SEQ ID NO: 136307 - DNA, 25 bp, Artificial sequence
  SiRNA target sequence
ccttgggcgaagtaaatttttgtcg

SEQ ID NO: 136308 - DNA, 25 bp, Artificial sequence
  SiRNA target sequence
cttgggcgaagtaaatttttgtcgc

SEQ ID NO: 136309 - DNA, 25 bp, Artificial sequence
  SiRNA target sequence
ttgggcgaagtaaatttttgtcgcg

SEQ ID NO: 136310 - DNA, 25 bp, Artificial sequence
  SiRNA target sequence
tgggcgaagtaaatttttgtcgcgg

SEQ ID NO: 136311 - DNA, 25 bp, Artificial sequence
  SiRNA target sequence
gggcgaagtaaatttttgtcgcggc

SEQ ID NO: 136312 - DNA, 25 bp, Artificial sequence
  SiRNA target sequence
ggcgaagtaaatttttgtcgcggca

SEQ ID NO: 136313 - DNA, 25 bp, Artificial sequence
  SiRNA target sequence
gcgaagtaaatttttgtcgcggcaa

SEQ ID NO: 136314 - DNA, 25 bp, Artificial sequence
  SiRNA target sequence
cgaagtaaatttttgtcgcggcaac

SEQ ID NO: 136315 - DNA, 25 bp, Artificial sequence
  SiRNA target sequence
gaagtaaatttttgtcgcggcaaca

SEQ ID NO: 136316 - DNA, 25 bp, Artificial sequence
  SiRNA target sequence
aagtaaatttttgtcgcggcaacaa

SEQ ID NO: 136317 - DNA, 25 bp, Artificial sequence
  SiRNA target sequence
agtaaatttttgtcgcggcaacaaa

SEQ ID NO: 136318 - DNA, 25 bp, Artificial sequence
  SiRNA target sequence
gtaaatttttgtcgcggcaacaaac

SEQ ID NO: 136319 - DNA, 25 bp, Artificial sequence
  SiRNA target sequence
taaatttttgtcgcggcaacaaact

SEQ ID NO: 136320 - DNA, 25 bp, Artificial sequence
  SiRNA target sequence
aaatttttgtcgcggcaacaaacta

SEQ ID NO: 136321 - DNA, 25 bp, Artificial sequence
  SiRNA target sequence
aatttttgtcgcggcaacaaactat

SEQ ID NO: 136322 - DNA, 25 bp, Artificial sequence
  SiRNA target sequence
atttttgtcgcggcaacaaactatt

SEQ ID NO: 136323 - DNA, 25 bp, Artificial sequence
  SiRNA target sequence
tttttgtcgcggcaacaaactatta

SEQ ID NO: 136324 - DNA, 25 bp, Artificial sequence
  SiRNA target sequence
ttttgtcgcggcaacaaactattac

SEQ ID NO: 136325 - DNA, 25 bp, Artificial sequence
  SiRNA target sequence
tttgtcgcggcaacaaactattaca

SEQ ID NO: 136326 - DNA, 25 bp, Artificial sequence
  SiRNA target sequence
ttgtcgcggcaacaaactattacaa

SEQ ID NO: 136327 - DNA, 25 bp, Artificial sequence
  SiRNA target sequence
tgtcgcggcaacaaactattacaaa

SEQ ID NO: 136328 - DNA, 25 bp, Artificial sequence
  SiRNA target sequence
gtcgcggcaacaaactattacaaaa

SEQ ID NO: 136329 - DNA, 25 bp, Artificial sequence
  SiRNA target sequence
tcgcggcaacaaactattacaaaat

SEQ ID NO: 136330 - DNA, 25 bp, Artificial sequence
  SiRNA target sequence
cgcggcaacaaactattacaaaatt

SEQ ID NO: 136331 - DNA, 25 bp, Artificial sequence
  SiRNA target sequence
gcggcaacaaactattacaaaattt

SEQ ID NO: 136332 - DNA, 25 bp, Artificial sequence
  SiRNA target sequence
cggcaacaaactattacaaaatttc

SEQ ID NO: 136333 - DNA, 25 bp, Artificial sequence
  SiRNA target sequence
ggcaacaaactattacaaaatttcc

SEQ ID NO: 136334 - DNA, 25 bp, Artificial sequence
  SiRNA target sequence
gcaacaaactattacaaaatttcct

SEQ ID NO: 136335 - DNA, 25 bp, Artificial sequence
  SiRNA target sequence
caacaaactattacaaaatttccta

SEQ ID NO: 136336 - DNA, 25 bp, Artificial sequence
  SiRNA target sequence
aacaaactattacaaaatttcctaa

SEQ ID NO: 136337 - DNA, 25 bp, Artificial sequence
  SiRNA target sequence
acaaactattacaaaatttcctaat

SEQ ID NO: 136338 - DNA, 25 bp, Artificial sequence
  SiRNA target sequence
caaactattacaaaatttcctaatg

SEQ ID NO: 136339 - DNA, 25 bp, Artificial sequence
  SiRNA target sequence
aaactattacaaaatttcctaatgt

SEQ ID NO: 136340 - DNA, 25 bp, Artificial sequence
  SiRNA target sequence
aactattacaaaatttcctaatgtg

SEQ ID NO: 136341 - DNA, 25 bp, Artificial sequence
  SiRNA target sequence
actattacaaaatttcctaatgtga

SEQ ID NO: 136342 - DNA, 25 bp, Artificial sequence
  SiRNA target sequence
ctattacaaaatttcctaatgtgag

SEQ ID NO: 136343 - DNA, 25 bp, Artificial sequence
  SiRNA target sequence
tattacaaaatttcctaatgtgaga

SEQ ID NO: 136344 - DNA, 25 bp, Artificial sequence
  SiRNA target sequence
attacaaaatttcctaatgtgagaa

SEQ ID NO: 136345 - DNA, 25 bp, Artificial sequence
  SiRNA target sequence
ttacaaaatttcctaatgtgagaaa

SEQ ID NO: 136346 - DNA, 25 bp, Artificial sequence
  SiRNA target sequence
tacaaaatttcctaatgtgagaaaa

SEQ ID NO: 136347 - DNA, 25 bp, Artificial sequence
  SiRNA target sequence
acaaaatttcctaatgtgagaaaaa

SEQ ID NO: 136348 - DNA, 25 bp, Artificial sequence
  SiRNA target sequence
caaaatttcctaatgtgagaaaaat

SEQ ID NO: 136349 - DNA, 25 bp, Artificial sequence
  SiRNA target sequence
aaaatttcctaatgtgagaaaaatc

SEQ ID NO: 136350 - DNA, 25 bp, Artificial sequence
  SiRNA target sequence
aaatttcctaatgtgagaaaaatcg

SEQ ID NO: 136351 - DNA, 25 bp, Artificial sequence
  SiRNA target sequence
aatttcctaatgtgagaaaaatcga

SEQ ID NO: 136352 - DNA, 25 bp, Artificial sequence
  SiRNA target sequence
atttcctaatgtgagaaaaatcgac

SEQ ID NO: 136353 - DNA, 25 bp, Artificial sequence
  SiRNA target sequence
tttcctaatgtgagaaaaatcgacc

SEQ ID NO: 136354 - DNA, 25 bp, Artificial sequence
  SiRNA target sequence
ttcctaatgtgagaaaaatcgacct

SEQ ID NO: 136355 - DNA, 25 bp, Artificial sequence
  SiRNA target sequence
tcctaatgtgagaaaaatcgacctt

SEQ ID NO: 136356 - DNA, 25 bp, Artificial sequence
  SiRNA target sequence
cctaatgtgagaaaaatcgaccttg

SEQ ID NO: 136357 - DNA, 25 bp, Artificial sequence
  SiRNA target sequence
ctaatgtgagaaaaatcgaccttgt

SEQ ID NO: 136358 - DNA, 25 bp, Artificial sequence
  SiRNA target sequence
taatgtgagaaaaatcgaccttgta

SEQ ID NO: 136359 - DNA, 25 bp, Artificial sequence
  SiRNA target sequence
aatgtgagaaaaatcgaccttgtag

SEQ ID NO: 136360 - DNA, 25 bp, Artificial sequence
  SiRNA target sequence
atgtgagaaaaatcgaccttgtagg

SEQ ID NO: 136361 - DNA, 25 bp, Artificial sequence
  SiRNA target sequence
tgtgagaaaaatcgaccttgtagga

SEQ ID NO: 136362 - DNA, 25 bp, Artificial sequence
  SiRNA target sequence
gtgagaaaaatcgaccttgtaggat

SEQ ID NO: 136363 - DNA, 25 bp, Artificial sequence
  SiRNA target sequence
tgagaaaaatcgaccttgtaggatc

SEQ ID NO: 136364 - DNA, 25 bp, Artificial sequence
  SiRNA target sequence
gagaaaaatcgaccttgtaggatcc

SEQ ID NO: 136365 - DNA, 25 bp, Artificial sequence
  SiRNA target sequence
agaaaaatcgaccttgtaggatccg

SEQ ID NO: 136366 - DNA, 25 bp, Artificial sequence
  SiRNA target sequence
gaaaaatcgaccttgtaggatccgt

SEQ ID NO: 136367 - DNA, 25 bp, Artificial sequence
  SiRNA target sequence
aaaaatcgaccttgtaggatccgtt

SEQ ID NO: 136368 - DNA, 25 bp, Artificial sequence
  SiRNA target sequence
aaaatcgaccttgtaggatccgttt

SEQ ID NO: 136369 - DNA, 25 bp, Artificial sequence
  SiRNA target sequence
aaatcgaccttgtaggatccgtttc

SEQ ID NO: 136370 - DNA, 25 bp, Artificial sequence
  SiRNA target sequence
aatcgaccttgtaggatccgtttcg

SEQ ID NO: 136371 - DNA, 25 bp, Artificial sequence
  SiRNA target sequence
atcgaccttgtaggatccgtttcgt

SEQ ID NO: 136372 - DNA, 25 bp, Artificial sequence
  SiRNA target sequence
tcgaccttgtaggatccgtttcgta

SEQ ID NO: 136373 - DNA, 25 bp, Artificial sequence
  SiRNA target sequence
cgaccttgtaggatccgtttcgtat

SEQ ID NO: 136374 - DNA, 25 bp, Artificial sequence
  SiRNA target sequence
gaccttgtaggatccgtttcgtatc

SEQ ID NO: 136375 - DNA, 25 bp, Artificial sequence
  SiRNA target sequence
accttgtaggatccgtttcgtatcg

SEQ ID NO: 136376 - DNA, 25 bp, Artificial sequence
  SiRNA target sequence
ccttgtaggatccgtttcgtatcgt

SEQ ID NO: 136377 - DNA, 25 bp, Artificial sequence
  SiRNA target sequence
cttgtaggatccgtttcgtatcgtg

SEQ ID NO: 136378 - DNA, 25 bp, Artificial sequence
  SiRNA target sequence
ttgtaggatccgtttcgtatcgtga

SEQ ID NO: 136379 - DNA, 25 bp, Artificial sequence
  SiRNA target sequence
tgtaggatccgtttcgtatcgtgat

SEQ ID NO: 136380 - DNA, 25 bp, Artificial sequence
  SiRNA target sequence
gtaggatccgtttcgtatcgtgatg

SEQ ID NO: 136381 - DNA, 25 bp, Artificial sequence
  SiRNA target sequence
taggatccgtttcgtatcgtgatgg

SEQ ID NO: 136382 - DNA, 25 bp, Artificial sequence
  SiRNA target sequence
aggatccgtttcgtatcgtgatggc

SEQ ID NO: 136383 - DNA, 25 bp, Artificial sequence
  SiRNA target sequence
ggatccgtttcgtatcgtgatggcc

SEQ ID NO: 136384 - DNA, 25 bp, Artificial sequence
  SiRNA target sequence
gatccgtttcgtatcgtgatggcca

SEQ ID NO: 136385 - DNA, 25 bp, Artificial sequence
  SiRNA target sequence
atccgtttcgtatcgtgatggccaa

SEQ ID NO: 136386 - DNA, 25 bp, Artificial sequence
  SiRNA target sequence
tccgtttcgtatcgtgatggccaat

SEQ ID NO: 136387 - DNA, 25 bp, Artificial sequence
  SiRNA target sequence
ccgtttcgtatcgtgatggccaatt

SEQ ID NO: 136388 - DNA, 25 bp, Artificial sequence
  SiRNA target sequence
cgtttcgtatcgtgatggccaattt

SEQ ID NO: 136389 - DNA, 25 bp, Artificial sequence
  SiRNA target sequence
gtttcgtatcgtgatggccaatttt

SEQ ID NO: 136390 - DNA, 25 bp, Artificial sequence
  SiRNA target sequence
tttcgtatcgtgatggccaatttta

SEQ ID NO: 136391 - DNA, 25 bp, Artificial sequence
  SiRNA target sequence
ttcgtatcgtgatggccaattttat

SEQ ID NO: 136392 - DNA, 25 bp, Artificial sequence
  SiRNA target sequence
tcgtatcgtgatggccaattttatg

SEQ ID NO: 136393 - DNA, 25 bp, Artificial sequence
  SiRNA target sequence
cgtatcgtgatggccaattttatga

SEQ ID NO: 136394 - DNA, 25 bp, Artificial sequence
  SiRNA target sequence
gtatcgtgatggccaattttatgat

SEQ ID NO: 136395 - DNA, 25 bp, Artificial sequence
  SiRNA target sequence
tatcgtgatggccaattttatgatg

SEQ ID NO: 136396 - DNA, 25 bp, Artificial sequence
  SiRNA target sequence
atcgtgatggccaattttatgatgc

SEQ ID NO: 136397 - DNA, 25 bp, Artificial sequence
  SiRNA target sequence
tcgtgatggccaattttatgatgct

SEQ ID NO: 136398 - DNA, 25 bp, Artificial sequence
  SiRNA target sequence
cgtgatggccaattttatgatgcta

SEQ ID NO: 136399 - DNA, 25 bp, Artificial sequence
  SiRNA target sequence
gtgatggccaattttatgatgctaa

SEQ ID NO: 136400 - DNA, 25 bp, Artificial sequence
  SiRNA target sequence
tgatggccaattttatgatgctaaa

SEQ ID NO: 136401 - DNA, 25 bp, Artificial sequence
  SiRNA target sequence
gatggccaattttatgatgctaaat

SEQ ID NO: 136402 - DNA, 25 bp, Artificial sequence
  SiRNA target sequence
atggccaattttatgatgctaaata

SEQ ID NO: 136403 - DNA, 25 bp, Artificial sequence
  SiRNA target sequence
tggccaattttatgatgctaaatac

SEQ ID NO: 136404 - DNA, 25 bp, Artificial sequence
  SiRNA target sequence
ggccaattttatgatgctaaataca

SEQ ID NO: 136405 - DNA, 25 bp, Artificial sequence
  SiRNA target sequence
gccaattttatgatgctaaatacaa

SEQ ID NO: 136406 - DNA, 25 bp, Artificial sequence
  SiRNA target sequence
ccaattttatgatgctaaatacaat

SEQ ID NO: 136407 - DNA, 25 bp, Artificial sequence
  SiRNA target sequence
caattttatgatgctaaatacaatg

SEQ ID NO: 136408 - DNA, 25 bp, Artificial sequence
  SiRNA target sequence
aattttatgatgctaaatacaatgt

SEQ ID NO: 136409 - DNA, 25 bp, Artificial sequence
  SiRNA target sequence
attttatgatgctaaatacaatgtt

SEQ ID NO: 136410 - DNA, 25 bp, Artificial sequence
  SiRNA target sequence
ttttatgatgctaaatacaatgttc

SEQ ID NO: 136411 - DNA, 25 bp, Artificial sequence
  SiRNA target sequence
tttatgatgctaaatacaatgttct

SEQ ID NO: 136412 - DNA, 25 bp, Artificial sequence
  SiRNA target sequence
ttatgatgctaaatacaatgttcta

SEQ ID NO: 136413 - DNA, 25 bp, Artificial sequence
  SiRNA target sequence
tatgatgctaaatacaatgttctat

SEQ ID NO: 136414 - DNA, 25 bp, Artificial sequence
  SiRNA target sequence
atgatgctaaatacaatgttctatt

SEQ ID NO: 136415 - DNA, 25 bp, Artificial sequence
  SiRNA target sequence
tgatgctaaatacaatgttctattg

SEQ ID NO: 136416 - DNA, 25 bp, Artificial sequence
  SiRNA target sequence
gatgctaaatacaatgttctattgg

SEQ ID NO: 136417 - DNA, 25 bp, Artificial sequence
  SiRNA target sequence
atgctaaatacaatgttctattggg

SEQ ID NO: 136418 - DNA, 25 bp, Artificial sequence
  SiRNA target sequence
tgctaaatacaatgttctattgggt

SEQ ID NO: 136419 - DNA, 25 bp, Artificial sequence
  SiRNA target sequence
gctaaatacaatgttctattgggtg

SEQ ID NO: 136420 - DNA, 25 bp, Artificial sequence
  SiRNA target sequence
ctaaatacaatgttctattgggtgt

SEQ ID NO: 136421 - DNA, 25 bp, Artificial sequence
  SiRNA target sequence
taaatacaatgttctattgggtgtc

SEQ ID NO: 136422 - DNA, 25 bp, Artificial sequence
  SiRNA target sequence
aaatacaatgttctattgggtgtca

SEQ ID NO: 136423 - DNA, 25 bp, Artificial sequence
  SiRNA target sequence
aatacaatgttctattgggtgtcac

SEQ ID NO: 136424 - DNA, 25 bp, Artificial sequence
  SiRNA target sequence
atacaatgttctattgggtgtcaca

SEQ ID NO: 136425 - DNA, 25 bp, Artificial sequence
  SiRNA target sequence
tacaatgttctattgggtgtcacag

SEQ ID NO: 136426 - DNA, 25 bp, Artificial sequence
  SiRNA target sequence
acaatgttctattgggtgtcacagc

SEQ ID NO: 136427 - DNA, 25 bp, Artificial sequence
  SiRNA target sequence
caatgttctattgggtgtcacagct

SEQ ID NO: 136428 - DNA, 25 bp, Artificial sequence
  SiRNA target sequence
aatgttctattgggtgtcacagcta

SEQ ID NO: 136429 - DNA, 25 bp, Artificial sequence
  SiRNA target sequence
atgttctattgggtgtcacagctac

SEQ ID NO: 136430 - DNA, 25 bp, Artificial sequence
  SiRNA target sequence
tgttctattgggtgtcacagctacc

SEQ ID NO: 136431 - DNA, 25 bp, Artificial sequence
  SiRNA target sequence
gttctattgggtgtcacagctacct

SEQ ID NO: 136432 - DNA, 25 bp, Artificial sequence
  SiRNA target sequence
ttctattgggtgtcacagctaccta

SEQ ID NO: 136433 - DNA, 25 bp, Artificial sequence
  SiRNA target sequence
tctattgggtgtcacagctacctac

SEQ ID NO: 136434 - DNA, 25 bp, Artificial sequence
  SiRNA target sequence
ctattgggtgtcacagctacctact

SEQ ID NO: 136435 - DNA, 25 bp, Artificial sequence
  SiRNA target sequence
tattgggtgtcacagctacctacta

SEQ ID NO: 136436 - DNA, 25 bp, Artificial sequence
  SiRNA target sequence
attgggtgtcacagctacctactat

SEQ ID NO: 136437 - DNA, 25 bp, Artificial sequence
  SiRNA target sequence
ttgggtgtcacagctacctactatg

SEQ ID NO: 136438 - DNA, 25 bp, Artificial sequence
  SiRNA target sequence
tgggtgtcacagctacctactatgg

SEQ ID NO: 136439 - DNA, 25 bp, Artificial sequence
  SiRNA target sequence
gggtgtcacagctacctactatgga

SEQ ID NO: 136440 - DNA, 25 bp, Artificial sequence
  SiRNA target sequence
ggtgtcacagctacctactatggag

SEQ ID NO: 136441 - DNA, 25 bp, Artificial sequence
  SiRNA target sequence
gtgtcacagctacctactatggagc

SEQ ID NO: 136442 - DNA, 25 bp, Artificial sequence
  SiRNA target sequence
tgtcacagctacctactatggagct

SEQ ID NO: 136443 - DNA, 25 bp, Artificial sequence
  SiRNA target sequence
gtcacagctacctactatggagctg

SEQ ID NO: 136444 - DNA, 25 bp, Artificial sequence
  SiRNA target sequence
tcacagctacctactatggagctgt

SEQ ID NO: 136445 - DNA, 25 bp, Artificial sequence
  SiRNA target sequence
cacagctacctactatggagctgtt

SEQ ID NO: 136446 - DNA, 25 bp, Artificial sequence
  SiRNA target sequence
acagctacctactatggagctgttg

SEQ ID NO: 136447 - DNA, 25 bp, Artificial sequence
  SiRNA target sequence
cagctacctactatggagctgttgt

SEQ ID NO: 136448 - DNA, 25 bp, Artificial sequence
  SiRNA target sequence
agctacctactatggagctgttgta

SEQ ID NO: 136449 - DNA, 25 bp, Artificial sequence
  SiRNA target sequence
gctacctactatggagctgttgtat

SEQ ID NO: 136450 - DNA, 25 bp, Artificial sequence
  SiRNA target sequence
ctacctactatggagctgttgtatt

SEQ ID NO: 136451 - DNA, 25 bp, Artificial sequence
  SiRNA target sequence
tacctactatggagctgttgtatta

SEQ ID NO: 136452 - DNA, 25 bp, Artificial sequence
  SiRNA target sequence
acctactatggagctgttgtattaa

SEQ ID NO: 136453 - DNA, 25 bp, Artificial sequence
  SiRNA target sequence
cctactatggagctgttgtattaaa

SEQ ID NO: 136454 - DNA, 25 bp, Artificial sequence
  SiRNA target sequence
ctactatggagctgttgtattaaat

SEQ ID NO: 136455 - DNA, 25 bp, Artificial sequence
  SiRNA target sequence
tactatggagctgttgtattaaatc

SEQ ID NO: 136456 - DNA, 25 bp, Artificial sequence
  SiRNA target sequence
actatggagctgttgtattaaatca

SEQ ID NO: 136457 - DNA, 25 bp, Artificial sequence
  SiRNA target sequence
ctatggagctgttgtattaaatcat

SEQ ID NO: 136458 - DNA, 25 bp, Artificial sequence
  SiRNA target sequence
tatggagctgttgtattaaatcatg

SEQ ID NO: 136459 - DNA, 25 bp, Artificial sequence
  SiRNA target sequence
atggagctgttgtattaaatcatgc

SEQ ID NO: 136460 - DNA, 25 bp, Artificial sequence
  SiRNA target sequence
tggagctgttgtattaaatcatgca

SEQ ID NO: 136461 - DNA, 25 bp, Artificial sequence
  SiRNA target sequence
ggagctgttgtattaaatcatgcaa

SEQ ID NO: 136462 - DNA, 25 bp, Artificial sequence
  SiRNA target sequence
gagctgttgtattaaatcatgcaaa

SEQ ID NO: 136463 - DNA, 25 bp, Artificial sequence
  SiRNA target sequence
agctgttgtattaaatcatgcaaaa

SEQ ID NO: 136464 - DNA, 25 bp, Artificial sequence
  SiRNA target sequence
gctgttgtattaaatcatgcaaaat

SEQ ID NO: 136465 - DNA, 25 bp, Artificial sequence
  SiRNA target sequence
ctgttgtattaaatcatgcaaaatt

SEQ ID NO: 136466 - DNA, 25 bp, Artificial sequence
  SiRNA target sequence
tgttgtattaaatcatgcaaaattc

SEQ ID NO: 136467 - DNA, 25 bp, Artificial sequence
  SiRNA target sequence
gttgtattaaatcatgcaaaattct

SEQ ID NO: 136468 - DNA, 25 bp, Artificial sequence
  SiRNA target sequence
ttgtattaaatcatgcaaaattctt

SEQ ID NO: 136469 - DNA, 25 bp, Artificial sequence
  SiRNA target sequence
tgtattaaatcatgcaaaattcttg

SEQ ID NO: 136470 - DNA, 25 bp, Artificial sequence
  SiRNA target sequence
gtattaaatcatgcaaaattcttgt

SEQ ID NO: 136471 - DNA, 25 bp, Artificial sequence
  SiRNA target sequence
tattaaatcatgcaaaattcttgtc

SEQ ID NO: 136472 - DNA, 25 bp, Artificial sequence
  SiRNA target sequence
attaaatcatgcaaaattcttgtca

SEQ ID NO: 136473 - DNA, 25 bp, Artificial sequence
  SiRNA target sequence
ttaaatcatgcaaaattcttgtcag

SEQ ID NO: 136474 - DNA, 25 bp, Artificial sequence
  SiRNA target sequence
taaatcatgcaaaattcttgtcagt

SEQ ID NO: 136475 - DNA, 25 bp, Artificial sequence
  SiRNA target sequence
aaatcatgcaaaattcttgtcagta

SEQ ID NO: 136476 - DNA, 25 bp, Artificial sequence
  SiRNA target sequence
aatcatgcaaaattcttgtcagtaa

SEQ ID NO: 136477 - DNA, 25 bp, Artificial sequence
  SiRNA target sequence
atcatgcaaaattcttgtcagtaac

SEQ ID NO: 136478 - DNA, 25 bp, Artificial sequence
  SiRNA target sequence
tcatgcaaaattcttgtcagtaaca

SEQ ID NO: 136479 - DNA, 25 bp, Artificial sequence
  SiRNA target sequence
catgcaaaattcttgtcagtaacaa

SEQ ID NO: 136480 - DNA, 25 bp, Artificial sequence
  SiRNA target sequence
atgcaaaattcttgtcagtaacaaa

SEQ ID NO: 136481 - DNA, 25 bp, Artificial sequence
  SiRNA target sequence
tgcaaaattcttgtcagtaacaaaa

SEQ ID NO: 136482 - DNA, 25 bp, Artificial sequence
  SiRNA target sequence
gcaaaattcttgtcagtaacaaaag

SEQ ID NO: 136483 - DNA, 25 bp, Artificial sequence
  SiRNA target sequence
caaaattcttgtcagtaacaaaaga

SEQ ID NO: 136484 - DNA, 25 bp, Artificial sequence
  SiRNA target sequence
aaaattcttgtcagtaacaaaagat

SEQ ID NO: 136485 - DNA, 25 bp, Artificial sequence
  SiRNA target sequence
aaattcttgtcagtaacaaaagatg

SEQ ID NO: 136486 - DNA, 25 bp, Artificial sequence
  SiRNA target sequence
aattcttgtcagtaacaaaagatgg

SEQ ID NO: 136487 - DNA, 25 bp, Artificial sequence
  SiRNA target sequence
attcttgtcagtaacaaaagatggc

SEQ ID NO: 136488 - DNA, 25 bp, Artificial sequence
  SiRNA target sequence
ttcttgtcagtaacaaaagatggcg

SEQ ID NO: 136489 - DNA, 25 bp, Artificial sequence
  SiRNA target sequence
tcttgtcagtaacaaaagatggcga

SEQ ID NO: 136490 - DNA, 25 bp, Artificial sequence
  SiRNA target sequence
cttgtcagtaacaaaagatggcgat

SEQ ID NO: 136491 - DNA, 25 bp, Artificial sequence
  SiRNA target sequence
ttgtcagtaacaaaagatggcgata

SEQ ID NO: 136492 - DNA, 25 bp, Artificial sequence
  SiRNA target sequence
tgtcagtaacaaaagatggcgataa

SEQ ID NO: 136493 - DNA, 25 bp, Artificial sequence
  SiRNA target sequence
gtcagtaacaaaagatggcgataaa

SEQ ID NO: 136494 - DNA, 25 bp, Artificial sequence
  SiRNA target sequence
tcagtaacaaaagatggcgataaaa

SEQ ID NO: 136495 - DNA, 25 bp, Artificial sequence
  SiRNA target sequence
cagtaacaaaagatggcgataaaat

SEQ ID NO: 136496 - DNA, 25 bp, Artificial sequence
  SiRNA target sequence
agtaacaaaagatggcgataaaatt

SEQ ID NO: 136497 - DNA, 25 bp, Artificial sequence
  SiRNA target sequence
gtaacaaaagatggcgataaaatta

SEQ ID NO: 136498 - DNA, 25 bp, Artificial sequence
  SiRNA target sequence
taacaaaagatggcgataaaattaa

SEQ ID NO: 136499 - DNA, 25 bp, Artificial sequence
  SiRNA target sequence
aacaaaagatggcgataaaattaat

SEQ ID NO: 136500 - DNA, 25 bp, Artificial sequence
  SiRNA target sequence
acaaaagatggcgataaaattaatg

SEQ ID NO: 136501 - DNA, 25 bp, Artificial sequence
  SiRNA target sequence
caaaagatggcgataaaattaatgg

SEQ ID NO: 136502 - DNA, 25 bp, Artificial sequence
  SiRNA target sequence
aaaagatggcgataaaattaatgga

SEQ ID NO: 136503 - DNA, 25 bp, Artificial sequence
  SiRNA target sequence
aaagatggcgataaaattaatggaa

SEQ ID NO: 136504 - DNA, 25 bp, Artificial sequence
  SiRNA target sequence
aagatggcgataaaattaatggaat

SEQ ID NO: 136505 - DNA, 25 bp, Artificial sequence
  SiRNA target sequence
agatggcgataaaattaatggaatt

SEQ ID NO: 136506 - DNA, 25 bp, Artificial sequence
  SiRNA target sequence
gatggcgataaaattaatggaatta

SEQ ID NO: 136507 - DNA, 25 bp, Artificial sequence
  SiRNA target sequence
atggcgataaaattaatggaattaa

SEQ ID NO: 136508 - DNA, 25 bp, Artificial sequence
  SiRNA target sequence
tggcgataaaattaatggaattaaa

SEQ ID NO: 136509 - DNA, 25 bp, Artificial sequence
  SiRNA target sequence
ggcgataaaattaatggaattaaat

SEQ ID NO: 136510 - DNA, 25 bp, Artificial sequence
  SiRNA target sequence
gcgataaaattaatggaattaaatg

SEQ ID NO: 136511 - DNA, 25 bp, Artificial sequence
  SiRNA target sequence
cgataaaattaatggaattaaatgt

SEQ ID NO: 136512 - DNA, 25 bp, Artificial sequence
  SiRNA target sequence
gataaaattaatggaattaaatgtc

SEQ ID NO: 136513 - DNA, 25 bp, Artificial sequence
  SiRNA target sequence
ataaaattaatggaattaaatgtca

SEQ ID NO: 136514 - DNA, 25 bp, Artificial sequence
  SiRNA target sequence
taaaattaatggaattaaatgtcaa

SEQ ID NO: 136515 - DNA, 25 bp, Artificial sequence
  SiRNA target sequence
aaaattaatggaattaaatgtcaag

SEQ ID NO: 136516 - DNA, 25 bp, Artificial sequence
  SiRNA target sequence
aaattaatggaattaaatgtcaaga

SEQ ID NO: 136517 - DNA, 25 bp, Artificial sequence
  SiRNA target sequence
aattaatggaattaaatgtcaagat

SEQ ID NO: 136518 - DNA, 25 bp, Artificial sequence
  SiRNA target sequence
attaatggaattaaatgtcaagatt

SEQ ID NO: 136519 - DNA, 25 bp, Artificial sequence
  SiRNA target sequence
ttaatggaattaaatgtcaagattc

SEQ ID NO: 136520 - DNA, 25 bp, Artificial sequence
  SiRNA target sequence
taatggaattaaatgtcaagattca

SEQ ID NO: 136521 - DNA, 25 bp, Artificial sequence
  SiRNA target sequence
aatggaattaaatgtcaagattcaa

SEQ ID NO: 136522 - DNA, 25 bp, Artificial sequence
  SiRNA target sequence
atggaattaaatgtcaagattcaat

SEQ ID NO: 136523 - DNA, 25 bp, Artificial sequence
  SiRNA target sequence
tggaattaaatgtcaagattcaata

SEQ ID NO: 136524 - DNA, 25 bp, Artificial sequence
  SiRNA target sequence
ggaattaaatgtcaagattcaataa

SEQ ID NO: 136525 - DNA, 25 bp, Artificial sequence
  SiRNA target sequence
gaattaaatgtcaagattcaataaa

SEQ ID NO: 136526 - DNA, 25 bp, Artificial sequence
  SiRNA target sequence
aattaaatgtcaagattcaataaat

SEQ ID NO: 136527 - DNA, 25 bp, Artificial sequence
  SiRNA target sequence
attaaatgtcaagattcaataaata

SEQ ID NO: 136528 - DNA, 25 bp, Artificial sequence
  SiRNA target sequence
ttaaatgtcaagattcaataaataa

SEQ ID NO: 136529 - DNA, 25 bp, Artificial sequence
  SiRNA target sequence
taaatgtcaagattcaataaataat

SEQ ID NO: 136530 - DNA, 25 bp, Artificial sequence
  SiRNA target sequence
aaatgtcaagattcaataaataatg

SEQ ID NO: 136531 - DNA, 25 bp, Artificial sequence
  SiRNA target sequence
aatgtcaagattcaataaataatga

SEQ ID NO: 136532 - DNA, 25 bp, Artificial sequence
  SiRNA target sequence
atgtcaagattcaataaataatgaa

SEQ ID NO: 136533 - DNA, 25 bp, Artificial sequence
  SiRNA target sequence
tgtcaagattcaataaataatgaaa

SEQ ID NO: 136534 - DNA, 25 bp, Artificial sequence
  SiRNA target sequence
gtcaagattcaataaataatgaaaa

SEQ ID NO: 136535 - DNA, 25 bp, Artificial sequence
  SiRNA target sequence
tcaagattcaataaataatgaaaaa

SEQ ID NO: 136536 - DNA, 25 bp, Artificial sequence
  SiRNA target sequence
caagattcaataaataatgaaaaat

SEQ ID NO: 136537 - DNA, 25 bp, Artificial sequence
  SiRNA target sequence
aagattcaataaataatgaaaaatt

SEQ ID NO: 136538 - DNA, 25 bp, Artificial sequence
  SiRNA target sequence
agattcaataaataatgaaaaattt

SEQ ID NO: 136539 - DNA, 25 bp, Artificial sequence
  SiRNA target sequence
gattcaataaataatgaaaaatttt

SEQ ID NO: 136540 - DNA, 25 bp, Artificial sequence
  SiRNA target sequence
attcaataaataatgaaaaattttt

SEQ ID NO: 136541 - DNA, 25 bp, Artificial sequence
  SiRNA target sequence
ttcaataaataatgaaaaattttta

SEQ ID NO: 136542 - DNA, 25 bp, Artificial sequence
  SiRNA target sequence
tcaataaataatgaaaaatttttaa

SEQ ID NO: 136543 - DNA, 25 bp, Artificial sequence
  SiRNA target sequence
caataaataatgaaaaatttttaat

SEQ ID NO: 136544 - DNA, 25 bp, Artificial sequence
  SiRNA target sequence
aataaataatgaaaaatttttaatt

SEQ ID NO: 136545 - DNA, 25 bp, Artificial sequence
  SiRNA target sequence
ataaataatgaaaaatttttaatta

SEQ ID NO: 136546 - DNA, 25 bp, Artificial sequence
  SiRNA target sequence
taaataatgaaaaatttttaattag

SEQ ID NO: 136547 - DNA, 25 bp, Artificial sequence
  SiRNA target sequence
aaataatgaaaaatttttaattagg

SEQ ID NO: 136548 - DNA, 25 bp, Artificial sequence
  SiRNA target sequence
aataatgaaaaatttttaattaggt

SEQ ID NO: 136549 - DNA, 25 bp, Artificial sequence
  SiRNA target sequence
ataatgaaaaatttttaattaggtg

SEQ ID NO: 136550 - DNA, 25 bp, Artificial sequence
  SiRNA target sequence
taatgaaaaatttttaattaggtgt

SEQ ID NO: 136551 - DNA, 25 bp, Artificial sequence
  SiRNA target sequence
aatgaaaaatttttaattaggtgta

SEQ ID NO: 136552 - DNA, 25 bp, Artificial sequence
  SiRNA target sequence
atgaaaaatttttaattaggtgtaa

SEQ ID NO: 136553 - DNA, 25 bp, Artificial sequence
  SiRNA target sequence
tgaaaaatttttaattaggtgtaaa

SEQ ID NO: 136554 - DNA, 25 bp, Artificial sequence
  SiRNA target sequence
gaaaaatttttaattaggtgtaaag

SEQ ID NO: 136555 - DNA, 25 bp, Artificial sequence
  SiRNA target sequence
aaaaatttttaattaggtgtaaagt

SEQ ID NO: 136556 - DNA, 25 bp, Artificial sequence
  SiRNA target sequence
aaaatttttaattaggtgtaaagtt

SEQ ID NO: 136557 - DNA, 25 bp, Artificial sequence
  SiRNA target sequence
aaatttttaattaggtgtaaagttt

SEQ ID NO: 136558 - DNA, 25 bp, Artificial sequence
  SiRNA target sequence
aatttttaattaggtgtaaagtttt

SEQ ID NO: 136559 - DNA, 25 bp, Artificial sequence
  SiRNA target sequence
atttttaattaggtgtaaagtttta

SEQ ID NO: 136560 - DNA, 25 bp, Artificial sequence
  SiRNA target sequence
tttttaattaggtgtaaagttttaa

SEQ ID NO: 136561 - DNA, 25 bp, Artificial sequence
  SiRNA target sequence
ttttaattaggtgtaaagttttaat

SEQ ID NO: 136562 - DNA, 25 bp, Artificial sequence
  SiRNA target sequence
tttaattaggtgtaaagttttaata

SEQ ID NO: 136563 - DNA, 25 bp, Artificial sequence
  SiRNA target sequence
ttaattaggtgtaaagttttaataa

SEQ ID NO: 136564 - DNA, 25 bp, Artificial sequence
  SiRNA target sequence
taattaggtgtaaagttttaataaa

SEQ ID NO: 136565 - DNA, 25 bp, Artificial sequence
  SiRNA target sequence
aattaggtgtaaagttttaataaat

SEQ ID NO: 136566 - DNA, 25 bp, Artificial sequence
  SiRNA target sequence
attaggtgtaaagttttaataaata

SEQ ID NO: 136567 - DNA, 25 bp, Artificial sequence
  SiRNA target sequence
ttaggtgtaaagttttaataaatac

SEQ ID NO: 136568 - DNA, 25 bp, Artificial sequence
  SiRNA target sequence
taggtgtaaagttttaataaatact

SEQ ID NO: 136569 - DNA, 25 bp, Artificial sequence
  SiRNA target sequence
aggtgtaaagttttaataaatactt

SEQ ID NO: 136570 - DNA, 25 bp, Artificial sequence
  SiRNA target sequence
ggtgtaaagttttaataaatacttc

SEQ ID NO: 136571 - DNA, 25 bp, Artificial sequence
  SiRNA target sequence
gtgtaaagttttaataaatacttct

SEQ ID NO: 136572 - DNA, 25 bp, Artificial sequence
  SiRNA target sequence
tgtaaagttttaataaatacttctg

SEQ ID NO: 136573 - DNA, 25 bp, Artificial sequence
  SiRNA target sequence
gtaaagttttaataaatacttctgg

SEQ ID NO: 136574 - DNA, 25 bp, Artificial sequence
  SiRNA target sequence
taaagttttaataaatacttctggc

SEQ ID NO: 136575 - DNA, 25 bp, Artificial sequence
  SiRNA target sequence
aaagttttaataaatacttctggcc

SEQ ID NO: 136576 - DNA, 25 bp, Artificial sequence
  SiRNA target sequence
aagttttaataaatacttctggccc

SEQ ID NO: 136577 - DNA, 25 bp, Artificial sequence
  SiRNA target sequence
agttttaataaatacttctggccct

SEQ ID NO: 136578 - DNA, 25 bp, Artificial sequence
  SiRNA target sequence
gttttaataaatacttctggccctt

SEQ ID NO: 136579 - DNA, 25 bp, Artificial sequence
  SiRNA target sequence
ttttaataaatacttctggcccttt

SEQ ID NO: 136580 - DNA, 25 bp, Artificial sequence
  SiRNA target sequence
tttaataaatacttctggccctttt

SEQ ID NO: 136581 - DNA, 25 bp, Artificial sequence
  SiRNA target sequence
ttaataaatacttctggcccttttg

SEQ ID NO: 136582 - DNA, 25 bp, Artificial sequence
  SiRNA target sequence
taataaatacttctggcccttttgc

SEQ ID NO: 136583 - DNA, 25 bp, Artificial sequence
  SiRNA target sequence
aataaatacttctggcccttttgct

SEQ ID NO: 136584 - DNA, 25 bp, Artificial sequence
  SiRNA target sequence
ataaatacttctggcccttttgctg

SEQ ID NO: 136585 - DNA, 25 bp, Artificial sequence
  SiRNA target sequence
taaatacttctggcccttttgctga

SEQ ID NO: 136586 - DNA, 25 bp, Artificial sequence
  SiRNA target sequence
aaatacttctggcccttttgctgac

SEQ ID NO: 136587 - DNA, 25 bp, Artificial sequence
  SiRNA target sequence
aatacttctggcccttttgctgacg

SEQ ID NO: 136588 - DNA, 25 bp, Artificial sequence
  SiRNA target sequence
atacttctggcccttttgctgacga

SEQ ID NO: 136589 - DNA, 25 bp, Artificial sequence
  SiRNA target sequence
tacttctggcccttttgctgacgag

SEQ ID NO: 136590 - DNA, 25 bp, Artificial sequence
  SiRNA target sequence
acttctggcccttttgctgacgagg

SEQ ID NO: 136591 - DNA, 25 bp, Artificial sequence
  SiRNA target sequence
cttctggcccttttgctgacgaggt

SEQ ID NO: 136592 - DNA, 25 bp, Artificial sequence
  SiRNA target sequence
ttctggcccttttgctgacgaggtt

SEQ ID NO: 136593 - DNA, 25 bp, Artificial sequence
  SiRNA target sequence
tctggcccttttgctgacgaggttc

SEQ ID NO: 136594 - DNA, 25 bp, Artificial sequence
  SiRNA target sequence
ctggcccttttgctgacgaggttcg

SEQ ID NO: 136595 - DNA, 25 bp, Artificial sequence
  SiRNA target sequence
tggcccttttgctgacgaggttcga

SEQ ID NO: 136596 - DNA, 25 bp, Artificial sequence
  SiRNA target sequence
ggcccttttgctgacgaggttcgaa

SEQ ID NO: 136597 - DNA, 25 bp, Artificial sequence
  SiRNA target sequence
gcccttttgctgacgaggttcgaaa

SEQ ID NO: 136598 - DNA, 25 bp, Artificial sequence
  SiRNA target sequence
cccttttgctgacgaggttcgaaat

SEQ ID NO: 136599 - DNA, 25 bp, Artificial sequence
  SiRNA target sequence
ccttttgctgacgaggttcgaaata

SEQ ID NO: 136600 - DNA, 25 bp, Artificial sequence
  SiRNA target sequence
cttttgctgacgaggttcgaaatac

SEQ ID NO: 136601 - DNA, 25 bp, Artificial sequence
  SiRNA target sequence
ttttgctgacgaggttcgaaataca

SEQ ID NO: 136602 - DNA, 25 bp, Artificial sequence
  SiRNA target sequence
tttgctgacgaggttcgaaatacat

SEQ ID NO: 136603 - DNA, 25 bp, Artificial sequence
  SiRNA target sequence
ttgctgacgaggttcgaaatacatc

SEQ ID NO: 136604 - DNA, 25 bp, Artificial sequence
  SiRNA target sequence
tgctgacgaggttcgaaatacatca

SEQ ID NO: 136605 - DNA, 25 bp, Artificial sequence
  SiRNA target sequence
gctgacgaggttcgaaatacatcaa

SEQ ID NO: 136606 - DNA, 25 bp, Artificial sequence
  SiRNA target sequence
ctgacgaggttcgaaatacatcaat

SEQ ID NO: 136607 - DNA, 25 bp, Artificial sequence
  SiRNA target sequence
tgacgaggttcgaaatacatcaatt

SEQ ID NO: 136608 - DNA, 25 bp, Artificial sequence
  SiRNA target sequence
gacgaggttcgaaatacatcaattg

SEQ ID NO: 136609 - DNA, 25 bp, Artificial sequence
  SiRNA target sequence
acgaggttcgaaatacatcaattga

SEQ ID NO: 136610 - DNA, 25 bp, Artificial sequence
  SiRNA target sequence
cgaggttcgaaatacatcaattgaa

SEQ ID NO: 136611 - DNA, 25 bp, Artificial sequence
  SiRNA target sequence
gaggttcgaaatacatcaattgaaa

SEQ ID NO: 136612 - DNA, 25 bp, Artificial sequence
  SiRNA target sequence
aggttcgaaatacatcaattgaaaa

SEQ ID NO: 136613 - DNA, 25 bp, Artificial sequence
  SiRNA target sequence
ggttcgaaatacatcaattgaaaac

SEQ ID NO: 136614 - DNA, 25 bp, Artificial sequence
  SiRNA target sequence
gttcgaaatacatcaattgaaaact

SEQ ID NO: 136615 - DNA, 25 bp, Artificial sequence
  SiRNA target sequence
ttcgaaatacatcaattgaaaactg

SEQ ID NO: 136616 - DNA, 25 bp, Artificial sequence
  SiRNA target sequence
tcgaaatacatcaattgaaaactgt

SEQ ID NO: 136617 - DNA, 25 bp, Artificial sequence
  SiRNA target sequence
cgaaatacatcaattgaaaactgtc

SEQ ID NO: 136618 - DNA, 25 bp, Artificial sequence
  SiRNA target sequence
gaaatacatcaattgaaaactgtca

SEQ ID NO: 136619 - DNA, 25 bp, Artificial sequence
  SiRNA target sequence
aaatacatcaattgaaaactgtcaa

SEQ ID NO: 136620 - DNA, 25 bp, Artificial sequence
  SiRNA target sequence
aatacatcaattgaaaactgtcaac

SEQ ID NO: 136621 - DNA, 25 bp, Artificial sequence
  SiRNA target sequence
atacatcaattgaaaactgtcaacc

SEQ ID NO: 136622 - DNA, 25 bp, Artificial sequence
  SiRNA target sequence
tacatcaattgaaaactgtcaacca

SEQ ID NO: 136623 - DNA, 25 bp, Artificial sequence
  SiRNA target sequence
acatcaattgaaaactgtcaaccaa

SEQ ID NO: 136624 - DNA, 25 bp, Artificial sequence
  SiRNA target sequence
catcaattgaaaactgtcaaccaat

SEQ ID NO: 136625 - DNA, 25 bp, Artificial sequence
  SiRNA target sequence
atcaattgaaaactgtcaaccaata

SEQ ID NO: 136626 - DNA, 25 bp, Artificial sequence
  SiRNA target sequence
tcaattgaaaactgtcaaccaatac

SEQ ID NO: 136627 - DNA, 25 bp, Artificial sequence
  SiRNA target sequence
caattgaaaactgtcaaccaatact

SEQ ID NO: 136628 - DNA, 25 bp, Artificial sequence
  SiRNA target sequence
aattgaaaactgtcaaccaatactc

SEQ ID NO: 136629 - DNA, 25 bp, Artificial sequence
  SiRNA target sequence
attgaaaactgtcaaccaatactcc

SEQ ID NO: 136630 - DNA, 25 bp, Artificial sequence
  SiRNA target sequence
ttgaaaactgtcaaccaatactcca

SEQ ID NO: 136631 - DNA, 25 bp, Artificial sequence
  SiRNA target sequence
tgaaaactgtcaaccaatactccaa

SEQ ID NO: 136632 - DNA, 25 bp, Artificial sequence
  SiRNA target sequence
gaaaactgtcaaccaatactccaac

SEQ ID NO: 136633 - DNA, 25 bp, Artificial sequence
  SiRNA target sequence
aaaactgtcaaccaatactccaaca

SEQ ID NO: 136634 - DNA, 25 bp, Artificial sequence
  SiRNA target sequence
aaactgtcaaccaatactccaacat

SEQ ID NO: 136635 - DNA, 25 bp, Artificial sequence
  SiRNA target sequence
aactgtcaaccaatactccaacata

SEQ ID NO: 136636 - DNA, 25 bp, Artificial sequence
  SiRNA target sequence
actgtcaaccaatactccaacatag

SEQ ID NO: 136637 - DNA, 25 bp, Artificial sequence
  SiRNA target sequence
ctgtcaaccaatactccaacatagt

SEQ ID NO: 136638 - DNA, 25 bp, Artificial sequence
  SiRNA target sequence
tgtcaaccaatactccaacatagtt

SEQ ID NO: 136639 - DNA, 25 bp, Artificial sequence
  SiRNA target sequence
gtcaaccaatactccaacatagtta

SEQ ID NO: 136640 - DNA, 25 bp, Artificial sequence
  SiRNA target sequence
tcaaccaatactccaacatagttat

SEQ ID NO: 136641 - DNA, 25 bp, Artificial sequence
  SiRNA target sequence
caaccaatactccaacatagttatg

SEQ ID NO: 136642 - DNA, 25 bp, Artificial sequence
  SiRNA target sequence
aaccaatactccaacatagttatgg

SEQ ID NO: 136643 - DNA, 25 bp, Artificial sequence
  SiRNA target sequence
accaatactccaacatagttatggt

SEQ ID NO: 136644 - DNA, 25 bp, Artificial sequence
  SiRNA target sequence
ccaatactccaacatagttatggta

SEQ ID NO: 136645 - DNA, 25 bp, Artificial sequence
  SiRNA target sequence
caatactccaacatagttatggtac

SEQ ID NO: 136646 - DNA, 25 bp, Artificial sequence
  SiRNA target sequence
aatactccaacatagttatggtaca

SEQ ID NO: 136647 - DNA, 25 bp, Artificial sequence
  SiRNA target sequence
atactccaacatagttatggtacac

SEQ ID NO: 136648 - DNA, 25 bp, Artificial sequence
  SiRNA target sequence
tactccaacatagttatggtacaca

SEQ ID NO: 136649 - DNA, 25 bp, Artificial sequence
  SiRNA target sequence
actccaacatagttatggtacacat

SEQ ID NO: 136650 - DNA, 25 bp, Artificial sequence
  SiRNA target sequence
ctccaacatagttatggtacacata

SEQ ID NO: 136651 - DNA, 25 bp, Artificial sequence
  SiRNA target sequence
tccaacatagttatggtacacatat

SEQ ID NO: 136652 - DNA, 25 bp, Artificial sequence
  SiRNA target sequence
ccaacatagttatggtacacatatt

SEQ ID NO: 136653 - DNA, 25 bp, Artificial sequence
  SiRNA target sequence
caacatagttatggtacacatattg

SEQ ID NO: 136654 - DNA, 25 bp, Artificial sequence
  SiRNA target sequence
aacatagttatggtacacatattgt

SEQ ID NO: 136655 - DNA, 25 bp, Artificial sequence
  SiRNA target sequence
acatagttatggtacacatattgta

SEQ ID NO: 136656 - DNA, 25 bp, Artificial sequence
  SiRNA target sequence
catagttatggtacacatattgtag

SEQ ID NO: 136657 - DNA, 25 bp, Artificial sequence
  SiRNA target sequence
atagttatggtacacatattgtagt

SEQ ID NO: 136658 - DNA, 25 bp, Artificial sequence
  SiRNA target sequence
tagttatggtacacatattgtagtt

SEQ ID NO: 136659 - DNA, 25 bp, Artificial sequence
  SiRNA target sequence
agttatggtacacatattgtagttc

SEQ ID NO: 136660 - DNA, 25 bp, Artificial sequence
  SiRNA target sequence
gttatggtacacatattgtagttcc

SEQ ID NO: 136661 - DNA, 25 bp, Artificial sequence
  SiRNA target sequence
ttatggtacacatattgtagttcct

SEQ ID NO: 136662 - DNA, 25 bp, Artificial sequence
  SiRNA target sequence
tatggtacacatattgtagttcctg

SEQ ID NO: 136663 - DNA, 25 bp, Artificial sequence
  SiRNA target sequence
atggtacacatattgtagttcctgc

SEQ ID NO: 136664 - DNA, 25 bp, Artificial sequence
  SiRNA target sequence
tggtacacatattgtagttcctgcg

SEQ ID NO: 136665 - DNA, 25 bp, Artificial sequence
  SiRNA target sequence
ggtacacatattgtagttcctgcga

SEQ ID NO: 136666 - DNA, 25 bp, Artificial sequence
  SiRNA target sequence
gtacacatattgtagttcctgcgat

SEQ ID NO: 136667 - DNA, 25 bp, Artificial sequence
  SiRNA target sequence
tacacatattgtagttcctgcgata

SEQ ID NO: 136668 - DNA, 25 bp, Artificial sequence
  SiRNA target sequence
acacatattgtagttcctgcgatat

SEQ ID NO: 136669 - DNA, 25 bp, Artificial sequence
  SiRNA target sequence
cacatattgtagttcctgcgatatt

SEQ ID NO: 136670 - DNA, 25 bp, Artificial sequence
  SiRNA target sequence
acatattgtagttcctgcgatattt

SEQ ID NO: 136671 - DNA, 25 bp, Artificial sequence
  SiRNA target sequence
catattgtagttcctgcgatatttt

SEQ ID NO: 136672 - DNA, 25 bp, Artificial sequence
  SiRNA target sequence
atattgtagttcctgcgatattttc

SEQ ID NO: 136673 - DNA, 25 bp, Artificial sequence
  SiRNA target sequence
tattgtagttcctgcgatattttcg

SEQ ID NO: 136674 - DNA, 25 bp, Artificial sequence
  SiRNA target sequence
attgtagttcctgcgatattttcgc

SEQ ID NO: 136675 - DNA, 25 bp, Artificial sequence
  SiRNA target sequence
ttgtagttcctgcgatattttcgcc

SEQ ID NO: 136676 - DNA, 25 bp, Artificial sequence
  SiRNA target sequence
tgtagttcctgcgatattttcgcct

SEQ ID NO: 136677 - DNA, 25 bp, Artificial sequence
  SiRNA target sequence
gtagttcctgcgatattttcgccta

SEQ ID NO: 136678 - DNA, 25 bp, Artificial sequence
  SiRNA target sequence
tagttcctgcgatattttcgcctaa

SEQ ID NO: 136679 - DNA, 25 bp, Artificial sequence
  SiRNA target sequence
agttcctgcgatattttcgcctaaa

SEQ ID NO: 136680 - DNA, 25 bp, Artificial sequence
  SiRNA target sequence
gttcctgcgatattttcgcctaaaa

SEQ ID NO: 136681 - DNA, 25 bp, Artificial sequence
  SiRNA target sequence
ttcctgcgatattttcgcctaaaaa

SEQ ID NO: 136682 - DNA, 25 bp, Artificial sequence
  SiRNA target sequence
tcctgcgatattttcgcctaaaaat

SEQ ID NO: 136683 - DNA, 25 bp, Artificial sequence
  SiRNA target sequence
cctgcgatattttcgcctaaaaata

SEQ ID NO: 136684 - DNA, 25 bp, Artificial sequence
  SiRNA target sequence
ctgcgatattttcgcctaaaaatat

SEQ ID NO: 136685 - DNA, 25 bp, Artificial sequence
  SiRNA target sequence
tgcgatattttcgcctaaaaatatg

SEQ ID NO: 136686 - DNA, 25 bp, Artificial sequence
  SiRNA target sequence
gcgatattttcgcctaaaaatatgg

SEQ ID NO: 136687 - DNA, 25 bp, Artificial sequence
  SiRNA target sequence
cgatattttcgcctaaaaatatggg

SEQ ID NO: 136688 - DNA, 25 bp, Artificial sequence
  SiRNA target sequence
gatattttcgcctaaaaatatgggc

SEQ ID NO: 136689 - DNA, 25 bp, Artificial sequence
  SiRNA target sequence
atattttcgcctaaaaatatgggct

SEQ ID NO: 136690 - DNA, 25 bp, Artificial sequence
  SiRNA target sequence
tattttcgcctaaaaatatgggctt

SEQ ID NO: 136691 - DNA, 25 bp, Artificial sequence
  SiRNA target sequence
attttcgcctaaaaatatgggcttt

SEQ ID NO: 136692 - DNA, 25 bp, Artificial sequence
  SiRNA target sequence
ttttcgcctaaaaatatgggctttg

SEQ ID NO: 136693 - DNA, 25 bp, Artificial sequence
  SiRNA target sequence
tttcgcctaaaaatatgggctttgt

SEQ ID NO: 136694 - DNA, 25 bp, Artificial sequence
  SiRNA target sequence
ttcgcctaaaaatatgggctttgtt

SEQ ID NO: 136695 - DNA, 25 bp, Artificial sequence
  SiRNA target sequence
tcgcctaaaaatatgggctttgttg

SEQ ID NO: 136696 - DNA, 25 bp, Artificial sequence
  SiRNA target sequence
cgcctaaaaatatgggctttgttga

SEQ ID NO: 136697 - DNA, 25 bp, Artificial sequence
  SiRNA target sequence
gcctaaaaatatgggctttgttgat

SEQ ID NO: 136698 - DNA, 25 bp, Artificial sequence
  SiRNA target sequence
cctaaaaatatgggctttgttgatc

SEQ ID NO: 136699 - DNA, 25 bp, Artificial sequence
  SiRNA target sequence
ctaaaaatatgggctttgttgatcc

SEQ ID NO: 136700 - DNA, 25 bp, Artificial sequence
  SiRNA target sequence
taaaaatatgggctttgttgatcca

SEQ ID NO: 136701 - DNA, 25 bp, Artificial sequence
  SiRNA target sequence
aaaaatatgggctttgttgatccaa

SEQ ID NO: 136702 - DNA, 25 bp, Artificial sequence
  SiRNA target sequence
aaaatatgggctttgttgatccaag

SEQ ID NO: 136703 - DNA, 25 bp, Artificial sequence
  SiRNA target sequence
aaatatgggctttgttgatccaagc

SEQ ID NO: 136704 - DNA, 25 bp, Artificial sequence
  SiRNA target sequence
aatatgggctttgttgatccaagca

SEQ ID NO: 136705 - DNA, 25 bp, Artificial sequence
  SiRNA target sequence
atatgggctttgttgatccaagcac

SEQ ID NO: 136706 - DNA, 25 bp, Artificial sequence
  SiRNA target sequence
tatgggctttgttgatccaagcacg

SEQ ID NO: 136707 - DNA, 25 bp, Artificial sequence
  SiRNA target sequence
atgggctttgttgatccaagcacga

SEQ ID NO: 136708 - DNA, 25 bp, Artificial sequence
  SiRNA target sequence
tgggctttgttgatccaagcacgag

SEQ ID NO: 136709 - DNA, 25 bp, Artificial sequence
  SiRNA target sequence
gggctttgttgatccaagcacgagt

SEQ ID NO: 136710 - DNA, 25 bp, Artificial sequence
  SiRNA target sequence
ggctttgttgatccaagcacgagtg

SEQ ID NO: 136711 - DNA, 25 bp, Artificial sequence
  SiRNA target sequence
gctttgttgatccaagcacgagtga

SEQ ID NO: 136712 - DNA, 25 bp, Artificial sequence
  SiRNA target sequence
ctttgttgatccaagcacgagtgat

SEQ ID NO: 136713 - DNA, 25 bp, Artificial sequence
  SiRNA target sequence
tttgttgatccaagcacgagtgatg

SEQ ID NO: 136714 - DNA, 25 bp, Artificial sequence
  SiRNA target sequence
ttgttgatccaagcacgagtgatgg

SEQ ID NO: 136715 - DNA, 25 bp, Artificial sequence
  SiRNA target sequence
tgttgatccaagcacgagtgatgga

SEQ ID NO: 136716 - DNA, 25 bp, Artificial sequence
  SiRNA target sequence
gttgatccaagcacgagtgatggaa

SEQ ID NO: 136717 - DNA, 25 bp, Artificial sequence
  SiRNA target sequence
ttgatccaagcacgagtgatggaag

SEQ ID NO: 136718 - DNA, 25 bp, Artificial sequence
  SiRNA target sequence
tgatccaagcacgagtgatggaaga

SEQ ID NO: 136719 - DNA, 25 bp, Artificial sequence
  SiRNA target sequence
gatccaagcacgagtgatggaagaa

SEQ ID NO: 136720 - DNA, 25 bp, Artificial sequence
  SiRNA target sequence
atccaagcacgagtgatggaagaat

SEQ ID NO: 136721 - DNA, 25 bp, Artificial sequence
  SiRNA target sequence
tccaagcacgagtgatggaagaatc

SEQ ID NO: 136722 - DNA, 25 bp, Artificial sequence
  SiRNA target sequence
ccaagcacgagtgatggaagaatcg

SEQ ID NO: 136723 - DNA, 25 bp, Artificial sequence
  SiRNA target sequence
caagcacgagtgatggaagaatcgc

SEQ ID NO: 136724 - DNA, 25 bp, Artificial sequence
  SiRNA target sequence
aagcacgagtgatggaagaatcgca

SEQ ID NO: 136725 - DNA, 25 bp, Artificial sequence
  SiRNA target sequence
agcacgagtgatggaagaatcgcat

SEQ ID NO: 136726 - DNA, 25 bp, Artificial sequence
  SiRNA target sequence
gcacgagtgatggaagaatcgcatt

SEQ ID NO: 136727 - DNA, 25 bp, Artificial sequence
  SiRNA target sequence
cacgagtgatggaagaatcgcattt

SEQ ID NO: 136728 - DNA, 25 bp, Artificial sequence
  SiRNA target sequence
acgagtgatggaagaatcgcatttt

SEQ ID NO: 136729 - DNA, 25 bp, Artificial sequence
  SiRNA target sequence
cgagtgatggaagaatcgcattttt

SEQ ID NO: 136730 - DNA, 25 bp, Artificial sequence
  SiRNA target sequence
gagtgatggaagaatcgcatttttt

SEQ ID NO: 136731 - DNA, 25 bp, Artificial sequence
  SiRNA target sequence
agtgatggaagaatcgcatttttta

SEQ ID NO: 136732 - DNA, 25 bp, Artificial sequence
  SiRNA target sequence
gtgatggaagaatcgcattttttat

SEQ ID NO: 136733 - DNA, 25 bp, Artificial sequence
  SiRNA target sequence
tgatggaagaatcgcattttttatg

SEQ ID NO: 136734 - DNA, 25 bp, Artificial sequence
  SiRNA target sequence
gatggaagaatcgcattttttatga

SEQ ID NO: 136735 - DNA, 25 bp, Artificial sequence
  SiRNA target sequence
atggaagaatcgcattttttatgaa

SEQ ID NO: 136736 - DNA, 25 bp, Artificial sequence
  SiRNA target sequence
tggaagaatcgcattttttatgaat

SEQ ID NO: 136737 - DNA, 25 bp, Artificial sequence
  SiRNA target sequence
ggaagaatcgcattttttatgaatt

SEQ ID NO: 136738 - DNA, 25 bp, Artificial sequence
  SiRNA target sequence
gaagaatcgcattttttatgaattt

SEQ ID NO: 136739 - DNA, 25 bp, Artificial sequence
  SiRNA target sequence
aagaatcgcattttttatgaatttt

SEQ ID NO: 136740 - DNA, 25 bp, Artificial sequence
  SiRNA target sequence
agaatcgcattttttatgaatttta

SEQ ID NO: 136741 - DNA, 25 bp, Artificial sequence
  SiRNA target sequence
gaatcgcattttttatgaattttaa

SEQ ID NO: 136742 - DNA, 25 bp, Artificial sequence
  SiRNA target sequence
aatcgcattttttatgaattttaaa

SEQ ID NO: 136743 - DNA, 25 bp, Artificial sequence
  SiRNA target sequence
atcgcattttttatgaattttaaag

SEQ ID NO: 136744 - DNA, 25 bp, Artificial sequence
  SiRNA target sequence
tcgcattttttatgaattttaaagg

SEQ ID NO: 136745 - DNA, 25 bp, Artificial sequence
  SiRNA target sequence
cgcattttttatgaattttaaaggt

SEQ ID NO: 136746 - DNA, 25 bp, Artificial sequence
  SiRNA target sequence
gcattttttatgaattttaaaggta

SEQ ID NO: 136747 - DNA, 25 bp, Artificial sequence
  SiRNA target sequence
cattttttatgaattttaaaggtaa

SEQ ID NO: 136748 - DNA, 25 bp, Artificial sequence
  SiRNA target sequence
attttttatgaattttaaaggtaaa

SEQ ID NO: 136749 - DNA, 25 bp, Artificial sequence
  SiRNA target sequence
ttttttatgaattttaaaggtaaaa

SEQ ID NO: 136750 - DNA, 25 bp, Artificial sequence
  SiRNA target sequence
tttttatgaattttaaaggtaaaac

SEQ ID NO: 136751 - DNA, 25 bp, Artificial sequence
  SiRNA target sequence
ttttatgaattttaaaggtaaaaca

SEQ ID NO: 136752 - DNA, 25 bp, Artificial sequence
  SiRNA target sequence
tttatgaattttaaaggtaaaacat

SEQ ID NO: 136753 - DNA, 25 bp, Artificial sequence
  SiRNA target sequence
ttatgaattttaaaggtaaaacatt

SEQ ID NO: 136754 - DNA, 25 bp, Artificial sequence
  SiRNA target sequence
tatgaattttaaaggtaaaacattg

SEQ ID NO: 136755 - DNA, 25 bp, Artificial sequence
  SiRNA target sequence
atgaattttaaaggtaaaacattga

SEQ ID NO: 136756 - DNA, 25 bp, Artificial sequence
  SiRNA target sequence
tgaattttaaaggtaaaacattgat

SEQ ID NO: 136757 - DNA, 25 bp, Artificial sequence
  SiRNA target sequence
gaattttaaaggtaaaacattgatt

SEQ ID NO: 136758 - DNA, 25 bp, Artificial sequence
  SiRNA target sequence
aattttaaaggtaaaacattgattg

SEQ ID NO: 136759 - DNA, 25 bp, Artificial sequence
  SiRNA target sequence
attttaaaggtaaaacattgattgg

SEQ ID NO: 136760 - DNA, 25 bp, Artificial sequence
  SiRNA target sequence
ttttaaaggtaaaacattgattgga

SEQ ID NO: 136761 - DNA, 25 bp, Artificial sequence
  SiRNA target sequence
tttaaaggtaaaacattgattggag

SEQ ID NO: 136762 - DNA, 25 bp, Artificial sequence
  SiRNA target sequence
ttaaaggtaaaacattgattggagg

SEQ ID NO: 136763 - DNA, 25 bp, Artificial sequence
  SiRNA target sequence
taaaggtaaaacattgattggagga

SEQ ID NO: 136764 - DNA, 25 bp, Artificial sequence
  SiRNA target sequence
aaaggtaaaacattgattggaggaa

SEQ ID NO: 136765 - DNA, 25 bp, Artificial sequence
  SiRNA target sequence
aaggtaaaacattgattggaggaac

SEQ ID NO: 136766 - DNA, 25 bp, Artificial sequence
  SiRNA target sequence
aggtaaaacattgattggaggaaca

SEQ ID NO: 136767 - DNA, 25 bp, Artificial sequence
  SiRNA target sequence
ggtaaaacattgattggaggaacag

SEQ ID NO: 136768 - DNA, 25 bp, Artificial sequence
  SiRNA target sequence
gtaaaacattgattggaggaacaga

SEQ ID NO: 136769 - DNA, 25 bp, Artificial sequence
  SiRNA target sequence
taaaacattgattggaggaacagat

SEQ ID NO: 136770 - DNA, 25 bp, Artificial sequence
  SiRNA target sequence
aaaacattgattggaggaacagatg

SEQ ID NO: 136771 - DNA, 25 bp, Artificial sequence
  SiRNA target sequence
aaacattgattggaggaacagatgt

SEQ ID NO: 136772 - DNA, 25 bp, Artificial sequence
  SiRNA target sequence
aacattgattggaggaacagatgtt

SEQ ID NO: 136773 - DNA, 25 bp, Artificial sequence
  SiRNA target sequence
acattgattggaggaacagatgtta

SEQ ID NO: 136774 - DNA, 25 bp, Artificial sequence
  SiRNA target sequence
cattgattggaggaacagatgttaa

SEQ ID NO: 136775 - DNA, 25 bp, Artificial sequence
  SiRNA target sequence
attgattggaggaacagatgttaag

SEQ ID NO: 136776 - DNA, 25 bp, Artificial sequence
  SiRNA target sequence
ttgattggaggaacagatgttaagt

SEQ ID NO: 136777 - DNA, 25 bp, Artificial sequence
  SiRNA target sequence
tgattggaggaacagatgttaagtg

SEQ ID NO: 136778 - DNA, 25 bp, Artificial sequence
  SiRNA target sequence
gattggaggaacagatgttaagtgt

SEQ ID NO: 136779 - DNA, 25 bp, Artificial sequence
  SiRNA target sequence
attggaggaacagatgttaagtgta

SEQ ID NO: 136780 - DNA, 25 bp, Artificial sequence
  SiRNA target sequence
ttggaggaacagatgttaagtgtaa

SEQ ID NO: 136781 - DNA, 25 bp, Artificial sequence
  SiRNA target sequence
tggaggaacagatgttaagtgtaaa

SEQ ID NO: 136782 - DNA, 25 bp, Artificial sequence
  SiRNA target sequence
ggaggaacagatgttaagtgtaaag

SEQ ID NO: 136783 - DNA, 25 bp, Artificial sequence
  SiRNA target sequence
gaggaacagatgttaagtgtaaagt

SEQ ID NO: 136784 - DNA, 25 bp, Artificial sequence
  SiRNA target sequence
aggaacagatgttaagtgtaaagtt

SEQ ID NO: 136785 - DNA, 25 bp, Artificial sequence
  SiRNA target sequence
ggaacagatgttaagtgtaaagttg

SEQ ID NO: 136786 - DNA, 25 bp, Artificial sequence
  SiRNA target sequence
gaacagatgttaagtgtaaagttga

SEQ ID NO: 136787 - DNA, 25 bp, Artificial sequence
  SiRNA target sequence
aacagatgttaagtgtaaagttgaa

SEQ ID NO: 136788 - DNA, 25 bp, Artificial sequence
  SiRNA target sequence
acagatgttaagtgtaaagttgaag

SEQ ID NO: 136789 - DNA, 25 bp, Artificial sequence
  SiRNA target sequence
cagatgttaagtgtaaagttgaaga

SEQ ID NO: 136790 - DNA, 25 bp, Artificial sequence
  SiRNA target sequence
agatgttaagtgtaaagttgaagat

SEQ ID NO: 136791 - DNA, 25 bp, Artificial sequence
  SiRNA target sequence
gatgttaagtgtaaagttgaagatt

SEQ ID NO: 136792 - DNA, 25 bp, Artificial sequence
  SiRNA target sequence
atgttaagtgtaaagttgaagattt

SEQ ID NO: 136793 - DNA, 25 bp, Artificial sequence
  SiRNA target sequence
tgttaagtgtaaagttgaagattta

SEQ ID NO: 136794 - DNA, 25 bp, Artificial sequence
  SiRNA target sequence
gttaagtgtaaagttgaagatttaa

SEQ ID NO: 136795 - DNA, 25 bp, Artificial sequence
  SiRNA target sequence
ttaagtgtaaagttgaagatttaat

SEQ ID NO: 136796 - DNA, 25 bp, Artificial sequence
  SiRNA target sequence
taagtgtaaagttgaagatttaata

SEQ ID NO: 136797 - DNA, 25 bp, Artificial sequence
  SiRNA target sequence
aagtgtaaagttgaagatttaataa

SEQ ID NO: 136798 - DNA, 25 bp, Artificial sequence
  SiRNA target sequence
agtgtaaagttgaagatttaataaa

SEQ ID NO: 136799 - DNA, 25 bp, Artificial sequence
  SiRNA target sequence
gtgtaaagttgaagatttaataaaa

SEQ ID NO: 136800 - DNA, 25 bp, Artificial sequence
  SiRNA target sequence
tgtaaagttgaagatttaataaaac

SEQ ID NO: 136801 - DNA, 25 bp, Artificial sequence
  SiRNA target sequence
gtaaagttgaagatttaataaaacc

SEQ ID NO: 136802 - DNA, 25 bp, Artificial sequence
  SiRNA target sequence
taaagttgaagatttaataaaaccg

SEQ ID NO: 136803 - DNA, 25 bp, Artificial sequence
  SiRNA target sequence
aaagttgaagatttaataaaaccga

SEQ ID NO: 136804 - DNA, 25 bp, Artificial sequence
  SiRNA target sequence
aagttgaagatttaataaaaccgac

SEQ ID NO: 136805 - DNA, 25 bp, Artificial sequence
  SiRNA target sequence
agttgaagatttaataaaaccgact

SEQ ID NO: 136806 - DNA, 25 bp, Artificial sequence
  SiRNA target sequence
gttgaagatttaataaaaccgactg

SEQ ID NO: 136807 - DNA, 25 bp, Artificial sequence
  SiRNA target sequence
ttgaagatttaataaaaccgactga

SEQ ID NO: 136808 - DNA, 25 bp, Artificial sequence
  SiRNA target sequence
tgaagatttaataaaaccgactgaa

SEQ ID NO: 136809 - DNA, 25 bp, Artificial sequence
  SiRNA target sequence
gaagatttaataaaaccgactgaag

SEQ ID NO: 136810 - DNA, 25 bp, Artificial sequence
  SiRNA target sequence
aagatttaataaaaccgactgaaga

SEQ ID NO: 136811 - DNA, 25 bp, Artificial sequence
  SiRNA target sequence
agatttaataaaaccgactgaagaa

SEQ ID NO: 136812 - DNA, 25 bp, Artificial sequence
  SiRNA target sequence
gatttaataaaaccgactgaagaag

SEQ ID NO: 136813 - DNA, 25 bp, Artificial sequence
  SiRNA target sequence
atttaataaaaccgactgaagaaga

SEQ ID NO: 136814 - DNA, 25 bp, Artificial sequence
  SiRNA target sequence
tttaataaaaccgactgaagaagat

SEQ ID NO: 136815 - DNA, 25 bp, Artificial sequence
  SiRNA target sequence
ttaataaaaccgactgaagaagatc

SEQ ID NO: 136816 - DNA, 25 bp, Artificial sequence
  SiRNA target sequence
taataaaaccgactgaagaagatct

SEQ ID NO: 136817 - DNA, 25 bp, Artificial sequence
  SiRNA target sequence
aataaaaccgactgaagaagatcta

SEQ ID NO: 136818 - DNA, 25 bp, Artificial sequence
  SiRNA target sequence
ataaaaccgactgaagaagatctaa

SEQ ID NO: 136819 - DNA, 25 bp, Artificial sequence
  SiRNA target sequence
taaaaccgactgaagaagatctaaa

SEQ ID NO: 136820 - DNA, 25 bp, Artificial sequence
  SiRNA target sequence
aaaaccgactgaagaagatctaaac

SEQ ID NO: 136821 - DNA, 25 bp, Artificial sequence
  SiRNA target sequence
aaaccgactgaagaagatctaaact

SEQ ID NO: 136822 - DNA, 25 bp, Artificial sequence
  SiRNA target sequence
aaccgactgaagaagatctaaactt

SEQ ID NO: 136823 - DNA, 25 bp, Artificial sequence
  SiRNA target sequence
accgactgaagaagatctaaacttt

SEQ ID NO: 136824 - DNA, 25 bp, Artificial sequence
  SiRNA target sequence
ccgactgaagaagatctaaactttc

SEQ ID NO: 136825 - DNA, 25 bp, Artificial sequence
  SiRNA target sequence
cgactgaagaagatctaaactttct

SEQ ID NO: 136826 - DNA, 25 bp, Artificial sequence
  SiRNA target sequence
gactgaagaagatctaaactttctt

SEQ ID NO: 136827 - DNA, 25 bp, Artificial sequence
  SiRNA target sequence
actgaagaagatctaaactttctta

SEQ ID NO: 136828 - DNA, 25 bp, Artificial sequence
  SiRNA target sequence
ctgaagaagatctaaactttcttat

SEQ ID NO: 136829 - DNA, 25 bp, Artificial sequence
  SiRNA target sequence
tgaagaagatctaaactttcttatt

SEQ ID NO: 136830 - DNA, 25 bp, Artificial sequence
  SiRNA target sequence
gaagaagatctaaactttcttattc

SEQ ID NO: 136831 - DNA, 25 bp, Artificial sequence
  SiRNA target sequence
aagaagatctaaactttcttattca

SEQ ID NO: 136832 - DNA, 25 bp, Artificial sequence
  SiRNA target sequence
agaagatctaaactttcttattcac

SEQ ID NO: 136833 - DNA, 25 bp, Artificial sequence
  SiRNA target sequence
gaagatctaaactttcttattcacg

SEQ ID NO: 136834 - DNA, 25 bp, Artificial sequence
  SiRNA target sequence
aagatctaaactttcttattcacga

SEQ ID NO: 136835 - DNA, 25 bp, Artificial sequence
  SiRNA target sequence
agatctaaactttcttattcacgag

SEQ ID NO: 136836 - DNA, 25 bp, Artificial sequence
  SiRNA target sequence
gatctaaactttcttattcacgagg

SEQ ID NO: 136837 - DNA, 25 bp, Artificial sequence
  SiRNA target sequence
atctaaactttcttattcacgaggc

SEQ ID NO: 136838 - DNA, 25 bp, Artificial sequence
  SiRNA target sequence
tctaaactttcttattcacgaggcc

SEQ ID NO: 136839 - DNA, 25 bp, Artificial sequence
  SiRNA target sequence
ctaaactttcttattcacgaggcca

SEQ ID NO: 136840 - DNA, 25 bp, Artificial sequence
  SiRNA target sequence
taaactttcttattcacgaggccaa

SEQ ID NO: 136841 - DNA, 25 bp, Artificial sequence
  SiRNA target sequence
aaactttcttattcacgaggccaat

SEQ ID NO: 136842 - DNA, 25 bp, Artificial sequence
  SiRNA target sequence
aactttcttattcacgaggccaatt

SEQ ID NO: 136843 - DNA, 25 bp, Artificial sequence
  SiRNA target sequence
actttcttattcacgaggccaatta

SEQ ID NO: 136844 - DNA, 25 bp, Artificial sequence
  SiRNA target sequence
ctttcttattcacgaggccaattat

SEQ ID NO: 136845 - DNA, 25 bp, Artificial sequence
  SiRNA target sequence
tttcttattcacgaggccaattatt

SEQ ID NO: 136846 - DNA, 25 bp, Artificial sequence
  SiRNA target sequence
ttcttattcacgaggccaattattt

SEQ ID NO: 136847 - DNA, 25 bp, Artificial sequence
  SiRNA target sequence
tcttattcacgaggccaattatttt

SEQ ID NO: 136848 - DNA, 25 bp, Artificial sequence
  SiRNA target sequence
cttattcacgaggccaattatttta

SEQ ID NO: 136849 - DNA, 25 bp, Artificial sequence
  SiRNA target sequence
ttattcacgaggccaattattttac

SEQ ID NO: 136850 - DNA, 25 bp, Artificial sequence
  SiRNA target sequence
tattcacgaggccaattattttaca

SEQ ID NO: 136851 - DNA, 25 bp, Artificial sequence
  SiRNA target sequence
attcacgaggccaattattttacag

SEQ ID NO: 136852 - DNA, 25 bp, Artificial sequence
  SiRNA target sequence
ttcacgaggccaattattttacaga

SEQ ID NO: 136853 - DNA, 25 bp, Artificial sequence
  SiRNA target sequence
tcacgaggccaattattttacagat

SEQ ID NO: 136854 - DNA, 25 bp, Artificial sequence
  SiRNA target sequence
cacgaggccaattattttacagatc

SEQ ID NO: 136855 - DNA, 25 bp, Artificial sequence
  SiRNA target sequence
acgaggccaattattttacagatca

SEQ ID NO: 136856 - DNA, 25 bp, Artificial sequence
  SiRNA target sequence
cgaggccaattattttacagatcac

SEQ ID NO: 136857 - DNA, 25 bp, Artificial sequence
  SiRNA target sequence
gaggccaattattttacagatcaca

SEQ ID NO: 136858 - DNA, 25 bp, Artificial sequence
  SiRNA target sequence
aggccaattattttacagatcacaa

SEQ ID NO: 136859 - DNA, 25 bp, Artificial sequence
  SiRNA target sequence
ggccaattattttacagatcacaat

SEQ ID NO: 136860 - DNA, 25 bp, Artificial sequence
  SiRNA target sequence
gccaattattttacagatcacaatt

SEQ ID NO: 136861 - DNA, 25 bp, Artificial sequence
  SiRNA target sequence
ccaattattttacagatcacaattt

SEQ ID NO: 136862 - DNA, 25 bp, Artificial sequence
  SiRNA target sequence
caattattttacagatcacaattta

SEQ ID NO: 136863 - DNA, 25 bp, Artificial sequence
  SiRNA target sequence
aattattttacagatcacaatttaa

SEQ ID NO: 136864 - DNA, 25 bp, Artificial sequence
  SiRNA target sequence
attattttacagatcacaatttaaa

SEQ ID NO: 136865 - DNA, 25 bp, Artificial sequence
  SiRNA target sequence
ttattttacagatcacaatttaaaa

SEQ ID NO: 136866 - DNA, 25 bp, Artificial sequence
  SiRNA target sequence
tattttacagatcacaatttaaaat

SEQ ID NO: 136867 - DNA, 25 bp, Artificial sequence
  SiRNA target sequence
attttacagatcacaatttaaaatt

SEQ ID NO: 136868 - DNA, 25 bp, Artificial sequence
  SiRNA target sequence
ttttacagatcacaatttaaaatta

SEQ ID NO: 136869 - DNA, 25 bp, Artificial sequence
  SiRNA target sequence
tttacagatcacaatttaaaattaa

SEQ ID NO: 136870 - DNA, 25 bp, Artificial sequence
  SiRNA target sequence
ttacagatcacaatttaaaattaac

SEQ ID NO: 136871 - DNA, 25 bp, Artificial sequence
  SiRNA target sequence
tacagatcacaatttaaaattaaca

SEQ ID NO: 136872 - DNA, 25 bp, Artificial sequence
  SiRNA target sequence
acagatcacaatttaaaattaacaa

SEQ ID NO: 136873 - DNA, 25 bp, Artificial sequence
  SiRNA target sequence
cagatcacaatttaaaattaacaaa

SEQ ID NO: 136874 - DNA, 25 bp, Artificial sequence
  SiRNA target sequence
agatcacaatttaaaattaacaaaa

SEQ ID NO: 136875 - DNA, 25 bp, Artificial sequence
  SiRNA target sequence
gatcacaatttaaaattaacaaaaa

SEQ ID NO: 136876 - DNA, 25 bp, Artificial sequence
  SiRNA target sequence
atcacaatttaaaattaacaaaaaa

SEQ ID NO: 136877 - DNA, 25 bp, Artificial sequence
  SiRNA target sequence
tcacaatttaaaattaacaaaaaaa

SEQ ID NO: 136878 - DNA, 25 bp, Artificial sequence
  SiRNA target sequence
cacaatttaaaattaacaaaaaaag

SEQ ID NO: 136879 - DNA, 25 bp, Artificial sequence
  SiRNA target sequence
acaatttaaaattaacaaaaaaaga

SEQ ID NO: 136880 - DNA, 25 bp, Artificial sequence
  SiRNA target sequence
caatttaaaattaacaaaaaaagat

SEQ ID NO: 136881 - DNA, 25 bp, Artificial sequence
  SiRNA target sequence
aatttaaaattaacaaaaaaagatg

SEQ ID NO: 136882 - DNA, 25 bp, Artificial sequence
  SiRNA target sequence
atttaaaattaacaaaaaaagatgt

SEQ ID NO: 136883 - DNA, 25 bp, Artificial sequence
  SiRNA target sequence
tttaaaattaacaaaaaaagatgtt

SEQ ID NO: 136884 - DNA, 25 bp, Artificial sequence
  SiRNA target sequence
ttaaaattaacaaaaaaagatgttt

SEQ ID NO: 136885 - DNA, 25 bp, Artificial sequence
  SiRNA target sequence
taaaattaacaaaaaaagatgtttt

SEQ ID NO: 136886 - DNA, 25 bp, Artificial sequence
  SiRNA target sequence
aaaattaacaaaaaaagatgttttg

SEQ ID NO: 136887 - DNA, 25 bp, Artificial sequence
  SiRNA target sequence
aaattaacaaaaaaagatgttttgt

SEQ ID NO: 136888 - DNA, 25 bp, Artificial sequence
  SiRNA target sequence
aattaacaaaaaaagatgttttgtc

SEQ ID NO: 136889 - DNA, 25 bp, Artificial sequence
  SiRNA target sequence
attaacaaaaaaagatgttttgtct

SEQ ID NO: 136890 - DNA, 25 bp, Artificial sequence
  SiRNA target sequence
ttaacaaaaaaagatgttttgtctg

SEQ ID NO: 136891 - DNA, 25 bp, Artificial sequence
  SiRNA target sequence
taacaaaaaaagatgttttgtctgt

SEQ ID NO: 136892 - DNA, 25 bp, Artificial sequence
  SiRNA target sequence
aacaaaaaaagatgttttgtctgtt

SEQ ID NO: 136893 - DNA, 25 bp, Artificial sequence
  SiRNA target sequence
acaaaaaaagatgttttgtctgttt

SEQ ID NO: 136894 - DNA, 25 bp, Artificial sequence
  SiRNA target sequence
caaaaaaagatgttttgtctgtttg

SEQ ID NO: 136895 - DNA, 25 bp, Artificial sequence
  SiRNA target sequence
aaaaaaagatgttttgtctgtttgg

SEQ ID NO: 136896 - DNA, 25 bp, Artificial sequence
  SiRNA target sequence
aaaaaagatgttttgtctgtttgga

SEQ ID NO: 136897 - DNA, 25 bp, Artificial sequence
  SiRNA target sequence
aaaaagatgttttgtctgtttggac

SEQ ID NO: 136898 - DNA, 25 bp, Artificial sequence
  SiRNA target sequence
aaaagatgttttgtctgtttggaca

SEQ ID NO: 136899 - DNA, 25 bp, Artificial sequence
  SiRNA target sequence
aaagatgttttgtctgtttggacag

SEQ ID NO: 136900 - DNA, 25 bp, Artificial sequence
  SiRNA target sequence
aagatgttttgtctgtttggacagg

SEQ ID NO: 136901 - DNA, 25 bp, Artificial sequence
  SiRNA target sequence
agatgttttgtctgtttggacaggt

SEQ ID NO: 136902 - DNA, 25 bp, Artificial sequence
  SiRNA target sequence
gatgttttgtctgtttggacaggta

SEQ ID NO: 136903 - DNA, 25 bp, Artificial sequence
  SiRNA target sequence
atgttttgtctgtttggacaggtat

SEQ ID NO: 136904 - DNA, 25 bp, Artificial sequence
  SiRNA target sequence
tgttttgtctgtttggacaggtatt

SEQ ID NO: 136905 - DNA, 25 bp, Artificial sequence
  SiRNA target sequence
gttttgtctgtttggacaggtatta

SEQ ID NO: 136906 - DNA, 25 bp, Artificial sequence
  SiRNA target sequence
ttttgtctgtttggacaggtattag

SEQ ID NO: 136907 - DNA, 25 bp, Artificial sequence
  SiRNA target sequence
tttgtctgtttggacaggtattaga

SEQ ID NO: 136908 - DNA, 25 bp, Artificial sequence
  SiRNA target sequence
ttgtctgtttggacaggtattagac

SEQ ID NO: 136909 - DNA, 25 bp, Artificial sequence
  SiRNA target sequence
tgtctgtttggacaggtattagacc

SEQ ID NO: 136910 - DNA, 25 bp, Artificial sequence
  SiRNA target sequence
gtctgtttggacaggtattagaccg

SEQ ID NO: 136911 - DNA, 25 bp, Artificial sequence
  SiRNA target sequence
tctgtttggacaggtattagaccgt

SEQ ID NO: 136912 - DNA, 25 bp, Artificial sequence
  SiRNA target sequence
ctgtttggacaggtattagaccgtt

SEQ ID NO: 136913 - DNA, 25 bp, Artificial sequence
  SiRNA target sequence
tgtttggacaggtattagaccgtta

SEQ ID NO: 136914 - DNA, 25 bp, Artificial sequence
  SiRNA target sequence
gtttggacaggtattagaccgttag

SEQ ID NO: 136915 - DNA, 25 bp, Artificial sequence
  SiRNA target sequence
tttggacaggtattagaccgttagt

SEQ ID NO: 136916 - DNA, 25 bp, Artificial sequence
  SiRNA target sequence
ttggacaggtattagaccgttagtc

SEQ ID NO: 136917 - DNA, 25 bp, Artificial sequence
  SiRNA target sequence
tggacaggtattagaccgttagtca

SEQ ID NO: 136918 - DNA, 25 bp, Artificial sequence
  SiRNA target sequence
ggacaggtattagaccgttagtcaa

SEQ ID NO: 136919 - DNA, 25 bp, Artificial sequence
  SiRNA target sequence
gacaggtattagaccgttagtcaag

SEQ ID NO: 136920 - DNA, 25 bp, Artificial sequence
  SiRNA target sequence
acaggtattagaccgttagtcaagg

SEQ ID NO: 136921 - DNA, 25 bp, Artificial sequence
  SiRNA target sequence
caggtattagaccgttagtcaagga

SEQ ID NO: 136922 - DNA, 25 bp, Artificial sequence
  SiRNA target sequence
aggtattagaccgttagtcaaggat

SEQ ID NO: 136923 - DNA, 25 bp, Artificial sequence
  SiRNA target sequence
ggtattagaccgttagtcaaggatt

SEQ ID NO: 136924 - DNA, 25 bp, Artificial sequence
  SiRNA target sequence
gtattagaccgttagtcaaggattt

SEQ ID NO: 136925 - DNA, 25 bp, Artificial sequence
  SiRNA target sequence
tattagaccgttagtcaaggattta

SEQ ID NO: 136926 - DNA, 25 bp, Artificial sequence
  SiRNA target sequence
attagaccgttagtcaaggatttat

SEQ ID NO: 136927 - DNA, 25 bp, Artificial sequence
  SiRNA target sequence
ttagaccgttagtcaaggatttatc

SEQ ID NO: 136928 - DNA, 25 bp, Artificial sequence
  SiRNA target sequence
tagaccgttagtcaaggatttatcg

SEQ ID NO: 136929 - DNA, 25 bp, Artificial sequence
  SiRNA target sequence
agaccgttagtcaaggatttatcga

SEQ ID NO: 136930 - DNA, 25 bp, Artificial sequence
  SiRNA target sequence
gaccgttagtcaaggatttatcgaa

SEQ ID NO: 136931 - DNA, 25 bp, Artificial sequence
  SiRNA target sequence
accgttagtcaaggatttatcgaaa

SEQ ID NO: 136932 - DNA, 25 bp, Artificial sequence
  SiRNA target sequence
ccgttagtcaaggatttatcgaaaa

SEQ ID NO: 136933 - DNA, 25 bp, Artificial sequence
  SiRNA target sequence
cgttagtcaaggatttatcgaaaag

SEQ ID NO: 136934 - DNA, 25 bp, Artificial sequence
  SiRNA target sequence
gttagtcaaggatttatcgaaaagt

SEQ ID NO: 136935 - DNA, 25 bp, Artificial sequence
  SiRNA target sequence
ttagtcaaggatttatcgaaaagtt

SEQ ID NO: 136936 - DNA, 25 bp, Artificial sequence
  SiRNA target sequence
tagtcaaggatttatcgaaaagttc

SEQ ID NO: 136937 - DNA, 25 bp, Artificial sequence
  SiRNA target sequence
agtcaaggatttatcgaaaagttca

SEQ ID NO: 136938 - DNA, 25 bp, Artificial sequence
  SiRNA target sequence
gtcaaggatttatcgaaaagttcaa

SEQ ID NO: 136939 - DNA, 25 bp, Artificial sequence
  SiRNA target sequence
tcaaggatttatcgaaaagttcaac

SEQ ID NO: 136940 - DNA, 25 bp, Artificial sequence
  SiRNA target sequence
caaggatttatcgaaaagttcaaca

SEQ ID NO: 136941 - DNA, 25 bp, Artificial sequence
  SiRNA target sequence
aaggatttatcgaaaagttcaacag

SEQ ID NO: 136942 - DNA, 25 bp, Artificial sequence
  SiRNA target sequence
aggatttatcgaaaagttcaacaga

SEQ ID NO: 136943 - DNA, 25 bp, Artificial sequence
  SiRNA target sequence
ggatttatcgaaaagttcaacagaa

SEQ ID NO: 136944 - DNA, 25 bp, Artificial sequence
  SiRNA target sequence
gatttatcgaaaagttcaacagaaa

SEQ ID NO: 136945 - DNA, 25 bp, Artificial sequence
  SiRNA target sequence
atttatcgaaaagttcaacagaaaa

SEQ ID NO: 136946 - DNA, 25 bp, Artificial sequence
  SiRNA target sequence
tttatcgaaaagttcaacagaaaag

SEQ ID NO: 136947 - DNA, 25 bp, Artificial sequence
  SiRNA target sequence
ttatcgaaaagttcaacagaaaaga

SEQ ID NO: 136948 - DNA, 25 bp, Artificial sequence
  SiRNA target sequence
tatcgaaaagttcaacagaaaagat

SEQ ID NO: 136949 - DNA, 25 bp, Artificial sequence
  SiRNA target sequence
atcgaaaagttcaacagaaaagata

SEQ ID NO: 136950 - DNA, 25 bp, Artificial sequence
  SiRNA target sequence
tcgaaaagttcaacagaaaagatat

SEQ ID NO: 136951 - DNA, 25 bp, Artificial sequence
  SiRNA target sequence
cgaaaagttcaacagaaaagatatg

SEQ ID NO: 136952 - DNA, 25 bp, Artificial sequence
  SiRNA target sequence
gaaaagttcaacagaaaagatatgt

SEQ ID NO: 136953 - DNA, 25 bp, Artificial sequence
  SiRNA target sequence
aaaagttcaacagaaaagatatgta

SEQ ID NO: 136954 - DNA, 25 bp, Artificial sequence
  SiRNA target sequence
aaagttcaacagaaaagatatgtag

SEQ ID NO: 136955 - DNA, 25 bp, Artificial sequence
  SiRNA target sequence
aagttcaacagaaaagatatgtaga

SEQ ID NO: 136956 - DNA, 25 bp, Artificial sequence
  SiRNA target sequence
agttcaacagaaaagatatgtagaa

SEQ ID NO: 136957 - DNA, 25 bp, Artificial sequence
  SiRNA target sequence
gttcaacagaaaagatatgtagaaa

SEQ ID NO: 136958 - DNA, 25 bp, Artificial sequence
  SiRNA target sequence
ttcaacagaaaagatatgtagaaaa

SEQ ID NO: 136959 - DNA, 25 bp, Artificial sequence
  SiRNA target sequence
tcaacagaaaagatatgtagaaaac

SEQ ID NO: 136960 - DNA, 25 bp, Artificial sequence
  SiRNA target sequence
caacagaaaagatatgtagaaaaca

SEQ ID NO: 136961 - DNA, 25 bp, Artificial sequence
  SiRNA target sequence
aacagaaaagatatgtagaaaacat

SEQ ID NO: 136962 - DNA, 25 bp, Artificial sequence
  SiRNA target sequence
acagaaaagatatgtagaaaacata

SEQ ID NO: 136963 - DNA, 25 bp, Artificial sequence
  SiRNA target sequence
cagaaaagatatgtagaaaacatac

SEQ ID NO: 136964 - DNA, 25 bp, Artificial sequence
  SiRNA target sequence
agaaaagatatgtagaaaacatact

SEQ ID NO: 136965 - DNA, 25 bp, Artificial sequence
  SiRNA target sequence
gaaaagatatgtagaaaacatacta

SEQ ID NO: 136966 - DNA, 25 bp, Artificial sequence
  SiRNA target sequence
aaaagatatgtagaaaacatactat

SEQ ID NO: 136967 - DNA, 25 bp, Artificial sequence
  SiRNA target sequence
aaagatatgtagaaaacatactata

SEQ ID NO: 136968 - DNA, 25 bp, Artificial sequence
  SiRNA target sequence
aagatatgtagaaaacatactataa

SEQ ID NO: 136969 - DNA, 25 bp, Artificial sequence
  SiRNA target sequence
agatatgtagaaaacatactataag

SEQ ID NO: 136970 - DNA, 25 bp, Artificial sequence
  SiRNA target sequence
gatatgtagaaaacatactataaga

SEQ ID NO: 136971 - DNA, 25 bp, Artificial sequence
  SiRNA target sequence
atatgtagaaaacatactataagaa

SEQ ID NO: 136972 - DNA, 25 bp, Artificial sequence
  SiRNA target sequence
tatgtagaaaacatactataagaat

SEQ ID NO: 136973 - DNA, 25 bp, Artificial sequence
  SiRNA target sequence
atgtagaaaacatactataagaata

SEQ ID NO: 136974 - DNA, 25 bp, Artificial sequence
  SiRNA target sequence
tgtagaaaacatactataagaatag

SEQ ID NO: 136975 - DNA, 25 bp, Artificial sequence
  SiRNA target sequence
gtagaaaacatactataagaataga

SEQ ID NO: 136976 - DNA, 25 bp, Artificial sequence
  SiRNA target sequence
tagaaaacatactataagaatagat

SEQ ID NO: 136977 - DNA, 25 bp, Artificial sequence
  SiRNA target sequence
agaaaacatactataagaatagata

SEQ ID NO: 136978 - DNA, 25 bp, Artificial sequence
  SiRNA target sequence
gaaaacatactataagaatagataa

SEQ ID NO: 136979 - DNA, 25 bp, Artificial sequence
  SiRNA target sequence
aaaacatactataagaatagataaa

SEQ ID NO: 136980 - DNA, 25 bp, Artificial sequence
  SiRNA target sequence
aaacatactataagaatagataaag

SEQ ID NO: 136981 - DNA, 25 bp, Artificial sequence
  SiRNA target sequence
aacatactataagaatagataaaga

SEQ ID NO: 136982 - DNA, 25 bp, Artificial sequence
  SiRNA target sequence
acatactataagaatagataaagac

SEQ ID NO: 136983 - DNA, 25 bp, Artificial sequence
  SiRNA target sequence
catactataagaatagataaagaca

SEQ ID NO: 136984 - DNA, 25 bp, Artificial sequence
  SiRNA target sequence
atactataagaatagataaagacaa

SEQ ID NO: 136985 - DNA, 25 bp, Artificial sequence
  SiRNA target sequence
tactataagaatagataaagacaat

SEQ ID NO: 136986 - DNA, 25 bp, Artificial sequence
  SiRNA target sequence
actataagaatagataaagacaata

SEQ ID NO: 136987 - DNA, 25 bp, Artificial sequence
  SiRNA target sequence
ctataagaatagataaagacaatat

SEQ ID NO: 136988 - DNA, 25 bp, Artificial sequence
  SiRNA target sequence
tataagaatagataaagacaatatg

SEQ ID NO: 136989 - DNA, 25 bp, Artificial sequence
  SiRNA target sequence
ataagaatagataaagacaatatgg

SEQ ID NO: 136990 - DNA, 25 bp, Artificial sequence
  SiRNA target sequence
taagaatagataaagacaatatggt

SEQ ID NO: 136991 - DNA, 25 bp, Artificial sequence
  SiRNA target sequence
aagaatagataaagacaatatggta

SEQ ID NO: 136992 - DNA, 25 bp, Artificial sequence
  SiRNA target sequence
agaatagataaagacaatatggtaa

SEQ ID NO: 136993 - DNA, 25 bp, Artificial sequence
  SiRNA target sequence
gaatagataaagacaatatggtaac

SEQ ID NO: 136994 - DNA, 25 bp, Artificial sequence
  SiRNA target sequence
aatagataaagacaatatggtaact

SEQ ID NO: 136995 - DNA, 25 bp, Artificial sequence
  SiRNA target sequence
atagataaagacaatatggtaactg

SEQ ID NO: 136996 - DNA, 25 bp, Artificial sequence
  SiRNA target sequence
tagataaagacaatatggtaactgt

SEQ ID NO: 136997 - DNA, 25 bp, Artificial sequence
  SiRNA target sequence
agataaagacaatatggtaactgta

SEQ ID NO: 136998 - DNA, 25 bp, Artificial sequence
  SiRNA target sequence
gataaagacaatatggtaactgtaa

SEQ ID NO: 136999 - DNA, 25 bp, Artificial sequence
  SiRNA target sequence
ataaagacaatatggtaactgtaac

SEQ ID NO: 137000 - DNA, 25 bp, Artificial sequence
  SiRNA target sequence
taaagacaatatggtaactgtaaca

SEQ ID NO: 137001 - DNA, 25 bp, Artificial sequence
  SiRNA target sequence
aaagacaatatggtaactgtaacag

SEQ ID NO: 137002 - DNA, 25 bp, Artificial sequence
  SiRNA target sequence
aagacaatatggtaactgtaacagg

SEQ ID NO: 137003 - DNA, 25 bp, Artificial sequence
  SiRNA target sequence
agacaatatggtaactgtaacaggt

SEQ ID NO: 137004 - DNA, 25 bp, Artificial sequence
  SiRNA target sequence
gacaatatggtaactgtaacaggtg

SEQ ID NO: 137005 - DNA, 25 bp, Artificial sequence
  SiRNA target sequence
acaatatggtaactgtaacaggtgg

SEQ ID NO: 137006 - DNA, 25 bp, Artificial sequence
  SiRNA target sequence
caatatggtaactgtaacaggtggt

SEQ ID NO: 137007 - DNA, 25 bp, Artificial sequence
  SiRNA target sequence
aatatggtaactgtaacaggtggta

SEQ ID NO: 137008 - DNA, 25 bp, Artificial sequence
  SiRNA target sequence
atatggtaactgtaacaggtggtaa

SEQ ID NO: 137009 - DNA, 25 bp, Artificial sequence
  SiRNA target sequence
tatggtaactgtaacaggtggtaag

SEQ ID NO: 137010 - DNA, 25 bp, Artificial sequence
  SiRNA target sequence
atggtaactgtaacaggtggtaagt

SEQ ID NO: 137011 - DNA, 25 bp, Artificial sequence
  SiRNA target sequence
tggtaactgtaacaggtggtaagtg

SEQ ID NO: 137012 - DNA, 25 bp, Artificial sequence
  SiRNA target sequence
ggtaactgtaacaggtggtaagtgg

SEQ ID NO: 137013 - DNA, 25 bp, Artificial sequence
  SiRNA target sequence
gtaactgtaacaggtggtaagtgga

SEQ ID NO: 137014 - DNA, 25 bp, Artificial sequence
  SiRNA target sequence
taactgtaacaggtggtaagtggac

SEQ ID NO: 137015 - DNA, 25 bp, Artificial sequence
  SiRNA target sequence
aactgtaacaggtggtaagtggaca

SEQ ID NO: 137016 - DNA, 25 bp, Artificial sequence
  SiRNA target sequence
actgtaacaggtggtaagtggacaa

SEQ ID NO: 137017 - DNA, 25 bp, Artificial sequence
  SiRNA target sequence
ctgtaacaggtggtaagtggacaat

SEQ ID NO: 137018 - DNA, 25 bp, Artificial sequence
  SiRNA target sequence
tgtaacaggtggtaagtggacaatt

SEQ ID NO: 137019 - DNA, 25 bp, Artificial sequence
  SiRNA target sequence
gtaacaggtggtaagtggacaattt

SEQ ID NO: 137020 - DNA, 25 bp, Artificial sequence
  SiRNA target sequence
taacaggtggtaagtggacaatttt

SEQ ID NO: 137021 - DNA, 25 bp, Artificial sequence
  SiRNA target sequence
aacaggtggtaagtggacaattttt

SEQ ID NO: 137022 - DNA, 25 bp, Artificial sequence
  SiRNA target sequence
acaggtggtaagtggacaatttttc

SEQ ID NO: 137023 - DNA, 25 bp, Artificial sequence
  SiRNA target sequence
caggtggtaagtggacaatttttcg

SEQ ID NO: 137024 - DNA, 25 bp, Artificial sequence
  SiRNA target sequence
aggtggtaagtggacaatttttcga

SEQ ID NO: 137025 - DNA, 25 bp, Artificial sequence
  SiRNA target sequence
ggtggtaagtggacaatttttcgac

SEQ ID NO: 137026 - DNA, 25 bp, Artificial sequence
  SiRNA target sequence
gtggtaagtggacaatttttcgact

SEQ ID NO: 137027 - DNA, 25 bp, Artificial sequence
  SiRNA target sequence
tggtaagtggacaatttttcgactt

SEQ ID NO: 137028 - DNA, 25 bp, Artificial sequence
  SiRNA target sequence
ggtaagtggacaatttttcgactta

SEQ ID NO: 137029 - DNA, 25 bp, Artificial sequence
  SiRNA target sequence
gtaagtggacaatttttcgacttat

SEQ ID NO: 137030 - DNA, 25 bp, Artificial sequence
  SiRNA target sequence
taagtggacaatttttcgacttatg

SEQ ID NO: 137031 - DNA, 25 bp, Artificial sequence
  SiRNA target sequence
aagtggacaatttttcgacttatgg

SEQ ID NO: 137032 - DNA, 25 bp, Artificial sequence
  SiRNA target sequence
agtggacaatttttcgacttatggg

SEQ ID NO: 137033 - DNA, 25 bp, Artificial sequence
  SiRNA target sequence
gtggacaatttttcgacttatggga

SEQ ID NO: 137034 - DNA, 25 bp, Artificial sequence
  SiRNA target sequence
tggacaatttttcgacttatgggag

SEQ ID NO: 137035 - DNA, 25 bp, Artificial sequence
  SiRNA target sequence
ggacaatttttcgacttatgggaga

SEQ ID NO: 137036 - DNA, 25 bp, Artificial sequence
  SiRNA target sequence
gacaatttttcgacttatgggagaa

SEQ ID NO: 137037 - DNA, 25 bp, Artificial sequence
  SiRNA target sequence
acaatttttcgacttatgggagaac

SEQ ID NO: 137038 - DNA, 25 bp, Artificial sequence
  SiRNA target sequence
caatttttcgacttatgggagaaca

SEQ ID NO: 137039 - DNA, 25 bp, Artificial sequence
  SiRNA target sequence
aatttttcgacttatgggagaacag

SEQ ID NO: 137040 - DNA, 25 bp, Artificial sequence
  SiRNA target sequence
atttttcgacttatgggagaacaga

SEQ ID NO: 137041 - DNA, 25 bp, Artificial sequence
  SiRNA target sequence
tttttcgacttatgggagaacagac

SEQ ID NO: 137042 - DNA, 25 bp, Artificial sequence
  SiRNA target sequence
ttttcgacttatgggagaacagaca

SEQ ID NO: 137043 - DNA, 25 bp, Artificial sequence
  SiRNA target sequence
tttcgacttatgggagaacagacaa

SEQ ID NO: 137044 - DNA, 25 bp, Artificial sequence
  SiRNA target sequence
ttcgacttatgggagaacagacaat

SEQ ID NO: 137045 - DNA, 25 bp, Artificial sequence
  SiRNA target sequence
tcgacttatgggagaacagacaata

SEQ ID NO: 137046 - DNA, 25 bp, Artificial sequence
  SiRNA target sequence
cgacttatgggagaacagacaataa

SEQ ID NO: 137047 - DNA, 25 bp, Artificial sequence
  SiRNA target sequence
gacttatgggagaacagacaataaa

SEQ ID NO: 137048 - DNA, 25 bp, Artificial sequence
  SiRNA target sequence
acttatgggagaacagacaataaat

SEQ ID NO: 137049 - DNA, 25 bp, Artificial sequence
  SiRNA target sequence
cttatgggagaacagacaataaatc

SEQ ID NO: 137050 - DNA, 25 bp, Artificial sequence
  SiRNA target sequence
ttatgggagaacagacaataaatca

SEQ ID NO: 137051 - DNA, 25 bp, Artificial sequence
  SiRNA target sequence
tatgggagaacagacaataaatcaa

SEQ ID NO: 137052 - DNA, 25 bp, Artificial sequence
  SiRNA target sequence
atgggagaacagacaataaatcaaa

SEQ ID NO: 137053 - DNA, 25 bp, Artificial sequence
  SiRNA target sequence
tgggagaacagacaataaatcaaat

SEQ ID NO: 137054 - DNA, 25 bp, Artificial sequence
  SiRNA target sequence
gggagaacagacaataaatcaaatt

SEQ ID NO: 137055 - DNA, 25 bp, Artificial sequence
  SiRNA target sequence
ggagaacagacaataaatcaaatta

SEQ ID NO: 137056 - DNA, 25 bp, Artificial sequence
  SiRNA target sequence
gagaacagacaataaatcaaattat

SEQ ID NO: 137057 - DNA, 25 bp, Artificial sequence
  SiRNA target sequence
agaacagacaataaatcaaattata

SEQ ID NO: 137058 - DNA, 25 bp, Artificial sequence
  SiRNA target sequence
gaacagacaataaatcaaattataa

SEQ ID NO: 137059 - DNA, 25 bp, Artificial sequence
  SiRNA target sequence
aacagacaataaatcaaattataaa

SEQ ID NO: 137060 - DNA, 25 bp, Artificial sequence
  SiRNA target sequence
acagacaataaatcaaattataaaa

SEQ ID NO: 137061 - DNA, 25 bp, Artificial sequence
  SiRNA target sequence
cagacaataaatcaaattataaaag

SEQ ID NO: 137062 - DNA, 25 bp, Artificial sequence
  SiRNA target sequence
agacaataaatcaaattataaaagt

SEQ ID NO: 137063 - DNA, 25 bp, Artificial sequence
  SiRNA target sequence
gacaataaatcaaattataaaagtt

SEQ ID NO: 137064 - DNA, 25 bp, Artificial sequence
  SiRNA target sequence
acaataaatcaaattataaaagttt

SEQ ID NO: 137065 - DNA, 25 bp, Artificial sequence
  SiRNA target sequence
caataaatcaaattataaaagtttt

SEQ ID NO: 137066 - DNA, 25 bp, Artificial sequence
  SiRNA target sequence
aataaatcaaattataaaagttttt

SEQ ID NO: 137067 - DNA, 25 bp, Artificial sequence
  SiRNA target sequence
ataaatcaaattataaaagttttta

SEQ ID NO: 137068 - DNA, 25 bp, Artificial sequence
  SiRNA target sequence
taaatcaaattataaaagtttttaa

SEQ ID NO: 137069 - DNA, 25 bp, Artificial sequence
  SiRNA target sequence
aaatcaaattataaaagtttttaat

SEQ ID NO: 137070 - DNA, 25 bp, Artificial sequence
  SiRNA target sequence
aatcaaattataaaagtttttaata

SEQ ID NO: 137071 - DNA, 25 bp, Artificial sequence
  SiRNA target sequence
atcaaattataaaagtttttaatat

SEQ ID NO: 137072 - DNA, 25 bp, Artificial sequence
  SiRNA target sequence
tcaaattataaaagtttttaatata

SEQ ID NO: 137073 - DNA, 25 bp, Artificial sequence
  SiRNA target sequence
caaattataaaagtttttaatataa

SEQ ID NO: 137074 - DNA, 25 bp, Artificial sequence
  SiRNA target sequence
aaattataaaagtttttaatataaa

SEQ ID NO: 137075 - DNA, 25 bp, Artificial sequence
  SiRNA target sequence
aattataaaagtttttaatataaag

SEQ ID NO: 137076 - DNA, 25 bp, Artificial sequence
  SiRNA target sequence
attataaaagtttttaatataaagt

SEQ ID NO: 137077 - DNA, 25 bp, Artificial sequence
  SiRNA target sequence
ttataaaagtttttaatataaagtc

SEQ ID NO: 137078 - DNA, 25 bp, Artificial sequence
  SiRNA target sequence
tataaaagtttttaatataaagtct

SEQ ID NO: 137079 - DNA, 25 bp, Artificial sequence
  SiRNA target sequence
ataaaagtttttaatataaagtcta

SEQ ID NO: 137080 - DNA, 25 bp, Artificial sequence
  SiRNA target sequence
taaaagtttttaatataaagtctaa

SEQ ID NO: 137081 - DNA, 25 bp, Artificial sequence
  SiRNA target sequence
aaaagtttttaatataaagtctaat

SEQ ID NO: 137082 - DNA, 25 bp, Artificial sequence
  SiRNA target sequence
aaagtttttaatataaagtctaata

SEQ ID NO: 137083 - DNA, 25 bp, Artificial sequence
  SiRNA target sequence
aagtttttaatataaagtctaataa

SEQ ID NO: 137084 - DNA, 25 bp, Artificial sequence
  SiRNA target sequence
agtttttaatataaagtctaataaa

SEQ ID NO: 137085 - DNA, 25 bp, Artificial sequence
  SiRNA target sequence
gtttttaatataaagtctaataaac

SEQ ID NO: 137086 - DNA, 25 bp, Artificial sequence
  SiRNA target sequence
tttttaatataaagtctaataaacc

SEQ ID NO: 137087 - DNA, 25 bp, Artificial sequence
  SiRNA target sequence
ttttaatataaagtctaataaacca

SEQ ID NO: 137088 - DNA, 25 bp, Artificial sequence
  SiRNA target sequence
tttaatataaagtctaataaaccaa

SEQ ID NO: 137089 - DNA, 25 bp, Artificial sequence
  SiRNA target sequence
ttaatataaagtctaataaaccaag

SEQ ID NO: 137090 - DNA, 25 bp, Artificial sequence
  SiRNA target sequence
taatataaagtctaataaaccaagt

SEQ ID NO: 137091 - DNA, 25 bp, Artificial sequence
  SiRNA target sequence
aatataaagtctaataaaccaagta

SEQ ID NO: 137092 - DNA, 25 bp, Artificial sequence
  SiRNA target sequence
atataaagtctaataaaccaagtat

SEQ ID NO: 137093 - DNA, 25 bp, Artificial sequence
  SiRNA target sequence
tataaagtctaataaaccaagtata

SEQ ID NO: 137094 - DNA, 25 bp, Artificial sequence
  SiRNA target sequence
ataaagtctaataaaccaagtataa

SEQ ID NO: 137095 - DNA, 25 bp, Artificial sequence
  SiRNA target sequence
taaagtctaataaaccaagtataac

SEQ ID NO: 137096 - DNA, 25 bp, Artificial sequence
  SiRNA target sequence
aaagtctaataaaccaagtataaca

SEQ ID NO: 137097 - DNA, 25 bp, Artificial sequence
  SiRNA target sequence
aagtctaataaaccaagtataacac

SEQ ID NO: 137098 - DNA, 25 bp, Artificial sequence
  SiRNA target sequence
agtctaataaaccaagtataacaca

SEQ ID NO: 137099 - DNA, 25 bp, Artificial sequence
  SiRNA target sequence
gtctaataaaccaagtataacacaa

SEQ ID NO: 137100 - DNA, 25 bp, Artificial sequence
  SiRNA target sequence
tctaataaaccaagtataacacaat

SEQ ID NO: 137101 - DNA, 25 bp, Artificial sequence
  SiRNA target sequence
ctaataaaccaagtataacacaata

SEQ ID NO: 137102 - DNA, 25 bp, Artificial sequence
  SiRNA target sequence
taataaaccaagtataacacaatat

SEQ ID NO: 137103 - DNA, 25 bp, Artificial sequence
  SiRNA target sequence
aataaaccaagtataacacaatatc

SEQ ID NO: 137104 - DNA, 25 bp, Artificial sequence
  SiRNA target sequence
ataaaccaagtataacacaatatct

SEQ ID NO: 137105 - DNA, 25 bp, Artificial sequence
  SiRNA target sequence
taaaccaagtataacacaatatctt

SEQ ID NO: 137106 - DNA, 25 bp, Artificial sequence
  SiRNA target sequence
aaaccaagtataacacaatatcttc

SEQ ID NO: 137107 - DNA, 25 bp, Artificial sequence
  SiRNA target sequence
aaccaagtataacacaatatcttcc

SEQ ID NO: 137108 - DNA, 25 bp, Artificial sequence
  SiRNA target sequence
accaagtataacacaatatcttcct

SEQ ID NO: 137109 - DNA, 25 bp, Artificial sequence
  SiRNA target sequence
ccaagtataacacaatatcttcctg

SEQ ID NO: 137110 - DNA, 25 bp, Artificial sequence
  SiRNA target sequence
caagtataacacaatatcttcctgt

SEQ ID NO: 137111 - DNA, 25 bp, Artificial sequence
  SiRNA target sequence
aagtataacacaatatcttcctgtt

SEQ ID NO: 137112 - DNA, 25 bp, Artificial sequence
  SiRNA target sequence
agtataacacaatatcttcctgttt

SEQ ID NO: 137113 - DNA, 25 bp, Artificial sequence
  SiRNA target sequence
gtataacacaatatcttcctgtttt

SEQ ID NO: 137114 - DNA, 25 bp, Artificial sequence
  SiRNA target sequence
tataacacaatatcttcctgttttg

SEQ ID NO: 137115 - DNA, 25 bp, Artificial sequence
  SiRNA target sequence
ataacacaatatcttcctgttttgg

SEQ ID NO: 137116 - DNA, 25 bp, Artificial sequence
  SiRNA target sequence
taacacaatatcttcctgttttggg

SEQ ID NO: 137117 - DNA, 25 bp, Artificial sequence
  SiRNA target sequence
aacacaatatcttcctgttttggga

SEQ ID NO: 137118 - DNA, 25 bp, Artificial sequence
  SiRNA target sequence
acacaatatcttcctgttttgggat

SEQ ID NO: 137119 - DNA, 25 bp, Artificial sequence
  SiRNA target sequence
cacaatatcttcctgttttgggatc

SEQ ID NO: 137120 - DNA, 25 bp, Artificial sequence
  SiRNA target sequence
acaatatcttcctgttttgggatca

SEQ ID NO: 137121 - DNA, 25 bp, Artificial sequence
  SiRNA target sequence
caatatcttcctgttttgggatcac

SEQ ID NO: 137122 - DNA, 25 bp, Artificial sequence
  SiRNA target sequence
aatatcttcctgttttgggatcaca

SEQ ID NO: 137123 - DNA, 25 bp, Artificial sequence
  SiRNA target sequence
atatcttcctgttttgggatcacag

SEQ ID NO: 137124 - DNA, 25 bp, Artificial sequence
  SiRNA target sequence
tatcttcctgttttgggatcacagg

SEQ ID NO: 137125 - DNA, 25 bp, Artificial sequence
  SiRNA target sequence
atcttcctgttttgggatcacaggg

SEQ ID NO: 137126 - DNA, 25 bp, Artificial sequence
  SiRNA target sequence
tcttcctgttttgggatcacaggga

SEQ ID NO: 137127 - DNA, 25 bp, Artificial sequence
  SiRNA target sequence
cttcctgttttgggatcacagggat

SEQ ID NO: 137128 - DNA, 25 bp, Artificial sequence
  SiRNA target sequence
ttcctgttttgggatcacagggata

SEQ ID NO: 137129 - DNA, 25 bp, Artificial sequence
  SiRNA target sequence
tcctgttttgggatcacagggatat

SEQ ID NO: 137130 - DNA, 25 bp, Artificial sequence
  SiRNA target sequence
cctgttttgggatcacagggatata

SEQ ID NO: 137131 - DNA, 25 bp, Artificial sequence
  SiRNA target sequence
ctgttttgggatcacagggatatac

SEQ ID NO: 137132 - DNA, 25 bp, Artificial sequence
  SiRNA target sequence
tgttttgggatcacagggatatact

SEQ ID NO: 137133 - DNA, 25 bp, Artificial sequence
  SiRNA target sequence
gttttgggatcacagggatatacta

SEQ ID NO: 137134 - DNA, 25 bp, Artificial sequence
  SiRNA target sequence
ttttgggatcacagggatatactaa

SEQ ID NO: 137135 - DNA, 25 bp, Artificial sequence
  SiRNA target sequence
tttgggatcacagggatatactaaa

SEQ ID NO: 137136 - DNA, 25 bp, Artificial sequence
  SiRNA target sequence
ttgggatcacagggatatactaaag

SEQ ID NO: 137137 - DNA, 25 bp, Artificial sequence
  SiRNA target sequence
tgggatcacagggatatactaaagc

SEQ ID NO: 137138 - DNA, 25 bp, Artificial sequence
  SiRNA target sequence
gggatcacagggatatactaaagct

SEQ ID NO: 137139 - DNA, 25 bp, Artificial sequence
  SiRNA target sequence
ggatcacagggatatactaaagcta

SEQ ID NO: 137140 - DNA, 25 bp, Artificial sequence
  SiRNA target sequence
gatcacagggatatactaaagctac

SEQ ID NO: 137141 - DNA, 25 bp, Artificial sequence
  SiRNA target sequence
atcacagggatatactaaagctaca

SEQ ID NO: 137142 - DNA, 25 bp, Artificial sequence
  SiRNA target sequence
tcacagggatatactaaagctacag

SEQ ID NO: 137143 - DNA, 25 bp, Artificial sequence
  SiRNA target sequence
cacagggatatactaaagctacaga

SEQ ID NO: 137144 - DNA, 25 bp, Artificial sequence
  SiRNA target sequence
acagggatatactaaagctacagaa

SEQ ID NO: 137145 - DNA, 25 bp, Artificial sequence
  SiRNA target sequence
cagggatatactaaagctacagaat

SEQ ID NO: 137146 - DNA, 25 bp, Artificial sequence
  SiRNA target sequence
agggatatactaaagctacagaatt

SEQ ID NO: 137147 - DNA, 25 bp, Artificial sequence
  SiRNA target sequence
gggatatactaaagctacagaattt

SEQ ID NO: 137148 - DNA, 25 bp, Artificial sequence
  SiRNA target sequence
ggatatactaaagctacagaatttg

SEQ ID NO: 137149 - DNA, 25 bp, Artificial sequence
  SiRNA target sequence
gatatactaaagctacagaatttga

SEQ ID NO: 137150 - DNA, 25 bp, Artificial sequence
  SiRNA target sequence
atatactaaagctacagaatttgat

SEQ ID NO: 137151 - DNA, 25 bp, Artificial sequence
  SiRNA target sequence
tatactaaagctacagaatttgatt

SEQ ID NO: 137152 - DNA, 25 bp, Artificial sequence
  SiRNA target sequence
atactaaagctacagaatttgattt

SEQ ID NO: 137153 - DNA, 25 bp, Artificial sequence
  SiRNA target sequence
tactaaagctacagaatttgatttg

SEQ ID NO: 137154 - DNA, 25 bp, Artificial sequence
  SiRNA target sequence
actaaagctacagaatttgatttgg

SEQ ID NO: 137155 - DNA, 25 bp, Artificial sequence
  SiRNA target sequence
ctaaagctacagaatttgatttggc

SEQ ID NO: 137156 - DNA, 25 bp, Artificial sequence
  SiRNA target sequence
taaagctacagaatttgatttggca

SEQ ID NO: 137157 - DNA, 25 bp, Artificial sequence
  SiRNA target sequence
aaagctacagaatttgatttggcac

SEQ ID NO: 137158 - DNA, 25 bp, Artificial sequence
  SiRNA target sequence
aagctacagaatttgatttggcact

SEQ ID NO: 137159 - DNA, 25 bp, Artificial sequence
  SiRNA target sequence
agctacagaatttgatttggcactt

SEQ ID NO: 137160 - DNA, 25 bp, Artificial sequence
  SiRNA target sequence
gctacagaatttgatttggcactta

SEQ ID NO: 137161 - DNA, 25 bp, Artificial sequence
  SiRNA target sequence
ctacagaatttgatttggcacttac

SEQ ID NO: 137162 - DNA, 25 bp, Artificial sequence
  SiRNA target sequence
tacagaatttgatttggcacttact

SEQ ID NO: 137163 - DNA, 25 bp, Artificial sequence
  SiRNA target sequence
acagaatttgatttggcacttactt

SEQ ID NO: 137164 - DNA, 25 bp, Artificial sequence
  SiRNA target sequence
cagaatttgatttggcacttacttt

SEQ ID NO: 137165 - DNA, 25 bp, Artificial sequence
  SiRNA target sequence
agaatttgatttggcacttacttta

SEQ ID NO: 137166 - DNA, 25 bp, Artificial sequence
  SiRNA target sequence
gaatttgatttggcacttactttaa

SEQ ID NO: 137167 - DNA, 25 bp, Artificial sequence
  SiRNA target sequence
aatttgatttggcacttactttaaa

SEQ ID NO: 137168 - DNA, 25 bp, Artificial sequence
  SiRNA target sequence
atttgatttggcacttactttaaat

SEQ ID NO: 137169 - DNA, 25 bp, Artificial sequence
  SiRNA target sequence
tttgatttggcacttactttaaata

SEQ ID NO: 137170 - DNA, 25 bp, Artificial sequence
  SiRNA target sequence
ttgatttggcacttactttaaatat

SEQ ID NO: 137171 - DNA, 25 bp, Artificial sequence
  SiRNA target sequence
tgatttggcacttactttaaatatt

SEQ ID NO: 137172 - DNA, 25 bp, Artificial sequence
  SiRNA target sequence
gatttggcacttactttaaatattc

SEQ ID NO: 137173 - DNA, 25 bp, Artificial sequence
  SiRNA target sequence
atttggcacttactttaaatattcc

SEQ ID NO: 137174 - DNA, 25 bp, Artificial sequence
  SiRNA target sequence
tttggcacttactttaaatattcca

SEQ ID NO: 137175 - DNA, 25 bp, Artificial sequence
  SiRNA target sequence
ttggcacttactttaaatattccag

SEQ ID NO: 137176 - DNA, 25 bp, Artificial sequence
  SiRNA target sequence
tggcacttactttaaatattccaga

SEQ ID NO: 137177 - DNA, 25 bp, Artificial sequence
  SiRNA target sequence
ggcacttactttaaatattccagaa

SEQ ID NO: 137178 - DNA, 25 bp, Artificial sequence
  SiRNA target sequence
gcacttactttaaatattccagaag

SEQ ID NO: 137179 - DNA, 25 bp, Artificial sequence
  SiRNA target sequence
cacttactttaaatattccagaaga

SEQ ID NO: 137180 - DNA, 25 bp, Artificial sequence
  SiRNA target sequence
acttactttaaatattccagaagat

SEQ ID NO: 137181 - DNA, 25 bp, Artificial sequence
  SiRNA target sequence
cttactttaaatattccagaagata

SEQ ID NO: 137182 - DNA, 25 bp, Artificial sequence
  SiRNA target sequence
ttactttaaatattccagaagatat

SEQ ID NO: 137183 - DNA, 25 bp, Artificial sequence
  SiRNA target sequence
tactttaaatattccagaagatata

SEQ ID NO: 137184 - DNA, 25 bp, Artificial sequence
  SiRNA target sequence
actttaaatattccagaagatatag

SEQ ID NO: 137185 - DNA, 25 bp, Artificial sequence
  SiRNA target sequence
ctttaaatattccagaagatatagc

SEQ ID NO: 137186 - DNA, 25 bp, Artificial sequence
  SiRNA target sequence
tttaaatattccagaagatatagct

SEQ ID NO: 137187 - DNA, 25 bp, Artificial sequence
  SiRNA target sequence
ttaaatattccagaagatatagcta

SEQ ID NO: 137188 - DNA, 25 bp, Artificial sequence
  SiRNA target sequence
taaatattccagaagatatagctaa

SEQ ID NO: 137189 - DNA, 25 bp, Artificial sequence
  SiRNA target sequence
aaatattccagaagatatagctaag

SEQ ID NO: 137190 - DNA, 25 bp, Artificial sequence
  SiRNA target sequence
aatattccagaagatatagctaagc

SEQ ID NO: 137191 - DNA, 25 bp, Artificial sequence
  SiRNA target sequence
atattccagaagatatagctaagca

SEQ ID NO: 137192 - DNA, 25 bp, Artificial sequence
  SiRNA target sequence
tattccagaagatatagctaagcat

SEQ ID NO: 137193 - DNA, 25 bp, Artificial sequence
  SiRNA target sequence
attccagaagatatagctaagcatt

SEQ ID NO: 137194 - DNA, 25 bp, Artificial sequence
  SiRNA target sequence
ttccagaagatatagctaagcattt

SEQ ID NO: 137195 - DNA, 25 bp, Artificial sequence
  SiRNA target sequence
tccagaagatatagctaagcattta

SEQ ID NO: 137196 - DNA, 25 bp, Artificial sequence
  SiRNA target sequence
ccagaagatatagctaagcatttag

SEQ ID NO: 137197 - DNA, 25 bp, Artificial sequence
  SiRNA target sequence
cagaagatatagctaagcatttagc

SEQ ID NO: 137198 - DNA, 25 bp, Artificial sequence
  SiRNA target sequence
agaagatatagctaagcatttagct

SEQ ID NO: 137199 - DNA, 25 bp, Artificial sequence
  SiRNA target sequence
gaagatatagctaagcatttagcta

SEQ ID NO: 137200 - DNA, 25 bp, Artificial sequence
  SiRNA target sequence
aagatatagctaagcatttagctac

SEQ ID NO: 137201 - DNA, 25 bp, Artificial sequence
  SiRNA target sequence
agatatagctaagcatttagctaca

SEQ ID NO: 137202 - DNA, 25 bp, Artificial sequence
  SiRNA target sequence
gatatagctaagcatttagctacaa

SEQ ID NO: 137203 - DNA, 25 bp, Artificial sequence
  SiRNA target sequence
atatagctaagcatttagctacaac

SEQ ID NO: 137204 - DNA, 25 bp, Artificial sequence
  SiRNA target sequence
tatagctaagcatttagctacaact

SEQ ID NO: 137205 - DNA, 25 bp, Artificial sequence
  SiRNA target sequence
atagctaagcatttagctacaactt

SEQ ID NO: 137206 - DNA, 25 bp, Artificial sequence
  SiRNA target sequence
tagctaagcatttagctacaactta

SEQ ID NO: 137207 - DNA, 25 bp, Artificial sequence
  SiRNA target sequence
agctaagcatttagctacaacttat

SEQ ID NO: 137208 - DNA, 25 bp, Artificial sequence
  SiRNA target sequence
gctaagcatttagctacaacttatg

SEQ ID NO: 137209 - DNA, 25 bp, Artificial sequence
  SiRNA target sequence
ctaagcatttagctacaacttatgg

SEQ ID NO: 137210 - DNA, 25 bp, Artificial sequence
  SiRNA target sequence
taagcatttagctacaacttatggt

SEQ ID NO: 137211 - DNA, 25 bp, Artificial sequence
  SiRNA target sequence
aagcatttagctacaacttatggta

SEQ ID NO: 137212 - DNA, 25 bp, Artificial sequence
  SiRNA target sequence
agcatttagctacaacttatggtac

SEQ ID NO: 137213 - DNA, 25 bp, Artificial sequence
  SiRNA target sequence
gcatttagctacaacttatggtacc

SEQ ID NO: 137214 - DNA, 25 bp, Artificial sequence
  SiRNA target sequence
catttagctacaacttatggtacca

SEQ ID NO: 137215 - DNA, 25 bp, Artificial sequence
  SiRNA target sequence
atttagctacaacttatggtaccaa

SEQ ID NO: 137216 - DNA, 25 bp, Artificial sequence
  SiRNA target sequence
tttagctacaacttatggtaccaaa

SEQ ID NO: 137217 - DNA, 25 bp, Artificial sequence
  SiRNA target sequence
ttagctacaacttatggtaccaaag

SEQ ID NO: 137218 - DNA, 25 bp, Artificial sequence
  SiRNA target sequence
tagctacaacttatggtaccaaagc

SEQ ID NO: 137219 - DNA, 25 bp, Artificial sequence
  SiRNA target sequence
agctacaacttatggtaccaaagct

SEQ ID NO: 137220 - DNA, 25 bp, Artificial sequence
  SiRNA target sequence
gctacaacttatggtaccaaagctt

SEQ ID NO: 137221 - DNA, 25 bp, Artificial sequence
  SiRNA target sequence
ctacaacttatggtaccaaagctta

SEQ ID NO: 137222 - DNA, 25 bp, Artificial sequence
  SiRNA target sequence
tacaacttatggtaccaaagcttac

SEQ ID NO: 137223 - DNA, 25 bp, Artificial sequence
  SiRNA target sequence
acaacttatggtaccaaagcttaca

SEQ ID NO: 137224 - DNA, 25 bp, Artificial sequence
  SiRNA target sequence
caacttatggtaccaaagcttacaa

SEQ ID NO: 137225 - DNA, 25 bp, Artificial sequence
  SiRNA target sequence
aacttatggtaccaaagcttacaat

SEQ ID NO: 137226 - DNA, 25 bp, Artificial sequence
  SiRNA target sequence
acttatggtaccaaagcttacaatt

SEQ ID NO: 137227 - DNA, 25 bp, Artificial sequence
  SiRNA target sequence
cttatggtaccaaagcttacaattt

SEQ ID NO: 137228 - DNA, 25 bp, Artificial sequence
  SiRNA target sequence
ttatggtaccaaagcttacaatttc

SEQ ID NO: 137229 - DNA, 25 bp, Artificial sequence
  SiRNA target sequence
tatggtaccaaagcttacaatttct

SEQ ID NO: 137230 - DNA, 25 bp, Artificial sequence
  SiRNA target sequence
atggtaccaaagcttacaatttctc

SEQ ID NO: 137231 - DNA, 25 bp, Artificial sequence
  SiRNA target sequence
tggtaccaaagcttacaatttctct

SEQ ID NO: 137232 - DNA, 25 bp, Artificial sequence
  SiRNA target sequence
ggtaccaaagcttacaatttctctg

SEQ ID NO: 137233 - DNA, 25 bp, Artificial sequence
  SiRNA target sequence
gtaccaaagcttacaatttctctga

SEQ ID NO: 137234 - DNA, 25 bp, Artificial sequence
  SiRNA target sequence
taccaaagcttacaatttctctgaa

SEQ ID NO: 137235 - DNA, 25 bp, Artificial sequence
  SiRNA target sequence
accaaagcttacaatttctctgaat

SEQ ID NO: 137236 - DNA, 25 bp, Artificial sequence
  SiRNA target sequence
ccaaagcttacaatttctctgaata

SEQ ID NO: 137237 - DNA, 25 bp, Artificial sequence
  SiRNA target sequence
caaagcttacaatttctctgaatac

SEQ ID NO: 137238 - DNA, 25 bp, Artificial sequence
  SiRNA target sequence
aaagcttacaatttctctgaatact

SEQ ID NO: 137239 - DNA, 25 bp, Artificial sequence
  SiRNA target sequence
aagcttacaatttctctgaatactt

SEQ ID NO: 137240 - DNA, 25 bp, Artificial sequence
  SiRNA target sequence
agcttacaatttctctgaatacttt

SEQ ID NO: 137241 - DNA, 25 bp, Artificial sequence
  SiRNA target sequence
gcttacaatttctctgaatacttta

SEQ ID NO: 137242 - DNA, 25 bp, Artificial sequence
  SiRNA target sequence
cttacaatttctctgaatactttaa

SEQ ID NO: 137243 - DNA, 25 bp, Artificial sequence
  SiRNA target sequence
ttacaatttctctgaatactttaat

SEQ ID NO: 137244 - DNA, 25 bp, Artificial sequence
  SiRNA target sequence
tacaatttctctgaatactttaatg

SEQ ID NO: 137245 - DNA, 25 bp, Artificial sequence
  SiRNA target sequence
acaatttctctgaatactttaatgg

SEQ ID NO: 137246 - DNA, 25 bp, Artificial sequence
  SiRNA target sequence
caatttctctgaatactttaatggg

SEQ ID NO: 137247 - DNA, 25 bp, Artificial sequence
  SiRNA target sequence
aatttctctgaatactttaatgggt

SEQ ID NO: 137248 - DNA, 25 bp, Artificial sequence
  SiRNA target sequence
atttctctgaatactttaatgggtc

SEQ ID NO: 137249 - DNA, 25 bp, Artificial sequence
  SiRNA target sequence
tttctctgaatactttaatgggtca

SEQ ID NO: 137250 - DNA, 25 bp, Artificial sequence
  SiRNA target sequence
ttctctgaatactttaatgggtcat

SEQ ID NO: 137251 - DNA, 25 bp, Artificial sequence
  SiRNA target sequence
tctctgaatactttaatgggtcata

SEQ ID NO: 137252 - DNA, 25 bp, Artificial sequence
  SiRNA target sequence
ctctgaatactttaatgggtcatac

SEQ ID NO: 137253 - DNA, 25 bp, Artificial sequence
  SiRNA target sequence
tctgaatactttaatgggtcataca

SEQ ID NO: 137254 - DNA, 25 bp, Artificial sequence
  SiRNA target sequence
ctgaatactttaatgggtcatacac

SEQ ID NO: 137255 - DNA, 25 bp, Artificial sequence
  SiRNA target sequence
tgaatactttaatgggtcatacacc

SEQ ID NO: 137256 - DNA, 25 bp, Artificial sequence
  SiRNA target sequence
gaatactttaatgggtcatacacca

SEQ ID NO: 137257 - DNA, 25 bp, Artificial sequence
  SiRNA target sequence
aatactttaatgggtcatacaccag

SEQ ID NO: 137258 - DNA, 25 bp, Artificial sequence
  SiRNA target sequence
atactttaatgggtcatacaccaga

SEQ ID NO: 137259 - DNA, 25 bp, Artificial sequence
  SiRNA target sequence
tactttaatgggtcatacaccagac

SEQ ID NO: 137260 - DNA, 25 bp, Artificial sequence
  SiRNA target sequence
actttaatgggtcatacaccagact

SEQ ID NO: 137261 - DNA, 25 bp, Artificial sequence
  SiRNA target sequence
ctttaatgggtcatacaccagactt

SEQ ID NO: 137262 - DNA, 25 bp, Artificial sequence
  SiRNA target sequence
tttaatgggtcatacaccagactta

SEQ ID NO: 137263 - DNA, 25 bp, Artificial sequence
  SiRNA target sequence
ttaatgggtcatacaccagacttac

SEQ ID NO: 137264 - DNA, 25 bp, Artificial sequence
  SiRNA target sequence
taatgggtcatacaccagacttaca

SEQ ID NO: 137265 - DNA, 25 bp, Artificial sequence
  SiRNA target sequence
aatgggtcatacaccagacttacag

SEQ ID NO: 137266 - DNA, 25 bp, Artificial sequence
  SiRNA target sequence
atgggtcatacaccagacttacaga

SEQ ID NO: 137267 - DNA, 25 bp, Artificial sequence
  SiRNA target sequence
tgggtcatacaccagacttacagat

SEQ ID NO: 137268 - DNA, 25 bp, Artificial sequence
  SiRNA target sequence
gggtcatacaccagacttacagatg

SEQ ID NO: 137269 - DNA, 25 bp, Artificial sequence
  SiRNA target sequence
ggtcatacaccagacttacagatgg

SEQ ID NO: 137270 - DNA, 25 bp, Artificial sequence
  SiRNA target sequence
gtcatacaccagacttacagatggt

SEQ ID NO: 137271 - DNA, 25 bp, Artificial sequence
  SiRNA target sequence
tcatacaccagacttacagatggtt

SEQ ID NO: 137272 - DNA, 25 bp, Artificial sequence
  SiRNA target sequence
catacaccagacttacagatggtta

SEQ ID NO: 137273 - DNA, 25 bp, Artificial sequence
  SiRNA target sequence
atacaccagacttacagatggttat

SEQ ID NO: 137274 - DNA, 25 bp, Artificial sequence
  SiRNA target sequence
tacaccagacttacagatggttatc

SEQ ID NO: 137275 - DNA, 25 bp, Artificial sequence
  SiRNA target sequence
acaccagacttacagatggttatcc

SEQ ID NO: 137276 - DNA, 25 bp, Artificial sequence
  SiRNA target sequence
caccagacttacagatggttatcct

SEQ ID NO: 137277 - DNA, 25 bp, Artificial sequence
  SiRNA target sequence
accagacttacagatggttatcctt

SEQ ID NO: 137278 - DNA, 25 bp, Artificial sequence
  SiRNA target sequence
ccagacttacagatggttatcctta

SEQ ID NO: 137279 - DNA, 25 bp, Artificial sequence
  SiRNA target sequence
cagacttacagatggttatccttat

SEQ ID NO: 137280 - DNA, 25 bp, Artificial sequence
  SiRNA target sequence
agacttacagatggttatccttata

SEQ ID NO: 137281 - DNA, 25 bp, Artificial sequence
  SiRNA target sequence
gacttacagatggttatccttatac

SEQ ID NO: 137282 - DNA, 25 bp, Artificial sequence
  SiRNA target sequence
acttacagatggttatccttataca

SEQ ID NO: 137283 - DNA, 25 bp, Artificial sequence
  SiRNA target sequence
cttacagatggttatccttatacaa

SEQ ID NO: 137284 - DNA, 25 bp, Artificial sequence
  SiRNA target sequence
ttacagatggttatccttatacaaa

SEQ ID NO: 137285 - DNA, 25 bp, Artificial sequence
  SiRNA target sequence
tacagatggttatccttatacaaaa

SEQ ID NO: 137286 - DNA, 25 bp, Artificial sequence
  SiRNA target sequence
acagatggttatccttatacaaaag

SEQ ID NO: 137287 - DNA, 25 bp, Artificial sequence
  SiRNA target sequence
cagatggttatccttatacaaaaga

SEQ ID NO: 137288 - DNA, 25 bp, Artificial sequence
  SiRNA target sequence
agatggttatccttatacaaaagaa

SEQ ID NO: 137289 - DNA, 25 bp, Artificial sequence
  SiRNA target sequence
gatggttatccttatacaaaagaag

SEQ ID NO: 137290 - DNA, 25 bp, Artificial sequence
  SiRNA target sequence
atggttatccttatacaaaagaaga

SEQ ID NO: 137291 - DNA, 25 bp, Artificial sequence
  SiRNA target sequence
tggttatccttatacaaaagaagaa

SEQ ID NO: 137292 - DNA, 25 bp, Artificial sequence
  SiRNA target sequence
ggttatccttatacaaaagaagaaa

SEQ ID NO: 137293 - DNA, 25 bp, Artificial sequence
  SiRNA target sequence
gttatccttatacaaaagaagaaat

SEQ ID NO: 137294 - DNA, 25 bp, Artificial sequence
  SiRNA target sequence
ttatccttatacaaaagaagaaata

SEQ ID NO: 137295 - DNA, 25 bp, Artificial sequence
  SiRNA target sequence
tatccttatacaaaagaagaaatag

SEQ ID NO: 137296 - DNA, 25 bp, Artificial sequence
  SiRNA target sequence
atccttatacaaaagaagaaatagt

SEQ ID NO: 137297 - DNA, 25 bp, Artificial sequence
  SiRNA target sequence
tccttatacaaaagaagaaatagta

SEQ ID NO: 137298 - DNA, 25 bp, Artificial sequence
  SiRNA target sequence
ccttatacaaaagaagaaatagtat

SEQ ID NO: 137299 - DNA, 25 bp, Artificial sequence
  SiRNA target sequence
cttatacaaaagaagaaatagtata

SEQ ID NO: 137300 - DNA, 25 bp, Artificial sequence
  SiRNA target sequence
ttatacaaaagaagaaatagtatat

SEQ ID NO: 137301 - DNA, 25 bp, Artificial sequence
  SiRNA target sequence
tatacaaaagaagaaatagtatatt

SEQ ID NO: 137302 - DNA, 25 bp, Artificial sequence
  SiRNA target sequence
atacaaaagaagaaatagtatattg

SEQ ID NO: 137303 - DNA, 25 bp, Artificial sequence
  SiRNA target sequence
tacaaaagaagaaatagtatattgt

SEQ ID NO: 137304 - DNA, 25 bp, Artificial sequence
  SiRNA target sequence
acaaaagaagaaatagtatattgta

SEQ ID NO: 137305 - DNA, 25 bp, Artificial sequence
  SiRNA target sequence
caaaagaagaaatagtatattgtat

SEQ ID NO: 137306 - DNA, 25 bp, Artificial sequence
  SiRNA target sequence
aaaagaagaaatagtatattgtatc

SEQ ID NO: 137307 - DNA, 25 bp, Artificial sequence
  SiRNA target sequence
aaagaagaaatagtatattgtatcg

SEQ ID NO: 137308 - DNA, 25 bp, Artificial sequence
  SiRNA target sequence
aagaagaaatagtatattgtatcga

SEQ ID NO: 137309 - DNA, 25 bp, Artificial sequence
  SiRNA target sequence
agaagaaatagtatattgtatcgaa

SEQ ID NO: 137310 - DNA, 25 bp, Artificial sequence
  SiRNA target sequence
gaagaaatagtatattgtatcgaac

SEQ ID NO: 137311 - DNA, 25 bp, Artificial sequence
  SiRNA target sequence
aagaaatagtatattgtatcgaaca

SEQ ID NO: 137312 - DNA, 25 bp, Artificial sequence
  SiRNA target sequence
agaaatagtatattgtatcgaacat

SEQ ID NO: 137313 - DNA, 25 bp, Artificial sequence
  SiRNA target sequence
gaaatagtatattgtatcgaacatg

SEQ ID NO: 137314 - DNA, 25 bp, Artificial sequence
  SiRNA target sequence
aaatagtatattgtatcgaacatga

SEQ ID NO: 137315 - DNA, 25 bp, Artificial sequence
  SiRNA target sequence
aatagtatattgtatcgaacatgaa

SEQ ID NO: 137316 - DNA, 25 bp, Artificial sequence
  SiRNA target sequence
atagtatattgtatcgaacatgaat

SEQ ID NO: 137317 - DNA, 25 bp, Artificial sequence
  SiRNA target sequence
tagtatattgtatcgaacatgaatt

SEQ ID NO: 137318 - DNA, 25 bp, Artificial sequence
  SiRNA target sequence
agtatattgtatcgaacatgaattg

SEQ ID NO: 137319 - DNA, 25 bp, Artificial sequence
  SiRNA target sequence
gtatattgtatcgaacatgaattgg

SEQ ID NO: 137320 - DNA, 25 bp, Artificial sequence
  SiRNA target sequence
tatattgtatcgaacatgaattggc

SEQ ID NO: 137321 - DNA, 25 bp, Artificial sequence
  SiRNA target sequence
atattgtatcgaacatgaattggct

SEQ ID NO: 137322 - DNA, 25 bp, Artificial sequence
  SiRNA target sequence
tattgtatcgaacatgaattggctt

SEQ ID NO: 137323 - DNA, 25 bp, Artificial sequence
  SiRNA target sequence
attgtatcgaacatgaattggctta

SEQ ID NO: 137324 - DNA, 25 bp, Artificial sequence
  SiRNA target sequence
ttgtatcgaacatgaattggcttat

SEQ ID NO: 137325 - DNA, 25 bp, Artificial sequence
  SiRNA target sequence
tgtatcgaacatgaattggcttatc

SEQ ID NO: 137326 - DNA, 25 bp, Artificial sequence
  SiRNA target sequence
gtatcgaacatgaattggcttatcg

SEQ ID NO: 137327 - DNA, 25 bp, Artificial sequence
  SiRNA target sequence
tatcgaacatgaattggcttatcgc

SEQ ID NO: 137328 - DNA, 25 bp, Artificial sequence
  SiRNA target sequence
atcgaacatgaattggcttatcgca

SEQ ID NO: 137329 - DNA, 25 bp, Artificial sequence
  SiRNA target sequence
tcgaacatgaattggcttatcgcat

SEQ ID NO: 137330 - DNA, 25 bp, Artificial sequence
  SiRNA target sequence
cgaacatgaattggcttatcgcatc

SEQ ID NO: 137331 - DNA, 25 bp, Artificial sequence
  SiRNA target sequence
gaacatgaattggcttatcgcatca

SEQ ID NO: 137332 - DNA, 25 bp, Artificial sequence
  SiRNA target sequence
aacatgaattggcttatcgcatcag

SEQ ID NO: 137333 - DNA, 25 bp, Artificial sequence
  SiRNA target sequence
acatgaattggcttatcgcatcagt

SEQ ID NO: 137334 - DNA, 25 bp, Artificial sequence
  SiRNA target sequence
catgaattggcttatcgcatcagtg

SEQ ID NO: 137335 - DNA, 25 bp, Artificial sequence
  SiRNA target sequence
atgaattggcttatcgcatcagtga

SEQ ID NO: 137336 - DNA, 25 bp, Artificial sequence
  SiRNA target sequence
tgaattggcttatcgcatcagtgat

SEQ ID NO: 137337 - DNA, 25 bp, Artificial sequence
  SiRNA target sequence
gaattggcttatcgcatcagtgata

SEQ ID NO: 137338 - DNA, 25 bp, Artificial sequence
  SiRNA target sequence
aattggcttatcgcatcagtgatat

SEQ ID NO: 137339 - DNA, 25 bp, Artificial sequence
  SiRNA target sequence
attggcttatcgcatcagtgatata

SEQ ID NO: 137340 - DNA, 25 bp, Artificial sequence
  SiRNA target sequence
ttggcttatcgcatcagtgatatat

SEQ ID NO: 137341 - DNA, 25 bp, Artificial sequence
  SiRNA target sequence
tggcttatcgcatcagtgatatatt

SEQ ID NO: 137342 - DNA, 25 bp, Artificial sequence
  SiRNA target sequence
ggcttatcgcatcagtgatatatta

SEQ ID NO: 137343 - DNA, 25 bp, Artificial sequence
  SiRNA target sequence
gcttatcgcatcagtgatatattat

SEQ ID NO: 137344 - DNA, 25 bp, Artificial sequence
  SiRNA target sequence
cttatcgcatcagtgatatattatt

SEQ ID NO: 137345 - DNA, 25 bp, Artificial sequence
  SiRNA target sequence
ttatcgcatcagtgatatattattt

SEQ ID NO: 137346 - DNA, 25 bp, Artificial sequence
  SiRNA target sequence
tatcgcatcagtgatatattattta

SEQ ID NO: 137347 - DNA, 25 bp, Artificial sequence
  SiRNA target sequence
atcgcatcagtgatatattatttaa

SEQ ID NO: 137348 - DNA, 25 bp, Artificial sequence
  SiRNA target sequence
tcgcatcagtgatatattatttaat

SEQ ID NO: 137349 - DNA, 25 bp, Artificial sequence
  SiRNA target sequence
cgcatcagtgatatattatttaata

SEQ ID NO: 137350 - DNA, 25 bp, Artificial sequence
  SiRNA target sequence
gcatcagtgatatattatttaatag

SEQ ID NO: 137351 - DNA, 25 bp, Artificial sequence
  SiRNA target sequence
catcagtgatatattatttaatagg

SEQ ID NO: 137352 - DNA, 25 bp, Artificial sequence
  SiRNA target sequence
atcagtgatatattatttaatagga

SEQ ID NO: 137353 - DNA, 25 bp, Artificial sequence
  SiRNA target sequence
tcagtgatatattatttaataggat

SEQ ID NO: 137354 - DNA, 25 bp, Artificial sequence
  SiRNA target sequence
cagtgatatattatttaataggatg

SEQ ID NO: 137355 - DNA, 25 bp, Artificial sequence
  SiRNA target sequence
agtgatatattatttaataggatga

SEQ ID NO: 137356 - DNA, 25 bp, Artificial sequence
  SiRNA target sequence
gtgatatattatttaataggatgat

SEQ ID NO: 137357 - DNA, 25 bp, Artificial sequence
  SiRNA target sequence
tgatatattatttaataggatgatg

SEQ ID NO: 137358 - DNA, 25 bp, Artificial sequence
  SiRNA target sequence
gatatattatttaataggatgatga

SEQ ID NO: 137359 - DNA, 25 bp, Artificial sequence
  SiRNA target sequence
atatattatttaataggatgatgat

SEQ ID NO: 137360 - DNA, 25 bp, Artificial sequence
  SiRNA target sequence
tatattatttaataggatgatgata

SEQ ID NO: 137361 - DNA, 25 bp, Artificial sequence
  SiRNA target sequence
atattatttaataggatgatgatag

SEQ ID NO: 137362 - DNA, 25 bp, Artificial sequence
  SiRNA target sequence
tattatttaataggatgatgatagg

SEQ ID NO: 137363 - DNA, 25 bp, Artificial sequence
  SiRNA target sequence
attatttaataggatgatgatagga

SEQ ID NO: 137364 - DNA, 25 bp, Artificial sequence
  SiRNA target sequence
ttatttaataggatgatgataggat

SEQ ID NO: 137365 - DNA, 25 bp, Artificial sequence
  SiRNA target sequence
tatttaataggatgatgataggata

SEQ ID NO: 137366 - DNA, 25 bp, Artificial sequence
  SiRNA target sequence
atttaataggatgatgataggatac

SEQ ID NO: 137367 - DNA, 25 bp, Artificial sequence
  SiRNA target sequence
tttaataggatgatgataggataca

SEQ ID NO: 137368 - DNA, 25 bp, Artificial sequence
  SiRNA target sequence
ttaataggatgatgataggatacat

SEQ ID NO: 137369 - DNA, 25 bp, Artificial sequence
  SiRNA target sequence
taataggatgatgataggatacatt

SEQ ID NO: 137370 - DNA, 25 bp, Artificial sequence
  SiRNA target sequence
aataggatgatgataggatacattg

SEQ ID NO: 137371 - DNA, 25 bp, Artificial sequence
  SiRNA target sequence
ataggatgatgataggatacattga

SEQ ID NO: 137372 - DNA, 25 bp, Artificial sequence
  SiRNA target sequence
taggatgatgataggatacattgac

SEQ ID NO: 137373 - DNA, 25 bp, Artificial sequence
  SiRNA target sequence
aggatgatgataggatacattgacg

SEQ ID NO: 137374 - DNA, 25 bp, Artificial sequence
  SiRNA target sequence
ggatgatgataggatacattgacgt

SEQ ID NO: 137375 - DNA, 25 bp, Artificial sequence
  SiRNA target sequence
gatgatgataggatacattgacgtc

SEQ ID NO: 137376 - DNA, 25 bp, Artificial sequence
  SiRNA target sequence
atgatgataggatacattgacgtca

SEQ ID NO: 137377 - DNA, 25 bp, Artificial sequence
  SiRNA target sequence
tgatgataggatacattgacgtcag

SEQ ID NO: 137378 - DNA, 25 bp, Artificial sequence
  SiRNA target sequence
gatgataggatacattgacgtcaga

SEQ ID NO: 137379 - DNA, 25 bp, Artificial sequence
  SiRNA target sequence
atgataggatacattgacgtcagaa

SEQ ID NO: 137380 - DNA, 25 bp, Artificial sequence
  SiRNA target sequence
tgataggatacattgacgtcagaag

SEQ ID NO: 137381 - DNA, 25 bp, Artificial sequence
  SiRNA target sequence
gataggatacattgacgtcagaaga

SEQ ID NO: 137382 - DNA, 25 bp, Artificial sequence
  SiRNA target sequence
ataggatacattgacgtcagaagag

SEQ ID NO: 137383 - DNA, 25 bp, Artificial sequence
  SiRNA target sequence
taggatacattgacgtcagaagagc

SEQ ID NO: 137384 - DNA, 25 bp, Artificial sequence
  SiRNA target sequence
aggatacattgacgtcagaagagca

SEQ ID NO: 137385 - DNA, 25 bp, Artificial sequence
  SiRNA target sequence
ggatacattgacgtcagaagagcat

SEQ ID NO: 137386 - DNA, 25 bp, Artificial sequence
  SiRNA target sequence
gatacattgacgtcagaagagcatt

SEQ ID NO: 137387 - DNA, 25 bp, Artificial sequence
  SiRNA target sequence
atacattgacgtcagaagagcattt

SEQ ID NO: 137388 - DNA, 25 bp, Artificial sequence
  SiRNA target sequence
tacattgacgtcagaagagcatttg

SEQ ID NO: 137389 - DNA, 25 bp, Artificial sequence
  SiRNA target sequence
acattgacgtcagaagagcatttga

SEQ ID NO: 137390 - DNA, 25 bp, Artificial sequence
  SiRNA target sequence
cattgacgtcagaagagcatttgat

SEQ ID NO: 137391 - DNA, 25 bp, Artificial sequence
  SiRNA target sequence
attgacgtcagaagagcatttgatt

SEQ ID NO: 137392 - DNA, 25 bp, Artificial sequence
  SiRNA target sequence
ttgacgtcagaagagcatttgattt

SEQ ID NO: 137393 - DNA, 25 bp, Artificial sequence
  SiRNA target sequence
tgacgtcagaagagcatttgattta

SEQ ID NO: 137394 - DNA, 25 bp, Artificial sequence
  SiRNA target sequence
gacgtcagaagagcatttgatttaa

SEQ ID NO: 137395 - DNA, 25 bp, Artificial sequence
  SiRNA target sequence
acgtcagaagagcatttgatttaat

SEQ ID NO: 137396 - DNA, 25 bp, Artificial sequence
  SiRNA target sequence
cgtcagaagagcatttgatttaatt

SEQ ID NO: 137397 - DNA, 25 bp, Artificial sequence
  SiRNA target sequence
gtcagaagagcatttgatttaattg

SEQ ID NO: 137398 - DNA, 25 bp, Artificial sequence
  SiRNA target sequence
tcagaagagcatttgatttaattgg

SEQ ID NO: 137399 - DNA, 25 bp, Artificial sequence
  SiRNA target sequence
cagaagagcatttgatttaattggt

SEQ ID NO: 137400 - DNA, 25 bp, Artificial sequence
  SiRNA target sequence
agaagagcatttgatttaattggta

SEQ ID NO: 137401 - DNA, 25 bp, Artificial sequence
  SiRNA target sequence
gaagagcatttgatttaattggtat

SEQ ID NO: 137402 - DNA, 25 bp, Artificial sequence
  SiRNA target sequence
aagagcatttgatttaattggtata

SEQ ID NO: 137403 - DNA, 25 bp, Artificial sequence
  SiRNA target sequence
agagcatttgatttaattggtatag

SEQ ID NO: 137404 - DNA, 25 bp, Artificial sequence
  SiRNA target sequence
gagcatttgatttaattggtatagt

SEQ ID NO: 137405 - DNA, 25 bp, Artificial sequence
  SiRNA target sequence
agcatttgatttaattggtatagta

SEQ ID NO: 137406 - DNA, 25 bp, Artificial sequence
  SiRNA target sequence
gcatttgatttaattggtatagtag

SEQ ID NO: 137407 - DNA, 25 bp, Artificial sequence
  SiRNA target sequence
catttgatttaattggtatagtagc

SEQ ID NO: 137408 - DNA, 25 bp, Artificial sequence
  SiRNA target sequence
atttgatttaattggtatagtagct

SEQ ID NO: 137409 - DNA, 25 bp, Artificial sequence
  SiRNA target sequence
tttgatttaattggtatagtagctg

SEQ ID NO: 137410 - DNA, 25 bp, Artificial sequence
  SiRNA target sequence
ttgatttaattggtatagtagctga

SEQ ID NO: 137411 - DNA, 25 bp, Artificial sequence
  SiRNA target sequence
tgatttaattggtatagtagctgaa

SEQ ID NO: 137412 - DNA, 25 bp, Artificial sequence
  SiRNA target sequence
gatttaattggtatagtagctgaag

SEQ ID NO: 137413 - DNA, 25 bp, Artificial sequence
  SiRNA target sequence
atttaattggtatagtagctgaagt

SEQ ID NO: 137414 - DNA, 25 bp, Artificial sequence
  SiRNA target sequence
tttaattggtatagtagctgaagta

SEQ ID NO: 137415 - DNA, 25 bp, Artificial sequence
  SiRNA target sequence
ttaattggtatagtagctgaagtaa

SEQ ID NO: 137416 - DNA, 25 bp, Artificial sequence
  SiRNA target sequence
taattggtatagtagctgaagtaat

SEQ ID NO: 137417 - DNA, 25 bp, Artificial sequence
  SiRNA target sequence
aattggtatagtagctgaagtaatg

SEQ ID NO: 137418 - DNA, 25 bp, Artificial sequence
  SiRNA target sequence
attggtatagtagctgaagtaatga

SEQ ID NO: 137419 - DNA, 25 bp, Artificial sequence
  SiRNA target sequence
ttggtatagtagctgaagtaatgaa

SEQ ID NO: 137420 - DNA, 25 bp, Artificial sequence
  SiRNA target sequence
tggtatagtagctgaagtaatgaaa

SEQ ID NO: 137421 - DNA, 25 bp, Artificial sequence
  SiRNA target sequence
ggtatagtagctgaagtaatgaaag

SEQ ID NO: 137422 - DNA, 25 bp, Artificial sequence
  SiRNA target sequence
gtatagtagctgaagtaatgaaaga

SEQ ID NO: 137423 - DNA, 25 bp, Artificial sequence
  SiRNA target sequence
tatagtagctgaagtaatgaaagac

SEQ ID NO: 137424 - DNA, 25 bp, Artificial sequence
  SiRNA target sequence
atagtagctgaagtaatgaaagact

SEQ ID NO: 137425 - DNA, 25 bp, Artificial sequence
  SiRNA target sequence
tagtagctgaagtaatgaaagacta

SEQ ID NO: 137426 - DNA, 25 bp, Artificial sequence
  SiRNA target sequence
agtagctgaagtaatgaaagactat

SEQ ID NO: 137427 - DNA, 25 bp, Artificial sequence
  SiRNA target sequence
gtagctgaagtaatgaaagactatt

SEQ ID NO: 137428 - DNA, 25 bp, Artificial sequence
  SiRNA target sequence
tagctgaagtaatgaaagactatta

SEQ ID NO: 137429 - DNA, 25 bp, Artificial sequence
  SiRNA target sequence
agctgaagtaatgaaagactattac

SEQ ID NO: 137430 - DNA, 25 bp, Artificial sequence
  SiRNA target sequence
gctgaagtaatgaaagactattacg

SEQ ID NO: 137431 - DNA, 25 bp, Artificial sequence
  SiRNA target sequence
ctgaagtaatgaaagactattacgg

SEQ ID NO: 137432 - DNA, 25 bp, Artificial sequence
  SiRNA target sequence
tgaagtaatgaaagactattacgga

SEQ ID NO: 137433 - DNA, 25 bp, Artificial sequence
  SiRNA target sequence
gaagtaatgaaagactattacggat

SEQ ID NO: 137434 - DNA, 25 bp, Artificial sequence
  SiRNA target sequence
aagtaatgaaagactattacggatg

SEQ ID NO: 137435 - DNA, 25 bp, Artificial sequence
  SiRNA target sequence
agtaatgaaagactattacggatgg

SEQ ID NO: 137436 - DNA, 25 bp, Artificial sequence
  SiRNA target sequence
gtaatgaaagactattacggatggg

SEQ ID NO: 137437 - DNA, 25 bp, Artificial sequence
  SiRNA target sequence
taatgaaagactattacggatggga

SEQ ID NO: 137438 - DNA, 25 bp, Artificial sequence
  SiRNA target sequence
aatgaaagactattacggatgggat

SEQ ID NO: 137439 - DNA, 25 bp, Artificial sequence
  SiRNA target sequence
atgaaagactattacggatgggatc

SEQ ID NO: 137440 - DNA, 25 bp, Artificial sequence
  SiRNA target sequence
tgaaagactattacggatgggatca

SEQ ID NO: 137441 - DNA, 25 bp, Artificial sequence
  SiRNA target sequence
gaaagactattacggatgggatcag

SEQ ID NO: 137442 - DNA, 25 bp, Artificial sequence
  SiRNA target sequence
aaagactattacggatgggatcagc

SEQ ID NO: 137443 - DNA, 25 bp, Artificial sequence
  SiRNA target sequence
aagactattacggatgggatcagca

SEQ ID NO: 137444 - DNA, 25 bp, Artificial sequence
  SiRNA target sequence
agactattacggatgggatcagcaa

SEQ ID NO: 137445 - DNA, 25 bp, Artificial sequence
  SiRNA target sequence
gactattacggatgggatcagcaaa

SEQ ID NO: 137446 - DNA, 25 bp, Artificial sequence
  SiRNA target sequence
actattacggatgggatcagcaaag

SEQ ID NO: 137447 - DNA, 25 bp, Artificial sequence
  SiRNA target sequence
ctattacggatgggatcagcaaaga

SEQ ID NO: 137448 - DNA, 25 bp, Artificial sequence
  SiRNA target sequence
tattacggatgggatcagcaaagat

SEQ ID NO: 137449 - DNA, 25 bp, Artificial sequence
  SiRNA target sequence
attacggatgggatcagcaaagata

SEQ ID NO: 137450 - DNA, 25 bp, Artificial sequence
  SiRNA target sequence
ttacggatgggatcagcaaagatat

SEQ ID NO: 137451 - DNA, 25 bp, Artificial sequence
  SiRNA target sequence
tacggatgggatcagcaaagatata

SEQ ID NO: 137452 - DNA, 25 bp, Artificial sequence
  SiRNA target sequence
acggatgggatcagcaaagatataa

SEQ ID NO: 137453 - DNA, 25 bp, Artificial sequence
  SiRNA target sequence
cggatgggatcagcaaagatataat

SEQ ID NO: 137454 - DNA, 25 bp, Artificial sequence
  SiRNA target sequence
ggatgggatcagcaaagatataatg

SEQ ID NO: 137455 - DNA, 25 bp, Artificial sequence
  SiRNA target sequence
gatgggatcagcaaagatataatga

SEQ ID NO: 137456 - DNA, 25 bp, Artificial sequence
  SiRNA target sequence
atgggatcagcaaagatataatgaa

SEQ ID NO: 137457 - DNA, 25 bp, Artificial sequence
  SiRNA target sequence
tgggatcagcaaagatataatgaag

SEQ ID NO: 137458 - DNA, 25 bp, Artificial sequence
  SiRNA target sequence
gggatcagcaaagatataatgaaga

SEQ ID NO: 137459 - DNA, 25 bp, Artificial sequence
  SiRNA target sequence
ggatcagcaaagatataatgaagaa

SEQ ID NO: 137460 - DNA, 25 bp, Artificial sequence
  SiRNA target sequence
gatcagcaaagatataatgaagaaa

SEQ ID NO: 137461 - DNA, 25 bp, Artificial sequence
  SiRNA target sequence
atcagcaaagatataatgaagaaac

SEQ ID NO: 137462 - DNA, 25 bp, Artificial sequence
  SiRNA target sequence
tcagcaaagatataatgaagaaaca

SEQ ID NO: 137463 - DNA, 25 bp, Artificial sequence
  SiRNA target sequence
cagcaaagatataatgaagaaacaa

SEQ ID NO: 137464 - DNA, 25 bp, Artificial sequence
  SiRNA target sequence
agcaaagatataatgaagaaacaaa

SEQ ID NO: 137465 - DNA, 25 bp, Artificial sequence
  SiRNA target sequence
gcaaagatataatgaagaaacaaaa

SEQ ID NO: 137466 - DNA, 25 bp, Artificial sequence
  SiRNA target sequence
caaagatataatgaagaaacaaaat

SEQ ID NO: 137467 - DNA, 25 bp, Artificial sequence
  SiRNA target sequence
aaagatataatgaagaaacaaaatt

SEQ ID NO: 137468 - DNA, 25 bp, Artificial sequence
  SiRNA target sequence
aagatataatgaagaaacaaaatta

SEQ ID NO: 137469 - DNA, 25 bp, Artificial sequence
  SiRNA target sequence
agatataatgaagaaacaaaattat

SEQ ID NO: 137470 - DNA, 25 bp, Artificial sequence
  SiRNA target sequence
gatataatgaagaaacaaaattatg

SEQ ID NO: 137471 - DNA, 25 bp, Artificial sequence
  SiRNA target sequence
atataatgaagaaacaaaattatgc

SEQ ID NO: 137472 - DNA, 25 bp, Artificial sequence
  SiRNA target sequence
tataatgaagaaacaaaattatgca

SEQ ID NO: 137473 - DNA, 25 bp, Artificial sequence
  SiRNA target sequence
ataatgaagaaacaaaattatgcat

SEQ ID NO: 137474 - DNA, 25 bp, Artificial sequence
  SiRNA target sequence
taatgaagaaacaaaattatgcatg

SEQ ID NO: 137475 - DNA, 25 bp, Artificial sequence
  SiRNA target sequence
aatgaagaaacaaaattatgcatgg

SEQ ID NO: 137476 - DNA, 25 bp, Artificial sequence
  SiRNA target sequence
atgaagaaacaaaattatgcatgga

SEQ ID NO: 137477 - DNA, 25 bp, Artificial sequence
  SiRNA target sequence
tgaagaaacaaaattatgcatggaa

SEQ ID NO: 137478 - DNA, 25 bp, Artificial sequence
  SiRNA target sequence
gaagaaacaaaattatgcatggaaa

SEQ ID NO: 137479 - DNA, 25 bp, Artificial sequence
  SiRNA target sequence
aagaaacaaaattatgcatggaaat

SEQ ID NO: 137480 - DNA, 25 bp, Artificial sequence
  SiRNA target sequence
agaaacaaaattatgcatggaaatg

SEQ ID NO: 137481 - DNA, 25 bp, Artificial sequence
  SiRNA target sequence
gaaacaaaattatgcatggaaatga

SEQ ID NO: 137482 - DNA, 25 bp, Artificial sequence
  SiRNA target sequence
aaacaaaattatgcatggaaatgat

SEQ ID NO: 137483 - DNA, 25 bp, Artificial sequence
  SiRNA target sequence
aacaaaattatgcatggaaatgatg

SEQ ID NO: 137484 - DNA, 25 bp, Artificial sequence
  SiRNA target sequence
acaaaattatgcatggaaatgatgg

SEQ ID NO: 137485 - DNA, 25 bp, Artificial sequence
  SiRNA target sequence
caaaattatgcatggaaatgatgga

SEQ ID NO: 137486 - DNA, 25 bp, Artificial sequence
  SiRNA target sequence
aaaattatgcatggaaatgatggaa

SEQ ID NO: 137487 - DNA, 25 bp, Artificial sequence
  SiRNA target sequence
aaattatgcatggaaatgatggaaa

SEQ ID NO: 137488 - DNA, 25 bp, Artificial sequence
  SiRNA target sequence
aattatgcatggaaatgatggaaac

SEQ ID NO: 137489 - DNA, 25 bp, Artificial sequence
  SiRNA target sequence
attatgcatggaaatgatggaaact

SEQ ID NO: 137490 - DNA, 25 bp, Artificial sequence
  SiRNA target sequence
ttatgcatggaaatgatggaaactt

SEQ ID NO: 137491 - DNA, 25 bp, Artificial sequence
  SiRNA target sequence
tatgcatggaaatgatggaaacttg

SEQ ID NO: 137492 - DNA, 25 bp, Artificial sequence
  SiRNA target sequence
atgcatggaaatgatggaaacttgt

SEQ ID NO: 137493 - DNA, 25 bp, Artificial sequence
  SiRNA target sequence
tgcatggaaatgatggaaacttgtg

SEQ ID NO: 137494 - DNA, 25 bp, Artificial sequence
  SiRNA target sequence
gcatggaaatgatggaaacttgtgg

SEQ ID NO: 137495 - DNA, 25 bp, Artificial sequence
  SiRNA target sequence
catggaaatgatggaaacttgtggt

SEQ ID NO: 137496 - DNA, 25 bp, Artificial sequence
  SiRNA target sequence
atggaaatgatggaaacttgtggtt

SEQ ID NO: 137497 - DNA, 25 bp, Artificial sequence
  SiRNA target sequence
tggaaatgatggaaacttgtggtta

SEQ ID NO: 137498 - DNA, 25 bp, Artificial sequence
  SiRNA target sequence
ggaaatgatggaaacttgtggttat

SEQ ID NO: 137499 - DNA, 25 bp, Artificial sequence
  SiRNA target sequence
gaaatgatggaaacttgtggttata

SEQ ID NO: 137500 - DNA, 25 bp, Artificial sequence
  SiRNA target sequence
aaatgatggaaacttgtggttatag

SEQ ID NO: 137501 - DNA, 25 bp, Artificial sequence
  SiRNA target sequence
aatgatggaaacttgtggttatagt

SEQ ID NO: 137502 - DNA, 25 bp, Artificial sequence
  SiRNA target sequence
atgatggaaacttgtggttatagtt

SEQ ID NO: 137503 - DNA, 25 bp, Artificial sequence
  SiRNA target sequence
tgatggaaacttgtggttatagttt

SEQ ID NO: 137504 - DNA, 25 bp, Artificial sequence
  SiRNA target sequence
gatggaaacttgtggttatagttta

SEQ ID NO: 137505 - DNA, 25 bp, Artificial sequence
  SiRNA target sequence
atggaaacttgtggttatagtttat

SEQ ID NO: 137506 - DNA, 25 bp, Artificial sequence
  SiRNA target sequence
tggaaacttgtggttatagtttatt

SEQ ID NO: 137507 - DNA, 25 bp, Artificial sequence
  SiRNA target sequence
ggaaacttgtggttatagtttatta

SEQ ID NO: 137508 - DNA, 25 bp, Artificial sequence
  SiRNA target sequence
gaaacttgtggttatagtttattaa

SEQ ID NO: 137509 - DNA, 25 bp, Artificial sequence
  SiRNA target sequence
aaacttgtggttatagtttattaaa

SEQ ID NO: 137510 - DNA, 25 bp, Artificial sequence
  SiRNA target sequence
aacttgtggttatagtttattaaaa

SEQ ID NO: 137511 - DNA, 25 bp, Artificial sequence
  SiRNA target sequence
acttgtggttatagtttattaaaaa

SEQ ID NO: 137512 - DNA, 25 bp, Artificial sequence
  SiRNA target sequence
cttgtggttatagtttattaaaaaa

SEQ ID NO: 137513 - DNA, 25 bp, Artificial sequence
  SiRNA target sequence
ttgtggttatagtttattaaaaaat

SEQ ID NO: 137514 - DNA, 25 bp, Artificial sequence
  SiRNA target sequence
tgtggttatagtttattaaaaaatt

SEQ ID NO: 137515 - DNA, 25 bp, Artificial sequence
  SiRNA target sequence
gtggttatagtttattaaaaaatta

SEQ ID NO: 137516 - DNA, 25 bp, Artificial sequence
  SiRNA target sequence
tggttatagtttattaaaaaattaa

SEQ ID NO: 137517 - DNA, 26 bp, Artificial sequence
  SiRNA target sequence
atggtgtataaggttttatttacagt

SEQ ID NO: 137518 - DNA, 26 bp, Artificial sequence
  SiRNA target sequence
tggtgtataaggttttatttacagta

SEQ ID NO: 137519 - DNA, 26 bp, Artificial sequence
  SiRNA target sequence
ggtgtataaggttttatttacagtaa

SEQ ID NO: 137520 - DNA, 26 bp, Artificial sequence
  SiRNA target sequence
gtgtataaggttttatttacagtaat

SEQ ID NO: 137521 - DNA, 26 bp, Artificial sequence
  SiRNA target sequence
tgtataaggttttatttacagtaata

SEQ ID NO: 137522 - DNA, 26 bp, Artificial sequence
  SiRNA target sequence
gtataaggttttatttacagtaatag

SEQ ID NO: 137523 - DNA, 26 bp, Artificial sequence
  SiRNA target sequence
tataaggttttatttacagtaatagg

SEQ ID NO: 137524 - DNA, 26 bp, Artificial sequence
  SiRNA target sequence
ataaggttttatttacagtaatagga

SEQ ID NO: 137525 - DNA, 26 bp, Artificial sequence
  SiRNA target sequence
taaggttttatttacagtaataggat

SEQ ID NO: 137526 - DNA, 26 bp, Artificial sequence
  SiRNA target sequence
aaggttttatttacagtaataggatt

SEQ ID NO: 137527 - DNA, 26 bp, Artificial sequence
  SiRNA target sequence
aggttttatttacagtaataggatta

SEQ ID NO: 137528 - DNA, 26 bp, Artificial sequence
  SiRNA target sequence
ggttttatttacagtaataggattaa

SEQ ID NO: 137529 - DNA, 26 bp, Artificial sequence
  SiRNA target sequence
gttttatttacagtaataggattaat

SEQ ID NO: 137530 - DNA, 26 bp, Artificial sequence
  SiRNA target sequence
ttttatttacagtaataggattaata

SEQ ID NO: 137531 - DNA, 26 bp, Artificial sequence
  SiRNA target sequence
tttatttacagtaataggattaatat

SEQ ID NO: 137532 - DNA, 26 bp, Artificial sequence
  SiRNA target sequence
ttatttacagtaataggattaatatg

SEQ ID NO: 137533 - DNA, 26 bp, Artificial sequence
  SiRNA target sequence
tatttacagtaataggattaatatgt

SEQ ID NO: 137534 - DNA, 26 bp, Artificial sequence
  SiRNA target sequence
atttacagtaataggattaatatgtg

SEQ ID NO: 137535 - DNA, 26 bp, Artificial sequence
  SiRNA target sequence
tttacagtaataggattaatatgtgg

SEQ ID NO: 137536 - DNA, 26 bp, Artificial sequence
  SiRNA target sequence
ttacagtaataggattaatatgtggt

SEQ ID NO: 137537 - DNA, 26 bp, Artificial sequence
  SiRNA target sequence
tacagtaataggattaatatgtggta

SEQ ID NO: 137538 - DNA, 26 bp, Artificial sequence
  SiRNA target sequence
acagtaataggattaatatgtggtat

SEQ ID NO: 137539 - DNA, 26 bp, Artificial sequence
  SiRNA target sequence
cagtaataggattaatatgtggtata

SEQ ID NO: 137540 - DNA, 26 bp, Artificial sequence
  SiRNA target sequence
agtaataggattaatatgtggtatac

SEQ ID NO: 137541 - DNA, 26 bp, Artificial sequence
  SiRNA target sequence
gtaataggattaatatgtggtatact

SEQ ID NO: 137542 - DNA, 26 bp, Artificial sequence
  SiRNA target sequence
taataggattaatatgtggtatactt

SEQ ID NO: 137543 - DNA, 26 bp, Artificial sequence
  SiRNA target sequence
aataggattaatatgtggtatactta

SEQ ID NO: 137544 - DNA, 26 bp, Artificial sequence
  SiRNA target sequence
ataggattaatatgtggtatacttac

SEQ ID NO: 137545 - DNA, 26 bp, Artificial sequence
  SiRNA target sequence
taggattaatatgtggtatacttaca

SEQ ID NO: 137546 - DNA, 26 bp, Artificial sequence
  SiRNA target sequence
aggattaatatgtggtatacttacaa

SEQ ID NO: 137547 - DNA, 26 bp, Artificial sequence
  SiRNA target sequence
ggattaatatgtggtatacttacaat

SEQ ID NO: 137548 - DNA, 26 bp, Artificial sequence
  SiRNA target sequence
gattaatatgtggtatacttacaata

SEQ ID NO: 137549 - DNA, 26 bp, Artificial sequence
  SiRNA target sequence
attaatatgtggtatacttacaataa

SEQ ID NO: 137550 - DNA, 26 bp, Artificial sequence
  SiRNA target sequence
ttaatatgtggtatacttacaataat

SEQ ID NO: 137551 - DNA, 26 bp, Artificial sequence
  SiRNA target sequence
taatatgtggtatacttacaataatt

SEQ ID NO: 137552 - DNA, 26 bp, Artificial sequence
  SiRNA target sequence
aatatgtggtatacttacaataatta

SEQ ID NO: 137553 - DNA, 26 bp, Artificial sequence
  SiRNA target sequence
atatgtggtatacttacaataattaa

SEQ ID NO: 137554 - DNA, 26 bp, Artificial sequence
  SiRNA target sequence
tatgtggtatacttacaataattaaa

SEQ ID NO: 137555 - DNA, 26 bp, Artificial sequence
  SiRNA target sequence
atgtggtatacttacaataattaaac

SEQ ID NO: 137556 - DNA, 26 bp, Artificial sequence
  SiRNA target sequence
tgtggtatacttacaataattaaacg

SEQ ID NO: 137557 - DNA, 26 bp, Artificial sequence
  SiRNA target sequence
gtggtatacttacaataattaaacga

SEQ ID NO: 137558 - DNA, 26 bp, Artificial sequence
  SiRNA target sequence
tggtatacttacaataattaaacgat

SEQ ID NO: 137559 - DNA, 26 bp, Artificial sequence
  SiRNA target sequence
ggtatacttacaataattaaacgata

SEQ ID NO: 137560 - DNA, 26 bp, Artificial sequence
  SiRNA target sequence
gtatacttacaataattaaacgatac

SEQ ID NO: 137561 - DNA, 26 bp, Artificial sequence
  SiRNA target sequence
tatacttacaataattaaacgataca

SEQ ID NO: 137562 - DNA, 26 bp, Artificial sequence
  SiRNA target sequence
atacttacaataattaaacgatacaa

SEQ ID NO: 137563 - DNA, 26 bp, Artificial sequence
  SiRNA target sequence
tacttacaataattaaacgatacaag

SEQ ID NO: 137564 - DNA, 26 bp, Artificial sequence
  SiRNA target sequence
acttacaataattaaacgatacaagt

SEQ ID NO: 137565 - DNA, 26 bp, Artificial sequence
  SiRNA target sequence
cttacaataattaaacgatacaagta

SEQ ID NO: 137566 - DNA, 26 bp, Artificial sequence
  SiRNA target sequence
ttacaataattaaacgatacaagtat

SEQ ID NO: 137567 - DNA, 26 bp, Artificial sequence
  SiRNA target sequence
tacaataattaaacgatacaagtatt

SEQ ID NO: 137568 - DNA, 26 bp, Artificial sequence
  SiRNA target sequence
acaataattaaacgatacaagtattt

SEQ ID NO: 137569 - DNA, 26 bp, Artificial sequence
  SiRNA target sequence
caataattaaacgatacaagtatttt

SEQ ID NO: 137570 - DNA, 26 bp, Artificial sequence
  SiRNA target sequence
aataattaaacgatacaagtatttta

SEQ ID NO: 137571 - DNA, 26 bp, Artificial sequence
  SiRNA target sequence
ataattaaacgatacaagtattttaa

SEQ ID NO: 137572 - DNA, 26 bp, Artificial sequence
  SiRNA target sequence
taattaaacgatacaagtattttaag

SEQ ID NO: 137573 - DNA, 26 bp, Artificial sequence
  SiRNA target sequence
aattaaacgatacaagtattttaaga

SEQ ID NO: 137574 - DNA, 26 bp, Artificial sequence
  SiRNA target sequence
attaaacgatacaagtattttaagat

SEQ ID NO: 137575 - DNA, 26 bp, Artificial sequence
  SiRNA target sequence
ttaaacgatacaagtattttaagata

SEQ ID NO: 137576 - DNA, 26 bp, Artificial sequence
  SiRNA target sequence
taaacgatacaagtattttaagataa

SEQ ID NO: 137577 - DNA, 26 bp, Artificial sequence
  SiRNA target sequence
aaacgatacaagtattttaagataaa

SEQ ID NO: 137578 - DNA, 26 bp, Artificial sequence
  SiRNA target sequence
aacgatacaagtattttaagataaaa

SEQ ID NO: 137579 - DNA, 26 bp, Artificial sequence
  SiRNA target sequence
acgatacaagtattttaagataaaaa

SEQ ID NO: 137580 - DNA, 26 bp, Artificial sequence
  SiRNA target sequence
cgatacaagtattttaagataaaaaa

SEQ ID NO: 137581 - DNA, 26 bp, Artificial sequence
  SiRNA target sequence
gatacaagtattttaagataaaaaaa

SEQ ID NO: 137582 - DNA, 26 bp, Artificial sequence
  SiRNA target sequence
atacaagtattttaagataaaaaaat

SEQ ID NO: 137583 - DNA, 26 bp, Artificial sequence
  SiRNA target sequence
tacaagtattttaagataaaaaaatt

SEQ ID NO: 137584 - DNA, 26 bp, Artificial sequence
  SiRNA target sequence
acaagtattttaagataaaaaaattg

SEQ ID NO: 137585 - DNA, 26 bp, Artificial sequence
  SiRNA target sequence
caagtattttaagataaaaaaattgg

SEQ ID NO: 137586 - DNA, 26 bp, Artificial sequence
  SiRNA target sequence
aagtattttaagataaaaaaattggc

SEQ ID NO: 137587 - DNA, 26 bp, Artificial sequence
  SiRNA target sequence
agtattttaagataaaaaaattggcc

SEQ ID NO: 137588 - DNA, 26 bp, Artificial sequence
  SiRNA target sequence
gtattttaagataaaaaaattggcct

SEQ ID NO: 137589 - DNA, 26 bp, Artificial sequence
  SiRNA target sequence
tattttaagataaaaaaattggcctt

SEQ ID NO: 137590 - DNA, 26 bp, Artificial sequence
  SiRNA target sequence
attttaagataaaaaaattggcctta

SEQ ID NO: 137591 - DNA, 26 bp, Artificial sequence
  SiRNA target sequence
ttttaagataaaaaaattggccttaa

SEQ ID NO: 137592 - DNA, 26 bp, Artificial sequence
  SiRNA target sequence
tttaagataaaaaaattggccttaac

SEQ ID NO: 137593 - DNA, 26 bp, Artificial sequence
  SiRNA target sequence
ttaagataaaaaaattggccttaact

SEQ ID NO: 137594 - DNA, 26 bp, Artificial sequence
  SiRNA target sequence
taagataaaaaaattggccttaactt

SEQ ID NO: 137595 - DNA, 26 bp, Artificial sequence
  SiRNA target sequence
aagataaaaaaattggccttaactta

SEQ ID NO: 137596 - DNA, 26 bp, Artificial sequence
  SiRNA target sequence
agataaaaaaattggccttaacttac

SEQ ID NO: 137597 - DNA, 26 bp, Artificial sequence
  SiRNA target sequence
gataaaaaaattggccttaacttact

SEQ ID NO: 137598 - DNA, 26 bp, Artificial sequence
  SiRNA target sequence
ataaaaaaattggccttaacttactt

SEQ ID NO: 137599 - DNA, 26 bp, Artificial sequence
  SiRNA target sequence
taaaaaaattggccttaacttacttc

SEQ ID NO: 137600 - DNA, 26 bp, Artificial sequence
  SiRNA target sequence
aaaaaaattggccttaacttacttcg

SEQ ID NO: 137601 - DNA, 26 bp, Artificial sequence
  SiRNA target sequence
aaaaaattggccttaacttacttcgg

SEQ ID NO: 137602 - DNA, 26 bp, Artificial sequence
  SiRNA target sequence
aaaaattggccttaacttacttcggg

SEQ ID NO: 137603 - DNA, 26 bp, Artificial sequence
  SiRNA target sequence
aaaattggccttaacttacttcggga

SEQ ID NO: 137604 - DNA, 26 bp, Artificial sequence
  SiRNA target sequence
aaattggccttaacttacttcgggaa

SEQ ID NO: 137605 - DNA, 26 bp, Artificial sequence
  SiRNA target sequence
aattggccttaacttacttcgggaaa

SEQ ID NO: 137606 - DNA, 26 bp, Artificial sequence
  SiRNA target sequence
attggccttaacttacttcgggaaac

SEQ ID NO: 137607 - DNA, 26 bp, Artificial sequence
  SiRNA target sequence
ttggccttaacttacttcgggaaaca

SEQ ID NO: 137608 - DNA, 26 bp, Artificial sequence
  SiRNA target sequence
tggccttaacttacttcgggaaacaa

SEQ ID NO: 137609 - DNA, 26 bp, Artificial sequence
  SiRNA target sequence
ggccttaacttacttcgggaaacaag

SEQ ID NO: 137610 - DNA, 26 bp, Artificial sequence
  SiRNA target sequence
gccttaacttacttcgggaaacaaga

SEQ ID NO: 137611 - DNA, 26 bp, Artificial sequence
  SiRNA target sequence
ccttaacttacttcgggaaacaagac

SEQ ID NO: 137612 - DNA, 26 bp, Artificial sequence
  SiRNA target sequence
cttaacttacttcgggaaacaagact

SEQ ID NO: 137613 - DNA, 26 bp, Artificial sequence
  SiRNA target sequence
ttaacttacttcgggaaacaagactt

SEQ ID NO: 137614 - DNA, 26 bp, Artificial sequence
  SiRNA target sequence
taacttacttcgggaaacaagacttg

SEQ ID NO: 137615 - DNA, 26 bp, Artificial sequence
  SiRNA target sequence
aacttacttcgggaaacaagacttgc

SEQ ID NO: 137616 - DNA, 26 bp, Artificial sequence
  SiRNA target sequence
acttacttcgggaaacaagacttgca

SEQ ID NO: 137617 - DNA, 26 bp, Artificial sequence
  SiRNA target sequence
cttacttcgggaaacaagacttgcaa

SEQ ID NO: 137618 - DNA, 26 bp, Artificial sequence
  SiRNA target sequence
ttacttcgggaaacaagacttgcaat

SEQ ID NO: 137619 - DNA, 26 bp, Artificial sequence
  SiRNA target sequence
tacttcgggaaacaagacttgcaatg

SEQ ID NO: 137620 - DNA, 26 bp, Artificial sequence
  SiRNA target sequence
acttcgggaaacaagacttgcaatgg

SEQ ID NO: 137621 - DNA, 26 bp, Artificial sequence
  SiRNA target sequence
cttcgggaaacaagacttgcaatgga

SEQ ID NO: 137622 - DNA, 26 bp, Artificial sequence
  SiRNA target sequence
ttcgggaaacaagacttgcaatggaa

SEQ ID NO: 137623 - DNA, 26 bp, Artificial sequence
  SiRNA target sequence
tcgggaaacaagacttgcaatggaaa

SEQ ID NO: 137624 - DNA, 26 bp, Artificial sequence
  SiRNA target sequence
cgggaaacaagacttgcaatggaaac

SEQ ID NO: 137625 - DNA, 26 bp, Artificial sequence
  SiRNA target sequence
gggaaacaagacttgcaatggaaacc

SEQ ID NO: 137626 - DNA, 26 bp, Artificial sequence
  SiRNA target sequence
ggaaacaagacttgcaatggaaacct

SEQ ID NO: 137627 - DNA, 26 bp, Artificial sequence
  SiRNA target sequence
gaaacaagacttgcaatggaaaccta

SEQ ID NO: 137628 - DNA, 26 bp, Artificial sequence
  SiRNA target sequence
aaacaagacttgcaatggaaacctaa

SEQ ID NO: 137629 - DNA, 26 bp, Artificial sequence
  SiRNA target sequence
aacaagacttgcaatggaaacctaaa

SEQ ID NO: 137630 - DNA, 26 bp, Artificial sequence
  SiRNA target sequence
acaagacttgcaatggaaacctaaaa

SEQ ID NO: 137631 - DNA, 26 bp, Artificial sequence
  SiRNA target sequence
caagacttgcaatggaaacctaaaag

SEQ ID NO: 137632 - DNA, 26 bp, Artificial sequence
  SiRNA target sequence
aagacttgcaatggaaacctaaaagt

SEQ ID NO: 137633 - DNA, 26 bp, Artificial sequence
  SiRNA target sequence
agacttgcaatggaaacctaaaagtc

SEQ ID NO: 137634 - DNA, 26 bp, Artificial sequence
  SiRNA target sequence
gacttgcaatggaaacctaaaagtcg

SEQ ID NO: 137635 - DNA, 26 bp, Artificial sequence
  SiRNA target sequence
acttgcaatggaaacctaaaagtcgg

SEQ ID NO: 137636 - DNA, 26 bp, Artificial sequence
  SiRNA target sequence
cttgcaatggaaacctaaaagtcggt

SEQ ID NO: 137637 - DNA, 26 bp, Artificial sequence
  SiRNA target sequence
ttgcaatggaaacctaaaagtcggtc

SEQ ID NO: 137638 - DNA, 26 bp, Artificial sequence
  SiRNA target sequence
tgcaatggaaacctaaaagtcggtca

SEQ ID NO: 137639 - DNA, 26 bp, Artificial sequence
  SiRNA target sequence
gcaatggaaacctaaaagtcggtcag

SEQ ID NO: 137640 - DNA, 26 bp, Artificial sequence
  SiRNA target sequence
caatggaaacctaaaagtcggtcaga

SEQ ID NO: 137641 - DNA, 26 bp, Artificial sequence
  SiRNA target sequence
aatggaaacctaaaagtcggtcagaa

SEQ ID NO: 137642 - DNA, 26 bp, Artificial sequence
  SiRNA target sequence
atggaaacctaaaagtcggtcagaaa

SEQ ID NO: 137643 - DNA, 26 bp, Artificial sequence
  SiRNA target sequence
tggaaacctaaaagtcggtcagaaat

SEQ ID NO: 137644 - DNA, 26 bp, Artificial sequence
  SiRNA target sequence
ggaaacctaaaagtcggtcagaaatt

SEQ ID NO: 137645 - DNA, 26 bp, Artificial sequence
  SiRNA target sequence
gaaacctaaaagtcggtcagaaatta

SEQ ID NO: 137646 - DNA, 26 bp, Artificial sequence
  SiRNA target sequence
aaacctaaaagtcggtcagaaattat

SEQ ID NO: 137647 - DNA, 26 bp, Artificial sequence
  SiRNA target sequence
aacctaaaagtcggtcagaaattatt

SEQ ID NO: 137648 - DNA, 26 bp, Artificial sequence
  SiRNA target sequence
acctaaaagtcggtcagaaattatta

SEQ ID NO: 137649 - DNA, 26 bp, Artificial sequence
  SiRNA target sequence
cctaaaagtcggtcagaaattattaa

SEQ ID NO: 137650 - DNA, 26 bp, Artificial sequence
  SiRNA target sequence
ctaaaagtcggtcagaaattattaac

SEQ ID NO: 137651 - DNA, 26 bp, Artificial sequence
  SiRNA target sequence
taaaagtcggtcagaaattattaacg

SEQ ID NO: 137652 - DNA, 26 bp, Artificial sequence
  SiRNA target sequence
aaaagtcggtcagaaattattaacga

SEQ ID NO: 137653 - DNA, 26 bp, Artificial sequence
  SiRNA target sequence
aaagtcggtcagaaattattaacgat

SEQ ID NO: 137654 - DNA, 26 bp, Artificial sequence
  SiRNA target sequence
aagtcggtcagaaattattaacgatt

SEQ ID NO: 137655 - DNA, 26 bp, Artificial sequence
  SiRNA target sequence
agtcggtcagaaattattaacgattt

SEQ ID NO: 137656 - DNA, 26 bp, Artificial sequence
  SiRNA target sequence
gtcggtcagaaattattaacgattta

SEQ ID NO: 137657 - DNA, 26 bp, Artificial sequence
  SiRNA target sequence
tcggtcagaaattattaacgatttaa

SEQ ID NO: 137658 - DNA, 26 bp, Artificial sequence
  SiRNA target sequence
cggtcagaaattattaacgatttaaa

SEQ ID NO: 137659 - DNA, 26 bp, Artificial sequence
  SiRNA target sequence
ggtcagaaattattaacgatttaaaa

SEQ ID NO: 137660 - DNA, 26 bp, Artificial sequence
  SiRNA target sequence
gtcagaaattattaacgatttaaaaa

SEQ ID NO: 137661 - DNA, 26 bp, Artificial sequence
  SiRNA target sequence
tcagaaattattaacgatttaaaaaa

SEQ ID NO: 137662 - DNA, 26 bp, Artificial sequence
  SiRNA target sequence
cagaaattattaacgatttaaaaaat

SEQ ID NO: 137663 - DNA, 26 bp, Artificial sequence
  SiRNA target sequence
agaaattattaacgatttaaaaaata

SEQ ID NO: 137664 - DNA, 26 bp, Artificial sequence
  SiRNA target sequence
gaaattattaacgatttaaaaaatac

SEQ ID NO: 137665 - DNA, 26 bp, Artificial sequence
  SiRNA target sequence
aaattattaacgatttaaaaaataca

SEQ ID NO: 137666 - DNA, 26 bp, Artificial sequence
  SiRNA target sequence
aattattaacgatttaaaaaatacaa

SEQ ID NO: 137667 - DNA, 26 bp, Artificial sequence
  SiRNA target sequence
attattaacgatttaaaaaatacaaa

SEQ ID NO: 137668 - DNA, 26 bp, Artificial sequence
  SiRNA target sequence
ttattaacgatttaaaaaatacaaac

SEQ ID NO: 137669 - DNA, 26 bp, Artificial sequence
  SiRNA target sequence
tattaacgatttaaaaaatacaaact

SEQ ID NO: 137670 - DNA, 26 bp, Artificial sequence
  SiRNA target sequence
attaacgatttaaaaaatacaaactt

SEQ ID NO: 137671 - DNA, 26 bp, Artificial sequence
  SiRNA target sequence
ttaacgatttaaaaaatacaaacttt

SEQ ID NO: 137672 - DNA, 26 bp, Artificial sequence
  SiRNA target sequence
taacgatttaaaaaatacaaactttg

SEQ ID NO: 137673 - DNA, 26 bp, Artificial sequence
  SiRNA target sequence
aacgatttaaaaaatacaaactttga

SEQ ID NO: 137674 - DNA, 26 bp, Artificial sequence
  SiRNA target sequence
acgatttaaaaaatacaaactttgac

SEQ ID NO: 137675 - DNA, 26 bp, Artificial sequence
  SiRNA target sequence
cgatttaaaaaatacaaactttgaca

SEQ ID NO: 137676 - DNA, 26 bp, Artificial sequence
  SiRNA target sequence
gatttaaaaaatacaaactttgacat

SEQ ID NO: 137677 - DNA, 26 bp, Artificial sequence
  SiRNA target sequence
atttaaaaaatacaaactttgacata

SEQ ID NO: 137678 - DNA, 26 bp, Artificial sequence
  SiRNA target sequence
tttaaaaaatacaaactttgacatat

SEQ ID NO: 137679 - DNA, 26 bp, Artificial sequence
  SiRNA target sequence
ttaaaaaatacaaactttgacatatt

SEQ ID NO: 137680 - DNA, 26 bp, Artificial sequence
  SiRNA target sequence
taaaaaatacaaactttgacatattg

SEQ ID NO: 137681 - DNA, 26 bp, Artificial sequence
  SiRNA target sequence
aaaaaatacaaactttgacatattga

SEQ ID NO: 137682 - DNA, 26 bp, Artificial sequence
  SiRNA target sequence
aaaaatacaaactttgacatattgat

SEQ ID NO: 137683 - DNA, 26 bp, Artificial sequence
  SiRNA target sequence
aaaatacaaactttgacatattgatt

SEQ ID NO: 137684 - DNA, 26 bp, Artificial sequence
  SiRNA target sequence
aaatacaaactttgacatattgatta

SEQ ID NO: 137685 - DNA, 26 bp, Artificial sequence
  SiRNA target sequence
aatacaaactttgacatattgattat

SEQ ID NO: 137686 - DNA, 26 bp, Artificial sequence
  SiRNA target sequence
atacaaactttgacatattgattatt

SEQ ID NO: 137687 - DNA, 26 bp, Artificial sequence
  SiRNA target sequence
tacaaactttgacatattgattattg

SEQ ID NO: 137688 - DNA, 26 bp, Artificial sequence
  SiRNA target sequence
acaaactttgacatattgattattgg

SEQ ID NO: 137689 - DNA, 26 bp, Artificial sequence
  SiRNA target sequence
caaactttgacatattgattattggt

SEQ ID NO: 137690 - DNA, 26 bp, Artificial sequence
  SiRNA target sequence
aaactttgacatattgattattggtg

SEQ ID NO: 137691 - DNA, 26 bp, Artificial sequence
  SiRNA target sequence
aactttgacatattgattattggtgg

SEQ ID NO: 137692 - DNA, 26 bp, Artificial sequence
  SiRNA target sequence
actttgacatattgattattggtggc

SEQ ID NO: 137693 - DNA, 26 bp, Artificial sequence
  SiRNA target sequence
ctttgacatattgattattggtggcg

SEQ ID NO: 137694 - DNA, 26 bp, Artificial sequence
  SiRNA target sequence
tttgacatattgattattggtggcgg

SEQ ID NO: 137695 - DNA, 26 bp, Artificial sequence
  SiRNA target sequence
ttgacatattgattattggtggcggt

SEQ ID NO: 137696 - DNA, 26 bp, Artificial sequence
  SiRNA target sequence
tgacatattgattattggtggcggtt

SEQ ID NO: 137697 - DNA, 26 bp, Artificial sequence
  SiRNA target sequence
gacatattgattattggtggcggttc

SEQ ID NO: 137698 - DNA, 26 bp, Artificial sequence
  SiRNA target sequence
acatattgattattggtggcggttca

SEQ ID NO: 137699 - DNA, 26 bp, Artificial sequence
  SiRNA target sequence
catattgattattggtggcggttcaa

SEQ ID NO: 137700 - DNA, 26 bp, Artificial sequence
  SiRNA target sequence
atattgattattggtggcggttcaac

SEQ ID NO: 137701 - DNA, 26 bp, Artificial sequence
  SiRNA target sequence
tattgattattggtggcggttcaacg

SEQ ID NO: 137702 - DNA, 26 bp, Artificial sequence
  SiRNA target sequence
attgattattggtggcggttcaacgg

SEQ ID NO: 137703 - DNA, 26 bp, Artificial sequence
  SiRNA target sequence
ttgattattggtggcggttcaacggg

SEQ ID NO: 137704 - DNA, 26 bp, Artificial sequence
  SiRNA target sequence
tgattattggtggcggttcaacggga

SEQ ID NO: 137705 - DNA, 26 bp, Artificial sequence
  SiRNA target sequence
gattattggtggcggttcaacgggaa

SEQ ID NO: 137706 - DNA, 26 bp, Artificial sequence
  SiRNA target sequence
attattggtggcggttcaacgggaat

SEQ ID NO: 137707 - DNA, 26 bp, Artificial sequence
  SiRNA target sequence
ttattggtggcggttcaacgggaatg

SEQ ID NO: 137708 - DNA, 26 bp, Artificial sequence
  SiRNA target sequence
tattggtggcggttcaacgggaatgg

SEQ ID NO: 137709 - DNA, 26 bp, Artificial sequence
  SiRNA target sequence
attggtggcggttcaacgggaatggg

SEQ ID NO: 137710 - DNA, 26 bp, Artificial sequence
  SiRNA target sequence
ttggtggcggttcaacgggaatggga

SEQ ID NO: 137711 - DNA, 26 bp, Artificial sequence
  SiRNA target sequence
tggtggcggttcaacgggaatgggat

SEQ ID NO: 137712 - DNA, 26 bp, Artificial sequence
  SiRNA target sequence
ggtggcggttcaacgggaatgggatg

SEQ ID NO: 137713 - DNA, 26 bp, Artificial sequence
  SiRNA target sequence
gtggcggttcaacgggaatgggatgt

SEQ ID NO: 137714 - DNA, 26 bp, Artificial sequence
  SiRNA target sequence
tggcggttcaacgggaatgggatgtg

SEQ ID NO: 137715 - DNA, 26 bp, Artificial sequence
  SiRNA target sequence
ggcggttcaacgggaatgggatgtgc

SEQ ID NO: 137716 - DNA, 26 bp, Artificial sequence
  SiRNA target sequence
gcggttcaacgggaatgggatgtgca

SEQ ID NO: 137717 - DNA, 26 bp, Artificial sequence
  SiRNA target sequence
cggttcaacgggaatgggatgtgcaa

SEQ ID NO: 137718 - DNA, 26 bp, Artificial sequence
  SiRNA target sequence
ggttcaacgggaatgggatgtgcaat

SEQ ID NO: 137719 - DNA, 26 bp, Artificial sequence
  SiRNA target sequence
gttcaacgggaatgggatgtgcaatc

SEQ ID NO: 137720 - DNA, 26 bp, Artificial sequence
  SiRNA target sequence
ttcaacgggaatgggatgtgcaatcg

SEQ ID NO: 137721 - DNA, 26 bp, Artificial sequence
  SiRNA target sequence
tcaacgggaatgggatgtgcaatcga

SEQ ID NO: 137722 - DNA, 26 bp, Artificial sequence
  SiRNA target sequence
caacgggaatgggatgtgcaatcgaa

SEQ ID NO: 137723 - DNA, 26 bp, Artificial sequence
  SiRNA target sequence
aacgggaatgggatgtgcaatcgaag

SEQ ID NO: 137724 - DNA, 26 bp, Artificial sequence
  SiRNA target sequence
acgggaatgggatgtgcaatcgaagc

SEQ ID NO: 137725 - DNA, 26 bp, Artificial sequence
  SiRNA target sequence
cgggaatgggatgtgcaatcgaagca

SEQ ID NO: 137726 - DNA, 26 bp, Artificial sequence
  SiRNA target sequence
gggaatgggatgtgcaatcgaagcag

SEQ ID NO: 137727 - DNA, 26 bp, Artificial sequence
  SiRNA target sequence
ggaatgggatgtgcaatcgaagcagc

SEQ ID NO: 137728 - DNA, 26 bp, Artificial sequence
  SiRNA target sequence
gaatgggatgtgcaatcgaagcagct

SEQ ID NO: 137729 - DNA, 26 bp, Artificial sequence
  SiRNA target sequence
aatgggatgtgcaatcgaagcagcta

SEQ ID NO: 137730 - DNA, 26 bp, Artificial sequence
  SiRNA target sequence
atgggatgtgcaatcgaagcagctac

SEQ ID NO: 137731 - DNA, 26 bp, Artificial sequence
  SiRNA target sequence
tgggatgtgcaatcgaagcagctaca

SEQ ID NO: 137732 - DNA, 26 bp, Artificial sequence
  SiRNA target sequence
gggatgtgcaatcgaagcagctacac

SEQ ID NO: 137733 - DNA, 26 bp, Artificial sequence
  SiRNA target sequence
ggatgtgcaatcgaagcagctacacg

SEQ ID NO: 137734 - DNA, 26 bp, Artificial sequence
  SiRNA target sequence
gatgtgcaatcgaagcagctacacga

SEQ ID NO: 137735 - DNA, 26 bp, Artificial sequence
  SiRNA target sequence
atgtgcaatcgaagcagctacacgag

SEQ ID NO: 137736 - DNA, 26 bp, Artificial sequence
  SiRNA target sequence
tgtgcaatcgaagcagctacacgagg

SEQ ID NO: 137737 - DNA, 26 bp, Artificial sequence
  SiRNA target sequence
gtgcaatcgaagcagctacacgaggt

SEQ ID NO: 137738 - DNA, 26 bp, Artificial sequence
  SiRNA target sequence
tgcaatcgaagcagctacacgaggta

SEQ ID NO: 137739 - DNA, 26 bp, Artificial sequence
  SiRNA target sequence
gcaatcgaagcagctacacgaggtat

SEQ ID NO: 137740 - DNA, 26 bp, Artificial sequence
  SiRNA target sequence
caatcgaagcagctacacgaggtata

SEQ ID NO: 137741 - DNA, 26 bp, Artificial sequence
  SiRNA target sequence
aatcgaagcagctacacgaggtataa

SEQ ID NO: 137742 - DNA, 26 bp, Artificial sequence
  SiRNA target sequence
atcgaagcagctacacgaggtataag

SEQ ID NO: 137743 - DNA, 26 bp, Artificial sequence
  SiRNA target sequence
tcgaagcagctacacgaggtataagt

SEQ ID NO: 137744 - DNA, 26 bp, Artificial sequence
  SiRNA target sequence
cgaagcagctacacgaggtataagtg

SEQ ID NO: 137745 - DNA, 26 bp, Artificial sequence
  SiRNA target sequence
gaagcagctacacgaggtataagtgt

SEQ ID NO: 137746 - DNA, 26 bp, Artificial sequence
  SiRNA target sequence
aagcagctacacgaggtataagtgtt

SEQ ID NO: 137747 - DNA, 26 bp, Artificial sequence
  SiRNA target sequence
agcagctacacgaggtataagtgttg

SEQ ID NO: 137748 - DNA, 26 bp, Artificial sequence
  SiRNA target sequence
gcagctacacgaggtataagtgttgg

SEQ ID NO: 137749 - DNA, 26 bp, Artificial sequence
  SiRNA target sequence
cagctacacgaggtataagtgttggc

SEQ ID NO: 137750 - DNA, 26 bp, Artificial sequence
  SiRNA target sequence
agctacacgaggtataagtgttggcc

SEQ ID NO: 137751 - DNA, 26 bp, Artificial sequence
  SiRNA target sequence
gctacacgaggtataagtgttggcct

SEQ ID NO: 137752 - DNA, 26 bp, Artificial sequence
  SiRNA target sequence
ctacacgaggtataagtgttggcctg

SEQ ID NO: 137753 - DNA, 26 bp, Artificial sequence
  SiRNA target sequence
tacacgaggtataagtgttggcctga

SEQ ID NO: 137754 - DNA, 26 bp, Artificial sequence
  SiRNA target sequence
acacgaggtataagtgttggcctgat

SEQ ID NO: 137755 - DNA, 26 bp, Artificial sequence
  SiRNA target sequence
cacgaggtataagtgttggcctgata

SEQ ID NO: 137756 - DNA, 26 bp, Artificial sequence
  SiRNA target sequence
acgaggtataagtgttggcctgatag

SEQ ID NO: 137757 - DNA, 26 bp, Artificial sequence
  SiRNA target sequence
cgaggtataagtgttggcctgataga

SEQ ID NO: 137758 - DNA, 26 bp, Artificial sequence
  SiRNA target sequence
gaggtataagtgttggcctgatagaa

SEQ ID NO: 137759 - DNA, 26 bp, Artificial sequence
  SiRNA target sequence
aggtataagtgttggcctgatagaag

SEQ ID NO: 137760 - DNA, 26 bp, Artificial sequence
  SiRNA target sequence
ggtataagtgttggcctgatagaagc

SEQ ID NO: 137761 - DNA, 26 bp, Artificial sequence
  SiRNA target sequence
gtataagtgttggcctgatagaagca

SEQ ID NO: 137762 - DNA, 26 bp, Artificial sequence
  SiRNA target sequence
tataagtgttggcctgatagaagcac

SEQ ID NO: 137763 - DNA, 26 bp, Artificial sequence
  SiRNA target sequence
ataagtgttggcctgatagaagcaca

SEQ ID NO: 137764 - DNA, 26 bp, Artificial sequence
  SiRNA target sequence
taagtgttggcctgatagaagcacat

SEQ ID NO: 137765 - DNA, 26 bp, Artificial sequence
  SiRNA target sequence
aagtgttggcctgatagaagcacatg

SEQ ID NO: 137766 - DNA, 26 bp, Artificial sequence
  SiRNA target sequence
agtgttggcctgatagaagcacatga

SEQ ID NO: 137767 - DNA, 26 bp, Artificial sequence
  SiRNA target sequence
gtgttggcctgatagaagcacatgat

SEQ ID NO: 137768 - DNA, 26 bp, Artificial sequence
  SiRNA target sequence
tgttggcctgatagaagcacatgatt

SEQ ID NO: 137769 - DNA, 26 bp, Artificial sequence
  SiRNA target sequence
gttggcctgatagaagcacatgattt

SEQ ID NO: 137770 - DNA, 26 bp, Artificial sequence
  SiRNA target sequence
ttggcctgatagaagcacatgatttt

SEQ ID NO: 137771 - DNA, 26 bp, Artificial sequence
  SiRNA target sequence
tggcctgatagaagcacatgattttg

SEQ ID NO: 137772 - DNA, 26 bp, Artificial sequence
  SiRNA target sequence
ggcctgatagaagcacatgattttgg

SEQ ID NO: 137773 - DNA, 26 bp, Artificial sequence
  SiRNA target sequence
gcctgatagaagcacatgattttggt

SEQ ID NO: 137774 - DNA, 26 bp, Artificial sequence
  SiRNA target sequence
cctgatagaagcacatgattttggtt

SEQ ID NO: 137775 - DNA, 26 bp, Artificial sequence
  SiRNA target sequence
ctgatagaagcacatgattttggttc

SEQ ID NO: 137776 - DNA, 26 bp, Artificial sequence
  SiRNA target sequence
tgatagaagcacatgattttggttcg

SEQ ID NO: 137777 - DNA, 26 bp, Artificial sequence
  SiRNA target sequence
gatagaagcacatgattttggttcgg

SEQ ID NO: 137778 - DNA, 26 bp, Artificial sequence
  SiRNA target sequence
atagaagcacatgattttggttcggg

SEQ ID NO: 137779 - DNA, 26 bp, Artificial sequence
  SiRNA target sequence
tagaagcacatgattttggttcgggc

SEQ ID NO: 137780 - DNA, 26 bp, Artificial sequence
  SiRNA target sequence
agaagcacatgattttggttcgggca

SEQ ID NO: 137781 - DNA, 26 bp, Artificial sequence
  SiRNA target sequence
gaagcacatgattttggttcgggcac

SEQ ID NO: 137782 - DNA, 26 bp, Artificial sequence
  SiRNA target sequence
aagcacatgattttggttcgggcacg

SEQ ID NO: 137783 - DNA, 26 bp, Artificial sequence
  SiRNA target sequence
agcacatgattttggttcgggcacga

SEQ ID NO: 137784 - DNA, 26 bp, Artificial sequence
  SiRNA target sequence
gcacatgattttggttcgggcacgag

SEQ ID NO: 137785 - DNA, 26 bp, Artificial sequence
  SiRNA target sequence
cacatgattttggttcgggcacgagt

SEQ ID NO: 137786 - DNA, 26 bp, Artificial sequence
  SiRNA target sequence
acatgattttggttcgggcacgagtt

SEQ ID NO: 137787 - DNA, 26 bp, Artificial sequence
  SiRNA target sequence
catgattttggttcgggcacgagttc

SEQ ID NO: 137788 - DNA, 26 bp, Artificial sequence
  SiRNA target sequence
atgattttggttcgggcacgagttca

SEQ ID NO: 137789 - DNA, 26 bp, Artificial sequence
  SiRNA target sequence
tgattttggttcgggcacgagttcaa

SEQ ID NO: 137790 - DNA, 26 bp, Artificial sequence
  SiRNA target sequence
gattttggttcgggcacgagttcaaa

SEQ ID NO: 137791 - DNA, 26 bp, Artificial sequence
  SiRNA target sequence
attttggttcgggcacgagttcaaaa

SEQ ID NO: 137792 - DNA, 26 bp, Artificial sequence
  SiRNA target sequence
ttttggttcgggcacgagttcaaaat

SEQ ID NO: 137793 - DNA, 26 bp, Artificial sequence
  SiRNA target sequence
tttggttcgggcacgagttcaaaatc

SEQ ID NO: 137794 - DNA, 26 bp, Artificial sequence
  SiRNA target sequence
ttggttcgggcacgagttcaaaatct

SEQ ID NO: 137795 - DNA, 26 bp, Artificial sequence
  SiRNA target sequence
tggttcgggcacgagttcaaaatcta

SEQ ID NO: 137796 - DNA, 26 bp, Artificial sequence
  SiRNA target sequence
ggttcgggcacgagttcaaaatctac

SEQ ID NO: 137797 - DNA, 26 bp, Artificial sequence
  SiRNA target sequence
gttcgggcacgagttcaaaatctaca

SEQ ID NO: 137798 - DNA, 26 bp, Artificial sequence
  SiRNA target sequence
ttcgggcacgagttcaaaatctacaa

SEQ ID NO: 137799 - DNA, 26 bp, Artificial sequence
  SiRNA target sequence
tcgggcacgagttcaaaatctacaaa

SEQ ID NO: 137800 - DNA, 26 bp, Artificial sequence
  SiRNA target sequence
cgggcacgagttcaaaatctacaaaa

SEQ ID NO: 137801 - DNA, 26 bp, Artificial sequence
  SiRNA target sequence
gggcacgagttcaaaatctacaaaac

SEQ ID NO: 137802 - DNA, 26 bp, Artificial sequence
  SiRNA target sequence
ggcacgagttcaaaatctacaaaact

SEQ ID NO: 137803 - DNA, 26 bp, Artificial sequence
  SiRNA target sequence
gcacgagttcaaaatctacaaaactt

SEQ ID NO: 137804 - DNA, 26 bp, Artificial sequence
  SiRNA target sequence
cacgagttcaaaatctacaaaacttt

SEQ ID NO: 137805 - DNA, 26 bp, Artificial sequence
  SiRNA target sequence
acgagttcaaaatctacaaaactttt

SEQ ID NO: 137806 - DNA, 26 bp, Artificial sequence
  SiRNA target sequence
cgagttcaaaatctacaaaacttttt

SEQ ID NO: 137807 - DNA, 26 bp, Artificial sequence
  SiRNA target sequence
gagttcaaaatctacaaaactttttc

SEQ ID NO: 137808 - DNA, 26 bp, Artificial sequence
  SiRNA target sequence
agttcaaaatctacaaaactttttca

SEQ ID NO: 137809 - DNA, 26 bp, Artificial sequence
  SiRNA target sequence
gttcaaaatctacaaaactttttcat

SEQ ID NO: 137810 - DNA, 26 bp, Artificial sequence
  SiRNA target sequence
ttcaaaatctacaaaactttttcatg

SEQ ID NO: 137811 - DNA, 26 bp, Artificial sequence
  SiRNA target sequence
tcaaaatctacaaaactttttcatgg

SEQ ID NO: 137812 - DNA, 26 bp, Artificial sequence
  SiRNA target sequence
caaaatctacaaaactttttcatggc

SEQ ID NO: 137813 - DNA, 26 bp, Artificial sequence
  SiRNA target sequence
aaaatctacaaaactttttcatggcg

SEQ ID NO: 137814 - DNA, 26 bp, Artificial sequence
  SiRNA target sequence
aaatctacaaaactttttcatggcgg

SEQ ID NO: 137815 - DNA, 26 bp, Artificial sequence
  SiRNA target sequence
aatctacaaaactttttcatggcggt

SEQ ID NO: 137816 - DNA, 26 bp, Artificial sequence
  SiRNA target sequence
atctacaaaactttttcatggcggtg

SEQ ID NO: 137817 - DNA, 26 bp, Artificial sequence
  SiRNA target sequence
tctacaaaactttttcatggcggtgt

SEQ ID NO: 137818 - DNA, 26 bp, Artificial sequence
  SiRNA target sequence
ctacaaaactttttcatggcggtgta

SEQ ID NO: 137819 - DNA, 26 bp, Artificial sequence
  SiRNA target sequence
tacaaaactttttcatggcggtgtac

SEQ ID NO: 137820 - DNA, 26 bp, Artificial sequence
  SiRNA target sequence
acaaaactttttcatggcggtgtacg

SEQ ID NO: 137821 - DNA, 26 bp, Artificial sequence
  SiRNA target sequence
caaaactttttcatggcggtgtacgc

SEQ ID NO: 137822 - DNA, 26 bp, Artificial sequence
  SiRNA target sequence
aaaactttttcatggcggtgtacgct

SEQ ID NO: 137823 - DNA, 26 bp, Artificial sequence
  SiRNA target sequence
aaactttttcatggcggtgtacgcta

SEQ ID NO: 137824 - DNA, 26 bp, Artificial sequence
  SiRNA target sequence
aactttttcatggcggtgtacgctac

SEQ ID NO: 137825 - DNA, 26 bp, Artificial sequence
  SiRNA target sequence
actttttcatggcggtgtacgctacc

SEQ ID NO: 137826 - DNA, 26 bp, Artificial sequence
  SiRNA target sequence
ctttttcatggcggtgtacgctacct

SEQ ID NO: 137827 - DNA, 26 bp, Artificial sequence
  SiRNA target sequence
tttttcatggcggtgtacgctacctt

SEQ ID NO: 137828 - DNA, 26 bp, Artificial sequence
  SiRNA target sequence
ttttcatggcggtgtacgctaccttg

SEQ ID NO: 137829 - DNA, 26 bp, Artificial sequence
  SiRNA target sequence
tttcatggcggtgtacgctaccttga

SEQ ID NO: 137830 - DNA, 26 bp, Artificial sequence
  SiRNA target sequence
ttcatggcggtgtacgctaccttgaa

SEQ ID NO: 137831 - DNA, 26 bp, Artificial sequence
  SiRNA target sequence
tcatggcggtgtacgctaccttgaaa

SEQ ID NO: 137832 - DNA, 26 bp, Artificial sequence
  SiRNA target sequence
catggcggtgtacgctaccttgaaaa

SEQ ID NO: 137833 - DNA, 26 bp, Artificial sequence
  SiRNA target sequence
atggcggtgtacgctaccttgaaaaa

SEQ ID NO: 137834 - DNA, 26 bp, Artificial sequence
  SiRNA target sequence
tggcggtgtacgctaccttgaaaaag

SEQ ID NO: 137835 - DNA, 26 bp, Artificial sequence
  SiRNA target sequence
ggcggtgtacgctaccttgaaaaagc

SEQ ID NO: 137836 - DNA, 26 bp, Artificial sequence
  SiRNA target sequence
gcggtgtacgctaccttgaaaaagct

SEQ ID NO: 137837 - DNA, 26 bp, Artificial sequence
  SiRNA target sequence
cggtgtacgctaccttgaaaaagctg

SEQ ID NO: 137838 - DNA, 26 bp, Artificial sequence
  SiRNA target sequence
ggtgtacgctaccttgaaaaagctgt

SEQ ID NO: 137839 - DNA, 26 bp, Artificial sequence
  SiRNA target sequence
gtgtacgctaccttgaaaaagctgtt

SEQ ID NO: 137840 - DNA, 26 bp, Artificial sequence
  SiRNA target sequence
tgtacgctaccttgaaaaagctgtta

SEQ ID NO: 137841 - DNA, 26 bp, Artificial sequence
  SiRNA target sequence
gtacgctaccttgaaaaagctgttaa

SEQ ID NO: 137842 - DNA, 26 bp, Artificial sequence
  SiRNA target sequence
tacgctaccttgaaaaagctgttaat

SEQ ID NO: 137843 - DNA, 26 bp, Artificial sequence
  SiRNA target sequence
acgctaccttgaaaaagctgttaatg

SEQ ID NO: 137844 - DNA, 26 bp, Artificial sequence
  SiRNA target sequence
cgctaccttgaaaaagctgttaatga

SEQ ID NO: 137845 - DNA, 26 bp, Artificial sequence
  SiRNA target sequence
gctaccttgaaaaagctgttaatgat

SEQ ID NO: 137846 - DNA, 26 bp, Artificial sequence
  SiRNA target sequence
ctaccttgaaaaagctgttaatgatt

SEQ ID NO: 137847 - DNA, 26 bp, Artificial sequence
  SiRNA target sequence
taccttgaaaaagctgttaatgattt

SEQ ID NO: 137848 - DNA, 26 bp, Artificial sequence
  SiRNA target sequence
accttgaaaaagctgttaatgattta

SEQ ID NO: 137849 - DNA, 26 bp, Artificial sequence
  SiRNA target sequence
ccttgaaaaagctgttaatgatttag

SEQ ID NO: 137850 - DNA, 26 bp, Artificial sequence
  SiRNA target sequence
cttgaaaaagctgttaatgatttaga

SEQ ID NO: 137851 - DNA, 26 bp, Artificial sequence
  SiRNA target sequence
ttgaaaaagctgttaatgatttagat

SEQ ID NO: 137852 - DNA, 26 bp, Artificial sequence
  SiRNA target sequence
tgaaaaagctgttaatgatttagata

SEQ ID NO: 137853 - DNA, 26 bp, Artificial sequence
  SiRNA target sequence
gaaaaagctgttaatgatttagatag

SEQ ID NO: 137854 - DNA, 26 bp, Artificial sequence
  SiRNA target sequence
aaaaagctgttaatgatttagataga

SEQ ID NO: 137855 - DNA, 26 bp, Artificial sequence
  SiRNA target sequence
aaaagctgttaatgatttagatagat

SEQ ID NO: 137856 - DNA, 26 bp, Artificial sequence
  SiRNA target sequence
aaagctgttaatgatttagatagatc

SEQ ID NO: 137857 - DNA, 26 bp, Artificial sequence
  SiRNA target sequence
aagctgttaatgatttagatagatct

SEQ ID NO: 137858 - DNA, 26 bp, Artificial sequence
  SiRNA target sequence
agctgttaatgatttagatagatctc

SEQ ID NO: 137859 - DNA, 26 bp, Artificial sequence
  SiRNA target sequence
gctgttaatgatttagatagatctca

SEQ ID NO: 137860 - DNA, 26 bp, Artificial sequence
  SiRNA target sequence
ctgttaatgatttagatagatctcag

SEQ ID NO: 137861 - DNA, 26 bp, Artificial sequence
  SiRNA target sequence
tgttaatgatttagatagatctcagt

SEQ ID NO: 137862 - DNA, 26 bp, Artificial sequence
  SiRNA target sequence
gttaatgatttagatagatctcagtt

SEQ ID NO: 137863 - DNA, 26 bp, Artificial sequence
  SiRNA target sequence
ttaatgatttagatagatctcagttt

SEQ ID NO: 137864 - DNA, 26 bp, Artificial sequence
  SiRNA target sequence
taatgatttagatagatctcagtttg

SEQ ID NO: 137865 - DNA, 26 bp, Artificial sequence
  SiRNA target sequence
aatgatttagatagatctcagtttga

SEQ ID NO: 137866 - DNA, 26 bp, Artificial sequence
  SiRNA target sequence
atgatttagatagatctcagtttgac

SEQ ID NO: 137867 - DNA, 26 bp, Artificial sequence
  SiRNA target sequence
tgatttagatagatctcagtttgact

SEQ ID NO: 137868 - DNA, 26 bp, Artificial sequence
  SiRNA target sequence
gatttagatagatctcagtttgactt

SEQ ID NO: 137869 - DNA, 26 bp, Artificial sequence
  SiRNA target sequence
atttagatagatctcagtttgacttg

SEQ ID NO: 137870 - DNA, 26 bp, Artificial sequence
  SiRNA target sequence
tttagatagatctcagtttgacttgg

SEQ ID NO: 137871 - DNA, 26 bp, Artificial sequence
  SiRNA target sequence
ttagatagatctcagtttgacttggt

SEQ ID NO: 137872 - DNA, 26 bp, Artificial sequence
  SiRNA target sequence
tagatagatctcagtttgacttggta

SEQ ID NO: 137873 - DNA, 26 bp, Artificial sequence
  SiRNA target sequence
agatagatctcagtttgacttggtat

SEQ ID NO: 137874 - DNA, 26 bp, Artificial sequence
  SiRNA target sequence
gatagatctcagtttgacttggtatc

SEQ ID NO: 137875 - DNA, 26 bp, Artificial sequence
  SiRNA target sequence
atagatctcagtttgacttggtatct

SEQ ID NO: 137876 - DNA, 26 bp, Artificial sequence
  SiRNA target sequence
tagatctcagtttgacttggtatctg

SEQ ID NO: 137877 - DNA, 26 bp, Artificial sequence
  SiRNA target sequence
agatctcagtttgacttggtatctga

SEQ ID NO: 137878 - DNA, 26 bp, Artificial sequence
  SiRNA target sequence
gatctcagtttgacttggtatctgaa

SEQ ID NO: 137879 - DNA, 26 bp, Artificial sequence
  SiRNA target sequence
atctcagtttgacttggtatctgaag

SEQ ID NO: 137880 - DNA, 26 bp, Artificial sequence
  SiRNA target sequence
tctcagtttgacttggtatctgaagc

SEQ ID NO: 137881 - DNA, 26 bp, Artificial sequence
  SiRNA target sequence
ctcagtttgacttggtatctgaagca

SEQ ID NO: 137882 - DNA, 26 bp, Artificial sequence
  SiRNA target sequence
tcagtttgacttggtatctgaagcat

SEQ ID NO: 137883 - DNA, 26 bp, Artificial sequence
  SiRNA target sequence
cagtttgacttggtatctgaagcatt

SEQ ID NO: 137884 - DNA, 26 bp, Artificial sequence
  SiRNA target sequence
agtttgacttggtatctgaagcatta

SEQ ID NO: 137885 - DNA, 26 bp, Artificial sequence
  SiRNA target sequence
gtttgacttggtatctgaagcattaa

SEQ ID NO: 137886 - DNA, 26 bp, Artificial sequence
  SiRNA target sequence
tttgacttggtatctgaagcattaag

SEQ ID NO: 137887 - DNA, 26 bp, Artificial sequence
  SiRNA target sequence
ttgacttggtatctgaagcattaagt

SEQ ID NO: 137888 - DNA, 26 bp, Artificial sequence
  SiRNA target sequence
tgacttggtatctgaagcattaagtg

SEQ ID NO: 137889 - DNA, 26 bp, Artificial sequence
  SiRNA target sequence
gacttggtatctgaagcattaagtga

SEQ ID NO: 137890 - DNA, 26 bp, Artificial sequence
  SiRNA target sequence
acttggtatctgaagcattaagtgaa

SEQ ID NO: 137891 - DNA, 26 bp, Artificial sequence
  SiRNA target sequence
cttggtatctgaagcattaagtgaac

SEQ ID NO: 137892 - DNA, 26 bp, Artificial sequence
  SiRNA target sequence
ttggtatctgaagcattaagtgaacg

SEQ ID NO: 137893 - DNA, 26 bp, Artificial sequence
  SiRNA target sequence
tggtatctgaagcattaagtgaacga

SEQ ID NO: 137894 - DNA, 26 bp, Artificial sequence
  SiRNA target sequence
ggtatctgaagcattaagtgaacgaa

SEQ ID NO: 137895 - DNA, 26 bp, Artificial sequence
  SiRNA target sequence
gtatctgaagcattaagtgaacgaaa

SEQ ID NO: 137896 - DNA, 26 bp, Artificial sequence
  SiRNA target sequence
tatctgaagcattaagtgaacgaaaa

SEQ ID NO: 137897 - DNA, 26 bp, Artificial sequence
  SiRNA target sequence
atctgaagcattaagtgaacgaaaaa

SEQ ID NO: 137898 - DNA, 26 bp, Artificial sequence
  SiRNA target sequence
tctgaagcattaagtgaacgaaaaat

SEQ ID NO: 137899 - DNA, 26 bp, Artificial sequence
  SiRNA target sequence
ctgaagcattaagtgaacgaaaaatt

SEQ ID NO: 137900 - DNA, 26 bp, Artificial sequence
  SiRNA target sequence
tgaagcattaagtgaacgaaaaattg

SEQ ID NO: 137901 - DNA, 26 bp, Artificial sequence
  SiRNA target sequence
gaagcattaagtgaacgaaaaattgt

SEQ ID NO: 137902 - DNA, 26 bp, Artificial sequence
  SiRNA target sequence
aagcattaagtgaacgaaaaattgtt

SEQ ID NO: 137903 - DNA, 26 bp, Artificial sequence
  SiRNA target sequence
agcattaagtgaacgaaaaattgtta

SEQ ID NO: 137904 - DNA, 26 bp, Artificial sequence
  SiRNA target sequence
gcattaagtgaacgaaaaattgttat

SEQ ID NO: 137905 - DNA, 26 bp, Artificial sequence
  SiRNA target sequence
cattaagtgaacgaaaaattgttatg

SEQ ID NO: 137906 - DNA, 26 bp, Artificial sequence
  SiRNA target sequence
attaagtgaacgaaaaattgttatga

SEQ ID NO: 137907 - DNA, 26 bp, Artificial sequence
  SiRNA target sequence
ttaagtgaacgaaaaattgttatgaa

SEQ ID NO: 137908 - DNA, 26 bp, Artificial sequence
  SiRNA target sequence
taagtgaacgaaaaattgttatgaat

SEQ ID NO: 137909 - DNA, 26 bp, Artificial sequence
  SiRNA target sequence
aagtgaacgaaaaattgttatgaata

SEQ ID NO: 137910 - DNA, 26 bp, Artificial sequence
  SiRNA target sequence
agtgaacgaaaaattgttatgaatat

SEQ ID NO: 137911 - DNA, 26 bp, Artificial sequence
  SiRNA target sequence
gtgaacgaaaaattgttatgaatatg

SEQ ID NO: 137912 - DNA, 26 bp, Artificial sequence
  SiRNA target sequence
tgaacgaaaaattgttatgaatatgt

SEQ ID NO: 137913 - DNA, 26 bp, Artificial sequence
  SiRNA target sequence
gaacgaaaaattgttatgaatatgtg

SEQ ID NO: 137914 - DNA, 26 bp, Artificial sequence
  SiRNA target sequence
aacgaaaaattgttatgaatatgtgt

SEQ ID NO: 137915 - DNA, 26 bp, Artificial sequence
  SiRNA target sequence
acgaaaaattgttatgaatatgtgtc

SEQ ID NO: 137916 - DNA, 26 bp, Artificial sequence
  SiRNA target sequence
cgaaaaattgttatgaatatgtgtcc

SEQ ID NO: 137917 - DNA, 26 bp, Artificial sequence
  SiRNA target sequence
gaaaaattgttatgaatatgtgtcct

SEQ ID NO: 137918 - DNA, 26 bp, Artificial sequence
  SiRNA target sequence
aaaaattgttatgaatatgtgtcctt

SEQ ID NO: 137919 - DNA, 26 bp, Artificial sequence
  SiRNA target sequence
aaaattgttatgaatatgtgtccttt

SEQ ID NO: 137920 - DNA, 26 bp, Artificial sequence
  SiRNA target sequence
aaattgttatgaatatgtgtcctttt

SEQ ID NO: 137921 - DNA, 26 bp, Artificial sequence
  SiRNA target sequence
aattgttatgaatatgtgtccttttc

SEQ ID NO: 137922 - DNA, 26 bp, Artificial sequence
  SiRNA target sequence
attgttatgaatatgtgtccttttct

SEQ ID NO: 137923 - DNA, 26 bp, Artificial sequence
  SiRNA target sequence
ttgttatgaatatgtgtccttttcta

SEQ ID NO: 137924 - DNA, 26 bp, Artificial sequence
  SiRNA target sequence
tgttatgaatatgtgtccttttctag

SEQ ID NO: 137925 - DNA, 26 bp, Artificial sequence
  SiRNA target sequence
gttatgaatatgtgtccttttctagt

SEQ ID NO: 137926 - DNA, 26 bp, Artificial sequence
  SiRNA target sequence
ttatgaatatgtgtccttttctagta

SEQ ID NO: 137927 - DNA, 26 bp, Artificial sequence
  SiRNA target sequence
tatgaatatgtgtccttttctagtaa

SEQ ID NO: 137928 - DNA, 26 bp, Artificial sequence
  SiRNA target sequence
atgaatatgtgtccttttctagtaag

SEQ ID NO: 137929 - DNA, 26 bp, Artificial sequence
  SiRNA target sequence
tgaatatgtgtccttttctagtaagg

SEQ ID NO: 137930 - DNA, 26 bp, Artificial sequence
  SiRNA target sequence
gaatatgtgtccttttctagtaaggt

SEQ ID NO: 137931 - DNA, 26 bp, Artificial sequence
  SiRNA target sequence
aatatgtgtccttttctagtaaggtc

SEQ ID NO: 137932 - DNA, 26 bp, Artificial sequence
  SiRNA target sequence
atatgtgtccttttctagtaaggtcg

SEQ ID NO: 137933 - DNA, 26 bp, Artificial sequence
  SiRNA target sequence
tatgtgtccttttctagtaaggtcga

SEQ ID NO: 137934 - DNA, 26 bp, Artificial sequence
  SiRNA target sequence
atgtgtccttttctagtaaggtcgat

SEQ ID NO: 137935 - DNA, 26 bp, Artificial sequence
  SiRNA target sequence
tgtgtccttttctagtaaggtcgatg

SEQ ID NO: 137936 - DNA, 26 bp, Artificial sequence
  SiRNA target sequence
gtgtccttttctagtaaggtcgatgg

SEQ ID NO: 137937 - DNA, 26 bp, Artificial sequence
  SiRNA target sequence
tgtccttttctagtaaggtcgatgga

SEQ ID NO: 137938 - DNA, 26 bp, Artificial sequence
  SiRNA target sequence
gtccttttctagtaaggtcgatggaa

SEQ ID NO: 137939 - DNA, 26 bp, Artificial sequence
  SiRNA target sequence
tccttttctagtaaggtcgatggaaa

SEQ ID NO: 137940 - DNA, 26 bp, Artificial sequence
  SiRNA target sequence
ccttttctagtaaggtcgatggaaat

SEQ ID NO: 137941 - DNA, 26 bp, Artificial sequence
  SiRNA target sequence
cttttctagtaaggtcgatggaaata

SEQ ID NO: 137942 - DNA, 26 bp, Artificial sequence
  SiRNA target sequence
ttttctagtaaggtcgatggaaatat

SEQ ID NO: 137943 - DNA, 26 bp, Artificial sequence
  SiRNA target sequence
tttctagtaaggtcgatggaaatatt

SEQ ID NO: 137944 - DNA, 26 bp, Artificial sequence
  SiRNA target sequence
ttctagtaaggtcgatggaaatatta

SEQ ID NO: 137945 - DNA, 26 bp, Artificial sequence
  SiRNA target sequence
tctagtaaggtcgatggaaatattat

SEQ ID NO: 137946 - DNA, 26 bp, Artificial sequence
  SiRNA target sequence
ctagtaaggtcgatggaaatattatt

SEQ ID NO: 137947 - DNA, 26 bp, Artificial sequence
  SiRNA target sequence
tagtaaggtcgatggaaatattattt

SEQ ID NO: 137948 - DNA, 26 bp, Artificial sequence
  SiRNA target sequence
agtaaggtcgatggaaatattatttc

SEQ ID NO: 137949 - DNA, 26 bp, Artificial sequence
  SiRNA target sequence
gtaaggtcgatggaaatattatttcc

SEQ ID NO: 137950 - DNA, 26 bp, Artificial sequence
  SiRNA target sequence
taaggtcgatggaaatattatttccg

SEQ ID NO: 137951 - DNA, 26 bp, Artificial sequence
  SiRNA target sequence
aaggtcgatggaaatattatttccgg

SEQ ID NO: 137952 - DNA, 26 bp, Artificial sequence
  SiRNA target sequence
aggtcgatggaaatattatttccggt

SEQ ID NO: 137953 - DNA, 26 bp, Artificial sequence
  SiRNA target sequence
ggtcgatggaaatattatttccggtt

SEQ ID NO: 137954 - DNA, 26 bp, Artificial sequence
  SiRNA target sequence
gtcgatggaaatattatttccggttt

SEQ ID NO: 137955 - DNA, 26 bp, Artificial sequence
  SiRNA target sequence
tcgatggaaatattatttccggttta

SEQ ID NO: 137956 - DNA, 26 bp, Artificial sequence
  SiRNA target sequence
cgatggaaatattatttccggtttat

SEQ ID NO: 137957 - DNA, 26 bp, Artificial sequence
  SiRNA target sequence
gatggaaatattatttccggtttata

SEQ ID NO: 137958 - DNA, 26 bp, Artificial sequence
  SiRNA target sequence
atggaaatattatttccggtttataa

SEQ ID NO: 137959 - DNA, 26 bp, Artificial sequence
  SiRNA target sequence
tggaaatattatttccggtttataaa

SEQ ID NO: 137960 - DNA, 26 bp, Artificial sequence
  SiRNA target sequence
ggaaatattatttccggtttataaaa

SEQ ID NO: 137961 - DNA, 26 bp, Artificial sequence
  SiRNA target sequence
gaaatattatttccggtttataaaag

SEQ ID NO: 137962 - DNA, 26 bp, Artificial sequence
  SiRNA target sequence
aaatattatttccggtttataaaagg

SEQ ID NO: 137963 - DNA, 26 bp, Artificial sequence
  SiRNA target sequence
aatattatttccggtttataaaaggc

SEQ ID NO: 137964 - DNA, 26 bp, Artificial sequence
  SiRNA target sequence
atattatttccggtttataaaaggct

SEQ ID NO: 137965 - DNA, 26 bp, Artificial sequence
  SiRNA target sequence
tattatttccggtttataaaaggctt

SEQ ID NO: 137966 - DNA, 26 bp, Artificial sequence
  SiRNA target sequence
attatttccggtttataaaaggcttt

SEQ ID NO: 137967 - DNA, 26 bp, Artificial sequence
  SiRNA target sequence
ttatttccggtttataaaaggctttt

SEQ ID NO: 137968 - DNA, 26 bp, Artificial sequence
  SiRNA target sequence
tatttccggtttataaaaggctttta

SEQ ID NO: 137969 - DNA, 26 bp, Artificial sequence
  SiRNA target sequence
atttccggtttataaaaggcttttaa

SEQ ID NO: 137970 - DNA, 26 bp, Artificial sequence
  SiRNA target sequence
tttccggtttataaaaggcttttaat

SEQ ID NO: 137971 - DNA, 26 bp, Artificial sequence
  SiRNA target sequence
ttccggtttataaaaggcttttaatt

SEQ ID NO: 137972 - DNA, 26 bp, Artificial sequence
  SiRNA target sequence
tccggtttataaaaggcttttaattc

SEQ ID NO: 137973 - DNA, 26 bp, Artificial sequence
  SiRNA target sequence
ccggtttataaaaggcttttaattcc

SEQ ID NO: 137974 - DNA, 26 bp, Artificial sequence
  SiRNA target sequence
cggtttataaaaggcttttaattcct

SEQ ID NO: 137975 - DNA, 26 bp, Artificial sequence
  SiRNA target sequence
ggtttataaaaggcttttaattcctt

SEQ ID NO: 137976 - DNA, 26 bp, Artificial sequence
  SiRNA target sequence
gtttataaaaggcttttaattcctta

SEQ ID NO: 137977 - DNA, 26 bp, Artificial sequence
  SiRNA target sequence
tttataaaaggcttttaattccttac

SEQ ID NO: 137978 - DNA, 26 bp, Artificial sequence
  SiRNA target sequence
ttataaaaggcttttaattccttact

SEQ ID NO: 137979 - DNA, 26 bp, Artificial sequence
  SiRNA target sequence
tataaaaggcttttaattccttacta

SEQ ID NO: 137980 - DNA, 26 bp, Artificial sequence
  SiRNA target sequence
ataaaaggcttttaattccttactac

SEQ ID NO: 137981 - DNA, 26 bp, Artificial sequence
  SiRNA target sequence
taaaaggcttttaattccttactact

SEQ ID NO: 137982 - DNA, 26 bp, Artificial sequence
  SiRNA target sequence
aaaaggcttttaattccttactacta

SEQ ID NO: 137983 - DNA, 26 bp, Artificial sequence
  SiRNA target sequence
aaaggcttttaattccttactactat

SEQ ID NO: 137984 - DNA, 26 bp, Artificial sequence
  SiRNA target sequence
aaggcttttaattccttactactata

SEQ ID NO: 137985 - DNA, 26 bp, Artificial sequence
  SiRNA target sequence
aggcttttaattccttactactatat

SEQ ID NO: 137986 - DNA, 26 bp, Artificial sequence
  SiRNA target sequence
ggcttttaattccttactactatatt

SEQ ID NO: 137987 - DNA, 26 bp, Artificial sequence
  SiRNA target sequence
gcttttaattccttactactatattg

SEQ ID NO: 137988 - DNA, 26 bp, Artificial sequence
  SiRNA target sequence
cttttaattccttactactatattgg

SEQ ID NO: 137989 - DNA, 26 bp, Artificial sequence
  SiRNA target sequence
ttttaattccttactactatattggc

SEQ ID NO: 137990 - DNA, 26 bp, Artificial sequence
  SiRNA target sequence
tttaattccttactactatattggcc

SEQ ID NO: 137991 - DNA, 26 bp, Artificial sequence
  SiRNA target sequence
ttaattccttactactatattggcct

SEQ ID NO: 137992 - DNA, 26 bp, Artificial sequence
  SiRNA target sequence
taattccttactactatattggcctt

SEQ ID NO: 137993 - DNA, 26 bp, Artificial sequence
  SiRNA target sequence
aattccttactactatattggcctta

SEQ ID NO: 137994 - DNA, 26 bp, Artificial sequence
  SiRNA target sequence
attccttactactatattggccttaa

SEQ ID NO: 137995 - DNA, 26 bp, Artificial sequence
  SiRNA target sequence
ttccttactactatattggccttaaa

SEQ ID NO: 137996 - DNA, 26 bp, Artificial sequence
  SiRNA target sequence
tccttactactatattggccttaaat

SEQ ID NO: 137997 - DNA, 26 bp, Artificial sequence
  SiRNA target sequence
ccttactactatattggccttaaatt

SEQ ID NO: 137998 - DNA, 26 bp, Artificial sequence
  SiRNA target sequence
cttactactatattggccttaaattt

SEQ ID NO: 137999 - DNA, 26 bp, Artificial sequence
  SiRNA target sequence
ttactactatattggccttaaatttt

SEQ ID NO: 138000 - DNA, 26 bp, Artificial sequence
  SiRNA target sequence
tactactatattggccttaaatttta

SEQ ID NO: 138001 - DNA, 26 bp, Artificial sequence
  SiRNA target sequence
actactatattggccttaaattttat

SEQ ID NO: 138002 - DNA, 26 bp, Artificial sequence
  SiRNA target sequence
ctactatattggccttaaattttatg

SEQ ID NO: 138003 - DNA, 26 bp, Artificial sequence
  SiRNA target sequence
tactatattggccttaaattttatga

SEQ ID NO: 138004 - DNA, 26 bp, Artificial sequence
  SiRNA target sequence
actatattggccttaaattttatgat

SEQ ID NO: 138005 - DNA, 26 bp, Artificial sequence
  SiRNA target sequence
ctatattggccttaaattttatgatt

SEQ ID NO: 138006 - DNA, 26 bp, Artificial sequence
  SiRNA target sequence
tatattggccttaaattttatgattg

SEQ ID NO: 138007 - DNA, 26 bp, Artificial sequence
  SiRNA target sequence
atattggccttaaattttatgattgg

SEQ ID NO: 138008 - DNA, 26 bp, Artificial sequence
  SiRNA target sequence
tattggccttaaattttatgattgga

SEQ ID NO: 138009 - DNA, 26 bp, Artificial sequence
  SiRNA target sequence
attggccttaaattttatgattggat

SEQ ID NO: 138010 - DNA, 26 bp, Artificial sequence
  SiRNA target sequence
ttggccttaaattttatgattggatt

SEQ ID NO: 138011 - DNA, 26 bp, Artificial sequence
  SiRNA target sequence
tggccttaaattttatgattggattt

SEQ ID NO: 138012 - DNA, 26 bp, Artificial sequence
  SiRNA target sequence
ggccttaaattttatgattggatttc

SEQ ID NO: 138013 - DNA, 26 bp, Artificial sequence
  SiRNA target sequence
gccttaaattttatgattggatttct

SEQ ID NO: 138014 - DNA, 26 bp, Artificial sequence
  SiRNA target sequence
ccttaaattttatgattggatttctg

SEQ ID NO: 138015 - DNA, 26 bp, Artificial sequence
  SiRNA target sequence
cttaaattttatgattggatttctgg

SEQ ID NO: 138016 - DNA, 26 bp, Artificial sequence
  SiRNA target sequence
ttaaattttatgattggatttctggg

SEQ ID NO: 138017 - DNA, 26 bp, Artificial sequence
  SiRNA target sequence
taaattttatgattggatttctgggc

SEQ ID NO: 138018 - DNA, 26 bp, Artificial sequence
  SiRNA target sequence
aaattttatgattggatttctgggca

SEQ ID NO: 138019 - DNA, 26 bp, Artificial sequence
  SiRNA target sequence
aattttatgattggatttctgggcaa

SEQ ID NO: 138020 - DNA, 26 bp, Artificial sequence
  SiRNA target sequence
attttatgattggatttctgggcaac

SEQ ID NO: 138021 - DNA, 26 bp, Artificial sequence
  SiRNA target sequence
ttttatgattggatttctgggcaacg

SEQ ID NO: 138022 - DNA, 26 bp, Artificial sequence
  SiRNA target sequence
tttatgattggatttctgggcaacgg

SEQ ID NO: 138023 - DNA, 26 bp, Artificial sequence
  SiRNA target sequence
ttatgattggatttctgggcaacggt

SEQ ID NO: 138024 - DNA, 26 bp, Artificial sequence
  SiRNA target sequence
tatgattggatttctgggcaacggtc

SEQ ID NO: 138025 - DNA, 26 bp, Artificial sequence
  SiRNA target sequence
atgattggatttctgggcaacggtcc

SEQ ID NO: 138026 - DNA, 26 bp, Artificial sequence
  SiRNA target sequence
tgattggatttctgggcaacggtccc

SEQ ID NO: 138027 - DNA, 26 bp, Artificial sequence
  SiRNA target sequence
gattggatttctgggcaacggtccct

SEQ ID NO: 138028 - DNA, 26 bp, Artificial sequence
  SiRNA target sequence
attggatttctgggcaacggtccctt

SEQ ID NO: 138029 - DNA, 26 bp, Artificial sequence
  SiRNA target sequence
ttggatttctgggcaacggtcccttg

SEQ ID NO: 138030 - DNA, 26 bp, Artificial sequence
  SiRNA target sequence
tggatttctgggcaacggtcccttgg

SEQ ID NO: 138031 - DNA, 26 bp, Artificial sequence
  SiRNA target sequence
ggatttctgggcaacggtcccttggg

SEQ ID NO: 138032 - DNA, 26 bp, Artificial sequence
  SiRNA target sequence
gatttctgggcaacggtcccttgggc

SEQ ID NO: 138033 - DNA, 26 bp, Artificial sequence
  SiRNA target sequence
atttctgggcaacggtcccttgggcg

SEQ ID NO: 138034 - DNA, 26 bp, Artificial sequence
  SiRNA target sequence
tttctgggcaacggtcccttgggcga

SEQ ID NO: 138035 - DNA, 26 bp, Artificial sequence
  SiRNA target sequence
ttctgggcaacggtcccttgggcgaa

SEQ ID NO: 138036 - DNA, 26 bp, Artificial sequence
  SiRNA target sequence
tctgggcaacggtcccttgggcgaag

SEQ ID NO: 138037 - DNA, 26 bp, Artificial sequence
  SiRNA target sequence
ctgggcaacggtcccttgggcgaagt

SEQ ID NO: 138038 - DNA, 26 bp, Artificial sequence
  SiRNA target sequence
tgggcaacggtcccttgggcgaagta

SEQ ID NO: 138039 - DNA, 26 bp, Artificial sequence
  SiRNA target sequence
gggcaacggtcccttgggcgaagtaa

SEQ ID NO: 138040 - DNA, 26 bp, Artificial sequence
  SiRNA target sequence
ggcaacggtcccttgggcgaagtaaa

SEQ ID NO: 138041 - DNA, 26 bp, Artificial sequence
  SiRNA target sequence
gcaacggtcccttgggcgaagtaaat

SEQ ID NO: 138042 - DNA, 26 bp, Artificial sequence
  SiRNA target sequence
caacggtcccttgggcgaagtaaatt

SEQ ID NO: 138043 - DNA, 26 bp, Artificial sequence
  SiRNA target sequence
aacggtcccttgggcgaagtaaattt

SEQ ID NO: 138044 - DNA, 26 bp, Artificial sequence
  SiRNA target sequence
acggtcccttgggcgaagtaaatttt

SEQ ID NO: 138045 - DNA, 26 bp, Artificial sequence
  SiRNA target sequence
cggtcccttgggcgaagtaaattttt

SEQ ID NO: 138046 - DNA, 26 bp, Artificial sequence
  SiRNA target sequence
ggtcccttgggcgaagtaaatttttg

SEQ ID NO: 138047 - DNA, 26 bp, Artificial sequence
  SiRNA target sequence
gtcccttgggcgaagtaaatttttgt

SEQ ID NO: 138048 - DNA, 26 bp, Artificial sequence
  SiRNA target sequence
tcccttgggcgaagtaaatttttgtc

SEQ ID NO: 138049 - DNA, 26 bp, Artificial sequence
  SiRNA target sequence
cccttgggcgaagtaaatttttgtcg

SEQ ID NO: 138050 - DNA, 26 bp, Artificial sequence
  SiRNA target sequence
ccttgggcgaagtaaatttttgtcgc

SEQ ID NO: 138051 - DNA, 26 bp, Artificial sequence
  SiRNA target sequence
cttgggcgaagtaaatttttgtcgcg

SEQ ID NO: 138052 - DNA, 26 bp, Artificial sequence
  SiRNA target sequence
ttgggcgaagtaaatttttgtcgcgg

SEQ ID NO: 138053 - DNA, 26 bp, Artificial sequence
  SiRNA target sequence
tgggcgaagtaaatttttgtcgcggc

SEQ ID NO: 138054 - DNA, 26 bp, Artificial sequence
  SiRNA target sequence
gggcgaagtaaatttttgtcgcggca

SEQ ID NO: 138055 - DNA, 26 bp, Artificial sequence
  SiRNA target sequence
ggcgaagtaaatttttgtcgcggcaa

SEQ ID NO: 138056 - DNA, 26 bp, Artificial sequence
  SiRNA target sequence
gcgaagtaaatttttgtcgcggcaac

SEQ ID NO: 138057 - DNA, 26 bp, Artificial sequence
  SiRNA target sequence
cgaagtaaatttttgtcgcggcaaca

SEQ ID NO: 138058 - DNA, 26 bp, Artificial sequence
  SiRNA target sequence
gaagtaaatttttgtcgcggcaacaa

SEQ ID NO: 138059 - DNA, 26 bp, Artificial sequence
  SiRNA target sequence
aagtaaatttttgtcgcggcaacaaa

SEQ ID NO: 138060 - DNA, 26 bp, Artificial sequence
  SiRNA target sequence
agtaaatttttgtcgcggcaacaaac

SEQ ID NO: 138061 - DNA, 26 bp, Artificial sequence
  SiRNA target sequence
gtaaatttttgtcgcggcaacaaact

SEQ ID NO: 138062 - DNA, 26 bp, Artificial sequence
  SiRNA target sequence
taaatttttgtcgcggcaacaaacta

SEQ ID NO: 138063 - DNA, 26 bp, Artificial sequence
  SiRNA target sequence
aaatttttgtcgcggcaacaaactat

SEQ ID NO: 138064 - DNA, 26 bp, Artificial sequence
  SiRNA target sequence
aatttttgtcgcggcaacaaactatt

SEQ ID NO: 138065 - DNA, 26 bp, Artificial sequence
  SiRNA target sequence
atttttgtcgcggcaacaaactatta

SEQ ID NO: 138066 - DNA, 26 bp, Artificial sequence
  SiRNA target sequence
tttttgtcgcggcaacaaactattac

SEQ ID NO: 138067 - DNA, 26 bp, Artificial sequence
  SiRNA target sequence
ttttgtcgcggcaacaaactattaca

SEQ ID NO: 138068 - DNA, 26 bp, Artificial sequence
  SiRNA target sequence
tttgtcgcggcaacaaactattacaa

SEQ ID NO: 138069 - DNA, 26 bp, Artificial sequence
  SiRNA target sequence
ttgtcgcggcaacaaactattacaaa

SEQ ID NO: 138070 - DNA, 26 bp, Artificial sequence
  SiRNA target sequence
tgtcgcggcaacaaactattacaaaa

SEQ ID NO: 138071 - DNA, 26 bp, Artificial sequence
  SiRNA target sequence
gtcgcggcaacaaactattacaaaat

SEQ ID NO: 138072 - DNA, 26 bp, Artificial sequence
  SiRNA target sequence
tcgcggcaacaaactattacaaaatt

SEQ ID NO: 138073 - DNA, 26 bp, Artificial sequence
  SiRNA target sequence
cgcggcaacaaactattacaaaattt

SEQ ID NO: 138074 - DNA, 26 bp, Artificial sequence
  SiRNA target sequence
gcggcaacaaactattacaaaatttc

SEQ ID NO: 138075 - DNA, 26 bp, Artificial sequence
  SiRNA target sequence
cggcaacaaactattacaaaatttcc

SEQ ID NO: 138076 - DNA, 26 bp, Artificial sequence
  SiRNA target sequence
ggcaacaaactattacaaaatttcct

SEQ ID NO: 138077 - DNA, 26 bp, Artificial sequence
  SiRNA target sequence
gcaacaaactattacaaaatttccta

SEQ ID NO: 138078 - DNA, 26 bp, Artificial sequence
  SiRNA target sequence
caacaaactattacaaaatttcctaa

SEQ ID NO: 138079 - DNA, 26 bp, Artificial sequence
  SiRNA target sequence
aacaaactattacaaaatttcctaat

SEQ ID NO: 138080 - DNA, 26 bp, Artificial sequence
  SiRNA target sequence
acaaactattacaaaatttcctaatg

SEQ ID NO: 138081 - DNA, 26 bp, Artificial sequence
  SiRNA target sequence
caaactattacaaaatttcctaatgt

SEQ ID NO: 138082 - DNA, 26 bp, Artificial sequence
  SiRNA target sequence
aaactattacaaaatttcctaatgtg

SEQ ID NO: 138083 - DNA, 26 bp, Artificial sequence
  SiRNA target sequence
aactattacaaaatttcctaatgtga

SEQ ID NO: 138084 - DNA, 26 bp, Artificial sequence
  SiRNA target sequence
actattacaaaatttcctaatgtgag

SEQ ID NO: 138085 - DNA, 26 bp, Artificial sequence
  SiRNA target sequence
ctattacaaaatttcctaatgtgaga

SEQ ID NO: 138086 - DNA, 26 bp, Artificial sequence
  SiRNA target sequence
tattacaaaatttcctaatgtgagaa

SEQ ID NO: 138087 - DNA, 26 bp, Artificial sequence
  SiRNA target sequence
attacaaaatttcctaatgtgagaaa

SEQ ID NO: 138088 - DNA, 26 bp, Artificial sequence
  SiRNA target sequence
ttacaaaatttcctaatgtgagaaaa

SEQ ID NO: 138089 - DNA, 26 bp, Artificial sequence
  SiRNA target sequence
tacaaaatttcctaatgtgagaaaaa

SEQ ID NO: 138090 - DNA, 26 bp, Artificial sequence
  SiRNA target sequence
acaaaatttcctaatgtgagaaaaat

SEQ ID NO: 138091 - DNA, 26 bp, Artificial sequence
  SiRNA target sequence
caaaatttcctaatgtgagaaaaatc

SEQ ID NO: 138092 - DNA, 26 bp, Artificial sequence
  SiRNA target sequence
aaaatttcctaatgtgagaaaaatcg

SEQ ID NO: 138093 - DNA, 26 bp, Artificial sequence
  SiRNA target sequence
aaatttcctaatgtgagaaaaatcga

SEQ ID NO: 138094 - DNA, 26 bp, Artificial sequence
  SiRNA target sequence
aatttcctaatgtgagaaaaatcgac

SEQ ID NO: 138095 - DNA, 26 bp, Artificial sequence
  SiRNA target sequence
atttcctaatgtgagaaaaatcgacc

SEQ ID NO: 138096 - DNA, 26 bp, Artificial sequence
  SiRNA target sequence
tttcctaatgtgagaaaaatcgacct

SEQ ID NO: 138097 - DNA, 26 bp, Artificial sequence
  SiRNA target sequence
ttcctaatgtgagaaaaatcgacctt

SEQ ID NO: 138098 - DNA, 26 bp, Artificial sequence
  SiRNA target sequence
tcctaatgtgagaaaaatcgaccttg

SEQ ID NO: 138099 - DNA, 26 bp, Artificial sequence
  SiRNA target sequence
cctaatgtgagaaaaatcgaccttgt

SEQ ID NO: 138100 - DNA, 26 bp, Artificial sequence
  SiRNA target sequence
ctaatgtgagaaaaatcgaccttgta

SEQ ID NO: 138101 - DNA, 26 bp, Artificial sequence
  SiRNA target sequence
taatgtgagaaaaatcgaccttgtag

SEQ ID NO: 138102 - DNA, 26 bp, Artificial sequence
  SiRNA target sequence
aatgtgagaaaaatcgaccttgtagg

SEQ ID NO: 138103 - DNA, 26 bp, Artificial sequence
  SiRNA target sequence
atgtgagaaaaatcgaccttgtagga

SEQ ID NO: 138104 - DNA, 26 bp, Artificial sequence
  SiRNA target sequence
tgtgagaaaaatcgaccttgtaggat

SEQ ID NO: 138105 - DNA, 26 bp, Artificial sequence
  SiRNA target sequence
gtgagaaaaatcgaccttgtaggatc

SEQ ID NO: 138106 - DNA, 26 bp, Artificial sequence
  SiRNA target sequence
tgagaaaaatcgaccttgtaggatcc

SEQ ID NO: 138107 - DNA, 26 bp, Artificial sequence
  SiRNA target sequence
gagaaaaatcgaccttgtaggatccg

SEQ ID NO: 138108 - DNA, 26 bp, Artificial sequence
  SiRNA target sequence
agaaaaatcgaccttgtaggatccgt

SEQ ID NO: 138109 - DNA, 26 bp, Artificial sequence
  SiRNA target sequence
gaaaaatcgaccttgtaggatccgtt

SEQ ID NO: 138110 - DNA, 26 bp, Artificial sequence
  SiRNA target sequence
aaaaatcgaccttgtaggatccgttt

SEQ ID NO: 138111 - DNA, 26 bp, Artificial sequence
  SiRNA target sequence
aaaatcgaccttgtaggatccgtttc

SEQ ID NO: 138112 - DNA, 26 bp, Artificial sequence
  SiRNA target sequence
aaatcgaccttgtaggatccgtttcg

SEQ ID NO: 138113 - DNA, 26 bp, Artificial sequence
  SiRNA target sequence
aatcgaccttgtaggatccgtttcgt

SEQ ID NO: 138114 - DNA, 26 bp, Artificial sequence
  SiRNA target sequence
atcgaccttgtaggatccgtttcgta

SEQ ID NO: 138115 - DNA, 26 bp, Artificial sequence
  SiRNA target sequence
tcgaccttgtaggatccgtttcgtat

SEQ ID NO: 138116 - DNA, 26 bp, Artificial sequence
  SiRNA target sequence
cgaccttgtaggatccgtttcgtatc

SEQ ID NO: 138117 - DNA, 26 bp, Artificial sequence
  SiRNA target sequence
gaccttgtaggatccgtttcgtatcg

SEQ ID NO: 138118 - DNA, 26 bp, Artificial sequence
  SiRNA target sequence
accttgtaggatccgtttcgtatcgt

SEQ ID NO: 138119 - DNA, 26 bp, Artificial sequence
  SiRNA target sequence
ccttgtaggatccgtttcgtatcgtg

SEQ ID NO: 138120 - DNA, 26 bp, Artificial sequence
  SiRNA target sequence
cttgtaggatccgtttcgtatcgtga

SEQ ID NO: 138121 - DNA, 26 bp, Artificial sequence
  SiRNA target sequence
ttgtaggatccgtttcgtatcgtgat

SEQ ID NO: 138122 - DNA, 26 bp, Artificial sequence
  SiRNA target sequence
tgtaggatccgtttcgtatcgtgatg

SEQ ID NO: 138123 - DNA, 26 bp, Artificial sequence
  SiRNA target sequence
gtaggatccgtttcgtatcgtgatgg

SEQ ID NO: 138124 - DNA, 26 bp, Artificial sequence
  SiRNA target sequence
taggatccgtttcgtatcgtgatggc

SEQ ID NO: 138125 - DNA, 26 bp, Artificial sequence
  SiRNA target sequence
aggatccgtttcgtatcgtgatggcc

SEQ ID NO: 138126 - DNA, 26 bp, Artificial sequence
  SiRNA target sequence
ggatccgtttcgtatcgtgatggcca

SEQ ID NO: 138127 - DNA, 26 bp, Artificial sequence
  SiRNA target sequence
gatccgtttcgtatcgtgatggccaa

SEQ ID NO: 138128 - DNA, 26 bp, Artificial sequence
  SiRNA target sequence
atccgtttcgtatcgtgatggccaat

SEQ ID NO: 138129 - DNA, 26 bp, Artificial sequence
  SiRNA target sequence
tccgtttcgtatcgtgatggccaatt

SEQ ID NO: 138130 - DNA, 26 bp, Artificial sequence
  SiRNA target sequence
ccgtttcgtatcgtgatggccaattt

SEQ ID NO: 138131 - DNA, 26 bp, Artificial sequence
  SiRNA target sequence
cgtttcgtatcgtgatggccaatttt

SEQ ID NO: 138132 - DNA, 26 bp, Artificial sequence
  SiRNA target sequence
gtttcgtatcgtgatggccaatttta

SEQ ID NO: 138133 - DNA, 26 bp, Artificial sequence
  SiRNA target sequence
tttcgtatcgtgatggccaattttat

SEQ ID NO: 138134 - DNA, 26 bp, Artificial sequence
  SiRNA target sequence
ttcgtatcgtgatggccaattttatg

SEQ ID NO: 138135 - DNA, 26 bp, Artificial sequence
  SiRNA target sequence
tcgtatcgtgatggccaattttatga

SEQ ID NO: 138136 - DNA, 26 bp, Artificial sequence
  SiRNA target sequence
cgtatcgtgatggccaattttatgat

SEQ ID NO: 138137 - DNA, 26 bp, Artificial sequence
  SiRNA target sequence
gtatcgtgatggccaattttatgatg

SEQ ID NO: 138138 - DNA, 26 bp, Artificial sequence
  SiRNA target sequence
tatcgtgatggccaattttatgatgc

SEQ ID NO: 138139 - DNA, 26 bp, Artificial sequence
  SiRNA target sequence
atcgtgatggccaattttatgatgct

SEQ ID NO: 138140 - DNA, 26 bp, Artificial sequence
  SiRNA target sequence
tcgtgatggccaattttatgatgcta

SEQ ID NO: 138141 - DNA, 26 bp, Artificial sequence
  SiRNA target sequence
cgtgatggccaattttatgatgctaa

SEQ ID NO: 138142 - DNA, 26 bp, Artificial sequence
  SiRNA target sequence
gtgatggccaattttatgatgctaaa

SEQ ID NO: 138143 - DNA, 26 bp, Artificial sequence
  SiRNA target sequence
tgatggccaattttatgatgctaaat

SEQ ID NO: 138144 - DNA, 26 bp, Artificial sequence
  SiRNA target sequence
gatggccaattttatgatgctaaata

SEQ ID NO: 138145 - DNA, 26 bp, Artificial sequence
  SiRNA target sequence
atggccaattttatgatgctaaatac

SEQ ID NO: 138146 - DNA, 26 bp, Artificial sequence
  SiRNA target sequence
tggccaattttatgatgctaaataca

SEQ ID NO: 138147 - DNA, 26 bp, Artificial sequence
  SiRNA target sequence
ggccaattttatgatgctaaatacaa

SEQ ID NO: 138148 - DNA, 26 bp, Artificial sequence
  SiRNA target sequence
gccaattttatgatgctaaatacaat

SEQ ID NO: 138149 - DNA, 26 bp, Artificial sequence
  SiRNA target sequence
ccaattttatgatgctaaatacaatg

SEQ ID NO: 138150 - DNA, 26 bp, Artificial sequence
  SiRNA target sequence
caattttatgatgctaaatacaatgt

SEQ ID NO: 138151 - DNA, 26 bp, Artificial sequence
  SiRNA target sequence
aattttatgatgctaaatacaatgtt

SEQ ID NO: 138152 - DNA, 26 bp, Artificial sequence
  SiRNA target sequence
attttatgatgctaaatacaatgttc

SEQ ID NO: 138153 - DNA, 26 bp, Artificial sequence
  SiRNA target sequence
ttttatgatgctaaatacaatgttct

SEQ ID NO: 138154 - DNA, 26 bp, Artificial sequence
  SiRNA target sequence
tttatgatgctaaatacaatgttcta

SEQ ID NO: 138155 - DNA, 26 bp, Artificial sequence
  SiRNA target sequence
ttatgatgctaaatacaatgttctat

SEQ ID NO: 138156 - DNA, 26 bp, Artificial sequence
  SiRNA target sequence
tatgatgctaaatacaatgttctatt

SEQ ID NO: 138157 - DNA, 26 bp, Artificial sequence
  SiRNA target sequence
atgatgctaaatacaatgttctattg

SEQ ID NO: 138158 - DNA, 26 bp, Artificial sequence
  SiRNA target sequence
tgatgctaaatacaatgttctattgg

SEQ ID NO: 138159 - DNA, 26 bp, Artificial sequence
  SiRNA target sequence
gatgctaaatacaatgttctattggg

SEQ ID NO: 138160 - DNA, 26 bp, Artificial sequence
  SiRNA target sequence
atgctaaatacaatgttctattgggt

SEQ ID NO: 138161 - DNA, 26 bp, Artificial sequence
  SiRNA target sequence
tgctaaatacaatgttctattgggtg

SEQ ID NO: 138162 - DNA, 26 bp, Artificial sequence
  SiRNA target sequence
gctaaatacaatgttctattgggtgt

SEQ ID NO: 138163 - DNA, 26 bp, Artificial sequence
  SiRNA target sequence
ctaaatacaatgttctattgggtgtc

SEQ ID NO: 138164 - DNA, 26 bp, Artificial sequence
  SiRNA target sequence
taaatacaatgttctattgggtgtca

SEQ ID NO: 138165 - DNA, 26 bp, Artificial sequence
  SiRNA target sequence
aaatacaatgttctattgggtgtcac

SEQ ID NO: 138166 - DNA, 26 bp, Artificial sequence
  SiRNA target sequence
aatacaatgttctattgggtgtcaca

SEQ ID NO: 138167 - DNA, 26 bp, Artificial sequence
  SiRNA target sequence
atacaatgttctattgggtgtcacag

SEQ ID NO: 138168 - DNA, 26 bp, Artificial sequence
  SiRNA target sequence
tacaatgttctattgggtgtcacagc

SEQ ID NO: 138169 - DNA, 26 bp, Artificial sequence
  SiRNA target sequence
acaatgttctattgggtgtcacagct

SEQ ID NO: 138170 - DNA, 26 bp, Artificial sequence
  SiRNA target sequence
caatgttctattgggtgtcacagcta

SEQ ID NO: 138171 - DNA, 26 bp, Artificial sequence
  SiRNA target sequence
aatgttctattgggtgtcacagctac

SEQ ID NO: 138172 - DNA, 26 bp, Artificial sequence
  SiRNA target sequence
atgttctattgggtgtcacagctacc

SEQ ID NO: 138173 - DNA, 26 bp, Artificial sequence
  SiRNA target sequence
tgttctattgggtgtcacagctacct

SEQ ID NO: 138174 - DNA, 26 bp, Artificial sequence
  SiRNA target sequence
gttctattgggtgtcacagctaccta

SEQ ID NO: 138175 - DNA, 26 bp, Artificial sequence
  SiRNA target sequence
ttctattgggtgtcacagctacctac

SEQ ID NO: 138176 - DNA, 26 bp, Artificial sequence
  SiRNA target sequence
tctattgggtgtcacagctacctact

SEQ ID NO: 138177 - DNA, 26 bp, Artificial sequence
  SiRNA target sequence
ctattgggtgtcacagctacctacta

SEQ ID NO: 138178 - DNA, 26 bp, Artificial sequence
  SiRNA target sequence
tattgggtgtcacagctacctactat

SEQ ID NO: 138179 - DNA, 26 bp, Artificial sequence
  SiRNA target sequence
attgggtgtcacagctacctactatg

SEQ ID NO: 138180 - DNA, 26 bp, Artificial sequence
  SiRNA target sequence
ttgggtgtcacagctacctactatgg

SEQ ID NO: 138181 - DNA, 26 bp, Artificial sequence
  SiRNA target sequence
tgggtgtcacagctacctactatgga

SEQ ID NO: 138182 - DNA, 26 bp, Artificial sequence
  SiRNA target sequence
gggtgtcacagctacctactatggag

SEQ ID NO: 138183 - DNA, 26 bp, Artificial sequence
  SiRNA target sequence
ggtgtcacagctacctactatggagc

SEQ ID NO: 138184 - DNA, 26 bp, Artificial sequence
  SiRNA target sequence
gtgtcacagctacctactatggagct

SEQ ID NO: 138185 - DNA, 26 bp, Artificial sequence
  SiRNA target sequence
tgtcacagctacctactatggagctg

SEQ ID NO: 138186 - DNA, 26 bp, Artificial sequence
  SiRNA target sequence
gtcacagctacctactatggagctgt

SEQ ID NO: 138187 - DNA, 26 bp, Artificial sequence
  SiRNA target sequence
tcacagctacctactatggagctgtt

SEQ ID NO: 138188 - DNA, 26 bp, Artificial sequence
  SiRNA target sequence
cacagctacctactatggagctgttg

SEQ ID NO: 138189 - DNA, 26 bp, Artificial sequence
  SiRNA target sequence
acagctacctactatggagctgttgt

SEQ ID NO: 138190 - DNA, 26 bp, Artificial sequence
  SiRNA target sequence
cagctacctactatggagctgttgta

SEQ ID NO: 138191 - DNA, 26 bp, Artificial sequence
  SiRNA target sequence
agctacctactatggagctgttgtat

SEQ ID NO: 138192 - DNA, 26 bp, Artificial sequence
  SiRNA target sequence
gctacctactatggagctgttgtatt

SEQ ID NO: 138193 - DNA, 26 bp, Artificial sequence
  SiRNA target sequence
ctacctactatggagctgttgtatta

SEQ ID NO: 138194 - DNA, 26 bp, Artificial sequence
  SiRNA target sequence
tacctactatggagctgttgtattaa

SEQ ID NO: 138195 - DNA, 26 bp, Artificial sequence
  SiRNA target sequence
acctactatggagctgttgtattaaa

SEQ ID NO: 138196 - DNA, 26 bp, Artificial sequence
  SiRNA target sequence
cctactatggagctgttgtattaaat

SEQ ID NO: 138197 - DNA, 26 bp, Artificial sequence
  SiRNA target sequence
ctactatggagctgttgtattaaatc

SEQ ID NO: 138198 - DNA, 26 bp, Artificial sequence
  SiRNA target sequence
tactatggagctgttgtattaaatca

SEQ ID NO: 138199 - DNA, 26 bp, Artificial sequence
  SiRNA target sequence
actatggagctgttgtattaaatcat

SEQ ID NO: 138200 - DNA, 26 bp, Artificial sequence
  SiRNA target sequence
ctatggagctgttgtattaaatcatg

SEQ ID NO: 138201 - DNA, 26 bp, Artificial sequence
  SiRNA target sequence
tatggagctgttgtattaaatcatgc

SEQ ID NO: 138202 - DNA, 26 bp, Artificial sequence
  SiRNA target sequence
atggagctgttgtattaaatcatgca

SEQ ID NO: 138203 - DNA, 26 bp, Artificial sequence
  SiRNA target sequence
tggagctgttgtattaaatcatgcaa

SEQ ID NO: 138204 - DNA, 26 bp, Artificial sequence
  SiRNA target sequence
ggagctgttgtattaaatcatgcaaa

SEQ ID NO: 138205 - DNA, 26 bp, Artificial sequence
  SiRNA target sequence
gagctgttgtattaaatcatgcaaaa

SEQ ID NO: 138206 - DNA, 26 bp, Artificial sequence
  SiRNA target sequence
agctgttgtattaaatcatgcaaaat

SEQ ID NO: 138207 - DNA, 26 bp, Artificial sequence
  SiRNA target sequence
gctgttgtattaaatcatgcaaaatt

SEQ ID NO: 138208 - DNA, 26 bp, Artificial sequence
  SiRNA target sequence
ctgttgtattaaatcatgcaaaattc

SEQ ID NO: 138209 - DNA, 26 bp, Artificial sequence
  SiRNA target sequence
tgttgtattaaatcatgcaaaattct

SEQ ID NO: 138210 - DNA, 26 bp, Artificial sequence
  SiRNA target sequence
gttgtattaaatcatgcaaaattctt

SEQ ID NO: 138211 - DNA, 26 bp, Artificial sequence
  SiRNA target sequence
ttgtattaaatcatgcaaaattcttg

SEQ ID NO: 138212 - DNA, 26 bp, Artificial sequence
  SiRNA target sequence
tgtattaaatcatgcaaaattcttgt

SEQ ID NO: 138213 - DNA, 26 bp, Artificial sequence
  SiRNA target sequence
gtattaaatcatgcaaaattcttgtc

SEQ ID NO: 138214 - DNA, 26 bp, Artificial sequence
  SiRNA target sequence
tattaaatcatgcaaaattcttgtca

SEQ ID NO: 138215 - DNA, 26 bp, Artificial sequence
  SiRNA target sequence
attaaatcatgcaaaattcttgtcag

SEQ ID NO: 138216 - DNA, 26 bp, Artificial sequence
  SiRNA target sequence
ttaaatcatgcaaaattcttgtcagt

SEQ ID NO: 138217 - DNA, 26 bp, Artificial sequence
  SiRNA target sequence
taaatcatgcaaaattcttgtcagta

SEQ ID NO: 138218 - DNA, 26 bp, Artificial sequence
  SiRNA target sequence
aaatcatgcaaaattcttgtcagtaa

SEQ ID NO: 138219 - DNA, 26 bp, Artificial sequence
  SiRNA target sequence
aatcatgcaaaattcttgtcagtaac

SEQ ID NO: 138220 - DNA, 26 bp, Artificial sequence
  SiRNA target sequence
atcatgcaaaattcttgtcagtaaca

SEQ ID NO: 138221 - DNA, 26 bp, Artificial sequence
  SiRNA target sequence
tcatgcaaaattcttgtcagtaacaa

SEQ ID NO: 138222 - DNA, 26 bp, Artificial sequence
  SiRNA target sequence
catgcaaaattcttgtcagtaacaaa

SEQ ID NO: 138223 - DNA, 26 bp, Artificial sequence
  SiRNA target sequence
atgcaaaattcttgtcagtaacaaaa

SEQ ID NO: 138224 - DNA, 26 bp, Artificial sequence
  SiRNA target sequence
tgcaaaattcttgtcagtaacaaaag

SEQ ID NO: 138225 - DNA, 26 bp, Artificial sequence
  SiRNA target sequence
gcaaaattcttgtcagtaacaaaaga

SEQ ID NO: 138226 - DNA, 26 bp, Artificial sequence
  SiRNA target sequence
caaaattcttgtcagtaacaaaagat

SEQ ID NO: 138227 - DNA, 26 bp, Artificial sequence
  SiRNA target sequence
aaaattcttgtcagtaacaaaagatg

SEQ ID NO: 138228 - DNA, 26 bp, Artificial sequence
  SiRNA target sequence
aaattcttgtcagtaacaaaagatgg

SEQ ID NO: 138229 - DNA, 26 bp, Artificial sequence
  SiRNA target sequence
aattcttgtcagtaacaaaagatggc

SEQ ID NO: 138230 - DNA, 26 bp, Artificial sequence
  SiRNA target sequence
attcttgtcagtaacaaaagatggcg

SEQ ID NO: 138231 - DNA, 26 bp, Artificial sequence
  SiRNA target sequence
ttcttgtcagtaacaaaagatggcga

SEQ ID NO: 138232 - DNA, 26 bp, Artificial sequence
  SiRNA target sequence
tcttgtcagtaacaaaagatggcgat

SEQ ID NO: 138233 - DNA, 26 bp, Artificial sequence
  SiRNA target sequence
cttgtcagtaacaaaagatggcgata

SEQ ID NO: 138234 - DNA, 26 bp, Artificial sequence
  SiRNA target sequence
ttgtcagtaacaaaagatggcgataa

SEQ ID NO: 138235 - DNA, 26 bp, Artificial sequence
  SiRNA target sequence
tgtcagtaacaaaagatggcgataaa

SEQ ID NO: 138236 - DNA, 26 bp, Artificial sequence
  SiRNA target sequence
gtcagtaacaaaagatggcgataaaa

SEQ ID NO: 138237 - DNA, 26 bp, Artificial sequence
  SiRNA target sequence
tcagtaacaaaagatggcgataaaat

SEQ ID NO: 138238 - DNA, 26 bp, Artificial sequence
  SiRNA target sequence
cagtaacaaaagatggcgataaaatt

SEQ ID NO: 138239 - DNA, 26 bp, Artificial sequence
  SiRNA target sequence
agtaacaaaagatggcgataaaatta

SEQ ID NO: 138240 - DNA, 26 bp, Artificial sequence
  SiRNA target sequence
gtaacaaaagatggcgataaaattaa

SEQ ID NO: 138241 - DNA, 26 bp, Artificial sequence
  SiRNA target sequence
taacaaaagatggcgataaaattaat

SEQ ID NO: 138242 - DNA, 26 bp, Artificial sequence
  SiRNA target sequence
aacaaaagatggcgataaaattaatg

SEQ ID NO: 138243 - DNA, 26 bp, Artificial sequence
  SiRNA target sequence
acaaaagatggcgataaaattaatgg

SEQ ID NO: 138244 - DNA, 26 bp, Artificial sequence
  SiRNA target sequence
caaaagatggcgataaaattaatgga

SEQ ID NO: 138245 - DNA, 26 bp, Artificial sequence
  SiRNA target sequence
aaaagatggcgataaaattaatggaa

SEQ ID NO: 138246 - DNA, 26 bp, Artificial sequence
  SiRNA target sequence
aaagatggcgataaaattaatggaat

SEQ ID NO: 138247 - DNA, 26 bp, Artificial sequence
  SiRNA target sequence
aagatggcgataaaattaatggaatt

SEQ ID NO: 138248 - DNA, 26 bp, Artificial sequence
  SiRNA target sequence
agatggcgataaaattaatggaatta

SEQ ID NO: 138249 - DNA, 26 bp, Artificial sequence
  SiRNA target sequence
gatggcgataaaattaatggaattaa

SEQ ID NO: 138250 - DNA, 26 bp, Artificial sequence
  SiRNA target sequence
atggcgataaaattaatggaattaaa

SEQ ID NO: 138251 - DNA, 26 bp, Artificial sequence
  SiRNA target sequence
tggcgataaaattaatggaattaaat

SEQ ID NO: 138252 - DNA, 26 bp, Artificial sequence
  SiRNA target sequence
ggcgataaaattaatggaattaaatg

SEQ ID NO: 138253 - DNA, 26 bp, Artificial sequence
  SiRNA target sequence
gcgataaaattaatggaattaaatgt

SEQ ID NO: 138254 - DNA, 26 bp, Artificial sequence
  SiRNA target sequence
cgataaaattaatggaattaaatgtc

SEQ ID NO: 138255 - DNA, 26 bp, Artificial sequence
  SiRNA target sequence
gataaaattaatggaattaaatgtca

SEQ ID NO: 138256 - DNA, 26 bp, Artificial sequence
  SiRNA target sequence
ataaaattaatggaattaaatgtcaa

SEQ ID NO: 138257 - DNA, 26 bp, Artificial sequence
  SiRNA target sequence
taaaattaatggaattaaatgtcaag

SEQ ID NO: 138258 - DNA, 26 bp, Artificial sequence
  SiRNA target sequence
aaaattaatggaattaaatgtcaaga

SEQ ID NO: 138259 - DNA, 26 bp, Artificial sequence
  SiRNA target sequence
aaattaatggaattaaatgtcaagat

SEQ ID NO: 138260 - DNA, 26 bp, Artificial sequence
  SiRNA target sequence
aattaatggaattaaatgtcaagatt

SEQ ID NO: 138261 - DNA, 26 bp, Artificial sequence
  SiRNA target sequence
attaatggaattaaatgtcaagattc

SEQ ID NO: 138262 - DNA, 26 bp, Artificial sequence
  SiRNA target sequence
ttaatggaattaaatgtcaagattca

SEQ ID NO: 138263 - DNA, 26 bp, Artificial sequence
  SiRNA target sequence
taatggaattaaatgtcaagattcaa

SEQ ID NO: 138264 - DNA, 26 bp, Artificial sequence
  SiRNA target sequence
aatggaattaaatgtcaagattcaat

SEQ ID NO: 138265 - DNA, 26 bp, Artificial sequence
  SiRNA target sequence
atggaattaaatgtcaagattcaata

SEQ ID NO: 138266 - DNA, 26 bp, Artificial sequence
  SiRNA target sequence
tggaattaaatgtcaagattcaataa

SEQ ID NO: 138267 - DNA, 26 bp, Artificial sequence
  SiRNA target sequence
ggaattaaatgtcaagattcaataaa

SEQ ID NO: 138268 - DNA, 26 bp, Artificial sequence
  SiRNA target sequence
gaattaaatgtcaagattcaataaat

SEQ ID NO: 138269 - DNA, 26 bp, Artificial sequence
  SiRNA target sequence
aattaaatgtcaagattcaataaata

SEQ ID NO: 138270 - DNA, 26 bp, Artificial sequence
  SiRNA target sequence
attaaatgtcaagattcaataaataa

SEQ ID NO: 138271 - DNA, 26 bp, Artificial sequence
  SiRNA target sequence
ttaaatgtcaagattcaataaataat

SEQ ID NO: 138272 - DNA, 26 bp, Artificial sequence
  SiRNA target sequence
taaatgtcaagattcaataaataatg

SEQ ID NO: 138273 - DNA, 26 bp, Artificial sequence
  SiRNA target sequence
aaatgtcaagattcaataaataatga

SEQ ID NO: 138274 - DNA, 26 bp, Artificial sequence
  SiRNA target sequence
aatgtcaagattcaataaataatgaa

SEQ ID NO: 138275 - DNA, 26 bp, Artificial sequence
  SiRNA target sequence
atgtcaagattcaataaataatgaaa

SEQ ID NO: 138276 - DNA, 26 bp, Artificial sequence
  SiRNA target sequence
tgtcaagattcaataaataatgaaaa

SEQ ID NO: 138277 - DNA, 26 bp, Artificial sequence
  SiRNA target sequence
gtcaagattcaataaataatgaaaaa

SEQ ID NO: 138278 - DNA, 26 bp, Artificial sequence
  SiRNA target sequence
tcaagattcaataaataatgaaaaat

SEQ ID NO: 138279 - DNA, 26 bp, Artificial sequence
  SiRNA target sequence
caagattcaataaataatgaaaaatt

SEQ ID NO: 138280 - DNA, 26 bp, Artificial sequence
  SiRNA target sequence
aagattcaataaataatgaaaaattt

SEQ ID NO: 138281 - DNA, 26 bp, Artificial sequence
  SiRNA target sequence
agattcaataaataatgaaaaatttt

SEQ ID NO: 138282 - DNA, 26 bp, Artificial sequence
  SiRNA target sequence
gattcaataaataatgaaaaattttt

SEQ ID NO: 138283 - DNA, 26 bp, Artificial sequence
  SiRNA target sequence
attcaataaataatgaaaaattttta

SEQ ID NO: 138284 - DNA, 26 bp, Artificial sequence
  SiRNA target sequence
ttcaataaataatgaaaaatttttaa

SEQ ID NO: 138285 - DNA, 26 bp, Artificial sequence
  SiRNA target sequence
tcaataaataatgaaaaatttttaat

SEQ ID NO: 138286 - DNA, 26 bp, Artificial sequence
  SiRNA target sequence
caataaataatgaaaaatttttaatt

SEQ ID NO: 138287 - DNA, 26 bp, Artificial sequence
  SiRNA target sequence
aataaataatgaaaaatttttaatta

SEQ ID NO: 138288 - DNA, 26 bp, Artificial sequence
  SiRNA target sequence
ataaataatgaaaaatttttaattag

SEQ ID NO: 138289 - DNA, 26 bp, Artificial sequence
  SiRNA target sequence
taaataatgaaaaatttttaattagg

SEQ ID NO: 138290 - DNA, 26 bp, Artificial sequence
  SiRNA target sequence
aaataatgaaaaatttttaattaggt

SEQ ID NO: 138291 - DNA, 26 bp, Artificial sequence
  SiRNA target sequence
aataatgaaaaatttttaattaggtg

SEQ ID NO: 138292 - DNA, 26 bp, Artificial sequence
  SiRNA target sequence
ataatgaaaaatttttaattaggtgt

SEQ ID NO: 138293 - DNA, 26 bp, Artificial sequence
  SiRNA target sequence
taatgaaaaatttttaattaggtgta

SEQ ID NO: 138294 - DNA, 26 bp, Artificial sequence
  SiRNA target sequence
aatgaaaaatttttaattaggtgtaa

SEQ ID NO: 138295 - DNA, 26 bp, Artificial sequence
  SiRNA target sequence
atgaaaaatttttaattaggtgtaaa

SEQ ID NO: 138296 - DNA, 26 bp, Artificial sequence
  SiRNA target sequence
tgaaaaatttttaattaggtgtaaag

SEQ ID NO: 138297 - DNA, 26 bp, Artificial sequence
  SiRNA target sequence
gaaaaatttttaattaggtgtaaagt

SEQ ID NO: 138298 - DNA, 26 bp, Artificial sequence
  SiRNA target sequence
aaaaatttttaattaggtgtaaagtt

SEQ ID NO: 138299 - DNA, 26 bp, Artificial sequence
  SiRNA target sequence
aaaatttttaattaggtgtaaagttt

SEQ ID NO: 138300 - DNA, 26 bp, Artificial sequence
  SiRNA target sequence
aaatttttaattaggtgtaaagtttt

SEQ ID NO: 138301 - DNA, 26 bp, Artificial sequence
  SiRNA target sequence
aatttttaattaggtgtaaagtttta

SEQ ID NO: 138302 - DNA, 26 bp, Artificial sequence
  SiRNA target sequence
atttttaattaggtgtaaagttttaa

SEQ ID NO: 138303 - DNA, 26 bp, Artificial sequence
  SiRNA target sequence
tttttaattaggtgtaaagttttaat

SEQ ID NO: 138304 - DNA, 26 bp, Artificial sequence
  SiRNA target sequence
ttttaattaggtgtaaagttttaata

SEQ ID NO: 138305 - DNA, 26 bp, Artificial sequence
  SiRNA target sequence
tttaattaggtgtaaagttttaataa

SEQ ID NO: 138306 - DNA, 26 bp, Artificial sequence
  SiRNA target sequence
ttaattaggtgtaaagttttaataaa

SEQ ID NO: 138307 - DNA, 26 bp, Artificial sequence
  SiRNA target sequence
taattaggtgtaaagttttaataaat

SEQ ID NO: 138308 - DNA, 26 bp, Artificial sequence
  SiRNA target sequence
aattaggtgtaaagttttaataaata

SEQ ID NO: 138309 - DNA, 26 bp, Artificial sequence
  SiRNA target sequence
attaggtgtaaagttttaataaatac

SEQ ID NO: 138310 - DNA, 26 bp, Artificial sequence
  SiRNA target sequence
ttaggtgtaaagttttaataaatact

SEQ ID NO: 138311 - DNA, 26 bp, Artificial sequence
  SiRNA target sequence
taggtgtaaagttttaataaatactt

SEQ ID NO: 138312 - DNA, 26 bp, Artificial sequence
  SiRNA target sequence
aggtgtaaagttttaataaatacttc

SEQ ID NO: 138313 - DNA, 26 bp, Artificial sequence
  SiRNA target sequence
ggtgtaaagttttaataaatacttct

SEQ ID NO: 138314 - DNA, 26 bp, Artificial sequence
  SiRNA target sequence
gtgtaaagttttaataaatacttctg

SEQ ID NO: 138315 - DNA, 26 bp, Artificial sequence
  SiRNA target sequence
tgtaaagttttaataaatacttctgg

SEQ ID NO: 138316 - DNA, 26 bp, Artificial sequence
  SiRNA target sequence
gtaaagttttaataaatacttctggc

SEQ ID NO: 138317 - DNA, 26 bp, Artificial sequence
  SiRNA target sequence
taaagttttaataaatacttctggcc

SEQ ID NO: 138318 - DNA, 26 bp, Artificial sequence
  SiRNA target sequence
aaagttttaataaatacttctggccc

SEQ ID NO: 138319 - DNA, 26 bp, Artificial sequence
  SiRNA target sequence
aagttttaataaatacttctggccct

SEQ ID NO: 138320 - DNA, 26 bp, Artificial sequence
  SiRNA target sequence
agttttaataaatacttctggccctt

SEQ ID NO: 138321 - DNA, 26 bp, Artificial sequence
  SiRNA target sequence
gttttaataaatacttctggcccttt

SEQ ID NO: 138322 - DNA, 26 bp, Artificial sequence
  SiRNA target sequence
ttttaataaatacttctggccctttt

SEQ ID NO: 138323 - DNA, 26 bp, Artificial sequence
  SiRNA target sequence
tttaataaatacttctggcccttttg

SEQ ID NO: 138324 - DNA, 26 bp, Artificial sequence
  SiRNA target sequence
ttaataaatacttctggcccttttgc

SEQ ID NO: 138325 - DNA, 26 bp, Artificial sequence
  SiRNA target sequence
taataaatacttctggcccttttgct

SEQ ID NO: 138326 - DNA, 26 bp, Artificial sequence
  SiRNA target sequence
aataaatacttctggcccttttgctg

SEQ ID NO: 138327 - DNA, 26 bp, Artificial sequence
  SiRNA target sequence
ataaatacttctggcccttttgctga

SEQ ID NO: 138328 - DNA, 26 bp, Artificial sequence
  SiRNA target sequence
taaatacttctggcccttttgctgac

SEQ ID NO: 138329 - DNA, 26 bp, Artificial sequence
  SiRNA target sequence
aaatacttctggcccttttgctgacg

SEQ ID NO: 138330 - DNA, 26 bp, Artificial sequence
  SiRNA target sequence
aatacttctggcccttttgctgacga

SEQ ID NO: 138331 - DNA, 26 bp, Artificial sequence
  SiRNA target sequence
atacttctggcccttttgctgacgag

SEQ ID NO: 138332 - DNA, 26 bp, Artificial sequence
  SiRNA target sequence
tacttctggcccttttgctgacgagg

SEQ ID NO: 138333 - DNA, 26 bp, Artificial sequence
  SiRNA target sequence
acttctggcccttttgctgacgaggt

SEQ ID NO: 138334 - DNA, 26 bp, Artificial sequence
  SiRNA target sequence
cttctggcccttttgctgacgaggtt

SEQ ID NO: 138335 - DNA, 26 bp, Artificial sequence
  SiRNA target sequence
ttctggcccttttgctgacgaggttc

SEQ ID NO: 138336 - DNA, 26 bp, Artificial sequence
  SiRNA target sequence
tctggcccttttgctgacgaggttcg

SEQ ID NO: 138337 - DNA, 26 bp, Artificial sequence
  SiRNA target sequence
ctggcccttttgctgacgaggttcga

SEQ ID NO: 138338 - DNA, 26 bp, Artificial sequence
  SiRNA target sequence
tggcccttttgctgacgaggttcgaa

SEQ ID NO: 138339 - DNA, 26 bp, Artificial sequence
  SiRNA target sequence
ggcccttttgctgacgaggttcgaaa

SEQ ID NO: 138340 - DNA, 26 bp, Artificial sequence
  SiRNA target sequence
gcccttttgctgacgaggttcgaaat

SEQ ID NO: 138341 - DNA, 26 bp, Artificial sequence
  SiRNA target sequence
cccttttgctgacgaggttcgaaata

SEQ ID NO: 138342 - DNA, 26 bp, Artificial sequence
  SiRNA target sequence
ccttttgctgacgaggttcgaaatac

SEQ ID NO: 138343 - DNA, 26 bp, Artificial sequence
  SiRNA target sequence
cttttgctgacgaggttcgaaataca

SEQ ID NO: 138344 - DNA, 26 bp, Artificial sequence
  SiRNA target sequence
ttttgctgacgaggttcgaaatacat

SEQ ID NO: 138345 - DNA, 26 bp, Artificial sequence
  SiRNA target sequence
tttgctgacgaggttcgaaatacatc

SEQ ID NO: 138346 - DNA, 26 bp, Artificial sequence
  SiRNA target sequence
ttgctgacgaggttcgaaatacatca

SEQ ID NO: 138347 - DNA, 26 bp, Artificial sequence
  SiRNA target sequence
tgctgacgaggttcgaaatacatcaa

SEQ ID NO: 138348 - DNA, 26 bp, Artificial sequence
  SiRNA target sequence
gctgacgaggttcgaaatacatcaat

SEQ ID NO: 138349 - DNA, 26 bp, Artificial sequence
  SiRNA target sequence
ctgacgaggttcgaaatacatcaatt

SEQ ID NO: 138350 - DNA, 26 bp, Artificial sequence
  SiRNA target sequence
tgacgaggttcgaaatacatcaattg

SEQ ID NO: 138351 - DNA, 26 bp, Artificial sequence
  SiRNA target sequence
gacgaggttcgaaatacatcaattga

SEQ ID NO: 138352 - DNA, 26 bp, Artificial sequence
  SiRNA target sequence
acgaggttcgaaatacatcaattgaa

SEQ ID NO: 138353 - DNA, 26 bp, Artificial sequence
  SiRNA target sequence
cgaggttcgaaatacatcaattgaaa

SEQ ID NO: 138354 - DNA, 26 bp, Artificial sequence
  SiRNA target sequence
gaggttcgaaatacatcaattgaaaa

SEQ ID NO: 138355 - DNA, 26 bp, Artificial sequence
  SiRNA target sequence
aggttcgaaatacatcaattgaaaac

SEQ ID NO: 138356 - DNA, 26 bp, Artificial sequence
  SiRNA target sequence
ggttcgaaatacatcaattgaaaact

SEQ ID NO: 138357 - DNA, 26 bp, Artificial sequence
  SiRNA target sequence
gttcgaaatacatcaattgaaaactg

SEQ ID NO: 138358 - DNA, 26 bp, Artificial sequence
  SiRNA target sequence
ttcgaaatacatcaattgaaaactgt

SEQ ID NO: 138359 - DNA, 26 bp, Artificial sequence
  SiRNA target sequence
tcgaaatacatcaattgaaaactgtc

SEQ ID NO: 138360 - DNA, 26 bp, Artificial sequence
  SiRNA target sequence
cgaaatacatcaattgaaaactgtca

SEQ ID NO: 138361 - DNA, 26 bp, Artificial sequence
  SiRNA target sequence
gaaatacatcaattgaaaactgtcaa

SEQ ID NO: 138362 - DNA, 26 bp, Artificial sequence
  SiRNA target sequence
aaatacatcaattgaaaactgtcaac

SEQ ID NO: 138363 - DNA, 26 bp, Artificial sequence
  SiRNA target sequence
aatacatcaattgaaaactgtcaacc

SEQ ID NO: 138364 - DNA, 26 bp, Artificial sequence
  SiRNA target sequence
atacatcaattgaaaactgtcaacca

SEQ ID NO: 138365 - DNA, 26 bp, Artificial sequence
  SiRNA target sequence
tacatcaattgaaaactgtcaaccaa

SEQ ID NO: 138366 - DNA, 26 bp, Artificial sequence
  SiRNA target sequence
acatcaattgaaaactgtcaaccaat

SEQ ID NO: 138367 - DNA, 26 bp, Artificial sequence
  SiRNA target sequence
catcaattgaaaactgtcaaccaata

SEQ ID NO: 138368 - DNA, 26 bp, Artificial sequence
  SiRNA target sequence
atcaattgaaaactgtcaaccaatac

SEQ ID NO: 138369 - DNA, 26 bp, Artificial sequence
  SiRNA target sequence
tcaattgaaaactgtcaaccaatact

SEQ ID NO: 138370 - DNA, 26 bp, Artificial sequence
  SiRNA target sequence
caattgaaaactgtcaaccaatactc

SEQ ID NO: 138371 - DNA, 26 bp, Artificial sequence
  SiRNA target sequence
aattgaaaactgtcaaccaatactcc

SEQ ID NO: 138372 - DNA, 26 bp, Artificial sequence
  SiRNA target sequence
attgaaaactgtcaaccaatactcca

SEQ ID NO: 138373 - DNA, 26 bp, Artificial sequence
  SiRNA target sequence
ttgaaaactgtcaaccaatactccaa

SEQ ID NO: 138374 - DNA, 26 bp, Artificial sequence
  SiRNA target sequence
tgaaaactgtcaaccaatactccaac

SEQ ID NO: 138375 - DNA, 26 bp, Artificial sequence
  SiRNA target sequence
gaaaactgtcaaccaatactccaaca

SEQ ID NO: 138376 - DNA, 26 bp, Artificial sequence
  SiRNA target sequence
aaaactgtcaaccaatactccaacat

SEQ ID NO: 138377 - DNA, 26 bp, Artificial sequence
  SiRNA target sequence
aaactgtcaaccaatactccaacata

SEQ ID NO: 138378 - DNA, 26 bp, Artificial sequence
  SiRNA target sequence
aactgtcaaccaatactccaacatag

SEQ ID NO: 138379 - DNA, 26 bp, Artificial sequence
  SiRNA target sequence
actgtcaaccaatactccaacatagt

SEQ ID NO: 138380 - DNA, 26 bp, Artificial sequence
  SiRNA target sequence
ctgtcaaccaatactccaacatagtt

SEQ ID NO: 138381 - DNA, 26 bp, Artificial sequence
  SiRNA target sequence
tgtcaaccaatactccaacatagtta

SEQ ID NO: 138382 - DNA, 26 bp, Artificial sequence
  SiRNA target sequence
gtcaaccaatactccaacatagttat

SEQ ID NO: 138383 - DNA, 26 bp, Artificial sequence
  SiRNA target sequence
tcaaccaatactccaacatagttatg

SEQ ID NO: 138384 - DNA, 26 bp, Artificial sequence
  SiRNA target sequence
caaccaatactccaacatagttatgg

SEQ ID NO: 138385 - DNA, 26 bp, Artificial sequence
  SiRNA target sequence
aaccaatactccaacatagttatggt

SEQ ID NO: 138386 - DNA, 26 bp, Artificial sequence
  SiRNA target sequence
accaatactccaacatagttatggta

SEQ ID NO: 138387 - DNA, 26 bp, Artificial sequence
  SiRNA target sequence
ccaatactccaacatagttatggtac

SEQ ID NO: 138388 - DNA, 26 bp, Artificial sequence
  SiRNA target sequence
caatactccaacatagttatggtaca

SEQ ID NO: 138389 - DNA, 26 bp, Artificial sequence
  SiRNA target sequence
aatactccaacatagttatggtacac

SEQ ID NO: 138390 - DNA, 26 bp, Artificial sequence
  SiRNA target sequence
atactccaacatagttatggtacaca

SEQ ID NO: 138391 - DNA, 26 bp, Artificial sequence
  SiRNA target sequence
tactccaacatagttatggtacacat

SEQ ID NO: 138392 - DNA, 26 bp, Artificial sequence
  SiRNA target sequence
actccaacatagttatggtacacata

SEQ ID NO: 138393 - DNA, 26 bp, Artificial sequence
  SiRNA target sequence
ctccaacatagttatggtacacatat

SEQ ID NO: 138394 - DNA, 26 bp, Artificial sequence
  SiRNA target sequence
tccaacatagttatggtacacatatt

SEQ ID NO: 138395 - DNA, 26 bp, Artificial sequence
  SiRNA target sequence
ccaacatagttatggtacacatattg

SEQ ID NO: 138396 - DNA, 26 bp, Artificial sequence
  SiRNA target sequence
caacatagttatggtacacatattgt

SEQ ID NO: 138397 - DNA, 26 bp, Artificial sequence
  SiRNA target sequence
aacatagttatggtacacatattgta

SEQ ID NO: 138398 - DNA, 26 bp, Artificial sequence
  SiRNA target sequence
acatagttatggtacacatattgtag

SEQ ID NO: 138399 - DNA, 26 bp, Artificial sequence
  SiRNA target sequence
catagttatggtacacatattgtagt

SEQ ID NO: 138400 - DNA, 26 bp, Artificial sequence
  SiRNA target sequence
atagttatggtacacatattgtagtt

SEQ ID NO: 138401 - DNA, 26 bp, Artificial sequence
  SiRNA target sequence
tagttatggtacacatattgtagttc

SEQ ID NO: 138402 - DNA, 26 bp, Artificial sequence
  SiRNA target sequence
agttatggtacacatattgtagttcc

SEQ ID NO: 138403 - DNA, 26 bp, Artificial sequence
  SiRNA target sequence
gttatggtacacatattgtagttcct

SEQ ID NO: 138404 - DNA, 26 bp, Artificial sequence
  SiRNA target sequence
ttatggtacacatattgtagttcctg

SEQ ID NO: 138405 - DNA, 26 bp, Artificial sequence
  SiRNA target sequence
tatggtacacatattgtagttcctgc

SEQ ID NO: 138406 - DNA, 26 bp, Artificial sequence
  SiRNA target sequence
atggtacacatattgtagttcctgcg

SEQ ID NO: 138407 - DNA, 26 bp, Artificial sequence
  SiRNA target sequence
tggtacacatattgtagttcctgcga

SEQ ID NO: 138408 - DNA, 26 bp, Artificial sequence
  SiRNA target sequence
ggtacacatattgtagttcctgcgat

SEQ ID NO: 138409 - DNA, 26 bp, Artificial sequence
  SiRNA target sequence
gtacacatattgtagttcctgcgata

SEQ ID NO: 138410 - DNA, 26 bp, Artificial sequence
  SiRNA target sequence
tacacatattgtagttcctgcgatat

SEQ ID NO: 138411 - DNA, 26 bp, Artificial sequence
  SiRNA target sequence
acacatattgtagttcctgcgatatt

SEQ ID NO: 138412 - DNA, 26 bp, Artificial sequence
  SiRNA target sequence
cacatattgtagttcctgcgatattt

SEQ ID NO: 138413 - DNA, 26 bp, Artificial sequence
  SiRNA target sequence
acatattgtagttcctgcgatatttt

SEQ ID NO: 138414 - DNA, 26 bp, Artificial sequence
  SiRNA target sequence
catattgtagttcctgcgatattttc

SEQ ID NO: 138415 - DNA, 26 bp, Artificial sequence
  SiRNA target sequence
atattgtagttcctgcgatattttcg

SEQ ID NO: 138416 - DNA, 26 bp, Artificial sequence
  SiRNA target sequence
tattgtagttcctgcgatattttcgc

SEQ ID NO: 138417 - DNA, 26 bp, Artificial sequence
  SiRNA target sequence
attgtagttcctgcgatattttcgcc

SEQ ID NO: 138418 - DNA, 26 bp, Artificial sequence
  SiRNA target sequence
ttgtagttcctgcgatattttcgcct

SEQ ID NO: 138419 - DNA, 26 bp, Artificial sequence
  SiRNA target sequence
tgtagttcctgcgatattttcgccta

SEQ ID NO: 138420 - DNA, 26 bp, Artificial sequence
  SiRNA target sequence
gtagttcctgcgatattttcgcctaa

SEQ ID NO: 138421 - DNA, 26 bp, Artificial sequence
  SiRNA target sequence
tagttcctgcgatattttcgcctaaa

SEQ ID NO: 138422 - DNA, 26 bp, Artificial sequence
  SiRNA target sequence
agttcctgcgatattttcgcctaaaa

SEQ ID NO: 138423 - DNA, 26 bp, Artificial sequence
  SiRNA target sequence
gttcctgcgatattttcgcctaaaaa

SEQ ID NO: 138424 - DNA, 26 bp, Artificial sequence
  SiRNA target sequence
ttcctgcgatattttcgcctaaaaat

SEQ ID NO: 138425 - DNA, 26 bp, Artificial sequence
  SiRNA target sequence
tcctgcgatattttcgcctaaaaata

SEQ ID NO: 138426 - DNA, 26 bp, Artificial sequence
  SiRNA target sequence
cctgcgatattttcgcctaaaaatat

SEQ ID NO: 138427 - DNA, 26 bp, Artificial sequence
  SiRNA target sequence
ctgcgatattttcgcctaaaaatatg

SEQ ID NO: 138428 - DNA, 26 bp, Artificial sequence
  SiRNA target sequence
tgcgatattttcgcctaaaaatatgg

SEQ ID NO: 138429 - DNA, 26 bp, Artificial sequence
  SiRNA target sequence
gcgatattttcgcctaaaaatatggg

SEQ ID NO: 138430 - DNA, 26 bp, Artificial sequence
  SiRNA target sequence
cgatattttcgcctaaaaatatgggc

SEQ ID NO: 138431 - DNA, 26 bp, Artificial sequence
  SiRNA target sequence
gatattttcgcctaaaaatatgggct

SEQ ID NO: 138432 - DNA, 26 bp, Artificial sequence
  SiRNA target sequence
atattttcgcctaaaaatatgggctt

SEQ ID NO: 138433 - DNA, 26 bp, Artificial sequence
  SiRNA target sequence
tattttcgcctaaaaatatgggcttt

SEQ ID NO: 138434 - DNA, 26 bp, Artificial sequence
  SiRNA target sequence
attttcgcctaaaaatatgggctttg

SEQ ID NO: 138435 - DNA, 26 bp, Artificial sequence
  SiRNA target sequence
ttttcgcctaaaaatatgggctttgt

SEQ ID NO: 138436 - DNA, 26 bp, Artificial sequence
  SiRNA target sequence
tttcgcctaaaaatatgggctttgtt

SEQ ID NO: 138437 - DNA, 26 bp, Artificial sequence
  SiRNA target sequence
ttcgcctaaaaatatgggctttgttg

SEQ ID NO: 138438 - DNA, 26 bp, Artificial sequence
  SiRNA target sequence
tcgcctaaaaatatgggctttgttga

SEQ ID NO: 138439 - DNA, 26 bp, Artificial sequence
  SiRNA target sequence
cgcctaaaaatatgggctttgttgat

SEQ ID NO: 138440 - DNA, 26 bp, Artificial sequence
  SiRNA target sequence
gcctaaaaatatgggctttgttgatc

SEQ ID NO: 138441 - DNA, 26 bp, Artificial sequence
  SiRNA target sequence
cctaaaaatatgggctttgttgatcc

SEQ ID NO: 138442 - DNA, 26 bp, Artificial sequence
  SiRNA target sequence
ctaaaaatatgggctttgttgatcca

SEQ ID NO: 138443 - DNA, 26 bp, Artificial sequence
  SiRNA target sequence
taaaaatatgggctttgttgatccaa

SEQ ID NO: 138444 - DNA, 26 bp, Artificial sequence
  SiRNA target sequence
aaaaatatgggctttgttgatccaag

SEQ ID NO: 138445 - DNA, 26 bp, Artificial sequence
  SiRNA target sequence
aaaatatgggctttgttgatccaagc

SEQ ID NO: 138446 - DNA, 26 bp, Artificial sequence
  SiRNA target sequence
aaatatgggctttgttgatccaagca

SEQ ID NO: 138447 - DNA, 26 bp, Artificial sequence
  SiRNA target sequence
aatatgggctttgttgatccaagcac

SEQ ID NO: 138448 - DNA, 26 bp, Artificial sequence
  SiRNA target sequence
atatgggctttgttgatccaagcacg

SEQ ID NO: 138449 - DNA, 26 bp, Artificial sequence
  SiRNA target sequence
tatgggctttgttgatccaagcacga

SEQ ID NO: 138450 - DNA, 26 bp, Artificial sequence
  SiRNA target sequence
atgggctttgttgatccaagcacgag

SEQ ID NO: 138451 - DNA, 26 bp, Artificial sequence
  SiRNA target sequence
tgggctttgttgatccaagcacgagt

SEQ ID NO: 138452 - DNA, 26 bp, Artificial sequence
  SiRNA target sequence
gggctttgttgatccaagcacgagtg

SEQ ID NO: 138453 - DNA, 26 bp, Artificial sequence
  SiRNA target sequence
ggctttgttgatccaagcacgagtga

SEQ ID NO: 138454 - DNA, 26 bp, Artificial sequence
  SiRNA target sequence
gctttgttgatccaagcacgagtgat

SEQ ID NO: 138455 - DNA, 26 bp, Artificial sequence
  SiRNA target sequence
ctttgttgatccaagcacgagtgatg

SEQ ID NO: 138456 - DNA, 26 bp, Artificial sequence
  SiRNA target sequence
tttgttgatccaagcacgagtgatgg

SEQ ID NO: 138457 - DNA, 26 bp, Artificial sequence
  SiRNA target sequence
ttgttgatccaagcacgagtgatgga

SEQ ID NO: 138458 - DNA, 26 bp, Artificial sequence
  SiRNA target sequence
tgttgatccaagcacgagtgatggaa

SEQ ID NO: 138459 - DNA, 26 bp, Artificial sequence
  SiRNA target sequence
gttgatccaagcacgagtgatggaag

SEQ ID NO: 138460 - DNA, 26 bp, Artificial sequence
  SiRNA target sequence
ttgatccaagcacgagtgatggaaga

SEQ ID NO: 138461 - DNA, 26 bp, Artificial sequence
  SiRNA target sequence
tgatccaagcacgagtgatggaagaa

SEQ ID NO: 138462 - DNA, 26 bp, Artificial sequence
  SiRNA target sequence
gatccaagcacgagtgatggaagaat

SEQ ID NO: 138463 - DNA, 26 bp, Artificial sequence
  SiRNA target sequence
atccaagcacgagtgatggaagaatc

SEQ ID NO: 138464 - DNA, 26 bp, Artificial sequence
  SiRNA target sequence
tccaagcacgagtgatggaagaatcg

SEQ ID NO: 138465 - DNA, 26 bp, Artificial sequence
  SiRNA target sequence
ccaagcacgagtgatggaagaatcgc

SEQ ID NO: 138466 - DNA, 26 bp, Artificial sequence
  SiRNA target sequence
caagcacgagtgatggaagaatcgca

SEQ ID NO: 138467 - DNA, 26 bp, Artificial sequence
  SiRNA target sequence
aagcacgagtgatggaagaatcgcat

SEQ ID NO: 138468 - DNA, 26 bp, Artificial sequence
  SiRNA target sequence
agcacgagtgatggaagaatcgcatt

SEQ ID NO: 138469 - DNA, 26 bp, Artificial sequence
  SiRNA target sequence
gcacgagtgatggaagaatcgcattt

SEQ ID NO: 138470 - DNA, 26 bp, Artificial sequence
  SiRNA target sequence
cacgagtgatggaagaatcgcatttt

SEQ ID NO: 138471 - DNA, 26 bp, Artificial sequence
  SiRNA target sequence
acgagtgatggaagaatcgcattttt

SEQ ID NO: 138472 - DNA, 26 bp, Artificial sequence
  SiRNA target sequence
cgagtgatggaagaatcgcatttttt

SEQ ID NO: 138473 - DNA, 26 bp, Artificial sequence
  SiRNA target sequence
gagtgatggaagaatcgcatttttta

SEQ ID NO: 138474 - DNA, 26 bp, Artificial sequence
  SiRNA target sequence
agtgatggaagaatcgcattttttat

SEQ ID NO: 138475 - DNA, 26 bp, Artificial sequence
  SiRNA target sequence
gtgatggaagaatcgcattttttatg

SEQ ID NO: 138476 - DNA, 26 bp, Artificial sequence
  SiRNA target sequence
tgatggaagaatcgcattttttatga

SEQ ID NO: 138477 - DNA, 26 bp, Artificial sequence
  SiRNA target sequence
gatggaagaatcgcattttttatgaa

SEQ ID NO: 138478 - DNA, 26 bp, Artificial sequence
  SiRNA target sequence
atggaagaatcgcattttttatgaat

SEQ ID NO: 138479 - DNA, 26 bp, Artificial sequence
  SiRNA target sequence
tggaagaatcgcattttttatgaatt

SEQ ID NO: 138480 - DNA, 26 bp, Artificial sequence
  SiRNA target sequence
ggaagaatcgcattttttatgaattt

SEQ ID NO: 138481 - DNA, 26 bp, Artificial sequence
  SiRNA target sequence
gaagaatcgcattttttatgaatttt

SEQ ID NO: 138482 - DNA, 26 bp, Artificial sequence
  SiRNA target sequence
aagaatcgcattttttatgaatttta

SEQ ID NO: 138483 - DNA, 26 bp, Artificial sequence
  SiRNA target sequence
agaatcgcattttttatgaattttaa

SEQ ID NO: 138484 - DNA, 26 bp, Artificial sequence
  SiRNA target sequence
gaatcgcattttttatgaattttaaa

SEQ ID NO: 138485 - DNA, 26 bp, Artificial sequence
  SiRNA target sequence
aatcgcattttttatgaattttaaag

SEQ ID NO: 138486 - DNA, 26 bp, Artificial sequence
  SiRNA target sequence
atcgcattttttatgaattttaaagg

SEQ ID NO: 138487 - DNA, 26 bp, Artificial sequence
  SiRNA target sequence
tcgcattttttatgaattttaaaggt

SEQ ID NO: 138488 - DNA, 26 bp, Artificial sequence
  SiRNA target sequence
cgcattttttatgaattttaaaggta

SEQ ID NO: 138489 - DNA, 26 bp, Artificial sequence
  SiRNA target sequence
gcattttttatgaattttaaaggtaa

SEQ ID NO: 138490 - DNA, 26 bp, Artificial sequence
  SiRNA target sequence
cattttttatgaattttaaaggtaaa

SEQ ID NO: 138491 - DNA, 26 bp, Artificial sequence
  SiRNA target sequence
attttttatgaattttaaaggtaaaa

SEQ ID NO: 138492 - DNA, 26 bp, Artificial sequence
  SiRNA target sequence
ttttttatgaattttaaaggtaaaac

SEQ ID NO: 138493 - DNA, 26 bp, Artificial sequence
  SiRNA target sequence
tttttatgaattttaaaggtaaaaca

SEQ ID NO: 138494 - DNA, 26 bp, Artificial sequence
  SiRNA target sequence
ttttatgaattttaaaggtaaaacat

SEQ ID NO: 138495 - DNA, 26 bp, Artificial sequence
  SiRNA target sequence
tttatgaattttaaaggtaaaacatt

SEQ ID NO: 138496 - DNA, 26 bp, Artificial sequence
  SiRNA target sequence
ttatgaattttaaaggtaaaacattg

SEQ ID NO: 138497 - DNA, 26 bp, Artificial sequence
  SiRNA target sequence
tatgaattttaaaggtaaaacattga

SEQ ID NO: 138498 - DNA, 26 bp, Artificial sequence
  SiRNA target sequence
atgaattttaaaggtaaaacattgat

SEQ ID NO: 138499 - DNA, 26 bp, Artificial sequence
  SiRNA target sequence
tgaattttaaaggtaaaacattgatt

SEQ ID NO: 138500 - DNA, 26 bp, Artificial sequence
  SiRNA target sequence
gaattttaaaggtaaaacattgattg

SEQ ID NO: 138501 - DNA, 26 bp, Artificial sequence
  SiRNA target sequence
aattttaaaggtaaaacattgattgg

SEQ ID NO: 138502 - DNA, 26 bp, Artificial sequence
  SiRNA target sequence
attttaaaggtaaaacattgattgga

SEQ ID NO: 138503 - DNA, 26 bp, Artificial sequence
  SiRNA target sequence
ttttaaaggtaaaacattgattggag

SEQ ID NO: 138504 - DNA, 26 bp, Artificial sequence
  SiRNA target sequence
tttaaaggtaaaacattgattggagg

SEQ ID NO: 138505 - DNA, 26 bp, Artificial sequence
  SiRNA target sequence
ttaaaggtaaaacattgattggagga

SEQ ID NO: 138506 - DNA, 26 bp, Artificial sequence
  SiRNA target sequence
taaaggtaaaacattgattggaggaa

SEQ ID NO: 138507 - DNA, 26 bp, Artificial sequence
  SiRNA target sequence
aaaggtaaaacattgattggaggaac

SEQ ID NO: 138508 - DNA, 26 bp, Artificial sequence
  SiRNA target sequence
aaggtaaaacattgattggaggaaca

SEQ ID NO: 138509 - DNA, 26 bp, Artificial sequence
  SiRNA target sequence
aggtaaaacattgattggaggaacag

SEQ ID NO: 138510 - DNA, 26 bp, Artificial sequence
  SiRNA target sequence
ggtaaaacattgattggaggaacaga

SEQ ID NO: 138511 - DNA, 26 bp, Artificial sequence
  SiRNA target sequence
gtaaaacattgattggaggaacagat

SEQ ID NO: 138512 - DNA, 26 bp, Artificial sequence
  SiRNA target sequence
taaaacattgattggaggaacagatg

SEQ ID NO: 138513 - DNA, 26 bp, Artificial sequence
  SiRNA target sequence
aaaacattgattggaggaacagatgt

SEQ ID NO: 138514 - DNA, 26 bp, Artificial sequence
  SiRNA target sequence
aaacattgattggaggaacagatgtt

SEQ ID NO: 138515 - DNA, 26 bp, Artificial sequence
  SiRNA target sequence
aacattgattggaggaacagatgtta

SEQ ID NO: 138516 - DNA, 26 bp, Artificial sequence
  SiRNA target sequence
acattgattggaggaacagatgttaa

SEQ ID NO: 138517 - DNA, 26 bp, Artificial sequence
  SiRNA target sequence
cattgattggaggaacagatgttaag

SEQ ID NO: 138518 - DNA, 26 bp, Artificial sequence
  SiRNA target sequence
attgattggaggaacagatgttaagt

SEQ ID NO: 138519 - DNA, 26 bp, Artificial sequence
  SiRNA target sequence
ttgattggaggaacagatgttaagtg

SEQ ID NO: 138520 - DNA, 26 bp, Artificial sequence
  SiRNA target sequence
tgattggaggaacagatgttaagtgt

SEQ ID NO: 138521 - DNA, 26 bp, Artificial sequence
  SiRNA target sequence
gattggaggaacagatgttaagtgta

SEQ ID NO: 138522 - DNA, 26 bp, Artificial sequence
  SiRNA target sequence
attggaggaacagatgttaagtgtaa

SEQ ID NO: 138523 - DNA, 26 bp, Artificial sequence
  SiRNA target sequence
ttggaggaacagatgttaagtgtaaa

SEQ ID NO: 138524 - DNA, 26 bp, Artificial sequence
  SiRNA target sequence
tggaggaacagatgttaagtgtaaag

SEQ ID NO: 138525 - DNA, 26 bp, Artificial sequence
  SiRNA target sequence
ggaggaacagatgttaagtgtaaagt

SEQ ID NO: 138526 - DNA, 26 bp, Artificial sequence
  SiRNA target sequence
gaggaacagatgttaagtgtaaagtt

SEQ ID NO: 138527 - DNA, 26 bp, Artificial sequence
  SiRNA target sequence
aggaacagatgttaagtgtaaagttg

SEQ ID NO: 138528 - DNA, 26 bp, Artificial sequence
  SiRNA target sequence
ggaacagatgttaagtgtaaagttga

SEQ ID NO: 138529 - DNA, 26 bp, Artificial sequence
  SiRNA target sequence
gaacagatgttaagtgtaaagttgaa

SEQ ID NO: 138530 - DNA, 26 bp, Artificial sequence
  SiRNA target sequence
aacagatgttaagtgtaaagttgaag

SEQ ID NO: 138531 - DNA, 26 bp, Artificial sequence
  SiRNA target sequence
acagatgttaagtgtaaagttgaaga

SEQ ID NO: 138532 - DNA, 26 bp, Artificial sequence
  SiRNA target sequence
cagatgttaagtgtaaagttgaagat

SEQ ID NO: 138533 - DNA, 26 bp, Artificial sequence
  SiRNA target sequence
agatgttaagtgtaaagttgaagatt

SEQ ID NO: 138534 - DNA, 26 bp, Artificial sequence
  SiRNA target sequence
gatgttaagtgtaaagttgaagattt

SEQ ID NO: 138535 - DNA, 26 bp, Artificial sequence
  SiRNA target sequence
atgttaagtgtaaagttgaagattta

SEQ ID NO: 138536 - DNA, 26 bp, Artificial sequence
  SiRNA target sequence
tgttaagtgtaaagttgaagatttaa

SEQ ID NO: 138537 - DNA, 26 bp, Artificial sequence
  SiRNA target sequence
gttaagtgtaaagttgaagatttaat

SEQ ID NO: 138538 - DNA, 26 bp, Artificial sequence
  SiRNA target sequence
ttaagtgtaaagttgaagatttaata

SEQ ID NO: 138539 - DNA, 26 bp, Artificial sequence
  SiRNA target sequence
taagtgtaaagttgaagatttaataa

SEQ ID NO: 138540 - DNA, 26 bp, Artificial sequence
  SiRNA target sequence
aagtgtaaagttgaagatttaataaa

SEQ ID NO: 138541 - DNA, 26 bp, Artificial sequence
  SiRNA target sequence
agtgtaaagttgaagatttaataaaa

SEQ ID NO: 138542 - DNA, 26 bp, Artificial sequence
  SiRNA target sequence
gtgtaaagttgaagatttaataaaac

SEQ ID NO: 138543 - DNA, 26 bp, Artificial sequence
  SiRNA target sequence
tgtaaagttgaagatttaataaaacc

SEQ ID NO: 138544 - DNA, 26 bp, Artificial sequence
  SiRNA target sequence
gtaaagttgaagatttaataaaaccg

SEQ ID NO: 138545 - DNA, 26 bp, Artificial sequence
  SiRNA target sequence
taaagttgaagatttaataaaaccga

SEQ ID NO: 138546 - DNA, 26 bp, Artificial sequence
  SiRNA target sequence
aaagttgaagatttaataaaaccgac

SEQ ID NO: 138547 - DNA, 26 bp, Artificial sequence
  SiRNA target sequence
aagttgaagatttaataaaaccgact

SEQ ID NO: 138548 - DNA, 26 bp, Artificial sequence
  SiRNA target sequence
agttgaagatttaataaaaccgactg

SEQ ID NO: 138549 - DNA, 26 bp, Artificial sequence
  SiRNA target sequence
gttgaagatttaataaaaccgactga

SEQ ID NO: 138550 - DNA, 26 bp, Artificial sequence
  SiRNA target sequence
ttgaagatttaataaaaccgactgaa

SEQ ID NO: 138551 - DNA, 26 bp, Artificial sequence
  SiRNA target sequence
tgaagatttaataaaaccgactgaag

SEQ ID NO: 138552 - DNA, 26 bp, Artificial sequence
  SiRNA target sequence
gaagatttaataaaaccgactgaaga

SEQ ID NO: 138553 - DNA, 26 bp, Artificial sequence
  SiRNA target sequence
aagatttaataaaaccgactgaagaa

SEQ ID NO: 138554 - DNA, 26 bp, Artificial sequence
  SiRNA target sequence
agatttaataaaaccgactgaagaag

SEQ ID NO: 138555 - DNA, 26 bp, Artificial sequence
  SiRNA target sequence
gatttaataaaaccgactgaagaaga

SEQ ID NO: 138556 - DNA, 26 bp, Artificial sequence
  SiRNA target sequence
atttaataaaaccgactgaagaagat

SEQ ID NO: 138557 - DNA, 26 bp, Artificial sequence
  SiRNA target sequence
tttaataaaaccgactgaagaagatc

SEQ ID NO: 138558 - DNA, 26 bp, Artificial sequence
  SiRNA target sequence
ttaataaaaccgactgaagaagatct

SEQ ID NO: 138559 - DNA, 26 bp, Artificial sequence
  SiRNA target sequence
taataaaaccgactgaagaagatcta

SEQ ID NO: 138560 - DNA, 26 bp, Artificial sequence
  SiRNA target sequence
aataaaaccgactgaagaagatctaa

SEQ ID NO: 138561 - DNA, 26 bp, Artificial sequence
  SiRNA target sequence
ataaaaccgactgaagaagatctaaa

SEQ ID NO: 138562 - DNA, 26 bp, Artificial sequence
  SiRNA target sequence
taaaaccgactgaagaagatctaaac

SEQ ID NO: 138563 - DNA, 26 bp, Artificial sequence
  SiRNA target sequence
aaaaccgactgaagaagatctaaact

SEQ ID NO: 138564 - DNA, 26 bp, Artificial sequence
  SiRNA target sequence
aaaccgactgaagaagatctaaactt

SEQ ID NO: 138565 - DNA, 26 bp, Artificial sequence
  SiRNA target sequence
aaccgactgaagaagatctaaacttt

SEQ ID NO: 138566 - DNA, 26 bp, Artificial sequence
  SiRNA target sequence
accgactgaagaagatctaaactttc

SEQ ID NO: 138567 - DNA, 26 bp, Artificial sequence
  SiRNA target sequence
ccgactgaagaagatctaaactttct

SEQ ID NO: 138568 - DNA, 26 bp, Artificial sequence
  SiRNA target sequence
cgactgaagaagatctaaactttctt

SEQ ID NO: 138569 - DNA, 26 bp, Artificial sequence
  SiRNA target sequence
gactgaagaagatctaaactttctta

SEQ ID NO: 138570 - DNA, 26 bp, Artificial sequence
  SiRNA target sequence
actgaagaagatctaaactttcttat

SEQ ID NO: 138571 - DNA, 26 bp, Artificial sequence
  SiRNA target sequence
ctgaagaagatctaaactttcttatt

SEQ ID NO: 138572 - DNA, 26 bp, Artificial sequence
  SiRNA target sequence
tgaagaagatctaaactttcttattc

SEQ ID NO: 138573 - DNA, 26 bp, Artificial sequence
  SiRNA target sequence
gaagaagatctaaactttcttattca

SEQ ID NO: 138574 - DNA, 26 bp, Artificial sequence
  SiRNA target sequence
aagaagatctaaactttcttattcac

SEQ ID NO: 138575 - DNA, 26 bp, Artificial sequence
  SiRNA target sequence
agaagatctaaactttcttattcacg

SEQ ID NO: 138576 - DNA, 26 bp, Artificial sequence
  SiRNA target sequence
gaagatctaaactttcttattcacga

SEQ ID NO: 138577 - DNA, 26 bp, Artificial sequence
  SiRNA target sequence
aagatctaaactttcttattcacgag

SEQ ID NO: 138578 - DNA, 26 bp, Artificial sequence
  SiRNA target sequence
agatctaaactttcttattcacgagg

SEQ ID NO: 138579 - DNA, 26 bp, Artificial sequence
  SiRNA target sequence
gatctaaactttcttattcacgaggc

SEQ ID NO: 138580 - DNA, 26 bp, Artificial sequence
  SiRNA target sequence
atctaaactttcttattcacgaggcc

SEQ ID NO: 138581 - DNA, 26 bp, Artificial sequence
  SiRNA target sequence
tctaaactttcttattcacgaggcca

SEQ ID NO: 138582 - DNA, 26 bp, Artificial sequence
  SiRNA target sequence
ctaaactttcttattcacgaggccaa

SEQ ID NO: 138583 - DNA, 26 bp, Artificial sequence
  SiRNA target sequence
taaactttcttattcacgaggccaat

SEQ ID NO: 138584 - DNA, 26 bp, Artificial sequence
  SiRNA target sequence
aaactttcttattcacgaggccaatt

SEQ ID NO: 138585 - DNA, 26 bp, Artificial sequence
  SiRNA target sequence
aactttcttattcacgaggccaatta

SEQ ID NO: 138586 - DNA, 26 bp, Artificial sequence
  SiRNA target sequence
actttcttattcacgaggccaattat

SEQ ID NO: 138587 - DNA, 26 bp, Artificial sequence
  SiRNA target sequence
ctttcttattcacgaggccaattatt

SEQ ID NO: 138588 - DNA, 26 bp, Artificial sequence
  SiRNA target sequence
tttcttattcacgaggccaattattt

SEQ ID NO: 138589 - DNA, 26 bp, Artificial sequence
  SiRNA target sequence
ttcttattcacgaggccaattatttt

SEQ ID NO: 138590 - DNA, 26 bp, Artificial sequence
  SiRNA target sequence
tcttattcacgaggccaattatttta

SEQ ID NO: 138591 - DNA, 26 bp, Artificial sequence
  SiRNA target sequence
cttattcacgaggccaattattttac

SEQ ID NO: 138592 - DNA, 26 bp, Artificial sequence
  SiRNA target sequence
ttattcacgaggccaattattttaca

SEQ ID NO: 138593 - DNA, 26 bp, Artificial sequence
  SiRNA target sequence
tattcacgaggccaattattttacag

SEQ ID NO: 138594 - DNA, 26 bp, Artificial sequence
  SiRNA target sequence
attcacgaggccaattattttacaga

SEQ ID NO: 138595 - DNA, 26 bp, Artificial sequence
  SiRNA target sequence
ttcacgaggccaattattttacagat

SEQ ID NO: 138596 - DNA, 26 bp, Artificial sequence
  SiRNA target sequence
tcacgaggccaattattttacagatc

SEQ ID NO: 138597 - DNA, 26 bp, Artificial sequence
  SiRNA target sequence
cacgaggccaattattttacagatca

SEQ ID NO: 138598 - DNA, 26 bp, Artificial sequence
  SiRNA target sequence
acgaggccaattattttacagatcac

SEQ ID NO: 138599 - DNA, 26 bp, Artificial sequence
  SiRNA target sequence
cgaggccaattattttacagatcaca

SEQ ID NO: 138600 - DNA, 26 bp, Artificial sequence
  SiRNA target sequence
gaggccaattattttacagatcacaa

SEQ ID NO: 138601 - DNA, 26 bp, Artificial sequence
  SiRNA target sequence
aggccaattattttacagatcacaat

SEQ ID NO: 138602 - DNA, 26 bp, Artificial sequence
  SiRNA target sequence
ggccaattattttacagatcacaatt

SEQ ID NO: 138603 - DNA, 26 bp, Artificial sequence
  SiRNA target sequence
gccaattattttacagatcacaattt

SEQ ID NO: 138604 - DNA, 26 bp, Artificial sequence
  SiRNA target sequence
ccaattattttacagatcacaattta

SEQ ID NO: 138605 - DNA, 26 bp, Artificial sequence
  SiRNA target sequence
caattattttacagatcacaatttaa

SEQ ID NO: 138606 - DNA, 26 bp, Artificial sequence
  SiRNA target sequence
aattattttacagatcacaatttaaa

SEQ ID NO: 138607 - DNA, 26 bp, Artificial sequence
  SiRNA target sequence
attattttacagatcacaatttaaaa

SEQ ID NO: 138608 - DNA, 26 bp, Artificial sequence
  SiRNA target sequence
ttattttacagatcacaatttaaaat

SEQ ID NO: 138609 - DNA, 26 bp, Artificial sequence
  SiRNA target sequence
tattttacagatcacaatttaaaatt

SEQ ID NO: 138610 - DNA, 26 bp, Artificial sequence
  SiRNA target sequence
attttacagatcacaatttaaaatta

SEQ ID NO: 138611 - DNA, 26 bp, Artificial sequence
  SiRNA target sequence
ttttacagatcacaatttaaaattaa

SEQ ID NO: 138612 - DNA, 26 bp, Artificial sequence
  SiRNA target sequence
tttacagatcacaatttaaaattaac

SEQ ID NO: 138613 - DNA, 26 bp, Artificial sequence
  SiRNA target sequence
ttacagatcacaatttaaaattaaca

SEQ ID NO: 138614 - DNA, 26 bp, Artificial sequence
  SiRNA target sequence
tacagatcacaatttaaaattaacaa

SEQ ID NO: 138615 - DNA, 26 bp, Artificial sequence
  SiRNA target sequence
acagatcacaatttaaaattaacaaa

SEQ ID NO: 138616 - DNA, 26 bp, Artificial sequence
  SiRNA target sequence
cagatcacaatttaaaattaacaaaa

SEQ ID NO: 138617 - DNA, 26 bp, Artificial sequence
  SiRNA target sequence
agatcacaatttaaaattaacaaaaa

SEQ ID NO: 138618 - DNA, 26 bp, Artificial sequence
  SiRNA target sequence
gatcacaatttaaaattaacaaaaaa

SEQ ID NO: 138619 - DNA, 26 bp, Artificial sequence
  SiRNA target sequence
atcacaatttaaaattaacaaaaaaa

SEQ ID NO: 138620 - DNA, 26 bp, Artificial sequence
  SiRNA target sequence
tcacaatttaaaattaacaaaaaaag

SEQ ID NO: 138621 - DNA, 26 bp, Artificial sequence
  SiRNA target sequence
cacaatttaaaattaacaaaaaaaga

SEQ ID NO: 138622 - DNA, 26 bp, Artificial sequence
  SiRNA target sequence
acaatttaaaattaacaaaaaaagat

SEQ ID NO: 138623 - DNA, 26 bp, Artificial sequence
  SiRNA target sequence
caatttaaaattaacaaaaaaagatg

SEQ ID NO: 138624 - DNA, 26 bp, Artificial sequence
  SiRNA target sequence
aatttaaaattaacaaaaaaagatgt

SEQ ID NO: 138625 - DNA, 26 bp, Artificial sequence
  SiRNA target sequence
atttaaaattaacaaaaaaagatgtt

SEQ ID NO: 138626 - DNA, 26 bp, Artificial sequence
  SiRNA target sequence
tttaaaattaacaaaaaaagatgttt

SEQ ID NO: 138627 - DNA, 26 bp, Artificial sequence
  SiRNA target sequence
ttaaaattaacaaaaaaagatgtttt

SEQ ID NO: 138628 - DNA, 26 bp, Artificial sequence
  SiRNA target sequence
taaaattaacaaaaaaagatgttttg

SEQ ID NO: 138629 - DNA, 26 bp, Artificial sequence
  SiRNA target sequence
aaaattaacaaaaaaagatgttttgt

SEQ ID NO: 138630 - DNA, 26 bp, Artificial sequence
  SiRNA target sequence
aaattaacaaaaaaagatgttttgtc

SEQ ID NO: 138631 - DNA, 26 bp, Artificial sequence
  SiRNA target sequence
aattaacaaaaaaagatgttttgtct

SEQ ID NO: 138632 - DNA, 26 bp, Artificial sequence
  SiRNA target sequence
attaacaaaaaaagatgttttgtctg

SEQ ID NO: 138633 - DNA, 26 bp, Artificial sequence
  SiRNA target sequence
ttaacaaaaaaagatgttttgtctgt

SEQ ID NO: 138634 - DNA, 26 bp, Artificial sequence
  SiRNA target sequence
taacaaaaaaagatgttttgtctgtt

SEQ ID NO: 138635 - DNA, 26 bp, Artificial sequence
  SiRNA target sequence
aacaaaaaaagatgttttgtctgttt

SEQ ID NO: 138636 - DNA, 26 bp, Artificial sequence
  SiRNA target sequence
acaaaaaaagatgttttgtctgtttg

SEQ ID NO: 138637 - DNA, 26 bp, Artificial sequence
  SiRNA target sequence
caaaaaaagatgttttgtctgtttgg

SEQ ID NO: 138638 - DNA, 26 bp, Artificial sequence
  SiRNA target sequence
aaaaaaagatgttttgtctgtttgga

SEQ ID NO: 138639 - DNA, 26 bp, Artificial sequence
  SiRNA target sequence
aaaaaagatgttttgtctgtttggac

SEQ ID NO: 138640 - DNA, 26 bp, Artificial sequence
  SiRNA target sequence
aaaaagatgttttgtctgtttggaca

SEQ ID NO: 138641 - DNA, 26 bp, Artificial sequence
  SiRNA target sequence
aaaagatgttttgtctgtttggacag

SEQ ID NO: 138642 - DNA, 26 bp, Artificial sequence
  SiRNA target sequence
aaagatgttttgtctgtttggacagg

SEQ ID NO: 138643 - DNA, 26 bp, Artificial sequence
  SiRNA target sequence
aagatgttttgtctgtttggacaggt

SEQ ID NO: 138644 - DNA, 26 bp, Artificial sequence
  SiRNA target sequence
agatgttttgtctgtttggacaggta

SEQ ID NO: 138645 - DNA, 26 bp, Artificial sequence
  SiRNA target sequence
gatgttttgtctgtttggacaggtat

SEQ ID NO: 138646 - DNA, 26 bp, Artificial sequence
  SiRNA target sequence
atgttttgtctgtttggacaggtatt

SEQ ID NO: 138647 - DNA, 26 bp, Artificial sequence
  SiRNA target sequence
tgttttgtctgtttggacaggtatta

SEQ ID NO: 138648 - DNA, 26 bp, Artificial sequence
  SiRNA target sequence
gttttgtctgtttggacaggtattag

SEQ ID NO: 138649 - DNA, 26 bp, Artificial sequence
  SiRNA target sequence
ttttgtctgtttggacaggtattaga

SEQ ID NO: 138650 - DNA, 26 bp, Artificial sequence
  SiRNA target sequence
tttgtctgtttggacaggtattagac

SEQ ID NO: 138651 - DNA, 26 bp, Artificial sequence
  SiRNA target sequence
ttgtctgtttggacaggtattagacc

SEQ ID NO: 138652 - DNA, 26 bp, Artificial sequence
  SiRNA target sequence
tgtctgtttggacaggtattagaccg

SEQ ID NO: 138653 - DNA, 26 bp, Artificial sequence
  SiRNA target sequence
gtctgtttggacaggtattagaccgt

SEQ ID NO: 138654 - DNA, 26 bp, Artificial sequence
  SiRNA target sequence
tctgtttggacaggtattagaccgtt

SEQ ID NO: 138655 - DNA, 26 bp, Artificial sequence
  SiRNA target sequence
ctgtttggacaggtattagaccgtta

SEQ ID NO: 138656 - DNA, 26 bp, Artificial sequence
  SiRNA target sequence
tgtttggacaggtattagaccgttag

SEQ ID NO: 138657 - DNA, 26 bp, Artificial sequence
  SiRNA target sequence
gtttggacaggtattagaccgttagt

SEQ ID NO: 138658 - DNA, 26 bp, Artificial sequence
  SiRNA target sequence
tttggacaggtattagaccgttagtc

SEQ ID NO: 138659 - DNA, 26 bp, Artificial sequence
  SiRNA target sequence
ttggacaggtattagaccgttagtca

SEQ ID NO: 138660 - DNA, 26 bp, Artificial sequence
  SiRNA target sequence
tggacaggtattagaccgttagtcaa

SEQ ID NO: 138661 - DNA, 26 bp, Artificial sequence
  SiRNA target sequence
ggacaggtattagaccgttagtcaag

SEQ ID NO: 138662 - DNA, 26 bp, Artificial sequence
  SiRNA target sequence
gacaggtattagaccgttagtcaagg

SEQ ID NO: 138663 - DNA, 26 bp, Artificial sequence
  SiRNA target sequence
acaggtattagaccgttagtcaagga

SEQ ID NO: 138664 - DNA, 26 bp, Artificial sequence
  SiRNA target sequence
caggtattagaccgttagtcaaggat

SEQ ID NO: 138665 - DNA, 26 bp, Artificial sequence
  SiRNA target sequence
aggtattagaccgttagtcaaggatt

SEQ ID NO: 138666 - DNA, 26 bp, Artificial sequence
  SiRNA target sequence
ggtattagaccgttagtcaaggattt

SEQ ID NO: 138667 - DNA, 26 bp, Artificial sequence
  SiRNA target sequence
gtattagaccgttagtcaaggattta

SEQ ID NO: 138668 - DNA, 26 bp, Artificial sequence
  SiRNA target sequence
tattagaccgttagtcaaggatttat

SEQ ID NO: 138669 - DNA, 26 bp, Artificial sequence
  SiRNA target sequence
attagaccgttagtcaaggatttatc

SEQ ID NO: 138670 - DNA, 26 bp, Artificial sequence
  SiRNA target sequence
ttagaccgttagtcaaggatttatcg

SEQ ID NO: 138671 - DNA, 26 bp, Artificial sequence
  SiRNA target sequence
tagaccgttagtcaaggatttatcga

SEQ ID NO: 138672 - DNA, 26 bp, Artificial sequence
  SiRNA target sequence
agaccgttagtcaaggatttatcgaa

SEQ ID NO: 138673 - DNA, 26 bp, Artificial sequence
  SiRNA target sequence
gaccgttagtcaaggatttatcgaaa

SEQ ID NO: 138674 - DNA, 26 bp, Artificial sequence
  SiRNA target sequence
accgttagtcaaggatttatcgaaaa

SEQ ID NO: 138675 - DNA, 26 bp, Artificial sequence
  SiRNA target sequence
ccgttagtcaaggatttatcgaaaag

SEQ ID NO: 138676 - DNA, 26 bp, Artificial sequence
  SiRNA target sequence
cgttagtcaaggatttatcgaaaagt

SEQ ID NO: 138677 - DNA, 26 bp, Artificial sequence
  SiRNA target sequence
gttagtcaaggatttatcgaaaagtt

SEQ ID NO: 138678 - DNA, 26 bp, Artificial sequence
  SiRNA target sequence
ttagtcaaggatttatcgaaaagttc

SEQ ID NO: 138679 - DNA, 26 bp, Artificial sequence
  SiRNA target sequence
tagtcaaggatttatcgaaaagttca

SEQ ID NO: 138680 - DNA, 26 bp, Artificial sequence
  SiRNA target sequence
agtcaaggatttatcgaaaagttcaa

SEQ ID NO: 138681 - DNA, 26 bp, Artificial sequence
  SiRNA target sequence
gtcaaggatttatcgaaaagttcaac

SEQ ID NO: 138682 - DNA, 26 bp, Artificial sequence
  SiRNA target sequence
tcaaggatttatcgaaaagttcaaca

SEQ ID NO: 138683 - DNA, 26 bp, Artificial sequence
  SiRNA target sequence
caaggatttatcgaaaagttcaacag

SEQ ID NO: 138684 - DNA, 26 bp, Artificial sequence
  SiRNA target sequence
aaggatttatcgaaaagttcaacaga

SEQ ID NO: 138685 - DNA, 26 bp, Artificial sequence
  SiRNA target sequence
aggatttatcgaaaagttcaacagaa

SEQ ID NO: 138686 - DNA, 26 bp, Artificial sequence
  SiRNA target sequence
ggatttatcgaaaagttcaacagaaa

SEQ ID NO: 138687 - DNA, 26 bp, Artificial sequence
  SiRNA target sequence
gatttatcgaaaagttcaacagaaaa

SEQ ID NO: 138688 - DNA, 26 bp, Artificial sequence
  SiRNA target sequence
atttatcgaaaagttcaacagaaaag

SEQ ID NO: 138689 - DNA, 26 bp, Artificial sequence
  SiRNA target sequence
tttatcgaaaagttcaacagaaaaga

SEQ ID NO: 138690 - DNA, 26 bp, Artificial sequence
  SiRNA target sequence
ttatcgaaaagttcaacagaaaagat

SEQ ID NO: 138691 - DNA, 26 bp, Artificial sequence
  SiRNA target sequence
tatcgaaaagttcaacagaaaagata

SEQ ID NO: 138692 - DNA, 26 bp, Artificial sequence
  SiRNA target sequence
atcgaaaagttcaacagaaaagatat

SEQ ID NO: 138693 - DNA, 26 bp, Artificial sequence
  SiRNA target sequence
tcgaaaagttcaacagaaaagatatg

SEQ ID NO: 138694 - DNA, 26 bp, Artificial sequence
  SiRNA target sequence
cgaaaagttcaacagaaaagatatgt

SEQ ID NO: 138695 - DNA, 26 bp, Artificial sequence
  SiRNA target sequence
gaaaagttcaacagaaaagatatgta

SEQ ID NO: 138696 - DNA, 26 bp, Artificial sequence
  SiRNA target sequence
aaaagttcaacagaaaagatatgtag

SEQ ID NO: 138697 - DNA, 26 bp, Artificial sequence
  SiRNA target sequence
aaagttcaacagaaaagatatgtaga

SEQ ID NO: 138698 - DNA, 26 bp, Artificial sequence
  SiRNA target sequence
aagttcaacagaaaagatatgtagaa

SEQ ID NO: 138699 - DNA, 26 bp, Artificial sequence
  SiRNA target sequence
agttcaacagaaaagatatgtagaaa

SEQ ID NO: 138700 - DNA, 26 bp, Artificial sequence
  SiRNA target sequence
gttcaacagaaaagatatgtagaaaa

SEQ ID NO: 138701 - DNA, 26 bp, Artificial sequence
  SiRNA target sequence
ttcaacagaaaagatatgtagaaaac

SEQ ID NO: 138702 - DNA, 26 bp, Artificial sequence
  SiRNA target sequence
tcaacagaaaagatatgtagaaaaca

SEQ ID NO: 138703 - DNA, 26 bp, Artificial sequence
  SiRNA target sequence
caacagaaaagatatgtagaaaacat

SEQ ID NO: 138704 - DNA, 26 bp, Artificial sequence
  SiRNA target sequence
aacagaaaagatatgtagaaaacata

SEQ ID NO: 138705 - DNA, 26 bp, Artificial sequence
  SiRNA target sequence
acagaaaagatatgtagaaaacatac

SEQ ID NO: 138706 - DNA, 26 bp, Artificial sequence
  SiRNA target sequence
cagaaaagatatgtagaaaacatact

SEQ ID NO: 138707 - DNA, 26 bp, Artificial sequence
  SiRNA target sequence
agaaaagatatgtagaaaacatacta

SEQ ID NO: 138708 - DNA, 26 bp, Artificial sequence
  SiRNA target sequence
gaaaagatatgtagaaaacatactat

SEQ ID NO: 138709 - DNA, 26 bp, Artificial sequence
  SiRNA target sequence
aaaagatatgtagaaaacatactata

SEQ ID NO: 138710 - DNA, 26 bp, Artificial sequence
  SiRNA target sequence
aaagatatgtagaaaacatactataa

SEQ ID NO: 138711 - DNA, 26 bp, Artificial sequence
  SiRNA target sequence
aagatatgtagaaaacatactataag

SEQ ID NO: 138712 - DNA, 26 bp, Artificial sequence
  SiRNA target sequence
agatatgtagaaaacatactataaga

SEQ ID NO: 138713 - DNA, 26 bp, Artificial sequence
  SiRNA target sequence
gatatgtagaaaacatactataagaa

SEQ ID NO: 138714 - DNA, 26 bp, Artificial sequence
  SiRNA target sequence
atatgtagaaaacatactataagaat

SEQ ID NO: 138715 - DNA, 26 bp, Artificial sequence
  SiRNA target sequence
tatgtagaaaacatactataagaata

SEQ ID NO: 138716 - DNA, 26 bp, Artificial sequence
  SiRNA target sequence
atgtagaaaacatactataagaatag

SEQ ID NO: 138717 - DNA, 26 bp, Artificial sequence
  SiRNA target sequence
tgtagaaaacatactataagaataga

SEQ ID NO: 138718 - DNA, 26 bp, Artificial sequence
  SiRNA target sequence
gtagaaaacatactataagaatagat

SEQ ID NO: 138719 - DNA, 26 bp, Artificial sequence
  SiRNA target sequence
tagaaaacatactataagaatagata

SEQ ID NO: 138720 - DNA, 26 bp, Artificial sequence
  SiRNA target sequence
agaaaacatactataagaatagataa

SEQ ID NO: 138721 - DNA, 26 bp, Artificial sequence
  SiRNA target sequence
gaaaacatactataagaatagataaa

SEQ ID NO: 138722 - DNA, 26 bp, Artificial sequence
  SiRNA target sequence
aaaacatactataagaatagataaag

SEQ ID NO: 138723 - DNA, 26 bp, Artificial sequence
  SiRNA target sequence
aaacatactataagaatagataaaga

SEQ ID NO: 138724 - DNA, 26 bp, Artificial sequence
  SiRNA target sequence
aacatactataagaatagataaagac

SEQ ID NO: 138725 - DNA, 26 bp, Artificial sequence
  SiRNA target sequence
acatactataagaatagataaagaca

SEQ ID NO: 138726 - DNA, 26 bp, Artificial sequence
  SiRNA target sequence
catactataagaatagataaagacaa

SEQ ID NO: 138727 - DNA, 26 bp, Artificial sequence
  SiRNA target sequence
atactataagaatagataaagacaat

SEQ ID NO: 138728 - DNA, 26 bp, Artificial sequence
  SiRNA target sequence
tactataagaatagataaagacaata

SEQ ID NO: 138729 - DNA, 26 bp, Artificial sequence
  SiRNA target sequence
actataagaatagataaagacaatat

SEQ ID NO: 138730 - DNA, 26 bp, Artificial sequence
  SiRNA target sequence
ctataagaatagataaagacaatatg

SEQ ID NO: 138731 - DNA, 26 bp, Artificial sequence
  SiRNA target sequence
tataagaatagataaagacaatatgg

SEQ ID NO: 138732 - DNA, 26 bp, Artificial sequence
  SiRNA target sequence
ataagaatagataaagacaatatggt

SEQ ID NO: 138733 - DNA, 26 bp, Artificial sequence
  SiRNA target sequence
taagaatagataaagacaatatggta

SEQ ID NO: 138734 - DNA, 26 bp, Artificial sequence
  SiRNA target sequence
aagaatagataaagacaatatggtaa

SEQ ID NO: 138735 - DNA, 26 bp, Artificial sequence
  SiRNA target sequence
agaatagataaagacaatatggtaac

SEQ ID NO: 138736 - DNA, 26 bp, Artificial sequence
  SiRNA target sequence
gaatagataaagacaatatggtaact

SEQ ID NO: 138737 - DNA, 26 bp, Artificial sequence
  SiRNA target sequence
aatagataaagacaatatggtaactg

SEQ ID NO: 138738 - DNA, 26 bp, Artificial sequence
  SiRNA target sequence
atagataaagacaatatggtaactgt

SEQ ID NO: 138739 - DNA, 26 bp, Artificial sequence
  SiRNA target sequence
tagataaagacaatatggtaactgta

SEQ ID NO: 138740 - DNA, 26 bp, Artificial sequence
  SiRNA target sequence
agataaagacaatatggtaactgtaa

SEQ ID NO: 138741 - DNA, 26 bp, Artificial sequence
  SiRNA target sequence
gataaagacaatatggtaactgtaac

SEQ ID NO: 138742 - DNA, 26 bp, Artificial sequence
  SiRNA target sequence
ataaagacaatatggtaactgtaaca

SEQ ID NO: 138743 - DNA, 26 bp, Artificial sequence
  SiRNA target sequence
taaagacaatatggtaactgtaacag

SEQ ID NO: 138744 - DNA, 26 bp, Artificial sequence
  SiRNA target sequence
aaagacaatatggtaactgtaacagg

SEQ ID NO: 138745 - DNA, 26 bp, Artificial sequence
  SiRNA target sequence
aagacaatatggtaactgtaacaggt

SEQ ID NO: 138746 - DNA, 26 bp, Artificial sequence
  SiRNA target sequence
agacaatatggtaactgtaacaggtg

SEQ ID NO: 138747 - DNA, 26 bp, Artificial sequence
  SiRNA target sequence
gacaatatggtaactgtaacaggtgg

SEQ ID NO: 138748 - DNA, 26 bp, Artificial sequence
  SiRNA target sequence
acaatatggtaactgtaacaggtggt

SEQ ID NO: 138749 - DNA, 26 bp, Artificial sequence
  SiRNA target sequence
caatatggtaactgtaacaggtggta

SEQ ID NO: 138750 - DNA, 26 bp, Artificial sequence
  SiRNA target sequence
aatatggtaactgtaacaggtggtaa

SEQ ID NO: 138751 - DNA, 26 bp, Artificial sequence
  SiRNA target sequence
atatggtaactgtaacaggtggtaag

SEQ ID NO: 138752 - DNA, 26 bp, Artificial sequence
  SiRNA target sequence
tatggtaactgtaacaggtggtaagt

SEQ ID NO: 138753 - DNA, 26 bp, Artificial sequence
  SiRNA target sequence
atggtaactgtaacaggtggtaagtg

SEQ ID NO: 138754 - DNA, 26 bp, Artificial sequence
  SiRNA target sequence
tggtaactgtaacaggtggtaagtgg

SEQ ID NO: 138755 - DNA, 26 bp, Artificial sequence
  SiRNA target sequence
ggtaactgtaacaggtggtaagtgga

SEQ ID NO: 138756 - DNA, 26 bp, Artificial sequence
  SiRNA target sequence
gtaactgtaacaggtggtaagtggac

SEQ ID NO: 138757 - DNA, 26 bp, Artificial sequence
  SiRNA target sequence
taactgtaacaggtggtaagtggaca

SEQ ID NO: 138758 - DNA, 26 bp, Artificial sequence
  SiRNA target sequence
aactgtaacaggtggtaagtggacaa

SEQ ID NO: 138759 - DNA, 26 bp, Artificial sequence
  SiRNA target sequence
actgtaacaggtggtaagtggacaat

SEQ ID NO: 138760 - DNA, 26 bp, Artificial sequence
  SiRNA target sequence
ctgtaacaggtggtaagtggacaatt

SEQ ID NO: 138761 - DNA, 26 bp, Artificial sequence
  SiRNA target sequence
tgtaacaggtggtaagtggacaattt

SEQ ID NO: 138762 - DNA, 26 bp, Artificial sequence
  SiRNA target sequence
gtaacaggtggtaagtggacaatttt

SEQ ID NO: 138763 - DNA, 26 bp, Artificial sequence
  SiRNA target sequence
taacaggtggtaagtggacaattttt

SEQ ID NO: 138764 - DNA, 26 bp, Artificial sequence
  SiRNA target sequence
aacaggtggtaagtggacaatttttc

SEQ ID NO: 138765 - DNA, 26 bp, Artificial sequence
  SiRNA target sequence
acaggtggtaagtggacaatttttcg

SEQ ID NO: 138766 - DNA, 26 bp, Artificial sequence
  SiRNA target sequence
caggtggtaagtggacaatttttcga

SEQ ID NO: 138767 - DNA, 26 bp, Artificial sequence
  SiRNA target sequence
aggtggtaagtggacaatttttcgac

SEQ ID NO: 138768 - DNA, 26 bp, Artificial sequence
  SiRNA target sequence
ggtggtaagtggacaatttttcgact

SEQ ID NO: 138769 - DNA, 26 bp, Artificial sequence
  SiRNA target sequence
gtggtaagtggacaatttttcgactt

SEQ ID NO: 138770 - DNA, 26 bp, Artificial sequence
  SiRNA target sequence
tggtaagtggacaatttttcgactta

SEQ ID NO: 138771 - DNA, 26 bp, Artificial sequence
  SiRNA target sequence
ggtaagtggacaatttttcgacttat

SEQ ID NO: 138772 - DNA, 26 bp, Artificial sequence
  SiRNA target sequence
gtaagtggacaatttttcgacttatg

SEQ ID NO: 138773 - DNA, 26 bp, Artificial sequence
  SiRNA target sequence
taagtggacaatttttcgacttatgg

SEQ ID NO: 138774 - DNA, 26 bp, Artificial sequence
  SiRNA target sequence
aagtggacaatttttcgacttatggg

SEQ ID NO: 138775 - DNA, 26 bp, Artificial sequence
  SiRNA target sequence
agtggacaatttttcgacttatggga

SEQ ID NO: 138776 - DNA, 26 bp, Artificial sequence
  SiRNA target sequence
gtggacaatttttcgacttatgggag

SEQ ID NO: 138777 - DNA, 26 bp, Artificial sequence
  SiRNA target sequence
tggacaatttttcgacttatgggaga

SEQ ID NO: 138778 - DNA, 26 bp, Artificial sequence
  SiRNA target sequence
ggacaatttttcgacttatgggagaa

SEQ ID NO: 138779 - DNA, 26 bp, Artificial sequence
  SiRNA target sequence
gacaatttttcgacttatgggagaac

SEQ ID NO: 138780 - DNA, 26 bp, Artificial sequence
  SiRNA target sequence
acaatttttcgacttatgggagaaca

SEQ ID NO: 138781 - DNA, 26 bp, Artificial sequence
  SiRNA target sequence
caatttttcgacttatgggagaacag

SEQ ID NO: 138782 - DNA, 26 bp, Artificial sequence
  SiRNA target sequence
aatttttcgacttatgggagaacaga

SEQ ID NO: 138783 - DNA, 26 bp, Artificial sequence
  SiRNA target sequence
atttttcgacttatgggagaacagac

SEQ ID NO: 138784 - DNA, 26 bp, Artificial sequence
  SiRNA target sequence
tttttcgacttatgggagaacagaca

SEQ ID NO: 138785 - DNA, 26 bp, Artificial sequence
  SiRNA target sequence
ttttcgacttatgggagaacagacaa

SEQ ID NO: 138786 - DNA, 26 bp, Artificial sequence
  SiRNA target sequence
tttcgacttatgggagaacagacaat

SEQ ID NO: 138787 - DNA, 26 bp, Artificial sequence
  SiRNA target sequence
ttcgacttatgggagaacagacaata

SEQ ID NO: 138788 - DNA, 26 bp, Artificial sequence
  SiRNA target sequence
tcgacttatgggagaacagacaataa

SEQ ID NO: 138789 - DNA, 26 bp, Artificial sequence
  SiRNA target sequence
cgacttatgggagaacagacaataaa

SEQ ID NO: 138790 - DNA, 26 bp, Artificial sequence
  SiRNA target sequence
gacttatgggagaacagacaataaat

SEQ ID NO: 138791 - DNA, 26 bp, Artificial sequence
  SiRNA target sequence
acttatgggagaacagacaataaatc

SEQ ID NO: 138792 - DNA, 26 bp, Artificial sequence
  SiRNA target sequence
cttatgggagaacagacaataaatca

SEQ ID NO: 138793 - DNA, 26 bp, Artificial sequence
  SiRNA target sequence
ttatgggagaacagacaataaatcaa

SEQ ID NO: 138794 - DNA, 26 bp, Artificial sequence
  SiRNA target sequence
tatgggagaacagacaataaatcaaa

SEQ ID NO: 138795 - DNA, 26 bp, Artificial sequence
  SiRNA target sequence
atgggagaacagacaataaatcaaat

SEQ ID NO: 138796 - DNA, 26 bp, Artificial sequence
  SiRNA target sequence
tgggagaacagacaataaatcaaatt

SEQ ID NO: 138797 - DNA, 26 bp, Artificial sequence
  SiRNA target sequence
gggagaacagacaataaatcaaatta

SEQ ID NO: 138798 - DNA, 26 bp, Artificial sequence
  SiRNA target sequence
ggagaacagacaataaatcaaattat

SEQ ID NO: 138799 - DNA, 26 bp, Artificial sequence
  SiRNA target sequence
gagaacagacaataaatcaaattata

SEQ ID NO: 138800 - DNA, 26 bp, Artificial sequence
  SiRNA target sequence
agaacagacaataaatcaaattataa

SEQ ID NO: 138801 - DNA, 26 bp, Artificial sequence
  SiRNA target sequence
gaacagacaataaatcaaattataaa

SEQ ID NO: 138802 - DNA, 26 bp, Artificial sequence
  SiRNA target sequence
aacagacaataaatcaaattataaaa

SEQ ID NO: 138803 - DNA, 26 bp, Artificial sequence
  SiRNA target sequence
acagacaataaatcaaattataaaag

SEQ ID NO: 138804 - DNA, 26 bp, Artificial sequence
  SiRNA target sequence
cagacaataaatcaaattataaaagt

SEQ ID NO: 138805 - DNA, 26 bp, Artificial sequence
  SiRNA target sequence
agacaataaatcaaattataaaagtt

SEQ ID NO: 138806 - DNA, 26 bp, Artificial sequence
  SiRNA target sequence
gacaataaatcaaattataaaagttt

SEQ ID NO: 138807 - DNA, 26 bp, Artificial sequence
  SiRNA target sequence
acaataaatcaaattataaaagtttt

SEQ ID NO: 138808 - DNA, 26 bp, Artificial sequence
  SiRNA target sequence
caataaatcaaattataaaagttttt

SEQ ID NO: 138809 - DNA, 26 bp, Artificial sequence
  SiRNA target sequence
aataaatcaaattataaaagttttta

SEQ ID NO: 138810 - DNA, 26 bp, Artificial sequence
  SiRNA target sequence
ataaatcaaattataaaagtttttaa

SEQ ID NO: 138811 - DNA, 26 bp, Artificial sequence
  SiRNA target sequence
taaatcaaattataaaagtttttaat

SEQ ID NO: 138812 - DNA, 26 bp, Artificial sequence
  SiRNA target sequence
aaatcaaattataaaagtttttaata

SEQ ID NO: 138813 - DNA, 26 bp, Artificial sequence
  SiRNA target sequence
aatcaaattataaaagtttttaatat

SEQ ID NO: 138814 - DNA, 26 bp, Artificial sequence
  SiRNA target sequence
atcaaattataaaagtttttaatata

SEQ ID NO: 138815 - DNA, 26 bp, Artificial sequence
  SiRNA target sequence
tcaaattataaaagtttttaatataa

SEQ ID NO: 138816 - DNA, 26 bp, Artificial sequence
  SiRNA target sequence
caaattataaaagtttttaatataaa

SEQ ID NO: 138817 - DNA, 26 bp, Artificial sequence
  SiRNA target sequence
aaattataaaagtttttaatataaag

SEQ ID NO: 138818 - DNA, 26 bp, Artificial sequence
  SiRNA target sequence
aattataaaagtttttaatataaagt

SEQ ID NO: 138819 - DNA, 26 bp, Artificial sequence
  SiRNA target sequence
attataaaagtttttaatataaagtc

SEQ ID NO: 138820 - DNA, 26 bp, Artificial sequence
  SiRNA target sequence
ttataaaagtttttaatataaagtct

SEQ ID NO: 138821 - DNA, 26 bp, Artificial sequence
  SiRNA target sequence
tataaaagtttttaatataaagtcta

SEQ ID NO: 138822 - DNA, 26 bp, Artificial sequence
  SiRNA target sequence
ataaaagtttttaatataaagtctaa

SEQ ID NO: 138823 - DNA, 26 bp, Artificial sequence
  SiRNA target sequence
taaaagtttttaatataaagtctaat

SEQ ID NO: 138824 - DNA, 26 bp, Artificial sequence
  SiRNA target sequence
aaaagtttttaatataaagtctaata

SEQ ID NO: 138825 - DNA, 26 bp, Artificial sequence
  SiRNA target sequence
aaagtttttaatataaagtctaataa

SEQ ID NO: 138826 - DNA, 26 bp, Artificial sequence
  SiRNA target sequence
aagtttttaatataaagtctaataaa

SEQ ID NO: 138827 - DNA, 26 bp, Artificial sequence
  SiRNA target sequence
agtttttaatataaagtctaataaac

SEQ ID NO: 138828 - DNA, 26 bp, Artificial sequence
  SiRNA target sequence
gtttttaatataaagtctaataaacc

SEQ ID NO: 138829 - DNA, 26 bp, Artificial sequence
  SiRNA target sequence
tttttaatataaagtctaataaacca

SEQ ID NO: 138830 - DNA, 26 bp, Artificial sequence
  SiRNA target sequence
ttttaatataaagtctaataaaccaa

SEQ ID NO: 138831 - DNA, 26 bp, Artificial sequence
  SiRNA target sequence
tttaatataaagtctaataaaccaag

SEQ ID NO: 138832 - DNA, 26 bp, Artificial sequence
  SiRNA target sequence
ttaatataaagtctaataaaccaagt

SEQ ID NO: 138833 - DNA, 26 bp, Artificial sequence
  SiRNA target sequence
taatataaagtctaataaaccaagta

SEQ ID NO: 138834 - DNA, 26 bp, Artificial sequence
  SiRNA target sequence
aatataaagtctaataaaccaagtat

SEQ ID NO: 138835 - DNA, 26 bp, Artificial sequence
  SiRNA target sequence
atataaagtctaataaaccaagtata

SEQ ID NO: 138836 - DNA, 26 bp, Artificial sequence
  SiRNA target sequence
tataaagtctaataaaccaagtataa

SEQ ID NO: 138837 - DNA, 26 bp, Artificial sequence
  SiRNA target sequence
ataaagtctaataaaccaagtataac

SEQ ID NO: 138838 - DNA, 26 bp, Artificial sequence
  SiRNA target sequence
taaagtctaataaaccaagtataaca

SEQ ID NO: 138839 - DNA, 26 bp, Artificial sequence
  SiRNA target sequence
aaagtctaataaaccaagtataacac

SEQ ID NO: 138840 - DNA, 26 bp, Artificial sequence
  SiRNA target sequence
aagtctaataaaccaagtataacaca

SEQ ID NO: 138841 - DNA, 26 bp, Artificial sequence
  SiRNA target sequence
agtctaataaaccaagtataacacaa

SEQ ID NO: 138842 - DNA, 26 bp, Artificial sequence
  SiRNA target sequence
gtctaataaaccaagtataacacaat

SEQ ID NO: 138843 - DNA, 26 bp, Artificial sequence
  SiRNA target sequence
tctaataaaccaagtataacacaata

SEQ ID NO: 138844 - DNA, 26 bp, Artificial sequence
  SiRNA target sequence
ctaataaaccaagtataacacaatat

SEQ ID NO: 138845 - DNA, 26 bp, Artificial sequence
  SiRNA target sequence
taataaaccaagtataacacaatatc

SEQ ID NO: 138846 - DNA, 26 bp, Artificial sequence
  SiRNA target sequence
aataaaccaagtataacacaatatct

SEQ ID NO: 138847 - DNA, 26 bp, Artificial sequence
  SiRNA target sequence
ataaaccaagtataacacaatatctt

SEQ ID NO: 138848 - DNA, 26 bp, Artificial sequence
  SiRNA target sequence
taaaccaagtataacacaatatcttc

SEQ ID NO: 138849 - DNA, 26 bp, Artificial sequence
  SiRNA target sequence
aaaccaagtataacacaatatcttcc

SEQ ID NO: 138850 - DNA, 26 bp, Artificial sequence
  SiRNA target sequence
aaccaagtataacacaatatcttcct

SEQ ID NO: 138851 - DNA, 26 bp, Artificial sequence
  SiRNA target sequence
accaagtataacacaatatcttcctg

SEQ ID NO: 138852 - DNA, 26 bp, Artificial sequence
  SiRNA target sequence
ccaagtataacacaatatcttcctgt

SEQ ID NO: 138853 - DNA, 26 bp, Artificial sequence
  SiRNA target sequence
caagtataacacaatatcttcctgtt

SEQ ID NO: 138854 - DNA, 26 bp, Artificial sequence
  SiRNA target sequence
aagtataacacaatatcttcctgttt

SEQ ID NO: 138855 - DNA, 26 bp, Artificial sequence
  SiRNA target sequence
agtataacacaatatcttcctgtttt

SEQ ID NO: 138856 - DNA, 26 bp, Artificial sequence
  SiRNA target sequence
gtataacacaatatcttcctgttttg

SEQ ID NO: 138857 - DNA, 26 bp, Artificial sequence
  SiRNA target sequence
tataacacaatatcttcctgttttgg

SEQ ID NO: 138858 - DNA, 26 bp, Artificial sequence
  SiRNA target sequence
ataacacaatatcttcctgttttggg

SEQ ID NO: 138859 - DNA, 26 bp, Artificial sequence
  SiRNA target sequence
taacacaatatcttcctgttttggga

SEQ ID NO: 138860 - DNA, 26 bp, Artificial sequence
  SiRNA target sequence
aacacaatatcttcctgttttgggat

SEQ ID NO: 138861 - DNA, 26 bp, Artificial sequence
  SiRNA target sequence
acacaatatcttcctgttttgggatc

SEQ ID NO: 138862 - DNA, 26 bp, Artificial sequence
  SiRNA target sequence
cacaatatcttcctgttttgggatca

SEQ ID NO: 138863 - DNA, 26 bp, Artificial sequence
  SiRNA target sequence
acaatatcttcctgttttgggatcac

SEQ ID NO: 138864 - DNA, 26 bp, Artificial sequence
  SiRNA target sequence
caatatcttcctgttttgggatcaca

SEQ ID NO: 138865 - DNA, 26 bp, Artificial sequence
  SiRNA target sequence
aatatcttcctgttttgggatcacag

SEQ ID NO: 138866 - DNA, 26 bp, Artificial sequence
  SiRNA target sequence
atatcttcctgttttgggatcacagg

SEQ ID NO: 138867 - DNA, 26 bp, Artificial sequence
  SiRNA target sequence
tatcttcctgttttgggatcacaggg

SEQ ID NO: 138868 - DNA, 26 bp, Artificial sequence
  SiRNA target sequence
atcttcctgttttgggatcacaggga

SEQ ID NO: 138869 - DNA, 26 bp, Artificial sequence
  SiRNA target sequence
tcttcctgttttgggatcacagggat

SEQ ID NO: 138870 - DNA, 26 bp, Artificial sequence
  SiRNA target sequence
cttcctgttttgggatcacagggata

SEQ ID NO: 138871 - DNA, 26 bp, Artificial sequence
  SiRNA target sequence
ttcctgttttgggatcacagggatat

SEQ ID NO: 138872 - DNA, 26 bp, Artificial sequence
  SiRNA target sequence
tcctgttttgggatcacagggatata

SEQ ID NO: 138873 - DNA, 26 bp, Artificial sequence
  SiRNA target sequence
cctgttttgggatcacagggatatac

SEQ ID NO: 138874 - DNA, 26 bp, Artificial sequence
  SiRNA target sequence
ctgttttgggatcacagggatatact

SEQ ID NO: 138875 - DNA, 26 bp, Artificial sequence
  SiRNA target sequence
tgttttgggatcacagggatatacta

SEQ ID NO: 138876 - DNA, 26 bp, Artificial sequence
  SiRNA target sequence
gttttgggatcacagggatatactaa

SEQ ID NO: 138877 - DNA, 26 bp, Artificial sequence
  SiRNA target sequence
ttttgggatcacagggatatactaaa

SEQ ID NO: 138878 - DNA, 26 bp, Artificial sequence
  SiRNA target sequence
tttgggatcacagggatatactaaag

SEQ ID NO: 138879 - DNA, 26 bp, Artificial sequence
  SiRNA target sequence
ttgggatcacagggatatactaaagc

SEQ ID NO: 138880 - DNA, 26 bp, Artificial sequence
  SiRNA target sequence
tgggatcacagggatatactaaagct

SEQ ID NO: 138881 - DNA, 26 bp, Artificial sequence
  SiRNA target sequence
gggatcacagggatatactaaagcta

SEQ ID NO: 138882 - DNA, 26 bp, Artificial sequence
  SiRNA target sequence
ggatcacagggatatactaaagctac

SEQ ID NO: 138883 - DNA, 26 bp, Artificial sequence
  SiRNA target sequence
gatcacagggatatactaaagctaca

SEQ ID NO: 138884 - DNA, 26 bp, Artificial sequence
  SiRNA target sequence
atcacagggatatactaaagctacag

SEQ ID NO: 138885 - DNA, 26 bp, Artificial sequence
  SiRNA target sequence
tcacagggatatactaaagctacaga

SEQ ID NO: 138886 - DNA, 26 bp, Artificial sequence
  SiRNA target sequence
cacagggatatactaaagctacagaa

SEQ ID NO: 138887 - DNA, 26 bp, Artificial sequence
  SiRNA target sequence
acagggatatactaaagctacagaat

SEQ ID NO: 138888 - DNA, 26 bp, Artificial sequence
  SiRNA target sequence
cagggatatactaaagctacagaatt

SEQ ID NO: 138889 - DNA, 26 bp, Artificial sequence
  SiRNA target sequence
agggatatactaaagctacagaattt

SEQ ID NO: 138890 - DNA, 26 bp, Artificial sequence
  SiRNA target sequence
gggatatactaaagctacagaatttg

SEQ ID NO: 138891 - DNA, 26 bp, Artificial sequence
  SiRNA target sequence
ggatatactaaagctacagaatttga

SEQ ID NO: 138892 - DNA, 26 bp, Artificial sequence
  SiRNA target sequence
gatatactaaagctacagaatttgat

SEQ ID NO: 138893 - DNA, 26 bp, Artificial sequence
  SiRNA target sequence
atatactaaagctacagaatttgatt

SEQ ID NO: 138894 - DNA, 26 bp, Artificial sequence
  SiRNA target sequence
tatactaaagctacagaatttgattt

SEQ ID NO: 138895 - DNA, 26 bp, Artificial sequence
  SiRNA target sequence
atactaaagctacagaatttgatttg

SEQ ID NO: 138896 - DNA, 26 bp, Artificial sequence
  SiRNA target sequence
tactaaagctacagaatttgatttgg

SEQ ID NO: 138897 - DNA, 26 bp, Artificial sequence
  SiRNA target sequence
actaaagctacagaatttgatttggc

SEQ ID NO: 138898 - DNA, 26 bp, Artificial sequence
  SiRNA target sequence
ctaaagctacagaatttgatttggca

SEQ ID NO: 138899 - DNA, 26 bp, Artificial sequence
  SiRNA target sequence
taaagctacagaatttgatttggcac

SEQ ID NO: 138900 - DNA, 26 bp, Artificial sequence
  SiRNA target sequence
aaagctacagaatttgatttggcact

SEQ ID NO: 138901 - DNA, 26 bp, Artificial sequence
  SiRNA target sequence
aagctacagaatttgatttggcactt

SEQ ID NO: 138902 - DNA, 26 bp, Artificial sequence
  SiRNA target sequence
agctacagaatttgatttggcactta

SEQ ID NO: 138903 - DNA, 26 bp, Artificial sequence
  SiRNA target sequence
gctacagaatttgatttggcacttac

SEQ ID NO: 138904 - DNA, 26 bp, Artificial sequence
  SiRNA target sequence
ctacagaatttgatttggcacttact

SEQ ID NO: 138905 - DNA, 26 bp, Artificial sequence
  SiRNA target sequence
tacagaatttgatttggcacttactt

SEQ ID NO: 138906 - DNA, 26 bp, Artificial sequence
  SiRNA target sequence
acagaatttgatttggcacttacttt

SEQ ID NO: 138907 - DNA, 26 bp, Artificial sequence
  SiRNA target sequence
cagaatttgatttggcacttacttta

SEQ ID NO: 138908 - DNA, 26 bp, Artificial sequence
  SiRNA target sequence
agaatttgatttggcacttactttaa

SEQ ID NO: 138909 - DNA, 26 bp, Artificial sequence
  SiRNA target sequence
gaatttgatttggcacttactttaaa

SEQ ID NO: 138910 - DNA, 26 bp, Artificial sequence
  SiRNA target sequence
aatttgatttggcacttactttaaat

SEQ ID NO: 138911 - DNA, 26 bp, Artificial sequence
  SiRNA target sequence
atttgatttggcacttactttaaata

SEQ ID NO: 138912 - DNA, 26 bp, Artificial sequence
  SiRNA target sequence
tttgatttggcacttactttaaatat

SEQ ID NO: 138913 - DNA, 26 bp, Artificial sequence
  SiRNA target sequence
ttgatttggcacttactttaaatatt

SEQ ID NO: 138914 - DNA, 26 bp, Artificial sequence
  SiRNA target sequence
tgatttggcacttactttaaatattc

SEQ ID NO: 138915 - DNA, 26 bp, Artificial sequence
  SiRNA target sequence
gatttggcacttactttaaatattcc

SEQ ID NO: 138916 - DNA, 26 bp, Artificial sequence
  SiRNA target sequence
atttggcacttactttaaatattcca

SEQ ID NO: 138917 - DNA, 26 bp, Artificial sequence
  SiRNA target sequence
tttggcacttactttaaatattccag

SEQ ID NO: 138918 - DNA, 26 bp, Artificial sequence
  SiRNA target sequence
ttggcacttactttaaatattccaga

SEQ ID NO: 138919 - DNA, 26 bp, Artificial sequence
  SiRNA target sequence
tggcacttactttaaatattccagaa

SEQ ID NO: 138920 - DNA, 26 bp, Artificial sequence
  SiRNA target sequence
ggcacttactttaaatattccagaag

SEQ ID NO: 138921 - DNA, 26 bp, Artificial sequence
  SiRNA target sequence
gcacttactttaaatattccagaaga

SEQ ID NO: 138922 - DNA, 26 bp, Artificial sequence
  SiRNA target sequence
cacttactttaaatattccagaagat

SEQ ID NO: 138923 - DNA, 26 bp, Artificial sequence
  SiRNA target sequence
acttactttaaatattccagaagata

SEQ ID NO: 138924 - DNA, 26 bp, Artificial sequence
  SiRNA target sequence
cttactttaaatattccagaagatat

SEQ ID NO: 138925 - DNA, 26 bp, Artificial sequence
  SiRNA target sequence
ttactttaaatattccagaagatata

SEQ ID NO: 138926 - DNA, 26 bp, Artificial sequence
  SiRNA target sequence
tactttaaatattccagaagatatag

SEQ ID NO: 138927 - DNA, 26 bp, Artificial sequence
  SiRNA target sequence
actttaaatattccagaagatatagc

SEQ ID NO: 138928 - DNA, 26 bp, Artificial sequence
  SiRNA target sequence
ctttaaatattccagaagatatagct

SEQ ID NO: 138929 - DNA, 26 bp, Artificial sequence
  SiRNA target sequence
tttaaatattccagaagatatagcta

SEQ ID NO: 138930 - DNA, 26 bp, Artificial sequence
  SiRNA target sequence
ttaaatattccagaagatatagctaa

SEQ ID NO: 138931 - DNA, 26 bp, Artificial sequence
  SiRNA target sequence
taaatattccagaagatatagctaag

SEQ ID NO: 138932 - DNA, 26 bp, Artificial sequence
  SiRNA target sequence
aaatattccagaagatatagctaagc

SEQ ID NO: 138933 - DNA, 26 bp, Artificial sequence
  SiRNA target sequence
aatattccagaagatatagctaagca

SEQ ID NO: 138934 - DNA, 26 bp, Artificial sequence
  SiRNA target sequence
atattccagaagatatagctaagcat

SEQ ID NO: 138935 - DNA, 26 bp, Artificial sequence
  SiRNA target sequence
tattccagaagatatagctaagcatt

SEQ ID NO: 138936 - DNA, 26 bp, Artificial sequence
  SiRNA target sequence
attccagaagatatagctaagcattt

SEQ ID NO: 138937 - DNA, 26 bp, Artificial sequence
  SiRNA target sequence
ttccagaagatatagctaagcattta

SEQ ID NO: 138938 - DNA, 26 bp, Artificial sequence
  SiRNA target sequence
tccagaagatatagctaagcatttag

SEQ ID NO: 138939 - DNA, 26 bp, Artificial sequence
  SiRNA target sequence
ccagaagatatagctaagcatttagc

SEQ ID NO: 138940 - DNA, 26 bp, Artificial sequence
  SiRNA target sequence
cagaagatatagctaagcatttagct

SEQ ID NO: 138941 - DNA, 26 bp, Artificial sequence
  SiRNA target sequence
agaagatatagctaagcatttagcta

SEQ ID NO: 138942 - DNA, 26 bp, Artificial sequence
  SiRNA target sequence
gaagatatagctaagcatttagctac

SEQ ID NO: 138943 - DNA, 26 bp, Artificial sequence
  SiRNA target sequence
aagatatagctaagcatttagctaca

SEQ ID NO: 138944 - DNA, 26 bp, Artificial sequence
  SiRNA target sequence
agatatagctaagcatttagctacaa

SEQ ID NO: 138945 - DNA, 26 bp, Artificial sequence
  SiRNA target sequence
gatatagctaagcatttagctacaac

SEQ ID NO: 138946 - DNA, 26 bp, Artificial sequence
  SiRNA target sequence
atatagctaagcatttagctacaact

SEQ ID NO: 138947 - DNA, 26 bp, Artificial sequence
  SiRNA target sequence
tatagctaagcatttagctacaactt

SEQ ID NO: 138948 - DNA, 26 bp, Artificial sequence
  SiRNA target sequence
atagctaagcatttagctacaactta

SEQ ID NO: 138949 - DNA, 26 bp, Artificial sequence
  SiRNA target sequence
tagctaagcatttagctacaacttat

SEQ ID NO: 138950 - DNA, 26 bp, Artificial sequence
  SiRNA target sequence
agctaagcatttagctacaacttatg

SEQ ID NO: 138951 - DNA, 26 bp, Artificial sequence
  SiRNA target sequence
gctaagcatttagctacaacttatgg

SEQ ID NO: 138952 - DNA, 26 bp, Artificial sequence
  SiRNA target sequence
ctaagcatttagctacaacttatggt

SEQ ID NO: 138953 - DNA, 26 bp, Artificial sequence
  SiRNA target sequence
taagcatttagctacaacttatggta

SEQ ID NO: 138954 - DNA, 26 bp, Artificial sequence
  SiRNA target sequence
aagcatttagctacaacttatggtac

SEQ ID NO: 138955 - DNA, 26 bp, Artificial sequence
  SiRNA target sequence
agcatttagctacaacttatggtacc

SEQ ID NO: 138956 - DNA, 26 bp, Artificial sequence
  SiRNA target sequence
gcatttagctacaacttatggtacca

SEQ ID NO: 138957 - DNA, 26 bp, Artificial sequence
  SiRNA target sequence
catttagctacaacttatggtaccaa

SEQ ID NO: 138958 - DNA, 26 bp, Artificial sequence
  SiRNA target sequence
atttagctacaacttatggtaccaaa

SEQ ID NO: 138959 - DNA, 26 bp, Artificial sequence
  SiRNA target sequence
tttagctacaacttatggtaccaaag

SEQ ID NO: 138960 - DNA, 26 bp, Artificial sequence
  SiRNA target sequence
ttagctacaacttatggtaccaaagc

SEQ ID NO: 138961 - DNA, 26 bp, Artificial sequence
  SiRNA target sequence
tagctacaacttatggtaccaaagct

SEQ ID NO: 138962 - DNA, 26 bp, Artificial sequence
  SiRNA target sequence
agctacaacttatggtaccaaagctt

SEQ ID NO: 138963 - DNA, 26 bp, Artificial sequence
  SiRNA target sequence
gctacaacttatggtaccaaagctta

SEQ ID NO: 138964 - DNA, 26 bp, Artificial sequence
  SiRNA target sequence
ctacaacttatggtaccaaagcttac

SEQ ID NO: 138965 - DNA, 26 bp, Artificial sequence
  SiRNA target sequence
tacaacttatggtaccaaagcttaca

SEQ ID NO: 138966 - DNA, 26 bp, Artificial sequence
  SiRNA target sequence
acaacttatggtaccaaagcttacaa

SEQ ID NO: 138967 - DNA, 26 bp, Artificial sequence
  SiRNA target sequence
caacttatggtaccaaagcttacaat

SEQ ID NO: 138968 - DNA, 26 bp, Artificial sequence
  SiRNA target sequence
aacttatggtaccaaagcttacaatt

SEQ ID NO: 138969 - DNA, 26 bp, Artificial sequence
  SiRNA target sequence
acttatggtaccaaagcttacaattt

SEQ ID NO: 138970 - DNA, 26 bp, Artificial sequence
  SiRNA target sequence
cttatggtaccaaagcttacaatttc

SEQ ID NO: 138971 - DNA, 26 bp, Artificial sequence
  SiRNA target sequence
ttatggtaccaaagcttacaatttct

SEQ ID NO: 138972 - DNA, 26 bp, Artificial sequence
  SiRNA target sequence
tatggtaccaaagcttacaatttctc

SEQ ID NO: 138973 - DNA, 26 bp, Artificial sequence
  SiRNA target sequence
atggtaccaaagcttacaatttctct

SEQ ID NO: 138974 - DNA, 26 bp, Artificial sequence
  SiRNA target sequence
tggtaccaaagcttacaatttctctg

SEQ ID NO: 138975 - DNA, 26 bp, Artificial sequence
  SiRNA target sequence
ggtaccaaagcttacaatttctctga

SEQ ID NO: 138976 - DNA, 26 bp, Artificial sequence
  SiRNA target sequence
gtaccaaagcttacaatttctctgaa

SEQ ID NO: 138977 - DNA, 26 bp, Artificial sequence
  SiRNA target sequence
taccaaagcttacaatttctctgaat

SEQ ID NO: 138978 - DNA, 26 bp, Artificial sequence
  SiRNA target sequence
accaaagcttacaatttctctgaata

SEQ ID NO: 138979 - DNA, 26 bp, Artificial sequence
  SiRNA target sequence
ccaaagcttacaatttctctgaatac

SEQ ID NO: 138980 - DNA, 26 bp, Artificial sequence
  SiRNA target sequence
caaagcttacaatttctctgaatact

SEQ ID NO: 138981 - DNA, 26 bp, Artificial sequence
  SiRNA target sequence
aaagcttacaatttctctgaatactt

SEQ ID NO: 138982 - DNA, 26 bp, Artificial sequence
  SiRNA target sequence
aagcttacaatttctctgaatacttt

SEQ ID NO: 138983 - DNA, 26 bp, Artificial sequence
  SiRNA target sequence
agcttacaatttctctgaatacttta

SEQ ID NO: 138984 - DNA, 26 bp, Artificial sequence
  SiRNA target sequence
gcttacaatttctctgaatactttaa

SEQ ID NO: 138985 - DNA, 26 bp, Artificial sequence
  SiRNA target sequence
cttacaatttctctgaatactttaat

SEQ ID NO: 138986 - DNA, 26 bp, Artificial sequence
  SiRNA target sequence
ttacaatttctctgaatactttaatg

SEQ ID NO: 138987 - DNA, 26 bp, Artificial sequence
  SiRNA target sequence
tacaatttctctgaatactttaatgg

SEQ ID NO: 138988 - DNA, 26 bp, Artificial sequence
  SiRNA target sequence
acaatttctctgaatactttaatggg

SEQ ID NO: 138989 - DNA, 26 bp, Artificial sequence
  SiRNA target sequence
caatttctctgaatactttaatgggt

SEQ ID NO: 138990 - DNA, 26 bp, Artificial sequence
  SiRNA target sequence
aatttctctgaatactttaatgggtc

SEQ ID NO: 138991 - DNA, 26 bp, Artificial sequence
  SiRNA target sequence
atttctctgaatactttaatgggtca

SEQ ID NO: 138992 - DNA, 26 bp, Artificial sequence
  SiRNA target sequence
tttctctgaatactttaatgggtcat

SEQ ID NO: 138993 - DNA, 26 bp, Artificial sequence
  SiRNA target sequence
ttctctgaatactttaatgggtcata

SEQ ID NO: 138994 - DNA, 26 bp, Artificial sequence
  SiRNA target sequence
tctctgaatactttaatgggtcatac

SEQ ID NO: 138995 - DNA, 26 bp, Artificial sequence
  SiRNA target sequence
ctctgaatactttaatgggtcataca

SEQ ID NO: 138996 - DNA, 26 bp, Artificial sequence
  SiRNA target sequence
tctgaatactttaatgggtcatacac

SEQ ID NO: 138997 - DNA, 26 bp, Artificial sequence
  SiRNA target sequence
ctgaatactttaatgggtcatacacc

SEQ ID NO: 138998 - DNA, 26 bp, Artificial sequence
  SiRNA target sequence
tgaatactttaatgggtcatacacca

SEQ ID NO: 138999 - DNA, 26 bp, Artificial sequence
  SiRNA target sequence
gaatactttaatgggtcatacaccag

SEQ ID NO: 139000 - DNA, 26 bp, Artificial sequence
  SiRNA target sequence
aatactttaatgggtcatacaccaga

SEQ ID NO: 139001 - DNA, 26 bp, Artificial sequence
  SiRNA target sequence
atactttaatgggtcatacaccagac

SEQ ID NO: 139002 - DNA, 26 bp, Artificial sequence
  SiRNA target sequence
tactttaatgggtcatacaccagact

SEQ ID NO: 139003 - DNA, 26 bp, Artificial sequence
  SiRNA target sequence
actttaatgggtcatacaccagactt

SEQ ID NO: 139004 - DNA, 26 bp, Artificial sequence
  SiRNA target sequence
ctttaatgggtcatacaccagactta

SEQ ID NO: 139005 - DNA, 26 bp, Artificial sequence
  SiRNA target sequence
tttaatgggtcatacaccagacttac

SEQ ID NO: 139006 - DNA, 26 bp, Artificial sequence
  SiRNA target sequence
ttaatgggtcatacaccagacttaca

SEQ ID NO: 139007 - DNA, 26 bp, Artificial sequence
  SiRNA target sequence
taatgggtcatacaccagacttacag

SEQ ID NO: 139008 - DNA, 26 bp, Artificial sequence
  SiRNA target sequence
aatgggtcatacaccagacttacaga

SEQ ID NO: 139009 - DNA, 26 bp, Artificial sequence
  SiRNA target sequence
atgggtcatacaccagacttacagat

SEQ ID NO: 139010 - DNA, 26 bp, Artificial sequence
  SiRNA target sequence
tgggtcatacaccagacttacagatg

SEQ ID NO: 139011 - DNA, 26 bp, Artificial sequence
  SiRNA target sequence
gggtcatacaccagacttacagatgg

SEQ ID NO: 139012 - DNA, 26 bp, Artificial sequence
  SiRNA target sequence
ggtcatacaccagacttacagatggt

SEQ ID NO: 139013 - DNA, 26 bp, Artificial sequence
  SiRNA target sequence
gtcatacaccagacttacagatggtt

SEQ ID NO: 139014 - DNA, 26 bp, Artificial sequence
  SiRNA target sequence
tcatacaccagacttacagatggtta

SEQ ID NO: 139015 - DNA, 26 bp, Artificial sequence
  SiRNA target sequence
catacaccagacttacagatggttat

SEQ ID NO: 139016 - DNA, 26 bp, Artificial sequence
  SiRNA target sequence
atacaccagacttacagatggttatc

SEQ ID NO: 139017 - DNA, 26 bp, Artificial sequence
  SiRNA target sequence
tacaccagacttacagatggttatcc

SEQ ID NO: 139018 - DNA, 26 bp, Artificial sequence
  SiRNA target sequence
acaccagacttacagatggttatcct

SEQ ID NO: 139019 - DNA, 26 bp, Artificial sequence
  SiRNA target sequence
caccagacttacagatggttatcctt

SEQ ID NO: 139020 - DNA, 26 bp, Artificial sequence
  SiRNA target sequence
accagacttacagatggttatcctta

SEQ ID NO: 139021 - DNA, 26 bp, Artificial sequence
  SiRNA target sequence
ccagacttacagatggttatccttat

SEQ ID NO: 139022 - DNA, 26 bp, Artificial sequence
  SiRNA target sequence
cagacttacagatggttatccttata

SEQ ID NO: 139023 - DNA, 26 bp, Artificial sequence
  SiRNA target sequence
agacttacagatggttatccttatac

SEQ ID NO: 139024 - DNA, 26 bp, Artificial sequence
  SiRNA target sequence
gacttacagatggttatccttataca

SEQ ID NO: 139025 - DNA, 26 bp, Artificial sequence
  SiRNA target sequence
acttacagatggttatccttatacaa

SEQ ID NO: 139026 - DNA, 26 bp, Artificial sequence
  SiRNA target sequence
cttacagatggttatccttatacaaa

SEQ ID NO: 139027 - DNA, 26 bp, Artificial sequence
  SiRNA target sequence
ttacagatggttatccttatacaaaa

SEQ ID NO: 139028 - DNA, 26 bp, Artificial sequence
  SiRNA target sequence
tacagatggttatccttatacaaaag

SEQ ID NO: 139029 - DNA, 26 bp, Artificial sequence
  SiRNA target sequence
acagatggttatccttatacaaaaga

SEQ ID NO: 139030 - DNA, 26 bp, Artificial sequence
  SiRNA target sequence
cagatggttatccttatacaaaagaa

SEQ ID NO: 139031 - DNA, 26 bp, Artificial sequence
  SiRNA target sequence
agatggttatccttatacaaaagaag

SEQ ID NO: 139032 - DNA, 26 bp, Artificial sequence
  SiRNA target sequence
gatggttatccttatacaaaagaaga

SEQ ID NO: 139033 - DNA, 26 bp, Artificial sequence
  SiRNA target sequence
atggttatccttatacaaaagaagaa

SEQ ID NO: 139034 - DNA, 26 bp, Artificial sequence
  SiRNA target sequence
tggttatccttatacaaaagaagaaa

SEQ ID NO: 139035 - DNA, 26 bp, Artificial sequence
  SiRNA target sequence
ggttatccttatacaaaagaagaaat

SEQ ID NO: 139036 - DNA, 26 bp, Artificial sequence
  SiRNA target sequence
gttatccttatacaaaagaagaaata

SEQ ID NO: 139037 - DNA, 26 bp, Artificial sequence
  SiRNA target sequence
ttatccttatacaaaagaagaaatag

SEQ ID NO: 139038 - DNA, 26 bp, Artificial sequence
  SiRNA target sequence
tatccttatacaaaagaagaaatagt

SEQ ID NO: 139039 - DNA, 26 bp, Artificial sequence
  SiRNA target sequence
atccttatacaaaagaagaaatagta

SEQ ID NO: 139040 - DNA, 26 bp, Artificial sequence
  SiRNA target sequence
tccttatacaaaagaagaaatagtat

SEQ ID NO: 139041 - DNA, 26 bp, Artificial sequence
  SiRNA target sequence
ccttatacaaaagaagaaatagtata

SEQ ID NO: 139042 - DNA, 26 bp, Artificial sequence
  SiRNA target sequence
cttatacaaaagaagaaatagtatat

SEQ ID NO: 139043 - DNA, 26 bp, Artificial sequence
  SiRNA target sequence
ttatacaaaagaagaaatagtatatt

SEQ ID NO: 139044 - DNA, 26 bp, Artificial sequence
  SiRNA target sequence
tatacaaaagaagaaatagtatattg

SEQ ID NO: 139045 - DNA, 26 bp, Artificial sequence
  SiRNA target sequence
atacaaaagaagaaatagtatattgt

SEQ ID NO: 139046 - DNA, 26 bp, Artificial sequence
  SiRNA target sequence
tacaaaagaagaaatagtatattgta

SEQ ID NO: 139047 - DNA, 26 bp, Artificial sequence
  SiRNA target sequence
acaaaagaagaaatagtatattgtat

SEQ ID NO: 139048 - DNA, 26 bp, Artificial sequence
  SiRNA target sequence
caaaagaagaaatagtatattgtatc

SEQ ID NO: 139049 - DNA, 26 bp, Artificial sequence
  SiRNA target sequence
aaaagaagaaatagtatattgtatcg

SEQ ID NO: 139050 - DNA, 26 bp, Artificial sequence
  SiRNA target sequence
aaagaagaaatagtatattgtatcga

SEQ ID NO: 139051 - DNA, 26 bp, Artificial sequence
  SiRNA target sequence
aagaagaaatagtatattgtatcgaa

SEQ ID NO: 139052 - DNA, 26 bp, Artificial sequence
  SiRNA target sequence
agaagaaatagtatattgtatcgaac

SEQ ID NO: 139053 - DNA, 26 bp, Artificial sequence
  SiRNA target sequence
gaagaaatagtatattgtatcgaaca

SEQ ID NO: 139054 - DNA, 26 bp, Artificial sequence
  SiRNA target sequence
aagaaatagtatattgtatcgaacat

SEQ ID NO: 139055 - DNA, 26 bp, Artificial sequence
  SiRNA target sequence
agaaatagtatattgtatcgaacatg

SEQ ID NO: 139056 - DNA, 26 bp, Artificial sequence
  SiRNA target sequence
gaaatagtatattgtatcgaacatga

SEQ ID NO: 139057 - DNA, 26 bp, Artificial sequence
  SiRNA target sequence
aaatagtatattgtatcgaacatgaa

SEQ ID NO: 139058 - DNA, 26 bp, Artificial sequence
  SiRNA target sequence
aatagtatattgtatcgaacatgaat

SEQ ID NO: 139059 - DNA, 26 bp, Artificial sequence
  SiRNA target sequence
atagtatattgtatcgaacatgaatt

SEQ ID NO: 139060 - DNA, 26 bp, Artificial sequence
  SiRNA target sequence
tagtatattgtatcgaacatgaattg

SEQ ID NO: 139061 - DNA, 26 bp, Artificial sequence
  SiRNA target sequence
agtatattgtatcgaacatgaattgg

SEQ ID NO: 139062 - DNA, 26 bp, Artificial sequence
  SiRNA target sequence
gtatattgtatcgaacatgaattggc

SEQ ID NO: 139063 - DNA, 26 bp, Artificial sequence
  SiRNA target sequence
tatattgtatcgaacatgaattggct

SEQ ID NO: 139064 - DNA, 26 bp, Artificial sequence
  SiRNA target sequence
atattgtatcgaacatgaattggctt

SEQ ID NO: 139065 - DNA, 26 bp, Artificial sequence
  SiRNA target sequence
tattgtatcgaacatgaattggctta

SEQ ID NO: 139066 - DNA, 26 bp, Artificial sequence
  SiRNA target sequence
attgtatcgaacatgaattggcttat

SEQ ID NO: 139067 - DNA, 26 bp, Artificial sequence
  SiRNA target sequence
ttgtatcgaacatgaattggcttatc

SEQ ID NO: 139068 - DNA, 26 bp, Artificial sequence
  SiRNA target sequence
tgtatcgaacatgaattggcttatcg

SEQ ID NO: 139069 - DNA, 26 bp, Artificial sequence
  SiRNA target sequence
gtatcgaacatgaattggcttatcgc

SEQ ID NO: 139070 - DNA, 26 bp, Artificial sequence
  SiRNA target sequence
tatcgaacatgaattggcttatcgca

SEQ ID NO: 139071 - DNA, 26 bp, Artificial sequence
  SiRNA target sequence
atcgaacatgaattggcttatcgcat

SEQ ID NO: 139072 - DNA, 26 bp, Artificial sequence
  SiRNA target sequence
tcgaacatgaattggcttatcgcatc

SEQ ID NO: 139073 - DNA, 26 bp, Artificial sequence
  SiRNA target sequence
cgaacatgaattggcttatcgcatca

SEQ ID NO: 139074 - DNA, 26 bp, Artificial sequence
  SiRNA target sequence
gaacatgaattggcttatcgcatcag

SEQ ID NO: 139075 - DNA, 26 bp, Artificial sequence
  SiRNA target sequence
aacatgaattggcttatcgcatcagt

SEQ ID NO: 139076 - DNA, 26 bp, Artificial sequence
  SiRNA target sequence
acatgaattggcttatcgcatcagtg

SEQ ID NO: 139077 - DNA, 26 bp, Artificial sequence
  SiRNA target sequence
catgaattggcttatcgcatcagtga

SEQ ID NO: 139078 - DNA, 26 bp, Artificial sequence
  SiRNA target sequence
atgaattggcttatcgcatcagtgat

SEQ ID NO: 139079 - DNA, 26 bp, Artificial sequence
  SiRNA target sequence
tgaattggcttatcgcatcagtgata

SEQ ID NO: 139080 - DNA, 26 bp, Artificial sequence
  SiRNA target sequence
gaattggcttatcgcatcagtgatat

SEQ ID NO: 139081 - DNA, 26 bp, Artificial sequence
  SiRNA target sequence
aattggcttatcgcatcagtgatata

SEQ ID NO: 139082 - DNA, 26 bp, Artificial sequence
  SiRNA target sequence
attggcttatcgcatcagtgatatat

SEQ ID NO: 139083 - DNA, 26 bp, Artificial sequence
  SiRNA target sequence
ttggcttatcgcatcagtgatatatt

SEQ ID NO: 139084 - DNA, 26 bp, Artificial sequence
  SiRNA target sequence
tggcttatcgcatcagtgatatatta

SEQ ID NO: 139085 - DNA, 26 bp, Artificial sequence
  SiRNA target sequence
ggcttatcgcatcagtgatatattat

SEQ ID NO: 139086 - DNA, 26 bp, Artificial sequence
  SiRNA target sequence
gcttatcgcatcagtgatatattatt

SEQ ID NO: 139087 - DNA, 26 bp, Artificial sequence
  SiRNA target sequence
cttatcgcatcagtgatatattattt

SEQ ID NO: 139088 - DNA, 26 bp, Artificial sequence
  SiRNA target sequence
ttatcgcatcagtgatatattattta

SEQ ID NO: 139089 - DNA, 26 bp, Artificial sequence
  SiRNA target sequence
tatcgcatcagtgatatattatttaa

SEQ ID NO: 139090 - DNA, 26 bp, Artificial sequence
  SiRNA target sequence
atcgcatcagtgatatattatttaat

SEQ ID NO: 139091 - DNA, 26 bp, Artificial sequence
  SiRNA target sequence
tcgcatcagtgatatattatttaata

SEQ ID NO: 139092 - DNA, 26 bp, Artificial sequence
  SiRNA target sequence
cgcatcagtgatatattatttaatag

SEQ ID NO: 139093 - DNA, 26 bp, Artificial sequence
  SiRNA target sequence
gcatcagtgatatattatttaatagg

SEQ ID NO: 139094 - DNA, 26 bp, Artificial sequence
  SiRNA target sequence
catcagtgatatattatttaatagga

SEQ ID NO: 139095 - DNA, 26 bp, Artificial sequence
  SiRNA target sequence
atcagtgatatattatttaataggat

SEQ ID NO: 139096 - DNA, 26 bp, Artificial sequence
  SiRNA target sequence
tcagtgatatattatttaataggatg

SEQ ID NO: 139097 - DNA, 26 bp, Artificial sequence
  SiRNA target sequence
cagtgatatattatttaataggatga

SEQ ID NO: 139098 - DNA, 26 bp, Artificial sequence
  SiRNA target sequence
agtgatatattatttaataggatgat

SEQ ID NO: 139099 - DNA, 26 bp, Artificial sequence
  SiRNA target sequence
gtgatatattatttaataggatgatg

SEQ ID NO: 139100 - DNA, 26 bp, Artificial sequence
  SiRNA target sequence
tgatatattatttaataggatgatga

SEQ ID NO: 139101 - DNA, 26 bp, Artificial sequence
  SiRNA target sequence
gatatattatttaataggatgatgat

SEQ ID NO: 139102 - DNA, 26 bp, Artificial sequence
  SiRNA target sequence
atatattatttaataggatgatgata

SEQ ID NO: 139103 - DNA, 26 bp, Artificial sequence
  SiRNA target sequence
tatattatttaataggatgatgatag

SEQ ID NO: 139104 - DNA, 26 bp, Artificial sequence
  SiRNA target sequence
atattatttaataggatgatgatagg

SEQ ID NO: 139105 - DNA, 26 bp, Artificial sequence
  SiRNA target sequence
tattatttaataggatgatgatagga

SEQ ID NO: 139106 - DNA, 26 bp, Artificial sequence
  SiRNA target sequence
attatttaataggatgatgataggat

SEQ ID NO: 139107 - DNA, 26 bp, Artificial sequence
  SiRNA target sequence
ttatttaataggatgatgataggata

SEQ ID NO: 139108 - DNA, 26 bp, Artificial sequence
  SiRNA target sequence
tatttaataggatgatgataggatac

SEQ ID NO: 139109 - DNA, 26 bp, Artificial sequence
  SiRNA target sequence
atttaataggatgatgataggataca

SEQ ID NO: 139110 - DNA, 26 bp, Artificial sequence
  SiRNA target sequence
tttaataggatgatgataggatacat

SEQ ID NO: 139111 - DNA, 26 bp, Artificial sequence
  SiRNA target sequence
ttaataggatgatgataggatacatt

SEQ ID NO: 139112 - DNA, 26 bp, Artificial sequence
  SiRNA target sequence
taataggatgatgataggatacattg

SEQ ID NO: 139113 - DNA, 26 bp, Artificial sequence
  SiRNA target sequence
aataggatgatgataggatacattga

SEQ ID NO: 139114 - DNA, 26 bp, Artificial sequence
  SiRNA target sequence
ataggatgatgataggatacattgac

SEQ ID NO: 139115 - DNA, 26 bp, Artificial sequence
  SiRNA target sequence
taggatgatgataggatacattgacg

SEQ ID NO: 139116 - DNA, 26 bp, Artificial sequence
  SiRNA target sequence
aggatgatgataggatacattgacgt

SEQ ID NO: 139117 - DNA, 26 bp, Artificial sequence
  SiRNA target sequence
ggatgatgataggatacattgacgtc

SEQ ID NO: 139118 - DNA, 26 bp, Artificial sequence
  SiRNA target sequence
gatgatgataggatacattgacgtca

SEQ ID NO: 139119 - DNA, 26 bp, Artificial sequence
  SiRNA target sequence
atgatgataggatacattgacgtcag

SEQ ID NO: 139120 - DNA, 26 bp, Artificial sequence
  SiRNA target sequence
tgatgataggatacattgacgtcaga

SEQ ID NO: 139121 - DNA, 26 bp, Artificial sequence
  SiRNA target sequence
gatgataggatacattgacgtcagaa

SEQ ID NO: 139122 - DNA, 26 bp, Artificial sequence
  SiRNA target sequence
atgataggatacattgacgtcagaag

SEQ ID NO: 139123 - DNA, 26 bp, Artificial sequence
  SiRNA target sequence
tgataggatacattgacgtcagaaga

SEQ ID NO: 139124 - DNA, 26 bp, Artificial sequence
  SiRNA target sequence
gataggatacattgacgtcagaagag

SEQ ID NO: 139125 - DNA, 26 bp, Artificial sequence
  SiRNA target sequence
ataggatacattgacgtcagaagagc

SEQ ID NO: 139126 - DNA, 26 bp, Artificial sequence
  SiRNA target sequence
taggatacattgacgtcagaagagca

SEQ ID NO: 139127 - DNA, 26 bp, Artificial sequence
  SiRNA target sequence
aggatacattgacgtcagaagagcat

SEQ ID NO: 139128 - DNA, 26 bp, Artificial sequence
  SiRNA target sequence
ggatacattgacgtcagaagagcatt

SEQ ID NO: 139129 - DNA, 26 bp, Artificial sequence
  SiRNA target sequence
gatacattgacgtcagaagagcattt

SEQ ID NO: 139130 - DNA, 26 bp, Artificial sequence
  SiRNA target sequence
atacattgacgtcagaagagcatttg

SEQ ID NO: 139131 - DNA, 26 bp, Artificial sequence
  SiRNA target sequence
tacattgacgtcagaagagcatttga

SEQ ID NO: 139132 - DNA, 26 bp, Artificial sequence
  SiRNA target sequence
acattgacgtcagaagagcatttgat

SEQ ID NO: 139133 - DNA, 26 bp, Artificial sequence
  SiRNA target sequence
cattgacgtcagaagagcatttgatt

SEQ ID NO: 139134 - DNA, 26 bp, Artificial sequence
  SiRNA target sequence
attgacgtcagaagagcatttgattt

SEQ ID NO: 139135 - DNA, 26 bp, Artificial sequence
  SiRNA target sequence
ttgacgtcagaagagcatttgattta

SEQ ID NO: 139136 - DNA, 26 bp, Artificial sequence
  SiRNA target sequence
tgacgtcagaagagcatttgatttaa

SEQ ID NO: 139137 - DNA, 26 bp, Artificial sequence
  SiRNA target sequence
gacgtcagaagagcatttgatttaat

SEQ ID NO: 139138 - DNA, 26 bp, Artificial sequence
  SiRNA target sequence
acgtcagaagagcatttgatttaatt

SEQ ID NO: 139139 - DNA, 26 bp, Artificial sequence
  SiRNA target sequence
cgtcagaagagcatttgatttaattg

SEQ ID NO: 139140 - DNA, 26 bp, Artificial sequence
  SiRNA target sequence
gtcagaagagcatttgatttaattgg

SEQ ID NO: 139141 - DNA, 26 bp, Artificial sequence
  SiRNA target sequence
tcagaagagcatttgatttaattggt

SEQ ID NO: 139142 - DNA, 26 bp, Artificial sequence
  SiRNA target sequence
cagaagagcatttgatttaattggta

SEQ ID NO: 139143 - DNA, 26 bp, Artificial sequence
  SiRNA target sequence
agaagagcatttgatttaattggtat

SEQ ID NO: 139144 - DNA, 26 bp, Artificial sequence
  SiRNA target sequence
gaagagcatttgatttaattggtata

SEQ ID NO: 139145 - DNA, 26 bp, Artificial sequence
  SiRNA target sequence
aagagcatttgatttaattggtatag

SEQ ID NO: 139146 - DNA, 26 bp, Artificial sequence
  SiRNA target sequence
agagcatttgatttaattggtatagt

SEQ ID NO: 139147 - DNA, 26 bp, Artificial sequence
  SiRNA target sequence
gagcatttgatttaattggtatagta

SEQ ID NO: 139148 - DNA, 26 bp, Artificial sequence
  SiRNA target sequence
agcatttgatttaattggtatagtag

SEQ ID NO: 139149 - DNA, 26 bp, Artificial sequence
  SiRNA target sequence
gcatttgatttaattggtatagtagc

SEQ ID NO: 139150 - DNA, 26 bp, Artificial sequence
  SiRNA target sequence
catttgatttaattggtatagtagct

SEQ ID NO: 139151 - DNA, 26 bp, Artificial sequence
  SiRNA target sequence
atttgatttaattggtatagtagctg

SEQ ID NO: 139152 - DNA, 26 bp, Artificial sequence
  SiRNA target sequence
tttgatttaattggtatagtagctga

SEQ ID NO: 139153 - DNA, 26 bp, Artificial sequence
  SiRNA target sequence
ttgatttaattggtatagtagctgaa

SEQ ID NO: 139154 - DNA, 26 bp, Artificial sequence
  SiRNA target sequence
tgatttaattggtatagtagctgaag

SEQ ID NO: 139155 - DNA, 26 bp, Artificial sequence
  SiRNA target sequence
gatttaattggtatagtagctgaagt

SEQ ID NO: 139156 - DNA, 26 bp, Artificial sequence
  SiRNA target sequence
atttaattggtatagtagctgaagta

SEQ ID NO: 139157 - DNA, 26 bp, Artificial sequence
  SiRNA target sequence
tttaattggtatagtagctgaagtaa

SEQ ID NO: 139158 - DNA, 26 bp, Artificial sequence
  SiRNA target sequence
ttaattggtatagtagctgaagtaat

SEQ ID NO: 139159 - DNA, 26 bp, Artificial sequence
  SiRNA target sequence
taattggtatagtagctgaagtaatg

SEQ ID NO: 139160 - DNA, 26 bp, Artificial sequence
  SiRNA target sequence
aattggtatagtagctgaagtaatga

SEQ ID NO: 139161 - DNA, 26 bp, Artificial sequence
  SiRNA target sequence
attggtatagtagctgaagtaatgaa

SEQ ID NO: 139162 - DNA, 26 bp, Artificial sequence
  SiRNA target sequence
ttggtatagtagctgaagtaatgaaa

SEQ ID NO: 139163 - DNA, 26 bp, Artificial sequence
  SiRNA target sequence
tggtatagtagctgaagtaatgaaag

SEQ ID NO: 139164 - DNA, 26 bp, Artificial sequence
  SiRNA target sequence
ggtatagtagctgaagtaatgaaaga

SEQ ID NO: 139165 - DNA, 26 bp, Artificial sequence
  SiRNA target sequence
gtatagtagctgaagtaatgaaagac

SEQ ID NO: 139166 - DNA, 26 bp, Artificial sequence
  SiRNA target sequence
tatagtagctgaagtaatgaaagact

SEQ ID NO: 139167 - DNA, 26 bp, Artificial sequence
  SiRNA target sequence
atagtagctgaagtaatgaaagacta

SEQ ID NO: 139168 - DNA, 26 bp, Artificial sequence
  SiRNA target sequence
tagtagctgaagtaatgaaagactat

SEQ ID NO: 139169 - DNA, 26 bp, Artificial sequence
  SiRNA target sequence
agtagctgaagtaatgaaagactatt

SEQ ID NO: 139170 - DNA, 26 bp, Artificial sequence
  SiRNA target sequence
gtagctgaagtaatgaaagactatta

SEQ ID NO: 139171 - DNA, 26 bp, Artificial sequence
  SiRNA target sequence
tagctgaagtaatgaaagactattac

SEQ ID NO: 139172 - DNA, 26 bp, Artificial sequence
  SiRNA target sequence
agctgaagtaatgaaagactattacg

SEQ ID NO: 139173 - DNA, 26 bp, Artificial sequence
  SiRNA target sequence
gctgaagtaatgaaagactattacgg

SEQ ID NO: 139174 - DNA, 26 bp, Artificial sequence
  SiRNA target sequence
ctgaagtaatgaaagactattacgga

SEQ ID NO: 139175 - DNA, 26 bp, Artificial sequence
  SiRNA target sequence
tgaagtaatgaaagactattacggat

SEQ ID NO: 139176 - DNA, 26 bp, Artificial sequence
  SiRNA target sequence
gaagtaatgaaagactattacggatg

SEQ ID NO: 139177 - DNA, 26 bp, Artificial sequence
  SiRNA target sequence
aagtaatgaaagactattacggatgg

SEQ ID NO: 139178 - DNA, 26 bp, Artificial sequence
  SiRNA target sequence
agtaatgaaagactattacggatggg

SEQ ID NO: 139179 - DNA, 26 bp, Artificial sequence
  SiRNA target sequence
gtaatgaaagactattacggatggga

SEQ ID NO: 139180 - DNA, 26 bp, Artificial sequence
  SiRNA target sequence
taatgaaagactattacggatgggat

SEQ ID NO: 139181 - DNA, 26 bp, Artificial sequence
  SiRNA target sequence
aatgaaagactattacggatgggatc

SEQ ID NO: 139182 - DNA, 26 bp, Artificial sequence
  SiRNA target sequence
atgaaagactattacggatgggatca

SEQ ID NO: 139183 - DNA, 26 bp, Artificial sequence
  SiRNA target sequence
tgaaagactattacggatgggatcag

SEQ ID NO: 139184 - DNA, 26 bp, Artificial sequence
  SiRNA target sequence
gaaagactattacggatgggatcagc

SEQ ID NO: 139185 - DNA, 26 bp, Artificial sequence
  SiRNA target sequence
aaagactattacggatgggatcagca

SEQ ID NO: 139186 - DNA, 26 bp, Artificial sequence
  SiRNA target sequence
aagactattacggatgggatcagcaa

SEQ ID NO: 139187 - DNA, 26 bp, Artificial sequence
  SiRNA target sequence
agactattacggatgggatcagcaaa

SEQ ID NO: 139188 - DNA, 26 bp, Artificial sequence
  SiRNA target sequence
gactattacggatgggatcagcaaag

SEQ ID NO: 139189 - DNA, 26 bp, Artificial sequence
  SiRNA target sequence
actattacggatgggatcagcaaaga

SEQ ID NO: 139190 - DNA, 26 bp, Artificial sequence
  SiRNA target sequence
ctattacggatgggatcagcaaagat

SEQ ID NO: 139191 - DNA, 26 bp, Artificial sequence
  SiRNA target sequence
tattacggatgggatcagcaaagata

SEQ ID NO: 139192 - DNA, 26 bp, Artificial sequence
  SiRNA target sequence
attacggatgggatcagcaaagatat

SEQ ID NO: 139193 - DNA, 26 bp, Artificial sequence
  SiRNA target sequence
ttacggatgggatcagcaaagatata

SEQ ID NO: 139194 - DNA, 26 bp, Artificial sequence
  SiRNA target sequence
tacggatgggatcagcaaagatataa

SEQ ID NO: 139195 - DNA, 26 bp, Artificial sequence
  SiRNA target sequence
acggatgggatcagcaaagatataat

SEQ ID NO: 139196 - DNA, 26 bp, Artificial sequence
  SiRNA target sequence
cggatgggatcagcaaagatataatg

SEQ ID NO: 139197 - DNA, 26 bp, Artificial sequence
  SiRNA target sequence
ggatgggatcagcaaagatataatga

SEQ ID NO: 139198 - DNA, 26 bp, Artificial sequence
  SiRNA target sequence
gatgggatcagcaaagatataatgaa

SEQ ID NO: 139199 - DNA, 26 bp, Artificial sequence
  SiRNA target sequence
atgggatcagcaaagatataatgaag

SEQ ID NO: 139200 - DNA, 26 bp, Artificial sequence
  SiRNA target sequence
tgggatcagcaaagatataatgaaga

SEQ ID NO: 139201 - DNA, 26 bp, Artificial sequence
  SiRNA target sequence
gggatcagcaaagatataatgaagaa

SEQ ID NO: 139202 - DNA, 26 bp, Artificial sequence
  SiRNA target sequence
ggatcagcaaagatataatgaagaaa

SEQ ID NO: 139203 - DNA, 26 bp, Artificial sequence
  SiRNA target sequence
gatcagcaaagatataatgaagaaac

SEQ ID NO: 139204 - DNA, 26 bp, Artificial sequence
  SiRNA target sequence
atcagcaaagatataatgaagaaaca

SEQ ID NO: 139205 - DNA, 26 bp, Artificial sequence
  SiRNA target sequence
tcagcaaagatataatgaagaaacaa

SEQ ID NO: 139206 - DNA, 26 bp, Artificial sequence
  SiRNA target sequence
cagcaaagatataatgaagaaacaaa

SEQ ID NO: 139207 - DNA, 26 bp, Artificial sequence
  SiRNA target sequence
agcaaagatataatgaagaaacaaaa

SEQ ID NO: 139208 - DNA, 26 bp, Artificial sequence
  SiRNA target sequence
gcaaagatataatgaagaaacaaaat

SEQ ID NO: 139209 - DNA, 26 bp, Artificial sequence
  SiRNA target sequence
caaagatataatgaagaaacaaaatt

SEQ ID NO: 139210 - DNA, 26 bp, Artificial sequence
  SiRNA target sequence
aaagatataatgaagaaacaaaatta

SEQ ID NO: 139211 - DNA, 26 bp, Artificial sequence
  SiRNA target sequence
aagatataatgaagaaacaaaattat

SEQ ID NO: 139212 - DNA, 26 bp, Artificial sequence
  SiRNA target sequence
agatataatgaagaaacaaaattatg

SEQ ID NO: 139213 - DNA, 26 bp, Artificial sequence
  SiRNA target sequence
gatataatgaagaaacaaaattatgc

SEQ ID NO: 139214 - DNA, 26 bp, Artificial sequence
  SiRNA target sequence
atataatgaagaaacaaaattatgca

SEQ ID NO: 139215 - DNA, 26 bp, Artificial sequence
  SiRNA target sequence
tataatgaagaaacaaaattatgcat

SEQ ID NO: 139216 - DNA, 26 bp, Artificial sequence
  SiRNA target sequence
ataatgaagaaacaaaattatgcatg

SEQ ID NO: 139217 - DNA, 26 bp, Artificial sequence
  SiRNA target sequence
taatgaagaaacaaaattatgcatgg

SEQ ID NO: 139218 - DNA, 26 bp, Artificial sequence
  SiRNA target sequence
aatgaagaaacaaaattatgcatgga

SEQ ID NO: 139219 - DNA, 26 bp, Artificial sequence
  SiRNA target sequence
atgaagaaacaaaattatgcatggaa

SEQ ID NO: 139220 - DNA, 26 bp, Artificial sequence
  SiRNA target sequence
tgaagaaacaaaattatgcatggaaa

SEQ ID NO: 139221 - DNA, 26 bp, Artificial sequence
  SiRNA target sequence
gaagaaacaaaattatgcatggaaat

SEQ ID NO: 139222 - DNA, 26 bp, Artificial sequence
  SiRNA target sequence
aagaaacaaaattatgcatggaaatg

SEQ ID NO: 139223 - DNA, 26 bp, Artificial sequence
  SiRNA target sequence
agaaacaaaattatgcatggaaatga

SEQ ID NO: 139224 - DNA, 26 bp, Artificial sequence
  SiRNA target sequence
gaaacaaaattatgcatggaaatgat

SEQ ID NO: 139225 - DNA, 26 bp, Artificial sequence
  SiRNA target sequence
aaacaaaattatgcatggaaatgatg

SEQ ID NO: 139226 - DNA, 26 bp, Artificial sequence
  SiRNA target sequence
aacaaaattatgcatggaaatgatgg

SEQ ID NO: 139227 - DNA, 26 bp, Artificial sequence
  SiRNA target sequence
acaaaattatgcatggaaatgatgga

SEQ ID NO: 139228 - DNA, 26 bp, Artificial sequence
  SiRNA target sequence
caaaattatgcatggaaatgatggaa

SEQ ID NO: 139229 - DNA, 26 bp, Artificial sequence
  SiRNA target sequence
aaaattatgcatggaaatgatggaaa

SEQ ID NO: 139230 - DNA, 26 bp, Artificial sequence
  SiRNA target sequence
aaattatgcatggaaatgatggaaac

SEQ ID NO: 139231 - DNA, 26 bp, Artificial sequence
  SiRNA target sequence
aattatgcatggaaatgatggaaact

SEQ ID NO: 139232 - DNA, 26 bp, Artificial sequence
  SiRNA target sequence
attatgcatggaaatgatggaaactt

SEQ ID NO: 139233 - DNA, 26 bp, Artificial sequence
  SiRNA target sequence
ttatgcatggaaatgatggaaacttg

SEQ ID NO: 139234 - DNA, 26 bp, Artificial sequence
  SiRNA target sequence
tatgcatggaaatgatggaaacttgt

SEQ ID NO: 139235 - DNA, 26 bp, Artificial sequence
  SiRNA target sequence
atgcatggaaatgatggaaacttgtg

SEQ ID NO: 139236 - DNA, 26 bp, Artificial sequence
  SiRNA target sequence
tgcatggaaatgatggaaacttgtgg

SEQ ID NO: 139237 - DNA, 26 bp, Artificial sequence
  SiRNA target sequence
gcatggaaatgatggaaacttgtggt

SEQ ID NO: 139238 - DNA, 26 bp, Artificial sequence
  SiRNA target sequence
catggaaatgatggaaacttgtggtt

SEQ ID NO: 139239 - DNA, 26 bp, Artificial sequence
  SiRNA target sequence
atggaaatgatggaaacttgtggtta

SEQ ID NO: 139240 - DNA, 26 bp, Artificial sequence
  SiRNA target sequence
tggaaatgatggaaacttgtggttat

SEQ ID NO: 139241 - DNA, 26 bp, Artificial sequence
  SiRNA target sequence
ggaaatgatggaaacttgtggttata

SEQ ID NO: 139242 - DNA, 26 bp, Artificial sequence
  SiRNA target sequence
gaaatgatggaaacttgtggttatag

SEQ ID NO: 139243 - DNA, 26 bp, Artificial sequence
  SiRNA target sequence
aaatgatggaaacttgtggttatagt

SEQ ID NO: 139244 - DNA, 26 bp, Artificial sequence
  SiRNA target sequence
aatgatggaaacttgtggttatagtt

SEQ ID NO: 139245 - DNA, 26 bp, Artificial sequence
  SiRNA target sequence
atgatggaaacttgtggttatagttt

SEQ ID NO: 139246 - DNA, 26 bp, Artificial sequence
  SiRNA target sequence
tgatggaaacttgtggttatagttta

SEQ ID NO: 139247 - DNA, 26 bp, Artificial sequence
  SiRNA target sequence
gatggaaacttgtggttatagtttat

SEQ ID NO: 139248 - DNA, 26 bp, Artificial sequence
  SiRNA target sequence
atggaaacttgtggttatagtttatt

SEQ ID NO: 139249 - DNA, 26 bp, Artificial sequence
  SiRNA target sequence
tggaaacttgtggttatagtttatta

SEQ ID NO: 139250 - DNA, 26 bp, Artificial sequence
  SiRNA target sequence
ggaaacttgtggttatagtttattaa

SEQ ID NO: 139251 - DNA, 26 bp, Artificial sequence
  SiRNA target sequence
gaaacttgtggttatagtttattaaa

SEQ ID NO: 139252 - DNA, 26 bp, Artificial sequence
  SiRNA target sequence
aaacttgtggttatagtttattaaaa

SEQ ID NO: 139253 - DNA, 26 bp, Artificial sequence
  SiRNA target sequence
aacttgtggttatagtttattaaaaa

SEQ ID NO: 139254 - DNA, 26 bp, Artificial sequence
  SiRNA target sequence
acttgtggttatagtttattaaaaaa

SEQ ID NO: 139255 - DNA, 26 bp, Artificial sequence
  SiRNA target sequence
cttgtggttatagtttattaaaaaat

SEQ ID NO: 139256 - DNA, 26 bp, Artificial sequence
  SiRNA target sequence
ttgtggttatagtttattaaaaaatt

SEQ ID NO: 139257 - DNA, 26 bp, Artificial sequence
  SiRNA target sequence
tgtggttatagtttattaaaaaatta

SEQ ID NO: 139258 - DNA, 26 bp, Artificial sequence
  SiRNA target sequence
gtggttatagtttattaaaaaattaa

SEQ ID NO: 139259 - DNA, 27 bp, Artificial sequence
  SiRNA target sequence
atggtgtataaggttttatttacagta

SEQ ID NO: 139260 - DNA, 27 bp, Artificial sequence
  SiRNA target sequence
tggtgtataaggttttatttacagtaa

SEQ ID NO: 139261 - DNA, 27 bp, Artificial sequence
  SiRNA target sequence
ggtgtataaggttttatttacagtaat

SEQ ID NO: 139262 - DNA, 27 bp, Artificial sequence
  SiRNA target sequence
gtgtataaggttttatttacagtaata

SEQ ID NO: 139263 - DNA, 27 bp, Artificial sequence
  SiRNA target sequence
tgtataaggttttatttacagtaatag

SEQ ID NO: 139264 - DNA, 27 bp, Artificial sequence
  SiRNA target sequence
gtataaggttttatttacagtaatagg

SEQ ID NO: 139265 - DNA, 27 bp, Artificial sequence
  SiRNA target sequence
tataaggttttatttacagtaatagga

SEQ ID NO: 139266 - DNA, 27 bp, Artificial sequence
  SiRNA target sequence
ataaggttttatttacagtaataggat

SEQ ID NO: 139267 - DNA, 27 bp, Artificial sequence
  SiRNA target sequence
taaggttttatttacagtaataggatt

SEQ ID NO: 139268 - DNA, 27 bp, Artificial sequence
  SiRNA target sequence
aaggttttatttacagtaataggatta

SEQ ID NO: 139269 - DNA, 27 bp, Artificial sequence
  SiRNA target sequence
aggttttatttacagtaataggattaa

SEQ ID NO: 139270 - DNA, 27 bp, Artificial sequence
  SiRNA target sequence
ggttttatttacagtaataggattaat

SEQ ID NO: 139271 - DNA, 27 bp, Artificial sequence
  SiRNA target sequence
gttttatttacagtaataggattaata

SEQ ID NO: 139272 - DNA, 27 bp, Artificial sequence
  SiRNA target sequence
ttttatttacagtaataggattaatat

SEQ ID NO: 139273 - DNA, 27 bp, Artificial sequence
  SiRNA target sequence
tttatttacagtaataggattaatatg

SEQ ID NO: 139274 - DNA, 27 bp, Artificial sequence
  SiRNA target sequence
ttatttacagtaataggattaatatgt

SEQ ID NO: 139275 - DNA, 27 bp, Artificial sequence
  SiRNA target sequence
tatttacagtaataggattaatatgtg

SEQ ID NO: 139276 - DNA, 27 bp, Artificial sequence
  SiRNA target sequence
atttacagtaataggattaatatgtgg

SEQ ID NO: 139277 - DNA, 27 bp, Artificial sequence
  SiRNA target sequence
tttacagtaataggattaatatgtggt

SEQ ID NO: 139278 - DNA, 27 bp, Artificial sequence
  SiRNA target sequence
ttacagtaataggattaatatgtggta

SEQ ID NO: 139279 - DNA, 27 bp, Artificial sequence
  SiRNA target sequence
tacagtaataggattaatatgtggtat

SEQ ID NO: 139280 - DNA, 27 bp, Artificial sequence
  SiRNA target sequence
acagtaataggattaatatgtggtata

SEQ ID NO: 139281 - DNA, 27 bp, Artificial sequence
  SiRNA target sequence
cagtaataggattaatatgtggtatac

SEQ ID NO: 139282 - DNA, 27 bp, Artificial sequence
  SiRNA target sequence
agtaataggattaatatgtggtatact

SEQ ID NO: 139283 - DNA, 27 bp, Artificial sequence
  SiRNA target sequence
gtaataggattaatatgtggtatactt

SEQ ID NO: 139284 - DNA, 27 bp, Artificial sequence
  SiRNA target sequence
taataggattaatatgtggtatactta

SEQ ID NO: 139285 - DNA, 27 bp, Artificial sequence
  SiRNA target sequence
aataggattaatatgtggtatacttac

SEQ ID NO: 139286 - DNA, 27 bp, Artificial sequence
  SiRNA target sequence
ataggattaatatgtggtatacttaca

SEQ ID NO: 139287 - DNA, 27 bp, Artificial sequence
  SiRNA target sequence
taggattaatatgtggtatacttacaa

SEQ ID NO: 139288 - DNA, 27 bp, Artificial sequence
  SiRNA target sequence
aggattaatatgtggtatacttacaat

SEQ ID NO: 139289 - DNA, 27 bp, Artificial sequence
  SiRNA target sequence
ggattaatatgtggtatacttacaata

SEQ ID NO: 139290 - DNA, 27 bp, Artificial sequence
  SiRNA target sequence
gattaatatgtggtatacttacaataa

SEQ ID NO: 139291 - DNA, 27 bp, Artificial sequence
  SiRNA target sequence
attaatatgtggtatacttacaataat

SEQ ID NO: 139292 - DNA, 27 bp, Artificial sequence
  SiRNA target sequence
ttaatatgtggtatacttacaataatt

SEQ ID NO: 139293 - DNA, 27 bp, Artificial sequence
  SiRNA target sequence
taatatgtggtatacttacaataatta

SEQ ID NO: 139294 - DNA, 27 bp, Artificial sequence
  SiRNA target sequence
aatatgtggtatacttacaataattaa

SEQ ID NO: 139295 - DNA, 27 bp, Artificial sequence
  SiRNA target sequence
atatgtggtatacttacaataattaaa

SEQ ID NO: 139296 - DNA, 27 bp, Artificial sequence
  SiRNA target sequence
tatgtggtatacttacaataattaaac

SEQ ID NO: 139297 - DNA, 27 bp, Artificial sequence
  SiRNA target sequence
atgtggtatacttacaataattaaacg

SEQ ID NO: 139298 - DNA, 27 bp, Artificial sequence
  SiRNA target sequence
tgtggtatacttacaataattaaacga

SEQ ID NO: 139299 - DNA, 27 bp, Artificial sequence
  SiRNA target sequence
gtggtatacttacaataattaaacgat

SEQ ID NO: 139300 - DNA, 27 bp, Artificial sequence
  SiRNA target sequence
tggtatacttacaataattaaacgata

SEQ ID NO: 139301 - DNA, 27 bp, Artificial sequence
  SiRNA target sequence
ggtatacttacaataattaaacgatac

SEQ ID NO: 139302 - DNA, 27 bp, Artificial sequence
  SiRNA target sequence
gtatacttacaataattaaacgataca

SEQ ID NO: 139303 - DNA, 27 bp, Artificial sequence
  SiRNA target sequence
tatacttacaataattaaacgatacaa

SEQ ID NO: 139304 - DNA, 27 bp, Artificial sequence
  SiRNA target sequence
atacttacaataattaaacgatacaag

SEQ ID NO: 139305 - DNA, 27 bp, Artificial sequence
  SiRNA target sequence
tacttacaataattaaacgatacaagt

SEQ ID NO: 139306 - DNA, 27 bp, Artificial sequence
  SiRNA target sequence
acttacaataattaaacgatacaagta

SEQ ID NO: 139307 - DNA, 27 bp, Artificial sequence
  SiRNA target sequence
cttacaataattaaacgatacaagtat

SEQ ID NO: 139308 - DNA, 27 bp, Artificial sequence
  SiRNA target sequence
ttacaataattaaacgatacaagtatt

SEQ ID NO: 139309 - DNA, 27 bp, Artificial sequence
  SiRNA target sequence
tacaataattaaacgatacaagtattt

SEQ ID NO: 139310 - DNA, 27 bp, Artificial sequence
  SiRNA target sequence
acaataattaaacgatacaagtatttt

SEQ ID NO: 139311 - DNA, 27 bp, Artificial sequence
  SiRNA target sequence
caataattaaacgatacaagtatttta

SEQ ID NO: 139312 - DNA, 27 bp, Artificial sequence
  SiRNA target sequence
aataattaaacgatacaagtattttaa

SEQ ID NO: 139313 - DNA, 27 bp, Artificial sequence
  SiRNA target sequence
ataattaaacgatacaagtattttaag

SEQ ID NO: 139314 - DNA, 27 bp, Artificial sequence
  SiRNA target sequence
taattaaacgatacaagtattttaaga

SEQ ID NO: 139315 - DNA, 27 bp, Artificial sequence
  SiRNA target sequence
aattaaacgatacaagtattttaagat

SEQ ID NO: 139316 - DNA, 27 bp, Artificial sequence
  SiRNA target sequence
attaaacgatacaagtattttaagata

SEQ ID NO: 139317 - DNA, 27 bp, Artificial sequence
  SiRNA target sequence
ttaaacgatacaagtattttaagataa

SEQ ID NO: 139318 - DNA, 27 bp, Artificial sequence
  SiRNA target sequence
taaacgatacaagtattttaagataaa

SEQ ID NO: 139319 - DNA, 27 bp, Artificial sequence
  SiRNA target sequence
aaacgatacaagtattttaagataaaa

SEQ ID NO: 139320 - DNA, 27 bp, Artificial sequence
  SiRNA target sequence
aacgatacaagtattttaagataaaaa

SEQ ID NO: 139321 - DNA, 27 bp, Artificial sequence
  SiRNA target sequence
acgatacaagtattttaagataaaaaa

SEQ ID NO: 139322 - DNA, 27 bp, Artificial sequence
  SiRNA target sequence
cgatacaagtattttaagataaaaaaa

SEQ ID NO: 139323 - DNA, 27 bp, Artificial sequence
  SiRNA target sequence
gatacaagtattttaagataaaaaaat

SEQ ID NO: 139324 - DNA, 27 bp, Artificial sequence
  SiRNA target sequence
atacaagtattttaagataaaaaaatt

SEQ ID NO: 139325 - DNA, 27 bp, Artificial sequence
  SiRNA target sequence
tacaagtattttaagataaaaaaattg

SEQ ID NO: 139326 - DNA, 27 bp, Artificial sequence
  SiRNA target sequence
acaagtattttaagataaaaaaattgg

SEQ ID NO: 139327 - DNA, 27 bp, Artificial sequence
  SiRNA target sequence
caagtattttaagataaaaaaattggc

SEQ ID NO: 139328 - DNA, 27 bp, Artificial sequence
  SiRNA target sequence
aagtattttaagataaaaaaattggcc

SEQ ID NO: 139329 - DNA, 27 bp, Artificial sequence
  SiRNA target sequence
agtattttaagataaaaaaattggcct

SEQ ID NO: 139330 - DNA, 27 bp, Artificial sequence
  SiRNA target sequence
gtattttaagataaaaaaattggcctt

SEQ ID NO: 139331 - DNA, 27 bp, Artificial sequence
  SiRNA target sequence
tattttaagataaaaaaattggcctta

SEQ ID NO: 139332 - DNA, 27 bp, Artificial sequence
  SiRNA target sequence
attttaagataaaaaaattggccttaa

SEQ ID NO: 139333 - DNA, 27 bp, Artificial sequence
  SiRNA target sequence
ttttaagataaaaaaattggccttaac

SEQ ID NO: 139334 - DNA, 27 bp, Artificial sequence
  SiRNA target sequence
tttaagataaaaaaattggccttaact

SEQ ID NO: 139335 - DNA, 27 bp, Artificial sequence
  SiRNA target sequence
ttaagataaaaaaattggccttaactt

SEQ ID NO: 139336 - DNA, 27 bp, Artificial sequence
  SiRNA target sequence
taagataaaaaaattggccttaactta

SEQ ID NO: 139337 - DNA, 27 bp, Artificial sequence
  SiRNA target sequence
aagataaaaaaattggccttaacttac

SEQ ID NO: 139338 - DNA, 27 bp, Artificial sequence
  SiRNA target sequence
agataaaaaaattggccttaacttact

SEQ ID NO: 139339 - DNA, 27 bp, Artificial sequence
  SiRNA target sequence
gataaaaaaattggccttaacttactt

SEQ ID NO: 139340 - DNA, 27 bp, Artificial sequence
  SiRNA target sequence
ataaaaaaattggccttaacttacttc

SEQ ID NO: 139341 - DNA, 27 bp, Artificial sequence
  SiRNA target sequence
taaaaaaattggccttaacttacttcg

SEQ ID NO: 139342 - DNA, 27 bp, Artificial sequence
  SiRNA target sequence
aaaaaaattggccttaacttacttcgg

SEQ ID NO: 139343 - DNA, 27 bp, Artificial sequence
  SiRNA target sequence
aaaaaattggccttaacttacttcggg

SEQ ID NO: 139344 - DNA, 27 bp, Artificial sequence
  SiRNA target sequence
aaaaattggccttaacttacttcggga

SEQ ID NO: 139345 - DNA, 27 bp, Artificial sequence
  SiRNA target sequence
aaaattggccttaacttacttcgggaa

SEQ ID NO: 139346 - DNA, 27 bp, Artificial sequence
  SiRNA target sequence
aaattggccttaacttacttcgggaaa

SEQ ID NO: 139347 - DNA, 27 bp, Artificial sequence
  SiRNA target sequence
aattggccttaacttacttcgggaaac

SEQ ID NO: 139348 - DNA, 27 bp, Artificial sequence
  SiRNA target sequence
attggccttaacttacttcgggaaaca

SEQ ID NO: 139349 - DNA, 27 bp, Artificial sequence
  SiRNA target sequence
ttggccttaacttacttcgggaaacaa

SEQ ID NO: 139350 - DNA, 27 bp, Artificial sequence
  SiRNA target sequence
tggccttaacttacttcgggaaacaag

SEQ ID NO: 139351 - DNA, 27 bp, Artificial sequence
  SiRNA target sequence
ggccttaacttacttcgggaaacaaga

SEQ ID NO: 139352 - DNA, 27 bp, Artificial sequence
  SiRNA target sequence
gccttaacttacttcgggaaacaagac

SEQ ID NO: 139353 - DNA, 27 bp, Artificial sequence
  SiRNA target sequence
ccttaacttacttcgggaaacaagact

SEQ ID NO: 139354 - DNA, 27 bp, Artificial sequence
  SiRNA target sequence
cttaacttacttcgggaaacaagactt

SEQ ID NO: 139355 - DNA, 27 bp, Artificial sequence
  SiRNA target sequence
ttaacttacttcgggaaacaagacttg

SEQ ID NO: 139356 - DNA, 27 bp, Artificial sequence
  SiRNA target sequence
taacttacttcgggaaacaagacttgc

SEQ ID NO: 139357 - DNA, 27 bp, Artificial sequence
  SiRNA target sequence
aacttacttcgggaaacaagacttgca

SEQ ID NO: 139358 - DNA, 27 bp, Artificial sequence
  SiRNA target sequence
acttacttcgggaaacaagacttgcaa

SEQ ID NO: 139359 - DNA, 27 bp, Artificial sequence
  SiRNA target sequence
cttacttcgggaaacaagacttgcaat

SEQ ID NO: 139360 - DNA, 27 bp, Artificial sequence
  SiRNA target sequence
ttacttcgggaaacaagacttgcaatg

SEQ ID NO: 139361 - DNA, 27 bp, Artificial sequence
  SiRNA target sequence
tacttcgggaaacaagacttgcaatgg

SEQ ID NO: 139362 - DNA, 27 bp, Artificial sequence
  SiRNA target sequence
acttcgggaaacaagacttgcaatgga

SEQ ID NO: 139363 - DNA, 27 bp, Artificial sequence
  SiRNA target sequence
cttcgggaaacaagacttgcaatggaa

SEQ ID NO: 139364 - DNA, 27 bp, Artificial sequence
  SiRNA target sequence
ttcgggaaacaagacttgcaatggaaa

SEQ ID NO: 139365 - DNA, 27 bp, Artificial sequence
  SiRNA target sequence
tcgggaaacaagacttgcaatggaaac

SEQ ID NO: 139366 - DNA, 27 bp, Artificial sequence
  SiRNA target sequence
cgggaaacaagacttgcaatggaaacc

SEQ ID NO: 139367 - DNA, 27 bp, Artificial sequence
  SiRNA target sequence
gggaaacaagacttgcaatggaaacct

SEQ ID NO: 139368 - DNA, 27 bp, Artificial sequence
  SiRNA target sequence
ggaaacaagacttgcaatggaaaccta

SEQ ID NO: 139369 - DNA, 27 bp, Artificial sequence
  SiRNA target sequence
gaaacaagacttgcaatggaaacctaa

SEQ ID NO: 139370 - DNA, 27 bp, Artificial sequence
  SiRNA target sequence
aaacaagacttgcaatggaaacctaaa

SEQ ID NO: 139371 - DNA, 27 bp, Artificial sequence
  SiRNA target sequence
aacaagacttgcaatggaaacctaaaa

SEQ ID NO: 139372 - DNA, 27 bp, Artificial sequence
  SiRNA target sequence
acaagacttgcaatggaaacctaaaag

SEQ ID NO: 139373 - DNA, 27 bp, Artificial sequence
  SiRNA target sequence
caagacttgcaatggaaacctaaaagt

SEQ ID NO: 139374 - DNA, 27 bp, Artificial sequence
  SiRNA target sequence
aagacttgcaatggaaacctaaaagtc

SEQ ID NO: 139375 - DNA, 27 bp, Artificial sequence
  SiRNA target sequence
agacttgcaatggaaacctaaaagtcg

SEQ ID NO: 139376 - DNA, 27 bp, Artificial sequence
  SiRNA target sequence
gacttgcaatggaaacctaaaagtcgg

SEQ ID NO: 139377 - DNA, 27 bp, Artificial sequence
  SiRNA target sequence
acttgcaatggaaacctaaaagtcggt

SEQ ID NO: 139378 - DNA, 27 bp, Artificial sequence
  SiRNA target sequence
cttgcaatggaaacctaaaagtcggtc

SEQ ID NO: 139379 - DNA, 27 bp, Artificial sequence
  SiRNA target sequence
ttgcaatggaaacctaaaagtcggtca

SEQ ID NO: 139380 - DNA, 27 bp, Artificial sequence
  SiRNA target sequence
tgcaatggaaacctaaaagtcggtcag

SEQ ID NO: 139381 - DNA, 27 bp, Artificial sequence
  SiRNA target sequence
gcaatggaaacctaaaagtcggtcaga

SEQ ID NO: 139382 - DNA, 27 bp, Artificial sequence
  SiRNA target sequence
caatggaaacctaaaagtcggtcagaa

SEQ ID NO: 139383 - DNA, 27 bp, Artificial sequence
  SiRNA target sequence
aatggaaacctaaaagtcggtcagaaa

SEQ ID NO: 139384 - DNA, 27 bp, Artificial sequence
  SiRNA target sequence
atggaaacctaaaagtcggtcagaaat

SEQ ID NO: 139385 - DNA, 27 bp, Artificial sequence
  SiRNA target sequence
tggaaacctaaaagtcggtcagaaatt

SEQ ID NO: 139386 - DNA, 27 bp, Artificial sequence
  SiRNA target sequence
ggaaacctaaaagtcggtcagaaatta

SEQ ID NO: 139387 - DNA, 27 bp, Artificial sequence
  SiRNA target sequence
gaaacctaaaagtcggtcagaaattat

SEQ ID NO: 139388 - DNA, 27 bp, Artificial sequence
  SiRNA target sequence
aaacctaaaagtcggtcagaaattatt

SEQ ID NO: 139389 - DNA, 27 bp, Artificial sequence
  SiRNA target sequence
aacctaaaagtcggtcagaaattatta

SEQ ID NO: 139390 - DNA, 27 bp, Artificial sequence
  SiRNA target sequence
acctaaaagtcggtcagaaattattaa

SEQ ID NO: 139391 - DNA, 27 bp, Artificial sequence
  SiRNA target sequence
cctaaaagtcggtcagaaattattaac

SEQ ID NO: 139392 - DNA, 27 bp, Artificial sequence
  SiRNA target sequence
ctaaaagtcggtcagaaattattaacg

SEQ ID NO: 139393 - DNA, 27 bp, Artificial sequence
  SiRNA target sequence
taaaagtcggtcagaaattattaacga

SEQ ID NO: 139394 - DNA, 27 bp, Artificial sequence
  SiRNA target sequence
aaaagtcggtcagaaattattaacgat

SEQ ID NO: 139395 - DNA, 27 bp, Artificial sequence
  SiRNA target sequence
aaagtcggtcagaaattattaacgatt

SEQ ID NO: 139396 - DNA, 27 bp, Artificial sequence
  SiRNA target sequence
aagtcggtcagaaattattaacgattt

SEQ ID NO: 139397 - DNA, 27 bp, Artificial sequence
  SiRNA target sequence
agtcggtcagaaattattaacgattta

SEQ ID NO: 139398 - DNA, 27 bp, Artificial sequence
  SiRNA target sequence
gtcggtcagaaattattaacgatttaa

SEQ ID NO: 139399 - DNA, 27 bp, Artificial sequence
  SiRNA target sequence
tcggtcagaaattattaacgatttaaa

SEQ ID NO: 139400 - DNA, 27 bp, Artificial sequence
  SiRNA target sequence
cggtcagaaattattaacgatttaaaa

SEQ ID NO: 139401 - DNA, 27 bp, Artificial sequence
  SiRNA target sequence
ggtcagaaattattaacgatttaaaaa

SEQ ID NO: 139402 - DNA, 27 bp, Artificial sequence
  SiRNA target sequence
gtcagaaattattaacgatttaaaaaa

SEQ ID NO: 139403 - DNA, 27 bp, Artificial sequence
  SiRNA target sequence
tcagaaattattaacgatttaaaaaat

SEQ ID NO: 139404 - DNA, 27 bp, Artificial sequence
  SiRNA target sequence
cagaaattattaacgatttaaaaaata

SEQ ID NO: 139405 - DNA, 27 bp, Artificial sequence
  SiRNA target sequence
agaaattattaacgatttaaaaaatac

SEQ ID NO: 139406 - DNA, 27 bp, Artificial sequence
  SiRNA target sequence
gaaattattaacgatttaaaaaataca

SEQ ID NO: 139407 - DNA, 27 bp, Artificial sequence
  SiRNA target sequence
aaattattaacgatttaaaaaatacaa

SEQ ID NO: 139408 - DNA, 27 bp, Artificial sequence
  SiRNA target sequence
aattattaacgatttaaaaaatacaaa

SEQ ID NO: 139409 - DNA, 27 bp, Artificial sequence
  SiRNA target sequence
attattaacgatttaaaaaatacaaac

SEQ ID NO: 139410 - DNA, 27 bp, Artificial sequence
  SiRNA target sequence
ttattaacgatttaaaaaatacaaact

SEQ ID NO: 139411 - DNA, 27 bp, Artificial sequence
  SiRNA target sequence
tattaacgatttaaaaaatacaaactt

SEQ ID NO: 139412 - DNA, 27 bp, Artificial sequence
  SiRNA target sequence
attaacgatttaaaaaatacaaacttt

SEQ ID NO: 139413 - DNA, 27 bp, Artificial sequence
  SiRNA target sequence
ttaacgatttaaaaaatacaaactttg

SEQ ID NO: 139414 - DNA, 27 bp, Artificial sequence
  SiRNA target sequence
taacgatttaaaaaatacaaactttga

SEQ ID NO: 139415 - DNA, 27 bp, Artificial sequence
  SiRNA target sequence
aacgatttaaaaaatacaaactttgac

SEQ ID NO: 139416 - DNA, 27 bp, Artificial sequence
  SiRNA target sequence
acgatttaaaaaatacaaactttgaca

SEQ ID NO: 139417 - DNA, 27 bp, Artificial sequence
  SiRNA target sequence
cgatttaaaaaatacaaactttgacat

SEQ ID NO: 139418 - DNA, 27 bp, Artificial sequence
  SiRNA target sequence
gatttaaaaaatacaaactttgacata

SEQ ID NO: 139419 - DNA, 27 bp, Artificial sequence
  SiRNA target sequence
atttaaaaaatacaaactttgacatat

SEQ ID NO: 139420 - DNA, 27 bp, Artificial sequence
  SiRNA target sequence
tttaaaaaatacaaactttgacatatt

SEQ ID NO: 139421 - DNA, 27 bp, Artificial sequence
  SiRNA target sequence
ttaaaaaatacaaactttgacatattg

SEQ ID NO: 139422 - DNA, 27 bp, Artificial sequence
  SiRNA target sequence
taaaaaatacaaactttgacatattga

SEQ ID NO: 139423 - DNA, 27 bp, Artificial sequence
  SiRNA target sequence
aaaaaatacaaactttgacatattgat

SEQ ID NO: 139424 - DNA, 27 bp, Artificial sequence
  SiRNA target sequence
aaaaatacaaactttgacatattgatt

SEQ ID NO: 139425 - DNA, 27 bp, Artificial sequence
  SiRNA target sequence
aaaatacaaactttgacatattgatta

SEQ ID NO: 139426 - DNA, 27 bp, Artificial sequence
  SiRNA target sequence
aaatacaaactttgacatattgattat

SEQ ID NO: 139427 - DNA, 27 bp, Artificial sequence
  SiRNA target sequence
aatacaaactttgacatattgattatt

SEQ ID NO: 139428 - DNA, 27 bp, Artificial sequence
  SiRNA target sequence
atacaaactttgacatattgattattg

SEQ ID NO: 139429 - DNA, 27 bp, Artificial sequence
  SiRNA target sequence
tacaaactttgacatattgattattgg

SEQ ID NO: 139430 - DNA, 27 bp, Artificial sequence
  SiRNA target sequence
acaaactttgacatattgattattggt

SEQ ID NO: 139431 - DNA, 27 bp, Artificial sequence
  SiRNA target sequence
caaactttgacatattgattattggtg

SEQ ID NO: 139432 - DNA, 27 bp, Artificial sequence
  SiRNA target sequence
aaactttgacatattgattattggtgg

SEQ ID NO: 139433 - DNA, 27 bp, Artificial sequence
  SiRNA target sequence
aactttgacatattgattattggtggc

SEQ ID NO: 139434 - DNA, 27 bp, Artificial sequence
  SiRNA target sequence
actttgacatattgattattggtggcg

SEQ ID NO: 139435 - DNA, 27 bp, Artificial sequence
  SiRNA target sequence
ctttgacatattgattattggtggcgg

SEQ ID NO: 139436 - DNA, 27 bp, Artificial sequence
  SiRNA target sequence
tttgacatattgattattggtggcggt

SEQ ID NO: 139437 - DNA, 27 bp, Artificial sequence
  SiRNA target sequence
ttgacatattgattattggtggcggtt

SEQ ID NO: 139438 - DNA, 27 bp, Artificial sequence
  SiRNA target sequence
tgacatattgattattggtggcggttc

SEQ ID NO: 139439 - DNA, 27 bp, Artificial sequence
  SiRNA target sequence
gacatattgattattggtggcggttca

SEQ ID NO: 139440 - DNA, 27 bp, Artificial sequence
  SiRNA target sequence
acatattgattattggtggcggttcaa

SEQ ID NO: 139441 - DNA, 27 bp, Artificial sequence
  SiRNA target sequence
catattgattattggtggcggttcaac

SEQ ID NO: 139442 - DNA, 27 bp, Artificial sequence
  SiRNA target sequence
atattgattattggtggcggttcaacg

SEQ ID NO: 139443 - DNA, 27 bp, Artificial sequence
  SiRNA target sequence
tattgattattggtggcggttcaacgg

SEQ ID NO: 139444 - DNA, 27 bp, Artificial sequence
  SiRNA target sequence
attgattattggtggcggttcaacggg

SEQ ID NO: 139445 - DNA, 27 bp, Artificial sequence
  SiRNA target sequence
ttgattattggtggcggttcaacggga

SEQ ID NO: 139446 - DNA, 27 bp, Artificial sequence
  SiRNA target sequence
tgattattggtggcggttcaacgggaa

SEQ ID NO: 139447 - DNA, 27 bp, Artificial sequence
  SiRNA target sequence
gattattggtggcggttcaacgggaat

SEQ ID NO: 139448 - DNA, 27 bp, Artificial sequence
  SiRNA target sequence
attattggtggcggttcaacgggaatg

SEQ ID NO: 139449 - DNA, 27 bp, Artificial sequence
  SiRNA target sequence
ttattggtggcggttcaacgggaatgg

SEQ ID NO: 139450 - DNA, 27 bp, Artificial sequence
  SiRNA target sequence
tattggtggcggttcaacgggaatggg

SEQ ID NO: 139451 - DNA, 27 bp, Artificial sequence
  SiRNA target sequence
attggtggcggttcaacgggaatggga

SEQ ID NO: 139452 - DNA, 27 bp, Artificial sequence
  SiRNA target sequence
ttggtggcggttcaacgggaatgggat

SEQ ID NO: 139453 - DNA, 27 bp, Artificial sequence
  SiRNA target sequence
tggtggcggttcaacgggaatgggatg

SEQ ID NO: 139454 - DNA, 27 bp, Artificial sequence
  SiRNA target sequence
ggtggcggttcaacgggaatgggatgt

SEQ ID NO: 139455 - DNA, 27 bp, Artificial sequence
  SiRNA target sequence
gtggcggttcaacgggaatgggatgtg

SEQ ID NO: 139456 - DNA, 27 bp, Artificial sequence
  SiRNA target sequence
tggcggttcaacgggaatgggatgtgc

SEQ ID NO: 139457 - DNA, 27 bp, Artificial sequence
  SiRNA target sequence
ggcggttcaacgggaatgggatgtgca

SEQ ID NO: 139458 - DNA, 27 bp, Artificial sequence
  SiRNA target sequence
gcggttcaacgggaatgggatgtgcaa

SEQ ID NO: 139459 - DNA, 27 bp, Artificial sequence
  SiRNA target sequence
cggttcaacgggaatgggatgtgcaat

SEQ ID NO: 139460 - DNA, 27 bp, Artificial sequence
  SiRNA target sequence
ggttcaacgggaatgggatgtgcaatc

SEQ ID NO: 139461 - DNA, 27 bp, Artificial sequence
  SiRNA target sequence
gttcaacgggaatgggatgtgcaatcg

SEQ ID NO: 139462 - DNA, 27 bp, Artificial sequence
  SiRNA target sequence
ttcaacgggaatgggatgtgcaatcga

SEQ ID NO: 139463 - DNA, 27 bp, Artificial sequence
  SiRNA target sequence
tcaacgggaatgggatgtgcaatcgaa

SEQ ID NO: 139464 - DNA, 27 bp, Artificial sequence
  SiRNA target sequence
caacgggaatgggatgtgcaatcgaag

SEQ ID NO: 139465 - DNA, 27 bp, Artificial sequence
  SiRNA target sequence
aacgggaatgggatgtgcaatcgaagc

SEQ ID NO: 139466 - DNA, 27 bp, Artificial sequence
  SiRNA target sequence
acgggaatgggatgtgcaatcgaagca

SEQ ID NO: 139467 - DNA, 27 bp, Artificial sequence
  SiRNA target sequence
cgggaatgggatgtgcaatcgaagcag

SEQ ID NO: 139468 - DNA, 27 bp, Artificial sequence
  SiRNA target sequence
gggaatgggatgtgcaatcgaagcagc

SEQ ID NO: 139469 - DNA, 27 bp, Artificial sequence
  SiRNA target sequence
ggaatgggatgtgcaatcgaagcagct

SEQ ID NO: 139470 - DNA, 27 bp, Artificial sequence
  SiRNA target sequence
gaatgggatgtgcaatcgaagcagcta

SEQ ID NO: 139471 - DNA, 27 bp, Artificial sequence
  SiRNA target sequence
aatgggatgtgcaatcgaagcagctac

SEQ ID NO: 139472 - DNA, 27 bp, Artificial sequence
  SiRNA target sequence
atgggatgtgcaatcgaagcagctaca

SEQ ID NO: 139473 - DNA, 27 bp, Artificial sequence
  SiRNA target sequence
tgggatgtgcaatcgaagcagctacac

SEQ ID NO: 139474 - DNA, 27 bp, Artificial sequence
  SiRNA target sequence
gggatgtgcaatcgaagcagctacacg

SEQ ID NO: 139475 - DNA, 27 bp, Artificial sequence
  SiRNA target sequence
ggatgtgcaatcgaagcagctacacga

SEQ ID NO: 139476 - DNA, 27 bp, Artificial sequence
  SiRNA target sequence
gatgtgcaatcgaagcagctacacgag

SEQ ID NO: 139477 - DNA, 27 bp, Artificial sequence
  SiRNA target sequence
atgtgcaatcgaagcagctacacgagg

SEQ ID NO: 139478 - DNA, 27 bp, Artificial sequence
  SiRNA target sequence
tgtgcaatcgaagcagctacacgaggt

SEQ ID NO: 139479 - DNA, 27 bp, Artificial sequence
  SiRNA target sequence
gtgcaatcgaagcagctacacgaggta

SEQ ID NO: 139480 - DNA, 27 bp, Artificial sequence
  SiRNA target sequence
tgcaatcgaagcagctacacgaggtat

SEQ ID NO: 139481 - DNA, 27 bp, Artificial sequence
  SiRNA target sequence
gcaatcgaagcagctacacgaggtata

SEQ ID NO: 139482 - DNA, 27 bp, Artificial sequence
  SiRNA target sequence
caatcgaagcagctacacgaggtataa

SEQ ID NO: 139483 - DNA, 27 bp, Artificial sequence
  SiRNA target sequence
aatcgaagcagctacacgaggtataag

SEQ ID NO: 139484 - DNA, 27 bp, Artificial sequence
  SiRNA target sequence
atcgaagcagctacacgaggtataagt

SEQ ID NO: 139485 - DNA, 27 bp, Artificial sequence
  SiRNA target sequence
tcgaagcagctacacgaggtataagtg

SEQ ID NO: 139486 - DNA, 27 bp, Artificial sequence
  SiRNA target sequence
cgaagcagctacacgaggtataagtgt

SEQ ID NO: 139487 - DNA, 27 bp, Artificial sequence
  SiRNA target sequence
gaagcagctacacgaggtataagtgtt

SEQ ID NO: 139488 - DNA, 27 bp, Artificial sequence
  SiRNA target sequence
aagcagctacacgaggtataagtgttg

SEQ ID NO: 139489 - DNA, 27 bp, Artificial sequence
  SiRNA target sequence
agcagctacacgaggtataagtgttgg

SEQ ID NO: 139490 - DNA, 27 bp, Artificial sequence
  SiRNA target sequence
gcagctacacgaggtataagtgttggc

SEQ ID NO: 139491 - DNA, 27 bp, Artificial sequence
  SiRNA target sequence
cagctacacgaggtataagtgttggcc

SEQ ID NO: 139492 - DNA, 27 bp, Artificial sequence
  SiRNA target sequence
agctacacgaggtataagtgttggcct

SEQ ID NO: 139493 - DNA, 27 bp, Artificial sequence
  SiRNA target sequence
gctacacgaggtataagtgttggcctg

SEQ ID NO: 139494 - DNA, 27 bp, Artificial sequence
  SiRNA target sequence
ctacacgaggtataagtgttggcctga

SEQ ID NO: 139495 - DNA, 27 bp, Artificial sequence
  SiRNA target sequence
tacacgaggtataagtgttggcctgat

SEQ ID NO: 139496 - DNA, 27 bp, Artificial sequence
  SiRNA target sequence
acacgaggtataagtgttggcctgata

SEQ ID NO: 139497 - DNA, 27 bp, Artificial sequence
  SiRNA target sequence
cacgaggtataagtgttggcctgatag

SEQ ID NO: 139498 - DNA, 27 bp, Artificial sequence
  SiRNA target sequence
acgaggtataagtgttggcctgataga

SEQ ID NO: 139499 - DNA, 27 bp, Artificial sequence
  SiRNA target sequence
cgaggtataagtgttggcctgatagaa

SEQ ID NO: 139500 - DNA, 27 bp, Artificial sequence
  SiRNA target sequence
gaggtataagtgttggcctgatagaag

SEQ ID NO: 139501 - DNA, 27 bp, Artificial sequence
  SiRNA target sequence
aggtataagtgttggcctgatagaagc

SEQ ID NO: 139502 - DNA, 27 bp, Artificial sequence
  SiRNA target sequence
ggtataagtgttggcctgatagaagca

SEQ ID NO: 139503 - DNA, 27 bp, Artificial sequence
  SiRNA target sequence
gtataagtgttggcctgatagaagcac

SEQ ID NO: 139504 - DNA, 27 bp, Artificial sequence
  SiRNA target sequence
tataagtgttggcctgatagaagcaca

SEQ ID NO: 139505 - DNA, 27 bp, Artificial sequence
  SiRNA target sequence
ataagtgttggcctgatagaagcacat

SEQ ID NO: 139506 - DNA, 27 bp, Artificial sequence
  SiRNA target sequence
taagtgttggcctgatagaagcacatg

SEQ ID NO: 139507 - DNA, 27 bp, Artificial sequence
  SiRNA target sequence
aagtgttggcctgatagaagcacatga

SEQ ID NO: 139508 - DNA, 27 bp, Artificial sequence
  SiRNA target sequence
agtgttggcctgatagaagcacatgat

SEQ ID NO: 139509 - DNA, 27 bp, Artificial sequence
  SiRNA target sequence
gtgttggcctgatagaagcacatgatt

SEQ ID NO: 139510 - DNA, 27 bp, Artificial sequence
  SiRNA target sequence
tgttggcctgatagaagcacatgattt

SEQ ID NO: 139511 - DNA, 27 bp, Artificial sequence
  SiRNA target sequence
gttggcctgatagaagcacatgatttt

SEQ ID NO: 139512 - DNA, 27 bp, Artificial sequence
  SiRNA target sequence
ttggcctgatagaagcacatgattttg

SEQ ID NO: 139513 - DNA, 27 bp, Artificial sequence
  SiRNA target sequence
tggcctgatagaagcacatgattttgg

SEQ ID NO: 139514 - DNA, 27 bp, Artificial sequence
  SiRNA target sequence
ggcctgatagaagcacatgattttggt

SEQ ID NO: 139515 - DNA, 27 bp, Artificial sequence
  SiRNA target sequence
gcctgatagaagcacatgattttggtt

SEQ ID NO: 139516 - DNA, 27 bp, Artificial sequence
  SiRNA target sequence
cctgatagaagcacatgattttggttc

SEQ ID NO: 139517 - DNA, 27 bp, Artificial sequence
  SiRNA target sequence
ctgatagaagcacatgattttggttcg

SEQ ID NO: 139518 - DNA, 27 bp, Artificial sequence
  SiRNA target sequence
tgatagaagcacatgattttggttcgg

SEQ ID NO: 139519 - DNA, 27 bp, Artificial sequence
  SiRNA target sequence
gatagaagcacatgattttggttcggg

SEQ ID NO: 139520 - DNA, 27 bp, Artificial sequence
  SiRNA target sequence
atagaagcacatgattttggttcgggc

SEQ ID NO: 139521 - DNA, 27 bp, Artificial sequence
  SiRNA target sequence
tagaagcacatgattttggttcgggca

SEQ ID NO: 139522 - DNA, 27 bp, Artificial sequence
  SiRNA target sequence
agaagcacatgattttggttcgggcac

SEQ ID NO: 139523 - DNA, 27 bp, Artificial sequence
  SiRNA target sequence
gaagcacatgattttggttcgggcacg

SEQ ID NO: 139524 - DNA, 27 bp, Artificial sequence
  SiRNA target sequence
aagcacatgattttggttcgggcacga

SEQ ID NO: 139525 - DNA, 27 bp, Artificial sequence
  SiRNA target sequence
agcacatgattttggttcgggcacgag

SEQ ID NO: 139526 - DNA, 27 bp, Artificial sequence
  SiRNA target sequence
gcacatgattttggttcgggcacgagt

SEQ ID NO: 139527 - DNA, 27 bp, Artificial sequence
  SiRNA target sequence
cacatgattttggttcgggcacgagtt

SEQ ID NO: 139528 - DNA, 27 bp, Artificial sequence
  SiRNA target sequence
acatgattttggttcgggcacgagttc

SEQ ID NO: 139529 - DNA, 27 bp, Artificial sequence
  SiRNA target sequence
catgattttggttcgggcacgagttca

SEQ ID NO: 139530 - DNA, 27 bp, Artificial sequence
  SiRNA target sequence
atgattttggttcgggcacgagttcaa

SEQ ID NO: 139531 - DNA, 27 bp, Artificial sequence
  SiRNA target sequence
tgattttggttcgggcacgagttcaaa

SEQ ID NO: 139532 - DNA, 27 bp, Artificial sequence
  SiRNA target sequence
gattttggttcgggcacgagttcaaaa

SEQ ID NO: 139533 - DNA, 27 bp, Artificial sequence
  SiRNA target sequence
attttggttcgggcacgagttcaaaat

SEQ ID NO: 139534 - DNA, 27 bp, Artificial sequence
  SiRNA target sequence
ttttggttcgggcacgagttcaaaatc

SEQ ID NO: 139535 - DNA, 27 bp, Artificial sequence
  SiRNA target sequence
tttggttcgggcacgagttcaaaatct

SEQ ID NO: 139536 - DNA, 27 bp, Artificial sequence
  SiRNA target sequence
ttggttcgggcacgagttcaaaatcta

SEQ ID NO: 139537 - DNA, 27 bp, Artificial sequence
  SiRNA target sequence
tggttcgggcacgagttcaaaatctac

SEQ ID NO: 139538 - DNA, 27 bp, Artificial sequence
  SiRNA target sequence
ggttcgggcacgagttcaaaatctaca

SEQ ID NO: 139539 - DNA, 27 bp, Artificial sequence
  SiRNA target sequence
gttcgggcacgagttcaaaatctacaa

SEQ ID NO: 139540 - DNA, 27 bp, Artificial sequence
  SiRNA target sequence
ttcgggcacgagttcaaaatctacaaa

SEQ ID NO: 139541 - DNA, 27 bp, Artificial sequence
  SiRNA target sequence
tcgggcacgagttcaaaatctacaaaa

SEQ ID NO: 139542 - DNA, 27 bp, Artificial sequence
  SiRNA target sequence
cgggcacgagttcaaaatctacaaaac

SEQ ID NO: 139543 - DNA, 27 bp, Artificial sequence
  SiRNA target sequence
gggcacgagttcaaaatctacaaaact

SEQ ID NO: 139544 - DNA, 27 bp, Artificial sequence
  SiRNA target sequence
ggcacgagttcaaaatctacaaaactt

SEQ ID NO: 139545 - DNA, 27 bp, Artificial sequence
  SiRNA target sequence
gcacgagttcaaaatctacaaaacttt

SEQ ID NO: 139546 - DNA, 27 bp, Artificial sequence
  SiRNA target sequence
cacgagttcaaaatctacaaaactttt

SEQ ID NO: 139547 - DNA, 27 bp, Artificial sequence
  SiRNA target sequence
acgagttcaaaatctacaaaacttttt

SEQ ID NO: 139548 - DNA, 27 bp, Artificial sequence
  SiRNA target sequence
cgagttcaaaatctacaaaactttttc

SEQ ID NO: 139549 - DNA, 27 bp, Artificial sequence
  SiRNA target sequence
gagttcaaaatctacaaaactttttca

SEQ ID NO: 139550 - DNA, 27 bp, Artificial sequence
  SiRNA target sequence
agttcaaaatctacaaaactttttcat

SEQ ID NO: 139551 - DNA, 27 bp, Artificial sequence
  SiRNA target sequence
gttcaaaatctacaaaactttttcatg

SEQ ID NO: 139552 - DNA, 27 bp, Artificial sequence
  SiRNA target sequence
ttcaaaatctacaaaactttttcatgg

SEQ ID NO: 139553 - DNA, 27 bp, Artificial sequence
  SiRNA target sequence
tcaaaatctacaaaactttttcatggc

SEQ ID NO: 139554 - DNA, 27 bp, Artificial sequence
  SiRNA target sequence
caaaatctacaaaactttttcatggcg

SEQ ID NO: 139555 - DNA, 27 bp, Artificial sequence
  SiRNA target sequence
aaaatctacaaaactttttcatggcgg

SEQ ID NO: 139556 - DNA, 27 bp, Artificial sequence
  SiRNA target sequence
aaatctacaaaactttttcatggcggt

SEQ ID NO: 139557 - DNA, 27 bp, Artificial sequence
  SiRNA target sequence
aatctacaaaactttttcatggcggtg

SEQ ID NO: 139558 - DNA, 27 bp, Artificial sequence
  SiRNA target sequence
atctacaaaactttttcatggcggtgt

SEQ ID NO: 139559 - DNA, 27 bp, Artificial sequence
  SiRNA target sequence
tctacaaaactttttcatggcggtgta

SEQ ID NO: 139560 - DNA, 27 bp, Artificial sequence
  SiRNA target sequence
ctacaaaactttttcatggcggtgtac

SEQ ID NO: 139561 - DNA, 27 bp, Artificial sequence
  SiRNA target sequence
tacaaaactttttcatggcggtgtacg

SEQ ID NO: 139562 - DNA, 27 bp, Artificial sequence
  SiRNA target sequence
acaaaactttttcatggcggtgtacgc

SEQ ID NO: 139563 - DNA, 27 bp, Artificial sequence
  SiRNA target sequence
caaaactttttcatggcggtgtacgct

SEQ ID NO: 139564 - DNA, 27 bp, Artificial sequence
  SiRNA target sequence
aaaactttttcatggcggtgtacgcta

SEQ ID NO: 139565 - DNA, 27 bp, Artificial sequence
  SiRNA target sequence
aaactttttcatggcggtgtacgctac

SEQ ID NO: 139566 - DNA, 27 bp, Artificial sequence
  SiRNA target sequence
aactttttcatggcggtgtacgctacc

SEQ ID NO: 139567 - DNA, 27 bp, Artificial sequence
  SiRNA target sequence
actttttcatggcggtgtacgctacct

SEQ ID NO: 139568 - DNA, 27 bp, Artificial sequence
  SiRNA target sequence
ctttttcatggcggtgtacgctacctt

SEQ ID NO: 139569 - DNA, 27 bp, Artificial sequence
  SiRNA target sequence
tttttcatggcggtgtacgctaccttg

SEQ ID NO: 139570 - DNA, 27 bp, Artificial sequence
  SiRNA target sequence
ttttcatggcggtgtacgctaccttga

SEQ ID NO: 139571 - DNA, 27 bp, Artificial sequence
  SiRNA target sequence
tttcatggcggtgtacgctaccttgaa

SEQ ID NO: 139572 - DNA, 27 bp, Artificial sequence
  SiRNA target sequence
ttcatggcggtgtacgctaccttgaaa

SEQ ID NO: 139573 - DNA, 27 bp, Artificial sequence
  SiRNA target sequence
tcatggcggtgtacgctaccttgaaaa

SEQ ID NO: 139574 - DNA, 27 bp, Artificial sequence
  SiRNA target sequence
catggcggtgtacgctaccttgaaaaa

SEQ ID NO: 139575 - DNA, 27 bp, Artificial sequence
  SiRNA target sequence
atggcggtgtacgctaccttgaaaaag

SEQ ID NO: 139576 - DNA, 27 bp, Artificial sequence
  SiRNA target sequence
tggcggtgtacgctaccttgaaaaagc

SEQ ID NO: 139577 - DNA, 27 bp, Artificial sequence
  SiRNA target sequence
ggcggtgtacgctaccttgaaaaagct

SEQ ID NO: 139578 - DNA, 27 bp, Artificial sequence
  SiRNA target sequence
gcggtgtacgctaccttgaaaaagctg

SEQ ID NO: 139579 - DNA, 27 bp, Artificial sequence
  SiRNA target sequence
cggtgtacgctaccttgaaaaagctgt

SEQ ID NO: 139580 - DNA, 27 bp, Artificial sequence
  SiRNA target sequence
ggtgtacgctaccttgaaaaagctgtt

SEQ ID NO: 139581 - DNA, 27 bp, Artificial sequence
  SiRNA target sequence
gtgtacgctaccttgaaaaagctgtta

SEQ ID NO: 139582 - DNA, 27 bp, Artificial sequence
  SiRNA target sequence
tgtacgctaccttgaaaaagctgttaa

SEQ ID NO: 139583 - DNA, 27 bp, Artificial sequence
  SiRNA target sequence
gtacgctaccttgaaaaagctgttaat

SEQ ID NO: 139584 - DNA, 27 bp, Artificial sequence
  SiRNA target sequence
tacgctaccttgaaaaagctgttaatg

SEQ ID NO: 139585 - DNA, 27 bp, Artificial sequence
  SiRNA target sequence
acgctaccttgaaaaagctgttaatga

SEQ ID NO: 139586 - DNA, 27 bp, Artificial sequence
  SiRNA target sequence
cgctaccttgaaaaagctgttaatgat

SEQ ID NO: 139587 - DNA, 27 bp, Artificial sequence
  SiRNA target sequence
gctaccttgaaaaagctgttaatgatt

SEQ ID NO: 139588 - DNA, 27 bp, Artificial sequence
  SiRNA target sequence
ctaccttgaaaaagctgttaatgattt

SEQ ID NO: 139589 - DNA, 27 bp, Artificial sequence
  SiRNA target sequence
taccttgaaaaagctgttaatgattta

SEQ ID NO: 139590 - DNA, 27 bp, Artificial sequence
  SiRNA target sequence
accttgaaaaagctgttaatgatttag

SEQ ID NO: 139591 - DNA, 27 bp, Artificial sequence
  SiRNA target sequence
ccttgaaaaagctgttaatgatttaga

SEQ ID NO: 139592 - DNA, 27 bp, Artificial sequence
  SiRNA target sequence
cttgaaaaagctgttaatgatttagat

SEQ ID NO: 139593 - DNA, 27 bp, Artificial sequence
  SiRNA target sequence
ttgaaaaagctgttaatgatttagata

SEQ ID NO: 139594 - DNA, 27 bp, Artificial sequence
  SiRNA target sequence
tgaaaaagctgttaatgatttagatag

SEQ ID NO: 139595 - DNA, 27 bp, Artificial sequence
  SiRNA target sequence
gaaaaagctgttaatgatttagataga

SEQ ID NO: 139596 - DNA, 27 bp, Artificial sequence
  SiRNA target sequence
aaaaagctgttaatgatttagatagat

SEQ ID NO: 139597 - DNA, 27 bp, Artificial sequence
  SiRNA target sequence
aaaagctgttaatgatttagatagatc

SEQ ID NO: 139598 - DNA, 27 bp, Artificial sequence
  SiRNA target sequence
aaagctgttaatgatttagatagatct

SEQ ID NO: 139599 - DNA, 27 bp, Artificial sequence
  SiRNA target sequence
aagctgttaatgatttagatagatctc

SEQ ID NO: 139600 - DNA, 27 bp, Artificial sequence
  SiRNA target sequence
agctgttaatgatttagatagatctca

SEQ ID NO: 139601 - DNA, 27 bp, Artificial sequence
  SiRNA target sequence
gctgttaatgatttagatagatctcag

SEQ ID NO: 139602 - DNA, 27 bp, Artificial sequence
  SiRNA target sequence
ctgttaatgatttagatagatctcagt

SEQ ID NO: 139603 - DNA, 27 bp, Artificial sequence
  SiRNA target sequence
tgttaatgatttagatagatctcagtt

SEQ ID NO: 139604 - DNA, 27 bp, Artificial sequence
  SiRNA target sequence
gttaatgatttagatagatctcagttt

SEQ ID NO: 139605 - DNA, 27 bp, Artificial sequence
  SiRNA target sequence
ttaatgatttagatagatctcagtttg

SEQ ID NO: 139606 - DNA, 27 bp, Artificial sequence
  SiRNA target sequence
taatgatttagatagatctcagtttga

SEQ ID NO: 139607 - DNA, 27 bp, Artificial sequence
  SiRNA target sequence
aatgatttagatagatctcagtttgac

SEQ ID NO: 139608 - DNA, 27 bp, Artificial sequence
  SiRNA target sequence
atgatttagatagatctcagtttgact

SEQ ID NO: 139609 - DNA, 27 bp, Artificial sequence
  SiRNA target sequence
tgatttagatagatctcagtttgactt

SEQ ID NO: 139610 - DNA, 27 bp, Artificial sequence
  SiRNA target sequence
gatttagatagatctcagtttgacttg

SEQ ID NO: 139611 - DNA, 27 bp, Artificial sequence
  SiRNA target sequence
atttagatagatctcagtttgacttgg

SEQ ID NO: 139612 - DNA, 27 bp, Artificial sequence
  SiRNA target sequence
tttagatagatctcagtttgacttggt

SEQ ID NO: 139613 - DNA, 27 bp, Artificial sequence
  SiRNA target sequence
ttagatagatctcagtttgacttggta

SEQ ID NO: 139614 - DNA, 27 bp, Artificial sequence
  SiRNA target sequence
tagatagatctcagtttgacttggtat

SEQ ID NO: 139615 - DNA, 27 bp, Artificial sequence
  SiRNA target sequence
agatagatctcagtttgacttggtatc

SEQ ID NO: 139616 - DNA, 27 bp, Artificial sequence
  SiRNA target sequence
gatagatctcagtttgacttggtatct

SEQ ID NO: 139617 - DNA, 27 bp, Artificial sequence
  SiRNA target sequence
atagatctcagtttgacttggtatctg

SEQ ID NO: 139618 - DNA, 27 bp, Artificial sequence
  SiRNA target sequence
tagatctcagtttgacttggtatctga

SEQ ID NO: 139619 - DNA, 27 bp, Artificial sequence
  SiRNA target sequence
agatctcagtttgacttggtatctgaa

SEQ ID NO: 139620 - DNA, 27 bp, Artificial sequence
  SiRNA target sequence
gatctcagtttgacttggtatctgaag

SEQ ID NO: 139621 - DNA, 27 bp, Artificial sequence
  SiRNA target sequence
atctcagtttgacttggtatctgaagc

SEQ ID NO: 139622 - DNA, 27 bp, Artificial sequence
  SiRNA target sequence
tctcagtttgacttggtatctgaagca

SEQ ID NO: 139623 - DNA, 27 bp, Artificial sequence
  SiRNA target sequence
ctcagtttgacttggtatctgaagcat

SEQ ID NO: 139624 - DNA, 27 bp, Artificial sequence
  SiRNA target sequence
tcagtttgacttggtatctgaagcatt

SEQ ID NO: 139625 - DNA, 27 bp, Artificial sequence
  SiRNA target sequence
cagtttgacttggtatctgaagcatta

SEQ ID NO: 139626 - DNA, 27 bp, Artificial sequence
  SiRNA target sequence
agtttgacttggtatctgaagcattaa

SEQ ID NO: 139627 - DNA, 27 bp, Artificial sequence
  SiRNA target sequence
gtttgacttggtatctgaagcattaag

SEQ ID NO: 139628 - DNA, 27 bp, Artificial sequence
  SiRNA target sequence
tttgacttggtatctgaagcattaagt

SEQ ID NO: 139629 - DNA, 27 bp, Artificial sequence
  SiRNA target sequence
ttgacttggtatctgaagcattaagtg

SEQ ID NO: 139630 - DNA, 27 bp, Artificial sequence
  SiRNA target sequence
tgacttggtatctgaagcattaagtga

SEQ ID NO: 139631 - DNA, 27 bp, Artificial sequence
  SiRNA target sequence
gacttggtatctgaagcattaagtgaa

SEQ ID NO: 139632 - DNA, 27 bp, Artificial sequence
  SiRNA target sequence
acttggtatctgaagcattaagtgaac

SEQ ID NO: 139633 - DNA, 27 bp, Artificial sequence
  SiRNA target sequence
cttggtatctgaagcattaagtgaacg

SEQ ID NO: 139634 - DNA, 27 bp, Artificial sequence
  SiRNA target sequence
ttggtatctgaagcattaagtgaacga

SEQ ID NO: 139635 - DNA, 27 bp, Artificial sequence
  SiRNA target sequence
tggtatctgaagcattaagtgaacgaa

SEQ ID NO: 139636 - DNA, 27 bp, Artificial sequence
  SiRNA target sequence
ggtatctgaagcattaagtgaacgaaa

SEQ ID NO: 139637 - DNA, 27 bp, Artificial sequence
  SiRNA target sequence
gtatctgaagcattaagtgaacgaaaa

SEQ ID NO: 139638 - DNA, 27 bp, Artificial sequence
  SiRNA target sequence
tatctgaagcattaagtgaacgaaaaa

SEQ ID NO: 139639 - DNA, 27 bp, Artificial sequence
  SiRNA target sequence
atctgaagcattaagtgaacgaaaaat

SEQ ID NO: 139640 - DNA, 27 bp, Artificial sequence
  SiRNA target sequence
tctgaagcattaagtgaacgaaaaatt

SEQ ID NO: 139641 - DNA, 27 bp, Artificial sequence
  SiRNA target sequence
ctgaagcattaagtgaacgaaaaattg

SEQ ID NO: 139642 - DNA, 27 bp, Artificial sequence
  SiRNA target sequence
tgaagcattaagtgaacgaaaaattgt

SEQ ID NO: 139643 - DNA, 27 bp, Artificial sequence
  SiRNA target sequence
gaagcattaagtgaacgaaaaattgtt

SEQ ID NO: 139644 - DNA, 27 bp, Artificial sequence
  SiRNA target sequence
aagcattaagtgaacgaaaaattgtta

SEQ ID NO: 139645 - DNA, 27 bp, Artificial sequence
  SiRNA target sequence
agcattaagtgaacgaaaaattgttat

SEQ ID NO: 139646 - DNA, 27 bp, Artificial sequence
  SiRNA target sequence
gcattaagtgaacgaaaaattgttatg

SEQ ID NO: 139647 - DNA, 27 bp, Artificial sequence
  SiRNA target sequence
cattaagtgaacgaaaaattgttatga

SEQ ID NO: 139648 - DNA, 27 bp, Artificial sequence
  SiRNA target sequence
attaagtgaacgaaaaattgttatgaa

SEQ ID NO: 139649 - DNA, 27 bp, Artificial sequence
  SiRNA target sequence
ttaagtgaacgaaaaattgttatgaat

SEQ ID NO: 139650 - DNA, 27 bp, Artificial sequence
  SiRNA target sequence
taagtgaacgaaaaattgttatgaata

SEQ ID NO: 139651 - DNA, 27 bp, Artificial sequence
  SiRNA target sequence
aagtgaacgaaaaattgttatgaatat

SEQ ID NO: 139652 - DNA, 27 bp, Artificial sequence
  SiRNA target sequence
agtgaacgaaaaattgttatgaatatg

SEQ ID NO: 139653 - DNA, 27 bp, Artificial sequence
  SiRNA target sequence
gtgaacgaaaaattgttatgaatatgt

SEQ ID NO: 139654 - DNA, 27 bp, Artificial sequence
  SiRNA target sequence
tgaacgaaaaattgttatgaatatgtg

SEQ ID NO: 139655 - DNA, 27 bp, Artificial sequence
  SiRNA target sequence
gaacgaaaaattgttatgaatatgtgt

SEQ ID NO: 139656 - DNA, 27 bp, Artificial sequence
  SiRNA target sequence
aacgaaaaattgttatgaatatgtgtc

SEQ ID NO: 139657 - DNA, 27 bp, Artificial sequence
  SiRNA target sequence
acgaaaaattgttatgaatatgtgtcc

SEQ ID NO: 139658 - DNA, 27 bp, Artificial sequence
  SiRNA target sequence
cgaaaaattgttatgaatatgtgtcct

SEQ ID NO: 139659 - DNA, 27 bp, Artificial sequence
  SiRNA target sequence
gaaaaattgttatgaatatgtgtcctt

SEQ ID NO: 139660 - DNA, 27 bp, Artificial sequence
  SiRNA target sequence
aaaaattgttatgaatatgtgtccttt

SEQ ID NO: 139661 - DNA, 27 bp, Artificial sequence
  SiRNA target sequence
aaaattgttatgaatatgtgtcctttt

SEQ ID NO: 139662 - DNA, 27 bp, Artificial sequence
  SiRNA target sequence
aaattgttatgaatatgtgtccttttc

SEQ ID NO: 139663 - DNA, 27 bp, Artificial sequence
  SiRNA target sequence
aattgttatgaatatgtgtccttttct

SEQ ID NO: 139664 - DNA, 27 bp, Artificial sequence
  SiRNA target sequence
attgttatgaatatgtgtccttttcta

SEQ ID NO: 139665 - DNA, 27 bp, Artificial sequence
  SiRNA target sequence
ttgttatgaatatgtgtccttttctag

SEQ ID NO: 139666 - DNA, 27 bp, Artificial sequence
  SiRNA target sequence
tgttatgaatatgtgtccttttctagt

SEQ ID NO: 139667 - DNA, 27 bp, Artificial sequence
  SiRNA target sequence
gttatgaatatgtgtccttttctagta

SEQ ID NO: 139668 - DNA, 27 bp, Artificial sequence
  SiRNA target sequence
ttatgaatatgtgtccttttctagtaa

SEQ ID NO: 139669 - DNA, 27 bp, Artificial sequence
  SiRNA target sequence
tatgaatatgtgtccttttctagtaag

SEQ ID NO: 139670 - DNA, 27 bp, Artificial sequence
  SiRNA target sequence
atgaatatgtgtccttttctagtaagg

SEQ ID NO: 139671 - DNA, 27 bp, Artificial sequence
  SiRNA target sequence
tgaatatgtgtccttttctagtaaggt

SEQ ID NO: 139672 - DNA, 27 bp, Artificial sequence
  SiRNA target sequence
gaatatgtgtccttttctagtaaggtc

SEQ ID NO: 139673 - DNA, 27 bp, Artificial sequence
  SiRNA target sequence
aatatgtgtccttttctagtaaggtcg

SEQ ID NO: 139674 - DNA, 27 bp, Artificial sequence
  SiRNA target sequence
atatgtgtccttttctagtaaggtcga

SEQ ID NO: 139675 - DNA, 27 bp, Artificial sequence
  SiRNA target sequence
tatgtgtccttttctagtaaggtcgat

SEQ ID NO: 139676 - DNA, 27 bp, Artificial sequence
  SiRNA target sequence
atgtgtccttttctagtaaggtcgatg

SEQ ID NO: 139677 - DNA, 27 bp, Artificial sequence
  SiRNA target sequence
tgtgtccttttctagtaaggtcgatgg

SEQ ID NO: 139678 - DNA, 27 bp, Artificial sequence
  SiRNA target sequence
gtgtccttttctagtaaggtcgatgga

SEQ ID NO: 139679 - DNA, 27 bp, Artificial sequence
  SiRNA target sequence
tgtccttttctagtaaggtcgatggaa

SEQ ID NO: 139680 - DNA, 27 bp, Artificial sequence
  SiRNA target sequence
gtccttttctagtaaggtcgatggaaa

SEQ ID NO: 139681 - DNA, 27 bp, Artificial sequence
  SiRNA target sequence
tccttttctagtaaggtcgatggaaat

SEQ ID NO: 139682 - DNA, 27 bp, Artificial sequence
  SiRNA target sequence
ccttttctagtaaggtcgatggaaata

SEQ ID NO: 139683 - DNA, 27 bp, Artificial sequence
  SiRNA target sequence
cttttctagtaaggtcgatggaaatat

SEQ ID NO: 139684 - DNA, 27 bp, Artificial sequence
  SiRNA target sequence
ttttctagtaaggtcgatggaaatatt

SEQ ID NO: 139685 - DNA, 27 bp, Artificial sequence
  SiRNA target sequence
tttctagtaaggtcgatggaaatatta

SEQ ID NO: 139686 - DNA, 27 bp, Artificial sequence
  SiRNA target sequence
ttctagtaaggtcgatggaaatattat

SEQ ID NO: 139687 - DNA, 27 bp, Artificial sequence
  SiRNA target sequence
tctagtaaggtcgatggaaatattatt

SEQ ID NO: 139688 - DNA, 27 bp, Artificial sequence
  SiRNA target sequence
ctagtaaggtcgatggaaatattattt

SEQ ID NO: 139689 - DNA, 27 bp, Artificial sequence
  SiRNA target sequence
tagtaaggtcgatggaaatattatttc

SEQ ID NO: 139690 - DNA, 27 bp, Artificial sequence
  SiRNA target sequence
agtaaggtcgatggaaatattatttcc

SEQ ID NO: 139691 - DNA, 27 bp, Artificial sequence
  SiRNA target sequence
gtaaggtcgatggaaatattatttccg

SEQ ID NO: 139692 - DNA, 27 bp, Artificial sequence
  SiRNA target sequence
taaggtcgatggaaatattatttccgg

SEQ ID NO: 139693 - DNA, 27 bp, Artificial sequence
  SiRNA target sequence
aaggtcgatggaaatattatttccggt

SEQ ID NO: 139694 - DNA, 27 bp, Artificial sequence
  SiRNA target sequence
aggtcgatggaaatattatttccggtt

SEQ ID NO: 139695 - DNA, 27 bp, Artificial sequence
  SiRNA target sequence
ggtcgatggaaatattatttccggttt

SEQ ID NO: 139696 - DNA, 27 bp, Artificial sequence
  SiRNA target sequence
gtcgatggaaatattatttccggttta

SEQ ID NO: 139697 - DNA, 27 bp, Artificial sequence
  SiRNA target sequence
tcgatggaaatattatttccggtttat

SEQ ID NO: 139698 - DNA, 27 bp, Artificial sequence
  SiRNA target sequence
cgatggaaatattatttccggtttata

SEQ ID NO: 139699 - DNA, 27 bp, Artificial sequence
  SiRNA target sequence
gatggaaatattatttccggtttataa

SEQ ID NO: 139700 - DNA, 27 bp, Artificial sequence
  SiRNA target sequence
atggaaatattatttccggtttataaa

SEQ ID NO: 139701 - DNA, 27 bp, Artificial sequence
  SiRNA target sequence
tggaaatattatttccggtttataaaa

SEQ ID NO: 139702 - DNA, 27 bp, Artificial sequence
  SiRNA target sequence
ggaaatattatttccggtttataaaag

SEQ ID NO: 139703 - DNA, 27 bp, Artificial sequence
  SiRNA target sequence
gaaatattatttccggtttataaaagg

SEQ ID NO: 139704 - DNA, 27 bp, Artificial sequence
  SiRNA target sequence
aaatattatttccggtttataaaaggc

SEQ ID NO: 139705 - DNA, 27 bp, Artificial sequence
  SiRNA target sequence
aatattatttccggtttataaaaggct

SEQ ID NO: 139706 - DNA, 27 bp, Artificial sequence
  SiRNA target sequence
atattatttccggtttataaaaggctt

SEQ ID NO: 139707 - DNA, 27 bp, Artificial sequence
  SiRNA target sequence
tattatttccggtttataaaaggcttt

SEQ ID NO: 139708 - DNA, 27 bp, Artificial sequence
  SiRNA target sequence
attatttccggtttataaaaggctttt

SEQ ID NO: 139709 - DNA, 27 bp, Artificial sequence
  SiRNA target sequence
ttatttccggtttataaaaggctttta

SEQ ID NO: 139710 - DNA, 27 bp, Artificial sequence
  SiRNA target sequence
tatttccggtttataaaaggcttttaa

SEQ ID NO: 139711 - DNA, 27 bp, Artificial sequence
  SiRNA target sequence
atttccggtttataaaaggcttttaat

SEQ ID NO: 139712 - DNA, 27 bp, Artificial sequence
  SiRNA target sequence
tttccggtttataaaaggcttttaatt

SEQ ID NO: 139713 - DNA, 27 bp, Artificial sequence
  SiRNA target sequence
ttccggtttataaaaggcttttaattc

SEQ ID NO: 139714 - DNA, 27 bp, Artificial sequence
  SiRNA target sequence
tccggtttataaaaggcttttaattcc

SEQ ID NO: 139715 - DNA, 27 bp, Artificial sequence
  SiRNA target sequence
ccggtttataaaaggcttttaattcct

SEQ ID NO: 139716 - DNA, 27 bp, Artificial sequence
  SiRNA target sequence
cggtttataaaaggcttttaattcctt

SEQ ID NO: 139717 - DNA, 27 bp, Artificial sequence
  SiRNA target sequence
ggtttataaaaggcttttaattcctta

SEQ ID NO: 139718 - DNA, 27 bp, Artificial sequence
  SiRNA target sequence
gtttataaaaggcttttaattccttac

SEQ ID NO: 139719 - DNA, 27 bp, Artificial sequence
  SiRNA target sequence
tttataaaaggcttttaattccttact

SEQ ID NO: 139720 - DNA, 27 bp, Artificial sequence
  SiRNA target sequence
ttataaaaggcttttaattccttacta

SEQ ID NO: 139721 - DNA, 27 bp, Artificial sequence
  SiRNA target sequence
tataaaaggcttttaattccttactac

SEQ ID NO: 139722 - DNA, 27 bp, Artificial sequence
  SiRNA target sequence
ataaaaggcttttaattccttactact

SEQ ID NO: 139723 - DNA, 27 bp, Artificial sequence
  SiRNA target sequence
taaaaggcttttaattccttactacta

SEQ ID NO: 139724 - DNA, 27 bp, Artificial sequence
  SiRNA target sequence
aaaaggcttttaattccttactactat

SEQ ID NO: 139725 - DNA, 27 bp, Artificial sequence
  SiRNA target sequence
aaaggcttttaattccttactactata

SEQ ID NO: 139726 - DNA, 27 bp, Artificial sequence
  SiRNA target sequence
aaggcttttaattccttactactatat

SEQ ID NO: 139727 - DNA, 27 bp, Artificial sequence
  SiRNA target sequence
aggcttttaattccttactactatatt

SEQ ID NO: 139728 - DNA, 27 bp, Artificial sequence
  SiRNA target sequence
ggcttttaattccttactactatattg

SEQ ID NO: 139729 - DNA, 27 bp, Artificial sequence
  SiRNA target sequence
gcttttaattccttactactatattgg

SEQ ID NO: 139730 - DNA, 27 bp, Artificial sequence
  SiRNA target sequence
cttttaattccttactactatattggc

SEQ ID NO: 139731 - DNA, 27 bp, Artificial sequence
  SiRNA target sequence
ttttaattccttactactatattggcc

SEQ ID NO: 139732 - DNA, 27 bp, Artificial sequence
  SiRNA target sequence
tttaattccttactactatattggcct

SEQ ID NO: 139733 - DNA, 27 bp, Artificial sequence
  SiRNA target sequence
ttaattccttactactatattggcctt

SEQ ID NO: 139734 - DNA, 27 bp, Artificial sequence
  SiRNA target sequence
taattccttactactatattggcctta

SEQ ID NO: 139735 - DNA, 27 bp, Artificial sequence
  SiRNA target sequence
aattccttactactatattggccttaa

SEQ ID NO: 139736 - DNA, 27 bp, Artificial sequence
  SiRNA target sequence
attccttactactatattggccttaaa

SEQ ID NO: 139737 - DNA, 27 bp, Artificial sequence
  SiRNA target sequence
ttccttactactatattggccttaaat

SEQ ID NO: 139738 - DNA, 27 bp, Artificial sequence
  SiRNA target sequence
tccttactactatattggccttaaatt

SEQ ID NO: 139739 - DNA, 27 bp, Artificial sequence
  SiRNA target sequence
ccttactactatattggccttaaattt

SEQ ID NO: 139740 - DNA, 27 bp, Artificial sequence
  SiRNA target sequence
cttactactatattggccttaaatttt

SEQ ID NO: 139741 - DNA, 27 bp, Artificial sequence
  SiRNA target sequence
ttactactatattggccttaaatttta

SEQ ID NO: 139742 - DNA, 27 bp, Artificial sequence
  SiRNA target sequence
tactactatattggccttaaattttat

SEQ ID NO: 139743 - DNA, 27 bp, Artificial sequence
  SiRNA target sequence
actactatattggccttaaattttatg

SEQ ID NO: 139744 - DNA, 27 bp, Artificial sequence
  SiRNA target sequence
ctactatattggccttaaattttatga

SEQ ID NO: 139745 - DNA, 27 bp, Artificial sequence
  SiRNA target sequence
tactatattggccttaaattttatgat

SEQ ID NO: 139746 - DNA, 27 bp, Artificial sequence
  SiRNA target sequence
actatattggccttaaattttatgatt

SEQ ID NO: 139747 - DNA, 27 bp, Artificial sequence
  SiRNA target sequence
ctatattggccttaaattttatgattg

SEQ ID NO: 139748 - DNA, 27 bp, Artificial sequence
  SiRNA target sequence
tatattggccttaaattttatgattgg

SEQ ID NO: 139749 - DNA, 27 bp, Artificial sequence
  SiRNA target sequence
atattggccttaaattttatgattgga

SEQ ID NO: 139750 - DNA, 27 bp, Artificial sequence
  SiRNA target sequence
tattggccttaaattttatgattggat

SEQ ID NO: 139751 - DNA, 27 bp, Artificial sequence
  SiRNA target sequence
attggccttaaattttatgattggatt

SEQ ID NO: 139752 - DNA, 27 bp, Artificial sequence
  SiRNA target sequence
ttggccttaaattttatgattggattt

SEQ ID NO: 139753 - DNA, 27 bp, Artificial sequence
  SiRNA target sequence
tggccttaaattttatgattggatttc

SEQ ID NO: 139754 - DNA, 27 bp, Artificial sequence
  SiRNA target sequence
ggccttaaattttatgattggatttct

SEQ ID NO: 139755 - DNA, 27 bp, Artificial sequence
  SiRNA target sequence
gccttaaattttatgattggatttctg

SEQ ID NO: 139756 - DNA, 27 bp, Artificial sequence
  SiRNA target sequence
ccttaaattttatgattggatttctgg

SEQ ID NO: 139757 - DNA, 27 bp, Artificial sequence
  SiRNA target sequence
cttaaattttatgattggatttctggg

SEQ ID NO: 139758 - DNA, 27 bp, Artificial sequence
  SiRNA target sequence
ttaaattttatgattggatttctgggc

SEQ ID NO: 139759 - DNA, 27 bp, Artificial sequence
  SiRNA target sequence
taaattttatgattggatttctgggca

SEQ ID NO: 139760 - DNA, 27 bp, Artificial sequence
  SiRNA target sequence
aaattttatgattggatttctgggcaa

SEQ ID NO: 139761 - DNA, 27 bp, Artificial sequence
  SiRNA target sequence
aattttatgattggatttctgggcaac

SEQ ID NO: 139762 - DNA, 27 bp, Artificial sequence
  SiRNA target sequence
attttatgattggatttctgggcaacg

SEQ ID NO: 139763 - DNA, 27 bp, Artificial sequence
  SiRNA target sequence
ttttatgattggatttctgggcaacgg

SEQ ID NO: 139764 - DNA, 27 bp, Artificial sequence
  SiRNA target sequence
tttatgattggatttctgggcaacggt

SEQ ID NO: 139765 - DNA, 27 bp, Artificial sequence
  SiRNA target sequence
ttatgattggatttctgggcaacggtc

SEQ ID NO: 139766 - DNA, 27 bp, Artificial sequence
  SiRNA target sequence
tatgattggatttctgggcaacggtcc

SEQ ID NO: 139767 - DNA, 27 bp, Artificial sequence
  SiRNA target sequence
atgattggatttctgggcaacggtccc

SEQ ID NO: 139768 - DNA, 27 bp, Artificial sequence
  SiRNA target sequence
tgattggatttctgggcaacggtccct

SEQ ID NO: 139769 - DNA, 27 bp, Artificial sequence
  SiRNA target sequence
gattggatttctgggcaacggtccctt

SEQ ID NO: 139770 - DNA, 27 bp, Artificial sequence
  SiRNA target sequence
attggatttctgggcaacggtcccttg

SEQ ID NO: 139771 - DNA, 27 bp, Artificial sequence
  SiRNA target sequence
ttggatttctgggcaacggtcccttgg

SEQ ID NO: 139772 - DNA, 27 bp, Artificial sequence
  SiRNA target sequence
tggatttctgggcaacggtcccttggg

SEQ ID NO: 139773 - DNA, 27 bp, Artificial sequence
  SiRNA target sequence
ggatttctgggcaacggtcccttgggc

SEQ ID NO: 139774 - DNA, 27 bp, Artificial sequence
  SiRNA target sequence
gatttctgggcaacggtcccttgggcg

SEQ ID NO: 139775 - DNA, 27 bp, Artificial sequence
  SiRNA target sequence
atttctgggcaacggtcccttgggcga

SEQ ID NO: 139776 - DNA, 27 bp, Artificial sequence
  SiRNA target sequence
tttctgggcaacggtcccttgggcgaa

SEQ ID NO: 139777 - DNA, 27 bp, Artificial sequence
  SiRNA target sequence
ttctgggcaacggtcccttgggcgaag

SEQ ID NO: 139778 - DNA, 27 bp, Artificial sequence
  SiRNA target sequence
tctgggcaacggtcccttgggcgaagt

SEQ ID NO: 139779 - DNA, 27 bp, Artificial sequence
  SiRNA target sequence
ctgggcaacggtcccttgggcgaagta

SEQ ID NO: 139780 - DNA, 27 bp, Artificial sequence
  SiRNA target sequence
tgggcaacggtcccttgggcgaagtaa

SEQ ID NO: 139781 - DNA, 27 bp, Artificial sequence
  SiRNA target sequence
gggcaacggtcccttgggcgaagtaaa

SEQ ID NO: 139782 - DNA, 27 bp, Artificial sequence
  SiRNA target sequence
ggcaacggtcccttgggcgaagtaaat

SEQ ID NO: 139783 - DNA, 27 bp, Artificial sequence
  SiRNA target sequence
gcaacggtcccttgggcgaagtaaatt

SEQ ID NO: 139784 - DNA, 27 bp, Artificial sequence
  SiRNA target sequence
caacggtcccttgggcgaagtaaattt

SEQ ID NO: 139785 - DNA, 27 bp, Artificial sequence
  SiRNA target sequence
aacggtcccttgggcgaagtaaatttt

SEQ ID NO: 139786 - DNA, 27 bp, Artificial sequence
  SiRNA target sequence
acggtcccttgggcgaagtaaattttt

SEQ ID NO: 139787 - DNA, 27 bp, Artificial sequence
  SiRNA target sequence
cggtcccttgggcgaagtaaatttttg

SEQ ID NO: 139788 - DNA, 27 bp, Artificial sequence
  SiRNA target sequence
ggtcccttgggcgaagtaaatttttgt

SEQ ID NO: 139789 - DNA, 27 bp, Artificial sequence
  SiRNA target sequence
gtcccttgggcgaagtaaatttttgtc

SEQ ID NO: 139790 - DNA, 27 bp, Artificial sequence
  SiRNA target sequence
tcccttgggcgaagtaaatttttgtcg

SEQ ID NO: 139791 - DNA, 27 bp, Artificial sequence
  SiRNA target sequence
cccttgggcgaagtaaatttttgtcgc

SEQ ID NO: 139792 - DNA, 27 bp, Artificial sequence
  SiRNA target sequence
ccttgggcgaagtaaatttttgtcgcg

SEQ ID NO: 139793 - DNA, 27 bp, Artificial sequence
  SiRNA target sequence
cttgggcgaagtaaatttttgtcgcgg

SEQ ID NO: 139794 - DNA, 27 bp, Artificial sequence
  SiRNA target sequence
ttgggcgaagtaaatttttgtcgcggc

SEQ ID NO: 139795 - DNA, 27 bp, Artificial sequence
  SiRNA target sequence
tgggcgaagtaaatttttgtcgcggca

SEQ ID NO: 139796 - DNA, 27 bp, Artificial sequence
  SiRNA target sequence
gggcgaagtaaatttttgtcgcggcaa

SEQ ID NO: 139797 - DNA, 27 bp, Artificial sequence
  SiRNA target sequence
ggcgaagtaaatttttgtcgcggcaac

SEQ ID NO: 139798 - DNA, 27 bp, Artificial sequence
  SiRNA target sequence
gcgaagtaaatttttgtcgcggcaaca

SEQ ID NO: 139799 - DNA, 27 bp, Artificial sequence
  SiRNA target sequence
cgaagtaaatttttgtcgcggcaacaa

SEQ ID NO: 139800 - DNA, 27 bp, Artificial sequence
  SiRNA target sequence
gaagtaaatttttgtcgcggcaacaaa

SEQ ID NO: 139801 - DNA, 27 bp, Artificial sequence
  SiRNA target sequence
aagtaaatttttgtcgcggcaacaaac

SEQ ID NO: 139802 - DNA, 27 bp, Artificial sequence
  SiRNA target sequence
agtaaatttttgtcgcggcaacaaact

SEQ ID NO: 139803 - DNA, 27 bp, Artificial sequence
  SiRNA target sequence
gtaaatttttgtcgcggcaacaaacta

SEQ ID NO: 139804 - DNA, 27 bp, Artificial sequence
  SiRNA target sequence
taaatttttgtcgcggcaacaaactat

SEQ ID NO: 139805 - DNA, 27 bp, Artificial sequence
  SiRNA target sequence
aaatttttgtcgcggcaacaaactatt

SEQ ID NO: 139806 - DNA, 27 bp, Artificial sequence
  SiRNA target sequence
aatttttgtcgcggcaacaaactatta

SEQ ID NO: 139807 - DNA, 27 bp, Artificial sequence
  SiRNA target sequence
atttttgtcgcggcaacaaactattac

SEQ ID NO: 139808 - DNA, 27 bp, Artificial sequence
  SiRNA target sequence
tttttgtcgcggcaacaaactattaca

SEQ ID NO: 139809 - DNA, 27 bp, Artificial sequence
  SiRNA target sequence
ttttgtcgcggcaacaaactattacaa

SEQ ID NO: 139810 - DNA, 27 bp, Artificial sequence
  SiRNA target sequence
tttgtcgcggcaacaaactattacaaa

SEQ ID NO: 139811 - DNA, 27 bp, Artificial sequence
  SiRNA target sequence
ttgtcgcggcaacaaactattacaaaa

SEQ ID NO: 139812 - DNA, 27 bp, Artificial sequence
  SiRNA target sequence
tgtcgcggcaacaaactattacaaaat

SEQ ID NO: 139813 - DNA, 27 bp, Artificial sequence
  SiRNA target sequence
gtcgcggcaacaaactattacaaaatt

SEQ ID NO: 139814 - DNA, 27 bp, Artificial sequence
  SiRNA target sequence
tcgcggcaacaaactattacaaaattt

SEQ ID NO: 139815 - DNA, 27 bp, Artificial sequence
  SiRNA target sequence
cgcggcaacaaactattacaaaatttc

SEQ ID NO: 139816 - DNA, 27 bp, Artificial sequence
  SiRNA target sequence
gcggcaacaaactattacaaaatttcc

SEQ ID NO: 139817 - DNA, 27 bp, Artificial sequence
  SiRNA target sequence
cggcaacaaactattacaaaatttcct

SEQ ID NO: 139818 - DNA, 27 bp, Artificial sequence
  SiRNA target sequence
ggcaacaaactattacaaaatttccta

SEQ ID NO: 139819 - DNA, 27 bp, Artificial sequence
  SiRNA target sequence
gcaacaaactattacaaaatttcctaa

SEQ ID NO: 139820 - DNA, 27 bp, Artificial sequence
  SiRNA target sequence
caacaaactattacaaaatttcctaat

SEQ ID NO: 139821 - DNA, 27 bp, Artificial sequence
  SiRNA target sequence
aacaaactattacaaaatttcctaatg

SEQ ID NO: 139822 - DNA, 27 bp, Artificial sequence
  SiRNA target sequence
acaaactattacaaaatttcctaatgt

SEQ ID NO: 139823 - DNA, 27 bp, Artificial sequence
  SiRNA target sequence
caaactattacaaaatttcctaatgtg

SEQ ID NO: 139824 - DNA, 27 bp, Artificial sequence
  SiRNA target sequence
aaactattacaaaatttcctaatgtga

SEQ ID NO: 139825 - DNA, 27 bp, Artificial sequence
  SiRNA target sequence
aactattacaaaatttcctaatgtgag

SEQ ID NO: 139826 - DNA, 27 bp, Artificial sequence
  SiRNA target sequence
actattacaaaatttcctaatgtgaga

SEQ ID NO: 139827 - DNA, 27 bp, Artificial sequence
  SiRNA target sequence
ctattacaaaatttcctaatgtgagaa

SEQ ID NO: 139828 - DNA, 27 bp, Artificial sequence
  SiRNA target sequence
tattacaaaatttcctaatgtgagaaa

SEQ ID NO: 139829 - DNA, 27 bp, Artificial sequence
  SiRNA target sequence
attacaaaatttcctaatgtgagaaaa

SEQ ID NO: 139830 - DNA, 27 bp, Artificial sequence
  SiRNA target sequence
ttacaaaatttcctaatgtgagaaaaa

SEQ ID NO: 139831 - DNA, 27 bp, Artificial sequence
  SiRNA target sequence
tacaaaatttcctaatgtgagaaaaat

SEQ ID NO: 139832 - DNA, 27 bp, Artificial sequence
  SiRNA target sequence
acaaaatttcctaatgtgagaaaaatc

SEQ ID NO: 139833 - DNA, 27 bp, Artificial sequence
  SiRNA target sequence
caaaatttcctaatgtgagaaaaatcg

SEQ ID NO: 139834 - DNA, 27 bp, Artificial sequence
  SiRNA target sequence
aaaatttcctaatgtgagaaaaatcga

SEQ ID NO: 139835 - DNA, 27 bp, Artificial sequence
  SiRNA target sequence
aaatttcctaatgtgagaaaaatcgac

SEQ ID NO: 139836 - DNA, 27 bp, Artificial sequence
  SiRNA target sequence
aatttcctaatgtgagaaaaatcgacc

SEQ ID NO: 139837 - DNA, 27 bp, Artificial sequence
  SiRNA target sequence
atttcctaatgtgagaaaaatcgacct

SEQ ID NO: 139838 - DNA, 27 bp, Artificial sequence
  SiRNA target sequence
tttcctaatgtgagaaaaatcgacctt

SEQ ID NO: 139839 - DNA, 27 bp, Artificial sequence
  SiRNA target sequence
ttcctaatgtgagaaaaatcgaccttg

SEQ ID NO: 139840 - DNA, 27 bp, Artificial sequence
  SiRNA target sequence
tcctaatgtgagaaaaatcgaccttgt

SEQ ID NO: 139841 - DNA, 27 bp, Artificial sequence
  SiRNA target sequence
cctaatgtgagaaaaatcgaccttgta

SEQ ID NO: 139842 - DNA, 27 bp, Artificial sequence
  SiRNA target sequence
ctaatgtgagaaaaatcgaccttgtag

SEQ ID NO: 139843 - DNA, 27 bp, Artificial sequence
  SiRNA target sequence
taatgtgagaaaaatcgaccttgtagg

SEQ ID NO: 139844 - DNA, 27 bp, Artificial sequence
  SiRNA target sequence
aatgtgagaaaaatcgaccttgtagga

SEQ ID NO: 139845 - DNA, 27 bp, Artificial sequence
  SiRNA target sequence
atgtgagaaaaatcgaccttgtaggat

SEQ ID NO: 139846 - DNA, 27 bp, Artificial sequence
  SiRNA target sequence
tgtgagaaaaatcgaccttgtaggatc

SEQ ID NO: 139847 - DNA, 27 bp, Artificial sequence
  SiRNA target sequence
gtgagaaaaatcgaccttgtaggatcc

SEQ ID NO: 139848 - DNA, 27 bp, Artificial sequence
  SiRNA target sequence
tgagaaaaatcgaccttgtaggatccg

SEQ ID NO: 139849 - DNA, 27 bp, Artificial sequence
  SiRNA target sequence
gagaaaaatcgaccttgtaggatccgt

SEQ ID NO: 139850 - DNA, 27 bp, Artificial sequence
  SiRNA target sequence
agaaaaatcgaccttgtaggatccgtt

SEQ ID NO: 139851 - DNA, 27 bp, Artificial sequence
  SiRNA target sequence
gaaaaatcgaccttgtaggatccgttt

SEQ ID NO: 139852 - DNA, 27 bp, Artificial sequence
  SiRNA target sequence
aaaaatcgaccttgtaggatccgtttc

SEQ ID NO: 139853 - DNA, 27 bp, Artificial sequence
  SiRNA target sequence
aaaatcgaccttgtaggatccgtttcg

SEQ ID NO: 139854 - DNA, 27 bp, Artificial sequence
  SiRNA target sequence
aaatcgaccttgtaggatccgtttcgt

SEQ ID NO: 139855 - DNA, 27 bp, Artificial sequence
  SiRNA target sequence
aatcgaccttgtaggatccgtttcgta

SEQ ID NO: 139856 - DNA, 27 bp, Artificial sequence
  SiRNA target sequence
atcgaccttgtaggatccgtttcgtat

SEQ ID NO: 139857 - DNA, 27 bp, Artificial sequence
  SiRNA target sequence
tcgaccttgtaggatccgtttcgtatc

SEQ ID NO: 139858 - DNA, 27 bp, Artificial sequence
  SiRNA target sequence
cgaccttgtaggatccgtttcgtatcg

SEQ ID NO: 139859 - DNA, 27 bp, Artificial sequence
  SiRNA target sequence
gaccttgtaggatccgtttcgtatcgt

SEQ ID NO: 139860 - DNA, 27 bp, Artificial sequence
  SiRNA target sequence
accttgtaggatccgtttcgtatcgtg

SEQ ID NO: 139861 - DNA, 27 bp, Artificial sequence
  SiRNA target sequence
ccttgtaggatccgtttcgtatcgtga

SEQ ID NO: 139862 - DNA, 27 bp, Artificial sequence
  SiRNA target sequence
cttgtaggatccgtttcgtatcgtgat

SEQ ID NO: 139863 - DNA, 27 bp, Artificial sequence
  SiRNA target sequence
ttgtaggatccgtttcgtatcgtgatg

SEQ ID NO: 139864 - DNA, 27 bp, Artificial sequence
  SiRNA target sequence
tgtaggatccgtttcgtatcgtgatgg

SEQ ID NO: 139865 - DNA, 27 bp, Artificial sequence
  SiRNA target sequence
gtaggatccgtttcgtatcgtgatggc

SEQ ID NO: 139866 - DNA, 27 bp, Artificial sequence
  SiRNA target sequence
taggatccgtttcgtatcgtgatggcc

SEQ ID NO: 139867 - DNA, 27 bp, Artificial sequence
  SiRNA target sequence
aggatccgtttcgtatcgtgatggcca

SEQ ID NO: 139868 - DNA, 27 bp, Artificial sequence
  SiRNA target sequence
ggatccgtttcgtatcgtgatggccaa

SEQ ID NO: 139869 - DNA, 27 bp, Artificial sequence
  SiRNA target sequence
gatccgtttcgtatcgtgatggccaat

SEQ ID NO: 139870 - DNA, 27 bp, Artificial sequence
  SiRNA target sequence
atccgtttcgtatcgtgatggccaatt

SEQ ID NO: 139871 - DNA, 27 bp, Artificial sequence
  SiRNA target sequence
tccgtttcgtatcgtgatggccaattt

SEQ ID NO: 139872 - DNA, 27 bp, Artificial sequence
  SiRNA target sequence
ccgtttcgtatcgtgatggccaatttt

SEQ ID NO: 139873 - DNA, 27 bp, Artificial sequence
  SiRNA target sequence
cgtttcgtatcgtgatggccaatttta

SEQ ID NO: 139874 - DNA, 27 bp, Artificial sequence
  SiRNA target sequence
gtttcgtatcgtgatggccaattttat

SEQ ID NO: 139875 - DNA, 27 bp, Artificial sequence
  SiRNA target sequence
tttcgtatcgtgatggccaattttatg

SEQ ID NO: 139876 - DNA, 27 bp, Artificial sequence
  SiRNA target sequence
ttcgtatcgtgatggccaattttatga

SEQ ID NO: 139877 - DNA, 27 bp, Artificial sequence
  SiRNA target sequence
tcgtatcgtgatggccaattttatgat

SEQ ID NO: 139878 - DNA, 27 bp, Artificial sequence
  SiRNA target sequence
cgtatcgtgatggccaattttatgatg

SEQ ID NO: 139879 - DNA, 27 bp, Artificial sequence
  SiRNA target sequence
gtatcgtgatggccaattttatgatgc

SEQ ID NO: 139880 - DNA, 27 bp, Artificial sequence
  SiRNA target sequence
tatcgtgatggccaattttatgatgct

SEQ ID NO: 139881 - DNA, 27 bp, Artificial sequence
  SiRNA target sequence
atcgtgatggccaattttatgatgcta

SEQ ID NO: 139882 - DNA, 27 bp, Artificial sequence
  SiRNA target sequence
tcgtgatggccaattttatgatgctaa

SEQ ID NO: 139883 - DNA, 27 bp, Artificial sequence
  SiRNA target sequence
cgtgatggccaattttatgatgctaaa

SEQ ID NO: 139884 - DNA, 27 bp, Artificial sequence
  SiRNA target sequence
gtgatggccaattttatgatgctaaat

SEQ ID NO: 139885 - DNA, 27 bp, Artificial sequence
  SiRNA target sequence
tgatggccaattttatgatgctaaata

SEQ ID NO: 139886 - DNA, 27 bp, Artificial sequence
  SiRNA target sequence
gatggccaattttatgatgctaaatac

SEQ ID NO: 139887 - DNA, 27 bp, Artificial sequence
  SiRNA target sequence
atggccaattttatgatgctaaataca

SEQ ID NO: 139888 - DNA, 27 bp, Artificial sequence
  SiRNA target sequence
tggccaattttatgatgctaaatacaa

SEQ ID NO: 139889 - DNA, 27 bp, Artificial sequence
  SiRNA target sequence
ggccaattttatgatgctaaatacaat

SEQ ID NO: 139890 - DNA, 27 bp, Artificial sequence
  SiRNA target sequence
gccaattttatgatgctaaatacaatg

SEQ ID NO: 139891 - DNA, 27 bp, Artificial sequence
  SiRNA target sequence
ccaattttatgatgctaaatacaatgt

SEQ ID NO: 139892 - DNA, 27 bp, Artificial sequence
  SiRNA target sequence
caattttatgatgctaaatacaatgtt

SEQ ID NO: 139893 - DNA, 27 bp, Artificial sequence
  SiRNA target sequence
aattttatgatgctaaatacaatgttc

SEQ ID NO: 139894 - DNA, 27 bp, Artificial sequence
  SiRNA target sequence
attttatgatgctaaatacaatgttct

SEQ ID NO: 139895 - DNA, 27 bp, Artificial sequence
  SiRNA target sequence
ttttatgatgctaaatacaatgttcta

SEQ ID NO: 139896 - DNA, 27 bp, Artificial sequence
  SiRNA target sequence
tttatgatgctaaatacaatgttctat

SEQ ID NO: 139897 - DNA, 27 bp, Artificial sequence
  SiRNA target sequence
ttatgatgctaaatacaatgttctatt

SEQ ID NO: 139898 - DNA, 27 bp, Artificial sequence
  SiRNA target sequence
tatgatgctaaatacaatgttctattg

SEQ ID NO: 139899 - DNA, 27 bp, Artificial sequence
  SiRNA target sequence
atgatgctaaatacaatgttctattgg

SEQ ID NO: 139900 - DNA, 27 bp, Artificial sequence
  SiRNA target sequence
tgatgctaaatacaatgttctattggg

SEQ ID NO: 139901 - DNA, 27 bp, Artificial sequence
  SiRNA target sequence
gatgctaaatacaatgttctattgggt

SEQ ID NO: 139902 - DNA, 27 bp, Artificial sequence
  SiRNA target sequence
atgctaaatacaatgttctattgggtg

SEQ ID NO: 139903 - DNA, 27 bp, Artificial sequence
  SiRNA target sequence
tgctaaatacaatgttctattgggtgt

SEQ ID NO: 139904 - DNA, 27 bp, Artificial sequence
  SiRNA target sequence
gctaaatacaatgttctattgggtgtc

SEQ ID NO: 139905 - DNA, 27 bp, Artificial sequence
  SiRNA target sequence
ctaaatacaatgttctattgggtgtca

SEQ ID NO: 139906 - DNA, 27 bp, Artificial sequence
  SiRNA target sequence
taaatacaatgttctattgggtgtcac

SEQ ID NO: 139907 - DNA, 27 bp, Artificial sequence
  SiRNA target sequence
aaatacaatgttctattgggtgtcaca

SEQ ID NO: 139908 - DNA, 27 bp, Artificial sequence
  SiRNA target sequence
aatacaatgttctattgggtgtcacag

SEQ ID NO: 139909 - DNA, 27 bp, Artificial sequence
  SiRNA target sequence
atacaatgttctattgggtgtcacagc

SEQ ID NO: 139910 - DNA, 27 bp, Artificial sequence
  SiRNA target sequence
tacaatgttctattgggtgtcacagct

SEQ ID NO: 139911 - DNA, 27 bp, Artificial sequence
  SiRNA target sequence
acaatgttctattgggtgtcacagcta

SEQ ID NO: 139912 - DNA, 27 bp, Artificial sequence
  SiRNA target sequence
caatgttctattgggtgtcacagctac

SEQ ID NO: 139913 - DNA, 27 bp, Artificial sequence
  SiRNA target sequence
aatgttctattgggtgtcacagctacc

SEQ ID NO: 139914 - DNA, 27 bp, Artificial sequence
  SiRNA target sequence
atgttctattgggtgtcacagctacct

SEQ ID NO: 139915 - DNA, 27 bp, Artificial sequence
  SiRNA target sequence
tgttctattgggtgtcacagctaccta

SEQ ID NO: 139916 - DNA, 27 bp, Artificial sequence
  SiRNA target sequence
gttctattgggtgtcacagctacctac

SEQ ID NO: 139917 - DNA, 27 bp, Artificial sequence
  SiRNA target sequence
ttctattgggtgtcacagctacctact

SEQ ID NO: 139918 - DNA, 27 bp, Artificial sequence
  SiRNA target sequence
tctattgggtgtcacagctacctacta

SEQ ID NO: 139919 - DNA, 27 bp, Artificial sequence
  SiRNA target sequence
ctattgggtgtcacagctacctactat

SEQ ID NO: 139920 - DNA, 27 bp, Artificial sequence
  SiRNA target sequence
tattgggtgtcacagctacctactatg

SEQ ID NO: 139921 - DNA, 27 bp, Artificial sequence
  SiRNA target sequence
attgggtgtcacagctacctactatgg

SEQ ID NO: 139922 - DNA, 27 bp, Artificial sequence
  SiRNA target sequence
ttgggtgtcacagctacctactatgga

SEQ ID NO: 139923 - DNA, 27 bp, Artificial sequence
  SiRNA target sequence
tgggtgtcacagctacctactatggag

SEQ ID NO: 139924 - DNA, 27 bp, Artificial sequence
  SiRNA target sequence
gggtgtcacagctacctactatggagc

SEQ ID NO: 139925 - DNA, 27 bp, Artificial sequence
  SiRNA target sequence
ggtgtcacagctacctactatggagct

SEQ ID NO: 139926 - DNA, 27 bp, Artificial sequence
  SiRNA target sequence
gtgtcacagctacctactatggagctg

SEQ ID NO: 139927 - DNA, 27 bp, Artificial sequence
  SiRNA target sequence
tgtcacagctacctactatggagctgt

SEQ ID NO: 139928 - DNA, 27 bp, Artificial sequence
  SiRNA target sequence
gtcacagctacctactatggagctgtt

SEQ ID NO: 139929 - DNA, 27 bp, Artificial sequence
  SiRNA target sequence
tcacagctacctactatggagctgttg

SEQ ID NO: 139930 - DNA, 27 bp, Artificial sequence
  SiRNA target sequence
cacagctacctactatggagctgttgt

SEQ ID NO: 139931 - DNA, 27 bp, Artificial sequence
  SiRNA target sequence
acagctacctactatggagctgttgta

SEQ ID NO: 139932 - DNA, 27 bp, Artificial sequence
  SiRNA target sequence
cagctacctactatggagctgttgtat

SEQ ID NO: 139933 - DNA, 27 bp, Artificial sequence
  SiRNA target sequence
agctacctactatggagctgttgtatt

SEQ ID NO: 139934 - DNA, 27 bp, Artificial sequence
  SiRNA target sequence
gctacctactatggagctgttgtatta

SEQ ID NO: 139935 - DNA, 27 bp, Artificial sequence
  SiRNA target sequence
ctacctactatggagctgttgtattaa

SEQ ID NO: 139936 - DNA, 27 bp, Artificial sequence
  SiRNA target sequence
tacctactatggagctgttgtattaaa

SEQ ID NO: 139937 - DNA, 27 bp, Artificial sequence
  SiRNA target sequence
acctactatggagctgttgtattaaat

SEQ ID NO: 139938 - DNA, 27 bp, Artificial sequence
  SiRNA target sequence
cctactatggagctgttgtattaaatc

SEQ ID NO: 139939 - DNA, 27 bp, Artificial sequence
  SiRNA target sequence
ctactatggagctgttgtattaaatca

SEQ ID NO: 139940 - DNA, 27 bp, Artificial sequence
  SiRNA target sequence
tactatggagctgttgtattaaatcat

SEQ ID NO: 139941 - DNA, 27 bp, Artificial sequence
  SiRNA target sequence
actatggagctgttgtattaaatcatg

SEQ ID NO: 139942 - DNA, 27 bp, Artificial sequence
  SiRNA target sequence
ctatggagctgttgtattaaatcatgc

SEQ ID NO: 139943 - DNA, 27 bp, Artificial sequence
  SiRNA target sequence
tatggagctgttgtattaaatcatgca

SEQ ID NO: 139944 - DNA, 27 bp, Artificial sequence
  SiRNA target sequence
atggagctgttgtattaaatcatgcaa

SEQ ID NO: 139945 - DNA, 27 bp, Artificial sequence
  SiRNA target sequence
tggagctgttgtattaaatcatgcaaa

SEQ ID NO: 139946 - DNA, 27 bp, Artificial sequence
  SiRNA target sequence
ggagctgttgtattaaatcatgcaaaa

SEQ ID NO: 139947 - DNA, 27 bp, Artificial sequence
  SiRNA target sequence
gagctgttgtattaaatcatgcaaaat

SEQ ID NO: 139948 - DNA, 27 bp, Artificial sequence
  SiRNA target sequence
agctgttgtattaaatcatgcaaaatt

SEQ ID NO: 139949 - DNA, 27 bp, Artificial sequence
  SiRNA target sequence
gctgttgtattaaatcatgcaaaattc

SEQ ID NO: 139950 - DNA, 27 bp, Artificial sequence
  SiRNA target sequence
ctgttgtattaaatcatgcaaaattct

SEQ ID NO: 139951 - DNA, 27 bp, Artificial sequence
  SiRNA target sequence
tgttgtattaaatcatgcaaaattctt

SEQ ID NO: 139952 - DNA, 27 bp, Artificial sequence
  SiRNA target sequence
gttgtattaaatcatgcaaaattcttg

SEQ ID NO: 139953 - DNA, 27 bp, Artificial sequence
  SiRNA target sequence
ttgtattaaatcatgcaaaattcttgt

SEQ ID NO: 139954 - DNA, 27 bp, Artificial sequence
  SiRNA target sequence
tgtattaaatcatgcaaaattcttgtc

SEQ ID NO: 139955 - DNA, 27 bp, Artificial sequence
  SiRNA target sequence
gtattaaatcatgcaaaattcttgtca

SEQ ID NO: 139956 - DNA, 27 bp, Artificial sequence
  SiRNA target sequence
tattaaatcatgcaaaattcttgtcag

SEQ ID NO: 139957 - DNA, 27 bp, Artificial sequence
  SiRNA target sequence
attaaatcatgcaaaattcttgtcagt

SEQ ID NO: 139958 - DNA, 27 bp, Artificial sequence
  SiRNA target sequence
ttaaatcatgcaaaattcttgtcagta

SEQ ID NO: 139959 - DNA, 27 bp, Artificial sequence
  SiRNA target sequence
taaatcatgcaaaattcttgtcagtaa

SEQ ID NO: 139960 - DNA, 27 bp, Artificial sequence
  SiRNA target sequence
aaatcatgcaaaattcttgtcagtaac

SEQ ID NO: 139961 - DNA, 27 bp, Artificial sequence
  SiRNA target sequence
aatcatgcaaaattcttgtcagtaaca

SEQ ID NO: 139962 - DNA, 27 bp, Artificial sequence
  SiRNA target sequence
atcatgcaaaattcttgtcagtaacaa

SEQ ID NO: 139963 - DNA, 27 bp, Artificial sequence
  SiRNA target sequence
tcatgcaaaattcttgtcagtaacaaa

SEQ ID NO: 139964 - DNA, 27 bp, Artificial sequence
  SiRNA target sequence
catgcaaaattcttgtcagtaacaaaa

SEQ ID NO: 139965 - DNA, 27 bp, Artificial sequence
  SiRNA target sequence
atgcaaaattcttgtcagtaacaaaag

SEQ ID NO: 139966 - DNA, 27 bp, Artificial sequence
  SiRNA target sequence
tgcaaaattcttgtcagtaacaaaaga

SEQ ID NO: 139967 - DNA, 27 bp, Artificial sequence
  SiRNA target sequence
gcaaaattcttgtcagtaacaaaagat

SEQ ID NO: 139968 - DNA, 27 bp, Artificial sequence
  SiRNA target sequence
caaaattcttgtcagtaacaaaagatg

SEQ ID NO: 139969 - DNA, 27 bp, Artificial sequence
  SiRNA target sequence
aaaattcttgtcagtaacaaaagatgg

SEQ ID NO: 139970 - DNA, 27 bp, Artificial sequence
  SiRNA target sequence
aaattcttgtcagtaacaaaagatggc

SEQ ID NO: 139971 - DNA, 27 bp, Artificial sequence
  SiRNA target sequence
aattcttgtcagtaacaaaagatggcg

SEQ ID NO: 139972 - DNA, 27 bp, Artificial sequence
  SiRNA target sequence
attcttgtcagtaacaaaagatggcga

SEQ ID NO: 139973 - DNA, 27 bp, Artificial sequence
  SiRNA target sequence
ttcttgtcagtaacaaaagatggcgat

SEQ ID NO: 139974 - DNA, 27 bp, Artificial sequence
  SiRNA target sequence
tcttgtcagtaacaaaagatggcgata

SEQ ID NO: 139975 - DNA, 27 bp, Artificial sequence
  SiRNA target sequence
cttgtcagtaacaaaagatggcgataa

SEQ ID NO: 139976 - DNA, 27 bp, Artificial sequence
  SiRNA target sequence
ttgtcagtaacaaaagatggcgataaa

SEQ ID NO: 139977 - DNA, 27 bp, Artificial sequence
  SiRNA target sequence
tgtcagtaacaaaagatggcgataaaa

SEQ ID NO: 139978 - DNA, 27 bp, Artificial sequence
  SiRNA target sequence
gtcagtaacaaaagatggcgataaaat

SEQ ID NO: 139979 - DNA, 27 bp, Artificial sequence
  SiRNA target sequence
tcagtaacaaaagatggcgataaaatt

SEQ ID NO: 139980 - DNA, 27 bp, Artificial sequence
  SiRNA target sequence
cagtaacaaaagatggcgataaaatta

SEQ ID NO: 139981 - DNA, 27 bp, Artificial sequence
  SiRNA target sequence
agtaacaaaagatggcgataaaattaa

SEQ ID NO: 139982 - DNA, 27 bp, Artificial sequence
  SiRNA target sequence
gtaacaaaagatggcgataaaattaat

SEQ ID NO: 139983 - DNA, 27 bp, Artificial sequence
  SiRNA target sequence
taacaaaagatggcgataaaattaatg

SEQ ID NO: 139984 - DNA, 27 bp, Artificial sequence
  SiRNA target sequence
aacaaaagatggcgataaaattaatgg

SEQ ID NO: 139985 - DNA, 27 bp, Artificial sequence
  SiRNA target sequence
acaaaagatggcgataaaattaatgga

SEQ ID NO: 139986 - DNA, 27 bp, Artificial sequence
  SiRNA target sequence
caaaagatggcgataaaattaatggaa

SEQ ID NO: 139987 - DNA, 27 bp, Artificial sequence
  SiRNA target sequence
aaaagatggcgataaaattaatggaat

SEQ ID NO: 139988 - DNA, 27 bp, Artificial sequence
  SiRNA target sequence
aaagatggcgataaaattaatggaatt

SEQ ID NO: 139989 - DNA, 27 bp, Artificial sequence
  SiRNA target sequence
aagatggcgataaaattaatggaatta

SEQ ID NO: 139990 - DNA, 27 bp, Artificial sequence
  SiRNA target sequence
agatggcgataaaattaatggaattaa

SEQ ID NO: 139991 - DNA, 27 bp, Artificial sequence
  SiRNA target sequence
gatggcgataaaattaatggaattaaa

SEQ ID NO: 139992 - DNA, 27 bp, Artificial sequence
  SiRNA target sequence
atggcgataaaattaatggaattaaat

SEQ ID NO: 139993 - DNA, 27 bp, Artificial sequence
  SiRNA target sequence
tggcgataaaattaatggaattaaatg

SEQ ID NO: 139994 - DNA, 27 bp, Artificial sequence
  SiRNA target sequence
ggcgataaaattaatggaattaaatgt

SEQ ID NO: 139995 - DNA, 27 bp, Artificial sequence
  SiRNA target sequence
gcgataaaattaatggaattaaatgtc

SEQ ID NO: 139996 - DNA, 27 bp, Artificial sequence
  SiRNA target sequence
cgataaaattaatggaattaaatgtca

SEQ ID NO: 139997 - DNA, 27 bp, Artificial sequence
  SiRNA target sequence
gataaaattaatggaattaaatgtcaa

SEQ ID NO: 139998 - DNA, 27 bp, Artificial sequence
  SiRNA target sequence
ataaaattaatggaattaaatgtcaag

SEQ ID NO: 139999 - DNA, 27 bp, Artificial sequence
  SiRNA target sequence
taaaattaatggaattaaatgtcaaga

SEQ ID NO: 140000 - DNA, 27 bp, Artificial sequence
  SiRNA target sequence
aaaattaatggaattaaatgtcaagat

SEQ ID NO: 140001 - DNA, 27 bp, Artificial sequence
  SiRNA target sequence
aaattaatggaattaaatgtcaagatt

SEQ ID NO: 140002 - DNA, 27 bp, Artificial sequence
  SiRNA target sequence
aattaatggaattaaatgtcaagattc

SEQ ID NO: 140003 - DNA, 27 bp, Artificial sequence
  SiRNA target sequence
attaatggaattaaatgtcaagattca

SEQ ID NO: 140004 - DNA, 27 bp, Artificial sequence
  SiRNA target sequence
ttaatggaattaaatgtcaagattcaa

SEQ ID NO: 140005 - DNA, 27 bp, Artificial sequence
  SiRNA target sequence
taatggaattaaatgtcaagattcaat

SEQ ID NO: 140006 - DNA, 27 bp, Artificial sequence
  SiRNA target sequence
aatggaattaaatgtcaagattcaata

SEQ ID NO: 140007 - DNA, 27 bp, Artificial sequence
  SiRNA target sequence
atggaattaaatgtcaagattcaataa

SEQ ID NO: 140008 - DNA, 27 bp, Artificial sequence
  SiRNA target sequence
tggaattaaatgtcaagattcaataaa

SEQ ID NO: 140009 - DNA, 27 bp, Artificial sequence
  SiRNA target sequence
ggaattaaatgtcaagattcaataaat

SEQ ID NO: 140010 - DNA, 27 bp, Artificial sequence
  SiRNA target sequence
gaattaaatgtcaagattcaataaata

SEQ ID NO: 140011 - DNA, 27 bp, Artificial sequence
  SiRNA target sequence
aattaaatgtcaagattcaataaataa

SEQ ID NO: 140012 - DNA, 27 bp, Artificial sequence
  SiRNA target sequence
attaaatgtcaagattcaataaataat

SEQ ID NO: 140013 - DNA, 27 bp, Artificial sequence
  SiRNA target sequence
ttaaatgtcaagattcaataaataatg

SEQ ID NO: 140014 - DNA, 27 bp, Artificial sequence
  SiRNA target sequence
taaatgtcaagattcaataaataatga

SEQ ID NO: 140015 - DNA, 27 bp, Artificial sequence
  SiRNA target sequence
aaatgtcaagattcaataaataatgaa

SEQ ID NO: 140016 - DNA, 27 bp, Artificial sequence
  SiRNA target sequence
aatgtcaagattcaataaataatgaaa

SEQ ID NO: 140017 - DNA, 27 bp, Artificial sequence
  SiRNA target sequence
atgtcaagattcaataaataatgaaaa

SEQ ID NO: 140018 - DNA, 27 bp, Artificial sequence
  SiRNA target sequence
tgtcaagattcaataaataatgaaaaa

SEQ ID NO: 140019 - DNA, 27 bp, Artificial sequence
  SiRNA target sequence
gtcaagattcaataaataatgaaaaat

SEQ ID NO: 140020 - DNA, 27 bp, Artificial sequence
  SiRNA target sequence
tcaagattcaataaataatgaaaaatt

SEQ ID NO: 140021 - DNA, 27 bp, Artificial sequence
  SiRNA target sequence
caagattcaataaataatgaaaaattt

SEQ ID NO: 140022 - DNA, 27 bp, Artificial sequence
  SiRNA target sequence
aagattcaataaataatgaaaaatttt

SEQ ID NO: 140023 - DNA, 27 bp, Artificial sequence
  SiRNA target sequence
agattcaataaataatgaaaaattttt

SEQ ID NO: 140024 - DNA, 27 bp, Artificial sequence
  SiRNA target sequence
gattcaataaataatgaaaaattttta

SEQ ID NO: 140025 - DNA, 27 bp, Artificial sequence
  SiRNA target sequence
attcaataaataatgaaaaatttttaa

SEQ ID NO: 140026 - DNA, 27 bp, Artificial sequence
  SiRNA target sequence
ttcaataaataatgaaaaatttttaat

SEQ ID NO: 140027 - DNA, 27 bp, Artificial sequence
  SiRNA target sequence
tcaataaataatgaaaaatttttaatt

SEQ ID NO: 140028 - DNA, 27 bp, Artificial sequence
  SiRNA target sequence
caataaataatgaaaaatttttaatta

SEQ ID NO: 140029 - DNA, 27 bp, Artificial sequence
  SiRNA target sequence
aataaataatgaaaaatttttaattag

SEQ ID NO: 140030 - DNA, 27 bp, Artificial sequence
  SiRNA target sequence
ataaataatgaaaaatttttaattagg

SEQ ID NO: 140031 - DNA, 27 bp, Artificial sequence
  SiRNA target sequence
taaataatgaaaaatttttaattaggt

SEQ ID NO: 140032 - DNA, 27 bp, Artificial sequence
  SiRNA target sequence
aaataatgaaaaatttttaattaggtg

SEQ ID NO: 140033 - DNA, 27 bp, Artificial sequence
  SiRNA target sequence
aataatgaaaaatttttaattaggtgt

SEQ ID NO: 140034 - DNA, 27 bp, Artificial sequence
  SiRNA target sequence
ataatgaaaaatttttaattaggtgta

SEQ ID NO: 140035 - DNA, 27 bp, Artificial sequence
  SiRNA target sequence
taatgaaaaatttttaattaggtgtaa

SEQ ID NO: 140036 - DNA, 27 bp, Artificial sequence
  SiRNA target sequence
aatgaaaaatttttaattaggtgtaaa

SEQ ID NO: 140037 - DNA, 27 bp, Artificial sequence
  SiRNA target sequence
atgaaaaatttttaattaggtgtaaag

SEQ ID NO: 140038 - DNA, 27 bp, Artificial sequence
  SiRNA target sequence
tgaaaaatttttaattaggtgtaaagt

SEQ ID NO: 140039 - DNA, 27 bp, Artificial sequence
  SiRNA target sequence
gaaaaatttttaattaggtgtaaagtt

SEQ ID NO: 140040 - DNA, 27 bp, Artificial sequence
  SiRNA target sequence
aaaaatttttaattaggtgtaaagttt

SEQ ID NO: 140041 - DNA, 27 bp, Artificial sequence
  SiRNA target sequence
aaaatttttaattaggtgtaaagtttt

SEQ ID NO: 140042 - DNA, 27 bp, Artificial sequence
  SiRNA target sequence
aaatttttaattaggtgtaaagtttta

SEQ ID NO: 140043 - DNA, 27 bp, Artificial sequence
  SiRNA target sequence
aatttttaattaggtgtaaagttttaa

SEQ ID NO: 140044 - DNA, 27 bp, Artificial sequence
  SiRNA target sequence
atttttaattaggtgtaaagttttaat

SEQ ID NO: 140045 - DNA, 27 bp, Artificial sequence
  SiRNA target sequence
tttttaattaggtgtaaagttttaata

SEQ ID NO: 140046 - DNA, 27 bp, Artificial sequence
  SiRNA target sequence
ttttaattaggtgtaaagttttaataa

SEQ ID NO: 140047 - DNA, 27 bp, Artificial sequence
  SiRNA target sequence
tttaattaggtgtaaagttttaataaa

SEQ ID NO: 140048 - DNA, 27 bp, Artificial sequence
  SiRNA target sequence
ttaattaggtgtaaagttttaataaat

SEQ ID NO: 140049 - DNA, 27 bp, Artificial sequence
  SiRNA target sequence
taattaggtgtaaagttttaataaata

SEQ ID NO: 140050 - DNA, 27 bp, Artificial sequence
  SiRNA target sequence
aattaggtgtaaagttttaataaatac

SEQ ID NO: 140051 - DNA, 27 bp, Artificial sequence
  SiRNA target sequence
attaggtgtaaagttttaataaatact

SEQ ID NO: 140052 - DNA, 27 bp, Artificial sequence
  SiRNA target sequence
ttaggtgtaaagttttaataaatactt

SEQ ID NO: 140053 - DNA, 27 bp, Artificial sequence
  SiRNA target sequence
taggtgtaaagttttaataaatacttc

SEQ ID NO: 140054 - DNA, 27 bp, Artificial sequence
  SiRNA target sequence
aggtgtaaagttttaataaatacttct

SEQ ID NO: 140055 - DNA, 27 bp, Artificial sequence
  SiRNA target sequence
ggtgtaaagttttaataaatacttctg

SEQ ID NO: 140056 - DNA, 27 bp, Artificial sequence
  SiRNA target sequence
gtgtaaagttttaataaatacttctgg

SEQ ID NO: 140057 - DNA, 27 bp, Artificial sequence
  SiRNA target sequence
tgtaaagttttaataaatacttctggc

SEQ ID NO: 140058 - DNA, 27 bp, Artificial sequence
  SiRNA target sequence
gtaaagttttaataaatacttctggcc

SEQ ID NO: 140059 - DNA, 27 bp, Artificial sequence
  SiRNA target sequence
taaagttttaataaatacttctggccc

SEQ ID NO: 140060 - DNA, 27 bp, Artificial sequence
  SiRNA target sequence
aaagttttaataaatacttctggccct

SEQ ID NO: 140061 - DNA, 27 bp, Artificial sequence
  SiRNA target sequence
aagttttaataaatacttctggccctt

SEQ ID NO: 140062 - DNA, 27 bp, Artificial sequence
  SiRNA target sequence
agttttaataaatacttctggcccttt

SEQ ID NO: 140063 - DNA, 27 bp, Artificial sequence
  SiRNA target sequence
gttttaataaatacttctggccctttt

SEQ ID NO: 140064 - DNA, 27 bp, Artificial sequence
  SiRNA target sequence
ttttaataaatacttctggcccttttg

SEQ ID NO: 140065 - DNA, 27 bp, Artificial sequence
  SiRNA target sequence
tttaataaatacttctggcccttttgc

SEQ ID NO: 140066 - DNA, 27 bp, Artificial sequence
  SiRNA target sequence
ttaataaatacttctggcccttttgct

SEQ ID NO: 140067 - DNA, 27 bp, Artificial sequence
  SiRNA target sequence
taataaatacttctggcccttttgctg

SEQ ID NO: 140068 - DNA, 27 bp, Artificial sequence
  SiRNA target sequence
aataaatacttctggcccttttgctga

SEQ ID NO: 140069 - DNA, 27 bp, Artificial sequence
  SiRNA target sequence
ataaatacttctggcccttttgctgac

SEQ ID NO: 140070 - DNA, 27 bp, Artificial sequence
  SiRNA target sequence
taaatacttctggcccttttgctgacg

SEQ ID NO: 140071 - DNA, 27 bp, Artificial sequence
  SiRNA target sequence
aaatacttctggcccttttgctgacga

SEQ ID NO: 140072 - DNA, 27 bp, Artificial sequence
  SiRNA target sequence
aatacttctggcccttttgctgacgag

SEQ ID NO: 140073 - DNA, 27 bp, Artificial sequence
  SiRNA target sequence
atacttctggcccttttgctgacgagg

SEQ ID NO: 140074 - DNA, 27 bp, Artificial sequence
  SiRNA target sequence
tacttctggcccttttgctgacgaggt

SEQ ID NO: 140075 - DNA, 27 bp, Artificial sequence
  SiRNA target sequence
acttctggcccttttgctgacgaggtt

SEQ ID NO: 140076 - DNA, 27 bp, Artificial sequence
  SiRNA target sequence
cttctggcccttttgctgacgaggttc

SEQ ID NO: 140077 - DNA, 27 bp, Artificial sequence
  SiRNA target sequence
ttctggcccttttgctgacgaggttcg

SEQ ID NO: 140078 - DNA, 27 bp, Artificial sequence
  SiRNA target sequence
tctggcccttttgctgacgaggttcga

SEQ ID NO: 140079 - DNA, 27 bp, Artificial sequence
  SiRNA target sequence
ctggcccttttgctgacgaggttcgaa

SEQ ID NO: 140080 - DNA, 27 bp, Artificial sequence
  SiRNA target sequence
tggcccttttgctgacgaggttcgaaa

SEQ ID NO: 140081 - DNA, 27 bp, Artificial sequence
  SiRNA target sequence
ggcccttttgctgacgaggttcgaaat

SEQ ID NO: 140082 - DNA, 27 bp, Artificial sequence
  SiRNA target sequence
gcccttttgctgacgaggttcgaaata

SEQ ID NO: 140083 - DNA, 27 bp, Artificial sequence
  SiRNA target sequence
cccttttgctgacgaggttcgaaatac

SEQ ID NO: 140084 - DNA, 27 bp, Artificial sequence
  SiRNA target sequence
ccttttgctgacgaggttcgaaataca

SEQ ID NO: 140085 - DNA, 27 bp, Artificial sequence
  SiRNA target sequence
cttttgctgacgaggttcgaaatacat

SEQ ID NO: 140086 - DNA, 27 bp, Artificial sequence
  SiRNA target sequence
ttttgctgacgaggttcgaaatacatc

SEQ ID NO: 140087 - DNA, 27 bp, Artificial sequence
  SiRNA target sequence
tttgctgacgaggttcgaaatacatca

SEQ ID NO: 140088 - DNA, 27 bp, Artificial sequence
  SiRNA target sequence
ttgctgacgaggttcgaaatacatcaa

SEQ ID NO: 140089 - DNA, 27 bp, Artificial sequence
  SiRNA target sequence
tgctgacgaggttcgaaatacatcaat

SEQ ID NO: 140090 - DNA, 27 bp, Artificial sequence
  SiRNA target sequence
gctgacgaggttcgaaatacatcaatt

SEQ ID NO: 140091 - DNA, 27 bp, Artificial sequence
  SiRNA target sequence
ctgacgaggttcgaaatacatcaattg

SEQ ID NO: 140092 - DNA, 27 bp, Artificial sequence
  SiRNA target sequence
tgacgaggttcgaaatacatcaattga

SEQ ID NO: 140093 - DNA, 27 bp, Artificial sequence
  SiRNA target sequence
gacgaggttcgaaatacatcaattgaa

SEQ ID NO: 140094 - DNA, 27 bp, Artificial sequence
  SiRNA target sequence
acgaggttcgaaatacatcaattgaaa

SEQ ID NO: 140095 - DNA, 27 bp, Artificial sequence
  SiRNA target sequence
cgaggttcgaaatacatcaattgaaaa

SEQ ID NO: 140096 - DNA, 27 bp, Artificial sequence
  SiRNA target sequence
gaggttcgaaatacatcaattgaaaac

SEQ ID NO: 140097 - DNA, 27 bp, Artificial sequence
  SiRNA target sequence
aggttcgaaatacatcaattgaaaact

SEQ ID NO: 140098 - DNA, 27 bp, Artificial sequence
  SiRNA target sequence
ggttcgaaatacatcaattgaaaactg

SEQ ID NO: 140099 - DNA, 27 bp, Artificial sequence
  SiRNA target sequence
gttcgaaatacatcaattgaaaactgt

SEQ ID NO: 140100 - DNA, 27 bp, Artificial sequence
  SiRNA target sequence
ttcgaaatacatcaattgaaaactgtc

SEQ ID NO: 140101 - DNA, 27 bp, Artificial sequence
  SiRNA target sequence
tcgaaatacatcaattgaaaactgtca

SEQ ID NO: 140102 - DNA, 27 bp, Artificial sequence
  SiRNA target sequence
cgaaatacatcaattgaaaactgtcaa

SEQ ID NO: 140103 - DNA, 27 bp, Artificial sequence
  SiRNA target sequence
gaaatacatcaattgaaaactgtcaac

SEQ ID NO: 140104 - DNA, 27 bp, Artificial sequence
  SiRNA target sequence
aaatacatcaattgaaaactgtcaacc

SEQ ID NO: 140105 - DNA, 27 bp, Artificial sequence
  SiRNA target sequence
aatacatcaattgaaaactgtcaacca

SEQ ID NO: 140106 - DNA, 27 bp, Artificial sequence
  SiRNA target sequence
atacatcaattgaaaactgtcaaccaa

SEQ ID NO: 140107 - DNA, 27 bp, Artificial sequence
  SiRNA target sequence
tacatcaattgaaaactgtcaaccaat

SEQ ID NO: 140108 - DNA, 27 bp, Artificial sequence
  SiRNA target sequence
acatcaattgaaaactgtcaaccaata

SEQ ID NO: 140109 - DNA, 27 bp, Artificial sequence
  SiRNA target sequence
catcaattgaaaactgtcaaccaatac

SEQ ID NO: 140110 - DNA, 27 bp, Artificial sequence
  SiRNA target sequence
atcaattgaaaactgtcaaccaatact

SEQ ID NO: 140111 - DNA, 27 bp, Artificial sequence
  SiRNA target sequence
tcaattgaaaactgtcaaccaatactc

SEQ ID NO: 140112 - DNA, 27 bp, Artificial sequence
  SiRNA target sequence
caattgaaaactgtcaaccaatactcc

SEQ ID NO: 140113 - DNA, 27 bp, Artificial sequence
  SiRNA target sequence
aattgaaaactgtcaaccaatactcca

SEQ ID NO: 140114 - DNA, 27 bp, Artificial sequence
  SiRNA target sequence
attgaaaactgtcaaccaatactccaa

SEQ ID NO: 140115 - DNA, 27 bp, Artificial sequence
  SiRNA target sequence
ttgaaaactgtcaaccaatactccaac

SEQ ID NO: 140116 - DNA, 27 bp, Artificial sequence
  SiRNA target sequence
tgaaaactgtcaaccaatactccaaca

SEQ ID NO: 140117 - DNA, 27 bp, Artificial sequence
  SiRNA target sequence
gaaaactgtcaaccaatactccaacat

SEQ ID NO: 140118 - DNA, 27 bp, Artificial sequence
  SiRNA target sequence
aaaactgtcaaccaatactccaacata

SEQ ID NO: 140119 - DNA, 27 bp, Artificial sequence
  SiRNA target sequence
aaactgtcaaccaatactccaacatag

SEQ ID NO: 140120 - DNA, 27 bp, Artificial sequence
  SiRNA target sequence
aactgtcaaccaatactccaacatagt

SEQ ID NO: 140121 - DNA, 27 bp, Artificial sequence
  SiRNA target sequence
actgtcaaccaatactccaacatagtt

SEQ ID NO: 140122 - DNA, 27 bp, Artificial sequence
  SiRNA target sequence
ctgtcaaccaatactccaacatagtta

SEQ ID NO: 140123 - DNA, 27 bp, Artificial sequence
  SiRNA target sequence
tgtcaaccaatactccaacatagttat

SEQ ID NO: 140124 - DNA, 27 bp, Artificial sequence
  SiRNA target sequence
gtcaaccaatactccaacatagttatg

SEQ ID NO: 140125 - DNA, 27 bp, Artificial sequence
  SiRNA target sequence
tcaaccaatactccaacatagttatgg

SEQ ID NO: 140126 - DNA, 27 bp, Artificial sequence
  SiRNA target sequence
caaccaatactccaacatagttatggt

SEQ ID NO: 140127 - DNA, 27 bp, Artificial sequence
  SiRNA target sequence
aaccaatactccaacatagttatggta

SEQ ID NO: 140128 - DNA, 27 bp, Artificial sequence
  SiRNA target sequence
accaatactccaacatagttatggtac

SEQ ID NO: 140129 - DNA, 27 bp, Artificial sequence
  SiRNA target sequence
ccaatactccaacatagttatggtaca

SEQ ID NO: 140130 - DNA, 27 bp, Artificial sequence
  SiRNA target sequence
caatactccaacatagttatggtacac

SEQ ID NO: 140131 - DNA, 27 bp, Artificial sequence
  SiRNA target sequence
aatactccaacatagttatggtacaca

SEQ ID NO: 140132 - DNA, 27 bp, Artificial sequence
  SiRNA target sequence
atactccaacatagttatggtacacat

SEQ ID NO: 140133 - DNA, 27 bp, Artificial sequence
  SiRNA target sequence
tactccaacatagttatggtacacata

SEQ ID NO: 140134 - DNA, 27 bp, Artificial sequence
  SiRNA target sequence
actccaacatagttatggtacacatat

SEQ ID NO: 140135 - DNA, 27 bp, Artificial sequence
  SiRNA target sequence
ctccaacatagttatggtacacatatt

SEQ ID NO: 140136 - DNA, 27 bp, Artificial sequence
  SiRNA target sequence
tccaacatagttatggtacacatattg

SEQ ID NO: 140137 - DNA, 27 bp, Artificial sequence
  SiRNA target sequence
ccaacatagttatggtacacatattgt

SEQ ID NO: 140138 - DNA, 27 bp, Artificial sequence
  SiRNA target sequence
caacatagttatggtacacatattgta

SEQ ID NO: 140139 - DNA, 27 bp, Artificial sequence
  SiRNA target sequence
aacatagttatggtacacatattgtag

SEQ ID NO: 140140 - DNA, 27 bp, Artificial sequence
  SiRNA target sequence
acatagttatggtacacatattgtagt

SEQ ID NO: 140141 - DNA, 27 bp, Artificial sequence
  SiRNA target sequence
catagttatggtacacatattgtagtt

SEQ ID NO: 140142 - DNA, 27 bp, Artificial sequence
  SiRNA target sequence
atagttatggtacacatattgtagttc

SEQ ID NO: 140143 - DNA, 27 bp, Artificial sequence
  SiRNA target sequence
tagttatggtacacatattgtagttcc

SEQ ID NO: 140144 - DNA, 27 bp, Artificial sequence
  SiRNA target sequence
agttatggtacacatattgtagttcct

SEQ ID NO: 140145 - DNA, 27 bp, Artificial sequence
  SiRNA target sequence
gttatggtacacatattgtagttcctg

SEQ ID NO: 140146 - DNA, 27 bp, Artificial sequence
  SiRNA target sequence
ttatggtacacatattgtagttcctgc

SEQ ID NO: 140147 - DNA, 27 bp, Artificial sequence
  SiRNA target sequence
tatggtacacatattgtagttcctgcg

SEQ ID NO: 140148 - DNA, 27 bp, Artificial sequence
  SiRNA target sequence
atggtacacatattgtagttcctgcga

SEQ ID NO: 140149 - DNA, 27 bp, Artificial sequence
  SiRNA target sequence
tggtacacatattgtagttcctgcgat

SEQ ID NO: 140150 - DNA, 27 bp, Artificial sequence
  SiRNA target sequence
ggtacacatattgtagttcctgcgata

SEQ ID NO: 140151 - DNA, 27 bp, Artificial sequence
  SiRNA target sequence
gtacacatattgtagttcctgcgatat

SEQ ID NO: 140152 - DNA, 27 bp, Artificial sequence
  SiRNA target sequence
tacacatattgtagttcctgcgatatt

SEQ ID NO: 140153 - DNA, 27 bp, Artificial sequence
  SiRNA target sequence
acacatattgtagttcctgcgatattt

SEQ ID NO: 140154 - DNA, 27 bp, Artificial sequence
  SiRNA target sequence
cacatattgtagttcctgcgatatttt

SEQ ID NO: 140155 - DNA, 27 bp, Artificial sequence
  SiRNA target sequence
acatattgtagttcctgcgatattttc

SEQ ID NO: 140156 - DNA, 27 bp, Artificial sequence
  SiRNA target sequence
catattgtagttcctgcgatattttcg

SEQ ID NO: 140157 - DNA, 27 bp, Artificial sequence
  SiRNA target sequence
atattgtagttcctgcgatattttcgc

SEQ ID NO: 140158 - DNA, 27 bp, Artificial sequence
  SiRNA target sequence
tattgtagttcctgcgatattttcgcc

SEQ ID NO: 140159 - DNA, 27 bp, Artificial sequence
  SiRNA target sequence
attgtagttcctgcgatattttcgcct

SEQ ID NO: 140160 - DNA, 27 bp, Artificial sequence
  SiRNA target sequence
ttgtagttcctgcgatattttcgccta

SEQ ID NO: 140161 - DNA, 27 bp, Artificial sequence
  SiRNA target sequence
tgtagttcctgcgatattttcgcctaa

SEQ ID NO: 140162 - DNA, 27 bp, Artificial sequence
  SiRNA target sequence
gtagttcctgcgatattttcgcctaaa

SEQ ID NO: 140163 - DNA, 27 bp, Artificial sequence
  SiRNA target sequence
tagttcctgcgatattttcgcctaaaa

SEQ ID NO: 140164 - DNA, 27 bp, Artificial sequence
  SiRNA target sequence
agttcctgcgatattttcgcctaaaaa

SEQ ID NO: 140165 - DNA, 27 bp, Artificial sequence
  SiRNA target sequence
gttcctgcgatattttcgcctaaaaat

SEQ ID NO: 140166 - DNA, 27 bp, Artificial sequence
  SiRNA target sequence
ttcctgcgatattttcgcctaaaaata

SEQ ID NO: 140167 - DNA, 27 bp, Artificial sequence
  SiRNA target sequence
tcctgcgatattttcgcctaaaaatat

SEQ ID NO: 140168 - DNA, 27 bp, Artificial sequence
  SiRNA target sequence
cctgcgatattttcgcctaaaaatatg

SEQ ID NO: 140169 - DNA, 27 bp, Artificial sequence
  SiRNA target sequence
ctgcgatattttcgcctaaaaatatgg

SEQ ID NO: 140170 - DNA, 27 bp, Artificial sequence
  SiRNA target sequence
tgcgatattttcgcctaaaaatatggg

SEQ ID NO: 140171 - DNA, 27 bp, Artificial sequence
  SiRNA target sequence
gcgatattttcgcctaaaaatatgggc

SEQ ID NO: 140172 - DNA, 27 bp, Artificial sequence
  SiRNA target sequence
cgatattttcgcctaaaaatatgggct

SEQ ID NO: 140173 - DNA, 27 bp, Artificial sequence
  SiRNA target sequence
gatattttcgcctaaaaatatgggctt

SEQ ID NO: 140174 - DNA, 27 bp, Artificial sequence
  SiRNA target sequence
atattttcgcctaaaaatatgggcttt

SEQ ID NO: 140175 - DNA, 27 bp, Artificial sequence
  SiRNA target sequence
tattttcgcctaaaaatatgggctttg

SEQ ID NO: 140176 - DNA, 27 bp, Artificial sequence
  SiRNA target sequence
attttcgcctaaaaatatgggctttgt

SEQ ID NO: 140177 - DNA, 27 bp, Artificial sequence
  SiRNA target sequence
ttttcgcctaaaaatatgggctttgtt

SEQ ID NO: 140178 - DNA, 27 bp, Artificial sequence
  SiRNA target sequence
tttcgcctaaaaatatgggctttgttg

SEQ ID NO: 140179 - DNA, 27 bp, Artificial sequence
  SiRNA target sequence
ttcgcctaaaaatatgggctttgttga

SEQ ID NO: 140180 - DNA, 27 bp, Artificial sequence
  SiRNA target sequence
tcgcctaaaaatatgggctttgttgat

SEQ ID NO: 140181 - DNA, 27 bp, Artificial sequence
  SiRNA target sequence
cgcctaaaaatatgggctttgttgatc

SEQ ID NO: 140182 - DNA, 27 bp, Artificial sequence
  SiRNA target sequence
gcctaaaaatatgggctttgttgatcc

SEQ ID NO: 140183 - DNA, 27 bp, Artificial sequence
  SiRNA target sequence
cctaaaaatatgggctttgttgatcca

SEQ ID NO: 140184 - DNA, 27 bp, Artificial sequence
  SiRNA target sequence
ctaaaaatatgggctttgttgatccaa

SEQ ID NO: 140185 - DNA, 27 bp, Artificial sequence
  SiRNA target sequence
taaaaatatgggctttgttgatccaag

SEQ ID NO: 140186 - DNA, 27 bp, Artificial sequence
  SiRNA target sequence
aaaaatatgggctttgttgatccaagc

SEQ ID NO: 140187 - DNA, 27 bp, Artificial sequence
  SiRNA target sequence
aaaatatgggctttgttgatccaagca

SEQ ID NO: 140188 - DNA, 27 bp, Artificial sequence
  SiRNA target sequence
aaatatgggctttgttgatccaagcac

SEQ ID NO: 140189 - DNA, 27 bp, Artificial sequence
  SiRNA target sequence
aatatgggctttgttgatccaagcacg

SEQ ID NO: 140190 - DNA, 27 bp, Artificial sequence
  SiRNA target sequence
atatgggctttgttgatccaagcacga

SEQ ID NO: 140191 - DNA, 27 bp, Artificial sequence
  SiRNA target sequence
tatgggctttgttgatccaagcacgag

SEQ ID NO: 140192 - DNA, 27 bp, Artificial sequence
  SiRNA target sequence
atgggctttgttgatccaagcacgagt

SEQ ID NO: 140193 - DNA, 27 bp, Artificial sequence
  SiRNA target sequence
tgggctttgttgatccaagcacgagtg

SEQ ID NO: 140194 - DNA, 27 bp, Artificial sequence
  SiRNA target sequence
gggctttgttgatccaagcacgagtga

SEQ ID NO: 140195 - DNA, 27 bp, Artificial sequence
  SiRNA target sequence
ggctttgttgatccaagcacgagtgat

SEQ ID NO: 140196 - DNA, 27 bp, Artificial sequence
  SiRNA target sequence
gctttgttgatccaagcacgagtgatg

SEQ ID NO: 140197 - DNA, 27 bp, Artificial sequence
  SiRNA target sequence
ctttgttgatccaagcacgagtgatgg

SEQ ID NO: 140198 - DNA, 27 bp, Artificial sequence
  SiRNA target sequence
tttgttgatccaagcacgagtgatgga

SEQ ID NO: 140199 - DNA, 27 bp, Artificial sequence
  SiRNA target sequence
ttgttgatccaagcacgagtgatggaa

SEQ ID NO: 140200 - DNA, 27 bp, Artificial sequence
  SiRNA target sequence
tgttgatccaagcacgagtgatggaag

SEQ ID NO: 140201 - DNA, 27 bp, Artificial sequence
  SiRNA target sequence
gttgatccaagcacgagtgatggaaga

SEQ ID NO: 140202 - DNA, 27 bp, Artificial sequence
  SiRNA target sequence
ttgatccaagcacgagtgatggaagaa

SEQ ID NO: 140203 - DNA, 27 bp, Artificial sequence
  SiRNA target sequence
tgatccaagcacgagtgatggaagaat

SEQ ID NO: 140204 - DNA, 27 bp, Artificial sequence
  SiRNA target sequence
gatccaagcacgagtgatggaagaatc

SEQ ID NO: 140205 - DNA, 27 bp, Artificial sequence
  SiRNA target sequence
atccaagcacgagtgatggaagaatcg

SEQ ID NO: 140206 - DNA, 27 bp, Artificial sequence
  SiRNA target sequence
tccaagcacgagtgatggaagaatcgc

SEQ ID NO: 140207 - DNA, 27 bp, Artificial sequence
  SiRNA target sequence
ccaagcacgagtgatggaagaatcgca

SEQ ID NO: 140208 - DNA, 27 bp, Artificial sequence
  SiRNA target sequence
caagcacgagtgatggaagaatcgcat

SEQ ID NO: 140209 - DNA, 27 bp, Artificial sequence
  SiRNA target sequence
aagcacgagtgatggaagaatcgcatt

SEQ ID NO: 140210 - DNA, 27 bp, Artificial sequence
  SiRNA target sequence
agcacgagtgatggaagaatcgcattt

SEQ ID NO: 140211 - DNA, 27 bp, Artificial sequence
  SiRNA target sequence
gcacgagtgatggaagaatcgcatttt

SEQ ID NO: 140212 - DNA, 27 bp, Artificial sequence
  SiRNA target sequence
cacgagtgatggaagaatcgcattttt

SEQ ID NO: 140213 - DNA, 27 bp, Artificial sequence
  SiRNA target sequence
acgagtgatggaagaatcgcatttttt

SEQ ID NO: 140214 - DNA, 27 bp, Artificial sequence
  SiRNA target sequence
cgagtgatggaagaatcgcatttttta

SEQ ID NO: 140215 - DNA, 27 bp, Artificial sequence
  SiRNA target sequence
gagtgatggaagaatcgcattttttat

SEQ ID NO: 140216 - DNA, 27 bp, Artificial sequence
  SiRNA target sequence
agtgatggaagaatcgcattttttatg

SEQ ID NO: 140217 - DNA, 27 bp, Artificial sequence
  SiRNA target sequence
gtgatggaagaatcgcattttttatga

SEQ ID NO: 140218 - DNA, 27 bp, Artificial sequence
  SiRNA target sequence
tgatggaagaatcgcattttttatgaa

SEQ ID NO: 140219 - DNA, 27 bp, Artificial sequence
  SiRNA target sequence
gatggaagaatcgcattttttatgaat

SEQ ID NO: 140220 - DNA, 27 bp, Artificial sequence
  SiRNA target sequence
atggaagaatcgcattttttatgaatt

SEQ ID NO: 140221 - DNA, 27 bp, Artificial sequence
  SiRNA target sequence
tggaagaatcgcattttttatgaattt

SEQ ID NO: 140222 - DNA, 27 bp, Artificial sequence
  SiRNA target sequence
ggaagaatcgcattttttatgaatttt

SEQ ID NO: 140223 - DNA, 27 bp, Artificial sequence
  SiRNA target sequence
gaagaatcgcattttttatgaatttta

SEQ ID NO: 140224 - DNA, 27 bp, Artificial sequence
  SiRNA target sequence
aagaatcgcattttttatgaattttaa

SEQ ID NO: 140225 - DNA, 27 bp, Artificial sequence
  SiRNA target sequence
agaatcgcattttttatgaattttaaa

SEQ ID NO: 140226 - DNA, 27 bp, Artificial sequence
  SiRNA target sequence
gaatcgcattttttatgaattttaaag

SEQ ID NO: 140227 - DNA, 27 bp, Artificial sequence
  SiRNA target sequence
aatcgcattttttatgaattttaaagg

SEQ ID NO: 140228 - DNA, 27 bp, Artificial sequence
  SiRNA target sequence
atcgcattttttatgaattttaaaggt

SEQ ID NO: 140229 - DNA, 27 bp, Artificial sequence
  SiRNA target sequence
tcgcattttttatgaattttaaaggta

SEQ ID NO: 140230 - DNA, 27 bp, Artificial sequence
  SiRNA target sequence
cgcattttttatgaattttaaaggtaa

SEQ ID NO: 140231 - DNA, 27 bp, Artificial sequence
  SiRNA target sequence
gcattttttatgaattttaaaggtaaa

SEQ ID NO: 140232 - DNA, 27 bp, Artificial sequence
  SiRNA target sequence
cattttttatgaattttaaaggtaaaa

SEQ ID NO: 140233 - DNA, 27 bp, Artificial sequence
  SiRNA target sequence
attttttatgaattttaaaggtaaaac

SEQ ID NO: 140234 - DNA, 27 bp, Artificial sequence
  SiRNA target sequence
ttttttatgaattttaaaggtaaaaca

SEQ ID NO: 140235 - DNA, 27 bp, Artificial sequence
  SiRNA target sequence
tttttatgaattttaaaggtaaaacat

SEQ ID NO: 140236 - DNA, 27 bp, Artificial sequence
  SiRNA target sequence
ttttatgaattttaaaggtaaaacatt

SEQ ID NO: 140237 - DNA, 27 bp, Artificial sequence
  SiRNA target sequence
tttatgaattttaaaggtaaaacattg

SEQ ID NO: 140238 - DNA, 27 bp, Artificial sequence
  SiRNA target sequence
ttatgaattttaaaggtaaaacattga

SEQ ID NO: 140239 - DNA, 27 bp, Artificial sequence
  SiRNA target sequence
tatgaattttaaaggtaaaacattgat

SEQ ID NO: 140240 - DNA, 27 bp, Artificial sequence
  SiRNA target sequence
atgaattttaaaggtaaaacattgatt

SEQ ID NO: 140241 - DNA, 27 bp, Artificial sequence
  SiRNA target sequence
tgaattttaaaggtaaaacattgattg

SEQ ID NO: 140242 - DNA, 27 bp, Artificial sequence
  SiRNA target sequence
gaattttaaaggtaaaacattgattgg

SEQ ID NO: 140243 - DNA, 27 bp, Artificial sequence
  SiRNA target sequence
aattttaaaggtaaaacattgattgga

SEQ ID NO: 140244 - DNA, 27 bp, Artificial sequence
  SiRNA target sequence
attttaaaggtaaaacattgattggag

SEQ ID NO: 140245 - DNA, 27 bp, Artificial sequence
  SiRNA target sequence
ttttaaaggtaaaacattgattggagg

SEQ ID NO: 140246 - DNA, 27 bp, Artificial sequence
  SiRNA target sequence
tttaaaggtaaaacattgattggagga

SEQ ID NO: 140247 - DNA, 27 bp, Artificial sequence
  SiRNA target sequence
ttaaaggtaaaacattgattggaggaa

SEQ ID NO: 140248 - DNA, 27 bp, Artificial sequence
  SiRNA target sequence
taaaggtaaaacattgattggaggaac

SEQ ID NO: 140249 - DNA, 27 bp, Artificial sequence
  SiRNA target sequence
aaaggtaaaacattgattggaggaaca

SEQ ID NO: 140250 - DNA, 27 bp, Artificial sequence
  SiRNA target sequence
aaggtaaaacattgattggaggaacag

SEQ ID NO: 140251 - DNA, 27 bp, Artificial sequence
  SiRNA target sequence
aggtaaaacattgattggaggaacaga

SEQ ID NO: 140252 - DNA, 27 bp, Artificial sequence
  SiRNA target sequence
ggtaaaacattgattggaggaacagat

SEQ ID NO: 140253 - DNA, 27 bp, Artificial sequence
  SiRNA target sequence
gtaaaacattgattggaggaacagatg

SEQ ID NO: 140254 - DNA, 27 bp, Artificial sequence
  SiRNA target sequence
taaaacattgattggaggaacagatgt

SEQ ID NO: 140255 - DNA, 27 bp, Artificial sequence
  SiRNA target sequence
aaaacattgattggaggaacagatgtt

SEQ ID NO: 140256 - DNA, 27 bp, Artificial sequence
  SiRNA target sequence
aaacattgattggaggaacagatgtta

SEQ ID NO: 140257 - DNA, 27 bp, Artificial sequence
  SiRNA target sequence
aacattgattggaggaacagatgttaa

SEQ ID NO: 140258 - DNA, 27 bp, Artificial sequence
  SiRNA target sequence
acattgattggaggaacagatgttaag

SEQ ID NO: 140259 - DNA, 27 bp, Artificial sequence
  SiRNA target sequence
cattgattggaggaacagatgttaagt

SEQ ID NO: 140260 - DNA, 27 bp, Artificial sequence
  SiRNA target sequence
attgattggaggaacagatgttaagtg

SEQ ID NO: 140261 - DNA, 27 bp, Artificial sequence
  SiRNA target sequence
ttgattggaggaacagatgttaagtgt

SEQ ID NO: 140262 - DNA, 27 bp, Artificial sequence
  SiRNA target sequence
tgattggaggaacagatgttaagtgta

SEQ ID NO: 140263 - DNA, 27 bp, Artificial sequence
  SiRNA target sequence
gattggaggaacagatgttaagtgtaa

SEQ ID NO: 140264 - DNA, 27 bp, Artificial sequence
  SiRNA target sequence
attggaggaacagatgttaagtgtaaa

SEQ ID NO: 140265 - DNA, 27 bp, Artificial sequence
  SiRNA target sequence
ttggaggaacagatgttaagtgtaaag

SEQ ID NO: 140266 - DNA, 27 bp, Artificial sequence
  SiRNA target sequence
tggaggaacagatgttaagtgtaaagt

SEQ ID NO: 140267 - DNA, 27 bp, Artificial sequence
  SiRNA target sequence
ggaggaacagatgttaagtgtaaagtt

SEQ ID NO: 140268 - DNA, 27 bp, Artificial sequence
  SiRNA target sequence
gaggaacagatgttaagtgtaaagttg

SEQ ID NO: 140269 - DNA, 27 bp, Artificial sequence
  SiRNA target sequence
aggaacagatgttaagtgtaaagttga

SEQ ID NO: 140270 - DNA, 27 bp, Artificial sequence
  SiRNA target sequence
ggaacagatgttaagtgtaaagttgaa

SEQ ID NO: 140271 - DNA, 27 bp, Artificial sequence
  SiRNA target sequence
gaacagatgttaagtgtaaagttgaag

SEQ ID NO: 140272 - DNA, 27 bp, Artificial sequence
  SiRNA target sequence
aacagatgttaagtgtaaagttgaaga

SEQ ID NO: 140273 - DNA, 27 bp, Artificial sequence
  SiRNA target sequence
acagatgttaagtgtaaagttgaagat

SEQ ID NO: 140274 - DNA, 27 bp, Artificial sequence
  SiRNA target sequence
cagatgttaagtgtaaagttgaagatt

SEQ ID NO: 140275 - DNA, 27 bp, Artificial sequence
  SiRNA target sequence
agatgttaagtgtaaagttgaagattt

SEQ ID NO: 140276 - DNA, 27 bp, Artificial sequence
  SiRNA target sequence
gatgttaagtgtaaagttgaagattta

SEQ ID NO: 140277 - DNA, 27 bp, Artificial sequence
  SiRNA target sequence
atgttaagtgtaaagttgaagatttaa

SEQ ID NO: 140278 - DNA, 27 bp, Artificial sequence
  SiRNA target sequence
tgttaagtgtaaagttgaagatttaat

SEQ ID NO: 140279 - DNA, 27 bp, Artificial sequence
  SiRNA target sequence
gttaagtgtaaagttgaagatttaata

SEQ ID NO: 140280 - DNA, 27 bp, Artificial sequence
  SiRNA target sequence
ttaagtgtaaagttgaagatttaataa

SEQ ID NO: 140281 - DNA, 27 bp, Artificial sequence
  SiRNA target sequence
taagtgtaaagttgaagatttaataaa

SEQ ID NO: 140282 - DNA, 27 bp, Artificial sequence
  SiRNA target sequence
aagtgtaaagttgaagatttaataaaa

SEQ ID NO: 140283 - DNA, 27 bp, Artificial sequence
  SiRNA target sequence
agtgtaaagttgaagatttaataaaac

SEQ ID NO: 140284 - DNA, 27 bp, Artificial sequence
  SiRNA target sequence
gtgtaaagttgaagatttaataaaacc

SEQ ID NO: 140285 - DNA, 27 bp, Artificial sequence
  SiRNA target sequence
tgtaaagttgaagatttaataaaaccg

SEQ ID NO: 140286 - DNA, 27 bp, Artificial sequence
  SiRNA target sequence
gtaaagttgaagatttaataaaaccga

SEQ ID NO: 140287 - DNA, 27 bp, Artificial sequence
  SiRNA target sequence
taaagttgaagatttaataaaaccgac

SEQ ID NO: 140288 - DNA, 27 bp, Artificial sequence
  SiRNA target sequence
aaagttgaagatttaataaaaccgact

SEQ ID NO: 140289 - DNA, 27 bp, Artificial sequence
  SiRNA target sequence
aagttgaagatttaataaaaccgactg

SEQ ID NO: 140290 - DNA, 27 bp, Artificial sequence
  SiRNA target sequence
agttgaagatttaataaaaccgactga

SEQ ID NO: 140291 - DNA, 27 bp, Artificial sequence
  SiRNA target sequence
gttgaagatttaataaaaccgactgaa

SEQ ID NO: 140292 - DNA, 27 bp, Artificial sequence
  SiRNA target sequence
ttgaagatttaataaaaccgactgaag

SEQ ID NO: 140293 - DNA, 27 bp, Artificial sequence
  SiRNA target sequence
tgaagatttaataaaaccgactgaaga

SEQ ID NO: 140294 - DNA, 27 bp, Artificial sequence
  SiRNA target sequence
gaagatttaataaaaccgactgaagaa

SEQ ID NO: 140295 - DNA, 27 bp, Artificial sequence
  SiRNA target sequence
aagatttaataaaaccgactgaagaag

SEQ ID NO: 140296 - DNA, 27 bp, Artificial sequence
  SiRNA target sequence
agatttaataaaaccgactgaagaaga

SEQ ID NO: 140297 - DNA, 27 bp, Artificial sequence
  SiRNA target sequence
gatttaataaaaccgactgaagaagat

SEQ ID NO: 140298 - DNA, 27 bp, Artificial sequence
  SiRNA target sequence
atttaataaaaccgactgaagaagatc

SEQ ID NO: 140299 - DNA, 27 bp, Artificial sequence
  SiRNA target sequence
tttaataaaaccgactgaagaagatct

SEQ ID NO: 140300 - DNA, 27 bp, Artificial sequence
  SiRNA target sequence
ttaataaaaccgactgaagaagatcta

SEQ ID NO: 140301 - DNA, 27 bp, Artificial sequence
  SiRNA target sequence
taataaaaccgactgaagaagatctaa

SEQ ID NO: 140302 - DNA, 27 bp, Artificial sequence
  SiRNA target sequence
aataaaaccgactgaagaagatctaaa

SEQ ID NO: 140303 - DNA, 27 bp, Artificial sequence
  SiRNA target sequence
ataaaaccgactgaagaagatctaaac

SEQ ID NO: 140304 - DNA, 27 bp, Artificial sequence
  SiRNA target sequence
taaaaccgactgaagaagatctaaact

SEQ ID NO: 140305 - DNA, 27 bp, Artificial sequence
  SiRNA target sequence
aaaaccgactgaagaagatctaaactt

SEQ ID NO: 140306 - DNA, 27 bp, Artificial sequence
  SiRNA target sequence
aaaccgactgaagaagatctaaacttt

SEQ ID NO: 140307 - DNA, 27 bp, Artificial sequence
  SiRNA target sequence
aaccgactgaagaagatctaaactttc

SEQ ID NO: 140308 - DNA, 27 bp, Artificial sequence
  SiRNA target sequence
accgactgaagaagatctaaactttct

SEQ ID NO: 140309 - DNA, 27 bp, Artificial sequence
  SiRNA target sequence
ccgactgaagaagatctaaactttctt

SEQ ID NO: 140310 - DNA, 27 bp, Artificial sequence
  SiRNA target sequence
cgactgaagaagatctaaactttctta

SEQ ID NO: 140311 - DNA, 27 bp, Artificial sequence
  SiRNA target sequence
gactgaagaagatctaaactttcttat

SEQ ID NO: 140312 - DNA, 27 bp, Artificial sequence
  SiRNA target sequence
actgaagaagatctaaactttcttatt

SEQ ID NO: 140313 - DNA, 27 bp, Artificial sequence
  SiRNA target sequence
ctgaagaagatctaaactttcttattc

SEQ ID NO: 140314 - DNA, 27 bp, Artificial sequence
  SiRNA target sequence
tgaagaagatctaaactttcttattca

SEQ ID NO: 140315 - DNA, 27 bp, Artificial sequence
  SiRNA target sequence
gaagaagatctaaactttcttattcac

SEQ ID NO: 140316 - DNA, 27 bp, Artificial sequence
  SiRNA target sequence
aagaagatctaaactttcttattcacg

SEQ ID NO: 140317 - DNA, 27 bp, Artificial sequence
  SiRNA target sequence
agaagatctaaactttcttattcacga

SEQ ID NO: 140318 - DNA, 27 bp, Artificial sequence
  SiRNA target sequence
gaagatctaaactttcttattcacgag

SEQ ID NO: 140319 - DNA, 27 bp, Artificial sequence
  SiRNA target sequence
aagatctaaactttcttattcacgagg

SEQ ID NO: 140320 - DNA, 27 bp, Artificial sequence
  SiRNA target sequence
agatctaaactttcttattcacgaggc

SEQ ID NO: 140321 - DNA, 27 bp, Artificial sequence
  SiRNA target sequence
gatctaaactttcttattcacgaggcc

SEQ ID NO: 140322 - DNA, 27 bp, Artificial sequence
  SiRNA target sequence
atctaaactttcttattcacgaggcca

SEQ ID NO: 140323 - DNA, 27 bp, Artificial sequence
  SiRNA target sequence
tctaaactttcttattcacgaggccaa

SEQ ID NO: 140324 - DNA, 27 bp, Artificial sequence
  SiRNA target sequence
ctaaactttcttattcacgaggccaat

SEQ ID NO: 140325 - DNA, 27 bp, Artificial sequence
  SiRNA target sequence
taaactttcttattcacgaggccaatt

SEQ ID NO: 140326 - DNA, 27 bp, Artificial sequence
  SiRNA target sequence
aaactttcttattcacgaggccaatta

SEQ ID NO: 140327 - DNA, 27 bp, Artificial sequence
  SiRNA target sequence
aactttcttattcacgaggccaattat

SEQ ID NO: 140328 - DNA, 27 bp, Artificial sequence
  SiRNA target sequence
actttcttattcacgaggccaattatt

SEQ ID NO: 140329 - DNA, 27 bp, Artificial sequence
  SiRNA target sequence
ctttcttattcacgaggccaattattt

SEQ ID NO: 140330 - DNA, 27 bp, Artificial sequence
  SiRNA target sequence
tttcttattcacgaggccaattatttt

SEQ ID NO: 140331 - DNA, 27 bp, Artificial sequence
  SiRNA target sequence
ttcttattcacgaggccaattatttta

SEQ ID NO: 140332 - DNA, 27 bp, Artificial sequence
  SiRNA target sequence
tcttattcacgaggccaattattttac

SEQ ID NO: 140333 - DNA, 27 bp, Artificial sequence
  SiRNA target sequence
cttattcacgaggccaattattttaca

SEQ ID NO: 140334 - DNA, 27 bp, Artificial sequence
  SiRNA target sequence
ttattcacgaggccaattattttacag

SEQ ID NO: 140335 - DNA, 27 bp, Artificial sequence
  SiRNA target sequence
tattcacgaggccaattattttacaga

SEQ ID NO: 140336 - DNA, 27 bp, Artificial sequence
  SiRNA target sequence
attcacgaggccaattattttacagat

SEQ ID NO: 140337 - DNA, 27 bp, Artificial sequence
  SiRNA target sequence
ttcacgaggccaattattttacagatc

SEQ ID NO: 140338 - DNA, 27 bp, Artificial sequence
  SiRNA target sequence
tcacgaggccaattattttacagatca

SEQ ID NO: 140339 - DNA, 27 bp, Artificial sequence
  SiRNA target sequence
cacgaggccaattattttacagatcac

SEQ ID NO: 140340 - DNA, 27 bp, Artificial sequence
  SiRNA target sequence
acgaggccaattattttacagatcaca

SEQ ID NO: 140341 - DNA, 27 bp, Artificial sequence
  SiRNA target sequence
cgaggccaattattttacagatcacaa

SEQ ID NO: 140342 - DNA, 27 bp, Artificial sequence
  SiRNA target sequence
gaggccaattattttacagatcacaat

SEQ ID NO: 140343 - DNA, 27 bp, Artificial sequence
  SiRNA target sequence
aggccaattattttacagatcacaatt

SEQ ID NO: 140344 - DNA, 27 bp, Artificial sequence
  SiRNA target sequence
ggccaattattttacagatcacaattt

SEQ ID NO: 140345 - DNA, 27 bp, Artificial sequence
  SiRNA target sequence
gccaattattttacagatcacaattta

SEQ ID NO: 140346 - DNA, 27 bp, Artificial sequence
  SiRNA target sequence
ccaattattttacagatcacaatttaa

SEQ ID NO: 140347 - DNA, 27 bp, Artificial sequence
  SiRNA target sequence
caattattttacagatcacaatttaaa

SEQ ID NO: 140348 - DNA, 27 bp, Artificial sequence
  SiRNA target sequence
aattattttacagatcacaatttaaaa

SEQ ID NO: 140349 - DNA, 27 bp, Artificial sequence
  SiRNA target sequence
attattttacagatcacaatttaaaat

SEQ ID NO: 140350 - DNA, 27 bp, Artificial sequence
  SiRNA target sequence
ttattttacagatcacaatttaaaatt

SEQ ID NO: 140351 - DNA, 27 bp, Artificial sequence
  SiRNA target sequence
tattttacagatcacaatttaaaatta

SEQ ID NO: 140352 - DNA, 27 bp, Artificial sequence
  SiRNA target sequence
attttacagatcacaatttaaaattaa

SEQ ID NO: 140353 - DNA, 27 bp, Artificial sequence
  SiRNA target sequence
ttttacagatcacaatttaaaattaac

SEQ ID NO: 140354 - DNA, 27 bp, Artificial sequence
  SiRNA target sequence
tttacagatcacaatttaaaattaaca

SEQ ID NO: 140355 - DNA, 27 bp, Artificial sequence
  SiRNA target sequence
ttacagatcacaatttaaaattaacaa

SEQ ID NO: 140356 - DNA, 27 bp, Artificial sequence
  SiRNA target sequence
tacagatcacaatttaaaattaacaaa

SEQ ID NO: 140357 - DNA, 27 bp, Artificial sequence
  SiRNA target sequence
acagatcacaatttaaaattaacaaaa

SEQ ID NO: 140358 - DNA, 27 bp, Artificial sequence
  SiRNA target sequence
cagatcacaatttaaaattaacaaaaa

SEQ ID NO: 140359 - DNA, 27 bp, Artificial sequence
  SiRNA target sequence
agatcacaatttaaaattaacaaaaaa

SEQ ID NO: 140360 - DNA, 27 bp, Artificial sequence
  SiRNA target sequence
gatcacaatttaaaattaacaaaaaaa

SEQ ID NO: 140361 - DNA, 27 bp, Artificial sequence
  SiRNA target sequence
atcacaatttaaaattaacaaaaaaag

SEQ ID NO: 140362 - DNA, 27 bp, Artificial sequence
  SiRNA target sequence
tcacaatttaaaattaacaaaaaaaga

SEQ ID NO: 140363 - DNA, 27 bp, Artificial sequence
  SiRNA target sequence
cacaatttaaaattaacaaaaaaagat

SEQ ID NO: 140364 - DNA, 27 bp, Artificial sequence
  SiRNA target sequence
acaatttaaaattaacaaaaaaagatg

SEQ ID NO: 140365 - DNA, 27 bp, Artificial sequence
  SiRNA target sequence
caatttaaaattaacaaaaaaagatgt

SEQ ID NO: 140366 - DNA, 27 bp, Artificial sequence
  SiRNA target sequence
aatttaaaattaacaaaaaaagatgtt

SEQ ID NO: 140367 - DNA, 27 bp, Artificial sequence
  SiRNA target sequence
atttaaaattaacaaaaaaagatgttt

SEQ ID NO: 140368 - DNA, 27 bp, Artificial sequence
  SiRNA target sequence
tttaaaattaacaaaaaaagatgtttt

SEQ ID NO: 140369 - DNA, 27 bp, Artificial sequence
  SiRNA target sequence
ttaaaattaacaaaaaaagatgttttg

SEQ ID NO: 140370 - DNA, 27 bp, Artificial sequence
  SiRNA target sequence
taaaattaacaaaaaaagatgttttgt

SEQ ID NO: 140371 - DNA, 27 bp, Artificial sequence
  SiRNA target sequence
aaaattaacaaaaaaagatgttttgtc

SEQ ID NO: 140372 - DNA, 27 bp, Artificial sequence
  SiRNA target sequence
aaattaacaaaaaaagatgttttgtct

SEQ ID NO: 140373 - DNA, 27 bp, Artificial sequence
  SiRNA target sequence
aattaacaaaaaaagatgttttgtctg

SEQ ID NO: 140374 - DNA, 27 bp, Artificial sequence
  SiRNA target sequence
attaacaaaaaaagatgttttgtctgt

SEQ ID NO: 140375 - DNA, 27 bp, Artificial sequence
  SiRNA target sequence
ttaacaaaaaaagatgttttgtctgtt

SEQ ID NO: 140376 - DNA, 27 bp, Artificial sequence
  SiRNA target sequence
taacaaaaaaagatgttttgtctgttt

SEQ ID NO: 140377 - DNA, 27 bp, Artificial sequence
  SiRNA target sequence
aacaaaaaaagatgttttgtctgtttg

SEQ ID NO: 140378 - DNA, 27 bp, Artificial sequence
  SiRNA target sequence
acaaaaaaagatgttttgtctgtttgg

SEQ ID NO: 140379 - DNA, 27 bp, Artificial sequence
  SiRNA target sequence
caaaaaaagatgttttgtctgtttgga

SEQ ID NO: 140380 - DNA, 27 bp, Artificial sequence
  SiRNA target sequence
aaaaaaagatgttttgtctgtttggac

SEQ ID NO: 140381 - DNA, 27 bp, Artificial sequence
  SiRNA target sequence
aaaaaagatgttttgtctgtttggaca

SEQ ID NO: 140382 - DNA, 27 bp, Artificial sequence
  SiRNA target sequence
aaaaagatgttttgtctgtttggacag

SEQ ID NO: 140383 - DNA, 27 bp, Artificial sequence
  SiRNA target sequence
aaaagatgttttgtctgtttggacagg

SEQ ID NO: 140384 - DNA, 27 bp, Artificial sequence
  SiRNA target sequence
aaagatgttttgtctgtttggacaggt

SEQ ID NO: 140385 - DNA, 27 bp, Artificial sequence
  SiRNA target sequence
aagatgttttgtctgtttggacaggta

SEQ ID NO: 140386 - DNA, 27 bp, Artificial sequence
  SiRNA target sequence
agatgttttgtctgtttggacaggtat

SEQ ID NO: 140387 - DNA, 27 bp, Artificial sequence
  SiRNA target sequence
gatgttttgtctgtttggacaggtatt

SEQ ID NO: 140388 - DNA, 27 bp, Artificial sequence
  SiRNA target sequence
atgttttgtctgtttggacaggtatta

SEQ ID NO: 140389 - DNA, 27 bp, Artificial sequence
  SiRNA target sequence
tgttttgtctgtttggacaggtattag

SEQ ID NO: 140390 - DNA, 27 bp, Artificial sequence
  SiRNA target sequence
gttttgtctgtttggacaggtattaga

SEQ ID NO: 140391 - DNA, 27 bp, Artificial sequence
  SiRNA target sequence
ttttgtctgtttggacaggtattagac

SEQ ID NO: 140392 - DNA, 27 bp, Artificial sequence
  SiRNA target sequence
tttgtctgtttggacaggtattagacc

SEQ ID NO: 140393 - DNA, 27 bp, Artificial sequence
  SiRNA target sequence
ttgtctgtttggacaggtattagaccg

SEQ ID NO: 140394 - DNA, 27 bp, Artificial sequence
  SiRNA target sequence
tgtctgtttggacaggtattagaccgt

SEQ ID NO: 140395 - DNA, 27 bp, Artificial sequence
  SiRNA target sequence
gtctgtttggacaggtattagaccgtt

SEQ ID NO: 140396 - DNA, 27 bp, Artificial sequence
  SiRNA target sequence
tctgtttggacaggtattagaccgtta

SEQ ID NO: 140397 - DNA, 27 bp, Artificial sequence
  SiRNA target sequence
ctgtttggacaggtattagaccgttag

SEQ ID NO: 140398 - DNA, 27 bp, Artificial sequence
  SiRNA target sequence
tgtttggacaggtattagaccgttagt

SEQ ID NO: 140399 - DNA, 27 bp, Artificial sequence
  SiRNA target sequence
gtttggacaggtattagaccgttagtc

SEQ ID NO: 140400 - DNA, 27 bp, Artificial sequence
  SiRNA target sequence
tttggacaggtattagaccgttagtca

SEQ ID NO: 140401 - DNA, 27 bp, Artificial sequence
  SiRNA target sequence
ttggacaggtattagaccgttagtcaa

SEQ ID NO: 140402 - DNA, 27 bp, Artificial sequence
  SiRNA target sequence
tggacaggtattagaccgttagtcaag

SEQ ID NO: 140403 - DNA, 27 bp, Artificial sequence
  SiRNA target sequence
ggacaggtattagaccgttagtcaagg

SEQ ID NO: 140404 - DNA, 27 bp, Artificial sequence
  SiRNA target sequence
gacaggtattagaccgttagtcaagga

SEQ ID NO: 140405 - DNA, 27 bp, Artificial sequence
  SiRNA target sequence
acaggtattagaccgttagtcaaggat

SEQ ID NO: 140406 - DNA, 27 bp, Artificial sequence
  SiRNA target sequence
caggtattagaccgttagtcaaggatt

SEQ ID NO: 140407 - DNA, 27 bp, Artificial sequence
  SiRNA target sequence
aggtattagaccgttagtcaaggattt

SEQ ID NO: 140408 - DNA, 27 bp, Artificial sequence
  SiRNA target sequence
ggtattagaccgttagtcaaggattta

SEQ ID NO: 140409 - DNA, 27 bp, Artificial sequence
  SiRNA target sequence
gtattagaccgttagtcaaggatttat

SEQ ID NO: 140410 - DNA, 27 bp, Artificial sequence
  SiRNA target sequence
tattagaccgttagtcaaggatttatc

SEQ ID NO: 140411 - DNA, 27 bp, Artificial sequence
  SiRNA target sequence
attagaccgttagtcaaggatttatcg

SEQ ID NO: 140412 - DNA, 27 bp, Artificial sequence
  SiRNA target sequence
ttagaccgttagtcaaggatttatcga

SEQ ID NO: 140413 - DNA, 27 bp, Artificial sequence
  SiRNA target sequence
tagaccgttagtcaaggatttatcgaa

SEQ ID NO: 140414 - DNA, 27 bp, Artificial sequence
  SiRNA target sequence
agaccgttagtcaaggatttatcgaaa

SEQ ID NO: 140415 - DNA, 27 bp, Artificial sequence
  SiRNA target sequence
gaccgttagtcaaggatttatcgaaaa

SEQ ID NO: 140416 - DNA, 27 bp, Artificial sequence
  SiRNA target sequence
accgttagtcaaggatttatcgaaaag

SEQ ID NO: 140417 - DNA, 27 bp, Artificial sequence
  SiRNA target sequence
ccgttagtcaaggatttatcgaaaagt

SEQ ID NO: 140418 - DNA, 27 bp, Artificial sequence
  SiRNA target sequence
cgttagtcaaggatttatcgaaaagtt

SEQ ID NO: 140419 - DNA, 27 bp, Artificial sequence
  SiRNA target sequence
gttagtcaaggatttatcgaaaagttc

SEQ ID NO: 140420 - DNA, 27 bp, Artificial sequence
  SiRNA target sequence
ttagtcaaggatttatcgaaaagttca

SEQ ID NO: 140421 - DNA, 27 bp, Artificial sequence
  SiRNA target sequence
tagtcaaggatttatcgaaaagttcaa

SEQ ID NO: 140422 - DNA, 27 bp, Artificial sequence
  SiRNA target sequence
agtcaaggatttatcgaaaagttcaac

SEQ ID NO: 140423 - DNA, 27 bp, Artificial sequence
  SiRNA target sequence
gtcaaggatttatcgaaaagttcaaca

SEQ ID NO: 140424 - DNA, 27 bp, Artificial sequence
  SiRNA target sequence
tcaaggatttatcgaaaagttcaacag

SEQ ID NO: 140425 - DNA, 27 bp, Artificial sequence
  SiRNA target sequence
caaggatttatcgaaaagttcaacaga

SEQ ID NO: 140426 - DNA, 27 bp, Artificial sequence
  SiRNA target sequence
aaggatttatcgaaaagttcaacagaa

SEQ ID NO: 140427 - DNA, 27 bp, Artificial sequence
  SiRNA target sequence
aggatttatcgaaaagttcaacagaaa

SEQ ID NO: 140428 - DNA, 27 bp, Artificial sequence
  SiRNA target sequence
ggatttatcgaaaagttcaacagaaaa

SEQ ID NO: 140429 - DNA, 27 bp, Artificial sequence
  SiRNA target sequence
gatttatcgaaaagttcaacagaaaag

SEQ ID NO: 140430 - DNA, 27 bp, Artificial sequence
  SiRNA target sequence
atttatcgaaaagttcaacagaaaaga

SEQ ID NO: 140431 - DNA, 27 bp, Artificial sequence
  SiRNA target sequence
tttatcgaaaagttcaacagaaaagat

SEQ ID NO: 140432 - DNA, 27 bp, Artificial sequence
  SiRNA target sequence
ttatcgaaaagttcaacagaaaagata

SEQ ID NO: 140433 - DNA, 27 bp, Artificial sequence
  SiRNA target sequence
tatcgaaaagttcaacagaaaagatat

SEQ ID NO: 140434 - DNA, 27 bp, Artificial sequence
  SiRNA target sequence
atcgaaaagttcaacagaaaagatatg

SEQ ID NO: 140435 - DNA, 27 bp, Artificial sequence
  SiRNA target sequence
tcgaaaagttcaacagaaaagatatgt

SEQ ID NO: 140436 - DNA, 27 bp, Artificial sequence
  SiRNA target sequence
cgaaaagttcaacagaaaagatatgta

SEQ ID NO: 140437 - DNA, 27 bp, Artificial sequence
  SiRNA target sequence
gaaaagttcaacagaaaagatatgtag

SEQ ID NO: 140438 - DNA, 27 bp, Artificial sequence
  SiRNA target sequence
aaaagttcaacagaaaagatatgtaga

SEQ ID NO: 140439 - DNA, 27 bp, Artificial sequence
  SiRNA target sequence
aaagttcaacagaaaagatatgtagaa

SEQ ID NO: 140440 - DNA, 27 bp, Artificial sequence
  SiRNA target sequence
aagttcaacagaaaagatatgtagaaa

SEQ ID NO: 140441 - DNA, 27 bp, Artificial sequence
  SiRNA target sequence
agttcaacagaaaagatatgtagaaaa

SEQ ID NO: 140442 - DNA, 27 bp, Artificial sequence
  SiRNA target sequence
gttcaacagaaaagatatgtagaaaac

SEQ ID NO: 140443 - DNA, 27 bp, Artificial sequence
  SiRNA target sequence
ttcaacagaaaagatatgtagaaaaca

SEQ ID NO: 140444 - DNA, 27 bp, Artificial sequence
  SiRNA target sequence
tcaacagaaaagatatgtagaaaacat

SEQ ID NO: 140445 - DNA, 27 bp, Artificial sequence
  SiRNA target sequence
caacagaaaagatatgtagaaaacata

SEQ ID NO: 140446 - DNA, 27 bp, Artificial sequence
  SiRNA target sequence
aacagaaaagatatgtagaaaacatac

SEQ ID NO: 140447 - DNA, 27 bp, Artificial sequence
  SiRNA target sequence
acagaaaagatatgtagaaaacatact

SEQ ID NO: 140448 - DNA, 27 bp, Artificial sequence
  SiRNA target sequence
cagaaaagatatgtagaaaacatacta

SEQ ID NO: 140449 - DNA, 27 bp, Artificial sequence
  SiRNA target sequence
agaaaagatatgtagaaaacatactat

SEQ ID NO: 140450 - DNA, 27 bp, Artificial sequence
  SiRNA target sequence
gaaaagatatgtagaaaacatactata

SEQ ID NO: 140451 - DNA, 27 bp, Artificial sequence
  SiRNA target sequence
aaaagatatgtagaaaacatactataa

SEQ ID NO: 140452 - DNA, 27 bp, Artificial sequence
  SiRNA target sequence
aaagatatgtagaaaacatactataag

SEQ ID NO: 140453 - DNA, 27 bp, Artificial sequence
  SiRNA target sequence
aagatatgtagaaaacatactataaga

SEQ ID NO: 140454 - DNA, 27 bp, Artificial sequence
  SiRNA target sequence
agatatgtagaaaacatactataagaa

SEQ ID NO: 140455 - DNA, 27 bp, Artificial sequence
  SiRNA target sequence
gatatgtagaaaacatactataagaat

SEQ ID NO: 140456 - DNA, 27 bp, Artificial sequence
  SiRNA target sequence
atatgtagaaaacatactataagaata

SEQ ID NO: 140457 - DNA, 27 bp, Artificial sequence
  SiRNA target sequence
tatgtagaaaacatactataagaatag

SEQ ID NO: 140458 - DNA, 27 bp, Artificial sequence
  SiRNA target sequence
atgtagaaaacatactataagaataga

SEQ ID NO: 140459 - DNA, 27 bp, Artificial sequence
  SiRNA target sequence
tgtagaaaacatactataagaatagat

SEQ ID NO: 140460 - DNA, 27 bp, Artificial sequence
  SiRNA target sequence
gtagaaaacatactataagaatagata

SEQ ID NO: 140461 - DNA, 27 bp, Artificial sequence
  SiRNA target sequence
tagaaaacatactataagaatagataa

SEQ ID NO: 140462 - DNA, 27 bp, Artificial sequence
  SiRNA target sequence
agaaaacatactataagaatagataaa

SEQ ID NO: 140463 - DNA, 27 bp, Artificial sequence
  SiRNA target sequence
gaaaacatactataagaatagataaag

SEQ ID NO: 140464 - DNA, 27 bp, Artificial sequence
  SiRNA target sequence
aaaacatactataagaatagataaaga

SEQ ID NO: 140465 - DNA, 27 bp, Artificial sequence
  SiRNA target sequence
aaacatactataagaatagataaagac

SEQ ID NO: 140466 - DNA, 27 bp, Artificial sequence
  SiRNA target sequence
aacatactataagaatagataaagaca

SEQ ID NO: 140467 - DNA, 27 bp, Artificial sequence
  SiRNA target sequence
acatactataagaatagataaagacaa

SEQ ID NO: 140468 - DNA, 27 bp, Artificial sequence
  SiRNA target sequence
catactataagaatagataaagacaat

SEQ ID NO: 140469 - DNA, 27 bp, Artificial sequence
  SiRNA target sequence
atactataagaatagataaagacaata

SEQ ID NO: 140470 - DNA, 27 bp, Artificial sequence
  SiRNA target sequence
tactataagaatagataaagacaatat

SEQ ID NO: 140471 - DNA, 27 bp, Artificial sequence
  SiRNA target sequence
actataagaatagataaagacaatatg

SEQ ID NO: 140472 - DNA, 27 bp, Artificial sequence
  SiRNA target sequence
ctataagaatagataaagacaatatgg

SEQ ID NO: 140473 - DNA, 27 bp, Artificial sequence
  SiRNA target sequence
tataagaatagataaagacaatatggt

SEQ ID NO: 140474 - DNA, 27 bp, Artificial sequence
  SiRNA target sequence
ataagaatagataaagacaatatggta

SEQ ID NO: 140475 - DNA, 27 bp, Artificial sequence
  SiRNA target sequence
taagaatagataaagacaatatggtaa

SEQ ID NO: 140476 - DNA, 27 bp, Artificial sequence
  SiRNA target sequence
aagaatagataaagacaatatggtaac

SEQ ID NO: 140477 - DNA, 27 bp, Artificial sequence
  SiRNA target sequence
agaatagataaagacaatatggtaact

SEQ ID NO: 140478 - DNA, 27 bp, Artificial sequence
  SiRNA target sequence
gaatagataaagacaatatggtaactg

SEQ ID NO: 140479 - DNA, 27 bp, Artificial sequence
  SiRNA target sequence
aatagataaagacaatatggtaactgt

SEQ ID NO: 140480 - DNA, 27 bp, Artificial sequence
  SiRNA target sequence
atagataaagacaatatggtaactgta

SEQ ID NO: 140481 - DNA, 27 bp, Artificial sequence
  SiRNA target sequence
tagataaagacaatatggtaactgtaa

SEQ ID NO: 140482 - DNA, 27 bp, Artificial sequence
  SiRNA target sequence
agataaagacaatatggtaactgtaac

SEQ ID NO: 140483 - DNA, 27 bp, Artificial sequence
  SiRNA target sequence
gataaagacaatatggtaactgtaaca

SEQ ID NO: 140484 - DNA, 27 bp, Artificial sequence
  SiRNA target sequence
ataaagacaatatggtaactgtaacag

SEQ ID NO: 140485 - DNA, 27 bp, Artificial sequence
  SiRNA target sequence
taaagacaatatggtaactgtaacagg

SEQ ID NO: 140486 - DNA, 27 bp, Artificial sequence
  SiRNA target sequence
aaagacaatatggtaactgtaacaggt

SEQ ID NO: 140487 - DNA, 27 bp, Artificial sequence
  SiRNA target sequence
aagacaatatggtaactgtaacaggtg

SEQ ID NO: 140488 - DNA, 27 bp, Artificial sequence
  SiRNA target sequence
agacaatatggtaactgtaacaggtgg

SEQ ID NO: 140489 - DNA, 27 bp, Artificial sequence
  SiRNA target sequence
gacaatatggtaactgtaacaggtggt

SEQ ID NO: 140490 - DNA, 27 bp, Artificial sequence
  SiRNA target sequence
acaatatggtaactgtaacaggtggta

SEQ ID NO: 140491 - DNA, 27 bp, Artificial sequence
  SiRNA target sequence
caatatggtaactgtaacaggtggtaa

SEQ ID NO: 140492 - DNA, 27 bp, Artificial sequence
  SiRNA target sequence
aatatggtaactgtaacaggtggtaag

SEQ ID NO: 140493 - DNA, 27 bp, Artificial sequence
  SiRNA target sequence
atatggtaactgtaacaggtggtaagt

SEQ ID NO: 140494 - DNA, 27 bp, Artificial sequence
  SiRNA target sequence
tatggtaactgtaacaggtggtaagtg

SEQ ID NO: 140495 - DNA, 27 bp, Artificial sequence
  SiRNA target sequence
atggtaactgtaacaggtggtaagtgg

SEQ ID NO: 140496 - DNA, 27 bp, Artificial sequence
  SiRNA target sequence
tggtaactgtaacaggtggtaagtgga

SEQ ID NO: 140497 - DNA, 27 bp, Artificial sequence
  SiRNA target sequence
ggtaactgtaacaggtggtaagtggac

SEQ ID NO: 140498 - DNA, 27 bp, Artificial sequence
  SiRNA target sequence
gtaactgtaacaggtggtaagtggaca

SEQ ID NO: 140499 - DNA, 27 bp, Artificial sequence
  SiRNA target sequence
taactgtaacaggtggtaagtggacaa

SEQ ID NO: 140500 - DNA, 27 bp, Artificial sequence
  SiRNA target sequence
aactgtaacaggtggtaagtggacaat

SEQ ID NO: 140501 - DNA, 27 bp, Artificial sequence
  SiRNA target sequence
actgtaacaggtggtaagtggacaatt

SEQ ID NO: 140502 - DNA, 27 bp, Artificial sequence
  SiRNA target sequence
ctgtaacaggtggtaagtggacaattt

SEQ ID NO: 140503 - DNA, 27 bp, Artificial sequence
  SiRNA target sequence
tgtaacaggtggtaagtggacaatttt

SEQ ID NO: 140504 - DNA, 27 bp, Artificial sequence
  SiRNA target sequence
gtaacaggtggtaagtggacaattttt

SEQ ID NO: 140505 - DNA, 27 bp, Artificial sequence
  SiRNA target sequence
taacaggtggtaagtggacaatttttc

SEQ ID NO: 140506 - DNA, 27 bp, Artificial sequence
  SiRNA target sequence
aacaggtggtaagtggacaatttttcg

SEQ ID NO: 140507 - DNA, 27 bp, Artificial sequence
  SiRNA target sequence
acaggtggtaagtggacaatttttcga

SEQ ID NO: 140508 - DNA, 27 bp, Artificial sequence
  SiRNA target sequence
caggtggtaagtggacaatttttcgac

SEQ ID NO: 140509 - DNA, 27 bp, Artificial sequence
  SiRNA target sequence
aggtggtaagtggacaatttttcgact

SEQ ID NO: 140510 - DNA, 27 bp, Artificial sequence
  SiRNA target sequence
ggtggtaagtggacaatttttcgactt

SEQ ID NO: 140511 - DNA, 27 bp, Artificial sequence
  SiRNA target sequence
gtggtaagtggacaatttttcgactta

SEQ ID NO: 140512 - DNA, 27 bp, Artificial sequence
  SiRNA target sequence
tggtaagtggacaatttttcgacttat

SEQ ID NO: 140513 - DNA, 27 bp, Artificial sequence
  SiRNA target sequence
ggtaagtggacaatttttcgacttatg

SEQ ID NO: 140514 - DNA, 27 bp, Artificial sequence
  SiRNA target sequence
gtaagtggacaatttttcgacttatgg

SEQ ID NO: 140515 - DNA, 27 bp, Artificial sequence
  SiRNA target sequence
taagtggacaatttttcgacttatggg

SEQ ID NO: 140516 - DNA, 27 bp, Artificial sequence
  SiRNA target sequence
aagtggacaatttttcgacttatggga

SEQ ID NO: 140517 - DNA, 27 bp, Artificial sequence
  SiRNA target sequence
agtggacaatttttcgacttatgggag

SEQ ID NO: 140518 - DNA, 27 bp, Artificial sequence
  SiRNA target sequence
gtggacaatttttcgacttatgggaga

SEQ ID NO: 140519 - DNA, 27 bp, Artificial sequence
  SiRNA target sequence
tggacaatttttcgacttatgggagaa

SEQ ID NO: 140520 - DNA, 27 bp, Artificial sequence
  SiRNA target sequence
ggacaatttttcgacttatgggagaac

SEQ ID NO: 140521 - DNA, 27 bp, Artificial sequence
  SiRNA target sequence
gacaatttttcgacttatgggagaaca

SEQ ID NO: 140522 - DNA, 27 bp, Artificial sequence
  SiRNA target sequence
acaatttttcgacttatgggagaacag

SEQ ID NO: 140523 - DNA, 27 bp, Artificial sequence
  SiRNA target sequence
caatttttcgacttatgggagaacaga

SEQ ID NO: 140524 - DNA, 27 bp, Artificial sequence
  SiRNA target sequence
aatttttcgacttatgggagaacagac

SEQ ID NO: 140525 - DNA, 27 bp, Artificial sequence
  SiRNA target sequence
atttttcgacttatgggagaacagaca

SEQ ID NO: 140526 - DNA, 27 bp, Artificial sequence
  SiRNA target sequence
tttttcgacttatgggagaacagacaa

SEQ ID NO: 140527 - DNA, 27 bp, Artificial sequence
  SiRNA target sequence
ttttcgacttatgggagaacagacaat

SEQ ID NO: 140528 - DNA, 27 bp, Artificial sequence
  SiRNA target sequence
tttcgacttatgggagaacagacaata

SEQ ID NO: 140529 - DNA, 27 bp, Artificial sequence
  SiRNA target sequence
ttcgacttatgggagaacagacaataa

SEQ ID NO: 140530 - DNA, 27 bp, Artificial sequence
  SiRNA target sequence
tcgacttatgggagaacagacaataaa

SEQ ID NO: 140531 - DNA, 27 bp, Artificial sequence
  SiRNA target sequence
cgacttatgggagaacagacaataaat

SEQ ID NO: 140532 - DNA, 27 bp, Artificial sequence
  SiRNA target sequence
gacttatgggagaacagacaataaatc

SEQ ID NO: 140533 - DNA, 27 bp, Artificial sequence
  SiRNA target sequence
acttatgggagaacagacaataaatca

SEQ ID NO: 140534 - DNA, 27 bp, Artificial sequence
  SiRNA target sequence
cttatgggagaacagacaataaatcaa

SEQ ID NO: 140535 - DNA, 27 bp, Artificial sequence
  SiRNA target sequence
ttatgggagaacagacaataaatcaaa

SEQ ID NO: 140536 - DNA, 27 bp, Artificial sequence
  SiRNA target sequence
tatgggagaacagacaataaatcaaat

SEQ ID NO: 140537 - DNA, 27 bp, Artificial sequence
  SiRNA target sequence
atgggagaacagacaataaatcaaatt

SEQ ID NO: 140538 - DNA, 27 bp, Artificial sequence
  SiRNA target sequence
tgggagaacagacaataaatcaaatta

SEQ ID NO: 140539 - DNA, 27 bp, Artificial sequence
  SiRNA target sequence
gggagaacagacaataaatcaaattat

SEQ ID NO: 140540 - DNA, 27 bp, Artificial sequence
  SiRNA target sequence
ggagaacagacaataaatcaaattata

SEQ ID NO: 140541 - DNA, 27 bp, Artificial sequence
  SiRNA target sequence
gagaacagacaataaatcaaattataa

SEQ ID NO: 140542 - DNA, 27 bp, Artificial sequence
  SiRNA target sequence
agaacagacaataaatcaaattataaa

SEQ ID NO: 140543 - DNA, 27 bp, Artificial sequence
  SiRNA target sequence
gaacagacaataaatcaaattataaaa

SEQ ID NO: 140544 - DNA, 27 bp, Artificial sequence
  SiRNA target sequence
aacagacaataaatcaaattataaaag

SEQ ID NO: 140545 - DNA, 27 bp, Artificial sequence
  SiRNA target sequence
acagacaataaatcaaattataaaagt

SEQ ID NO: 140546 - DNA, 27 bp, Artificial sequence
  SiRNA target sequence
cagacaataaatcaaattataaaagtt

SEQ ID NO: 140547 - DNA, 27 bp, Artificial sequence
  SiRNA target sequence
agacaataaatcaaattataaaagttt

SEQ ID NO: 140548 - DNA, 27 bp, Artificial sequence
  SiRNA target sequence
gacaataaatcaaattataaaagtttt

SEQ ID NO: 140549 - DNA, 27 bp, Artificial sequence
  SiRNA target sequence
acaataaatcaaattataaaagttttt

SEQ ID NO: 140550 - DNA, 27 bp, Artificial sequence
  SiRNA target sequence
caataaatcaaattataaaagttttta

SEQ ID NO: 140551 - DNA, 27 bp, Artificial sequence
  SiRNA target sequence
aataaatcaaattataaaagtttttaa

SEQ ID NO: 140552 - DNA, 27 bp, Artificial sequence
  SiRNA target sequence
ataaatcaaattataaaagtttttaat

SEQ ID NO: 140553 - DNA, 27 bp, Artificial sequence
  SiRNA target sequence
taaatcaaattataaaagtttttaata

SEQ ID NO: 140554 - DNA, 27 bp, Artificial sequence
  SiRNA target sequence
aaatcaaattataaaagtttttaatat

SEQ ID NO: 140555 - DNA, 27 bp, Artificial sequence
  SiRNA target sequence
aatcaaattataaaagtttttaatata

SEQ ID NO: 140556 - DNA, 27 bp, Artificial sequence
  SiRNA target sequence
atcaaattataaaagtttttaatataa

SEQ ID NO: 140557 - DNA, 27 bp, Artificial sequence
  SiRNA target sequence
tcaaattataaaagtttttaatataaa

SEQ ID NO: 140558 - DNA, 27 bp, Artificial sequence
  SiRNA target sequence
caaattataaaagtttttaatataaag

SEQ ID NO: 140559 - DNA, 27 bp, Artificial sequence
  SiRNA target sequence
aaattataaaagtttttaatataaagt

SEQ ID NO: 140560 - DNA, 27 bp, Artificial sequence
  SiRNA target sequence
aattataaaagtttttaatataaagtc

SEQ ID NO: 140561 - DNA, 27 bp, Artificial sequence
  SiRNA target sequence
attataaaagtttttaatataaagtct

SEQ ID NO: 140562 - DNA, 27 bp, Artificial sequence
  SiRNA target sequence
ttataaaagtttttaatataaagtcta

SEQ ID NO: 140563 - DNA, 27 bp, Artificial sequence
  SiRNA target sequence
tataaaagtttttaatataaagtctaa

SEQ ID NO: 140564 - DNA, 27 bp, Artificial sequence
  SiRNA target sequence
ataaaagtttttaatataaagtctaat

SEQ ID NO: 140565 - DNA, 27 bp, Artificial sequence
  SiRNA target sequence
taaaagtttttaatataaagtctaata

SEQ ID NO: 140566 - DNA, 27 bp, Artificial sequence
  SiRNA target sequence
aaaagtttttaatataaagtctaataa

SEQ ID NO: 140567 - DNA, 27 bp, Artificial sequence
  SiRNA target sequence
aaagtttttaatataaagtctaataaa

SEQ ID NO: 140568 - DNA, 27 bp, Artificial sequence
  SiRNA target sequence
aagtttttaatataaagtctaataaac

SEQ ID NO: 140569 - DNA, 27 bp, Artificial sequence
  SiRNA target sequence
agtttttaatataaagtctaataaacc

SEQ ID NO: 140570 - DNA, 27 bp, Artificial sequence
  SiRNA target sequence
gtttttaatataaagtctaataaacca

SEQ ID NO: 140571 - DNA, 27 bp, Artificial sequence
  SiRNA target sequence
tttttaatataaagtctaataaaccaa

SEQ ID NO: 140572 - DNA, 27 bp, Artificial sequence
  SiRNA target sequence
ttttaatataaagtctaataaaccaag

SEQ ID NO: 140573 - DNA, 27 bp, Artificial sequence
  SiRNA target sequence
tttaatataaagtctaataaaccaagt

SEQ ID NO: 140574 - DNA, 27 bp, Artificial sequence
  SiRNA target sequence
ttaatataaagtctaataaaccaagta

SEQ ID NO: 140575 - DNA, 27 bp, Artificial sequence
  SiRNA target sequence
taatataaagtctaataaaccaagtat

SEQ ID NO: 140576 - DNA, 27 bp, Artificial sequence
  SiRNA target sequence
aatataaagtctaataaaccaagtata

SEQ ID NO: 140577 - DNA, 27 bp, Artificial sequence
  SiRNA target sequence
atataaagtctaataaaccaagtataa

SEQ ID NO: 140578 - DNA, 27 bp, Artificial sequence
  SiRNA target sequence
tataaagtctaataaaccaagtataac

SEQ ID NO: 140579 - DNA, 27 bp, Artificial sequence
  SiRNA target sequence
ataaagtctaataaaccaagtataaca

SEQ ID NO: 140580 - DNA, 27 bp, Artificial sequence
  SiRNA target sequence
taaagtctaataaaccaagtataacac

SEQ ID NO: 140581 - DNA, 27 bp, Artificial sequence
  SiRNA target sequence
aaagtctaataaaccaagtataacaca

SEQ ID NO: 140582 - DNA, 27 bp, Artificial sequence
  SiRNA target sequence
aagtctaataaaccaagtataacacaa

SEQ ID NO: 140583 - DNA, 27 bp, Artificial sequence
  SiRNA target sequence
agtctaataaaccaagtataacacaat

SEQ ID NO: 140584 - DNA, 27 bp, Artificial sequence
  SiRNA target sequence
gtctaataaaccaagtataacacaata

SEQ ID NO: 140585 - DNA, 27 bp, Artificial sequence
  SiRNA target sequence
tctaataaaccaagtataacacaatat

SEQ ID NO: 140586 - DNA, 27 bp, Artificial sequence
  SiRNA target sequence
ctaataaaccaagtataacacaatatc

SEQ ID NO: 140587 - DNA, 27 bp, Artificial sequence
  SiRNA target sequence
taataaaccaagtataacacaatatct

SEQ ID NO: 140588 - DNA, 27 bp, Artificial sequence
  SiRNA target sequence
aataaaccaagtataacacaatatctt

SEQ ID NO: 140589 - DNA, 27 bp, Artificial sequence
  SiRNA target sequence
ataaaccaagtataacacaatatcttc

SEQ ID NO: 140590 - DNA, 27 bp, Artificial sequence
  SiRNA target sequence
taaaccaagtataacacaatatcttcc

SEQ ID NO: 140591 - DNA, 27 bp, Artificial sequence
  SiRNA target sequence
aaaccaagtataacacaatatcttcct

SEQ ID NO: 140592 - DNA, 27 bp, Artificial sequence
  SiRNA target sequence
aaccaagtataacacaatatcttcctg

SEQ ID NO: 140593 - DNA, 27 bp, Artificial sequence
  SiRNA target sequence
accaagtataacacaatatcttcctgt

SEQ ID NO: 140594 - DNA, 27 bp, Artificial sequence
  SiRNA target sequence
ccaagtataacacaatatcttcctgtt

SEQ ID NO: 140595 - DNA, 27 bp, Artificial sequence
  SiRNA target sequence
caagtataacacaatatcttcctgttt

SEQ ID NO: 140596 - DNA, 27 bp, Artificial sequence
  SiRNA target sequence
aagtataacacaatatcttcctgtttt

SEQ ID NO: 140597 - DNA, 27 bp, Artificial sequence
  SiRNA target sequence
agtataacacaatatcttcctgttttg

SEQ ID NO: 140598 - DNA, 27 bp, Artificial sequence
  SiRNA target sequence
gtataacacaatatcttcctgttttgg

SEQ ID NO: 140599 - DNA, 27 bp, Artificial sequence
  SiRNA target sequence
tataacacaatatcttcctgttttggg

SEQ ID NO: 140600 - DNA, 27 bp, Artificial sequence
  SiRNA target sequence
ataacacaatatcttcctgttttggga

SEQ ID NO: 140601 - DNA, 27 bp, Artificial sequence
  SiRNA target sequence
taacacaatatcttcctgttttgggat

SEQ ID NO: 140602 - DNA, 27 bp, Artificial sequence
  SiRNA target sequence
aacacaatatcttcctgttttgggatc

SEQ ID NO: 140603 - DNA, 27 bp, Artificial sequence
  SiRNA target sequence
acacaatatcttcctgttttgggatca

SEQ ID NO: 140604 - DNA, 27 bp, Artificial sequence
  SiRNA target sequence
cacaatatcttcctgttttgggatcac

SEQ ID NO: 140605 - DNA, 27 bp, Artificial sequence
  SiRNA target sequence
acaatatcttcctgttttgggatcaca

SEQ ID NO: 140606 - DNA, 27 bp, Artificial sequence
  SiRNA target sequence
caatatcttcctgttttgggatcacag

SEQ ID NO: 140607 - DNA, 27 bp, Artificial sequence
  SiRNA target sequence
aatatcttcctgttttgggatcacagg

SEQ ID NO: 140608 - DNA, 27 bp, Artificial sequence
  SiRNA target sequence
atatcttcctgttttgggatcacaggg

SEQ ID NO: 140609 - DNA, 27 bp, Artificial sequence
  SiRNA target sequence
tatcttcctgttttgggatcacaggga

SEQ ID NO: 140610 - DNA, 27 bp, Artificial sequence
  SiRNA target sequence
atcttcctgttttgggatcacagggat

SEQ ID NO: 140611 - DNA, 27 bp, Artificial sequence
  SiRNA target sequence
tcttcctgttttgggatcacagggata

SEQ ID NO: 140612 - DNA, 27 bp, Artificial sequence
  SiRNA target sequence
cttcctgttttgggatcacagggatat

SEQ ID NO: 140613 - DNA, 27 bp, Artificial sequence
  SiRNA target sequence
ttcctgttttgggatcacagggatata

SEQ ID NO: 140614 - DNA, 27 bp, Artificial sequence
  SiRNA target sequence
tcctgttttgggatcacagggatatac

SEQ ID NO: 140615 - DNA, 27 bp, Artificial sequence
  SiRNA target sequence
cctgttttgggatcacagggatatact

SEQ ID NO: 140616 - DNA, 27 bp, Artificial sequence
  SiRNA target sequence
ctgttttgggatcacagggatatacta

SEQ ID NO: 140617 - DNA, 27 bp, Artificial sequence
  SiRNA target sequence
tgttttgggatcacagggatatactaa

SEQ ID NO: 140618 - DNA, 27 bp, Artificial sequence
  SiRNA target sequence
gttttgggatcacagggatatactaaa

SEQ ID NO: 140619 - DNA, 27 bp, Artificial sequence
  SiRNA target sequence
ttttgggatcacagggatatactaaag

SEQ ID NO: 140620 - DNA, 27 bp, Artificial sequence
  SiRNA target sequence
tttgggatcacagggatatactaaagc

SEQ ID NO: 140621 - DNA, 27 bp, Artificial sequence
  SiRNA target sequence
ttgggatcacagggatatactaaagct

SEQ ID NO: 140622 - DNA, 27 bp, Artificial sequence
  SiRNA target sequence
tgggatcacagggatatactaaagcta

SEQ ID NO: 140623 - DNA, 27 bp, Artificial sequence
  SiRNA target sequence
gggatcacagggatatactaaagctac

SEQ ID NO: 140624 - DNA, 27 bp, Artificial sequence
  SiRNA target sequence
ggatcacagggatatactaaagctaca

SEQ ID NO: 140625 - DNA, 27 bp, Artificial sequence
  SiRNA target sequence
gatcacagggatatactaaagctacag

SEQ ID NO: 140626 - DNA, 27 bp, Artificial sequence
  SiRNA target sequence
atcacagggatatactaaagctacaga

SEQ ID NO: 140627 - DNA, 27 bp, Artificial sequence
  SiRNA target sequence
tcacagggatatactaaagctacagaa

SEQ ID NO: 140628 - DNA, 27 bp, Artificial sequence
  SiRNA target sequence
cacagggatatactaaagctacagaat

SEQ ID NO: 140629 - DNA, 27 bp, Artificial sequence
  SiRNA target sequence
acagggatatactaaagctacagaatt

SEQ ID NO: 140630 - DNA, 27 bp, Artificial sequence
  SiRNA target sequence
cagggatatactaaagctacagaattt

SEQ ID NO: 140631 - DNA, 27 bp, Artificial sequence
  SiRNA target sequence
agggatatactaaagctacagaatttg

SEQ ID NO: 140632 - DNA, 27 bp, Artificial sequence
  SiRNA target sequence
gggatatactaaagctacagaatttga

SEQ ID NO: 140633 - DNA, 27 bp, Artificial sequence
  SiRNA target sequence
ggatatactaaagctacagaatttgat

SEQ ID NO: 140634 - DNA, 27 bp, Artificial sequence
  SiRNA target sequence
gatatactaaagctacagaatttgatt

SEQ ID NO: 140635 - DNA, 27 bp, Artificial sequence
  SiRNA target sequence
atatactaaagctacagaatttgattt

SEQ ID NO: 140636 - DNA, 27 bp, Artificial sequence
  SiRNA target sequence
tatactaaagctacagaatttgatttg

SEQ ID NO: 140637 - DNA, 27 bp, Artificial sequence
  SiRNA target sequence
atactaaagctacagaatttgatttgg

SEQ ID NO: 140638 - DNA, 27 bp, Artificial sequence
  SiRNA target sequence
tactaaagctacagaatttgatttggc

SEQ ID NO: 140639 - DNA, 27 bp, Artificial sequence
  SiRNA target sequence
actaaagctacagaatttgatttggca

SEQ ID NO: 140640 - DNA, 27 bp, Artificial sequence
  SiRNA target sequence
ctaaagctacagaatttgatttggcac

SEQ ID NO: 140641 - DNA, 27 bp, Artificial sequence
  SiRNA target sequence
taaagctacagaatttgatttggcact

SEQ ID NO: 140642 - DNA, 27 bp, Artificial sequence
  SiRNA target sequence
aaagctacagaatttgatttggcactt

SEQ ID NO: 140643 - DNA, 27 bp, Artificial sequence
  SiRNA target sequence
aagctacagaatttgatttggcactta

SEQ ID NO: 140644 - DNA, 27 bp, Artificial sequence
  SiRNA target sequence
agctacagaatttgatttggcacttac

SEQ ID NO: 140645 - DNA, 27 bp, Artificial sequence
  SiRNA target sequence
gctacagaatttgatttggcacttact

SEQ ID NO: 140646 - DNA, 27 bp, Artificial sequence
  SiRNA target sequence
ctacagaatttgatttggcacttactt

SEQ ID NO: 140647 - DNA, 27 bp, Artificial sequence
  SiRNA target sequence
tacagaatttgatttggcacttacttt

SEQ ID NO: 140648 - DNA, 27 bp, Artificial sequence
  SiRNA target sequence
acagaatttgatttggcacttacttta

SEQ ID NO: 140649 - DNA, 27 bp, Artificial sequence
  SiRNA target sequence
cagaatttgatttggcacttactttaa

SEQ ID NO: 140650 - DNA, 27 bp, Artificial sequence
  SiRNA target sequence
agaatttgatttggcacttactttaaa

SEQ ID NO: 140651 - DNA, 27 bp, Artificial sequence
  SiRNA target sequence
gaatttgatttggcacttactttaaat

SEQ ID NO: 140652 - DNA, 27 bp, Artificial sequence
  SiRNA target sequence
aatttgatttggcacttactttaaata

SEQ ID NO: 140653 - DNA, 27 bp, Artificial sequence
  SiRNA target sequence
atttgatttggcacttactttaaatat

SEQ ID NO: 140654 - DNA, 27 bp, Artificial sequence
  SiRNA target sequence
tttgatttggcacttactttaaatatt

SEQ ID NO: 140655 - DNA, 27 bp, Artificial sequence
  SiRNA target sequence
ttgatttggcacttactttaaatattc

SEQ ID NO: 140656 - DNA, 27 bp, Artificial sequence
  SiRNA target sequence
tgatttggcacttactttaaatattcc

SEQ ID NO: 140657 - DNA, 27 bp, Artificial sequence
  SiRNA target sequence
gatttggcacttactttaaatattcca

SEQ ID NO: 140658 - DNA, 27 bp, Artificial sequence
  SiRNA target sequence
atttggcacttactttaaatattccag

SEQ ID NO: 140659 - DNA, 27 bp, Artificial sequence
  SiRNA target sequence
tttggcacttactttaaatattccaga

SEQ ID NO: 140660 - DNA, 27 bp, Artificial sequence
  SiRNA target sequence
ttggcacttactttaaatattccagaa

SEQ ID NO: 140661 - DNA, 27 bp, Artificial sequence
  SiRNA target sequence
tggcacttactttaaatattccagaag

SEQ ID NO: 140662 - DNA, 27 bp, Artificial sequence
  SiRNA target sequence
ggcacttactttaaatattccagaaga

SEQ ID NO: 140663 - DNA, 27 bp, Artificial sequence
  SiRNA target sequence
gcacttactttaaatattccagaagat

SEQ ID NO: 140664 - DNA, 27 bp, Artificial sequence
  SiRNA target sequence
cacttactttaaatattccagaagata

SEQ ID NO: 140665 - DNA, 27 bp, Artificial sequence
  SiRNA target sequence
acttactttaaatattccagaagatat

SEQ ID NO: 140666 - DNA, 27 bp, Artificial sequence
  SiRNA target sequence
cttactttaaatattccagaagatata

SEQ ID NO: 140667 - DNA, 27 bp, Artificial sequence
  SiRNA target sequence
ttactttaaatattccagaagatatag

SEQ ID NO: 140668 - DNA, 27 bp, Artificial sequence
  SiRNA target sequence
tactttaaatattccagaagatatagc

SEQ ID NO: 140669 - DNA, 27 bp, Artificial sequence
  SiRNA target sequence
actttaaatattccagaagatatagct

SEQ ID NO: 140670 - DNA, 27 bp, Artificial sequence
  SiRNA target sequence
ctttaaatattccagaagatatagcta

SEQ ID NO: 140671 - DNA, 27 bp, Artificial sequence
  SiRNA target sequence
tttaaatattccagaagatatagctaa

SEQ ID NO: 140672 - DNA, 27 bp, Artificial sequence
  SiRNA target sequence
ttaaatattccagaagatatagctaag

SEQ ID NO: 140673 - DNA, 27 bp, Artificial sequence
  SiRNA target sequence
taaatattccagaagatatagctaagc

SEQ ID NO: 140674 - DNA, 27 bp, Artificial sequence
  SiRNA target sequence
aaatattccagaagatatagctaagca

SEQ ID NO: 140675 - DNA, 27 bp, Artificial sequence
  SiRNA target sequence
aatattccagaagatatagctaagcat

SEQ ID NO: 140676 - DNA, 27 bp, Artificial sequence
  SiRNA target sequence
atattccagaagatatagctaagcatt

SEQ ID NO: 140677 - DNA, 27 bp, Artificial sequence
  SiRNA target sequence
tattccagaagatatagctaagcattt

SEQ ID NO: 140678 - DNA, 27 bp, Artificial sequence
  SiRNA target sequence
attccagaagatatagctaagcattta

SEQ ID NO: 140679 - DNA, 27 bp, Artificial sequence
  SiRNA target sequence
ttccagaagatatagctaagcatttag

SEQ ID NO: 140680 - DNA, 27 bp, Artificial sequence
  SiRNA target sequence
tccagaagatatagctaagcatttagc

SEQ ID NO: 140681 - DNA, 27 bp, Artificial sequence
  SiRNA target sequence
ccagaagatatagctaagcatttagct

SEQ ID NO: 140682 - DNA, 27 bp, Artificial sequence
  SiRNA target sequence
cagaagatatagctaagcatttagcta

SEQ ID NO: 140683 - DNA, 27 bp, Artificial sequence
  SiRNA target sequence
agaagatatagctaagcatttagctac

SEQ ID NO: 140684 - DNA, 27 bp, Artificial sequence
  SiRNA target sequence
gaagatatagctaagcatttagctaca

SEQ ID NO: 140685 - DNA, 27 bp, Artificial sequence
  SiRNA target sequence
aagatatagctaagcatttagctacaa

SEQ ID NO: 140686 - DNA, 27 bp, Artificial sequence
  SiRNA target sequence
agatatagctaagcatttagctacaac

SEQ ID NO: 140687 - DNA, 27 bp, Artificial sequence
  SiRNA target sequence
gatatagctaagcatttagctacaact

SEQ ID NO: 140688 - DNA, 27 bp, Artificial sequence
  SiRNA target sequence
atatagctaagcatttagctacaactt

SEQ ID NO: 140689 - DNA, 27 bp, Artificial sequence
  SiRNA target sequence
tatagctaagcatttagctacaactta

SEQ ID NO: 140690 - DNA, 27 bp, Artificial sequence
  SiRNA target sequence
atagctaagcatttagctacaacttat

SEQ ID NO: 140691 - DNA, 27 bp, Artificial sequence
  SiRNA target sequence
tagctaagcatttagctacaacttatg

SEQ ID NO: 140692 - DNA, 27 bp, Artificial sequence
  SiRNA target sequence
agctaagcatttagctacaacttatgg

SEQ ID NO: 140693 - DNA, 27 bp, Artificial sequence
  SiRNA target sequence
gctaagcatttagctacaacttatggt

SEQ ID NO: 140694 - DNA, 27 bp, Artificial sequence
  SiRNA target sequence
ctaagcatttagctacaacttatggta

SEQ ID NO: 140695 - DNA, 27 bp, Artificial sequence
  SiRNA target sequence
taagcatttagctacaacttatggtac

SEQ ID NO: 140696 - DNA, 27 bp, Artificial sequence
  SiRNA target sequence
aagcatttagctacaacttatggtacc

SEQ ID NO: 140697 - DNA, 27 bp, Artificial sequence
  SiRNA target sequence
agcatttagctacaacttatggtacca

SEQ ID NO: 140698 - DNA, 27 bp, Artificial sequence
  SiRNA target sequence
gcatttagctacaacttatggtaccaa

SEQ ID NO: 140699 - DNA, 27 bp, Artificial sequence
  SiRNA target sequence
catttagctacaacttatggtaccaaa

SEQ ID NO: 140700 - DNA, 27 bp, Artificial sequence
  SiRNA target sequence
atttagctacaacttatggtaccaaag

SEQ ID NO: 140701 - DNA, 27 bp, Artificial sequence
  SiRNA target sequence
tttagctacaacttatggtaccaaagc

SEQ ID NO: 140702 - DNA, 27 bp, Artificial sequence
  SiRNA target sequence
ttagctacaacttatggtaccaaagct

SEQ ID NO: 140703 - DNA, 27 bp, Artificial sequence
  SiRNA target sequence
tagctacaacttatggtaccaaagctt

SEQ ID NO: 140704 - DNA, 27 bp, Artificial sequence
  SiRNA target sequence
agctacaacttatggtaccaaagctta

SEQ ID NO: 140705 - DNA, 27 bp, Artificial sequence
  SiRNA target sequence
gctacaacttatggtaccaaagcttac

SEQ ID NO: 140706 - DNA, 27 bp, Artificial sequence
  SiRNA target sequence
ctacaacttatggtaccaaagcttaca

SEQ ID NO: 140707 - DNA, 27 bp, Artificial sequence
  SiRNA target sequence
tacaacttatggtaccaaagcttacaa

SEQ ID NO: 140708 - DNA, 27 bp, Artificial sequence
  SiRNA target sequence
acaacttatggtaccaaagcttacaat

SEQ ID NO: 140709 - DNA, 27 bp, Artificial sequence
  SiRNA target sequence
caacttatggtaccaaagcttacaatt

SEQ ID NO: 140710 - DNA, 27 bp, Artificial sequence
  SiRNA target sequence
aacttatggtaccaaagcttacaattt

SEQ ID NO: 140711 - DNA, 27 bp, Artificial sequence
  SiRNA target sequence
acttatggtaccaaagcttacaatttc

SEQ ID NO: 140712 - DNA, 27 bp, Artificial sequence
  SiRNA target sequence
cttatggtaccaaagcttacaatttct

SEQ ID NO: 140713 - DNA, 27 bp, Artificial sequence
  SiRNA target sequence
ttatggtaccaaagcttacaatttctc

SEQ ID NO: 140714 - DNA, 27 bp, Artificial sequence
  SiRNA target sequence
tatggtaccaaagcttacaatttctct

SEQ ID NO: 140715 - DNA, 27 bp, Artificial sequence
  SiRNA target sequence
atggtaccaaagcttacaatttctctg

SEQ ID NO: 140716 - DNA, 27 bp, Artificial sequence
  SiRNA target sequence
tggtaccaaagcttacaatttctctga

SEQ ID NO: 140717 - DNA, 27 bp, Artificial sequence
  SiRNA target sequence
ggtaccaaagcttacaatttctctgaa

SEQ ID NO: 140718 - DNA, 27 bp, Artificial sequence
  SiRNA target sequence
gtaccaaagcttacaatttctctgaat

SEQ ID NO: 140719 - DNA, 27 bp, Artificial sequence
  SiRNA target sequence
taccaaagcttacaatttctctgaata

SEQ ID NO: 140720 - DNA, 27 bp, Artificial sequence
  SiRNA target sequence
accaaagcttacaatttctctgaatac

SEQ ID NO: 140721 - DNA, 27 bp, Artificial sequence
  SiRNA target sequence
ccaaagcttacaatttctctgaatact

SEQ ID NO: 140722 - DNA, 27 bp, Artificial sequence
  SiRNA target sequence
caaagcttacaatttctctgaatactt

SEQ ID NO: 140723 - DNA, 27 bp, Artificial sequence
  SiRNA target sequence
aaagcttacaatttctctgaatacttt

SEQ ID NO: 140724 - DNA, 27 bp, Artificial sequence
  SiRNA target sequence
aagcttacaatttctctgaatacttta

SEQ ID NO: 140725 - DNA, 27 bp, Artificial sequence
  SiRNA target sequence
agcttacaatttctctgaatactttaa

SEQ ID NO: 140726 - DNA, 27 bp, Artificial sequence
  SiRNA target sequence
gcttacaatttctctgaatactttaat

SEQ ID NO: 140727 - DNA, 27 bp, Artificial sequence
  SiRNA target sequence
cttacaatttctctgaatactttaatg

SEQ ID NO: 140728 - DNA, 27 bp, Artificial sequence
  SiRNA target sequence
ttacaatttctctgaatactttaatgg

SEQ ID NO: 140729 - DNA, 27 bp, Artificial sequence
  SiRNA target sequence
tacaatttctctgaatactttaatggg

SEQ ID NO: 140730 - DNA, 27 bp, Artificial sequence
  SiRNA target sequence
acaatttctctgaatactttaatgggt

SEQ ID NO: 140731 - DNA, 27 bp, Artificial sequence
  SiRNA target sequence
caatttctctgaatactttaatgggtc

SEQ ID NO: 140732 - DNA, 27 bp, Artificial sequence
  SiRNA target sequence
aatttctctgaatactttaatgggtca

SEQ ID NO: 140733 - DNA, 27 bp, Artificial sequence
  SiRNA target sequence
atttctctgaatactttaatgggtcat

SEQ ID NO: 140734 - DNA, 27 bp, Artificial sequence
  SiRNA target sequence
tttctctgaatactttaatgggtcata

SEQ ID NO: 140735 - DNA, 27 bp, Artificial sequence
  SiRNA target sequence
ttctctgaatactttaatgggtcatac

SEQ ID NO: 140736 - DNA, 27 bp, Artificial sequence
  SiRNA target sequence
tctctgaatactttaatgggtcataca

SEQ ID NO: 140737 - DNA, 27 bp, Artificial sequence
  SiRNA target sequence
ctctgaatactttaatgggtcatacac

SEQ ID NO: 140738 - DNA, 27 bp, Artificial sequence
  SiRNA target sequence
tctgaatactttaatgggtcatacacc

SEQ ID NO: 140739 - DNA, 27 bp, Artificial sequence
  SiRNA target sequence
ctgaatactttaatgggtcatacacca

SEQ ID NO: 140740 - DNA, 27 bp, Artificial sequence
  SiRNA target sequence
tgaatactttaatgggtcatacaccag

SEQ ID NO: 140741 - DNA, 27 bp, Artificial sequence
  SiRNA target sequence
gaatactttaatgggtcatacaccaga

SEQ ID NO: 140742 - DNA, 27 bp, Artificial sequence
  SiRNA target sequence
aatactttaatgggtcatacaccagac

SEQ ID NO: 140743 - DNA, 27 bp, Artificial sequence
  SiRNA target sequence
atactttaatgggtcatacaccagact

SEQ ID NO: 140744 - DNA, 27 bp, Artificial sequence
  SiRNA target sequence
tactttaatgggtcatacaccagactt

SEQ ID NO: 140745 - DNA, 27 bp, Artificial sequence
  SiRNA target sequence
actttaatgggtcatacaccagactta

SEQ ID NO: 140746 - DNA, 27 bp, Artificial sequence
  SiRNA target sequence
ctttaatgggtcatacaccagacttac

SEQ ID NO: 140747 - DNA, 27 bp, Artificial sequence
  SiRNA target sequence
tttaatgggtcatacaccagacttaca

SEQ ID NO: 140748 - DNA, 27 bp, Artificial sequence
  SiRNA target sequence
ttaatgggtcatacaccagacttacag

SEQ ID NO: 140749 - DNA, 27 bp, Artificial sequence
  SiRNA target sequence
taatgggtcatacaccagacttacaga

SEQ ID NO: 140750 - DNA, 27 bp, Artificial sequence
  SiRNA target sequence
aatgggtcatacaccagacttacagat

SEQ ID NO: 140751 - DNA, 27 bp, Artificial sequence
  SiRNA target sequence
atgggtcatacaccagacttacagatg

SEQ ID NO: 140752 - DNA, 27 bp, Artificial sequence
  SiRNA target sequence
tgggtcatacaccagacttacagatgg

SEQ ID NO: 140753 - DNA, 27 bp, Artificial sequence
  SiRNA target sequence
gggtcatacaccagacttacagatggt

SEQ ID NO: 140754 - DNA, 27 bp, Artificial sequence
  SiRNA target sequence
ggtcatacaccagacttacagatggtt

SEQ ID NO: 140755 - DNA, 27 bp, Artificial sequence
  SiRNA target sequence
gtcatacaccagacttacagatggtta

SEQ ID NO: 140756 - DNA, 27 bp, Artificial sequence
  SiRNA target sequence
tcatacaccagacttacagatggttat

SEQ ID NO: 140757 - DNA, 27 bp, Artificial sequence
  SiRNA target sequence
catacaccagacttacagatggttatc

SEQ ID NO: 140758 - DNA, 27 bp, Artificial sequence
  SiRNA target sequence
atacaccagacttacagatggttatcc

SEQ ID NO: 140759 - DNA, 27 bp, Artificial sequence
  SiRNA target sequence
tacaccagacttacagatggttatcct

SEQ ID NO: 140760 - DNA, 27 bp, Artificial sequence
  SiRNA target sequence
acaccagacttacagatggttatcctt

SEQ ID NO: 140761 - DNA, 27 bp, Artificial sequence
  SiRNA target sequence
caccagacttacagatggttatcctta

SEQ ID NO: 140762 - DNA, 27 bp, Artificial sequence
  SiRNA target sequence
accagacttacagatggttatccttat

SEQ ID NO: 140763 - DNA, 27 bp, Artificial sequence
  SiRNA target sequence
ccagacttacagatggttatccttata

SEQ ID NO: 140764 - DNA, 27 bp, Artificial sequence
  SiRNA target sequence
cagacttacagatggttatccttatac

SEQ ID NO: 140765 - DNA, 27 bp, Artificial sequence
  SiRNA target sequence
agacttacagatggttatccttataca

SEQ ID NO: 140766 - DNA, 27 bp, Artificial sequence
  SiRNA target sequence
gacttacagatggttatccttatacaa

SEQ ID NO: 140767 - DNA, 27 bp, Artificial sequence
  SiRNA target sequence
acttacagatggttatccttatacaaa

SEQ ID NO: 140768 - DNA, 27 bp, Artificial sequence
  SiRNA target sequence
cttacagatggttatccttatacaaaa

SEQ ID NO: 140769 - DNA, 27 bp, Artificial sequence
  SiRNA target sequence
ttacagatggttatccttatacaaaag

SEQ ID NO: 140770 - DNA, 27 bp, Artificial sequence
  SiRNA target sequence
tacagatggttatccttatacaaaaga

SEQ ID NO: 140771 - DNA, 27 bp, Artificial sequence
  SiRNA target sequence
acagatggttatccttatacaaaagaa

SEQ ID NO: 140772 - DNA, 27 bp, Artificial sequence
  SiRNA target sequence
cagatggttatccttatacaaaagaag

SEQ ID NO: 140773 - DNA, 27 bp, Artificial sequence
  SiRNA target sequence
agatggttatccttatacaaaagaaga

SEQ ID NO: 140774 - DNA, 27 bp, Artificial sequence
  SiRNA target sequence
gatggttatccttatacaaaagaagaa

SEQ ID NO: 140775 - DNA, 27 bp, Artificial sequence
  SiRNA target sequence
atggttatccttatacaaaagaagaaa

SEQ ID NO: 140776 - DNA, 27 bp, Artificial sequence
  SiRNA target sequence
tggttatccttatacaaaagaagaaat

SEQ ID NO: 140777 - DNA, 27 bp, Artificial sequence
  SiRNA target sequence
ggttatccttatacaaaagaagaaata

SEQ ID NO: 140778 - DNA, 27 bp, Artificial sequence
  SiRNA target sequence
gttatccttatacaaaagaagaaatag

SEQ ID NO: 140779 - DNA, 27 bp, Artificial sequence
  SiRNA target sequence
ttatccttatacaaaagaagaaatagt

SEQ ID NO: 140780 - DNA, 27 bp, Artificial sequence
  SiRNA target sequence
tatccttatacaaaagaagaaatagta

SEQ ID NO: 140781 - DNA, 27 bp, Artificial sequence
  SiRNA target sequence
atccttatacaaaagaagaaatagtat

SEQ ID NO: 140782 - DNA, 27 bp, Artificial sequence
  SiRNA target sequence
tccttatacaaaagaagaaatagtata

SEQ ID NO: 140783 - DNA, 27 bp, Artificial sequence
  SiRNA target sequence
ccttatacaaaagaagaaatagtatat

SEQ ID NO: 140784 - DNA, 27 bp, Artificial sequence
  SiRNA target sequence
cttatacaaaagaagaaatagtatatt

SEQ ID NO: 140785 - DNA, 27 bp, Artificial sequence
  SiRNA target sequence
ttatacaaaagaagaaatagtatattg

SEQ ID NO: 140786 - DNA, 27 bp, Artificial sequence
  SiRNA target sequence
tatacaaaagaagaaatagtatattgt

SEQ ID NO: 140787 - DNA, 27 bp, Artificial sequence
  SiRNA target sequence
atacaaaagaagaaatagtatattgta

SEQ ID NO: 140788 - DNA, 27 bp, Artificial sequence
  SiRNA target sequence
tacaaaagaagaaatagtatattgtat

SEQ ID NO: 140789 - DNA, 27 bp, Artificial sequence
  SiRNA target sequence
acaaaagaagaaatagtatattgtatc

SEQ ID NO: 140790 - DNA, 27 bp, Artificial sequence
  SiRNA target sequence
caaaagaagaaatagtatattgtatcg

SEQ ID NO: 140791 - DNA, 27 bp, Artificial sequence
  SiRNA target sequence
aaaagaagaaatagtatattgtatcga

SEQ ID NO: 140792 - DNA, 27 bp, Artificial sequence
  SiRNA target sequence
aaagaagaaatagtatattgtatcgaa

SEQ ID NO: 140793 - DNA, 27 bp, Artificial sequence
  SiRNA target sequence
aagaagaaatagtatattgtatcgaac

SEQ ID NO: 140794 - DNA, 27 bp, Artificial sequence
  SiRNA target sequence
agaagaaatagtatattgtatcgaaca

SEQ ID NO: 140795 - DNA, 27 bp, Artificial sequence
  SiRNA target sequence
gaagaaatagtatattgtatcgaacat

SEQ ID NO: 140796 - DNA, 27 bp, Artificial sequence
  SiRNA target sequence
aagaaatagtatattgtatcgaacatg

SEQ ID NO: 140797 - DNA, 27 bp, Artificial sequence
  SiRNA target sequence
agaaatagtatattgtatcgaacatga

SEQ ID NO: 140798 - DNA, 27 bp, Artificial sequence
  SiRNA target sequence
gaaatagtatattgtatcgaacatgaa

SEQ ID NO: 140799 - DNA, 27 bp, Artificial sequence
  SiRNA target sequence
aaatagtatattgtatcgaacatgaat

SEQ ID NO: 140800 - DNA, 27 bp, Artificial sequence
  SiRNA target sequence
aatagtatattgtatcgaacatgaatt

SEQ ID NO: 140801 - DNA, 27 bp, Artificial sequence
  SiRNA target sequence
atagtatattgtatcgaacatgaattg

SEQ ID NO: 140802 - DNA, 27 bp, Artificial sequence
  SiRNA target sequence
tagtatattgtatcgaacatgaattgg

SEQ ID NO: 140803 - DNA, 27 bp, Artificial sequence
  SiRNA target sequence
agtatattgtatcgaacatgaattggc

SEQ ID NO: 140804 - DNA, 27 bp, Artificial sequence
  SiRNA target sequence
gtatattgtatcgaacatgaattggct

SEQ ID NO: 140805 - DNA, 27 bp, Artificial sequence
  SiRNA target sequence
tatattgtatcgaacatgaattggctt

SEQ ID NO: 140806 - DNA, 27 bp, Artificial sequence
  SiRNA target sequence
atattgtatcgaacatgaattggctta

SEQ ID NO: 140807 - DNA, 27 bp, Artificial sequence
  SiRNA target sequence
tattgtatcgaacatgaattggcttat

SEQ ID NO: 140808 - DNA, 27 bp, Artificial sequence
  SiRNA target sequence
attgtatcgaacatgaattggcttatc

SEQ ID NO: 140809 - DNA, 27 bp, Artificial sequence
  SiRNA target sequence
ttgtatcgaacatgaattggcttatcg

SEQ ID NO: 140810 - DNA, 27 bp, Artificial sequence
  SiRNA target sequence
tgtatcgaacatgaattggcttatcgc

SEQ ID NO: 140811 - DNA, 27 bp, Artificial sequence
  SiRNA target sequence
gtatcgaacatgaattggcttatcgca

SEQ ID NO: 140812 - DNA, 27 bp, Artificial sequence
  SiRNA target sequence
tatcgaacatgaattggcttatcgcat

SEQ ID NO: 140813 - DNA, 27 bp, Artificial sequence
  SiRNA target sequence
atcgaacatgaattggcttatcgcatc

SEQ ID NO: 140814 - DNA, 27 bp, Artificial sequence
  SiRNA target sequence
tcgaacatgaattggcttatcgcatca

SEQ ID NO: 140815 - DNA, 27 bp, Artificial sequence
  SiRNA target sequence
cgaacatgaattggcttatcgcatcag

SEQ ID NO: 140816 - DNA, 27 bp, Artificial sequence
  SiRNA target sequence
gaacatgaattggcttatcgcatcagt

SEQ ID NO: 140817 - DNA, 27 bp, Artificial sequence
  SiRNA target sequence
aacatgaattggcttatcgcatcagtg

SEQ ID NO: 140818 - DNA, 27 bp, Artificial sequence
  SiRNA target sequence
acatgaattggcttatcgcatcagtga

SEQ ID NO: 140819 - DNA, 27 bp, Artificial sequence
  SiRNA target sequence
catgaattggcttatcgcatcagtgat

SEQ ID NO: 140820 - DNA, 27 bp, Artificial sequence
  SiRNA target sequence
atgaattggcttatcgcatcagtgata

SEQ ID NO: 140821 - DNA, 27 bp, Artificial sequence
  SiRNA target sequence
tgaattggcttatcgcatcagtgatat

SEQ ID NO: 140822 - DNA, 27 bp, Artificial sequence
  SiRNA target sequence
gaattggcttatcgcatcagtgatata

SEQ ID NO: 140823 - DNA, 27 bp, Artificial sequence
  SiRNA target sequence
aattggcttatcgcatcagtgatatat

SEQ ID NO: 140824 - DNA, 27 bp, Artificial sequence
  SiRNA target sequence
attggcttatcgcatcagtgatatatt

SEQ ID NO: 140825 - DNA, 27 bp, Artificial sequence
  SiRNA target sequence
ttggcttatcgcatcagtgatatatta

SEQ ID NO: 140826 - DNA, 27 bp, Artificial sequence
  SiRNA target sequence
tggcttatcgcatcagtgatatattat

SEQ ID NO: 140827 - DNA, 27 bp, Artificial sequence
  SiRNA target sequence
ggcttatcgcatcagtgatatattatt

SEQ ID NO: 140828 - DNA, 27 bp, Artificial sequence
  SiRNA target sequence
gcttatcgcatcagtgatatattattt

SEQ ID NO: 140829 - DNA, 27 bp, Artificial sequence
  SiRNA target sequence
cttatcgcatcagtgatatattattta

SEQ ID NO: 140830 - DNA, 27 bp, Artificial sequence
  SiRNA target sequence
ttatcgcatcagtgatatattatttaa

SEQ ID NO: 140831 - DNA, 27 bp, Artificial sequence
  SiRNA target sequence
tatcgcatcagtgatatattatttaat

SEQ ID NO: 140832 - DNA, 27 bp, Artificial sequence
  SiRNA target sequence
atcgcatcagtgatatattatttaata

SEQ ID NO: 140833 - DNA, 27 bp, Artificial sequence
  SiRNA target sequence
tcgcatcagtgatatattatttaatag

SEQ ID NO: 140834 - DNA, 27 bp, Artificial sequence
  SiRNA target sequence
cgcatcagtgatatattatttaatagg

SEQ ID NO: 140835 - DNA, 27 bp, Artificial sequence
  SiRNA target sequence
gcatcagtgatatattatttaatagga

SEQ ID NO: 140836 - DNA, 27 bp, Artificial sequence
  SiRNA target sequence
catcagtgatatattatttaataggat

SEQ ID NO: 140837 - DNA, 27 bp, Artificial sequence
  SiRNA target sequence
atcagtgatatattatttaataggatg

SEQ ID NO: 140838 - DNA, 27 bp, Artificial sequence
  SiRNA target sequence
tcagtgatatattatttaataggatga

SEQ ID NO: 140839 - DNA, 27 bp, Artificial sequence
  SiRNA target sequence
cagtgatatattatttaataggatgat

SEQ ID NO: 140840 - DNA, 27 bp, Artificial sequence
  SiRNA target sequence
agtgatatattatttaataggatgatg

SEQ ID NO: 140841 - DNA, 27 bp, Artificial sequence
  SiRNA target sequence
gtgatatattatttaataggatgatga

SEQ ID NO: 140842 - DNA, 27 bp, Artificial sequence
  SiRNA target sequence
tgatatattatttaataggatgatgat

SEQ ID NO: 140843 - DNA, 27 bp, Artificial sequence
  SiRNA target sequence
gatatattatttaataggatgatgata

SEQ ID NO: 140844 - DNA, 27 bp, Artificial sequence
  SiRNA target sequence
atatattatttaataggatgatgatag

SEQ ID NO: 140845 - DNA, 27 bp, Artificial sequence
  SiRNA target sequence
tatattatttaataggatgatgatagg

SEQ ID NO: 140846 - DNA, 27 bp, Artificial sequence
  SiRNA target sequence
atattatttaataggatgatgatagga

SEQ ID NO: 140847 - DNA, 27 bp, Artificial sequence
  SiRNA target sequence
tattatttaataggatgatgataggat

SEQ ID NO: 140848 - DNA, 27 bp, Artificial sequence
  SiRNA target sequence
attatttaataggatgatgataggata

SEQ ID NO: 140849 - DNA, 27 bp, Artificial sequence
  SiRNA target sequence
ttatttaataggatgatgataggatac

SEQ ID NO: 140850 - DNA, 27 bp, Artificial sequence
  SiRNA target sequence
tatttaataggatgatgataggataca

SEQ ID NO: 140851 - DNA, 27 bp, Artificial sequence
  SiRNA target sequence
atttaataggatgatgataggatacat

SEQ ID NO: 140852 - DNA, 27 bp, Artificial sequence
  SiRNA target sequence
tttaataggatgatgataggatacatt

SEQ ID NO: 140853 - DNA, 27 bp, Artificial sequence
  SiRNA target sequence
ttaataggatgatgataggatacattg

SEQ ID NO: 140854 - DNA, 27 bp, Artificial sequence
  SiRNA target sequence
taataggatgatgataggatacattga

SEQ ID NO: 140855 - DNA, 27 bp, Artificial sequence
  SiRNA target sequence
aataggatgatgataggatacattgac

SEQ ID NO: 140856 - DNA, 27 bp, Artificial sequence
  SiRNA target sequence
ataggatgatgataggatacattgacg

SEQ ID NO: 140857 - DNA, 27 bp, Artificial sequence
  SiRNA target sequence
taggatgatgataggatacattgacgt

SEQ ID NO: 140858 - DNA, 27 bp, Artificial sequence
  SiRNA target sequence
aggatgatgataggatacattgacgtc

SEQ ID NO: 140859 - DNA, 27 bp, Artificial sequence
  SiRNA target sequence
ggatgatgataggatacattgacgtca

SEQ ID NO: 140860 - DNA, 27 bp, Artificial sequence
  SiRNA target sequence
gatgatgataggatacattgacgtcag

SEQ ID NO: 140861 - DNA, 27 bp, Artificial sequence
  SiRNA target sequence
atgatgataggatacattgacgtcaga

SEQ ID NO: 140862 - DNA, 27 bp, Artificial sequence
  SiRNA target sequence
tgatgataggatacattgacgtcagaa

SEQ ID NO: 140863 - DNA, 27 bp, Artificial sequence
  SiRNA target sequence
gatgataggatacattgacgtcagaag

SEQ ID NO: 140864 - DNA, 27 bp, Artificial sequence
  SiRNA target sequence
atgataggatacattgacgtcagaaga

SEQ ID NO: 140865 - DNA, 27 bp, Artificial sequence
  SiRNA target sequence
tgataggatacattgacgtcagaagag

SEQ ID NO: 140866 - DNA, 27 bp, Artificial sequence
  SiRNA target sequence
gataggatacattgacgtcagaagagc

SEQ ID NO: 140867 - DNA, 27 bp, Artificial sequence
  SiRNA target sequence
ataggatacattgacgtcagaagagca

SEQ ID NO: 140868 - DNA, 27 bp, Artificial sequence
  SiRNA target sequence
taggatacattgacgtcagaagagcat

SEQ ID NO: 140869 - DNA, 27 bp, Artificial sequence
  SiRNA target sequence
aggatacattgacgtcagaagagcatt

SEQ ID NO: 140870 - DNA, 27 bp, Artificial sequence
  SiRNA target sequence
ggatacattgacgtcagaagagcattt

SEQ ID NO: 140871 - DNA, 27 bp, Artificial sequence
  SiRNA target sequence
gatacattgacgtcagaagagcatttg

SEQ ID NO: 140872 - DNA, 27 bp, Artificial sequence
  SiRNA target sequence
atacattgacgtcagaagagcatttga

SEQ ID NO: 140873 - DNA, 27 bp, Artificial sequence
  SiRNA target sequence
tacattgacgtcagaagagcatttgat

SEQ ID NO: 140874 - DNA, 27 bp, Artificial sequence
  SiRNA target sequence
acattgacgtcagaagagcatttgatt

SEQ ID NO: 140875 - DNA, 27 bp, Artificial sequence
  SiRNA target sequence
cattgacgtcagaagagcatttgattt

SEQ ID NO: 140876 - DNA, 27 bp, Artificial sequence
  SiRNA target sequence
attgacgtcagaagagcatttgattta

SEQ ID NO: 140877 - DNA, 27 bp, Artificial sequence
  SiRNA target sequence
ttgacgtcagaagagcatttgatttaa

SEQ ID NO: 140878 - DNA, 27 bp, Artificial sequence
  SiRNA target sequence
tgacgtcagaagagcatttgatttaat

SEQ ID NO: 140879 - DNA, 27 bp, Artificial sequence
  SiRNA target sequence
gacgtcagaagagcatttgatttaatt

SEQ ID NO: 140880 - DNA, 27 bp, Artificial sequence
  SiRNA target sequence
acgtcagaagagcatttgatttaattg

SEQ ID NO: 140881 - DNA, 27 bp, Artificial sequence
  SiRNA target sequence
cgtcagaagagcatttgatttaattgg

SEQ ID NO: 140882 - DNA, 27 bp, Artificial sequence
  SiRNA target sequence
gtcagaagagcatttgatttaattggt

SEQ ID NO: 140883 - DNA, 27 bp, Artificial sequence
  SiRNA target sequence
tcagaagagcatttgatttaattggta

SEQ ID NO: 140884 - DNA, 27 bp, Artificial sequence
  SiRNA target sequence
cagaagagcatttgatttaattggtat

SEQ ID NO: 140885 - DNA, 27 bp, Artificial sequence
  SiRNA target sequence
agaagagcatttgatttaattggtata

SEQ ID NO: 140886 - DNA, 27 bp, Artificial sequence
  SiRNA target sequence
gaagagcatttgatttaattggtatag

SEQ ID NO: 140887 - DNA, 27 bp, Artificial sequence
  SiRNA target sequence
aagagcatttgatttaattggtatagt

SEQ ID NO: 140888 - DNA, 27 bp, Artificial sequence
  SiRNA target sequence
agagcatttgatttaattggtatagta

SEQ ID NO: 140889 - DNA, 27 bp, Artificial sequence
  SiRNA target sequence
gagcatttgatttaattggtatagtag

SEQ ID NO: 140890 - DNA, 27 bp, Artificial sequence
  SiRNA target sequence
agcatttgatttaattggtatagtagc

SEQ ID NO: 140891 - DNA, 27 bp, Artificial sequence
  SiRNA target sequence
gcatttgatttaattggtatagtagct

SEQ ID NO: 140892 - DNA, 27 bp, Artificial sequence
  SiRNA target sequence
catttgatttaattggtatagtagctg

SEQ ID NO: 140893 - DNA, 27 bp, Artificial sequence
  SiRNA target sequence
atttgatttaattggtatagtagctga

SEQ ID NO: 140894 - DNA, 27 bp, Artificial sequence
  SiRNA target sequence
tttgatttaattggtatagtagctgaa

SEQ ID NO: 140895 - DNA, 27 bp, Artificial sequence
  SiRNA target sequence
ttgatttaattggtatagtagctgaag

SEQ ID NO: 140896 - DNA, 27 bp, Artificial sequence
  SiRNA target sequence
tgatttaattggtatagtagctgaagt

SEQ ID NO: 140897 - DNA, 27 bp, Artificial sequence
  SiRNA target sequence
gatttaattggtatagtagctgaagta

SEQ ID NO: 140898 - DNA, 27 bp, Artificial sequence
  SiRNA target sequence
atttaattggtatagtagctgaagtaa

SEQ ID NO: 140899 - DNA, 27 bp, Artificial sequence
  SiRNA target sequence
tttaattggtatagtagctgaagtaat

SEQ ID NO: 140900 - DNA, 27 bp, Artificial sequence
  SiRNA target sequence
ttaattggtatagtagctgaagtaatg

SEQ ID NO: 140901 - DNA, 27 bp, Artificial sequence
  SiRNA target sequence
taattggtatagtagctgaagtaatga

SEQ ID NO: 140902 - DNA, 27 bp, Artificial sequence
  SiRNA target sequence
aattggtatagtagctgaagtaatgaa

SEQ ID NO: 140903 - DNA, 27 bp, Artificial sequence
  SiRNA target sequence
attggtatagtagctgaagtaatgaaa

SEQ ID NO: 140904 - DNA, 27 bp, Artificial sequence
  SiRNA target sequence
ttggtatagtagctgaagtaatgaaag

SEQ ID NO: 140905 - DNA, 27 bp, Artificial sequence
  SiRNA target sequence
tggtatagtagctgaagtaatgaaaga

SEQ ID NO: 140906 - DNA, 27 bp, Artificial sequence
  SiRNA target sequence
ggtatagtagctgaagtaatgaaagac

SEQ ID NO: 140907 - DNA, 27 bp, Artificial sequence
  SiRNA target sequence
gtatagtagctgaagtaatgaaagact

SEQ ID NO: 140908 - DNA, 27 bp, Artificial sequence
  SiRNA target sequence
tatagtagctgaagtaatgaaagacta

SEQ ID NO: 140909 - DNA, 27 bp, Artificial sequence
  SiRNA target sequence
atagtagctgaagtaatgaaagactat

SEQ ID NO: 140910 - DNA, 27 bp, Artificial sequence
  SiRNA target sequence
tagtagctgaagtaatgaaagactatt

SEQ ID NO: 140911 - DNA, 27 bp, Artificial sequence
  SiRNA target sequence
agtagctgaagtaatgaaagactatta

SEQ ID NO: 140912 - DNA, 27 bp, Artificial sequence
  SiRNA target sequence
gtagctgaagtaatgaaagactattac

SEQ ID NO: 140913 - DNA, 27 bp, Artificial sequence
  SiRNA target sequence
tagctgaagtaatgaaagactattacg

SEQ ID NO: 140914 - DNA, 27 bp, Artificial sequence
  SiRNA target sequence
agctgaagtaatgaaagactattacgg

SEQ ID NO: 140915 - DNA, 27 bp, Artificial sequence
  SiRNA target sequence
gctgaagtaatgaaagactattacgga

SEQ ID NO: 140916 - DNA, 27 bp, Artificial sequence
  SiRNA target sequence
ctgaagtaatgaaagactattacggat

SEQ ID NO: 140917 - DNA, 27 bp, Artificial sequence
  SiRNA target sequence
tgaagtaatgaaagactattacggatg

SEQ ID NO: 140918 - DNA, 27 bp, Artificial sequence
  SiRNA target sequence
gaagtaatgaaagactattacggatgg

SEQ ID NO: 140919 - DNA, 27 bp, Artificial sequence
  SiRNA target sequence
aagtaatgaaagactattacggatggg

SEQ ID NO: 140920 - DNA, 27 bp, Artificial sequence
  SiRNA target sequence
agtaatgaaagactattacggatggga

SEQ ID NO: 140921 - DNA, 27 bp, Artificial sequence
  SiRNA target sequence
gtaatgaaagactattacggatgggat

SEQ ID NO: 140922 - DNA, 27 bp, Artificial sequence
  SiRNA target sequence
taatgaaagactattacggatgggatc

SEQ ID NO: 140923 - DNA, 27 bp, Artificial sequence
  SiRNA target sequence
aatgaaagactattacggatgggatca

SEQ ID NO: 140924 - DNA, 27 bp, Artificial sequence
  SiRNA target sequence
atgaaagactattacggatgggatcag

SEQ ID NO: 140925 - DNA, 27 bp, Artificial sequence
  SiRNA target sequence
tgaaagactattacggatgggatcagc

SEQ ID NO: 140926 - DNA, 27 bp, Artificial sequence
  SiRNA target sequence
gaaagactattacggatgggatcagca

SEQ ID NO: 140927 - DNA, 27 bp, Artificial sequence
  SiRNA target sequence
aaagactattacggatgggatcagcaa

SEQ ID NO: 140928 - DNA, 27 bp, Artificial sequence
  SiRNA target sequence
aagactattacggatgggatcagcaaa

SEQ ID NO: 140929 - DNA, 27 bp, Artificial sequence
  SiRNA target sequence
agactattacggatgggatcagcaaag

SEQ ID NO: 140930 - DNA, 27 bp, Artificial sequence
  SiRNA target sequence
gactattacggatgggatcagcaaaga

SEQ ID NO: 140931 - DNA, 27 bp, Artificial sequence
  SiRNA target sequence
actattacggatgggatcagcaaagat

SEQ ID NO: 140932 - DNA, 27 bp, Artificial sequence
  SiRNA target sequence
ctattacggatgggatcagcaaagata

SEQ ID NO: 140933 - DNA, 27 bp, Artificial sequence
  SiRNA target sequence
tattacggatgggatcagcaaagatat

SEQ ID NO: 140934 - DNA, 27 bp, Artificial sequence
  SiRNA target sequence
attacggatgggatcagcaaagatata

SEQ ID NO: 140935 - DNA, 27 bp, Artificial sequence
  SiRNA target sequence
ttacggatgggatcagcaaagatataa

SEQ ID NO: 140936 - DNA, 27 bp, Artificial sequence
  SiRNA target sequence
tacggatgggatcagcaaagatataat

SEQ ID NO: 140937 - DNA, 27 bp, Artificial sequence
  SiRNA target sequence
acggatgggatcagcaaagatataatg

SEQ ID NO: 140938 - DNA, 27 bp, Artificial sequence
  SiRNA target sequence
cggatgggatcagcaaagatataatga

SEQ ID NO: 140939 - DNA, 27 bp, Artificial sequence
  SiRNA target sequence
ggatgggatcagcaaagatataatgaa

SEQ ID NO: 140940 - DNA, 27 bp, Artificial sequence
  SiRNA target sequence
gatgggatcagcaaagatataatgaag

SEQ ID NO: 140941 - DNA, 27 bp, Artificial sequence
  SiRNA target sequence
atgggatcagcaaagatataatgaaga

SEQ ID NO: 140942 - DNA, 27 bp, Artificial sequence
  SiRNA target sequence
tgggatcagcaaagatataatgaagaa

SEQ ID NO: 140943 - DNA, 27 bp, Artificial sequence
  SiRNA target sequence
gggatcagcaaagatataatgaagaaa

SEQ ID NO: 140944 - DNA, 27 bp, Artificial sequence
  SiRNA target sequence
ggatcagcaaagatataatgaagaaac

SEQ ID NO: 140945 - DNA, 27 bp, Artificial sequence
  SiRNA target sequence
gatcagcaaagatataatgaagaaaca

SEQ ID NO: 140946 - DNA, 27 bp, Artificial sequence
  SiRNA target sequence
atcagcaaagatataatgaagaaacaa

SEQ ID NO: 140947 - DNA, 27 bp, Artificial sequence
  SiRNA target sequence
tcagcaaagatataatgaagaaacaaa

SEQ ID NO: 140948 - DNA, 27 bp, Artificial sequence
  SiRNA target sequence
cagcaaagatataatgaagaaacaaaa

SEQ ID NO: 140949 - DNA, 27 bp, Artificial sequence
  SiRNA target sequence
agcaaagatataatgaagaaacaaaat

SEQ ID NO: 140950 - DNA, 27 bp, Artificial sequence
  SiRNA target sequence
gcaaagatataatgaagaaacaaaatt

SEQ ID NO: 140951 - DNA, 27 bp, Artificial sequence
  SiRNA target sequence
caaagatataatgaagaaacaaaatta

SEQ ID NO: 140952 - DNA, 27 bp, Artificial sequence
  SiRNA target sequence
aaagatataatgaagaaacaaaattat

SEQ ID NO: 140953 - DNA, 27 bp, Artificial sequence
  SiRNA target sequence
aagatataatgaagaaacaaaattatg

SEQ ID NO: 140954 - DNA, 27 bp, Artificial sequence
  SiRNA target sequence
agatataatgaagaaacaaaattatgc

SEQ ID NO: 140955 - DNA, 27 bp, Artificial sequence
  SiRNA target sequence
gatataatgaagaaacaaaattatgca

SEQ ID NO: 140956 - DNA, 27 bp, Artificial sequence
  SiRNA target sequence
atataatgaagaaacaaaattatgcat

SEQ ID NO: 140957 - DNA, 27 bp, Artificial sequence
  SiRNA target sequence
tataatgaagaaacaaaattatgcatg

SEQ ID NO: 140958 - DNA, 27 bp, Artificial sequence
  SiRNA target sequence
ataatgaagaaacaaaattatgcatgg

SEQ ID NO: 140959 - DNA, 27 bp, Artificial sequence
  SiRNA target sequence
taatgaagaaacaaaattatgcatgga

SEQ ID NO: 140960 - DNA, 27 bp, Artificial sequence
  SiRNA target sequence
aatgaagaaacaaaattatgcatggaa

SEQ ID NO: 140961 - DNA, 27 bp, Artificial sequence
  SiRNA target sequence
atgaagaaacaaaattatgcatggaaa

SEQ ID NO: 140962 - DNA, 27 bp, Artificial sequence
  SiRNA target sequence
tgaagaaacaaaattatgcatggaaat

SEQ ID NO: 140963 - DNA, 27 bp, Artificial sequence
  SiRNA target sequence
gaagaaacaaaattatgcatggaaatg

SEQ ID NO: 140964 - DNA, 27 bp, Artificial sequence
  SiRNA target sequence
aagaaacaaaattatgcatggaaatga

SEQ ID NO: 140965 - DNA, 27 bp, Artificial sequence
  SiRNA target sequence
agaaacaaaattatgcatggaaatgat

SEQ ID NO: 140966 - DNA, 27 bp, Artificial sequence
  SiRNA target sequence
gaaacaaaattatgcatggaaatgatg

SEQ ID NO: 140967 - DNA, 27 bp, Artificial sequence
  SiRNA target sequence
aaacaaaattatgcatggaaatgatgg

SEQ ID NO: 140968 - DNA, 27 bp, Artificial sequence
  SiRNA target sequence
aacaaaattatgcatggaaatgatgga

SEQ ID NO: 140969 - DNA, 27 bp, Artificial sequence
  SiRNA target sequence
acaaaattatgcatggaaatgatggaa

SEQ ID NO: 140970 - DNA, 27 bp, Artificial sequence
  SiRNA target sequence
caaaattatgcatggaaatgatggaaa

SEQ ID NO: 140971 - DNA, 27 bp, Artificial sequence
  SiRNA target sequence
aaaattatgcatggaaatgatggaaac

SEQ ID NO: 140972 - DNA, 27 bp, Artificial sequence
  SiRNA target sequence
aaattatgcatggaaatgatggaaact

SEQ ID NO: 140973 - DNA, 27 bp, Artificial sequence
  SiRNA target sequence
aattatgcatggaaatgatggaaactt

SEQ ID NO: 140974 - DNA, 27 bp, Artificial sequence
  SiRNA target sequence
attatgcatggaaatgatggaaacttg

SEQ ID NO: 140975 - DNA, 27 bp, Artificial sequence
  SiRNA target sequence
ttatgcatggaaatgatggaaacttgt

SEQ ID NO: 140976 - DNA, 27 bp, Artificial sequence
  SiRNA target sequence
tatgcatggaaatgatggaaacttgtg

SEQ ID NO: 140977 - DNA, 27 bp, Artificial sequence
  SiRNA target sequence
atgcatggaaatgatggaaacttgtgg

SEQ ID NO: 140978 - DNA, 27 bp, Artificial sequence
  SiRNA target sequence
tgcatggaaatgatggaaacttgtggt

SEQ ID NO: 140979 - DNA, 27 bp, Artificial sequence
  SiRNA target sequence
gcatggaaatgatggaaacttgtggtt

SEQ ID NO: 140980 - DNA, 27 bp, Artificial sequence
  SiRNA target sequence
catggaaatgatggaaacttgtggtta

SEQ ID NO: 140981 - DNA, 27 bp, Artificial sequence
  SiRNA target sequence
atggaaatgatggaaacttgtggttat

SEQ ID NO: 140982 - DNA, 27 bp, Artificial sequence
  SiRNA target sequence
tggaaatgatggaaacttgtggttata

SEQ ID NO: 140983 - DNA, 27 bp, Artificial sequence
  SiRNA target sequence
ggaaatgatggaaacttgtggttatag

SEQ ID NO: 140984 - DNA, 27 bp, Artificial sequence
  SiRNA target sequence
gaaatgatggaaacttgtggttatagt

SEQ ID NO: 140985 - DNA, 27 bp, Artificial sequence
  SiRNA target sequence
aaatgatggaaacttgtggttatagtt

SEQ ID NO: 140986 - DNA, 27 bp, Artificial sequence
  SiRNA target sequence
aatgatggaaacttgtggttatagttt

SEQ ID NO: 140987 - DNA, 27 bp, Artificial sequence
  SiRNA target sequence
atgatggaaacttgtggttatagttta

SEQ ID NO: 140988 - DNA, 27 bp, Artificial sequence
  SiRNA target sequence
tgatggaaacttgtggttatagtttat

SEQ ID NO: 140989 - DNA, 27 bp, Artificial sequence
  SiRNA target sequence
gatggaaacttgtggttatagtttatt

SEQ ID NO: 140990 - DNA, 27 bp, Artificial sequence
  SiRNA target sequence
atggaaacttgtggttatagtttatta

SEQ ID NO: 140991 - DNA, 27 bp, Artificial sequence
  SiRNA target sequence
tggaaacttgtggttatagtttattaa

SEQ ID NO: 140992 - DNA, 27 bp, Artificial sequence
  SiRNA target sequence
ggaaacttgtggttatagtttattaaa

SEQ ID NO: 140993 - DNA, 27 bp, Artificial sequence
  SiRNA target sequence
gaaacttgtggttatagtttattaaaa

SEQ ID NO: 140994 - DNA, 27 bp, Artificial sequence
  SiRNA target sequence
aaacttgtggttatagtttattaaaaa

SEQ ID NO: 140995 - DNA, 27 bp, Artificial sequence
  SiRNA target sequence
aacttgtggttatagtttattaaaaaa

SEQ ID NO: 140996 - DNA, 27 bp, Artificial sequence
  SiRNA target sequence
acttgtggttatagtttattaaaaaat

SEQ ID NO: 140997 - DNA, 27 bp, Artificial sequence
  SiRNA target sequence
cttgtggttatagtttattaaaaaatt

SEQ ID NO: 140998 - DNA, 27 bp, Artificial sequence
  SiRNA target sequence
ttgtggttatagtttattaaaaaatta

SEQ ID NO: 140999 - DNA, 27 bp, Artificial sequence
  SiRNA target sequence
tgtggttatagtttattaaaaaattaa

SEQ ID NO: 141000 - DNA, 19 bp, Artificial sequence
  SiRNA target sequence
ttaatttatgcataattga

SEQ ID NO: 141001 - DNA, 19 bp, Artificial sequence
  SiRNA target sequence
taatttatgcataattgac

SEQ ID NO: 141002 - DNA, 19 bp, Artificial sequence
  SiRNA target sequence
aatttatgcataattgacc

SEQ ID NO: 141003 - DNA, 19 bp, Artificial sequence
  SiRNA target sequence
atttatgcataattgacca

SEQ ID NO: 141004 - DNA, 19 bp, Artificial sequence
  SiRNA target sequence
tttatgcataattgaccat

SEQ ID NO: 141005 - DNA, 19 bp, Artificial sequence
  SiRNA target sequence
ttatgcataattgaccatc

SEQ ID NO: 141006 - DNA, 19 bp, Artificial sequence
  SiRNA target sequence
tatgcataattgaccatca

SEQ ID NO: 141007 - DNA, 19 bp, Artificial sequence
  SiRNA target sequence
atgcataattgaccatcat

SEQ ID NO: 141008 - DNA, 19 bp, Artificial sequence
  SiRNA target sequence
tgcataattgaccatcatc

SEQ ID NO: 141009 - DNA, 19 bp, Artificial sequence
  SiRNA target sequence
gcataattgaccatcatca

SEQ ID NO: 141010 - DNA, 19 bp, Artificial sequence
  SiRNA target sequence
cataattgaccatcatcag

SEQ ID NO: 141011 - DNA, 19 bp, Artificial sequence
  SiRNA target sequence
ataattgaccatcatcagt

SEQ ID NO: 141012 - DNA, 19 bp, Artificial sequence
  SiRNA target sequence
taattgaccatcatcagta

SEQ ID NO: 141013 - DNA, 19 bp, Artificial sequence
  SiRNA target sequence
aattgaccatcatcagtaa

SEQ ID NO: 141014 - DNA, 19 bp, Artificial sequence
  SiRNA target sequence
attgaccatcatcagtaat

SEQ ID NO: 141015 - DNA, 19 bp, Artificial sequence
  SiRNA target sequence
ttgaccatcatcagtaata

SEQ ID NO: 141016 - DNA, 19 bp, Artificial sequence
  SiRNA target sequence
tgaccatcatcagtaataa

SEQ ID NO: 141017 - DNA, 19 bp, Artificial sequence
  SiRNA target sequence
gaccatcatcagtaataaa

SEQ ID NO: 141018 - DNA, 19 bp, Artificial sequence
  SiRNA target sequence
accatcatcagtaataaac

SEQ ID NO: 141019 - DNA, 19 bp, Artificial sequence
  SiRNA target sequence
ccatcatcagtaataaaca

SEQ ID NO: 141020 - DNA, 19 bp, Artificial sequence
  SiRNA target sequence
catcatcagtaataaacac

SEQ ID NO: 141021 - DNA, 19 bp, Artificial sequence
  SiRNA target sequence
atcatcagtaataaacaca

SEQ ID NO: 141022 - DNA, 19 bp, Artificial sequence
  SiRNA target sequence
tcatcagtaataaacacat

SEQ ID NO: 141023 - DNA, 19 bp, Artificial sequence
  SiRNA target sequence
catcagtaataaacacatt

SEQ ID NO: 141024 - DNA, 19 bp, Artificial sequence
  SiRNA target sequence
atcagtaataaacacatta

SEQ ID NO: 141025 - DNA, 19 bp, Artificial sequence
  SiRNA target sequence
tcagtaataaacacattac

SEQ ID NO: 141026 - DNA, 19 bp, Artificial sequence
  SiRNA target sequence
cagtaataaacacattacc

SEQ ID NO: 141027 - DNA, 19 bp, Artificial sequence
  SiRNA target sequence
agtaataaacacattacct

SEQ ID NO: 141028 - DNA, 19 bp, Artificial sequence
  SiRNA target sequence
gtaataaacacattacctt

SEQ ID NO: 141029 - DNA, 19 bp, Artificial sequence
  SiRNA target sequence
taataaacacattaccttt

SEQ ID NO: 141030 - DNA, 19 bp, Artificial sequence
  SiRNA target sequence
aataaacacattacctttc

SEQ ID NO: 141031 - DNA, 19 bp, Artificial sequence
  SiRNA target sequence
ataaacacattacctttct

SEQ ID NO: 141032 - DNA, 19 bp, Artificial sequence
  SiRNA target sequence
taaacacattacctttctt

SEQ ID NO: 141033 - DNA, 19 bp, Artificial sequence
  SiRNA target sequence
aaacacattacctttcttt

SEQ ID NO: 141034 - DNA, 19 bp, Artificial sequence
  SiRNA target sequence
aacacattacctttctttt

SEQ ID NO: 141035 - DNA, 19 bp, Artificial sequence
  SiRNA target sequence
acacattacctttcttttc

SEQ ID NO: 141036 - DNA, 19 bp, Artificial sequence
  SiRNA target sequence
cacattacctttcttttct

SEQ ID NO: 141037 - DNA, 19 bp, Artificial sequence
  SiRNA target sequence
acattacctttcttttcta

SEQ ID NO: 141038 - DNA, 19 bp, Artificial sequence
  SiRNA target sequence
cattacctttcttttctac

SEQ ID NO: 141039 - DNA, 19 bp, Artificial sequence
  SiRNA target sequence
attacctttcttttctacc

SEQ ID NO: 141040 - DNA, 19 bp, Artificial sequence
  SiRNA target sequence
ttacctttcttttctacca

SEQ ID NO: 141041 - DNA, 19 bp, Artificial sequence
  SiRNA target sequence
tacctttcttttctaccac

SEQ ID NO: 141042 - DNA, 19 bp, Artificial sequence
  SiRNA target sequence
acctttcttttctaccaca

SEQ ID NO: 141043 - DNA, 19 bp, Artificial sequence
  SiRNA target sequence
cctttcttttctaccacac

SEQ ID NO: 141044 - DNA, 19 bp, Artificial sequence
  SiRNA target sequence
ctttcttttctaccacaca

SEQ ID NO: 141045 - DNA, 19 bp, Artificial sequence
  SiRNA target sequence
tttcttttctaccacacat

SEQ ID NO: 141046 - DNA, 19 bp, Artificial sequence
  SiRNA target sequence
ttcttttctaccacacatt

SEQ ID NO: 141047 - DNA, 19 bp, Artificial sequence
  SiRNA target sequence
tcttttctaccacacattt

SEQ ID NO: 141048 - DNA, 19 bp, Artificial sequence
  SiRNA target sequence
cttttctaccacacatttt

SEQ ID NO: 141049 - DNA, 19 bp, Artificial sequence
  SiRNA target sequence
ttttctaccacacattttt

SEQ ID NO: 141050 - DNA, 19 bp, Artificial sequence
  SiRNA target sequence
tttctaccacacatttttg

SEQ ID NO: 141051 - DNA, 19 bp, Artificial sequence
  SiRNA target sequence
ttctaccacacatttttga

SEQ ID NO: 141052 - DNA, 19 bp, Artificial sequence
  SiRNA target sequence
tctaccacacatttttgat

SEQ ID NO: 141053 - DNA, 19 bp, Artificial sequence
  SiRNA target sequence
ctaccacacatttttgata

SEQ ID NO: 141054 - DNA, 19 bp, Artificial sequence
  SiRNA target sequence
taccacacatttttgatat

SEQ ID NO: 141055 - DNA, 19 bp, Artificial sequence
  SiRNA target sequence
accacacatttttgatata

SEQ ID NO: 141056 - DNA, 19 bp, Artificial sequence
  SiRNA target sequence
ccacacatttttgatatat

SEQ ID NO: 141057 - DNA, 19 bp, Artificial sequence
  SiRNA target sequence
cacacatttttgatatatt

SEQ ID NO: 141058 - DNA, 19 bp, Artificial sequence
  SiRNA target sequence
acacatttttgatatattt

SEQ ID NO: 141059 - DNA, 19 bp, Artificial sequence
  SiRNA target sequence
cacatttttgatatatttc

SEQ ID NO: 141060 - DNA, 19 bp, Artificial sequence
  SiRNA target sequence
acatttttgatatatttca

SEQ ID NO: 141061 - DNA, 19 bp, Artificial sequence
  SiRNA target sequence
catttttgatatatttcat

SEQ ID NO: 141062 - DNA, 19 bp, Artificial sequence
  SiRNA target sequence
atttttgatatatttcatt

SEQ ID NO: 141063 - DNA, 19 bp, Artificial sequence
  SiRNA target sequence
tttttgatatatttcatta

SEQ ID NO: 141064 - DNA, 19 bp, Artificial sequence
  SiRNA target sequence
ttttgatatatttcattaa

SEQ ID NO: 141065 - DNA, 19 bp, Artificial sequence
  SiRNA target sequence
tttgatatatttcattaac

SEQ ID NO: 141066 - DNA, 19 bp, Artificial sequence
  SiRNA target sequence
ttgatatatttcattaact

SEQ ID NO: 141067 - DNA, 19 bp, Artificial sequence
  SiRNA target sequence
tgatatatttcattaacta

SEQ ID NO: 141068 - DNA, 19 bp, Artificial sequence
  SiRNA target sequence
gatatatttcattaactac

SEQ ID NO: 141069 - DNA, 19 bp, Artificial sequence
  SiRNA target sequence
atatatttcattaactaca

SEQ ID NO: 141070 - DNA, 19 bp, Artificial sequence
  SiRNA target sequence
tatatttcattaactacat

SEQ ID NO: 141071 - DNA, 19 bp, Artificial sequence
  SiRNA target sequence
atatttcattaactacatc

SEQ ID NO: 141072 - DNA, 19 bp, Artificial sequence
  SiRNA target sequence
tatttcattaactacatcc

SEQ ID NO: 141073 - DNA, 19 bp, Artificial sequence
  SiRNA target sequence
atttcattaactacatccc

SEQ ID NO: 141074 - DNA, 19 bp, Artificial sequence
  SiRNA target sequence
tttcattaactacatccca

SEQ ID NO: 141075 - DNA, 19 bp, Artificial sequence
  SiRNA target sequence
ttcattaactacatcccaa

SEQ ID NO: 141076 - DNA, 19 bp, Artificial sequence
  SiRNA target sequence
tcattaactacatcccaat

SEQ ID NO: 141077 - DNA, 19 bp, Artificial sequence
  SiRNA target sequence
cattaactacatcccaatc

SEQ ID NO: 141078 - DNA, 19 bp, Artificial sequence
  SiRNA target sequence
attaactacatcccaatca

SEQ ID NO: 141079 - DNA, 19 bp, Artificial sequence
  SiRNA target sequence
ttaactacatcccaatcaa

SEQ ID NO: 141080 - DNA, 19 bp, Artificial sequence
  SiRNA target sequence
taactacatcccaatcaat

SEQ ID NO: 141081 - DNA, 19 bp, Artificial sequence
  SiRNA target sequence
aactacatcccaatcaatt

SEQ ID NO: 141082 - DNA, 19 bp, Artificial sequence
  SiRNA target sequence
actacatcccaatcaatta

SEQ ID NO: 141083 - DNA, 19 bp, Artificial sequence
  SiRNA target sequence
ctacatcccaatcaattac

SEQ ID NO: 141084 - DNA, 19 bp, Artificial sequence
  SiRNA target sequence
tacatcccaatcaattaca

SEQ ID NO: 141085 - DNA, 19 bp, Artificial sequence
  SiRNA target sequence
acatcccaatcaattacat

SEQ ID NO: 141086 - DNA, 19 bp, Artificial sequence
  SiRNA target sequence
catcccaatcaattacatt

SEQ ID NO: 141087 - DNA, 19 bp, Artificial sequence
  SiRNA target sequence
atcccaatcaattacattc

SEQ ID NO: 141088 - DNA, 19 bp, Artificial sequence
  SiRNA target sequence
tcccaatcaattacattcc

SEQ ID NO: 141089 - DNA, 19 bp, Artificial sequence
  SiRNA target sequence
cccaatcaattacattcca

SEQ ID NO: 141090 - DNA, 19 bp, Artificial sequence
  SiRNA target sequence
ccaatcaattacattccac

SEQ ID NO: 141091 - DNA, 19 bp, Artificial sequence
  SiRNA target sequence
caatcaattacattccacc

SEQ ID NO: 141092 - DNA, 19 bp, Artificial sequence
  SiRNA target sequence
aatcaattacattccacca

SEQ ID NO: 141093 - DNA, 19 bp, Artificial sequence
  SiRNA target sequence
atcaattacattccaccat

SEQ ID NO: 141094 - DNA, 19 bp, Artificial sequence
  SiRNA target sequence
tcaattacattccaccatt

SEQ ID NO: 141095 - DNA, 19 bp, Artificial sequence
  SiRNA target sequence
caattacattccaccattc

SEQ ID NO: 141096 - DNA, 19 bp, Artificial sequence
  SiRNA target sequence
aattacattccaccattca

SEQ ID NO: 141097 - DNA, 19 bp, Artificial sequence
  SiRNA target sequence
attacattccaccattcat

SEQ ID NO: 141098 - DNA, 19 bp, Artificial sequence
  SiRNA target sequence
ttacattccaccattcatt

SEQ ID NO: 141099 - DNA, 19 bp, Artificial sequence
  SiRNA target sequence
tacattccaccattcatta

SEQ ID NO: 141100 - DNA, 19 bp, Artificial sequence
  SiRNA target sequence
acattccaccattcattaa

SEQ ID NO: 141101 - DNA, 19 bp, Artificial sequence
  SiRNA target sequence
cattccaccattcattaat

SEQ ID NO: 141102 - DNA, 19 bp, Artificial sequence
  SiRNA target sequence
attccaccattcattaatg

SEQ ID NO: 141103 - DNA, 19 bp, Artificial sequence
  SiRNA target sequence
ttccaccattcattaatgt

SEQ ID NO: 141104 - DNA, 19 bp, Artificial sequence
  SiRNA target sequence
tccaccattcattaatgta

SEQ ID NO: 141105 - DNA, 19 bp, Artificial sequence
  SiRNA target sequence
ccaccattcattaatgtat

SEQ ID NO: 141106 - DNA, 19 bp, Artificial sequence
  SiRNA target sequence
caccattcattaatgtatt

SEQ ID NO: 141107 - DNA, 19 bp, Artificial sequence
  SiRNA target sequence
accattcattaatgtattc

SEQ ID NO: 141108 - DNA, 19 bp, Artificial sequence
  SiRNA target sequence
ccattcattaatgtattct

SEQ ID NO: 141109 - DNA, 19 bp, Artificial sequence
  SiRNA target sequence
cattcattaatgtattctt

SEQ ID NO: 141110 - DNA, 19 bp, Artificial sequence
  SiRNA target sequence
attcattaatgtattcttt

SEQ ID NO: 141111 - DNA, 19 bp, Artificial sequence
  SiRNA target sequence
ttcattaatgtattctttt

SEQ ID NO: 141112 - DNA, 19 bp, Artificial sequence
  SiRNA target sequence
tcattaatgtattcttttc

SEQ ID NO: 141113 - DNA, 19 bp, Artificial sequence
  SiRNA target sequence
cattaatgtattcttttct

SEQ ID NO: 141114 - DNA, 19 bp, Artificial sequence
  SiRNA target sequence
attaatgtattcttttctc

SEQ ID NO: 141115 - DNA, 19 bp, Artificial sequence
  SiRNA target sequence
ttaatgtattcttttctcc

SEQ ID NO: 141116 - DNA, 19 bp, Artificial sequence
  SiRNA target sequence
taatgtattcttttctcct

SEQ ID NO: 141117 - DNA, 19 bp, Artificial sequence
  SiRNA target sequence
aatgtattcttttctccta

SEQ ID NO: 141118 - DNA, 19 bp, Artificial sequence
  SiRNA target sequence
atgtattcttttctcctat

SEQ ID NO: 141119 - DNA, 19 bp, Artificial sequence
  SiRNA target sequence
tgtattcttttctcctatt

SEQ ID NO: 141120 - DNA, 19 bp, Artificial sequence
  SiRNA target sequence
gtattcttttctcctattt

SEQ ID NO: 141121 - DNA, 19 bp, Artificial sequence
  SiRNA target sequence
tattcttttctcctatttt

SEQ ID NO: 141122 - DNA, 19 bp, Artificial sequence
  SiRNA target sequence
attcttttctcctattttt

SEQ ID NO: 141123 - DNA, 19 bp, Artificial sequence
  SiRNA target sequence
ttcttttctcctattttta

SEQ ID NO: 141124 - DNA, 19 bp, Artificial sequence
  SiRNA target sequence
tcttttctcctatttttat

SEQ ID NO: 141125 - DNA, 19 bp, Artificial sequence
  SiRNA target sequence
cttttctcctatttttata

SEQ ID NO: 141126 - DNA, 19 bp, Artificial sequence
  SiRNA target sequence
ttttctcctatttttatac

SEQ ID NO: 141127 - DNA, 19 bp, Artificial sequence
  SiRNA target sequence
tttctcctatttttatact

SEQ ID NO: 141128 - DNA, 19 bp, Artificial sequence
  SiRNA target sequence
ttctcctatttttatactg

SEQ ID NO: 141129 - DNA, 19 bp, Artificial sequence
  SiRNA target sequence
tctcctatttttatactgt

SEQ ID NO: 141130 - DNA, 19 bp, Artificial sequence
  SiRNA target sequence
ctcctatttttatactgta

SEQ ID NO: 141131 - DNA, 19 bp, Artificial sequence
  SiRNA target sequence
tcctatttttatactgtaa

SEQ ID NO: 141132 - DNA, 19 bp, Artificial sequence
  SiRNA target sequence
cctatttttatactgtaaa

SEQ ID NO: 141133 - DNA, 19 bp, Artificial sequence
  SiRNA target sequence
ctatttttatactgtaaat

SEQ ID NO: 141134 - DNA, 19 bp, Artificial sequence
  SiRNA target sequence
tatttttatactgtaaata

SEQ ID NO: 141135 - DNA, 19 bp, Artificial sequence
  SiRNA target sequence
atttttatactgtaaataa

SEQ ID NO: 141136 - DNA, 19 bp, Artificial sequence
  SiRNA target sequence
tttttatactgtaaataat

SEQ ID NO: 141137 - DNA, 19 bp, Artificial sequence
  SiRNA target sequence
ttttatactgtaaataata

SEQ ID NO: 141138 - DNA, 19 bp, Artificial sequence
  SiRNA target sequence
tttatactgtaaataatac

SEQ ID NO: 141139 - DNA, 19 bp, Artificial sequence
  SiRNA target sequence
ttatactgtaaataatacg

SEQ ID NO: 141140 - DNA, 19 bp, Artificial sequence
  SiRNA target sequence
tatactgtaaataatacgc

SEQ ID NO: 141141 - DNA, 19 bp, Artificial sequence
  SiRNA target sequence
atactgtaaataatacgca

SEQ ID NO: 141142 - DNA, 19 bp, Artificial sequence
  SiRNA target sequence
tactgtaaataatacgcat

SEQ ID NO: 141143 - DNA, 19 bp, Artificial sequence
  SiRNA target sequence
actgtaaataatacgcatg

SEQ ID NO: 141144 - DNA, 19 bp, Artificial sequence
  SiRNA target sequence
ctgtaaataatacgcatgt

SEQ ID NO: 141145 - DNA, 19 bp, Artificial sequence
  SiRNA target sequence
tgtaaataatacgcatgtt

SEQ ID NO: 141146 - DNA, 19 bp, Artificial sequence
  SiRNA target sequence
gtaaataatacgcatgttc

SEQ ID NO: 141147 - DNA, 19 bp, Artificial sequence
  SiRNA target sequence
taaataatacgcatgttcc

SEQ ID NO: 141148 - DNA, 19 bp, Artificial sequence
  SiRNA target sequence
aaataatacgcatgttccc

SEQ ID NO: 141149 - DNA, 19 bp, Artificial sequence
  SiRNA target sequence
aataatacgcatgttccca

SEQ ID NO: 141150 - DNA, 19 bp, Artificial sequence
  SiRNA target sequence
ataatacgcatgttcccat

SEQ ID NO: 141151 - DNA, 19 bp, Artificial sequence
  SiRNA target sequence
taatacgcatgttcccata

SEQ ID NO: 141152 - DNA, 19 bp, Artificial sequence
  SiRNA target sequence
aatacgcatgttcccatac

SEQ ID NO: 141153 - DNA, 19 bp, Artificial sequence
  SiRNA target sequence
atacgcatgttcccataca

SEQ ID NO: 141154 - DNA, 19 bp, Artificial sequence
  SiRNA target sequence
tacgcatgttcccatacat

SEQ ID NO: 141155 - DNA, 19 bp, Artificial sequence
  SiRNA target sequence
acgcatgttcccatacatc

SEQ ID NO: 141156 - DNA, 19 bp, Artificial sequence
  SiRNA target sequence
cgcatgttcccatacatca

SEQ ID NO: 141157 - DNA, 19 bp, Artificial sequence
  SiRNA target sequence
gcatgttcccatacatcaa

SEQ ID NO: 141158 - DNA, 19 bp, Artificial sequence
  SiRNA target sequence
catgttcccatacatcaag

SEQ ID NO: 141159 - DNA, 19 bp, Artificial sequence
  SiRNA target sequence
atgttcccatacatcaaga

SEQ ID NO: 141160 - DNA, 19 bp, Artificial sequence
  SiRNA target sequence
tgttcccatacatcaagac

SEQ ID NO: 141161 - DNA, 19 bp, Artificial sequence
  SiRNA target sequence
gttcccatacatcaagaca

SEQ ID NO: 141162 - DNA, 19 bp, Artificial sequence
  SiRNA target sequence
ttcccatacatcaagacat

SEQ ID NO: 141163 - DNA, 19 bp, Artificial sequence
  SiRNA target sequence
tcccatacatcaagacata

SEQ ID NO: 141164 - DNA, 19 bp, Artificial sequence
  SiRNA target sequence
cccatacatcaagacatag

SEQ ID NO: 141165 - DNA, 19 bp, Artificial sequence
  SiRNA target sequence
ccatacatcaagacatagt

SEQ ID NO: 141166 - DNA, 19 bp, Artificial sequence
  SiRNA target sequence
catacatcaagacatagta

SEQ ID NO: 141167 - DNA, 19 bp, Artificial sequence
  SiRNA target sequence
atacatcaagacatagtaa

SEQ ID NO: 141168 - DNA, 19 bp, Artificial sequence
  SiRNA target sequence
tacatcaagacatagtaaa

SEQ ID NO: 141169 - DNA, 19 bp, Artificial sequence
  SiRNA target sequence
acatcaagacatagtaaag

SEQ ID NO: 141170 - DNA, 19 bp, Artificial sequence
  SiRNA target sequence
catcaagacatagtaaagg

SEQ ID NO: 141171 - DNA, 19 bp, Artificial sequence
  SiRNA target sequence
atcaagacatagtaaagga

SEQ ID NO: 141172 - DNA, 19 bp, Artificial sequence
  SiRNA target sequence
tcaagacatagtaaaggaa

SEQ ID NO: 141173 - DNA, 19 bp, Artificial sequence
  SiRNA target sequence
caagacatagtaaaggaat

SEQ ID NO: 141174 - DNA, 19 bp, Artificial sequence
  SiRNA target sequence
aagacatagtaaaggaata

SEQ ID NO: 141175 - DNA, 19 bp, Artificial sequence
  SiRNA target sequence
agacatagtaaaggaatac

SEQ ID NO: 141176 - DNA, 19 bp, Artificial sequence
  SiRNA target sequence
gacatagtaaaggaataca

SEQ ID NO: 141177 - DNA, 19 bp, Artificial sequence
  SiRNA target sequence
acatagtaaaggaatacat

SEQ ID NO: 141178 - DNA, 19 bp, Artificial sequence
  SiRNA target sequence
catagtaaaggaatacatt

SEQ ID NO: 141179 - DNA, 19 bp, Artificial sequence
  SiRNA target sequence
atagtaaaggaatacattc

SEQ ID NO: 141180 - DNA, 19 bp, Artificial sequence
  SiRNA target sequence
tagtaaaggaatacattca

SEQ ID NO: 141181 - DNA, 19 bp, Artificial sequence
  SiRNA target sequence
agtaaaggaatacattcac

SEQ ID NO: 141182 - DNA, 19 bp, Artificial sequence
  SiRNA target sequence
gtaaaggaatacattcacc

SEQ ID NO: 141183 - DNA, 19 bp, Artificial sequence
  SiRNA target sequence
taaaggaatacattcacca

SEQ ID NO: 141184 - DNA, 19 bp, Artificial sequence
  SiRNA target sequence
aaaggaatacattcaccat

SEQ ID NO: 141185 - DNA, 19 bp, Artificial sequence
  SiRNA target sequence
aaggaatacattcaccatc

SEQ ID NO: 141186 - DNA, 19 bp, Artificial sequence
  SiRNA target sequence
aggaatacattcaccatcc

SEQ ID NO: 141187 - DNA, 19 bp, Artificial sequence
  SiRNA target sequence
ggaatacattcaccatcct

SEQ ID NO: 141188 - DNA, 19 bp, Artificial sequence
  SiRNA target sequence
gaatacattcaccatcctc

SEQ ID NO: 141189 - DNA, 19 bp, Artificial sequence
  SiRNA target sequence
aatacattcaccatcctcc

SEQ ID NO: 141190 - DNA, 19 bp, Artificial sequence
  SiRNA target sequence
atacattcaccatcctcca

SEQ ID NO: 141191 - DNA, 19 bp, Artificial sequence
  SiRNA target sequence
tacattcaccatcctccat

SEQ ID NO: 141192 - DNA, 19 bp, Artificial sequence
  SiRNA target sequence
acattcaccatcctccatc

SEQ ID NO: 141193 - DNA, 19 bp, Artificial sequence
  SiRNA target sequence
cattcaccatcctccatca

SEQ ID NO: 141194 - DNA, 19 bp, Artificial sequence
  SiRNA target sequence
attcaccatcctccatcat

SEQ ID NO: 141195 - DNA, 19 bp, Artificial sequence
  SiRNA target sequence
ttcaccatcctccatcata

SEQ ID NO: 141196 - DNA, 19 bp, Artificial sequence
  SiRNA target sequence
tcaccatcctccatcatag

SEQ ID NO: 141197 - DNA, 19 bp, Artificial sequence
  SiRNA target sequence
caccatcctccatcatagg

SEQ ID NO: 141198 - DNA, 19 bp, Artificial sequence
  SiRNA target sequence
accatcctccatcatagga

SEQ ID NO: 141199 - DNA, 19 bp, Artificial sequence
  SiRNA target sequence
ccatcctccatcataggat

SEQ ID NO: 141200 - DNA, 19 bp, Artificial sequence
  SiRNA target sequence
catcctccatcataggatt

SEQ ID NO: 141201 - DNA, 19 bp, Artificial sequence
  SiRNA target sequence
atcctccatcataggattg

SEQ ID NO: 141202 - DNA, 19 bp, Artificial sequence
  SiRNA target sequence
tcctccatcataggattgt

SEQ ID NO: 141203 - DNA, 19 bp, Artificial sequence
  SiRNA target sequence
cctccatcataggattgtc

SEQ ID NO: 141204 - DNA, 19 bp, Artificial sequence
  SiRNA target sequence
ctccatcataggattgtct

SEQ ID NO: 141205 - DNA, 19 bp, Artificial sequence
  SiRNA target sequence
tccatcataggattgtctt

SEQ ID NO: 141206 - DNA, 19 bp, Artificial sequence
  SiRNA target sequence
ccatcataggattgtcttg

SEQ ID NO: 141207 - DNA, 19 bp, Artificial sequence
  SiRNA target sequence
catcataggattgtcttga

SEQ ID NO: 141208 - DNA, 19 bp, Artificial sequence
  SiRNA target sequence
atcataggattgtcttgat

SEQ ID NO: 141209 - DNA, 19 bp, Artificial sequence
  SiRNA target sequence
tcataggattgtcttgatt

SEQ ID NO: 141210 - DNA, 19 bp, Artificial sequence
  SiRNA target sequence
cataggattgtcttgatta

SEQ ID NO: 141211 - DNA, 19 bp, Artificial sequence
  SiRNA target sequence
ataggattgtcttgattaa

SEQ ID NO: 141212 - DNA, 19 bp, Artificial sequence
  SiRNA target sequence
taggattgtcttgattaac

SEQ ID NO: 141213 - DNA, 19 bp, Artificial sequence
  SiRNA target sequence
aggattgtcttgattaaca

SEQ ID NO: 141214 - DNA, 19 bp, Artificial sequence
  SiRNA target sequence
ggattgtcttgattaacac

SEQ ID NO: 141215 - DNA, 19 bp, Artificial sequence
  SiRNA target sequence
gattgtcttgattaacact

SEQ ID NO: 141216 - DNA, 19 bp, Artificial sequence
  SiRNA target sequence
attgtcttgattaacactg

SEQ ID NO: 141217 - DNA, 19 bp, Artificial sequence
  SiRNA target sequence
ttgtcttgattaacactgg

SEQ ID NO: 141218 - DNA, 19 bp, Artificial sequence
  SiRNA target sequence
tgtcttgattaacactggt

SEQ ID NO: 141219 - DNA, 19 bp, Artificial sequence
  SiRNA target sequence
gtcttgattaacactggtc

SEQ ID NO: 141220 - DNA, 19 bp, Artificial sequence
  SiRNA target sequence
tcttgattaacactggtct

SEQ ID NO: 141221 - DNA, 19 bp, Artificial sequence
  SiRNA target sequence
cttgattaacactggtctt

SEQ ID NO: 141222 - DNA, 19 bp, Artificial sequence
  SiRNA target sequence
ttgattaacactggtctta

SEQ ID NO: 141223 - DNA, 19 bp, Artificial sequence
  SiRNA target sequence
tgattaacactggtcttaa

SEQ ID NO: 141224 - DNA, 19 bp, Artificial sequence
  SiRNA target sequence
gattaacactggtcttaat

SEQ ID NO: 141225 - DNA, 19 bp, Artificial sequence
  SiRNA target sequence
attaacactggtcttaata

SEQ ID NO: 141226 - DNA, 19 bp, Artificial sequence
  SiRNA target sequence
ttaacactggtcttaatac

SEQ ID NO: 141227 - DNA, 19 bp, Artificial sequence
  SiRNA target sequence
taacactggtcttaataca

SEQ ID NO: 141228 - DNA, 19 bp, Artificial sequence
  SiRNA target sequence
aacactggtcttaatacac

SEQ ID NO: 141229 - DNA, 19 bp, Artificial sequence
  SiRNA target sequence
acactggtcttaatacaca

SEQ ID NO: 141230 - DNA, 19 bp, Artificial sequence
  SiRNA target sequence
cactggtcttaatacacaa

SEQ ID NO: 141231 - DNA, 19 bp, Artificial sequence
  SiRNA target sequence
actggtcttaatacacaat

SEQ ID NO: 141232 - DNA, 19 bp, Artificial sequence
  SiRNA target sequence
ctggtcttaatacacaatt

SEQ ID NO: 141233 - DNA, 19 bp, Artificial sequence
  SiRNA target sequence
tggtcttaatacacaattt

SEQ ID NO: 141234 - DNA, 19 bp, Artificial sequence
  SiRNA target sequence
ggtcttaatacacaattta

SEQ ID NO: 141235 - DNA, 19 bp, Artificial sequence
  SiRNA target sequence
gtcttaatacacaatttat

SEQ ID NO: 141236 - DNA, 19 bp, Artificial sequence
  SiRNA target sequence
tcttaatacacaatttatc

SEQ ID NO: 141237 - DNA, 19 bp, Artificial sequence
  SiRNA target sequence
cttaatacacaatttatct

SEQ ID NO: 141238 - DNA, 19 bp, Artificial sequence
  SiRNA target sequence
ttaatacacaatttatctt

SEQ ID NO: 141239 - DNA, 19 bp, Artificial sequence
  SiRNA target sequence
taatacacaatttatcttt

SEQ ID NO: 141240 - DNA, 19 bp, Artificial sequence
  SiRNA target sequence
aatacacaatttatcttta

SEQ ID NO: 141241 - DNA, 19 bp, Artificial sequence
  SiRNA target sequence
atacacaatttatctttat

SEQ ID NO: 141242 - DNA, 19 bp, Artificial sequence
  SiRNA target sequence
tacacaatttatctttata

SEQ ID NO: 141243 - DNA, 19 bp, Artificial sequence
  SiRNA target sequence
acacaatttatctttatat

SEQ ID NO: 141244 - DNA, 19 bp, Artificial sequence
  SiRNA target sequence
cacaatttatctttatata

SEQ ID NO: 141245 - DNA, 19 bp, Artificial sequence
  SiRNA target sequence
acaatttatctttatatat

SEQ ID NO: 141246 - DNA, 19 bp, Artificial sequence
  SiRNA target sequence
caatttatctttatatatc

SEQ ID NO: 141247 - DNA, 19 bp, Artificial sequence
  SiRNA target sequence
aatttatctttatatatca

SEQ ID NO: 141248 - DNA, 19 bp, Artificial sequence
  SiRNA target sequence
atttatctttatatatcaa

SEQ ID NO: 141249 - DNA, 19 bp, Artificial sequence
  SiRNA target sequence
tttatctttatatatcaac

SEQ ID NO: 141250 - DNA, 19 bp, Artificial sequence
  SiRNA target sequence
ttatctttatatatcaacc

SEQ ID NO: 141251 - DNA, 19 bp, Artificial sequence
  SiRNA target sequence
tatctttatatatcaacca

SEQ ID NO: 141252 - DNA, 19 bp, Artificial sequence
  SiRNA target sequence
atctttatatatcaaccac

SEQ ID NO: 141253 - DNA, 19 bp, Artificial sequence
  SiRNA target sequence
tctttatatatcaaccaca

SEQ ID NO: 141254 - DNA, 19 bp, Artificial sequence
  SiRNA target sequence
ctttatatatcaaccacac

SEQ ID NO: 141255 - DNA, 19 bp, Artificial sequence
  SiRNA target sequence
tttatatatcaaccacacc

SEQ ID NO: 141256 - DNA, 19 bp, Artificial sequence
  SiRNA target sequence
ttatatatcaaccacaccc

SEQ ID NO: 141257 - DNA, 19 bp, Artificial sequence
  SiRNA target sequence
tatatatcaaccacaccca

SEQ ID NO: 141258 - DNA, 19 bp, Artificial sequence
  SiRNA target sequence
atatatcaaccacacccat

SEQ ID NO: 141259 - DNA, 19 bp, Artificial sequence
  SiRNA target sequence
tatatcaaccacacccatc

SEQ ID NO: 141260 - DNA, 19 bp, Artificial sequence
  SiRNA target sequence
atatcaaccacacccatcc

SEQ ID NO: 141261 - DNA, 19 bp, Artificial sequence
  SiRNA target sequence
tatcaaccacacccatcct

SEQ ID NO: 141262 - DNA, 19 bp, Artificial sequence
  SiRNA target sequence
atcaaccacacccatcctg

SEQ ID NO: 141263 - DNA, 19 bp, Artificial sequence
  SiRNA target sequence
tcaaccacacccatcctga

SEQ ID NO: 141264 - DNA, 19 bp, Artificial sequence
  SiRNA target sequence
caaccacacccatcctgat

SEQ ID NO: 141265 - DNA, 19 bp, Artificial sequence
  SiRNA target sequence
aaccacacccatcctgatc

SEQ ID NO: 141266 - DNA, 19 bp, Artificial sequence
  SiRNA target sequence
accacacccatcctgatcc

SEQ ID NO: 141267 - DNA, 19 bp, Artificial sequence
  SiRNA target sequence
ccacacccatcctgatcca

SEQ ID NO: 141268 - DNA, 19 bp, Artificial sequence
  SiRNA target sequence
cacacccatcctgatccaa

SEQ ID NO: 141269 - DNA, 19 bp, Artificial sequence
  SiRNA target sequence
acacccatcctgatccaaa

SEQ ID NO: 141270 - DNA, 19 bp, Artificial sequence
  SiRNA target sequence
cacccatcctgatccaaat

SEQ ID NO: 141271 - DNA, 19 bp, Artificial sequence
  SiRNA target sequence
acccatcctgatccaaata

SEQ ID NO: 141272 - DNA, 19 bp, Artificial sequence
  SiRNA target sequence
cccatcctgatccaaataa

SEQ ID NO: 141273 - DNA, 19 bp, Artificial sequence
  SiRNA target sequence
ccatcctgatccaaataat

SEQ ID NO: 141274 - DNA, 19 bp, Artificial sequence
  SiRNA target sequence
catcctgatccaaataatt

SEQ ID NO: 141275 - DNA, 19 bp, Artificial sequence
  SiRNA target sequence
atcctgatccaaataattt

SEQ ID NO: 141276 - DNA, 19 bp, Artificial sequence
  SiRNA target sequence
tcctgatccaaataatttt

SEQ ID NO: 141277 - DNA, 19 bp, Artificial sequence
  SiRNA target sequence
cctgatccaaataatttta

SEQ ID NO: 141278 - DNA, 19 bp, Artificial sequence
  SiRNA target sequence
ctgatccaaataattttac

SEQ ID NO: 141279 - DNA, 19 bp, Artificial sequence
  SiRNA target sequence
tgatccaaataattttaca

SEQ ID NO: 141280 - DNA, 19 bp, Artificial sequence
  SiRNA target sequence
gatccaaataattttacag

SEQ ID NO: 141281 - DNA, 19 bp, Artificial sequence
  SiRNA target sequence
atccaaataattttacagc

SEQ ID NO: 141282 - DNA, 19 bp, Artificial sequence
  SiRNA target sequence
tccaaataattttacagct

SEQ ID NO: 141283 - DNA, 19 bp, Artificial sequence
  SiRNA target sequence
ccaaataattttacagctt

SEQ ID NO: 141284 - DNA, 19 bp, Artificial sequence
  SiRNA target sequence
caaataattttacagcttc

SEQ ID NO: 141285 - DNA, 19 bp, Artificial sequence
  SiRNA target sequence
aaataattttacagcttca

SEQ ID NO: 141286 - DNA, 19 bp, Artificial sequence
  SiRNA target sequence
aataattttacagcttcag

SEQ ID NO: 141287 - DNA, 19 bp, Artificial sequence
  SiRNA target sequence
ataattttacagcttcagt

SEQ ID NO: 141288 - DNA, 19 bp, Artificial sequence
  SiRNA target sequence
taattttacagcttcagta

SEQ ID NO: 141289 - DNA, 19 bp, Artificial sequence
  SiRNA target sequence
aattttacagcttcagtat

SEQ ID NO: 141290 - DNA, 19 bp, Artificial sequence
  SiRNA target sequence
attttacagcttcagtatt

SEQ ID NO: 141291 - DNA, 19 bp, Artificial sequence
  SiRNA target sequence
ttttacagcttcagtatta

SEQ ID NO: 141292 - DNA, 19 bp, Artificial sequence
  SiRNA target sequence
tttacagcttcagtattaa

SEQ ID NO: 141293 - DNA, 19 bp, Artificial sequence
  SiRNA target sequence
ttacagcttcagtattaaa

SEQ ID NO: 141294 - DNA, 19 bp, Artificial sequence
  SiRNA target sequence
tacagcttcagtattaaaa

SEQ ID NO: 141295 - DNA, 19 bp, Artificial sequence
  SiRNA target sequence
acagcttcagtattaaaat

SEQ ID NO: 141296 - DNA, 19 bp, Artificial sequence
  SiRNA target sequence
cagcttcagtattaaaatt

SEQ ID NO: 141297 - DNA, 19 bp, Artificial sequence
  SiRNA target sequence
agcttcagtattaaaattc

SEQ ID NO: 141298 - DNA, 19 bp, Artificial sequence
  SiRNA target sequence
gcttcagtattaaaattct

SEQ ID NO: 141299 - DNA, 19 bp, Artificial sequence
  SiRNA target sequence
cttcagtattaaaattctc

SEQ ID NO: 141300 - DNA, 19 bp, Artificial sequence
  SiRNA target sequence
ttcagtattaaaattctcc

SEQ ID NO: 141301 - DNA, 19 bp, Artificial sequence
  SiRNA target sequence
tcagtattaaaattctcct

SEQ ID NO: 141302 - DNA, 19 bp, Artificial sequence
  SiRNA target sequence
cagtattaaaattctcctt

SEQ ID NO: 141303 - DNA, 19 bp, Artificial sequence
  SiRNA target sequence
agtattaaaattctcctta

SEQ ID NO: 141304 - DNA, 19 bp, Artificial sequence
  SiRNA target sequence
gtattaaaattctccttaa

SEQ ID NO: 141305 - DNA, 19 bp, Artificial sequence
  SiRNA target sequence
tattaaaattctccttaaa

SEQ ID NO: 141306 - DNA, 19 bp, Artificial sequence
  SiRNA target sequence
attaaaattctccttaaat

SEQ ID NO: 141307 - DNA, 19 bp, Artificial sequence
  SiRNA target sequence
ttaaaattctccttaaatt

SEQ ID NO: 141308 - DNA, 19 bp, Artificial sequence
  SiRNA target sequence
taaaattctccttaaattt

SEQ ID NO: 141309 - DNA, 19 bp, Artificial sequence
  SiRNA target sequence
aaaattctccttaaattta

SEQ ID NO: 141310 - DNA, 19 bp, Artificial sequence
  SiRNA target sequence
aaattctccttaaatttat

SEQ ID NO: 141311 - DNA, 19 bp, Artificial sequence
  SiRNA target sequence
aattctccttaaatttatt

SEQ ID NO: 141312 - DNA, 19 bp, Artificial sequence
  SiRNA target sequence
attctccttaaatttattt

SEQ ID NO: 141313 - DNA, 19 bp, Artificial sequence
  SiRNA target sequence
ttctccttaaatttattta

SEQ ID NO: 141314 - DNA, 19 bp, Artificial sequence
  SiRNA target sequence
tctccttaaatttatttat

SEQ ID NO: 141315 - DNA, 19 bp, Artificial sequence
  SiRNA target sequence
ctccttaaatttatttatt

SEQ ID NO: 141316 - DNA, 19 bp, Artificial sequence
  SiRNA target sequence
tccttaaatttatttattg

SEQ ID NO: 141317 - DNA, 19 bp, Artificial sequence
  SiRNA target sequence
ccttaaatttatttattga

SEQ ID NO: 141318 - DNA, 19 bp, Artificial sequence
  SiRNA target sequence
cttaaatttatttattgat

SEQ ID NO: 141319 - DNA, 19 bp, Artificial sequence
  SiRNA target sequence
ttaaatttatttattgatc

SEQ ID NO: 141320 - DNA, 19 bp, Artificial sequence
  SiRNA target sequence
taaatttatttattgatcc

SEQ ID NO: 141321 - DNA, 19 bp, Artificial sequence
  SiRNA target sequence
aaatttatttattgatcca

SEQ ID NO: 141322 - DNA, 19 bp, Artificial sequence
  SiRNA target sequence
aatttatttattgatccaa

SEQ ID NO: 141323 - DNA, 19 bp, Artificial sequence
  SiRNA target sequence
atttatttattgatccaaa

SEQ ID NO: 141324 - DNA, 19 bp, Artificial sequence
  SiRNA target sequence
tttatttattgatccaaag

SEQ ID NO: 141325 - DNA, 19 bp, Artificial sequence
  SiRNA target sequence
ttatttattgatccaaagt

SEQ ID NO: 141326 - DNA, 19 bp, Artificial sequence
  SiRNA target sequence
tatttattgatccaaagtc

SEQ ID NO: 141327 - DNA, 19 bp, Artificial sequence
  SiRNA target sequence
atttattgatccaaagtct

SEQ ID NO: 141328 - DNA, 19 bp, Artificial sequence
  SiRNA target sequence
tttattgatccaaagtctt

SEQ ID NO: 141329 - DNA, 19 bp, Artificial sequence
  SiRNA target sequence
ttattgatccaaagtcttt

SEQ ID NO: 141330 - DNA, 19 bp, Artificial sequence
  SiRNA target sequence
tattgatccaaagtctttt

SEQ ID NO: 141331 - DNA, 19 bp, Artificial sequence
  SiRNA target sequence
attgatccaaagtctttta

SEQ ID NO: 141332 - DNA, 19 bp, Artificial sequence
  SiRNA target sequence
ttgatccaaagtcttttat

SEQ ID NO: 141333 - DNA, 19 bp, Artificial sequence
  SiRNA target sequence
tgatccaaagtcttttatt

SEQ ID NO: 141334 - DNA, 19 bp, Artificial sequence
  SiRNA target sequence
gatccaaagtcttttatta

SEQ ID NO: 141335 - DNA, 19 bp, Artificial sequence
  SiRNA target sequence
atccaaagtcttttattat

SEQ ID NO: 141336 - DNA, 19 bp, Artificial sequence
  SiRNA target sequence
tccaaagtcttttattata

SEQ ID NO: 141337 - DNA, 19 bp, Artificial sequence
  SiRNA target sequence
ccaaagtcttttattatag

SEQ ID NO: 141338 - DNA, 19 bp, Artificial sequence
  SiRNA target sequence
caaagtcttttattatagc

SEQ ID NO: 141339 - DNA, 19 bp, Artificial sequence
  SiRNA target sequence
aaagtcttttattatagca

SEQ ID NO: 141340 - DNA, 19 bp, Artificial sequence
  SiRNA target sequence
aagtcttttattatagcac

SEQ ID NO: 141341 - DNA, 19 bp, Artificial sequence
  SiRNA target sequence
agtcttttattatagcact

SEQ ID NO: 141342 - DNA, 19 bp, Artificial sequence
  SiRNA target sequence
gtcttttattatagcactt

SEQ ID NO: 141343 - DNA, 19 bp, Artificial sequence
  SiRNA target sequence
tcttttattatagcacttt

SEQ ID NO: 141344 - DNA, 19 bp, Artificial sequence
  SiRNA target sequence
cttttattatagcactttc

SEQ ID NO: 141345 - DNA, 19 bp, Artificial sequence
  SiRNA target sequence
ttttattatagcactttcc

SEQ ID NO: 141346 - DNA, 19 bp, Artificial sequence
  SiRNA target sequence
tttattatagcactttcca

SEQ ID NO: 141347 - DNA, 19 bp, Artificial sequence
  SiRNA target sequence
ttattatagcactttccaa

SEQ ID NO: 141348 - DNA, 19 bp, Artificial sequence
  SiRNA target sequence
tattatagcactttccaac

SEQ ID NO: 141349 - DNA, 19 bp, Artificial sequence
  SiRNA target sequence
attatagcactttccaact

SEQ ID NO: 141350 - DNA, 19 bp, Artificial sequence
  SiRNA target sequence
ttatagcactttccaactg

SEQ ID NO: 141351 - DNA, 19 bp, Artificial sequence
  SiRNA target sequence
tatagcactttccaactgg

SEQ ID NO: 141352 - DNA, 19 bp, Artificial sequence
  SiRNA target sequence
atagcactttccaactggg

SEQ ID NO: 141353 - DNA, 19 bp, Artificial sequence
  SiRNA target sequence
tagcactttccaactggga

SEQ ID NO: 141354 - DNA, 19 bp, Artificial sequence
  SiRNA target sequence
agcactttccaactgggaa

SEQ ID NO: 141355 - DNA, 19 bp, Artificial sequence
  SiRNA target sequence
gcactttccaactgggaag

SEQ ID NO: 141356 - DNA, 19 bp, Artificial sequence
  SiRNA target sequence
cactttccaactgggaaga

SEQ ID NO: 141357 - DNA, 19 bp, Artificial sequence
  SiRNA target sequence
actttccaactgggaagaa

SEQ ID NO: 141358 - DNA, 19 bp, Artificial sequence
  SiRNA target sequence
ctttccaactgggaagaaa

SEQ ID NO: 141359 - DNA, 19 bp, Artificial sequence
  SiRNA target sequence
tttccaactgggaagaaat

SEQ ID NO: 141360 - DNA, 19 bp, Artificial sequence
  SiRNA target sequence
ttccaactgggaagaaatc

SEQ ID NO: 141361 - DNA, 19 bp, Artificial sequence
  SiRNA target sequence
tccaactgggaagaaatct

SEQ ID NO: 141362 - DNA, 19 bp, Artificial sequence
  SiRNA target sequence
ccaactgggaagaaatctt

SEQ ID NO: 141363 - DNA, 19 bp, Artificial sequence
  SiRNA target sequence
caactgggaagaaatcttt

SEQ ID NO: 141364 - DNA, 19 bp, Artificial sequence
  SiRNA target sequence
aactgggaagaaatctttt

SEQ ID NO: 141365 - DNA, 19 bp, Artificial sequence
  SiRNA target sequence
actgggaagaaatcttttt

SEQ ID NO: 141366 - DNA, 19 bp, Artificial sequence
  SiRNA target sequence
ctgggaagaaatcttttta

SEQ ID NO: 141367 - DNA, 19 bp, Artificial sequence
  SiRNA target sequence
tgggaagaaatctttttat

SEQ ID NO: 141368 - DNA, 19 bp, Artificial sequence
  SiRNA target sequence
gggaagaaatctttttatt

SEQ ID NO: 141369 - DNA, 19 bp, Artificial sequence
  SiRNA target sequence
ggaagaaatctttttattt

SEQ ID NO: 141370 - DNA, 19 bp, Artificial sequence
  SiRNA target sequence
gaagaaatctttttatttt

SEQ ID NO: 141371 - DNA, 19 bp, Artificial sequence
  SiRNA target sequence
aagaaatctttttattttc

SEQ ID NO: 141372 - DNA, 19 bp, Artificial sequence
  SiRNA target sequence
agaaatctttttattttct

SEQ ID NO: 141373 - DNA, 19 bp, Artificial sequence
  SiRNA target sequence
gaaatctttttattttctg

SEQ ID NO: 141374 - DNA, 19 bp, Artificial sequence
  SiRNA target sequence
aaatctttttattttctgg

SEQ ID NO: 141375 - DNA, 19 bp, Artificial sequence
  SiRNA target sequence
aatctttttattttctggt

SEQ ID NO: 141376 - DNA, 19 bp, Artificial sequence
  SiRNA target sequence
atctttttattttctggtg

SEQ ID NO: 141377 - DNA, 19 bp, Artificial sequence
  SiRNA target sequence
tctttttattttctggtga

SEQ ID NO: 141378 - DNA, 19 bp, Artificial sequence
  SiRNA target sequence
ctttttattttctggtgac

SEQ ID NO: 141379 - DNA, 19 bp, Artificial sequence
  SiRNA target sequence
tttttattttctggtgaca

SEQ ID NO: 141380 - DNA, 19 bp, Artificial sequence
  SiRNA target sequence
ttttattttctggtgacat

SEQ ID NO: 141381 - DNA, 19 bp, Artificial sequence
  SiRNA target sequence
tttattttctggtgacatt

SEQ ID NO: 141382 - DNA, 19 bp, Artificial sequence
  SiRNA target sequence
ttattttctggtgacatta

SEQ ID NO: 141383 - DNA, 19 bp, Artificial sequence
  SiRNA target sequence
tattttctggtgacattac

SEQ ID NO: 141384 - DNA, 19 bp, Artificial sequence
  SiRNA target sequence
attttctggtgacattacc

SEQ ID NO: 141385 - DNA, 19 bp, Artificial sequence
  SiRNA target sequence
ttttctggtgacattacca

SEQ ID NO: 141386 - DNA, 19 bp, Artificial sequence
  SiRNA target sequence
tttctggtgacattaccaa

SEQ ID NO: 141387 - DNA, 19 bp, Artificial sequence
  SiRNA target sequence
ttctggtgacattaccaac

SEQ ID NO: 141388 - DNA, 19 bp, Artificial sequence
  SiRNA target sequence
tctggtgacattaccaacc

SEQ ID NO: 141389 - DNA, 19 bp, Artificial sequence
  SiRNA target sequence
ctggtgacattaccaacca

SEQ ID NO: 141390 - DNA, 19 bp, Artificial sequence
  SiRNA target sequence
tggtgacattaccaaccag

SEQ ID NO: 141391 - DNA, 19 bp, Artificial sequence
  SiRNA target sequence
ggtgacattaccaaccaga

SEQ ID NO: 141392 - DNA, 19 bp, Artificial sequence
  SiRNA target sequence
gtgacattaccaaccagaa

SEQ ID NO: 141393 - DNA, 19 bp, Artificial sequence
  SiRNA target sequence
tgacattaccaaccagaaa

SEQ ID NO: 141394 - DNA, 19 bp, Artificial sequence
  SiRNA target sequence
gacattaccaaccagaaaa

SEQ ID NO: 141395 - DNA, 19 bp, Artificial sequence
  SiRNA target sequence
acattaccaaccagaaaag

SEQ ID NO: 141396 - DNA, 19 bp, Artificial sequence
  SiRNA target sequence
cattaccaaccagaaaaga

SEQ ID NO: 141397 - DNA, 19 bp, Artificial sequence
  SiRNA target sequence
attaccaaccagaaaagac

SEQ ID NO: 141398 - DNA, 19 bp, Artificial sequence
  SiRNA target sequence
ttaccaaccagaaaagact

SEQ ID NO: 141399 - DNA, 19 bp, Artificial sequence
  SiRNA target sequence
taccaaccagaaaagacta

SEQ ID NO: 141400 - DNA, 19 bp, Artificial sequence
  SiRNA target sequence
accaaccagaaaagactat

SEQ ID NO: 141401 - DNA, 19 bp, Artificial sequence
  SiRNA target sequence
ccaaccagaaaagactatg

SEQ ID NO: 141402 - DNA, 19 bp, Artificial sequence
  SiRNA target sequence
caaccagaaaagactatgg

SEQ ID NO: 141403 - DNA, 19 bp, Artificial sequence
  SiRNA target sequence
aaccagaaaagactatggt

SEQ ID NO: 141404 - DNA, 19 bp, Artificial sequence
  SiRNA target sequence
accagaaaagactatggtt

SEQ ID NO: 141405 - DNA, 19 bp, Artificial sequence
  SiRNA target sequence
ccagaaaagactatggttg

SEQ ID NO: 141406 - DNA, 19 bp, Artificial sequence
  SiRNA target sequence
cagaaaagactatggttgt

SEQ ID NO: 141407 - DNA, 19 bp, Artificial sequence
  SiRNA target sequence
agaaaagactatggttgta

SEQ ID NO: 141408 - DNA, 19 bp, Artificial sequence
  SiRNA target sequence
gaaaagactatggttgtaa

SEQ ID NO: 141409 - DNA, 19 bp, Artificial sequence
  SiRNA target sequence
aaaagactatggttgtaat

SEQ ID NO: 141410 - DNA, 19 bp, Artificial sequence
  SiRNA target sequence
aaagactatggttgtaatg

SEQ ID NO: 141411 - DNA, 19 bp, Artificial sequence
  SiRNA target sequence
aagactatggttgtaatga

SEQ ID NO: 141412 - DNA, 19 bp, Artificial sequence
  SiRNA target sequence
agactatggttgtaatgac

SEQ ID NO: 141413 - DNA, 19 bp, Artificial sequence
  SiRNA target sequence
gactatggttgtaatgacc

SEQ ID NO: 141414 - DNA, 19 bp, Artificial sequence
  SiRNA target sequence
actatggttgtaatgacca

SEQ ID NO: 141415 - DNA, 19 bp, Artificial sequence
  SiRNA target sequence
ctatggttgtaatgaccac

SEQ ID NO: 141416 - DNA, 19 bp, Artificial sequence
  SiRNA target sequence
tatggttgtaatgaccacc

SEQ ID NO: 141417 - DNA, 19 bp, Artificial sequence
  SiRNA target sequence
atggttgtaatgaccacca

SEQ ID NO: 141418 - DNA, 19 bp, Artificial sequence
  SiRNA target sequence
tggttgtaatgaccaccac

SEQ ID NO: 141419 - DNA, 19 bp, Artificial sequence
  SiRNA target sequence
ggttgtaatgaccaccacc

SEQ ID NO: 141420 - DNA, 19 bp, Artificial sequence
  SiRNA target sequence
gttgtaatgaccaccacca

SEQ ID NO: 141421 - DNA, 19 bp, Artificial sequence
  SiRNA target sequence
ttgtaatgaccaccaccat

SEQ ID NO: 141422 - DNA, 19 bp, Artificial sequence
  SiRNA target sequence
tgtaatgaccaccaccata

SEQ ID NO: 141423 - DNA, 19 bp, Artificial sequence
  SiRNA target sequence
gtaatgaccaccaccataa

SEQ ID NO: 141424 - DNA, 19 bp, Artificial sequence
  SiRNA target sequence
taatgaccaccaccataat

SEQ ID NO: 141425 - DNA, 19 bp, Artificial sequence
  SiRNA target sequence
aatgaccaccaccataatc

SEQ ID NO: 141426 - DNA, 19 bp, Artificial sequence
  SiRNA target sequence
atgaccaccaccataatct

SEQ ID NO: 141427 - DNA, 19 bp, Artificial sequence
  SiRNA target sequence
tgaccaccaccataatctc

SEQ ID NO: 141428 - DNA, 19 bp, Artificial sequence
  SiRNA target sequence
gaccaccaccataatctct

SEQ ID NO: 141429 - DNA, 19 bp, Artificial sequence
  SiRNA target sequence
accaccaccataatctctt

SEQ ID NO: 141430 - DNA, 19 bp, Artificial sequence
  SiRNA target sequence
ccaccaccataatctctta

SEQ ID NO: 141431 - DNA, 19 bp, Artificial sequence
  SiRNA target sequence
caccaccataatctcttaa

SEQ ID NO: 141432 - DNA, 19 bp, Artificial sequence
  SiRNA target sequence
accaccataatctcttaat

SEQ ID NO: 141433 - DNA, 19 bp, Artificial sequence
  SiRNA target sequence
ccaccataatctcttaatt

SEQ ID NO: 141434 - DNA, 19 bp, Artificial sequence
  SiRNA target sequence
caccataatctcttaattg

SEQ ID NO: 141435 - DNA, 19 bp, Artificial sequence
  SiRNA target sequence
accataatctcttaattgt

SEQ ID NO: 141436 - DNA, 19 bp, Artificial sequence
  SiRNA target sequence
ccataatctcttaattgtt

SEQ ID NO: 141437 - DNA, 19 bp, Artificial sequence
  SiRNA target sequence
cataatctcttaattgttt

SEQ ID NO: 141438 - DNA, 19 bp, Artificial sequence
  SiRNA target sequence
ataatctcttaattgttta

SEQ ID NO: 141439 - DNA, 19 bp, Artificial sequence
  SiRNA target sequence
taatctcttaattgtttat

SEQ ID NO: 141440 - DNA, 19 bp, Artificial sequence
  SiRNA target sequence
aatctcttaattgtttatc

SEQ ID NO: 141441 - DNA, 19 bp, Artificial sequence
  SiRNA target sequence
atctcttaattgtttatca

SEQ ID NO: 141442 - DNA, 19 bp, Artificial sequence
  SiRNA target sequence
tctcttaattgtttatcaa

SEQ ID NO: 141443 - DNA, 19 bp, Artificial sequence
  SiRNA target sequence
ctcttaattgtttatcaac

SEQ ID NO: 141444 - DNA, 19 bp, Artificial sequence
  SiRNA target sequence
tcttaattgtttatcaaca

SEQ ID NO: 141445 - DNA, 19 bp, Artificial sequence
  SiRNA target sequence
cttaattgtttatcaacaa

SEQ ID NO: 141446 - DNA, 19 bp, Artificial sequence
  SiRNA target sequence
ttaattgtttatcaacaag

SEQ ID NO: 141447 - DNA, 19 bp, Artificial sequence
  SiRNA target sequence
taattgtttatcaacaagt

SEQ ID NO: 141448 - DNA, 19 bp, Artificial sequence
  SiRNA target sequence
aattgtttatcaacaagtg

SEQ ID NO: 141449 - DNA, 19 bp, Artificial sequence
  SiRNA target sequence
attgtttatcaacaagtgc

SEQ ID NO: 141450 - DNA, 19 bp, Artificial sequence
  SiRNA target sequence
ttgtttatcaacaagtgca

SEQ ID NO: 141451 - DNA, 19 bp, Artificial sequence
  SiRNA target sequence
tgtttatcaacaagtgcat

SEQ ID NO: 141452 - DNA, 19 bp, Artificial sequence
  SiRNA target sequence
gtttatcaacaagtgcatt

SEQ ID NO: 141453 - DNA, 19 bp, Artificial sequence
  SiRNA target sequence
tttatcaacaagtgcattt

SEQ ID NO: 141454 - DNA, 19 bp, Artificial sequence
  SiRNA target sequence
ttatcaacaagtgcatttc

SEQ ID NO: 141455 - DNA, 19 bp, Artificial sequence
  SiRNA target sequence
tatcaacaagtgcatttcc

SEQ ID NO: 141456 - DNA, 19 bp, Artificial sequence
  SiRNA target sequence
atcaacaagtgcatttcct

SEQ ID NO: 141457 - DNA, 19 bp, Artificial sequence
  SiRNA target sequence
tcaacaagtgcatttcctt

SEQ ID NO: 141458 - DNA, 19 bp, Artificial sequence
  SiRNA target sequence
caacaagtgcatttccttt

SEQ ID NO: 141459 - DNA, 19 bp, Artificial sequence
  SiRNA target sequence
aacaagtgcatttccttta

SEQ ID NO: 141460 - DNA, 19 bp, Artificial sequence
  SiRNA target sequence
acaagtgcatttcctttat

SEQ ID NO: 141461 - DNA, 19 bp, Artificial sequence
  SiRNA target sequence
caagtgcatttcctttatt

SEQ ID NO: 141462 - DNA, 19 bp, Artificial sequence
  SiRNA target sequence
aagtgcatttcctttatta

SEQ ID NO: 141463 - DNA, 19 bp, Artificial sequence
  SiRNA target sequence
agtgcatttcctttattat

SEQ ID NO: 141464 - DNA, 19 bp, Artificial sequence
  SiRNA target sequence
gtgcatttcctttattatt

SEQ ID NO: 141465 - DNA, 19 bp, Artificial sequence
  SiRNA target sequence
tgcatttcctttattatta

SEQ ID NO: 141466 - DNA, 19 bp, Artificial sequence
  SiRNA target sequence
gcatttcctttattattaa

SEQ ID NO: 141467 - DNA, 19 bp, Artificial sequence
  SiRNA target sequence
catttcctttattattaaa

SEQ ID NO: 141468 - DNA, 19 bp, Artificial sequence
  SiRNA target sequence
atttcctttattattaaaa

SEQ ID NO: 141469 - DNA, 19 bp, Artificial sequence
  SiRNA target sequence
tttcctttattattaaaaa

SEQ ID NO: 141470 - DNA, 19 bp, Artificial sequence
  SiRNA target sequence
ttcctttattattaaaaag

SEQ ID NO: 141471 - DNA, 19 bp, Artificial sequence
  SiRNA target sequence
tcctttattattaaaaagt

SEQ ID NO: 141472 - DNA, 19 bp, Artificial sequence
  SiRNA target sequence
cctttattattaaaaagta

SEQ ID NO: 141473 - DNA, 19 bp, Artificial sequence
  SiRNA target sequence
ctttattattaaaaagtaa

SEQ ID NO: 141474 - DNA, 19 bp, Artificial sequence
  SiRNA target sequence
tttattattaaaaagtaat

SEQ ID NO: 141475 - DNA, 19 bp, Artificial sequence
  SiRNA target sequence
ttattattaaaaagtaatg

SEQ ID NO: 141476 - DNA, 19 bp, Artificial sequence
  SiRNA target sequence
tattattaaaaagtaatga

SEQ ID NO: 141477 - DNA, 19 bp, Artificial sequence
  SiRNA target sequence
attattaaaaagtaatgaa

SEQ ID NO: 141478 - DNA, 19 bp, Artificial sequence
  SiRNA target sequence
ttattaaaaagtaatgaat

SEQ ID NO: 141479 - DNA, 19 bp, Artificial sequence
  SiRNA target sequence
tattaaaaagtaatgaatt

SEQ ID NO: 141480 - DNA, 19 bp, Artificial sequence
  SiRNA target sequence
attaaaaagtaatgaattt

SEQ ID NO: 141481 - DNA, 19 bp, Artificial sequence
  SiRNA target sequence
ttaaaaagtaatgaattta

SEQ ID NO: 141482 - DNA, 19 bp, Artificial sequence
  SiRNA target sequence
taaaaagtaatgaatttaa

SEQ ID NO: 141483 - DNA, 19 bp, Artificial sequence
  SiRNA target sequence
aaaaagtaatgaatttaat

SEQ ID NO: 141484 - DNA, 19 bp, Artificial sequence
  SiRNA target sequence
aaaagtaatgaatttaatg

SEQ ID NO: 141485 - DNA, 19 bp, Artificial sequence
  SiRNA target sequence
aaagtaatgaatttaatga

SEQ ID NO: 141486 - DNA, 19 bp, Artificial sequence
  SiRNA target sequence
aagtaatgaatttaatgat

SEQ ID NO: 141487 - DNA, 19 bp, Artificial sequence
  SiRNA target sequence
agtaatgaatttaatgatt

SEQ ID NO: 141488 - DNA, 19 bp, Artificial sequence
  SiRNA target sequence
gtaatgaatttaatgattt

SEQ ID NO: 141489 - DNA, 19 bp, Artificial sequence
  SiRNA target sequence
taatgaatttaatgattta

SEQ ID NO: 141490 - DNA, 19 bp, Artificial sequence
  SiRNA target sequence
aatgaatttaatgatttac

SEQ ID NO: 141491 - DNA, 19 bp, Artificial sequence
  SiRNA target sequence
atgaatttaatgatttacc

SEQ ID NO: 141492 - DNA, 19 bp, Artificial sequence
  SiRNA target sequence
tgaatttaatgatttacca

SEQ ID NO: 141493 - DNA, 19 bp, Artificial sequence
  SiRNA target sequence
gaatttaatgatttaccac

SEQ ID NO: 141494 - DNA, 19 bp, Artificial sequence
  SiRNA target sequence
aatttaatgatttaccaca

SEQ ID NO: 141495 - DNA, 19 bp, Artificial sequence
  SiRNA target sequence
atttaatgatttaccacac

SEQ ID NO: 141496 - DNA, 19 bp, Artificial sequence
  SiRNA target sequence
tttaatgatttaccacaca

SEQ ID NO: 141497 - DNA, 19 bp, Artificial sequence
  SiRNA target sequence
ttaatgatttaccacacaa

SEQ ID NO: 141498 - DNA, 19 bp, Artificial sequence
  SiRNA target sequence
taatgatttaccacacaaa

SEQ ID NO: 141499 - DNA, 19 bp, Artificial sequence
  SiRNA target sequence
aatgatttaccacacaaat

SEQ ID NO: 141500 - DNA, 19 bp, Artificial sequence
  SiRNA target sequence
atgatttaccacacaaatt

SEQ ID NO: 141501 - DNA, 19 bp, Artificial sequence
  SiRNA target sequence
tgatttaccacacaaattg

SEQ ID NO: 141502 - DNA, 19 bp, Artificial sequence
  SiRNA target sequence
gatttaccacacaaattgt

SEQ ID NO: 141503 - DNA, 19 bp, Artificial sequence
  SiRNA target sequence
atttaccacacaaattgtt

SEQ ID NO: 141504 - DNA, 19 bp, Artificial sequence
  SiRNA target sequence
tttaccacacaaattgtta

SEQ ID NO: 141505 - DNA, 19 bp, Artificial sequence
  SiRNA target sequence
ttaccacacaaattgttat

SEQ ID NO: 141506 - DNA, 19 bp, Artificial sequence
  SiRNA target sequence
taccacacaaattgttatc

SEQ ID NO: 141507 - DNA, 19 bp, Artificial sequence
  SiRNA target sequence
accacacaaattgttatct

SEQ ID NO: 141508 - DNA, 19 bp, Artificial sequence
  SiRNA target sequence
ccacacaaattgttatcta

SEQ ID NO: 141509 - DNA, 19 bp, Artificial sequence
  SiRNA target sequence
cacacaaattgttatctaa

SEQ ID NO: 141510 - DNA, 19 bp, Artificial sequence
  SiRNA target sequence
acacaaattgttatctaat

SEQ ID NO: 141511 - DNA, 19 bp, Artificial sequence
  SiRNA target sequence
cacaaattgttatctaata

SEQ ID NO: 141512 - DNA, 19 bp, Artificial sequence
  SiRNA target sequence
acaaattgttatctaatat

SEQ ID NO: 141513 - DNA, 19 bp, Artificial sequence
  SiRNA target sequence
caaattgttatctaatatt

SEQ ID NO: 141514 - DNA, 19 bp, Artificial sequence
  SiRNA target sequence
aaattgttatctaatatta

SEQ ID NO: 141515 - DNA, 19 bp, Artificial sequence
  SiRNA target sequence
aattgttatctaatattat

SEQ ID NO: 141516 - DNA, 19 bp, Artificial sequence
  SiRNA target sequence
attgttatctaatattatt

SEQ ID NO: 141517 - DNA, 19 bp, Artificial sequence
  SiRNA target sequence
ttgttatctaatattattt

SEQ ID NO: 141518 - DNA, 19 bp, Artificial sequence
  SiRNA target sequence
tgttatctaatattatttt

SEQ ID NO: 141519 - DNA, 19 bp, Artificial sequence
  SiRNA target sequence
gttatctaatattatttta

SEQ ID NO: 141520 - DNA, 19 bp, Artificial sequence
  SiRNA target sequence
ttatctaatattattttat

SEQ ID NO: 141521 - DNA, 19 bp, Artificial sequence
  SiRNA target sequence
tatctaatattattttatt

SEQ ID NO: 141522 - DNA, 19 bp, Artificial sequence
  SiRNA target sequence
atctaatattattttatta

SEQ ID NO: 141523 - DNA, 19 bp, Artificial sequence
  SiRNA target sequence
tctaatattattttattaa

SEQ ID NO: 141524 - DNA, 19 bp, Artificial sequence
  SiRNA target sequence
ctaatattattttattaag

SEQ ID NO: 141525 - DNA, 19 bp, Artificial sequence
  SiRNA target sequence
taatattattttattaaga

SEQ ID NO: 141526 - DNA, 19 bp, Artificial sequence
  SiRNA target sequence
aatattattttattaagag

SEQ ID NO: 141527 - DNA, 19 bp, Artificial sequence
  SiRNA target sequence
atattattttattaagagt

SEQ ID NO: 141528 - DNA, 19 bp, Artificial sequence
  SiRNA target sequence
tattattttattaagagtg

SEQ ID NO: 141529 - DNA, 19 bp, Artificial sequence
  SiRNA target sequence
attattttattaagagtgt

SEQ ID NO: 141530 - DNA, 19 bp, Artificial sequence
  SiRNA target sequence
ttattttattaagagtgtc

SEQ ID NO: 141531 - DNA, 19 bp, Artificial sequence
  SiRNA target sequence
tattttattaagagtgtct

SEQ ID NO: 141532 - DNA, 19 bp, Artificial sequence
  SiRNA target sequence
attttattaagagtgtcta

SEQ ID NO: 141533 - DNA, 19 bp, Artificial sequence
  SiRNA target sequence
ttttattaagagtgtctac

SEQ ID NO: 141534 - DNA, 19 bp, Artificial sequence
  SiRNA target sequence
tttattaagagtgtctaca

SEQ ID NO: 141535 - DNA, 19 bp, Artificial sequence
  SiRNA target sequence
ttattaagagtgtctacat

SEQ ID NO: 141536 - DNA, 19 bp, Artificial sequence
  SiRNA target sequence
tattaagagtgtctacata

SEQ ID NO: 141537 - DNA, 19 bp, Artificial sequence
  SiRNA target sequence
attaagagtgtctacatac

SEQ ID NO: 141538 - DNA, 19 bp, Artificial sequence
  SiRNA target sequence
ttaagagtgtctacatacg

SEQ ID NO: 141539 - DNA, 19 bp, Artificial sequence
  SiRNA target sequence
taagagtgtctacatacgc

SEQ ID NO: 141540 - DNA, 19 bp, Artificial sequence
  SiRNA target sequence
aagagtgtctacatacgct

SEQ ID NO: 141541 - DNA, 19 bp, Artificial sequence
  SiRNA target sequence
agagtgtctacatacgctt

SEQ ID NO: 141542 - DNA, 19 bp, Artificial sequence
  SiRNA target sequence
gagtgtctacatacgcttg

SEQ ID NO: 141543 - DNA, 19 bp, Artificial sequence
  SiRNA target sequence
agtgtctacatacgcttga

SEQ ID NO: 141544 - DNA, 19 bp, Artificial sequence
  SiRNA target sequence
gtgtctacatacgcttgat

SEQ ID NO: 141545 - DNA, 19 bp, Artificial sequence
  SiRNA target sequence
tgtctacatacgcttgatg

SEQ ID NO: 141546 - DNA, 19 bp, Artificial sequence
  SiRNA target sequence
gtctacatacgcttgatgg

SEQ ID NO: 141547 - DNA, 19 bp, Artificial sequence
  SiRNA target sequence
tctacatacgcttgatggt

SEQ ID NO: 141548 - DNA, 19 bp, Artificial sequence
  SiRNA target sequence
ctacatacgcttgatggtg

SEQ ID NO: 141549 - DNA, 19 bp, Artificial sequence
  SiRNA target sequence
tacatacgcttgatggtgc

SEQ ID NO: 141550 - DNA, 19 bp, Artificial sequence
  SiRNA target sequence
acatacgcttgatggtgct

SEQ ID NO: 141551 - DNA, 19 bp, Artificial sequence
  SiRNA target sequence
catacgcttgatggtgctt

SEQ ID NO: 141552 - DNA, 19 bp, Artificial sequence
  SiRNA target sequence
atacgcttgatggtgctta

SEQ ID NO: 141553 - DNA, 19 bp, Artificial sequence
  SiRNA target sequence
tacgcttgatggtgcttag

SEQ ID NO: 141554 - DNA, 19 bp, Artificial sequence
  SiRNA target sequence
acgcttgatggtgcttaga

SEQ ID NO: 141555 - DNA, 19 bp, Artificial sequence
  SiRNA target sequence
cgcttgatggtgcttagag

SEQ ID NO: 141556 - DNA, 19 bp, Artificial sequence
  SiRNA target sequence
gcttgatggtgcttagagt

SEQ ID NO: 141557 - DNA, 19 bp, Artificial sequence
  SiRNA target sequence
cttgatggtgcttagagtg

SEQ ID NO: 141558 - DNA, 19 bp, Artificial sequence
  SiRNA target sequence
ttgatggtgcttagagtgg

SEQ ID NO: 141559 - DNA, 19 bp, Artificial sequence
  SiRNA target sequence
tgatggtgcttagagtggt

SEQ ID NO: 141560 - DNA, 19 bp, Artificial sequence
  SiRNA target sequence
gatggtgcttagagtggtg

SEQ ID NO: 141561 - DNA, 19 bp, Artificial sequence
  SiRNA target sequence
atggtgcttagagtggtgg

SEQ ID NO: 141562 - DNA, 19 bp, Artificial sequence
  SiRNA target sequence
tggtgcttagagtggtggg

SEQ ID NO: 141563 - DNA, 19 bp, Artificial sequence
  SiRNA target sequence
ggtgcttagagtggtgggt

SEQ ID NO: 141564 - DNA, 19 bp, Artificial sequence
  SiRNA target sequence
gtgcttagagtggtgggtc

SEQ ID NO: 141565 - DNA, 19 bp, Artificial sequence
  SiRNA target sequence
tgcttagagtggtgggtct

SEQ ID NO: 141566 - DNA, 19 bp, Artificial sequence
  SiRNA target sequence
gcttagagtggtgggtctc

SEQ ID NO: 141567 - DNA, 19 bp, Artificial sequence
  SiRNA target sequence
cttagagtggtgggtctcc

SEQ ID NO: 141568 - DNA, 19 bp, Artificial sequence
  SiRNA target sequence
ttagagtggtgggtctcca

SEQ ID NO: 141569 - DNA, 19 bp, Artificial sequence
  SiRNA target sequence
tagagtggtgggtctccat

SEQ ID NO: 141570 - DNA, 19 bp, Artificial sequence
  SiRNA target sequence
agagtggtgggtctccatt

SEQ ID NO: 141571 - DNA, 19 bp, Artificial sequence
  SiRNA target sequence
gagtggtgggtctccatta

SEQ ID NO: 141572 - DNA, 19 bp, Artificial sequence
  SiRNA target sequence
agtggtgggtctccattat

SEQ ID NO: 141573 - DNA, 19 bp, Artificial sequence
  SiRNA target sequence
gtggtgggtctccattata

SEQ ID NO: 141574 - DNA, 19 bp, Artificial sequence
  SiRNA target sequence
tggtgggtctccattatat

SEQ ID NO: 141575 - DNA, 19 bp, Artificial sequence
  SiRNA target sequence
ggtgggtctccattatatc

SEQ ID NO: 141576 - DNA, 19 bp, Artificial sequence
  SiRNA target sequence
gtgggtctccattatatct

SEQ ID NO: 141577 - DNA, 19 bp, Artificial sequence
  SiRNA target sequence
tgggtctccattatatctt

SEQ ID NO: 141578 - DNA, 19 bp, Artificial sequence
  SiRNA target sequence
gggtctccattatatcttc

SEQ ID NO: 141579 - DNA, 19 bp, Artificial sequence
  SiRNA target sequence
ggtctccattatatcttca

SEQ ID NO: 141580 - DNA, 19 bp, Artificial sequence
  SiRNA target sequence
gtctccattatatcttcac

SEQ ID NO: 141581 - DNA, 19 bp, Artificial sequence
  SiRNA target sequence
tctccattatatcttcact

SEQ ID NO: 141582 - DNA, 19 bp, Artificial sequence
  SiRNA target sequence
ctccattatatcttcactt

SEQ ID NO: 141583 - DNA, 19 bp, Artificial sequence
  SiRNA target sequence
tccattatatcttcactta

SEQ ID NO: 141584 - DNA, 19 bp, Artificial sequence
  SiRNA target sequence
ccattatatcttcacttat

SEQ ID NO: 141585 - DNA, 19 bp, Artificial sequence
  SiRNA target sequence
cattatatcttcacttata

SEQ ID NO: 141586 - DNA, 19 bp, Artificial sequence
  SiRNA target sequence
attatatcttcacttatat

SEQ ID NO: 141587 - DNA, 19 bp, Artificial sequence
  SiRNA target sequence
ttatatcttcacttatata

SEQ ID NO: 141588 - DNA, 19 bp, Artificial sequence
  SiRNA target sequence
tatatcttcacttatataa

SEQ ID NO: 141589 - DNA, 19 bp, Artificial sequence
  SiRNA target sequence
atatcttcacttatataag

SEQ ID NO: 141590 - DNA, 19 bp, Artificial sequence
  SiRNA target sequence
tatcttcacttatataagg

SEQ ID NO: 141591 - DNA, 19 bp, Artificial sequence
  SiRNA target sequence
atcttcacttatataaggc

SEQ ID NO: 141592 - DNA, 19 bp, Artificial sequence
  SiRNA target sequence
tcttcacttatataaggct

SEQ ID NO: 141593 - DNA, 19 bp, Artificial sequence
  SiRNA target sequence
cttcacttatataaggctc

SEQ ID NO: 141594 - DNA, 19 bp, Artificial sequence
  SiRNA target sequence
ttcacttatataaggctct

SEQ ID NO: 141595 - DNA, 19 bp, Artificial sequence
  SiRNA target sequence
tcacttatataaggctcta

SEQ ID NO: 141596 - DNA, 19 bp, Artificial sequence
  SiRNA target sequence
cacttatataaggctctag

SEQ ID NO: 141597 - DNA, 19 bp, Artificial sequence
  SiRNA target sequence
acttatataaggctctaga

SEQ ID NO: 141598 - DNA, 19 bp, Artificial sequence
  SiRNA target sequence
cttatataaggctctagag

SEQ ID NO: 141599 - DNA, 19 bp, Artificial sequence
  SiRNA target sequence
ttatataaggctctagaga

SEQ ID NO: 141600 - DNA, 19 bp, Artificial sequence
  SiRNA target sequence
tatataaggctctagagat

SEQ ID NO: 141601 - DNA, 19 bp, Artificial sequence
  SiRNA target sequence
atataaggctctagagatt

SEQ ID NO: 141602 - DNA, 19 bp, Artificial sequence
  SiRNA target sequence
tataaggctctagagattt

SEQ ID NO: 141603 - DNA, 19 bp, Artificial sequence
  SiRNA target sequence
ataaggctctagagattta

SEQ ID NO: 141604 - DNA, 19 bp, Artificial sequence
  SiRNA target sequence
taaggctctagagatttat

SEQ ID NO: 141605 - DNA, 19 bp, Artificial sequence
  SiRNA target sequence
aaggctctagagatttata

SEQ ID NO: 141606 - DNA, 19 bp, Artificial sequence
  SiRNA target sequence
aggctctagagatttataa

SEQ ID NO: 141607 - DNA, 19 bp, Artificial sequence
  SiRNA target sequence
ggctctagagatttataac

SEQ ID NO: 141608 - DNA, 19 bp, Artificial sequence
  SiRNA target sequence
gctctagagatttataact

SEQ ID NO: 141609 - DNA, 19 bp, Artificial sequence
  SiRNA target sequence
ctctagagatttataacta

SEQ ID NO: 141610 - DNA, 19 bp, Artificial sequence
  SiRNA target sequence
tctagagatttataactat

SEQ ID NO: 141611 - DNA, 19 bp, Artificial sequence
  SiRNA target sequence
ctagagatttataactata

SEQ ID NO: 141612 - DNA, 19 bp, Artificial sequence
  SiRNA target sequence
tagagatttataactatat

SEQ ID NO: 141613 - DNA, 19 bp, Artificial sequence
  SiRNA target sequence
agagatttataactatatt

SEQ ID NO: 141614 - DNA, 19 bp, Artificial sequence
  SiRNA target sequence
gagatttataactatattt

SEQ ID NO: 141615 - DNA, 19 bp, Artificial sequence
  SiRNA target sequence
agatttataactatatttc

SEQ ID NO: 141616 - DNA, 19 bp, Artificial sequence
  SiRNA target sequence
gatttataactatatttca

SEQ ID NO: 141617 - DNA, 19 bp, Artificial sequence
  SiRNA target sequence
atttataactatatttcag

SEQ ID NO: 141618 - DNA, 19 bp, Artificial sequence
  SiRNA target sequence
tttataactatatttcaga

SEQ ID NO: 141619 - DNA, 19 bp, Artificial sequence
  SiRNA target sequence
ttataactatatttcagat

SEQ ID NO: 141620 - DNA, 19 bp, Artificial sequence
  SiRNA target sequence
tataactatatttcagatt

SEQ ID NO: 141621 - DNA, 19 bp, Artificial sequence
  SiRNA target sequence
ataactatatttcagattt

SEQ ID NO: 141622 - DNA, 19 bp, Artificial sequence
  SiRNA target sequence
taactatatttcagatttg

SEQ ID NO: 141623 - DNA, 19 bp, Artificial sequence
  SiRNA target sequence
aactatatttcagatttgg

SEQ ID NO: 141624 - DNA, 19 bp, Artificial sequence
  SiRNA target sequence
actatatttcagatttgga

SEQ ID NO: 141625 - DNA, 19 bp, Artificial sequence
  SiRNA target sequence
ctatatttcagatttggaa

SEQ ID NO: 141626 - DNA, 19 bp, Artificial sequence
  SiRNA target sequence
tatatttcagatttggaag

SEQ ID NO: 141627 - DNA, 19 bp, Artificial sequence
  SiRNA target sequence
atatttcagatttggaaga

SEQ ID NO: 141628 - DNA, 19 bp, Artificial sequence
  SiRNA target sequence
tatttcagatttggaagag

SEQ ID NO: 141629 - DNA, 19 bp, Artificial sequence
  SiRNA target sequence
atttcagatttggaagagt

SEQ ID NO: 141630 - DNA, 19 bp, Artificial sequence
  SiRNA target sequence
tttcagatttggaagagtg

SEQ ID NO: 141631 - DNA, 19 bp, Artificial sequence
  SiRNA target sequence
ttcagatttggaagagtga

SEQ ID NO: 141632 - DNA, 19 bp, Artificial sequence
  SiRNA target sequence
tcagatttggaagagtgaa

SEQ ID NO: 141633 - DNA, 19 bp, Artificial sequence
  SiRNA target sequence
cagatttggaagagtgaac

SEQ ID NO: 141634 - DNA, 19 bp, Artificial sequence
  SiRNA target sequence
agatttggaagagtgaaca

SEQ ID NO: 141635 - DNA, 19 bp, Artificial sequence
  SiRNA target sequence
gatttggaagagtgaacat

SEQ ID NO: 141636 - DNA, 20 bp, Artificial sequence
  SiRNA target sequence
ttaatttatgcataattgac

SEQ ID NO: 141637 - DNA, 20 bp, Artificial sequence
  SiRNA target sequence
taatttatgcataattgacc

SEQ ID NO: 141638 - DNA, 20 bp, Artificial sequence
  SiRNA target sequence
aatttatgcataattgacca

SEQ ID NO: 141639 - DNA, 20 bp, Artificial sequence
  SiRNA target sequence
atttatgcataattgaccat

SEQ ID NO: 141640 - DNA, 20 bp, Artificial sequence
  SiRNA target sequence
tttatgcataattgaccatc

SEQ ID NO: 141641 - DNA, 20 bp, Artificial sequence
  SiRNA target sequence
ttatgcataattgaccatca

SEQ ID NO: 141642 - DNA, 20 bp, Artificial sequence
  SiRNA target sequence
tatgcataattgaccatcat

SEQ ID NO: 141643 - DNA, 20 bp, Artificial sequence
  SiRNA target sequence
atgcataattgaccatcatc

SEQ ID NO: 141644 - DNA, 20 bp, Artificial sequence
  SiRNA target sequence
tgcataattgaccatcatca

SEQ ID NO: 141645 - DNA, 20 bp, Artificial sequence
  SiRNA target sequence
gcataattgaccatcatcag

SEQ ID NO: 141646 - DNA, 20 bp, Artificial sequence
  SiRNA target sequence
cataattgaccatcatcagt

SEQ ID NO: 141647 - DNA, 20 bp, Artificial sequence
  SiRNA target sequence
ataattgaccatcatcagta

SEQ ID NO: 141648 - DNA, 20 bp, Artificial sequence
  SiRNA target sequence
taattgaccatcatcagtaa

SEQ ID NO: 141649 - DNA, 20 bp, Artificial sequence
  SiRNA target sequence
aattgaccatcatcagtaat

SEQ ID NO: 141650 - DNA, 20 bp, Artificial sequence
  SiRNA target sequence
attgaccatcatcagtaata

SEQ ID NO: 141651 - DNA, 20 bp, Artificial sequence
  SiRNA target sequence
ttgaccatcatcagtaataa

SEQ ID NO: 141652 - DNA, 20 bp, Artificial sequence
  SiRNA target sequence
tgaccatcatcagtaataaa

SEQ ID NO: 141653 - DNA, 20 bp, Artificial sequence
  SiRNA target sequence
gaccatcatcagtaataaac

SEQ ID NO: 141654 - DNA, 20 bp, Artificial sequence
  SiRNA target sequence
accatcatcagtaataaaca

SEQ ID NO: 141655 - DNA, 20 bp, Artificial sequence
  SiRNA target sequence
ccatcatcagtaataaacac

SEQ ID NO: 141656 - DNA, 20 bp, Artificial sequence
  SiRNA target sequence
catcatcagtaataaacaca

SEQ ID NO: 141657 - DNA, 20 bp, Artificial sequence
  SiRNA target sequence
atcatcagtaataaacacat

SEQ ID NO: 141658 - DNA, 20 bp, Artificial sequence
  SiRNA target sequence
tcatcagtaataaacacatt

SEQ ID NO: 141659 - DNA, 20 bp, Artificial sequence
  SiRNA target sequence
catcagtaataaacacatta

SEQ ID NO: 141660 - DNA, 20 bp, Artificial sequence
  SiRNA target sequence
atcagtaataaacacattac

SEQ ID NO: 141661 - DNA, 20 bp, Artificial sequence
  SiRNA target sequence
tcagtaataaacacattacc

SEQ ID NO: 141662 - DNA, 20 bp, Artificial sequence
  SiRNA target sequence
cagtaataaacacattacct

SEQ ID NO: 141663 - DNA, 20 bp, Artificial sequence
  SiRNA target sequence
agtaataaacacattacctt

SEQ ID NO: 141664 - DNA, 20 bp, Artificial sequence
  SiRNA target sequence
gtaataaacacattaccttt

SEQ ID NO: 141665 - DNA, 20 bp, Artificial sequence
  SiRNA target sequence
taataaacacattacctttc

SEQ ID NO: 141666 - DNA, 20 bp, Artificial sequence
  SiRNA target sequence
aataaacacattacctttct

SEQ ID NO: 141667 - DNA, 20 bp, Artificial sequence
  SiRNA target sequence
ataaacacattacctttctt

SEQ ID NO: 141668 - DNA, 20 bp, Artificial sequence
  SiRNA target sequence
taaacacattacctttcttt

SEQ ID NO: 141669 - DNA, 20 bp, Artificial sequence
  SiRNA target sequence
aaacacattacctttctttt

SEQ ID NO: 141670 - DNA, 20 bp, Artificial sequence
  SiRNA target sequence
aacacattacctttcttttc

SEQ ID NO: 141671 - DNA, 20 bp, Artificial sequence
  SiRNA target sequence
acacattacctttcttttct

SEQ ID NO: 141672 - DNA, 20 bp, Artificial sequence
  SiRNA target sequence
cacattacctttcttttcta

SEQ ID NO: 141673 - DNA, 20 bp, Artificial sequence
  SiRNA target sequence
acattacctttcttttctac

SEQ ID NO: 141674 - DNA, 20 bp, Artificial sequence
  SiRNA target sequence
cattacctttcttttctacc

SEQ ID NO: 141675 - DNA, 20 bp, Artificial sequence
  SiRNA target sequence
attacctttcttttctacca

SEQ ID NO: 141676 - DNA, 20 bp, Artificial sequence
  SiRNA target sequence
ttacctttcttttctaccac

SEQ ID NO: 141677 - DNA, 20 bp, Artificial sequence
  SiRNA target sequence
tacctttcttttctaccaca

SEQ ID NO: 141678 - DNA, 20 bp, Artificial sequence
  SiRNA target sequence
acctttcttttctaccacac

SEQ ID NO: 141679 - DNA, 20 bp, Artificial sequence
  SiRNA target sequence
cctttcttttctaccacaca

SEQ ID NO: 141680 - DNA, 20 bp, Artificial sequence
  SiRNA target sequence
ctttcttttctaccacacat

SEQ ID NO: 141681 - DNA, 20 bp, Artificial sequence
  SiRNA target sequence
tttcttttctaccacacatt

SEQ ID NO: 141682 - DNA, 20 bp, Artificial sequence
  SiRNA target sequence
ttcttttctaccacacattt

SEQ ID NO: 141683 - DNA, 20 bp, Artificial sequence
  SiRNA target sequence
tcttttctaccacacatttt

SEQ ID NO: 141684 - DNA, 20 bp, Artificial sequence
  SiRNA target sequence
cttttctaccacacattttt

SEQ ID NO: 141685 - DNA, 20 bp, Artificial sequence
  SiRNA target sequence
ttttctaccacacatttttg

SEQ ID NO: 141686 - DNA, 20 bp, Artificial sequence
  SiRNA target sequence
tttctaccacacatttttga

SEQ ID NO: 141687 - DNA, 20 bp, Artificial sequence
  SiRNA target sequence
ttctaccacacatttttgat

SEQ ID NO: 141688 - DNA, 20 bp, Artificial sequence
  SiRNA target sequence
tctaccacacatttttgata

SEQ ID NO: 141689 - DNA, 20 bp, Artificial sequence
  SiRNA target sequence
ctaccacacatttttgatat

SEQ ID NO: 141690 - DNA, 20 bp, Artificial sequence
  SiRNA target sequence
taccacacatttttgatata

SEQ ID NO: 141691 - DNA, 20 bp, Artificial sequence
  SiRNA target sequence
accacacatttttgatatat

SEQ ID NO: 141692 - DNA, 20 bp, Artificial sequence
  SiRNA target sequence
ccacacatttttgatatatt

SEQ ID NO: 141693 - DNA, 20 bp, Artificial sequence
  SiRNA target sequence
cacacatttttgatatattt

SEQ ID NO: 141694 - DNA, 20 bp, Artificial sequence
  SiRNA target sequence
acacatttttgatatatttc

SEQ ID NO: 141695 - DNA, 20 bp, Artificial sequence
  SiRNA target sequence
cacatttttgatatatttca

SEQ ID NO: 141696 - DNA, 20 bp, Artificial sequence
  SiRNA target sequence
acatttttgatatatttcat

SEQ ID NO: 141697 - DNA, 20 bp, Artificial sequence
  SiRNA target sequence
catttttgatatatttcatt

SEQ ID NO: 141698 - DNA, 20 bp, Artificial sequence
  SiRNA target sequence
atttttgatatatttcatta

SEQ ID NO: 141699 - DNA, 20 bp, Artificial sequence
  SiRNA target sequence
tttttgatatatttcattaa

SEQ ID NO: 141700 - DNA, 20 bp, Artificial sequence
  SiRNA target sequence
ttttgatatatttcattaac

SEQ ID NO: 141701 - DNA, 20 bp, Artificial sequence
  SiRNA target sequence
tttgatatatttcattaact

SEQ ID NO: 141702 - DNA, 20 bp, Artificial sequence
  SiRNA target sequence
ttgatatatttcattaacta

SEQ ID NO: 141703 - DNA, 20 bp, Artificial sequence
  SiRNA target sequence
tgatatatttcattaactac

SEQ ID NO: 141704 - DNA, 20 bp, Artificial sequence
  SiRNA target sequence
gatatatttcattaactaca

SEQ ID NO: 141705 - DNA, 20 bp, Artificial sequence
  SiRNA target sequence
atatatttcattaactacat

SEQ ID NO: 141706 - DNA, 20 bp, Artificial sequence
  SiRNA target sequence
tatatttcattaactacatc

SEQ ID NO: 141707 - DNA, 20 bp, Artificial sequence
  SiRNA target sequence
atatttcattaactacatcc

SEQ ID NO: 141708 - DNA, 20 bp, Artificial sequence
  SiRNA target sequence
tatttcattaactacatccc

SEQ ID NO: 141709 - DNA, 20 bp, Artificial sequence
  SiRNA target sequence
atttcattaactacatccca

SEQ ID NO: 141710 - DNA, 20 bp, Artificial sequence
  SiRNA target sequence
tttcattaactacatcccaa

SEQ ID NO: 141711 - DNA, 20 bp, Artificial sequence
  SiRNA target sequence
ttcattaactacatcccaat

SEQ ID NO: 141712 - DNA, 20 bp, Artificial sequence
  SiRNA target sequence
tcattaactacatcccaatc

SEQ ID NO: 141713 - DNA, 20 bp, Artificial sequence
  SiRNA target sequence
cattaactacatcccaatca

SEQ ID NO: 141714 - DNA, 20 bp, Artificial sequence
  SiRNA target sequence
attaactacatcccaatcaa

SEQ ID NO: 141715 - DNA, 20 bp, Artificial sequence
  SiRNA target sequence
ttaactacatcccaatcaat

SEQ ID NO: 141716 - DNA, 20 bp, Artificial sequence
  SiRNA target sequence
taactacatcccaatcaatt

SEQ ID NO: 141717 - DNA, 20 bp, Artificial sequence
  SiRNA target sequence
aactacatcccaatcaatta

SEQ ID NO: 141718 - DNA, 20 bp, Artificial sequence
  SiRNA target sequence
actacatcccaatcaattac

SEQ ID NO: 141719 - DNA, 20 bp, Artificial sequence
  SiRNA target sequence
ctacatcccaatcaattaca

SEQ ID NO: 141720 - DNA, 20 bp, Artificial sequence
  SiRNA target sequence
tacatcccaatcaattacat

SEQ ID NO: 141721 - DNA, 20 bp, Artificial sequence
  SiRNA target sequence
acatcccaatcaattacatt

SEQ ID NO: 141722 - DNA, 20 bp, Artificial sequence
  SiRNA target sequence
catcccaatcaattacattc

SEQ ID NO: 141723 - DNA, 20 bp, Artificial sequence
  SiRNA target sequence
atcccaatcaattacattcc

SEQ ID NO: 141724 - DNA, 20 bp, Artificial sequence
  SiRNA target sequence
tcccaatcaattacattcca

SEQ ID NO: 141725 - DNA, 20 bp, Artificial sequence
  SiRNA target sequence
cccaatcaattacattccac

SEQ ID NO: 141726 - DNA, 20 bp, Artificial sequence
  SiRNA target sequence
ccaatcaattacattccacc

SEQ ID NO: 141727 - DNA, 20 bp, Artificial sequence
  SiRNA target sequence
caatcaattacattccacca

SEQ ID NO: 141728 - DNA, 20 bp, Artificial sequence
  SiRNA target sequence
aatcaattacattccaccat

SEQ ID NO: 141729 - DNA, 20 bp, Artificial sequence
  SiRNA target sequence
atcaattacattccaccatt

SEQ ID NO: 141730 - DNA, 20 bp, Artificial sequence
  SiRNA target sequence
tcaattacattccaccattc

SEQ ID NO: 141731 - DNA, 20 bp, Artificial sequence
  SiRNA target sequence
caattacattccaccattca

SEQ ID NO: 141732 - DNA, 20 bp, Artificial sequence
  SiRNA target sequence
aattacattccaccattcat

SEQ ID NO: 141733 - DNA, 20 bp, Artificial sequence
  SiRNA target sequence
attacattccaccattcatt

SEQ ID NO: 141734 - DNA, 20 bp, Artificial sequence
  SiRNA target sequence
ttacattccaccattcatta

SEQ ID NO: 141735 - DNA, 20 bp, Artificial sequence
  SiRNA target sequence
tacattccaccattcattaa

SEQ ID NO: 141736 - DNA, 20 bp, Artificial sequence
  SiRNA target sequence
acattccaccattcattaat

SEQ ID NO: 141737 - DNA, 20 bp, Artificial sequence
  SiRNA target sequence
cattccaccattcattaatg

SEQ ID NO: 141738 - DNA, 20 bp, Artificial sequence
  SiRNA target sequence
attccaccattcattaatgt

SEQ ID NO: 141739 - DNA, 20 bp, Artificial sequence
  SiRNA target sequence
ttccaccattcattaatgta

SEQ ID NO: 141740 - DNA, 20 bp, Artificial sequence
  SiRNA target sequence
tccaccattcattaatgtat

SEQ ID NO: 141741 - DNA, 20 bp, Artificial sequence
  SiRNA target sequence
ccaccattcattaatgtatt

SEQ ID NO: 141742 - DNA, 20 bp, Artificial sequence
  SiRNA target sequence
caccattcattaatgtattc

SEQ ID NO: 141743 - DNA, 20 bp, Artificial sequence
  SiRNA target sequence
accattcattaatgtattct

SEQ ID NO: 141744 - DNA, 20 bp, Artificial sequence
  SiRNA target sequence
ccattcattaatgtattctt

SEQ ID NO: 141745 - DNA, 20 bp, Artificial sequence
  SiRNA target sequence
cattcattaatgtattcttt

SEQ ID NO: 141746 - DNA, 20 bp, Artificial sequence
  SiRNA target sequence
attcattaatgtattctttt

SEQ ID NO: 141747 - DNA, 20 bp, Artificial sequence
  SiRNA target sequence
ttcattaatgtattcttttc

SEQ ID NO: 141748 - DNA, 20 bp, Artificial sequence
  SiRNA target sequence
tcattaatgtattcttttct

SEQ ID NO: 141749 - DNA, 20 bp, Artificial sequence
  SiRNA target sequence
cattaatgtattcttttctc

SEQ ID NO: 141750 - DNA, 20 bp, Artificial sequence
  SiRNA target sequence
attaatgtattcttttctcc

SEQ ID NO: 141751 - DNA, 20 bp, Artificial sequence
  SiRNA target sequence
ttaatgtattcttttctcct

SEQ ID NO: 141752 - DNA, 20 bp, Artificial sequence
  SiRNA target sequence
taatgtattcttttctccta

SEQ ID NO: 141753 - DNA, 20 bp, Artificial sequence
  SiRNA target sequence
aatgtattcttttctcctat

SEQ ID NO: 141754 - DNA, 20 bp, Artificial sequence
  SiRNA target sequence
atgtattcttttctcctatt

SEQ ID NO: 141755 - DNA, 20 bp, Artificial sequence
  SiRNA target sequence
tgtattcttttctcctattt

SEQ ID NO: 141756 - DNA, 20 bp, Artificial sequence
  SiRNA target sequence
gtattcttttctcctatttt

SEQ ID NO: 141757 - DNA, 20 bp, Artificial sequence
  SiRNA target sequence
tattcttttctcctattttt

SEQ ID NO: 141758 - DNA, 20 bp, Artificial sequence
  SiRNA target sequence
attcttttctcctattttta

SEQ ID NO: 141759 - DNA, 20 bp, Artificial sequence
  SiRNA target sequence
ttcttttctcctatttttat

SEQ ID NO: 141760 - DNA, 20 bp, Artificial sequence
  SiRNA target sequence
tcttttctcctatttttata

SEQ ID NO: 141761 - DNA, 20 bp, Artificial sequence
  SiRNA target sequence
cttttctcctatttttatac

SEQ ID NO: 141762 - DNA, 20 bp, Artificial sequence
  SiRNA target sequence
ttttctcctatttttatact

SEQ ID NO: 141763 - DNA, 20 bp, Artificial sequence
  SiRNA target sequence
tttctcctatttttatactg

SEQ ID NO: 141764 - DNA, 20 bp, Artificial sequence
  SiRNA target sequence
ttctcctatttttatactgt

SEQ ID NO: 141765 - DNA, 20 bp, Artificial sequence
  SiRNA target sequence
tctcctatttttatactgta

SEQ ID NO: 141766 - DNA, 20 bp, Artificial sequence
  SiRNA target sequence
ctcctatttttatactgtaa

SEQ ID NO: 141767 - DNA, 20 bp, Artificial sequence
  SiRNA target sequence
tcctatttttatactgtaaa

SEQ ID NO: 141768 - DNA, 20 bp, Artificial sequence
  SiRNA target sequence
cctatttttatactgtaaat

SEQ ID NO: 141769 - DNA, 20 bp, Artificial sequence
  SiRNA target sequence
ctatttttatactgtaaata

SEQ ID NO: 141770 - DNA, 20 bp, Artificial sequence
  SiRNA target sequence
tatttttatactgtaaataa

SEQ ID NO: 141771 - DNA, 20 bp, Artificial sequence
  SiRNA target sequence
atttttatactgtaaataat

SEQ ID NO: 141772 - DNA, 20 bp, Artificial sequence
  SiRNA target sequence
tttttatactgtaaataata

SEQ ID NO: 141773 - DNA, 20 bp, Artificial sequence
  SiRNA target sequence
ttttatactgtaaataatac

SEQ ID NO: 141774 - DNA, 20 bp, Artificial sequence
  SiRNA target sequence
tttatactgtaaataatacg

SEQ ID NO: 141775 - DNA, 20 bp, Artificial sequence
  SiRNA target sequence
ttatactgtaaataatacgc

SEQ ID NO: 141776 - DNA, 20 bp, Artificial sequence
  SiRNA target sequence
tatactgtaaataatacgca

SEQ ID NO: 141777 - DNA, 20 bp, Artificial sequence
  SiRNA target sequence
atactgtaaataatacgcat

SEQ ID NO: 141778 - DNA, 20 bp, Artificial sequence
  SiRNA target sequence
tactgtaaataatacgcatg

SEQ ID NO: 141779 - DNA, 20 bp, Artificial sequence
  SiRNA target sequence
actgtaaataatacgcatgt

SEQ ID NO: 141780 - DNA, 20 bp, Artificial sequence
  SiRNA target sequence
ctgtaaataatacgcatgtt

SEQ ID NO: 141781 - DNA, 20 bp, Artificial sequence
  SiRNA target sequence
tgtaaataatacgcatgttc

SEQ ID NO: 141782 - DNA, 20 bp, Artificial sequence
  SiRNA target sequence
gtaaataatacgcatgttcc

SEQ ID NO: 141783 - DNA, 20 bp, Artificial sequence
  SiRNA target sequence
taaataatacgcatgttccc

SEQ ID NO: 141784 - DNA, 20 bp, Artificial sequence
  SiRNA target sequence
aaataatacgcatgttccca

SEQ ID NO: 141785 - DNA, 20 bp, Artificial sequence
  SiRNA target sequence
aataatacgcatgttcccat

SEQ ID NO: 141786 - DNA, 20 bp, Artificial sequence
  SiRNA target sequence
ataatacgcatgttcccata

SEQ ID NO: 141787 - DNA, 20 bp, Artificial sequence
  SiRNA target sequence
taatacgcatgttcccatac

SEQ ID NO: 141788 - DNA, 20 bp, Artificial sequence
  SiRNA target sequence
aatacgcatgttcccataca

SEQ ID NO: 141789 - DNA, 20 bp, Artificial sequence
  SiRNA target sequence
atacgcatgttcccatacat

SEQ ID NO: 141790 - DNA, 20 bp, Artificial sequence
  SiRNA target sequence
tacgcatgttcccatacatc

SEQ ID NO: 141791 - DNA, 20 bp, Artificial sequence
  SiRNA target sequence
acgcatgttcccatacatca

SEQ ID NO: 141792 - DNA, 20 bp, Artificial sequence
  SiRNA target sequence
cgcatgttcccatacatcaa

SEQ ID NO: 141793 - DNA, 20 bp, Artificial sequence
  SiRNA target sequence
gcatgttcccatacatcaag

SEQ ID NO: 141794 - DNA, 20 bp, Artificial sequence
  SiRNA target sequence
catgttcccatacatcaaga

SEQ ID NO: 141795 - DNA, 20 bp, Artificial sequence
  SiRNA target sequence
atgttcccatacatcaagac

SEQ ID NO: 141796 - DNA, 20 bp, Artificial sequence
  SiRNA target sequence
tgttcccatacatcaagaca

SEQ ID NO: 141797 - DNA, 20 bp, Artificial sequence
  SiRNA target sequence
gttcccatacatcaagacat

SEQ ID NO: 141798 - DNA, 20 bp, Artificial sequence
  SiRNA target sequence
ttcccatacatcaagacata

SEQ ID NO: 141799 - DNA, 20 bp, Artificial sequence
  SiRNA target sequence
tcccatacatcaagacatag

SEQ ID NO: 141800 - DNA, 20 bp, Artificial sequence
  SiRNA target sequence
cccatacatcaagacatagt

SEQ ID NO: 141801 - DNA, 20 bp, Artificial sequence
  SiRNA target sequence
ccatacatcaagacatagta

SEQ ID NO: 141802 - DNA, 20 bp, Artificial sequence
  SiRNA target sequence
catacatcaagacatagtaa

SEQ ID NO: 141803 - DNA, 20 bp, Artificial sequence
  SiRNA target sequence
atacatcaagacatagtaaa

SEQ ID NO: 141804 - DNA, 20 bp, Artificial sequence
  SiRNA target sequence
tacatcaagacatagtaaag

SEQ ID NO: 141805 - DNA, 20 bp, Artificial sequence
  SiRNA target sequence
acatcaagacatagtaaagg

SEQ ID NO: 141806 - DNA, 20 bp, Artificial sequence
  SiRNA target sequence
catcaagacatagtaaagga

SEQ ID NO: 141807 - DNA, 20 bp, Artificial sequence
  SiRNA target sequence
atcaagacatagtaaaggaa

SEQ ID NO: 141808 - DNA, 20 bp, Artificial sequence
  SiRNA target sequence
tcaagacatagtaaaggaat

SEQ ID NO: 141809 - DNA, 20 bp, Artificial sequence
  SiRNA target sequence
caagacatagtaaaggaata

SEQ ID NO: 141810 - DNA, 20 bp, Artificial sequence
  SiRNA target sequence
aagacatagtaaaggaatac

SEQ ID NO: 141811 - DNA, 20 bp, Artificial sequence
  SiRNA target sequence
agacatagtaaaggaataca

SEQ ID NO: 141812 - DNA, 20 bp, Artificial sequence
  SiRNA target sequence
gacatagtaaaggaatacat

SEQ ID NO: 141813 - DNA, 20 bp, Artificial sequence
  SiRNA target sequence
acatagtaaaggaatacatt

SEQ ID NO: 141814 - DNA, 20 bp, Artificial sequence
  SiRNA target sequence
catagtaaaggaatacattc

SEQ ID NO: 141815 - DNA, 20 bp, Artificial sequence
  SiRNA target sequence
atagtaaaggaatacattca

SEQ ID NO: 141816 - DNA, 20 bp, Artificial sequence
  SiRNA target sequence
tagtaaaggaatacattcac

SEQ ID NO: 141817 - DNA, 20 bp, Artificial sequence
  SiRNA target sequence
agtaaaggaatacattcacc

SEQ ID NO: 141818 - DNA, 20 bp, Artificial sequence
  SiRNA target sequence
gtaaaggaatacattcacca

SEQ ID NO: 141819 - DNA, 20 bp, Artificial sequence
  SiRNA target sequence
taaaggaatacattcaccat

SEQ ID NO: 141820 - DNA, 20 bp, Artificial sequence
  SiRNA target sequence
aaaggaatacattcaccatc

SEQ ID NO: 141821 - DNA, 20 bp, Artificial sequence
  SiRNA target sequence
aaggaatacattcaccatcc

SEQ ID NO: 141822 - DNA, 20 bp, Artificial sequence
  SiRNA target sequence
aggaatacattcaccatcct

SEQ ID NO: 141823 - DNA, 20 bp, Artificial sequence
  SiRNA target sequence
ggaatacattcaccatcctc

SEQ ID NO: 141824 - DNA, 20 bp, Artificial sequence
  SiRNA target sequence
gaatacattcaccatcctcc

SEQ ID NO: 141825 - DNA, 20 bp, Artificial sequence
  SiRNA target sequence
aatacattcaccatcctcca

SEQ ID NO: 141826 - DNA, 20 bp, Artificial sequence
  SiRNA target sequence
atacattcaccatcctccat

SEQ ID NO: 141827 - DNA, 20 bp, Artificial sequence
  SiRNA target sequence
tacattcaccatcctccatc

SEQ ID NO: 141828 - DNA, 20 bp, Artificial sequence
  SiRNA target sequence
acattcaccatcctccatca

SEQ ID NO: 141829 - DNA, 20 bp, Artificial sequence
  SiRNA target sequence
cattcaccatcctccatcat

SEQ ID NO: 141830 - DNA, 20 bp, Artificial sequence
  SiRNA target sequence
attcaccatcctccatcata

SEQ ID NO: 141831 - DNA, 20 bp, Artificial sequence
  SiRNA target sequence
ttcaccatcctccatcatag

SEQ ID NO: 141832 - DNA, 20 bp, Artificial sequence
  SiRNA target sequence
tcaccatcctccatcatagg

SEQ ID NO: 141833 - DNA, 20 bp, Artificial sequence
  SiRNA target sequence
caccatcctccatcatagga

SEQ ID NO: 141834 - DNA, 20 bp, Artificial sequence
  SiRNA target sequence
accatcctccatcataggat

SEQ ID NO: 141835 - DNA, 20 bp, Artificial sequence
  SiRNA target sequence
ccatcctccatcataggatt

SEQ ID NO: 141836 - DNA, 20 bp, Artificial sequence
  SiRNA target sequence
catcctccatcataggattg

SEQ ID NO: 141837 - DNA, 20 bp, Artificial sequence
  SiRNA target sequence
atcctccatcataggattgt

SEQ ID NO: 141838 - DNA, 20 bp, Artificial sequence
  SiRNA target sequence
tcctccatcataggattgtc

SEQ ID NO: 141839 - DNA, 20 bp, Artificial sequence
  SiRNA target sequence
cctccatcataggattgtct

SEQ ID NO: 141840 - DNA, 20 bp, Artificial sequence
  SiRNA target sequence
ctccatcataggattgtctt

SEQ ID NO: 141841 - DNA, 20 bp, Artificial sequence
  SiRNA target sequence
tccatcataggattgtcttg

SEQ ID NO: 141842 - DNA, 20 bp, Artificial sequence
  SiRNA target sequence
ccatcataggattgtcttga

SEQ ID NO: 141843 - DNA, 20 bp, Artificial sequence
  SiRNA target sequence
catcataggattgtcttgat

SEQ ID NO: 141844 - DNA, 20 bp, Artificial sequence
  SiRNA target sequence
atcataggattgtcttgatt

SEQ ID NO: 141845 - DNA, 20 bp, Artificial sequence
  SiRNA target sequence
tcataggattgtcttgatta

SEQ ID NO: 141846 - DNA, 20 bp, Artificial sequence
  SiRNA target sequence
cataggattgtcttgattaa

SEQ ID NO: 141847 - DNA, 20 bp, Artificial sequence
  SiRNA target sequence
ataggattgtcttgattaac

SEQ ID NO: 141848 - DNA, 20 bp, Artificial sequence
  SiRNA target sequence
taggattgtcttgattaaca

SEQ ID NO: 141849 - DNA, 20 bp, Artificial sequence
  SiRNA target sequence
aggattgtcttgattaacac

SEQ ID NO: 141850 - DNA, 20 bp, Artificial sequence
  SiRNA target sequence
ggattgtcttgattaacact

SEQ ID NO: 141851 - DNA, 20 bp, Artificial sequence
  SiRNA target sequence
gattgtcttgattaacactg

SEQ ID NO: 141852 - DNA, 20 bp, Artificial sequence
  SiRNA target sequence
attgtcttgattaacactgg

SEQ ID NO: 141853 - DNA, 20 bp, Artificial sequence
  SiRNA target sequence
ttgtcttgattaacactggt

SEQ ID NO: 141854 - DNA, 20 bp, Artificial sequence
  SiRNA target sequence
tgtcttgattaacactggtc

SEQ ID NO: 141855 - DNA, 20 bp, Artificial sequence
  SiRNA target sequence
gtcttgattaacactggtct

SEQ ID NO: 141856 - DNA, 20 bp, Artificial sequence
  SiRNA target sequence
tcttgattaacactggtctt

SEQ ID NO: 141857 - DNA, 20 bp, Artificial sequence
  SiRNA target sequence
cttgattaacactggtctta

SEQ ID NO: 141858 - DNA, 20 bp, Artificial sequence
  SiRNA target sequence
ttgattaacactggtcttaa

SEQ ID NO: 141859 - DNA, 20 bp, Artificial sequence
  SiRNA target sequence
tgattaacactggtcttaat

SEQ ID NO: 141860 - DNA, 20 bp, Artificial sequence
  SiRNA target sequence
gattaacactggtcttaata

SEQ ID NO: 141861 - DNA, 20 bp, Artificial sequence
  SiRNA target sequence
attaacactggtcttaatac

SEQ ID NO: 141862 - DNA, 20 bp, Artificial sequence
  SiRNA target sequence
ttaacactggtcttaataca

SEQ ID NO: 141863 - DNA, 20 bp, Artificial sequence
  SiRNA target sequence
taacactggtcttaatacac

SEQ ID NO: 141864 - DNA, 20 bp, Artificial sequence
  SiRNA target sequence
aacactggtcttaatacaca

SEQ ID NO: 141865 - DNA, 20 bp, Artificial sequence
  SiRNA target sequence
acactggtcttaatacacaa

SEQ ID NO: 141866 - DNA, 20 bp, Artificial sequence
  SiRNA target sequence
cactggtcttaatacacaat

SEQ ID NO: 141867 - DNA, 20 bp, Artificial sequence
  SiRNA target sequence
actggtcttaatacacaatt

SEQ ID NO: 141868 - DNA, 20 bp, Artificial sequence
  SiRNA target sequence
ctggtcttaatacacaattt

SEQ ID NO: 141869 - DNA, 20 bp, Artificial sequence
  SiRNA target sequence
tggtcttaatacacaattta

SEQ ID NO: 141870 - DNA, 20 bp, Artificial sequence
  SiRNA target sequence
ggtcttaatacacaatttat

SEQ ID NO: 141871 - DNA, 20 bp, Artificial sequence
  SiRNA target sequence
gtcttaatacacaatttatc

SEQ ID NO: 141872 - DNA, 20 bp, Artificial sequence
  SiRNA target sequence
tcttaatacacaatttatct

SEQ ID NO: 141873 - DNA, 20 bp, Artificial sequence
  SiRNA target sequence
cttaatacacaatttatctt

SEQ ID NO: 141874 - DNA, 20 bp, Artificial sequence
  SiRNA target sequence
ttaatacacaatttatcttt

SEQ ID NO: 141875 - DNA, 20 bp, Artificial sequence
  SiRNA target sequence
taatacacaatttatcttta

SEQ ID NO: 141876 - DNA, 20 bp, Artificial sequence
  SiRNA target sequence
aatacacaatttatctttat

SEQ ID NO: 141877 - DNA, 20 bp, Artificial sequence
  SiRNA target sequence
atacacaatttatctttata

SEQ ID NO: 141878 - DNA, 20 bp, Artificial sequence
  SiRNA target sequence
tacacaatttatctttatat

SEQ ID NO: 141879 - DNA, 20 bp, Artificial sequence
  SiRNA target sequence
acacaatttatctttatata

SEQ ID NO: 141880 - DNA, 20 bp, Artificial sequence
  SiRNA target sequence
cacaatttatctttatatat

SEQ ID NO: 141881 - DNA, 20 bp, Artificial sequence
  SiRNA target sequence
acaatttatctttatatatc

SEQ ID NO: 141882 - DNA, 20 bp, Artificial sequence
  SiRNA target sequence
caatttatctttatatatca

SEQ ID NO: 141883 - DNA, 20 bp, Artificial sequence
  SiRNA target sequence
aatttatctttatatatcaa

SEQ ID NO: 141884 - DNA, 20 bp, Artificial sequence
  SiRNA target sequence
atttatctttatatatcaac

SEQ ID NO: 141885 - DNA, 20 bp, Artificial sequence
  SiRNA target sequence
tttatctttatatatcaacc

SEQ ID NO: 141886 - DNA, 20 bp, Artificial sequence
  SiRNA target sequence
ttatctttatatatcaacca

SEQ ID NO: 141887 - DNA, 20 bp, Artificial sequence
  SiRNA target sequence
tatctttatatatcaaccac

SEQ ID NO: 141888 - DNA, 20 bp, Artificial sequence
  SiRNA target sequence
atctttatatatcaaccaca

SEQ ID NO: 141889 - DNA, 20 bp, Artificial sequence
  SiRNA target sequence
tctttatatatcaaccacac

SEQ ID NO: 141890 - DNA, 20 bp, Artificial sequence
  SiRNA target sequence
ctttatatatcaaccacacc

SEQ ID NO: 141891 - DNA, 20 bp, Artificial sequence
  SiRNA target sequence
tttatatatcaaccacaccc

SEQ ID NO: 141892 - DNA, 20 bp, Artificial sequence
  SiRNA target sequence
ttatatatcaaccacaccca

SEQ ID NO: 141893 - DNA, 20 bp, Artificial sequence
  SiRNA target sequence
tatatatcaaccacacccat

SEQ ID NO: 141894 - DNA, 20 bp, Artificial sequence
  SiRNA target sequence
atatatcaaccacacccatc

SEQ ID NO: 141895 - DNA, 20 bp, Artificial sequence
  SiRNA target sequence
tatatcaaccacacccatcc

SEQ ID NO: 141896 - DNA, 20 bp, Artificial sequence
  SiRNA target sequence
atatcaaccacacccatcct

SEQ ID NO: 141897 - DNA, 20 bp, Artificial sequence
  SiRNA target sequence
tatcaaccacacccatcctg

SEQ ID NO: 141898 - DNA, 20 bp, Artificial sequence
  SiRNA target sequence
atcaaccacacccatcctga

SEQ ID NO: 141899 - DNA, 20 bp, Artificial sequence
  SiRNA target sequence
tcaaccacacccatcctgat

SEQ ID NO: 141900 - DNA, 20 bp, Artificial sequence
  SiRNA target sequence
caaccacacccatcctgatc

SEQ ID NO: 141901 - DNA, 20 bp, Artificial sequence
  SiRNA target sequence
aaccacacccatcctgatcc

SEQ ID NO: 141902 - DNA, 20 bp, Artificial sequence
  SiRNA target sequence
accacacccatcctgatcca

SEQ ID NO: 141903 - DNA, 20 bp, Artificial sequence
  SiRNA target sequence
ccacacccatcctgatccaa

SEQ ID NO: 141904 - DNA, 20 bp, Artificial sequence
  SiRNA target sequence
cacacccatcctgatccaaa

SEQ ID NO: 141905 - DNA, 20 bp, Artificial sequence
  SiRNA target sequence
acacccatcctgatccaaat

SEQ ID NO: 141906 - DNA, 20 bp, Artificial sequence
  SiRNA target sequence
cacccatcctgatccaaata

SEQ ID NO: 141907 - DNA, 20 bp, Artificial sequence
  SiRNA target sequence
acccatcctgatccaaataa

SEQ ID NO: 141908 - DNA, 20 bp, Artificial sequence
  SiRNA target sequence
cccatcctgatccaaataat

SEQ ID NO: 141909 - DNA, 20 bp, Artificial sequence
  SiRNA target sequence
ccatcctgatccaaataatt

SEQ ID NO: 141910 - DNA, 20 bp, Artificial sequence
  SiRNA target sequence
catcctgatccaaataattt

SEQ ID NO: 141911 - DNA, 20 bp, Artificial sequence
  SiRNA target sequence
atcctgatccaaataatttt

SEQ ID NO: 141912 - DNA, 20 bp, Artificial sequence
  SiRNA target sequence
tcctgatccaaataatttta

SEQ ID NO: 141913 - DNA, 20 bp, Artificial sequence
  SiRNA target sequence
cctgatccaaataattttac

SEQ ID NO: 141914 - DNA, 20 bp, Artificial sequence
  SiRNA target sequence
ctgatccaaataattttaca

SEQ ID NO: 141915 - DNA, 20 bp, Artificial sequence
  SiRNA target sequence
tgatccaaataattttacag

SEQ ID NO: 141916 - DNA, 20 bp, Artificial sequence
  SiRNA target sequence
gatccaaataattttacagc

SEQ ID NO: 141917 - DNA, 20 bp, Artificial sequence
  SiRNA target sequence
atccaaataattttacagct

SEQ ID NO: 141918 - DNA, 20 bp, Artificial sequence
  SiRNA target sequence
tccaaataattttacagctt

SEQ ID NO: 141919 - DNA, 20 bp, Artificial sequence
  SiRNA target sequence
ccaaataattttacagcttc

SEQ ID NO: 141920 - DNA, 20 bp, Artificial sequence
  SiRNA target sequence
caaataattttacagcttca

SEQ ID NO: 141921 - DNA, 20 bp, Artificial sequence
  SiRNA target sequence
aaataattttacagcttcag

SEQ ID NO: 141922 - DNA, 20 bp, Artificial sequence
  SiRNA target sequence
aataattttacagcttcagt

SEQ ID NO: 141923 - DNA, 20 bp, Artificial sequence
  SiRNA target sequence
ataattttacagcttcagta

SEQ ID NO: 141924 - DNA, 20 bp, Artificial sequence
  SiRNA target sequence
taattttacagcttcagtat

SEQ ID NO: 141925 - DNA, 20 bp, Artificial sequence
  SiRNA target sequence
aattttacagcttcagtatt

SEQ ID NO: 141926 - DNA, 20 bp, Artificial sequence
  SiRNA target sequence
attttacagcttcagtatta

SEQ ID NO: 141927 - DNA, 20 bp, Artificial sequence
  SiRNA target sequence
ttttacagcttcagtattaa

SEQ ID NO: 141928 - DNA, 20 bp, Artificial sequence
  SiRNA target sequence
tttacagcttcagtattaaa

SEQ ID NO: 141929 - DNA, 20 bp, Artificial sequence
  SiRNA target sequence
ttacagcttcagtattaaaa

SEQ ID NO: 141930 - DNA, 20 bp, Artificial sequence
  SiRNA target sequence
tacagcttcagtattaaaat

SEQ ID NO: 141931 - DNA, 20 bp, Artificial sequence
  SiRNA target sequence
acagcttcagtattaaaatt

SEQ ID NO: 141932 - DNA, 20 bp, Artificial sequence
  SiRNA target sequence
cagcttcagtattaaaattc

SEQ ID NO: 141933 - DNA, 20 bp, Artificial sequence
  SiRNA target sequence
agcttcagtattaaaattct

SEQ ID NO: 141934 - DNA, 20 bp, Artificial sequence
  SiRNA target sequence
gcttcagtattaaaattctc

SEQ ID NO: 141935 - DNA, 20 bp, Artificial sequence
  SiRNA target sequence
cttcagtattaaaattctcc

SEQ ID NO: 141936 - DNA, 20 bp, Artificial sequence
  SiRNA target sequence
ttcagtattaaaattctcct

SEQ ID NO: 141937 - DNA, 20 bp, Artificial sequence
  SiRNA target sequence
tcagtattaaaattctcctt

SEQ ID NO: 141938 - DNA, 20 bp, Artificial sequence
  SiRNA target sequence
cagtattaaaattctcctta

SEQ ID NO: 141939 - DNA, 20 bp, Artificial sequence
  SiRNA target sequence
agtattaaaattctccttaa

SEQ ID NO: 141940 - DNA, 20 bp, Artificial sequence
  SiRNA target sequence
gtattaaaattctccttaaa

SEQ ID NO: 141941 - DNA, 20 bp, Artificial sequence
  SiRNA target sequence
tattaaaattctccttaaat

SEQ ID NO: 141942 - DNA, 20 bp, Artificial sequence
  SiRNA target sequence
attaaaattctccttaaatt

SEQ ID NO: 141943 - DNA, 20 bp, Artificial sequence
  SiRNA target sequence
ttaaaattctccttaaattt

SEQ ID NO: 141944 - DNA, 20 bp, Artificial sequence
  SiRNA target sequence
taaaattctccttaaattta

SEQ ID NO: 141945 - DNA, 20 bp, Artificial sequence
  SiRNA target sequence
aaaattctccttaaatttat

SEQ ID NO: 141946 - DNA, 20 bp, Artificial sequence
  SiRNA target sequence
aaattctccttaaatttatt

SEQ ID NO: 141947 - DNA, 20 bp, Artificial sequence
  SiRNA target sequence
aattctccttaaatttattt

SEQ ID NO: 141948 - DNA, 20 bp, Artificial sequence
  SiRNA target sequence
attctccttaaatttattta

SEQ ID NO: 141949 - DNA, 20 bp, Artificial sequence
  SiRNA target sequence
ttctccttaaatttatttat

SEQ ID NO: 141950 - DNA, 20 bp, Artificial sequence
  SiRNA target sequence
tctccttaaatttatttatt

SEQ ID NO: 141951 - DNA, 20 bp, Artificial sequence
  SiRNA target sequence
ctccttaaatttatttattg

SEQ ID NO: 141952 - DNA, 20 bp, Artificial sequence
  SiRNA target sequence
tccttaaatttatttattga

SEQ ID NO: 141953 - DNA, 20 bp, Artificial sequence
  SiRNA target sequence
ccttaaatttatttattgat

SEQ ID NO: 141954 - DNA, 20 bp, Artificial sequence
  SiRNA target sequence
cttaaatttatttattgatc

SEQ ID NO: 141955 - DNA, 20 bp, Artificial sequence
  SiRNA target sequence
ttaaatttatttattgatcc

SEQ ID NO: 141956 - DNA, 20 bp, Artificial sequence
  SiRNA target sequence
taaatttatttattgatcca

SEQ ID NO: 141957 - DNA, 20 bp, Artificial sequence
  SiRNA target sequence
aaatttatttattgatccaa

SEQ ID NO: 141958 - DNA, 20 bp, Artificial sequence
  SiRNA target sequence
aatttatttattgatccaaa

SEQ ID NO: 141959 - DNA, 20 bp, Artificial sequence
  SiRNA target sequence
atttatttattgatccaaag

SEQ ID NO: 141960 - DNA, 20 bp, Artificial sequence
  SiRNA target sequence
tttatttattgatccaaagt

SEQ ID NO: 141961 - DNA, 20 bp, Artificial sequence
  SiRNA target sequence
ttatttattgatccaaagtc

SEQ ID NO: 141962 - DNA, 20 bp, Artificial sequence
  SiRNA target sequence
tatttattgatccaaagtct

SEQ ID NO: 141963 - DNA, 20 bp, Artificial sequence
  SiRNA target sequence
atttattgatccaaagtctt

SEQ ID NO: 141964 - DNA, 20 bp, Artificial sequence
  SiRNA target sequence
tttattgatccaaagtcttt

SEQ ID NO: 141965 - DNA, 20 bp, Artificial sequence
  SiRNA target sequence
ttattgatccaaagtctttt

SEQ ID NO: 141966 - DNA, 20 bp, Artificial sequence
  SiRNA target sequence
tattgatccaaagtctttta

SEQ ID NO: 141967 - DNA, 20 bp, Artificial sequence
  SiRNA target sequence
attgatccaaagtcttttat

SEQ ID NO: 141968 - DNA, 20 bp, Artificial sequence
  SiRNA target sequence
ttgatccaaagtcttttatt

SEQ ID NO: 141969 - DNA, 20 bp, Artificial sequence
  SiRNA target sequence
tgatccaaagtcttttatta

SEQ ID NO: 141970 - DNA, 20 bp, Artificial sequence
  SiRNA target sequence
gatccaaagtcttttattat

SEQ ID NO: 141971 - DNA, 20 bp, Artificial sequence
  SiRNA target sequence
atccaaagtcttttattata

SEQ ID NO: 141972 - DNA, 20 bp, Artificial sequence
  SiRNA target sequence
tccaaagtcttttattatag

SEQ ID NO: 141973 - DNA, 20 bp, Artificial sequence
  SiRNA target sequence
ccaaagtcttttattatagc

SEQ ID NO: 141974 - DNA, 20 bp, Artificial sequence
  SiRNA target sequence
caaagtcttttattatagca

SEQ ID NO: 141975 - DNA, 20 bp, Artificial sequence
  SiRNA target sequence
aaagtcttttattatagcac

SEQ ID NO: 141976 - DNA, 20 bp, Artificial sequence
  SiRNA target sequence
aagtcttttattatagcact

SEQ ID NO: 141977 - DNA, 20 bp, Artificial sequence
  SiRNA target sequence
agtcttttattatagcactt

SEQ ID NO: 141978 - DNA, 20 bp, Artificial sequence
  SiRNA target sequence
gtcttttattatagcacttt

SEQ ID NO: 141979 - DNA, 20 bp, Artificial sequence
  SiRNA target sequence
tcttttattatagcactttc

SEQ ID NO: 141980 - DNA, 20 bp, Artificial sequence
  SiRNA target sequence
cttttattatagcactttcc

SEQ ID NO: 141981 - DNA, 20 bp, Artificial sequence
  SiRNA target sequence
ttttattatagcactttcca

SEQ ID NO: 141982 - DNA, 20 bp, Artificial sequence
  SiRNA target sequence
tttattatagcactttccaa

SEQ ID NO: 141983 - DNA, 20 bp, Artificial sequence
  SiRNA target sequence
ttattatagcactttccaac

SEQ ID NO: 141984 - DNA, 20 bp, Artificial sequence
  SiRNA target sequence
tattatagcactttccaact

SEQ ID NO: 141985 - DNA, 20 bp, Artificial sequence
  SiRNA target sequence
attatagcactttccaactg

SEQ ID NO: 141986 - DNA, 20 bp, Artificial sequence
  SiRNA target sequence
ttatagcactttccaactgg

SEQ ID NO: 141987 - DNA, 20 bp, Artificial sequence
  SiRNA target sequence
tatagcactttccaactggg

SEQ ID NO: 141988 - DNA, 20 bp, Artificial sequence
  SiRNA target sequence
atagcactttccaactggga

SEQ ID NO: 141989 - DNA, 20 bp, Artificial sequence
  SiRNA target sequence
tagcactttccaactgggaa

SEQ ID NO: 141990 - DNA, 20 bp, Artificial sequence
  SiRNA target sequence
agcactttccaactgggaag

SEQ ID NO: 141991 - DNA, 20 bp, Artificial sequence
  SiRNA target sequence
gcactttccaactgggaaga

SEQ ID NO: 141992 - DNA, 20 bp, Artificial sequence
  SiRNA target sequence
cactttccaactgggaagaa

SEQ ID NO: 141993 - DNA, 20 bp, Artificial sequence
  SiRNA target sequence
actttccaactgggaagaaa

SEQ ID NO: 141994 - DNA, 20 bp, Artificial sequence
  SiRNA target sequence
ctttccaactgggaagaaat

SEQ ID NO: 141995 - DNA, 20 bp, Artificial sequence
  SiRNA target sequence
tttccaactgggaagaaatc

SEQ ID NO: 141996 - DNA, 20 bp, Artificial sequence
  SiRNA target sequence
ttccaactgggaagaaatct

SEQ ID NO: 141997 - DNA, 20 bp, Artificial sequence
  SiRNA target sequence
tccaactgggaagaaatctt

SEQ ID NO: 141998 - DNA, 20 bp, Artificial sequence
  SiRNA target sequence
ccaactgggaagaaatcttt

SEQ ID NO: 141999 - DNA, 20 bp, Artificial sequence
  SiRNA target sequence
caactgggaagaaatctttt

SEQ ID NO: 142000 - DNA, 20 bp, Artificial sequence
  SiRNA target sequence
aactgggaagaaatcttttt

SEQ ID NO: 142001 - DNA, 20 bp, Artificial sequence
  SiRNA target sequence
actgggaagaaatcttttta

SEQ ID NO: 142002 - DNA, 20 bp, Artificial sequence
  SiRNA target sequence
ctgggaagaaatctttttat

SEQ ID NO: 142003 - DNA, 20 bp, Artificial sequence
  SiRNA target sequence
tgggaagaaatctttttatt

SEQ ID NO: 142004 - DNA, 20 bp, Artificial sequence
  SiRNA target sequence
gggaagaaatctttttattt

SEQ ID NO: 142005 - DNA, 20 bp, Artificial sequence
  SiRNA target sequence
ggaagaaatctttttatttt

SEQ ID NO: 142006 - DNA, 20 bp, Artificial sequence
  SiRNA target sequence
gaagaaatctttttattttc

SEQ ID NO: 142007 - DNA, 20 bp, Artificial sequence
  SiRNA target sequence
aagaaatctttttattttct

SEQ ID NO: 142008 - DNA, 20 bp, Artificial sequence
  SiRNA target sequence
agaaatctttttattttctg

SEQ ID NO: 142009 - DNA, 20 bp, Artificial sequence
  SiRNA target sequence
gaaatctttttattttctgg

SEQ ID NO: 142010 - DNA, 20 bp, Artificial sequence
  SiRNA target sequence
aaatctttttattttctggt

SEQ ID NO: 142011 - DNA, 20 bp, Artificial sequence
  SiRNA target sequence
aatctttttattttctggtg

SEQ ID NO: 142012 - DNA, 20 bp, Artificial sequence
  SiRNA target sequence
atctttttattttctggtga

SEQ ID NO: 142013 - DNA, 20 bp, Artificial sequence
  SiRNA target sequence
tctttttattttctggtgac

SEQ ID NO: 142014 - DNA, 20 bp, Artificial sequence
  SiRNA target sequence
ctttttattttctggtgaca

SEQ ID NO: 142015 - DNA, 20 bp, Artificial sequence
  SiRNA target sequence
tttttattttctggtgacat

SEQ ID NO: 142016 - DNA, 20 bp, Artificial sequence
  SiRNA target sequence
ttttattttctggtgacatt

SEQ ID NO: 142017 - DNA, 20 bp, Artificial sequence
  SiRNA target sequence
tttattttctggtgacatta

SEQ ID NO: 142018 - DNA, 20 bp, Artificial sequence
  SiRNA target sequence
ttattttctggtgacattac

SEQ ID NO: 142019 - DNA, 20 bp, Artificial sequence
  SiRNA target sequence
tattttctggtgacattacc

SEQ ID NO: 142020 - DNA, 20 bp, Artificial sequence
  SiRNA target sequence
attttctggtgacattacca

SEQ ID NO: 142021 - DNA, 20 bp, Artificial sequence
  SiRNA target sequence
ttttctggtgacattaccaa

SEQ ID NO: 142022 - DNA, 20 bp, Artificial sequence
  SiRNA target sequence
tttctggtgacattaccaac

SEQ ID NO: 142023 - DNA, 20 bp, Artificial sequence
  SiRNA target sequence
ttctggtgacattaccaacc

SEQ ID NO: 142024 - DNA, 20 bp, Artificial sequence
  SiRNA target sequence
tctggtgacattaccaacca

SEQ ID NO: 142025 - DNA, 20 bp, Artificial sequence
  SiRNA target sequence
ctggtgacattaccaaccag

SEQ ID NO: 142026 - DNA, 20 bp, Artificial sequence
  SiRNA target sequence
tggtgacattaccaaccaga

SEQ ID NO: 142027 - DNA, 20 bp, Artificial sequence
  SiRNA target sequence
ggtgacattaccaaccagaa

SEQ ID NO: 142028 - DNA, 20 bp, Artificial sequence
  SiRNA target sequence
gtgacattaccaaccagaaa

SEQ ID NO: 142029 - DNA, 20 bp, Artificial sequence
  SiRNA target sequence
tgacattaccaaccagaaaa

SEQ ID NO: 142030 - DNA, 20 bp, Artificial sequence
  SiRNA target sequence
gacattaccaaccagaaaag

SEQ ID NO: 142031 - DNA, 20 bp, Artificial sequence
  SiRNA target sequence
acattaccaaccagaaaaga

SEQ ID NO: 142032 - DNA, 20 bp, Artificial sequence
  SiRNA target sequence
cattaccaaccagaaaagac

SEQ ID NO: 142033 - DNA, 20 bp, Artificial sequence
  SiRNA target sequence
attaccaaccagaaaagact

SEQ ID NO: 142034 - DNA, 20 bp, Artificial sequence
  SiRNA target sequence
ttaccaaccagaaaagacta

SEQ ID NO: 142035 - DNA, 20 bp, Artificial sequence
  SiRNA target sequence
taccaaccagaaaagactat

SEQ ID NO: 142036 - DNA, 20 bp, Artificial sequence
  SiRNA target sequence
accaaccagaaaagactatg

SEQ ID NO: 142037 - DNA, 20 bp, Artificial sequence
  SiRNA target sequence
ccaaccagaaaagactatgg

SEQ ID NO: 142038 - DNA, 20 bp, Artificial sequence
  SiRNA target sequence
caaccagaaaagactatggt

SEQ ID NO: 142039 - DNA, 20 bp, Artificial sequence
  SiRNA target sequence
aaccagaaaagactatggtt

SEQ ID NO: 142040 - DNA, 20 bp, Artificial sequence
  SiRNA target sequence
accagaaaagactatggttg

SEQ ID NO: 142041 - DNA, 20 bp, Artificial sequence
  SiRNA target sequence
ccagaaaagactatggttgt

SEQ ID NO: 142042 - DNA, 20 bp, Artificial sequence
  SiRNA target sequence
cagaaaagactatggttgta

SEQ ID NO: 142043 - DNA, 20 bp, Artificial sequence
  SiRNA target sequence
agaaaagactatggttgtaa

SEQ ID NO: 142044 - DNA, 20 bp, Artificial sequence
  SiRNA target sequence
gaaaagactatggttgtaat

SEQ ID NO: 142045 - DNA, 20 bp, Artificial sequence
  SiRNA target sequence
aaaagactatggttgtaatg

SEQ ID NO: 142046 - DNA, 20 bp, Artificial sequence
  SiRNA target sequence
aaagactatggttgtaatga

SEQ ID NO: 142047 - DNA, 20 bp, Artificial sequence
  SiRNA target sequence
aagactatggttgtaatgac

SEQ ID NO: 142048 - DNA, 20 bp, Artificial sequence
  SiRNA target sequence
agactatggttgtaatgacc

SEQ ID NO: 142049 - DNA, 20 bp, Artificial sequence
  SiRNA target sequence
gactatggttgtaatgacca

SEQ ID NO: 142050 - DNA, 20 bp, Artificial sequence
  SiRNA target sequence
actatggttgtaatgaccac

SEQ ID NO: 142051 - DNA, 20 bp, Artificial sequence
  SiRNA target sequence
ctatggttgtaatgaccacc

SEQ ID NO: 142052 - DNA, 20 bp, Artificial sequence
  SiRNA target sequence
tatggttgtaatgaccacca

SEQ ID NO: 142053 - DNA, 20 bp, Artificial sequence
  SiRNA target sequence
atggttgtaatgaccaccac

SEQ ID NO: 142054 - DNA, 20 bp, Artificial sequence
  SiRNA target sequence
tggttgtaatgaccaccacc

SEQ ID NO: 142055 - DNA, 20 bp, Artificial sequence
  SiRNA target sequence
ggttgtaatgaccaccacca

SEQ ID NO: 142056 - DNA, 20 bp, Artificial sequence
  SiRNA target sequence
gttgtaatgaccaccaccat

SEQ ID NO: 142057 - DNA, 20 bp, Artificial sequence
  SiRNA target sequence
ttgtaatgaccaccaccata

SEQ ID NO: 142058 - DNA, 20 bp, Artificial sequence
  SiRNA target sequence
tgtaatgaccaccaccataa

SEQ ID NO: 142059 - DNA, 20 bp, Artificial sequence
  SiRNA target sequence
gtaatgaccaccaccataat

SEQ ID NO: 142060 - DNA, 20 bp, Artificial sequence
  SiRNA target sequence
taatgaccaccaccataatc

SEQ ID NO: 142061 - DNA, 20 bp, Artificial sequence
  SiRNA target sequence
aatgaccaccaccataatct

SEQ ID NO: 142062 - DNA, 20 bp, Artificial sequence
  SiRNA target sequence
atgaccaccaccataatctc

SEQ ID NO: 142063 - DNA, 20 bp, Artificial sequence
  SiRNA target sequence
tgaccaccaccataatctct

SEQ ID NO: 142064 - DNA, 20 bp, Artificial sequence
  SiRNA target sequence
gaccaccaccataatctctt

SEQ ID NO: 142065 - DNA, 20 bp, Artificial sequence
  SiRNA target sequence
accaccaccataatctctta

SEQ ID NO: 142066 - DNA, 20 bp, Artificial sequence
  SiRNA target sequence
ccaccaccataatctcttaa

SEQ ID NO: 142067 - DNA, 20 bp, Artificial sequence
  SiRNA target sequence
caccaccataatctcttaat

SEQ ID NO: 142068 - DNA, 20 bp, Artificial sequence
  SiRNA target sequence
accaccataatctcttaatt

SEQ ID NO: 142069 - DNA, 20 bp, Artificial sequence
  SiRNA target sequence
ccaccataatctcttaattg

SEQ ID NO: 142070 - DNA, 20 bp, Artificial sequence
  SiRNA target sequence
caccataatctcttaattgt

SEQ ID NO: 142071 - DNA, 20 bp, Artificial sequence
  SiRNA target sequence
accataatctcttaattgtt

SEQ ID NO: 142072 - DNA, 20 bp, Artificial sequence
  SiRNA target sequence
ccataatctcttaattgttt

SEQ ID NO: 142073 - DNA, 20 bp, Artificial sequence
  SiRNA target sequence
cataatctcttaattgttta

SEQ ID NO: 142074 - DNA, 20 bp, Artificial sequence
  SiRNA target sequence
ataatctcttaattgtttat

SEQ ID NO: 142075 - DNA, 20 bp, Artificial sequence
  SiRNA target sequence
taatctcttaattgtttatc

SEQ ID NO: 142076 - DNA, 20 bp, Artificial sequence
  SiRNA target sequence
aatctcttaattgtttatca

SEQ ID NO: 142077 - DNA, 20 bp, Artificial sequence
  SiRNA target sequence
atctcttaattgtttatcaa

SEQ ID NO: 142078 - DNA, 20 bp, Artificial sequence
  SiRNA target sequence
tctcttaattgtttatcaac

SEQ ID NO: 142079 - DNA, 20 bp, Artificial sequence
  SiRNA target sequence
ctcttaattgtttatcaaca

SEQ ID NO: 142080 - DNA, 20 bp, Artificial sequence
  SiRNA target sequence
tcttaattgtttatcaacaa

SEQ ID NO: 142081 - DNA, 20 bp, Artificial sequence
  SiRNA target sequence
cttaattgtttatcaacaag

SEQ ID NO: 142082 - DNA, 20 bp, Artificial sequence
  SiRNA target sequence
ttaattgtttatcaacaagt

SEQ ID NO: 142083 - DNA, 20 bp, Artificial sequence
  SiRNA target sequence
taattgtttatcaacaagtg

SEQ ID NO: 142084 - DNA, 20 bp, Artificial sequence
  SiRNA target sequence
aattgtttatcaacaagtgc

SEQ ID NO: 142085 - DNA, 20 bp, Artificial sequence
  SiRNA target sequence
attgtttatcaacaagtgca

SEQ ID NO: 142086 - DNA, 20 bp, Artificial sequence
  SiRNA target sequence
ttgtttatcaacaagtgcat

SEQ ID NO: 142087 - DNA, 20 bp, Artificial sequence
  SiRNA target sequence
tgtttatcaacaagtgcatt

SEQ ID NO: 142088 - DNA, 20 bp, Artificial sequence
  SiRNA target sequence
gtttatcaacaagtgcattt

SEQ ID NO: 142089 - DNA, 20 bp, Artificial sequence
  SiRNA target sequence
tttatcaacaagtgcatttc

SEQ ID NO: 142090 - DNA, 20 bp, Artificial sequence
  SiRNA target sequence
ttatcaacaagtgcatttcc

SEQ ID NO: 142091 - DNA, 20 bp, Artificial sequence
  SiRNA target sequence
tatcaacaagtgcatttcct

SEQ ID NO: 142092 - DNA, 20 bp, Artificial sequence
  SiRNA target sequence
atcaacaagtgcatttcctt

SEQ ID NO: 142093 - DNA, 20 bp, Artificial sequence
  SiRNA target sequence
tcaacaagtgcatttccttt

SEQ ID NO: 142094 - DNA, 20 bp, Artificial sequence
  SiRNA target sequence
caacaagtgcatttccttta

SEQ ID NO: 142095 - DNA, 20 bp, Artificial sequence
  SiRNA target sequence
aacaagtgcatttcctttat

SEQ ID NO: 142096 - DNA, 20 bp, Artificial sequence
  SiRNA target sequence
acaagtgcatttcctttatt

SEQ ID NO: 142097 - DNA, 20 bp, Artificial sequence
  SiRNA target sequence
caagtgcatttcctttatta

SEQ ID NO: 142098 - DNA, 20 bp, Artificial sequence
  SiRNA target sequence
aagtgcatttcctttattat

SEQ ID NO: 142099 - DNA, 20 bp, Artificial sequence
  SiRNA target sequence
agtgcatttcctttattatt

SEQ ID NO: 142100 - DNA, 20 bp, Artificial sequence
  SiRNA target sequence
gtgcatttcctttattatta

SEQ ID NO: 142101 - DNA, 20 bp, Artificial sequence
  SiRNA target sequence
tgcatttcctttattattaa

SEQ ID NO: 142102 - DNA, 20 bp, Artificial sequence
  SiRNA target sequence
gcatttcctttattattaaa

SEQ ID NO: 142103 - DNA, 20 bp, Artificial sequence
  SiRNA target sequence
catttcctttattattaaaa

SEQ ID NO: 142104 - DNA, 20 bp, Artificial sequence
  SiRNA target sequence
atttcctttattattaaaaa

SEQ ID NO: 142105 - DNA, 20 bp, Artificial sequence
  SiRNA target sequence
tttcctttattattaaaaag

SEQ ID NO: 142106 - DNA, 20 bp, Artificial sequence
  SiRNA target sequence
ttcctttattattaaaaagt

SEQ ID NO: 142107 - DNA, 20 bp, Artificial sequence
  SiRNA target sequence
tcctttattattaaaaagta

SEQ ID NO: 142108 - DNA, 20 bp, Artificial sequence
  SiRNA target sequence
cctttattattaaaaagtaa

SEQ ID NO: 142109 - DNA, 20 bp, Artificial sequence
  SiRNA target sequence
ctttattattaaaaagtaat

SEQ ID NO: 142110 - DNA, 20 bp, Artificial sequence
  SiRNA target sequence
tttattattaaaaagtaatg

SEQ ID NO: 142111 - DNA, 20 bp, Artificial sequence
  SiRNA target sequence
ttattattaaaaagtaatga

SEQ ID NO: 142112 - DNA, 20 bp, Artificial sequence
  SiRNA target sequence
tattattaaaaagtaatgaa

SEQ ID NO: 142113 - DNA, 20 bp, Artificial sequence
  SiRNA target sequence
attattaaaaagtaatgaat

SEQ ID NO: 142114 - DNA, 20 bp, Artificial sequence
  SiRNA target sequence
ttattaaaaagtaatgaatt

SEQ ID NO: 142115 - DNA, 20 bp, Artificial sequence
  SiRNA target sequence
tattaaaaagtaatgaattt

SEQ ID NO: 142116 - DNA, 20 bp, Artificial sequence
  SiRNA target sequence
attaaaaagtaatgaattta

SEQ ID NO: 142117 - DNA, 20 bp, Artificial sequence
  SiRNA target sequence
ttaaaaagtaatgaatttaa

SEQ ID NO: 142118 - DNA, 20 bp, Artificial sequence
  SiRNA target sequence
taaaaagtaatgaatttaat

SEQ ID NO: 142119 - DNA, 20 bp, Artificial sequence
  SiRNA target sequence
aaaaagtaatgaatttaatg

SEQ ID NO: 142120 - DNA, 20 bp, Artificial sequence
  SiRNA target sequence
aaaagtaatgaatttaatga

SEQ ID NO: 142121 - DNA, 20 bp, Artificial sequence
  SiRNA target sequence
aaagtaatgaatttaatgat

SEQ ID NO: 142122 - DNA, 20 bp, Artificial sequence
  SiRNA target sequence
aagtaatgaatttaatgatt

SEQ ID NO: 142123 - DNA, 20 bp, Artificial sequence
  SiRNA target sequence
agtaatgaatttaatgattt

SEQ ID NO: 142124 - DNA, 20 bp, Artificial sequence
  SiRNA target sequence
gtaatgaatttaatgattta

SEQ ID NO: 142125 - DNA, 20 bp, Artificial sequence
  SiRNA target sequence
taatgaatttaatgatttac

SEQ ID NO: 142126 - DNA, 20 bp, Artificial sequence
  SiRNA target sequence
aatgaatttaatgatttacc

SEQ ID NO: 142127 - DNA, 20 bp, Artificial sequence
  SiRNA target sequence
atgaatttaatgatttacca

SEQ ID NO: 142128 - DNA, 20 bp, Artificial sequence
  SiRNA target sequence
tgaatttaatgatttaccac

SEQ ID NO: 142129 - DNA, 20 bp, Artificial sequence
  SiRNA target sequence
gaatttaatgatttaccaca

SEQ ID NO: 142130 - DNA, 20 bp, Artificial sequence
  SiRNA target sequence
aatttaatgatttaccacac

SEQ ID NO: 142131 - DNA, 20 bp, Artificial sequence
  SiRNA target sequence
atttaatgatttaccacaca

SEQ ID NO: 142132 - DNA, 20 bp, Artificial sequence
  SiRNA target sequence
tttaatgatttaccacacaa

SEQ ID NO: 142133 - DNA, 20 bp, Artificial sequence
  SiRNA target sequence
ttaatgatttaccacacaaa

SEQ ID NO: 142134 - DNA, 20 bp, Artificial sequence
  SiRNA target sequence
taatgatttaccacacaaat

SEQ ID NO: 142135 - DNA, 20 bp, Artificial sequence
  SiRNA target sequence
aatgatttaccacacaaatt

SEQ ID NO: 142136 - DNA, 20 bp, Artificial sequence
  SiRNA target sequence
atgatttaccacacaaattg

SEQ ID NO: 142137 - DNA, 20 bp, Artificial sequence
  SiRNA target sequence
tgatttaccacacaaattgt

SEQ ID NO: 142138 - DNA, 20 bp, Artificial sequence
  SiRNA target sequence
gatttaccacacaaattgtt

SEQ ID NO: 142139 - DNA, 20 bp, Artificial sequence
  SiRNA target sequence
atttaccacacaaattgtta

SEQ ID NO: 142140 - DNA, 20 bp, Artificial sequence
  SiRNA target sequence
tttaccacacaaattgttat

SEQ ID NO: 142141 - DNA, 20 bp, Artificial sequence
  SiRNA target sequence
ttaccacacaaattgttatc

SEQ ID NO: 142142 - DNA, 20 bp, Artificial sequence
  SiRNA target sequence
taccacacaaattgttatct

SEQ ID NO: 142143 - DNA, 20 bp, Artificial sequence
  SiRNA target sequence
accacacaaattgttatcta

SEQ ID NO: 142144 - DNA, 20 bp, Artificial sequence
  SiRNA target sequence
ccacacaaattgttatctaa

SEQ ID NO: 142145 - DNA, 20 bp, Artificial sequence
  SiRNA target sequence
cacacaaattgttatctaat

SEQ ID NO: 142146 - DNA, 20 bp, Artificial sequence
  SiRNA target sequence
acacaaattgttatctaata

SEQ ID NO: 142147 - DNA, 20 bp, Artificial sequence
  SiRNA target sequence
cacaaattgttatctaatat

SEQ ID NO: 142148 - DNA, 20 bp, Artificial sequence
  SiRNA target sequence
acaaattgttatctaatatt

SEQ ID NO: 142149 - DNA, 20 bp, Artificial sequence
  SiRNA target sequence
caaattgttatctaatatta

SEQ ID NO: 142150 - DNA, 20 bp, Artificial sequence
  SiRNA target sequence
aaattgttatctaatattat

SEQ ID NO: 142151 - DNA, 20 bp, Artificial sequence
  SiRNA target sequence
aattgttatctaatattatt

SEQ ID NO: 142152 - DNA, 20 bp, Artificial sequence
  SiRNA target sequence
attgttatctaatattattt

SEQ ID NO: 142153 - DNA, 20 bp, Artificial sequence
  SiRNA target sequence
ttgttatctaatattatttt

SEQ ID NO: 142154 - DNA, 20 bp, Artificial sequence
  SiRNA target sequence
tgttatctaatattatttta

SEQ ID NO: 142155 - DNA, 20 bp, Artificial sequence
  SiRNA target sequence
gttatctaatattattttat

SEQ ID NO: 142156 - DNA, 20 bp, Artificial sequence
  SiRNA target sequence
ttatctaatattattttatt

SEQ ID NO: 142157 - DNA, 20 bp, Artificial sequence
  SiRNA target sequence
tatctaatattattttatta

SEQ ID NO: 142158 - DNA, 20 bp, Artificial sequence
  SiRNA target sequence
atctaatattattttattaa

SEQ ID NO: 142159 - DNA, 20 bp, Artificial sequence
  SiRNA target sequence
tctaatattattttattaag

SEQ ID NO: 142160 - DNA, 20 bp, Artificial sequence
  SiRNA target sequence
ctaatattattttattaaga

SEQ ID NO: 142161 - DNA, 20 bp, Artificial sequence
  SiRNA target sequence
taatattattttattaagag

SEQ ID NO: 142162 - DNA, 20 bp, Artificial sequence
  SiRNA target sequence
aatattattttattaagagt

SEQ ID NO: 142163 - DNA, 20 bp, Artificial sequence
  SiRNA target sequence
atattattttattaagagtg

SEQ ID NO: 142164 - DNA, 20 bp, Artificial sequence
  SiRNA target sequence
tattattttattaagagtgt

SEQ ID NO: 142165 - DNA, 20 bp, Artificial sequence
  SiRNA target sequence
attattttattaagagtgtc

SEQ ID NO: 142166 - DNA, 20 bp, Artificial sequence
  SiRNA target sequence
ttattttattaagagtgtct

SEQ ID NO: 142167 - DNA, 20 bp, Artificial sequence
  SiRNA target sequence
tattttattaagagtgtcta

SEQ ID NO: 142168 - DNA, 20 bp, Artificial sequence
  SiRNA target sequence
attttattaagagtgtctac

SEQ ID NO: 142169 - DNA, 20 bp, Artificial sequence
  SiRNA target sequence
ttttattaagagtgtctaca

SEQ ID NO: 142170 - DNA, 20 bp, Artificial sequence
  SiRNA target sequence
tttattaagagtgtctacat

SEQ ID NO: 142171 - DNA, 20 bp, Artificial sequence
  SiRNA target sequence
ttattaagagtgtctacata

SEQ ID NO: 142172 - DNA, 20 bp, Artificial sequence
  SiRNA target sequence
tattaagagtgtctacatac

SEQ ID NO: 142173 - DNA, 20 bp, Artificial sequence
  SiRNA target sequence
attaagagtgtctacatacg

SEQ ID NO: 142174 - DNA, 20 bp, Artificial sequence
  SiRNA target sequence
ttaagagtgtctacatacgc

SEQ ID NO: 142175 - DNA, 20 bp, Artificial sequence
  SiRNA target sequence
taagagtgtctacatacgct

SEQ ID NO: 142176 - DNA, 20 bp, Artificial sequence
  SiRNA target sequence
aagagtgtctacatacgctt

SEQ ID NO: 142177 - DNA, 20 bp, Artificial sequence
  SiRNA target sequence
agagtgtctacatacgcttg

SEQ ID NO: 142178 - DNA, 20 bp, Artificial sequence
  SiRNA target sequence
gagtgtctacatacgcttga

SEQ ID NO: 142179 - DNA, 20 bp, Artificial sequence
  SiRNA target sequence
agtgtctacatacgcttgat

SEQ ID NO: 142180 - DNA, 20 bp, Artificial sequence
  SiRNA target sequence
gtgtctacatacgcttgatg

SEQ ID NO: 142181 - DNA, 20 bp, Artificial sequence
  SiRNA target sequence
tgtctacatacgcttgatgg

SEQ ID NO: 142182 - DNA, 20 bp, Artificial sequence
  SiRNA target sequence
gtctacatacgcttgatggt

SEQ ID NO: 142183 - DNA, 20 bp, Artificial sequence
  SiRNA target sequence
tctacatacgcttgatggtg

SEQ ID NO: 142184 - DNA, 20 bp, Artificial sequence
  SiRNA target sequence
ctacatacgcttgatggtgc

SEQ ID NO: 142185 - DNA, 20 bp, Artificial sequence
  SiRNA target sequence
tacatacgcttgatggtgct

SEQ ID NO: 142186 - DNA, 20 bp, Artificial sequence
  SiRNA target sequence
acatacgcttgatggtgctt

SEQ ID NO: 142187 - DNA, 20 bp, Artificial sequence
  SiRNA target sequence
catacgcttgatggtgctta

SEQ ID NO: 142188 - DNA, 20 bp, Artificial sequence
  SiRNA target sequence
atacgcttgatggtgcttag

SEQ ID NO: 142189 - DNA, 20 bp, Artificial sequence
  SiRNA target sequence
tacgcttgatggtgcttaga

SEQ ID NO: 142190 - DNA, 20 bp, Artificial sequence
  SiRNA target sequence
acgcttgatggtgcttagag

SEQ ID NO: 142191 - DNA, 20 bp, Artificial sequence
  SiRNA target sequence
cgcttgatggtgcttagagt

SEQ ID NO: 142192 - DNA, 20 bp, Artificial sequence
  SiRNA target sequence
gcttgatggtgcttagagtg

SEQ ID NO: 142193 - DNA, 20 bp, Artificial sequence
  SiRNA target sequence
cttgatggtgcttagagtgg

SEQ ID NO: 142194 - DNA, 20 bp, Artificial sequence
  SiRNA target sequence
ttgatggtgcttagagtggt

SEQ ID NO: 142195 - DNA, 20 bp, Artificial sequence
  SiRNA target sequence
tgatggtgcttagagtggtg

SEQ ID NO: 142196 - DNA, 20 bp, Artificial sequence
  SiRNA target sequence
gatggtgcttagagtggtgg

SEQ ID NO: 142197 - DNA, 20 bp, Artificial sequence
  SiRNA target sequence
atggtgcttagagtggtggg

SEQ ID NO: 142198 - DNA, 20 bp, Artificial sequence
  SiRNA target sequence
tggtgcttagagtggtgggt

SEQ ID NO: 142199 - DNA, 20 bp, Artificial sequence
  SiRNA target sequence
ggtgcttagagtggtgggtc

SEQ ID NO: 142200 - DNA, 20 bp, Artificial sequence
  SiRNA target sequence
gtgcttagagtggtgggtct

SEQ ID NO: 142201 - DNA, 20 bp, Artificial sequence
  SiRNA target sequence
tgcttagagtggtgggtctc

SEQ ID NO: 142202 - DNA, 20 bp, Artificial sequence
  SiRNA target sequence
gcttagagtggtgggtctcc

SEQ ID NO: 142203 - DNA, 20 bp, Artificial sequence
  SiRNA target sequence
cttagagtggtgggtctcca

SEQ ID NO: 142204 - DNA, 20 bp, Artificial sequence
  SiRNA target sequence
ttagagtggtgggtctccat

SEQ ID NO: 142205 - DNA, 20 bp, Artificial sequence
  SiRNA target sequence
tagagtggtgggtctccatt

SEQ ID NO: 142206 - DNA, 20 bp, Artificial sequence
  SiRNA target sequence
agagtggtgggtctccatta

SEQ ID NO: 142207 - DNA, 20 bp, Artificial sequence
  SiRNA target sequence
gagtggtgggtctccattat

SEQ ID NO: 142208 - DNA, 20 bp, Artificial sequence
  SiRNA target sequence
agtggtgggtctccattata

SEQ ID NO: 142209 - DNA, 20 bp, Artificial sequence
  SiRNA target sequence
gtggtgggtctccattatat

SEQ ID NO: 142210 - DNA, 20 bp, Artificial sequence
  SiRNA target sequence
tggtgggtctccattatatc

SEQ ID NO: 142211 - DNA, 20 bp, Artificial sequence
  SiRNA target sequence
ggtgggtctccattatatct

SEQ ID NO: 142212 - DNA, 20 bp, Artificial sequence
  SiRNA target sequence
gtgggtctccattatatctt

SEQ ID NO: 142213 - DNA, 20 bp, Artificial sequence
  SiRNA target sequence
tgggtctccattatatcttc

SEQ ID NO: 142214 - DNA, 20 bp, Artificial sequence
  SiRNA target sequence
gggtctccattatatcttca

SEQ ID NO: 142215 - DNA, 20 bp, Artificial sequence
  SiRNA target sequence
ggtctccattatatcttcac

SEQ ID NO: 142216 - DNA, 20 bp, Artificial sequence
  SiRNA target sequence
gtctccattatatcttcact

SEQ ID NO: 142217 - DNA, 20 bp, Artificial sequence
  SiRNA target sequence
tctccattatatcttcactt

SEQ ID NO: 142218 - DNA, 20 bp, Artificial sequence
  SiRNA target sequence
ctccattatatcttcactta

SEQ ID NO: 142219 - DNA, 20 bp, Artificial sequence
  SiRNA target sequence
tccattatatcttcacttat

SEQ ID NO: 142220 - DNA, 20 bp, Artificial sequence
  SiRNA target sequence
ccattatatcttcacttata

SEQ ID NO: 142221 - DNA, 20 bp, Artificial sequence
  SiRNA target sequence
cattatatcttcacttatat

SEQ ID NO: 142222 - DNA, 20 bp, Artificial sequence
  SiRNA target sequence
attatatcttcacttatata

SEQ ID NO: 142223 - DNA, 20 bp, Artificial sequence
  SiRNA target sequence
ttatatcttcacttatataa

SEQ ID NO: 142224 - DNA, 20 bp, Artificial sequence
  SiRNA target sequence
tatatcttcacttatataag

SEQ ID NO: 142225 - DNA, 20 bp, Artificial sequence
  SiRNA target sequence
atatcttcacttatataagg

SEQ ID NO: 142226 - DNA, 20 bp, Artificial sequence
  SiRNA target sequence
tatcttcacttatataaggc

SEQ ID NO: 142227 - DNA, 20 bp, Artificial sequence
  SiRNA target sequence
atcttcacttatataaggct

SEQ ID NO: 142228 - DNA, 20 bp, Artificial sequence
  SiRNA target sequence
tcttcacttatataaggctc

SEQ ID NO: 142229 - DNA, 20 bp, Artificial sequence
  SiRNA target sequence
cttcacttatataaggctct

SEQ ID NO: 142230 - DNA, 20 bp, Artificial sequence
  SiRNA target sequence
ttcacttatataaggctcta

SEQ ID NO: 142231 - DNA, 20 bp, Artificial sequence
  SiRNA target sequence
tcacttatataaggctctag

SEQ ID NO: 142232 - DNA, 20 bp, Artificial sequence
  SiRNA target sequence
cacttatataaggctctaga

SEQ ID NO: 142233 - DNA, 20 bp, Artificial sequence
  SiRNA target sequence
acttatataaggctctagag

SEQ ID NO: 142234 - DNA, 20 bp, Artificial sequence
  SiRNA target sequence
cttatataaggctctagaga

SEQ ID NO: 142235 - DNA, 20 bp, Artificial sequence
  SiRNA target sequence
ttatataaggctctagagat

SEQ ID NO: 142236 - DNA, 20 bp, Artificial sequence
  SiRNA target sequence
tatataaggctctagagatt

SEQ ID NO: 142237 - DNA, 20 bp, Artificial sequence
  SiRNA target sequence
atataaggctctagagattt

SEQ ID NO: 142238 - DNA, 20 bp, Artificial sequence
  SiRNA target sequence
tataaggctctagagattta

SEQ ID NO: 142239 - DNA, 20 bp, Artificial sequence
  SiRNA target sequence
ataaggctctagagatttat

SEQ ID NO: 142240 - DNA, 20 bp, Artificial sequence
  SiRNA target sequence
taaggctctagagatttata

SEQ ID NO: 142241 - DNA, 20 bp, Artificial sequence
  SiRNA target sequence
aaggctctagagatttataa

SEQ ID NO: 142242 - DNA, 20 bp, Artificial sequence
  SiRNA target sequence
aggctctagagatttataac

SEQ ID NO: 142243 - DNA, 20 bp, Artificial sequence
  SiRNA target sequence
ggctctagagatttataact

SEQ ID NO: 142244 - DNA, 20 bp, Artificial sequence
  SiRNA target sequence
gctctagagatttataacta

SEQ ID NO: 142245 - DNA, 20 bp, Artificial sequence
  SiRNA target sequence
ctctagagatttataactat

SEQ ID NO: 142246 - DNA, 20 bp, Artificial sequence
  SiRNA target sequence
tctagagatttataactata

SEQ ID NO: 142247 - DNA, 20 bp, Artificial sequence
  SiRNA target sequence
ctagagatttataactatat

SEQ ID NO: 142248 - DNA, 20 bp, Artificial sequence
  SiRNA target sequence
tagagatttataactatatt

SEQ ID NO: 142249 - DNA, 20 bp, Artificial sequence
  SiRNA target sequence
agagatttataactatattt

SEQ ID NO: 142250 - DNA, 20 bp, Artificial sequence
  SiRNA target sequence
gagatttataactatatttc

SEQ ID NO: 142251 - DNA, 20 bp, Artificial sequence
  SiRNA target sequence
agatttataactatatttca

SEQ ID NO: 142252 - DNA, 20 bp, Artificial sequence
  SiRNA target sequence
gatttataactatatttcag

SEQ ID NO: 142253 - DNA, 20 bp, Artificial sequence
  SiRNA target sequence
atttataactatatttcaga

SEQ ID NO: 142254 - DNA, 20 bp, Artificial sequence
  SiRNA target sequence
tttataactatatttcagat

SEQ ID NO: 142255 - DNA, 20 bp, Artificial sequence
  SiRNA target sequence
ttataactatatttcagatt

SEQ ID NO: 142256 - DNA, 20 bp, Artificial sequence
  SiRNA target sequence
tataactatatttcagattt

SEQ ID NO: 142257 - DNA, 20 bp, Artificial sequence
  SiRNA target sequence
ataactatatttcagatttg

SEQ ID NO: 142258 - DNA, 20 bp, Artificial sequence
  SiRNA target sequence
taactatatttcagatttgg

SEQ ID NO: 142259 - DNA, 20 bp, Artificial sequence
  SiRNA target sequence
aactatatttcagatttgga

SEQ ID NO: 142260 - DNA, 20 bp, Artificial sequence
  SiRNA target sequence
actatatttcagatttggaa

SEQ ID NO: 142261 - DNA, 20 bp, Artificial sequence
  SiRNA target sequence
ctatatttcagatttggaag

SEQ ID NO: 142262 - DNA, 20 bp, Artificial sequence
  SiRNA target sequence
tatatttcagatttggaaga

SEQ ID NO: 142263 - DNA, 20 bp, Artificial sequence
  SiRNA target sequence
atatttcagatttggaagag

SEQ ID NO: 142264 - DNA, 20 bp, Artificial sequence
  SiRNA target sequence
tatttcagatttggaagagt

SEQ ID NO: 142265 - DNA, 20 bp, Artificial sequence
  SiRNA target sequence
atttcagatttggaagagtg

SEQ ID NO: 142266 - DNA, 20 bp, Artificial sequence
  SiRNA target sequence
tttcagatttggaagagtga

SEQ ID NO: 142267 - DNA, 20 bp, Artificial sequence
  SiRNA target sequence
ttcagatttggaagagtgaa

SEQ ID NO: 142268 - DNA, 20 bp, Artificial sequence
  SiRNA target sequence
tcagatttggaagagtgaac

SEQ ID NO: 142269 - DNA, 20 bp, Artificial sequence
  SiRNA target sequence
cagatttggaagagtgaaca

SEQ ID NO: 142270 - DNA, 20 bp, Artificial sequence
  SiRNA target sequence
agatttggaagagtgaacat

SEQ ID NO: 142271 - DNA, 21 bp, Artificial sequence
  SiRNA target sequence
ttaatttatgcataattgacc

SEQ ID NO: 142272 - DNA, 21 bp, Artificial sequence
  SiRNA target sequence
taatttatgcataattgacca

SEQ ID NO: 142273 - DNA, 21 bp, Artificial sequence
  SiRNA target sequence
aatttatgcataattgaccat

SEQ ID NO: 142274 - DNA, 21 bp, Artificial sequence
  SiRNA target sequence
atttatgcataattgaccatc

SEQ ID NO: 142275 - DNA, 21 bp, Artificial sequence
  SiRNA target sequence
tttatgcataattgaccatca

SEQ ID NO: 142276 - DNA, 21 bp, Artificial sequence
  SiRNA target sequence
ttatgcataattgaccatcat

SEQ ID NO: 142277 - DNA, 21 bp, Artificial sequence
  SiRNA target sequence
tatgcataattgaccatcatc

SEQ ID NO: 142278 - DNA, 21 bp, Artificial sequence
  SiRNA target sequence
atgcataattgaccatcatca

SEQ ID NO: 142279 - DNA, 21 bp, Artificial sequence
  SiRNA target sequence
tgcataattgaccatcatcag

SEQ ID NO: 142280 - DNA, 21 bp, Artificial sequence
  SiRNA target sequence
gcataattgaccatcatcagt

SEQ ID NO: 142281 - DNA, 21 bp, Artificial sequence
  SiRNA target sequence
cataattgaccatcatcagta

SEQ ID NO: 142282 - DNA, 21 bp, Artificial sequence
  SiRNA target sequence
ataattgaccatcatcagtaa

SEQ ID NO: 142283 - DNA, 21 bp, Artificial sequence
  SiRNA target sequence
taattgaccatcatcagtaat

SEQ ID NO: 142284 - DNA, 21 bp, Artificial sequence
  SiRNA target sequence
aattgaccatcatcagtaata

SEQ ID NO: 142285 - DNA, 21 bp, Artificial sequence
  SiRNA target sequence
attgaccatcatcagtaataa

SEQ ID NO: 142286 - DNA, 21 bp, Artificial sequence
  SiRNA target sequence
ttgaccatcatcagtaataaa

SEQ ID NO: 142287 - DNA, 21 bp, Artificial sequence
  SiRNA target sequence
tgaccatcatcagtaataaac

SEQ ID NO: 142288 - DNA, 21 bp, Artificial sequence
  SiRNA target sequence
gaccatcatcagtaataaaca

SEQ ID NO: 142289 - DNA, 21 bp, Artificial sequence
  SiRNA target sequence
accatcatcagtaataaacac

SEQ ID NO: 142290 - DNA, 21 bp, Artificial sequence
  SiRNA target sequence
ccatcatcagtaataaacaca

SEQ ID NO: 142291 - DNA, 21 bp, Artificial sequence
  SiRNA target sequence
catcatcagtaataaacacat

SEQ ID NO: 142292 - DNA, 21 bp, Artificial sequence
  SiRNA target sequence
atcatcagtaataaacacatt

SEQ ID NO: 142293 - DNA, 21 bp, Artificial sequence
  SiRNA target sequence
tcatcagtaataaacacatta

SEQ ID NO: 142294 - DNA, 21 bp, Artificial sequence
  SiRNA target sequence
catcagtaataaacacattac

SEQ ID NO: 142295 - DNA, 21 bp, Artificial sequence
  SiRNA target sequence
atcagtaataaacacattacc

SEQ ID NO: 142296 - DNA, 21 bp, Artificial sequence
  SiRNA target sequence
tcagtaataaacacattacct

SEQ ID NO: 142297 - DNA, 21 bp, Artificial sequence
  SiRNA target sequence
cagtaataaacacattacctt

SEQ ID NO: 142298 - DNA, 21 bp, Artificial sequence
  SiRNA target sequence
agtaataaacacattaccttt

SEQ ID NO: 142299 - DNA, 21 bp, Artificial sequence
  SiRNA target sequence
gtaataaacacattacctttc

SEQ ID NO: 142300 - DNA, 21 bp, Artificial sequence
  SiRNA target sequence
taataaacacattacctttct

SEQ ID NO: 142301 - DNA, 21 bp, Artificial sequence
  SiRNA target sequence
aataaacacattacctttctt

SEQ ID NO: 142302 - DNA, 21 bp, Artificial sequence
  SiRNA target sequence
ataaacacattacctttcttt

SEQ ID NO: 142303 - DNA, 21 bp, Artificial sequence
  SiRNA target sequence
taaacacattacctttctttt

SEQ ID NO: 142304 - DNA, 21 bp, Artificial sequence
  SiRNA target sequence
aaacacattacctttcttttc

SEQ ID NO: 142305 - DNA, 21 bp, Artificial sequence
  SiRNA target sequence
aacacattacctttcttttct

SEQ ID NO: 142306 - DNA, 21 bp, Artificial sequence
  SiRNA target sequence
acacattacctttcttttcta

SEQ ID NO: 142307 - DNA, 21 bp, Artificial sequence
  SiRNA target sequence
cacattacctttcttttctac

SEQ ID NO: 142308 - DNA, 21 bp, Artificial sequence
  SiRNA target sequence
acattacctttcttttctacc

SEQ ID NO: 142309 - DNA, 21 bp, Artificial sequence
  SiRNA target sequence
cattacctttcttttctacca

SEQ ID NO: 142310 - DNA, 21 bp, Artificial sequence
  SiRNA target sequence
attacctttcttttctaccac

SEQ ID NO: 142311 - DNA, 21 bp, Artificial sequence
  SiRNA target sequence
ttacctttcttttctaccaca

SEQ ID NO: 142312 - DNA, 21 bp, Artificial sequence
  SiRNA target sequence
tacctttcttttctaccacac

SEQ ID NO: 142313 - DNA, 21 bp, Artificial sequence
  SiRNA target sequence
acctttcttttctaccacaca

SEQ ID NO: 142314 - DNA, 21 bp, Artificial sequence
  SiRNA target sequence
cctttcttttctaccacacat

SEQ ID NO: 142315 - DNA, 21 bp, Artificial sequence
  SiRNA target sequence
ctttcttttctaccacacatt

SEQ ID NO: 142316 - DNA, 21 bp, Artificial sequence
  SiRNA target sequence
tttcttttctaccacacattt

SEQ ID NO: 142317 - DNA, 21 bp, Artificial sequence
  SiRNA target sequence
ttcttttctaccacacatttt

SEQ ID NO: 142318 - DNA, 21 bp, Artificial sequence
  SiRNA target sequence
tcttttctaccacacattttt

SEQ ID NO: 142319 - DNA, 21 bp, Artificial sequence
  SiRNA target sequence
cttttctaccacacatttttg

SEQ ID NO: 142320 - DNA, 21 bp, Artificial sequence
  SiRNA target sequence
ttttctaccacacatttttga

SEQ ID NO: 142321 - DNA, 21 bp, Artificial sequence
  SiRNA target sequence
tttctaccacacatttttgat

SEQ ID NO: 142322 - DNA, 21 bp, Artificial sequence
  SiRNA target sequence
ttctaccacacatttttgata

SEQ ID NO: 142323 - DNA, 21 bp, Artificial sequence
  SiRNA target sequence
tctaccacacatttttgatat

SEQ ID NO: 142324 - DNA, 21 bp, Artificial sequence
  SiRNA target sequence
ctaccacacatttttgatata

SEQ ID NO: 142325 - DNA, 21 bp, Artificial sequence
  SiRNA target sequence
taccacacatttttgatatat

SEQ ID NO: 142326 - DNA, 21 bp, Artificial sequence
  SiRNA target sequence
accacacatttttgatatatt

SEQ ID NO: 142327 - DNA, 21 bp, Artificial sequence
  SiRNA target sequence
ccacacatttttgatatattt

SEQ ID NO: 142328 - DNA, 21 bp, Artificial sequence
  SiRNA target sequence
cacacatttttgatatatttc

SEQ ID NO: 142329 - DNA, 21 bp, Artificial sequence
  SiRNA target sequence
acacatttttgatatatttca

SEQ ID NO: 142330 - DNA, 21 bp, Artificial sequence
  SiRNA target sequence
cacatttttgatatatttcat

SEQ ID NO: 142331 - DNA, 21 bp, Artificial sequence
  SiRNA target sequence
acatttttgatatatttcatt

SEQ ID NO: 142332 - DNA, 21 bp, Artificial sequence
  SiRNA target sequence
catttttgatatatttcatta

SEQ ID NO: 142333 - DNA, 21 bp, Artificial sequence
  SiRNA target sequence
atttttgatatatttcattaa

SEQ ID NO: 142334 - DNA, 21 bp, Artificial sequence
  SiRNA target sequence
tttttgatatatttcattaac

SEQ ID NO: 142335 - DNA, 21 bp, Artificial sequence
  SiRNA target sequence
ttttgatatatttcattaact

SEQ ID NO: 142336 - DNA, 21 bp, Artificial sequence
  SiRNA target sequence
tttgatatatttcattaacta

SEQ ID NO: 142337 - DNA, 21 bp, Artificial sequence
  SiRNA target sequence
ttgatatatttcattaactac

SEQ ID NO: 142338 - DNA, 21 bp, Artificial sequence
  SiRNA target sequence
tgatatatttcattaactaca

SEQ ID NO: 142339 - DNA, 21 bp, Artificial sequence
  SiRNA target sequence
gatatatttcattaactacat

SEQ ID NO: 142340 - DNA, 21 bp, Artificial sequence
  SiRNA target sequence
atatatttcattaactacatc

SEQ ID NO: 142341 - DNA, 21 bp, Artificial sequence
  SiRNA target sequence
tatatttcattaactacatcc

SEQ ID NO: 142342 - DNA, 21 bp, Artificial sequence
  SiRNA target sequence
atatttcattaactacatccc

SEQ ID NO: 142343 - DNA, 21 bp, Artificial sequence
  SiRNA target sequence
tatttcattaactacatccca

SEQ ID NO: 142344 - DNA, 21 bp, Artificial sequence
  SiRNA target sequence
atttcattaactacatcccaa

SEQ ID NO: 142345 - DNA, 21 bp, Artificial sequence
  SiRNA target sequence
tttcattaactacatcccaat

SEQ ID NO: 142346 - DNA, 21 bp, Artificial sequence
  SiRNA target sequence
ttcattaactacatcccaatc

SEQ ID NO: 142347 - DNA, 21 bp, Artificial sequence
  SiRNA target sequence
tcattaactacatcccaatca

SEQ ID NO: 142348 - DNA, 21 bp, Artificial sequence
  SiRNA target sequence
cattaactacatcccaatcaa

SEQ ID NO: 142349 - DNA, 21 bp, Artificial sequence
  SiRNA target sequence
attaactacatcccaatcaat

SEQ ID NO: 142350 - DNA, 21 bp, Artificial sequence
  SiRNA target sequence
ttaactacatcccaatcaatt

SEQ ID NO: 142351 - DNA, 21 bp, Artificial sequence
  SiRNA target sequence
taactacatcccaatcaatta

SEQ ID NO: 142352 - DNA, 21 bp, Artificial sequence
  SiRNA target sequence
aactacatcccaatcaattac

SEQ ID NO: 142353 - DNA, 21 bp, Artificial sequence
  SiRNA target sequence
actacatcccaatcaattaca

SEQ ID NO: 142354 - DNA, 21 bp, Artificial sequence
  SiRNA target sequence
ctacatcccaatcaattacat

SEQ ID NO: 142355 - DNA, 21 bp, Artificial sequence
  SiRNA target sequence
tacatcccaatcaattacatt

SEQ ID NO: 142356 - DNA, 21 bp, Artificial sequence
  SiRNA target sequence
acatcccaatcaattacattc

SEQ ID NO: 142357 - DNA, 21 bp, Artificial sequence
  SiRNA target sequence
catcccaatcaattacattcc

SEQ ID NO: 142358 - DNA, 21 bp, Artificial sequence
  SiRNA target sequence
atcccaatcaattacattcca

SEQ ID NO: 142359 - DNA, 21 bp, Artificial sequence
  SiRNA target sequence
tcccaatcaattacattccac

SEQ ID NO: 142360 - DNA, 21 bp, Artificial sequence
  SiRNA target sequence
cccaatcaattacattccacc

SEQ ID NO: 142361 - DNA, 21 bp, Artificial sequence
  SiRNA target sequence
ccaatcaattacattccacca

SEQ ID NO: 142362 - DNA, 21 bp, Artificial sequence
  SiRNA target sequence
caatcaattacattccaccat

SEQ ID NO: 142363 - DNA, 21 bp, Artificial sequence
  SiRNA target sequence
aatcaattacattccaccatt

SEQ ID NO: 142364 - DNA, 21 bp, Artificial sequence
  SiRNA target sequence
atcaattacattccaccattc

SEQ ID NO: 142365 - DNA, 21 bp, Artificial sequence
  SiRNA target sequence
tcaattacattccaccattca

SEQ ID NO: 142366 - DNA, 21 bp, Artificial sequence
  SiRNA target sequence
caattacattccaccattcat

SEQ ID NO: 142367 - DNA, 21 bp, Artificial sequence
  SiRNA target sequence
aattacattccaccattcatt

SEQ ID NO: 142368 - DNA, 21 bp, Artificial sequence
  SiRNA target sequence
attacattccaccattcatta

SEQ ID NO: 142369 - DNA, 21 bp, Artificial sequence
  SiRNA target sequence
ttacattccaccattcattaa

SEQ ID NO: 142370 - DNA, 21 bp, Artificial sequence
  SiRNA target sequence
tacattccaccattcattaat

SEQ ID NO: 142371 - DNA, 21 bp, Artificial sequence
  SiRNA target sequence
acattccaccattcattaatg

SEQ ID NO: 142372 - DNA, 21 bp, Artificial sequence
  SiRNA target sequence
cattccaccattcattaatgt

SEQ ID NO: 142373 - DNA, 21 bp, Artificial sequence
  SiRNA target sequence
attccaccattcattaatgta

SEQ ID NO: 142374 - DNA, 21 bp, Artificial sequence
  SiRNA target sequence
ttccaccattcattaatgtat

SEQ ID NO: 142375 - DNA, 21 bp, Artificial sequence
  SiRNA target sequence
tccaccattcattaatgtatt

SEQ ID NO: 142376 - DNA, 21 bp, Artificial sequence
  SiRNA target sequence
ccaccattcattaatgtattc

SEQ ID NO: 142377 - DNA, 21 bp, Artificial sequence
  SiRNA target sequence
caccattcattaatgtattct

SEQ ID NO: 142378 - DNA, 21 bp, Artificial sequence
  SiRNA target sequence
accattcattaatgtattctt

SEQ ID NO: 142379 - DNA, 21 bp, Artificial sequence
  SiRNA target sequence
ccattcattaatgtattcttt

SEQ ID NO: 142380 - DNA, 21 bp, Artificial sequence
  SiRNA target sequence
cattcattaatgtattctttt

SEQ ID NO: 142381 - DNA, 21 bp, Artificial sequence
  SiRNA target sequence
attcattaatgtattcttttc

SEQ ID NO: 142382 - DNA, 21 bp, Artificial sequence
  SiRNA target sequence
ttcattaatgtattcttttct

SEQ ID NO: 142383 - DNA, 21 bp, Artificial sequence
  SiRNA target sequence
tcattaatgtattcttttctc

SEQ ID NO: 142384 - DNA, 21 bp, Artificial sequence
  SiRNA target sequence
cattaatgtattcttttctcc

SEQ ID NO: 142385 - DNA, 21 bp, Artificial sequence
  SiRNA target sequence
attaatgtattcttttctcct

SEQ ID NO: 142386 - DNA, 21 bp, Artificial sequence
  SiRNA target sequence
ttaatgtattcttttctccta

SEQ ID NO: 142387 - DNA, 21 bp, Artificial sequence
  SiRNA target sequence
taatgtattcttttctcctat

SEQ ID NO: 142388 - DNA, 21 bp, Artificial sequence
  SiRNA target sequence
aatgtattcttttctcctatt

SEQ ID NO: 142389 - DNA, 21 bp, Artificial sequence
  SiRNA target sequence
atgtattcttttctcctattt

SEQ ID NO: 142390 - DNA, 21 bp, Artificial sequence
  SiRNA target sequence
tgtattcttttctcctatttt

SEQ ID NO: 142391 - DNA, 21 bp, Artificial sequence
  SiRNA target sequence
gtattcttttctcctattttt

SEQ ID NO: 142392 - DNA, 21 bp, Artificial sequence
  SiRNA target sequence
tattcttttctcctattttta

SEQ ID NO: 142393 - DNA, 21 bp, Artificial sequence
  SiRNA target sequence
attcttttctcctatttttat

SEQ ID NO: 142394 - DNA, 21 bp, Artificial sequence
  SiRNA target sequence
ttcttttctcctatttttata

SEQ ID NO: 142395 - DNA, 21 bp, Artificial sequence
  SiRNA target sequence
tcttttctcctatttttatac

SEQ ID NO: 142396 - DNA, 21 bp, Artificial sequence
  SiRNA target sequence
cttttctcctatttttatact

SEQ ID NO: 142397 - DNA, 21 bp, Artificial sequence
  SiRNA target sequence
ttttctcctatttttatactg

SEQ ID NO: 142398 - DNA, 21 bp, Artificial sequence
  SiRNA target sequence
tttctcctatttttatactgt

SEQ ID NO: 142399 - DNA, 21 bp, Artificial sequence
  SiRNA target sequence
ttctcctatttttatactgta

SEQ ID NO: 142400 - DNA, 21 bp, Artificial sequence
  SiRNA target sequence
tctcctatttttatactgtaa

SEQ ID NO: 142401 - DNA, 21 bp, Artificial sequence
  SiRNA target sequence
ctcctatttttatactgtaaa

SEQ ID NO: 142402 - DNA, 21 bp, Artificial sequence
  SiRNA target sequence
tcctatttttatactgtaaat

SEQ ID NO: 142403 - DNA, 21 bp, Artificial sequence
  SiRNA target sequence
cctatttttatactgtaaata

SEQ ID NO: 142404 - DNA, 21 bp, Artificial sequence
  SiRNA target sequence
ctatttttatactgtaaataa

SEQ ID NO: 142405 - DNA, 21 bp, Artificial sequence
  SiRNA target sequence
tatttttatactgtaaataat

SEQ ID NO: 142406 - DNA, 21 bp, Artificial sequence
  SiRNA target sequence
atttttatactgtaaataata

SEQ ID NO: 142407 - DNA, 21 bp, Artificial sequence
  SiRNA target sequence
tttttatactgtaaataatac

SEQ ID NO: 142408 - DNA, 21 bp, Artificial sequence
  SiRNA target sequence
ttttatactgtaaataatacg

SEQ ID NO: 142409 - DNA, 21 bp, Artificial sequence
  SiRNA target sequence
tttatactgtaaataatacgc

SEQ ID NO: 142410 - DNA, 21 bp, Artificial sequence
  SiRNA target sequence
ttatactgtaaataatacgca

SEQ ID NO: 142411 - DNA, 21 bp, Artificial sequence
  SiRNA target sequence
tatactgtaaataatacgcat

SEQ ID NO: 142412 - DNA, 21 bp, Artificial sequence
  SiRNA target sequence
atactgtaaataatacgcatg

SEQ ID NO: 142413 - DNA, 21 bp, Artificial sequence
  SiRNA target sequence
tactgtaaataatacgcatgt

SEQ ID NO: 142414 - DNA, 21 bp, Artificial sequence
  SiRNA target sequence
actgtaaataatacgcatgtt

SEQ ID NO: 142415 - DNA, 21 bp, Artificial sequence
  SiRNA target sequence
ctgtaaataatacgcatgttc

SEQ ID NO: 142416 - DNA, 21 bp, Artificial sequence
  SiRNA target sequence
tgtaaataatacgcatgttcc

SEQ ID NO: 142417 - DNA, 21 bp, Artificial sequence
  SiRNA target sequence
gtaaataatacgcatgttccc

SEQ ID NO: 142418 - DNA, 21 bp, Artificial sequence
  SiRNA target sequence
taaataatacgcatgttccca

SEQ ID NO: 142419 - DNA, 21 bp, Artificial sequence
  SiRNA target sequence
aaataatacgcatgttcccat

SEQ ID NO: 142420 - DNA, 21 bp, Artificial sequence
  SiRNA target sequence
aataatacgcatgttcccata

SEQ ID NO: 142421 - DNA, 21 bp, Artificial sequence
  SiRNA target sequence
ataatacgcatgttcccatac

SEQ ID NO: 142422 - DNA, 21 bp, Artificial sequence
  SiRNA target sequence
taatacgcatgttcccataca

SEQ ID NO: 142423 - DNA, 21 bp, Artificial sequence
  SiRNA target sequence
aatacgcatgttcccatacat

SEQ ID NO: 142424 - DNA, 21 bp, Artificial sequence
  SiRNA target sequence
atacgcatgttcccatacatc

SEQ ID NO: 142425 - DNA, 21 bp, Artificial sequence
  SiRNA target sequence
tacgcatgttcccatacatca

SEQ ID NO: 142426 - DNA, 21 bp, Artificial sequence
  SiRNA target sequence
acgcatgttcccatacatcaa

SEQ ID NO: 142427 - DNA, 21 bp, Artificial sequence
  SiRNA target sequence
cgcatgttcccatacatcaag

SEQ ID NO: 142428 - DNA, 21 bp, Artificial sequence
  SiRNA target sequence
gcatgttcccatacatcaaga

SEQ ID NO: 142429 - DNA, 21 bp, Artificial sequence
  SiRNA target sequence
catgttcccatacatcaagac

SEQ ID NO: 142430 - DNA, 21 bp, Artificial sequence
  SiRNA target sequence
atgttcccatacatcaagaca

SEQ ID NO: 142431 - DNA, 21 bp, Artificial sequence
  SiRNA target sequence
tgttcccatacatcaagacat

SEQ ID NO: 142432 - DNA, 21 bp, Artificial sequence
  SiRNA target sequence
gttcccatacatcaagacata

SEQ ID NO: 142433 - DNA, 21 bp, Artificial sequence
  SiRNA target sequence
ttcccatacatcaagacatag

SEQ ID NO: 142434 - DNA, 21 bp, Artificial sequence
  SiRNA target sequence
tcccatacatcaagacatagt

SEQ ID NO: 142435 - DNA, 21 bp, Artificial sequence
  SiRNA target sequence
cccatacatcaagacatagta

SEQ ID NO: 142436 - DNA, 21 bp, Artificial sequence
  SiRNA target sequence
ccatacatcaagacatagtaa

SEQ ID NO: 142437 - DNA, 21 bp, Artificial sequence
  SiRNA target sequence
catacatcaagacatagtaaa

SEQ ID NO: 142438 - DNA, 21 bp, Artificial sequence
  SiRNA target sequence
atacatcaagacatagtaaag

SEQ ID NO: 142439 - DNA, 21 bp, Artificial sequence
  SiRNA target sequence
tacatcaagacatagtaaagg

SEQ ID NO: 142440 - DNA, 21 bp, Artificial sequence
  SiRNA target sequence
acatcaagacatagtaaagga

SEQ ID NO: 142441 - DNA, 21 bp, Artificial sequence
  SiRNA target sequence
catcaagacatagtaaaggaa

SEQ ID NO: 142442 - DNA, 21 bp, Artificial sequence
  SiRNA target sequence
atcaagacatagtaaaggaat

SEQ ID NO: 142443 - DNA, 21 bp, Artificial sequence
  SiRNA target sequence
tcaagacatagtaaaggaata

SEQ ID NO: 142444 - DNA, 21 bp, Artificial sequence
  SiRNA target sequence
caagacatagtaaaggaatac

SEQ ID NO: 142445 - DNA, 21 bp, Artificial sequence
  SiRNA target sequence
aagacatagtaaaggaataca

SEQ ID NO: 142446 - DNA, 21 bp, Artificial sequence
  SiRNA target sequence
agacatagtaaaggaatacat

SEQ ID NO: 142447 - DNA, 21 bp, Artificial sequence
  SiRNA target sequence
gacatagtaaaggaatacatt

SEQ ID NO: 142448 - DNA, 21 bp, Artificial sequence
  SiRNA target sequence
acatagtaaaggaatacattc

SEQ ID NO: 142449 - DNA, 21 bp, Artificial sequence
  SiRNA target sequence
catagtaaaggaatacattca

SEQ ID NO: 142450 - DNA, 21 bp, Artificial sequence
  SiRNA target sequence
atagtaaaggaatacattcac

SEQ ID NO: 142451 - DNA, 21 bp, Artificial sequence
  SiRNA target sequence
tagtaaaggaatacattcacc

SEQ ID NO: 142452 - DNA, 21 bp, Artificial sequence
  SiRNA target sequence
agtaaaggaatacattcacca

SEQ ID NO: 142453 - DNA, 21 bp, Artificial sequence
  SiRNA target sequence
gtaaaggaatacattcaccat

SEQ ID NO: 142454 - DNA, 21 bp, Artificial sequence
  SiRNA target sequence
taaaggaatacattcaccatc

SEQ ID NO: 142455 - DNA, 21 bp, Artificial sequence
  SiRNA target sequence
aaaggaatacattcaccatcc

SEQ ID NO: 142456 - DNA, 21 bp, Artificial sequence
  SiRNA target sequence
aaggaatacattcaccatcct

SEQ ID NO: 142457 - DNA, 21 bp, Artificial sequence
  SiRNA target sequence
aggaatacattcaccatcctc

SEQ ID NO: 142458 - DNA, 21 bp, Artificial sequence
  SiRNA target sequence
ggaatacattcaccatcctcc

SEQ ID NO: 142459 - DNA, 21 bp, Artificial sequence
  SiRNA target sequence
gaatacattcaccatcctcca

SEQ ID NO: 142460 - DNA, 21 bp, Artificial sequence
  SiRNA target sequence
aatacattcaccatcctccat

SEQ ID NO: 142461 - DNA, 21 bp, Artificial sequence
  SiRNA target sequence
atacattcaccatcctccatc

SEQ ID NO: 142462 - DNA, 21 bp, Artificial sequence
  SiRNA target sequence
tacattcaccatcctccatca

SEQ ID NO: 142463 - DNA, 21 bp, Artificial sequence
  SiRNA target sequence
acattcaccatcctccatcat

SEQ ID NO: 142464 - DNA, 21 bp, Artificial sequence
  SiRNA target sequence
cattcaccatcctccatcata

SEQ ID NO: 142465 - DNA, 21 bp, Artificial sequence
  SiRNA target sequence
attcaccatcctccatcatag

SEQ ID NO: 142466 - DNA, 21 bp, Artificial sequence
  SiRNA target sequence
ttcaccatcctccatcatagg

SEQ ID NO: 142467 - DNA, 21 bp, Artificial sequence
  SiRNA target sequence
tcaccatcctccatcatagga

SEQ ID NO: 142468 - DNA, 21 bp, Artificial sequence
  SiRNA target sequence
caccatcctccatcataggat

SEQ ID NO: 142469 - DNA, 21 bp, Artificial sequence
  SiRNA target sequence
accatcctccatcataggatt

SEQ ID NO: 142470 - DNA, 21 bp, Artificial sequence
  SiRNA target sequence
ccatcctccatcataggattg

SEQ ID NO: 142471 - DNA, 21 bp, Artificial sequence
  SiRNA target sequence
catcctccatcataggattgt

SEQ ID NO: 142472 - DNA, 21 bp, Artificial sequence
  SiRNA target sequence
atcctccatcataggattgtc

SEQ ID NO: 142473 - DNA, 21 bp, Artificial sequence
  SiRNA target sequence
tcctccatcataggattgtct

SEQ ID NO: 142474 - DNA, 21 bp, Artificial sequence
  SiRNA target sequence
cctccatcataggattgtctt

SEQ ID NO: 142475 - DNA, 21 bp, Artificial sequence
  SiRNA target sequence
ctccatcataggattgtcttg

SEQ ID NO: 142476 - DNA, 21 bp, Artificial sequence
  SiRNA target sequence
tccatcataggattgtcttga

SEQ ID NO: 142477 - DNA, 21 bp, Artificial sequence
  SiRNA target sequence
ccatcataggattgtcttgat

SEQ ID NO: 142478 - DNA, 21 bp, Artificial sequence
  SiRNA target sequence
catcataggattgtcttgatt

SEQ ID NO: 142479 - DNA, 21 bp, Artificial sequence
  SiRNA target sequence
atcataggattgtcttgatta

SEQ ID NO: 142480 - DNA, 21 bp, Artificial sequence
  SiRNA target sequence
tcataggattgtcttgattaa

SEQ ID NO: 142481 - DNA, 21 bp, Artificial sequence
  SiRNA target sequence
cataggattgtcttgattaac

SEQ ID NO: 142482 - DNA, 21 bp, Artificial sequence
  SiRNA target sequence
ataggattgtcttgattaaca

SEQ ID NO: 142483 - DNA, 21 bp, Artificial sequence
  SiRNA target sequence
taggattgtcttgattaacac

SEQ ID NO: 142484 - DNA, 21 bp, Artificial sequence
  SiRNA target sequence
aggattgtcttgattaacact

SEQ ID NO: 142485 - DNA, 21 bp, Artificial sequence
  SiRNA target sequence
ggattgtcttgattaacactg

SEQ ID NO: 142486 - DNA, 21 bp, Artificial sequence
  SiRNA target sequence
gattgtcttgattaacactgg

SEQ ID NO: 142487 - DNA, 21 bp, Artificial sequence
  SiRNA target sequence
attgtcttgattaacactggt

SEQ ID NO: 142488 - DNA, 21 bp, Artificial sequence
  SiRNA target sequence
ttgtcttgattaacactggtc

SEQ ID NO: 142489 - DNA, 21 bp, Artificial sequence
  SiRNA target sequence
tgtcttgattaacactggtct

SEQ ID NO: 142490 - DNA, 21 bp, Artificial sequence
  SiRNA target sequence
gtcttgattaacactggtctt

SEQ ID NO: 142491 - DNA, 21 bp, Artificial sequence
  SiRNA target sequence
tcttgattaacactggtctta

SEQ ID NO: 142492 - DNA, 21 bp, Artificial sequence
  SiRNA target sequence
cttgattaacactggtcttaa

SEQ ID NO: 142493 - DNA, 21 bp, Artificial sequence
  SiRNA target sequence
ttgattaacactggtcttaat

SEQ ID NO: 142494 - DNA, 21 bp, Artificial sequence
  SiRNA target sequence
tgattaacactggtcttaata

SEQ ID NO: 142495 - DNA, 21 bp, Artificial sequence
  SiRNA target sequence
gattaacactggtcttaatac

SEQ ID NO: 142496 - DNA, 21 bp, Artificial sequence
  SiRNA target sequence
attaacactggtcttaataca

SEQ ID NO: 142497 - DNA, 21 bp, Artificial sequence
  SiRNA target sequence
ttaacactggtcttaatacac

SEQ ID NO: 142498 - DNA, 21 bp, Artificial sequence
  SiRNA target sequence
taacactggtcttaatacaca

SEQ ID NO: 142499 - DNA, 21 bp, Artificial sequence
  SiRNA target sequence
aacactggtcttaatacacaa

SEQ ID NO: 142500 - DNA, 21 bp, Artificial sequence
  SiRNA target sequence
acactggtcttaatacacaat

SEQ ID NO: 142501 - DNA, 21 bp, Artificial sequence
  SiRNA target sequence
cactggtcttaatacacaatt

SEQ ID NO: 142502 - DNA, 21 bp, Artificial sequence
  SiRNA target sequence
actggtcttaatacacaattt

SEQ ID NO: 142503 - DNA, 21 bp, Artificial sequence
  SiRNA target sequence
ctggtcttaatacacaattta

SEQ ID NO: 142504 - DNA, 21 bp, Artificial sequence
  SiRNA target sequence
tggtcttaatacacaatttat

SEQ ID NO: 142505 - DNA, 21 bp, Artificial sequence
  SiRNA target sequence
ggtcttaatacacaatttatc

SEQ ID NO: 142506 - DNA, 21 bp, Artificial sequence
  SiRNA target sequence
gtcttaatacacaatttatct

SEQ ID NO: 142507 - DNA, 21 bp, Artificial sequence
  SiRNA target sequence
tcttaatacacaatttatctt

SEQ ID NO: 142508 - DNA, 21 bp, Artificial sequence
  SiRNA target sequence
cttaatacacaatttatcttt

SEQ ID NO: 142509 - DNA, 21 bp, Artificial sequence
  SiRNA target sequence
ttaatacacaatttatcttta

SEQ ID NO: 142510 - DNA, 21 bp, Artificial sequence
  SiRNA target sequence
taatacacaatttatctttat

SEQ ID NO: 142511 - DNA, 21 bp, Artificial sequence
  SiRNA target sequence
aatacacaatttatctttata

SEQ ID NO: 142512 - DNA, 21 bp, Artificial sequence
  SiRNA target sequence
atacacaatttatctttatat

SEQ ID NO: 142513 - DNA, 21 bp, Artificial sequence
  SiRNA target sequence
tacacaatttatctttatata

SEQ ID NO: 142514 - DNA, 21 bp, Artificial sequence
  SiRNA target sequence
acacaatttatctttatatat

SEQ ID NO: 142515 - DNA, 21 bp, Artificial sequence
  SiRNA target sequence
cacaatttatctttatatatc

SEQ ID NO: 142516 - DNA, 21 bp, Artificial sequence
  SiRNA target sequence
acaatttatctttatatatca

SEQ ID NO: 142517 - DNA, 21 bp, Artificial sequence
  SiRNA target sequence
caatttatctttatatatcaa

SEQ ID NO: 142518 - DNA, 21 bp, Artificial sequence
  SiRNA target sequence
aatttatctttatatatcaac

SEQ ID NO: 142519 - DNA, 21 bp, Artificial sequence
  SiRNA target sequence
atttatctttatatatcaacc

SEQ ID NO: 142520 - DNA, 21 bp, Artificial sequence
  SiRNA target sequence
tttatctttatatatcaacca

SEQ ID NO: 142521 - DNA, 21 bp, Artificial sequence
  SiRNA target sequence
ttatctttatatatcaaccac

SEQ ID NO: 142522 - DNA, 21 bp, Artificial sequence
  SiRNA target sequence
tatctttatatatcaaccaca

SEQ ID NO: 142523 - DNA, 21 bp, Artificial sequence
  SiRNA target sequence
atctttatatatcaaccacac

SEQ ID NO: 142524 - DNA, 21 bp, Artificial sequence
  SiRNA target sequence
tctttatatatcaaccacacc

SEQ ID NO: 142525 - DNA, 21 bp, Artificial sequence
  SiRNA target sequence
ctttatatatcaaccacaccc

SEQ ID NO: 142526 - DNA, 21 bp, Artificial sequence
  SiRNA target sequence
tttatatatcaaccacaccca

SEQ ID NO: 142527 - DNA, 21 bp, Artificial sequence
  SiRNA target sequence
ttatatatcaaccacacccat

SEQ ID NO: 142528 - DNA, 21 bp, Artificial sequence
  SiRNA target sequence
tatatatcaaccacacccatc

SEQ ID NO: 142529 - DNA, 21 bp, Artificial sequence
  SiRNA target sequence
atatatcaaccacacccatcc

SEQ ID NO: 142530 - DNA, 21 bp, Artificial sequence
  SiRNA target sequence
tatatcaaccacacccatcct

SEQ ID NO: 142531 - DNA, 21 bp, Artificial sequence
  SiRNA target sequence
atatcaaccacacccatcctg

SEQ ID NO: 142532 - DNA, 21 bp, Artificial sequence
  SiRNA target sequence
tatcaaccacacccatcctga

SEQ ID NO: 142533 - DNA, 21 bp, Artificial sequence
  SiRNA target sequence
atcaaccacacccatcctgat

SEQ ID NO: 142534 - DNA, 21 bp, Artificial sequence
  SiRNA target sequence
tcaaccacacccatcctgatc

SEQ ID NO: 142535 - DNA, 21 bp, Artificial sequence
  SiRNA target sequence
caaccacacccatcctgatcc

SEQ ID NO: 142536 - DNA, 21 bp, Artificial sequence
  SiRNA target sequence
aaccacacccatcctgatcca

SEQ ID NO: 142537 - DNA, 21 bp, Artificial sequence
  SiRNA target sequence
accacacccatcctgatccaa

SEQ ID NO: 142538 - DNA, 21 bp, Artificial sequence
  SiRNA target sequence
ccacacccatcctgatccaaa

SEQ ID NO: 142539 - DNA, 21 bp, Artificial sequence
  SiRNA target sequence
cacacccatcctgatccaaat

SEQ ID NO: 142540 - DNA, 21 bp, Artificial sequence
  SiRNA target sequence
acacccatcctgatccaaata

SEQ ID NO: 142541 - DNA, 21 bp, Artificial sequence
  SiRNA target sequence
cacccatcctgatccaaataa

SEQ ID NO: 142542 - DNA, 21 bp, Artificial sequence
  SiRNA target sequence
acccatcctgatccaaataat

SEQ ID NO: 142543 - DNA, 21 bp, Artificial sequence
  SiRNA target sequence
cccatcctgatccaaataatt

SEQ ID NO: 142544 - DNA, 21 bp, Artificial sequence
  SiRNA target sequence
ccatcctgatccaaataattt

SEQ ID NO: 142545 - DNA, 21 bp, Artificial sequence
  SiRNA target sequence
catcctgatccaaataatttt

SEQ ID NO: 142546 - DNA, 21 bp, Artificial sequence
  SiRNA target sequence
atcctgatccaaataatttta

SEQ ID NO: 142547 - DNA, 21 bp, Artificial sequence
  SiRNA target sequence
tcctgatccaaataattttac

SEQ ID NO: 142548 - DNA, 21 bp, Artificial sequence
  SiRNA target sequence
cctgatccaaataattttaca

SEQ ID NO: 142549 - DNA, 21 bp, Artificial sequence
  SiRNA target sequence
ctgatccaaataattttacag

SEQ ID NO: 142550 - DNA, 21 bp, Artificial sequence
  SiRNA target sequence
tgatccaaataattttacagc

SEQ ID NO: 142551 - DNA, 21 bp, Artificial sequence
  SiRNA target sequence
gatccaaataattttacagct

SEQ ID NO: 142552 - DNA, 21 bp, Artificial sequence
  SiRNA target sequence
atccaaataattttacagctt

SEQ ID NO: 142553 - DNA, 21 bp, Artificial sequence
  SiRNA target sequence
tccaaataattttacagcttc

SEQ ID NO: 142554 - DNA, 21 bp, Artificial sequence
  SiRNA target sequence
ccaaataattttacagcttca

SEQ ID NO: 142555 - DNA, 21 bp, Artificial sequence
  SiRNA target sequence
caaataattttacagcttcag

SEQ ID NO: 142556 - DNA, 21 bp, Artificial sequence
  SiRNA target sequence
aaataattttacagcttcagt

SEQ ID NO: 142557 - DNA, 21 bp, Artificial sequence
  SiRNA target sequence
aataattttacagcttcagta

SEQ ID NO: 142558 - DNA, 21 bp, Artificial sequence
  SiRNA target sequence
ataattttacagcttcagtat

SEQ ID NO: 142559 - DNA, 21 bp, Artificial sequence
  SiRNA target sequence
taattttacagcttcagtatt

SEQ ID NO: 142560 - DNA, 21 bp, Artificial sequence
  SiRNA target sequence
aattttacagcttcagtatta

SEQ ID NO: 142561 - DNA, 21 bp, Artificial sequence
  SiRNA target sequence
attttacagcttcagtattaa

SEQ ID NO: 142562 - DNA, 21 bp, Artificial sequence
  SiRNA target sequence
ttttacagcttcagtattaaa

SEQ ID NO: 142563 - DNA, 21 bp, Artificial sequence
  SiRNA target sequence
tttacagcttcagtattaaaa

SEQ ID NO: 142564 - DNA, 21 bp, Artificial sequence
  SiRNA target sequence
ttacagcttcagtattaaaat

SEQ ID NO: 142565 - DNA, 21 bp, Artificial sequence
  SiRNA target sequence
tacagcttcagtattaaaatt

SEQ ID NO: 142566 - DNA, 21 bp, Artificial sequence
  SiRNA target sequence
acagcttcagtattaaaattc

SEQ ID NO: 142567 - DNA, 21 bp, Artificial sequence
  SiRNA target sequence
cagcttcagtattaaaattct

SEQ ID NO: 142568 - DNA, 21 bp, Artificial sequence
  SiRNA target sequence
agcttcagtattaaaattctc

SEQ ID NO: 142569 - DNA, 21 bp, Artificial sequence
  SiRNA target sequence
gcttcagtattaaaattctcc

SEQ ID NO: 142570 - DNA, 21 bp, Artificial sequence
  SiRNA target sequence
cttcagtattaaaattctcct

SEQ ID NO: 142571 - DNA, 21 bp, Artificial sequence
  SiRNA target sequence
ttcagtattaaaattctcctt

SEQ ID NO: 142572 - DNA, 21 bp, Artificial sequence
  SiRNA target sequence
tcagtattaaaattctcctta

SEQ ID NO: 142573 - DNA, 21 bp, Artificial sequence
  SiRNA target sequence
cagtattaaaattctccttaa

SEQ ID NO: 142574 - DNA, 21 bp, Artificial sequence
  SiRNA target sequence
agtattaaaattctccttaaa

SEQ ID NO: 142575 - DNA, 21 bp, Artificial sequence
  SiRNA target sequence
gtattaaaattctccttaaat

SEQ ID NO: 142576 - DNA, 21 bp, Artificial sequence
  SiRNA target sequence
tattaaaattctccttaaatt

SEQ ID NO: 142577 - DNA, 21 bp, Artificial sequence
  SiRNA target sequence
attaaaattctccttaaattt

SEQ ID NO: 142578 - DNA, 21 bp, Artificial sequence
  SiRNA target sequence
ttaaaattctccttaaattta

SEQ ID NO: 142579 - DNA, 21 bp, Artificial sequence
  SiRNA target sequence
taaaattctccttaaatttat

SEQ ID NO: 142580 - DNA, 21 bp, Artificial sequence
  SiRNA target sequence
aaaattctccttaaatttatt

SEQ ID NO: 142581 - DNA, 21 bp, Artificial sequence
  SiRNA target sequence
aaattctccttaaatttattt

SEQ ID NO: 142582 - DNA, 21 bp, Artificial sequence
  SiRNA target sequence
aattctccttaaatttattta

SEQ ID NO: 142583 - DNA, 21 bp, Artificial sequence
  SiRNA target sequence
attctccttaaatttatttat

SEQ ID NO: 142584 - DNA, 21 bp, Artificial sequence
  SiRNA target sequence
ttctccttaaatttatttatt

SEQ ID NO: 142585 - DNA, 21 bp, Artificial sequence
  SiRNA target sequence
tctccttaaatttatttattg

SEQ ID NO: 142586 - DNA, 21 bp, Artificial sequence
  SiRNA target sequence
ctccttaaatttatttattga

SEQ ID NO: 142587 - DNA, 21 bp, Artificial sequence
  SiRNA target sequence
tccttaaatttatttattgat

SEQ ID NO: 142588 - DNA, 21 bp, Artificial sequence
  SiRNA target sequence
ccttaaatttatttattgatc

SEQ ID NO: 142589 - DNA, 21 bp, Artificial sequence
  SiRNA target sequence
cttaaatttatttattgatcc

SEQ ID NO: 142590 - DNA, 21 bp, Artificial sequence
  SiRNA target sequence
ttaaatttatttattgatcca

SEQ ID NO: 142591 - DNA, 21 bp, Artificial sequence
  SiRNA target sequence
taaatttatttattgatccaa

SEQ ID NO: 142592 - DNA, 21 bp, Artificial sequence
  SiRNA target sequence
aaatttatttattgatccaaa

SEQ ID NO: 142593 - DNA, 21 bp, Artificial sequence
  SiRNA target sequence
aatttatttattgatccaaag

SEQ ID NO: 142594 - DNA, 21 bp, Artificial sequence
  SiRNA target sequence
atttatttattgatccaaagt

SEQ ID NO: 142595 - DNA, 21 bp, Artificial sequence
  SiRNA target sequence
tttatttattgatccaaagtc

SEQ ID NO: 142596 - DNA, 21 bp, Artificial sequence
  SiRNA target sequence
ttatttattgatccaaagtct

SEQ ID NO: 142597 - DNA, 21 bp, Artificial sequence
  SiRNA target sequence
tatttattgatccaaagtctt

SEQ ID NO: 142598 - DNA, 21 bp, Artificial sequence
  SiRNA target sequence
atttattgatccaaagtcttt

SEQ ID NO: 142599 - DNA, 21 bp, Artificial sequence
  SiRNA target sequence
tttattgatccaaagtctttt

SEQ ID NO: 142600 - DNA, 21 bp, Artificial sequence
  SiRNA target sequence
ttattgatccaaagtctttta

SEQ ID NO: 142601 - DNA, 21 bp, Artificial sequence
  SiRNA target sequence
tattgatccaaagtcttttat

SEQ ID NO: 142602 - DNA, 21 bp, Artificial sequence
  SiRNA target sequence
attgatccaaagtcttttatt

SEQ ID NO: 142603 - DNA, 21 bp, Artificial sequence
  SiRNA target sequence
ttgatccaaagtcttttatta

SEQ ID NO: 142604 - DNA, 21 bp, Artificial sequence
  SiRNA target sequence
tgatccaaagtcttttattat

SEQ ID NO: 142605 - DNA, 21 bp, Artificial sequence
  SiRNA target sequence
gatccaaagtcttttattata

SEQ ID NO: 142606 - DNA, 21 bp, Artificial sequence
  SiRNA target sequence
atccaaagtcttttattatag

SEQ ID NO: 142607 - DNA, 21 bp, Artificial sequence
  SiRNA target sequence
tccaaagtcttttattatagc

SEQ ID NO: 142608 - DNA, 21 bp, Artificial sequence
  SiRNA target sequence
ccaaagtcttttattatagca

SEQ ID NO: 142609 - DNA, 21 bp, Artificial sequence
  SiRNA target sequence
caaagtcttttattatagcac

SEQ ID NO: 142610 - DNA, 21 bp, Artificial sequence
  SiRNA target sequence
aaagtcttttattatagcact

SEQ ID NO: 142611 - DNA, 21 bp, Artificial sequence
  SiRNA target sequence
aagtcttttattatagcactt

SEQ ID NO: 142612 - DNA, 21 bp, Artificial sequence
  SiRNA target sequence
agtcttttattatagcacttt

SEQ ID NO: 142613 - DNA, 21 bp, Artificial sequence
  SiRNA target sequence
gtcttttattatagcactttc

SEQ ID NO: 142614 - DNA, 21 bp, Artificial sequence
  SiRNA target sequence
tcttttattatagcactttcc

SEQ ID NO: 142615 - DNA, 21 bp, Artificial sequence
  SiRNA target sequence
cttttattatagcactttcca

SEQ ID NO: 142616 - DNA, 21 bp, Artificial sequence
  SiRNA target sequence
ttttattatagcactttccaa

SEQ ID NO: 142617 - DNA, 21 bp, Artificial sequence
  SiRNA target sequence
tttattatagcactttccaac

SEQ ID NO: 142618 - DNA, 21 bp, Artificial sequence
  SiRNA target sequence
ttattatagcactttccaact

SEQ ID NO: 142619 - DNA, 21 bp, Artificial sequence
  SiRNA target sequence
tattatagcactttccaactg

SEQ ID NO: 142620 - DNA, 21 bp, Artificial sequence
  SiRNA target sequence
attatagcactttccaactgg

SEQ ID NO: 142621 - DNA, 21 bp, Artificial sequence
  SiRNA target sequence
ttatagcactttccaactggg

SEQ ID NO: 142622 - DNA, 21 bp, Artificial sequence
  SiRNA target sequence
tatagcactttccaactggga

SEQ ID NO: 142623 - DNA, 21 bp, Artificial sequence
  SiRNA target sequence
atagcactttccaactgggaa

SEQ ID NO: 142624 - DNA, 21 bp, Artificial sequence
  SiRNA target sequence
tagcactttccaactgggaag

SEQ ID NO: 142625 - DNA, 21 bp, Artificial sequence
  SiRNA target sequence
agcactttccaactgggaaga

SEQ ID NO: 142626 - DNA, 21 bp, Artificial sequence
  SiRNA target sequence
gcactttccaactgggaagaa

SEQ ID NO: 142627 - DNA, 21 bp, Artificial sequence
  SiRNA target sequence
cactttccaactgggaagaaa

SEQ ID NO: 142628 - DNA, 21 bp, Artificial sequence
  SiRNA target sequence
actttccaactgggaagaaat

SEQ ID NO: 142629 - DNA, 21 bp, Artificial sequence
  SiRNA target sequence
ctttccaactgggaagaaatc

SEQ ID NO: 142630 - DNA, 21 bp, Artificial sequence
  SiRNA target sequence
tttccaactgggaagaaatct

SEQ ID NO: 142631 - DNA, 21 bp, Artificial sequence
  SiRNA target sequence
ttccaactgggaagaaatctt

SEQ ID NO: 142632 - DNA, 21 bp, Artificial sequence
  SiRNA target sequence
tccaactgggaagaaatcttt

SEQ ID NO: 142633 - DNA, 21 bp, Artificial sequence
  SiRNA target sequence
ccaactgggaagaaatctttt

SEQ ID NO: 142634 - DNA, 21 bp, Artificial sequence
  SiRNA target sequence
caactgggaagaaatcttttt

SEQ ID NO: 142635 - DNA, 21 bp, Artificial sequence
  SiRNA target sequence
aactgggaagaaatcttttta

SEQ ID NO: 142636 - DNA, 21 bp, Artificial sequence
  SiRNA target sequence
actgggaagaaatctttttat

SEQ ID NO: 142637 - DNA, 21 bp, Artificial sequence
  SiRNA target sequence
ctgggaagaaatctttttatt

SEQ ID NO: 142638 - DNA, 21 bp, Artificial sequence
  SiRNA target sequence
tgggaagaaatctttttattt

SEQ ID NO: 142639 - DNA, 21 bp, Artificial sequence
  SiRNA target sequence
gggaagaaatctttttatttt

SEQ ID NO: 142640 - DNA, 21 bp, Artificial sequence
  SiRNA target sequence
ggaagaaatctttttattttc

SEQ ID NO: 142641 - DNA, 21 bp, Artificial sequence
  SiRNA target sequence
gaagaaatctttttattttct

SEQ ID NO: 142642 - DNA, 21 bp, Artificial sequence
  SiRNA target sequence
aagaaatctttttattttctg

SEQ ID NO: 142643 - DNA, 21 bp, Artificial sequence
  SiRNA target sequence
agaaatctttttattttctgg

SEQ ID NO: 142644 - DNA, 21 bp, Artificial sequence
  SiRNA target sequence
gaaatctttttattttctggt

SEQ ID NO: 142645 - DNA, 21 bp, Artificial sequence
  SiRNA target sequence
aaatctttttattttctggtg

SEQ ID NO: 142646 - DNA, 21 bp, Artificial sequence
  SiRNA target sequence
aatctttttattttctggtga

SEQ ID NO: 142647 - DNA, 21 bp, Artificial sequence
  SiRNA target sequence
atctttttattttctggtgac

SEQ ID NO: 142648 - DNA, 21 bp, Artificial sequence
  SiRNA target sequence
tctttttattttctggtgaca

SEQ ID NO: 142649 - DNA, 21 bp, Artificial sequence
  SiRNA target sequence
ctttttattttctggtgacat

SEQ ID NO: 142650 - DNA, 21 bp, Artificial sequence
  SiRNA target sequence
tttttattttctggtgacatt

SEQ ID NO: 142651 - DNA, 21 bp, Artificial sequence
  SiRNA target sequence
ttttattttctggtgacatta

SEQ ID NO: 142652 - DNA, 21 bp, Artificial sequence
  SiRNA target sequence
tttattttctggtgacattac

SEQ ID NO: 142653 - DNA, 21 bp, Artificial sequence
  SiRNA target sequence
ttattttctggtgacattacc

SEQ ID NO: 142654 - DNA, 21 bp, Artificial sequence
  SiRNA target sequence
tattttctggtgacattacca

SEQ ID NO: 142655 - DNA, 21 bp, Artificial sequence
  SiRNA target sequence
attttctggtgacattaccaa

SEQ ID NO: 142656 - DNA, 21 bp, Artificial sequence
  SiRNA target sequence
ttttctggtgacattaccaac

SEQ ID NO: 142657 - DNA, 21 bp, Artificial sequence
  SiRNA target sequence
tttctggtgacattaccaacc

SEQ ID NO: 142658 - DNA, 21 bp, Artificial sequence
  SiRNA target sequence
ttctggtgacattaccaacca

SEQ ID NO: 142659 - DNA, 21 bp, Artificial sequence
  SiRNA target sequence
tctggtgacattaccaaccag

SEQ ID NO: 142660 - DNA, 21 bp, Artificial sequence
  SiRNA target sequence
ctggtgacattaccaaccaga

SEQ ID NO: 142661 - DNA, 21 bp, Artificial sequence
  SiRNA target sequence
tggtgacattaccaaccagaa

SEQ ID NO: 142662 - DNA, 21 bp, Artificial sequence
  SiRNA target sequence
ggtgacattaccaaccagaaa

SEQ ID NO: 142663 - DNA, 21 bp, Artificial sequence
  SiRNA target sequence
gtgacattaccaaccagaaaa

SEQ ID NO: 142664 - DNA, 21 bp, Artificial sequence
  SiRNA target sequence
tgacattaccaaccagaaaag

SEQ ID NO: 142665 - DNA, 21 bp, Artificial sequence
  SiRNA target sequence
gacattaccaaccagaaaaga

SEQ ID NO: 142666 - DNA, 21 bp, Artificial sequence
  SiRNA target sequence
acattaccaaccagaaaagac

SEQ ID NO: 142667 - DNA, 21 bp, Artificial sequence
  SiRNA target sequence
cattaccaaccagaaaagact

SEQ ID NO: 142668 - DNA, 21 bp, Artificial sequence
  SiRNA target sequence
attaccaaccagaaaagacta

SEQ ID NO: 142669 - DNA, 21 bp, Artificial sequence
  SiRNA target sequence
ttaccaaccagaaaagactat

SEQ ID NO: 142670 - DNA, 21 bp, Artificial sequence
  SiRNA target sequence
taccaaccagaaaagactatg

SEQ ID NO: 142671 - DNA, 21 bp, Artificial sequence
  SiRNA target sequence
accaaccagaaaagactatgg

SEQ ID NO: 142672 - DNA, 21 bp, Artificial sequence
  SiRNA target sequence
ccaaccagaaaagactatggt

SEQ ID NO: 142673 - DNA, 21 bp, Artificial sequence
  SiRNA target sequence
caaccagaaaagactatggtt

SEQ ID NO: 142674 - DNA, 21 bp, Artificial sequence
  SiRNA target sequence
aaccagaaaagactatggttg

SEQ ID NO: 142675 - DNA, 21 bp, Artificial sequence
  SiRNA target sequence
accagaaaagactatggttgt

SEQ ID NO: 142676 - DNA, 21 bp, Artificial sequence
  SiRNA target sequence
ccagaaaagactatggttgta

SEQ ID NO: 142677 - DNA, 21 bp, Artificial sequence
  SiRNA target sequence
cagaaaagactatggttgtaa

SEQ ID NO: 142678 - DNA, 21 bp, Artificial sequence
  SiRNA target sequence
agaaaagactatggttgtaat

SEQ ID NO: 142679 - DNA, 21 bp, Artificial sequence
  SiRNA target sequence
gaaaagactatggttgtaatg

SEQ ID NO: 142680 - DNA, 21 bp, Artificial sequence
  SiRNA target sequence
aaaagactatggttgtaatga

SEQ ID NO: 142681 - DNA, 21 bp, Artificial sequence
  SiRNA target sequence
aaagactatggttgtaatgac

SEQ ID NO: 142682 - DNA, 21 bp, Artificial sequence
  SiRNA target sequence
aagactatggttgtaatgacc

SEQ ID NO: 142683 - DNA, 21 bp, Artificial sequence
  SiRNA target sequence
agactatggttgtaatgacca

SEQ ID NO: 142684 - DNA, 21 bp, Artificial sequence
  SiRNA target sequence
gactatggttgtaatgaccac

SEQ ID NO: 142685 - DNA, 21 bp, Artificial sequence
  SiRNA target sequence
actatggttgtaatgaccacc

SEQ ID NO: 142686 - DNA, 21 bp, Artificial sequence
  SiRNA target sequence
ctatggttgtaatgaccacca

SEQ ID NO: 142687 - DNA, 21 bp, Artificial sequence
  SiRNA target sequence
tatggttgtaatgaccaccac

SEQ ID NO: 142688 - DNA, 21 bp, Artificial sequence
  SiRNA target sequence
atggttgtaatgaccaccacc

SEQ ID NO: 142689 - DNA, 21 bp, Artificial sequence
  SiRNA target sequence
tggttgtaatgaccaccacca

SEQ ID NO: 142690 - DNA, 21 bp, Artificial sequence
  SiRNA target sequence
ggttgtaatgaccaccaccat

SEQ ID NO: 142691 - DNA, 21 bp, Artificial sequence
  SiRNA target sequence
gttgtaatgaccaccaccata

SEQ ID NO: 142692 - DNA, 21 bp, Artificial sequence
  SiRNA target sequence
ttgtaatgaccaccaccataa

SEQ ID NO: 142693 - DNA, 21 bp, Artificial sequence
  SiRNA target sequence
tgtaatgaccaccaccataat

SEQ ID NO: 142694 - DNA, 21 bp, Artificial sequence
  SiRNA target sequence
gtaatgaccaccaccataatc

SEQ ID NO: 142695 - DNA, 21 bp, Artificial sequence
  SiRNA target sequence
taatgaccaccaccataatct

SEQ ID NO: 142696 - DNA, 21 bp, Artificial sequence
  SiRNA target sequence
aatgaccaccaccataatctc

SEQ ID NO: 142697 - DNA, 21 bp, Artificial sequence
  SiRNA target sequence
atgaccaccaccataatctct

SEQ ID NO: 142698 - DNA, 21 bp, Artificial sequence
  SiRNA target sequence
tgaccaccaccataatctctt

SEQ ID NO: 142699 - DNA, 21 bp, Artificial sequence
  SiRNA target sequence
gaccaccaccataatctctta

SEQ ID NO: 142700 - DNA, 21 bp, Artificial sequence
  SiRNA target sequence
accaccaccataatctcttaa

SEQ ID NO: 142701 - DNA, 21 bp, Artificial sequence
  SiRNA target sequence
ccaccaccataatctcttaat

SEQ ID NO: 142702 - DNA, 21 bp, Artificial sequence
  SiRNA target sequence
caccaccataatctcttaatt

SEQ ID NO: 142703 - DNA, 21 bp, Artificial sequence
  SiRNA target sequence
accaccataatctcttaattg

SEQ ID NO: 142704 - DNA, 21 bp, Artificial sequence
  SiRNA target sequence
ccaccataatctcttaattgt

SEQ ID NO: 142705 - DNA, 21 bp, Artificial sequence
  SiRNA target sequence
caccataatctcttaattgtt

SEQ ID NO: 142706 - DNA, 21 bp, Artificial sequence
  SiRNA target sequence
accataatctcttaattgttt

SEQ ID NO: 142707 - DNA, 21 bp, Artificial sequence
  SiRNA target sequence
ccataatctcttaattgttta

SEQ ID NO: 142708 - DNA, 21 bp, Artificial sequence
  SiRNA target sequence
cataatctcttaattgtttat

SEQ ID NO: 142709 - DNA, 21 bp, Artificial sequence
  SiRNA target sequence
ataatctcttaattgtttatc

SEQ ID NO: 142710 - DNA, 21 bp, Artificial sequence
  SiRNA target sequence
taatctcttaattgtttatca

SEQ ID NO: 142711 - DNA, 21 bp, Artificial sequence
  SiRNA target sequence
aatctcttaattgtttatcaa

SEQ ID NO: 142712 - DNA, 21 bp, Artificial sequence
  SiRNA target sequence
atctcttaattgtttatcaac

SEQ ID NO: 142713 - DNA, 21 bp, Artificial sequence
  SiRNA target sequence
tctcttaattgtttatcaaca

SEQ ID NO: 142714 - DNA, 21 bp, Artificial sequence
  SiRNA target sequence
ctcttaattgtttatcaacaa

SEQ ID NO: 142715 - DNA, 21 bp, Artificial sequence
  SiRNA target sequence
tcttaattgtttatcaacaag

SEQ ID NO: 142716 - DNA, 21 bp, Artificial sequence
  SiRNA target sequence
cttaattgtttatcaacaagt

SEQ ID NO: 142717 - DNA, 21 bp, Artificial sequence
  SiRNA target sequence
ttaattgtttatcaacaagtg

SEQ ID NO: 142718 - DNA, 21 bp, Artificial sequence
  SiRNA target sequence
taattgtttatcaacaagtgc

SEQ ID NO: 142719 - DNA, 21 bp, Artificial sequence
  SiRNA target sequence
aattgtttatcaacaagtgca

SEQ ID NO: 142720 - DNA, 21 bp, Artificial sequence
  SiRNA target sequence
attgtttatcaacaagtgcat

SEQ ID NO: 142721 - DNA, 21 bp, Artificial sequence
  SiRNA target sequence
ttgtttatcaacaagtgcatt

SEQ ID NO: 142722 - DNA, 21 bp, Artificial sequence
  SiRNA target sequence
tgtttatcaacaagtgcattt

SEQ ID NO: 142723 - DNA, 21 bp, Artificial sequence
  SiRNA target sequence
gtttatcaacaagtgcatttc

SEQ ID NO: 142724 - DNA, 21 bp, Artificial sequence
  SiRNA target sequence
tttatcaacaagtgcatttcc

SEQ ID NO: 142725 - DNA, 21 bp, Artificial sequence
  SiRNA target sequence
ttatcaacaagtgcatttcct

SEQ ID NO: 142726 - DNA, 21 bp, Artificial sequence
  SiRNA target sequence
tatcaacaagtgcatttcctt

SEQ ID NO: 142727 - DNA, 21 bp, Artificial sequence
  SiRNA target sequence
atcaacaagtgcatttccttt

SEQ ID NO: 142728 - DNA, 21 bp, Artificial sequence
  SiRNA target sequence
tcaacaagtgcatttccttta

SEQ ID NO: 142729 - DNA, 21 bp, Artificial sequence
  SiRNA target sequence
caacaagtgcatttcctttat

SEQ ID NO: 142730 - DNA, 21 bp, Artificial sequence
  SiRNA target sequence
aacaagtgcatttcctttatt

SEQ ID NO: 142731 - DNA, 21 bp, Artificial sequence
  SiRNA target sequence
acaagtgcatttcctttatta

SEQ ID NO: 142732 - DNA, 21 bp, Artificial sequence
  SiRNA target sequence
caagtgcatttcctttattat

SEQ ID NO: 142733 - DNA, 21 bp, Artificial sequence
  SiRNA target sequence
aagtgcatttcctttattatt

SEQ ID NO: 142734 - DNA, 21 bp, Artificial sequence
  SiRNA target sequence
agtgcatttcctttattatta

SEQ ID NO: 142735 - DNA, 21 bp, Artificial sequence
  SiRNA target sequence
gtgcatttcctttattattaa

SEQ ID NO: 142736 - DNA, 21 bp, Artificial sequence
  SiRNA target sequence
tgcatttcctttattattaaa

SEQ ID NO: 142737 - DNA, 21 bp, Artificial sequence
  SiRNA target sequence
gcatttcctttattattaaaa

SEQ ID NO: 142738 - DNA, 21 bp, Artificial sequence
  SiRNA target sequence
catttcctttattattaaaaa

SEQ ID NO: 142739 - DNA, 21 bp, Artificial sequence
  SiRNA target sequence
atttcctttattattaaaaag

SEQ ID NO: 142740 - DNA, 21 bp, Artificial sequence
  SiRNA target sequence
tttcctttattattaaaaagt

SEQ ID NO: 142741 - DNA, 21 bp, Artificial sequence
  SiRNA target sequence
ttcctttattattaaaaagta

SEQ ID NO: 142742 - DNA, 21 bp, Artificial sequence
  SiRNA target sequence
tcctttattattaaaaagtaa

SEQ ID NO: 142743 - DNA, 21 bp, Artificial sequence
  SiRNA target sequence
cctttattattaaaaagtaat

SEQ ID NO: 142744 - DNA, 21 bp, Artificial sequence
  SiRNA target sequence
ctttattattaaaaagtaatg

SEQ ID NO: 142745 - DNA, 21 bp, Artificial sequence
  SiRNA target sequence
tttattattaaaaagtaatga

SEQ ID NO: 142746 - DNA, 21 bp, Artificial sequence
  SiRNA target sequence
ttattattaaaaagtaatgaa

SEQ ID NO: 142747 - DNA, 21 bp, Artificial sequence
  SiRNA target sequence
tattattaaaaagtaatgaat

SEQ ID NO: 142748 - DNA, 21 bp, Artificial sequence
  SiRNA target sequence
attattaaaaagtaatgaatt

SEQ ID NO: 142749 - DNA, 21 bp, Artificial sequence
  SiRNA target sequence
ttattaaaaagtaatgaattt

SEQ ID NO: 142750 - DNA, 21 bp, Artificial sequence
  SiRNA target sequence
tattaaaaagtaatgaattta

SEQ ID NO: 142751 - DNA, 21 bp, Artificial sequence
  SiRNA target sequence
attaaaaagtaatgaatttaa

SEQ ID NO: 142752 - DNA, 21 bp, Artificial sequence
  SiRNA target sequence
ttaaaaagtaatgaatttaat

SEQ ID NO: 142753 - DNA, 21 bp, Artificial sequence
  SiRNA target sequence
taaaaagtaatgaatttaatg

SEQ ID NO: 142754 - DNA, 21 bp, Artificial sequence
  SiRNA target sequence
aaaaagtaatgaatttaatga

SEQ ID NO: 142755 - DNA, 21 bp, Artificial sequence
  SiRNA target sequence
aaaagtaatgaatttaatgat

SEQ ID NO: 142756 - DNA, 21 bp, Artificial sequence
  SiRNA target sequence
aaagtaatgaatttaatgatt

SEQ ID NO: 142757 - DNA, 21 bp, Artificial sequence
  SiRNA target sequence
aagtaatgaatttaatgattt

SEQ ID NO: 142758 - DNA, 21 bp, Artificial sequence
  SiRNA target sequence
agtaatgaatttaatgattta

SEQ ID NO: 142759 - DNA, 21 bp, Artificial sequence
  SiRNA target sequence
gtaatgaatttaatgatttac

SEQ ID NO: 142760 - DNA, 21 bp, Artificial sequence
  SiRNA target sequence
taatgaatttaatgatttacc

SEQ ID NO: 142761 - DNA, 21 bp, Artificial sequence
  SiRNA target sequence
aatgaatttaatgatttacca

SEQ ID NO: 142762 - DNA, 21 bp, Artificial sequence
  SiRNA target sequence
atgaatttaatgatttaccac

SEQ ID NO: 142763 - DNA, 21 bp, Artificial sequence
  SiRNA target sequence
tgaatttaatgatttaccaca

SEQ ID NO: 142764 - DNA, 21 bp, Artificial sequence
  SiRNA target sequence
gaatttaatgatttaccacac

SEQ ID NO: 142765 - DNA, 21 bp, Artificial sequence
  SiRNA target sequence
aatttaatgatttaccacaca

SEQ ID NO: 142766 - DNA, 21 bp, Artificial sequence
  SiRNA target sequence
atttaatgatttaccacacaa

SEQ ID NO: 142767 - DNA, 21 bp, Artificial sequence
  SiRNA target sequence
tttaatgatttaccacacaaa

SEQ ID NO: 142768 - DNA, 21 bp, Artificial sequence
  SiRNA target sequence
ttaatgatttaccacacaaat

SEQ ID NO: 142769 - DNA, 21 bp, Artificial sequence
  SiRNA target sequence
taatgatttaccacacaaatt

SEQ ID NO: 142770 - DNA, 21 bp, Artificial sequence
  SiRNA target sequence
aatgatttaccacacaaattg

SEQ ID NO: 142771 - DNA, 21 bp, Artificial sequence
  SiRNA target sequence
atgatttaccacacaaattgt

SEQ ID NO: 142772 - DNA, 21 bp, Artificial sequence
  SiRNA target sequence
tgatttaccacacaaattgtt

SEQ ID NO: 142773 - DNA, 21 bp, Artificial sequence
  SiRNA target sequence
gatttaccacacaaattgtta

SEQ ID NO: 142774 - DNA, 21 bp, Artificial sequence
  SiRNA target sequence
atttaccacacaaattgttat

SEQ ID NO: 142775 - DNA, 21 bp, Artificial sequence
  SiRNA target sequence
tttaccacacaaattgttatc

SEQ ID NO: 142776 - DNA, 21 bp, Artificial sequence
  SiRNA target sequence
ttaccacacaaattgttatct

SEQ ID NO: 142777 - DNA, 21 bp, Artificial sequence
  SiRNA target sequence
taccacacaaattgttatcta

SEQ ID NO: 142778 - DNA, 21 bp, Artificial sequence
  SiRNA target sequence
accacacaaattgttatctaa

SEQ ID NO: 142779 - DNA, 21 bp, Artificial sequence
  SiRNA target sequence
ccacacaaattgttatctaat

SEQ ID NO: 142780 - DNA, 21 bp, Artificial sequence
  SiRNA target sequence
cacacaaattgttatctaata

SEQ ID NO: 142781 - DNA, 21 bp, Artificial sequence
  SiRNA target sequence
acacaaattgttatctaatat

SEQ ID NO: 142782 - DNA, 21 bp, Artificial sequence
  SiRNA target sequence
cacaaattgttatctaatatt

SEQ ID NO: 142783 - DNA, 21 bp, Artificial sequence
  SiRNA target sequence
acaaattgttatctaatatta

SEQ ID NO: 142784 - DNA, 21 bp, Artificial sequence
  SiRNA target sequence
caaattgttatctaatattat

SEQ ID NO: 142785 - DNA, 21 bp, Artificial sequence
  SiRNA target sequence
aaattgttatctaatattatt

SEQ ID NO: 142786 - DNA, 21 bp, Artificial sequence
  SiRNA target sequence
aattgttatctaatattattt

SEQ ID NO: 142787 - DNA, 21 bp, Artificial sequence
  SiRNA target sequence
attgttatctaatattatttt

SEQ ID NO: 142788 - DNA, 21 bp, Artificial sequence
  SiRNA target sequence
ttgttatctaatattatttta

SEQ ID NO: 142789 - DNA, 21 bp, Artificial sequence
  SiRNA target sequence
tgttatctaatattattttat

SEQ ID NO: 142790 - DNA, 21 bp, Artificial sequence
  SiRNA target sequence
gttatctaatattattttatt

SEQ ID NO: 142791 - DNA, 21 bp, Artificial sequence
  SiRNA target sequence
ttatctaatattattttatta

SEQ ID NO: 142792 - DNA, 21 bp, Artificial sequence
  SiRNA target sequence
tatctaatattattttattaa

SEQ ID NO: 142793 - DNA, 21 bp, Artificial sequence
  SiRNA target sequence
atctaatattattttattaag

SEQ ID NO: 142794 - DNA, 21 bp, Artificial sequence
  SiRNA target sequence
tctaatattattttattaaga

SEQ ID NO: 142795 - DNA, 21 bp, Artificial sequence
  SiRNA target sequence
ctaatattattttattaagag

SEQ ID NO: 142796 - DNA, 21 bp, Artificial sequence
  SiRNA target sequence
taatattattttattaagagt

SEQ ID NO: 142797 - DNA, 21 bp, Artificial sequence
  SiRNA target sequence
aatattattttattaagagtg

SEQ ID NO: 142798 - DNA, 21 bp, Artificial sequence
  SiRNA target sequence
atattattttattaagagtgt

SEQ ID NO: 142799 - DNA, 21 bp, Artificial sequence
  SiRNA target sequence
tattattttattaagagtgtc

SEQ ID NO: 142800 - DNA, 21 bp, Artificial sequence
  SiRNA target sequence
attattttattaagagtgtct

SEQ ID NO: 142801 - DNA, 21 bp, Artificial sequence
  SiRNA target sequence
ttattttattaagagtgtcta

SEQ ID NO: 142802 - DNA, 21 bp, Artificial sequence
  SiRNA target sequence
tattttattaagagtgtctac

SEQ ID NO: 142803 - DNA, 21 bp, Artificial sequence
  SiRNA target sequence
attttattaagagtgtctaca

SEQ ID NO: 142804 - DNA, 21 bp, Artificial sequence
  SiRNA target sequence
ttttattaagagtgtctacat

SEQ ID NO: 142805 - DNA, 21 bp, Artificial sequence
  SiRNA target sequence
tttattaagagtgtctacata

SEQ ID NO: 142806 - DNA, 21 bp, Artificial sequence
  SiRNA target sequence
ttattaagagtgtctacatac

SEQ ID NO: 142807 - DNA, 21 bp, Artificial sequence
  SiRNA target sequence
tattaagagtgtctacatacg

SEQ ID NO: 142808 - DNA, 21 bp, Artificial sequence
  SiRNA target sequence
attaagagtgtctacatacgc

SEQ ID NO: 142809 - DNA, 21 bp, Artificial sequence
  SiRNA target sequence
ttaagagtgtctacatacgct

SEQ ID NO: 142810 - DNA, 21 bp, Artificial sequence
  SiRNA target sequence
taagagtgtctacatacgctt

SEQ ID NO: 142811 - DNA, 21 bp, Artificial sequence
  SiRNA target sequence
aagagtgtctacatacgcttg

SEQ ID NO: 142812 - DNA, 21 bp, Artificial sequence
  SiRNA target sequence
agagtgtctacatacgcttga

SEQ ID NO: 142813 - DNA, 21 bp, Artificial sequence
  SiRNA target sequence
gagtgtctacatacgcttgat

SEQ ID NO: 142814 - DNA, 21 bp, Artificial sequence
  SiRNA target sequence
agtgtctacatacgcttgatg

SEQ ID NO: 142815 - DNA, 21 bp, Artificial sequence
  SiRNA target sequence
gtgtctacatacgcttgatgg

SEQ ID NO: 142816 - DNA, 21 bp, Artificial sequence
  SiRNA target sequence
tgtctacatacgcttgatggt

SEQ ID NO: 142817 - DNA, 21 bp, Artificial sequence
  SiRNA target sequence
gtctacatacgcttgatggtg

SEQ ID NO: 142818 - DNA, 21 bp, Artificial sequence
  SiRNA target sequence
tctacatacgcttgatggtgc

SEQ ID NO: 142819 - DNA, 21 bp, Artificial sequence
  SiRNA target sequence
ctacatacgcttgatggtgct

SEQ ID NO: 142820 - DNA, 21 bp, Artificial sequence
  SiRNA target sequence
tacatacgcttgatggtgctt

SEQ ID NO: 142821 - DNA, 21 bp, Artificial sequence
  SiRNA target sequence
acatacgcttgatggtgctta

SEQ ID NO: 142822 - DNA, 21 bp, Artificial sequence
  SiRNA target sequence
catacgcttgatggtgcttag

SEQ ID NO: 142823 - DNA, 21 bp, Artificial sequence
  SiRNA target sequence
atacgcttgatggtgcttaga

SEQ ID NO: 142824 - DNA, 21 bp, Artificial sequence
  SiRNA target sequence
tacgcttgatggtgcttagag

SEQ ID NO: 142825 - DNA, 21 bp, Artificial sequence
  SiRNA target sequence
acgcttgatggtgcttagagt

SEQ ID NO: 142826 - DNA, 21 bp, Artificial sequence
  SiRNA target sequence
cgcttgatggtgcttagagtg

SEQ ID NO: 142827 - DNA, 21 bp, Artificial sequence
  SiRNA target sequence
gcttgatggtgcttagagtgg

SEQ ID NO: 142828 - DNA, 21 bp, Artificial sequence
  SiRNA target sequence
cttgatggtgcttagagtggt

SEQ ID NO: 142829 - DNA, 21 bp, Artificial sequence
  SiRNA target sequence
ttgatggtgcttagagtggtg

SEQ ID NO: 142830 - DNA, 21 bp, Artificial sequence
  SiRNA target sequence
tgatggtgcttagagtggtgg

SEQ ID NO: 142831 - DNA, 21 bp, Artificial sequence
  SiRNA target sequence
gatggtgcttagagtggtggg

SEQ ID NO: 142832 - DNA, 21 bp, Artificial sequence
  SiRNA target sequence
atggtgcttagagtggtgggt

SEQ ID NO: 142833 - DNA, 21 bp, Artificial sequence
  SiRNA target sequence
tggtgcttagagtggtgggtc

SEQ ID NO: 142834 - DNA, 21 bp, Artificial sequence
  SiRNA target sequence
ggtgcttagagtggtgggtct

SEQ ID NO: 142835 - DNA, 21 bp, Artificial sequence
  SiRNA target sequence
gtgcttagagtggtgggtctc

SEQ ID NO: 142836 - DNA, 21 bp, Artificial sequence
  SiRNA target sequence
tgcttagagtggtgggtctcc

SEQ ID NO: 142837 - DNA, 21 bp, Artificial sequence
  SiRNA target sequence
gcttagagtggtgggtctcca

SEQ ID NO: 142838 - DNA, 21 bp, Artificial sequence
  SiRNA target sequence
cttagagtggtgggtctccat

SEQ ID NO: 142839 - DNA, 21 bp, Artificial sequence
  SiRNA target sequence
ttagagtggtgggtctccatt

SEQ ID NO: 142840 - DNA, 21 bp, Artificial sequence
  SiRNA target sequence
tagagtggtgggtctccatta

SEQ ID NO: 142841 - DNA, 21 bp, Artificial sequence
  SiRNA target sequence
agagtggtgggtctccattat

SEQ ID NO: 142842 - DNA, 21 bp, Artificial sequence
  SiRNA target sequence
gagtggtgggtctccattata

SEQ ID NO: 142843 - DNA, 21 bp, Artificial sequence
  SiRNA target sequence
agtggtgggtctccattatat

SEQ ID NO: 142844 - DNA, 21 bp, Artificial sequence
  SiRNA target sequence
gtggtgggtctccattatatc

SEQ ID NO: 142845 - DNA, 21 bp, Artificial sequence
  SiRNA target sequence
tggtgggtctccattatatct

SEQ ID NO: 142846 - DNA, 21 bp, Artificial sequence
  SiRNA target sequence
ggtgggtctccattatatctt

SEQ ID NO: 142847 - DNA, 21 bp, Artificial sequence
  SiRNA target sequence
gtgggtctccattatatcttc

SEQ ID NO: 142848 - DNA, 21 bp, Artificial sequence
  SiRNA target sequence
tgggtctccattatatcttca

SEQ ID NO: 142849 - DNA, 21 bp, Artificial sequence
  SiRNA target sequence
gggtctccattatatcttcac

SEQ ID NO: 142850 - DNA, 21 bp, Artificial sequence
  SiRNA target sequence
ggtctccattatatcttcact

SEQ ID NO: 142851 - DNA, 21 bp, Artificial sequence
  SiRNA target sequence
gtctccattatatcttcactt

SEQ ID NO: 142852 - DNA, 21 bp, Artificial sequence
  SiRNA target sequence
tctccattatatcttcactta

SEQ ID NO: 142853 - DNA, 21 bp, Artificial sequence
  SiRNA target sequence
ctccattatatcttcacttat

SEQ ID NO: 142854 - DNA, 21 bp, Artificial sequence
  SiRNA target sequence
tccattatatcttcacttata

SEQ ID NO: 142855 - DNA, 21 bp, Artificial sequence
  SiRNA target sequence
ccattatatcttcacttatat

SEQ ID NO: 142856 - DNA, 21 bp, Artificial sequence
  SiRNA target sequence
cattatatcttcacttatata

SEQ ID NO: 142857 - DNA, 21 bp, Artificial sequence
  SiRNA target sequence
attatatcttcacttatataa

SEQ ID NO: 142858 - DNA, 21 bp, Artificial sequence
  SiRNA target sequence
ttatatcttcacttatataag

SEQ ID NO: 142859 - DNA, 21 bp, Artificial sequence
  SiRNA target sequence
tatatcttcacttatataagg

SEQ ID NO: 142860 - DNA, 21 bp, Artificial sequence
  SiRNA target sequence
atatcttcacttatataaggc

SEQ ID NO: 142861 - DNA, 21 bp, Artificial sequence
  SiRNA target sequence
tatcttcacttatataaggct

SEQ ID NO: 142862 - DNA, 21 bp, Artificial sequence
  SiRNA target sequence
atcttcacttatataaggctc

SEQ ID NO: 142863 - DNA, 21 bp, Artificial sequence
  SiRNA target sequence
tcttcacttatataaggctct

SEQ ID NO: 142864 - DNA, 21 bp, Artificial sequence
  SiRNA target sequence
cttcacttatataaggctcta

SEQ ID NO: 142865 - DNA, 21 bp, Artificial sequence
  SiRNA target sequence
ttcacttatataaggctctag

SEQ ID NO: 142866 - DNA, 21 bp, Artificial sequence
  SiRNA target sequence
tcacttatataaggctctaga

SEQ ID NO: 142867 - DNA, 21 bp, Artificial sequence
  SiRNA target sequence
cacttatataaggctctagag

SEQ ID NO: 142868 - DNA, 21 bp, Artificial sequence
  SiRNA target sequence
acttatataaggctctagaga

SEQ ID NO: 142869 - DNA, 21 bp, Artificial sequence
  SiRNA target sequence
cttatataaggctctagagat

SEQ ID NO: 142870 - DNA, 21 bp, Artificial sequence
  SiRNA target sequence
ttatataaggctctagagatt

SEQ ID NO: 142871 - DNA, 21 bp, Artificial sequence
  SiRNA target sequence
tatataaggctctagagattt

SEQ ID NO: 142872 - DNA, 21 bp, Artificial sequence
  SiRNA target sequence
atataaggctctagagattta

SEQ ID NO: 142873 - DNA, 21 bp, Artificial sequence
  SiRNA target sequence
tataaggctctagagatttat

SEQ ID NO: 142874 - DNA, 21 bp, Artificial sequence
  SiRNA target sequence
ataaggctctagagatttata

SEQ ID NO: 142875 - DNA, 21 bp, Artificial sequence
  SiRNA target sequence
taaggctctagagatttataa

SEQ ID NO: 142876 - DNA, 21 bp, Artificial sequence
  SiRNA target sequence
aaggctctagagatttataac

SEQ ID NO: 142877 - DNA, 21 bp, Artificial sequence
  SiRNA target sequence
aggctctagagatttataact

SEQ ID NO: 142878 - DNA, 21 bp, Artificial sequence
  SiRNA target sequence
ggctctagagatttataacta

SEQ ID NO: 142879 - DNA, 21 bp, Artificial sequence
  SiRNA target sequence
gctctagagatttataactat

SEQ ID NO: 142880 - DNA, 21 bp, Artificial sequence
  SiRNA target sequence
ctctagagatttataactata

SEQ ID NO: 142881 - DNA, 21 bp, Artificial sequence
  SiRNA target sequence
tctagagatttataactatat

SEQ ID NO: 142882 - DNA, 21 bp, Artificial sequence
  SiRNA target sequence
ctagagatttataactatatt

SEQ ID NO: 142883 - DNA, 21 bp, Artificial sequence
  SiRNA target sequence
tagagatttataactatattt

SEQ ID NO: 142884 - DNA, 21 bp, Artificial sequence
  SiRNA target sequence
agagatttataactatatttc

SEQ ID NO: 142885 - DNA, 21 bp, Artificial sequence
  SiRNA target sequence
gagatttataactatatttca

SEQ ID NO: 142886 - DNA, 21 bp, Artificial sequence
  SiRNA target sequence
agatttataactatatttcag

SEQ ID NO: 142887 - DNA, 21 bp, Artificial sequence
  SiRNA target sequence
gatttataactatatttcaga

SEQ ID NO: 142888 - DNA, 21 bp, Artificial sequence
  SiRNA target sequence
atttataactatatttcagat

SEQ ID NO: 142889 - DNA, 21 bp, Artificial sequence
  SiRNA target sequence
tttataactatatttcagatt

SEQ ID NO: 142890 - DNA, 21 bp, Artificial sequence
  SiRNA target sequence
ttataactatatttcagattt

SEQ ID NO: 142891 - DNA, 21 bp, Artificial sequence
  SiRNA target sequence
tataactatatttcagatttg

SEQ ID NO: 142892 - DNA, 21 bp, Artificial sequence
  SiRNA target sequence
ataactatatttcagatttgg

SEQ ID NO: 142893 - DNA, 21 bp, Artificial sequence
  SiRNA target sequence
taactatatttcagatttgga

SEQ ID NO: 142894 - DNA, 21 bp, Artificial sequence
  SiRNA target sequence
aactatatttcagatttggaa

SEQ ID NO: 142895 - DNA, 21 bp, Artificial sequence
  SiRNA target sequence
actatatttcagatttggaag

SEQ ID NO: 142896 - DNA, 21 bp, Artificial sequence
  SiRNA target sequence
ctatatttcagatttggaaga

SEQ ID NO: 142897 - DNA, 21 bp, Artificial sequence
  SiRNA target sequence
tatatttcagatttggaagag

SEQ ID NO: 142898 - DNA, 21 bp, Artificial sequence
  SiRNA target sequence
atatttcagatttggaagagt

SEQ ID NO: 142899 - DNA, 21 bp, Artificial sequence
  SiRNA target sequence
tatttcagatttggaagagtg

SEQ ID NO: 142900 - DNA, 21 bp, Artificial sequence
  SiRNA target sequence
atttcagatttggaagagtga

SEQ ID NO: 142901 - DNA, 21 bp, Artificial sequence
  SiRNA target sequence
tttcagatttggaagagtgaa

SEQ ID NO: 142902 - DNA, 21 bp, Artificial sequence
  SiRNA target sequence
ttcagatttggaagagtgaac

SEQ ID NO: 142903 - DNA, 21 bp, Artificial sequence
  SiRNA target sequence
tcagatttggaagagtgaaca

SEQ ID NO: 142904 - DNA, 21 bp, Artificial sequence
  SiRNA target sequence
cagatttggaagagtgaacat

SEQ ID NO: 142905 - DNA, 22 bp, Artificial sequence
  SiRNA target sequence
ttaatttatgcataattgacca

SEQ ID NO: 142906 - DNA, 22 bp, Artificial sequence
  SiRNA target sequence
taatttatgcataattgaccat

SEQ ID NO: 142907 - DNA, 22 bp, Artificial sequence
  SiRNA target sequence
aatttatgcataattgaccatc

SEQ ID NO: 142908 - DNA, 22 bp, Artificial sequence
  SiRNA target sequence
atttatgcataattgaccatca

SEQ ID NO: 142909 - DNA, 22 bp, Artificial sequence
  SiRNA target sequence
tttatgcataattgaccatcat

SEQ ID NO: 142910 - DNA, 22 bp, Artificial sequence
  SiRNA target sequence
ttatgcataattgaccatcatc

SEQ ID NO: 142911 - DNA, 22 bp, Artificial sequence
  SiRNA target sequence
tatgcataattgaccatcatca

SEQ ID NO: 142912 - DNA, 22 bp, Artificial sequence
  SiRNA target sequence
atgcataattgaccatcatcag

SEQ ID NO: 142913 - DNA, 22 bp, Artificial sequence
  SiRNA target sequence
tgcataattgaccatcatcagt

SEQ ID NO: 142914 - DNA, 22 bp, Artificial sequence
  SiRNA target sequence
gcataattgaccatcatcagta

SEQ ID NO: 142915 - DNA, 22 bp, Artificial sequence
  SiRNA target sequence
cataattgaccatcatcagtaa

SEQ ID NO: 142916 - DNA, 22 bp, Artificial sequence
  SiRNA target sequence
ataattgaccatcatcagtaat

SEQ ID NO: 142917 - DNA, 22 bp, Artificial sequence
  SiRNA target sequence
taattgaccatcatcagtaata

SEQ ID NO: 142918 - DNA, 22 bp, Artificial sequence
  SiRNA target sequence
aattgaccatcatcagtaataa

SEQ ID NO: 142919 - DNA, 22 bp, Artificial sequence
  SiRNA target sequence
attgaccatcatcagtaataaa

SEQ ID NO: 142920 - DNA, 22 bp, Artificial sequence
  SiRNA target sequence
ttgaccatcatcagtaataaac

SEQ ID NO: 142921 - DNA, 22 bp, Artificial sequence
  SiRNA target sequence
tgaccatcatcagtaataaaca

SEQ ID NO: 142922 - DNA, 22 bp, Artificial sequence
  SiRNA target sequence
gaccatcatcagtaataaacac

SEQ ID NO: 142923 - DNA, 22 bp, Artificial sequence
  SiRNA target sequence
accatcatcagtaataaacaca

SEQ ID NO: 142924 - DNA, 22 bp, Artificial sequence
  SiRNA target sequence
ccatcatcagtaataaacacat

SEQ ID NO: 142925 - DNA, 22 bp, Artificial sequence
  SiRNA target sequence
catcatcagtaataaacacatt

SEQ ID NO: 142926 - DNA, 22 bp, Artificial sequence
  SiRNA target sequence
atcatcagtaataaacacatta

SEQ ID NO: 142927 - DNA, 22 bp, Artificial sequence
  SiRNA target sequence
tcatcagtaataaacacattac

SEQ ID NO: 142928 - DNA, 22 bp, Artificial sequence
  SiRNA target sequence
catcagtaataaacacattacc

SEQ ID NO: 142929 - DNA, 22 bp, Artificial sequence
  SiRNA target sequence
atcagtaataaacacattacct

SEQ ID NO: 142930 - DNA, 22 bp, Artificial sequence
  SiRNA target sequence
tcagtaataaacacattacctt

SEQ ID NO: 142931 - DNA, 22 bp, Artificial sequence
  SiRNA target sequence
cagtaataaacacattaccttt

SEQ ID NO: 142932 - DNA, 22 bp, Artificial sequence
  SiRNA target sequence
agtaataaacacattacctttc

SEQ ID NO: 142933 - DNA, 22 bp, Artificial sequence
  SiRNA target sequence
gtaataaacacattacctttct

SEQ ID NO: 142934 - DNA, 22 bp, Artificial sequence
  SiRNA target sequence
taataaacacattacctttctt

SEQ ID NO: 142935 - DNA, 22 bp, Artificial sequence
  SiRNA target sequence
aataaacacattacctttcttt

SEQ ID NO: 142936 - DNA, 22 bp, Artificial sequence
  SiRNA target sequence
ataaacacattacctttctttt

SEQ ID NO: 142937 - DNA, 22 bp, Artificial sequence
  SiRNA target sequence
taaacacattacctttcttttc

SEQ ID NO: 142938 - DNA, 22 bp, Artificial sequence
  SiRNA target sequence
aaacacattacctttcttttct

SEQ ID NO: 142939 - DNA, 22 bp, Artificial sequence
  SiRNA target sequence
aacacattacctttcttttcta

SEQ ID NO: 142940 - DNA, 22 bp, Artificial sequence
  SiRNA target sequence
acacattacctttcttttctac

SEQ ID NO: 142941 - DNA, 22 bp, Artificial sequence
  SiRNA target sequence
cacattacctttcttttctacc

SEQ ID NO: 142942 - DNA, 22 bp, Artificial sequence
  SiRNA target sequence
acattacctttcttttctacca

SEQ ID NO: 142943 - DNA, 22 bp, Artificial sequence
  SiRNA target sequence
cattacctttcttttctaccac

SEQ ID NO: 142944 - DNA, 22 bp, Artificial sequence
  SiRNA target sequence
attacctttcttttctaccaca

SEQ ID NO: 142945 - DNA, 22 bp, Artificial sequence
  SiRNA target sequence
ttacctttcttttctaccacac

SEQ ID NO: 142946 - DNA, 22 bp, Artificial sequence
  SiRNA target sequence
tacctttcttttctaccacaca

SEQ ID NO: 142947 - DNA, 22 bp, Artificial sequence
  SiRNA target sequence
acctttcttttctaccacacat

SEQ ID NO: 142948 - DNA, 22 bp, Artificial sequence
  SiRNA target sequence
cctttcttttctaccacacatt

SEQ ID NO: 142949 - DNA, 22 bp, Artificial sequence
  SiRNA target sequence
ctttcttttctaccacacattt

SEQ ID NO: 142950 - DNA, 22 bp, Artificial sequence
  SiRNA target sequence
tttcttttctaccacacatttt

SEQ ID NO: 142951 - DNA, 22 bp, Artificial sequence
  SiRNA target sequence
ttcttttctaccacacattttt

SEQ ID NO: 142952 - DNA, 22 bp, Artificial sequence
  SiRNA target sequence
tcttttctaccacacatttttg

SEQ ID NO: 142953 - DNA, 22 bp, Artificial sequence
  SiRNA target sequence
cttttctaccacacatttttga

SEQ ID NO: 142954 - DNA, 22 bp, Artificial sequence
  SiRNA target sequence
ttttctaccacacatttttgat

SEQ ID NO: 142955 - DNA, 22 bp, Artificial sequence
  SiRNA target sequence
tttctaccacacatttttgata

SEQ ID NO: 142956 - DNA, 22 bp, Artificial sequence
  SiRNA target sequence
ttctaccacacatttttgatat

SEQ ID NO: 142957 - DNA, 22 bp, Artificial sequence
  SiRNA target sequence
tctaccacacatttttgatata

SEQ ID NO: 142958 - DNA, 22 bp, Artificial sequence
  SiRNA target sequence
ctaccacacatttttgatatat

SEQ ID NO: 142959 - DNA, 22 bp, Artificial sequence
  SiRNA target sequence
taccacacatttttgatatatt

SEQ ID NO: 142960 - DNA, 22 bp, Artificial sequence
  SiRNA target sequence
accacacatttttgatatattt

SEQ ID NO: 142961 - DNA, 22 bp, Artificial sequence
  SiRNA target sequence
ccacacatttttgatatatttc

SEQ ID NO: 142962 - DNA, 22 bp, Artificial sequence
  SiRNA target sequence
cacacatttttgatatatttca

SEQ ID NO: 142963 - DNA, 22 bp, Artificial sequence
  SiRNA target sequence
acacatttttgatatatttcat

SEQ ID NO: 142964 - DNA, 22 bp, Artificial sequence
  SiRNA target sequence
cacatttttgatatatttcatt

SEQ ID NO: 142965 - DNA, 22 bp, Artificial sequence
  SiRNA target sequence
acatttttgatatatttcatta

SEQ ID NO: 142966 - DNA, 22 bp, Artificial sequence
  SiRNA target sequence
catttttgatatatttcattaa

SEQ ID NO: 142967 - DNA, 22 bp, Artificial sequence
  SiRNA target sequence
atttttgatatatttcattaac

SEQ ID NO: 142968 - DNA, 22 bp, Artificial sequence
  SiRNA target sequence
tttttgatatatttcattaact

SEQ ID NO: 142969 - DNA, 22 bp, Artificial sequence
  SiRNA target sequence
ttttgatatatttcattaacta

SEQ ID NO: 142970 - DNA, 22 bp, Artificial sequence
  SiRNA target sequence
tttgatatatttcattaactac

SEQ ID NO: 142971 - DNA, 22 bp, Artificial sequence
  SiRNA target sequence
ttgatatatttcattaactaca

SEQ ID NO: 142972 - DNA, 22 bp, Artificial sequence
  SiRNA target sequence
tgatatatttcattaactacat

SEQ ID NO: 142973 - DNA, 22 bp, Artificial sequence
  SiRNA target sequence
gatatatttcattaactacatc

SEQ ID NO: 142974 - DNA, 22 bp, Artificial sequence
  SiRNA target sequence
atatatttcattaactacatcc

SEQ ID NO: 142975 - DNA, 22 bp, Artificial sequence
  SiRNA target sequence
tatatttcattaactacatccc

SEQ ID NO: 142976 - DNA, 22 bp, Artificial sequence
  SiRNA target sequence
atatttcattaactacatccca

SEQ ID NO: 142977 - DNA, 22 bp, Artificial sequence
  SiRNA target sequence
tatttcattaactacatcccaa

SEQ ID NO: 142978 - DNA, 22 bp, Artificial sequence
  SiRNA target sequence
atttcattaactacatcccaat

SEQ ID NO: 142979 - DNA, 22 bp, Artificial sequence
  SiRNA target sequence
tttcattaactacatcccaatc

SEQ ID NO: 142980 - DNA, 22 bp, Artificial sequence
  SiRNA target sequence
ttcattaactacatcccaatca

SEQ ID NO: 142981 - DNA, 22 bp, Artificial sequence
  SiRNA target sequence
tcattaactacatcccaatcaa

SEQ ID NO: 142982 - DNA, 22 bp, Artificial sequence
  SiRNA target sequence
cattaactacatcccaatcaat

SEQ ID NO: 142983 - DNA, 22 bp, Artificial sequence
  SiRNA target sequence
attaactacatcccaatcaatt

SEQ ID NO: 142984 - DNA, 22 bp, Artificial sequence
  SiRNA target sequence
ttaactacatcccaatcaatta

SEQ ID NO: 142985 - DNA, 22 bp, Artificial sequence
  SiRNA target sequence
taactacatcccaatcaattac

SEQ ID NO: 142986 - DNA, 22 bp, Artificial sequence
  SiRNA target sequence
aactacatcccaatcaattaca

SEQ ID NO: 142987 - DNA, 22 bp, Artificial sequence
  SiRNA target sequence
actacatcccaatcaattacat

SEQ ID NO: 142988 - DNA, 22 bp, Artificial sequence
  SiRNA target sequence
ctacatcccaatcaattacatt

SEQ ID NO: 142989 - DNA, 22 bp, Artificial sequence
  SiRNA target sequence
tacatcccaatcaattacattc

SEQ ID NO: 142990 - DNA, 22 bp, Artificial sequence
  SiRNA target sequence
acatcccaatcaattacattcc

SEQ ID NO: 142991 - DNA, 22 bp, Artificial sequence
  SiRNA target sequence
catcccaatcaattacattcca

SEQ ID NO: 142992 - DNA, 22 bp, Artificial sequence
  SiRNA target sequence
atcccaatcaattacattccac

SEQ ID NO: 142993 - DNA, 22 bp, Artificial sequence
  SiRNA target sequence
tcccaatcaattacattccacc

SEQ ID NO: 142994 - DNA, 22 bp, Artificial sequence
  SiRNA target sequence
cccaatcaattacattccacca

SEQ ID NO: 142995 - DNA, 22 bp, Artificial sequence
  SiRNA target sequence
ccaatcaattacattccaccat

SEQ ID NO: 142996 - DNA, 22 bp, Artificial sequence
  SiRNA target sequence
caatcaattacattccaccatt

SEQ ID NO: 142997 - DNA, 22 bp, Artificial sequence
  SiRNA target sequence
aatcaattacattccaccattc

SEQ ID NO: 142998 - DNA, 22 bp, Artificial sequence
  SiRNA target sequence
atcaattacattccaccattca

SEQ ID NO: 142999 - DNA, 22 bp, Artificial sequence
  SiRNA target sequence
tcaattacattccaccattcat

SEQ ID NO: 143000 - DNA, 22 bp, Artificial sequence
  SiRNA target sequence
caattacattccaccattcatt

SEQ ID NO: 143001 - DNA, 22 bp, Artificial sequence
  SiRNA target sequence
aattacattccaccattcatta

SEQ ID NO: 143002 - DNA, 22 bp, Artificial sequence
  SiRNA target sequence
attacattccaccattcattaa

SEQ ID NO: 143003 - DNA, 22 bp, Artificial sequence
  SiRNA target sequence
ttacattccaccattcattaat

SEQ ID NO: 143004 - DNA, 22 bp, Artificial sequence
  SiRNA target sequence
tacattccaccattcattaatg

SEQ ID NO: 143005 - DNA, 22 bp, Artificial sequence
  SiRNA target sequence
acattccaccattcattaatgt

SEQ ID NO: 143006 - DNA, 22 bp, Artificial sequence
  SiRNA target sequence
cattccaccattcattaatgta

SEQ ID NO: 143007 - DNA, 22 bp, Artificial sequence
  SiRNA target sequence
attccaccattcattaatgtat

SEQ ID NO: 143008 - DNA, 22 bp, Artificial sequence
  SiRNA target sequence
ttccaccattcattaatgtatt

SEQ ID NO: 143009 - DNA, 22 bp, Artificial sequence
  SiRNA target sequence
tccaccattcattaatgtattc

SEQ ID NO: 143010 - DNA, 22 bp, Artificial sequence
  SiRNA target sequence
ccaccattcattaatgtattct

SEQ ID NO: 143011 - DNA, 22 bp, Artificial sequence
  SiRNA target sequence
caccattcattaatgtattctt

SEQ ID NO: 143012 - DNA, 22 bp, Artificial sequence
  SiRNA target sequence
accattcattaatgtattcttt

SEQ ID NO: 143013 - DNA, 22 bp, Artificial sequence
  SiRNA target sequence
ccattcattaatgtattctttt

SEQ ID NO: 143014 - DNA, 22 bp, Artificial sequence
  SiRNA target sequence
cattcattaatgtattcttttc

SEQ ID NO: 143015 - DNA, 22 bp, Artificial sequence
  SiRNA target sequence
attcattaatgtattcttttct

SEQ ID NO: 143016 - DNA, 22 bp, Artificial sequence
  SiRNA target sequence
ttcattaatgtattcttttctc

SEQ ID NO: 143017 - DNA, 22 bp, Artificial sequence
  SiRNA target sequence
tcattaatgtattcttttctcc

SEQ ID NO: 143018 - DNA, 22 bp, Artificial sequence
  SiRNA target sequence
cattaatgtattcttttctcct

SEQ ID NO: 143019 - DNA, 22 bp, Artificial sequence
  SiRNA target sequence
attaatgtattcttttctccta

SEQ ID NO: 143020 - DNA, 22 bp, Artificial sequence
  SiRNA target sequence
ttaatgtattcttttctcctat

SEQ ID NO: 143021 - DNA, 22 bp, Artificial sequence
  SiRNA target sequence
taatgtattcttttctcctatt

SEQ ID NO: 143022 - DNA, 22 bp, Artificial sequence
  SiRNA target sequence
aatgtattcttttctcctattt

SEQ ID NO: 143023 - DNA, 22 bp, Artificial sequence
  SiRNA target sequence
atgtattcttttctcctatttt

SEQ ID NO: 143024 - DNA, 22 bp, Artificial sequence
  SiRNA target sequence
tgtattcttttctcctattttt

SEQ ID NO: 143025 - DNA, 22 bp, Artificial sequence
  SiRNA target sequence
gtattcttttctcctattttta

SEQ ID NO: 143026 - DNA, 22 bp, Artificial sequence
  SiRNA target sequence
tattcttttctcctatttttat

SEQ ID NO: 143027 - DNA, 22 bp, Artificial sequence
  SiRNA target sequence
attcttttctcctatttttata

SEQ ID NO: 143028 - DNA, 22 bp, Artificial sequence
  SiRNA target sequence
ttcttttctcctatttttatac

SEQ ID NO: 143029 - DNA, 22 bp, Artificial sequence
  SiRNA target sequence
tcttttctcctatttttatact

SEQ ID NO: 143030 - DNA, 22 bp, Artificial sequence
  SiRNA target sequence
cttttctcctatttttatactg

SEQ ID NO: 143031 - DNA, 22 bp, Artificial sequence
  SiRNA target sequence
ttttctcctatttttatactgt

SEQ ID NO: 143032 - DNA, 22 bp, Artificial sequence
  SiRNA target sequence
tttctcctatttttatactgta

SEQ ID NO: 143033 - DNA, 22 bp, Artificial sequence
  SiRNA target sequence
ttctcctatttttatactgtaa

SEQ ID NO: 143034 - DNA, 22 bp, Artificial sequence
  SiRNA target sequence
tctcctatttttatactgtaaa

SEQ ID NO: 143035 - DNA, 22 bp, Artificial sequence
  SiRNA target sequence
ctcctatttttatactgtaaat

SEQ ID NO: 143036 - DNA, 22 bp, Artificial sequence
  SiRNA target sequence
tcctatttttatactgtaaata

SEQ ID NO: 143037 - DNA, 22 bp, Artificial sequence
  SiRNA target sequence
cctatttttatactgtaaataa

SEQ ID NO: 143038 - DNA, 22 bp, Artificial sequence
  SiRNA target sequence
ctatttttatactgtaaataat

SEQ ID NO: 143039 - DNA, 22 bp, Artificial sequence
  SiRNA target sequence
tatttttatactgtaaataata

SEQ ID NO: 143040 - DNA, 22 bp, Artificial sequence
  SiRNA target sequence
atttttatactgtaaataatac

SEQ ID NO: 143041 - DNA, 22 bp, Artificial sequence
  SiRNA target sequence
tttttatactgtaaataatacg

SEQ ID NO: 143042 - DNA, 22 bp, Artificial sequence
  SiRNA target sequence
ttttatactgtaaataatacgc

SEQ ID NO: 143043 - DNA, 22 bp, Artificial sequence
  SiRNA target sequence
tttatactgtaaataatacgca

SEQ ID NO: 143044 - DNA, 22 bp, Artificial sequence
  SiRNA target sequence
ttatactgtaaataatacgcat

SEQ ID NO: 143045 - DNA, 22 bp, Artificial sequence
  SiRNA target sequence
tatactgtaaataatacgcatg

SEQ ID NO: 143046 - DNA, 22 bp, Artificial sequence
  SiRNA target sequence
atactgtaaataatacgcatgt

SEQ ID NO: 143047 - DNA, 22 bp, Artificial sequence
  SiRNA target sequence
tactgtaaataatacgcatgtt

SEQ ID NO: 143048 - DNA, 22 bp, Artificial sequence
  SiRNA target sequence
actgtaaataatacgcatgttc

SEQ ID NO: 143049 - DNA, 22 bp, Artificial sequence
  SiRNA target sequence
ctgtaaataatacgcatgttcc

SEQ ID NO: 143050 - DNA, 22 bp, Artificial sequence
  SiRNA target sequence
tgtaaataatacgcatgttccc

SEQ ID NO: 143051 - DNA, 22 bp, Artificial sequence
  SiRNA target sequence
gtaaataatacgcatgttccca

SEQ ID NO: 143052 - DNA, 22 bp, Artificial sequence
  SiRNA target sequence
taaataatacgcatgttcccat

SEQ ID NO: 143053 - DNA, 22 bp, Artificial sequence
  SiRNA target sequence
aaataatacgcatgttcccata

SEQ ID NO: 143054 - DNA, 22 bp, Artificial sequence
  SiRNA target sequence
aataatacgcatgttcccatac

SEQ ID NO: 143055 - DNA, 22 bp, Artificial sequence
  SiRNA target sequence
ataatacgcatgttcccataca

SEQ ID NO: 143056 - DNA, 22 bp, Artificial sequence
  SiRNA target sequence
taatacgcatgttcccatacat

SEQ ID NO: 143057 - DNA, 22 bp, Artificial sequence
  SiRNA target sequence
aatacgcatgttcccatacatc

SEQ ID NO: 143058 - DNA, 22 bp, Artificial sequence
  SiRNA target sequence
atacgcatgttcccatacatca

SEQ ID NO: 143059 - DNA, 22 bp, Artificial sequence
  SiRNA target sequence
tacgcatgttcccatacatcaa

SEQ ID NO: 143060 - DNA, 22 bp, Artificial sequence
  SiRNA target sequence
acgcatgttcccatacatcaag

SEQ ID NO: 143061 - DNA, 22 bp, Artificial sequence
  SiRNA target sequence
cgcatgttcccatacatcaaga

SEQ ID NO: 143062 - DNA, 22 bp, Artificial sequence
  SiRNA target sequence
gcatgttcccatacatcaagac

SEQ ID NO: 143063 - DNA, 22 bp, Artificial sequence
  SiRNA target sequence
catgttcccatacatcaagaca

SEQ ID NO: 143064 - DNA, 22 bp, Artificial sequence
  SiRNA target sequence
atgttcccatacatcaagacat

SEQ ID NO: 143065 - DNA, 22 bp, Artificial sequence
  SiRNA target sequence
tgttcccatacatcaagacata

SEQ ID NO: 143066 - DNA, 22 bp, Artificial sequence
  SiRNA target sequence
gttcccatacatcaagacatag

SEQ ID NO: 143067 - DNA, 22 bp, Artificial sequence
  SiRNA target sequence
ttcccatacatcaagacatagt

SEQ ID NO: 143068 - DNA, 22 bp, Artificial sequence
  SiRNA target sequence
tcccatacatcaagacatagta

SEQ ID NO: 143069 - DNA, 22 bp, Artificial sequence
  SiRNA target sequence
cccatacatcaagacatagtaa

SEQ ID NO: 143070 - DNA, 22 bp, Artificial sequence
  SiRNA target sequence
ccatacatcaagacatagtaaa

SEQ ID NO: 143071 - DNA, 22 bp, Artificial sequence
  SiRNA target sequence
catacatcaagacatagtaaag

SEQ ID NO: 143072 - DNA, 22 bp, Artificial sequence
  SiRNA target sequence
atacatcaagacatagtaaagg

SEQ ID NO: 143073 - DNA, 22 bp, Artificial sequence
  SiRNA target sequence
tacatcaagacatagtaaagga

SEQ ID NO: 143074 - DNA, 22 bp, Artificial sequence
  SiRNA target sequence
acatcaagacatagtaaaggaa

SEQ ID NO: 143075 - DNA, 22 bp, Artificial sequence
  SiRNA target sequence
catcaagacatagtaaaggaat

SEQ ID NO: 143076 - DNA, 22 bp, Artificial sequence
  SiRNA target sequence
atcaagacatagtaaaggaata

SEQ ID NO: 143077 - DNA, 22 bp, Artificial sequence
  SiRNA target sequence
tcaagacatagtaaaggaatac

SEQ ID NO: 143078 - DNA, 22 bp, Artificial sequence
  SiRNA target sequence
caagacatagtaaaggaataca

SEQ ID NO: 143079 - DNA, 22 bp, Artificial sequence
  SiRNA target sequence
aagacatagtaaaggaatacat

SEQ ID NO: 143080 - DNA, 22 bp, Artificial sequence
  SiRNA target sequence
agacatagtaaaggaatacatt

SEQ ID NO: 143081 - DNA, 22 bp, Artificial sequence
  SiRNA target sequence
gacatagtaaaggaatacattc

SEQ ID NO: 143082 - DNA, 22 bp, Artificial sequence
  SiRNA target sequence
acatagtaaaggaatacattca

SEQ ID NO: 143083 - DNA, 22 bp, Artificial sequence
  SiRNA target sequence
catagtaaaggaatacattcac

SEQ ID NO: 143084 - DNA, 22 bp, Artificial sequence
  SiRNA target sequence
atagtaaaggaatacattcacc

SEQ ID NO: 143085 - DNA, 22 bp, Artificial sequence
  SiRNA target sequence
tagtaaaggaatacattcacca

SEQ ID NO: 143086 - DNA, 22 bp, Artificial sequence
  SiRNA target sequence
agtaaaggaatacattcaccat

SEQ ID NO: 143087 - DNA, 22 bp, Artificial sequence
  SiRNA target sequence
gtaaaggaatacattcaccatc

SEQ ID NO: 143088 - DNA, 22 bp, Artificial sequence
  SiRNA target sequence
taaaggaatacattcaccatcc

SEQ ID NO: 143089 - DNA, 22 bp, Artificial sequence
  SiRNA target sequence
aaaggaatacattcaccatcct

SEQ ID NO: 143090 - DNA, 22 bp, Artificial sequence
  SiRNA target sequence
aaggaatacattcaccatcctc

SEQ ID NO: 143091 - DNA, 22 bp, Artificial sequence
  SiRNA target sequence
aggaatacattcaccatcctcc

SEQ ID NO: 143092 - DNA, 22 bp, Artificial sequence
  SiRNA target sequence
ggaatacattcaccatcctcca

SEQ ID NO: 143093 - DNA, 22 bp, Artificial sequence
  SiRNA target sequence
gaatacattcaccatcctccat

SEQ ID NO: 143094 - DNA, 22 bp, Artificial sequence
  SiRNA target sequence
aatacattcaccatcctccatc

SEQ ID NO: 143095 - DNA, 22 bp, Artificial sequence
  SiRNA target sequence
atacattcaccatcctccatca

SEQ ID NO: 143096 - DNA, 22 bp, Artificial sequence
  SiRNA target sequence
tacattcaccatcctccatcat

SEQ ID NO: 143097 - DNA, 22 bp, Artificial sequence
  SiRNA target sequence
acattcaccatcctccatcata

SEQ ID NO: 143098 - DNA, 22 bp, Artificial sequence
  SiRNA target sequence
cattcaccatcctccatcatag

SEQ ID NO: 143099 - DNA, 22 bp, Artificial sequence
  SiRNA target sequence
attcaccatcctccatcatagg

SEQ ID NO: 143100 - DNA, 22 bp, Artificial sequence
  SiRNA target sequence
ttcaccatcctccatcatagga

SEQ ID NO: 143101 - DNA, 22 bp, Artificial sequence
  SiRNA target sequence
tcaccatcctccatcataggat

SEQ ID NO: 143102 - DNA, 22 bp, Artificial sequence
  SiRNA target sequence
caccatcctccatcataggatt

SEQ ID NO: 143103 - DNA, 22 bp, Artificial sequence
  SiRNA target sequence
accatcctccatcataggattg

SEQ ID NO: 143104 - DNA, 22 bp, Artificial sequence
  SiRNA target sequence
ccatcctccatcataggattgt

SEQ ID NO: 143105 - DNA, 22 bp, Artificial sequence
  SiRNA target sequence
catcctccatcataggattgtc

SEQ ID NO: 143106 - DNA, 22 bp, Artificial sequence
  SiRNA target sequence
atcctccatcataggattgtct

SEQ ID NO: 143107 - DNA, 22 bp, Artificial sequence
  SiRNA target sequence
tcctccatcataggattgtctt

SEQ ID NO: 143108 - DNA, 22 bp, Artificial sequence
  SiRNA target sequence
cctccatcataggattgtcttg

SEQ ID NO: 143109 - DNA, 22 bp, Artificial sequence
  SiRNA target sequence
ctccatcataggattgtcttga

SEQ ID NO: 143110 - DNA, 22 bp, Artificial sequence
  SiRNA target sequence
tccatcataggattgtcttgat

SEQ ID NO: 143111 - DNA, 22 bp, Artificial sequence
  SiRNA target sequence
ccatcataggattgtcttgatt

SEQ ID NO: 143112 - DNA, 22 bp, Artificial sequence
  SiRNA target sequence
catcataggattgtcttgatta

SEQ ID NO: 143113 - DNA, 22 bp, Artificial sequence
  SiRNA target sequence
atcataggattgtcttgattaa

SEQ ID NO: 143114 - DNA, 22 bp, Artificial sequence
  SiRNA target sequence
tcataggattgtcttgattaac

SEQ ID NO: 143115 - DNA, 22 bp, Artificial sequence
  SiRNA target sequence
cataggattgtcttgattaaca

SEQ ID NO: 143116 - DNA, 22 bp, Artificial sequence
  SiRNA target sequence
ataggattgtcttgattaacac

SEQ ID NO: 143117 - DNA, 22 bp, Artificial sequence
  SiRNA target sequence
taggattgtcttgattaacact

SEQ ID NO: 143118 - DNA, 22 bp, Artificial sequence
  SiRNA target sequence
aggattgtcttgattaacactg

SEQ ID NO: 143119 - DNA, 22 bp, Artificial sequence
  SiRNA target sequence
ggattgtcttgattaacactgg

SEQ ID NO: 143120 - DNA, 22 bp, Artificial sequence
  SiRNA target sequence
gattgtcttgattaacactggt

SEQ ID NO: 143121 - DNA, 22 bp, Artificial sequence
  SiRNA target sequence
attgtcttgattaacactggtc

SEQ ID NO: 143122 - DNA, 22 bp, Artificial sequence
  SiRNA target sequence
ttgtcttgattaacactggtct

SEQ ID NO: 143123 - DNA, 22 bp, Artificial sequence
  SiRNA target sequence
tgtcttgattaacactggtctt

SEQ ID NO: 143124 - DNA, 22 bp, Artificial sequence
  SiRNA target sequence
gtcttgattaacactggtctta

SEQ ID NO: 143125 - DNA, 22 bp, Artificial sequence
  SiRNA target sequence
tcttgattaacactggtcttaa

SEQ ID NO: 143126 - DNA, 22 bp, Artificial sequence
  SiRNA target sequence
cttgattaacactggtcttaat

SEQ ID NO: 143127 - DNA, 22 bp, Artificial sequence
  SiRNA target sequence
ttgattaacactggtcttaata

SEQ ID NO: 143128 - DNA, 22 bp, Artificial sequence
  SiRNA target sequence
tgattaacactggtcttaatac

SEQ ID NO: 143129 - DNA, 22 bp, Artificial sequence
  SiRNA target sequence
gattaacactggtcttaataca

SEQ ID NO: 143130 - DNA, 22 bp, Artificial sequence
  SiRNA target sequence
attaacactggtcttaatacac

SEQ ID NO: 143131 - DNA, 22 bp, Artificial sequence
  SiRNA target sequence
ttaacactggtcttaatacaca

SEQ ID NO: 143132 - DNA, 22 bp, Artificial sequence
  SiRNA target sequence
taacactggtcttaatacacaa

SEQ ID NO: 143133 - DNA, 22 bp, Artificial sequence
  SiRNA target sequence
aacactggtcttaatacacaat

SEQ ID NO: 143134 - DNA, 22 bp, Artificial sequence
  SiRNA target sequence
acactggtcttaatacacaatt

SEQ ID NO: 143135 - DNA, 22 bp, Artificial sequence
  SiRNA target sequence
cactggtcttaatacacaattt

SEQ ID NO: 143136 - DNA, 22 bp, Artificial sequence
  SiRNA target sequence
actggtcttaatacacaattta

SEQ ID NO: 143137 - DNA, 22 bp, Artificial sequence
  SiRNA target sequence
ctggtcttaatacacaatttat

SEQ ID NO: 143138 - DNA, 22 bp, Artificial sequence
  SiRNA target sequence
tggtcttaatacacaatttatc

SEQ ID NO: 143139 - DNA, 22 bp, Artificial sequence
  SiRNA target sequence
ggtcttaatacacaatttatct

SEQ ID NO: 143140 - DNA, 22 bp, Artificial sequence
  SiRNA target sequence
gtcttaatacacaatttatctt

SEQ ID NO: 143141 - DNA, 22 bp, Artificial sequence
  SiRNA target sequence
tcttaatacacaatttatcttt

SEQ ID NO: 143142 - DNA, 22 bp, Artificial sequence
  SiRNA target sequence
cttaatacacaatttatcttta

SEQ ID NO: 143143 - DNA, 22 bp, Artificial sequence
  SiRNA target sequence
ttaatacacaatttatctttat

SEQ ID NO: 143144 - DNA, 22 bp, Artificial sequence
  SiRNA target sequence
taatacacaatttatctttata

SEQ ID NO: 143145 - DNA, 22 bp, Artificial sequence
  SiRNA target sequence
aatacacaatttatctttatat

SEQ ID NO: 143146 - DNA, 22 bp, Artificial sequence
  SiRNA target sequence
atacacaatttatctttatata

SEQ ID NO: 143147 - DNA, 22 bp, Artificial sequence
  SiRNA target sequence
tacacaatttatctttatatat

SEQ ID NO: 143148 - DNA, 22 bp, Artificial sequence
  SiRNA target sequence
acacaatttatctttatatatc

SEQ ID NO: 143149 - DNA, 22 bp, Artificial sequence
  SiRNA target sequence
cacaatttatctttatatatca

SEQ ID NO: 143150 - DNA, 22 bp, Artificial sequence
  SiRNA target sequence
acaatttatctttatatatcaa

SEQ ID NO: 143151 - DNA, 22 bp, Artificial sequence
  SiRNA target sequence
caatttatctttatatatcaac

SEQ ID NO: 143152 - DNA, 22 bp, Artificial sequence
  SiRNA target sequence
aatttatctttatatatcaacc

SEQ ID NO: 143153 - DNA, 22 bp, Artificial sequence
  SiRNA target sequence
atttatctttatatatcaacca

SEQ ID NO: 143154 - DNA, 22 bp, Artificial sequence
  SiRNA target sequence
tttatctttatatatcaaccac

SEQ ID NO: 143155 - DNA, 22 bp, Artificial sequence
  SiRNA target sequence
ttatctttatatatcaaccaca

SEQ ID NO: 143156 - DNA, 22 bp, Artificial sequence
  SiRNA target sequence
tatctttatatatcaaccacac

SEQ ID NO: 143157 - DNA, 22 bp, Artificial sequence
  SiRNA target sequence
atctttatatatcaaccacacc

SEQ ID NO: 143158 - DNA, 22 bp, Artificial sequence
  SiRNA target sequence
tctttatatatcaaccacaccc

SEQ ID NO: 143159 - DNA, 22 bp, Artificial sequence
  SiRNA target sequence
ctttatatatcaaccacaccca

SEQ ID NO: 143160 - DNA, 22 bp, Artificial sequence
  SiRNA target sequence
tttatatatcaaccacacccat

SEQ ID NO: 143161 - DNA, 22 bp, Artificial sequence
  SiRNA target sequence
ttatatatcaaccacacccatc

SEQ ID NO: 143162 - DNA, 22 bp, Artificial sequence
  SiRNA target sequence
tatatatcaaccacacccatcc

SEQ ID NO: 143163 - DNA, 22 bp, Artificial sequence
  SiRNA target sequence
atatatcaaccacacccatcct

SEQ ID NO: 143164 - DNA, 22 bp, Artificial sequence
  SiRNA target sequence
tatatcaaccacacccatcctg

SEQ ID NO: 143165 - DNA, 22 bp, Artificial sequence
  SiRNA target sequence
atatcaaccacacccatcctga

SEQ ID NO: 143166 - DNA, 22 bp, Artificial sequence
  SiRNA target sequence
tatcaaccacacccatcctgat

SEQ ID NO: 143167 - DNA, 22 bp, Artificial sequence
  SiRNA target sequence
atcaaccacacccatcctgatc

SEQ ID NO: 143168 - DNA, 22 bp, Artificial sequence
  SiRNA target sequence
tcaaccacacccatcctgatcc

SEQ ID NO: 143169 - DNA, 22 bp, Artificial sequence
  SiRNA target sequence
caaccacacccatcctgatcca

SEQ ID NO: 143170 - DNA, 22 bp, Artificial sequence
  SiRNA target sequence
aaccacacccatcctgatccaa

SEQ ID NO: 143171 - DNA, 22 bp, Artificial sequence
  SiRNA target sequence
accacacccatcctgatccaaa

SEQ ID NO: 143172 - DNA, 22 bp, Artificial sequence
  SiRNA target sequence
ccacacccatcctgatccaaat

SEQ ID NO: 143173 - DNA, 22 bp, Artificial sequence
  SiRNA target sequence
cacacccatcctgatccaaata

SEQ ID NO: 143174 - DNA, 22 bp, Artificial sequence
  SiRNA target sequence
acacccatcctgatccaaataa

SEQ ID NO: 143175 - DNA, 22 bp, Artificial sequence
  SiRNA target sequence
cacccatcctgatccaaataat

SEQ ID NO: 143176 - DNA, 22 bp, Artificial sequence
  SiRNA target sequence
acccatcctgatccaaataatt

SEQ ID NO: 143177 - DNA, 22 bp, Artificial sequence
  SiRNA target sequence
cccatcctgatccaaataattt

SEQ ID NO: 143178 - DNA, 22 bp, Artificial sequence
  SiRNA target sequence
ccatcctgatccaaataatttt

SEQ ID NO: 143179 - DNA, 22 bp, Artificial sequence
  SiRNA target sequence
catcctgatccaaataatttta

SEQ ID NO: 143180 - DNA, 22 bp, Artificial sequence
  SiRNA target sequence
atcctgatccaaataattttac

SEQ ID NO: 143181 - DNA, 22 bp, Artificial sequence
  SiRNA target sequence
tcctgatccaaataattttaca

SEQ ID NO: 143182 - DNA, 22 bp, Artificial sequence
  SiRNA target sequence
cctgatccaaataattttacag

SEQ ID NO: 143183 - DNA, 22 bp, Artificial sequence
  SiRNA target sequence
ctgatccaaataattttacagc

SEQ ID NO: 143184 - DNA, 22 bp, Artificial sequence
  SiRNA target sequence
tgatccaaataattttacagct

SEQ ID NO: 143185 - DNA, 22 bp, Artificial sequence
  SiRNA target sequence
gatccaaataattttacagctt

SEQ ID NO: 143186 - DNA, 22 bp, Artificial sequence
  SiRNA target sequence
atccaaataattttacagcttc

SEQ ID NO: 143187 - DNA, 22 bp, Artificial sequence
  SiRNA target sequence
tccaaataattttacagcttca

SEQ ID NO: 143188 - DNA, 22 bp, Artificial sequence
  SiRNA target sequence
ccaaataattttacagcttcag

SEQ ID NO: 143189 - DNA, 22 bp, Artificial sequence
  SiRNA target sequence
caaataattttacagcttcagt

SEQ ID NO: 143190 - DNA, 22 bp, Artificial sequence
  SiRNA target sequence
aaataattttacagcttcagta

SEQ ID NO: 143191 - DNA, 22 bp, Artificial sequence
  SiRNA target sequence
aataattttacagcttcagtat

SEQ ID NO: 143192 - DNA, 22 bp, Artificial sequence
  SiRNA target sequence
ataattttacagcttcagtatt

SEQ ID NO: 143193 - DNA, 22 bp, Artificial sequence
  SiRNA target sequence
taattttacagcttcagtatta

SEQ ID NO: 143194 - DNA, 22 bp, Artificial sequence
  SiRNA target sequence
aattttacagcttcagtattaa

SEQ ID NO: 143195 - DNA, 22 bp, Artificial sequence
  SiRNA target sequence
attttacagcttcagtattaaa

SEQ ID NO: 143196 - DNA, 22 bp, Artificial sequence
  SiRNA target sequence
ttttacagcttcagtattaaaa

SEQ ID NO: 143197 - DNA, 22 bp, Artificial sequence
  SiRNA target sequence
tttacagcttcagtattaaaat

SEQ ID NO: 143198 - DNA, 22 bp, Artificial sequence
  SiRNA target sequence
ttacagcttcagtattaaaatt

SEQ ID NO: 143199 - DNA, 22 bp, Artificial sequence
  SiRNA target sequence
tacagcttcagtattaaaattc

SEQ ID NO: 143200 - DNA, 22 bp, Artificial sequence
  SiRNA target sequence
acagcttcagtattaaaattct

SEQ ID NO: 143201 - DNA, 22 bp, Artificial sequence
  SiRNA target sequence
cagcttcagtattaaaattctc

SEQ ID NO: 143202 - DNA, 22 bp, Artificial sequence
  SiRNA target sequence
agcttcagtattaaaattctcc

SEQ ID NO: 143203 - DNA, 22 bp, Artificial sequence
  SiRNA target sequence
gcttcagtattaaaattctcct

SEQ ID NO: 143204 - DNA, 22 bp, Artificial sequence
  SiRNA target sequence
cttcagtattaaaattctcctt

SEQ ID NO: 143205 - DNA, 22 bp, Artificial sequence
  SiRNA target sequence
ttcagtattaaaattctcctta

SEQ ID NO: 143206 - DNA, 22 bp, Artificial sequence
  SiRNA target sequence
tcagtattaaaattctccttaa

SEQ ID NO: 143207 - DNA, 22 bp, Artificial sequence
  SiRNA target sequence
cagtattaaaattctccttaaa

SEQ ID NO: 143208 - DNA, 22 bp, Artificial sequence
  SiRNA target sequence
agtattaaaattctccttaaat

SEQ ID NO: 143209 - DNA, 22 bp, Artificial sequence
  SiRNA target sequence
gtattaaaattctccttaaatt

SEQ ID NO: 143210 - DNA, 22 bp, Artificial sequence
  SiRNA target sequence
tattaaaattctccttaaattt

SEQ ID NO: 143211 - DNA, 22 bp, Artificial sequence
  SiRNA target sequence
attaaaattctccttaaattta

SEQ ID NO: 143212 - DNA, 22 bp, Artificial sequence
  SiRNA target sequence
ttaaaattctccttaaatttat

SEQ ID NO: 143213 - DNA, 22 bp, Artificial sequence
  SiRNA target sequence
taaaattctccttaaatttatt

SEQ ID NO: 143214 - DNA, 22 bp, Artificial sequence
  SiRNA target sequence
aaaattctccttaaatttattt

SEQ ID NO: 143215 - DNA, 22 bp, Artificial sequence
  SiRNA target sequence
aaattctccttaaatttattta

SEQ ID NO: 143216 - DNA, 22 bp, Artificial sequence
  SiRNA target sequence
aattctccttaaatttatttat

SEQ ID NO: 143217 - DNA, 22 bp, Artificial sequence
  SiRNA target sequence
attctccttaaatttatttatt

SEQ ID NO: 143218 - DNA, 22 bp, Artificial sequence
  SiRNA target sequence
ttctccttaaatttatttattg

SEQ ID NO: 143219 - DNA, 22 bp, Artificial sequence
  SiRNA target sequence
tctccttaaatttatttattga

SEQ ID NO: 143220 - DNA, 22 bp, Artificial sequence
  SiRNA target sequence
ctccttaaatttatttattgat

SEQ ID NO: 143221 - DNA, 22 bp, Artificial sequence
  SiRNA target sequence
tccttaaatttatttattgatc

SEQ ID NO: 143222 - DNA, 22 bp, Artificial sequence
  SiRNA target sequence
ccttaaatttatttattgatcc

SEQ ID NO: 143223 - DNA, 22 bp, Artificial sequence
  SiRNA target sequence
cttaaatttatttattgatcca

SEQ ID NO: 143224 - DNA, 22 bp, Artificial sequence
  SiRNA target sequence
ttaaatttatttattgatccaa

SEQ ID NO: 143225 - DNA, 22 bp, Artificial sequence
  SiRNA target sequence
taaatttatttattgatccaaa

SEQ ID NO: 143226 - DNA, 22 bp, Artificial sequence
  SiRNA target sequence
aaatttatttattgatccaaag

SEQ ID NO: 143227 - DNA, 22 bp, Artificial sequence
  SiRNA target sequence
aatttatttattgatccaaagt

SEQ ID NO: 143228 - DNA, 22 bp, Artificial sequence
  SiRNA target sequence
atttatttattgatccaaagtc

SEQ ID NO: 143229 - DNA, 22 bp, Artificial sequence
  SiRNA target sequence
tttatttattgatccaaagtct

SEQ ID NO: 143230 - DNA, 22 bp, Artificial sequence
  SiRNA target sequence
ttatttattgatccaaagtctt

SEQ ID NO: 143231 - DNA, 22 bp, Artificial sequence
  SiRNA target sequence
tatttattgatccaaagtcttt

SEQ ID NO: 143232 - DNA, 22 bp, Artificial sequence
  SiRNA target sequence
atttattgatccaaagtctttt

SEQ ID NO: 143233 - DNA, 22 bp, Artificial sequence
  SiRNA target sequence
tttattgatccaaagtctttta

SEQ ID NO: 143234 - DNA, 22 bp, Artificial sequence
  SiRNA target sequence
ttattgatccaaagtcttttat

SEQ ID NO: 143235 - DNA, 22 bp, Artificial sequence
  SiRNA target sequence
tattgatccaaagtcttttatt

SEQ ID NO: 143236 - DNA, 22 bp, Artificial sequence
  SiRNA target sequence
attgatccaaagtcttttatta

SEQ ID NO: 143237 - DNA, 22 bp, Artificial sequence
  SiRNA target sequence
ttgatccaaagtcttttattat

SEQ ID NO: 143238 - DNA, 22 bp, Artificial sequence
  SiRNA target sequence
tgatccaaagtcttttattata

SEQ ID NO: 143239 - DNA, 22 bp, Artificial sequence
  SiRNA target sequence
gatccaaagtcttttattatag

SEQ ID NO: 143240 - DNA, 22 bp, Artificial sequence
  SiRNA target sequence
atccaaagtcttttattatagc

SEQ ID NO: 143241 - DNA, 22 bp, Artificial sequence
  SiRNA target sequence
tccaaagtcttttattatagca

SEQ ID NO: 143242 - DNA, 22 bp, Artificial sequence
  SiRNA target sequence
ccaaagtcttttattatagcac

SEQ ID NO: 143243 - DNA, 22 bp, Artificial sequence
  SiRNA target sequence
caaagtcttttattatagcact

SEQ ID NO: 143244 - DNA, 22 bp, Artificial sequence
  SiRNA target sequence
aaagtcttttattatagcactt

SEQ ID NO: 143245 - DNA, 22 bp, Artificial sequence
  SiRNA target sequence
aagtcttttattatagcacttt

SEQ ID NO: 143246 - DNA, 22 bp, Artificial sequence
  SiRNA target sequence
agtcttttattatagcactttc

SEQ ID NO: 143247 - DNA, 22 bp, Artificial sequence
  SiRNA target sequence
gtcttttattatagcactttcc

SEQ ID NO: 143248 - DNA, 22 bp, Artificial sequence
  SiRNA target sequence
tcttttattatagcactttcca

SEQ ID NO: 143249 - DNA, 22 bp, Artificial sequence
  SiRNA target sequence
cttttattatagcactttccaa

SEQ ID NO: 143250 - DNA, 22 bp, Artificial sequence
  SiRNA target sequence
ttttattatagcactttccaac

SEQ ID NO: 143251 - DNA, 22 bp, Artificial sequence
  SiRNA target sequence
tttattatagcactttccaact

SEQ ID NO: 143252 - DNA, 22 bp, Artificial sequence
  SiRNA target sequence
ttattatagcactttccaactg

SEQ ID NO: 143253 - DNA, 22 bp, Artificial sequence
  SiRNA target sequence
tattatagcactttccaactgg

SEQ ID NO: 143254 - DNA, 22 bp, Artificial sequence
  SiRNA target sequence
attatagcactttccaactggg

SEQ ID NO: 143255 - DNA, 22 bp, Artificial sequence
  SiRNA target sequence
ttatagcactttccaactggga

SEQ ID NO: 143256 - DNA, 22 bp, Artificial sequence
  SiRNA target sequence
tatagcactttccaactgggaa

SEQ ID NO: 143257 - DNA, 22 bp, Artificial sequence
  SiRNA target sequence
atagcactttccaactgggaag

SEQ ID NO: 143258 - DNA, 22 bp, Artificial sequence
  SiRNA target sequence
tagcactttccaactgggaaga

SEQ ID NO: 143259 - DNA, 22 bp, Artificial sequence
  SiRNA target sequence
agcactttccaactgggaagaa

SEQ ID NO: 143260 - DNA, 22 bp, Artificial sequence
  SiRNA target sequence
gcactttccaactgggaagaaa

SEQ ID NO: 143261 - DNA, 22 bp, Artificial sequence
  SiRNA target sequence
cactttccaactgggaagaaat

SEQ ID NO: 143262 - DNA, 22 bp, Artificial sequence
  SiRNA target sequence
actttccaactgggaagaaatc

SEQ ID NO: 143263 - DNA, 22 bp, Artificial sequence
  SiRNA target sequence
ctttccaactgggaagaaatct

SEQ ID NO: 143264 - DNA, 22 bp, Artificial sequence
  SiRNA target sequence
tttccaactgggaagaaatctt

SEQ ID NO: 143265 - DNA, 22 bp, Artificial sequence
  SiRNA target sequence
ttccaactgggaagaaatcttt

SEQ ID NO: 143266 - DNA, 22 bp, Artificial sequence
  SiRNA target sequence
tccaactgggaagaaatctttt

SEQ ID NO: 143267 - DNA, 22 bp, Artificial sequence
  SiRNA target sequence
ccaactgggaagaaatcttttt

SEQ ID NO: 143268 - DNA, 22 bp, Artificial sequence
  SiRNA target sequence
caactgggaagaaatcttttta

SEQ ID NO: 143269 - DNA, 22 bp, Artificial sequence
  SiRNA target sequence
aactgggaagaaatctttttat

SEQ ID NO: 143270 - DNA, 22 bp, Artificial sequence
  SiRNA target sequence
actgggaagaaatctttttatt

SEQ ID NO: 143271 - DNA, 22 bp, Artificial sequence
  SiRNA target sequence
ctgggaagaaatctttttattt

SEQ ID NO: 143272 - DNA, 22 bp, Artificial sequence
  SiRNA target sequence
tgggaagaaatctttttatttt

SEQ ID NO: 143273 - DNA, 22 bp, Artificial sequence
  SiRNA target sequence
gggaagaaatctttttattttc

SEQ ID NO: 143274 - DNA, 22 bp, Artificial sequence
  SiRNA target sequence
ggaagaaatctttttattttct

SEQ ID NO: 143275 - DNA, 22 bp, Artificial sequence
  SiRNA target sequence
gaagaaatctttttattttctg

SEQ ID NO: 143276 - DNA, 22 bp, Artificial sequence
  SiRNA target sequence
aagaaatctttttattttctgg

SEQ ID NO: 143277 - DNA, 22 bp, Artificial sequence
  SiRNA target sequence
agaaatctttttattttctggt

SEQ ID NO: 143278 - DNA, 22 bp, Artificial sequence
  SiRNA target sequence
gaaatctttttattttctggtg

SEQ ID NO: 143279 - DNA, 22 bp, Artificial sequence
  SiRNA target sequence
aaatctttttattttctggtga

SEQ ID NO: 143280 - DNA, 22 bp, Artificial sequence
  SiRNA target sequence
aatctttttattttctggtgac

SEQ ID NO: 143281 - DNA, 22 bp, Artificial sequence
  SiRNA target sequence
atctttttattttctggtgaca

SEQ ID NO: 143282 - DNA, 22 bp, Artificial sequence
  SiRNA target sequence
tctttttattttctggtgacat

SEQ ID NO: 143283 - DNA, 22 bp, Artificial sequence
  SiRNA target sequence
ctttttattttctggtgacatt

SEQ ID NO: 143284 - DNA, 22 bp, Artificial sequence
  SiRNA target sequence
tttttattttctggtgacatta

SEQ ID NO: 143285 - DNA, 22 bp, Artificial sequence
  SiRNA target sequence
ttttattttctggtgacattac

SEQ ID NO: 143286 - DNA, 22 bp, Artificial sequence
  SiRNA target sequence
tttattttctggtgacattacc

SEQ ID NO: 143287 - DNA, 22 bp, Artificial sequence
  SiRNA target sequence
ttattttctggtgacattacca

SEQ ID NO: 143288 - DNA, 22 bp, Artificial sequence
  SiRNA target sequence
tattttctggtgacattaccaa

SEQ ID NO: 143289 - DNA, 22 bp, Artificial sequence
  SiRNA target sequence
attttctggtgacattaccaac

SEQ ID NO: 143290 - DNA, 22 bp, Artificial sequence
  SiRNA target sequence
ttttctggtgacattaccaacc

SEQ ID NO: 143291 - DNA, 22 bp, Artificial sequence
  SiRNA target sequence
tttctggtgacattaccaacca

SEQ ID NO: 143292 - DNA, 22 bp, Artificial sequence
  SiRNA target sequence
ttctggtgacattaccaaccag

SEQ ID NO: 143293 - DNA, 22 bp, Artificial sequence
  SiRNA target sequence
tctggtgacattaccaaccaga

SEQ ID NO: 143294 - DNA, 22 bp, Artificial sequence
  SiRNA target sequence
ctggtgacattaccaaccagaa

SEQ ID NO: 143295 - DNA, 22 bp, Artificial sequence
  SiRNA target sequence
tggtgacattaccaaccagaaa

SEQ ID NO: 143296 - DNA, 22 bp, Artificial sequence
  SiRNA target sequence
ggtgacattaccaaccagaaaa

SEQ ID NO: 143297 - DNA, 22 bp, Artificial sequence
  SiRNA target sequence
gtgacattaccaaccagaaaag

SEQ ID NO: 143298 - DNA, 22 bp, Artificial sequence
  SiRNA target sequence
tgacattaccaaccagaaaaga

SEQ ID NO: 143299 - DNA, 22 bp, Artificial sequence
  SiRNA target sequence
gacattaccaaccagaaaagac

SEQ ID NO: 143300 - DNA, 22 bp, Artificial sequence
  SiRNA target sequence
acattaccaaccagaaaagact

SEQ ID NO: 143301 - DNA, 22 bp, Artificial sequence
  SiRNA target sequence
cattaccaaccagaaaagacta

SEQ ID NO: 143302 - DNA, 22 bp, Artificial sequence
  SiRNA target sequence
attaccaaccagaaaagactat

SEQ ID NO: 143303 - DNA, 22 bp, Artificial sequence
  SiRNA target sequence
ttaccaaccagaaaagactatg

SEQ ID NO: 143304 - DNA, 22 bp, Artificial sequence
  SiRNA target sequence
taccaaccagaaaagactatgg

SEQ ID NO: 143305 - DNA, 22 bp, Artificial sequence
  SiRNA target sequence
accaaccagaaaagactatggt

SEQ ID NO: 143306 - DNA, 22 bp, Artificial sequence
  SiRNA target sequence
ccaaccagaaaagactatggtt

SEQ ID NO: 143307 - DNA, 22 bp, Artificial sequence
  SiRNA target sequence
caaccagaaaagactatggttg

SEQ ID NO: 143308 - DNA, 22 bp, Artificial sequence
  SiRNA target sequence
aaccagaaaagactatggttgt

SEQ ID NO: 143309 - DNA, 22 bp, Artificial sequence
  SiRNA target sequence
accagaaaagactatggttgta

SEQ ID NO: 143310 - DNA, 22 bp, Artificial sequence
  SiRNA target sequence
ccagaaaagactatggttgtaa

SEQ ID NO: 143311 - DNA, 22 bp, Artificial sequence
  SiRNA target sequence
cagaaaagactatggttgtaat

SEQ ID NO: 143312 - DNA, 22 bp, Artificial sequence
  SiRNA target sequence
agaaaagactatggttgtaatg

SEQ ID NO: 143313 - DNA, 22 bp, Artificial sequence
  SiRNA target sequence
gaaaagactatggttgtaatga

SEQ ID NO: 143314 - DNA, 22 bp, Artificial sequence
  SiRNA target sequence
aaaagactatggttgtaatgac

SEQ ID NO: 143315 - DNA, 22 bp, Artificial sequence
  SiRNA target sequence
aaagactatggttgtaatgacc

SEQ ID NO: 143316 - DNA, 22 bp, Artificial sequence
  SiRNA target sequence
aagactatggttgtaatgacca

SEQ ID NO: 143317 - DNA, 22 bp, Artificial sequence
  SiRNA target sequence
agactatggttgtaatgaccac

SEQ ID NO: 143318 - DNA, 22 bp, Artificial sequence
  SiRNA target sequence
gactatggttgtaatgaccacc

SEQ ID NO: 143319 - DNA, 22 bp, Artificial sequence
  SiRNA target sequence
actatggttgtaatgaccacca

SEQ ID NO: 143320 - DNA, 22 bp, Artificial sequence
  SiRNA target sequence
ctatggttgtaatgaccaccac

SEQ ID NO: 143321 - DNA, 22 bp, Artificial sequence
  SiRNA target sequence
tatggttgtaatgaccaccacc

SEQ ID NO: 143322 - DNA, 22 bp, Artificial sequence
  SiRNA target sequence
atggttgtaatgaccaccacca

SEQ ID NO: 143323 - DNA, 22 bp, Artificial sequence
  SiRNA target sequence
tggttgtaatgaccaccaccat

SEQ ID NO: 143324 - DNA, 22 bp, Artificial sequence
  SiRNA target sequence
ggttgtaatgaccaccaccata

SEQ ID NO: 143325 - DNA, 22 bp, Artificial sequence
  SiRNA target sequence
gttgtaatgaccaccaccataa

SEQ ID NO: 143326 - DNA, 22 bp, Artificial sequence
  SiRNA target sequence
ttgtaatgaccaccaccataat

SEQ ID NO: 143327 - DNA, 22 bp, Artificial sequence
  SiRNA target sequence
tgtaatgaccaccaccataatc

SEQ ID NO: 143328 - DNA, 22 bp, Artificial sequence
  SiRNA target sequence
gtaatgaccaccaccataatct

SEQ ID NO: 143329 - DNA, 22 bp, Artificial sequence
  SiRNA target sequence
taatgaccaccaccataatctc

SEQ ID NO: 143330 - DNA, 22 bp, Artificial sequence
  SiRNA target sequence
aatgaccaccaccataatctct

SEQ ID NO: 143331 - DNA, 22 bp, Artificial sequence
  SiRNA target sequence
atgaccaccaccataatctctt

SEQ ID NO: 143332 - DNA, 22 bp, Artificial sequence
  SiRNA target sequence
tgaccaccaccataatctctta

SEQ ID NO: 143333 - DNA, 22 bp, Artificial sequence
  SiRNA target sequence
gaccaccaccataatctcttaa

SEQ ID NO: 143334 - DNA, 22 bp, Artificial sequence
  SiRNA target sequence
accaccaccataatctcttaat

SEQ ID NO: 143335 - DNA, 22 bp, Artificial sequence
  SiRNA target sequence
ccaccaccataatctcttaatt

SEQ ID NO: 143336 - DNA, 22 bp, Artificial sequence
  SiRNA target sequence
caccaccataatctcttaattg

SEQ ID NO: 143337 - DNA, 22 bp, Artificial sequence
  SiRNA target sequence
accaccataatctcttaattgt

SEQ ID NO: 143338 - DNA, 22 bp, Artificial sequence
  SiRNA target sequence
ccaccataatctcttaattgtt

SEQ ID NO: 143339 - DNA, 22 bp, Artificial sequence
  SiRNA target sequence
caccataatctcttaattgttt

SEQ ID NO: 143340 - DNA, 22 bp, Artificial sequence
  SiRNA target sequence
accataatctcttaattgttta

SEQ ID NO: 143341 - DNA, 22 bp, Artificial sequence
  SiRNA target sequence
ccataatctcttaattgtttat

SEQ ID NO: 143342 - DNA, 22 bp, Artificial sequence
  SiRNA target sequence
cataatctcttaattgtttatc

SEQ ID NO: 143343 - DNA, 22 bp, Artificial sequence
  SiRNA target sequence
ataatctcttaattgtttatca

SEQ ID NO: 143344 - DNA, 22 bp, Artificial sequence
  SiRNA target sequence
taatctcttaattgtttatcaa

SEQ ID NO: 143345 - DNA, 22 bp, Artificial sequence
  SiRNA target sequence
aatctcttaattgtttatcaac

SEQ ID NO: 143346 - DNA, 22 bp, Artificial sequence
  SiRNA target sequence
atctcttaattgtttatcaaca

SEQ ID NO: 143347 - DNA, 22 bp, Artificial sequence
  SiRNA target sequence
tctcttaattgtttatcaacaa

SEQ ID NO: 143348 - DNA, 22 bp, Artificial sequence
  SiRNA target sequence
ctcttaattgtttatcaacaag

SEQ ID NO: 143349 - DNA, 22 bp, Artificial sequence
  SiRNA target sequence
tcttaattgtttatcaacaagt

SEQ ID NO: 143350 - DNA, 22 bp, Artificial sequence
  SiRNA target sequence
cttaattgtttatcaacaagtg

SEQ ID NO: 143351 - DNA, 22 bp, Artificial sequence
  SiRNA target sequence
ttaattgtttatcaacaagtgc

SEQ ID NO: 143352 - DNA, 22 bp, Artificial sequence
  SiRNA target sequence
taattgtttatcaacaagtgca

SEQ ID NO: 143353 - DNA, 22 bp, Artificial sequence
  SiRNA target sequence
aattgtttatcaacaagtgcat

SEQ ID NO: 143354 - DNA, 22 bp, Artificial sequence
  SiRNA target sequence
attgtttatcaacaagtgcatt

SEQ ID NO: 143355 - DNA, 22 bp, Artificial sequence
  SiRNA target sequence
ttgtttatcaacaagtgcattt

SEQ ID NO: 143356 - DNA, 22 bp, Artificial sequence
  SiRNA target sequence
tgtttatcaacaagtgcatttc

SEQ ID NO: 143357 - DNA, 22 bp, Artificial sequence
  SiRNA target sequence
gtttatcaacaagtgcatttcc

SEQ ID NO: 143358 - DNA, 22 bp, Artificial sequence
  SiRNA target sequence
tttatcaacaagtgcatttcct

SEQ ID NO: 143359 - DNA, 22 bp, Artificial sequence
  SiRNA target sequence
ttatcaacaagtgcatttcctt

SEQ ID NO: 143360 - DNA, 22 bp, Artificial sequence
  SiRNA target sequence
tatcaacaagtgcatttccttt

SEQ ID NO: 143361 - DNA, 22 bp, Artificial sequence
  SiRNA target sequence
atcaacaagtgcatttccttta

SEQ ID NO: 143362 - DNA, 22 bp, Artificial sequence
  SiRNA target sequence
tcaacaagtgcatttcctttat

SEQ ID NO: 143363 - DNA, 22 bp, Artificial sequence
  SiRNA target sequence
caacaagtgcatttcctttatt

SEQ ID NO: 143364 - DNA, 22 bp, Artificial sequence
  SiRNA target sequence
aacaagtgcatttcctttatta

SEQ ID NO: 143365 - DNA, 22 bp, Artificial sequence
  SiRNA target sequence
acaagtgcatttcctttattat

SEQ ID NO: 143366 - DNA, 22 bp, Artificial sequence
  SiRNA target sequence
caagtgcatttcctttattatt

SEQ ID NO: 143367 - DNA, 22 bp, Artificial sequence
  SiRNA target sequence
aagtgcatttcctttattatta

SEQ ID NO: 143368 - DNA, 22 bp, Artificial sequence
  SiRNA target sequence
agtgcatttcctttattattaa

SEQ ID NO: 143369 - DNA, 22 bp, Artificial sequence
  SiRNA target sequence
gtgcatttcctttattattaaa

SEQ ID NO: 143370 - DNA, 22 bp, Artificial sequence
  SiRNA target sequence
tgcatttcctttattattaaaa

SEQ ID NO: 143371 - DNA, 22 bp, Artificial sequence
  SiRNA target sequence
gcatttcctttattattaaaaa

SEQ ID NO: 143372 - DNA, 22 bp, Artificial sequence
  SiRNA target sequence
catttcctttattattaaaaag

SEQ ID NO: 143373 - DNA, 22 bp, Artificial sequence
  SiRNA target sequence
atttcctttattattaaaaagt

SEQ ID NO: 143374 - DNA, 22 bp, Artificial sequence
  SiRNA target sequence
tttcctttattattaaaaagta

SEQ ID NO: 143375 - DNA, 22 bp, Artificial sequence
  SiRNA target sequence
ttcctttattattaaaaagtaa

SEQ ID NO: 143376 - DNA, 22 bp, Artificial sequence
  SiRNA target sequence
tcctttattattaaaaagtaat

SEQ ID NO: 143377 - DNA, 22 bp, Artificial sequence
  SiRNA target sequence
cctttattattaaaaagtaatg

SEQ ID NO: 143378 - DNA, 22 bp, Artificial sequence
  SiRNA target sequence
ctttattattaaaaagtaatga

SEQ ID NO: 143379 - DNA, 22 bp, Artificial sequence
  SiRNA target sequence
tttattattaaaaagtaatgaa

SEQ ID NO: 143380 - DNA, 22 bp, Artificial sequence
  SiRNA target sequence
ttattattaaaaagtaatgaat

SEQ ID NO: 143381 - DNA, 22 bp, Artificial sequence
  SiRNA target sequence
tattattaaaaagtaatgaatt

SEQ ID NO: 143382 - DNA, 22 bp, Artificial sequence
  SiRNA target sequence
attattaaaaagtaatgaattt

SEQ ID NO: 143383 - DNA, 22 bp, Artificial sequence
  SiRNA target sequence
ttattaaaaagtaatgaattta

SEQ ID NO: 143384 - DNA, 22 bp, Artificial sequence
  SiRNA target sequence
tattaaaaagtaatgaatttaa

SEQ ID NO: 143385 - DNA, 22 bp, Artificial sequence
  SiRNA target sequence
attaaaaagtaatgaatttaat

SEQ ID NO: 143386 - DNA, 22 bp, Artificial sequence
  SiRNA target sequence
ttaaaaagtaatgaatttaatg

SEQ ID NO: 143387 - DNA, 22 bp, Artificial sequence
  SiRNA target sequence
taaaaagtaatgaatttaatga

SEQ ID NO: 143388 - DNA, 22 bp, Artificial sequence
  SiRNA target sequence
aaaaagtaatgaatttaatgat

SEQ ID NO: 143389 - DNA, 22 bp, Artificial sequence
  SiRNA target sequence
aaaagtaatgaatttaatgatt

SEQ ID NO: 143390 - DNA, 22 bp, Artificial sequence
  SiRNA target sequence
aaagtaatgaatttaatgattt

SEQ ID NO: 143391 - DNA, 22 bp, Artificial sequence
  SiRNA target sequence
aagtaatgaatttaatgattta

SEQ ID NO: 143392 - DNA, 22 bp, Artificial sequence
  SiRNA target sequence
agtaatgaatttaatgatttac

SEQ ID NO: 143393 - DNA, 22 bp, Artificial sequence
  SiRNA target sequence
gtaatgaatttaatgatttacc

SEQ ID NO: 143394 - DNA, 22 bp, Artificial sequence
  SiRNA target sequence
taatgaatttaatgatttacca

SEQ ID NO: 143395 - DNA, 22 bp, Artificial sequence
  SiRNA target sequence
aatgaatttaatgatttaccac

SEQ ID NO: 143396 - DNA, 22 bp, Artificial sequence
  SiRNA target sequence
atgaatttaatgatttaccaca

SEQ ID NO: 143397 - DNA, 22 bp, Artificial sequence
  SiRNA target sequence
tgaatttaatgatttaccacac

SEQ ID NO: 143398 - DNA, 22 bp, Artificial sequence
  SiRNA target sequence
gaatttaatgatttaccacaca

SEQ ID NO: 143399 - DNA, 22 bp, Artificial sequence
  SiRNA target sequence
aatttaatgatttaccacacaa

SEQ ID NO: 143400 - DNA, 22 bp, Artificial sequence
  SiRNA target sequence
atttaatgatttaccacacaaa

SEQ ID NO: 143401 - DNA, 22 bp, Artificial sequence
  SiRNA target sequence
tttaatgatttaccacacaaat

SEQ ID NO: 143402 - DNA, 22 bp, Artificial sequence
  SiRNA target sequence
ttaatgatttaccacacaaatt

SEQ ID NO: 143403 - DNA, 22 bp, Artificial sequence
  SiRNA target sequence
taatgatttaccacacaaattg

SEQ ID NO: 143404 - DNA, 22 bp, Artificial sequence
  SiRNA target sequence
aatgatttaccacacaaattgt

SEQ ID NO: 143405 - DNA, 22 bp, Artificial sequence
  SiRNA target sequence
atgatttaccacacaaattgtt

SEQ ID NO: 143406 - DNA, 22 bp, Artificial sequence
  SiRNA target sequence
tgatttaccacacaaattgtta

SEQ ID NO: 143407 - DNA, 22 bp, Artificial sequence
  SiRNA target sequence
gatttaccacacaaattgttat

SEQ ID NO: 143408 - DNA, 22 bp, Artificial sequence
  SiRNA target sequence
atttaccacacaaattgttatc

SEQ ID NO: 143409 - DNA, 22 bp, Artificial sequence
  SiRNA target sequence
tttaccacacaaattgttatct

SEQ ID NO: 143410 - DNA, 22 bp, Artificial sequence
  SiRNA target sequence
ttaccacacaaattgttatcta

SEQ ID NO: 143411 - DNA, 22 bp, Artificial sequence
  SiRNA target sequence
taccacacaaattgttatctaa

SEQ ID NO: 143412 - DNA, 22 bp, Artificial sequence
  SiRNA target sequence
accacacaaattgttatctaat

SEQ ID NO: 143413 - DNA, 22 bp, Artificial sequence
  SiRNA target sequence
ccacacaaattgttatctaata

SEQ ID NO: 143414 - DNA, 22 bp, Artificial sequence
  SiRNA target sequence
cacacaaattgttatctaatat

SEQ ID NO: 143415 - DNA, 22 bp, Artificial sequence
  SiRNA target sequence
acacaaattgttatctaatatt

SEQ ID NO: 143416 - DNA, 22 bp, Artificial sequence
  SiRNA target sequence
cacaaattgttatctaatatta

SEQ ID NO: 143417 - DNA, 22 bp, Artificial sequence
  SiRNA target sequence
acaaattgttatctaatattat

SEQ ID NO: 143418 - DNA, 22 bp, Artificial sequence
  SiRNA target sequence
caaattgttatctaatattatt

SEQ ID NO: 143419 - DNA, 22 bp, Artificial sequence
  SiRNA target sequence
aaattgttatctaatattattt

SEQ ID NO: 143420 - DNA, 22 bp, Artificial sequence
  SiRNA target sequence
aattgttatctaatattatttt

SEQ ID NO: 143421 - DNA, 22 bp, Artificial sequence
  SiRNA target sequence
attgttatctaatattatttta

SEQ ID NO: 143422 - DNA, 22 bp, Artificial sequence
  SiRNA target sequence
ttgttatctaatattattttat

SEQ ID NO: 143423 - DNA, 22 bp, Artificial sequence
  SiRNA target sequence
tgttatctaatattattttatt

SEQ ID NO: 143424 - DNA, 22 bp, Artificial sequence
  SiRNA target sequence
gttatctaatattattttatta

SEQ ID NO: 143425 - DNA, 22 bp, Artificial sequence
  SiRNA target sequence
ttatctaatattattttattaa

SEQ ID NO: 143426 - DNA, 22 bp, Artificial sequence
  SiRNA target sequence
tatctaatattattttattaag

SEQ ID NO: 143427 - DNA, 22 bp, Artificial sequence
  SiRNA target sequence
atctaatattattttattaaga

SEQ ID NO: 143428 - DNA, 22 bp, Artificial sequence
  SiRNA target sequence
tctaatattattttattaagag

SEQ ID NO: 143429 - DNA, 22 bp, Artificial sequence
  SiRNA target sequence
ctaatattattttattaagagt

SEQ ID NO: 143430 - DNA, 22 bp, Artificial sequence
  SiRNA target sequence
taatattattttattaagagtg

SEQ ID NO: 143431 - DNA, 22 bp, Artificial sequence
  SiRNA target sequence
aatattattttattaagagtgt

SEQ ID NO: 143432 - DNA, 22 bp, Artificial sequence
  SiRNA target sequence
atattattttattaagagtgtc

SEQ ID NO: 143433 - DNA, 22 bp, Artificial sequence
  SiRNA target sequence
tattattttattaagagtgtct

SEQ ID NO: 143434 - DNA, 22 bp, Artificial sequence
  SiRNA target sequence
attattttattaagagtgtcta

SEQ ID NO: 143435 - DNA, 22 bp, Artificial sequence
  SiRNA target sequence
ttattttattaagagtgtctac

SEQ ID NO: 143436 - DNA, 22 bp, Artificial sequence
  SiRNA target sequence
tattttattaagagtgtctaca

SEQ ID NO: 143437 - DNA, 22 bp, Artificial sequence
  SiRNA target sequence
attttattaagagtgtctacat

SEQ ID NO: 143438 - DNA, 22 bp, Artificial sequence
  SiRNA target sequence
ttttattaagagtgtctacata

SEQ ID NO: 143439 - DNA, 22 bp, Artificial sequence
  SiRNA target sequence
tttattaagagtgtctacatac

SEQ ID NO: 143440 - DNA, 22 bp, Artificial sequence
  SiRNA target sequence
ttattaagagtgtctacatacg

SEQ ID NO: 143441 - DNA, 22 bp, Artificial sequence
  SiRNA target sequence
tattaagagtgtctacatacgc

SEQ ID NO: 143442 - DNA, 22 bp, Artificial sequence
  SiRNA target sequence
attaagagtgtctacatacgct

SEQ ID NO: 143443 - DNA, 22 bp, Artificial sequence
  SiRNA target sequence
ttaagagtgtctacatacgctt

SEQ ID NO: 143444 - DNA, 22 bp, Artificial sequence
  SiRNA target sequence
taagagtgtctacatacgcttg

SEQ ID NO: 143445 - DNA, 22 bp, Artificial sequence
  SiRNA target sequence
aagagtgtctacatacgcttga

SEQ ID NO: 143446 - DNA, 22 bp, Artificial sequence
  SiRNA target sequence
agagtgtctacatacgcttgat

SEQ ID NO: 143447 - DNA, 22 bp, Artificial sequence
  SiRNA target sequence
gagtgtctacatacgcttgatg

SEQ ID NO: 143448 - DNA, 22 bp, Artificial sequence
  SiRNA target sequence
agtgtctacatacgcttgatgg

SEQ ID NO: 143449 - DNA, 22 bp, Artificial sequence
  SiRNA target sequence
gtgtctacatacgcttgatggt

SEQ ID NO: 143450 - DNA, 22 bp, Artificial sequence
  SiRNA target sequence
tgtctacatacgcttgatggtg

SEQ ID NO: 143451 - DNA, 22 bp, Artificial sequence
  SiRNA target sequence
gtctacatacgcttgatggtgc

SEQ ID NO: 143452 - DNA, 22 bp, Artificial sequence
  SiRNA target sequence
tctacatacgcttgatggtgct

SEQ ID NO: 143453 - DNA, 22 bp, Artificial sequence
  SiRNA target sequence
ctacatacgcttgatggtgctt

SEQ ID NO: 143454 - DNA, 22 bp, Artificial sequence
  SiRNA target sequence
tacatacgcttgatggtgctta

SEQ ID NO: 143455 - DNA, 22 bp, Artificial sequence
  SiRNA target sequence
acatacgcttgatggtgcttag

SEQ ID NO: 143456 - DNA, 22 bp, Artificial sequence
  SiRNA target sequence
catacgcttgatggtgcttaga

SEQ ID NO: 143457 - DNA, 22 bp, Artificial sequence
  SiRNA target sequence
atacgcttgatggtgcttagag

SEQ ID NO: 143458 - DNA, 22 bp, Artificial sequence
  SiRNA target sequence
tacgcttgatggtgcttagagt

SEQ ID NO: 143459 - DNA, 22 bp, Artificial sequence
  SiRNA target sequence
acgcttgatggtgcttagagtg

SEQ ID NO: 143460 - DNA, 22 bp, Artificial sequence
  SiRNA target sequence
cgcttgatggtgcttagagtgg

SEQ ID NO: 143461 - DNA, 22 bp, Artificial sequence
  SiRNA target sequence
gcttgatggtgcttagagtggt

SEQ ID NO: 143462 - DNA, 22 bp, Artificial sequence
  SiRNA target sequence
cttgatggtgcttagagtggtg

SEQ ID NO: 143463 - DNA, 22 bp, Artificial sequence
  SiRNA target sequence
ttgatggtgcttagagtggtgg

SEQ ID NO: 143464 - DNA, 22 bp, Artificial sequence
  SiRNA target sequence
tgatggtgcttagagtggtggg

SEQ ID NO: 143465 - DNA, 22 bp, Artificial sequence
  SiRNA target sequence
gatggtgcttagagtggtgggt

SEQ ID NO: 143466 - DNA, 22 bp, Artificial sequence
  SiRNA target sequence
atggtgcttagagtggtgggtc

SEQ ID NO: 143467 - DNA, 22 bp, Artificial sequence
  SiRNA target sequence
tggtgcttagagtggtgggtct

SEQ ID NO: 143468 - DNA, 22 bp, Artificial sequence
  SiRNA target sequence
ggtgcttagagtggtgggtctc

SEQ ID NO: 143469 - DNA, 22 bp, Artificial sequence
  SiRNA target sequence
gtgcttagagtggtgggtctcc

SEQ ID NO: 143470 - DNA, 22 bp, Artificial sequence
  SiRNA target sequence
tgcttagagtggtgggtctcca

SEQ ID NO: 143471 - DNA, 22 bp, Artificial sequence
  SiRNA target sequence
gcttagagtggtgggtctccat

SEQ ID NO: 143472 - DNA, 22 bp, Artificial sequence
  SiRNA target sequence
cttagagtggtgggtctccatt

SEQ ID NO: 143473 - DNA, 22 bp, Artificial sequence
  SiRNA target sequence
ttagagtggtgggtctccatta

SEQ ID NO: 143474 - DNA, 22 bp, Artificial sequence
  SiRNA target sequence
tagagtggtgggtctccattat

SEQ ID NO: 143475 - DNA, 22 bp, Artificial sequence
  SiRNA target sequence
agagtggtgggtctccattata

SEQ ID NO: 143476 - DNA, 22 bp, Artificial sequence
  SiRNA target sequence
gagtggtgggtctccattatat

SEQ ID NO: 143477 - DNA, 22 bp, Artificial sequence
  SiRNA target sequence
agtggtgggtctccattatatc

SEQ ID NO: 143478 - DNA, 22 bp, Artificial sequence
  SiRNA target sequence
gtggtgggtctccattatatct

SEQ ID NO: 143479 - DNA, 22 bp, Artificial sequence
  SiRNA target sequence
tggtgggtctccattatatctt

SEQ ID NO: 143480 - DNA, 22 bp, Artificial sequence
  SiRNA target sequence
ggtgggtctccattatatcttc

SEQ ID NO: 143481 - DNA, 22 bp, Artificial sequence
  SiRNA target sequence
gtgggtctccattatatcttca

SEQ ID NO: 143482 - DNA, 22 bp, Artificial sequence
  SiRNA target sequence
tgggtctccattatatcttcac

SEQ ID NO: 143483 - DNA, 22 bp, Artificial sequence
  SiRNA target sequence
gggtctccattatatcttcact

SEQ ID NO: 143484 - DNA, 22 bp, Artificial sequence
  SiRNA target sequence
ggtctccattatatcttcactt

SEQ ID NO: 143485 - DNA, 22 bp, Artificial sequence
  SiRNA target sequence
gtctccattatatcttcactta

SEQ ID NO: 143486 - DNA, 22 bp, Artificial sequence
  SiRNA target sequence
tctccattatatcttcacttat

SEQ ID NO: 143487 - DNA, 22 bp, Artificial sequence
  SiRNA target sequence
ctccattatatcttcacttata

SEQ ID NO: 143488 - DNA, 22 bp, Artificial sequence
  SiRNA target sequence
tccattatatcttcacttatat

SEQ ID NO: 143489 - DNA, 22 bp, Artificial sequence
  SiRNA target sequence
ccattatatcttcacttatata

SEQ ID NO: 143490 - DNA, 22 bp, Artificial sequence
  SiRNA target sequence
cattatatcttcacttatataa

SEQ ID NO: 143491 - DNA, 22 bp, Artificial sequence
  SiRNA target sequence
attatatcttcacttatataag

SEQ ID NO: 143492 - DNA, 22 bp, Artificial sequence
  SiRNA target sequence
ttatatcttcacttatataagg

SEQ ID NO: 143493 - DNA, 22 bp, Artificial sequence
  SiRNA target sequence
tatatcttcacttatataaggc

SEQ ID NO: 143494 - DNA, 22 bp, Artificial sequence
  SiRNA target sequence
atatcttcacttatataaggct

SEQ ID NO: 143495 - DNA, 22 bp, Artificial sequence
  SiRNA target sequence
tatcttcacttatataaggctc

SEQ ID NO: 143496 - DNA, 22 bp, Artificial sequence
  SiRNA target sequence
atcttcacttatataaggctct

SEQ ID NO: 143497 - DNA, 22 bp, Artificial sequence
  SiRNA target sequence
tcttcacttatataaggctcta

SEQ ID NO: 143498 - DNA, 22 bp, Artificial sequence
  SiRNA target sequence
cttcacttatataaggctctag

SEQ ID NO: 143499 - DNA, 22 bp, Artificial sequence
  SiRNA target sequence
ttcacttatataaggctctaga

SEQ ID NO: 143500 - DNA, 22 bp, Artificial sequence
  SiRNA target sequence
tcacttatataaggctctagag

SEQ ID NO: 143501 - DNA, 22 bp, Artificial sequence
  SiRNA target sequence
cacttatataaggctctagaga

SEQ ID NO: 143502 - DNA, 22 bp, Artificial sequence
  SiRNA target sequence
acttatataaggctctagagat

SEQ ID NO: 143503 - DNA, 22 bp, Artificial sequence
  SiRNA target sequence
cttatataaggctctagagatt

SEQ ID NO: 143504 - DNA, 22 bp, Artificial sequence
  SiRNA target sequence
ttatataaggctctagagattt

SEQ ID NO: 143505 - DNA, 22 bp, Artificial sequence
  SiRNA target sequence
tatataaggctctagagattta

SEQ ID NO: 143506 - DNA, 22 bp, Artificial sequence
  SiRNA target sequence
atataaggctctagagatttat

SEQ ID NO: 143507 - DNA, 22 bp, Artificial sequence
  SiRNA target sequence
tataaggctctagagatttata

SEQ ID NO: 143508 - DNA, 22 bp, Artificial sequence
  SiRNA target sequence
ataaggctctagagatttataa

SEQ ID NO: 143509 - DNA, 22 bp, Artificial sequence
  SiRNA target sequence
taaggctctagagatttataac

SEQ ID NO: 143510 - DNA, 22 bp, Artificial sequence
  SiRNA target sequence
aaggctctagagatttataact

SEQ ID NO: 143511 - DNA, 22 bp, Artificial sequence
  SiRNA target sequence
aggctctagagatttataacta

SEQ ID NO: 143512 - DNA, 22 bp, Artificial sequence
  SiRNA target sequence
ggctctagagatttataactat

SEQ ID NO: 143513 - DNA, 22 bp, Artificial sequence
  SiRNA target sequence
gctctagagatttataactata

SEQ ID NO: 143514 - DNA, 22 bp, Artificial sequence
  SiRNA target sequence
ctctagagatttataactatat

SEQ ID NO: 143515 - DNA, 22 bp, Artificial sequence
  SiRNA target sequence
tctagagatttataactatatt

SEQ ID NO: 143516 - DNA, 22 bp, Artificial sequence
  SiRNA target sequence
ctagagatttataactatattt

SEQ ID NO: 143517 - DNA, 22 bp, Artificial sequence
  SiRNA target sequence
tagagatttataactatatttc

SEQ ID NO: 143518 - DNA, 22 bp, Artificial sequence
  SiRNA target sequence
agagatttataactatatttca

SEQ ID NO: 143519 - DNA, 22 bp, Artificial sequence
  SiRNA target sequence
gagatttataactatatttcag

SEQ ID NO: 143520 - DNA, 22 bp, Artificial sequence
  SiRNA target sequence
agatttataactatatttcaga

SEQ ID NO: 143521 - DNA, 22 bp, Artificial sequence
  SiRNA target sequence
gatttataactatatttcagat

SEQ ID NO: 143522 - DNA, 22 bp, Artificial sequence
  SiRNA target sequence
atttataactatatttcagatt

SEQ ID NO: 143523 - DNA, 22 bp, Artificial sequence
  SiRNA target sequence
tttataactatatttcagattt

SEQ ID NO: 143524 - DNA, 22 bp, Artificial sequence
  SiRNA target sequence
ttataactatatttcagatttg

SEQ ID NO: 143525 - DNA, 22 bp, Artificial sequence
  SiRNA target sequence
tataactatatttcagatttgg

SEQ ID NO: 143526 - DNA, 22 bp, Artificial sequence
  SiRNA target sequence
ataactatatttcagatttgga

SEQ ID NO: 143527 - DNA, 22 bp, Artificial sequence
  SiRNA target sequence
taactatatttcagatttggaa

SEQ ID NO: 143528 - DNA, 22 bp, Artificial sequence
  SiRNA target sequence
aactatatttcagatttggaag

SEQ ID NO: 143529 - DNA, 22 bp, Artificial sequence
  SiRNA target sequence
actatatttcagatttggaaga

SEQ ID NO: 143530 - DNA, 22 bp, Artificial sequence
  SiRNA target sequence
ctatatttcagatttggaagag

SEQ ID NO: 143531 - DNA, 22 bp, Artificial sequence
  SiRNA target sequence
tatatttcagatttggaagagt

SEQ ID NO: 143532 - DNA, 22 bp, Artificial sequence
  SiRNA target sequence
atatttcagatttggaagagtg

SEQ ID NO: 143533 - DNA, 22 bp, Artificial sequence
  SiRNA target sequence
tatttcagatttggaagagtga

SEQ ID NO: 143534 - DNA, 22 bp, Artificial sequence
  SiRNA target sequence
atttcagatttggaagagtgaa

SEQ ID NO: 143535 - DNA, 22 bp, Artificial sequence
  SiRNA target sequence
tttcagatttggaagagtgaac

SEQ ID NO: 143536 - DNA, 22 bp, Artificial sequence
  SiRNA target sequence
ttcagatttggaagagtgaaca

SEQ ID NO: 143537 - DNA, 22 bp, Artificial sequence
  SiRNA target sequence
tcagatttggaagagtgaacat

SEQ ID NO: 143538 - DNA, 23 bp, Artificial sequence
  SiRNA target sequence
ttaatttatgcataattgaccat

SEQ ID NO: 143539 - DNA, 23 bp, Artificial sequence
  SiRNA target sequence
taatttatgcataattgaccatc

SEQ ID NO: 143540 - DNA, 23 bp, Artificial sequence
  SiRNA target sequence
aatttatgcataattgaccatca

SEQ ID NO: 143541 - DNA, 23 bp, Artificial sequence
  SiRNA target sequence
atttatgcataattgaccatcat

SEQ ID NO: 143542 - DNA, 23 bp, Artificial sequence
  SiRNA target sequence
tttatgcataattgaccatcatc

SEQ ID NO: 143543 - DNA, 23 bp, Artificial sequence
  SiRNA target sequence
ttatgcataattgaccatcatca

SEQ ID NO: 143544 - DNA, 23 bp, Artificial sequence
  SiRNA target sequence
tatgcataattgaccatcatcag

SEQ ID NO: 143545 - DNA, 23 bp, Artificial sequence
  SiRNA target sequence
atgcataattgaccatcatcagt

SEQ ID NO: 143546 - DNA, 23 bp, Artificial sequence
  SiRNA target sequence
tgcataattgaccatcatcagta

SEQ ID NO: 143547 - DNA, 23 bp, Artificial sequence
  SiRNA target sequence
gcataattgaccatcatcagtaa

SEQ ID NO: 143548 - DNA, 23 bp, Artificial sequence
  SiRNA target sequence
cataattgaccatcatcagtaat

SEQ ID NO: 143549 - DNA, 23 bp, Artificial sequence
  SiRNA target sequence
ataattgaccatcatcagtaata

SEQ ID NO: 143550 - DNA, 23 bp, Artificial sequence
  SiRNA target sequence
taattgaccatcatcagtaataa

SEQ ID NO: 143551 - DNA, 23 bp, Artificial sequence
  SiRNA target sequence
aattgaccatcatcagtaataaa

SEQ ID NO: 143552 - DNA, 23 bp, Artificial sequence
  SiRNA target sequence
attgaccatcatcagtaataaac

SEQ ID NO: 143553 - DNA, 23 bp, Artificial sequence
  SiRNA target sequence
ttgaccatcatcagtaataaaca

SEQ ID NO: 143554 - DNA, 23 bp, Artificial sequence
  SiRNA target sequence
tgaccatcatcagtaataaacac

SEQ ID NO: 143555 - DNA, 23 bp, Artificial sequence
  SiRNA target sequence
gaccatcatcagtaataaacaca

SEQ ID NO: 143556 - DNA, 23 bp, Artificial sequence
  SiRNA target sequence
accatcatcagtaataaacacat

SEQ ID NO: 143557 - DNA, 23 bp, Artificial sequence
  SiRNA target sequence
ccatcatcagtaataaacacatt

SEQ ID NO: 143558 - DNA, 23 bp, Artificial sequence
  SiRNA target sequence
catcatcagtaataaacacatta

SEQ ID NO: 143559 - DNA, 23 bp, Artificial sequence
  SiRNA target sequence
atcatcagtaataaacacattac

SEQ ID NO: 143560 - DNA, 23 bp, Artificial sequence
  SiRNA target sequence
tcatcagtaataaacacattacc

SEQ ID NO: 143561 - DNA, 23 bp, Artificial sequence
  SiRNA target sequence
catcagtaataaacacattacct

SEQ ID NO: 143562 - DNA, 23 bp, Artificial sequence
  SiRNA target sequence
atcagtaataaacacattacctt

SEQ ID NO: 143563 - DNA, 23 bp, Artificial sequence
  SiRNA target sequence
tcagtaataaacacattaccttt

SEQ ID NO: 143564 - DNA, 23 bp, Artificial sequence
  SiRNA target sequence
cagtaataaacacattacctttc

SEQ ID NO: 143565 - DNA, 23 bp, Artificial sequence
  SiRNA target sequence
agtaataaacacattacctttct

SEQ ID NO: 143566 - DNA, 23 bp, Artificial sequence
  SiRNA target sequence
gtaataaacacattacctttctt

SEQ ID NO: 143567 - DNA, 23 bp, Artificial sequence
  SiRNA target sequence
taataaacacattacctttcttt

SEQ ID NO: 143568 - DNA, 23 bp, Artificial sequence
  SiRNA target sequence
aataaacacattacctttctttt

SEQ ID NO: 143569 - DNA, 23 bp, Artificial sequence
  SiRNA target sequence
ataaacacattacctttcttttc

SEQ ID NO: 143570 - DNA, 23 bp, Artificial sequence
  SiRNA target sequence
taaacacattacctttcttttct

SEQ ID NO: 143571 - DNA, 23 bp, Artificial sequence
  SiRNA target sequence
aaacacattacctttcttttcta

SEQ ID NO: 143572 - DNA, 23 bp, Artificial sequence
  SiRNA target sequence
aacacattacctttcttttctac

SEQ ID NO: 143573 - DNA, 23 bp, Artificial sequence
  SiRNA target sequence
acacattacctttcttttctacc

SEQ ID NO: 143574 - DNA, 23 bp, Artificial sequence
  SiRNA target sequence
cacattacctttcttttctacca

SEQ ID NO: 143575 - DNA, 23 bp, Artificial sequence
  SiRNA target sequence
acattacctttcttttctaccac

SEQ ID NO: 143576 - DNA, 23 bp, Artificial sequence
  SiRNA target sequence
cattacctttcttttctaccaca

SEQ ID NO: 143577 - DNA, 23 bp, Artificial sequence
  SiRNA target sequence
attacctttcttttctaccacac

SEQ ID NO: 143578 - DNA, 23 bp, Artificial sequence
  SiRNA target sequence
ttacctttcttttctaccacaca

SEQ ID NO: 143579 - DNA, 23 bp, Artificial sequence
  SiRNA target sequence
tacctttcttttctaccacacat

SEQ ID NO: 143580 - DNA, 23 bp, Artificial sequence
  SiRNA target sequence
acctttcttttctaccacacatt

SEQ ID NO: 143581 - DNA, 23 bp, Artificial sequence
  SiRNA target sequence
cctttcttttctaccacacattt

SEQ ID NO: 143582 - DNA, 23 bp, Artificial sequence
  SiRNA target sequence
ctttcttttctaccacacatttt

SEQ ID NO: 143583 - DNA, 23 bp, Artificial sequence
  SiRNA target sequence
tttcttttctaccacacattttt

SEQ ID NO: 143584 - DNA, 23 bp, Artificial sequence
  SiRNA target sequence
ttcttttctaccacacatttttg

SEQ ID NO: 143585 - DNA, 23 bp, Artificial sequence
  SiRNA target sequence
tcttttctaccacacatttttga

SEQ ID NO: 143586 - DNA, 23 bp, Artificial sequence
  SiRNA target sequence
cttttctaccacacatttttgat

SEQ ID NO: 143587 - DNA, 23 bp, Artificial sequence
  SiRNA target sequence
ttttctaccacacatttttgata

SEQ ID NO: 143588 - DNA, 23 bp, Artificial sequence
  SiRNA target sequence
tttctaccacacatttttgatat

SEQ ID NO: 143589 - DNA, 23 bp, Artificial sequence
  SiRNA target sequence
ttctaccacacatttttgatata

SEQ ID NO: 143590 - DNA, 23 bp, Artificial sequence
  SiRNA target sequence
tctaccacacatttttgatatat

SEQ ID NO: 143591 - DNA, 23 bp, Artificial sequence
  SiRNA target sequence
ctaccacacatttttgatatatt

SEQ ID NO: 143592 - DNA, 23 bp, Artificial sequence
  SiRNA target sequence
taccacacatttttgatatattt

SEQ ID NO: 143593 - DNA, 23 bp, Artificial sequence
  SiRNA target sequence
accacacatttttgatatatttc

SEQ ID NO: 143594 - DNA, 23 bp, Artificial sequence
  SiRNA target sequence
ccacacatttttgatatatttca

SEQ ID NO: 143595 - DNA, 23 bp, Artificial sequence
  SiRNA target sequence
cacacatttttgatatatttcat

SEQ ID NO: 143596 - DNA, 23 bp, Artificial sequence
  SiRNA target sequence
acacatttttgatatatttcatt

SEQ ID NO: 143597 - DNA, 23 bp, Artificial sequence
  SiRNA target sequence
cacatttttgatatatttcatta

SEQ ID NO: 143598 - DNA, 23 bp, Artificial sequence
  SiRNA target sequence
acatttttgatatatttcattaa

SEQ ID NO: 143599 - DNA, 23 bp, Artificial sequence
  SiRNA target sequence
catttttgatatatttcattaac

SEQ ID NO: 143600 - DNA, 23 bp, Artificial sequence
  SiRNA target sequence
atttttgatatatttcattaact

SEQ ID NO: 143601 - DNA, 23 bp, Artificial sequence
  SiRNA target sequence
tttttgatatatttcattaacta

SEQ ID NO: 143602 - DNA, 23 bp, Artificial sequence
  SiRNA target sequence
ttttgatatatttcattaactac

SEQ ID NO: 143603 - DNA, 23 bp, Artificial sequence
  SiRNA target sequence
tttgatatatttcattaactaca

SEQ ID NO: 143604 - DNA, 23 bp, Artificial sequence
  SiRNA target sequence
ttgatatatttcattaactacat

SEQ ID NO: 143605 - DNA, 23 bp, Artificial sequence
  SiRNA target sequence
tgatatatttcattaactacatc

SEQ ID NO: 143606 - DNA, 23 bp, Artificial sequence
  SiRNA target sequence
gatatatttcattaactacatcc

SEQ ID NO: 143607 - DNA, 23 bp, Artificial sequence
  SiRNA target sequence
atatatttcattaactacatccc

SEQ ID NO: 143608 - DNA, 23 bp, Artificial sequence
  SiRNA target sequence
tatatttcattaactacatccca

SEQ ID NO: 143609 - DNA, 23 bp, Artificial sequence
  SiRNA target sequence
atatttcattaactacatcccaa

SEQ ID NO: 143610 - DNA, 23 bp, Artificial sequence
  SiRNA target sequence
tatttcattaactacatcccaat

SEQ ID NO: 143611 - DNA, 23 bp, Artificial sequence
  SiRNA target sequence
atttcattaactacatcccaatc

SEQ ID NO: 143612 - DNA, 23 bp, Artificial sequence
  SiRNA target sequence
tttcattaactacatcccaatca

SEQ ID NO: 143613 - DNA, 23 bp, Artificial sequence
  SiRNA target sequence
ttcattaactacatcccaatcaa

SEQ ID NO: 143614 - DNA, 23 bp, Artificial sequence
  SiRNA target sequence
tcattaactacatcccaatcaat

SEQ ID NO: 143615 - DNA, 23 bp, Artificial sequence
  SiRNA target sequence
cattaactacatcccaatcaatt

SEQ ID NO: 143616 - DNA, 23 bp, Artificial sequence
  SiRNA target sequence
attaactacatcccaatcaatta

SEQ ID NO: 143617 - DNA, 23 bp, Artificial sequence
  SiRNA target sequence
ttaactacatcccaatcaattac

SEQ ID NO: 143618 - DNA, 23 bp, Artificial sequence
  SiRNA target sequence
taactacatcccaatcaattaca

SEQ ID NO: 143619 - DNA, 23 bp, Artificial sequence
  SiRNA target sequence
aactacatcccaatcaattacat

SEQ ID NO: 143620 - DNA, 23 bp, Artificial sequence
  SiRNA target sequence
actacatcccaatcaattacatt

SEQ ID NO: 143621 - DNA, 23 bp, Artificial sequence
  SiRNA target sequence
ctacatcccaatcaattacattc

SEQ ID NO: 143622 - DNA, 23 bp, Artificial sequence
  SiRNA target sequence
tacatcccaatcaattacattcc

SEQ ID NO: 143623 - DNA, 23 bp, Artificial sequence
  SiRNA target sequence
acatcccaatcaattacattcca

SEQ ID NO: 143624 - DNA, 23 bp, Artificial sequence
  SiRNA target sequence
catcccaatcaattacattccac

SEQ ID NO: 143625 - DNA, 23 bp, Artificial sequence
  SiRNA target sequence
atcccaatcaattacattccacc

SEQ ID NO: 143626 - DNA, 23 bp, Artificial sequence
  SiRNA target sequence
tcccaatcaattacattccacca

SEQ ID NO: 143627 - DNA, 23 bp, Artificial sequence
  SiRNA target sequence
cccaatcaattacattccaccat

SEQ ID NO: 143628 - DNA, 23 bp, Artificial sequence
  SiRNA target sequence
ccaatcaattacattccaccatt

SEQ ID NO: 143629 - DNA, 23 bp, Artificial sequence
  SiRNA target sequence
caatcaattacattccaccattc

SEQ ID NO: 143630 - DNA, 23 bp, Artificial sequence
  SiRNA target sequence
aatcaattacattccaccattca

SEQ ID NO: 143631 - DNA, 23 bp, Artificial sequence
  SiRNA target sequence
atcaattacattccaccattcat

SEQ ID NO: 143632 - DNA, 23 bp, Artificial sequence
  SiRNA target sequence
tcaattacattccaccattcatt

SEQ ID NO: 143633 - DNA, 23 bp, Artificial sequence
  SiRNA target sequence
caattacattccaccattcatta

SEQ ID NO: 143634 - DNA, 23 bp, Artificial sequence
  SiRNA target sequence
aattacattccaccattcattaa

SEQ ID NO: 143635 - DNA, 23 bp, Artificial sequence
  SiRNA target sequence
attacattccaccattcattaat

SEQ ID NO: 143636 - DNA, 23 bp, Artificial sequence
  SiRNA target sequence
ttacattccaccattcattaatg

SEQ ID NO: 143637 - DNA, 23 bp, Artificial sequence
  SiRNA target sequence
tacattccaccattcattaatgt

SEQ ID NO: 143638 - DNA, 23 bp, Artificial sequence
  SiRNA target sequence
acattccaccattcattaatgta

SEQ ID NO: 143639 - DNA, 23 bp, Artificial sequence
  SiRNA target sequence
cattccaccattcattaatgtat

SEQ ID NO: 143640 - DNA, 23 bp, Artificial sequence
  SiRNA target sequence
attccaccattcattaatgtatt

SEQ ID NO: 143641 - DNA, 23 bp, Artificial sequence
  SiRNA target sequence
ttccaccattcattaatgtattc

SEQ ID NO: 143642 - DNA, 23 bp, Artificial sequence
  SiRNA target sequence
tccaccattcattaatgtattct

SEQ ID NO: 143643 - DNA, 23 bp, Artificial sequence
  SiRNA target sequence
ccaccattcattaatgtattctt

SEQ ID NO: 143644 - DNA, 23 bp, Artificial sequence
  SiRNA target sequence
caccattcattaatgtattcttt

SEQ ID NO: 143645 - DNA, 23 bp, Artificial sequence
  SiRNA target sequence
accattcattaatgtattctttt

SEQ ID NO: 143646 - DNA, 23 bp, Artificial sequence
  SiRNA target sequence
ccattcattaatgtattcttttc

SEQ ID NO: 143647 - DNA, 23 bp, Artificial sequence
  SiRNA target sequence
cattcattaatgtattcttttct

SEQ ID NO: 143648 - DNA, 23 bp, Artificial sequence
  SiRNA target sequence
attcattaatgtattcttttctc

SEQ ID NO: 143649 - DNA, 23 bp, Artificial sequence
  SiRNA target sequence
ttcattaatgtattcttttctcc

SEQ ID NO: 143650 - DNA, 23 bp, Artificial sequence
  SiRNA target sequence
tcattaatgtattcttttctcct

SEQ ID NO: 143651 - DNA, 23 bp, Artificial sequence
  SiRNA target sequence
cattaatgtattcttttctccta

SEQ ID NO: 143652 - DNA, 23 bp, Artificial sequence
  SiRNA target sequence
attaatgtattcttttctcctat

SEQ ID NO: 143653 - DNA, 23 bp, Artificial sequence
  SiRNA target sequence
ttaatgtattcttttctcctatt

SEQ ID NO: 143654 - DNA, 23 bp, Artificial sequence
  SiRNA target sequence
taatgtattcttttctcctattt

SEQ ID NO: 143655 - DNA, 23 bp, Artificial sequence
  SiRNA target sequence
aatgtattcttttctcctatttt

SEQ ID NO: 143656 - DNA, 23 bp, Artificial sequence
  SiRNA target sequence
atgtattcttttctcctattttt

SEQ ID NO: 143657 - DNA, 23 bp, Artificial sequence
  SiRNA target sequence
tgtattcttttctcctattttta

SEQ ID NO: 143658 - DNA, 23 bp, Artificial sequence
  SiRNA target sequence
gtattcttttctcctatttttat

SEQ ID NO: 143659 - DNA, 23 bp, Artificial sequence
  SiRNA target sequence
tattcttttctcctatttttata

SEQ ID NO: 143660 - DNA, 23 bp, Artificial sequence
  SiRNA target sequence
attcttttctcctatttttatac

SEQ ID NO: 143661 - DNA, 23 bp, Artificial sequence
  SiRNA target sequence
ttcttttctcctatttttatact

SEQ ID NO: 143662 - DNA, 23 bp, Artificial sequence
  SiRNA target sequence
tcttttctcctatttttatactg

SEQ ID NO: 143663 - DNA, 23 bp, Artificial sequence
  SiRNA target sequence
cttttctcctatttttatactgt

SEQ ID NO: 143664 - DNA, 23 bp, Artificial sequence
  SiRNA target sequence
ttttctcctatttttatactgta

SEQ ID NO: 143665 - DNA, 23 bp, Artificial sequence
  SiRNA target sequence
tttctcctatttttatactgtaa

SEQ ID NO: 143666 - DNA, 23 bp, Artificial sequence
  SiRNA target sequence
ttctcctatttttatactgtaaa

SEQ ID NO: 143667 - DNA, 23 bp, Artificial sequence
  SiRNA target sequence
tctcctatttttatactgtaaat

SEQ ID NO: 143668 - DNA, 23 bp, Artificial sequence
  SiRNA target sequence
ctcctatttttatactgtaaata

SEQ ID NO: 143669 - DNA, 23 bp, Artificial sequence
  SiRNA target sequence
tcctatttttatactgtaaataa

SEQ ID NO: 143670 - DNA, 23 bp, Artificial sequence
  SiRNA target sequence
cctatttttatactgtaaataat

SEQ ID NO: 143671 - DNA, 23 bp, Artificial sequence
  SiRNA target sequence
ctatttttatactgtaaataata

SEQ ID NO: 143672 - DNA, 23 bp, Artificial sequence
  SiRNA target sequence
tatttttatactgtaaataatac

SEQ ID NO: 143673 - DNA, 23 bp, Artificial sequence
  SiRNA target sequence
atttttatactgtaaataatacg

SEQ ID NO: 143674 - DNA, 23 bp, Artificial sequence
  SiRNA target sequence
tttttatactgtaaataatacgc

SEQ ID NO: 143675 - DNA, 23 bp, Artificial sequence
  SiRNA target sequence
ttttatactgtaaataatacgca

SEQ ID NO: 143676 - DNA, 23 bp, Artificial sequence
  SiRNA target sequence
tttatactgtaaataatacgcat

SEQ ID NO: 143677 - DNA, 23 bp, Artificial sequence
  SiRNA target sequence
ttatactgtaaataatacgcatg

SEQ ID NO: 143678 - DNA, 23 bp, Artificial sequence
  SiRNA target sequence
tatactgtaaataatacgcatgt

SEQ ID NO: 143679 - DNA, 23 bp, Artificial sequence
  SiRNA target sequence
atactgtaaataatacgcatgtt

SEQ ID NO: 143680 - DNA, 23 bp, Artificial sequence
  SiRNA target sequence
tactgtaaataatacgcatgttc

SEQ ID NO: 143681 - DNA, 23 bp, Artificial sequence
  SiRNA target sequence
actgtaaataatacgcatgttcc

SEQ ID NO: 143682 - DNA, 23 bp, Artificial sequence
  SiRNA target sequence
ctgtaaataatacgcatgttccc

SEQ ID NO: 143683 - DNA, 23 bp, Artificial sequence
  SiRNA target sequence
tgtaaataatacgcatgttccca

SEQ ID NO: 143684 - DNA, 23 bp, Artificial sequence
  SiRNA target sequence
gtaaataatacgcatgttcccat

SEQ ID NO: 143685 - DNA, 23 bp, Artificial sequence
  SiRNA target sequence
taaataatacgcatgttcccata

SEQ ID NO: 143686 - DNA, 23 bp, Artificial sequence
  SiRNA target sequence
aaataatacgcatgttcccatac

SEQ ID NO: 143687 - DNA, 23 bp, Artificial sequence
  SiRNA target sequence
aataatacgcatgttcccataca

SEQ ID NO: 143688 - DNA, 23 bp, Artificial sequence
  SiRNA target sequence
ataatacgcatgttcccatacat

SEQ ID NO: 143689 - DNA, 23 bp, Artificial sequence
  SiRNA target sequence
taatacgcatgttcccatacatc

SEQ ID NO: 143690 - DNA, 23 bp, Artificial sequence
  SiRNA target sequence
aatacgcatgttcccatacatca

SEQ ID NO: 143691 - DNA, 23 bp, Artificial sequence
  SiRNA target sequence
atacgcatgttcccatacatcaa

SEQ ID NO: 143692 - DNA, 23 bp, Artificial sequence
  SiRNA target sequence
tacgcatgttcccatacatcaag

SEQ ID NO: 143693 - DNA, 23 bp, Artificial sequence
  SiRNA target sequence
acgcatgttcccatacatcaaga

SEQ ID NO: 143694 - DNA, 23 bp, Artificial sequence
  SiRNA target sequence
cgcatgttcccatacatcaagac

SEQ ID NO: 143695 - DNA, 23 bp, Artificial sequence
  SiRNA target sequence
gcatgttcccatacatcaagaca

SEQ ID NO: 143696 - DNA, 23 bp, Artificial sequence
  SiRNA target sequence
catgttcccatacatcaagacat

SEQ ID NO: 143697 - DNA, 23 bp, Artificial sequence
  SiRNA target sequence
atgttcccatacatcaagacata

SEQ ID NO: 143698 - DNA, 23 bp, Artificial sequence
  SiRNA target sequence
tgttcccatacatcaagacatag

SEQ ID NO: 143699 - DNA, 23 bp, Artificial sequence
  SiRNA target sequence
gttcccatacatcaagacatagt

SEQ ID NO: 143700 - DNA, 23 bp, Artificial sequence
  SiRNA target sequence
ttcccatacatcaagacatagta

SEQ ID NO: 143701 - DNA, 23 bp, Artificial sequence
  SiRNA target sequence
tcccatacatcaagacatagtaa

SEQ ID NO: 143702 - DNA, 23 bp, Artificial sequence
  SiRNA target sequence
cccatacatcaagacatagtaaa

SEQ ID NO: 143703 - DNA, 23 bp, Artificial sequence
  SiRNA target sequence
ccatacatcaagacatagtaaag

SEQ ID NO: 143704 - DNA, 23 bp, Artificial sequence
  SiRNA target sequence
catacatcaagacatagtaaagg

SEQ ID NO: 143705 - DNA, 23 bp, Artificial sequence
  SiRNA target sequence
atacatcaagacatagtaaagga

SEQ ID NO: 143706 - DNA, 23 bp, Artificial sequence
  SiRNA target sequence
tacatcaagacatagtaaaggaa

SEQ ID NO: 143707 - DNA, 23 bp, Artificial sequence
  SiRNA target sequence
acatcaagacatagtaaaggaat

SEQ ID NO: 143708 - DNA, 23 bp, Artificial sequence
  SiRNA target sequence
catcaagacatagtaaaggaata

SEQ ID NO: 143709 - DNA, 23 bp, Artificial sequence
  SiRNA target sequence
atcaagacatagtaaaggaatac

SEQ ID NO: 143710 - DNA, 23 bp, Artificial sequence
  SiRNA target sequence
tcaagacatagtaaaggaataca

SEQ ID NO: 143711 - DNA, 23 bp, Artificial sequence
  SiRNA target sequence
caagacatagtaaaggaatacat

SEQ ID NO: 143712 - DNA, 23 bp, Artificial sequence
  SiRNA target sequence
aagacatagtaaaggaatacatt

SEQ ID NO: 143713 - DNA, 23 bp, Artificial sequence
  SiRNA target sequence
agacatagtaaaggaatacattc

SEQ ID NO: 143714 - DNA, 23 bp, Artificial sequence
  SiRNA target sequence
gacatagtaaaggaatacattca

SEQ ID NO: 143715 - DNA, 23 bp, Artificial sequence
  SiRNA target sequence
acatagtaaaggaatacattcac

SEQ ID NO: 143716 - DNA, 23 bp, Artificial sequence
  SiRNA target sequence
catagtaaaggaatacattcacc

SEQ ID NO: 143717 - DNA, 23 bp, Artificial sequence
  SiRNA target sequence
atagtaaaggaatacattcacca

SEQ ID NO: 143718 - DNA, 23 bp, Artificial sequence
  SiRNA target sequence
tagtaaaggaatacattcaccat

SEQ ID NO: 143719 - DNA, 23 bp, Artificial sequence
  SiRNA target sequence
agtaaaggaatacattcaccatc

SEQ ID NO: 143720 - DNA, 23 bp, Artificial sequence
  SiRNA target sequence
gtaaaggaatacattcaccatcc

SEQ ID NO: 143721 - DNA, 23 bp, Artificial sequence
  SiRNA target sequence
taaaggaatacattcaccatcct

SEQ ID NO: 143722 - DNA, 23 bp, Artificial sequence
  SiRNA target sequence
aaaggaatacattcaccatcctc

SEQ ID NO: 143723 - DNA, 23 bp, Artificial sequence
  SiRNA target sequence
aaggaatacattcaccatcctcc

SEQ ID NO: 143724 - DNA, 23 bp, Artificial sequence
  SiRNA target sequence
aggaatacattcaccatcctcca

SEQ ID NO: 143725 - DNA, 23 bp, Artificial sequence
  SiRNA target sequence
ggaatacattcaccatcctccat

SEQ ID NO: 143726 - DNA, 23 bp, Artificial sequence
  SiRNA target sequence
gaatacattcaccatcctccatc

SEQ ID NO: 143727 - DNA, 23 bp, Artificial sequence
  SiRNA target sequence
aatacattcaccatcctccatca

SEQ ID NO: 143728 - DNA, 23 bp, Artificial sequence
  SiRNA target sequence
atacattcaccatcctccatcat

SEQ ID NO: 143729 - DNA, 23 bp, Artificial sequence
  SiRNA target sequence
tacattcaccatcctccatcata

SEQ ID NO: 143730 - DNA, 23 bp, Artificial sequence
  SiRNA target sequence
acattcaccatcctccatcatag

SEQ ID NO: 143731 - DNA, 23 bp, Artificial sequence
  SiRNA target sequence
cattcaccatcctccatcatagg

SEQ ID NO: 143732 - DNA, 23 bp, Artificial sequence
  SiRNA target sequence
attcaccatcctccatcatagga

SEQ ID NO: 143733 - DNA, 23 bp, Artificial sequence
  SiRNA target sequence
ttcaccatcctccatcataggat

SEQ ID NO: 143734 - DNA, 23 bp, Artificial sequence
  SiRNA target sequence
tcaccatcctccatcataggatt

SEQ ID NO: 143735 - DNA, 23 bp, Artificial sequence
  SiRNA target sequence
caccatcctccatcataggattg

SEQ ID NO: 143736 - DNA, 23 bp, Artificial sequence
  SiRNA target sequence
accatcctccatcataggattgt

SEQ ID NO: 143737 - DNA, 23 bp, Artificial sequence
  SiRNA target sequence
ccatcctccatcataggattgtc

SEQ ID NO: 143738 - DNA, 23 bp, Artificial sequence
  SiRNA target sequence
catcctccatcataggattgtct

SEQ ID NO: 143739 - DNA, 23 bp, Artificial sequence
  SiRNA target sequence
atcctccatcataggattgtctt

SEQ ID NO: 143740 - DNA, 23 bp, Artificial sequence
  SiRNA target sequence
tcctccatcataggattgtcttg

SEQ ID NO: 143741 - DNA, 23 bp, Artificial sequence
  SiRNA target sequence
cctccatcataggattgtcttga

SEQ ID NO: 143742 - DNA, 23 bp, Artificial sequence
  SiRNA target sequence
ctccatcataggattgtcttgat

SEQ ID NO: 143743 - DNA, 23 bp, Artificial sequence
  SiRNA target sequence
tccatcataggattgtcttgatt

SEQ ID NO: 143744 - DNA, 23 bp, Artificial sequence
  SiRNA target sequence
ccatcataggattgtcttgatta

SEQ ID NO: 143745 - DNA, 23 bp, Artificial sequence
  SiRNA target sequence
catcataggattgtcttgattaa

SEQ ID NO: 143746 - DNA, 23 bp, Artificial sequence
  SiRNA target sequence
atcataggattgtcttgattaac

SEQ ID NO: 143747 - DNA, 23 bp, Artificial sequence
  SiRNA target sequence
tcataggattgtcttgattaaca

SEQ ID NO: 143748 - DNA, 23 bp, Artificial sequence
  SiRNA target sequence
cataggattgtcttgattaacac

SEQ ID NO: 143749 - DNA, 23 bp, Artificial sequence
  SiRNA target sequence
ataggattgtcttgattaacact

SEQ ID NO: 143750 - DNA, 23 bp, Artificial sequence
  SiRNA target sequence
taggattgtcttgattaacactg

SEQ ID NO: 143751 - DNA, 23 bp, Artificial sequence
  SiRNA target sequence
aggattgtcttgattaacactgg

SEQ ID NO: 143752 - DNA, 23 bp, Artificial sequence
  SiRNA target sequence
ggattgtcttgattaacactggt

SEQ ID NO: 143753 - DNA, 23 bp, Artificial sequence
  SiRNA target sequence
gattgtcttgattaacactggtc

SEQ ID NO: 143754 - DNA, 23 bp, Artificial sequence
  SiRNA target sequence
attgtcttgattaacactggtct

SEQ ID NO: 143755 - DNA, 23 bp, Artificial sequence
  SiRNA target sequence
ttgtcttgattaacactggtctt

SEQ ID NO: 143756 - DNA, 23 bp, Artificial sequence
  SiRNA target sequence
tgtcttgattaacactggtctta

SEQ ID NO: 143757 - DNA, 23 bp, Artificial sequence
  SiRNA target sequence
gtcttgattaacactggtcttaa

SEQ ID NO: 143758 - DNA, 23 bp, Artificial sequence
  SiRNA target sequence
tcttgattaacactggtcttaat

SEQ ID NO: 143759 - DNA, 23 bp, Artificial sequence
  SiRNA target sequence
cttgattaacactggtcttaata

SEQ ID NO: 143760 - DNA, 23 bp, Artificial sequence
  SiRNA target sequence
ttgattaacactggtcttaatac

SEQ ID NO: 143761 - DNA, 23 bp, Artificial sequence
  SiRNA target sequence
tgattaacactggtcttaataca

SEQ ID NO: 143762 - DNA, 23 bp, Artificial sequence
  SiRNA target sequence
gattaacactggtcttaatacac

SEQ ID NO: 143763 - DNA, 23 bp, Artificial sequence
  SiRNA target sequence
attaacactggtcttaatacaca

SEQ ID NO: 143764 - DNA, 23 bp, Artificial sequence
  SiRNA target sequence
ttaacactggtcttaatacacaa

SEQ ID NO: 143765 - DNA, 23 bp, Artificial sequence
  SiRNA target sequence
taacactggtcttaatacacaat

SEQ ID NO: 143766 - DNA, 23 bp, Artificial sequence
  SiRNA target sequence
aacactggtcttaatacacaatt

SEQ ID NO: 143767 - DNA, 23 bp, Artificial sequence
  SiRNA target sequence
acactggtcttaatacacaattt

SEQ ID NO: 143768 - DNA, 23 bp, Artificial sequence
  SiRNA target sequence
cactggtcttaatacacaattta

SEQ ID NO: 143769 - DNA, 23 bp, Artificial sequence
  SiRNA target sequence
actggtcttaatacacaatttat

SEQ ID NO: 143770 - DNA, 23 bp, Artificial sequence
  SiRNA target sequence
ctggtcttaatacacaatttatc

SEQ ID NO: 143771 - DNA, 23 bp, Artificial sequence
  SiRNA target sequence
tggtcttaatacacaatttatct

SEQ ID NO: 143772 - DNA, 23 bp, Artificial sequence
  SiRNA target sequence
ggtcttaatacacaatttatctt

SEQ ID NO: 143773 - DNA, 23 bp, Artificial sequence
  SiRNA target sequence
gtcttaatacacaatttatcttt

SEQ ID NO: 143774 - DNA, 23 bp, Artificial sequence
  SiRNA target sequence
tcttaatacacaatttatcttta

SEQ ID NO: 143775 - DNA, 23 bp, Artificial sequence
  SiRNA target sequence
cttaatacacaatttatctttat

SEQ ID NO: 143776 - DNA, 23 bp, Artificial sequence
  SiRNA target sequence
ttaatacacaatttatctttata

SEQ ID NO: 143777 - DNA, 23 bp, Artificial sequence
  SiRNA target sequence
taatacacaatttatctttatat

SEQ ID NO: 143778 - DNA, 23 bp, Artificial sequence
  SiRNA target sequence
aatacacaatttatctttatata

SEQ ID NO: 143779 - DNA, 23 bp, Artificial sequence
  SiRNA target sequence
atacacaatttatctttatatat

SEQ ID NO: 143780 - DNA, 23 bp, Artificial sequence
  SiRNA target sequence
tacacaatttatctttatatatc

SEQ ID NO: 143781 - DNA, 23 bp, Artificial sequence
  SiRNA target sequence
acacaatttatctttatatatca

SEQ ID NO: 143782 - DNA, 23 bp, Artificial sequence
  SiRNA target sequence
cacaatttatctttatatatcaa

SEQ ID NO: 143783 - DNA, 23 bp, Artificial sequence
  SiRNA target sequence
acaatttatctttatatatcaac

SEQ ID NO: 143784 - DNA, 23 bp, Artificial sequence
  SiRNA target sequence
caatttatctttatatatcaacc

SEQ ID NO: 143785 - DNA, 23 bp, Artificial sequence
  SiRNA target sequence
aatttatctttatatatcaacca

SEQ ID NO: 143786 - DNA, 23 bp, Artificial sequence
  SiRNA target sequence
atttatctttatatatcaaccac

SEQ ID NO: 143787 - DNA, 23 bp, Artificial sequence
  SiRNA target sequence
tttatctttatatatcaaccaca

SEQ ID NO: 143788 - DNA, 23 bp, Artificial sequence
  SiRNA target sequence
ttatctttatatatcaaccacac

SEQ ID NO: 143789 - DNA, 23 bp, Artificial sequence
  SiRNA target sequence
tatctttatatatcaaccacacc

SEQ ID NO: 143790 - DNA, 23 bp, Artificial sequence
  SiRNA target sequence
atctttatatatcaaccacaccc

SEQ ID NO: 143791 - DNA, 23 bp, Artificial sequence
  SiRNA target sequence
tctttatatatcaaccacaccca

SEQ ID NO: 143792 - DNA, 23 bp, Artificial sequence
  SiRNA target sequence
ctttatatatcaaccacacccat

SEQ ID NO: 143793 - DNA, 23 bp, Artificial sequence
  SiRNA target sequence
tttatatatcaaccacacccatc

SEQ ID NO: 143794 - DNA, 23 bp, Artificial sequence
  SiRNA target sequence
ttatatatcaaccacacccatcc

SEQ ID NO: 143795 - DNA, 23 bp, Artificial sequence
  SiRNA target sequence
tatatatcaaccacacccatcct

SEQ ID NO: 143796 - DNA, 23 bp, Artificial sequence
  SiRNA target sequence
atatatcaaccacacccatcctg

SEQ ID NO: 143797 - DNA, 23 bp, Artificial sequence
  SiRNA target sequence
tatatcaaccacacccatcctga

SEQ ID NO: 143798 - DNA, 23 bp, Artificial sequence
  SiRNA target sequence
atatcaaccacacccatcctgat

SEQ ID NO: 143799 - DNA, 23 bp, Artificial sequence
  SiRNA target sequence
tatcaaccacacccatcctgatc

SEQ ID NO: 143800 - DNA, 23 bp, Artificial sequence
  SiRNA target sequence
atcaaccacacccatcctgatcc

SEQ ID NO: 143801 - DNA, 23 bp, Artificial sequence
  SiRNA target sequence
tcaaccacacccatcctgatcca

SEQ ID NO: 143802 - DNA, 23 bp, Artificial sequence
  SiRNA target sequence
caaccacacccatcctgatccaa

SEQ ID NO: 143803 - DNA, 23 bp, Artificial sequence
  SiRNA target sequence
aaccacacccatcctgatccaaa

SEQ ID NO: 143804 - DNA, 23 bp, Artificial sequence
  SiRNA target sequence
accacacccatcctgatccaaat

SEQ ID NO: 143805 - DNA, 23 bp, Artificial sequence
  SiRNA target sequence
ccacacccatcctgatccaaata

SEQ ID NO: 143806 - DNA, 23 bp, Artificial sequence
  SiRNA target sequence
cacacccatcctgatccaaataa

SEQ ID NO: 143807 - DNA, 23 bp, Artificial sequence
  SiRNA target sequence
acacccatcctgatccaaataat

SEQ ID NO: 143808 - DNA, 23 bp, Artificial sequence
  SiRNA target sequence
cacccatcctgatccaaataatt

SEQ ID NO: 143809 - DNA, 23 bp, Artificial sequence
  SiRNA target sequence
acccatcctgatccaaataattt

SEQ ID NO: 143810 - DNA, 23 bp, Artificial sequence
  SiRNA target sequence
cccatcctgatccaaataatttt

SEQ ID NO: 143811 - DNA, 23 bp, Artificial sequence
  SiRNA target sequence
ccatcctgatccaaataatttta

SEQ ID NO: 143812 - DNA, 23 bp, Artificial sequence
  SiRNA target sequence
catcctgatccaaataattttac

SEQ ID NO: 143813 - DNA, 23 bp, Artificial sequence
  SiRNA target sequence
atcctgatccaaataattttaca

SEQ ID NO: 143814 - DNA, 23 bp, Artificial sequence
  SiRNA target sequence
tcctgatccaaataattttacag

SEQ ID NO: 143815 - DNA, 23 bp, Artificial sequence
  SiRNA target sequence
cctgatccaaataattttacagc

SEQ ID NO: 143816 - DNA, 23 bp, Artificial sequence
  SiRNA target sequence
ctgatccaaataattttacagct

SEQ ID NO: 143817 - DNA, 23 bp, Artificial sequence
  SiRNA target sequence
tgatccaaataattttacagctt

SEQ ID NO: 143818 - DNA, 23 bp, Artificial sequence
  SiRNA target sequence
gatccaaataattttacagcttc

SEQ ID NO: 143819 - DNA, 23 bp, Artificial sequence
  SiRNA target sequence
atccaaataattttacagcttca

SEQ ID NO: 143820 - DNA, 23 bp, Artificial sequence
  SiRNA target sequence
tccaaataattttacagcttcag

SEQ ID NO: 143821 - DNA, 23 bp, Artificial sequence
  SiRNA target sequence
ccaaataattttacagcttcagt

SEQ ID NO: 143822 - DNA, 23 bp, Artificial sequence
  SiRNA target sequence
caaataattttacagcttcagta

SEQ ID NO: 143823 - DNA, 23 bp, Artificial sequence
  SiRNA target sequence
aaataattttacagcttcagtat

SEQ ID NO: 143824 - DNA, 23 bp, Artificial sequence
  SiRNA target sequence
aataattttacagcttcagtatt

SEQ ID NO: 143825 - DNA, 23 bp, Artificial sequence
  SiRNA target sequence
ataattttacagcttcagtatta

SEQ ID NO: 143826 - DNA, 23 bp, Artificial sequence
  SiRNA target sequence
taattttacagcttcagtattaa

SEQ ID NO: 143827 - DNA, 23 bp, Artificial sequence
  SiRNA target sequence
aattttacagcttcagtattaaa

SEQ ID NO: 143828 - DNA, 23 bp, Artificial sequence
  SiRNA target sequence
attttacagcttcagtattaaaa

SEQ ID NO: 143829 - DNA, 23 bp, Artificial sequence
  SiRNA target sequence
ttttacagcttcagtattaaaat

SEQ ID NO: 143830 - DNA, 23 bp, Artificial sequence
  SiRNA target sequence
tttacagcttcagtattaaaatt

SEQ ID NO: 143831 - DNA, 23 bp, Artificial sequence
  SiRNA target sequence
ttacagcttcagtattaaaattc

SEQ ID NO: 143832 - DNA, 23 bp, Artificial sequence
  SiRNA target sequence
tacagcttcagtattaaaattct

SEQ ID NO: 143833 - DNA, 23 bp, Artificial sequence
  SiRNA target sequence
acagcttcagtattaaaattctc

SEQ ID NO: 143834 - DNA, 23 bp, Artificial sequence
  SiRNA target sequence
cagcttcagtattaaaattctcc

SEQ ID NO: 143835 - DNA, 23 bp, Artificial sequence
  SiRNA target sequence
agcttcagtattaaaattctcct

SEQ ID NO: 143836 - DNA, 23 bp, Artificial sequence
  SiRNA target sequence
gcttcagtattaaaattctcctt

SEQ ID NO: 143837 - DNA, 23 bp, Artificial sequence
  SiRNA target sequence
cttcagtattaaaattctcctta

SEQ ID NO: 143838 - DNA, 23 bp, Artificial sequence
  SiRNA target sequence
ttcagtattaaaattctccttaa

SEQ ID NO: 143839 - DNA, 23 bp, Artificial sequence
  SiRNA target sequence
tcagtattaaaattctccttaaa

SEQ ID NO: 143840 - DNA, 23 bp, Artificial sequence
  SiRNA target sequence
cagtattaaaattctccttaaat

SEQ ID NO: 143841 - DNA, 23 bp, Artificial sequence
  SiRNA target sequence
agtattaaaattctccttaaatt

SEQ ID NO: 143842 - DNA, 23 bp, Artificial sequence
  SiRNA target sequence
gtattaaaattctccttaaattt

SEQ ID NO: 143843 - DNA, 23 bp, Artificial sequence
  SiRNA target sequence
tattaaaattctccttaaattta

SEQ ID NO: 143844 - DNA, 23 bp, Artificial sequence
  SiRNA target sequence
attaaaattctccttaaatttat

SEQ ID NO: 143845 - DNA, 23 bp, Artificial sequence
  SiRNA target sequence
ttaaaattctccttaaatttatt

SEQ ID NO: 143846 - DNA, 23 bp, Artificial sequence
  SiRNA target sequence
taaaattctccttaaatttattt

SEQ ID NO: 143847 - DNA, 23 bp, Artificial sequence
  SiRNA target sequence
aaaattctccttaaatttattta

SEQ ID NO: 143848 - DNA, 23 bp, Artificial sequence
  SiRNA target sequence
aaattctccttaaatttatttat

SEQ ID NO: 143849 - DNA, 23 bp, Artificial sequence
  SiRNA target sequence
aattctccttaaatttatttatt

SEQ ID NO: 143850 - DNA, 23 bp, Artificial sequence
  SiRNA target sequence
attctccttaaatttatttattg

SEQ ID NO: 143851 - DNA, 23 bp, Artificial sequence
  SiRNA target sequence
ttctccttaaatttatttattga

SEQ ID NO: 143852 - DNA, 23 bp, Artificial sequence
  SiRNA target sequence
tctccttaaatttatttattgat

SEQ ID NO: 143853 - DNA, 23 bp, Artificial sequence
  SiRNA target sequence
ctccttaaatttatttattgatc

SEQ ID NO: 143854 - DNA, 23 bp, Artificial sequence
  SiRNA target sequence
tccttaaatttatttattgatcc

SEQ ID NO: 143855 - DNA, 23 bp, Artificial sequence
  SiRNA target sequence
ccttaaatttatttattgatcca

SEQ ID NO: 143856 - DNA, 23 bp, Artificial sequence
  SiRNA target sequence
cttaaatttatttattgatccaa

SEQ ID NO: 143857 - DNA, 23 bp, Artificial sequence
  SiRNA target sequence
ttaaatttatttattgatccaaa

SEQ ID NO: 143858 - DNA, 23 bp, Artificial sequence
  SiRNA target sequence
taaatttatttattgatccaaag

SEQ ID NO: 143859 - DNA, 23 bp, Artificial sequence
  SiRNA target sequence
aaatttatttattgatccaaagt

SEQ ID NO: 143860 - DNA, 23 bp, Artificial sequence
  SiRNA target sequence
aatttatttattgatccaaagtc

SEQ ID NO: 143861 - DNA, 23 bp, Artificial sequence
  SiRNA target sequence
atttatttattgatccaaagtct

SEQ ID NO: 143862 - DNA, 23 bp, Artificial sequence
  SiRNA target sequence
tttatttattgatccaaagtctt

SEQ ID NO: 143863 - DNA, 23 bp, Artificial sequence
  SiRNA target sequence
ttatttattgatccaaagtcttt

SEQ ID NO: 143864 - DNA, 23 bp, Artificial sequence
  SiRNA target sequence
tatttattgatccaaagtctttt

SEQ ID NO: 143865 - DNA, 23 bp, Artificial sequence
  SiRNA target sequence
atttattgatccaaagtctttta

SEQ ID NO: 143866 - DNA, 23 bp, Artificial sequence
  SiRNA target sequence
tttattgatccaaagtcttttat

SEQ ID NO: 143867 - DNA, 23 bp, Artificial sequence
  SiRNA target sequence
ttattgatccaaagtcttttatt

SEQ ID NO: 143868 - DNA, 23 bp, Artificial sequence
  SiRNA target sequence
tattgatccaaagtcttttatta

SEQ ID NO: 143869 - DNA, 23 bp, Artificial sequence
  SiRNA target sequence
attgatccaaagtcttttattat

SEQ ID NO: 143870 - DNA, 23 bp, Artificial sequence
  SiRNA target sequence
ttgatccaaagtcttttattata

SEQ ID NO: 143871 - DNA, 23 bp, Artificial sequence
  SiRNA target sequence
tgatccaaagtcttttattatag

SEQ ID NO: 143872 - DNA, 23 bp, Artificial sequence
  SiRNA target sequence
gatccaaagtcttttattatagc

SEQ ID NO: 143873 - DNA, 23 bp, Artificial sequence
  SiRNA target sequence
atccaaagtcttttattatagca

SEQ ID NO: 143874 - DNA, 23 bp, Artificial sequence
  SiRNA target sequence
tccaaagtcttttattatagcac

SEQ ID NO: 143875 - DNA, 23 bp, Artificial sequence
  SiRNA target sequence
ccaaagtcttttattatagcact

SEQ ID NO: 143876 - DNA, 23 bp, Artificial sequence
  SiRNA target sequence
caaagtcttttattatagcactt

SEQ ID NO: 143877 - DNA, 23 bp, Artificial sequence
  SiRNA target sequence
aaagtcttttattatagcacttt

SEQ ID NO: 143878 - DNA, 23 bp, Artificial sequence
  SiRNA target sequence
aagtcttttattatagcactttc

SEQ ID NO: 143879 - DNA, 23 bp, Artificial sequence
  SiRNA target sequence
agtcttttattatagcactttcc

SEQ ID NO: 143880 - DNA, 23 bp, Artificial sequence
  SiRNA target sequence
gtcttttattatagcactttcca

SEQ ID NO: 143881 - DNA, 23 bp, Artificial sequence
  SiRNA target sequence
tcttttattatagcactttccaa

SEQ ID NO: 143882 - DNA, 23 bp, Artificial sequence
  SiRNA target sequence
cttttattatagcactttccaac

SEQ ID NO: 143883 - DNA, 23 bp, Artificial sequence
  SiRNA target sequence
ttttattatagcactttccaact

SEQ ID NO: 143884 - DNA, 23 bp, Artificial sequence
  SiRNA target sequence
tttattatagcactttccaactg

SEQ ID NO: 143885 - DNA, 23 bp, Artificial sequence
  SiRNA target sequence
ttattatagcactttccaactgg

SEQ ID NO: 143886 - DNA, 23 bp, Artificial sequence
  SiRNA target sequence
tattatagcactttccaactggg

SEQ ID NO: 143887 - DNA, 23 bp, Artificial sequence
  SiRNA target sequence
attatagcactttccaactggga

SEQ ID NO: 143888 - DNA, 23 bp, Artificial sequence
  SiRNA target sequence
ttatagcactttccaactgggaa

SEQ ID NO: 143889 - DNA, 23 bp, Artificial sequence
  SiRNA target sequence
tatagcactttccaactgggaag

SEQ ID NO: 143890 - DNA, 23 bp, Artificial sequence
  SiRNA target sequence
atagcactttccaactgggaaga

SEQ ID NO: 143891 - DNA, 23 bp, Artificial sequence
  SiRNA target sequence
tagcactttccaactgggaagaa

SEQ ID NO: 143892 - DNA, 23 bp, Artificial sequence
  SiRNA target sequence
agcactttccaactgggaagaaa

SEQ ID NO: 143893 - DNA, 23 bp, Artificial sequence
  SiRNA target sequence
gcactttccaactgggaagaaat

SEQ ID NO: 143894 - DNA, 23 bp, Artificial sequence
  SiRNA target sequence
cactttccaactgggaagaaatc

SEQ ID NO: 143895 - DNA, 23 bp, Artificial sequence
  SiRNA target sequence
actttccaactgggaagaaatct

SEQ ID NO: 143896 - DNA, 23 bp, Artificial sequence
  SiRNA target sequence
ctttccaactgggaagaaatctt

SEQ ID NO: 143897 - DNA, 23 bp, Artificial sequence
  SiRNA target sequence
tttccaactgggaagaaatcttt

SEQ ID NO: 143898 - DNA, 23 bp, Artificial sequence
  SiRNA target sequence
ttccaactgggaagaaatctttt

SEQ ID NO: 143899 - DNA, 23 bp, Artificial sequence
  SiRNA target sequence
tccaactgggaagaaatcttttt

SEQ ID NO: 143900 - DNA, 23 bp, Artificial sequence
  SiRNA target sequence
ccaactgggaagaaatcttttta

SEQ ID NO: 143901 - DNA, 23 bp, Artificial sequence
  SiRNA target sequence
caactgggaagaaatctttttat

SEQ ID NO: 143902 - DNA, 23 bp, Artificial sequence
  SiRNA target sequence
aactgggaagaaatctttttatt

SEQ ID NO: 143903 - DNA, 23 bp, Artificial sequence
  SiRNA target sequence
actgggaagaaatctttttattt

SEQ ID NO: 143904 - DNA, 23 bp, Artificial sequence
  SiRNA target sequence
ctgggaagaaatctttttatttt

SEQ ID NO: 143905 - DNA, 23 bp, Artificial sequence
  SiRNA target sequence
tgggaagaaatctttttattttc

SEQ ID NO: 143906 - DNA, 23 bp, Artificial sequence
  SiRNA target sequence
gggaagaaatctttttattttct

SEQ ID NO: 143907 - DNA, 23 bp, Artificial sequence
  SiRNA target sequence
ggaagaaatctttttattttctg

SEQ ID NO: 143908 - DNA, 23 bp, Artificial sequence
  SiRNA target sequence
gaagaaatctttttattttctgg

SEQ ID NO: 143909 - DNA, 23 bp, Artificial sequence
  SiRNA target sequence
aagaaatctttttattttctggt

SEQ ID NO: 143910 - DNA, 23 bp, Artificial sequence
  SiRNA target sequence
agaaatctttttattttctggtg

SEQ ID NO: 143911 - DNA, 23 bp, Artificial sequence
  SiRNA target sequence
gaaatctttttattttctggtga

SEQ ID NO: 143912 - DNA, 23 bp, Artificial sequence
  SiRNA target sequence
aaatctttttattttctggtgac

SEQ ID NO: 143913 - DNA, 23 bp, Artificial sequence
  SiRNA target sequence
aatctttttattttctggtgaca

SEQ ID NO: 143914 - DNA, 23 bp, Artificial sequence
  SiRNA target sequence
atctttttattttctggtgacat

SEQ ID NO: 143915 - DNA, 23 bp, Artificial sequence
  SiRNA target sequence
tctttttattttctggtgacatt

SEQ ID NO: 143916 - DNA, 23 bp, Artificial sequence
  SiRNA target sequence
ctttttattttctggtgacatta

SEQ ID NO: 143917 - DNA, 23 bp, Artificial sequence
  SiRNA target sequence
tttttattttctggtgacattac

SEQ ID NO: 143918 - DNA, 23 bp, Artificial sequence
  SiRNA target sequence
ttttattttctggtgacattacc

SEQ ID NO: 143919 - DNA, 23 bp, Artificial sequence
  SiRNA target sequence
tttattttctggtgacattacca

SEQ ID NO: 143920 - DNA, 23 bp, Artificial sequence
  SiRNA target sequence
ttattttctggtgacattaccaa

SEQ ID NO: 143921 - DNA, 23 bp, Artificial sequence
  SiRNA target sequence
tattttctggtgacattaccaac

SEQ ID NO: 143922 - DNA, 23 bp, Artificial sequence
  SiRNA target sequence
attttctggtgacattaccaacc

SEQ ID NO: 143923 - DNA, 23 bp, Artificial sequence
  SiRNA target sequence
ttttctggtgacattaccaacca

SEQ ID NO: 143924 - DNA, 23 bp, Artificial sequence
  SiRNA target sequence
tttctggtgacattaccaaccag

SEQ ID NO: 143925 - DNA, 23 bp, Artificial sequence
  SiRNA target sequence
ttctggtgacattaccaaccaga

SEQ ID NO: 143926 - DNA, 23 bp, Artificial sequence
  SiRNA target sequence
tctggtgacattaccaaccagaa

SEQ ID NO: 143927 - DNA, 23 bp, Artificial sequence
  SiRNA target sequence
ctggtgacattaccaaccagaaa

SEQ ID NO: 143928 - DNA, 23 bp, Artificial sequence
  SiRNA target sequence
tggtgacattaccaaccagaaaa

SEQ ID NO: 143929 - DNA, 23 bp, Artificial sequence
  SiRNA target sequence
ggtgacattaccaaccagaaaag

SEQ ID NO: 143930 - DNA, 23 bp, Artificial sequence
  SiRNA target sequence
gtgacattaccaaccagaaaaga

SEQ ID NO: 143931 - DNA, 23 bp, Artificial sequence
  SiRNA target sequence
tgacattaccaaccagaaaagac

SEQ ID NO: 143932 - DNA, 23 bp, Artificial sequence
  SiRNA target sequence
gacattaccaaccagaaaagact

SEQ ID NO: 143933 - DNA, 23 bp, Artificial sequence
  SiRNA target sequence
acattaccaaccagaaaagacta

SEQ ID NO: 143934 - DNA, 23 bp, Artificial sequence
  SiRNA target sequence
cattaccaaccagaaaagactat

SEQ ID NO: 143935 - DNA, 23 bp, Artificial sequence
  SiRNA target sequence
attaccaaccagaaaagactatg

SEQ ID NO: 143936 - DNA, 23 bp, Artificial sequence
  SiRNA target sequence
ttaccaaccagaaaagactatgg

SEQ ID NO: 143937 - DNA, 23 bp, Artificial sequence
  SiRNA target sequence
taccaaccagaaaagactatggt

SEQ ID NO: 143938 - DNA, 23 bp, Artificial sequence
  SiRNA target sequence
accaaccagaaaagactatggtt

SEQ ID NO: 143939 - DNA, 23 bp, Artificial sequence
  SiRNA target sequence
ccaaccagaaaagactatggttg

SEQ ID NO: 143940 - DNA, 23 bp, Artificial sequence
  SiRNA target sequence
caaccagaaaagactatggttgt

SEQ ID NO: 143941 - DNA, 23 bp, Artificial sequence
  SiRNA target sequence
aaccagaaaagactatggttgta

SEQ ID NO: 143942 - DNA, 23 bp, Artificial sequence
  SiRNA target sequence
accagaaaagactatggttgtaa

SEQ ID NO: 143943 - DNA, 23 bp, Artificial sequence
  SiRNA target sequence
ccagaaaagactatggttgtaat

SEQ ID NO: 143944 - DNA, 23 bp, Artificial sequence
  SiRNA target sequence
cagaaaagactatggttgtaatg

SEQ ID NO: 143945 - DNA, 23 bp, Artificial sequence
  SiRNA target sequence
agaaaagactatggttgtaatga

SEQ ID NO: 143946 - DNA, 23 bp, Artificial sequence
  SiRNA target sequence
gaaaagactatggttgtaatgac

SEQ ID NO: 143947 - DNA, 23 bp, Artificial sequence
  SiRNA target sequence
aaaagactatggttgtaatgacc

SEQ ID NO: 143948 - DNA, 23 bp, Artificial sequence
  SiRNA target sequence
aaagactatggttgtaatgacca

SEQ ID NO: 143949 - DNA, 23 bp, Artificial sequence
  SiRNA target sequence
aagactatggttgtaatgaccac

SEQ ID NO: 143950 - DNA, 23 bp, Artificial sequence
  SiRNA target sequence
agactatggttgtaatgaccacc

SEQ ID NO: 143951 - DNA, 23 bp, Artificial sequence
  SiRNA target sequence
gactatggttgtaatgaccacca

SEQ ID NO: 143952 - DNA, 23 bp, Artificial sequence
  SiRNA target sequence
actatggttgtaatgaccaccac

SEQ ID NO: 143953 - DNA, 23 bp, Artificial sequence
  SiRNA target sequence
ctatggttgtaatgaccaccacc

SEQ ID NO: 143954 - DNA, 23 bp, Artificial sequence
  SiRNA target sequence
tatggttgtaatgaccaccacca

SEQ ID NO: 143955 - DNA, 23 bp, Artificial sequence
  SiRNA target sequence
atggttgtaatgaccaccaccat

SEQ ID NO: 143956 - DNA, 23 bp, Artificial sequence
  SiRNA target sequence
tggttgtaatgaccaccaccata

SEQ ID NO: 143957 - DNA, 23 bp, Artificial sequence
  SiRNA target sequence
ggttgtaatgaccaccaccataa

SEQ ID NO: 143958 - DNA, 23 bp, Artificial sequence
  SiRNA target sequence
gttgtaatgaccaccaccataat

SEQ ID NO: 143959 - DNA, 23 bp, Artificial sequence
  SiRNA target sequence
ttgtaatgaccaccaccataatc

SEQ ID NO: 143960 - DNA, 23 bp, Artificial sequence
  SiRNA target sequence
tgtaatgaccaccaccataatct

SEQ ID NO: 143961 - DNA, 23 bp, Artificial sequence
  SiRNA target sequence
gtaatgaccaccaccataatctc

SEQ ID NO: 143962 - DNA, 23 bp, Artificial sequence
  SiRNA target sequence
taatgaccaccaccataatctct

SEQ ID NO: 143963 - DNA, 23 bp, Artificial sequence
  SiRNA target sequence
aatgaccaccaccataatctctt

SEQ ID NO: 143964 - DNA, 23 bp, Artificial sequence
  SiRNA target sequence
atgaccaccaccataatctctta

SEQ ID NO: 143965 - DNA, 23 bp, Artificial sequence
  SiRNA target sequence
tgaccaccaccataatctcttaa

SEQ ID NO: 143966 - DNA, 23 bp, Artificial sequence
  SiRNA target sequence
gaccaccaccataatctcttaat

SEQ ID NO: 143967 - DNA, 23 bp, Artificial sequence
  SiRNA target sequence
accaccaccataatctcttaatt

SEQ ID NO: 143968 - DNA, 23 bp, Artificial sequence
  SiRNA target sequence
ccaccaccataatctcttaattg

SEQ ID NO: 143969 - DNA, 23 bp, Artificial sequence
  SiRNA target sequence
caccaccataatctcttaattgt

SEQ ID NO: 143970 - DNA, 23 bp, Artificial sequence
  SiRNA target sequence
accaccataatctcttaattgtt

SEQ ID NO: 143971 - DNA, 23 bp, Artificial sequence
  SiRNA target sequence
ccaccataatctcttaattgttt

SEQ ID NO: 143972 - DNA, 23 bp, Artificial sequence
  SiRNA target sequence
caccataatctcttaattgttta

SEQ ID NO: 143973 - DNA, 23 bp, Artificial sequence
  SiRNA target sequence
accataatctcttaattgtttat

SEQ ID NO: 143974 - DNA, 23 bp, Artificial sequence
  SiRNA target sequence
ccataatctcttaattgtttatc

SEQ ID NO: 143975 - DNA, 23 bp, Artificial sequence
  SiRNA target sequence
cataatctcttaattgtttatca

SEQ ID NO: 143976 - DNA, 23 bp, Artificial sequence
  SiRNA target sequence
ataatctcttaattgtttatcaa

SEQ ID NO: 143977 - DNA, 23 bp, Artificial sequence
  SiRNA target sequence
taatctcttaattgtttatcaac

SEQ ID NO: 143978 - DNA, 23 bp, Artificial sequence
  SiRNA target sequence
aatctcttaattgtttatcaaca

SEQ ID NO: 143979 - DNA, 23 bp, Artificial sequence
  SiRNA target sequence
atctcttaattgtttatcaacaa

SEQ ID NO: 143980 - DNA, 23 bp, Artificial sequence
  SiRNA target sequence
tctcttaattgtttatcaacaag

SEQ ID NO: 143981 - DNA, 23 bp, Artificial sequence
  SiRNA target sequence
ctcttaattgtttatcaacaagt

SEQ ID NO: 143982 - DNA, 23 bp, Artificial sequence
  SiRNA target sequence
tcttaattgtttatcaacaagtg

SEQ ID NO: 143983 - DNA, 23 bp, Artificial sequence
  SiRNA target sequence
cttaattgtttatcaacaagtgc

SEQ ID NO: 143984 - DNA, 23 bp, Artificial sequence
  SiRNA target sequence
ttaattgtttatcaacaagtgca

SEQ ID NO: 143985 - DNA, 23 bp, Artificial sequence
  SiRNA target sequence
taattgtttatcaacaagtgcat

SEQ ID NO: 143986 - DNA, 23 bp, Artificial sequence
  SiRNA target sequence
aattgtttatcaacaagtgcatt

SEQ ID NO: 143987 - DNA, 23 bp, Artificial sequence
  SiRNA target sequence
attgtttatcaacaagtgcattt

SEQ ID NO: 143988 - DNA, 23 bp, Artificial sequence
  SiRNA target sequence
ttgtttatcaacaagtgcatttc

SEQ ID NO: 143989 - DNA, 23 bp, Artificial sequence
  SiRNA target sequence
tgtttatcaacaagtgcatttcc

SEQ ID NO: 143990 - DNA, 23 bp, Artificial sequence
  SiRNA target sequence
gtttatcaacaagtgcatttcct

SEQ ID NO: 143991 - DNA, 23 bp, Artificial sequence
  SiRNA target sequence
tttatcaacaagtgcatttcctt

SEQ ID NO: 143992 - DNA, 23 bp, Artificial sequence
  SiRNA target sequence
ttatcaacaagtgcatttccttt

SEQ ID NO: 143993 - DNA, 23 bp, Artificial sequence
  SiRNA target sequence
tatcaacaagtgcatttccttta

SEQ ID NO: 143994 - DNA, 23 bp, Artificial sequence
  SiRNA target sequence
atcaacaagtgcatttcctttat

SEQ ID NO: 143995 - DNA, 23 bp, Artificial sequence
  SiRNA target sequence
tcaacaagtgcatttcctttatt

SEQ ID NO: 143996 - DNA, 23 bp, Artificial sequence
  SiRNA target sequence
caacaagtgcatttcctttatta

SEQ ID NO: 143997 - DNA, 23 bp, Artificial sequence
  SiRNA target sequence
aacaagtgcatttcctttattat

SEQ ID NO: 143998 - DNA, 23 bp, Artificial sequence
  SiRNA target sequence
acaagtgcatttcctttattatt

SEQ ID NO: 143999 - DNA, 23 bp, Artificial sequence
  SiRNA target sequence
caagtgcatttcctttattatta

SEQ ID NO: 144000 - DNA, 23 bp, Artificial sequence
  SiRNA target sequence
aagtgcatttcctttattattaa

SEQ ID NO: 144001 - DNA, 23 bp, Artificial sequence
  SiRNA target sequence
agtgcatttcctttattattaaa

SEQ ID NO: 144002 - DNA, 23 bp, Artificial sequence
  SiRNA target sequence
gtgcatttcctttattattaaaa

SEQ ID NO: 144003 - DNA, 23 bp, Artificial sequence
  SiRNA target sequence
tgcatttcctttattattaaaaa

SEQ ID NO: 144004 - DNA, 23 bp, Artificial sequence
  SiRNA target sequence
gcatttcctttattattaaaaag

SEQ ID NO: 144005 - DNA, 23 bp, Artificial sequence
  SiRNA target sequence
catttcctttattattaaaaagt

SEQ ID NO: 144006 - DNA, 23 bp, Artificial sequence
  SiRNA target sequence
atttcctttattattaaaaagta

SEQ ID NO: 144007 - DNA, 23 bp, Artificial sequence
  SiRNA target sequence
tttcctttattattaaaaagtaa

SEQ ID NO: 144008 - DNA, 23 bp, Artificial sequence
  SiRNA target sequence
ttcctttattattaaaaagtaat

SEQ ID NO: 144009 - DNA, 23 bp, Artificial sequence
  SiRNA target sequence
tcctttattattaaaaagtaatg

SEQ ID NO: 144010 - DNA, 23 bp, Artificial sequence
  SiRNA target sequence
cctttattattaaaaagtaatga

SEQ ID NO: 144011 - DNA, 23 bp, Artificial sequence
  SiRNA target sequence
ctttattattaaaaagtaatgaa

SEQ ID NO: 144012 - DNA, 23 bp, Artificial sequence
  SiRNA target sequence
tttattattaaaaagtaatgaat

SEQ ID NO: 144013 - DNA, 23 bp, Artificial sequence
  SiRNA target sequence
ttattattaaaaagtaatgaatt

SEQ ID NO: 144014 - DNA, 23 bp, Artificial sequence
  SiRNA target sequence
tattattaaaaagtaatgaattt

SEQ ID NO: 144015 - DNA, 23 bp, Artificial sequence
  SiRNA target sequence
attattaaaaagtaatgaattta

SEQ ID NO: 144016 - DNA, 23 bp, Artificial sequence
  SiRNA target sequence
ttattaaaaagtaatgaatttaa

SEQ ID NO: 144017 - DNA, 23 bp, Artificial sequence
  SiRNA target sequence
tattaaaaagtaatgaatttaat

SEQ ID NO: 144018 - DNA, 23 bp, Artificial sequence
  SiRNA target sequence
attaaaaagtaatgaatttaatg

SEQ ID NO: 144019 - DNA, 23 bp, Artificial sequence
  SiRNA target sequence
ttaaaaagtaatgaatttaatga

SEQ ID NO: 144020 - DNA, 23 bp, Artificial sequence
  SiRNA target sequence
taaaaagtaatgaatttaatgat

SEQ ID NO: 144021 - DNA, 23 bp, Artificial sequence
  SiRNA target sequence
aaaaagtaatgaatttaatgatt

SEQ ID NO: 144022 - DNA, 23 bp, Artificial sequence
  SiRNA target sequence
aaaagtaatgaatttaatgattt

SEQ ID NO: 144023 - DNA, 23 bp, Artificial sequence
  SiRNA target sequence
aaagtaatgaatttaatgattta

SEQ ID NO: 144024 - DNA, 23 bp, Artificial sequence
  SiRNA target sequence
aagtaatgaatttaatgatttac

SEQ ID NO: 144025 - DNA, 23 bp, Artificial sequence
  SiRNA target sequence
agtaatgaatttaatgatttacc

SEQ ID NO: 144026 - DNA, 23 bp, Artificial sequence
  SiRNA target sequence
gtaatgaatttaatgatttacca

SEQ ID NO: 144027 - DNA, 23 bp, Artificial sequence
  SiRNA target sequence
taatgaatttaatgatttaccac

SEQ ID NO: 144028 - DNA, 23 bp, Artificial sequence
  SiRNA target sequence
aatgaatttaatgatttaccaca

SEQ ID NO: 144029 - DNA, 23 bp, Artificial sequence
  SiRNA target sequence
atgaatttaatgatttaccacac

SEQ ID NO: 144030 - DNA, 23 bp, Artificial sequence
  SiRNA target sequence
tgaatttaatgatttaccacaca

SEQ ID NO: 144031 - DNA, 23 bp, Artificial sequence
  SiRNA target sequence
gaatttaatgatttaccacacaa

SEQ ID NO: 144032 - DNA, 23 bp, Artificial sequence
  SiRNA target sequence
aatttaatgatttaccacacaaa

SEQ ID NO: 144033 - DNA, 23 bp, Artificial sequence
  SiRNA target sequence
atttaatgatttaccacacaaat

SEQ ID NO: 144034 - DNA, 23 bp, Artificial sequence
  SiRNA target sequence
tttaatgatttaccacacaaatt

SEQ ID NO: 144035 - DNA, 23 bp, Artificial sequence
  SiRNA target sequence
ttaatgatttaccacacaaattg

SEQ ID NO: 144036 - DNA, 23 bp, Artificial sequence
  SiRNA target sequence
taatgatttaccacacaaattgt

SEQ ID NO: 144037 - DNA, 23 bp, Artificial sequence
  SiRNA target sequence
aatgatttaccacacaaattgtt

SEQ ID NO: 144038 - DNA, 23 bp, Artificial sequence
  SiRNA target sequence
atgatttaccacacaaattgtta

SEQ ID NO: 144039 - DNA, 23 bp, Artificial sequence
  SiRNA target sequence
tgatttaccacacaaattgttat

SEQ ID NO: 144040 - DNA, 23 bp, Artificial sequence
  SiRNA target sequence
gatttaccacacaaattgttatc

SEQ ID NO: 144041 - DNA, 23 bp, Artificial sequence
  SiRNA target sequence
atttaccacacaaattgttatct

SEQ ID NO: 144042 - DNA, 23 bp, Artificial sequence
  SiRNA target sequence
tttaccacacaaattgttatcta

SEQ ID NO: 144043 - DNA, 23 bp, Artificial sequence
  SiRNA target sequence
ttaccacacaaattgttatctaa

SEQ ID NO: 144044 - DNA, 23 bp, Artificial sequence
  SiRNA target sequence
taccacacaaattgttatctaat

SEQ ID NO: 144045 - DNA, 23 bp, Artificial sequence
  SiRNA target sequence
accacacaaattgttatctaata

SEQ ID NO: 144046 - DNA, 23 bp, Artificial sequence
  SiRNA target sequence
ccacacaaattgttatctaatat

SEQ ID NO: 144047 - DNA, 23 bp, Artificial sequence
  SiRNA target sequence
cacacaaattgttatctaatatt

SEQ ID NO: 144048 - DNA, 23 bp, Artificial sequence
  SiRNA target sequence
acacaaattgttatctaatatta

SEQ ID NO: 144049 - DNA, 23 bp, Artificial sequence
  SiRNA target sequence
cacaaattgttatctaatattat

SEQ ID NO: 144050 - DNA, 23 bp, Artificial sequence
  SiRNA target sequence
acaaattgttatctaatattatt

SEQ ID NO: 144051 - DNA, 23 bp, Artificial sequence
  SiRNA target sequence
caaattgttatctaatattattt

SEQ ID NO: 144052 - DNA, 23 bp, Artificial sequence
  SiRNA target sequence
aaattgttatctaatattatttt

SEQ ID NO: 144053 - DNA, 23 bp, Artificial sequence
  SiRNA target sequence
aattgttatctaatattatttta

SEQ ID NO: 144054 - DNA, 23 bp, Artificial sequence
  SiRNA target sequence
attgttatctaatattattttat

SEQ ID NO: 144055 - DNA, 23 bp, Artificial sequence
  SiRNA target sequence
ttgttatctaatattattttatt

SEQ ID NO: 144056 - DNA, 23 bp, Artificial sequence
  SiRNA target sequence
tgttatctaatattattttatta

SEQ ID NO: 144057 - DNA, 23 bp, Artificial sequence
  SiRNA target sequence
gttatctaatattattttattaa

SEQ ID NO: 144058 - DNA, 23 bp, Artificial sequence
  SiRNA target sequence
ttatctaatattattttattaag

SEQ ID NO: 144059 - DNA, 23 bp, Artificial sequence
  SiRNA target sequence
tatctaatattattttattaaga

SEQ ID NO: 144060 - DNA, 23 bp, Artificial sequence
  SiRNA target sequence
atctaatattattttattaagag

SEQ ID NO: 144061 - DNA, 23 bp, Artificial sequence
  SiRNA target sequence
tctaatattattttattaagagt

SEQ ID NO: 144062 - DNA, 23 bp, Artificial sequence
  SiRNA target sequence
ctaatattattttattaagagtg

SEQ ID NO: 144063 - DNA, 23 bp, Artificial sequence
  SiRNA target sequence
taatattattttattaagagtgt

SEQ ID NO: 144064 - DNA, 23 bp, Artificial sequence
  SiRNA target sequence
aatattattttattaagagtgtc

SEQ ID NO: 144065 - DNA, 23 bp, Artificial sequence
  SiRNA target sequence
atattattttattaagagtgtct

SEQ ID NO: 144066 - DNA, 23 bp, Artificial sequence
  SiRNA target sequence
tattattttattaagagtgtcta

SEQ ID NO: 144067 - DNA, 23 bp, Artificial sequence
  SiRNA target sequence
attattttattaagagtgtctac

SEQ ID NO: 144068 - DNA, 23 bp, Artificial sequence
  SiRNA target sequence
ttattttattaagagtgtctaca

SEQ ID NO: 144069 - DNA, 23 bp, Artificial sequence
  SiRNA target sequence
tattttattaagagtgtctacat

SEQ ID NO: 144070 - DNA, 23 bp, Artificial sequence
  SiRNA target sequence
attttattaagagtgtctacata

SEQ ID NO: 144071 - DNA, 23 bp, Artificial sequence
  SiRNA target sequence
ttttattaagagtgtctacatac

SEQ ID NO: 144072 - DNA, 23 bp, Artificial sequence
  SiRNA target sequence
tttattaagagtgtctacatacg

SEQ ID NO: 144073 - DNA, 23 bp, Artificial sequence
  SiRNA target sequence
ttattaagagtgtctacatacgc

SEQ ID NO: 144074 - DNA, 23 bp, Artificial sequence
  SiRNA target sequence
tattaagagtgtctacatacgct

SEQ ID NO: 144075 - DNA, 23 bp, Artificial sequence
  SiRNA target sequence
attaagagtgtctacatacgctt

SEQ ID NO: 144076 - DNA, 23 bp, Artificial sequence
  SiRNA target sequence
ttaagagtgtctacatacgcttg

SEQ ID NO: 144077 - DNA, 23 bp, Artificial sequence
  SiRNA target sequence
taagagtgtctacatacgcttga

SEQ ID NO: 144078 - DNA, 23 bp, Artificial sequence
  SiRNA target sequence
aagagtgtctacatacgcttgat

SEQ ID NO: 144079 - DNA, 23 bp, Artificial sequence
  SiRNA target sequence
agagtgtctacatacgcttgatg

SEQ ID NO: 144080 - DNA, 23 bp, Artificial sequence
  SiRNA target sequence
gagtgtctacatacgcttgatgg

SEQ ID NO: 144081 - DNA, 23 bp, Artificial sequence
  SiRNA target sequence
agtgtctacatacgcttgatggt

SEQ ID NO: 144082 - DNA, 23 bp, Artificial sequence
  SiRNA target sequence
gtgtctacatacgcttgatggtg

SEQ ID NO: 144083 - DNA, 23 bp, Artificial sequence
  SiRNA target sequence
tgtctacatacgcttgatggtgc

SEQ ID NO: 144084 - DNA, 23 bp, Artificial sequence
  SiRNA target sequence
gtctacatacgcttgatggtgct

SEQ ID NO: 144085 - DNA, 23 bp, Artificial sequence
  SiRNA target sequence
tctacatacgcttgatggtgctt

SEQ ID NO: 144086 - DNA, 23 bp, Artificial sequence
  SiRNA target sequence
ctacatacgcttgatggtgctta

SEQ ID NO: 144087 - DNA, 23 bp, Artificial sequence
  SiRNA target sequence
tacatacgcttgatggtgcttag

SEQ ID NO: 144088 - DNA, 23 bp, Artificial sequence
  SiRNA target sequence
acatacgcttgatggtgcttaga

SEQ ID NO: 144089 - DNA, 23 bp, Artificial sequence
  SiRNA target sequence
catacgcttgatggtgcttagag

SEQ ID NO: 144090 - DNA, 23 bp, Artificial sequence
  SiRNA target sequence
atacgcttgatggtgcttagagt

SEQ ID NO: 144091 - DNA, 23 bp, Artificial sequence
  SiRNA target sequence
tacgcttgatggtgcttagagtg

SEQ ID NO: 144092 - DNA, 23 bp, Artificial sequence
  SiRNA target sequence
acgcttgatggtgcttagagtgg

SEQ ID NO: 144093 - DNA, 23 bp, Artificial sequence
  SiRNA target sequence
cgcttgatggtgcttagagtggt

SEQ ID NO: 144094 - DNA, 23 bp, Artificial sequence
  SiRNA target sequence
gcttgatggtgcttagagtggtg

SEQ ID NO: 144095 - DNA, 23 bp, Artificial sequence
  SiRNA target sequence
cttgatggtgcttagagtggtgg

SEQ ID NO: 144096 - DNA, 23 bp, Artificial sequence
  SiRNA target sequence
ttgatggtgcttagagtggtggg

SEQ ID NO: 144097 - DNA, 23 bp, Artificial sequence
  SiRNA target sequence
tgatggtgcttagagtggtgggt

SEQ ID NO: 144098 - DNA, 23 bp, Artificial sequence
  SiRNA target sequence
gatggtgcttagagtggtgggtc

SEQ ID NO: 144099 - DNA, 23 bp, Artificial sequence
  SiRNA target sequence
atggtgcttagagtggtgggtct

SEQ ID NO: 144100 - DNA, 23 bp, Artificial sequence
  SiRNA target sequence
tggtgcttagagtggtgggtctc

SEQ ID NO: 144101 - DNA, 23 bp, Artificial sequence
  SiRNA target sequence
ggtgcttagagtggtgggtctcc

SEQ ID NO: 144102 - DNA, 23 bp, Artificial sequence
  SiRNA target sequence
gtgcttagagtggtgggtctcca

SEQ ID NO: 144103 - DNA, 23 bp, Artificial sequence
  SiRNA target sequence
tgcttagagtggtgggtctccat

SEQ ID NO: 144104 - DNA, 23 bp, Artificial sequence
  SiRNA target sequence
gcttagagtggtgggtctccatt

SEQ ID NO: 144105 - DNA, 23 bp, Artificial sequence
  SiRNA target sequence
cttagagtggtgggtctccatta

SEQ ID NO: 144106 - DNA, 23 bp, Artificial sequence
  SiRNA target sequence
ttagagtggtgggtctccattat

SEQ ID NO: 144107 - DNA, 23 bp, Artificial sequence
  SiRNA target sequence
tagagtggtgggtctccattata

SEQ ID NO: 144108 - DNA, 23 bp, Artificial sequence
  SiRNA target sequence
agagtggtgggtctccattatat

SEQ ID NO: 144109 - DNA, 23 bp, Artificial sequence
  SiRNA target sequence
gagtggtgggtctccattatatc

SEQ ID NO: 144110 - DNA, 23 bp, Artificial sequence
  SiRNA target sequence
agtggtgggtctccattatatct

SEQ ID NO: 144111 - DNA, 23 bp, Artificial sequence
  SiRNA target sequence
gtggtgggtctccattatatctt

SEQ ID NO: 144112 - DNA, 23 bp, Artificial sequence
  SiRNA target sequence
tggtgggtctccattatatcttc

SEQ ID NO: 144113 - DNA, 23 bp, Artificial sequence
  SiRNA target sequence
ggtgggtctccattatatcttca

SEQ ID NO: 144114 - DNA, 23 bp, Artificial sequence
  SiRNA target sequence
gtgggtctccattatatcttcac

SEQ ID NO: 144115 - DNA, 23 bp, Artificial sequence
  SiRNA target sequence
tgggtctccattatatcttcact

SEQ ID NO: 144116 - DNA, 23 bp, Artificial sequence
  SiRNA target sequence
gggtctccattatatcttcactt

SEQ ID NO: 144117 - DNA, 23 bp, Artificial sequence
  SiRNA target sequence
ggtctccattatatcttcactta

SEQ ID NO: 144118 - DNA, 23 bp, Artificial sequence
  SiRNA target sequence
gtctccattatatcttcacttat

SEQ ID NO: 144119 - DNA, 23 bp, Artificial sequence
  SiRNA target sequence
tctccattatatcttcacttata

SEQ ID NO: 144120 - DNA, 23 bp, Artificial sequence
  SiRNA target sequence
ctccattatatcttcacttatat

SEQ ID NO: 144121 - DNA, 23 bp, Artificial sequence
  SiRNA target sequence
tccattatatcttcacttatata

SEQ ID NO: 144122 - DNA, 23 bp, Artificial sequence
  SiRNA target sequence
ccattatatcttcacttatataa

SEQ ID NO: 144123 - DNA, 23 bp, Artificial sequence
  SiRNA target sequence
cattatatcttcacttatataag

SEQ ID NO: 144124 - DNA, 23 bp, Artificial sequence
  SiRNA target sequence
attatatcttcacttatataagg

SEQ ID NO: 144125 - DNA, 23 bp, Artificial sequence
  SiRNA target sequence
ttatatcttcacttatataaggc

SEQ ID NO: 144126 - DNA, 23 bp, Artificial sequence
  SiRNA target sequence
tatatcttcacttatataaggct

SEQ ID NO: 144127 - DNA, 23 bp, Artificial sequence
  SiRNA target sequence
atatcttcacttatataaggctc

SEQ ID NO: 144128 - DNA, 23 bp, Artificial sequence
  SiRNA target sequence
tatcttcacttatataaggctct

SEQ ID NO: 144129 - DNA, 23 bp, Artificial sequence
  SiRNA target sequence
atcttcacttatataaggctcta

SEQ ID NO: 144130 - DNA, 23 bp, Artificial sequence
  SiRNA target sequence
tcttcacttatataaggctctag

SEQ ID NO: 144131 - DNA, 23 bp, Artificial sequence
  SiRNA target sequence
cttcacttatataaggctctaga

SEQ ID NO: 144132 - DNA, 23 bp, Artificial sequence
  SiRNA target sequence
ttcacttatataaggctctagag

SEQ ID NO: 144133 - DNA, 23 bp, Artificial sequence
  SiRNA target sequence
tcacttatataaggctctagaga

SEQ ID NO: 144134 - DNA, 23 bp, Artificial sequence
  SiRNA target sequence
cacttatataaggctctagagat

SEQ ID NO: 144135 - DNA, 23 bp, Artificial sequence
  SiRNA target sequence
acttatataaggctctagagatt

SEQ ID NO: 144136 - DNA, 23 bp, Artificial sequence
  SiRNA target sequence
cttatataaggctctagagattt

SEQ ID NO: 144137 - DNA, 23 bp, Artificial sequence
  SiRNA target sequence
ttatataaggctctagagattta

SEQ ID NO: 144138 - DNA, 23 bp, Artificial sequence
  SiRNA target sequence
tatataaggctctagagatttat

SEQ ID NO: 144139 - DNA, 23 bp, Artificial sequence
  SiRNA target sequence
atataaggctctagagatttata

SEQ ID NO: 144140 - DNA, 23 bp, Artificial sequence
  SiRNA target sequence
tataaggctctagagatttataa

SEQ ID NO: 144141 - DNA, 23 bp, Artificial sequence
  SiRNA target sequence
ataaggctctagagatttataac

SEQ ID NO: 144142 - DNA, 23 bp, Artificial sequence
  SiRNA target sequence
taaggctctagagatttataact

SEQ ID NO: 144143 - DNA, 23 bp, Artificial sequence
  SiRNA target sequence
aaggctctagagatttataacta

SEQ ID NO: 144144 - DNA, 23 bp, Artificial sequence
  SiRNA target sequence
aggctctagagatttataactat

SEQ ID NO: 144145 - DNA, 23 bp, Artificial sequence
  SiRNA target sequence
ggctctagagatttataactata

SEQ ID NO: 144146 - DNA, 23 bp, Artificial sequence
  SiRNA target sequence
gctctagagatttataactatat

SEQ ID NO: 144147 - DNA, 23 bp, Artificial sequence
  SiRNA target sequence
ctctagagatttataactatatt

SEQ ID NO: 144148 - DNA, 23 bp, Artificial sequence
  SiRNA target sequence
tctagagatttataactatattt

SEQ ID NO: 144149 - DNA, 23 bp, Artificial sequence
  SiRNA target sequence
ctagagatttataactatatttc

SEQ ID NO: 144150 - DNA, 23 bp, Artificial sequence
  SiRNA target sequence
tagagatttataactatatttca

SEQ ID NO: 144151 - DNA, 23 bp, Artificial sequence
  SiRNA target sequence
agagatttataactatatttcag

SEQ ID NO: 144152 - DNA, 23 bp, Artificial sequence
  SiRNA target sequence
gagatttataactatatttcaga

SEQ ID NO: 144153 - DNA, 23 bp, Artificial sequence
  SiRNA target sequence
agatttataactatatttcagat

SEQ ID NO: 144154 - DNA, 23 bp, Artificial sequence
  SiRNA target sequence
gatttataactatatttcagatt

SEQ ID NO: 144155 - DNA, 23 bp, Artificial sequence
  SiRNA target sequence
atttataactatatttcagattt

SEQ ID NO: 144156 - DNA, 23 bp, Artificial sequence
  SiRNA target sequence
tttataactatatttcagatttg

SEQ ID NO: 144157 - DNA, 23 bp, Artificial sequence
  SiRNA target sequence
ttataactatatttcagatttgg

SEQ ID NO: 144158 - DNA, 23 bp, Artificial sequence
  SiRNA target sequence
tataactatatttcagatttgga

SEQ ID NO: 144159 - DNA, 23 bp, Artificial sequence
  SiRNA target sequence
ataactatatttcagatttggaa

SEQ ID NO: 144160 - DNA, 23 bp, Artificial sequence
  SiRNA target sequence
taactatatttcagatttggaag

SEQ ID NO: 144161 - DNA, 23 bp, Artificial sequence
  SiRNA target sequence
aactatatttcagatttggaaga

SEQ ID NO: 144162 - DNA, 23 bp, Artificial sequence
  SiRNA target sequence
actatatttcagatttggaagag

SEQ ID NO: 144163 - DNA, 23 bp, Artificial sequence
  SiRNA target sequence
ctatatttcagatttggaagagt

SEQ ID NO: 144164 - DNA, 23 bp, Artificial sequence
  SiRNA target sequence
tatatttcagatttggaagagtg

SEQ ID NO: 144165 - DNA, 23 bp, Artificial sequence
  SiRNA target sequence
atatttcagatttggaagagtga

SEQ ID NO: 144166 - DNA, 23 bp, Artificial sequence
  SiRNA target sequence
tatttcagatttggaagagtgaa

SEQ ID NO: 144167 - DNA, 23 bp, Artificial sequence
  SiRNA target sequence
atttcagatttggaagagtgaac

SEQ ID NO: 144168 - DNA, 23 bp, Artificial sequence
  SiRNA target sequence
tttcagatttggaagagtgaaca

SEQ ID NO: 144169 - DNA, 23 bp, Artificial sequence
  SiRNA target sequence
ttcagatttggaagagtgaacat

SEQ ID NO: 144170 - DNA, 24 bp, Artificial sequence
  SiRNA target sequence
ttaatttatgcataattgaccatc

SEQ ID NO: 144171 - DNA, 24 bp, Artificial sequence
  SiRNA target sequence
taatttatgcataattgaccatca

SEQ ID NO: 144172 - DNA, 24 bp, Artificial sequence
  SiRNA target sequence
aatttatgcataattgaccatcat

SEQ ID NO: 144173 - DNA, 24 bp, Artificial sequence
  SiRNA target sequence
atttatgcataattgaccatcatc

SEQ ID NO: 144174 - DNA, 24 bp, Artificial sequence
  SiRNA target sequence
tttatgcataattgaccatcatca

SEQ ID NO: 144175 - DNA, 24 bp, Artificial sequence
  SiRNA target sequence
ttatgcataattgaccatcatcag

SEQ ID NO: 144176 - DNA, 24 bp, Artificial sequence
  SiRNA target sequence
tatgcataattgaccatcatcagt

SEQ ID NO: 144177 - DNA, 24 bp, Artificial sequence
  SiRNA target sequence
atgcataattgaccatcatcagta

SEQ ID NO: 144178 - DNA, 24 bp, Artificial sequence
  SiRNA target sequence
tgcataattgaccatcatcagtaa

SEQ ID NO: 144179 - DNA, 24 bp, Artificial sequence
  SiRNA target sequence
gcataattgaccatcatcagtaat

SEQ ID NO: 144180 - DNA, 24 bp, Artificial sequence
  SiRNA target sequence
cataattgaccatcatcagtaata

SEQ ID NO: 144181 - DNA, 24 bp, Artificial sequence
  SiRNA target sequence
ataattgaccatcatcagtaataa

SEQ ID NO: 144182 - DNA, 24 bp, Artificial sequence
  SiRNA target sequence
taattgaccatcatcagtaataaa

SEQ ID NO: 144183 - DNA, 24 bp, Artificial sequence
  SiRNA target sequence
aattgaccatcatcagtaataaac

SEQ ID NO: 144184 - DNA, 24 bp, Artificial sequence
  SiRNA target sequence
attgaccatcatcagtaataaaca

SEQ ID NO: 144185 - DNA, 24 bp, Artificial sequence
  SiRNA target sequence
ttgaccatcatcagtaataaacac

SEQ ID NO: 144186 - DNA, 24 bp, Artificial sequence
  SiRNA target sequence
tgaccatcatcagtaataaacaca

SEQ ID NO: 144187 - DNA, 24 bp, Artificial sequence
  SiRNA target sequence
gaccatcatcagtaataaacacat

SEQ ID NO: 144188 - DNA, 24 bp, Artificial sequence
  SiRNA target sequence
accatcatcagtaataaacacatt

SEQ ID NO: 144189 - DNA, 24 bp, Artificial sequence
  SiRNA target sequence
ccatcatcagtaataaacacatta

SEQ ID NO: 144190 - DNA, 24 bp, Artificial sequence
  SiRNA target sequence
catcatcagtaataaacacattac

SEQ ID NO: 144191 - DNA, 24 bp, Artificial sequence
  SiRNA target sequence
atcatcagtaataaacacattacc

SEQ ID NO: 144192 - DNA, 24 bp, Artificial sequence
  SiRNA target sequence
tcatcagtaataaacacattacct

SEQ ID NO: 144193 - DNA, 24 bp, Artificial sequence
  SiRNA target sequence
catcagtaataaacacattacctt

SEQ ID NO: 144194 - DNA, 24 bp, Artificial sequence
  SiRNA target sequence
atcagtaataaacacattaccttt

SEQ ID NO: 144195 - DNA, 24 bp, Artificial sequence
  SiRNA target sequence
tcagtaataaacacattacctttc

SEQ ID NO: 144196 - DNA, 24 bp, Artificial sequence
  SiRNA target sequence
cagtaataaacacattacctttct

SEQ ID NO: 144197 - DNA, 24 bp, Artificial sequence
  SiRNA target sequence
agtaataaacacattacctttctt

SEQ ID NO: 144198 - DNA, 24 bp, Artificial sequence
  SiRNA target sequence
gtaataaacacattacctttcttt

SEQ ID NO: 144199 - DNA, 24 bp, Artificial sequence
  SiRNA target sequence
taataaacacattacctttctttt

SEQ ID NO: 144200 - DNA, 24 bp, Artificial sequence
  SiRNA target sequence
aataaacacattacctttcttttc

SEQ ID NO: 144201 - DNA, 24 bp, Artificial sequence
  SiRNA target sequence
ataaacacattacctttcttttct

SEQ ID NO: 144202 - DNA, 24 bp, Artificial sequence
  SiRNA target sequence
taaacacattacctttcttttcta

SEQ ID NO: 144203 - DNA, 24 bp, Artificial sequence
  SiRNA target sequence
aaacacattacctttcttttctac

SEQ ID NO: 144204 - DNA, 24 bp, Artificial sequence
  SiRNA target sequence
aacacattacctttcttttctacc

SEQ ID NO: 144205 - DNA, 24 bp, Artificial sequence
  SiRNA target sequence
acacattacctttcttttctacca

SEQ ID NO: 144206 - DNA, 24 bp, Artificial sequence
  SiRNA target sequence
cacattacctttcttttctaccac

SEQ ID NO: 144207 - DNA, 24 bp, Artificial sequence
  SiRNA target sequence
acattacctttcttttctaccaca

SEQ ID NO: 144208 - DNA, 24 bp, Artificial sequence
  SiRNA target sequence
cattacctttcttttctaccacac

SEQ ID NO: 144209 - DNA, 24 bp, Artificial sequence
  SiRNA target sequence
attacctttcttttctaccacaca

SEQ ID NO: 144210 - DNA, 24 bp, Artificial sequence
  SiRNA target sequence
ttacctttcttttctaccacacat

SEQ ID NO: 144211 - DNA, 24 bp, Artificial sequence
  SiRNA target sequence
tacctttcttttctaccacacatt

SEQ ID NO: 144212 - DNA, 24 bp, Artificial sequence
  SiRNA target sequence
acctttcttttctaccacacattt

SEQ ID NO: 144213 - DNA, 24 bp, Artificial sequence
  SiRNA target sequence
cctttcttttctaccacacatttt

SEQ ID NO: 144214 - DNA, 24 bp, Artificial sequence
  SiRNA target sequence
ctttcttttctaccacacattttt

SEQ ID NO: 144215 - DNA, 24 bp, Artificial sequence
  SiRNA target sequence
tttcttttctaccacacatttttg

SEQ ID NO: 144216 - DNA, 24 bp, Artificial sequence
  SiRNA target sequence
ttcttttctaccacacatttttga

SEQ ID NO: 144217 - DNA, 24 bp, Artificial sequence
  SiRNA target sequence
tcttttctaccacacatttttgat

SEQ ID NO: 144218 - DNA, 24 bp, Artificial sequence
  SiRNA target sequence
cttttctaccacacatttttgata

SEQ ID NO: 144219 - DNA, 24 bp, Artificial sequence
  SiRNA target sequence
ttttctaccacacatttttgatat

SEQ ID NO: 144220 - DNA, 24 bp, Artificial sequence
  SiRNA target sequence
tttctaccacacatttttgatata

SEQ ID NO: 144221 - DNA, 24 bp, Artificial sequence
  SiRNA target sequence
ttctaccacacatttttgatatat

SEQ ID NO: 144222 - DNA, 24 bp, Artificial sequence
  SiRNA target sequence
tctaccacacatttttgatatatt

SEQ ID NO: 144223 - DNA, 24 bp, Artificial sequence
  SiRNA target sequence
ctaccacacatttttgatatattt

SEQ ID NO: 144224 - DNA, 24 bp, Artificial sequence
  SiRNA target sequence
taccacacatttttgatatatttc

SEQ ID NO: 144225 - DNA, 24 bp, Artificial sequence
  SiRNA target sequence
accacacatttttgatatatttca

SEQ ID NO: 144226 - DNA, 24 bp, Artificial sequence
  SiRNA target sequence
ccacacatttttgatatatttcat

SEQ ID NO: 144227 - DNA, 24 bp, Artificial sequence
  SiRNA target sequence
cacacatttttgatatatttcatt

SEQ ID NO: 144228 - DNA, 24 bp, Artificial sequence
  SiRNA target sequence
acacatttttgatatatttcatta

SEQ ID NO: 144229 - DNA, 24 bp, Artificial sequence
  SiRNA target sequence
cacatttttgatatatttcattaa

SEQ ID NO: 144230 - DNA, 24 bp, Artificial sequence
  SiRNA target sequence
acatttttgatatatttcattaac

SEQ ID NO: 144231 - DNA, 24 bp, Artificial sequence
  SiRNA target sequence
catttttgatatatttcattaact

SEQ ID NO: 144232 - DNA, 24 bp, Artificial sequence
  SiRNA target sequence
atttttgatatatttcattaacta

SEQ ID NO: 144233 - DNA, 24 bp, Artificial sequence
  SiRNA target sequence
tttttgatatatttcattaactac

SEQ ID NO: 144234 - DNA, 24 bp, Artificial sequence
  SiRNA target sequence
ttttgatatatttcattaactaca

SEQ ID NO: 144235 - DNA, 24 bp, Artificial sequence
  SiRNA target sequence
tttgatatatttcattaactacat

SEQ ID NO: 144236 - DNA, 24 bp, Artificial sequence
  SiRNA target sequence
ttgatatatttcattaactacatc

SEQ ID NO: 144237 - DNA, 24 bp, Artificial sequence
  SiRNA target sequence
tgatatatttcattaactacatcc

SEQ ID NO: 144238 - DNA, 24 bp, Artificial sequence
  SiRNA target sequence
gatatatttcattaactacatccc

SEQ ID NO: 144239 - DNA, 24 bp, Artificial sequence
  SiRNA target sequence
atatatttcattaactacatccca

SEQ ID NO: 144240 - DNA, 24 bp, Artificial sequence
  SiRNA target sequence
tatatttcattaactacatcccaa

SEQ ID NO: 144241 - DNA, 24 bp, Artificial sequence
  SiRNA target sequence
atatttcattaactacatcccaat

SEQ ID NO: 144242 - DNA, 24 bp, Artificial sequence
  SiRNA target sequence
tatttcattaactacatcccaatc

SEQ ID NO: 144243 - DNA, 24 bp, Artificial sequence
  SiRNA target sequence
atttcattaactacatcccaatca

SEQ ID NO: 144244 - DNA, 24 bp, Artificial sequence
  SiRNA target sequence
tttcattaactacatcccaatcaa

SEQ ID NO: 144245 - DNA, 24 bp, Artificial sequence
  SiRNA target sequence
ttcattaactacatcccaatcaat

SEQ ID NO: 144246 - DNA, 24 bp, Artificial sequence
  SiRNA target sequence
tcattaactacatcccaatcaatt

SEQ ID NO: 144247 - DNA, 24 bp, Artificial sequence
  SiRNA target sequence
cattaactacatcccaatcaatta

SEQ ID NO: 144248 - DNA, 24 bp, Artificial sequence
  SiRNA target sequence
attaactacatcccaatcaattac

SEQ ID NO: 144249 - DNA, 24 bp, Artificial sequence
  SiRNA target sequence
ttaactacatcccaatcaattaca

SEQ ID NO: 144250 - DNA, 24 bp, Artificial sequence
  SiRNA target sequence
taactacatcccaatcaattacat

SEQ ID NO: 144251 - DNA, 24 bp, Artificial sequence
  SiRNA target sequence
aactacatcccaatcaattacatt

SEQ ID NO: 144252 - DNA, 24 bp, Artificial sequence
  SiRNA target sequence
actacatcccaatcaattacattc

SEQ ID NO: 144253 - DNA, 24 bp, Artificial sequence
  SiRNA target sequence
ctacatcccaatcaattacattcc

SEQ ID NO: 144254 - DNA, 24 bp, Artificial sequence
  SiRNA target sequence
tacatcccaatcaattacattcca

SEQ ID NO: 144255 - DNA, 24 bp, Artificial sequence
  SiRNA target sequence
acatcccaatcaattacattccac

SEQ ID NO: 144256 - DNA, 24 bp, Artificial sequence
  SiRNA target sequence
catcccaatcaattacattccacc

SEQ ID NO: 144257 - DNA, 24 bp, Artificial sequence
  SiRNA target sequence
atcccaatcaattacattccacca

SEQ ID NO: 144258 - DNA, 24 bp, Artificial sequence
  SiRNA target sequence
tcccaatcaattacattccaccat

SEQ ID NO: 144259 - DNA, 24 bp, Artificial sequence
  SiRNA target sequence
cccaatcaattacattccaccatt

SEQ ID NO: 144260 - DNA, 24 bp, Artificial sequence
  SiRNA target sequence
ccaatcaattacattccaccattc

SEQ ID NO: 144261 - DNA, 24 bp, Artificial sequence
  SiRNA target sequence
caatcaattacattccaccattca

SEQ ID NO: 144262 - DNA, 24 bp, Artificial sequence
  SiRNA target sequence
aatcaattacattccaccattcat

SEQ ID NO: 144263 - DNA, 24 bp, Artificial sequence
  SiRNA target sequence
atcaattacattccaccattcatt

SEQ ID NO: 144264 - DNA, 24 bp, Artificial sequence
  SiRNA target sequence
tcaattacattccaccattcatta

SEQ ID NO: 144265 - DNA, 24 bp, Artificial sequence
  SiRNA target sequence
caattacattccaccattcattaa

SEQ ID NO: 144266 - DNA, 24 bp, Artificial sequence
  SiRNA target sequence
aattacattccaccattcattaat

SEQ ID NO: 144267 - DNA, 24 bp, Artificial sequence
  SiRNA target sequence
attacattccaccattcattaatg

SEQ ID NO: 144268 - DNA, 24 bp, Artificial sequence
  SiRNA target sequence
ttacattccaccattcattaatgt

SEQ ID NO: 144269 - DNA, 24 bp, Artificial sequence
  SiRNA target sequence
tacattccaccattcattaatgta

SEQ ID NO: 144270 - DNA, 24 bp, Artificial sequence
  SiRNA target sequence
acattccaccattcattaatgtat

SEQ ID NO: 144271 - DNA, 24 bp, Artificial sequence
  SiRNA target sequence
cattccaccattcattaatgtatt

SEQ ID NO: 144272 - DNA, 24 bp, Artificial sequence
  SiRNA target sequence
attccaccattcattaatgtattc

SEQ ID NO: 144273 - DNA, 24 bp, Artificial sequence
  SiRNA target sequence
ttccaccattcattaatgtattct

SEQ ID NO: 144274 - DNA, 24 bp, Artificial sequence
  SiRNA target sequence
tccaccattcattaatgtattctt

SEQ ID NO: 144275 - DNA, 24 bp, Artificial sequence
  SiRNA target sequence
ccaccattcattaatgtattcttt

SEQ ID NO: 144276 - DNA, 24 bp, Artificial sequence
  SiRNA target sequence
caccattcattaatgtattctttt

SEQ ID NO: 144277 - DNA, 24 bp, Artificial sequence
  SiRNA target sequence
accattcattaatgtattcttttc

SEQ ID NO: 144278 - DNA, 24 bp, Artificial sequence
  SiRNA target sequence
ccattcattaatgtattcttttct

SEQ ID NO: 144279 - DNA, 24 bp, Artificial sequence
  SiRNA target sequence
cattcattaatgtattcttttctc

SEQ ID NO: 144280 - DNA, 24 bp, Artificial sequence
  SiRNA target sequence
attcattaatgtattcttttctcc

SEQ ID NO: 144281 - DNA, 24 bp, Artificial sequence
  SiRNA target sequence
ttcattaatgtattcttttctcct

SEQ ID NO: 144282 - DNA, 24 bp, Artificial sequence
  SiRNA target sequence
tcattaatgtattcttttctccta

SEQ ID NO: 144283 - DNA, 24 bp, Artificial sequence
  SiRNA target sequence
cattaatgtattcttttctcctat

SEQ ID NO: 144284 - DNA, 24 bp, Artificial sequence
  SiRNA target sequence
attaatgtattcttttctcctatt

SEQ ID NO: 144285 - DNA, 24 bp, Artificial sequence
  SiRNA target sequence
ttaatgtattcttttctcctattt

SEQ ID NO: 144286 - DNA, 24 bp, Artificial sequence
  SiRNA target sequence
taatgtattcttttctcctatttt

SEQ ID NO: 144287 - DNA, 24 bp, Artificial sequence
  SiRNA target sequence
aatgtattcttttctcctattttt

SEQ ID NO: 144288 - DNA, 24 bp, Artificial sequence
  SiRNA target sequence
atgtattcttttctcctattttta

SEQ ID NO: 144289 - DNA, 24 bp, Artificial sequence
  SiRNA target sequence
tgtattcttttctcctatttttat

SEQ ID NO: 144290 - DNA, 24 bp, Artificial sequence
  SiRNA target sequence
gtattcttttctcctatttttata

SEQ ID NO: 144291 - DNA, 24 bp, Artificial sequence
  SiRNA target sequence
tattcttttctcctatttttatac

SEQ ID NO: 144292 - DNA, 24 bp, Artificial sequence
  SiRNA target sequence
attcttttctcctatttttatact

SEQ ID NO: 144293 - DNA, 24 bp, Artificial sequence
  SiRNA target sequence
ttcttttctcctatttttatactg

SEQ ID NO: 144294 - DNA, 24 bp, Artificial sequence
  SiRNA target sequence
tcttttctcctatttttatactgt

SEQ ID NO: 144295 - DNA, 24 bp, Artificial sequence
  SiRNA target sequence
cttttctcctatttttatactgta

SEQ ID NO: 144296 - DNA, 24 bp, Artificial sequence
  SiRNA target sequence
ttttctcctatttttatactgtaa

SEQ ID NO: 144297 - DNA, 24 bp, Artificial sequence
  SiRNA target sequence
tttctcctatttttatactgtaaa

SEQ ID NO: 144298 - DNA, 24 bp, Artificial sequence
  SiRNA target sequence
ttctcctatttttatactgtaaat

SEQ ID NO: 144299 - DNA, 24 bp, Artificial sequence
  SiRNA target sequence
tctcctatttttatactgtaaata

SEQ ID NO: 144300 - DNA, 24 bp, Artificial sequence
  SiRNA target sequence
ctcctatttttatactgtaaataa

SEQ ID NO: 144301 - DNA, 24 bp, Artificial sequence
  SiRNA target sequence
tcctatttttatactgtaaataat

SEQ ID NO: 144302 - DNA, 24 bp, Artificial sequence
  SiRNA target sequence
cctatttttatactgtaaataata

SEQ ID NO: 144303 - DNA, 24 bp, Artificial sequence
  SiRNA target sequence
ctatttttatactgtaaataatac

SEQ ID NO: 144304 - DNA, 24 bp, Artificial sequence
  SiRNA target sequence
tatttttatactgtaaataatacg

SEQ ID NO: 144305 - DNA, 24 bp, Artificial sequence
  SiRNA target sequence
atttttatactgtaaataatacgc

SEQ ID NO: 144306 - DNA, 24 bp, Artificial sequence
  SiRNA target sequence
tttttatactgtaaataatacgca

SEQ ID NO: 144307 - DNA, 24 bp, Artificial sequence
  SiRNA target sequence
ttttatactgtaaataatacgcat

SEQ ID NO: 144308 - DNA, 24 bp, Artificial sequence
  SiRNA target sequence
tttatactgtaaataatacgcatg

SEQ ID NO: 144309 - DNA, 24 bp, Artificial sequence
  SiRNA target sequence
ttatactgtaaataatacgcatgt

SEQ ID NO: 144310 - DNA, 24 bp, Artificial sequence
  SiRNA target sequence
tatactgtaaataatacgcatgtt

SEQ ID NO: 144311 - DNA, 24 bp, Artificial sequence
  SiRNA target sequence
atactgtaaataatacgcatgttc

SEQ ID NO: 144312 - DNA, 24 bp, Artificial sequence
  SiRNA target sequence
tactgtaaataatacgcatgttcc

SEQ ID NO: 144313 - DNA, 24 bp, Artificial sequence
  SiRNA target sequence
actgtaaataatacgcatgttccc

SEQ ID NO: 144314 - DNA, 24 bp, Artificial sequence
  SiRNA target sequence
ctgtaaataatacgcatgttccca

SEQ ID NO: 144315 - DNA, 24 bp, Artificial sequence
  SiRNA target sequence
tgtaaataatacgcatgttcccat

SEQ ID NO: 144316 - DNA, 24 bp, Artificial sequence
  SiRNA target sequence
gtaaataatacgcatgttcccata

SEQ ID NO: 144317 - DNA, 24 bp, Artificial sequence
  SiRNA target sequence
taaataatacgcatgttcccatac

SEQ ID NO: 144318 - DNA, 24 bp, Artificial sequence
  SiRNA target sequence
aaataatacgcatgttcccataca

SEQ ID NO: 144319 - DNA, 24 bp, Artificial sequence
  SiRNA target sequence
aataatacgcatgttcccatacat

SEQ ID NO: 144320 - DNA, 24 bp, Artificial sequence
  SiRNA target sequence
ataatacgcatgttcccatacatc

SEQ ID NO: 144321 - DNA, 24 bp, Artificial sequence
  SiRNA target sequence
taatacgcatgttcccatacatca

SEQ ID NO: 144322 - DNA, 24 bp, Artificial sequence
  SiRNA target sequence
aatacgcatgttcccatacatcaa

SEQ ID NO: 144323 - DNA, 24 bp, Artificial sequence
  SiRNA target sequence
atacgcatgttcccatacatcaag

SEQ ID NO: 144324 - DNA, 24 bp, Artificial sequence
  SiRNA target sequence
tacgcatgttcccatacatcaaga

SEQ ID NO: 144325 - DNA, 24 bp, Artificial sequence
  SiRNA target sequence
acgcatgttcccatacatcaagac

SEQ ID NO: 144326 - DNA, 24 bp, Artificial sequence
  SiRNA target sequence
cgcatgttcccatacatcaagaca

SEQ ID NO: 144327 - DNA, 24 bp, Artificial sequence
  SiRNA target sequence
gcatgttcccatacatcaagacat

SEQ ID NO: 144328 - DNA, 24 bp, Artificial sequence
  SiRNA target sequence
catgttcccatacatcaagacata

SEQ ID NO: 144329 - DNA, 24 bp, Artificial sequence
  SiRNA target sequence
atgttcccatacatcaagacatag

SEQ ID NO: 144330 - DNA, 24 bp, Artificial sequence
  SiRNA target sequence
tgttcccatacatcaagacatagt

SEQ ID NO: 144331 - DNA, 24 bp, Artificial sequence
  SiRNA target sequence
gttcccatacatcaagacatagta

SEQ ID NO: 144332 - DNA, 24 bp, Artificial sequence
  SiRNA target sequence
ttcccatacatcaagacatagtaa

SEQ ID NO: 144333 - DNA, 24 bp, Artificial sequence
  SiRNA target sequence
tcccatacatcaagacatagtaaa

SEQ ID NO: 144334 - DNA, 24 bp, Artificial sequence
  SiRNA target sequence
cccatacatcaagacatagtaaag

SEQ ID NO: 144335 - DNA, 24 bp, Artificial sequence
  SiRNA target sequence
ccatacatcaagacatagtaaagg

SEQ ID NO: 144336 - DNA, 24 bp, Artificial sequence
  SiRNA target sequence
catacatcaagacatagtaaagga

SEQ ID NO: 144337 - DNA, 24 bp, Artificial sequence
  SiRNA target sequence
atacatcaagacatagtaaaggaa

SEQ ID NO: 144338 - DNA, 24 bp, Artificial sequence
  SiRNA target sequence
tacatcaagacatagtaaaggaat

SEQ ID NO: 144339 - DNA, 24 bp, Artificial sequence
  SiRNA target sequence
acatcaagacatagtaaaggaata

SEQ ID NO: 144340 - DNA, 24 bp, Artificial sequence
  SiRNA target sequence
catcaagacatagtaaaggaatac

SEQ ID NO: 144341 - DNA, 24 bp, Artificial sequence
  SiRNA target sequence
atcaagacatagtaaaggaataca

SEQ ID NO: 144342 - DNA, 24 bp, Artificial sequence
  SiRNA target sequence
tcaagacatagtaaaggaatacat

SEQ ID NO: 144343 - DNA, 24 bp, Artificial sequence
  SiRNA target sequence
caagacatagtaaaggaatacatt

SEQ ID NO: 144344 - DNA, 24 bp, Artificial sequence
  SiRNA target sequence
aagacatagtaaaggaatacattc

SEQ ID NO: 144345 - DNA, 24 bp, Artificial sequence
  SiRNA target sequence
agacatagtaaaggaatacattca

SEQ ID NO: 144346 - DNA, 24 bp, Artificial sequence
  SiRNA target sequence
gacatagtaaaggaatacattcac

SEQ ID NO: 144347 - DNA, 24 bp, Artificial sequence
  SiRNA target sequence
acatagtaaaggaatacattcacc

SEQ ID NO: 144348 - DNA, 24 bp, Artificial sequence
  SiRNA target sequence
catagtaaaggaatacattcacca

SEQ ID NO: 144349 - DNA, 24 bp, Artificial sequence
  SiRNA target sequence
atagtaaaggaatacattcaccat

SEQ ID NO: 144350 - DNA, 24 bp, Artificial sequence
  SiRNA target sequence
tagtaaaggaatacattcaccatc

SEQ ID NO: 144351 - DNA, 24 bp, Artificial sequence
  SiRNA target sequence
agtaaaggaatacattcaccatcc

SEQ ID NO: 144352 - DNA, 24 bp, Artificial sequence
  SiRNA target sequence
gtaaaggaatacattcaccatcct

SEQ ID NO: 144353 - DNA, 24 bp, Artificial sequence
  SiRNA target sequence
taaaggaatacattcaccatcctc

SEQ ID NO: 144354 - DNA, 24 bp, Artificial sequence
  SiRNA target sequence
aaaggaatacattcaccatcctcc

SEQ ID NO: 144355 - DNA, 24 bp, Artificial sequence
  SiRNA target sequence
aaggaatacattcaccatcctcca

SEQ ID NO: 144356 - DNA, 24 bp, Artificial sequence
  SiRNA target sequence
aggaatacattcaccatcctccat

SEQ ID NO: 144357 - DNA, 24 bp, Artificial sequence
  SiRNA target sequence
ggaatacattcaccatcctccatc

SEQ ID NO: 144358 - DNA, 24 bp, Artificial sequence
  SiRNA target sequence
gaatacattcaccatcctccatca

SEQ ID NO: 144359 - DNA, 24 bp, Artificial sequence
  SiRNA target sequence
aatacattcaccatcctccatcat

SEQ ID NO: 144360 - DNA, 24 bp, Artificial sequence
  SiRNA target sequence
atacattcaccatcctccatcata

SEQ ID NO: 144361 - DNA, 24 bp, Artificial sequence
  SiRNA target sequence
tacattcaccatcctccatcatag

SEQ ID NO: 144362 - DNA, 24 bp, Artificial sequence
  SiRNA target sequence
acattcaccatcctccatcatagg

SEQ ID NO: 144363 - DNA, 24 bp, Artificial sequence
  SiRNA target sequence
cattcaccatcctccatcatagga

SEQ ID NO: 144364 - DNA, 24 bp, Artificial sequence
  SiRNA target sequence
attcaccatcctccatcataggat

SEQ ID NO: 144365 - DNA, 24 bp, Artificial sequence
  SiRNA target sequence
ttcaccatcctccatcataggatt

SEQ ID NO: 144366 - DNA, 24 bp, Artificial sequence
  SiRNA target sequence
tcaccatcctccatcataggattg

SEQ ID NO: 144367 - DNA, 24 bp, Artificial sequence
  SiRNA target sequence
caccatcctccatcataggattgt

SEQ ID NO: 144368 - DNA, 24 bp, Artificial sequence
  SiRNA target sequence
accatcctccatcataggattgtc

SEQ ID NO: 144369 - DNA, 24 bp, Artificial sequence
  SiRNA target sequence
ccatcctccatcataggattgtct

SEQ ID NO: 144370 - DNA, 24 bp, Artificial sequence
  SiRNA target sequence
catcctccatcataggattgtctt

SEQ ID NO: 144371 - DNA, 24 bp, Artificial sequence
  SiRNA target sequence
atcctccatcataggattgtcttg

SEQ ID NO: 144372 - DNA, 24 bp, Artificial sequence
  SiRNA target sequence
tcctccatcataggattgtcttga

SEQ ID NO: 144373 - DNA, 24 bp, Artificial sequence
  SiRNA target sequence
cctccatcataggattgtcttgat

SEQ ID NO: 144374 - DNA, 24 bp, Artificial sequence
  SiRNA target sequence
ctccatcataggattgtcttgatt

SEQ ID NO: 144375 - DNA, 24 bp, Artificial sequence
  SiRNA target sequence
tccatcataggattgtcttgatta

SEQ ID NO: 144376 - DNA, 24 bp, Artificial sequence
  SiRNA target sequence
ccatcataggattgtcttgattaa

SEQ ID NO: 144377 - DNA, 24 bp, Artificial sequence
  SiRNA target sequence
catcataggattgtcttgattaac

SEQ ID NO: 144378 - DNA, 24 bp, Artificial sequence
  SiRNA target sequence
atcataggattgtcttgattaaca

SEQ ID NO: 144379 - DNA, 24 bp, Artificial sequence
  SiRNA target sequence
tcataggattgtcttgattaacac

SEQ ID NO: 144380 - DNA, 24 bp, Artificial sequence
  SiRNA target sequence
cataggattgtcttgattaacact

SEQ ID NO: 144381 - DNA, 24 bp, Artificial sequence
  SiRNA target sequence
ataggattgtcttgattaacactg

SEQ ID NO: 144382 - DNA, 24 bp, Artificial sequence
  SiRNA target sequence
taggattgtcttgattaacactgg

SEQ ID NO: 144383 - DNA, 24 bp, Artificial sequence
  SiRNA target sequence
aggattgtcttgattaacactggt

SEQ ID NO: 144384 - DNA, 24 bp, Artificial sequence
  SiRNA target sequence
ggattgtcttgattaacactggtc

SEQ ID NO: 144385 - DNA, 24 bp, Artificial sequence
  SiRNA target sequence
gattgtcttgattaacactggtct

SEQ ID NO: 144386 - DNA, 24 bp, Artificial sequence
  SiRNA target sequence
attgtcttgattaacactggtctt

SEQ ID NO: 144387 - DNA, 24 bp, Artificial sequence
  SiRNA target sequence
ttgtcttgattaacactggtctta

SEQ ID NO: 144388 - DNA, 24 bp, Artificial sequence
  SiRNA target sequence
tgtcttgattaacactggtcttaa

SEQ ID NO: 144389 - DNA, 24 bp, Artificial sequence
  SiRNA target sequence
gtcttgattaacactggtcttaat

SEQ ID NO: 144390 - DNA, 24 bp, Artificial sequence
  SiRNA target sequence
tcttgattaacactggtcttaata

SEQ ID NO: 144391 - DNA, 24 bp, Artificial sequence
  SiRNA target sequence
cttgattaacactggtcttaatac

SEQ ID NO: 144392 - DNA, 24 bp, Artificial sequence
  SiRNA target sequence
ttgattaacactggtcttaataca

SEQ ID NO: 144393 - DNA, 24 bp, Artificial sequence
  SiRNA target sequence
tgattaacactggtcttaatacac

SEQ ID NO: 144394 - DNA, 24 bp, Artificial sequence
  SiRNA target sequence
gattaacactggtcttaatacaca

SEQ ID NO: 144395 - DNA, 24 bp, Artificial sequence
  SiRNA target sequence
attaacactggtcttaatacacaa

SEQ ID NO: 144396 - DNA, 24 bp, Artificial sequence
  SiRNA target sequence
ttaacactggtcttaatacacaat

SEQ ID NO: 144397 - DNA, 24 bp, Artificial sequence
  SiRNA target sequence
taacactggtcttaatacacaatt

SEQ ID NO: 144398 - DNA, 24 bp, Artificial sequence
  SiRNA target sequence
aacactggtcttaatacacaattt

SEQ ID NO: 144399 - DNA, 24 bp, Artificial sequence
  SiRNA target sequence
acactggtcttaatacacaattta

SEQ ID NO: 144400 - DNA, 24 bp, Artificial sequence
  SiRNA target sequence
cactggtcttaatacacaatttat

SEQ ID NO: 144401 - DNA, 24 bp, Artificial sequence
  SiRNA target sequence
actggtcttaatacacaatttatc

SEQ ID NO: 144402 - DNA, 24 bp, Artificial sequence
  SiRNA target sequence
ctggtcttaatacacaatttatct

SEQ ID NO: 144403 - DNA, 24 bp, Artificial sequence
  SiRNA target sequence
tggtcttaatacacaatttatctt

SEQ ID NO: 144404 - DNA, 24 bp, Artificial sequence
  SiRNA target sequence
ggtcttaatacacaatttatcttt

SEQ ID NO: 144405 - DNA, 24 bp, Artificial sequence
  SiRNA target sequence
gtcttaatacacaatttatcttta

SEQ ID NO: 144406 - DNA, 24 bp, Artificial sequence
  SiRNA target sequence
tcttaatacacaatttatctttat

SEQ ID NO: 144407 - DNA, 24 bp, Artificial sequence
  SiRNA target sequence
cttaatacacaatttatctttata

SEQ ID NO: 144408 - DNA, 24 bp, Artificial sequence
  SiRNA target sequence
ttaatacacaatttatctttatat

SEQ ID NO: 144409 - DNA, 24 bp, Artificial sequence
  SiRNA target sequence
taatacacaatttatctttatata

SEQ ID NO: 144410 - DNA, 24 bp, Artificial sequence
  SiRNA target sequence
aatacacaatttatctttatatat

SEQ ID NO: 144411 - DNA, 24 bp, Artificial sequence
  SiRNA target sequence
atacacaatttatctttatatatc

SEQ ID NO: 144412 - DNA, 24 bp, Artificial sequence
  SiRNA target sequence
tacacaatttatctttatatatca

SEQ ID NO: 144413 - DNA, 24 bp, Artificial sequence
  SiRNA target sequence
acacaatttatctttatatatcaa

SEQ ID NO: 144414 - DNA, 24 bp, Artificial sequence
  SiRNA target sequence
cacaatttatctttatatatcaac

SEQ ID NO: 144415 - DNA, 24 bp, Artificial sequence
  SiRNA target sequence
acaatttatctttatatatcaacc

SEQ ID NO: 144416 - DNA, 24 bp, Artificial sequence
  SiRNA target sequence
caatttatctttatatatcaacca

SEQ ID NO: 144417 - DNA, 24 bp, Artificial sequence
  SiRNA target sequence
aatttatctttatatatcaaccac

SEQ ID NO: 144418 - DNA, 24 bp, Artificial sequence
  SiRNA target sequence
atttatctttatatatcaaccaca

SEQ ID NO: 144419 - DNA, 24 bp, Artificial sequence
  SiRNA target sequence
tttatctttatatatcaaccacac

SEQ ID NO: 144420 - DNA, 24 bp, Artificial sequence
  SiRNA target sequence
ttatctttatatatcaaccacacc

SEQ ID NO: 144421 - DNA, 24 bp, Artificial sequence
  SiRNA target sequence
tatctttatatatcaaccacaccc

SEQ ID NO: 144422 - DNA, 24 bp, Artificial sequence
  SiRNA target sequence
atctttatatatcaaccacaccca

SEQ ID NO: 144423 - DNA, 24 bp, Artificial sequence
  SiRNA target sequence
tctttatatatcaaccacacccat

SEQ ID NO: 144424 - DNA, 24 bp, Artificial sequence
  SiRNA target sequence
ctttatatatcaaccacacccatc

SEQ ID NO: 144425 - DNA, 24 bp, Artificial sequence
  SiRNA target sequence
tttatatatcaaccacacccatcc

SEQ ID NO: 144426 - DNA, 24 bp, Artificial sequence
  SiRNA target sequence
ttatatatcaaccacacccatcct

SEQ ID NO: 144427 - DNA, 24 bp, Artificial sequence
  SiRNA target sequence
tatatatcaaccacacccatcctg

SEQ ID NO: 144428 - DNA, 24 bp, Artificial sequence
  SiRNA target sequence
atatatcaaccacacccatcctga

SEQ ID NO: 144429 - DNA, 24 bp, Artificial sequence
  SiRNA target sequence
tatatcaaccacacccatcctgat

SEQ ID NO: 144430 - DNA, 24 bp, Artificial sequence
  SiRNA target sequence
atatcaaccacacccatcctgatc

SEQ ID NO: 144431 - DNA, 24 bp, Artificial sequence
  SiRNA target sequence
tatcaaccacacccatcctgatcc

SEQ ID NO: 144432 - DNA, 24 bp, Artificial sequence
  SiRNA target sequence
atcaaccacacccatcctgatcca

SEQ ID NO: 144433 - DNA, 24 bp, Artificial sequence
  SiRNA target sequence
tcaaccacacccatcctgatccaa

SEQ ID NO: 144434 - DNA, 24 bp, Artificial sequence
  SiRNA target sequence
caaccacacccatcctgatccaaa

SEQ ID NO: 144435 - DNA, 24 bp, Artificial sequence
  SiRNA target sequence
aaccacacccatcctgatccaaat

SEQ ID NO: 144436 - DNA, 24 bp, Artificial sequence
  SiRNA target sequence
accacacccatcctgatccaaata

SEQ ID NO: 144437 - DNA, 24 bp, Artificial sequence
  SiRNA target sequence
ccacacccatcctgatccaaataa

SEQ ID NO: 144438 - DNA, 24 bp, Artificial sequence
  SiRNA target sequence
cacacccatcctgatccaaataat

SEQ ID NO: 144439 - DNA, 24 bp, Artificial sequence
  SiRNA target sequence
acacccatcctgatccaaataatt

SEQ ID NO: 144440 - DNA, 24 bp, Artificial sequence
  SiRNA target sequence
cacccatcctgatccaaataattt

SEQ ID NO: 144441 - DNA, 24 bp, Artificial sequence
  SiRNA target sequence
acccatcctgatccaaataatttt

SEQ ID NO: 144442 - DNA, 24 bp, Artificial sequence
  SiRNA target sequence
cccatcctgatccaaataatttta

SEQ ID NO: 144443 - DNA, 24 bp, Artificial sequence
  SiRNA target sequence
ccatcctgatccaaataattttac

SEQ ID NO: 144444 - DNA, 24 bp, Artificial sequence
  SiRNA target sequence
catcctgatccaaataattttaca

SEQ ID NO: 144445 - DNA, 24 bp, Artificial sequence
  SiRNA target sequence
atcctgatccaaataattttacag

SEQ ID NO: 144446 - DNA, 24 bp, Artificial sequence
  SiRNA target sequence
tcctgatccaaataattttacagc

SEQ ID NO: 144447 - DNA, 24 bp, Artificial sequence
  SiRNA target sequence
cctgatccaaataattttacagct

SEQ ID NO: 144448 - DNA, 24 bp, Artificial sequence
  SiRNA target sequence
ctgatccaaataattttacagctt

SEQ ID NO: 144449 - DNA, 24 bp, Artificial sequence
  SiRNA target sequence
tgatccaaataattttacagcttc

SEQ ID NO: 144450 - DNA, 24 bp, Artificial sequence
  SiRNA target sequence
gatccaaataattttacagcttca

SEQ ID NO: 144451 - DNA, 24 bp, Artificial sequence
  SiRNA target sequence
atccaaataattttacagcttcag

SEQ ID NO: 144452 - DNA, 24 bp, Artificial sequence
  SiRNA target sequence
tccaaataattttacagcttcagt

SEQ ID NO: 144453 - DNA, 24 bp, Artificial sequence
  SiRNA target sequence
ccaaataattttacagcttcagta

SEQ ID NO: 144454 - DNA, 24 bp, Artificial sequence
  SiRNA target sequence
caaataattttacagcttcagtat

SEQ ID NO: 144455 - DNA, 24 bp, Artificial sequence
  SiRNA target sequence
aaataattttacagcttcagtatt

SEQ ID NO: 144456 - DNA, 24 bp, Artificial sequence
  SiRNA target sequence
aataattttacagcttcagtatta

SEQ ID NO: 144457 - DNA, 24 bp, Artificial sequence
  SiRNA target sequence
ataattttacagcttcagtattaa

SEQ ID NO: 144458 - DNA, 24 bp, Artificial sequence
  SiRNA target sequence
taattttacagcttcagtattaaa

SEQ ID NO: 144459 - DNA, 24 bp, Artificial sequence
  SiRNA target sequence
aattttacagcttcagtattaaaa

SEQ ID NO: 144460 - DNA, 24 bp, Artificial sequence
  SiRNA target sequence
attttacagcttcagtattaaaat

SEQ ID NO: 144461 - DNA, 24 bp, Artificial sequence
  SiRNA target sequence
ttttacagcttcagtattaaaatt

SEQ ID NO: 144462 - DNA, 24 bp, Artificial sequence
  SiRNA target sequence
tttacagcttcagtattaaaattc

SEQ ID NO: 144463 - DNA, 24 bp, Artificial sequence
  SiRNA target sequence
ttacagcttcagtattaaaattct

SEQ ID NO: 144464 - DNA, 24 bp, Artificial sequence
  SiRNA target sequence
tacagcttcagtattaaaattctc

SEQ ID NO: 144465 - DNA, 24 bp, Artificial sequence
  SiRNA target sequence
acagcttcagtattaaaattctcc

SEQ ID NO: 144466 - DNA, 24 bp, Artificial sequence
  SiRNA target sequence
cagcttcagtattaaaattctcct

SEQ ID NO: 144467 - DNA, 24 bp, Artificial sequence
  SiRNA target sequence
agcttcagtattaaaattctcctt

SEQ ID NO: 144468 - DNA, 24 bp, Artificial sequence
  SiRNA target sequence
gcttcagtattaaaattctcctta

SEQ ID NO: 144469 - DNA, 24 bp, Artificial sequence
  SiRNA target sequence
cttcagtattaaaattctccttaa

SEQ ID NO: 144470 - DNA, 24 bp, Artificial sequence
  SiRNA target sequence
ttcagtattaaaattctccttaaa

SEQ ID NO: 144471 - DNA, 24 bp, Artificial sequence
  SiRNA target sequence
tcagtattaaaattctccttaaat

SEQ ID NO: 144472 - DNA, 24 bp, Artificial sequence
  SiRNA target sequence
cagtattaaaattctccttaaatt

SEQ ID NO: 144473 - DNA, 24 bp, Artificial sequence
  SiRNA target sequence
agtattaaaattctccttaaattt

SEQ ID NO: 144474 - DNA, 24 bp, Artificial sequence
  SiRNA target sequence
gtattaaaattctccttaaattta

SEQ ID NO: 144475 - DNA, 24 bp, Artificial sequence
  SiRNA target sequence
tattaaaattctccttaaatttat

SEQ ID NO: 144476 - DNA, 24 bp, Artificial sequence
  SiRNA target sequence
attaaaattctccttaaatttatt

SEQ ID NO: 144477 - DNA, 24 bp, Artificial sequence
  SiRNA target sequence
ttaaaattctccttaaatttattt

SEQ ID NO: 144478 - DNA, 24 bp, Artificial sequence
  SiRNA target sequence
taaaattctccttaaatttattta

SEQ ID NO: 144479 - DNA, 24 bp, Artificial sequence
  SiRNA target sequence
aaaattctccttaaatttatttat

SEQ ID NO: 144480 - DNA, 24 bp, Artificial sequence
  SiRNA target sequence
aaattctccttaaatttatttatt

SEQ ID NO: 144481 - DNA, 24 bp, Artificial sequence
  SiRNA target sequence
aattctccttaaatttatttattg

SEQ ID NO: 144482 - DNA, 24 bp, Artificial sequence
  SiRNA target sequence
attctccttaaatttatttattga

SEQ ID NO: 144483 - DNA, 24 bp, Artificial sequence
  SiRNA target sequence
ttctccttaaatttatttattgat

SEQ ID NO: 144484 - DNA, 24 bp, Artificial sequence
  SiRNA target sequence
tctccttaaatttatttattgatc

SEQ ID NO: 144485 - DNA, 24 bp, Artificial sequence
  SiRNA target sequence
ctccttaaatttatttattgatcc

SEQ ID NO: 144486 - DNA, 24 bp, Artificial sequence
  SiRNA target sequence
tccttaaatttatttattgatcca

SEQ ID NO: 144487 - DNA, 24 bp, Artificial sequence
  SiRNA target sequence
ccttaaatttatttattgatccaa

SEQ ID NO: 144488 - DNA, 24 bp, Artificial sequence
  SiRNA target sequence
cttaaatttatttattgatccaaa

SEQ ID NO: 144489 - DNA, 24 bp, Artificial sequence
  SiRNA target sequence
ttaaatttatttattgatccaaag

SEQ ID NO: 144490 - DNA, 24 bp, Artificial sequence
  SiRNA target sequence
taaatttatttattgatccaaagt

SEQ ID NO: 144491 - DNA, 24 bp, Artificial sequence
  SiRNA target sequence
aaatttatttattgatccaaagtc

SEQ ID NO: 144492 - DNA, 24 bp, Artificial sequence
  SiRNA target sequence
aatttatttattgatccaaagtct

SEQ ID NO: 144493 - DNA, 24 bp, Artificial sequence
  SiRNA target sequence
atttatttattgatccaaagtctt

SEQ ID NO: 144494 - DNA, 24 bp, Artificial sequence
  SiRNA target sequence
tttatttattgatccaaagtcttt

SEQ ID NO: 144495 - DNA, 24 bp, Artificial sequence
  SiRNA target sequence
ttatttattgatccaaagtctttt

SEQ ID NO: 144496 - DNA, 24 bp, Artificial sequence
  SiRNA target sequence
tatttattgatccaaagtctttta

SEQ ID NO: 144497 - DNA, 24 bp, Artificial sequence
  SiRNA target sequence
atttattgatccaaagtcttttat

SEQ ID NO: 144498 - DNA, 24 bp, Artificial sequence
  SiRNA target sequence
tttattgatccaaagtcttttatt

SEQ ID NO: 144499 - DNA, 24 bp, Artificial sequence
  SiRNA target sequence
ttattgatccaaagtcttttatta

SEQ ID NO: 144500 - DNA, 24 bp, Artificial sequence
  SiRNA target sequence
tattgatccaaagtcttttattat

SEQ ID NO: 144501 - DNA, 24 bp, Artificial sequence
  SiRNA target sequence
attgatccaaagtcttttattata

SEQ ID NO: 144502 - DNA, 24 bp, Artificial sequence
  SiRNA target sequence
ttgatccaaagtcttttattatag

SEQ ID NO: 144503 - DNA, 24 bp, Artificial sequence
  SiRNA target sequence
tgatccaaagtcttttattatagc

SEQ ID NO: 144504 - DNA, 24 bp, Artificial sequence
  SiRNA target sequence
gatccaaagtcttttattatagca

SEQ ID NO: 144505 - DNA, 24 bp, Artificial sequence
  SiRNA target sequence
atccaaagtcttttattatagcac

SEQ ID NO: 144506 - DNA, 24 bp, Artificial sequence
  SiRNA target sequence
tccaaagtcttttattatagcact

SEQ ID NO: 144507 - DNA, 24 bp, Artificial sequence
  SiRNA target sequence
ccaaagtcttttattatagcactt

SEQ ID NO: 144508 - DNA, 24 bp, Artificial sequence
  SiRNA target sequence
caaagtcttttattatagcacttt

SEQ ID NO: 144509 - DNA, 24 bp, Artificial sequence
  SiRNA target sequence
aaagtcttttattatagcactttc

SEQ ID NO: 144510 - DNA, 24 bp, Artificial sequence
  SiRNA target sequence
aagtcttttattatagcactttcc

SEQ ID NO: 144511 - DNA, 24 bp, Artificial sequence
  SiRNA target sequence
agtcttttattatagcactttcca

SEQ ID NO: 144512 - DNA, 24 bp, Artificial sequence
  SiRNA target sequence
gtcttttattatagcactttccaa

SEQ ID NO: 144513 - DNA, 24 bp, Artificial sequence
  SiRNA target sequence
tcttttattatagcactttccaac

SEQ ID NO: 144514 - DNA, 24 bp, Artificial sequence
  SiRNA target sequence
cttttattatagcactttccaact

SEQ ID NO: 144515 - DNA, 24 bp, Artificial sequence
  SiRNA target sequence
ttttattatagcactttccaactg

SEQ ID NO: 144516 - DNA, 24 bp, Artificial sequence
  SiRNA target sequence
tttattatagcactttccaactgg

SEQ ID NO: 144517 - DNA, 24 bp, Artificial sequence
  SiRNA target sequence
ttattatagcactttccaactggg

SEQ ID NO: 144518 - DNA, 24 bp, Artificial sequence
  SiRNA target sequence
tattatagcactttccaactggga

SEQ ID NO: 144519 - DNA, 24 bp, Artificial sequence
  SiRNA target sequence
attatagcactttccaactgggaa

SEQ ID NO: 144520 - DNA, 24 bp, Artificial sequence
  SiRNA target sequence
ttatagcactttccaactgggaag

SEQ ID NO: 144521 - DNA, 24 bp, Artificial sequence
  SiRNA target sequence
tatagcactttccaactgggaaga

SEQ ID NO: 144522 - DNA, 24 bp, Artificial sequence
  SiRNA target sequence
atagcactttccaactgggaagaa

SEQ ID NO: 144523 - DNA, 24 bp, Artificial sequence
  SiRNA target sequence
tagcactttccaactgggaagaaa

SEQ ID NO: 144524 - DNA, 24 bp, Artificial sequence
  SiRNA target sequence
agcactttccaactgggaagaaat

SEQ ID NO: 144525 - DNA, 24 bp, Artificial sequence
  SiRNA target sequence
gcactttccaactgggaagaaatc

SEQ ID NO: 144526 - DNA, 24 bp, Artificial sequence
  SiRNA target sequence
cactttccaactgggaagaaatct

SEQ ID NO: 144527 - DNA, 24 bp, Artificial sequence
  SiRNA target sequence
actttccaactgggaagaaatctt

SEQ ID NO: 144528 - DNA, 24 bp, Artificial sequence
  SiRNA target sequence
ctttccaactgggaagaaatcttt

SEQ ID NO: 144529 - DNA, 24 bp, Artificial sequence
  SiRNA target sequence
tttccaactgggaagaaatctttt

SEQ ID NO: 144530 - DNA, 24 bp, Artificial sequence
  SiRNA target sequence
ttccaactgggaagaaatcttttt

SEQ ID NO: 144531 - DNA, 24 bp, Artificial sequence
  SiRNA target sequence
tccaactgggaagaaatcttttta

SEQ ID NO: 144532 - DNA, 24 bp, Artificial sequence
  SiRNA target sequence
ccaactgggaagaaatctttttat

SEQ ID NO: 144533 - DNA, 24 bp, Artificial sequence
  SiRNA target sequence
caactgggaagaaatctttttatt

SEQ ID NO: 144534 - DNA, 24 bp, Artificial sequence
  SiRNA target sequence
aactgggaagaaatctttttattt

SEQ ID NO: 144535 - DNA, 24 bp, Artificial sequence
  SiRNA target sequence
actgggaagaaatctttttatttt

SEQ ID NO: 144536 - DNA, 24 bp, Artificial sequence
  SiRNA target sequence
ctgggaagaaatctttttattttc

SEQ ID NO: 144537 - DNA, 24 bp, Artificial sequence
  SiRNA target sequence
tgggaagaaatctttttattttct

SEQ ID NO: 144538 - DNA, 24 bp, Artificial sequence
  SiRNA target sequence
gggaagaaatctttttattttctg

SEQ ID NO: 144539 - DNA, 24 bp, Artificial sequence
  SiRNA target sequence
ggaagaaatctttttattttctgg

SEQ ID NO: 144540 - DNA, 24 bp, Artificial sequence
  SiRNA target sequence
gaagaaatctttttattttctggt

SEQ ID NO: 144541 - DNA, 24 bp, Artificial sequence
  SiRNA target sequence
aagaaatctttttattttctggtg

SEQ ID NO: 144542 - DNA, 24 bp, Artificial sequence
  SiRNA target sequence
agaaatctttttattttctggtga

SEQ ID NO: 144543 - DNA, 24 bp, Artificial sequence
  SiRNA target sequence
gaaatctttttattttctggtgac

SEQ ID NO: 144544 - DNA, 24 bp, Artificial sequence
  SiRNA target sequence
aaatctttttattttctggtgaca

SEQ ID NO: 144545 - DNA, 24 bp, Artificial sequence
  SiRNA target sequence
aatctttttattttctggtgacat

SEQ ID NO: 144546 - DNA, 24 bp, Artificial sequence
  SiRNA target sequence
atctttttattttctggtgacatt

SEQ ID NO: 144547 - DNA, 24 bp, Artificial sequence
  SiRNA target sequence
tctttttattttctggtgacatta

SEQ ID NO: 144548 - DNA, 24 bp, Artificial sequence
  SiRNA target sequence
ctttttattttctggtgacattac

SEQ ID NO: 144549 - DNA, 24 bp, Artificial sequence
  SiRNA target sequence
tttttattttctggtgacattacc

SEQ ID NO: 144550 - DNA, 24 bp, Artificial sequence
  SiRNA target sequence
ttttattttctggtgacattacca

SEQ ID NO: 144551 - DNA, 24 bp, Artificial sequence
  SiRNA target sequence
tttattttctggtgacattaccaa

SEQ ID NO: 144552 - DNA, 24 bp, Artificial sequence
  SiRNA target sequence
ttattttctggtgacattaccaac

SEQ ID NO: 144553 - DNA, 24 bp, Artificial sequence
  SiRNA target sequence
tattttctggtgacattaccaacc

SEQ ID NO: 144554 - DNA, 24 bp, Artificial sequence
  SiRNA target sequence
attttctggtgacattaccaacca

SEQ ID NO: 144555 - DNA, 24 bp, Artificial sequence
  SiRNA target sequence
ttttctggtgacattaccaaccag

SEQ ID NO: 144556 - DNA, 24 bp, Artificial sequence
  SiRNA target sequence
tttctggtgacattaccaaccaga

SEQ ID NO: 144557 - DNA, 24 bp, Artificial sequence
  SiRNA target sequence
ttctggtgacattaccaaccagaa

SEQ ID NO: 144558 - DNA, 24 bp, Artificial sequence
  SiRNA target sequence
tctggtgacattaccaaccagaaa

SEQ ID NO: 144559 - DNA, 24 bp, Artificial sequence
  SiRNA target sequence
ctggtgacattaccaaccagaaaa

SEQ ID NO: 144560 - DNA, 24 bp, Artificial sequence
  SiRNA target sequence
tggtgacattaccaaccagaaaag

SEQ ID NO: 144561 - DNA, 24 bp, Artificial sequence
  SiRNA target sequence
ggtgacattaccaaccagaaaaga

SEQ ID NO: 144562 - DNA, 24 bp, Artificial sequence
  SiRNA target sequence
gtgacattaccaaccagaaaagac

SEQ ID NO: 144563 - DNA, 24 bp, Artificial sequence
  SiRNA target sequence
tgacattaccaaccagaaaagact

SEQ ID NO: 144564 - DNA, 24 bp, Artificial sequence
  SiRNA target sequence
gacattaccaaccagaaaagacta

SEQ ID NO: 144565 - DNA, 24 bp, Artificial sequence
  SiRNA target sequence
acattaccaaccagaaaagactat

SEQ ID NO: 144566 - DNA, 24 bp, Artificial sequence
  SiRNA target sequence
cattaccaaccagaaaagactatg

SEQ ID NO: 144567 - DNA, 24 bp, Artificial sequence
  SiRNA target sequence
attaccaaccagaaaagactatgg

SEQ ID NO: 144568 - DNA, 24 bp, Artificial sequence
  SiRNA target sequence
ttaccaaccagaaaagactatggt

SEQ ID NO: 144569 - DNA, 24 bp, Artificial sequence
  SiRNA target sequence
taccaaccagaaaagactatggtt

SEQ ID NO: 144570 - DNA, 24 bp, Artificial sequence
  SiRNA target sequence
accaaccagaaaagactatggttg

SEQ ID NO: 144571 - DNA, 24 bp, Artificial sequence
  SiRNA target sequence
ccaaccagaaaagactatggttgt

SEQ ID NO: 144572 - DNA, 24 bp, Artificial sequence
  SiRNA target sequence
caaccagaaaagactatggttgta

SEQ ID NO: 144573 - DNA, 24 bp, Artificial sequence
  SiRNA target sequence
aaccagaaaagactatggttgtaa

SEQ ID NO: 144574 - DNA, 24 bp, Artificial sequence
  SiRNA target sequence
accagaaaagactatggttgtaat

SEQ ID NO: 144575 - DNA, 24 bp, Artificial sequence
  SiRNA target sequence
ccagaaaagactatggttgtaatg

SEQ ID NO: 144576 - DNA, 24 bp, Artificial sequence
  SiRNA target sequence
cagaaaagactatggttgtaatga

SEQ ID NO: 144577 - DNA, 24 bp, Artificial sequence
  SiRNA target sequence
agaaaagactatggttgtaatgac

SEQ ID NO: 144578 - DNA, 24 bp, Artificial sequence
  SiRNA target sequence
gaaaagactatggttgtaatgacc

SEQ ID NO: 144579 - DNA, 24 bp, Artificial sequence
  SiRNA target sequence
aaaagactatggttgtaatgacca

SEQ ID NO: 144580 - DNA, 24 bp, Artificial sequence
  SiRNA target sequence
aaagactatggttgtaatgaccac

SEQ ID NO: 144581 - DNA, 24 bp, Artificial sequence
  SiRNA target sequence
aagactatggttgtaatgaccacc

SEQ ID NO: 144582 - DNA, 24 bp, Artificial sequence
  SiRNA target sequence
agactatggttgtaatgaccacca

SEQ ID NO: 144583 - DNA, 24 bp, Artificial sequence
  SiRNA target sequence
gactatggttgtaatgaccaccac

SEQ ID NO: 144584 - DNA, 24 bp, Artificial sequence
  SiRNA target sequence
actatggttgtaatgaccaccacc

SEQ ID NO: 144585 - DNA, 24 bp, Artificial sequence
  SiRNA target sequence
ctatggttgtaatgaccaccacca

SEQ ID NO: 144586 - DNA, 24 bp, Artificial sequence
  SiRNA target sequence
tatggttgtaatgaccaccaccat

SEQ ID NO: 144587 - DNA, 24 bp, Artificial sequence
  SiRNA target sequence
atggttgtaatgaccaccaccata

SEQ ID NO: 144588 - DNA, 24 bp, Artificial sequence
  SiRNA target sequence
tggttgtaatgaccaccaccataa

SEQ ID NO: 144589 - DNA, 24 bp, Artificial sequence
  SiRNA target sequence
ggttgtaatgaccaccaccataat

SEQ ID NO: 144590 - DNA, 24 bp, Artificial sequence
  SiRNA target sequence
gttgtaatgaccaccaccataatc

SEQ ID NO: 144591 - DNA, 24 bp, Artificial sequence
  SiRNA target sequence
ttgtaatgaccaccaccataatct

SEQ ID NO: 144592 - DNA, 24 bp, Artificial sequence
  SiRNA target sequence
tgtaatgaccaccaccataatctc

SEQ ID NO: 144593 - DNA, 24 bp, Artificial sequence
  SiRNA target sequence
gtaatgaccaccaccataatctct

SEQ ID NO: 144594 - DNA, 24 bp, Artificial sequence
  SiRNA target sequence
taatgaccaccaccataatctctt

SEQ ID NO: 144595 - DNA, 24 bp, Artificial sequence
  SiRNA target sequence
aatgaccaccaccataatctctta

SEQ ID NO: 144596 - DNA, 24 bp, Artificial sequence
  SiRNA target sequence
atgaccaccaccataatctcttaa

SEQ ID NO: 144597 - DNA, 24 bp, Artificial sequence
  SiRNA target sequence
tgaccaccaccataatctcttaat

SEQ ID NO: 144598 - DNA, 24 bp, Artificial sequence
  SiRNA target sequence
gaccaccaccataatctcttaatt

SEQ ID NO: 144599 - DNA, 24 bp, Artificial sequence
  SiRNA target sequence
accaccaccataatctcttaattg

SEQ ID NO: 144600 - DNA, 24 bp, Artificial sequence
  SiRNA target sequence
ccaccaccataatctcttaattgt

SEQ ID NO: 144601 - DNA, 24 bp, Artificial sequence
  SiRNA target sequence
caccaccataatctcttaattgtt

SEQ ID NO: 144602 - DNA, 24 bp, Artificial sequence
  SiRNA target sequence
accaccataatctcttaattgttt

SEQ ID NO: 144603 - DNA, 24 bp, Artificial sequence
  SiRNA target sequence
ccaccataatctcttaattgttta

SEQ ID NO: 144604 - DNA, 24 bp, Artificial sequence
  SiRNA target sequence
caccataatctcttaattgtttat

SEQ ID NO: 144605 - DNA, 24 bp, Artificial sequence
  SiRNA target sequence
accataatctcttaattgtttatc

SEQ ID NO: 144606 - DNA, 24 bp, Artificial sequence
  SiRNA target sequence
ccataatctcttaattgtttatca

SEQ ID NO: 144607 - DNA, 24 bp, Artificial sequence
  SiRNA target sequence
cataatctcttaattgtttatcaa

SEQ ID NO: 144608 - DNA, 24 bp, Artificial sequence
  SiRNA target sequence
ataatctcttaattgtttatcaac

SEQ ID NO: 144609 - DNA, 24 bp, Artificial sequence
  SiRNA target sequence
taatctcttaattgtttatcaaca

SEQ ID NO: 144610 - DNA, 24 bp, Artificial sequence
  SiRNA target sequence
aatctcttaattgtttatcaacaa

SEQ ID NO: 144611 - DNA, 24 bp, Artificial sequence
  SiRNA target sequence
atctcttaattgtttatcaacaag

SEQ ID NO: 144612 - DNA, 24 bp, Artificial sequence
  SiRNA target sequence
tctcttaattgtttatcaacaagt

SEQ ID NO: 144613 - DNA, 24 bp, Artificial sequence
  SiRNA target sequence
ctcttaattgtttatcaacaagtg

SEQ ID NO: 144614 - DNA, 24 bp, Artificial sequence
  SiRNA target sequence
tcttaattgtttatcaacaagtgc

SEQ ID NO: 144615 - DNA, 24 bp, Artificial sequence
  SiRNA target sequence
cttaattgtttatcaacaagtgca

SEQ ID NO: 144616 - DNA, 24 bp, Artificial sequence
  SiRNA target sequence
ttaattgtttatcaacaagtgcat

SEQ ID NO: 144617 - DNA, 24 bp, Artificial sequence
  SiRNA target sequence
taattgtttatcaacaagtgcatt

SEQ ID NO: 144618 - DNA, 24 bp, Artificial sequence
  SiRNA target sequence
aattgtttatcaacaagtgcattt

SEQ ID NO: 144619 - DNA, 24 bp, Artificial sequence
  SiRNA target sequence
attgtttatcaacaagtgcatttc

SEQ ID NO: 144620 - DNA, 24 bp, Artificial sequence
  SiRNA target sequence
ttgtttatcaacaagtgcatttcc

SEQ ID NO: 144621 - DNA, 24 bp, Artificial sequence
  SiRNA target sequence
tgtttatcaacaagtgcatttcct

SEQ ID NO: 144622 - DNA, 24 bp, Artificial sequence
  SiRNA target sequence
gtttatcaacaagtgcatttcctt

SEQ ID NO: 144623 - DNA, 24 bp, Artificial sequence
  SiRNA target sequence
tttatcaacaagtgcatttccttt

SEQ ID NO: 144624 - DNA, 24 bp, Artificial sequence
  SiRNA target sequence
ttatcaacaagtgcatttccttta

SEQ ID NO: 144625 - DNA, 24 bp, Artificial sequence
  SiRNA target sequence
tatcaacaagtgcatttcctttat

SEQ ID NO: 144626 - DNA, 24 bp, Artificial sequence
  SiRNA target sequence
atcaacaagtgcatttcctttatt

SEQ ID NO: 144627 - DNA, 24 bp, Artificial sequence
  SiRNA target sequence
tcaacaagtgcatttcctttatta

SEQ ID NO: 144628 - DNA, 24 bp, Artificial sequence
  SiRNA target sequence
caacaagtgcatttcctttattat

SEQ ID NO: 144629 - DNA, 24 bp, Artificial sequence
  SiRNA target sequence
aacaagtgcatttcctttattatt

SEQ ID NO: 144630 - DNA, 24 bp, Artificial sequence
  SiRNA target sequence
acaagtgcatttcctttattatta

SEQ ID NO: 144631 - DNA, 24 bp, Artificial sequence
  SiRNA target sequence
caagtgcatttcctttattattaa

SEQ ID NO: 144632 - DNA, 24 bp, Artificial sequence
  SiRNA target sequence
aagtgcatttcctttattattaaa

SEQ ID NO: 144633 - DNA, 24 bp, Artificial sequence
  SiRNA target sequence
agtgcatttcctttattattaaaa

SEQ ID NO: 144634 - DNA, 24 bp, Artificial sequence
  SiRNA target sequence
gtgcatttcctttattattaaaaa

SEQ ID NO: 144635 - DNA, 24 bp, Artificial sequence
  SiRNA target sequence
tgcatttcctttattattaaaaag

SEQ ID NO: 144636 - DNA, 24 bp, Artificial sequence
  SiRNA target sequence
gcatttcctttattattaaaaagt

SEQ ID NO: 144637 - DNA, 24 bp, Artificial sequence
  SiRNA target sequence
catttcctttattattaaaaagta

SEQ ID NO: 144638 - DNA, 24 bp, Artificial sequence
  SiRNA target sequence
atttcctttattattaaaaagtaa

SEQ ID NO: 144639 - DNA, 24 bp, Artificial sequence
  SiRNA target sequence
tttcctttattattaaaaagtaat

SEQ ID NO: 144640 - DNA, 24 bp, Artificial sequence
  SiRNA target sequence
ttcctttattattaaaaagtaatg

SEQ ID NO: 144641 - DNA, 24 bp, Artificial sequence
  SiRNA target sequence
tcctttattattaaaaagtaatga

SEQ ID NO: 144642 - DNA, 24 bp, Artificial sequence
  SiRNA target sequence
cctttattattaaaaagtaatgaa

SEQ ID NO: 144643 - DNA, 24 bp, Artificial sequence
  SiRNA target sequence
ctttattattaaaaagtaatgaat

SEQ ID NO: 144644 - DNA, 24 bp, Artificial sequence
  SiRNA target sequence
tttattattaaaaagtaatgaatt

SEQ ID NO: 144645 - DNA, 24 bp, Artificial sequence
  SiRNA target sequence
ttattattaaaaagtaatgaattt

SEQ ID NO: 144646 - DNA, 24 bp, Artificial sequence
  SiRNA target sequence
tattattaaaaagtaatgaattta

SEQ ID NO: 144647 - DNA, 24 bp, Artificial sequence
  SiRNA target sequence
attattaaaaagtaatgaatttaa

SEQ ID NO: 144648 - DNA, 24 bp, Artificial sequence
  SiRNA target sequence
ttattaaaaagtaatgaatttaat

SEQ ID NO: 144649 - DNA, 24 bp, Artificial sequence
  SiRNA target sequence
tattaaaaagtaatgaatttaatg

SEQ ID NO: 144650 - DNA, 24 bp, Artificial sequence
  SiRNA target sequence
attaaaaagtaatgaatttaatga

SEQ ID NO: 144651 - DNA, 24 bp, Artificial sequence
  SiRNA target sequence
ttaaaaagtaatgaatttaatgat

SEQ ID NO: 144652 - DNA, 24 bp, Artificial sequence
  SiRNA target sequence
taaaaagtaatgaatttaatgatt

SEQ ID NO: 144653 - DNA, 24 bp, Artificial sequence
  SiRNA target sequence
aaaaagtaatgaatttaatgattt

SEQ ID NO: 144654 - DNA, 24 bp, Artificial sequence
  SiRNA target sequence
aaaagtaatgaatttaatgattta

SEQ ID NO: 144655 - DNA, 24 bp, Artificial sequence
  SiRNA target sequence
aaagtaatgaatttaatgatttac

SEQ ID NO: 144656 - DNA, 24 bp, Artificial sequence
  SiRNA target sequence
aagtaatgaatttaatgatttacc

SEQ ID NO: 144657 - DNA, 24 bp, Artificial sequence
  SiRNA target sequence
agtaatgaatttaatgatttacca

SEQ ID NO: 144658 - DNA, 24 bp, Artificial sequence
  SiRNA target sequence
gtaatgaatttaatgatttaccac

SEQ ID NO: 144659 - DNA, 24 bp, Artificial sequence
  SiRNA target sequence
taatgaatttaatgatttaccaca

SEQ ID NO: 144660 - DNA, 24 bp, Artificial sequence
  SiRNA target sequence
aatgaatttaatgatttaccacac

SEQ ID NO: 144661 - DNA, 24 bp, Artificial sequence
  SiRNA target sequence
atgaatttaatgatttaccacaca

SEQ ID NO: 144662 - DNA, 24 bp, Artificial sequence
  SiRNA target sequence
tgaatttaatgatttaccacacaa

SEQ ID NO: 144663 - DNA, 24 bp, Artificial sequence
  SiRNA target sequence
gaatttaatgatttaccacacaaa

SEQ ID NO: 144664 - DNA, 24 bp, Artificial sequence
  SiRNA target sequence
aatttaatgatttaccacacaaat

SEQ ID NO: 144665 - DNA, 24 bp, Artificial sequence
  SiRNA target sequence
atttaatgatttaccacacaaatt

SEQ ID NO: 144666 - DNA, 24 bp, Artificial sequence
  SiRNA target sequence
tttaatgatttaccacacaaattg

SEQ ID NO: 144667 - DNA, 24 bp, Artificial sequence
  SiRNA target sequence
ttaatgatttaccacacaaattgt

SEQ ID NO: 144668 - DNA, 24 bp, Artificial sequence
  SiRNA target sequence
taatgatttaccacacaaattgtt

SEQ ID NO: 144669 - DNA, 24 bp, Artificial sequence
  SiRNA target sequence
aatgatttaccacacaaattgtta

SEQ ID NO: 144670 - DNA, 24 bp, Artificial sequence
  SiRNA target sequence
atgatttaccacacaaattgttat

SEQ ID NO: 144671 - DNA, 24 bp, Artificial sequence
  SiRNA target sequence
tgatttaccacacaaattgttatc

SEQ ID NO: 144672 - DNA, 24 bp, Artificial sequence
  SiRNA target sequence
gatttaccacacaaattgttatct

SEQ ID NO: 144673 - DNA, 24 bp, Artificial sequence
  SiRNA target sequence
atttaccacacaaattgttatcta

SEQ ID NO: 144674 - DNA, 24 bp, Artificial sequence
  SiRNA target sequence
tttaccacacaaattgttatctaa

SEQ ID NO: 144675 - DNA, 24 bp, Artificial sequence
  SiRNA target sequence
ttaccacacaaattgttatctaat

SEQ ID NO: 144676 - DNA, 24 bp, Artificial sequence
  SiRNA target sequence
taccacacaaattgttatctaata

SEQ ID NO: 144677 - DNA, 24 bp, Artificial sequence
  SiRNA target sequence
accacacaaattgttatctaatat

SEQ ID NO: 144678 - DNA, 24 bp, Artificial sequence
  SiRNA target sequence
ccacacaaattgttatctaatatt

SEQ ID NO: 144679 - DNA, 24 bp, Artificial sequence
  SiRNA target sequence
cacacaaattgttatctaatatta

SEQ ID NO: 144680 - DNA, 24 bp, Artificial sequence
  SiRNA target sequence
acacaaattgttatctaatattat

SEQ ID NO: 144681 - DNA, 24 bp, Artificial sequence
  SiRNA target sequence
cacaaattgttatctaatattatt

SEQ ID NO: 144682 - DNA, 24 bp, Artificial sequence
  SiRNA target sequence
acaaattgttatctaatattattt

SEQ ID NO: 144683 - DNA, 24 bp, Artificial sequence
  SiRNA target sequence
caaattgttatctaatattatttt

SEQ ID NO: 144684 - DNA, 24 bp, Artificial sequence
  SiRNA target sequence
aaattgttatctaatattatttta

SEQ ID NO: 144685 - DNA, 24 bp, Artificial sequence
  SiRNA target sequence
aattgttatctaatattattttat

SEQ ID NO: 144686 - DNA, 24 bp, Artificial sequence
  SiRNA target sequence
attgttatctaatattattttatt

SEQ ID NO: 144687 - DNA, 24 bp, Artificial sequence
  SiRNA target sequence
ttgttatctaatattattttatta

SEQ ID NO: 144688 - DNA, 24 bp, Artificial sequence
  SiRNA target sequence
tgttatctaatattattttattaa

SEQ ID NO: 144689 - DNA, 24 bp, Artificial sequence
  SiRNA target sequence
gttatctaatattattttattaag

SEQ ID NO: 144690 - DNA, 24 bp, Artificial sequence
  SiRNA target sequence
ttatctaatattattttattaaga

SEQ ID NO: 144691 - DNA, 24 bp, Artificial sequence
  SiRNA target sequence
tatctaatattattttattaagag

SEQ ID NO: 144692 - DNA, 24 bp, Artificial sequence
  SiRNA target sequence
atctaatattattttattaagagt

SEQ ID NO: 144693 - DNA, 24 bp, Artificial sequence
  SiRNA target sequence
tctaatattattttattaagagtg

SEQ ID NO: 144694 - DNA, 24 bp, Artificial sequence
  SiRNA target sequence
ctaatattattttattaagagtgt

SEQ ID NO: 144695 - DNA, 24 bp, Artificial sequence
  SiRNA target sequence
taatattattttattaagagtgtc

SEQ ID NO: 144696 - DNA, 24 bp, Artificial sequence
  SiRNA target sequence
aatattattttattaagagtgtct

SEQ ID NO: 144697 - DNA, 24 bp, Artificial sequence
  SiRNA target sequence
atattattttattaagagtgtcta

SEQ ID NO: 144698 - DNA, 24 bp, Artificial sequence
  SiRNA target sequence
tattattttattaagagtgtctac

SEQ ID NO: 144699 - DNA, 24 bp, Artificial sequence
  SiRNA target sequence
attattttattaagagtgtctaca

SEQ ID NO: 144700 - DNA, 24 bp, Artificial sequence
  SiRNA target sequence
ttattttattaagagtgtctacat

SEQ ID NO: 144701 - DNA, 24 bp, Artificial sequence
  SiRNA target sequence
tattttattaagagtgtctacata

SEQ ID NO: 144702 - DNA, 24 bp, Artificial sequence
  SiRNA target sequence
attttattaagagtgtctacatac

SEQ ID NO: 144703 - DNA, 24 bp, Artificial sequence
  SiRNA target sequence
ttttattaagagtgtctacatacg

SEQ ID NO: 144704 - DNA, 24 bp, Artificial sequence
  SiRNA target sequence
tttattaagagtgtctacatacgc

SEQ ID NO: 144705 - DNA, 24 bp, Artificial sequence
  SiRNA target sequence
ttattaagagtgtctacatacgct

SEQ ID NO: 144706 - DNA, 24 bp, Artificial sequence
  SiRNA target sequence
tattaagagtgtctacatacgctt

SEQ ID NO: 144707 - DNA, 24 bp, Artificial sequence
  SiRNA target sequence
attaagagtgtctacatacgcttg

SEQ ID NO: 144708 - DNA, 24 bp, Artificial sequence
  SiRNA target sequence
ttaagagtgtctacatacgcttga

SEQ ID NO: 144709 - DNA, 24 bp, Artificial sequence
  SiRNA target sequence
taagagtgtctacatacgcttgat

SEQ ID NO: 144710 - DNA, 24 bp, Artificial sequence
  SiRNA target sequence
aagagtgtctacatacgcttgatg

SEQ ID NO: 144711 - DNA, 24 bp, Artificial sequence
  SiRNA target sequence
agagtgtctacatacgcttgatgg

SEQ ID NO: 144712 - DNA, 24 bp, Artificial sequence
  SiRNA target sequence
gagtgtctacatacgcttgatggt

SEQ ID NO: 144713 - DNA, 24 bp, Artificial sequence
  SiRNA target sequence
agtgtctacatacgcttgatggtg

SEQ ID NO: 144714 - DNA, 24 bp, Artificial sequence
  SiRNA target sequence
gtgtctacatacgcttgatggtgc

SEQ ID NO: 144715 - DNA, 24 bp, Artificial sequence
  SiRNA target sequence
tgtctacatacgcttgatggtgct

SEQ ID NO: 144716 - DNA, 24 bp, Artificial sequence
  SiRNA target sequence
gtctacatacgcttgatggtgctt

SEQ ID NO: 144717 - DNA, 24 bp, Artificial sequence
  SiRNA target sequence
tctacatacgcttgatggtgctta

SEQ ID NO: 144718 - DNA, 24 bp, Artificial sequence
  SiRNA target sequence
ctacatacgcttgatggtgcttag

SEQ ID NO: 144719 - DNA, 24 bp, Artificial sequence
  SiRNA target sequence
tacatacgcttgatggtgcttaga

SEQ ID NO: 144720 - DNA, 24 bp, Artificial sequence
  SiRNA target sequence
acatacgcttgatggtgcttagag

SEQ ID NO: 144721 - DNA, 24 bp, Artificial sequence
  SiRNA target sequence
catacgcttgatggtgcttagagt

SEQ ID NO: 144722 - DNA, 24 bp, Artificial sequence
  SiRNA target sequence
atacgcttgatggtgcttagagtg

SEQ ID NO: 144723 - DNA, 24 bp, Artificial sequence
  SiRNA target sequence
tacgcttgatggtgcttagagtgg

SEQ ID NO: 144724 - DNA, 24 bp, Artificial sequence
  SiRNA target sequence
acgcttgatggtgcttagagtggt

SEQ ID NO: 144725 - DNA, 24 bp, Artificial sequence
  SiRNA target sequence
cgcttgatggtgcttagagtggtg

SEQ ID NO: 144726 - DNA, 24 bp, Artificial sequence
  SiRNA target sequence
gcttgatggtgcttagagtggtgg

SEQ ID NO: 144727 - DNA, 24 bp, Artificial sequence
  SiRNA target sequence
cttgatggtgcttagagtggtggg

SEQ ID NO: 144728 - DNA, 24 bp, Artificial sequence
  SiRNA target sequence
ttgatggtgcttagagtggtgggt

SEQ ID NO: 144729 - DNA, 24 bp, Artificial sequence
  SiRNA target sequence
tgatggtgcttagagtggtgggtc

SEQ ID NO: 144730 - DNA, 24 bp, Artificial sequence
  SiRNA target sequence
gatggtgcttagagtggtgggtct

SEQ ID NO: 144731 - DNA, 24 bp, Artificial sequence
  SiRNA target sequence
atggtgcttagagtggtgggtctc

SEQ ID NO: 144732 - DNA, 24 bp, Artificial sequence
  SiRNA target sequence
tggtgcttagagtggtgggtctcc

SEQ ID NO: 144733 - DNA, 24 bp, Artificial sequence
  SiRNA target sequence
ggtgcttagagtggtgggtctcca

SEQ ID NO: 144734 - DNA, 24 bp, Artificial sequence
  SiRNA target sequence
gtgcttagagtggtgggtctccat

SEQ ID NO: 144735 - DNA, 24 bp, Artificial sequence
  SiRNA target sequence
tgcttagagtggtgggtctccatt

SEQ ID NO: 144736 - DNA, 24 bp, Artificial sequence
  SiRNA target sequence
gcttagagtggtgggtctccatta

SEQ ID NO: 144737 - DNA, 24 bp, Artificial sequence
  SiRNA target sequence
cttagagtggtgggtctccattat

SEQ ID NO: 144738 - DNA, 24 bp, Artificial sequence
  SiRNA target sequence
ttagagtggtgggtctccattata

SEQ ID NO: 144739 - DNA, 24 bp, Artificial sequence
  SiRNA target sequence
tagagtggtgggtctccattatat

SEQ ID NO: 144740 - DNA, 24 bp, Artificial sequence
  SiRNA target sequence
agagtggtgggtctccattatatc

SEQ ID NO: 144741 - DNA, 24 bp, Artificial sequence
  SiRNA target sequence
gagtggtgggtctccattatatct

SEQ ID NO: 144742 - DNA, 24 bp, Artificial sequence
  SiRNA target sequence
agtggtgggtctccattatatctt

SEQ ID NO: 144743 - DNA, 24 bp, Artificial sequence
  SiRNA target sequence
gtggtgggtctccattatatcttc

SEQ ID NO: 144744 - DNA, 24 bp, Artificial sequence
  SiRNA target sequence
tggtgggtctccattatatcttca

SEQ ID NO: 144745 - DNA, 24 bp, Artificial sequence
  SiRNA target sequence
ggtgggtctccattatatcttcac

SEQ ID NO: 144746 - DNA, 24 bp, Artificial sequence
  SiRNA target sequence
gtgggtctccattatatcttcact

SEQ ID NO: 144747 - DNA, 24 bp, Artificial sequence
  SiRNA target sequence
tgggtctccattatatcttcactt

SEQ ID NO: 144748 - DNA, 24 bp, Artificial sequence
  SiRNA target sequence
gggtctccattatatcttcactta

SEQ ID NO: 144749 - DNA, 24 bp, Artificial sequence
  SiRNA target sequence
ggtctccattatatcttcacttat

SEQ ID NO: 144750 - DNA, 24 bp, Artificial sequence
  SiRNA target sequence
gtctccattatatcttcacttata

SEQ ID NO: 144751 - DNA, 24 bp, Artificial sequence
  SiRNA target sequence
tctccattatatcttcacttatat

SEQ ID NO: 144752 - DNA, 24 bp, Artificial sequence
  SiRNA target sequence
ctccattatatcttcacttatata

SEQ ID NO: 144753 - DNA, 24 bp, Artificial sequence
  SiRNA target sequence
tccattatatcttcacttatataa

SEQ ID NO: 144754 - DNA, 24 bp, Artificial sequence
  SiRNA target sequence
ccattatatcttcacttatataag

SEQ ID NO: 144755 - DNA, 24 bp, Artificial sequence
  SiRNA target sequence
cattatatcttcacttatataagg

SEQ ID NO: 144756 - DNA, 24 bp, Artificial sequence
  SiRNA target sequence
attatatcttcacttatataaggc

SEQ ID NO: 144757 - DNA, 24 bp, Artificial sequence
  SiRNA target sequence
ttatatcttcacttatataaggct

SEQ ID NO: 144758 - DNA, 24 bp, Artificial sequence
  SiRNA target sequence
tatatcttcacttatataaggctc

SEQ ID NO: 144759 - DNA, 24 bp, Artificial sequence
  SiRNA target sequence
atatcttcacttatataaggctct

SEQ ID NO: 144760 - DNA, 24 bp, Artificial sequence
  SiRNA target sequence
tatcttcacttatataaggctcta

SEQ ID NO: 144761 - DNA, 24 bp, Artificial sequence
  SiRNA target sequence
atcttcacttatataaggctctag

SEQ ID NO: 144762 - DNA, 24 bp, Artificial sequence
  SiRNA target sequence
tcttcacttatataaggctctaga

SEQ ID NO: 144763 - DNA, 24 bp, Artificial sequence
  SiRNA target sequence
cttcacttatataaggctctagag

SEQ ID NO: 144764 - DNA, 24 bp, Artificial sequence
  SiRNA target sequence
ttcacttatataaggctctagaga

SEQ ID NO: 144765 - DNA, 24 bp, Artificial sequence
  SiRNA target sequence
tcacttatataaggctctagagat

SEQ ID NO: 144766 - DNA, 24 bp, Artificial sequence
  SiRNA target sequence
cacttatataaggctctagagatt

SEQ ID NO: 144767 - DNA, 24 bp, Artificial sequence
  SiRNA target sequence
acttatataaggctctagagattt

SEQ ID NO: 144768 - DNA, 24 bp, Artificial sequence
  SiRNA target sequence
cttatataaggctctagagattta

SEQ ID NO: 144769 - DNA, 24 bp, Artificial sequence
  SiRNA target sequence
ttatataaggctctagagatttat

SEQ ID NO: 144770 - DNA, 24 bp, Artificial sequence
  SiRNA target sequence
tatataaggctctagagatttata

SEQ ID NO: 144771 - DNA, 24 bp, Artificial sequence
  SiRNA target sequence
atataaggctctagagatttataa

SEQ ID NO: 144772 - DNA, 24 bp, Artificial sequence
  SiRNA target sequence
tataaggctctagagatttataac

SEQ ID NO: 144773 - DNA, 24 bp, Artificial sequence
  SiRNA target sequence
ataaggctctagagatttataact

SEQ ID NO: 144774 - DNA, 24 bp, Artificial sequence
  SiRNA target sequence
taaggctctagagatttataacta

SEQ ID NO: 144775 - DNA, 24 bp, Artificial sequence
  SiRNA target sequence
aaggctctagagatttataactat

SEQ ID NO: 144776 - DNA, 24 bp, Artificial sequence
  SiRNA target sequence
aggctctagagatttataactata

SEQ ID NO: 144777 - DNA, 24 bp, Artificial sequence
  SiRNA target sequence
ggctctagagatttataactatat

SEQ ID NO: 144778 - DNA, 24 bp, Artificial sequence
  SiRNA target sequence
gctctagagatttataactatatt

SEQ ID NO: 144779 - DNA, 24 bp, Artificial sequence
  SiRNA target sequence
ctctagagatttataactatattt

SEQ ID NO: 144780 - DNA, 24 bp, Artificial sequence
  SiRNA target sequence
tctagagatttataactatatttc

SEQ ID NO: 144781 - DNA, 24 bp, Artificial sequence
  SiRNA target sequence
ctagagatttataactatatttca

SEQ ID NO: 144782 - DNA, 24 bp, Artificial sequence
  SiRNA target sequence
tagagatttataactatatttcag

SEQ ID NO: 144783 - DNA, 24 bp, Artificial sequence
  SiRNA target sequence
agagatttataactatatttcaga

SEQ ID NO: 144784 - DNA, 24 bp, Artificial sequence
  SiRNA target sequence
gagatttataactatatttcagat

SEQ ID NO: 144785 - DNA, 24 bp, Artificial sequence
  SiRNA target sequence
agatttataactatatttcagatt

SEQ ID NO: 144786 - DNA, 24 bp, Artificial sequence
  SiRNA target sequence
gatttataactatatttcagattt

SEQ ID NO: 144787 - DNA, 24 bp, Artificial sequence
  SiRNA target sequence
atttataactatatttcagatttg

SEQ ID NO: 144788 - DNA, 24 bp, Artificial sequence
  SiRNA target sequence
tttataactatatttcagatttgg

SEQ ID NO: 144789 - DNA, 24 bp, Artificial sequence
  SiRNA target sequence
ttataactatatttcagatttgga

SEQ ID NO: 144790 - DNA, 24 bp, Artificial sequence
  SiRNA target sequence
tataactatatttcagatttggaa

SEQ ID NO: 144791 - DNA, 24 bp, Artificial sequence
  SiRNA target sequence
ataactatatttcagatttggaag

SEQ ID NO: 144792 - DNA, 24 bp, Artificial sequence
  SiRNA target sequence
taactatatttcagatttggaaga

SEQ ID NO: 144793 - DNA, 24 bp, Artificial sequence
  SiRNA target sequence
aactatatttcagatttggaagag

SEQ ID NO: 144794 - DNA, 24 bp, Artificial sequence
  SiRNA target sequence
actatatttcagatttggaagagt

SEQ ID NO: 144795 - DNA, 24 bp, Artificial sequence
  SiRNA target sequence
ctatatttcagatttggaagagtg

SEQ ID NO: 144796 - DNA, 24 bp, Artificial sequence
  SiRNA target sequence
tatatttcagatttggaagagtga

SEQ ID NO: 144797 - DNA, 24 bp, Artificial sequence
  SiRNA target sequence
atatttcagatttggaagagtgaa

SEQ ID NO: 144798 - DNA, 24 bp, Artificial sequence
  SiRNA target sequence
tatttcagatttggaagagtgaac

SEQ ID NO: 144799 - DNA, 24 bp, Artificial sequence
  SiRNA target sequence
atttcagatttggaagagtgaaca

SEQ ID NO: 144800 - DNA, 24 bp, Artificial sequence
  SiRNA target sequence
tttcagatttggaagagtgaacat

SEQ ID NO: 144801 - DNA, 25 bp, Artificial sequence
  SiRNA target sequence
ttaatttatgcataattgaccatca

SEQ ID NO: 144802 - DNA, 25 bp, Artificial sequence
  SiRNA target sequence
taatttatgcataattgaccatcat

SEQ ID NO: 144803 - DNA, 25 bp, Artificial sequence
  SiRNA target sequence
aatttatgcataattgaccatcatc

SEQ ID NO: 144804 - DNA, 25 bp, Artificial sequence
  SiRNA target sequence
atttatgcataattgaccatcatca

SEQ ID NO: 144805 - DNA, 25 bp, Artificial sequence
  SiRNA target sequence
tttatgcataattgaccatcatcag

SEQ ID NO: 144806 - DNA, 25 bp, Artificial sequence
  SiRNA target sequence
ttatgcataattgaccatcatcagt

SEQ ID NO: 144807 - DNA, 25 bp, Artificial sequence
  SiRNA target sequence
tatgcataattgaccatcatcagta

SEQ ID NO: 144808 - DNA, 25 bp, Artificial sequence
  SiRNA target sequence
atgcataattgaccatcatcagtaa

SEQ ID NO: 144809 - DNA, 25 bp, Artificial sequence
  SiRNA target sequence
tgcataattgaccatcatcagtaat

SEQ ID NO: 144810 - DNA, 25 bp, Artificial sequence
  SiRNA target sequence
gcataattgaccatcatcagtaata

SEQ ID NO: 144811 - DNA, 25 bp, Artificial sequence
  SiRNA target sequence
cataattgaccatcatcagtaataa

SEQ ID NO: 144812 - DNA, 25 bp, Artificial sequence
  SiRNA target sequence
ataattgaccatcatcagtaataaa

SEQ ID NO: 144813 - DNA, 25 bp, Artificial sequence
  SiRNA target sequence
taattgaccatcatcagtaataaac

SEQ ID NO: 144814 - DNA, 25 bp, Artificial sequence
  SiRNA target sequence
aattgaccatcatcagtaataaaca

SEQ ID NO: 144815 - DNA, 25 bp, Artificial sequence
  SiRNA target sequence
attgaccatcatcagtaataaacac

SEQ ID NO: 144816 - DNA, 25 bp, Artificial sequence
  SiRNA target sequence
ttgaccatcatcagtaataaacaca

SEQ ID NO: 144817 - DNA, 25 bp, Artificial sequence
  SiRNA target sequence
tgaccatcatcagtaataaacacat

SEQ ID NO: 144818 - DNA, 25 bp, Artificial sequence
  SiRNA target sequence
gaccatcatcagtaataaacacatt

SEQ ID NO: 144819 - DNA, 25 bp, Artificial sequence
  SiRNA target sequence
accatcatcagtaataaacacatta

SEQ ID NO: 144820 - DNA, 25 bp, Artificial sequence
  SiRNA target sequence
ccatcatcagtaataaacacattac

SEQ ID NO: 144821 - DNA, 25 bp, Artificial sequence
  SiRNA target sequence
catcatcagtaataaacacattacc

SEQ ID NO: 144822 - DNA, 25 bp, Artificial sequence
  SiRNA target sequence
atcatcagtaataaacacattacct

SEQ ID NO: 144823 - DNA, 25 bp, Artificial sequence
  SiRNA target sequence
tcatcagtaataaacacattacctt

SEQ ID NO: 144824 - DNA, 25 bp, Artificial sequence
  SiRNA target sequence
catcagtaataaacacattaccttt

SEQ ID NO: 144825 - DNA, 25 bp, Artificial sequence
  SiRNA target sequence
atcagtaataaacacattacctttc

SEQ ID NO: 144826 - DNA, 25 bp, Artificial sequence
  SiRNA target sequence
tcagtaataaacacattacctttct

SEQ ID NO: 144827 - DNA, 25 bp, Artificial sequence
  SiRNA target sequence
cagtaataaacacattacctttctt

SEQ ID NO: 144828 - DNA, 25 bp, Artificial sequence
  SiRNA target sequence
agtaataaacacattacctttcttt

SEQ ID NO: 144829 - DNA, 25 bp, Artificial sequence
  SiRNA target sequence
gtaataaacacattacctttctttt

SEQ ID NO: 144830 - DNA, 25 bp, Artificial sequence
  SiRNA target sequence
taataaacacattacctttcttttc

SEQ ID NO: 144831 - DNA, 25 bp, Artificial sequence
  SiRNA target sequence
aataaacacattacctttcttttct

SEQ ID NO: 144832 - DNA, 25 bp, Artificial sequence
  SiRNA target sequence
ataaacacattacctttcttttcta

SEQ ID NO: 144833 - DNA, 25 bp, Artificial sequence
  SiRNA target sequence
taaacacattacctttcttttctac

SEQ ID NO: 144834 - DNA, 25 bp, Artificial sequence
  SiRNA target sequence
aaacacattacctttcttttctacc

SEQ ID NO: 144835 - DNA, 25 bp, Artificial sequence
  SiRNA target sequence
aacacattacctttcttttctacca

SEQ ID NO: 144836 - DNA, 25 bp, Artificial sequence
  SiRNA target sequence
acacattacctttcttttctaccac

SEQ ID NO: 144837 - DNA, 25 bp, Artificial sequence
  SiRNA target sequence
cacattacctttcttttctaccaca

SEQ ID NO: 144838 - DNA, 25 bp, Artificial sequence
  SiRNA target sequence
acattacctttcttttctaccacac

SEQ ID NO: 144839 - DNA, 25 bp, Artificial sequence
  SiRNA target sequence
cattacctttcttttctaccacaca

SEQ ID NO: 144840 - DNA, 25 bp, Artificial sequence
  SiRNA target sequence
attacctttcttttctaccacacat

SEQ ID NO: 144841 - DNA, 25 bp, Artificial sequence
  SiRNA target sequence
ttacctttcttttctaccacacatt

SEQ ID NO: 144842 - DNA, 25 bp, Artificial sequence
  SiRNA target sequence
tacctttcttttctaccacacattt

SEQ ID NO: 144843 - DNA, 25 bp, Artificial sequence
  SiRNA target sequence
acctttcttttctaccacacatttt

SEQ ID NO: 144844 - DNA, 25 bp, Artificial sequence
  SiRNA target sequence
cctttcttttctaccacacattttt

SEQ ID NO: 144845 - DNA, 25 bp, Artificial sequence
  SiRNA target sequence
ctttcttttctaccacacatttttg

SEQ ID NO: 144846 - DNA, 25 bp, Artificial sequence
  SiRNA target sequence
tttcttttctaccacacatttttga

SEQ ID NO: 144847 - DNA, 25 bp, Artificial sequence
  SiRNA target sequence
ttcttttctaccacacatttttgat

SEQ ID NO: 144848 - DNA, 25 bp, Artificial sequence
  SiRNA target sequence
tcttttctaccacacatttttgata

SEQ ID NO: 144849 - DNA, 25 bp, Artificial sequence
  SiRNA target sequence
cttttctaccacacatttttgatat

SEQ ID NO: 144850 - DNA, 25 bp, Artificial sequence
  SiRNA target sequence
ttttctaccacacatttttgatata

SEQ ID NO: 144851 - DNA, 25 bp, Artificial sequence
  SiRNA target sequence
tttctaccacacatttttgatatat

SEQ ID NO: 144852 - DNA, 25 bp, Artificial sequence
  SiRNA target sequence
ttctaccacacatttttgatatatt

SEQ ID NO: 144853 - DNA, 25 bp, Artificial sequence
  SiRNA target sequence
tctaccacacatttttgatatattt

SEQ ID NO: 144854 - DNA, 25 bp, Artificial sequence
  SiRNA target sequence
ctaccacacatttttgatatatttc

SEQ ID NO: 144855 - DNA, 25 bp, Artificial sequence
  SiRNA target sequence
taccacacatttttgatatatttca

SEQ ID NO: 144856 - DNA, 25 bp, Artificial sequence
  SiRNA target sequence
accacacatttttgatatatttcat

SEQ ID NO: 144857 - DNA, 25 bp, Artificial sequence
  SiRNA target sequence
ccacacatttttgatatatttcatt

SEQ ID NO: 144858 - DNA, 25 bp, Artificial sequence
  SiRNA target sequence
cacacatttttgatatatttcatta

SEQ ID NO: 144859 - DNA, 25 bp, Artificial sequence
  SiRNA target sequence
acacatttttgatatatttcattaa

SEQ ID NO: 144860 - DNA, 25 bp, Artificial sequence
  SiRNA target sequence
cacatttttgatatatttcattaac

SEQ ID NO: 144861 - DNA, 25 bp, Artificial sequence
  SiRNA target sequence
acatttttgatatatttcattaact

SEQ ID NO: 144862 - DNA, 25 bp, Artificial sequence
  SiRNA target sequence
catttttgatatatttcattaacta

SEQ ID NO: 144863 - DNA, 25 bp, Artificial sequence
  SiRNA target sequence
atttttgatatatttcattaactac

SEQ ID NO: 144864 - DNA, 25 bp, Artificial sequence
  SiRNA target sequence
tttttgatatatttcattaactaca

SEQ ID NO: 144865 - DNA, 25 bp, Artificial sequence
  SiRNA target sequence
ttttgatatatttcattaactacat

SEQ ID NO: 144866 - DNA, 25 bp, Artificial sequence
  SiRNA target sequence
tttgatatatttcattaactacatc

SEQ ID NO: 144867 - DNA, 25 bp, Artificial sequence
  SiRNA target sequence
ttgatatatttcattaactacatcc

SEQ ID NO: 144868 - DNA, 25 bp, Artificial sequence
  SiRNA target sequence
tgatatatttcattaactacatccc

SEQ ID NO: 144869 - DNA, 25 bp, Artificial sequence
  SiRNA target sequence
gatatatttcattaactacatccca

SEQ ID NO: 144870 - DNA, 25 bp, Artificial sequence
  SiRNA target sequence
atatatttcattaactacatcccaa

SEQ ID NO: 144871 - DNA, 25 bp, Artificial sequence
  SiRNA target sequence
tatatttcattaactacatcccaat

SEQ ID NO: 144872 - DNA, 25 bp, Artificial sequence
  SiRNA target sequence
atatttcattaactacatcccaatc

SEQ ID NO: 144873 - DNA, 25 bp, Artificial sequence
  SiRNA target sequence
tatttcattaactacatcccaatca

SEQ ID NO: 144874 - DNA, 25 bp, Artificial sequence
  SiRNA target sequence
atttcattaactacatcccaatcaa

SEQ ID NO: 144875 - DNA, 25 bp, Artificial sequence
  SiRNA target sequence
tttcattaactacatcccaatcaat

SEQ ID NO: 144876 - DNA, 25 bp, Artificial sequence
  SiRNA target sequence
ttcattaactacatcccaatcaatt

SEQ ID NO: 144877 - DNA, 25 bp, Artificial sequence
  SiRNA target sequence
tcattaactacatcccaatcaatta

SEQ ID NO: 144878 - DNA, 25 bp, Artificial sequence
  SiRNA target sequence
cattaactacatcccaatcaattac

SEQ ID NO: 144879 - DNA, 25 bp, Artificial sequence
  SiRNA target sequence
attaactacatcccaatcaattaca

SEQ ID NO: 144880 - DNA, 25 bp, Artificial sequence
  SiRNA target sequence
ttaactacatcccaatcaattacat

SEQ ID NO: 144881 - DNA, 25 bp, Artificial sequence
  SiRNA target sequence
taactacatcccaatcaattacatt

SEQ ID NO: 144882 - DNA, 25 bp, Artificial sequence
  SiRNA target sequence
aactacatcccaatcaattacattc

SEQ ID NO: 144883 - DNA, 25 bp, Artificial sequence
  SiRNA target sequence
actacatcccaatcaattacattcc

SEQ ID NO: 144884 - DNA, 25 bp, Artificial sequence
  SiRNA target sequence
ctacatcccaatcaattacattcca

SEQ ID NO: 144885 - DNA, 25 bp, Artificial sequence
  SiRNA target sequence
tacatcccaatcaattacattccac

SEQ ID NO: 144886 - DNA, 25 bp, Artificial sequence
  SiRNA target sequence
acatcccaatcaattacattccacc

SEQ ID NO: 144887 - DNA, 25 bp, Artificial sequence
  SiRNA target sequence
catcccaatcaattacattccacca

SEQ ID NO: 144888 - DNA, 25 bp, Artificial sequence
  SiRNA target sequence
atcccaatcaattacattccaccat

SEQ ID NO: 144889 - DNA, 25 bp, Artificial sequence
  SiRNA target sequence
tcccaatcaattacattccaccatt

SEQ ID NO: 144890 - DNA, 25 bp, Artificial sequence
  SiRNA target sequence
cccaatcaattacattccaccattc

SEQ ID NO: 144891 - DNA, 25 bp, Artificial sequence
  SiRNA target sequence
ccaatcaattacattccaccattca

SEQ ID NO: 144892 - DNA, 25 bp, Artificial sequence
  SiRNA target sequence
caatcaattacattccaccattcat

SEQ ID NO: 144893 - DNA, 25 bp, Artificial sequence
  SiRNA target sequence
aatcaattacattccaccattcatt

SEQ ID NO: 144894 - DNA, 25 bp, Artificial sequence
  SiRNA target sequence
atcaattacattccaccattcatta

SEQ ID NO: 144895 - DNA, 25 bp, Artificial sequence
  SiRNA target sequence
tcaattacattccaccattcattaa

SEQ ID NO: 144896 - DNA, 25 bp, Artificial sequence
  SiRNA target sequence
caattacattccaccattcattaat

SEQ ID NO: 144897 - DNA, 25 bp, Artificial sequence
  SiRNA target sequence
aattacattccaccattcattaatg

SEQ ID NO: 144898 - DNA, 25 bp, Artificial sequence
  SiRNA target sequence
attacattccaccattcattaatgt

SEQ ID NO: 144899 - DNA, 25 bp, Artificial sequence
  SiRNA target sequence
ttacattccaccattcattaatgta

SEQ ID NO: 144900 - DNA, 25 bp, Artificial sequence
  SiRNA target sequence
tacattccaccattcattaatgtat

SEQ ID NO: 144901 - DNA, 25 bp, Artificial sequence
  SiRNA target sequence
acattccaccattcattaatgtatt

SEQ ID NO: 144902 - DNA, 25 bp, Artificial sequence
  SiRNA target sequence
cattccaccattcattaatgtattc

SEQ ID NO: 144903 - DNA, 25 bp, Artificial sequence
  SiRNA target sequence
attccaccattcattaatgtattct

SEQ ID NO: 144904 - DNA, 25 bp, Artificial sequence
  SiRNA target sequence
ttccaccattcattaatgtattctt

SEQ ID NO: 144905 - DNA, 25 bp, Artificial sequence
  SiRNA target sequence
tccaccattcattaatgtattcttt

SEQ ID NO: 144906 - DNA, 25 bp, Artificial sequence
  SiRNA target sequence
ccaccattcattaatgtattctttt

SEQ ID NO: 144907 - DNA, 25 bp, Artificial sequence
  SiRNA target sequence
caccattcattaatgtattcttttc

SEQ ID NO: 144908 - DNA, 25 bp, Artificial sequence
  SiRNA target sequence
accattcattaatgtattcttttct

SEQ ID NO: 144909 - DNA, 25 bp, Artificial sequence
  SiRNA target sequence
ccattcattaatgtattcttttctc

SEQ ID NO: 144910 - DNA, 25 bp, Artificial sequence
  SiRNA target sequence
cattcattaatgtattcttttctcc

SEQ ID NO: 144911 - DNA, 25 bp, Artificial sequence
  SiRNA target sequence
attcattaatgtattcttttctcct

SEQ ID NO: 144912 - DNA, 25 bp, Artificial sequence
  SiRNA target sequence
ttcattaatgtattcttttctccta

SEQ ID NO: 144913 - DNA, 25 bp, Artificial sequence
  SiRNA target sequence
tcattaatgtattcttttctcctat

SEQ ID NO: 144914 - DNA, 25 bp, Artificial sequence
  SiRNA target sequence
cattaatgtattcttttctcctatt

SEQ ID NO: 144915 - DNA, 25 bp, Artificial sequence
  SiRNA target sequence
attaatgtattcttttctcctattt

SEQ ID NO: 144916 - DNA, 25 bp, Artificial sequence
  SiRNA target sequence
ttaatgtattcttttctcctatttt

SEQ ID NO: 144917 - DNA, 25 bp, Artificial sequence
  SiRNA target sequence
taatgtattcttttctcctattttt

SEQ ID NO: 144918 - DNA, 25 bp, Artificial sequence
  SiRNA target sequence
aatgtattcttttctcctattttta

SEQ ID NO: 144919 - DNA, 25 bp, Artificial sequence
  SiRNA target sequence
atgtattcttttctcctatttttat

SEQ ID NO: 144920 - DNA, 25 bp, Artificial sequence
  SiRNA target sequence
tgtattcttttctcctatttttata

SEQ ID NO: 144921 - DNA, 25 bp, Artificial sequence
  SiRNA target sequence
gtattcttttctcctatttttatac

SEQ ID NO: 144922 - DNA, 25 bp, Artificial sequence
  SiRNA target sequence
tattcttttctcctatttttatact

SEQ ID NO: 144923 - DNA, 25 bp, Artificial sequence
  SiRNA target sequence
attcttttctcctatttttatactg

SEQ ID NO: 144924 - DNA, 25 bp, Artificial sequence
  SiRNA target sequence
ttcttttctcctatttttatactgt

SEQ ID NO: 144925 - DNA, 25 bp, Artificial sequence
  SiRNA target sequence
tcttttctcctatttttatactgta

SEQ ID NO: 144926 - DNA, 25 bp, Artificial sequence
  SiRNA target sequence
cttttctcctatttttatactgtaa

SEQ ID NO: 144927 - DNA, 25 bp, Artificial sequence
  SiRNA target sequence
ttttctcctatttttatactgtaaa

SEQ ID NO: 144928 - DNA, 25 bp, Artificial sequence
  SiRNA target sequence
tttctcctatttttatactgtaaat

SEQ ID NO: 144929 - DNA, 25 bp, Artificial sequence
  SiRNA target sequence
ttctcctatttttatactgtaaata

SEQ ID NO: 144930 - DNA, 25 bp, Artificial sequence
  SiRNA target sequence
tctcctatttttatactgtaaataa

SEQ ID NO: 144931 - DNA, 25 bp, Artificial sequence
  SiRNA target sequence
ctcctatttttatactgtaaataat

SEQ ID NO: 144932 - DNA, 25 bp, Artificial sequence
  SiRNA target sequence
tcctatttttatactgtaaataata

SEQ ID NO: 144933 - DNA, 25 bp, Artificial sequence
  SiRNA target sequence
cctatttttatactgtaaataatac

SEQ ID NO: 144934 - DNA, 25 bp, Artificial sequence
  SiRNA target sequence
ctatttttatactgtaaataatacg

SEQ ID NO: 144935 - DNA, 25 bp, Artificial sequence
  SiRNA target sequence
tatttttatactgtaaataatacgc

SEQ ID NO: 144936 - DNA, 25 bp, Artificial sequence
  SiRNA target sequence
atttttatactgtaaataatacgca

SEQ ID NO: 144937 - DNA, 25 bp, Artificial sequence
  SiRNA target sequence
tttttatactgtaaataatacgcat

SEQ ID NO: 144938 - DNA, 25 bp, Artificial sequence
  SiRNA target sequence
ttttatactgtaaataatacgcatg

SEQ ID NO: 144939 - DNA, 25 bp, Artificial sequence
  SiRNA target sequence
tttatactgtaaataatacgcatgt

SEQ ID NO: 144940 - DNA, 25 bp, Artificial sequence
  SiRNA target sequence
ttatactgtaaataatacgcatgtt

SEQ ID NO: 144941 - DNA, 25 bp, Artificial sequence
  SiRNA target sequence
tatactgtaaataatacgcatgttc

SEQ ID NO: 144942 - DNA, 25 bp, Artificial sequence
  SiRNA target sequence
atactgtaaataatacgcatgttcc

SEQ ID NO: 144943 - DNA, 25 bp, Artificial sequence
  SiRNA target sequence
tactgtaaataatacgcatgttccc

SEQ ID NO: 144944 - DNA, 25 bp, Artificial sequence
  SiRNA target sequence
actgtaaataatacgcatgttccca

SEQ ID NO: 144945 - DNA, 25 bp, Artificial sequence
  SiRNA target sequence
ctgtaaataatacgcatgttcccat

SEQ ID NO: 144946 - DNA, 25 bp, Artificial sequence
  SiRNA target sequence
tgtaaataatacgcatgttcccata

SEQ ID NO: 144947 - DNA, 25 bp, Artificial sequence
  SiRNA target sequence
gtaaataatacgcatgttcccatac

SEQ ID NO: 144948 - DNA, 25 bp, Artificial sequence
  SiRNA target sequence
taaataatacgcatgttcccataca

SEQ ID NO: 144949 - DNA, 25 bp, Artificial sequence
  SiRNA target sequence
aaataatacgcatgttcccatacat

SEQ ID NO: 144950 - DNA, 25 bp, Artificial sequence
  SiRNA target sequence
aataatacgcatgttcccatacatc

SEQ ID NO: 144951 - DNA, 25 bp, Artificial sequence
  SiRNA target sequence
ataatacgcatgttcccatacatca

SEQ ID NO: 144952 - DNA, 25 bp, Artificial sequence
  SiRNA target sequence
taatacgcatgttcccatacatcaa

SEQ ID NO: 144953 - DNA, 25 bp, Artificial sequence
  SiRNA target sequence
aatacgcatgttcccatacatcaag

SEQ ID NO: 144954 - DNA, 25 bp, Artificial sequence
  SiRNA target sequence
atacgcatgttcccatacatcaaga

SEQ ID NO: 144955 - DNA, 25 bp, Artificial sequence
  SiRNA target sequence
tacgcatgttcccatacatcaagac

SEQ ID NO: 144956 - DNA, 25 bp, Artificial sequence
  SiRNA target sequence
acgcatgttcccatacatcaagaca

SEQ ID NO: 144957 - DNA, 25 bp, Artificial sequence
  SiRNA target sequence
cgcatgttcccatacatcaagacat

SEQ ID NO: 144958 - DNA, 25 bp, Artificial sequence
  SiRNA target sequence
gcatgttcccatacatcaagacata

SEQ ID NO: 144959 - DNA, 25 bp, Artificial sequence
  SiRNA target sequence
catgttcccatacatcaagacatag

SEQ ID NO: 144960 - DNA, 25 bp, Artificial sequence
  SiRNA target sequence
atgttcccatacatcaagacatagt

SEQ ID NO: 144961 - DNA, 25 bp, Artificial sequence
  SiRNA target sequence
tgttcccatacatcaagacatagta

SEQ ID NO: 144962 - DNA, 25 bp, Artificial sequence
  SiRNA target sequence
gttcccatacatcaagacatagtaa

SEQ ID NO: 144963 - DNA, 25 bp, Artificial sequence
  SiRNA target sequence
ttcccatacatcaagacatagtaaa

SEQ ID NO: 144964 - DNA, 25 bp, Artificial sequence
  SiRNA target sequence
tcccatacatcaagacatagtaaag

SEQ ID NO: 144965 - DNA, 25 bp, Artificial sequence
  SiRNA target sequence
cccatacatcaagacatagtaaagg

SEQ ID NO: 144966 - DNA, 25 bp, Artificial sequence
  SiRNA target sequence
ccatacatcaagacatagtaaagga

SEQ ID NO: 144967 - DNA, 25 bp, Artificial sequence
  SiRNA target sequence
catacatcaagacatagtaaaggaa

SEQ ID NO: 144968 - DNA, 25 bp, Artificial sequence
  SiRNA target sequence
atacatcaagacatagtaaaggaat

SEQ ID NO: 144969 - DNA, 25 bp, Artificial sequence
  SiRNA target sequence
tacatcaagacatagtaaaggaata

SEQ ID NO: 144970 - DNA, 25 bp, Artificial sequence
  SiRNA target sequence
acatcaagacatagtaaaggaatac

SEQ ID NO: 144971 - DNA, 25 bp, Artificial sequence
  SiRNA target sequence
catcaagacatagtaaaggaataca

SEQ ID NO: 144972 - DNA, 25 bp, Artificial sequence
  SiRNA target sequence
atcaagacatagtaaaggaatacat

SEQ ID NO: 144973 - DNA, 25 bp, Artificial sequence
  SiRNA target sequence
tcaagacatagtaaaggaatacatt

SEQ ID NO: 144974 - DNA, 25 bp, Artificial sequence
  SiRNA target sequence
caagacatagtaaaggaatacattc

SEQ ID NO: 144975 - DNA, 25 bp, Artificial sequence
  SiRNA target sequence
aagacatagtaaaggaatacattca

SEQ ID NO: 144976 - DNA, 25 bp, Artificial sequence
  SiRNA target sequence
agacatagtaaaggaatacattcac

SEQ ID NO: 144977 - DNA, 25 bp, Artificial sequence
  SiRNA target sequence
gacatagtaaaggaatacattcacc

SEQ ID NO: 144978 - DNA, 25 bp, Artificial sequence
  SiRNA target sequence
acatagtaaaggaatacattcacca

SEQ ID NO: 144979 - DNA, 25 bp, Artificial sequence
  SiRNA target sequence
catagtaaaggaatacattcaccat

SEQ ID NO: 144980 - DNA, 25 bp, Artificial sequence
  SiRNA target sequence
atagtaaaggaatacattcaccatc

SEQ ID NO: 144981 - DNA, 25 bp, Artificial sequence
  SiRNA target sequence
tagtaaaggaatacattcaccatcc

SEQ ID NO: 144982 - DNA, 25 bp, Artificial sequence
  SiRNA target sequence
agtaaaggaatacattcaccatcct

SEQ ID NO: 144983 - DNA, 25 bp, Artificial sequence
  SiRNA target sequence
gtaaaggaatacattcaccatcctc

SEQ ID NO: 144984 - DNA, 25 bp, Artificial sequence
  SiRNA target sequence
taaaggaatacattcaccatcctcc

SEQ ID NO: 144985 - DNA, 25 bp, Artificial sequence
  SiRNA target sequence
aaaggaatacattcaccatcctcca

SEQ ID NO: 144986 - DNA, 25 bp, Artificial sequence
  SiRNA target sequence
aaggaatacattcaccatcctccat

SEQ ID NO: 144987 - DNA, 25 bp, Artificial sequence
  SiRNA target sequence
aggaatacattcaccatcctccatc

SEQ ID NO: 144988 - DNA, 25 bp, Artificial sequence
  SiRNA target sequence
ggaatacattcaccatcctccatca

SEQ ID NO: 144989 - DNA, 25 bp, Artificial sequence
  SiRNA target sequence
gaatacattcaccatcctccatcat

SEQ ID NO: 144990 - DNA, 25 bp, Artificial sequence
  SiRNA target sequence
aatacattcaccatcctccatcata

SEQ ID NO: 144991 - DNA, 25 bp, Artificial sequence
  SiRNA target sequence
atacattcaccatcctccatcatag

SEQ ID NO: 144992 - DNA, 25 bp, Artificial sequence
  SiRNA target sequence
tacattcaccatcctccatcatagg

SEQ ID NO: 144993 - DNA, 25 bp, Artificial sequence
  SiRNA target sequence
acattcaccatcctccatcatagga

SEQ ID NO: 144994 - DNA, 25 bp, Artificial sequence
  SiRNA target sequence
cattcaccatcctccatcataggat

SEQ ID NO: 144995 - DNA, 25 bp, Artificial sequence
  SiRNA target sequence
attcaccatcctccatcataggatt

SEQ ID NO: 144996 - DNA, 25 bp, Artificial sequence
  SiRNA target sequence
ttcaccatcctccatcataggattg

SEQ ID NO: 144997 - DNA, 25 bp, Artificial sequence
  SiRNA target sequence
tcaccatcctccatcataggattgt

SEQ ID NO: 144998 - DNA, 25 bp, Artificial sequence
  SiRNA target sequence
caccatcctccatcataggattgtc

SEQ ID NO: 144999 - DNA, 25 bp, Artificial sequence
  SiRNA target sequence
accatcctccatcataggattgtct

SEQ ID NO: 145000 - DNA, 25 bp, Artificial sequence
  SiRNA target sequence
ccatcctccatcataggattgtctt

SEQ ID NO: 145001 - DNA, 25 bp, Artificial sequence
  SiRNA target sequence
catcctccatcataggattgtcttg

SEQ ID NO: 145002 - DNA, 25 bp, Artificial sequence
  SiRNA target sequence
atcctccatcataggattgtcttga

SEQ ID NO: 145003 - DNA, 25 bp, Artificial sequence
  SiRNA target sequence
tcctccatcataggattgtcttgat

SEQ ID NO: 145004 - DNA, 25 bp, Artificial sequence
  SiRNA target sequence
cctccatcataggattgtcttgatt

SEQ ID NO: 145005 - DNA, 25 bp, Artificial sequence
  SiRNA target sequence
ctccatcataggattgtcttgatta

SEQ ID NO: 145006 - DNA, 25 bp, Artificial sequence
  SiRNA target sequence
tccatcataggattgtcttgattaa

SEQ ID NO: 145007 - DNA, 25 bp, Artificial sequence
  SiRNA target sequence
ccatcataggattgtcttgattaac

SEQ ID NO: 145008 - DNA, 25 bp, Artificial sequence
  SiRNA target sequence
catcataggattgtcttgattaaca

SEQ ID NO: 145009 - DNA, 25 bp, Artificial sequence
  SiRNA target sequence
atcataggattgtcttgattaacac

SEQ ID NO: 145010 - DNA, 25 bp, Artificial sequence
  SiRNA target sequence
tcataggattgtcttgattaacact

SEQ ID NO: 145011 - DNA, 25 bp, Artificial sequence
  SiRNA target sequence
cataggattgtcttgattaacactg

SEQ ID NO: 145012 - DNA, 25 bp, Artificial sequence
  SiRNA target sequence
ataggattgtcttgattaacactgg

SEQ ID NO: 145013 - DNA, 25 bp, Artificial sequence
  SiRNA target sequence
taggattgtcttgattaacactggt

SEQ ID NO: 145014 - DNA, 25 bp, Artificial sequence
  SiRNA target sequence
aggattgtcttgattaacactggtc

SEQ ID NO: 145015 - DNA, 25 bp, Artificial sequence
  SiRNA target sequence
ggattgtcttgattaacactggtct

SEQ ID NO: 145016 - DNA, 25 bp, Artificial sequence
  SiRNA target sequence
gattgtcttgattaacactggtctt

SEQ ID NO: 145017 - DNA, 25 bp, Artificial sequence
  SiRNA target sequence
attgtcttgattaacactggtctta

SEQ ID NO: 145018 - DNA, 25 bp, Artificial sequence
  SiRNA target sequence
ttgtcttgattaacactggtcttaa

SEQ ID NO: 145019 - DNA, 25 bp, Artificial sequence
  SiRNA target sequence
tgtcttgattaacactggtcttaat

SEQ ID NO: 145020 - DNA, 25 bp, Artificial sequence
  SiRNA target sequence
gtcttgattaacactggtcttaata

SEQ ID NO: 145021 - DNA, 25 bp, Artificial sequence
  SiRNA target sequence
tcttgattaacactggtcttaatac

SEQ ID NO: 145022 - DNA, 25 bp, Artificial sequence
  SiRNA target sequence
cttgattaacactggtcttaataca

SEQ ID NO: 145023 - DNA, 25 bp, Artificial sequence
  SiRNA target sequence
ttgattaacactggtcttaatacac

SEQ ID NO: 145024 - DNA, 25 bp, Artificial sequence
  SiRNA target sequence
tgattaacactggtcttaatacaca

SEQ ID NO: 145025 - DNA, 25 bp, Artificial sequence
  SiRNA target sequence
gattaacactggtcttaatacacaa

SEQ ID NO: 145026 - DNA, 25 bp, Artificial sequence
  SiRNA target sequence
attaacactggtcttaatacacaat

SEQ ID NO: 145027 - DNA, 25 bp, Artificial sequence
  SiRNA target sequence
ttaacactggtcttaatacacaatt

SEQ ID NO: 145028 - DNA, 25 bp, Artificial sequence
  SiRNA target sequence
taacactggtcttaatacacaattt

SEQ ID NO: 145029 - DNA, 25 bp, Artificial sequence
  SiRNA target sequence
aacactggtcttaatacacaattta

SEQ ID NO: 145030 - DNA, 25 bp, Artificial sequence
  SiRNA target sequence
acactggtcttaatacacaatttat

SEQ ID NO: 145031 - DNA, 25 bp, Artificial sequence
  SiRNA target sequence
cactggtcttaatacacaatttatc

SEQ ID NO: 145032 - DNA, 25 bp, Artificial sequence
  SiRNA target sequence
actggtcttaatacacaatttatct

SEQ ID NO: 145033 - DNA, 25 bp, Artificial sequence
  SiRNA target sequence
ctggtcttaatacacaatttatctt

SEQ ID NO: 145034 - DNA, 25 bp, Artificial sequence
  SiRNA target sequence
tggtcttaatacacaatttatcttt

SEQ ID NO: 145035 - DNA, 25 bp, Artificial sequence
  SiRNA target sequence
ggtcttaatacacaatttatcttta

SEQ ID NO: 145036 - DNA, 25 bp, Artificial sequence
  SiRNA target sequence
gtcttaatacacaatttatctttat

SEQ ID NO: 145037 - DNA, 25 bp, Artificial sequence
  SiRNA target sequence
tcttaatacacaatttatctttata

SEQ ID NO: 145038 - DNA, 25 bp, Artificial sequence
  SiRNA target sequence
cttaatacacaatttatctttatat

SEQ ID NO: 145039 - DNA, 25 bp, Artificial sequence
  SiRNA target sequence
ttaatacacaatttatctttatata

SEQ ID NO: 145040 - DNA, 25 bp, Artificial sequence
  SiRNA target sequence
taatacacaatttatctttatatat

SEQ ID NO: 145041 - DNA, 25 bp, Artificial sequence
  SiRNA target sequence
aatacacaatttatctttatatatc

SEQ ID NO: 145042 - DNA, 25 bp, Artificial sequence
  SiRNA target sequence
atacacaatttatctttatatatca

SEQ ID NO: 145043 - DNA, 25 bp, Artificial sequence
  SiRNA target sequence
tacacaatttatctttatatatcaa

SEQ ID NO: 145044 - DNA, 25 bp, Artificial sequence
  SiRNA target sequence
acacaatttatctttatatatcaac

SEQ ID NO: 145045 - DNA, 25 bp, Artificial sequence
  SiRNA target sequence
cacaatttatctttatatatcaacc

SEQ ID NO: 145046 - DNA, 25 bp, Artificial sequence
  SiRNA target sequence
acaatttatctttatatatcaacca

SEQ ID NO: 145047 - DNA, 25 bp, Artificial sequence
  SiRNA target sequence
caatttatctttatatatcaaccac

SEQ ID NO: 145048 - DNA, 25 bp, Artificial sequence
  SiRNA target sequence
aatttatctttatatatcaaccaca

SEQ ID NO: 145049 - DNA, 25 bp, Artificial sequence
  SiRNA target sequence
atttatctttatatatcaaccacac

SEQ ID NO: 145050 - DNA, 25 bp, Artificial sequence
  SiRNA target sequence
tttatctttatatatcaaccacacc

SEQ ID NO: 145051 - DNA, 25 bp, Artificial sequence
  SiRNA target sequence
ttatctttatatatcaaccacaccc

SEQ ID NO: 145052 - DNA, 25 bp, Artificial sequence
  SiRNA target sequence
tatctttatatatcaaccacaccca

SEQ ID NO: 145053 - DNA, 25 bp, Artificial sequence
  SiRNA target sequence
atctttatatatcaaccacacccat

SEQ ID NO: 145054 - DNA, 25 bp, Artificial sequence
  SiRNA target sequence
tctttatatatcaaccacacccatc

SEQ ID NO: 145055 - DNA, 25 bp, Artificial sequence
  SiRNA target sequence
ctttatatatcaaccacacccatcc

SEQ ID NO: 145056 - DNA, 25 bp, Artificial sequence
  SiRNA target sequence
tttatatatcaaccacacccatcct

SEQ ID NO: 145057 - DNA, 25 bp, Artificial sequence
  SiRNA target sequence
ttatatatcaaccacacccatcctg

SEQ ID NO: 145058 - DNA, 25 bp, Artificial sequence
  SiRNA target sequence
tatatatcaaccacacccatcctga

SEQ ID NO: 145059 - DNA, 25 bp, Artificial sequence
  SiRNA target sequence
atatatcaaccacacccatcctgat

SEQ ID NO: 145060 - DNA, 25 bp, Artificial sequence
  SiRNA target sequence
tatatcaaccacacccatcctgatc

SEQ ID NO: 145061 - DNA, 25 bp, Artificial sequence
  SiRNA target sequence
atatcaaccacacccatcctgatcc

SEQ ID NO: 145062 - DNA, 25 bp, Artificial sequence
  SiRNA target sequence
tatcaaccacacccatcctgatcca

SEQ ID NO: 145063 - DNA, 25 bp, Artificial sequence
  SiRNA target sequence
atcaaccacacccatcctgatccaa

SEQ ID NO: 145064 - DNA, 25 bp, Artificial sequence
  SiRNA target sequence
tcaaccacacccatcctgatccaaa

SEQ ID NO: 145065 - DNA, 25 bp, Artificial sequence
  SiRNA target sequence
caaccacacccatcctgatccaaat

SEQ ID NO: 145066 - DNA, 25 bp, Artificial sequence
  SiRNA target sequence
aaccacacccatcctgatccaaata

SEQ ID NO: 145067 - DNA, 25 bp, Artificial sequence
  SiRNA target sequence
accacacccatcctgatccaaataa

SEQ ID NO: 145068 - DNA, 25 bp, Artificial sequence
  SiRNA target sequence
ccacacccatcctgatccaaataat

SEQ ID NO: 145069 - DNA, 25 bp, Artificial sequence
  SiRNA target sequence
cacacccatcctgatccaaataatt

SEQ ID NO: 145070 - DNA, 25 bp, Artificial sequence
  SiRNA target sequence
acacccatcctgatccaaataattt

SEQ ID NO: 145071 - DNA, 25 bp, Artificial sequence
  SiRNA target sequence
cacccatcctgatccaaataatttt

SEQ ID NO: 145072 - DNA, 25 bp, Artificial sequence
  SiRNA target sequence
acccatcctgatccaaataatttta

SEQ ID NO: 145073 - DNA, 25 bp, Artificial sequence
  SiRNA target sequence
cccatcctgatccaaataattttac

SEQ ID NO: 145074 - DNA, 25 bp, Artificial sequence
  SiRNA target sequence
ccatcctgatccaaataattttaca

SEQ ID NO: 145075 - DNA, 25 bp, Artificial sequence
  SiRNA target sequence
catcctgatccaaataattttacag

SEQ ID NO: 145076 - DNA, 25 bp, Artificial sequence
  SiRNA target sequence
atcctgatccaaataattttacagc

SEQ ID NO: 145077 - DNA, 25 bp, Artificial sequence
  SiRNA target sequence
tcctgatccaaataattttacagct

SEQ ID NO: 145078 - DNA, 25 bp, Artificial sequence
  SiRNA target sequence
cctgatccaaataattttacagctt

SEQ ID NO: 145079 - DNA, 25 bp, Artificial sequence
  SiRNA target sequence
ctgatccaaataattttacagcttc

SEQ ID NO: 145080 - DNA, 25 bp, Artificial sequence
  SiRNA target sequence
tgatccaaataattttacagcttca

SEQ ID NO: 145081 - DNA, 25 bp, Artificial sequence
  SiRNA target sequence
gatccaaataattttacagcttcag

SEQ ID NO: 145082 - DNA, 25 bp, Artificial sequence
  SiRNA target sequence
atccaaataattttacagcttcagt

SEQ ID NO: 145083 - DNA, 25 bp, Artificial sequence
  SiRNA target sequence
tccaaataattttacagcttcagta

SEQ ID NO: 145084 - DNA, 25 bp, Artificial sequence
  SiRNA target sequence
ccaaataattttacagcttcagtat

SEQ ID NO: 145085 - DNA, 25 bp, Artificial sequence
  SiRNA target sequence
caaataattttacagcttcagtatt

SEQ ID NO: 145086 - DNA, 25 bp, Artificial sequence
  SiRNA target sequence
aaataattttacagcttcagtatta

SEQ ID NO: 145087 - DNA, 25 bp, Artificial sequence
  SiRNA target sequence
aataattttacagcttcagtattaa

SEQ ID NO: 145088 - DNA, 25 bp, Artificial sequence
  SiRNA target sequence
ataattttacagcttcagtattaaa

SEQ ID NO: 145089 - DNA, 25 bp, Artificial sequence
  SiRNA target sequence
taattttacagcttcagtattaaaa

SEQ ID NO: 145090 - DNA, 25 bp, Artificial sequence
  SiRNA target sequence
aattttacagcttcagtattaaaat

SEQ ID NO: 145091 - DNA, 25 bp, Artificial sequence
  SiRNA target sequence
attttacagcttcagtattaaaatt

SEQ ID NO: 145092 - DNA, 25 bp, Artificial sequence
  SiRNA target sequence
ttttacagcttcagtattaaaattc

SEQ ID NO: 145093 - DNA, 25 bp, Artificial sequence
  SiRNA target sequence
tttacagcttcagtattaaaattct

SEQ ID NO: 145094 - DNA, 25 bp, Artificial sequence
  SiRNA target sequence
ttacagcttcagtattaaaattctc

SEQ ID NO: 145095 - DNA, 25 bp, Artificial sequence
  SiRNA target sequence
tacagcttcagtattaaaattctcc

SEQ ID NO: 145096 - DNA, 25 bp, Artificial sequence
  SiRNA target sequence
acagcttcagtattaaaattctcct

SEQ ID NO: 145097 - DNA, 25 bp, Artificial sequence
  SiRNA target sequence
cagcttcagtattaaaattctcctt

SEQ ID NO: 145098 - DNA, 25 bp, Artificial sequence
  SiRNA target sequence
agcttcagtattaaaattctcctta

SEQ ID NO: 145099 - DNA, 25 bp, Artificial sequence
  SiRNA target sequence
gcttcagtattaaaattctccttaa

SEQ ID NO: 145100 - DNA, 25 bp, Artificial sequence
  SiRNA target sequence
cttcagtattaaaattctccttaaa

SEQ ID NO: 145101 - DNA, 25 bp, Artificial sequence
  SiRNA target sequence
ttcagtattaaaattctccttaaat

SEQ ID NO: 145102 - DNA, 25 bp, Artificial sequence
  SiRNA target sequence
tcagtattaaaattctccttaaatt

SEQ ID NO: 145103 - DNA, 25 bp, Artificial sequence
  SiRNA target sequence
cagtattaaaattctccttaaattt

SEQ ID NO: 145104 - DNA, 25 bp, Artificial sequence
  SiRNA target sequence
agtattaaaattctccttaaattta

SEQ ID NO: 145105 - DNA, 25 bp, Artificial sequence
  SiRNA target sequence
gtattaaaattctccttaaatttat

SEQ ID NO: 145106 - DNA, 25 bp, Artificial sequence
  SiRNA target sequence
tattaaaattctccttaaatttatt

SEQ ID NO: 145107 - DNA, 25 bp, Artificial sequence
  SiRNA target sequence
attaaaattctccttaaatttattt

SEQ ID NO: 145108 - DNA, 25 bp, Artificial sequence
  SiRNA target sequence
ttaaaattctccttaaatttattta

SEQ ID NO: 145109 - DNA, 25 bp, Artificial sequence
  SiRNA target sequence
taaaattctccttaaatttatttat

SEQ ID NO: 145110 - DNA, 25 bp, Artificial sequence
  SiRNA target sequence
aaaattctccttaaatttatttatt

SEQ ID NO: 145111 - DNA, 25 bp, Artificial sequence
  SiRNA target sequence
aaattctccttaaatttatttattg

SEQ ID NO: 145112 - DNA, 25 bp, Artificial sequence
  SiRNA target sequence
aattctccttaaatttatttattga

SEQ ID NO: 145113 - DNA, 25 bp, Artificial sequence
  SiRNA target sequence
attctccttaaatttatttattgat

SEQ ID NO: 145114 - DNA, 25 bp, Artificial sequence
  SiRNA target sequence
ttctccttaaatttatttattgatc

SEQ ID NO: 145115 - DNA, 25 bp, Artificial sequence
  SiRNA target sequence
tctccttaaatttatttattgatcc

SEQ ID NO: 145116 - DNA, 25 bp, Artificial sequence
  SiRNA target sequence
ctccttaaatttatttattgatcca

SEQ ID NO: 145117 - DNA, 25 bp, Artificial sequence
  SiRNA target sequence
tccttaaatttatttattgatccaa

SEQ ID NO: 145118 - DNA, 25 bp, Artificial sequence
  SiRNA target sequence
ccttaaatttatttattgatccaaa

SEQ ID NO: 145119 - DNA, 25 bp, Artificial sequence
  SiRNA target sequence
cttaaatttatttattgatccaaag

SEQ ID NO: 145120 - DNA, 25 bp, Artificial sequence
  SiRNA target sequence
ttaaatttatttattgatccaaagt

SEQ ID NO: 145121 - DNA, 25 bp, Artificial sequence
  SiRNA target sequence
taaatttatttattgatccaaagtc

SEQ ID NO: 145122 - DNA, 25 bp, Artificial sequence
  SiRNA target sequence
aaatttatttattgatccaaagtct

SEQ ID NO: 145123 - DNA, 25 bp, Artificial sequence
  SiRNA target sequence
aatttatttattgatccaaagtctt

SEQ ID NO: 145124 - DNA, 25 bp, Artificial sequence
  SiRNA target sequence
atttatttattgatccaaagtcttt

SEQ ID NO: 145125 - DNA, 25 bp, Artificial sequence
  SiRNA target sequence
tttatttattgatccaaagtctttt

SEQ ID NO: 145126 - DNA, 25 bp, Artificial sequence
  SiRNA target sequence
ttatttattgatccaaagtctttta

SEQ ID NO: 145127 - DNA, 25 bp, Artificial sequence
  SiRNA target sequence
tatttattgatccaaagtcttttat

SEQ ID NO: 145128 - DNA, 25 bp, Artificial sequence
  SiRNA target sequence
atttattgatccaaagtcttttatt

SEQ ID NO: 145129 - DNA, 25 bp, Artificial sequence
  SiRNA target sequence
tttattgatccaaagtcttttatta

SEQ ID NO: 145130 - DNA, 25 bp, Artificial sequence
  SiRNA target sequence
ttattgatccaaagtcttttattat

SEQ ID NO: 145131 - DNA, 25 bp, Artificial sequence
  SiRNA target sequence
tattgatccaaagtcttttattata

SEQ ID NO: 145132 - DNA, 25 bp, Artificial sequence
  SiRNA target sequence
attgatccaaagtcttttattatag

SEQ ID NO: 145133 - DNA, 25 bp, Artificial sequence
  SiRNA target sequence
ttgatccaaagtcttttattatagc

SEQ ID NO: 145134 - DNA, 25 bp, Artificial sequence
  SiRNA target sequence
tgatccaaagtcttttattatagca

SEQ ID NO: 145135 - DNA, 25 bp, Artificial sequence
  SiRNA target sequence
gatccaaagtcttttattatagcac

SEQ ID NO: 145136 - DNA, 25 bp, Artificial sequence
  SiRNA target sequence
atccaaagtcttttattatagcact

SEQ ID NO: 145137 - DNA, 25 bp, Artificial sequence
  SiRNA target sequence
tccaaagtcttttattatagcactt

SEQ ID NO: 145138 - DNA, 25 bp, Artificial sequence
  SiRNA target sequence
ccaaagtcttttattatagcacttt

SEQ ID NO: 145139 - DNA, 25 bp, Artificial sequence
  SiRNA target sequence
caaagtcttttattatagcactttc

SEQ ID NO: 145140 - DNA, 25 bp, Artificial sequence
  SiRNA target sequence
aaagtcttttattatagcactttcc

SEQ ID NO: 145141 - DNA, 25 bp, Artificial sequence
  SiRNA target sequence
aagtcttttattatagcactttcca

SEQ ID NO: 145142 - DNA, 25 bp, Artificial sequence
  SiRNA target sequence
agtcttttattatagcactttccaa

SEQ ID NO: 145143 - DNA, 25 bp, Artificial sequence
  SiRNA target sequence
gtcttttattatagcactttccaac

SEQ ID NO: 145144 - DNA, 25 bp, Artificial sequence
  SiRNA target sequence
tcttttattatagcactttccaact

SEQ ID NO: 145145 - DNA, 25 bp, Artificial sequence
  SiRNA target sequence
cttttattatagcactttccaactg

SEQ ID NO: 145146 - DNA, 25 bp, Artificial sequence
  SiRNA target sequence
ttttattatagcactttccaactgg

SEQ ID NO: 145147 - DNA, 25 bp, Artificial sequence
  SiRNA target sequence
tttattatagcactttccaactggg

SEQ ID NO: 145148 - DNA, 25 bp, Artificial sequence
  SiRNA target sequence
ttattatagcactttccaactggga

SEQ ID NO: 145149 - DNA, 25 bp, Artificial sequence
  SiRNA target sequence
tattatagcactttccaactgggaa

SEQ ID NO: 145150 - DNA, 25 bp, Artificial sequence
  SiRNA target sequence
attatagcactttccaactgggaag

SEQ ID NO: 145151 - DNA, 25 bp, Artificial sequence
  SiRNA target sequence
ttatagcactttccaactgggaaga

SEQ ID NO: 145152 - DNA, 25 bp, Artificial sequence
  SiRNA target sequence
tatagcactttccaactgggaagaa

SEQ ID NO: 145153 - DNA, 25 bp, Artificial sequence
  SiRNA target sequence
atagcactttccaactgggaagaaa

SEQ ID NO: 145154 - DNA, 25 bp, Artificial sequence
  SiRNA target sequence
tagcactttccaactgggaagaaat

SEQ ID NO: 145155 - DNA, 25 bp, Artificial sequence
  SiRNA target sequence
agcactttccaactgggaagaaatc

SEQ ID NO: 145156 - DNA, 25 bp, Artificial sequence
  SiRNA target sequence
gcactttccaactgggaagaaatct

SEQ ID NO: 145157 - DNA, 25 bp, Artificial sequence
  SiRNA target sequence
cactttccaactgggaagaaatctt

SEQ ID NO: 145158 - DNA, 25 bp, Artificial sequence
  SiRNA target sequence
actttccaactgggaagaaatcttt

SEQ ID NO: 145159 - DNA, 25 bp, Artificial sequence
  SiRNA target sequence
ctttccaactgggaagaaatctttt

SEQ ID NO: 145160 - DNA, 25 bp, Artificial sequence
  SiRNA target sequence
tttccaactgggaagaaatcttttt

SEQ ID NO: 145161 - DNA, 25 bp, Artificial sequence
  SiRNA target sequence
ttccaactgggaagaaatcttttta

SEQ ID NO: 145162 - DNA, 25 bp, Artificial sequence
  SiRNA target sequence
tccaactgggaagaaatctttttat

SEQ ID NO: 145163 - DNA, 25 bp, Artificial sequence
  SiRNA target sequence
ccaactgggaagaaatctttttatt

SEQ ID NO: 145164 - DNA, 25 bp, Artificial sequence
  SiRNA target sequence
caactgggaagaaatctttttattt

SEQ ID NO: 145165 - DNA, 25 bp, Artificial sequence
  SiRNA target sequence
aactgggaagaaatctttttatttt

SEQ ID NO: 145166 - DNA, 25 bp, Artificial sequence
  SiRNA target sequence
actgggaagaaatctttttattttc

SEQ ID NO: 145167 - DNA, 25 bp, Artificial sequence
  SiRNA target sequence
ctgggaagaaatctttttattttct

SEQ ID NO: 145168 - DNA, 25 bp, Artificial sequence
  SiRNA target sequence
tgggaagaaatctttttattttctg

SEQ ID NO: 145169 - DNA, 25 bp, Artificial sequence
  SiRNA target sequence
gggaagaaatctttttattttctgg

SEQ ID NO: 145170 - DNA, 25 bp, Artificial sequence
  SiRNA target sequence
ggaagaaatctttttattttctggt

SEQ ID NO: 145171 - DNA, 25 bp, Artificial sequence
  SiRNA target sequence
gaagaaatctttttattttctggtg

SEQ ID NO: 145172 - DNA, 25 bp, Artificial sequence
  SiRNA target sequence
aagaaatctttttattttctggtga

SEQ ID NO: 145173 - DNA, 25 bp, Artificial sequence
  SiRNA target sequence
agaaatctttttattttctggtgac

SEQ ID NO: 145174 - DNA, 25 bp, Artificial sequence
  SiRNA target sequence
gaaatctttttattttctggtgaca

SEQ ID NO: 145175 - DNA, 25 bp, Artificial sequence
  SiRNA target sequence
aaatctttttattttctggtgacat

SEQ ID NO: 145176 - DNA, 25 bp, Artificial sequence
  SiRNA target sequence
aatctttttattttctggtgacatt

SEQ ID NO: 145177 - DNA, 25 bp, Artificial sequence
  SiRNA target sequence
atctttttattttctggtgacatta

SEQ ID NO: 145178 - DNA, 25 bp, Artificial sequence
  SiRNA target sequence
tctttttattttctggtgacattac

SEQ ID NO: 145179 - DNA, 25 bp, Artificial sequence
  SiRNA target sequence
ctttttattttctggtgacattacc

SEQ ID NO: 145180 - DNA, 25 bp, Artificial sequence
  SiRNA target sequence
tttttattttctggtgacattacca

SEQ ID NO: 145181 - DNA, 25 bp, Artificial sequence
  SiRNA target sequence
ttttattttctggtgacattaccaa

SEQ ID NO: 145182 - DNA, 25 bp, Artificial sequence
  SiRNA target sequence
tttattttctggtgacattaccaac

SEQ ID NO: 145183 - DNA, 25 bp, Artificial sequence
  SiRNA target sequence
ttattttctggtgacattaccaacc

SEQ ID NO: 145184 - DNA, 25 bp, Artificial sequence
  SiRNA target sequence
tattttctggtgacattaccaacca

SEQ ID NO: 145185 - DNA, 25 bp, Artificial sequence
  SiRNA target sequence
attttctggtgacattaccaaccag

SEQ ID NO: 145186 - DNA, 25 bp, Artificial sequence
  SiRNA target sequence
ttttctggtgacattaccaaccaga

SEQ ID NO: 145187 - DNA, 25 bp, Artificial sequence
  SiRNA target sequence
tttctggtgacattaccaaccagaa

SEQ ID NO: 145188 - DNA, 25 bp, Artificial sequence
  SiRNA target sequence
ttctggtgacattaccaaccagaaa

SEQ ID NO: 145189 - DNA, 25 bp, Artificial sequence
  SiRNA target sequence
tctggtgacattaccaaccagaaaa

SEQ ID NO: 145190 - DNA, 25 bp, Artificial sequence
  SiRNA target sequence
ctggtgacattaccaaccagaaaag

SEQ ID NO: 145191 - DNA, 25 bp, Artificial sequence
  SiRNA target sequence
tggtgacattaccaaccagaaaaga

SEQ ID NO: 145192 - DNA, 25 bp, Artificial sequence
  SiRNA target sequence
ggtgacattaccaaccagaaaagac

SEQ ID NO: 145193 - DNA, 25 bp, Artificial sequence
  SiRNA target sequence
gtgacattaccaaccagaaaagact

SEQ ID NO: 145194 - DNA, 25 bp, Artificial sequence
  SiRNA target sequence
tgacattaccaaccagaaaagacta

SEQ ID NO: 145195 - DNA, 25 bp, Artificial sequence
  SiRNA target sequence
gacattaccaaccagaaaagactat

SEQ ID NO: 145196 - DNA, 25 bp, Artificial sequence
  SiRNA target sequence
acattaccaaccagaaaagactatg

SEQ ID NO: 145197 - DNA, 25 bp, Artificial sequence
  SiRNA target sequence
cattaccaaccagaaaagactatgg

SEQ ID NO: 145198 - DNA, 25 bp, Artificial sequence
  SiRNA target sequence
attaccaaccagaaaagactatggt

SEQ ID NO: 145199 - DNA, 25 bp, Artificial sequence
  SiRNA target sequence
ttaccaaccagaaaagactatggtt

SEQ ID NO: 145200 - DNA, 25 bp, Artificial sequence
  SiRNA target sequence
taccaaccagaaaagactatggttg

SEQ ID NO: 145201 - DNA, 25 bp, Artificial sequence
  SiRNA target sequence
accaaccagaaaagactatggttgt

SEQ ID NO: 145202 - DNA, 25 bp, Artificial sequence
  SiRNA target sequence
ccaaccagaaaagactatggttgta

SEQ ID NO: 145203 - DNA, 25 bp, Artificial sequence
  SiRNA target sequence
caaccagaaaagactatggttgtaa

SEQ ID NO: 145204 - DNA, 25 bp, Artificial sequence
  SiRNA target sequence
aaccagaaaagactatggttgtaat

SEQ ID NO: 145205 - DNA, 25 bp, Artificial sequence
  SiRNA target sequence
accagaaaagactatggttgtaatg

SEQ ID NO: 145206 - DNA, 25 bp, Artificial sequence
  SiRNA target sequence
ccagaaaagactatggttgtaatga

SEQ ID NO: 145207 - DNA, 25 bp, Artificial sequence
  SiRNA target sequence
cagaaaagactatggttgtaatgac

SEQ ID NO: 145208 - DNA, 25 bp, Artificial sequence
  SiRNA target sequence
agaaaagactatggttgtaatgacc

SEQ ID NO: 145209 - DNA, 25 bp, Artificial sequence
  SiRNA target sequence
gaaaagactatggttgtaatgacca

SEQ ID NO: 145210 - DNA, 25 bp, Artificial sequence
  SiRNA target sequence
aaaagactatggttgtaatgaccac

SEQ ID NO: 145211 - DNA, 25 bp, Artificial sequence
  SiRNA target sequence
aaagactatggttgtaatgaccacc

SEQ ID NO: 145212 - DNA, 25 bp, Artificial sequence
  SiRNA target sequence
aagactatggttgtaatgaccacca

SEQ ID NO: 145213 - DNA, 25 bp, Artificial sequence
  SiRNA target sequence
agactatggttgtaatgaccaccac

SEQ ID NO: 145214 - DNA, 25 bp, Artificial sequence
  SiRNA target sequence
gactatggttgtaatgaccaccacc

SEQ ID NO: 145215 - DNA, 25 bp, Artificial sequence
  SiRNA target sequence
actatggttgtaatgaccaccacca

SEQ ID NO: 145216 - DNA, 25 bp, Artificial sequence
  SiRNA target sequence
ctatggttgtaatgaccaccaccat

SEQ ID NO: 145217 - DNA, 25 bp, Artificial sequence
  SiRNA target sequence
tatggttgtaatgaccaccaccata

SEQ ID NO: 145218 - DNA, 25 bp, Artificial sequence
  SiRNA target sequence
atggttgtaatgaccaccaccataa

SEQ ID NO: 145219 - DNA, 25 bp, Artificial sequence
  SiRNA target sequence
tggttgtaatgaccaccaccataat

SEQ ID NO: 145220 - DNA, 25 bp, Artificial sequence
  SiRNA target sequence
ggttgtaatgaccaccaccataatc

SEQ ID NO: 145221 - DNA, 25 bp, Artificial sequence
  SiRNA target sequence
gttgtaatgaccaccaccataatct

SEQ ID NO: 145222 - DNA, 25 bp, Artificial sequence
  SiRNA target sequence
ttgtaatgaccaccaccataatctc

SEQ ID NO: 145223 - DNA, 25 bp, Artificial sequence
  SiRNA target sequence
tgtaatgaccaccaccataatctct

SEQ ID NO: 145224 - DNA, 25 bp, Artificial sequence
  SiRNA target sequence
gtaatgaccaccaccataatctctt

SEQ ID NO: 145225 - DNA, 25 bp, Artificial sequence
  SiRNA target sequence
taatgaccaccaccataatctctta

SEQ ID NO: 145226 - DNA, 25 bp, Artificial sequence
  SiRNA target sequence
aatgaccaccaccataatctcttaa

SEQ ID NO: 145227 - DNA, 25 bp, Artificial sequence
  SiRNA target sequence
atgaccaccaccataatctcttaat

SEQ ID NO: 145228 - DNA, 25 bp, Artificial sequence
  SiRNA target sequence
tgaccaccaccataatctcttaatt

SEQ ID NO: 145229 - DNA, 25 bp, Artificial sequence
  SiRNA target sequence
gaccaccaccataatctcttaattg

SEQ ID NO: 145230 - DNA, 25 bp, Artificial sequence
  SiRNA target sequence
accaccaccataatctcttaattgt

SEQ ID NO: 145231 - DNA, 25 bp, Artificial sequence
  SiRNA target sequence
ccaccaccataatctcttaattgtt

SEQ ID NO: 145232 - DNA, 25 bp, Artificial sequence
  SiRNA target sequence
caccaccataatctcttaattgttt

SEQ ID NO: 145233 - DNA, 25 bp, Artificial sequence
  SiRNA target sequence
accaccataatctcttaattgttta

SEQ ID NO: 145234 - DNA, 25 bp, Artificial sequence
  SiRNA target sequence
ccaccataatctcttaattgtttat

SEQ ID NO: 145235 - DNA, 25 bp, Artificial sequence
  SiRNA target sequence
caccataatctcttaattgtttatc

SEQ ID NO: 145236 - DNA, 25 bp, Artificial sequence
  SiRNA target sequence
accataatctcttaattgtttatca

SEQ ID NO: 145237 - DNA, 25 bp, Artificial sequence
  SiRNA target sequence
ccataatctcttaattgtttatcaa

SEQ ID NO: 145238 - DNA, 25 bp, Artificial sequence
  SiRNA target sequence
cataatctcttaattgtttatcaac

SEQ ID NO: 145239 - DNA, 25 bp, Artificial sequence
  SiRNA target sequence
ataatctcttaattgtttatcaaca

SEQ ID NO: 145240 - DNA, 25 bp, Artificial sequence
  SiRNA target sequence
taatctcttaattgtttatcaacaa

SEQ ID NO: 145241 - DNA, 25 bp, Artificial sequence
  SiRNA target sequence
aatctcttaattgtttatcaacaag

SEQ ID NO: 145242 - DNA, 25 bp, Artificial sequence
  SiRNA target sequence
atctcttaattgtttatcaacaagt

SEQ ID NO: 145243 - DNA, 25 bp, Artificial sequence
  SiRNA target sequence
tctcttaattgtttatcaacaagtg

SEQ ID NO: 145244 - DNA, 25 bp, Artificial sequence
  SiRNA target sequence
ctcttaattgtttatcaacaagtgc

SEQ ID NO: 145245 - DNA, 25 bp, Artificial sequence
  SiRNA target sequence
tcttaattgtttatcaacaagtgca

SEQ ID NO: 145246 - DNA, 25 bp, Artificial sequence
  SiRNA target sequence
cttaattgtttatcaacaagtgcat

SEQ ID NO: 145247 - DNA, 25 bp, Artificial sequence
  SiRNA target sequence
ttaattgtttatcaacaagtgcatt

SEQ ID NO: 145248 - DNA, 25 bp, Artificial sequence
  SiRNA target sequence
taattgtttatcaacaagtgcattt

SEQ ID NO: 145249 - DNA, 25 bp, Artificial sequence
  SiRNA target sequence
aattgtttatcaacaagtgcatttc

SEQ ID NO: 145250 - DNA, 25 bp, Artificial sequence
  SiRNA target sequence
attgtttatcaacaagtgcatttcc

SEQ ID NO: 145251 - DNA, 25 bp, Artificial sequence
  SiRNA target sequence
ttgtttatcaacaagtgcatttcct

SEQ ID NO: 145252 - DNA, 25 bp, Artificial sequence
  SiRNA target sequence
tgtttatcaacaagtgcatttcctt

SEQ ID NO: 145253 - DNA, 25 bp, Artificial sequence
  SiRNA target sequence
gtttatcaacaagtgcatttccttt

SEQ ID NO: 145254 - DNA, 25 bp, Artificial sequence
  SiRNA target sequence
tttatcaacaagtgcatttccttta

SEQ ID NO: 145255 - DNA, 25 bp, Artificial sequence
  SiRNA target sequence
ttatcaacaagtgcatttcctttat

SEQ ID NO: 145256 - DNA, 25 bp, Artificial sequence
  SiRNA target sequence
tatcaacaagtgcatttcctttatt

SEQ ID NO: 145257 - DNA, 25 bp, Artificial sequence
  SiRNA target sequence
atcaacaagtgcatttcctttatta

SEQ ID NO: 145258 - DNA, 25 bp, Artificial sequence
  SiRNA target sequence
tcaacaagtgcatttcctttattat

SEQ ID NO: 145259 - DNA, 25 bp, Artificial sequence
  SiRNA target sequence
caacaagtgcatttcctttattatt

SEQ ID NO: 145260 - DNA, 25 bp, Artificial sequence
  SiRNA target sequence
aacaagtgcatttcctttattatta

SEQ ID NO: 145261 - DNA, 25 bp, Artificial sequence
  SiRNA target sequence
acaagtgcatttcctttattattaa

SEQ ID NO: 145262 - DNA, 25 bp, Artificial sequence
  SiRNA target sequence
caagtgcatttcctttattattaaa

SEQ ID NO: 145263 - DNA, 25 bp, Artificial sequence
  SiRNA target sequence
aagtgcatttcctttattattaaaa

SEQ ID NO: 145264 - DNA, 25 bp, Artificial sequence
  SiRNA target sequence
agtgcatttcctttattattaaaaa

SEQ ID NO: 145265 - DNA, 25 bp, Artificial sequence
  SiRNA target sequence
gtgcatttcctttattattaaaaag

SEQ ID NO: 145266 - DNA, 25 bp, Artificial sequence
  SiRNA target sequence
tgcatttcctttattattaaaaagt

SEQ ID NO: 145267 - DNA, 25 bp, Artificial sequence
  SiRNA target sequence
gcatttcctttattattaaaaagta

SEQ ID NO: 145268 - DNA, 25 bp, Artificial sequence
  SiRNA target sequence
catttcctttattattaaaaagtaa

SEQ ID NO: 145269 - DNA, 25 bp, Artificial sequence
  SiRNA target sequence
atttcctttattattaaaaagtaat

SEQ ID NO: 145270 - DNA, 25 bp, Artificial sequence
  SiRNA target sequence
tttcctttattattaaaaagtaatg

SEQ ID NO: 145271 - DNA, 25 bp, Artificial sequence
  SiRNA target sequence
ttcctttattattaaaaagtaatga

SEQ ID NO: 145272 - DNA, 25 bp, Artificial sequence
  SiRNA target sequence
tcctttattattaaaaagtaatgaa

SEQ ID NO: 145273 - DNA, 25 bp, Artificial sequence
  SiRNA target sequence
cctttattattaaaaagtaatgaat

SEQ ID NO: 145274 - DNA, 25 bp, Artificial sequence
  SiRNA target sequence
ctttattattaaaaagtaatgaatt

SEQ ID NO: 145275 - DNA, 25 bp, Artificial sequence
  SiRNA target sequence
tttattattaaaaagtaatgaattt

SEQ ID NO: 145276 - DNA, 25 bp, Artificial sequence
  SiRNA target sequence
ttattattaaaaagtaatgaattta

SEQ ID NO: 145277 - DNA, 25 bp, Artificial sequence
  SiRNA target sequence
tattattaaaaagtaatgaatttaa

SEQ ID NO: 145278 - DNA, 25 bp, Artificial sequence
  SiRNA target sequence
attattaaaaagtaatgaatttaat

SEQ ID NO: 145279 - DNA, 25 bp, Artificial sequence
  SiRNA target sequence
ttattaaaaagtaatgaatttaatg

SEQ ID NO: 145280 - DNA, 25 bp, Artificial sequence
  SiRNA target sequence
tattaaaaagtaatgaatttaatga

SEQ ID NO: 145281 - DNA, 25 bp, Artificial sequence
  SiRNA target sequence
attaaaaagtaatgaatttaatgat

SEQ ID NO: 145282 - DNA, 25 bp, Artificial sequence
  SiRNA target sequence
ttaaaaagtaatgaatttaatgatt

SEQ ID NO: 145283 - DNA, 25 bp, Artificial sequence
  SiRNA target sequence
taaaaagtaatgaatttaatgattt

SEQ ID NO: 145284 - DNA, 25 bp, Artificial sequence
  SiRNA target sequence
aaaaagtaatgaatttaatgattta

SEQ ID NO: 145285 - DNA, 25 bp, Artificial sequence
  SiRNA target sequence
aaaagtaatgaatttaatgatttac

SEQ ID NO: 145286 - DNA, 25 bp, Artificial sequence
  SiRNA target sequence
aaagtaatgaatttaatgatttacc

SEQ ID NO: 145287 - DNA, 25 bp, Artificial sequence
  SiRNA target sequence
aagtaatgaatttaatgatttacca

SEQ ID NO: 145288 - DNA, 25 bp, Artificial sequence
  SiRNA target sequence
agtaatgaatttaatgatttaccac

SEQ ID NO: 145289 - DNA, 25 bp, Artificial sequence
  SiRNA target sequence
gtaatgaatttaatgatttaccaca

SEQ ID NO: 145290 - DNA, 25 bp, Artificial sequence
  SiRNA target sequence
taatgaatttaatgatttaccacac

SEQ ID NO: 145291 - DNA, 25 bp, Artificial sequence
  SiRNA target sequence
aatgaatttaatgatttaccacaca

SEQ ID NO: 145292 - DNA, 25 bp, Artificial sequence
  SiRNA target sequence
atgaatttaatgatttaccacacaa

SEQ ID NO: 145293 - DNA, 25 bp, Artificial sequence
  SiRNA target sequence
tgaatttaatgatttaccacacaaa

SEQ ID NO: 145294 - DNA, 25 bp, Artificial sequence
  SiRNA target sequence
gaatttaatgatttaccacacaaat

SEQ ID NO: 145295 - DNA, 25 bp, Artificial sequence
  SiRNA target sequence
aatttaatgatttaccacacaaatt

SEQ ID NO: 145296 - DNA, 25 bp, Artificial sequence
  SiRNA target sequence
atttaatgatttaccacacaaattg

SEQ ID NO: 145297 - DNA, 25 bp, Artificial sequence
  SiRNA target sequence
tttaatgatttaccacacaaattgt

SEQ ID NO: 145298 - DNA, 25 bp, Artificial sequence
  SiRNA target sequence
ttaatgatttaccacacaaattgtt

SEQ ID NO: 145299 - DNA, 25 bp, Artificial sequence
  SiRNA target sequence
taatgatttaccacacaaattgtta

SEQ ID NO: 145300 - DNA, 25 bp, Artificial sequence
  SiRNA target sequence
aatgatttaccacacaaattgttat

SEQ ID NO: 145301 - DNA, 25 bp, Artificial sequence
  SiRNA target sequence
atgatttaccacacaaattgttatc

SEQ ID NO: 145302 - DNA, 25 bp, Artificial sequence
  SiRNA target sequence
tgatttaccacacaaattgttatct

SEQ ID NO: 145303 - DNA, 25 bp, Artificial sequence
  SiRNA target sequence
gatttaccacacaaattgttatcta

SEQ ID NO: 145304 - DNA, 25 bp, Artificial sequence
  SiRNA target sequence
atttaccacacaaattgttatctaa

SEQ ID NO: 145305 - DNA, 25 bp, Artificial sequence
  SiRNA target sequence
tttaccacacaaattgttatctaat

SEQ ID NO: 145306 - DNA, 25 bp, Artificial sequence
  SiRNA target sequence
ttaccacacaaattgttatctaata

SEQ ID NO: 145307 - DNA, 25 bp, Artificial sequence
  SiRNA target sequence
taccacacaaattgttatctaatat

SEQ ID NO: 145308 - DNA, 25 bp, Artificial sequence
  SiRNA target sequence
accacacaaattgttatctaatatt

SEQ ID NO: 145309 - DNA, 25 bp, Artificial sequence
  SiRNA target sequence
ccacacaaattgttatctaatatta

SEQ ID NO: 145310 - DNA, 25 bp, Artificial sequence
  SiRNA target sequence
cacacaaattgttatctaatattat

SEQ ID NO: 145311 - DNA, 25 bp, Artificial sequence
  SiRNA target sequence
acacaaattgttatctaatattatt

SEQ ID NO: 145312 - DNA, 25 bp, Artificial sequence
  SiRNA target sequence
cacaaattgttatctaatattattt

SEQ ID NO: 145313 - DNA, 25 bp, Artificial sequence
  SiRNA target sequence
acaaattgttatctaatattatttt

SEQ ID NO: 145314 - DNA, 25 bp, Artificial sequence
  SiRNA target sequence
caaattgttatctaatattatttta

SEQ ID NO: 145315 - DNA, 25 bp, Artificial sequence
  SiRNA target sequence
aaattgttatctaatattattttat

SEQ ID NO: 145316 - DNA, 25 bp, Artificial sequence
  SiRNA target sequence
aattgttatctaatattattttatt

SEQ ID NO: 145317 - DNA, 25 bp, Artificial sequence
  SiRNA target sequence
attgttatctaatattattttatta

SEQ ID NO: 145318 - DNA, 25 bp, Artificial sequence
  SiRNA target sequence
ttgttatctaatattattttattaa

SEQ ID NO: 145319 - DNA, 25 bp, Artificial sequence
  SiRNA target sequence
tgttatctaatattattttattaag

SEQ ID NO: 145320 - DNA, 25 bp, Artificial sequence
  SiRNA target sequence
gttatctaatattattttattaaga

SEQ ID NO: 145321 - DNA, 25 bp, Artificial sequence
  SiRNA target sequence
ttatctaatattattttattaagag

SEQ ID NO: 145322 - DNA, 25 bp, Artificial sequence
  SiRNA target sequence
tatctaatattattttattaagagt

SEQ ID NO: 145323 - DNA, 25 bp, Artificial sequence
  SiRNA target sequence
atctaatattattttattaagagtg

SEQ ID NO: 145324 - DNA, 25 bp, Artificial sequence
  SiRNA target sequence
tctaatattattttattaagagtgt

SEQ ID NO: 145325 - DNA, 25 bp, Artificial sequence
  SiRNA target sequence
ctaatattattttattaagagtgtc

SEQ ID NO: 145326 - DNA, 25 bp, Artificial sequence
  SiRNA target sequence
taatattattttattaagagtgtct

SEQ ID NO: 145327 - DNA, 25 bp, Artificial sequence
  SiRNA target sequence
aatattattttattaagagtgtcta

SEQ ID NO: 145328 - DNA, 25 bp, Artificial sequence
  SiRNA target sequence
atattattttattaagagtgtctac

SEQ ID NO: 145329 - DNA, 25 bp, Artificial sequence
  SiRNA target sequence
tattattttattaagagtgtctaca

SEQ ID NO: 145330 - DNA, 25 bp, Artificial sequence
  SiRNA target sequence
attattttattaagagtgtctacat

SEQ ID NO: 145331 - DNA, 25 bp, Artificial sequence
  SiRNA target sequence
ttattttattaagagtgtctacata

SEQ ID NO: 145332 - DNA, 25 bp, Artificial sequence
  SiRNA target sequence
tattttattaagagtgtctacatac

SEQ ID NO: 145333 - DNA, 25 bp, Artificial sequence
  SiRNA target sequence
attttattaagagtgtctacatacg

SEQ ID NO: 145334 - DNA, 25 bp, Artificial sequence
  SiRNA target sequence
ttttattaagagtgtctacatacgc

SEQ ID NO: 145335 - DNA, 25 bp, Artificial sequence
  SiRNA target sequence
tttattaagagtgtctacatacgct

SEQ ID NO: 145336 - DNA, 25 bp, Artificial sequence
  SiRNA target sequence
ttattaagagtgtctacatacgctt

SEQ ID NO: 145337 - DNA, 25 bp, Artificial sequence
  SiRNA target sequence
tattaagagtgtctacatacgcttg

SEQ ID NO: 145338 - DNA, 25 bp, Artificial sequence
  SiRNA target sequence
attaagagtgtctacatacgcttga

SEQ ID NO: 145339 - DNA, 25 bp, Artificial sequence
  SiRNA target sequence
ttaagagtgtctacatacgcttgat

SEQ ID NO: 145340 - DNA, 25 bp, Artificial sequence
  SiRNA target sequence
taagagtgtctacatacgcttgatg

SEQ ID NO: 145341 - DNA, 25 bp, Artificial sequence
  SiRNA target sequence
aagagtgtctacatacgcttgatgg

SEQ ID NO: 145342 - DNA, 25 bp, Artificial sequence
  SiRNA target sequence
agagtgtctacatacgcttgatggt

SEQ ID NO: 145343 - DNA, 25 bp, Artificial sequence
  SiRNA target sequence
gagtgtctacatacgcttgatggtg

SEQ ID NO: 145344 - DNA, 25 bp, Artificial sequence
  SiRNA target sequence
agtgtctacatacgcttgatggtgc

SEQ ID NO: 145345 - DNA, 25 bp, Artificial sequence
  SiRNA target sequence
gtgtctacatacgcttgatggtgct

SEQ ID NO: 145346 - DNA, 25 bp, Artificial sequence
  SiRNA target sequence
tgtctacatacgcttgatggtgctt

SEQ ID NO: 145347 - DNA, 25 bp, Artificial sequence
  SiRNA target sequence
gtctacatacgcttgatggtgctta

SEQ ID NO: 145348 - DNA, 25 bp, Artificial sequence
  SiRNA target sequence
tctacatacgcttgatggtgcttag

SEQ ID NO: 145349 - DNA, 25 bp, Artificial sequence
  SiRNA target sequence
ctacatacgcttgatggtgcttaga

SEQ ID NO: 145350 - DNA, 25 bp, Artificial sequence
  SiRNA target sequence
tacatacgcttgatggtgcttagag

SEQ ID NO: 145351 - DNA, 25 bp, Artificial sequence
  SiRNA target sequence
acatacgcttgatggtgcttagagt

SEQ ID NO: 145352 - DNA, 25 bp, Artificial sequence
  SiRNA target sequence
catacgcttgatggtgcttagagtg

SEQ ID NO: 145353 - DNA, 25 bp, Artificial sequence
  SiRNA target sequence
atacgcttgatggtgcttagagtgg

SEQ ID NO: 145354 - DNA, 25 bp, Artificial sequence
  SiRNA target sequence
tacgcttgatggtgcttagagtggt

SEQ ID NO: 145355 - DNA, 25 bp, Artificial sequence
  SiRNA target sequence
acgcttgatggtgcttagagtggtg

SEQ ID NO: 145356 - DNA, 25 bp, Artificial sequence
  SiRNA target sequence
cgcttgatggtgcttagagtggtgg

SEQ ID NO: 145357 - DNA, 25 bp, Artificial sequence
  SiRNA target sequence
gcttgatggtgcttagagtggtggg

SEQ ID NO: 145358 - DNA, 25 bp, Artificial sequence
  SiRNA target sequence
cttgatggtgcttagagtggtgggt

SEQ ID NO: 145359 - DNA, 25 bp, Artificial sequence
  SiRNA target sequence
ttgatggtgcttagagtggtgggtc

SEQ ID NO: 145360 - DNA, 25 bp, Artificial sequence
  SiRNA target sequence
tgatggtgcttagagtggtgggtct

SEQ ID NO: 145361 - DNA, 25 bp, Artificial sequence
  SiRNA target sequence
gatggtgcttagagtggtgggtctc

SEQ ID NO: 145362 - DNA, 25 bp, Artificial sequence
  SiRNA target sequence
atggtgcttagagtggtgggtctcc

SEQ ID NO: 145363 - DNA, 25 bp, Artificial sequence
  SiRNA target sequence
tggtgcttagagtggtgggtctcca

SEQ ID NO: 145364 - DNA, 25 bp, Artificial sequence
  SiRNA target sequence
ggtgcttagagtggtgggtctccat

SEQ ID NO: 145365 - DNA, 25 bp, Artificial sequence
  SiRNA target sequence
gtgcttagagtggtgggtctccatt

SEQ ID NO: 145366 - DNA, 25 bp, Artificial sequence
  SiRNA target sequence
tgcttagagtggtgggtctccatta

SEQ ID NO: 145367 - DNA, 25 bp, Artificial sequence
  SiRNA target sequence
gcttagagtggtgggtctccattat

SEQ ID NO: 145368 - DNA, 25 bp, Artificial sequence
  SiRNA target sequence
cttagagtggtgggtctccattata

SEQ ID NO: 145369 - DNA, 25 bp, Artificial sequence
  SiRNA target sequence
ttagagtggtgggtctccattatat

SEQ ID NO: 145370 - DNA, 25 bp, Artificial sequence
  SiRNA target sequence
tagagtggtgggtctccattatatc

SEQ ID NO: 145371 - DNA, 25 bp, Artificial sequence
  SiRNA target sequence
agagtggtgggtctccattatatct

SEQ ID NO: 145372 - DNA, 25 bp, Artificial sequence
  SiRNA target sequence
gagtggtgggtctccattatatctt

SEQ ID NO: 145373 - DNA, 25 bp, Artificial sequence
  SiRNA target sequence
agtggtgggtctccattatatcttc

SEQ ID NO: 145374 - DNA, 25 bp, Artificial sequence
  SiRNA target sequence
gtggtgggtctccattatatcttca

SEQ ID NO: 145375 - DNA, 25 bp, Artificial sequence
  SiRNA target sequence
tggtgggtctccattatatcttcac

SEQ ID NO: 145376 - DNA, 25 bp, Artificial sequence
  SiRNA target sequence
ggtgggtctccattatatcttcact

SEQ ID NO: 145377 - DNA, 25 bp, Artificial sequence
  SiRNA target sequence
gtgggtctccattatatcttcactt

SEQ ID NO: 145378 - DNA, 25 bp, Artificial sequence
  SiRNA target sequence
tgggtctccattatatcttcactta

SEQ ID NO: 145379 - DNA, 25 bp, Artificial sequence
  SiRNA target sequence
gggtctccattatatcttcacttat

SEQ ID NO: 145380 - DNA, 25 bp, Artificial sequence
  SiRNA target sequence
ggtctccattatatcttcacttata

SEQ ID NO: 145381 - DNA, 25 bp, Artificial sequence
  SiRNA target sequence
gtctccattatatcttcacttatat

SEQ ID NO: 145382 - DNA, 25 bp, Artificial sequence
  SiRNA target sequence
tctccattatatcttcacttatata

SEQ ID NO: 145383 - DNA, 25 bp, Artificial sequence
  SiRNA target sequence
ctccattatatcttcacttatataa

SEQ ID NO: 145384 - DNA, 25 bp, Artificial sequence
  SiRNA target sequence
tccattatatcttcacttatataag

SEQ ID NO: 145385 - DNA, 25 bp, Artificial sequence
  SiRNA target sequence
ccattatatcttcacttatataagg

SEQ ID NO: 145386 - DNA, 25 bp, Artificial sequence
  SiRNA target sequence
cattatatcttcacttatataaggc

SEQ ID NO: 145387 - DNA, 25 bp, Artificial sequence
  SiRNA target sequence
attatatcttcacttatataaggct

SEQ ID NO: 145388 - DNA, 25 bp, Artificial sequence
  SiRNA target sequence
ttatatcttcacttatataaggctc

SEQ ID NO: 145389 - DNA, 25 bp, Artificial sequence
  SiRNA target sequence
tatatcttcacttatataaggctct

SEQ ID NO: 145390 - DNA, 25 bp, Artificial sequence
  SiRNA target sequence
atatcttcacttatataaggctcta

SEQ ID NO: 145391 - DNA, 25 bp, Artificial sequence
  SiRNA target sequence
tatcttcacttatataaggctctag

SEQ ID NO: 145392 - DNA, 25 bp, Artificial sequence
  SiRNA target sequence
atcttcacttatataaggctctaga

SEQ ID NO: 145393 - DNA, 25 bp, Artificial sequence
  SiRNA target sequence
tcttcacttatataaggctctagag

SEQ ID NO: 145394 - DNA, 25 bp, Artificial sequence
  SiRNA target sequence
cttcacttatataaggctctagaga

SEQ ID NO: 145395 - DNA, 25 bp, Artificial sequence
  SiRNA target sequence
ttcacttatataaggctctagagat

SEQ ID NO: 145396 - DNA, 25 bp, Artificial sequence
  SiRNA target sequence
tcacttatataaggctctagagatt

SEQ ID NO: 145397 - DNA, 25 bp, Artificial sequence
  SiRNA target sequence
cacttatataaggctctagagattt

SEQ ID NO: 145398 - DNA, 25 bp, Artificial sequence
  SiRNA target sequence
acttatataaggctctagagattta

SEQ ID NO: 145399 - DNA, 25 bp, Artificial sequence
  SiRNA target sequence
cttatataaggctctagagatttat

SEQ ID NO: 145400 - DNA, 25 bp, Artificial sequence
  SiRNA target sequence
ttatataaggctctagagatttata

SEQ ID NO: 145401 - DNA, 25 bp, Artificial sequence
  SiRNA target sequence
tatataaggctctagagatttataa

SEQ ID NO: 145402 - DNA, 25 bp, Artificial sequence
  SiRNA target sequence
atataaggctctagagatttataac

SEQ ID NO: 145403 - DNA, 25 bp, Artificial sequence
  SiRNA target sequence
tataaggctctagagatttataact

SEQ ID NO: 145404 - DNA, 25 bp, Artificial sequence
  SiRNA target sequence
ataaggctctagagatttataacta

SEQ ID NO: 145405 - DNA, 25 bp, Artificial sequence
  SiRNA target sequence
taaggctctagagatttataactat

SEQ ID NO: 145406 - DNA, 25 bp, Artificial sequence
  SiRNA target sequence
aaggctctagagatttataactata

SEQ ID NO: 145407 - DNA, 25 bp, Artificial sequence
  SiRNA target sequence
aggctctagagatttataactatat

SEQ ID NO: 145408 - DNA, 25 bp, Artificial sequence
  SiRNA target sequence
ggctctagagatttataactatatt

SEQ ID NO: 145409 - DNA, 25 bp, Artificial sequence
  SiRNA target sequence
gctctagagatttataactatattt

SEQ ID NO: 145410 - DNA, 25 bp, Artificial sequence
  SiRNA target sequence
ctctagagatttataactatatttc

SEQ ID NO: 145411 - DNA, 25 bp, Artificial sequence
  SiRNA target sequence
tctagagatttataactatatttca

SEQ ID NO: 145412 - DNA, 25 bp, Artificial sequence
  SiRNA target sequence
ctagagatttataactatatttcag

SEQ ID NO: 145413 - DNA, 25 bp, Artificial sequence
  SiRNA target sequence
tagagatttataactatatttcaga

SEQ ID NO: 145414 - DNA, 25 bp, Artificial sequence
  SiRNA target sequence
agagatttataactatatttcagat

SEQ ID NO: 145415 - DNA, 25 bp, Artificial sequence
  SiRNA target sequence
gagatttataactatatttcagatt

SEQ ID NO: 145416 - DNA, 25 bp, Artificial sequence
  SiRNA target sequence
agatttataactatatttcagattt

SEQ ID NO: 145417 - DNA, 25 bp, Artificial sequence
  SiRNA target sequence
gatttataactatatttcagatttg

SEQ ID NO: 145418 - DNA, 25 bp, Artificial sequence
  SiRNA target sequence
atttataactatatttcagatttgg

SEQ ID NO: 145419 - DNA, 25 bp, Artificial sequence
  SiRNA target sequence
tttataactatatttcagatttgga

SEQ ID NO: 145420 - DNA, 25 bp, Artificial sequence
  SiRNA target sequence
ttataactatatttcagatttggaa

SEQ ID NO: 145421 - DNA, 25 bp, Artificial sequence
  SiRNA target sequence
tataactatatttcagatttggaag

SEQ ID NO: 145422 - DNA, 25 bp, Artificial sequence
  SiRNA target sequence
ataactatatttcagatttggaaga

SEQ ID NO: 145423 - DNA, 25 bp, Artificial sequence
  SiRNA target sequence
taactatatttcagatttggaagag

SEQ ID NO: 145424 - DNA, 25 bp, Artificial sequence
  SiRNA target sequence
aactatatttcagatttggaagagt

SEQ ID NO: 145425 - DNA, 25 bp, Artificial sequence
  SiRNA target sequence
actatatttcagatttggaagagtg

SEQ ID NO: 145426 - DNA, 25 bp, Artificial sequence
  SiRNA target sequence
ctatatttcagatttggaagagtga

SEQ ID NO: 145427 - DNA, 25 bp, Artificial sequence
  SiRNA target sequence
tatatttcagatttggaagagtgaa

SEQ ID NO: 145428 - DNA, 25 bp, Artificial sequence
  SiRNA target sequence
atatttcagatttggaagagtgaac

SEQ ID NO: 145429 - DNA, 25 bp, Artificial sequence
  SiRNA target sequence
tatttcagatttggaagagtgaaca

SEQ ID NO: 145430 - DNA, 25 bp, Artificial sequence
  SiRNA target sequence
atttcagatttggaagagtgaacat

SEQ ID NO: 145431 - DNA, 26 bp, Artificial sequence
  SiRNA target sequence
ttaatttatgcataattgaccatcat

SEQ ID NO: 145432 - DNA, 26 bp, Artificial sequence
  SiRNA target sequence
taatttatgcataattgaccatcatc

SEQ ID NO: 145433 - DNA, 26 bp, Artificial sequence
  SiRNA target sequence
aatttatgcataattgaccatcatca

SEQ ID NO: 145434 - DNA, 26 bp, Artificial sequence
  SiRNA target sequence
atttatgcataattgaccatcatcag

SEQ ID NO: 145435 - DNA, 26 bp, Artificial sequence
  SiRNA target sequence
tttatgcataattgaccatcatcagt

SEQ ID NO: 145436 - DNA, 26 bp, Artificial sequence
  SiRNA target sequence
ttatgcataattgaccatcatcagta

SEQ ID NO: 145437 - DNA, 26 bp, Artificial sequence
  SiRNA target sequence
tatgcataattgaccatcatcagtaa

SEQ ID NO: 145438 - DNA, 26 bp, Artificial sequence
  SiRNA target sequence
atgcataattgaccatcatcagtaat

SEQ ID NO: 145439 - DNA, 26 bp, Artificial sequence
  SiRNA target sequence
tgcataattgaccatcatcagtaata

SEQ ID NO: 145440 - DNA, 26 bp, Artificial sequence
  SiRNA target sequence
gcataattgaccatcatcagtaataa

SEQ ID NO: 145441 - DNA, 26 bp, Artificial sequence
  SiRNA target sequence
cataattgaccatcatcagtaataaa

SEQ ID NO: 145442 - DNA, 26 bp, Artificial sequence
  SiRNA target sequence
ataattgaccatcatcagtaataaac

SEQ ID NO: 145443 - DNA, 26 bp, Artificial sequence
  SiRNA target sequence
taattgaccatcatcagtaataaaca

SEQ ID NO: 145444 - DNA, 26 bp, Artificial sequence
  SiRNA target sequence
aattgaccatcatcagtaataaacac

SEQ ID NO: 145445 - DNA, 26 bp, Artificial sequence
  SiRNA target sequence
attgaccatcatcagtaataaacaca

SEQ ID NO: 145446 - DNA, 26 bp, Artificial sequence
  SiRNA target sequence
ttgaccatcatcagtaataaacacat

SEQ ID NO: 145447 - DNA, 26 bp, Artificial sequence
  SiRNA target sequence
tgaccatcatcagtaataaacacatt

SEQ ID NO: 145448 - DNA, 26 bp, Artificial sequence
  SiRNA target sequence
gaccatcatcagtaataaacacatta

SEQ ID NO: 145449 - DNA, 26 bp, Artificial sequence
  SiRNA target sequence
accatcatcagtaataaacacattac

SEQ ID NO: 145450 - DNA, 26 bp, Artificial sequence
  SiRNA target sequence
ccatcatcagtaataaacacattacc

SEQ ID NO: 145451 - DNA, 26 bp, Artificial sequence
  SiRNA target sequence
catcatcagtaataaacacattacct

SEQ ID NO: 145452 - DNA, 26 bp, Artificial sequence
  SiRNA target sequence
atcatcagtaataaacacattacctt

SEQ ID NO: 145453 - DNA, 26 bp, Artificial sequence
  SiRNA target sequence
tcatcagtaataaacacattaccttt

SEQ ID NO: 145454 - DNA, 26 bp, Artificial sequence
  SiRNA target sequence
catcagtaataaacacattacctttc

SEQ ID NO: 145455 - DNA, 26 bp, Artificial sequence
  SiRNA target sequence
atcagtaataaacacattacctttct

SEQ ID NO: 145456 - DNA, 26 bp, Artificial sequence
  SiRNA target sequence
tcagtaataaacacattacctttctt

SEQ ID NO: 145457 - DNA, 26 bp, Artificial sequence
  SiRNA target sequence
cagtaataaacacattacctttcttt

SEQ ID NO: 145458 - DNA, 26 bp, Artificial sequence
  SiRNA target sequence
agtaataaacacattacctttctttt

SEQ ID NO: 145459 - DNA, 26 bp, Artificial sequence
  SiRNA target sequence
gtaataaacacattacctttcttttc

SEQ ID NO: 145460 - DNA, 26 bp, Artificial sequence
  SiRNA target sequence
taataaacacattacctttcttttct

SEQ ID NO: 145461 - DNA, 26 bp, Artificial sequence
  SiRNA target sequence
aataaacacattacctttcttttcta

SEQ ID NO: 145462 - DNA, 26 bp, Artificial sequence
  SiRNA target sequence
ataaacacattacctttcttttctac

SEQ ID NO: 145463 - DNA, 26 bp, Artificial sequence
  SiRNA target sequence
taaacacattacctttcttttctacc

SEQ ID NO: 145464 - DNA, 26 bp, Artificial sequence
  SiRNA target sequence
aaacacattacctttcttttctacca

SEQ ID NO: 145465 - DNA, 26 bp, Artificial sequence
  SiRNA target sequence
aacacattacctttcttttctaccac

SEQ ID NO: 145466 - DNA, 26 bp, Artificial sequence
  SiRNA target sequence
acacattacctttcttttctaccaca

SEQ ID NO: 145467 - DNA, 26 bp, Artificial sequence
  SiRNA target sequence
cacattacctttcttttctaccacac

SEQ ID NO: 145468 - DNA, 26 bp, Artificial sequence
  SiRNA target sequence
acattacctttcttttctaccacaca

SEQ ID NO: 145469 - DNA, 26 bp, Artificial sequence
  SiRNA target sequence
cattacctttcttttctaccacacat

SEQ ID NO: 145470 - DNA, 26 bp, Artificial sequence
  SiRNA target sequence
attacctttcttttctaccacacatt

SEQ ID NO: 145471 - DNA, 26 bp, Artificial sequence
  SiRNA target sequence
ttacctttcttttctaccacacattt

SEQ ID NO: 145472 - DNA, 26 bp, Artificial sequence
  SiRNA target sequence
tacctttcttttctaccacacatttt

SEQ ID NO: 145473 - DNA, 26 bp, Artificial sequence
  SiRNA target sequence
acctttcttttctaccacacattttt

SEQ ID NO: 145474 - DNA, 26 bp, Artificial sequence
  SiRNA target sequence
cctttcttttctaccacacatttttg

SEQ ID NO: 145475 - DNA, 26 bp, Artificial sequence
  SiRNA target sequence
ctttcttttctaccacacatttttga

SEQ ID NO: 145476 - DNA, 26 bp, Artificial sequence
  SiRNA target sequence
tttcttttctaccacacatttttgat

SEQ ID NO: 145477 - DNA, 26 bp, Artificial sequence
  SiRNA target sequence
ttcttttctaccacacatttttgata

SEQ ID NO: 145478 - DNA, 26 bp, Artificial sequence
  SiRNA target sequence
tcttttctaccacacatttttgatat

SEQ ID NO: 145479 - DNA, 26 bp, Artificial sequence
  SiRNA target sequence
cttttctaccacacatttttgatata

SEQ ID NO: 145480 - DNA, 26 bp, Artificial sequence
  SiRNA target sequence
ttttctaccacacatttttgatatat

SEQ ID NO: 145481 - DNA, 26 bp, Artificial sequence
  SiRNA target sequence
tttctaccacacatttttgatatatt

SEQ ID NO: 145482 - DNA, 26 bp, Artificial sequence
  SiRNA target sequence
ttctaccacacatttttgatatattt

SEQ ID NO: 145483 - DNA, 26 bp, Artificial sequence
  SiRNA target sequence
tctaccacacatttttgatatatttc

SEQ ID NO: 145484 - DNA, 26 bp, Artificial sequence
  SiRNA target sequence
ctaccacacatttttgatatatttca

SEQ ID NO: 145485 - DNA, 26 bp, Artificial sequence
  SiRNA target sequence
taccacacatttttgatatatttcat

SEQ ID NO: 145486 - DNA, 26 bp, Artificial sequence
  SiRNA target sequence
accacacatttttgatatatttcatt

SEQ ID NO: 145487 - DNA, 26 bp, Artificial sequence
  SiRNA target sequence
ccacacatttttgatatatttcatta

SEQ ID NO: 145488 - DNA, 26 bp, Artificial sequence
  SiRNA target sequence
cacacatttttgatatatttcattaa

SEQ ID NO: 145489 - DNA, 26 bp, Artificial sequence
  SiRNA target sequence
acacatttttgatatatttcattaac

SEQ ID NO: 145490 - DNA, 26 bp, Artificial sequence
  SiRNA target sequence
cacatttttgatatatttcattaact

SEQ ID NO: 145491 - DNA, 26 bp, Artificial sequence
  SiRNA target sequence
acatttttgatatatttcattaacta

SEQ ID NO: 145492 - DNA, 26 bp, Artificial sequence
  SiRNA target sequence
catttttgatatatttcattaactac

SEQ ID NO: 145493 - DNA, 26 bp, Artificial sequence
  SiRNA target sequence
atttttgatatatttcattaactaca

SEQ ID NO: 145494 - DNA, 26 bp, Artificial sequence
  SiRNA target sequence
tttttgatatatttcattaactacat

SEQ ID NO: 145495 - DNA, 26 bp, Artificial sequence
  SiRNA target sequence
ttttgatatatttcattaactacatc

SEQ ID NO: 145496 - DNA, 26 bp, Artificial sequence
  SiRNA target sequence
tttgatatatttcattaactacatcc

SEQ ID NO: 145497 - DNA, 26 bp, Artificial sequence
  SiRNA target sequence
ttgatatatttcattaactacatccc

SEQ ID NO: 145498 - DNA, 26 bp, Artificial sequence
  SiRNA target sequence
tgatatatttcattaactacatccca

SEQ ID NO: 145499 - DNA, 26 bp, Artificial sequence
  SiRNA target sequence
gatatatttcattaactacatcccaa

SEQ ID NO: 145500 - DNA, 26 bp, Artificial sequence
  SiRNA target sequence
atatatttcattaactacatcccaat

SEQ ID NO: 145501 - DNA, 26 bp, Artificial sequence
  SiRNA target sequence
tatatttcattaactacatcccaatc

SEQ ID NO: 145502 - DNA, 26 bp, Artificial sequence
  SiRNA target sequence
atatttcattaactacatcccaatca

SEQ ID NO: 145503 - DNA, 26 bp, Artificial sequence
  SiRNA target sequence
tatttcattaactacatcccaatcaa

SEQ ID NO: 145504 - DNA, 26 bp, Artificial sequence
  SiRNA target sequence
atttcattaactacatcccaatcaat

SEQ ID NO: 145505 - DNA, 26 bp, Artificial sequence
  SiRNA target sequence
tttcattaactacatcccaatcaatt

SEQ ID NO: 145506 - DNA, 26 bp, Artificial sequence
  SiRNA target sequence
ttcattaactacatcccaatcaatta

SEQ ID NO: 145507 - DNA, 26 bp, Artificial sequence
  SiRNA target sequence
tcattaactacatcccaatcaattac

SEQ ID NO: 145508 - DNA, 26 bp, Artificial sequence
  SiRNA target sequence
cattaactacatcccaatcaattaca

SEQ ID NO: 145509 - DNA, 26 bp, Artificial sequence
  SiRNA target sequence
attaactacatcccaatcaattacat

SEQ ID NO: 145510 - DNA, 26 bp, Artificial sequence
  SiRNA target sequence
ttaactacatcccaatcaattacatt

SEQ ID NO: 145511 - DNA, 26 bp, Artificial sequence
  SiRNA target sequence
taactacatcccaatcaattacattc

SEQ ID NO: 145512 - DNA, 26 bp, Artificial sequence
  SiRNA target sequence
aactacatcccaatcaattacattcc

SEQ ID NO: 145513 - DNA, 26 bp, Artificial sequence
  SiRNA target sequence
actacatcccaatcaattacattcca

SEQ ID NO: 145514 - DNA, 26 bp, Artificial sequence
  SiRNA target sequence
ctacatcccaatcaattacattccac

SEQ ID NO: 145515 - DNA, 26 bp, Artificial sequence
  SiRNA target sequence
tacatcccaatcaattacattccacc

SEQ ID NO: 145516 - DNA, 26 bp, Artificial sequence
  SiRNA target sequence
acatcccaatcaattacattccacca

SEQ ID NO: 145517 - DNA, 26 bp, Artificial sequence
  SiRNA target sequence
catcccaatcaattacattccaccat

SEQ ID NO: 145518 - DNA, 26 bp, Artificial sequence
  SiRNA target sequence
atcccaatcaattacattccaccatt

SEQ ID NO: 145519 - DNA, 26 bp, Artificial sequence
  SiRNA target sequence
tcccaatcaattacattccaccattc

SEQ ID NO: 145520 - DNA, 26 bp, Artificial sequence
  SiRNA target sequence
cccaatcaattacattccaccattca

SEQ ID NO: 145521 - DNA, 26 bp, Artificial sequence
  SiRNA target sequence
ccaatcaattacattccaccattcat

SEQ ID NO: 145522 - DNA, 26 bp, Artificial sequence
  SiRNA target sequence
caatcaattacattccaccattcatt

SEQ ID NO: 145523 - DNA, 26 bp, Artificial sequence
  SiRNA target sequence
aatcaattacattccaccattcatta

SEQ ID NO: 145524 - DNA, 26 bp, Artificial sequence
  SiRNA target sequence
atcaattacattccaccattcattaa

SEQ ID NO: 145525 - DNA, 26 bp, Artificial sequence
  SiRNA target sequence
tcaattacattccaccattcattaat

SEQ ID NO: 145526 - DNA, 26 bp, Artificial sequence
  SiRNA target sequence
caattacattccaccattcattaatg

SEQ ID NO: 145527 - DNA, 26 bp, Artificial sequence
  SiRNA target sequence
aattacattccaccattcattaatgt

SEQ ID NO: 145528 - DNA, 26 bp, Artificial sequence
  SiRNA target sequence
attacattccaccattcattaatgta

SEQ ID NO: 145529 - DNA, 26 bp, Artificial sequence
  SiRNA target sequence
ttacattccaccattcattaatgtat

SEQ ID NO: 145530 - DNA, 26 bp, Artificial sequence
  SiRNA target sequence
tacattccaccattcattaatgtatt

SEQ ID NO: 145531 - DNA, 26 bp, Artificial sequence
  SiRNA target sequence
acattccaccattcattaatgtattc

SEQ ID NO: 145532 - DNA, 26 bp, Artificial sequence
  SiRNA target sequence
cattccaccattcattaatgtattct

SEQ ID NO: 145533 - DNA, 26 bp, Artificial sequence
  SiRNA target sequence
attccaccattcattaatgtattctt

SEQ ID NO: 145534 - DNA, 26 bp, Artificial sequence
  SiRNA target sequence
ttccaccattcattaatgtattcttt

SEQ ID NO: 145535 - DNA, 26 bp, Artificial sequence
  SiRNA target sequence
tccaccattcattaatgtattctttt

SEQ ID NO: 145536 - DNA, 26 bp, Artificial sequence
  SiRNA target sequence
ccaccattcattaatgtattcttttc

SEQ ID NO: 145537 - DNA, 26 bp, Artificial sequence
  SiRNA target sequence
caccattcattaatgtattcttttct

SEQ ID NO: 145538 - DNA, 26 bp, Artificial sequence
  SiRNA target sequence
accattcattaatgtattcttttctc

SEQ ID NO: 145539 - DNA, 26 bp, Artificial sequence
  SiRNA target sequence
ccattcattaatgtattcttttctcc

SEQ ID NO: 145540 - DNA, 26 bp, Artificial sequence
  SiRNA target sequence
cattcattaatgtattcttttctcct

SEQ ID NO: 145541 - DNA, 26 bp, Artificial sequence
  SiRNA target sequence
attcattaatgtattcttttctccta

SEQ ID NO: 145542 - DNA, 26 bp, Artificial sequence
  SiRNA target sequence
ttcattaatgtattcttttctcctat

SEQ ID NO: 145543 - DNA, 26 bp, Artificial sequence
  SiRNA target sequence
tcattaatgtattcttttctcctatt

SEQ ID NO: 145544 - DNA, 26 bp, Artificial sequence
  SiRNA target sequence
cattaatgtattcttttctcctattt

SEQ ID NO: 145545 - DNA, 26 bp, Artificial sequence
  SiRNA target sequence
attaatgtattcttttctcctatttt

SEQ ID NO: 145546 - DNA, 26 bp, Artificial sequence
  SiRNA target sequence
ttaatgtattcttttctcctattttt

SEQ ID NO: 145547 - DNA, 26 bp, Artificial sequence
  SiRNA target sequence
taatgtattcttttctcctattttta

SEQ ID NO: 145548 - DNA, 26 bp, Artificial sequence
  SiRNA target sequence
aatgtattcttttctcctatttttat

SEQ ID NO: 145549 - DNA, 26 bp, Artificial sequence
  SiRNA target sequence
atgtattcttttctcctatttttata

SEQ ID NO: 145550 - DNA, 26 bp, Artificial sequence
  SiRNA target sequence
tgtattcttttctcctatttttatac

SEQ ID NO: 145551 - DNA, 26 bp, Artificial sequence
  SiRNA target sequence
gtattcttttctcctatttttatact

SEQ ID NO: 145552 - DNA, 26 bp, Artificial sequence
  SiRNA target sequence
tattcttttctcctatttttatactg

SEQ ID NO: 145553 - DNA, 26 bp, Artificial sequence
  SiRNA target sequence
attcttttctcctatttttatactgt

SEQ ID NO: 145554 - DNA, 26 bp, Artificial sequence
  SiRNA target sequence
ttcttttctcctatttttatactgta

SEQ ID NO: 145555 - DNA, 26 bp, Artificial sequence
  SiRNA target sequence
tcttttctcctatttttatactgtaa

SEQ ID NO: 145556 - DNA, 26 bp, Artificial sequence
  SiRNA target sequence
cttttctcctatttttatactgtaaa

SEQ ID NO: 145557 - DNA, 26 bp, Artificial sequence
  SiRNA target sequence
ttttctcctatttttatactgtaaat

SEQ ID NO: 145558 - DNA, 26 bp, Artificial sequence
  SiRNA target sequence
tttctcctatttttatactgtaaata

SEQ ID NO: 145559 - DNA, 26 bp, Artificial sequence
  SiRNA target sequence
ttctcctatttttatactgtaaataa

SEQ ID NO: 145560 - DNA, 26 bp, Artificial sequence
  SiRNA target sequence
tctcctatttttatactgtaaataat

SEQ ID NO: 145561 - DNA, 26 bp, Artificial sequence
  SiRNA target sequence
ctcctatttttatactgtaaataata

SEQ ID NO: 145562 - DNA, 26 bp, Artificial sequence
  SiRNA target sequence
tcctatttttatactgtaaataatac

SEQ ID NO: 145563 - DNA, 26 bp, Artificial sequence
  SiRNA target sequence
cctatttttatactgtaaataatacg

SEQ ID NO: 145564 - DNA, 26 bp, Artificial sequence
  SiRNA target sequence
ctatttttatactgtaaataatacgc

SEQ ID NO: 145565 - DNA, 26 bp, Artificial sequence
  SiRNA target sequence
tatttttatactgtaaataatacgca

SEQ ID NO: 145566 - DNA, 26 bp, Artificial sequence
  SiRNA target sequence
atttttatactgtaaataatacgcat

SEQ ID NO: 145567 - DNA, 26 bp, Artificial sequence
  SiRNA target sequence
tttttatactgtaaataatacgcatg

SEQ ID NO: 145568 - DNA, 26 bp, Artificial sequence
  SiRNA target sequence
ttttatactgtaaataatacgcatgt

SEQ ID NO: 145569 - DNA, 26 bp, Artificial sequence
  SiRNA target sequence
tttatactgtaaataatacgcatgtt

SEQ ID NO: 145570 - DNA, 26 bp, Artificial sequence
  SiRNA target sequence
ttatactgtaaataatacgcatgttc

SEQ ID NO: 145571 - DNA, 26 bp, Artificial sequence
  SiRNA target sequence
tatactgtaaataatacgcatgttcc

SEQ ID NO: 145572 - DNA, 26 bp, Artificial sequence
  SiRNA target sequence
atactgtaaataatacgcatgttccc

SEQ ID NO: 145573 - DNA, 26 bp, Artificial sequence
  SiRNA target sequence
tactgtaaataatacgcatgttccca

SEQ ID NO: 145574 - DNA, 26 bp, Artificial sequence
  SiRNA target sequence
actgtaaataatacgcatgttcccat

SEQ ID NO: 145575 - DNA, 26 bp, Artificial sequence
  SiRNA target sequence
ctgtaaataatacgcatgttcccata

SEQ ID NO: 145576 - DNA, 26 bp, Artificial sequence
  SiRNA target sequence
tgtaaataatacgcatgttcccatac

SEQ ID NO: 145577 - DNA, 26 bp, Artificial sequence
  SiRNA target sequence
gtaaataatacgcatgttcccataca

SEQ ID NO: 145578 - DNA, 26 bp, Artificial sequence
  SiRNA target sequence
taaataatacgcatgttcccatacat

SEQ ID NO: 145579 - DNA, 26 bp, Artificial sequence
  SiRNA target sequence
aaataatacgcatgttcccatacatc

SEQ ID NO: 145580 - DNA, 26 bp, Artificial sequence
  SiRNA target sequence
aataatacgcatgttcccatacatca

SEQ ID NO: 145581 - DNA, 26 bp, Artificial sequence
  SiRNA target sequence
ataatacgcatgttcccatacatcaa

SEQ ID NO: 145582 - DNA, 26 bp, Artificial sequence
  SiRNA target sequence
taatacgcatgttcccatacatcaag

SEQ ID NO: 145583 - DNA, 26 bp, Artificial sequence
  SiRNA target sequence
aatacgcatgttcccatacatcaaga

SEQ ID NO: 145584 - DNA, 26 bp, Artificial sequence
  SiRNA target sequence
atacgcatgttcccatacatcaagac

SEQ ID NO: 145585 - DNA, 26 bp, Artificial sequence
  SiRNA target sequence
tacgcatgttcccatacatcaagaca

SEQ ID NO: 145586 - DNA, 26 bp, Artificial sequence
  SiRNA target sequence
acgcatgttcccatacatcaagacat

SEQ ID NO: 145587 - DNA, 26 bp, Artificial sequence
  SiRNA target sequence
cgcatgttcccatacatcaagacata

SEQ ID NO: 145588 - DNA, 26 bp, Artificial sequence
  SiRNA target sequence
gcatgttcccatacatcaagacatag

SEQ ID NO: 145589 - DNA, 26 bp, Artificial sequence
  SiRNA target sequence
catgttcccatacatcaagacatagt

SEQ ID NO: 145590 - DNA, 26 bp, Artificial sequence
  SiRNA target sequence
atgttcccatacatcaagacatagta

SEQ ID NO: 145591 - DNA, 26 bp, Artificial sequence
  SiRNA target sequence
tgttcccatacatcaagacatagtaa

SEQ ID NO: 145592 - DNA, 26 bp, Artificial sequence
  SiRNA target sequence
gttcccatacatcaagacatagtaaa

SEQ ID NO: 145593 - DNA, 26 bp, Artificial sequence
  SiRNA target sequence
ttcccatacatcaagacatagtaaag

SEQ ID NO: 145594 - DNA, 26 bp, Artificial sequence
  SiRNA target sequence
tcccatacatcaagacatagtaaagg

SEQ ID NO: 145595 - DNA, 26 bp, Artificial sequence
  SiRNA target sequence
cccatacatcaagacatagtaaagga

SEQ ID NO: 145596 - DNA, 26 bp, Artificial sequence
  SiRNA target sequence
ccatacatcaagacatagtaaaggaa

SEQ ID NO: 145597 - DNA, 26 bp, Artificial sequence
  SiRNA target sequence
catacatcaagacatagtaaaggaat

SEQ ID NO: 145598 - DNA, 26 bp, Artificial sequence
  SiRNA target sequence
atacatcaagacatagtaaaggaata

SEQ ID NO: 145599 - DNA, 26 bp, Artificial sequence
  SiRNA target sequence
tacatcaagacatagtaaaggaatac

SEQ ID NO: 145600 - DNA, 26 bp, Artificial sequence
  SiRNA target sequence
acatcaagacatagtaaaggaataca

SEQ ID NO: 145601 - DNA, 26 bp, Artificial sequence
  SiRNA target sequence
catcaagacatagtaaaggaatacat

SEQ ID NO: 145602 - DNA, 26 bp, Artificial sequence
  SiRNA target sequence
atcaagacatagtaaaggaatacatt

SEQ ID NO: 145603 - DNA, 26 bp, Artificial sequence
  SiRNA target sequence
tcaagacatagtaaaggaatacattc

SEQ ID NO: 145604 - DNA, 26 bp, Artificial sequence
  SiRNA target sequence
caagacatagtaaaggaatacattca

SEQ ID NO: 145605 - DNA, 26 bp, Artificial sequence
  SiRNA target sequence
aagacatagtaaaggaatacattcac

SEQ ID NO: 145606 - DNA, 26 bp, Artificial sequence
  SiRNA target sequence
agacatagtaaaggaatacattcacc

SEQ ID NO: 145607 - DNA, 26 bp, Artificial sequence
  SiRNA target sequence
gacatagtaaaggaatacattcacca

SEQ ID NO: 145608 - DNA, 26 bp, Artificial sequence
  SiRNA target sequence
acatagtaaaggaatacattcaccat

SEQ ID NO: 145609 - DNA, 26 bp, Artificial sequence
  SiRNA target sequence
catagtaaaggaatacattcaccatc

SEQ ID NO: 145610 - DNA, 26 bp, Artificial sequence
  SiRNA target sequence
atagtaaaggaatacattcaccatcc

SEQ ID NO: 145611 - DNA, 26 bp, Artificial sequence
  SiRNA target sequence
tagtaaaggaatacattcaccatcct

SEQ ID NO: 145612 - DNA, 26 bp, Artificial sequence
  SiRNA target sequence
agtaaaggaatacattcaccatcctc

SEQ ID NO: 145613 - DNA, 26 bp, Artificial sequence
  SiRNA target sequence
gtaaaggaatacattcaccatcctcc

SEQ ID NO: 145614 - DNA, 26 bp, Artificial sequence
  SiRNA target sequence
taaaggaatacattcaccatcctcca

SEQ ID NO: 145615 - DNA, 26 bp, Artificial sequence
  SiRNA target sequence
aaaggaatacattcaccatcctccat

SEQ ID NO: 145616 - DNA, 26 bp, Artificial sequence
  SiRNA target sequence
aaggaatacattcaccatcctccatc

SEQ ID NO: 145617 - DNA, 26 bp, Artificial sequence
  SiRNA target sequence
aggaatacattcaccatcctccatca

SEQ ID NO: 145618 - DNA, 26 bp, Artificial sequence
  SiRNA target sequence
ggaatacattcaccatcctccatcat

SEQ ID NO: 145619 - DNA, 26 bp, Artificial sequence
  SiRNA target sequence
gaatacattcaccatcctccatcata

SEQ ID NO: 145620 - DNA, 26 bp, Artificial sequence
  SiRNA target sequence
aatacattcaccatcctccatcatag

SEQ ID NO: 145621 - DNA, 26 bp, Artificial sequence
  SiRNA target sequence
atacattcaccatcctccatcatagg

SEQ ID NO: 145622 - DNA, 26 bp, Artificial sequence
  SiRNA target sequence
tacattcaccatcctccatcatagga

SEQ ID NO: 145623 - DNA, 26 bp, Artificial sequence
  SiRNA target sequence
acattcaccatcctccatcataggat

SEQ ID NO: 145624 - DNA, 26 bp, Artificial sequence
  SiRNA target sequence
cattcaccatcctccatcataggatt

SEQ ID NO: 145625 - DNA, 26 bp, Artificial sequence
  SiRNA target sequence
attcaccatcctccatcataggattg

SEQ ID NO: 145626 - DNA, 26 bp, Artificial sequence
  SiRNA target sequence
ttcaccatcctccatcataggattgt

SEQ ID NO: 145627 - DNA, 26 bp, Artificial sequence
  SiRNA target sequence
tcaccatcctccatcataggattgtc

SEQ ID NO: 145628 - DNA, 26 bp, Artificial sequence
  SiRNA target sequence
caccatcctccatcataggattgtct

SEQ ID NO: 145629 - DNA, 26 bp, Artificial sequence
  SiRNA target sequence
accatcctccatcataggattgtctt

SEQ ID NO: 145630 - DNA, 26 bp, Artificial sequence
  SiRNA target sequence
ccatcctccatcataggattgtcttg

SEQ ID NO: 145631 - DNA, 26 bp, Artificial sequence
  SiRNA target sequence
catcctccatcataggattgtcttga

SEQ ID NO: 145632 - DNA, 26 bp, Artificial sequence
  SiRNA target sequence
atcctccatcataggattgtcttgat

SEQ ID NO: 145633 - DNA, 26 bp, Artificial sequence
  SiRNA target sequence
tcctccatcataggattgtcttgatt

SEQ ID NO: 145634 - DNA, 26 bp, Artificial sequence
  SiRNA target sequence
cctccatcataggattgtcttgatta

SEQ ID NO: 145635 - DNA, 26 bp, Artificial sequence
  SiRNA target sequence
ctccatcataggattgtcttgattaa

SEQ ID NO: 145636 - DNA, 26 bp, Artificial sequence
  SiRNA target sequence
tccatcataggattgtcttgattaac

SEQ ID NO: 145637 - DNA, 26 bp, Artificial sequence
  SiRNA target sequence
ccatcataggattgtcttgattaaca

SEQ ID NO: 145638 - DNA, 26 bp, Artificial sequence
  SiRNA target sequence
catcataggattgtcttgattaacac

SEQ ID NO: 145639 - DNA, 26 bp, Artificial sequence
  SiRNA target sequence
atcataggattgtcttgattaacact

SEQ ID NO: 145640 - DNA, 26 bp, Artificial sequence
  SiRNA target sequence
tcataggattgtcttgattaacactg

SEQ ID NO: 145641 - DNA, 26 bp, Artificial sequence
  SiRNA target sequence
cataggattgtcttgattaacactgg

SEQ ID NO: 145642 - DNA, 26 bp, Artificial sequence
  SiRNA target sequence
ataggattgtcttgattaacactggt

SEQ ID NO: 145643 - DNA, 26 bp, Artificial sequence
  SiRNA target sequence
taggattgtcttgattaacactggtc

SEQ ID NO: 145644 - DNA, 26 bp, Artificial sequence
  SiRNA target sequence
aggattgtcttgattaacactggtct

SEQ ID NO: 145645 - DNA, 26 bp, Artificial sequence
  SiRNA target sequence
ggattgtcttgattaacactggtctt

SEQ ID NO: 145646 - DNA, 26 bp, Artificial sequence
  SiRNA target sequence
gattgtcttgattaacactggtctta

SEQ ID NO: 145647 - DNA, 26 bp, Artificial sequence
  SiRNA target sequence
attgtcttgattaacactggtcttaa

SEQ ID NO: 145648 - DNA, 26 bp, Artificial sequence
  SiRNA target sequence
ttgtcttgattaacactggtcttaat

SEQ ID NO: 145649 - DNA, 26 bp, Artificial sequence
  SiRNA target sequence
tgtcttgattaacactggtcttaata

SEQ ID NO: 145650 - DNA, 26 bp, Artificial sequence
  SiRNA target sequence
gtcttgattaacactggtcttaatac

SEQ ID NO: 145651 - DNA, 26 bp, Artificial sequence
  SiRNA target sequence
tcttgattaacactggtcttaataca

SEQ ID NO: 145652 - DNA, 26 bp, Artificial sequence
  SiRNA target sequence
cttgattaacactggtcttaatacac

SEQ ID NO: 145653 - DNA, 26 bp, Artificial sequence
  SiRNA target sequence
ttgattaacactggtcttaatacaca

SEQ ID NO: 145654 - DNA, 26 bp, Artificial sequence
  SiRNA target sequence
tgattaacactggtcttaatacacaa

SEQ ID NO: 145655 - DNA, 26 bp, Artificial sequence
  SiRNA target sequence
gattaacactggtcttaatacacaat

SEQ ID NO: 145656 - DNA, 26 bp, Artificial sequence
  SiRNA target sequence
attaacactggtcttaatacacaatt

SEQ ID NO: 145657 - DNA, 26 bp, Artificial sequence
  SiRNA target sequence
ttaacactggtcttaatacacaattt

SEQ ID NO: 145658 - DNA, 26 bp, Artificial sequence
  SiRNA target sequence
taacactggtcttaatacacaattta

SEQ ID NO: 145659 - DNA, 26 bp, Artificial sequence
  SiRNA target sequence
aacactggtcttaatacacaatttat

SEQ ID NO: 145660 - DNA, 26 bp, Artificial sequence
  SiRNA target sequence
acactggtcttaatacacaatttatc

SEQ ID NO: 145661 - DNA, 26 bp, Artificial sequence
  SiRNA target sequence
cactggtcttaatacacaatttatct

SEQ ID NO: 145662 - DNA, 26 bp, Artificial sequence
  SiRNA target sequence
actggtcttaatacacaatttatctt

SEQ ID NO: 145663 - DNA, 26 bp, Artificial sequence
  SiRNA target sequence
ctggtcttaatacacaatttatcttt

SEQ ID NO: 145664 - DNA, 26 bp, Artificial sequence
  SiRNA target sequence
tggtcttaatacacaatttatcttta

SEQ ID NO: 145665 - DNA, 26 bp, Artificial sequence
  SiRNA target sequence
ggtcttaatacacaatttatctttat

SEQ ID NO: 145666 - DNA, 26 bp, Artificial sequence
  SiRNA target sequence
gtcttaatacacaatttatctttata

SEQ ID NO: 145667 - DNA, 26 bp, Artificial sequence
  SiRNA target sequence
tcttaatacacaatttatctttatat

SEQ ID NO: 145668 - DNA, 26 bp, Artificial sequence
  SiRNA target sequence
cttaatacacaatttatctttatata

SEQ ID NO: 145669 - DNA, 26 bp, Artificial sequence
  SiRNA target sequence
ttaatacacaatttatctttatatat

SEQ ID NO: 145670 - DNA, 26 bp, Artificial sequence
  SiRNA target sequence
taatacacaatttatctttatatatc

SEQ ID NO: 145671 - DNA, 26 bp, Artificial sequence
  SiRNA target sequence
aatacacaatttatctttatatatca

SEQ ID NO: 145672 - DNA, 26 bp, Artificial sequence
  SiRNA target sequence
atacacaatttatctttatatatcaa

SEQ ID NO: 145673 - DNA, 26 bp, Artificial sequence
  SiRNA target sequence
tacacaatttatctttatatatcaac

SEQ ID NO: 145674 - DNA, 26 bp, Artificial sequence
  SiRNA target sequence
acacaatttatctttatatatcaacc

SEQ ID NO: 145675 - DNA, 26 bp, Artificial sequence
  SiRNA target sequence
cacaatttatctttatatatcaacca

SEQ ID NO: 145676 - DNA, 26 bp, Artificial sequence
  SiRNA target sequence
acaatttatctttatatatcaaccac

SEQ ID NO: 145677 - DNA, 26 bp, Artificial sequence
  SiRNA target sequence
caatttatctttatatatcaaccaca

SEQ ID NO: 145678 - DNA, 26 bp, Artificial sequence
  SiRNA target sequence
aatttatctttatatatcaaccacac

SEQ ID NO: 145679 - DNA, 26 bp, Artificial sequence
  SiRNA target sequence
atttatctttatatatcaaccacacc

SEQ ID NO: 145680 - DNA, 26 bp, Artificial sequence
  SiRNA target sequence
tttatctttatatatcaaccacaccc

SEQ ID NO: 145681 - DNA, 26 bp, Artificial sequence
  SiRNA target sequence
ttatctttatatatcaaccacaccca

SEQ ID NO: 145682 - DNA, 26 bp, Artificial sequence
  SiRNA target sequence
tatctttatatatcaaccacacccat

SEQ ID NO: 145683 - DNA, 26 bp, Artificial sequence
  SiRNA target sequence
atctttatatatcaaccacacccatc

SEQ ID NO: 145684 - DNA, 26 bp, Artificial sequence
  SiRNA target sequence
tctttatatatcaaccacacccatcc

SEQ ID NO: 145685 - DNA, 26 bp, Artificial sequence
  SiRNA target sequence
ctttatatatcaaccacacccatcct

SEQ ID NO: 145686 - DNA, 26 bp, Artificial sequence
  SiRNA target sequence
tttatatatcaaccacacccatcctg

SEQ ID NO: 145687 - DNA, 26 bp, Artificial sequence
  SiRNA target sequence
ttatatatcaaccacacccatcctga

SEQ ID NO: 145688 - DNA, 26 bp, Artificial sequence
  SiRNA target sequence
tatatatcaaccacacccatcctgat

SEQ ID NO: 145689 - DNA, 26 bp, Artificial sequence
  SiRNA target sequence
atatatcaaccacacccatcctgatc

SEQ ID NO: 145690 - DNA, 26 bp, Artificial sequence
  SiRNA target sequence
tatatcaaccacacccatcctgatcc

SEQ ID NO: 145691 - DNA, 26 bp, Artificial sequence
  SiRNA target sequence
atatcaaccacacccatcctgatcca

SEQ ID NO: 145692 - DNA, 26 bp, Artificial sequence
  SiRNA target sequence
tatcaaccacacccatcctgatccaa

SEQ ID NO: 145693 - DNA, 26 bp, Artificial sequence
  SiRNA target sequence
atcaaccacacccatcctgatccaaa

SEQ ID NO: 145694 - DNA, 26 bp, Artificial sequence
  SiRNA target sequence
tcaaccacacccatcctgatccaaat

SEQ ID NO: 145695 - DNA, 26 bp, Artificial sequence
  SiRNA target sequence
caaccacacccatcctgatccaaata

SEQ ID NO: 145696 - DNA, 26 bp, Artificial sequence
  SiRNA target sequence
aaccacacccatcctgatccaaataa

SEQ ID NO: 145697 - DNA, 26 bp, Artificial sequence
  SiRNA target sequence
accacacccatcctgatccaaataat

SEQ ID NO: 145698 - DNA, 26 bp, Artificial sequence
  SiRNA target sequence
ccacacccatcctgatccaaataatt

SEQ ID NO: 145699 - DNA, 26 bp, Artificial sequence
  SiRNA target sequence
cacacccatcctgatccaaataattt

SEQ ID NO: 145700 - DNA, 26 bp, Artificial sequence
  SiRNA target sequence
acacccatcctgatccaaataatttt

SEQ ID NO: 145701 - DNA, 26 bp, Artificial sequence
  SiRNA target sequence
cacccatcctgatccaaataatttta

SEQ ID NO: 145702 - DNA, 26 bp, Artificial sequence
  SiRNA target sequence
acccatcctgatccaaataattttac

SEQ ID NO: 145703 - DNA, 26 bp, Artificial sequence
  SiRNA target sequence
cccatcctgatccaaataattttaca

SEQ ID NO: 145704 - DNA, 26 bp, Artificial sequence
  SiRNA target sequence
ccatcctgatccaaataattttacag

SEQ ID NO: 145705 - DNA, 26 bp, Artificial sequence
  SiRNA target sequence
catcctgatccaaataattttacagc

SEQ ID NO: 145706 - DNA, 26 bp, Artificial sequence
  SiRNA target sequence
atcctgatccaaataattttacagct

SEQ ID NO: 145707 - DNA, 26 bp, Artificial sequence
  SiRNA target sequence
tcctgatccaaataattttacagctt

SEQ ID NO: 145708 - DNA, 26 bp, Artificial sequence
  SiRNA target sequence
cctgatccaaataattttacagcttc

SEQ ID NO: 145709 - DNA, 26 bp, Artificial sequence
  SiRNA target sequence
ctgatccaaataattttacagcttca

SEQ ID NO: 145710 - DNA, 26 bp, Artificial sequence
  SiRNA target sequence
tgatccaaataattttacagcttcag

SEQ ID NO: 145711 - DNA, 26 bp, Artificial sequence
  SiRNA target sequence
gatccaaataattttacagcttcagt

SEQ ID NO: 145712 - DNA, 26 bp, Artificial sequence
  SiRNA target sequence
atccaaataattttacagcttcagta

SEQ ID NO: 145713 - DNA, 26 bp, Artificial sequence
  SiRNA target sequence
tccaaataattttacagcttcagtat

SEQ ID NO: 145714 - DNA, 26 bp, Artificial sequence
  SiRNA target sequence
ccaaataattttacagcttcagtatt

SEQ ID NO: 145715 - DNA, 26 bp, Artificial sequence
  SiRNA target sequence
caaataattttacagcttcagtatta

SEQ ID NO: 145716 - DNA, 26 bp, Artificial sequence
  SiRNA target sequence
aaataattttacagcttcagtattaa

SEQ ID NO: 145717 - DNA, 26 bp, Artificial sequence
  SiRNA target sequence
aataattttacagcttcagtattaaa

SEQ ID NO: 145718 - DNA, 26 bp, Artificial sequence
  SiRNA target sequence
ataattttacagcttcagtattaaaa

SEQ ID NO: 145719 - DNA, 26 bp, Artificial sequence
  SiRNA target sequence
taattttacagcttcagtattaaaat

SEQ ID NO: 145720 - DNA, 26 bp, Artificial sequence
  SiRNA target sequence
aattttacagcttcagtattaaaatt

SEQ ID NO: 145721 - DNA, 26 bp, Artificial sequence
  SiRNA target sequence
attttacagcttcagtattaaaattc

SEQ ID NO: 145722 - DNA, 26 bp, Artificial sequence
  SiRNA target sequence
ttttacagcttcagtattaaaattct

SEQ ID NO: 145723 - DNA, 26 bp, Artificial sequence
  SiRNA target sequence
tttacagcttcagtattaaaattctc

SEQ ID NO: 145724 - DNA, 26 bp, Artificial sequence
  SiRNA target sequence
ttacagcttcagtattaaaattctcc

SEQ ID NO: 145725 - DNA, 26 bp, Artificial sequence
  SiRNA target sequence
tacagcttcagtattaaaattctcct

SEQ ID NO: 145726 - DNA, 26 bp, Artificial sequence
  SiRNA target sequence
acagcttcagtattaaaattctcctt

SEQ ID NO: 145727 - DNA, 26 bp, Artificial sequence
  SiRNA target sequence
cagcttcagtattaaaattctcctta

SEQ ID NO: 145728 - DNA, 26 bp, Artificial sequence
  SiRNA target sequence
agcttcagtattaaaattctccttaa

SEQ ID NO: 145729 - DNA, 26 bp, Artificial sequence
  SiRNA target sequence
gcttcagtattaaaattctccttaaa

SEQ ID NO: 145730 - DNA, 26 bp, Artificial sequence
  SiRNA target sequence
cttcagtattaaaattctccttaaat

SEQ ID NO: 145731 - DNA, 26 bp, Artificial sequence
  SiRNA target sequence
ttcagtattaaaattctccttaaatt

SEQ ID NO: 145732 - DNA, 26 bp, Artificial sequence
  SiRNA target sequence
tcagtattaaaattctccttaaattt

SEQ ID NO: 145733 - DNA, 26 bp, Artificial sequence
  SiRNA target sequence
cagtattaaaattctccttaaattta

SEQ ID NO: 145734 - DNA, 26 bp, Artificial sequence
  SiRNA target sequence
agtattaaaattctccttaaatttat

SEQ ID NO: 145735 - DNA, 26 bp, Artificial sequence
  SiRNA target sequence
gtattaaaattctccttaaatttatt

SEQ ID NO: 145736 - DNA, 26 bp, Artificial sequence
  SiRNA target sequence
tattaaaattctccttaaatttattt

SEQ ID NO: 145737 - DNA, 26 bp, Artificial sequence
  SiRNA target sequence
attaaaattctccttaaatttattta

SEQ ID NO: 145738 - DNA, 26 bp, Artificial sequence
  SiRNA target sequence
ttaaaattctccttaaatttatttat

SEQ ID NO: 145739 - DNA, 26 bp, Artificial sequence
  SiRNA target sequence
taaaattctccttaaatttatttatt

SEQ ID NO: 145740 - DNA, 26 bp, Artificial sequence
  SiRNA target sequence
aaaattctccttaaatttatttattg

SEQ ID NO: 145741 - DNA, 26 bp, Artificial sequence
  SiRNA target sequence
aaattctccttaaatttatttattga

SEQ ID NO: 145742 - DNA, 26 bp, Artificial sequence
  SiRNA target sequence
aattctccttaaatttatttattgat

SEQ ID NO: 145743 - DNA, 26 bp, Artificial sequence
  SiRNA target sequence
attctccttaaatttatttattgatc

SEQ ID NO: 145744 - DNA, 26 bp, Artificial sequence
  SiRNA target sequence
ttctccttaaatttatttattgatcc

SEQ ID NO: 145745 - DNA, 26 bp, Artificial sequence
  SiRNA target sequence
tctccttaaatttatttattgatcca

SEQ ID NO: 145746 - DNA, 26 bp, Artificial sequence
  SiRNA target sequence
ctccttaaatttatttattgatccaa

SEQ ID NO: 145747 - DNA, 26 bp, Artificial sequence
  SiRNA target sequence
tccttaaatttatttattgatccaaa

SEQ ID NO: 145748 - DNA, 26 bp, Artificial sequence
  SiRNA target sequence
ccttaaatttatttattgatccaaag

SEQ ID NO: 145749 - DNA, 26 bp, Artificial sequence
  SiRNA target sequence
cttaaatttatttattgatccaaagt

SEQ ID NO: 145750 - DNA, 26 bp, Artificial sequence
  SiRNA target sequence
ttaaatttatttattgatccaaagtc

SEQ ID NO: 145751 - DNA, 26 bp, Artificial sequence
  SiRNA target sequence
taaatttatttattgatccaaagtct

SEQ ID NO: 145752 - DNA, 26 bp, Artificial sequence
  SiRNA target sequence
aaatttatttattgatccaaagtctt

SEQ ID NO: 145753 - DNA, 26 bp, Artificial sequence
  SiRNA target sequence
aatttatttattgatccaaagtcttt

SEQ ID NO: 145754 - DNA, 26 bp, Artificial sequence
  SiRNA target sequence
atttatttattgatccaaagtctttt

SEQ ID NO: 145755 - DNA, 26 bp, Artificial sequence
  SiRNA target sequence
tttatttattgatccaaagtctttta

SEQ ID NO: 145756 - DNA, 26 bp, Artificial sequence
  SiRNA target sequence
ttatttattgatccaaagtcttttat

SEQ ID NO: 145757 - DNA, 26 bp, Artificial sequence
  SiRNA target sequence
tatttattgatccaaagtcttttatt

SEQ ID NO: 145758 - DNA, 26 bp, Artificial sequence
  SiRNA target sequence
atttattgatccaaagtcttttatta

SEQ ID NO: 145759 - DNA, 26 bp, Artificial sequence
  SiRNA target sequence
tttattgatccaaagtcttttattat

SEQ ID NO: 145760 - DNA, 26 bp, Artificial sequence
  SiRNA target sequence
ttattgatccaaagtcttttattata

SEQ ID NO: 145761 - DNA, 26 bp, Artificial sequence
  SiRNA target sequence
tattgatccaaagtcttttattatag

SEQ ID NO: 145762 - DNA, 26 bp, Artificial sequence
  SiRNA target sequence
attgatccaaagtcttttattatagc

SEQ ID NO: 145763 - DNA, 26 bp, Artificial sequence
  SiRNA target sequence
ttgatccaaagtcttttattatagca

SEQ ID NO: 145764 - DNA, 26 bp, Artificial sequence
  SiRNA target sequence
tgatccaaagtcttttattatagcac

SEQ ID NO: 145765 - DNA, 26 bp, Artificial sequence
  SiRNA target sequence
gatccaaagtcttttattatagcact

SEQ ID NO: 145766 - DNA, 26 bp, Artificial sequence
  SiRNA target sequence
atccaaagtcttttattatagcactt

SEQ ID NO: 145767 - DNA, 26 bp, Artificial sequence
  SiRNA target sequence
tccaaagtcttttattatagcacttt

SEQ ID NO: 145768 - DNA, 26 bp, Artificial sequence
  SiRNA target sequence
ccaaagtcttttattatagcactttc

SEQ ID NO: 145769 - DNA, 26 bp, Artificial sequence
  SiRNA target sequence
caaagtcttttattatagcactttcc

SEQ ID NO: 145770 - DNA, 26 bp, Artificial sequence
  SiRNA target sequence
aaagtcttttattatagcactttcca

SEQ ID NO: 145771 - DNA, 26 bp, Artificial sequence
  SiRNA target sequence
aagtcttttattatagcactttccaa

SEQ ID NO: 145772 - DNA, 26 bp, Artificial sequence
  SiRNA target sequence
agtcttttattatagcactttccaac

SEQ ID NO: 145773 - DNA, 26 bp, Artificial sequence
  SiRNA target sequence
gtcttttattatagcactttccaact

SEQ ID NO: 145774 - DNA, 26 bp, Artificial sequence
  SiRNA target sequence
tcttttattatagcactttccaactg

SEQ ID NO: 145775 - DNA, 26 bp, Artificial sequence
  SiRNA target sequence
cttttattatagcactttccaactgg

SEQ ID NO: 145776 - DNA, 26 bp, Artificial sequence
  SiRNA target sequence
ttttattatagcactttccaactggg

SEQ ID NO: 145777 - DNA, 26 bp, Artificial sequence
  SiRNA target sequence
tttattatagcactttccaactggga

SEQ ID NO: 145778 - DNA, 26 bp, Artificial sequence
  SiRNA target sequence
ttattatagcactttccaactgggaa

SEQ ID NO: 145779 - DNA, 26 bp, Artificial sequence
  SiRNA target sequence
tattatagcactttccaactgggaag

SEQ ID NO: 145780 - DNA, 26 bp, Artificial sequence
  SiRNA target sequence
attatagcactttccaactgggaaga

SEQ ID NO: 145781 - DNA, 26 bp, Artificial sequence
  SiRNA target sequence
ttatagcactttccaactgggaagaa

SEQ ID NO: 145782 - DNA, 26 bp, Artificial sequence
  SiRNA target sequence
tatagcactttccaactgggaagaaa

SEQ ID NO: 145783 - DNA, 26 bp, Artificial sequence
  SiRNA target sequence
atagcactttccaactgggaagaaat

SEQ ID NO: 145784 - DNA, 26 bp, Artificial sequence
  SiRNA target sequence
tagcactttccaactgggaagaaatc

SEQ ID NO: 145785 - DNA, 26 bp, Artificial sequence
  SiRNA target sequence
agcactttccaactgggaagaaatct

SEQ ID NO: 145786 - DNA, 26 bp, Artificial sequence
  SiRNA target sequence
gcactttccaactgggaagaaatctt

SEQ ID NO: 145787 - DNA, 26 bp, Artificial sequence
  SiRNA target sequence
cactttccaactgggaagaaatcttt

SEQ ID NO: 145788 - DNA, 26 bp, Artificial sequence
  SiRNA target sequence
actttccaactgggaagaaatctttt

SEQ ID NO: 145789 - DNA, 26 bp, Artificial sequence
  SiRNA target sequence
ctttccaactgggaagaaatcttttt

SEQ ID NO: 145790 - DNA, 26 bp, Artificial sequence
  SiRNA target sequence
tttccaactgggaagaaatcttttta

SEQ ID NO: 145791 - DNA, 26 bp, Artificial sequence
  SiRNA target sequence
ttccaactgggaagaaatctttttat

SEQ ID NO: 145792 - DNA, 26 bp, Artificial sequence
  SiRNA target sequence
tccaactgggaagaaatctttttatt

SEQ ID NO: 145793 - DNA, 26 bp, Artificial sequence
  SiRNA target sequence
ccaactgggaagaaatctttttattt

SEQ ID NO: 145794 - DNA, 26 bp, Artificial sequence
  SiRNA target sequence
caactgggaagaaatctttttatttt

SEQ ID NO: 145795 - DNA, 26 bp, Artificial sequence
  SiRNA target sequence
aactgggaagaaatctttttattttc

SEQ ID NO: 145796 - DNA, 26 bp, Artificial sequence
  SiRNA target sequence
actgggaagaaatctttttattttct

SEQ ID NO: 145797 - DNA, 26 bp, Artificial sequence
  SiRNA target sequence
ctgggaagaaatctttttattttctg

SEQ ID NO: 145798 - DNA, 26 bp, Artificial sequence
  SiRNA target sequence
tgggaagaaatctttttattttctgg

SEQ ID NO: 145799 - DNA, 26 bp, Artificial sequence
  SiRNA target sequence
gggaagaaatctttttattttctggt

SEQ ID NO: 145800 - DNA, 26 bp, Artificial sequence
  SiRNA target sequence
ggaagaaatctttttattttctggtg

SEQ ID NO: 145801 - DNA, 26 bp, Artificial sequence
  SiRNA target sequence
gaagaaatctttttattttctggtga

SEQ ID NO: 145802 - DNA, 26 bp, Artificial sequence
  SiRNA target sequence
aagaaatctttttattttctggtgac

SEQ ID NO: 145803 - DNA, 26 bp, Artificial sequence
  SiRNA target sequence
agaaatctttttattttctggtgaca

SEQ ID NO: 145804 - DNA, 26 bp, Artificial sequence
  SiRNA target sequence
gaaatctttttattttctggtgacat

SEQ ID NO: 145805 - DNA, 26 bp, Artificial sequence
  SiRNA target sequence
aaatctttttattttctggtgacatt

SEQ ID NO: 145806 - DNA, 26 bp, Artificial sequence
  SiRNA target sequence
aatctttttattttctggtgacatta

SEQ ID NO: 145807 - DNA, 26 bp, Artificial sequence
  SiRNA target sequence
atctttttattttctggtgacattac

SEQ ID NO: 145808 - DNA, 26 bp, Artificial sequence
  SiRNA target sequence
tctttttattttctggtgacattacc

SEQ ID NO: 145809 - DNA, 26 bp, Artificial sequence
  SiRNA target sequence
ctttttattttctggtgacattacca

SEQ ID NO: 145810 - DNA, 26 bp, Artificial sequence
  SiRNA target sequence
tttttattttctggtgacattaccaa

SEQ ID NO: 145811 - DNA, 26 bp, Artificial sequence
  SiRNA target sequence
ttttattttctggtgacattaccaac

SEQ ID NO: 145812 - DNA, 26 bp, Artificial sequence
  SiRNA target sequence
tttattttctggtgacattaccaacc

SEQ ID NO: 145813 - DNA, 26 bp, Artificial sequence
  SiRNA target sequence
ttattttctggtgacattaccaacca

SEQ ID NO: 145814 - DNA, 26 bp, Artificial sequence
  SiRNA target sequence
tattttctggtgacattaccaaccag

SEQ ID NO: 145815 - DNA, 26 bp, Artificial sequence
  SiRNA target sequence
attttctggtgacattaccaaccaga

SEQ ID NO: 145816 - DNA, 26 bp, Artificial sequence
  SiRNA target sequence
ttttctggtgacattaccaaccagaa

SEQ ID NO: 145817 - DNA, 26 bp, Artificial sequence
  SiRNA target sequence
tttctggtgacattaccaaccagaaa

SEQ ID NO: 145818 - DNA, 26 bp, Artificial sequence
  SiRNA target sequence
ttctggtgacattaccaaccagaaaa

SEQ ID NO: 145819 - DNA, 26 bp, Artificial sequence
  SiRNA target sequence
tctggtgacattaccaaccagaaaag

SEQ ID NO: 145820 - DNA, 26 bp, Artificial sequence
  SiRNA target sequence
ctggtgacattaccaaccagaaaaga

SEQ ID NO: 145821 - DNA, 26 bp, Artificial sequence
  SiRNA target sequence
tggtgacattaccaaccagaaaagac

SEQ ID NO: 145822 - DNA, 26 bp, Artificial sequence
  SiRNA target sequence
ggtgacattaccaaccagaaaagact

SEQ ID NO: 145823 - DNA, 26 bp, Artificial sequence
  SiRNA target sequence
gtgacattaccaaccagaaaagacta

SEQ ID NO: 145824 - DNA, 26 bp, Artificial sequence
  SiRNA target sequence
tgacattaccaaccagaaaagactat

SEQ ID NO: 145825 - DNA, 26 bp, Artificial sequence
  SiRNA target sequence
gacattaccaaccagaaaagactatg

SEQ ID NO: 145826 - DNA, 26 bp, Artificial sequence
  SiRNA target sequence
acattaccaaccagaaaagactatgg

SEQ ID NO: 145827 - DNA, 26 bp, Artificial sequence
  SiRNA target sequence
cattaccaaccagaaaagactatggt

SEQ ID NO: 145828 - DNA, 26 bp, Artificial sequence
  SiRNA target sequence
attaccaaccagaaaagactatggtt

SEQ ID NO: 145829 - DNA, 26 bp, Artificial sequence
  SiRNA target sequence
ttaccaaccagaaaagactatggttg

SEQ ID NO: 145830 - DNA, 26 bp, Artificial sequence
  SiRNA target sequence
taccaaccagaaaagactatggttgt

SEQ ID NO: 145831 - DNA, 26 bp, Artificial sequence
  SiRNA target sequence
accaaccagaaaagactatggttgta

SEQ ID NO: 145832 - DNA, 26 bp, Artificial sequence
  SiRNA target sequence
ccaaccagaaaagactatggttgtaa

SEQ ID NO: 145833 - DNA, 26 bp, Artificial sequence
  SiRNA target sequence
caaccagaaaagactatggttgtaat

SEQ ID NO: 145834 - DNA, 26 bp, Artificial sequence
  SiRNA target sequence
aaccagaaaagactatggttgtaatg

SEQ ID NO: 145835 - DNA, 26 bp, Artificial sequence
  SiRNA target sequence
accagaaaagactatggttgtaatga

SEQ ID NO: 145836 - DNA, 26 bp, Artificial sequence
  SiRNA target sequence
ccagaaaagactatggttgtaatgac

SEQ ID NO: 145837 - DNA, 26 bp, Artificial sequence
  SiRNA target sequence
cagaaaagactatggttgtaatgacc

SEQ ID NO: 145838 - DNA, 26 bp, Artificial sequence
  SiRNA target sequence
agaaaagactatggttgtaatgacca

SEQ ID NO: 145839 - DNA, 26 bp, Artificial sequence
  SiRNA target sequence
gaaaagactatggttgtaatgaccac

SEQ ID NO: 145840 - DNA, 26 bp, Artificial sequence
  SiRNA target sequence
aaaagactatggttgtaatgaccacc

SEQ ID NO: 145841 - DNA, 26 bp, Artificial sequence
  SiRNA target sequence
aaagactatggttgtaatgaccacca

SEQ ID NO: 145842 - DNA, 26 bp, Artificial sequence
  SiRNA target sequence
aagactatggttgtaatgaccaccac

SEQ ID NO: 145843 - DNA, 26 bp, Artificial sequence
  SiRNA target sequence
agactatggttgtaatgaccaccacc

SEQ ID NO: 145844 - DNA, 26 bp, Artificial sequence
  SiRNA target sequence
gactatggttgtaatgaccaccacca

SEQ ID NO: 145845 - DNA, 26 bp, Artificial sequence
  SiRNA target sequence
actatggttgtaatgaccaccaccat

SEQ ID NO: 145846 - DNA, 26 bp, Artificial sequence
  SiRNA target sequence
ctatggttgtaatgaccaccaccata

SEQ ID NO: 145847 - DNA, 26 bp, Artificial sequence
  SiRNA target sequence
tatggttgtaatgaccaccaccataa

SEQ ID NO: 145848 - DNA, 26 bp, Artificial sequence
  SiRNA target sequence
atggttgtaatgaccaccaccataat

SEQ ID NO: 145849 - DNA, 26 bp, Artificial sequence
  SiRNA target sequence
tggttgtaatgaccaccaccataatc

SEQ ID NO: 145850 - DNA, 26 bp, Artificial sequence
  SiRNA target sequence
ggttgtaatgaccaccaccataatct

SEQ ID NO: 145851 - DNA, 26 bp, Artificial sequence
  SiRNA target sequence
gttgtaatgaccaccaccataatctc

SEQ ID NO: 145852 - DNA, 26 bp, Artificial sequence
  SiRNA target sequence
ttgtaatgaccaccaccataatctct

SEQ ID NO: 145853 - DNA, 26 bp, Artificial sequence
  SiRNA target sequence
tgtaatgaccaccaccataatctctt

SEQ ID NO: 145854 - DNA, 26 bp, Artificial sequence
  SiRNA target sequence
gtaatgaccaccaccataatctctta

SEQ ID NO: 145855 - DNA, 26 bp, Artificial sequence
  SiRNA target sequence
taatgaccaccaccataatctcttaa

SEQ ID NO: 145856 - DNA, 26 bp, Artificial sequence
  SiRNA target sequence
aatgaccaccaccataatctcttaat

SEQ ID NO: 145857 - DNA, 26 bp, Artificial sequence
  SiRNA target sequence
atgaccaccaccataatctcttaatt

SEQ ID NO: 145858 - DNA, 26 bp, Artificial sequence
  SiRNA target sequence
tgaccaccaccataatctcttaattg

SEQ ID NO: 145859 - DNA, 26 bp, Artificial sequence
  SiRNA target sequence
gaccaccaccataatctcttaattgt

SEQ ID NO: 145860 - DNA, 26 bp, Artificial sequence
  SiRNA target sequence
accaccaccataatctcttaattgtt

SEQ ID NO: 145861 - DNA, 26 bp, Artificial sequence
  SiRNA target sequence
ccaccaccataatctcttaattgttt

SEQ ID NO: 145862 - DNA, 26 bp, Artificial sequence
  SiRNA target sequence
caccaccataatctcttaattgttta

SEQ ID NO: 145863 - DNA, 26 bp, Artificial sequence
  SiRNA target sequence
accaccataatctcttaattgtttat

SEQ ID NO: 145864 - DNA, 26 bp, Artificial sequence
  SiRNA target sequence
ccaccataatctcttaattgtttatc

SEQ ID NO: 145865 - DNA, 26 bp, Artificial sequence
  SiRNA target sequence
caccataatctcttaattgtttatca

SEQ ID NO: 145866 - DNA, 26 bp, Artificial sequence
  SiRNA target sequence
accataatctcttaattgtttatcaa

SEQ ID NO: 145867 - DNA, 26 bp, Artificial sequence
  SiRNA target sequence
ccataatctcttaattgtttatcaac

SEQ ID NO: 145868 - DNA, 26 bp, Artificial sequence
  SiRNA target sequence
cataatctcttaattgtttatcaaca

SEQ ID NO: 145869 - DNA, 26 bp, Artificial sequence
  SiRNA target sequence
ataatctcttaattgtttatcaacaa

SEQ ID NO: 145870 - DNA, 26 bp, Artificial sequence
  SiRNA target sequence
taatctcttaattgtttatcaacaag

SEQ ID NO: 145871 - DNA, 26 bp, Artificial sequence
  SiRNA target sequence
aatctcttaattgtttatcaacaagt

SEQ ID NO: 145872 - DNA, 26 bp, Artificial sequence
  SiRNA target sequence
atctcttaattgtttatcaacaagtg

SEQ ID NO: 145873 - DNA, 26 bp, Artificial sequence
  SiRNA target sequence
tctcttaattgtttatcaacaagtgc

SEQ ID NO: 145874 - DNA, 26 bp, Artificial sequence
  SiRNA target sequence
ctcttaattgtttatcaacaagtgca

SEQ ID NO: 145875 - DNA, 26 bp, Artificial sequence
  SiRNA target sequence
tcttaattgtttatcaacaagtgcat

SEQ ID NO: 145876 - DNA, 26 bp, Artificial sequence
  SiRNA target sequence
cttaattgtttatcaacaagtgcatt

SEQ ID NO: 145877 - DNA, 26 bp, Artificial sequence
  SiRNA target sequence
ttaattgtttatcaacaagtgcattt

SEQ ID NO: 145878 - DNA, 26 bp, Artificial sequence
  SiRNA target sequence
taattgtttatcaacaagtgcatttc

SEQ ID NO: 145879 - DNA, 26 bp, Artificial sequence
  SiRNA target sequence
aattgtttatcaacaagtgcatttcc

SEQ ID NO: 145880 - DNA, 26 bp, Artificial sequence
  SiRNA target sequence
attgtttatcaacaagtgcatttcct

SEQ ID NO: 145881 - DNA, 26 bp, Artificial sequence
  SiRNA target sequence
ttgtttatcaacaagtgcatttcctt

SEQ ID NO: 145882 - DNA, 26 bp, Artificial sequence
  SiRNA target sequence
tgtttatcaacaagtgcatttccttt

SEQ ID NO: 145883 - DNA, 26 bp, Artificial sequence
  SiRNA target sequence
gtttatcaacaagtgcatttccttta

SEQ ID NO: 145884 - DNA, 26 bp, Artificial sequence
  SiRNA target sequence
tttatcaacaagtgcatttcctttat

SEQ ID NO: 145885 - DNA, 26 bp, Artificial sequence
  SiRNA target sequence
ttatcaacaagtgcatttcctttatt

SEQ ID NO: 145886 - DNA, 26 bp, Artificial sequence
  SiRNA target sequence
tatcaacaagtgcatttcctttatta

SEQ ID NO: 145887 - DNA, 26 bp, Artificial sequence
  SiRNA target sequence
atcaacaagtgcatttcctttattat

SEQ ID NO: 145888 - DNA, 26 bp, Artificial sequence
  SiRNA target sequence
tcaacaagtgcatttcctttattatt

SEQ ID NO: 145889 - DNA, 26 bp, Artificial sequence
  SiRNA target sequence
caacaagtgcatttcctttattatta

SEQ ID NO: 145890 - DNA, 26 bp, Artificial sequence
  SiRNA target sequence
aacaagtgcatttcctttattattaa

SEQ ID NO: 145891 - DNA, 26 bp, Artificial sequence
  SiRNA target sequence
acaagtgcatttcctttattattaaa

SEQ ID NO: 145892 - DNA, 26 bp, Artificial sequence
  SiRNA target sequence
caagtgcatttcctttattattaaaa

SEQ ID NO: 145893 - DNA, 26 bp, Artificial sequence
  SiRNA target sequence
aagtgcatttcctttattattaaaaa

SEQ ID NO: 145894 - DNA, 26 bp, Artificial sequence
  SiRNA target sequence
agtgcatttcctttattattaaaaag

SEQ ID NO: 145895 - DNA, 26 bp, Artificial sequence
  SiRNA target sequence
gtgcatttcctttattattaaaaagt

SEQ ID NO: 145896 - DNA, 26 bp, Artificial sequence
  SiRNA target sequence
tgcatttcctttattattaaaaagta

SEQ ID NO: 145897 - DNA, 26 bp, Artificial sequence
  SiRNA target sequence
gcatttcctttattattaaaaagtaa

SEQ ID NO: 145898 - DNA, 26 bp, Artificial sequence
  SiRNA target sequence
catttcctttattattaaaaagtaat

SEQ ID NO: 145899 - DNA, 26 bp, Artificial sequence
  SiRNA target sequence
atttcctttattattaaaaagtaatg

SEQ ID NO: 145900 - DNA, 26 bp, Artificial sequence
  SiRNA target sequence
tttcctttattattaaaaagtaatga

SEQ ID NO: 145901 - DNA, 26 bp, Artificial sequence
  SiRNA target sequence
ttcctttattattaaaaagtaatgaa

SEQ ID NO: 145902 - DNA, 26 bp, Artificial sequence
  SiRNA target sequence
tcctttattattaaaaagtaatgaat

SEQ ID NO: 145903 - DNA, 26 bp, Artificial sequence
  SiRNA target sequence
cctttattattaaaaagtaatgaatt

SEQ ID NO: 145904 - DNA, 26 bp, Artificial sequence
  SiRNA target sequence
ctttattattaaaaagtaatgaattt

SEQ ID NO: 145905 - DNA, 26 bp, Artificial sequence
  SiRNA target sequence
tttattattaaaaagtaatgaattta

SEQ ID NO: 145906 - DNA, 26 bp, Artificial sequence
  SiRNA target sequence
ttattattaaaaagtaatgaatttaa

SEQ ID NO: 145907 - DNA, 26 bp, Artificial sequence
  SiRNA target sequence
tattattaaaaagtaatgaatttaat

SEQ ID NO: 145908 - DNA, 26 bp, Artificial sequence
  SiRNA target sequence
attattaaaaagtaatgaatttaatg

SEQ ID NO: 145909 - DNA, 26 bp, Artificial sequence
  SiRNA target sequence
ttattaaaaagtaatgaatttaatga

SEQ ID NO: 145910 - DNA, 26 bp, Artificial sequence
  SiRNA target sequence
tattaaaaagtaatgaatttaatgat

SEQ ID NO: 145911 - DNA, 26 bp, Artificial sequence
  SiRNA target sequence
attaaaaagtaatgaatttaatgatt

SEQ ID NO: 145912 - DNA, 26 bp, Artificial sequence
  SiRNA target sequence
ttaaaaagtaatgaatttaatgattt

SEQ ID NO: 145913 - DNA, 26 bp, Artificial sequence
  SiRNA target sequence
taaaaagtaatgaatttaatgattta

SEQ ID NO: 145914 - DNA, 26 bp, Artificial sequence
  SiRNA target sequence
aaaaagtaatgaatttaatgatttac

SEQ ID NO: 145915 - DNA, 26 bp, Artificial sequence
  SiRNA target sequence
aaaagtaatgaatttaatgatttacc

SEQ ID NO: 145916 - DNA, 26 bp, Artificial sequence
  SiRNA target sequence
aaagtaatgaatttaatgatttacca

SEQ ID NO: 145917 - DNA, 26 bp, Artificial sequence
  SiRNA target sequence
aagtaatgaatttaatgatttaccac

SEQ ID NO: 145918 - DNA, 26 bp, Artificial sequence
  SiRNA target sequence
agtaatgaatttaatgatttaccaca

SEQ ID NO: 145919 - DNA, 26 bp, Artificial sequence
  SiRNA target sequence
gtaatgaatttaatgatttaccacac

SEQ ID NO: 145920 - DNA, 26 bp, Artificial sequence
  SiRNA target sequence
taatgaatttaatgatttaccacaca

SEQ ID NO: 145921 - DNA, 26 bp, Artificial sequence
  SiRNA target sequence
aatgaatttaatgatttaccacacaa

SEQ ID NO: 145922 - DNA, 26 bp, Artificial sequence
  SiRNA target sequence
atgaatttaatgatttaccacacaaa

SEQ ID NO: 145923 - DNA, 26 bp, Artificial sequence
  SiRNA target sequence
tgaatttaatgatttaccacacaaat

SEQ ID NO: 145924 - DNA, 26 bp, Artificial sequence
  SiRNA target sequence
gaatttaatgatttaccacacaaatt

SEQ ID NO: 145925 - DNA, 26 bp, Artificial sequence
  SiRNA target sequence
aatttaatgatttaccacacaaattg

SEQ ID NO: 145926 - DNA, 26 bp, Artificial sequence
  SiRNA target sequence
atttaatgatttaccacacaaattgt

SEQ ID NO: 145927 - DNA, 26 bp, Artificial sequence
  SiRNA target sequence
tttaatgatttaccacacaaattgtt

SEQ ID NO: 145928 - DNA, 26 bp, Artificial sequence
  SiRNA target sequence
ttaatgatttaccacacaaattgtta

SEQ ID NO: 145929 - DNA, 26 bp, Artificial sequence
  SiRNA target sequence
taatgatttaccacacaaattgttat

SEQ ID NO: 145930 - DNA, 26 bp, Artificial sequence
  SiRNA target sequence
aatgatttaccacacaaattgttatc

SEQ ID NO: 145931 - DNA, 26 bp, Artificial sequence
  SiRNA target sequence
atgatttaccacacaaattgttatct

SEQ ID NO: 145932 - DNA, 26 bp, Artificial sequence
  SiRNA target sequence
tgatttaccacacaaattgttatcta

SEQ ID NO: 145933 - DNA, 26 bp, Artificial sequence
  SiRNA target sequence
gatttaccacacaaattgttatctaa

SEQ ID NO: 145934 - DNA, 26 bp, Artificial sequence
  SiRNA target sequence
atttaccacacaaattgttatctaat

SEQ ID NO: 145935 - DNA, 26 bp, Artificial sequence
  SiRNA target sequence
tttaccacacaaattgttatctaata

SEQ ID NO: 145936 - DNA, 26 bp, Artificial sequence
  SiRNA target sequence
ttaccacacaaattgttatctaatat

SEQ ID NO: 145937 - DNA, 26 bp, Artificial sequence
  SiRNA target sequence
taccacacaaattgttatctaatatt

SEQ ID NO: 145938 - DNA, 26 bp, Artificial sequence
  SiRNA target sequence
accacacaaattgttatctaatatta

SEQ ID NO: 145939 - DNA, 26 bp, Artificial sequence
  SiRNA target sequence
ccacacaaattgttatctaatattat

SEQ ID NO: 145940 - DNA, 26 bp, Artificial sequence
  SiRNA target sequence
cacacaaattgttatctaatattatt

SEQ ID NO: 145941 - DNA, 26 bp, Artificial sequence
  SiRNA target sequence
acacaaattgttatctaatattattt

SEQ ID NO: 145942 - DNA, 26 bp, Artificial sequence
  SiRNA target sequence
cacaaattgttatctaatattatttt

SEQ ID NO: 145943 - DNA, 26 bp, Artificial sequence
  SiRNA target sequence
acaaattgttatctaatattatttta

SEQ ID NO: 145944 - DNA, 26 bp, Artificial sequence
  SiRNA target sequence
caaattgttatctaatattattttat

SEQ ID NO: 145945 - DNA, 26 bp, Artificial sequence
  SiRNA target sequence
aaattgttatctaatattattttatt

SEQ ID NO: 145946 - DNA, 26 bp, Artificial sequence
  SiRNA target sequence
aattgttatctaatattattttatta

SEQ ID NO: 145947 - DNA, 26 bp, Artificial sequence
  SiRNA target sequence
attgttatctaatattattttattaa

SEQ ID NO: 145948 - DNA, 26 bp, Artificial sequence
  SiRNA target sequence
ttgttatctaatattattttattaag

SEQ ID NO: 145949 - DNA, 26 bp, Artificial sequence
  SiRNA target sequence
tgttatctaatattattttattaaga

SEQ ID NO: 145950 - DNA, 26 bp, Artificial sequence
  SiRNA target sequence
gttatctaatattattttattaagag

SEQ ID NO: 145951 - DNA, 26 bp, Artificial sequence
  SiRNA target sequence
ttatctaatattattttattaagagt

SEQ ID NO: 145952 - DNA, 26 bp, Artificial sequence
  SiRNA target sequence
tatctaatattattttattaagagtg

SEQ ID NO: 145953 - DNA, 26 bp, Artificial sequence
  SiRNA target sequence
atctaatattattttattaagagtgt

SEQ ID NO: 145954 - DNA, 26 bp, Artificial sequence
  SiRNA target sequence
tctaatattattttattaagagtgtc

SEQ ID NO: 145955 - DNA, 26 bp, Artificial sequence
  SiRNA target sequence
ctaatattattttattaagagtgtct

SEQ ID NO: 145956 - DNA, 26 bp, Artificial sequence
  SiRNA target sequence
taatattattttattaagagtgtcta

SEQ ID NO: 145957 - DNA, 26 bp, Artificial sequence
  SiRNA target sequence
aatattattttattaagagtgtctac

SEQ ID NO: 145958 - DNA, 26 bp, Artificial sequence
  SiRNA target sequence
atattattttattaagagtgtctaca

SEQ ID NO: 145959 - DNA, 26 bp, Artificial sequence
  SiRNA target sequence
tattattttattaagagtgtctacat

SEQ ID NO: 145960 - DNA, 26 bp, Artificial sequence
  SiRNA target sequence
attattttattaagagtgtctacata

SEQ ID NO: 145961 - DNA, 26 bp, Artificial sequence
  SiRNA target sequence
ttattttattaagagtgtctacatac

SEQ ID NO: 145962 - DNA, 26 bp, Artificial sequence
  SiRNA target sequence
tattttattaagagtgtctacatacg

SEQ ID NO: 145963 - DNA, 26 bp, Artificial sequence
  SiRNA target sequence
attttattaagagtgtctacatacgc

SEQ ID NO: 145964 - DNA, 26 bp, Artificial sequence
  SiRNA target sequence
ttttattaagagtgtctacatacgct

SEQ ID NO: 145965 - DNA, 26 bp, Artificial sequence
  SiRNA target sequence
tttattaagagtgtctacatacgctt

SEQ ID NO: 145966 - DNA, 26 bp, Artificial sequence
  SiRNA target sequence
ttattaagagtgtctacatacgcttg

SEQ ID NO: 145967 - DNA, 26 bp, Artificial sequence
  SiRNA target sequence
tattaagagtgtctacatacgcttga

SEQ ID NO: 145968 - DNA, 26 bp, Artificial sequence
  SiRNA target sequence
attaagagtgtctacatacgcttgat

SEQ ID NO: 145969 - DNA, 26 bp, Artificial sequence
  SiRNA target sequence
ttaagagtgtctacatacgcttgatg

SEQ ID NO: 145970 - DNA, 26 bp, Artificial sequence
  SiRNA target sequence
taagagtgtctacatacgcttgatgg

SEQ ID NO: 145971 - DNA, 26 bp, Artificial sequence
  SiRNA target sequence
aagagtgtctacatacgcttgatggt

SEQ ID NO: 145972 - DNA, 26 bp, Artificial sequence
  SiRNA target sequence
agagtgtctacatacgcttgatggtg

SEQ ID NO: 145973 - DNA, 26 bp, Artificial sequence
  SiRNA target sequence
gagtgtctacatacgcttgatggtgc

SEQ ID NO: 145974 - DNA, 26 bp, Artificial sequence
  SiRNA target sequence
agtgtctacatacgcttgatggtgct

SEQ ID NO: 145975 - DNA, 26 bp, Artificial sequence
  SiRNA target sequence
gtgtctacatacgcttgatggtgctt

SEQ ID NO: 145976 - DNA, 26 bp, Artificial sequence
  SiRNA target sequence
tgtctacatacgcttgatggtgctta

SEQ ID NO: 145977 - DNA, 26 bp, Artificial sequence
  SiRNA target sequence
gtctacatacgcttgatggtgcttag

SEQ ID NO: 145978 - DNA, 26 bp, Artificial sequence
  SiRNA target sequence
tctacatacgcttgatggtgcttaga

SEQ ID NO: 145979 - DNA, 26 bp, Artificial sequence
  SiRNA target sequence
ctacatacgcttgatggtgcttagag

SEQ ID NO: 145980 - DNA, 26 bp, Artificial sequence
  SiRNA target sequence
tacatacgcttgatggtgcttagagt

SEQ ID NO: 145981 - DNA, 26 bp, Artificial sequence
  SiRNA target sequence
acatacgcttgatggtgcttagagtg

SEQ ID NO: 145982 - DNA, 26 bp, Artificial sequence
  SiRNA target sequence
catacgcttgatggtgcttagagtgg

SEQ ID NO: 145983 - DNA, 26 bp, Artificial sequence
  SiRNA target sequence
atacgcttgatggtgcttagagtggt

SEQ ID NO: 145984 - DNA, 26 bp, Artificial sequence
  SiRNA target sequence
tacgcttgatggtgcttagagtggtg

SEQ ID NO: 145985 - DNA, 26 bp, Artificial sequence
  SiRNA target sequence
acgcttgatggtgcttagagtggtgg

SEQ ID NO: 145986 - DNA, 26 bp, Artificial sequence
  SiRNA target sequence
cgcttgatggtgcttagagtggtggg

SEQ ID NO: 145987 - DNA, 26 bp, Artificial sequence
  SiRNA target sequence
gcttgatggtgcttagagtggtgggt

SEQ ID NO: 145988 - DNA, 26 bp, Artificial sequence
  SiRNA target sequence
cttgatggtgcttagagtggtgggtc

SEQ ID NO: 145989 - DNA, 26 bp, Artificial sequence
  SiRNA target sequence
ttgatggtgcttagagtggtgggtct

SEQ ID NO: 145990 - DNA, 26 bp, Artificial sequence
  SiRNA target sequence
tgatggtgcttagagtggtgggtctc

SEQ ID NO: 145991 - DNA, 26 bp, Artificial sequence
  SiRNA target sequence
gatggtgcttagagtggtgggtctcc

SEQ ID NO: 145992 - DNA, 26 bp, Artificial sequence
  SiRNA target sequence
atggtgcttagagtggtgggtctcca

SEQ ID NO: 145993 - DNA, 26 bp, Artificial sequence
  SiRNA target sequence
tggtgcttagagtggtgggtctccat

SEQ ID NO: 145994 - DNA, 26 bp, Artificial sequence
  SiRNA target sequence
ggtgcttagagtggtgggtctccatt

SEQ ID NO: 145995 - DNA, 26 bp, Artificial sequence
  SiRNA target sequence
gtgcttagagtggtgggtctccatta

SEQ ID NO: 145996 - DNA, 26 bp, Artificial sequence
  SiRNA target sequence
tgcttagagtggtgggtctccattat

SEQ ID NO: 145997 - DNA, 26 bp, Artificial sequence
  SiRNA target sequence
gcttagagtggtgggtctccattata

SEQ ID NO: 145998 - DNA, 26 bp, Artificial sequence
  SiRNA target sequence
cttagagtggtgggtctccattatat

SEQ ID NO: 145999 - DNA, 26 bp, Artificial sequence
  SiRNA target sequence
ttagagtggtgggtctccattatatc

SEQ ID NO: 146000 - DNA, 26 bp, Artificial sequence
  SiRNA target sequence
tagagtggtgggtctccattatatct

SEQ ID NO: 146001 - DNA, 26 bp, Artificial sequence
  SiRNA target sequence
agagtggtgggtctccattatatctt

SEQ ID NO: 146002 - DNA, 26 bp, Artificial sequence
  SiRNA target sequence
gagtggtgggtctccattatatcttc

SEQ ID NO: 146003 - DNA, 26 bp, Artificial sequence
  SiRNA target sequence
agtggtgggtctccattatatcttca

SEQ ID NO: 146004 - DNA, 26 bp, Artificial sequence
  SiRNA target sequence
gtggtgggtctccattatatcttcac

SEQ ID NO: 146005 - DNA, 26 bp, Artificial sequence
  SiRNA target sequence
tggtgggtctccattatatcttcact

SEQ ID NO: 146006 - DNA, 26 bp, Artificial sequence
  SiRNA target sequence
ggtgggtctccattatatcttcactt

SEQ ID NO: 146007 - DNA, 26 bp, Artificial sequence
  SiRNA target sequence
gtgggtctccattatatcttcactta

SEQ ID NO: 146008 - DNA, 26 bp, Artificial sequence
  SiRNA target sequence
tgggtctccattatatcttcacttat

SEQ ID NO: 146009 - DNA, 26 bp, Artificial sequence
  SiRNA target sequence
gggtctccattatatcttcacttata

SEQ ID NO: 146010 - DNA, 26 bp, Artificial sequence
  SiRNA target sequence
ggtctccattatatcttcacttatat

SEQ ID NO: 146011 - DNA, 26 bp, Artificial sequence
  SiRNA target sequence
gtctccattatatcttcacttatata

SEQ ID NO: 146012 - DNA, 26 bp, Artificial sequence
  SiRNA target sequence
tctccattatatcttcacttatataa

SEQ ID NO: 146013 - DNA, 26 bp, Artificial sequence
  SiRNA target sequence
ctccattatatcttcacttatataag

SEQ ID NO: 146014 - DNA, 26 bp, Artificial sequence
  SiRNA target sequence
tccattatatcttcacttatataagg

SEQ ID NO: 146015 - DNA, 26 bp, Artificial sequence
  SiRNA target sequence
ccattatatcttcacttatataaggc

SEQ ID NO: 146016 - DNA, 26 bp, Artificial sequence
  SiRNA target sequence
cattatatcttcacttatataaggct

SEQ ID NO: 146017 - DNA, 26 bp, Artificial sequence
  SiRNA target sequence
attatatcttcacttatataaggctc

SEQ ID NO: 146018 - DNA, 26 bp, Artificial sequence
  SiRNA target sequence
ttatatcttcacttatataaggctct

SEQ ID NO: 146019 - DNA, 26 bp, Artificial sequence
  SiRNA target sequence
tatatcttcacttatataaggctcta

SEQ ID NO: 146020 - DNA, 26 bp, Artificial sequence
  SiRNA target sequence
atatcttcacttatataaggctctag

SEQ ID NO: 146021 - DNA, 26 bp, Artificial sequence
  SiRNA target sequence
tatcttcacttatataaggctctaga

SEQ ID NO: 146022 - DNA, 26 bp, Artificial sequence
  SiRNA target sequence
atcttcacttatataaggctctagag

SEQ ID NO: 146023 - DNA, 26 bp, Artificial sequence
  SiRNA target sequence
tcttcacttatataaggctctagaga

SEQ ID NO: 146024 - DNA, 26 bp, Artificial sequence
  SiRNA target sequence
cttcacttatataaggctctagagat

SEQ ID NO: 146025 - DNA, 26 bp, Artificial sequence
  SiRNA target sequence
ttcacttatataaggctctagagatt

SEQ ID NO: 146026 - DNA, 26 bp, Artificial sequence
  SiRNA target sequence
tcacttatataaggctctagagattt

SEQ ID NO: 146027 - DNA, 26 bp, Artificial sequence
  SiRNA target sequence
cacttatataaggctctagagattta

SEQ ID NO: 146028 - DNA, 26 bp, Artificial sequence
  SiRNA target sequence
acttatataaggctctagagatttat

SEQ ID NO: 146029 - DNA, 26 bp, Artificial sequence
  SiRNA target sequence
cttatataaggctctagagatttata

SEQ ID NO: 146030 - DNA, 26 bp, Artificial sequence
  SiRNA target sequence
ttatataaggctctagagatttataa

SEQ ID NO: 146031 - DNA, 26 bp, Artificial sequence
  SiRNA target sequence
tatataaggctctagagatttataac

SEQ ID NO: 146032 - DNA, 26 bp, Artificial sequence
  SiRNA target sequence
atataaggctctagagatttataact

SEQ ID NO: 146033 - DNA, 26 bp, Artificial sequence
  SiRNA target sequence
tataaggctctagagatttataacta

SEQ ID NO: 146034 - DNA, 26 bp, Artificial sequence
  SiRNA target sequence
ataaggctctagagatttataactat

SEQ ID NO: 146035 - DNA, 26 bp, Artificial sequence
  SiRNA target sequence
taaggctctagagatttataactata

SEQ ID NO: 146036 - DNA, 26 bp, Artificial sequence
  SiRNA target sequence
aaggctctagagatttataactatat

SEQ ID NO: 146037 - DNA, 26 bp, Artificial sequence
  SiRNA target sequence
aggctctagagatttataactatatt

SEQ ID NO: 146038 - DNA, 26 bp, Artificial sequence
  SiRNA target sequence
ggctctagagatttataactatattt

SEQ ID NO: 146039 - DNA, 26 bp, Artificial sequence
  SiRNA target sequence
gctctagagatttataactatatttc

SEQ ID NO: 146040 - DNA, 26 bp, Artificial sequence
  SiRNA target sequence
ctctagagatttataactatatttca

SEQ ID NO: 146041 - DNA, 26 bp, Artificial sequence
  SiRNA target sequence
tctagagatttataactatatttcag

SEQ ID NO: 146042 - DNA, 26 bp, Artificial sequence
  SiRNA target sequence
ctagagatttataactatatttcaga

SEQ ID NO: 146043 - DNA, 26 bp, Artificial sequence
  SiRNA target sequence
tagagatttataactatatttcagat

SEQ ID NO: 146044 - DNA, 26 bp, Artificial sequence
  SiRNA target sequence
agagatttataactatatttcagatt

SEQ ID NO: 146045 - DNA, 26 bp, Artificial sequence
  SiRNA target sequence
gagatttataactatatttcagattt

SEQ ID NO: 146046 - DNA, 26 bp, Artificial sequence
  SiRNA target sequence
agatttataactatatttcagatttg

SEQ ID NO: 146047 - DNA, 26 bp, Artificial sequence
  SiRNA target sequence
gatttataactatatttcagatttgg

SEQ ID NO: 146048 - DNA, 26 bp, Artificial sequence
  SiRNA target sequence
atttataactatatttcagatttgga

SEQ ID NO: 146049 - DNA, 26 bp, Artificial sequence
  SiRNA target sequence
tttataactatatttcagatttggaa

SEQ ID NO: 146050 - DNA, 26 bp, Artificial sequence
  SiRNA target sequence
ttataactatatttcagatttggaag

SEQ ID NO: 146051 - DNA, 26 bp, Artificial sequence
  SiRNA target sequence
tataactatatttcagatttggaaga

SEQ ID NO: 146052 - DNA, 26 bp, Artificial sequence
  SiRNA target sequence
ataactatatttcagatttggaagag

SEQ ID NO: 146053 - DNA, 26 bp, Artificial sequence
  SiRNA target sequence
taactatatttcagatttggaagagt

SEQ ID NO: 146054 - DNA, 26 bp, Artificial sequence
  SiRNA target sequence
aactatatttcagatttggaagagtg

SEQ ID NO: 146055 - DNA, 26 bp, Artificial sequence
  SiRNA target sequence
actatatttcagatttggaagagtga

SEQ ID NO: 146056 - DNA, 26 bp, Artificial sequence
  SiRNA target sequence
ctatatttcagatttggaagagtgaa

SEQ ID NO: 146057 - DNA, 26 bp, Artificial sequence
  SiRNA target sequence
tatatttcagatttggaagagtgaac

SEQ ID NO: 146058 - DNA, 26 bp, Artificial sequence
  SiRNA target sequence
atatttcagatttggaagagtgaaca

SEQ ID NO: 146059 - DNA, 26 bp, Artificial sequence
  SiRNA target sequence
tatttcagatttggaagagtgaacat

SEQ ID NO: 146060 - DNA, 27 bp, Artificial sequence
  SiRNA target sequence
ttaatttatgcataattgaccatcatc

SEQ ID NO: 146061 - DNA, 27 bp, Artificial sequence
  SiRNA target sequence
taatttatgcataattgaccatcatca

SEQ ID NO: 146062 - DNA, 27 bp, Artificial sequence
  SiRNA target sequence
aatttatgcataattgaccatcatcag

SEQ ID NO: 146063 - DNA, 27 bp, Artificial sequence
  SiRNA target sequence
atttatgcataattgaccatcatcagt

SEQ ID NO: 146064 - DNA, 27 bp, Artificial sequence
  SiRNA target sequence
tttatgcataattgaccatcatcagta

SEQ ID NO: 146065 - DNA, 27 bp, Artificial sequence
  SiRNA target sequence
ttatgcataattgaccatcatcagtaa

SEQ ID NO: 146066 - DNA, 27 bp, Artificial sequence
  SiRNA target sequence
tatgcataattgaccatcatcagtaat

SEQ ID NO: 146067 - DNA, 27 bp, Artificial sequence
  SiRNA target sequence
atgcataattgaccatcatcagtaata

SEQ ID NO: 146068 - DNA, 27 bp, Artificial sequence
  SiRNA target sequence
tgcataattgaccatcatcagtaataa

SEQ ID NO: 146069 - DNA, 27 bp, Artificial sequence
  SiRNA target sequence
gcataattgaccatcatcagtaataaa

SEQ ID NO: 146070 - DNA, 27 bp, Artificial sequence
  SiRNA target sequence
cataattgaccatcatcagtaataaac

SEQ ID NO: 146071 - DNA, 27 bp, Artificial sequence
  SiRNA target sequence
ataattgaccatcatcagtaataaaca

SEQ ID NO: 146072 - DNA, 27 bp, Artificial sequence
  SiRNA target sequence
taattgaccatcatcagtaataaacac

SEQ ID NO: 146073 - DNA, 27 bp, Artificial sequence
  SiRNA target sequence
aattgaccatcatcagtaataaacaca

SEQ ID NO: 146074 - DNA, 27 bp, Artificial sequence
  SiRNA target sequence
attgaccatcatcagtaataaacacat

SEQ ID NO: 146075 - DNA, 27 bp, Artificial sequence
  SiRNA target sequence
ttgaccatcatcagtaataaacacatt

SEQ ID NO: 146076 - DNA, 27 bp, Artificial sequence
  SiRNA target sequence
tgaccatcatcagtaataaacacatta

SEQ ID NO: 146077 - DNA, 27 bp, Artificial sequence
  SiRNA target sequence
gaccatcatcagtaataaacacattac

SEQ ID NO: 146078 - DNA, 27 bp, Artificial sequence
  SiRNA target sequence
accatcatcagtaataaacacattacc

SEQ ID NO: 146079 - DNA, 27 bp, Artificial sequence
  SiRNA target sequence
ccatcatcagtaataaacacattacct

SEQ ID NO: 146080 - DNA, 27 bp, Artificial sequence
  SiRNA target sequence
catcatcagtaataaacacattacctt

SEQ ID NO: 146081 - DNA, 27 bp, Artificial sequence
  SiRNA target sequence
atcatcagtaataaacacattaccttt

SEQ ID NO: 146082 - DNA, 27 bp, Artificial sequence
  SiRNA target sequence
tcatcagtaataaacacattacctttc

SEQ ID NO: 146083 - DNA, 27 bp, Artificial sequence
  SiRNA target sequence
catcagtaataaacacattacctttct

SEQ ID NO: 146084 - DNA, 27 bp, Artificial sequence
  SiRNA target sequence
atcagtaataaacacattacctttctt

SEQ ID NO: 146085 - DNA, 27 bp, Artificial sequence
  SiRNA target sequence
tcagtaataaacacattacctttcttt

SEQ ID NO: 146086 - DNA, 27 bp, Artificial sequence
  SiRNA target sequence
cagtaataaacacattacctttctttt

SEQ ID NO: 146087 - DNA, 27 bp, Artificial sequence
  SiRNA target sequence
agtaataaacacattacctttcttttc

SEQ ID NO: 146088 - DNA, 27 bp, Artificial sequence
  SiRNA target sequence
gtaataaacacattacctttcttttct

SEQ ID NO: 146089 - DNA, 27 bp, Artificial sequence
  SiRNA target sequence
taataaacacattacctttcttttcta

SEQ ID NO: 146090 - DNA, 27 bp, Artificial sequence
  SiRNA target sequence
aataaacacattacctttcttttctac

SEQ ID NO: 146091 - DNA, 27 bp, Artificial sequence
  SiRNA target sequence
ataaacacattacctttcttttctacc

SEQ ID NO: 146092 - DNA, 27 bp, Artificial sequence
  SiRNA target sequence
taaacacattacctttcttttctacca

SEQ ID NO: 146093 - DNA, 27 bp, Artificial sequence
  SiRNA target sequence
aaacacattacctttcttttctaccac

SEQ ID NO: 146094 - DNA, 27 bp, Artificial sequence
  SiRNA target sequence
aacacattacctttcttttctaccaca

SEQ ID NO: 146095 - DNA, 27 bp, Artificial sequence
  SiRNA target sequence
acacattacctttcttttctaccacac

SEQ ID NO: 146096 - DNA, 27 bp, Artificial sequence
  SiRNA target sequence
cacattacctttcttttctaccacaca

SEQ ID NO: 146097 - DNA, 27 bp, Artificial sequence
  SiRNA target sequence
acattacctttcttttctaccacacat

SEQ ID NO: 146098 - DNA, 27 bp, Artificial sequence
  SiRNA target sequence
cattacctttcttttctaccacacatt

SEQ ID NO: 146099 - DNA, 27 bp, Artificial sequence
  SiRNA target sequence
attacctttcttttctaccacacattt

SEQ ID NO: 146100 - DNA, 27 bp, Artificial sequence
  SiRNA target sequence
ttacctttcttttctaccacacatttt

SEQ ID NO: 146101 - DNA, 27 bp, Artificial sequence
  SiRNA target sequence
tacctttcttttctaccacacattttt

SEQ ID NO: 146102 - DNA, 27 bp, Artificial sequence
  SiRNA target sequence
acctttcttttctaccacacatttttg

SEQ ID NO: 146103 - DNA, 27 bp, Artificial sequence
  SiRNA target sequence
cctttcttttctaccacacatttttga

SEQ ID NO: 146104 - DNA, 27 bp, Artificial sequence
  SiRNA target sequence
ctttcttttctaccacacatttttgat

SEQ ID NO: 146105 - DNA, 27 bp, Artificial sequence
  SiRNA target sequence
tttcttttctaccacacatttttgata

SEQ ID NO: 146106 - DNA, 27 bp, Artificial sequence
  SiRNA target sequence
ttcttttctaccacacatttttgatat

SEQ ID NO: 146107 - DNA, 27 bp, Artificial sequence
  SiRNA target sequence
tcttttctaccacacatttttgatata

SEQ ID NO: 146108 - DNA, 27 bp, Artificial sequence
  SiRNA target sequence
cttttctaccacacatttttgatatat

SEQ ID NO: 146109 - DNA, 27 bp, Artificial sequence
  SiRNA target sequence
ttttctaccacacatttttgatatatt

SEQ ID NO: 146110 - DNA, 27 bp, Artificial sequence
  SiRNA target sequence
tttctaccacacatttttgatatattt

SEQ ID NO: 146111 - DNA, 27 bp, Artificial sequence
  SiRNA target sequence
ttctaccacacatttttgatatatttc

SEQ ID NO: 146112 - DNA, 27 bp, Artificial sequence
  SiRNA target sequence
tctaccacacatttttgatatatttca

SEQ ID NO: 146113 - DNA, 27 bp, Artificial sequence
  SiRNA target sequence
ctaccacacatttttgatatatttcat

SEQ ID NO: 146114 - DNA, 27 bp, Artificial sequence
  SiRNA target sequence
taccacacatttttgatatatttcatt

SEQ ID NO: 146115 - DNA, 27 bp, Artificial sequence
  SiRNA target sequence
accacacatttttgatatatttcatta

SEQ ID NO: 146116 - DNA, 27 bp, Artificial sequence
  SiRNA target sequence
ccacacatttttgatatatttcattaa

SEQ ID NO: 146117 - DNA, 27 bp, Artificial sequence
  SiRNA target sequence
cacacatttttgatatatttcattaac

SEQ ID NO: 146118 - DNA, 27 bp, Artificial sequence
  SiRNA target sequence
acacatttttgatatatttcattaact

SEQ ID NO: 146119 - DNA, 27 bp, Artificial sequence
  SiRNA target sequence
cacatttttgatatatttcattaacta

SEQ ID NO: 146120 - DNA, 27 bp, Artificial sequence
  SiRNA target sequence
acatttttgatatatttcattaactac

SEQ ID NO: 146121 - DNA, 27 bp, Artificial sequence
  SiRNA target sequence
catttttgatatatttcattaactaca

SEQ ID NO: 146122 - DNA, 27 bp, Artificial sequence
  SiRNA target sequence
atttttgatatatttcattaactacat

SEQ ID NO: 146123 - DNA, 27 bp, Artificial sequence
  SiRNA target sequence
tttttgatatatttcattaactacatc

SEQ ID NO: 146124 - DNA, 27 bp, Artificial sequence
  SiRNA target sequence
ttttgatatatttcattaactacatcc

SEQ ID NO: 146125 - DNA, 27 bp, Artificial sequence
  SiRNA target sequence
tttgatatatttcattaactacatccc

SEQ ID NO: 146126 - DNA, 27 bp, Artificial sequence
  SiRNA target sequence
ttgatatatttcattaactacatccca

SEQ ID NO: 146127 - DNA, 27 bp, Artificial sequence
  SiRNA target sequence
tgatatatttcattaactacatcccaa

SEQ ID NO: 146128 - DNA, 27 bp, Artificial sequence
  SiRNA target sequence
gatatatttcattaactacatcccaat

SEQ ID NO: 146129 - DNA, 27 bp, Artificial sequence
  SiRNA target sequence
atatatttcattaactacatcccaatc

SEQ ID NO: 146130 - DNA, 27 bp, Artificial sequence
  SiRNA target sequence
tatatttcattaactacatcccaatca

SEQ ID NO: 146131 - DNA, 27 bp, Artificial sequence
  SiRNA target sequence
atatttcattaactacatcccaatcaa

SEQ ID NO: 146132 - DNA, 27 bp, Artificial sequence
  SiRNA target sequence
tatttcattaactacatcccaatcaat

SEQ ID NO: 146133 - DNA, 27 bp, Artificial sequence
  SiRNA target sequence
atttcattaactacatcccaatcaatt

SEQ ID NO: 146134 - DNA, 27 bp, Artificial sequence
  SiRNA target sequence
tttcattaactacatcccaatcaatta

SEQ ID NO: 146135 - DNA, 27 bp, Artificial sequence
  SiRNA target sequence
ttcattaactacatcccaatcaattac

SEQ ID NO: 146136 - DNA, 27 bp, Artificial sequence
  SiRNA target sequence
tcattaactacatcccaatcaattaca

SEQ ID NO: 146137 - DNA, 27 bp, Artificial sequence
  SiRNA target sequence
cattaactacatcccaatcaattacat

SEQ ID NO: 146138 - DNA, 27 bp, Artificial sequence
  SiRNA target sequence
attaactacatcccaatcaattacatt

SEQ ID NO: 146139 - DNA, 27 bp, Artificial sequence
  SiRNA target sequence
ttaactacatcccaatcaattacattc

SEQ ID NO: 146140 - DNA, 27 bp, Artificial sequence
  SiRNA target sequence
taactacatcccaatcaattacattcc

SEQ ID NO: 146141 - DNA, 27 bp, Artificial sequence
  SiRNA target sequence
aactacatcccaatcaattacattcca

SEQ ID NO: 146142 - DNA, 27 bp, Artificial sequence
  SiRNA target sequence
actacatcccaatcaattacattccac

SEQ ID NO: 146143 - DNA, 27 bp, Artificial sequence
  SiRNA target sequence
ctacatcccaatcaattacattccacc

SEQ ID NO: 146144 - DNA, 27 bp, Artificial sequence
  SiRNA target sequence
tacatcccaatcaattacattccacca

SEQ ID NO: 146145 - DNA, 27 bp, Artificial sequence
  SiRNA target sequence
acatcccaatcaattacattccaccat

SEQ ID NO: 146146 - DNA, 27 bp, Artificial sequence
  SiRNA target sequence
catcccaatcaattacattccaccatt

SEQ ID NO: 146147 - DNA, 27 bp, Artificial sequence
  SiRNA target sequence
atcccaatcaattacattccaccattc

SEQ ID NO: 146148 - DNA, 27 bp, Artificial sequence
  SiRNA target sequence
tcccaatcaattacattccaccattca

SEQ ID NO: 146149 - DNA, 27 bp, Artificial sequence
  SiRNA target sequence
cccaatcaattacattccaccattcat

SEQ ID NO: 146150 - DNA, 27 bp, Artificial sequence
  SiRNA target sequence
ccaatcaattacattccaccattcatt

SEQ ID NO: 146151 - DNA, 27 bp, Artificial sequence
  SiRNA target sequence
caatcaattacattccaccattcatta

SEQ ID NO: 146152 - DNA, 27 bp, Artificial sequence
  SiRNA target sequence
aatcaattacattccaccattcattaa

SEQ ID NO: 146153 - DNA, 27 bp, Artificial sequence
  SiRNA target sequence
atcaattacattccaccattcattaat

SEQ ID NO: 146154 - DNA, 27 bp, Artificial sequence
  SiRNA target sequence
tcaattacattccaccattcattaatg

SEQ ID NO: 146155 - DNA, 27 bp, Artificial sequence
  SiRNA target sequence
caattacattccaccattcattaatgt

SEQ ID NO: 146156 - DNA, 27 bp, Artificial sequence
  SiRNA target sequence
aattacattccaccattcattaatgta

SEQ ID NO: 146157 - DNA, 27 bp, Artificial sequence
  SiRNA target sequence
attacattccaccattcattaatgtat

SEQ ID NO: 146158 - DNA, 27 bp, Artificial sequence
  SiRNA target sequence
ttacattccaccattcattaatgtatt

SEQ ID NO: 146159 - DNA, 27 bp, Artificial sequence
  SiRNA target sequence
tacattccaccattcattaatgtattc

SEQ ID NO: 146160 - DNA, 27 bp, Artificial sequence
  SiRNA target sequence
acattccaccattcattaatgtattct

SEQ ID NO: 146161 - DNA, 27 bp, Artificial sequence
  SiRNA target sequence
cattccaccattcattaatgtattctt

SEQ ID NO: 146162 - DNA, 27 bp, Artificial sequence
  SiRNA target sequence
attccaccattcattaatgtattcttt

SEQ ID NO: 146163 - DNA, 27 bp, Artificial sequence
  SiRNA target sequence
ttccaccattcattaatgtattctttt

SEQ ID NO: 146164 - DNA, 27 bp, Artificial sequence
  SiRNA target sequence
tccaccattcattaatgtattcttttc

SEQ ID NO: 146165 - DNA, 27 bp, Artificial sequence
  SiRNA target sequence
ccaccattcattaatgtattcttttct

SEQ ID NO: 146166 - DNA, 27 bp, Artificial sequence
  SiRNA target sequence
caccattcattaatgtattcttttctc

SEQ ID NO: 146167 - DNA, 27 bp, Artificial sequence
  SiRNA target sequence
accattcattaatgtattcttttctcc

SEQ ID NO: 146168 - DNA, 27 bp, Artificial sequence
  SiRNA target sequence
ccattcattaatgtattcttttctcct

SEQ ID NO: 146169 - DNA, 27 bp, Artificial sequence
  SiRNA target sequence
cattcattaatgtattcttttctccta

SEQ ID NO: 146170 - DNA, 27 bp, Artificial sequence
  SiRNA target sequence
attcattaatgtattcttttctcctat

SEQ ID NO: 146171 - DNA, 27 bp, Artificial sequence
  SiRNA target sequence
ttcattaatgtattcttttctcctatt

SEQ ID NO: 146172 - DNA, 27 bp, Artificial sequence
  SiRNA target sequence
tcattaatgtattcttttctcctattt

SEQ ID NO: 146173 - DNA, 27 bp, Artificial sequence
  SiRNA target sequence
cattaatgtattcttttctcctatttt

SEQ ID NO: 146174 - DNA, 27 bp, Artificial sequence
  SiRNA target sequence
attaatgtattcttttctcctattttt

SEQ ID NO: 146175 - DNA, 27 bp, Artificial sequence
  SiRNA target sequence
ttaatgtattcttttctcctattttta

SEQ ID NO: 146176 - DNA, 27 bp, Artificial sequence
  SiRNA target sequence
taatgtattcttttctcctatttttat

SEQ ID NO: 146177 - DNA, 27 bp, Artificial sequence
  SiRNA target sequence
aatgtattcttttctcctatttttata

SEQ ID NO: 146178 - DNA, 27 bp, Artificial sequence
  SiRNA target sequence
atgtattcttttctcctatttttatac

SEQ ID NO: 146179 - DNA, 27 bp, Artificial sequence
  SiRNA target sequence
tgtattcttttctcctatttttatact

SEQ ID NO: 146180 - DNA, 27 bp, Artificial sequence
  SiRNA target sequence
gtattcttttctcctatttttatactg

SEQ ID NO: 146181 - DNA, 27 bp, Artificial sequence
  SiRNA target sequence
tattcttttctcctatttttatactgt

SEQ ID NO: 146182 - DNA, 27 bp, Artificial sequence
  SiRNA target sequence
attcttttctcctatttttatactgta

SEQ ID NO: 146183 - DNA, 27 bp, Artificial sequence
  SiRNA target sequence
ttcttttctcctatttttatactgtaa

SEQ ID NO: 146184 - DNA, 27 bp, Artificial sequence
  SiRNA target sequence
tcttttctcctatttttatactgtaaa

SEQ ID NO: 146185 - DNA, 27 bp, Artificial sequence
  SiRNA target sequence
cttttctcctatttttatactgtaaat

SEQ ID NO: 146186 - DNA, 27 bp, Artificial sequence
  SiRNA target sequence
ttttctcctatttttatactgtaaata

SEQ ID NO: 146187 - DNA, 27 bp, Artificial sequence
  SiRNA target sequence
tttctcctatttttatactgtaaataa

SEQ ID NO: 146188 - DNA, 27 bp, Artificial sequence
  SiRNA target sequence
ttctcctatttttatactgtaaataat

SEQ ID NO: 146189 - DNA, 27 bp, Artificial sequence
  SiRNA target sequence
tctcctatttttatactgtaaataata

SEQ ID NO: 146190 - DNA, 27 bp, Artificial sequence
  SiRNA target sequence
ctcctatttttatactgtaaataatac

SEQ ID NO: 146191 - DNA, 27 bp, Artificial sequence
  SiRNA target sequence
tcctatttttatactgtaaataatacg

SEQ ID NO: 146192 - DNA, 27 bp, Artificial sequence
  SiRNA target sequence
cctatttttatactgtaaataatacgc

SEQ ID NO: 146193 - DNA, 27 bp, Artificial sequence
  SiRNA target sequence
ctatttttatactgtaaataatacgca

SEQ ID NO: 146194 - DNA, 27 bp, Artificial sequence
  SiRNA target sequence
tatttttatactgtaaataatacgcat

SEQ ID NO: 146195 - DNA, 27 bp, Artificial sequence
  SiRNA target sequence
atttttatactgtaaataatacgcatg

SEQ ID NO: 146196 - DNA, 27 bp, Artificial sequence
  SiRNA target sequence
tttttatactgtaaataatacgcatgt

SEQ ID NO: 146197 - DNA, 27 bp, Artificial sequence
  SiRNA target sequence
ttttatactgtaaataatacgcatgtt

SEQ ID NO: 146198 - DNA, 27 bp, Artificial sequence
  SiRNA target sequence
tttatactgtaaataatacgcatgttc

SEQ ID NO: 146199 - DNA, 27 bp, Artificial sequence
  SiRNA target sequence
ttatactgtaaataatacgcatgttcc

SEQ ID NO: 146200 - DNA, 27 bp, Artificial sequence
  SiRNA target sequence
tatactgtaaataatacgcatgttccc

SEQ ID NO: 146201 - DNA, 27 bp, Artificial sequence
  SiRNA target sequence
atactgtaaataatacgcatgttccca

SEQ ID NO: 146202 - DNA, 27 bp, Artificial sequence
  SiRNA target sequence
tactgtaaataatacgcatgttcccat

SEQ ID NO: 146203 - DNA, 27 bp, Artificial sequence
  SiRNA target sequence
actgtaaataatacgcatgttcccata

SEQ ID NO: 146204 - DNA, 27 bp, Artificial sequence
  SiRNA target sequence
ctgtaaataatacgcatgttcccatac

SEQ ID NO: 146205 - DNA, 27 bp, Artificial sequence
  SiRNA target sequence
tgtaaataatacgcatgttcccataca

SEQ ID NO: 146206 - DNA, 27 bp, Artificial sequence
  SiRNA target sequence
gtaaataatacgcatgttcccatacat

SEQ ID NO: 146207 - DNA, 27 bp, Artificial sequence
  SiRNA target sequence
taaataatacgcatgttcccatacatc

SEQ ID NO: 146208 - DNA, 27 bp, Artificial sequence
  SiRNA target sequence
aaataatacgcatgttcccatacatca

SEQ ID NO: 146209 - DNA, 27 bp, Artificial sequence
  SiRNA target sequence
aataatacgcatgttcccatacatcaa

SEQ ID NO: 146210 - DNA, 27 bp, Artificial sequence
  SiRNA target sequence
ataatacgcatgttcccatacatcaag

SEQ ID NO: 146211 - DNA, 27 bp, Artificial sequence
  SiRNA target sequence
taatacgcatgttcccatacatcaaga

SEQ ID NO: 146212 - DNA, 27 bp, Artificial sequence
  SiRNA target sequence
aatacgcatgttcccatacatcaagac

SEQ ID NO: 146213 - DNA, 27 bp, Artificial sequence
  SiRNA target sequence
atacgcatgttcccatacatcaagaca

SEQ ID NO: 146214 - DNA, 27 bp, Artificial sequence
  SiRNA target sequence
tacgcatgttcccatacatcaagacat

SEQ ID NO: 146215 - DNA, 27 bp, Artificial sequence
  SiRNA target sequence
acgcatgttcccatacatcaagacata

SEQ ID NO: 146216 - DNA, 27 bp, Artificial sequence
  SiRNA target sequence
cgcatgttcccatacatcaagacatag

SEQ ID NO: 146217 - DNA, 27 bp, Artificial sequence
  SiRNA target sequence
gcatgttcccatacatcaagacatagt

SEQ ID NO: 146218 - DNA, 27 bp, Artificial sequence
  SiRNA target sequence
catgttcccatacatcaagacatagta

SEQ ID NO: 146219 - DNA, 27 bp, Artificial sequence
  SiRNA target sequence
atgttcccatacatcaagacatagtaa

SEQ ID NO: 146220 - DNA, 27 bp, Artificial sequence
  SiRNA target sequence
tgttcccatacatcaagacatagtaaa

SEQ ID NO: 146221 - DNA, 27 bp, Artificial sequence
  SiRNA target sequence
gttcccatacatcaagacatagtaaag

SEQ ID NO: 146222 - DNA, 27 bp, Artificial sequence
  SiRNA target sequence
ttcccatacatcaagacatagtaaagg

SEQ ID NO: 146223 - DNA, 27 bp, Artificial sequence
  SiRNA target sequence
tcccatacatcaagacatagtaaagga

SEQ ID NO: 146224 - DNA, 27 bp, Artificial sequence
  SiRNA target sequence
cccatacatcaagacatagtaaaggaa

SEQ ID NO: 146225 - DNA, 27 bp, Artificial sequence
  SiRNA target sequence
ccatacatcaagacatagtaaaggaat

SEQ ID NO: 146226 - DNA, 27 bp, Artificial sequence
  SiRNA target sequence
catacatcaagacatagtaaaggaata

SEQ ID NO: 146227 - DNA, 27 bp, Artificial sequence
  SiRNA target sequence
atacatcaagacatagtaaaggaatac

SEQ ID NO: 146228 - DNA, 27 bp, Artificial sequence
  SiRNA target sequence
tacatcaagacatagtaaaggaataca

SEQ ID NO: 146229 - DNA, 27 bp, Artificial sequence
  SiRNA target sequence
acatcaagacatagtaaaggaatacat

SEQ ID NO: 146230 - DNA, 27 bp, Artificial sequence
  SiRNA target sequence
catcaagacatagtaaaggaatacatt

SEQ ID NO: 146231 - DNA, 27 bp, Artificial sequence
  SiRNA target sequence
atcaagacatagtaaaggaatacattc

SEQ ID NO: 146232 - DNA, 27 bp, Artificial sequence
  SiRNA target sequence
tcaagacatagtaaaggaatacattca

SEQ ID NO: 146233 - DNA, 27 bp, Artificial sequence
  SiRNA target sequence
caagacatagtaaaggaatacattcac

SEQ ID NO: 146234 - DNA, 27 bp, Artificial sequence
  SiRNA target sequence
aagacatagtaaaggaatacattcacc

SEQ ID NO: 146235 - DNA, 27 bp, Artificial sequence
  SiRNA target sequence
agacatagtaaaggaatacattcacca

SEQ ID NO: 146236 - DNA, 27 bp, Artificial sequence
  SiRNA target sequence
gacatagtaaaggaatacattcaccat

SEQ ID NO: 146237 - DNA, 27 bp, Artificial sequence
  SiRNA target sequence
acatagtaaaggaatacattcaccatc

SEQ ID NO: 146238 - DNA, 27 bp, Artificial sequence
  SiRNA target sequence
catagtaaaggaatacattcaccatcc

SEQ ID NO: 146239 - DNA, 27 bp, Artificial sequence
  SiRNA target sequence
atagtaaaggaatacattcaccatcct

SEQ ID NO: 146240 - DNA, 27 bp, Artificial sequence
  SiRNA target sequence
tagtaaaggaatacattcaccatcctc

SEQ ID NO: 146241 - DNA, 27 bp, Artificial sequence
  SiRNA target sequence
agtaaaggaatacattcaccatcctcc

SEQ ID NO: 146242 - DNA, 27 bp, Artificial sequence
  SiRNA target sequence
gtaaaggaatacattcaccatcctcca

SEQ ID NO: 146243 - DNA, 27 bp, Artificial sequence
  SiRNA target sequence
taaaggaatacattcaccatcctccat

SEQ ID NO: 146244 - DNA, 27 bp, Artificial sequence
  SiRNA target sequence
aaaggaatacattcaccatcctccatc

SEQ ID NO: 146245 - DNA, 27 bp, Artificial sequence
  SiRNA target sequence
aaggaatacattcaccatcctccatca

SEQ ID NO: 146246 - DNA, 27 bp, Artificial sequence
  SiRNA target sequence
aggaatacattcaccatcctccatcat

SEQ ID NO: 146247 - DNA, 27 bp, Artificial sequence
  SiRNA target sequence
ggaatacattcaccatcctccatcata

SEQ ID NO: 146248 - DNA, 27 bp, Artificial sequence
  SiRNA target sequence
gaatacattcaccatcctccatcatag

SEQ ID NO: 146249 - DNA, 27 bp, Artificial sequence
  SiRNA target sequence
aatacattcaccatcctccatcatagg

SEQ ID NO: 146250 - DNA, 27 bp, Artificial sequence
  SiRNA target sequence
atacattcaccatcctccatcatagga

SEQ ID NO: 146251 - DNA, 27 bp, Artificial sequence
  SiRNA target sequence
tacattcaccatcctccatcataggat

SEQ ID NO: 146252 - DNA, 27 bp, Artificial sequence
  SiRNA target sequence
acattcaccatcctccatcataggatt

SEQ ID NO: 146253 - DNA, 27 bp, Artificial sequence
  SiRNA target sequence
cattcaccatcctccatcataggattg

SEQ ID NO: 146254 - DNA, 27 bp, Artificial sequence
  SiRNA target sequence
attcaccatcctccatcataggattgt

SEQ ID NO: 146255 - DNA, 27 bp, Artificial sequence
  SiRNA target sequence
ttcaccatcctccatcataggattgtc

SEQ ID NO: 146256 - DNA, 27 bp, Artificial sequence
  SiRNA target sequence
tcaccatcctccatcataggattgtct

SEQ ID NO: 146257 - DNA, 27 bp, Artificial sequence
  SiRNA target sequence
caccatcctccatcataggattgtctt

SEQ ID NO: 146258 - DNA, 27 bp, Artificial sequence
  SiRNA target sequence
accatcctccatcataggattgtcttg

SEQ ID NO: 146259 - DNA, 27 bp, Artificial sequence
  SiRNA target sequence
ccatcctccatcataggattgtcttga

SEQ ID NO: 146260 - DNA, 27 bp, Artificial sequence
  SiRNA target sequence
catcctccatcataggattgtcttgat

SEQ ID NO: 146261 - DNA, 27 bp, Artificial sequence
  SiRNA target sequence
atcctccatcataggattgtcttgatt

SEQ ID NO: 146262 - DNA, 27 bp, Artificial sequence
  SiRNA target sequence
tcctccatcataggattgtcttgatta

SEQ ID NO: 146263 - DNA, 27 bp, Artificial sequence
  SiRNA target sequence
cctccatcataggattgtcttgattaa

SEQ ID NO: 146264 - DNA, 27 bp, Artificial sequence
  SiRNA target sequence
ctccatcataggattgtcttgattaac

SEQ ID NO: 146265 - DNA, 27 bp, Artificial sequence
  SiRNA target sequence
tccatcataggattgtcttgattaaca

SEQ ID NO: 146266 - DNA, 27 bp, Artificial sequence
  SiRNA target sequence
ccatcataggattgtcttgattaacac

SEQ ID NO: 146267 - DNA, 27 bp, Artificial sequence
  SiRNA target sequence
catcataggattgtcttgattaacact

SEQ ID NO: 146268 - DNA, 27 bp, Artificial sequence
  SiRNA target sequence
atcataggattgtcttgattaacactg

SEQ ID NO: 146269 - DNA, 27 bp, Artificial sequence
  SiRNA target sequence
tcataggattgtcttgattaacactgg

SEQ ID NO: 146270 - DNA, 27 bp, Artificial sequence
  SiRNA target sequence
cataggattgtcttgattaacactggt

SEQ ID NO: 146271 - DNA, 27 bp, Artificial sequence
  SiRNA target sequence
ataggattgtcttgattaacactggtc

SEQ ID NO: 146272 - DNA, 27 bp, Artificial sequence
  SiRNA target sequence
taggattgtcttgattaacactggtct

SEQ ID NO: 146273 - DNA, 27 bp, Artificial sequence
  SiRNA target sequence
aggattgtcttgattaacactggtctt

SEQ ID NO: 146274 - DNA, 27 bp, Artificial sequence
  SiRNA target sequence
ggattgtcttgattaacactggtctta

SEQ ID NO: 146275 - DNA, 27 bp, Artificial sequence
  SiRNA target sequence
gattgtcttgattaacactggtcttaa

SEQ ID NO: 146276 - DNA, 27 bp, Artificial sequence
  SiRNA target sequence
attgtcttgattaacactggtcttaat

SEQ ID NO: 146277 - DNA, 27 bp, Artificial sequence
  SiRNA target sequence
ttgtcttgattaacactggtcttaata

SEQ ID NO: 146278 - DNA, 27 bp, Artificial sequence
  SiRNA target sequence
tgtcttgattaacactggtcttaatac

SEQ ID NO: 146279 - DNA, 27 bp, Artificial sequence
  SiRNA target sequence
gtcttgattaacactggtcttaataca

SEQ ID NO: 146280 - DNA, 27 bp, Artificial sequence
  SiRNA target sequence
tcttgattaacactggtcttaatacac

SEQ ID NO: 146281 - DNA, 27 bp, Artificial sequence
  SiRNA target sequence
cttgattaacactggtcttaatacaca

SEQ ID NO: 146282 - DNA, 27 bp, Artificial sequence
  SiRNA target sequence
ttgattaacactggtcttaatacacaa

SEQ ID NO: 146283 - DNA, 27 bp, Artificial sequence
  SiRNA target sequence
tgattaacactggtcttaatacacaat

SEQ ID NO: 146284 - DNA, 27 bp, Artificial sequence
  SiRNA target sequence
gattaacactggtcttaatacacaatt

SEQ ID NO: 146285 - DNA, 27 bp, Artificial sequence
  SiRNA target sequence
attaacactggtcttaatacacaattt

SEQ ID NO: 146286 - DNA, 27 bp, Artificial sequence
  SiRNA target sequence
ttaacactggtcttaatacacaattta

SEQ ID NO: 146287 - DNA, 27 bp, Artificial sequence
  SiRNA target sequence
taacactggtcttaatacacaatttat

SEQ ID NO: 146288 - DNA, 27 bp, Artificial sequence
  SiRNA target sequence
aacactggtcttaatacacaatttatc

SEQ ID NO: 146289 - DNA, 27 bp, Artificial sequence
  SiRNA target sequence
acactggtcttaatacacaatttatct

SEQ ID NO: 146290 - DNA, 27 bp, Artificial sequence
  SiRNA target sequence
cactggtcttaatacacaatttatctt

SEQ ID NO: 146291 - DNA, 27 bp, Artificial sequence
  SiRNA target sequence
actggtcttaatacacaatttatcttt

SEQ ID NO: 146292 - DNA, 27 bp, Artificial sequence
  SiRNA target sequence
ctggtcttaatacacaatttatcttta

SEQ ID NO: 146293 - DNA, 27 bp, Artificial sequence
  SiRNA target sequence
tggtcttaatacacaatttatctttat

SEQ ID NO: 146294 - DNA, 27 bp, Artificial sequence
  SiRNA target sequence
ggtcttaatacacaatttatctttata

SEQ ID NO: 146295 - DNA, 27 bp, Artificial sequence
  SiRNA target sequence
gtcttaatacacaatttatctttatat

SEQ ID NO: 146296 - DNA, 27 bp, Artificial sequence
  SiRNA target sequence
tcttaatacacaatttatctttatata

SEQ ID NO: 146297 - DNA, 27 bp, Artificial sequence
  SiRNA target sequence
cttaatacacaatttatctttatatat

SEQ ID NO: 146298 - DNA, 27 bp, Artificial sequence
  SiRNA target sequence
ttaatacacaatttatctttatatatc

SEQ ID NO: 146299 - DNA, 27 bp, Artificial sequence
  SiRNA target sequence
taatacacaatttatctttatatatca

SEQ ID NO: 146300 - DNA, 27 bp, Artificial sequence
  SiRNA target sequence
aatacacaatttatctttatatatcaa

SEQ ID NO: 146301 - DNA, 27 bp, Artificial sequence
  SiRNA target sequence
atacacaatttatctttatatatcaac

SEQ ID NO: 146302 - DNA, 27 bp, Artificial sequence
  SiRNA target sequence
tacacaatttatctttatatatcaacc

SEQ ID NO: 146303 - DNA, 27 bp, Artificial sequence
  SiRNA target sequence
acacaatttatctttatatatcaacca

SEQ ID NO: 146304 - DNA, 27 bp, Artificial sequence
  SiRNA target sequence
cacaatttatctttatatatcaaccac

SEQ ID NO: 146305 - DNA, 27 bp, Artificial sequence
  SiRNA target sequence
acaatttatctttatatatcaaccaca

SEQ ID NO: 146306 - DNA, 27 bp, Artificial sequence
  SiRNA target sequence
caatttatctttatatatcaaccacac

SEQ ID NO: 146307 - DNA, 27 bp, Artificial sequence
  SiRNA target sequence
aatttatctttatatatcaaccacacc

SEQ ID NO: 146308 - DNA, 27 bp, Artificial sequence
  SiRNA target sequence
atttatctttatatatcaaccacaccc

SEQ ID NO: 146309 - DNA, 27 bp, Artificial sequence
  SiRNA target sequence
tttatctttatatatcaaccacaccca

SEQ ID NO: 146310 - DNA, 27 bp, Artificial sequence
  SiRNA target sequence
ttatctttatatatcaaccacacccat

SEQ ID NO: 146311 - DNA, 27 bp, Artificial sequence
  SiRNA target sequence
tatctttatatatcaaccacacccatc

SEQ ID NO: 146312 - DNA, 27 bp, Artificial sequence
  SiRNA target sequence
atctttatatatcaaccacacccatcc

SEQ ID NO: 146313 - DNA, 27 bp, Artificial sequence
  SiRNA target sequence
tctttatatatcaaccacacccatcct

SEQ ID NO: 146314 - DNA, 27 bp, Artificial sequence
  SiRNA target sequence
ctttatatatcaaccacacccatcctg

SEQ ID NO: 146315 - DNA, 27 bp, Artificial sequence
  SiRNA target sequence
tttatatatcaaccacacccatcctga

SEQ ID NO: 146316 - DNA, 27 bp, Artificial sequence
  SiRNA target sequence
ttatatatcaaccacacccatcctgat

SEQ ID NO: 146317 - DNA, 27 bp, Artificial sequence
  SiRNA target sequence
tatatatcaaccacacccatcctgatc

SEQ ID NO: 146318 - DNA, 27 bp, Artificial sequence
  SiRNA target sequence
atatatcaaccacacccatcctgatcc

SEQ ID NO: 146319 - DNA, 27 bp, Artificial sequence
  SiRNA target sequence
tatatcaaccacacccatcctgatcca

SEQ ID NO: 146320 - DNA, 27 bp, Artificial sequence
  SiRNA target sequence
atatcaaccacacccatcctgatccaa

SEQ ID NO: 146321 - DNA, 27 bp, Artificial sequence
  SiRNA target sequence
tatcaaccacacccatcctgatccaaa

SEQ ID NO: 146322 - DNA, 27 bp, Artificial sequence
  SiRNA target sequence
atcaaccacacccatcctgatccaaat

SEQ ID NO: 146323 - DNA, 27 bp, Artificial sequence
  SiRNA target sequence
tcaaccacacccatcctgatccaaata

SEQ ID NO: 146324 - DNA, 27 bp, Artificial sequence
  SiRNA target sequence
caaccacacccatcctgatccaaataa

SEQ ID NO: 146325 - DNA, 27 bp, Artificial sequence
  SiRNA target sequence
aaccacacccatcctgatccaaataat

SEQ ID NO: 146326 - DNA, 27 bp, Artificial sequence
  SiRNA target sequence
accacacccatcctgatccaaataatt

SEQ ID NO: 146327 - DNA, 27 bp, Artificial sequence
  SiRNA target sequence
ccacacccatcctgatccaaataattt

SEQ ID NO: 146328 - DNA, 27 bp, Artificial sequence
  SiRNA target sequence
cacacccatcctgatccaaataatttt

SEQ ID NO: 146329 - DNA, 27 bp, Artificial sequence
  SiRNA target sequence
acacccatcctgatccaaataatttta

SEQ ID NO: 146330 - DNA, 27 bp, Artificial sequence
  SiRNA target sequence
cacccatcctgatccaaataattttac

SEQ ID NO: 146331 - DNA, 27 bp, Artificial sequence
  SiRNA target sequence
acccatcctgatccaaataattttaca

SEQ ID NO: 146332 - DNA, 27 bp, Artificial sequence
  SiRNA target sequence
cccatcctgatccaaataattttacag

SEQ ID NO: 146333 - DNA, 27 bp, Artificial sequence
  SiRNA target sequence
ccatcctgatccaaataattttacagc

SEQ ID NO: 146334 - DNA, 27 bp, Artificial sequence
  SiRNA target sequence
catcctgatccaaataattttacagct

SEQ ID NO: 146335 - DNA, 27 bp, Artificial sequence
  SiRNA target sequence
atcctgatccaaataattttacagctt

SEQ ID NO: 146336 - DNA, 27 bp, Artificial sequence
  SiRNA target sequence
tcctgatccaaataattttacagcttc

SEQ ID NO: 146337 - DNA, 27 bp, Artificial sequence
  SiRNA target sequence
cctgatccaaataattttacagcttca

SEQ ID NO: 146338 - DNA, 27 bp, Artificial sequence
  SiRNA target sequence
ctgatccaaataattttacagcttcag

SEQ ID NO: 146339 - DNA, 27 bp, Artificial sequence
  SiRNA target sequence
tgatccaaataattttacagcttcagt

SEQ ID NO: 146340 - DNA, 27 bp, Artificial sequence
  SiRNA target sequence
gatccaaataattttacagcttcagta

SEQ ID NO: 146341 - DNA, 27 bp, Artificial sequence
  SiRNA target sequence
atccaaataattttacagcttcagtat

SEQ ID NO: 146342 - DNA, 27 bp, Artificial sequence
  SiRNA target sequence
tccaaataattttacagcttcagtatt

SEQ ID NO: 146343 - DNA, 27 bp, Artificial sequence
  SiRNA target sequence
ccaaataattttacagcttcagtatta

SEQ ID NO: 146344 - DNA, 27 bp, Artificial sequence
  SiRNA target sequence
caaataattttacagcttcagtattaa

SEQ ID NO: 146345 - DNA, 27 bp, Artificial sequence
  SiRNA target sequence
aaataattttacagcttcagtattaaa

SEQ ID NO: 146346 - DNA, 27 bp, Artificial sequence
  SiRNA target sequence
aataattttacagcttcagtattaaaa

SEQ ID NO: 146347 - DNA, 27 bp, Artificial sequence
  SiRNA target sequence
ataattttacagcttcagtattaaaat

SEQ ID NO: 146348 - DNA, 27 bp, Artificial sequence
  SiRNA target sequence
taattttacagcttcagtattaaaatt

SEQ ID NO: 146349 - DNA, 27 bp, Artificial sequence
  SiRNA target sequence
aattttacagcttcagtattaaaattc

SEQ ID NO: 146350 - DNA, 27 bp, Artificial sequence
  SiRNA target sequence
attttacagcttcagtattaaaattct

SEQ ID NO: 146351 - DNA, 27 bp, Artificial sequence
  SiRNA target sequence
ttttacagcttcagtattaaaattctc

SEQ ID NO: 146352 - DNA, 27 bp, Artificial sequence
  SiRNA target sequence
tttacagcttcagtattaaaattctcc

SEQ ID NO: 146353 - DNA, 27 bp, Artificial sequence
  SiRNA target sequence
ttacagcttcagtattaaaattctcct

SEQ ID NO: 146354 - DNA, 27 bp, Artificial sequence
  SiRNA target sequence
tacagcttcagtattaaaattctcctt

SEQ ID NO: 146355 - DNA, 27 bp, Artificial sequence
  SiRNA target sequence
acagcttcagtattaaaattctcctta

SEQ ID NO: 146356 - DNA, 27 bp, Artificial sequence
  SiRNA target sequence
cagcttcagtattaaaattctccttaa

SEQ ID NO: 146357 - DNA, 27 bp, Artificial sequence
  SiRNA target sequence
agcttcagtattaaaattctccttaaa

SEQ ID NO: 146358 - DNA, 27 bp, Artificial sequence
  SiRNA target sequence
gcttcagtattaaaattctccttaaat

SEQ ID NO: 146359 - DNA, 27 bp, Artificial sequence
  SiRNA target sequence
cttcagtattaaaattctccttaaatt

SEQ ID NO: 146360 - DNA, 27 bp, Artificial sequence
  SiRNA target sequence
ttcagtattaaaattctccttaaattt

SEQ ID NO: 146361 - DNA, 27 bp, Artificial sequence
  SiRNA target sequence
tcagtattaaaattctccttaaattta

SEQ ID NO: 146362 - DNA, 27 bp, Artificial sequence
  SiRNA target sequence
cagtattaaaattctccttaaatttat

SEQ ID NO: 146363 - DNA, 27 bp, Artificial sequence
  SiRNA target sequence
agtattaaaattctccttaaatttatt

SEQ ID NO: 146364 - DNA, 27 bp, Artificial sequence
  SiRNA target sequence
gtattaaaattctccttaaatttattt

SEQ ID NO: 146365 - DNA, 27 bp, Artificial sequence
  SiRNA target sequence
tattaaaattctccttaaatttattta

SEQ ID NO: 146366 - DNA, 27 bp, Artificial sequence
  SiRNA target sequence
attaaaattctccttaaatttatttat

SEQ ID NO: 146367 - DNA, 27 bp, Artificial sequence
  SiRNA target sequence
ttaaaattctccttaaatttatttatt

SEQ ID NO: 146368 - DNA, 27 bp, Artificial sequence
  SiRNA target sequence
taaaattctccttaaatttatttattg

SEQ ID NO: 146369 - DNA, 27 bp, Artificial sequence
  SiRNA target sequence
aaaattctccttaaatttatttattga

SEQ ID NO: 146370 - DNA, 27 bp, Artificial sequence
  SiRNA target sequence
aaattctccttaaatttatttattgat

SEQ ID NO: 146371 - DNA, 27 bp, Artificial sequence
  SiRNA target sequence
aattctccttaaatttatttattgatc

SEQ ID NO: 146372 - DNA, 27 bp, Artificial sequence
  SiRNA target sequence
attctccttaaatttatttattgatcc

SEQ ID NO: 146373 - DNA, 27 bp, Artificial sequence
  SiRNA target sequence
ttctccttaaatttatttattgatcca

SEQ ID NO: 146374 - DNA, 27 bp, Artificial sequence
  SiRNA target sequence
tctccttaaatttatttattgatccaa

SEQ ID NO: 146375 - DNA, 27 bp, Artificial sequence
  SiRNA target sequence
ctccttaaatttatttattgatccaaa

SEQ ID NO: 146376 - DNA, 27 bp, Artificial sequence
  SiRNA target sequence
tccttaaatttatttattgatccaaag

SEQ ID NO: 146377 - DNA, 27 bp, Artificial sequence
  SiRNA target sequence
ccttaaatttatttattgatccaaagt

SEQ ID NO: 146378 - DNA, 27 bp, Artificial sequence
  SiRNA target sequence
cttaaatttatttattgatccaaagtc

SEQ ID NO: 146379 - DNA, 27 bp, Artificial sequence
  SiRNA target sequence
ttaaatttatttattgatccaaagtct

SEQ ID NO: 146380 - DNA, 27 bp, Artificial sequence
  SiRNA target sequence
taaatttatttattgatccaaagtctt

SEQ ID NO: 146381 - DNA, 27 bp, Artificial sequence
  SiRNA target sequence
aaatttatttattgatccaaagtcttt

SEQ ID NO: 146382 - DNA, 27 bp, Artificial sequence
  SiRNA target sequence
aatttatttattgatccaaagtctttt

SEQ ID NO: 146383 - DNA, 27 bp, Artificial sequence
  SiRNA target sequence
atttatttattgatccaaagtctttta

SEQ ID NO: 146384 - DNA, 27 bp, Artificial sequence
  SiRNA target sequence
tttatttattgatccaaagtcttttat

SEQ ID NO: 146385 - DNA, 27 bp, Artificial sequence
  SiRNA target sequence
ttatttattgatccaaagtcttttatt

SEQ ID NO: 146386 - DNA, 27 bp, Artificial sequence
  SiRNA target sequence
tatttattgatccaaagtcttttatta

SEQ ID NO: 146387 - DNA, 27 bp, Artificial sequence
  SiRNA target sequence
atttattgatccaaagtcttttattat

SEQ ID NO: 146388 - DNA, 27 bp, Artificial sequence
  SiRNA target sequence
tttattgatccaaagtcttttattata

SEQ ID NO: 146389 - DNA, 27 bp, Artificial sequence
  SiRNA target sequence
ttattgatccaaagtcttttattatag

SEQ ID NO: 146390 - DNA, 27 bp, Artificial sequence
  SiRNA target sequence
tattgatccaaagtcttttattatagc

SEQ ID NO: 146391 - DNA, 27 bp, Artificial sequence
  SiRNA target sequence
attgatccaaagtcttttattatagca

SEQ ID NO: 146392 - DNA, 27 bp, Artificial sequence
  SiRNA target sequence
ttgatccaaagtcttttattatagcac

SEQ ID NO: 146393 - DNA, 27 bp, Artificial sequence
  SiRNA target sequence
tgatccaaagtcttttattatagcact

SEQ ID NO: 146394 - DNA, 27 bp, Artificial sequence
  SiRNA target sequence
gatccaaagtcttttattatagcactt

SEQ ID NO: 146395 - DNA, 27 bp, Artificial sequence
  SiRNA target sequence
atccaaagtcttttattatagcacttt

SEQ ID NO: 146396 - DNA, 27 bp, Artificial sequence
  SiRNA target sequence
tccaaagtcttttattatagcactttc

SEQ ID NO: 146397 - DNA, 27 bp, Artificial sequence
  SiRNA target sequence
ccaaagtcttttattatagcactttcc

SEQ ID NO: 146398 - DNA, 27 bp, Artificial sequence
  SiRNA target sequence
caaagtcttttattatagcactttcca

SEQ ID NO: 146399 - DNA, 27 bp, Artificial sequence
  SiRNA target sequence
aaagtcttttattatagcactttccaa

SEQ ID NO: 146400 - DNA, 27 bp, Artificial sequence
  SiRNA target sequence
aagtcttttattatagcactttccaac

SEQ ID NO: 146401 - DNA, 27 bp, Artificial sequence
  SiRNA target sequence
agtcttttattatagcactttccaact

SEQ ID NO: 146402 - DNA, 27 bp, Artificial sequence
  SiRNA target sequence
gtcttttattatagcactttccaactg

SEQ ID NO: 146403 - DNA, 27 bp, Artificial sequence
  SiRNA target sequence
tcttttattatagcactttccaactgg

SEQ ID NO: 146404 - DNA, 27 bp, Artificial sequence
  SiRNA target sequence
cttttattatagcactttccaactggg

SEQ ID NO: 146405 - DNA, 27 bp, Artificial sequence
  SiRNA target sequence
ttttattatagcactttccaactggga

SEQ ID NO: 146406 - DNA, 27 bp, Artificial sequence
  SiRNA target sequence
tttattatagcactttccaactgggaa

SEQ ID NO: 146407 - DNA, 27 bp, Artificial sequence
  SiRNA target sequence
ttattatagcactttccaactgggaag

SEQ ID NO: 146408 - DNA, 27 bp, Artificial sequence
  SiRNA target sequence
tattatagcactttccaactgggaaga

SEQ ID NO: 146409 - DNA, 27 bp, Artificial sequence
  SiRNA target sequence
attatagcactttccaactgggaagaa

SEQ ID NO: 146410 - DNA, 27 bp, Artificial sequence
  SiRNA target sequence
ttatagcactttccaactgggaagaaa

SEQ ID NO: 146411 - DNA, 27 bp, Artificial sequence
  SiRNA target sequence
tatagcactttccaactgggaagaaat

SEQ ID NO: 146412 - DNA, 27 bp, Artificial sequence
  SiRNA target sequence
atagcactttccaactgggaagaaatc

SEQ ID NO: 146413 - DNA, 27 bp, Artificial sequence
  SiRNA target sequence
tagcactttccaactgggaagaaatct

SEQ ID NO: 146414 - DNA, 27 bp, Artificial sequence
  SiRNA target sequence
agcactttccaactgggaagaaatctt

SEQ ID NO: 146415 - DNA, 27 bp, Artificial sequence
  SiRNA target sequence
gcactttccaactgggaagaaatcttt

SEQ ID NO: 146416 - DNA, 27 bp, Artificial sequence
  SiRNA target sequence
cactttccaactgggaagaaatctttt

SEQ ID NO: 146417 - DNA, 27 bp, Artificial sequence
  SiRNA target sequence
actttccaactgggaagaaatcttttt

SEQ ID NO: 146418 - DNA, 27 bp, Artificial sequence
  SiRNA target sequence
ctttccaactgggaagaaatcttttta

SEQ ID NO: 146419 - DNA, 27 bp, Artificial sequence
  SiRNA target sequence
tttccaactgggaagaaatctttttat

SEQ ID NO: 146420 - DNA, 27 bp, Artificial sequence
  SiRNA target sequence
ttccaactgggaagaaatctttttatt

SEQ ID NO: 146421 - DNA, 27 bp, Artificial sequence
  SiRNA target sequence
tccaactgggaagaaatctttttattt

SEQ ID NO: 146422 - DNA, 27 bp, Artificial sequence
  SiRNA target sequence
ccaactgggaagaaatctttttatttt

SEQ ID NO: 146423 - DNA, 27 bp, Artificial sequence
  SiRNA target sequence
caactgggaagaaatctttttattttc

SEQ ID NO: 146424 - DNA, 27 bp, Artificial sequence
  SiRNA target sequence
aactgggaagaaatctttttattttct

SEQ ID NO: 146425 - DNA, 27 bp, Artificial sequence
  SiRNA target sequence
actgggaagaaatctttttattttctg

SEQ ID NO: 146426 - DNA, 27 bp, Artificial sequence
  SiRNA target sequence
ctgggaagaaatctttttattttctgg

SEQ ID NO: 146427 - DNA, 27 bp, Artificial sequence
  SiRNA target sequence
tgggaagaaatctttttattttctggt

SEQ ID NO: 146428 - DNA, 27 bp, Artificial sequence
  SiRNA target sequence
gggaagaaatctttttattttctggtg

SEQ ID NO: 146429 - DNA, 27 bp, Artificial sequence
  SiRNA target sequence
ggaagaaatctttttattttctggtga

SEQ ID NO: 146430 - DNA, 27 bp, Artificial sequence
  SiRNA target sequence
gaagaaatctttttattttctggtgac

SEQ ID NO: 146431 - DNA, 27 bp, Artificial sequence
  SiRNA target sequence
aagaaatctttttattttctggtgaca

SEQ ID NO: 146432 - DNA, 27 bp, Artificial sequence
  SiRNA target sequence
agaaatctttttattttctggtgacat

SEQ ID NO: 146433 - DNA, 27 bp, Artificial sequence
  SiRNA target sequence
gaaatctttttattttctggtgacatt

SEQ ID NO: 146434 - DNA, 27 bp, Artificial sequence
  SiRNA target sequence
aaatctttttattttctggtgacatta

SEQ ID NO: 146435 - DNA, 27 bp, Artificial sequence
  SiRNA target sequence
aatctttttattttctggtgacattac

SEQ ID NO: 146436 - DNA, 27 bp, Artificial sequence
  SiRNA target sequence
atctttttattttctggtgacattacc

SEQ ID NO: 146437 - DNA, 27 bp, Artificial sequence
  SiRNA target sequence
tctttttattttctggtgacattacca

SEQ ID NO: 146438 - DNA, 27 bp, Artificial sequence
  SiRNA target sequence
ctttttattttctggtgacattaccaa

SEQ ID NO: 146439 - DNA, 27 bp, Artificial sequence
  SiRNA target sequence
tttttattttctggtgacattaccaac

SEQ ID NO: 146440 - DNA, 27 bp, Artificial sequence
  SiRNA target sequence
ttttattttctggtgacattaccaacc

SEQ ID NO: 146441 - DNA, 27 bp, Artificial sequence
  SiRNA target sequence
tttattttctggtgacattaccaacca

SEQ ID NO: 146442 - DNA, 27 bp, Artificial sequence
  SiRNA target sequence
ttattttctggtgacattaccaaccag

SEQ ID NO: 146443 - DNA, 27 bp, Artificial sequence
  SiRNA target sequence
tattttctggtgacattaccaaccaga

SEQ ID NO: 146444 - DNA, 27 bp, Artificial sequence
  SiRNA target sequence
attttctggtgacattaccaaccagaa

SEQ ID NO: 146445 - DNA, 27 bp, Artificial sequence
  SiRNA target sequence
ttttctggtgacattaccaaccagaaa

SEQ ID NO: 146446 - DNA, 27 bp, Artificial sequence
  SiRNA target sequence
tttctggtgacattaccaaccagaaaa

SEQ ID NO: 146447 - DNA, 27 bp, Artificial sequence
  SiRNA target sequence
ttctggtgacattaccaaccagaaaag

SEQ ID NO: 146448 - DNA, 27 bp, Artificial sequence
  SiRNA target sequence
tctggtgacattaccaaccagaaaaga

SEQ ID NO: 146449 - DNA, 27 bp, Artificial sequence
  SiRNA target sequence
ctggtgacattaccaaccagaaaagac

SEQ ID NO: 146450 - DNA, 27 bp, Artificial sequence
  SiRNA target sequence
tggtgacattaccaaccagaaaagact

SEQ ID NO: 146451 - DNA, 27 bp, Artificial sequence
  SiRNA target sequence
ggtgacattaccaaccagaaaagacta

SEQ ID NO: 146452 - DNA, 27 bp, Artificial sequence
  SiRNA target sequence
gtgacattaccaaccagaaaagactat

SEQ ID NO: 146453 - DNA, 27 bp, Artificial sequence
  SiRNA target sequence
tgacattaccaaccagaaaagactatg

SEQ ID NO: 146454 - DNA, 27 bp, Artificial sequence
  SiRNA target sequence
gacattaccaaccagaaaagactatgg

SEQ ID NO: 146455 - DNA, 27 bp, Artificial sequence
  SiRNA target sequence
acattaccaaccagaaaagactatggt

SEQ ID NO: 146456 - DNA, 27 bp, Artificial sequence
  SiRNA target sequence
cattaccaaccagaaaagactatggtt

SEQ ID NO: 146457 - DNA, 27 bp, Artificial sequence
  SiRNA target sequence
attaccaaccagaaaagactatggttg

SEQ ID NO: 146458 - DNA, 27 bp, Artificial sequence
  SiRNA target sequence
ttaccaaccagaaaagactatggttgt

SEQ ID NO: 146459 - DNA, 27 bp, Artificial sequence
  SiRNA target sequence
taccaaccagaaaagactatggttgta

SEQ ID NO: 146460 - DNA, 27 bp, Artificial sequence
  SiRNA target sequence
accaaccagaaaagactatggttgtaa

SEQ ID NO: 146461 - DNA, 27 bp, Artificial sequence
  SiRNA target sequence
ccaaccagaaaagactatggttgtaat

SEQ ID NO: 146462 - DNA, 27 bp, Artificial sequence
  SiRNA target sequence
caaccagaaaagactatggttgtaatg

SEQ ID NO: 146463 - DNA, 27 bp, Artificial sequence
  SiRNA target sequence
aaccagaaaagactatggttgtaatga

SEQ ID NO: 146464 - DNA, 27 bp, Artificial sequence
  SiRNA target sequence
accagaaaagactatggttgtaatgac

SEQ ID NO: 146465 - DNA, 27 bp, Artificial sequence
  SiRNA target sequence
ccagaaaagactatggttgtaatgacc

SEQ ID NO: 146466 - DNA, 27 bp, Artificial sequence
  SiRNA target sequence
cagaaaagactatggttgtaatgacca

SEQ ID NO: 146467 - DNA, 27 bp, Artificial sequence
  SiRNA target sequence
agaaaagactatggttgtaatgaccac

SEQ ID NO: 146468 - DNA, 27 bp, Artificial sequence
  SiRNA target sequence
gaaaagactatggttgtaatgaccacc

SEQ ID NO: 146469 - DNA, 27 bp, Artificial sequence
  SiRNA target sequence
aaaagactatggttgtaatgaccacca

SEQ ID NO: 146470 - DNA, 27 bp, Artificial sequence
  SiRNA target sequence
aaagactatggttgtaatgaccaccac

SEQ ID NO: 146471 - DNA, 27 bp, Artificial sequence
  SiRNA target sequence
aagactatggttgtaatgaccaccacc

SEQ ID NO: 146472 - DNA, 27 bp, Artificial sequence
  SiRNA target sequence
agactatggttgtaatgaccaccacca

SEQ ID NO: 146473 - DNA, 27 bp, Artificial sequence
  SiRNA target sequence
gactatggttgtaatgaccaccaccat

SEQ ID NO: 146474 - DNA, 27 bp, Artificial sequence
  SiRNA target sequence
actatggttgtaatgaccaccaccata

SEQ ID NO: 146475 - DNA, 27 bp, Artificial sequence
  SiRNA target sequence
ctatggttgtaatgaccaccaccataa

SEQ ID NO: 146476 - DNA, 27 bp, Artificial sequence
  SiRNA target sequence
tatggttgtaatgaccaccaccataat

SEQ ID NO: 146477 - DNA, 27 bp, Artificial sequence
  SiRNA target sequence
atggttgtaatgaccaccaccataatc

SEQ ID NO: 146478 - DNA, 27 bp, Artificial sequence
  SiRNA target sequence
tggttgtaatgaccaccaccataatct

SEQ ID NO: 146479 - DNA, 27 bp, Artificial sequence
  SiRNA target sequence
ggttgtaatgaccaccaccataatctc

SEQ ID NO: 146480 - DNA, 27 bp, Artificial sequence
  SiRNA target sequence
gttgtaatgaccaccaccataatctct

SEQ ID NO: 146481 - DNA, 27 bp, Artificial sequence
  SiRNA target sequence
ttgtaatgaccaccaccataatctctt

SEQ ID NO: 146482 - DNA, 27 bp, Artificial sequence
  SiRNA target sequence
tgtaatgaccaccaccataatctctta

SEQ ID NO: 146483 - DNA, 27 bp, Artificial sequence
  SiRNA target sequence
gtaatgaccaccaccataatctcttaa

SEQ ID NO: 146484 - DNA, 27 bp, Artificial sequence
  SiRNA target sequence
taatgaccaccaccataatctcttaat

SEQ ID NO: 146485 - DNA, 27 bp, Artificial sequence
  SiRNA target sequence
aatgaccaccaccataatctcttaatt

SEQ ID NO: 146486 - DNA, 27 bp, Artificial sequence
  SiRNA target sequence
atgaccaccaccataatctcttaattg

SEQ ID NO: 146487 - DNA, 27 bp, Artificial sequence
  SiRNA target sequence
tgaccaccaccataatctcttaattgt

SEQ ID NO: 146488 - DNA, 27 bp, Artificial sequence
  SiRNA target sequence
gaccaccaccataatctcttaattgtt

SEQ ID NO: 146489 - DNA, 27 bp, Artificial sequence
  SiRNA target sequence
accaccaccataatctcttaattgttt

SEQ ID NO: 146490 - DNA, 27 bp, Artificial sequence
  SiRNA target sequence
ccaccaccataatctcttaattgttta

SEQ ID NO: 146491 - DNA, 27 bp, Artificial sequence
  SiRNA target sequence
caccaccataatctcttaattgtttat

SEQ ID NO: 146492 - DNA, 27 bp, Artificial sequence
  SiRNA target sequence
accaccataatctcttaattgtttatc

SEQ ID NO: 146493 - DNA, 27 bp, Artificial sequence
  SiRNA target sequence
ccaccataatctcttaattgtttatca

SEQ ID NO: 146494 - DNA, 27 bp, Artificial sequence
  SiRNA target sequence
caccataatctcttaattgtttatcaa

SEQ ID NO: 146495 - DNA, 27 bp, Artificial sequence
  SiRNA target sequence
accataatctcttaattgtttatcaac

SEQ ID NO: 146496 - DNA, 27 bp, Artificial sequence
  SiRNA target sequence
ccataatctcttaattgtttatcaaca

SEQ ID NO: 146497 - DNA, 27 bp, Artificial sequence
  SiRNA target sequence
cataatctcttaattgtttatcaacaa

SEQ ID NO: 146498 - DNA, 27 bp, Artificial sequence
  SiRNA target sequence
ataatctcttaattgtttatcaacaag

SEQ ID NO: 146499 - DNA, 27 bp, Artificial sequence
  SiRNA target sequence
taatctcttaattgtttatcaacaagt

SEQ ID NO: 146500 - DNA, 27 bp, Artificial sequence
  SiRNA target sequence
aatctcttaattgtttatcaacaagtg

SEQ ID NO: 146501 - DNA, 27 bp, Artificial sequence
  SiRNA target sequence
atctcttaattgtttatcaacaagtgc

SEQ ID NO: 146502 - DNA, 27 bp, Artificial sequence
  SiRNA target sequence
tctcttaattgtttatcaacaagtgca

SEQ ID NO: 146503 - DNA, 27 bp, Artificial sequence
  SiRNA target sequence
ctcttaattgtttatcaacaagtgcat

SEQ ID NO: 146504 - DNA, 27 bp, Artificial sequence
  SiRNA target sequence
tcttaattgtttatcaacaagtgcatt

SEQ ID NO: 146505 - DNA, 27 bp, Artificial sequence
  SiRNA target sequence
cttaattgtttatcaacaagtgcattt

SEQ ID NO: 146506 - DNA, 27 bp, Artificial sequence
  SiRNA target sequence
ttaattgtttatcaacaagtgcatttc

SEQ ID NO: 146507 - DNA, 27 bp, Artificial sequence
  SiRNA target sequence
taattgtttatcaacaagtgcatttcc

SEQ ID NO: 146508 - DNA, 27 bp, Artificial sequence
  SiRNA target sequence
aattgtttatcaacaagtgcatttcct

SEQ ID NO: 146509 - DNA, 27 bp, Artificial sequence
  SiRNA target sequence
attgtttatcaacaagtgcatttcctt

SEQ ID NO: 146510 - DNA, 27 bp, Artificial sequence
  SiRNA target sequence
ttgtttatcaacaagtgcatttccttt

SEQ ID NO: 146511 - DNA, 27 bp, Artificial sequence
  SiRNA target sequence
tgtttatcaacaagtgcatttccttta

SEQ ID NO: 146512 - DNA, 27 bp, Artificial sequence
  SiRNA target sequence
gtttatcaacaagtgcatttcctttat

SEQ ID NO: 146513 - DNA, 27 bp, Artificial sequence
  SiRNA target sequence
tttatcaacaagtgcatttcctttatt

SEQ ID NO: 146514 - DNA, 27 bp, Artificial sequence
  SiRNA target sequence
ttatcaacaagtgcatttcctttatta

SEQ ID NO: 146515 - DNA, 27 bp, Artificial sequence
  SiRNA target sequence
tatcaacaagtgcatttcctttattat

SEQ ID NO: 146516 - DNA, 27 bp, Artificial sequence
  SiRNA target sequence
atcaacaagtgcatttcctttattatt

SEQ ID NO: 146517 - DNA, 27 bp, Artificial sequence
  SiRNA target sequence
tcaacaagtgcatttcctttattatta

SEQ ID NO: 146518 - DNA, 27 bp, Artificial sequence
  SiRNA target sequence
caacaagtgcatttcctttattattaa

SEQ ID NO: 146519 - DNA, 27 bp, Artificial sequence
  SiRNA target sequence
aacaagtgcatttcctttattattaaa

SEQ ID NO: 146520 - DNA, 27 bp, Artificial sequence
  SiRNA target sequence
acaagtgcatttcctttattattaaaa

SEQ ID NO: 146521 - DNA, 27 bp, Artificial sequence
  SiRNA target sequence
caagtgcatttcctttattattaaaaa

SEQ ID NO: 146522 - DNA, 27 bp, Artificial sequence
  SiRNA target sequence
aagtgcatttcctttattattaaaaag

SEQ ID NO: 146523 - DNA, 27 bp, Artificial sequence
  SiRNA target sequence
agtgcatttcctttattattaaaaagt

SEQ ID NO: 146524 - DNA, 27 bp, Artificial sequence
  SiRNA target sequence
gtgcatttcctttattattaaaaagta

SEQ ID NO: 146525 - DNA, 27 bp, Artificial sequence
  SiRNA target sequence
tgcatttcctttattattaaaaagtaa

SEQ ID NO: 146526 - DNA, 27 bp, Artificial sequence
  SiRNA target sequence
gcatttcctttattattaaaaagtaat

SEQ ID NO: 146527 - DNA, 27 bp, Artificial sequence
  SiRNA target sequence
catttcctttattattaaaaagtaatg

SEQ ID NO: 146528 - DNA, 27 bp, Artificial sequence
  SiRNA target sequence
atttcctttattattaaaaagtaatga

SEQ ID NO: 146529 - DNA, 27 bp, Artificial sequence
  SiRNA target sequence
tttcctttattattaaaaagtaatgaa

SEQ ID NO: 146530 - DNA, 27 bp, Artificial sequence
  SiRNA target sequence
ttcctttattattaaaaagtaatgaat

SEQ ID NO: 146531 - DNA, 27 bp, Artificial sequence
  SiRNA target sequence
tcctttattattaaaaagtaatgaatt

SEQ ID NO: 146532 - DNA, 27 bp, Artificial sequence
  SiRNA target sequence
cctttattattaaaaagtaatgaattt

SEQ ID NO: 146533 - DNA, 27 bp, Artificial sequence
  SiRNA target sequence
ctttattattaaaaagtaatgaattta

SEQ ID NO: 146534 - DNA, 27 bp, Artificial sequence
  SiRNA target sequence
tttattattaaaaagtaatgaatttaa

SEQ ID NO: 146535 - DNA, 27 bp, Artificial sequence
  SiRNA target sequence
ttattattaaaaagtaatgaatttaat

SEQ ID NO: 146536 - DNA, 27 bp, Artificial sequence
  SiRNA target sequence
tattattaaaaagtaatgaatttaatg

SEQ ID NO: 146537 - DNA, 27 bp, Artificial sequence
  SiRNA target sequence
attattaaaaagtaatgaatttaatga

SEQ ID NO: 146538 - DNA, 27 bp, Artificial sequence
  SiRNA target sequence
ttattaaaaagtaatgaatttaatgat

SEQ ID NO: 146539 - DNA, 27 bp, Artificial sequence
  SiRNA target sequence
tattaaaaagtaatgaatttaatgatt

SEQ ID NO: 146540 - DNA, 27 bp, Artificial sequence
  SiRNA target sequence
attaaaaagtaatgaatttaatgattt

SEQ ID NO: 146541 - DNA, 27 bp, Artificial sequence
  SiRNA target sequence
ttaaaaagtaatgaatttaatgattta

SEQ ID NO: 146542 - DNA, 27 bp, Artificial sequence
  SiRNA target sequence
taaaaagtaatgaatttaatgatttac

SEQ ID NO: 146543 - DNA, 27 bp, Artificial sequence
  SiRNA target sequence
aaaaagtaatgaatttaatgatttacc

SEQ ID NO: 146544 - DNA, 27 bp, Artificial sequence
  SiRNA target sequence
aaaagtaatgaatttaatgatttacca

SEQ ID NO: 146545 - DNA, 27 bp, Artificial sequence
  SiRNA target sequence
aaagtaatgaatttaatgatttaccac

SEQ ID NO: 146546 - DNA, 27 bp, Artificial sequence
  SiRNA target sequence
aagtaatgaatttaatgatttaccaca

SEQ ID NO: 146547 - DNA, 27 bp, Artificial sequence
  SiRNA target sequence
agtaatgaatttaatgatttaccacac

SEQ ID NO: 146548 - DNA, 27 bp, Artificial sequence
  SiRNA target sequence
gtaatgaatttaatgatttaccacaca

SEQ ID NO: 146549 - DNA, 27 bp, Artificial sequence
  SiRNA target sequence
taatgaatttaatgatttaccacacaa

SEQ ID NO: 146550 - DNA, 27 bp, Artificial sequence
  SiRNA target sequence
aatgaatttaatgatttaccacacaaa

SEQ ID NO: 146551 - DNA, 27 bp, Artificial sequence
  SiRNA target sequence
atgaatttaatgatttaccacacaaat

SEQ ID NO: 146552 - DNA, 27 bp, Artificial sequence
  SiRNA target sequence
tgaatttaatgatttaccacacaaatt

SEQ ID NO: 146553 - DNA, 27 bp, Artificial sequence
  SiRNA target sequence
gaatttaatgatttaccacacaaattg

SEQ ID NO: 146554 - DNA, 27 bp, Artificial sequence
  SiRNA target sequence
aatttaatgatttaccacacaaattgt

SEQ ID NO: 146555 - DNA, 27 bp, Artificial sequence
  SiRNA target sequence
atttaatgatttaccacacaaattgtt

SEQ ID NO: 146556 - DNA, 27 bp, Artificial sequence
  SiRNA target sequence
tttaatgatttaccacacaaattgtta

SEQ ID NO: 146557 - DNA, 27 bp, Artificial sequence
  SiRNA target sequence
ttaatgatttaccacacaaattgttat

SEQ ID NO: 146558 - DNA, 27 bp, Artificial sequence
  SiRNA target sequence
taatgatttaccacacaaattgttatc

SEQ ID NO: 146559 - DNA, 27 bp, Artificial sequence
  SiRNA target sequence
aatgatttaccacacaaattgttatct

SEQ ID NO: 146560 - DNA, 27 bp, Artificial sequence
  SiRNA target sequence
atgatttaccacacaaattgttatcta

SEQ ID NO: 146561 - DNA, 27 bp, Artificial sequence
  SiRNA target sequence
tgatttaccacacaaattgttatctaa

SEQ ID NO: 146562 - DNA, 27 bp, Artificial sequence
  SiRNA target sequence
gatttaccacacaaattgttatctaat

SEQ ID NO: 146563 - DNA, 27 bp, Artificial sequence
  SiRNA target sequence
atttaccacacaaattgttatctaata

SEQ ID NO: 146564 - DNA, 27 bp, Artificial sequence
  SiRNA target sequence
tttaccacacaaattgttatctaatat

SEQ ID NO: 146565 - DNA, 27 bp, Artificial sequence
  SiRNA target sequence
ttaccacacaaattgttatctaatatt

SEQ ID NO: 146566 - DNA, 27 bp, Artificial sequence
  SiRNA target sequence
taccacacaaattgttatctaatatta

SEQ ID NO: 146567 - DNA, 27 bp, Artificial sequence
  SiRNA target sequence
accacacaaattgttatctaatattat

SEQ ID NO: 146568 - DNA, 27 bp, Artificial sequence
  SiRNA target sequence
ccacacaaattgttatctaatattatt

SEQ ID NO: 146569 - DNA, 27 bp, Artificial sequence
  SiRNA target sequence
cacacaaattgttatctaatattattt

SEQ ID NO: 146570 - DNA, 27 bp, Artificial sequence
  SiRNA target sequence
acacaaattgttatctaatattatttt

SEQ ID NO: 146571 - DNA, 27 bp, Artificial sequence
  SiRNA target sequence
cacaaattgttatctaatattatttta

SEQ ID NO: 146572 - DNA, 27 bp, Artificial sequence
  SiRNA target sequence
acaaattgttatctaatattattttat

SEQ ID NO: 146573 - DNA, 27 bp, Artificial sequence
  SiRNA target sequence
caaattgttatctaatattattttatt

SEQ ID NO: 146574 - DNA, 27 bp, Artificial sequence
  SiRNA target sequence
aaattgttatctaatattattttatta

SEQ ID NO: 146575 - DNA, 27 bp, Artificial sequence
  SiRNA target sequence
aattgttatctaatattattttattaa

SEQ ID NO: 146576 - DNA, 27 bp, Artificial sequence
  SiRNA target sequence
attgttatctaatattattttattaag

SEQ ID NO: 146577 - DNA, 27 bp, Artificial sequence
  SiRNA target sequence
ttgttatctaatattattttattaaga

SEQ ID NO: 146578 - DNA, 27 bp, Artificial sequence
  SiRNA target sequence
tgttatctaatattattttattaagag

SEQ ID NO: 146579 - DNA, 27 bp, Artificial sequence
  SiRNA target sequence
gttatctaatattattttattaagagt

SEQ ID NO: 146580 - DNA, 27 bp, Artificial sequence
  SiRNA target sequence
ttatctaatattattttattaagagtg

SEQ ID NO: 146581 - DNA, 27 bp, Artificial sequence
  SiRNA target sequence
tatctaatattattttattaagagtgt

SEQ ID NO: 146582 - DNA, 27 bp, Artificial sequence
  SiRNA target sequence
atctaatattattttattaagagtgtc

SEQ ID NO: 146583 - DNA, 27 bp, Artificial sequence
  SiRNA target sequence
tctaatattattttattaagagtgtct

SEQ ID NO: 146584 - DNA, 27 bp, Artificial sequence
  SiRNA target sequence
ctaatattattttattaagagtgtcta

SEQ ID NO: 146585 - DNA, 27 bp, Artificial sequence
  SiRNA target sequence
taatattattttattaagagtgtctac

SEQ ID NO: 146586 - DNA, 27 bp, Artificial sequence
  SiRNA target sequence
aatattattttattaagagtgtctaca

SEQ ID NO: 146587 - DNA, 27 bp, Artificial sequence
  SiRNA target sequence
atattattttattaagagtgtctacat

SEQ ID NO: 146588 - DNA, 27 bp, Artificial sequence
  SiRNA target sequence
tattattttattaagagtgtctacata

SEQ ID NO: 146589 - DNA, 27 bp, Artificial sequence
  SiRNA target sequence
attattttattaagagtgtctacatac

SEQ ID NO: 146590 - DNA, 27 bp, Artificial sequence
  SiRNA target sequence
ttattttattaagagtgtctacatacg

SEQ ID NO: 146591 - DNA, 27 bp, Artificial sequence
  SiRNA target sequence
tattttattaagagtgtctacatacgc

SEQ ID NO: 146592 - DNA, 27 bp, Artificial sequence
  SiRNA target sequence
attttattaagagtgtctacatacgct

SEQ ID NO: 146593 - DNA, 27 bp, Artificial sequence
  SiRNA target sequence
ttttattaagagtgtctacatacgctt

SEQ ID NO: 146594 - DNA, 27 bp, Artificial sequence
  SiRNA target sequence
tttattaagagtgtctacatacgcttg

SEQ ID NO: 146595 - DNA, 27 bp, Artificial sequence
  SiRNA target sequence
ttattaagagtgtctacatacgcttga

SEQ ID NO: 146596 - DNA, 27 bp, Artificial sequence
  SiRNA target sequence
tattaagagtgtctacatacgcttgat

SEQ ID NO: 146597 - DNA, 27 bp, Artificial sequence
  SiRNA target sequence
attaagagtgtctacatacgcttgatg

SEQ ID NO: 146598 - DNA, 27 bp, Artificial sequence
  SiRNA target sequence
ttaagagtgtctacatacgcttgatgg

SEQ ID NO: 146599 - DNA, 27 bp, Artificial sequence
  SiRNA target sequence
taagagtgtctacatacgcttgatggt

SEQ ID NO: 146600 - DNA, 27 bp, Artificial sequence
  SiRNA target sequence
aagagtgtctacatacgcttgatggtg

SEQ ID NO: 146601 - DNA, 27 bp, Artificial sequence
  SiRNA target sequence
agagtgtctacatacgcttgatggtgc

SEQ ID NO: 146602 - DNA, 27 bp, Artificial sequence
  SiRNA target sequence
gagtgtctacatacgcttgatggtgct

SEQ ID NO: 146603 - DNA, 27 bp, Artificial sequence
  SiRNA target sequence
agtgtctacatacgcttgatggtgctt

SEQ ID NO: 146604 - DNA, 27 bp, Artificial sequence
  SiRNA target sequence
gtgtctacatacgcttgatggtgctta

SEQ ID NO: 146605 - DNA, 27 bp, Artificial sequence
  SiRNA target sequence
tgtctacatacgcttgatggtgcttag

SEQ ID NO: 146606 - DNA, 27 bp, Artificial sequence
  SiRNA target sequence
gtctacatacgcttgatggtgcttaga

SEQ ID NO: 146607 - DNA, 27 bp, Artificial sequence
  SiRNA target sequence
tctacatacgcttgatggtgcttagag

SEQ ID NO: 146608 - DNA, 27 bp, Artificial sequence
  SiRNA target sequence
ctacatacgcttgatggtgcttagagt

SEQ ID NO: 146609 - DNA, 27 bp, Artificial sequence
  SiRNA target sequence
tacatacgcttgatggtgcttagagtg

SEQ ID NO: 146610 - DNA, 27 bp, Artificial sequence
  SiRNA target sequence
acatacgcttgatggtgcttagagtgg

SEQ ID NO: 146611 - DNA, 27 bp, Artificial sequence
  SiRNA target sequence
catacgcttgatggtgcttagagtggt

SEQ ID NO: 146612 - DNA, 27 bp, Artificial sequence
  SiRNA target sequence
atacgcttgatggtgcttagagtggtg

SEQ ID NO: 146613 - DNA, 27 bp, Artificial sequence
  SiRNA target sequence
tacgcttgatggtgcttagagtggtgg

SEQ ID NO: 146614 - DNA, 27 bp, Artificial sequence
  SiRNA target sequence
acgcttgatggtgcttagagtggtggg

SEQ ID NO: 146615 - DNA, 27 bp, Artificial sequence
  SiRNA target sequence
cgcttgatggtgcttagagtggtgggt

SEQ ID NO: 146616 - DNA, 27 bp, Artificial sequence
  SiRNA target sequence
gcttgatggtgcttagagtggtgggtc

SEQ ID NO: 146617 - DNA, 27 bp, Artificial sequence
  SiRNA target sequence
cttgatggtgcttagagtggtgggtct

SEQ ID NO: 146618 - DNA, 27 bp, Artificial sequence
  SiRNA target sequence
ttgatggtgcttagagtggtgggtctc

SEQ ID NO: 146619 - DNA, 27 bp, Artificial sequence
  SiRNA target sequence
tgatggtgcttagagtggtgggtctcc

SEQ ID NO: 146620 - DNA, 27 bp, Artificial sequence
  SiRNA target sequence
gatggtgcttagagtggtgggtctcca

SEQ ID NO: 146621 - DNA, 27 bp, Artificial sequence
  SiRNA target sequence
atggtgcttagagtggtgggtctccat

SEQ ID NO: 146622 - DNA, 27 bp, Artificial sequence
  SiRNA target sequence
tggtgcttagagtggtgggtctccatt

SEQ ID NO: 146623 - DNA, 27 bp, Artificial sequence
  SiRNA target sequence
ggtgcttagagtggtgggtctccatta

SEQ ID NO: 146624 - DNA, 27 bp, Artificial sequence
  SiRNA target sequence
gtgcttagagtggtgggtctccattat

SEQ ID NO: 146625 - DNA, 27 bp, Artificial sequence
  SiRNA target sequence
tgcttagagtggtgggtctccattata

SEQ ID NO: 146626 - DNA, 27 bp, Artificial sequence
  SiRNA target sequence
gcttagagtggtgggtctccattatat

SEQ ID NO: 146627 - DNA, 27 bp, Artificial sequence
  SiRNA target sequence
cttagagtggtgggtctccattatatc

SEQ ID NO: 146628 - DNA, 27 bp, Artificial sequence
  SiRNA target sequence
ttagagtggtgggtctccattatatct

SEQ ID NO: 146629 - DNA, 27 bp, Artificial sequence
  SiRNA target sequence
tagagtggtgggtctccattatatctt

SEQ ID NO: 146630 - DNA, 27 bp, Artificial sequence
  SiRNA target sequence
agagtggtgggtctccattatatcttc

SEQ ID NO: 146631 - DNA, 27 bp, Artificial sequence
  SiRNA target sequence
gagtggtgggtctccattatatcttca

SEQ ID NO: 146632 - DNA, 27 bp, Artificial sequence
  SiRNA target sequence
agtggtgggtctccattatatcttcac

SEQ ID NO: 146633 - DNA, 27 bp, Artificial sequence
  SiRNA target sequence
gtggtgggtctccattatatcttcact

SEQ ID NO: 146634 - DNA, 27 bp, Artificial sequence
  SiRNA target sequence
tggtgggtctccattatatcttcactt

SEQ ID NO: 146635 - DNA, 27 bp, Artificial sequence
  SiRNA target sequence
ggtgggtctccattatatcttcactta

SEQ ID NO: 146636 - DNA, 27 bp, Artificial sequence
  SiRNA target sequence
gtgggtctccattatatcttcacttat

SEQ ID NO: 146637 - DNA, 27 bp, Artificial sequence
  SiRNA target sequence
tgggtctccattatatcttcacttata

SEQ ID NO: 146638 - DNA, 27 bp, Artificial sequence
  SiRNA target sequence
gggtctccattatatcttcacttatat

SEQ ID NO: 146639 - DNA, 27 bp, Artificial sequence
  SiRNA target sequence
ggtctccattatatcttcacttatata

SEQ ID NO: 146640 - DNA, 27 bp, Artificial sequence
  SiRNA target sequence
gtctccattatatcttcacttatataa

SEQ ID NO: 146641 - DNA, 27 bp, Artificial sequence
  SiRNA target sequence
tctccattatatcttcacttatataag

SEQ ID NO: 146642 - DNA, 27 bp, Artificial sequence
  SiRNA target sequence
ctccattatatcttcacttatataagg

SEQ ID NO: 146643 - DNA, 27 bp, Artificial sequence
  SiRNA target sequence
tccattatatcttcacttatataaggc

SEQ ID NO: 146644 - DNA, 27 bp, Artificial sequence
  SiRNA target sequence
ccattatatcttcacttatataaggct

SEQ ID NO: 146645 - DNA, 27 bp, Artificial sequence
  SiRNA target sequence
cattatatcttcacttatataaggctc

SEQ ID NO: 146646 - DNA, 27 bp, Artificial sequence
  SiRNA target sequence
attatatcttcacttatataaggctct

SEQ ID NO: 146647 - DNA, 27 bp, Artificial sequence
  SiRNA target sequence
ttatatcttcacttatataaggctcta

SEQ ID NO: 146648 - DNA, 27 bp, Artificial sequence
  SiRNA target sequence
tatatcttcacttatataaggctctag

SEQ ID NO: 146649 - DNA, 27 bp, Artificial sequence
  SiRNA target sequence
atatcttcacttatataaggctctaga

SEQ ID NO: 146650 - DNA, 27 bp, Artificial sequence
  SiRNA target sequence
tatcttcacttatataaggctctagag

SEQ ID NO: 146651 - DNA, 27 bp, Artificial sequence
  SiRNA target sequence
atcttcacttatataaggctctagaga

SEQ ID NO: 146652 - DNA, 27 bp, Artificial sequence
  SiRNA target sequence
tcttcacttatataaggctctagagat

SEQ ID NO: 146653 - DNA, 27 bp, Artificial sequence
  SiRNA target sequence
cttcacttatataaggctctagagatt

SEQ ID NO: 146654 - DNA, 27 bp, Artificial sequence
  SiRNA target sequence
ttcacttatataaggctctagagattt

SEQ ID NO: 146655 - DNA, 27 bp, Artificial sequence
  SiRNA target sequence
tcacttatataaggctctagagattta

SEQ ID NO: 146656 - DNA, 27 bp, Artificial sequence
  SiRNA target sequence
cacttatataaggctctagagatttat

SEQ ID NO: 146657 - DNA, 27 bp, Artificial sequence
  SiRNA target sequence
acttatataaggctctagagatttata

SEQ ID NO: 146658 - DNA, 27 bp, Artificial sequence
  SiRNA target sequence
cttatataaggctctagagatttataa

SEQ ID NO: 146659 - DNA, 27 bp, Artificial sequence
  SiRNA target sequence
ttatataaggctctagagatttataac

SEQ ID NO: 146660 - DNA, 27 bp, Artificial sequence
  SiRNA target sequence
tatataaggctctagagatttataact

SEQ ID NO: 146661 - DNA, 27 bp, Artificial sequence
  SiRNA target sequence
atataaggctctagagatttataacta

SEQ ID NO: 146662 - DNA, 27 bp, Artificial sequence
  SiRNA target sequence
tataaggctctagagatttataactat

SEQ ID NO: 146663 - DNA, 27 bp, Artificial sequence
  SiRNA target sequence
ataaggctctagagatttataactata

SEQ ID NO: 146664 - DNA, 27 bp, Artificial sequence
  SiRNA target sequence
taaggctctagagatttataactatat

SEQ ID NO: 146665 - DNA, 27 bp, Artificial sequence
  SiRNA target sequence
aaggctctagagatttataactatatt

SEQ ID NO: 146666 - DNA, 27 bp, Artificial sequence
  SiRNA target sequence
aggctctagagatttataactatattt

SEQ ID NO: 146667 - DNA, 27 bp, Artificial sequence
  SiRNA target sequence
ggctctagagatttataactatatttc

SEQ ID NO: 146668 - DNA, 27 bp, Artificial sequence
  SiRNA target sequence
gctctagagatttataactatatttca

SEQ ID NO: 146669 - DNA, 27 bp, Artificial sequence
  SiRNA target sequence
ctctagagatttataactatatttcag

SEQ ID NO: 146670 - DNA, 27 bp, Artificial sequence
  SiRNA target sequence
tctagagatttataactatatttcaga

SEQ ID NO: 146671 - DNA, 27 bp, Artificial sequence
  SiRNA target sequence
ctagagatttataactatatttcagat

SEQ ID NO: 146672 - DNA, 27 bp, Artificial sequence
  SiRNA target sequence
tagagatttataactatatttcagatt

SEQ ID NO: 146673 - DNA, 27 bp, Artificial sequence
  SiRNA target sequence
agagatttataactatatttcagattt

SEQ ID NO: 146674 - DNA, 27 bp, Artificial sequence
  SiRNA target sequence
gagatttataactatatttcagatttg

SEQ ID NO: 146675 - DNA, 27 bp, Artificial sequence
  SiRNA target sequence
agatttataactatatttcagatttgg

SEQ ID NO: 146676 - DNA, 27 bp, Artificial sequence
  SiRNA target sequence
gatttataactatatttcagatttgga

SEQ ID NO: 146677 - DNA, 27 bp, Artificial sequence
  SiRNA target sequence
atttataactatatttcagatttggaa

SEQ ID NO: 146678 - DNA, 27 bp, Artificial sequence
  SiRNA target sequence
tttataactatatttcagatttggaag

SEQ ID NO: 146679 - DNA, 27 bp, Artificial sequence
  SiRNA target sequence
ttataactatatttcagatttggaaga

SEQ ID NO: 146680 - DNA, 27 bp, Artificial sequence
  SiRNA target sequence
tataactatatttcagatttggaagag

SEQ ID NO: 146681 - DNA, 27 bp, Artificial sequence
  SiRNA target sequence
ataactatatttcagatttggaagagt

SEQ ID NO: 146682 - DNA, 27 bp, Artificial sequence
  SiRNA target sequence
taactatatttcagatttggaagagtg

SEQ ID NO: 146683 - DNA, 27 bp, Artificial sequence
  SiRNA target sequence
aactatatttcagatttggaagagtga

SEQ ID NO: 146684 - DNA, 27 bp, Artificial sequence
  SiRNA target sequence
actatatttcagatttggaagagtgaa

SEQ ID NO: 146685 - DNA, 27 bp, Artificial sequence
  SiRNA target sequence
ctatatttcagatttggaagagtgaac

SEQ ID NO: 146686 - DNA, 27 bp, Artificial sequence
  SiRNA target sequence
tatatttcagatttggaagagtgaaca

SEQ ID NO: 146687 - DNA, 27 bp, Artificial sequence
  SiRNA target sequence
atatttcagatttggaagagtgaacat

SEQ ID NO: 146688 - DNA, 19 bp, Artificial sequence
  SiRNA target sequence
atggcacaagacccccaag

SEQ ID NO: 146689 - DNA, 19 bp, Artificial sequence
  SiRNA target sequence
tggcacaagacccccaagg

SEQ ID NO: 146690 - DNA, 19 bp, Artificial sequence
  SiRNA target sequence
ggcacaagacccccaagga

SEQ ID NO: 146691 - DNA, 19 bp, Artificial sequence
  SiRNA target sequence
gcacaagacccccaaggac

SEQ ID NO: 146692 - DNA, 19 bp, Artificial sequence
  SiRNA target sequence
cacaagacccccaaggact

SEQ ID NO: 146693 - DNA, 19 bp, Artificial sequence
  SiRNA target sequence
acaagacccccaaggactt

SEQ ID NO: 146694 - DNA, 19 bp, Artificial sequence
  SiRNA target sequence
caagacccccaaggacttt

SEQ ID NO: 146695 - DNA, 19 bp, Artificial sequence
  SiRNA target sequence
aagacccccaaggacttta

SEQ ID NO: 146696 - DNA, 19 bp, Artificial sequence
  SiRNA target sequence
agacccccaaggactttat

SEQ ID NO: 146697 - DNA, 19 bp, Artificial sequence
  SiRNA target sequence
gacccccaaggactttatg

SEQ ID NO: 146698 - DNA, 19 bp, Artificial sequence
  SiRNA target sequence
acccccaaggactttatga

SEQ ID NO: 146699 - DNA, 19 bp, Artificial sequence
  SiRNA target sequence
cccccaaggactttatgaa

SEQ ID NO: 146700 - DNA, 19 bp, Artificial sequence
  SiRNA target sequence
ccccaaggactttatgaag

SEQ ID NO: 146701 - DNA, 19 bp, Artificial sequence
  SiRNA target sequence
cccaaggactttatgaagt

SEQ ID NO: 146702 - DNA, 19 bp, Artificial sequence
  SiRNA target sequence
ccaaggactttatgaagta

SEQ ID NO: 146703 - DNA, 19 bp, Artificial sequence
  SiRNA target sequence
caaggactttatgaagtat

SEQ ID NO: 146704 - DNA, 19 bp, Artificial sequence
  SiRNA target sequence
aaggactttatgaagtatt

SEQ ID NO: 146705 - DNA, 19 bp, Artificial sequence
  SiRNA target sequence
aggactttatgaagtatta

SEQ ID NO: 146706 - DNA, 19 bp, Artificial sequence
  SiRNA target sequence
ggactttatgaagtattag

SEQ ID NO: 146707 - DNA, 19 bp, Artificial sequence
  SiRNA target sequence
gactttatgaagtattagg

SEQ ID NO: 146708 - DNA, 19 bp, Artificial sequence
  SiRNA target sequence
actttatgaagtattagga

SEQ ID NO: 146709 - DNA, 19 bp, Artificial sequence
  SiRNA target sequence
ctttatgaagtattaggac

SEQ ID NO: 146710 - DNA, 19 bp, Artificial sequence
  SiRNA target sequence
tttatgaagtattaggact

SEQ ID NO: 146711 - DNA, 19 bp, Artificial sequence
  SiRNA target sequence
ttatgaagtattaggactt

SEQ ID NO: 146712 - DNA, 19 bp, Artificial sequence
  SiRNA target sequence
tatgaagtattaggactta

SEQ ID NO: 146713 - DNA, 19 bp, Artificial sequence
  SiRNA target sequence
atgaagtattaggacttaa

SEQ ID NO: 146714 - DNA, 19 bp, Artificial sequence
  SiRNA target sequence
tgaagtattaggacttaaa

SEQ ID NO: 146715 - DNA, 19 bp, Artificial sequence
  SiRNA target sequence
gaagtattaggacttaaag

SEQ ID NO: 146716 - DNA, 19 bp, Artificial sequence
  SiRNA target sequence
aagtattaggacttaaagc

SEQ ID NO: 146717 - DNA, 19 bp, Artificial sequence
  SiRNA target sequence
agtattaggacttaaagct

SEQ ID NO: 146718 - DNA, 19 bp, Artificial sequence
  SiRNA target sequence
gtattaggacttaaagctg

SEQ ID NO: 146719 - DNA, 19 bp, Artificial sequence
  SiRNA target sequence
tattaggacttaaagctgg

SEQ ID NO: 146720 - DNA, 19 bp, Artificial sequence
  SiRNA target sequence
attaggacttaaagctggt

SEQ ID NO: 146721 - DNA, 19 bp, Artificial sequence
  SiRNA target sequence
ttaggacttaaagctggtg

SEQ ID NO: 146722 - DNA, 19 bp, Artificial sequence
  SiRNA target sequence
taggacttaaagctggtgc

SEQ ID NO: 146723 - DNA, 19 bp, Artificial sequence
  SiRNA target sequence
aggacttaaagctggtgca

SEQ ID NO: 146724 - DNA, 19 bp, Artificial sequence
  SiRNA target sequence
ggacttaaagctggtgcaa

SEQ ID NO: 146725 - DNA, 19 bp, Artificial sequence
  SiRNA target sequence
gacttaaagctggtgcaag

SEQ ID NO: 146726 - DNA, 19 bp, Artificial sequence
  SiRNA target sequence
acttaaagctggtgcaagc

SEQ ID NO: 146727 - DNA, 19 bp, Artificial sequence
  SiRNA target sequence
cttaaagctggtgcaagca

SEQ ID NO: 146728 - DNA, 19 bp, Artificial sequence
  SiRNA target sequence
ttaaagctggtgcaagcat

SEQ ID NO: 146729 - DNA, 19 bp, Artificial sequence
  SiRNA target sequence
taaagctggtgcaagcatt

SEQ ID NO: 146730 - DNA, 19 bp, Artificial sequence
  SiRNA target sequence
aaagctggtgcaagcattg

SEQ ID NO: 146731 - DNA, 19 bp, Artificial sequence
  SiRNA target sequence
aagctggtgcaagcattga

SEQ ID NO: 146732 - DNA, 19 bp, Artificial sequence
  SiRNA target sequence
agctggtgcaagcattgat

SEQ ID NO: 146733 - DNA, 19 bp, Artificial sequence
  SiRNA target sequence
gctggtgcaagcattgatg

SEQ ID NO: 146734 - DNA, 19 bp, Artificial sequence
  SiRNA target sequence
ctggtgcaagcattgatga

SEQ ID NO: 146735 - DNA, 19 bp, Artificial sequence
  SiRNA target sequence
tggtgcaagcattgatgaa

SEQ ID NO: 146736 - DNA, 19 bp, Artificial sequence
  SiRNA target sequence
ggtgcaagcattgatgaag

SEQ ID NO: 146737 - DNA, 19 bp, Artificial sequence
  SiRNA target sequence
gtgcaagcattgatgaagt

SEQ ID NO: 146738 - DNA, 19 bp, Artificial sequence
  SiRNA target sequence
tgcaagcattgatgaagtt

SEQ ID NO: 146739 - DNA, 19 bp, Artificial sequence
  SiRNA target sequence
gcaagcattgatgaagtta

SEQ ID NO: 146740 - DNA, 19 bp, Artificial sequence
  SiRNA target sequence
caagcattgatgaagttaa

SEQ ID NO: 146741 - DNA, 19 bp, Artificial sequence
  SiRNA target sequence
aagcattgatgaagttaaa

SEQ ID NO: 146742 - DNA, 19 bp, Artificial sequence
  SiRNA target sequence
agcattgatgaagttaaaa

SEQ ID NO: 146743 - DNA, 19 bp, Artificial sequence
  SiRNA target sequence
gcattgatgaagttaaaaa

SEQ ID NO: 146744 - DNA, 19 bp, Artificial sequence
  SiRNA target sequence
cattgatgaagttaaaaaa

SEQ ID NO: 146745 - DNA, 19 bp, Artificial sequence
  SiRNA target sequence
attgatgaagttaaaaaag

SEQ ID NO: 146746 - DNA, 19 bp, Artificial sequence
  SiRNA target sequence
ttgatgaagttaaaaaagc

SEQ ID NO: 146747 - DNA, 19 bp, Artificial sequence
  SiRNA target sequence
tgatgaagttaaaaaagca

SEQ ID NO: 146748 - DNA, 19 bp, Artificial sequence
  SiRNA target sequence
gatgaagttaaaaaagcat

SEQ ID NO: 146749 - DNA, 19 bp, Artificial sequence
  SiRNA target sequence
atgaagttaaaaaagcatt

SEQ ID NO: 146750 - DNA, 19 bp, Artificial sequence
  SiRNA target sequence
tgaagttaaaaaagcattt

SEQ ID NO: 146751 - DNA, 19 bp, Artificial sequence
  SiRNA target sequence
gaagttaaaaaagcattta

SEQ ID NO: 146752 - DNA, 19 bp, Artificial sequence
  SiRNA target sequence
aagttaaaaaagcatttac

SEQ ID NO: 146753 - DNA, 19 bp, Artificial sequence
  SiRNA target sequence
agttaaaaaagcatttaca

SEQ ID NO: 146754 - DNA, 19 bp, Artificial sequence
  SiRNA target sequence
gttaaaaaagcatttacaa

SEQ ID NO: 146755 - DNA, 19 bp, Artificial sequence
  SiRNA target sequence
ttaaaaaagcatttacaaa

SEQ ID NO: 146756 - DNA, 19 bp, Artificial sequence
  SiRNA target sequence
taaaaaagcatttacaaaa

SEQ ID NO: 146757 - DNA, 19 bp, Artificial sequence
  SiRNA target sequence
aaaaaagcatttacaaaaa

SEQ ID NO: 146758 - DNA, 19 bp, Artificial sequence
  SiRNA target sequence
aaaaagcatttacaaaaaa

SEQ ID NO: 146759 - DNA, 19 bp, Artificial sequence
  SiRNA target sequence
aaaagcatttacaaaaaaa

SEQ ID NO: 146760 - DNA, 19 bp, Artificial sequence
  SiRNA target sequence
aaagcatttacaaaaaaac

SEQ ID NO: 146761 - DNA, 19 bp, Artificial sequence
  SiRNA target sequence
aagcatttacaaaaaaaca

SEQ ID NO: 146762 - DNA, 19 bp, Artificial sequence
  SiRNA target sequence
agcatttacaaaaaaacaa

SEQ ID NO: 146763 - DNA, 19 bp, Artificial sequence
  SiRNA target sequence
gcatttacaaaaaaacaaa

SEQ ID NO: 146764 - DNA, 19 bp, Artificial sequence
  SiRNA target sequence
catttacaaaaaaacaaag

SEQ ID NO: 146765 - DNA, 19 bp, Artificial sequence
  SiRNA target sequence
atttacaaaaaaacaaagg

SEQ ID NO: 146766 - DNA, 19 bp, Artificial sequence
  SiRNA target sequence
tttacaaaaaaacaaaggg

SEQ ID NO: 146767 - DNA, 19 bp, Artificial sequence
  SiRNA target sequence
ttacaaaaaaacaaaggga

SEQ ID NO: 146768 - DNA, 19 bp, Artificial sequence
  SiRNA target sequence
tacaaaaaaacaaagggaa

SEQ ID NO: 146769 - DNA, 19 bp, Artificial sequence
  SiRNA target sequence
acaaaaaaacaaagggaat

SEQ ID NO: 146770 - DNA, 19 bp, Artificial sequence
  SiRNA target sequence
caaaaaaacaaagggaatg

SEQ ID NO: 146771 - DNA, 19 bp, Artificial sequence
  SiRNA target sequence
aaaaaaacaaagggaatgt

SEQ ID NO: 146772 - DNA, 19 bp, Artificial sequence
  SiRNA target sequence
aaaaaacaaagggaatgtc

SEQ ID NO: 146773 - DNA, 19 bp, Artificial sequence
  SiRNA target sequence
aaaaacaaagggaatgtca

SEQ ID NO: 146774 - DNA, 19 bp, Artificial sequence
  SiRNA target sequence
aaaacaaagggaatgtcat

SEQ ID NO: 146775 - DNA, 19 bp, Artificial sequence
  SiRNA target sequence
aaacaaagggaatgtcatc

SEQ ID NO: 146776 - DNA, 19 bp, Artificial sequence
  SiRNA target sequence
aacaaagggaatgtcatcc

SEQ ID NO: 146777 - DNA, 19 bp, Artificial sequence
  SiRNA target sequence
acaaagggaatgtcatccc

SEQ ID NO: 146778 - DNA, 19 bp, Artificial sequence
  SiRNA target sequence
caaagggaatgtcatcccg

SEQ ID NO: 146779 - DNA, 19 bp, Artificial sequence
  SiRNA target sequence
aaagggaatgtcatcccga

SEQ ID NO: 146780 - DNA, 19 bp, Artificial sequence
  SiRNA target sequence
aagggaatgtcatcccgat

SEQ ID NO: 146781 - DNA, 19 bp, Artificial sequence
  SiRNA target sequence
agggaatgtcatcccgatg

SEQ ID NO: 146782 - DNA, 19 bp, Artificial sequence
  SiRNA target sequence
gggaatgtcatcccgatgg

SEQ ID NO: 146783 - DNA, 19 bp, Artificial sequence
  SiRNA target sequence
ggaatgtcatcccgatggt

SEQ ID NO: 146784 - DNA, 19 bp, Artificial sequence
  SiRNA target sequence
gaatgtcatcccgatggtg

SEQ ID NO: 146785 - DNA, 19 bp, Artificial sequence
  SiRNA target sequence
aatgtcatcccgatggtgc

SEQ ID NO: 146786 - DNA, 19 bp, Artificial sequence
  SiRNA target sequence
atgtcatcccgatggtgca

SEQ ID NO: 146787 - DNA, 19 bp, Artificial sequence
  SiRNA target sequence
tgtcatcccgatggtgcat

SEQ ID NO: 146788 - DNA, 19 bp, Artificial sequence
  SiRNA target sequence
gtcatcccgatggtgcatt

SEQ ID NO: 146789 - DNA, 19 bp, Artificial sequence
  SiRNA target sequence
tcatcccgatggtgcattt

SEQ ID NO: 146790 - DNA, 19 bp, Artificial sequence
  SiRNA target sequence
catcccgatggtgcatttt

SEQ ID NO: 146791 - DNA, 19 bp, Artificial sequence
  SiRNA target sequence
atcccgatggtgcattttt

SEQ ID NO: 146792 - DNA, 19 bp, Artificial sequence
  SiRNA target sequence
tcccgatggtgcatttttt

SEQ ID NO: 146793 - DNA, 19 bp, Artificial sequence
  SiRNA target sequence
cccgatggtgcatttttta

SEQ ID NO: 146794 - DNA, 19 bp, Artificial sequence
  SiRNA target sequence
ccgatggtgcattttttaa

SEQ ID NO: 146795 - DNA, 19 bp, Artificial sequence
  SiRNA target sequence
cgatggtgcattttttaaa

SEQ ID NO: 146796 - DNA, 19 bp, Artificial sequence
  SiRNA target sequence
gatggtgcattttttaaag

SEQ ID NO: 146797 - DNA, 19 bp, Artificial sequence
  SiRNA target sequence
atggtgcattttttaaagc

SEQ ID NO: 146798 - DNA, 19 bp, Artificial sequence
  SiRNA target sequence
tggtgcattttttaaagct

SEQ ID NO: 146799 - DNA, 19 bp, Artificial sequence
  SiRNA target sequence
ggtgcattttttaaagctg

SEQ ID NO: 146800 - DNA, 19 bp, Artificial sequence
  SiRNA target sequence
gtgcattttttaaagctgc

SEQ ID NO: 146801 - DNA, 19 bp, Artificial sequence
  SiRNA target sequence
tgcattttttaaagctgct

SEQ ID NO: 146802 - DNA, 19 bp, Artificial sequence
  SiRNA target sequence
gcattttttaaagctgctc

SEQ ID NO: 146803 - DNA, 19 bp, Artificial sequence
  SiRNA target sequence
cattttttaaagctgctct

SEQ ID NO: 146804 - DNA, 19 bp, Artificial sequence
  SiRNA target sequence
attttttaaagctgctctt

SEQ ID NO: 146805 - DNA, 19 bp, Artificial sequence
  SiRNA target sequence
ttttttaaagctgctctta

SEQ ID NO: 146806 - DNA, 19 bp, Artificial sequence
  SiRNA target sequence
tttttaaagctgctcttag

SEQ ID NO: 146807 - DNA, 19 bp, Artificial sequence
  SiRNA target sequence
ttttaaagctgctcttaga

SEQ ID NO: 146808 - DNA, 19 bp, Artificial sequence
  SiRNA target sequence
tttaaagctgctcttagaa

SEQ ID NO: 146809 - DNA, 19 bp, Artificial sequence
  SiRNA target sequence
ttaaagctgctcttagaaa

SEQ ID NO: 146810 - DNA, 19 bp, Artificial sequence
  SiRNA target sequence
taaagctgctcttagaaaa

SEQ ID NO: 146811 - DNA, 19 bp, Artificial sequence
  SiRNA target sequence
aaagctgctcttagaaaat

SEQ ID NO: 146812 - DNA, 19 bp, Artificial sequence
  SiRNA target sequence
aagctgctcttagaaaatg

SEQ ID NO: 146813 - DNA, 19 bp, Artificial sequence
  SiRNA target sequence
agctgctcttagaaaatgt

SEQ ID NO: 146814 - DNA, 19 bp, Artificial sequence
  SiRNA target sequence
gctgctcttagaaaatgta

SEQ ID NO: 146815 - DNA, 19 bp, Artificial sequence
  SiRNA target sequence
ctgctcttagaaaatgtaa

SEQ ID NO: 146816 - DNA, 19 bp, Artificial sequence
  SiRNA target sequence
tgctcttagaaaatgtaaa

SEQ ID NO: 146817 - DNA, 19 bp, Artificial sequence
  SiRNA target sequence
gctcttagaaaatgtaaaa

SEQ ID NO: 146818 - DNA, 19 bp, Artificial sequence
  SiRNA target sequence
ctcttagaaaatgtaaaac

SEQ ID NO: 146819 - DNA, 19 bp, Artificial sequence
  SiRNA target sequence
tcttagaaaatgtaaaaca

SEQ ID NO: 146820 - DNA, 19 bp, Artificial sequence
  SiRNA target sequence
cttagaaaatgtaaaacag

SEQ ID NO: 146821 - DNA, 19 bp, Artificial sequence
  SiRNA target sequence
ttagaaaatgtaaaacaga

SEQ ID NO: 146822 - DNA, 19 bp, Artificial sequence
  SiRNA target sequence
tagaaaatgtaaaacagat

SEQ ID NO: 146823 - DNA, 19 bp, Artificial sequence
  SiRNA target sequence
agaaaatgtaaaacagatg

SEQ ID NO: 146824 - DNA, 19 bp, Artificial sequence
  SiRNA target sequence
gaaaatgtaaaacagatga

SEQ ID NO: 146825 - DNA, 19 bp, Artificial sequence
  SiRNA target sequence
aaaatgtaaaacagatgaa

SEQ ID NO: 146826 - DNA, 19 bp, Artificial sequence
  SiRNA target sequence
aaatgtaaaacagatgaag

SEQ ID NO: 146827 - DNA, 19 bp, Artificial sequence
  SiRNA target sequence
aatgtaaaacagatgaaga

SEQ ID NO: 146828 - DNA, 19 bp, Artificial sequence
  SiRNA target sequence
atgtaaaacagatgaagaa

SEQ ID NO: 146829 - DNA, 19 bp, Artificial sequence
  SiRNA target sequence
tgtaaaacagatgaagaaa

SEQ ID NO: 146830 - DNA, 19 bp, Artificial sequence
  SiRNA target sequence
gtaaaacagatgaagaaag

SEQ ID NO: 146831 - DNA, 19 bp, Artificial sequence
  SiRNA target sequence
taaaacagatgaagaaaga

SEQ ID NO: 146832 - DNA, 19 bp, Artificial sequence
  SiRNA target sequence
aaaacagatgaagaaagag

SEQ ID NO: 146833 - DNA, 19 bp, Artificial sequence
  SiRNA target sequence
aaacagatgaagaaagagc

SEQ ID NO: 146834 - DNA, 19 bp, Artificial sequence
  SiRNA target sequence
aacagatgaagaaagagca

SEQ ID NO: 146835 - DNA, 19 bp, Artificial sequence
  SiRNA target sequence
acagatgaagaaagagcaa

SEQ ID NO: 146836 - DNA, 19 bp, Artificial sequence
  SiRNA target sequence
cagatgaagaaagagcaaa

SEQ ID NO: 146837 - DNA, 19 bp, Artificial sequence
  SiRNA target sequence
agatgaagaaagagcaaaa

SEQ ID NO: 146838 - DNA, 19 bp, Artificial sequence
  SiRNA target sequence
gatgaagaaagagcaaaag

SEQ ID NO: 146839 - DNA, 19 bp, Artificial sequence
  SiRNA target sequence
atgaagaaagagcaaaagt

SEQ ID NO: 146840 - DNA, 19 bp, Artificial sequence
  SiRNA target sequence
tgaagaaagagcaaaagtt

SEQ ID NO: 146841 - DNA, 19 bp, Artificial sequence
  SiRNA target sequence
gaagaaagagcaaaagttg

SEQ ID NO: 146842 - DNA, 19 bp, Artificial sequence
  SiRNA target sequence
aagaaagagcaaaagttga

SEQ ID NO: 146843 - DNA, 19 bp, Artificial sequence
  SiRNA target sequence
agaaagagcaaaagttgaa

SEQ ID NO: 146844 - DNA, 19 bp, Artificial sequence
  SiRNA target sequence
gaaagagcaaaagttgaaa

SEQ ID NO: 146845 - DNA, 19 bp, Artificial sequence
  SiRNA target sequence
aaagagcaaaagttgaaaa

SEQ ID NO: 146846 - DNA, 19 bp, Artificial sequence
  SiRNA target sequence
aagagcaaaagttgaaaaa

SEQ ID NO: 146847 - DNA, 19 bp, Artificial sequence
  SiRNA target sequence
agagcaaaagttgaaaaag

SEQ ID NO: 146848 - DNA, 19 bp, Artificial sequence
  SiRNA target sequence
gagcaaaagttgaaaaaga

SEQ ID NO: 146849 - DNA, 19 bp, Artificial sequence
  SiRNA target sequence
agcaaaagttgaaaaagaa

SEQ ID NO: 146850 - DNA, 19 bp, Artificial sequence
  SiRNA target sequence
gcaaaagttgaaaaagaat

SEQ ID NO: 146851 - DNA, 19 bp, Artificial sequence
  SiRNA target sequence
caaaagttgaaaaagaatt

SEQ ID NO: 146852 - DNA, 19 bp, Artificial sequence
  SiRNA target sequence
aaaagttgaaaaagaattt

SEQ ID NO: 146853 - DNA, 19 bp, Artificial sequence
  SiRNA target sequence
aaagttgaaaaagaattta

SEQ ID NO: 146854 - DNA, 19 bp, Artificial sequence
  SiRNA target sequence
aagttgaaaaagaatttaa

SEQ ID NO: 146855 - DNA, 19 bp, Artificial sequence
  SiRNA target sequence
agttgaaaaagaatttaaa

SEQ ID NO: 146856 - DNA, 19 bp, Artificial sequence
  SiRNA target sequence
gttgaaaaagaatttaaag

SEQ ID NO: 146857 - DNA, 19 bp, Artificial sequence
  SiRNA target sequence
ttgaaaaagaatttaaaga

SEQ ID NO: 146858 - DNA, 19 bp, Artificial sequence
  SiRNA target sequence
tgaaaaagaatttaaagaa

SEQ ID NO: 146859 - DNA, 19 bp, Artificial sequence
  SiRNA target sequence
gaaaaagaatttaaagaaa

SEQ ID NO: 146860 - DNA, 19 bp, Artificial sequence
  SiRNA target sequence
aaaaagaatttaaagaaaa

SEQ ID NO: 146861 - DNA, 19 bp, Artificial sequence
  SiRNA target sequence
aaaagaatttaaagaaaaa

SEQ ID NO: 146862 - DNA, 19 bp, Artificial sequence
  SiRNA target sequence
aaagaatttaaagaaaaat

SEQ ID NO: 146863 - DNA, 19 bp, Artificial sequence
  SiRNA target sequence
aagaatttaaagaaaaatc

SEQ ID NO: 146864 - DNA, 19 bp, Artificial sequence
  SiRNA target sequence
agaatttaaagaaaaatca

SEQ ID NO: 146865 - DNA, 19 bp, Artificial sequence
  SiRNA target sequence
gaatttaaagaaaaatcac

SEQ ID NO: 146866 - DNA, 19 bp, Artificial sequence
  SiRNA target sequence
aatttaaagaaaaatcaca

SEQ ID NO: 146867 - DNA, 19 bp, Artificial sequence
  SiRNA target sequence
atttaaagaaaaatcacaa

SEQ ID NO: 146868 - DNA, 19 bp, Artificial sequence
  SiRNA target sequence
tttaaagaaaaatcacaaa

SEQ ID NO: 146869 - DNA, 19 bp, Artificial sequence
  SiRNA target sequence
ttaaagaaaaatcacaaaa

SEQ ID NO: 146870 - DNA, 19 bp, Artificial sequence
  SiRNA target sequence
taaagaaaaatcacaaaaa

SEQ ID NO: 146871 - DNA, 19 bp, Artificial sequence
  SiRNA target sequence
aaagaaaaatcacaaaaat

SEQ ID NO: 146872 - DNA, 19 bp, Artificial sequence
  SiRNA target sequence
aagaaaaatcacaaaaatg

SEQ ID NO: 146873 - DNA, 19 bp, Artificial sequence
  SiRNA target sequence
agaaaaatcacaaaaatgt

SEQ ID NO: 146874 - DNA, 19 bp, Artificial sequence
  SiRNA target sequence
gaaaaatcacaaaaatgta

SEQ ID NO: 146875 - DNA, 19 bp, Artificial sequence
  SiRNA target sequence
aaaaatcacaaaaatgtaa

SEQ ID NO: 146876 - DNA, 19 bp, Artificial sequence
  SiRNA target sequence
aaaatcacaaaaatgtaat

SEQ ID NO: 146877 - DNA, 19 bp, Artificial sequence
  SiRNA target sequence
aaatcacaaaaatgtaatc

SEQ ID NO: 146878 - DNA, 19 bp, Artificial sequence
  SiRNA target sequence
aatcacaaaaatgtaatca

SEQ ID NO: 146879 - DNA, 19 bp, Artificial sequence
  SiRNA target sequence
atcacaaaaatgtaatcaa

SEQ ID NO: 146880 - DNA, 19 bp, Artificial sequence
  SiRNA target sequence
tcacaaaaatgtaatcaag

SEQ ID NO: 146881 - DNA, 19 bp, Artificial sequence
  SiRNA target sequence
cacaaaaatgtaatcaagc

SEQ ID NO: 146882 - DNA, 19 bp, Artificial sequence
  SiRNA target sequence
acaaaaatgtaatcaagct

SEQ ID NO: 146883 - DNA, 19 bp, Artificial sequence
  SiRNA target sequence
caaaaatgtaatcaagcta

SEQ ID NO: 146884 - DNA, 19 bp, Artificial sequence
  SiRNA target sequence
aaaaatgtaatcaagctaa

SEQ ID NO: 146885 - DNA, 19 bp, Artificial sequence
  SiRNA target sequence
aaaatgtaatcaagctaaa

SEQ ID NO: 146886 - DNA, 19 bp, Artificial sequence
  SiRNA target sequence
aaatgtaatcaagctaaag

SEQ ID NO: 146887 - DNA, 19 bp, Artificial sequence
  SiRNA target sequence
aatgtaatcaagctaaagc

SEQ ID NO: 146888 - DNA, 19 bp, Artificial sequence
  SiRNA target sequence
atgtaatcaagctaaagca

SEQ ID NO: 146889 - DNA, 19 bp, Artificial sequence
  SiRNA target sequence
tgtaatcaagctaaagcag

SEQ ID NO: 146890 - DNA, 19 bp, Artificial sequence
  SiRNA target sequence
gtaatcaagctaaagcagt

SEQ ID NO: 146891 - DNA, 19 bp, Artificial sequence
  SiRNA target sequence
taatcaagctaaagcagtt

SEQ ID NO: 146892 - DNA, 19 bp, Artificial sequence
  SiRNA target sequence
aatcaagctaaagcagttt

SEQ ID NO: 146893 - DNA, 19 bp, Artificial sequence
  SiRNA target sequence
atcaagctaaagcagtttt

SEQ ID NO: 146894 - DNA, 19 bp, Artificial sequence
  SiRNA target sequence
tcaagctaaagcagtttta

SEQ ID NO: 146895 - DNA, 19 bp, Artificial sequence
  SiRNA target sequence
caagctaaagcagttttat

SEQ ID NO: 146896 - DNA, 19 bp, Artificial sequence
  SiRNA target sequence
aagctaaagcagttttatt

SEQ ID NO: 146897 - DNA, 19 bp, Artificial sequence
  SiRNA target sequence
agctaaagcagttttattt

SEQ ID NO: 146898 - DNA, 19 bp, Artificial sequence
  SiRNA target sequence
gctaaagcagttttatttg

SEQ ID NO: 146899 - DNA, 19 bp, Artificial sequence
  SiRNA target sequence
ctaaagcagttttatttga

SEQ ID NO: 146900 - DNA, 19 bp, Artificial sequence
  SiRNA target sequence
taaagcagttttatttgat

SEQ ID NO: 146901 - DNA, 19 bp, Artificial sequence
  SiRNA target sequence
aaagcagttttatttgatg

SEQ ID NO: 146902 - DNA, 19 bp, Artificial sequence
  SiRNA target sequence
aagcagttttatttgatga

SEQ ID NO: 146903 - DNA, 19 bp, Artificial sequence
  SiRNA target sequence
agcagttttatttgatgag

SEQ ID NO: 146904 - DNA, 19 bp, Artificial sequence
  SiRNA target sequence
gcagttttatttgatgaga

SEQ ID NO: 146905 - DNA, 19 bp, Artificial sequence
  SiRNA target sequence
cagttttatttgatgagaa

SEQ ID NO: 146906 - DNA, 19 bp, Artificial sequence
  SiRNA target sequence
agttttatttgatgagaaa

SEQ ID NO: 146907 - DNA, 19 bp, Artificial sequence
  SiRNA target sequence
gttttatttgatgagaaaa

SEQ ID NO: 146908 - DNA, 19 bp, Artificial sequence
  SiRNA target sequence
ttttatttgatgagaaaaa

SEQ ID NO: 146909 - DNA, 19 bp, Artificial sequence
  SiRNA target sequence
tttatttgatgagaaaaaa

SEQ ID NO: 146910 - DNA, 19 bp, Artificial sequence
  SiRNA target sequence
ttatttgatgagaaaaaaa

SEQ ID NO: 146911 - DNA, 19 bp, Artificial sequence
  SiRNA target sequence
tatttgatgagaaaaaaaa

SEQ ID NO: 146912 - DNA, 19 bp, Artificial sequence
  SiRNA target sequence
atttgatgagaaaaaaaag

SEQ ID NO: 146913 - DNA, 19 bp, Artificial sequence
  SiRNA target sequence
tttgatgagaaaaaaaagc

SEQ ID NO: 146914 - DNA, 19 bp, Artificial sequence
  SiRNA target sequence
ttgatgagaaaaaaaagca

SEQ ID NO: 146915 - DNA, 19 bp, Artificial sequence
  SiRNA target sequence
tgatgagaaaaaaaagcaa

SEQ ID NO: 146916 - DNA, 19 bp, Artificial sequence
  SiRNA target sequence
gatgagaaaaaaaagcaag

SEQ ID NO: 146917 - DNA, 19 bp, Artificial sequence
  SiRNA target sequence
atgagaaaaaaaagcaaga

SEQ ID NO: 146918 - DNA, 19 bp, Artificial sequence
  SiRNA target sequence
tgagaaaaaaaagcaagag

SEQ ID NO: 146919 - DNA, 19 bp, Artificial sequence
  SiRNA target sequence
gagaaaaaaaagcaagagt

SEQ ID NO: 146920 - DNA, 19 bp, Artificial sequence
  SiRNA target sequence
agaaaaaaaagcaagagta

SEQ ID NO: 146921 - DNA, 19 bp, Artificial sequence
  SiRNA target sequence
gaaaaaaaagcaagagtat

SEQ ID NO: 146922 - DNA, 19 bp, Artificial sequence
  SiRNA target sequence
aaaaaaaagcaagagtatg

SEQ ID NO: 146923 - DNA, 19 bp, Artificial sequence
  SiRNA target sequence
aaaaaaagcaagagtatga

SEQ ID NO: 146924 - DNA, 19 bp, Artificial sequence
  SiRNA target sequence
aaaaaagcaagagtatgat

SEQ ID NO: 146925 - DNA, 19 bp, Artificial sequence
  SiRNA target sequence
aaaaagcaagagtatgata

SEQ ID NO: 146926 - DNA, 19 bp, Artificial sequence
  SiRNA target sequence
aaaagcaagagtatgatat

SEQ ID NO: 146927 - DNA, 19 bp, Artificial sequence
  SiRNA target sequence
aaagcaagagtatgatatg

SEQ ID NO: 146928 - DNA, 19 bp, Artificial sequence
  SiRNA target sequence
aagcaagagtatgatatgg

SEQ ID NO: 146929 - DNA, 19 bp, Artificial sequence
  SiRNA target sequence
agcaagagtatgatatggg

SEQ ID NO: 146930 - DNA, 19 bp, Artificial sequence
  SiRNA target sequence
gcaagagtatgatatggga

SEQ ID NO: 146931 - DNA, 19 bp, Artificial sequence
  SiRNA target sequence
caagagtatgatatgggaa

SEQ ID NO: 146932 - DNA, 19 bp, Artificial sequence
  SiRNA target sequence
aagagtatgatatgggaat

SEQ ID NO: 146933 - DNA, 19 bp, Artificial sequence
  SiRNA target sequence
agagtatgatatgggaatg

SEQ ID NO: 146934 - DNA, 19 bp, Artificial sequence
  SiRNA target sequence
gagtatgatatgggaatga

SEQ ID NO: 146935 - DNA, 19 bp, Artificial sequence
  SiRNA target sequence
agtatgatatgggaatgac

SEQ ID NO: 146936 - DNA, 19 bp, Artificial sequence
  SiRNA target sequence
gtatgatatgggaatgact

SEQ ID NO: 146937 - DNA, 19 bp, Artificial sequence
  SiRNA target sequence
tatgatatgggaatgactg

SEQ ID NO: 146938 - DNA, 19 bp, Artificial sequence
  SiRNA target sequence
atgatatgggaatgactgg

SEQ ID NO: 146939 - DNA, 19 bp, Artificial sequence
  SiRNA target sequence
tgatatgggaatgactggc

SEQ ID NO: 146940 - DNA, 19 bp, Artificial sequence
  SiRNA target sequence
gatatgggaatgactggcg

SEQ ID NO: 146941 - DNA, 19 bp, Artificial sequence
  SiRNA target sequence
atatgggaatgactggcga

SEQ ID NO: 146942 - DNA, 19 bp, Artificial sequence
  SiRNA target sequence
tatgggaatgactggcgat

SEQ ID NO: 146943 - DNA, 19 bp, Artificial sequence
  SiRNA target sequence
atgggaatgactggcgatt

SEQ ID NO: 146944 - DNA, 19 bp, Artificial sequence
  SiRNA target sequence
tgggaatgactggcgattt

SEQ ID NO: 146945 - DNA, 19 bp, Artificial sequence
  SiRNA target sequence
gggaatgactggcgatttt

SEQ ID NO: 146946 - DNA, 19 bp, Artificial sequence
  SiRNA target sequence
ggaatgactggcgattttg

SEQ ID NO: 146947 - DNA, 19 bp, Artificial sequence
  SiRNA target sequence
gaatgactggcgattttgg

SEQ ID NO: 146948 - DNA, 19 bp, Artificial sequence
  SiRNA target sequence
aatgactggcgattttgga

SEQ ID NO: 146949 - DNA, 19 bp, Artificial sequence
  SiRNA target sequence
atgactggcgattttggat

SEQ ID NO: 146950 - DNA, 19 bp, Artificial sequence
  SiRNA target sequence
tgactggcgattttggatt

SEQ ID NO: 146951 - DNA, 19 bp, Artificial sequence
  SiRNA target sequence
gactggcgattttggattt

SEQ ID NO: 146952 - DNA, 19 bp, Artificial sequence
  SiRNA target sequence
actggcgattttggatttt

SEQ ID NO: 146953 - DNA, 19 bp, Artificial sequence
  SiRNA target sequence
ctggcgattttggattttc

SEQ ID NO: 146954 - DNA, 19 bp, Artificial sequence
  SiRNA target sequence
tggcgattttggattttct

SEQ ID NO: 146955 - DNA, 19 bp, Artificial sequence
  SiRNA target sequence
ggcgattttggattttctg

SEQ ID NO: 146956 - DNA, 19 bp, Artificial sequence
  SiRNA target sequence
gcgattttggattttctgc

SEQ ID NO: 146957 - DNA, 19 bp, Artificial sequence
  SiRNA target sequence
cgattttggattttctgca

SEQ ID NO: 146958 - DNA, 19 bp, Artificial sequence
  SiRNA target sequence
gattttggattttctgcag

SEQ ID NO: 146959 - DNA, 19 bp, Artificial sequence
  SiRNA target sequence
attttggattttctgcagg

SEQ ID NO: 146960 - DNA, 19 bp, Artificial sequence
  SiRNA target sequence
ttttggattttctgcaggt

SEQ ID NO: 146961 - DNA, 19 bp, Artificial sequence
  SiRNA target sequence
tttggattttctgcaggtg

SEQ ID NO: 146962 - DNA, 19 bp, Artificial sequence
  SiRNA target sequence
ttggattttctgcaggtgg

SEQ ID NO: 146963 - DNA, 19 bp, Artificial sequence
  SiRNA target sequence
tggattttctgcaggtggt

SEQ ID NO: 146964 - DNA, 19 bp, Artificial sequence
  SiRNA target sequence
ggattttctgcaggtggtg

SEQ ID NO: 146965 - DNA, 19 bp, Artificial sequence
  SiRNA target sequence
gattttctgcaggtggtgg

SEQ ID NO: 146966 - DNA, 19 bp, Artificial sequence
  SiRNA target sequence
attttctgcaggtggtgga

SEQ ID NO: 146967 - DNA, 19 bp, Artificial sequence
  SiRNA target sequence
ttttctgcaggtggtggag

SEQ ID NO: 146968 - DNA, 19 bp, Artificial sequence
  SiRNA target sequence
tttctgcaggtggtggaga

SEQ ID NO: 146969 - DNA, 19 bp, Artificial sequence
  SiRNA target sequence
ttctgcaggtggtggagac

SEQ ID NO: 146970 - DNA, 19 bp, Artificial sequence
  SiRNA target sequence
tctgcaggtggtggagact

SEQ ID NO: 146971 - DNA, 19 bp, Artificial sequence
  SiRNA target sequence
ctgcaggtggtggagactt

SEQ ID NO: 146972 - DNA, 19 bp, Artificial sequence
  SiRNA target sequence
tgcaggtggtggagacttt

SEQ ID NO: 146973 - DNA, 19 bp, Artificial sequence
  SiRNA target sequence
gcaggtggtggagactttt

SEQ ID NO: 146974 - DNA, 19 bp, Artificial sequence
  SiRNA target sequence
caggtggtggagacttttt

SEQ ID NO: 146975 - DNA, 19 bp, Artificial sequence
  SiRNA target sequence
aggtggtggagactttttc

SEQ ID NO: 146976 - DNA, 19 bp, Artificial sequence
  SiRNA target sequence
ggtggtggagactttttcg

SEQ ID NO: 146977 - DNA, 19 bp, Artificial sequence
  SiRNA target sequence
gtggtggagactttttcga

SEQ ID NO: 146978 - DNA, 19 bp, Artificial sequence
  SiRNA target sequence
tggtggagactttttcgat

SEQ ID NO: 146979 - DNA, 19 bp, Artificial sequence
  SiRNA target sequence
ggtggagactttttcgata

SEQ ID NO: 146980 - DNA, 19 bp, Artificial sequence
  SiRNA target sequence
gtggagactttttcgatat

SEQ ID NO: 146981 - DNA, 19 bp, Artificial sequence
  SiRNA target sequence
tggagactttttcgatatt

SEQ ID NO: 146982 - DNA, 19 bp, Artificial sequence
  SiRNA target sequence
ggagactttttcgatattt

SEQ ID NO: 146983 - DNA, 19 bp, Artificial sequence
  SiRNA target sequence
gagactttttcgatatttt

SEQ ID NO: 146984 - DNA, 19 bp, Artificial sequence
  SiRNA target sequence
agactttttcgatattttt

SEQ ID NO: 146985 - DNA, 19 bp, Artificial sequence
  SiRNA target sequence
gactttttcgatatttttt

SEQ ID NO: 146986 - DNA, 19 bp, Artificial sequence
  SiRNA target sequence
actttttcgatattttttc

SEQ ID NO: 146987 - DNA, 19 bp, Artificial sequence
  SiRNA target sequence
ctttttcgatattttttca

SEQ ID NO: 146988 - DNA, 19 bp, Artificial sequence
  SiRNA target sequence
tttttcgatattttttcaa

SEQ ID NO: 146989 - DNA, 19 bp, Artificial sequence
  SiRNA target sequence
ttttcgatattttttcaag

SEQ ID NO: 146990 - DNA, 19 bp, Artificial sequence
  SiRNA target sequence
tttcgatattttttcaagt

SEQ ID NO: 146991 - DNA, 19 bp, Artificial sequence
  SiRNA target sequence
ttcgatattttttcaagtt

SEQ ID NO: 146992 - DNA, 19 bp, Artificial sequence
  SiRNA target sequence
tcgatattttttcaagttt

SEQ ID NO: 146993 - DNA, 19 bp, Artificial sequence
  SiRNA target sequence
cgatattttttcaagtttt

SEQ ID NO: 146994 - DNA, 19 bp, Artificial sequence
  SiRNA target sequence
gatattttttcaagtttta

SEQ ID NO: 146995 - DNA, 19 bp, Artificial sequence
  SiRNA target sequence
atattttttcaagttttac

SEQ ID NO: 146996 - DNA, 19 bp, Artificial sequence
  SiRNA target sequence
tattttttcaagttttact

SEQ ID NO: 146997 - DNA, 19 bp, Artificial sequence
  SiRNA target sequence
attttttcaagttttactg

SEQ ID NO: 146998 - DNA, 19 bp, Artificial sequence
  SiRNA target sequence
ttttttcaagttttactgg

SEQ ID NO: 146999 - DNA, 19 bp, Artificial sequence
  SiRNA target sequence
tttttcaagttttactggt

SEQ ID NO: 147000 - DNA, 19 bp, Artificial sequence
  SiRNA target sequence
ttttcaagttttactggtg

SEQ ID NO: 147001 - DNA, 19 bp, Artificial sequence
  SiRNA target sequence
tttcaagttttactggtgg

SEQ ID NO: 147002 - DNA, 19 bp, Artificial sequence
  SiRNA target sequence
ttcaagttttactggtgga

SEQ ID NO: 147003 - DNA, 19 bp, Artificial sequence
  SiRNA target sequence
tcaagttttactggtggag

SEQ ID NO: 147004 - DNA, 19 bp, Artificial sequence
  SiRNA target sequence
caagttttactggtggagg

SEQ ID NO: 147005 - DNA, 19 bp, Artificial sequence
  SiRNA target sequence
aagttttactggtggagga

SEQ ID NO: 147006 - DNA, 19 bp, Artificial sequence
  SiRNA target sequence
agttttactggtggaggaa

SEQ ID NO: 147007 - DNA, 19 bp, Artificial sequence
  SiRNA target sequence
gttttactggtggaggaag

SEQ ID NO: 147008 - DNA, 19 bp, Artificial sequence
  SiRNA target sequence
ttttactggtggaggaaga

SEQ ID NO: 147009 - DNA, 19 bp, Artificial sequence
  SiRNA target sequence
tttactggtggaggaagaa

SEQ ID NO: 147010 - DNA, 19 bp, Artificial sequence
  SiRNA target sequence
ttactggtggaggaagaag

SEQ ID NO: 147011 - DNA, 19 bp, Artificial sequence
  SiRNA target sequence
tactggtggaggaagaaga

SEQ ID NO: 147012 - DNA, 19 bp, Artificial sequence
  SiRNA target sequence
actggtggaggaagaagaa

SEQ ID NO: 147013 - DNA, 19 bp, Artificial sequence
  SiRNA target sequence
ctggtggaggaagaagaaa

SEQ ID NO: 147014 - DNA, 19 bp, Artificial sequence
  SiRNA target sequence
tggtggaggaagaagaaat

SEQ ID NO: 147015 - DNA, 19 bp, Artificial sequence
  SiRNA target sequence
ggtggaggaagaagaaatc

SEQ ID NO: 147016 - DNA, 19 bp, Artificial sequence
  SiRNA target sequence
gtggaggaagaagaaatcg

SEQ ID NO: 147017 - DNA, 19 bp, Artificial sequence
  SiRNA target sequence
tggaggaagaagaaatcga

SEQ ID NO: 147018 - DNA, 19 bp, Artificial sequence
  SiRNA target sequence
ggaggaagaagaaatcgag

SEQ ID NO: 147019 - DNA, 19 bp, Artificial sequence
  SiRNA target sequence
gaggaagaagaaatcgagt

SEQ ID NO: 147020 - DNA, 19 bp, Artificial sequence
  SiRNA target sequence
aggaagaagaaatcgagta

SEQ ID NO: 147021 - DNA, 19 bp, Artificial sequence
  SiRNA target sequence
ggaagaagaaatcgagtac

SEQ ID NO: 147022 - DNA, 19 bp, Artificial sequence
  SiRNA target sequence
gaagaagaaatcgagtaca

SEQ ID NO: 147023 - DNA, 19 bp, Artificial sequence
  SiRNA target sequence
aagaagaaatcgagtacaa

SEQ ID NO: 147024 - DNA, 19 bp, Artificial sequence
  SiRNA target sequence
agaagaaatcgagtacaaa

SEQ ID NO: 147025 - DNA, 19 bp, Artificial sequence
  SiRNA target sequence
gaagaaatcgagtacaaaa

SEQ ID NO: 147026 - DNA, 19 bp, Artificial sequence
  SiRNA target sequence
aagaaatcgagtacaaaaa

SEQ ID NO: 147027 - DNA, 19 bp, Artificial sequence
  SiRNA target sequence
agaaatcgagtacaaaaag

SEQ ID NO: 147028 - DNA, 19 bp, Artificial sequence
  SiRNA target sequence
gaaatcgagtacaaaaagt

SEQ ID NO: 147029 - DNA, 19 bp, Artificial sequence
  SiRNA target sequence
aaatcgagtacaaaaagtt

SEQ ID NO: 147030 - DNA, 19 bp, Artificial sequence
  SiRNA target sequence
aatcgagtacaaaaagttc

SEQ ID NO: 147031 - DNA, 19 bp, Artificial sequence
  SiRNA target sequence
atcgagtacaaaaagttca

SEQ ID NO: 147032 - DNA, 19 bp, Artificial sequence
  SiRNA target sequence
tcgagtacaaaaagttcaa

SEQ ID NO: 147033 - DNA, 19 bp, Artificial sequence
  SiRNA target sequence
cgagtacaaaaagttcaag

SEQ ID NO: 147034 - DNA, 19 bp, Artificial sequence
  SiRNA target sequence
gagtacaaaaagttcaaga

SEQ ID NO: 147035 - DNA, 19 bp, Artificial sequence
  SiRNA target sequence
agtacaaaaagttcaagat

SEQ ID NO: 147036 - DNA, 19 bp, Artificial sequence
  SiRNA target sequence
gtacaaaaagttcaagata

SEQ ID NO: 147037 - DNA, 19 bp, Artificial sequence
  SiRNA target sequence
tacaaaaagttcaagatac

SEQ ID NO: 147038 - DNA, 19 bp, Artificial sequence
  SiRNA target sequence
acaaaaagttcaagataca

SEQ ID NO: 147039 - DNA, 19 bp, Artificial sequence
  SiRNA target sequence
caaaaagttcaagatacag

SEQ ID NO: 147040 - DNA, 19 bp, Artificial sequence
  SiRNA target sequence
aaaaagttcaagatacaga

SEQ ID NO: 147041 - DNA, 19 bp, Artificial sequence
  SiRNA target sequence
aaaagttcaagatacagaa

SEQ ID NO: 147042 - DNA, 19 bp, Artificial sequence
  SiRNA target sequence
aaagttcaagatacagaat

SEQ ID NO: 147043 - DNA, 19 bp, Artificial sequence
  SiRNA target sequence
aagttcaagatacagaata

SEQ ID NO: 147044 - DNA, 19 bp, Artificial sequence
  SiRNA target sequence
agttcaagatacagaatac

SEQ ID NO: 147045 - DNA, 19 bp, Artificial sequence
  SiRNA target sequence
gttcaagatacagaatacg

SEQ ID NO: 147046 - DNA, 19 bp, Artificial sequence
  SiRNA target sequence
ttcaagatacagaatacga

SEQ ID NO: 147047 - DNA, 19 bp, Artificial sequence
  SiRNA target sequence
tcaagatacagaatacgag

SEQ ID NO: 147048 - DNA, 19 bp, Artificial sequence
  SiRNA target sequence
caagatacagaatacgagt

SEQ ID NO: 147049 - DNA, 19 bp, Artificial sequence
  SiRNA target sequence
aagatacagaatacgagtt

SEQ ID NO: 147050 - DNA, 19 bp, Artificial sequence
  SiRNA target sequence
agatacagaatacgagttt

SEQ ID NO: 147051 - DNA, 19 bp, Artificial sequence
  SiRNA target sequence
gatacagaatacgagttta

SEQ ID NO: 147052 - DNA, 19 bp, Artificial sequence
  SiRNA target sequence
atacagaatacgagtttaa

SEQ ID NO: 147053 - DNA, 19 bp, Artificial sequence
  SiRNA target sequence
tacagaatacgagtttaat

SEQ ID NO: 147054 - DNA, 19 bp, Artificial sequence
  SiRNA target sequence
acagaatacgagtttaata

SEQ ID NO: 147055 - DNA, 19 bp, Artificial sequence
  SiRNA target sequence
cagaatacgagtttaatat

SEQ ID NO: 147056 - DNA, 19 bp, Artificial sequence
  SiRNA target sequence
agaatacgagtttaatatt

SEQ ID NO: 147057 - DNA, 19 bp, Artificial sequence
  SiRNA target sequence
gaatacgagtttaatattt

SEQ ID NO: 147058 - DNA, 19 bp, Artificial sequence
  SiRNA target sequence
aatacgagtttaatatttc

SEQ ID NO: 147059 - DNA, 19 bp, Artificial sequence
  SiRNA target sequence
atacgagtttaatatttcg

SEQ ID NO: 147060 - DNA, 19 bp, Artificial sequence
  SiRNA target sequence
tacgagtttaatatttcgt

SEQ ID NO: 147061 - DNA, 19 bp, Artificial sequence
  SiRNA target sequence
acgagtttaatatttcgtt

SEQ ID NO: 147062 - DNA, 19 bp, Artificial sequence
  SiRNA target sequence
cgagtttaatatttcgttg

SEQ ID NO: 147063 - DNA, 19 bp, Artificial sequence
  SiRNA target sequence
gagtttaatatttcgttga

SEQ ID NO: 147064 - DNA, 19 bp, Artificial sequence
  SiRNA target sequence
agtttaatatttcgttgaa

SEQ ID NO: 147065 - DNA, 19 bp, Artificial sequence
  SiRNA target sequence
gtttaatatttcgttgaag

SEQ ID NO: 147066 - DNA, 19 bp, Artificial sequence
  SiRNA target sequence
tttaatatttcgttgaagg

SEQ ID NO: 147067 - DNA, 19 bp, Artificial sequence
  SiRNA target sequence
ttaatatttcgttgaagga

SEQ ID NO: 147068 - DNA, 19 bp, Artificial sequence
  SiRNA target sequence
taatatttcgttgaaggaa

SEQ ID NO: 147069 - DNA, 19 bp, Artificial sequence
  SiRNA target sequence
aatatttcgttgaaggaag

SEQ ID NO: 147070 - DNA, 19 bp, Artificial sequence
  SiRNA target sequence
atatttcgttgaaggaagc

SEQ ID NO: 147071 - DNA, 19 bp, Artificial sequence
  SiRNA target sequence
tatttcgttgaaggaagct

SEQ ID NO: 147072 - DNA, 19 bp, Artificial sequence
  SiRNA target sequence
atttcgttgaaggaagctt

SEQ ID NO: 147073 - DNA, 19 bp, Artificial sequence
  SiRNA target sequence
tttcgttgaaggaagctta

SEQ ID NO: 147074 - DNA, 19 bp, Artificial sequence
  SiRNA target sequence
ttcgttgaaggaagcttat

SEQ ID NO: 147075 - DNA, 19 bp, Artificial sequence
  SiRNA target sequence
tcgttgaaggaagcttata

SEQ ID NO: 147076 - DNA, 19 bp, Artificial sequence
  SiRNA target sequence
cgttgaaggaagcttatat

SEQ ID NO: 147077 - DNA, 19 bp, Artificial sequence
  SiRNA target sequence
gttgaaggaagcttatatg

SEQ ID NO: 147078 - DNA, 19 bp, Artificial sequence
  SiRNA target sequence
ttgaaggaagcttatatgg

SEQ ID NO: 147079 - DNA, 19 bp, Artificial sequence
  SiRNA target sequence
tgaaggaagcttatatggg

SEQ ID NO: 147080 - DNA, 19 bp, Artificial sequence
  SiRNA target sequence
gaaggaagcttatatggga

SEQ ID NO: 147081 - DNA, 19 bp, Artificial sequence
  SiRNA target sequence
aaggaagcttatatgggaa

SEQ ID NO: 147082 - DNA, 19 bp, Artificial sequence
  SiRNA target sequence
aggaagcttatatgggaaa

SEQ ID NO: 147083 - DNA, 19 bp, Artificial sequence
  SiRNA target sequence
ggaagcttatatgggaaag

SEQ ID NO: 147084 - DNA, 19 bp, Artificial sequence
  SiRNA target sequence
gaagcttatatgggaaagc

SEQ ID NO: 147085 - DNA, 19 bp, Artificial sequence
  SiRNA target sequence
aagcttatatgggaaagcg

SEQ ID NO: 147086 - DNA, 19 bp, Artificial sequence
  SiRNA target sequence
agcttatatgggaaagcga

SEQ ID NO: 147087 - DNA, 19 bp, Artificial sequence
  SiRNA target sequence
gcttatatgggaaagcgag

SEQ ID NO: 147088 - DNA, 19 bp, Artificial sequence
  SiRNA target sequence
cttatatgggaaagcgagc

SEQ ID NO: 147089 - DNA, 19 bp, Artificial sequence
  SiRNA target sequence
ttatatgggaaagcgagct

SEQ ID NO: 147090 - DNA, 19 bp, Artificial sequence
  SiRNA target sequence
tatatgggaaagcgagcta

SEQ ID NO: 147091 - DNA, 19 bp, Artificial sequence
  SiRNA target sequence
atatgggaaagcgagctag

SEQ ID NO: 147092 - DNA, 19 bp, Artificial sequence
  SiRNA target sequence
tatgggaaagcgagctagt

SEQ ID NO: 147093 - DNA, 19 bp, Artificial sequence
  SiRNA target sequence
atgggaaagcgagctagtt

SEQ ID NO: 147094 - DNA, 19 bp, Artificial sequence
  SiRNA target sequence
tgggaaagcgagctagttt

SEQ ID NO: 147095 - DNA, 19 bp, Artificial sequence
  SiRNA target sequence
gggaaagcgagctagtttt

SEQ ID NO: 147096 - DNA, 19 bp, Artificial sequence
  SiRNA target sequence
ggaaagcgagctagtttta

SEQ ID NO: 147097 - DNA, 19 bp, Artificial sequence
  SiRNA target sequence
gaaagcgagctagttttaa

SEQ ID NO: 147098 - DNA, 19 bp, Artificial sequence
  SiRNA target sequence
aaagcgagctagttttaat

SEQ ID NO: 147099 - DNA, 19 bp, Artificial sequence
  SiRNA target sequence
aagcgagctagttttaatg

SEQ ID NO: 147100 - DNA, 19 bp, Artificial sequence
  SiRNA target sequence
agcgagctagttttaatgt

SEQ ID NO: 147101 - DNA, 19 bp, Artificial sequence
  SiRNA target sequence
gcgagctagttttaatgta

SEQ ID NO: 147102 - DNA, 19 bp, Artificial sequence
  SiRNA target sequence
cgagctagttttaatgtaa

SEQ ID NO: 147103 - DNA, 19 bp, Artificial sequence
  SiRNA target sequence
gagctagttttaatgtaaa

SEQ ID NO: 147104 - DNA, 19 bp, Artificial sequence
  SiRNA target sequence
agctagttttaatgtaaaa

SEQ ID NO: 147105 - DNA, 19 bp, Artificial sequence
  SiRNA target sequence
gctagttttaatgtaaaag

SEQ ID NO: 147106 - DNA, 19 bp, Artificial sequence
  SiRNA target sequence
ctagttttaatgtaaaagt

SEQ ID NO: 147107 - DNA, 19 bp, Artificial sequence
  SiRNA target sequence
tagttttaatgtaaaagtg

SEQ ID NO: 147108 - DNA, 19 bp, Artificial sequence
  SiRNA target sequence
agttttaatgtaaaagtgc

SEQ ID NO: 147109 - DNA, 19 bp, Artificial sequence
  SiRNA target sequence
gttttaatgtaaaagtgca

SEQ ID NO: 147110 - DNA, 19 bp, Artificial sequence
  SiRNA target sequence
ttttaatgtaaaagtgcaa

SEQ ID NO: 147111 - DNA, 19 bp, Artificial sequence
  SiRNA target sequence
tttaatgtaaaagtgcaaa

SEQ ID NO: 147112 - DNA, 19 bp, Artificial sequence
  SiRNA target sequence
ttaatgtaaaagtgcaaag

SEQ ID NO: 147113 - DNA, 19 bp, Artificial sequence
  SiRNA target sequence
taatgtaaaagtgcaaaga

SEQ ID NO: 147114 - DNA, 19 bp, Artificial sequence
  SiRNA target sequence
aatgtaaaagtgcaaagag

SEQ ID NO: 147115 - DNA, 19 bp, Artificial sequence
  SiRNA target sequence
atgtaaaagtgcaaagaga

SEQ ID NO: 147116 - DNA, 19 bp, Artificial sequence
  SiRNA target sequence
tgtaaaagtgcaaagagaa

SEQ ID NO: 147117 - DNA, 19 bp, Artificial sequence
  SiRNA target sequence
gtaaaagtgcaaagagaat

SEQ ID NO: 147118 - DNA, 19 bp, Artificial sequence
  SiRNA target sequence
taaaagtgcaaagagaatg

SEQ ID NO: 147119 - DNA, 19 bp, Artificial sequence
  SiRNA target sequence
aaaagtgcaaagagaatgt

SEQ ID NO: 147120 - DNA, 19 bp, Artificial sequence
  SiRNA target sequence
aaagtgcaaagagaatgtt

SEQ ID NO: 147121 - DNA, 19 bp, Artificial sequence
  SiRNA target sequence
aagtgcaaagagaatgttc

SEQ ID NO: 147122 - DNA, 19 bp, Artificial sequence
  SiRNA target sequence
agtgcaaagagaatgttct

SEQ ID NO: 147123 - DNA, 19 bp, Artificial sequence
  SiRNA target sequence
gtgcaaagagaatgttctg

SEQ ID NO: 147124 - DNA, 19 bp, Artificial sequence
  SiRNA target sequence
tgcaaagagaatgttctgc

SEQ ID NO: 147125 - DNA, 19 bp, Artificial sequence
  SiRNA target sequence
gcaaagagaatgttctgcg

SEQ ID NO: 147126 - DNA, 19 bp, Artificial sequence
  SiRNA target sequence
caaagagaatgttctgcgt

SEQ ID NO: 147127 - DNA, 19 bp, Artificial sequence
  SiRNA target sequence
aaagagaatgttctgcgtg

SEQ ID NO: 147128 - DNA, 19 bp, Artificial sequence
  SiRNA target sequence
aagagaatgttctgcgtgt

SEQ ID NO: 147129 - DNA, 19 bp, Artificial sequence
  SiRNA target sequence
agagaatgttctgcgtgta

SEQ ID NO: 147130 - DNA, 19 bp, Artificial sequence
  SiRNA target sequence
gagaatgttctgcgtgtaa

SEQ ID NO: 147131 - DNA, 19 bp, Artificial sequence
  SiRNA target sequence
agaatgttctgcgtgtaac

SEQ ID NO: 147132 - DNA, 19 bp, Artificial sequence
  SiRNA target sequence
gaatgttctgcgtgtaacg

SEQ ID NO: 147133 - DNA, 19 bp, Artificial sequence
  SiRNA target sequence
aatgttctgcgtgtaacgg

SEQ ID NO: 147134 - DNA, 19 bp, Artificial sequence
  SiRNA target sequence
atgttctgcgtgtaacggt

SEQ ID NO: 147135 - DNA, 19 bp, Artificial sequence
  SiRNA target sequence
tgttctgcgtgtaacggta

SEQ ID NO: 147136 - DNA, 19 bp, Artificial sequence
  SiRNA target sequence
gttctgcgtgtaacggtaa

SEQ ID NO: 147137 - DNA, 19 bp, Artificial sequence
  SiRNA target sequence
ttctgcgtgtaacggtaaa

SEQ ID NO: 147138 - DNA, 19 bp, Artificial sequence
  SiRNA target sequence
tctgcgtgtaacggtaaag

SEQ ID NO: 147139 - DNA, 19 bp, Artificial sequence
  SiRNA target sequence
ctgcgtgtaacggtaaagg

SEQ ID NO: 147140 - DNA, 19 bp, Artificial sequence
  SiRNA target sequence
tgcgtgtaacggtaaagga

SEQ ID NO: 147141 - DNA, 19 bp, Artificial sequence
  SiRNA target sequence
gcgtgtaacggtaaaggag

SEQ ID NO: 147142 - DNA, 19 bp, Artificial sequence
  SiRNA target sequence
cgtgtaacggtaaaggagg

SEQ ID NO: 147143 - DNA, 19 bp, Artificial sequence
  SiRNA target sequence
gtgtaacggtaaaggagga

SEQ ID NO: 147144 - DNA, 19 bp, Artificial sequence
  SiRNA target sequence
tgtaacggtaaaggaggag

SEQ ID NO: 147145 - DNA, 19 bp, Artificial sequence
  SiRNA target sequence
gtaacggtaaaggaggaga

SEQ ID NO: 147146 - DNA, 19 bp, Artificial sequence
  SiRNA target sequence
taacggtaaaggaggagac

SEQ ID NO: 147147 - DNA, 19 bp, Artificial sequence
  SiRNA target sequence
aacggtaaaggaggagaca

SEQ ID NO: 147148 - DNA, 19 bp, Artificial sequence
  SiRNA target sequence
acggtaaaggaggagacag

SEQ ID NO: 147149 - DNA, 19 bp, Artificial sequence
  SiRNA target sequence
cggtaaaggaggagacagt

SEQ ID NO: 147150 - DNA, 19 bp, Artificial sequence
  SiRNA target sequence
ggtaaaggaggagacagtg

SEQ ID NO: 147151 - DNA, 19 bp, Artificial sequence
  SiRNA target sequence
gtaaaggaggagacagtgt

SEQ ID NO: 147152 - DNA, 19 bp, Artificial sequence
  SiRNA target sequence
taaaggaggagacagtgtt

SEQ ID NO: 147153 - DNA, 19 bp, Artificial sequence
  SiRNA target sequence
aaaggaggagacagtgttg

SEQ ID NO: 147154 - DNA, 19 bp, Artificial sequence
  SiRNA target sequence
aaggaggagacagtgttga

SEQ ID NO: 147155 - DNA, 19 bp, Artificial sequence
  SiRNA target sequence
aggaggagacagtgttgaa

SEQ ID NO: 147156 - DNA, 19 bp, Artificial sequence
  SiRNA target sequence
ggaggagacagtgttgaaa

SEQ ID NO: 147157 - DNA, 19 bp, Artificial sequence
  SiRNA target sequence
gaggagacagtgttgaaac

SEQ ID NO: 147158 - DNA, 19 bp, Artificial sequence
  SiRNA target sequence
aggagacagtgttgaaaca

SEQ ID NO: 147159 - DNA, 19 bp, Artificial sequence
  SiRNA target sequence
ggagacagtgttgaaacat

SEQ ID NO: 147160 - DNA, 19 bp, Artificial sequence
  SiRNA target sequence
gagacagtgttgaaacatg

SEQ ID NO: 147161 - DNA, 19 bp, Artificial sequence
  SiRNA target sequence
agacagtgttgaaacatgt

SEQ ID NO: 147162 - DNA, 19 bp, Artificial sequence
  SiRNA target sequence
gacagtgttgaaacatgtg

SEQ ID NO: 147163 - DNA, 19 bp, Artificial sequence
  SiRNA target sequence
acagtgttgaaacatgtga

SEQ ID NO: 147164 - DNA, 19 bp, Artificial sequence
  SiRNA target sequence
cagtgttgaaacatgtgaa

SEQ ID NO: 147165 - DNA, 19 bp, Artificial sequence
  SiRNA target sequence
agtgttgaaacatgtgaac

SEQ ID NO: 147166 - DNA, 19 bp, Artificial sequence
  SiRNA target sequence
gtgttgaaacatgtgaacc

SEQ ID NO: 147167 - DNA, 19 bp, Artificial sequence
  SiRNA target sequence
tgttgaaacatgtgaacca

SEQ ID NO: 147168 - DNA, 19 bp, Artificial sequence
  SiRNA target sequence
gttgaaacatgtgaaccat

SEQ ID NO: 147169 - DNA, 19 bp, Artificial sequence
  SiRNA target sequence
ttgaaacatgtgaaccatg

SEQ ID NO: 147170 - DNA, 19 bp, Artificial sequence
  SiRNA target sequence
tgaaacatgtgaaccatgt

SEQ ID NO: 147171 - DNA, 19 bp, Artificial sequence
  SiRNA target sequence
gaaacatgtgaaccatgta

SEQ ID NO: 147172 - DNA, 19 bp, Artificial sequence
  SiRNA target sequence
aaacatgtgaaccatgtaa

SEQ ID NO: 147173 - DNA, 19 bp, Artificial sequence
  SiRNA target sequence
aacatgtgaaccatgtaaa

SEQ ID NO: 147174 - DNA, 19 bp, Artificial sequence
  SiRNA target sequence
acatgtgaaccatgtaaag

SEQ ID NO: 147175 - DNA, 19 bp, Artificial sequence
  SiRNA target sequence
catgtgaaccatgtaaagg

SEQ ID NO: 147176 - DNA, 19 bp, Artificial sequence
  SiRNA target sequence
atgtgaaccatgtaaaggt

SEQ ID NO: 147177 - DNA, 19 bp, Artificial sequence
  SiRNA target sequence
tgtgaaccatgtaaaggta

SEQ ID NO: 147178 - DNA, 19 bp, Artificial sequence
  SiRNA target sequence
gtgaaccatgtaaaggtaa

SEQ ID NO: 147179 - DNA, 19 bp, Artificial sequence
  SiRNA target sequence
tgaaccatgtaaaggtaaa

SEQ ID NO: 147180 - DNA, 19 bp, Artificial sequence
  SiRNA target sequence
gaaccatgtaaaggtaaag

SEQ ID NO: 147181 - DNA, 19 bp, Artificial sequence
  SiRNA target sequence
aaccatgtaaaggtaaagg

SEQ ID NO: 147182 - DNA, 19 bp, Artificial sequence
  SiRNA target sequence
accatgtaaaggtaaaggt

SEQ ID NO: 147183 - DNA, 19 bp, Artificial sequence
  SiRNA target sequence
ccatgtaaaggtaaaggta

SEQ ID NO: 147184 - DNA, 19 bp, Artificial sequence
  SiRNA target sequence
catgtaaaggtaaaggtaa

SEQ ID NO: 147185 - DNA, 19 bp, Artificial sequence
  SiRNA target sequence
atgtaaaggtaaaggtaag

SEQ ID NO: 147186 - DNA, 19 bp, Artificial sequence
  SiRNA target sequence
tgtaaaggtaaaggtaagg

SEQ ID NO: 147187 - DNA, 19 bp, Artificial sequence
  SiRNA target sequence
gtaaaggtaaaggtaaggt

SEQ ID NO: 147188 - DNA, 19 bp, Artificial sequence
  SiRNA target sequence
taaaggtaaaggtaaggta

SEQ ID NO: 147189 - DNA, 19 bp, Artificial sequence
  SiRNA target sequence
aaaggtaaaggtaaggtag

SEQ ID NO: 147190 - DNA, 19 bp, Artificial sequence
  SiRNA target sequence
aaggtaaaggtaaggtaga

SEQ ID NO: 147191 - DNA, 19 bp, Artificial sequence
  SiRNA target sequence
aggtaaaggtaaggtagaa

SEQ ID NO: 147192 - DNA, 19 bp, Artificial sequence
  SiRNA target sequence
ggtaaaggtaaggtagaac

SEQ ID NO: 147193 - DNA, 19 bp, Artificial sequence
  SiRNA target sequence
gtaaaggtaaggtagaaca

SEQ ID NO: 147194 - DNA, 19 bp, Artificial sequence
  SiRNA target sequence
taaaggtaaggtagaacat

SEQ ID NO: 147195 - DNA, 19 bp, Artificial sequence
  SiRNA target sequence
aaaggtaaggtagaacatc

SEQ ID NO: 147196 - DNA, 19 bp, Artificial sequence
  SiRNA target sequence
aaggtaaggtagaacatca

SEQ ID NO: 147197 - DNA, 19 bp, Artificial sequence
  SiRNA target sequence
aggtaaggtagaacatcat

SEQ ID NO: 147198 - DNA, 19 bp, Artificial sequence
  SiRNA target sequence
ggtaaggtagaacatcata

SEQ ID NO: 147199 - DNA, 19 bp, Artificial sequence
  SiRNA target sequence
gtaaggtagaacatcatag

SEQ ID NO: 147200 - DNA, 19 bp, Artificial sequence
  SiRNA target sequence
taaggtagaacatcatagg

SEQ ID NO: 147201 - DNA, 19 bp, Artificial sequence
  SiRNA target sequence
aaggtagaacatcatagga

SEQ ID NO: 147202 - DNA, 19 bp, Artificial sequence
  SiRNA target sequence
aggtagaacatcataggag

SEQ ID NO: 147203 - DNA, 19 bp, Artificial sequence
  SiRNA target sequence
ggtagaacatcataggaga

SEQ ID NO: 147204 - DNA, 19 bp, Artificial sequence
  SiRNA target sequence
gtagaacatcataggagac

SEQ ID NO: 147205 - DNA, 19 bp, Artificial sequence
  SiRNA target sequence
tagaacatcataggagact

SEQ ID NO: 147206 - DNA, 19 bp, Artificial sequence
  SiRNA target sequence
agaacatcataggagacta

SEQ ID NO: 147207 - DNA, 19 bp, Artificial sequence
  SiRNA target sequence
gaacatcataggagactag

SEQ ID NO: 147208 - DNA, 19 bp, Artificial sequence
  SiRNA target sequence
aacatcataggagactagg

SEQ ID NO: 147209 - DNA, 19 bp, Artificial sequence
  SiRNA target sequence
acatcataggagactaggt

SEQ ID NO: 147210 - DNA, 19 bp, Artificial sequence
  SiRNA target sequence
catcataggagactaggtc

SEQ ID NO: 147211 - DNA, 19 bp, Artificial sequence
  SiRNA target sequence
atcataggagactaggtcc

SEQ ID NO: 147212 - DNA, 19 bp, Artificial sequence
  SiRNA target sequence
tcataggagactaggtcct

SEQ ID NO: 147213 - DNA, 19 bp, Artificial sequence
  SiRNA target sequence
cataggagactaggtcctt

SEQ ID NO: 147214 - DNA, 19 bp, Artificial sequence
  SiRNA target sequence
ataggagactaggtccttt

SEQ ID NO: 147215 - DNA, 19 bp, Artificial sequence
  SiRNA target sequence
taggagactaggtccttta

SEQ ID NO: 147216 - DNA, 19 bp, Artificial sequence
  SiRNA target sequence
aggagactaggtcctttaa

SEQ ID NO: 147217 - DNA, 19 bp, Artificial sequence
  SiRNA target sequence
ggagactaggtcctttaat

SEQ ID NO: 147218 - DNA, 19 bp, Artificial sequence
  SiRNA target sequence
gagactaggtcctttaatt

SEQ ID NO: 147219 - DNA, 19 bp, Artificial sequence
  SiRNA target sequence
agactaggtcctttaattt

SEQ ID NO: 147220 - DNA, 19 bp, Artificial sequence
  SiRNA target sequence
gactaggtcctttaatttc

SEQ ID NO: 147221 - DNA, 19 bp, Artificial sequence
  SiRNA target sequence
actaggtcctttaatttct

SEQ ID NO: 147222 - DNA, 19 bp, Artificial sequence
  SiRNA target sequence
ctaggtcctttaatttctg

SEQ ID NO: 147223 - DNA, 19 bp, Artificial sequence
  SiRNA target sequence
taggtcctttaatttctgt

SEQ ID NO: 147224 - DNA, 19 bp, Artificial sequence
  SiRNA target sequence
aggtcctttaatttctgta

SEQ ID NO: 147225 - DNA, 19 bp, Artificial sequence
  SiRNA target sequence
ggtcctttaatttctgtac

SEQ ID NO: 147226 - DNA, 19 bp, Artificial sequence
  SiRNA target sequence
gtcctttaatttctgtaca

SEQ ID NO: 147227 - DNA, 19 bp, Artificial sequence
  SiRNA target sequence
tcctttaatttctgtacaa

SEQ ID NO: 147228 - DNA, 19 bp, Artificial sequence
  SiRNA target sequence
cctttaatttctgtacaag

SEQ ID NO: 147229 - DNA, 19 bp, Artificial sequence
  SiRNA target sequence
ctttaatttctgtacaaga

SEQ ID NO: 147230 - DNA, 19 bp, Artificial sequence
  SiRNA target sequence
tttaatttctgtacaagaa

SEQ ID NO: 147231 - DNA, 19 bp, Artificial sequence
  SiRNA target sequence
ttaatttctgtacaagaag

SEQ ID NO: 147232 - DNA, 19 bp, Artificial sequence
  SiRNA target sequence
taatttctgtacaagaagc

SEQ ID NO: 147233 - DNA, 19 bp, Artificial sequence
  SiRNA target sequence
aatttctgtacaagaagca

SEQ ID NO: 147234 - DNA, 19 bp, Artificial sequence
  SiRNA target sequence
atttctgtacaagaagcac

SEQ ID NO: 147235 - DNA, 19 bp, Artificial sequence
  SiRNA target sequence
tttctgtacaagaagcacc

SEQ ID NO: 147236 - DNA, 19 bp, Artificial sequence
  SiRNA target sequence
ttctgtacaagaagcacct

SEQ ID NO: 147237 - DNA, 19 bp, Artificial sequence
  SiRNA target sequence
tctgtacaagaagcacctt

SEQ ID NO: 147238 - DNA, 19 bp, Artificial sequence
  SiRNA target sequence
ctgtacaagaagcaccttg

SEQ ID NO: 147239 - DNA, 19 bp, Artificial sequence
  SiRNA target sequence
tgtacaagaagcaccttgt

SEQ ID NO: 147240 - DNA, 19 bp, Artificial sequence
  SiRNA target sequence
gtacaagaagcaccttgta

SEQ ID NO: 147241 - DNA, 19 bp, Artificial sequence
  SiRNA target sequence
tacaagaagcaccttgtaa

SEQ ID NO: 147242 - DNA, 19 bp, Artificial sequence
  SiRNA target sequence
acaagaagcaccttgtaat

SEQ ID NO: 147243 - DNA, 19 bp, Artificial sequence
  SiRNA target sequence
caagaagcaccttgtaata

SEQ ID NO: 147244 - DNA, 19 bp, Artificial sequence
  SiRNA target sequence
aagaagcaccttgtaataa

SEQ ID NO: 147245 - DNA, 19 bp, Artificial sequence
  SiRNA target sequence
agaagcaccttgtaataat

SEQ ID NO: 147246 - DNA, 19 bp, Artificial sequence
  SiRNA target sequence
gaagcaccttgtaataatt

SEQ ID NO: 147247 - DNA, 19 bp, Artificial sequence
  SiRNA target sequence
aagcaccttgtaataattg

SEQ ID NO: 147248 - DNA, 19 bp, Artificial sequence
  SiRNA target sequence
agcaccttgtaataattgt

SEQ ID NO: 147249 - DNA, 19 bp, Artificial sequence
  SiRNA target sequence
gcaccttgtaataattgta

SEQ ID NO: 147250 - DNA, 19 bp, Artificial sequence
  SiRNA target sequence
caccttgtaataattgtaa

SEQ ID NO: 147251 - DNA, 19 bp, Artificial sequence
  SiRNA target sequence
accttgtaataattgtaat

SEQ ID NO: 147252 - DNA, 19 bp, Artificial sequence
  SiRNA target sequence
ccttgtaataattgtaatt

SEQ ID NO: 147253 - DNA, 19 bp, Artificial sequence
  SiRNA target sequence
cttgtaataattgtaattc

SEQ ID NO: 147254 - DNA, 19 bp, Artificial sequence
  SiRNA target sequence
ttgtaataattgtaattct

SEQ ID NO: 147255 - DNA, 19 bp, Artificial sequence
  SiRNA target sequence
tgtaataattgtaattcta

SEQ ID NO: 147256 - DNA, 19 bp, Artificial sequence
  SiRNA target sequence
gtaataattgtaattctac

SEQ ID NO: 147257 - DNA, 19 bp, Artificial sequence
  SiRNA target sequence
taataattgtaattctact

SEQ ID NO: 147258 - DNA, 19 bp, Artificial sequence
  SiRNA target sequence
aataattgtaattctactg

SEQ ID NO: 147259 - DNA, 19 bp, Artificial sequence
  SiRNA target sequence
ataattgtaattctactgg

SEQ ID NO: 147260 - DNA, 19 bp, Artificial sequence
  SiRNA target sequence
taattgtaattctactgga

SEQ ID NO: 147261 - DNA, 19 bp, Artificial sequence
  SiRNA target sequence
aattgtaattctactggat

SEQ ID NO: 147262 - DNA, 19 bp, Artificial sequence
  SiRNA target sequence
attgtaattctactggatt

SEQ ID NO: 147263 - DNA, 19 bp, Artificial sequence
  SiRNA target sequence
ttgtaattctactggattt

SEQ ID NO: 147264 - DNA, 19 bp, Artificial sequence
  SiRNA target sequence
tgtaattctactggatttg

SEQ ID NO: 147265 - DNA, 19 bp, Artificial sequence
  SiRNA target sequence
gtaattctactggatttgt

SEQ ID NO: 147266 - DNA, 19 bp, Artificial sequence
  SiRNA target sequence
taattctactggatttgtt

SEQ ID NO: 147267 - DNA, 19 bp, Artificial sequence
  SiRNA target sequence
aattctactggatttgttg

SEQ ID NO: 147268 - DNA, 19 bp, Artificial sequence
  SiRNA target sequence
attctactggatttgttgt

SEQ ID NO: 147269 - DNA, 19 bp, Artificial sequence
  SiRNA target sequence
ttctactggatttgttgtt

SEQ ID NO: 147270 - DNA, 19 bp, Artificial sequence
  SiRNA target sequence
tctactggatttgttgtta

SEQ ID NO: 147271 - DNA, 19 bp, Artificial sequence
  SiRNA target sequence
ctactggatttgttgttaa

SEQ ID NO: 147272 - DNA, 19 bp, Artificial sequence
  SiRNA target sequence
tactggatttgttgttaaa

SEQ ID NO: 147273 - DNA, 19 bp, Artificial sequence
  SiRNA target sequence
actggatttgttgttaaag

SEQ ID NO: 147274 - DNA, 19 bp, Artificial sequence
  SiRNA target sequence
ctggatttgttgttaaagg

SEQ ID NO: 147275 - DNA, 19 bp, Artificial sequence
  SiRNA target sequence
tggatttgttgttaaagga

SEQ ID NO: 147276 - DNA, 19 bp, Artificial sequence
  SiRNA target sequence
ggatttgttgttaaaggaa

SEQ ID NO: 147277 - DNA, 19 bp, Artificial sequence
  SiRNA target sequence
gatttgttgttaaaggaaa

SEQ ID NO: 147278 - DNA, 19 bp, Artificial sequence
  SiRNA target sequence
atttgttgttaaaggaaag

SEQ ID NO: 147279 - DNA, 19 bp, Artificial sequence
  SiRNA target sequence
tttgttgttaaaggaaagc

SEQ ID NO: 147280 - DNA, 19 bp, Artificial sequence
  SiRNA target sequence
ttgttgttaaaggaaagct

SEQ ID NO: 147281 - DNA, 19 bp, Artificial sequence
  SiRNA target sequence
tgttgttaaaggaaagctt

SEQ ID NO: 147282 - DNA, 19 bp, Artificial sequence
  SiRNA target sequence
gttgttaaaggaaagcttt

SEQ ID NO: 147283 - DNA, 19 bp, Artificial sequence
  SiRNA target sequence
ttgttaaaggaaagctttg

SEQ ID NO: 147284 - DNA, 19 bp, Artificial sequence
  SiRNA target sequence
tgttaaaggaaagctttgt

SEQ ID NO: 147285 - DNA, 19 bp, Artificial sequence
  SiRNA target sequence
gttaaaggaaagctttgtc

SEQ ID NO: 147286 - DNA, 19 bp, Artificial sequence
  SiRNA target sequence
ttaaaggaaagctttgtca

SEQ ID NO: 147287 - DNA, 19 bp, Artificial sequence
  SiRNA target sequence
taaaggaaagctttgtcaa

SEQ ID NO: 147288 - DNA, 19 bp, Artificial sequence
  SiRNA target sequence
aaaggaaagctttgtcaaa

SEQ ID NO: 147289 - DNA, 19 bp, Artificial sequence
  SiRNA target sequence
aaggaaagctttgtcaaag

SEQ ID NO: 147290 - DNA, 19 bp, Artificial sequence
  SiRNA target sequence
aggaaagctttgtcaaagt

SEQ ID NO: 147291 - DNA, 19 bp, Artificial sequence
  SiRNA target sequence
ggaaagctttgtcaaagtt

SEQ ID NO: 147292 - DNA, 19 bp, Artificial sequence
  SiRNA target sequence
gaaagctttgtcaaagttg

SEQ ID NO: 147293 - DNA, 19 bp, Artificial sequence
  SiRNA target sequence
aaagctttgtcaaagttgt

SEQ ID NO: 147294 - DNA, 19 bp, Artificial sequence
  SiRNA target sequence
aagctttgtcaaagttgta

SEQ ID NO: 147295 - DNA, 19 bp, Artificial sequence
  SiRNA target sequence
agctttgtcaaagttgtaa

SEQ ID NO: 147296 - DNA, 19 bp, Artificial sequence
  SiRNA target sequence
gctttgtcaaagttgtaaa

SEQ ID NO: 147297 - DNA, 19 bp, Artificial sequence
  SiRNA target sequence
ctttgtcaaagttgtaaag

SEQ ID NO: 147298 - DNA, 19 bp, Artificial sequence
  SiRNA target sequence
tttgtcaaagttgtaaagg

SEQ ID NO: 147299 - DNA, 19 bp, Artificial sequence
  SiRNA target sequence
ttgtcaaagttgtaaaggt

SEQ ID NO: 147300 - DNA, 19 bp, Artificial sequence
  SiRNA target sequence
tgtcaaagttgtaaaggta

SEQ ID NO: 147301 - DNA, 19 bp, Artificial sequence
  SiRNA target sequence
gtcaaagttgtaaaggtaa

SEQ ID NO: 147302 - DNA, 19 bp, Artificial sequence
  SiRNA target sequence
tcaaagttgtaaaggtaaa

SEQ ID NO: 147303 - DNA, 19 bp, Artificial sequence
  SiRNA target sequence
caaagttgtaaaggtaaac

SEQ ID NO: 147304 - DNA, 19 bp, Artificial sequence
  SiRNA target sequence
aaagttgtaaaggtaaaca

SEQ ID NO: 147305 - DNA, 19 bp, Artificial sequence
  SiRNA target sequence
aagttgtaaaggtaaacaa

SEQ ID NO: 147306 - DNA, 19 bp, Artificial sequence
  SiRNA target sequence
agttgtaaaggtaaacaat

SEQ ID NO: 147307 - DNA, 19 bp, Artificial sequence
  SiRNA target sequence
gttgtaaaggtaaacaata

SEQ ID NO: 147308 - DNA, 19 bp, Artificial sequence
  SiRNA target sequence
ttgtaaaggtaaacaatac

SEQ ID NO: 147309 - DNA, 19 bp, Artificial sequence
  SiRNA target sequence
tgtaaaggtaaacaatacg

SEQ ID NO: 147310 - DNA, 19 bp, Artificial sequence
  SiRNA target sequence
gtaaaggtaaacaatacgt

SEQ ID NO: 147311 - DNA, 19 bp, Artificial sequence
  SiRNA target sequence
taaaggtaaacaatacgtt

SEQ ID NO: 147312 - DNA, 19 bp, Artificial sequence
  SiRNA target sequence
aaaggtaaacaatacgttg

SEQ ID NO: 147313 - DNA, 19 bp, Artificial sequence
  SiRNA target sequence
aaggtaaacaatacgttga

SEQ ID NO: 147314 - DNA, 19 bp, Artificial sequence
  SiRNA target sequence
aggtaaacaatacgttgag

SEQ ID NO: 147315 - DNA, 19 bp, Artificial sequence
  SiRNA target sequence
ggtaaacaatacgttgaga

SEQ ID NO: 147316 - DNA, 19 bp, Artificial sequence
  SiRNA target sequence
gtaaacaatacgttgagac

SEQ ID NO: 147317 - DNA, 19 bp, Artificial sequence
  SiRNA target sequence
taaacaatacgttgagact

SEQ ID NO: 147318 - DNA, 19 bp, Artificial sequence
  SiRNA target sequence
aaacaatacgttgagacta

SEQ ID NO: 147319 - DNA, 19 bp, Artificial sequence
  SiRNA target sequence
aacaatacgttgagactaa

SEQ ID NO: 147320 - DNA, 19 bp, Artificial sequence
  SiRNA target sequence
acaatacgttgagactaaa

SEQ ID NO: 147321 - DNA, 19 bp, Artificial sequence
  SiRNA target sequence
caatacgttgagactaaag

SEQ ID NO: 147322 - DNA, 19 bp, Artificial sequence
  SiRNA target sequence
aatacgttgagactaaaga

SEQ ID NO: 147323 - DNA, 19 bp, Artificial sequence
  SiRNA target sequence
atacgttgagactaaagaa

SEQ ID NO: 147324 - DNA, 19 bp, Artificial sequence
  SiRNA target sequence
tacgttgagactaaagaac

SEQ ID NO: 147325 - DNA, 19 bp, Artificial sequence
  SiRNA target sequence
acgttgagactaaagaaca

SEQ ID NO: 147326 - DNA, 19 bp, Artificial sequence
  SiRNA target sequence
cgttgagactaaagaacat

SEQ ID NO: 147327 - DNA, 19 bp, Artificial sequence
  SiRNA target sequence
gttgagactaaagaacata

SEQ ID NO: 147328 - DNA, 19 bp, Artificial sequence
  SiRNA target sequence
ttgagactaaagaacatat

SEQ ID NO: 147329 - DNA, 19 bp, Artificial sequence
  SiRNA target sequence
tgagactaaagaacatatt

SEQ ID NO: 147330 - DNA, 19 bp, Artificial sequence
  SiRNA target sequence
gagactaaagaacatattg

SEQ ID NO: 147331 - DNA, 19 bp, Artificial sequence
  SiRNA target sequence
agactaaagaacatattga

SEQ ID NO: 147332 - DNA, 19 bp, Artificial sequence
  SiRNA target sequence
gactaaagaacatattgaa

SEQ ID NO: 147333 - DNA, 19 bp, Artificial sequence
  SiRNA target sequence
actaaagaacatattgaag

SEQ ID NO: 147334 - DNA, 19 bp, Artificial sequence
  SiRNA target sequence
ctaaagaacatattgaagt

SEQ ID NO: 147335 - DNA, 19 bp, Artificial sequence
  SiRNA target sequence
taaagaacatattgaagtg

SEQ ID NO: 147336 - DNA, 19 bp, Artificial sequence
  SiRNA target sequence
aaagaacatattgaagtgg

SEQ ID NO: 147337 - DNA, 19 bp, Artificial sequence
  SiRNA target sequence
aagaacatattgaagtgga

SEQ ID NO: 147338 - DNA, 19 bp, Artificial sequence
  SiRNA target sequence
agaacatattgaagtggaa

SEQ ID NO: 147339 - DNA, 19 bp, Artificial sequence
  SiRNA target sequence
gaacatattgaagtggaag

SEQ ID NO: 147340 - DNA, 19 bp, Artificial sequence
  SiRNA target sequence
aacatattgaagtggaagt

SEQ ID NO: 147341 - DNA, 19 bp, Artificial sequence
  SiRNA target sequence
acatattgaagtggaagta

SEQ ID NO: 147342 - DNA, 19 bp, Artificial sequence
  SiRNA target sequence
catattgaagtggaagtag

SEQ ID NO: 147343 - DNA, 19 bp, Artificial sequence
  SiRNA target sequence
atattgaagtggaagtaga

SEQ ID NO: 147344 - DNA, 19 bp, Artificial sequence
  SiRNA target sequence
tattgaagtggaagtagag

SEQ ID NO: 147345 - DNA, 19 bp, Artificial sequence
  SiRNA target sequence
attgaagtggaagtagagc

SEQ ID NO: 147346 - DNA, 19 bp, Artificial sequence
  SiRNA target sequence
ttgaagtggaagtagagcc

SEQ ID NO: 147347 - DNA, 19 bp, Artificial sequence
  SiRNA target sequence
tgaagtggaagtagagcca

SEQ ID NO: 147348 - DNA, 19 bp, Artificial sequence
  SiRNA target sequence
gaagtggaagtagagccag

SEQ ID NO: 147349 - DNA, 19 bp, Artificial sequence
  SiRNA target sequence
aagtggaagtagagccagg

SEQ ID NO: 147350 - DNA, 19 bp, Artificial sequence
  SiRNA target sequence
agtggaagtagagccagga

SEQ ID NO: 147351 - DNA, 19 bp, Artificial sequence
  SiRNA target sequence
gtggaagtagagccaggag

SEQ ID NO: 147352 - DNA, 19 bp, Artificial sequence
  SiRNA target sequence
tggaagtagagccaggagt

SEQ ID NO: 147353 - DNA, 19 bp, Artificial sequence
  SiRNA target sequence
ggaagtagagccaggagta

SEQ ID NO: 147354 - DNA, 19 bp, Artificial sequence
  SiRNA target sequence
gaagtagagccaggagtac

SEQ ID NO: 147355 - DNA, 19 bp, Artificial sequence
  SiRNA target sequence
aagtagagccaggagtaca

SEQ ID NO: 147356 - DNA, 19 bp, Artificial sequence
  SiRNA target sequence
agtagagccaggagtacag

SEQ ID NO: 147357 - DNA, 19 bp, Artificial sequence
  SiRNA target sequence
gtagagccaggagtacaga

SEQ ID NO: 147358 - DNA, 19 bp, Artificial sequence
  SiRNA target sequence
tagagccaggagtacagaa

SEQ ID NO: 147359 - DNA, 19 bp, Artificial sequence
  SiRNA target sequence
agagccaggagtacagaac

SEQ ID NO: 147360 - DNA, 19 bp, Artificial sequence
  SiRNA target sequence
gagccaggagtacagaacg

SEQ ID NO: 147361 - DNA, 19 bp, Artificial sequence
  SiRNA target sequence
agccaggagtacagaacgg

SEQ ID NO: 147362 - DNA, 19 bp, Artificial sequence
  SiRNA target sequence
gccaggagtacagaacggt

SEQ ID NO: 147363 - DNA, 19 bp, Artificial sequence
  SiRNA target sequence
ccaggagtacagaacggta

SEQ ID NO: 147364 - DNA, 19 bp, Artificial sequence
  SiRNA target sequence
caggagtacagaacggtag

SEQ ID NO: 147365 - DNA, 19 bp, Artificial sequence
  SiRNA target sequence
aggagtacagaacggtaga

SEQ ID NO: 147366 - DNA, 19 bp, Artificial sequence
  SiRNA target sequence
ggagtacagaacggtagaa

SEQ ID NO: 147367 - DNA, 19 bp, Artificial sequence
  SiRNA target sequence
gagtacagaacggtagaaa

SEQ ID NO: 147368 - DNA, 19 bp, Artificial sequence
  SiRNA target sequence
agtacagaacggtagaaaa

SEQ ID NO: 147369 - DNA, 19 bp, Artificial sequence
  SiRNA target sequence
gtacagaacggtagaaaat

SEQ ID NO: 147370 - DNA, 19 bp, Artificial sequence
  SiRNA target sequence
tacagaacggtagaaaata

SEQ ID NO: 147371 - DNA, 19 bp, Artificial sequence
  SiRNA target sequence
acagaacggtagaaaatat

SEQ ID NO: 147372 - DNA, 19 bp, Artificial sequence
  SiRNA target sequence
cagaacggtagaaaatata

SEQ ID NO: 147373 - DNA, 19 bp, Artificial sequence
  SiRNA target sequence
agaacggtagaaaatatac

SEQ ID NO: 147374 - DNA, 19 bp, Artificial sequence
  SiRNA target sequence
gaacggtagaaaatataca

SEQ ID NO: 147375 - DNA, 19 bp, Artificial sequence
  SiRNA target sequence
aacggtagaaaatatacat

SEQ ID NO: 147376 - DNA, 19 bp, Artificial sequence
  SiRNA target sequence
acggtagaaaatatacatt

SEQ ID NO: 147377 - DNA, 19 bp, Artificial sequence
  SiRNA target sequence
cggtagaaaatatacattt

SEQ ID NO: 147378 - DNA, 19 bp, Artificial sequence
  SiRNA target sequence
ggtagaaaatatacatttt

SEQ ID NO: 147379 - DNA, 19 bp, Artificial sequence
  SiRNA target sequence
gtagaaaatatacattttc

SEQ ID NO: 147380 - DNA, 19 bp, Artificial sequence
  SiRNA target sequence
tagaaaatatacattttct

SEQ ID NO: 147381 - DNA, 19 bp, Artificial sequence
  SiRNA target sequence
agaaaatatacattttctg

SEQ ID NO: 147382 - DNA, 19 bp, Artificial sequence
  SiRNA target sequence
gaaaatatacattttctgg

SEQ ID NO: 147383 - DNA, 19 bp, Artificial sequence
  SiRNA target sequence
aaaatatacattttctggc

SEQ ID NO: 147384 - DNA, 19 bp, Artificial sequence
  SiRNA target sequence
aaatatacattttctggca

SEQ ID NO: 147385 - DNA, 19 bp, Artificial sequence
  SiRNA target sequence
aatatacattttctggcaa

SEQ ID NO: 147386 - DNA, 19 bp, Artificial sequence
  SiRNA target sequence
atatacattttctggcaaa

SEQ ID NO: 147387 - DNA, 19 bp, Artificial sequence
  SiRNA target sequence
tatacattttctggcaaag

SEQ ID NO: 147388 - DNA, 19 bp, Artificial sequence
  SiRNA target sequence
atacattttctggcaaagg

SEQ ID NO: 147389 - DNA, 19 bp, Artificial sequence
  SiRNA target sequence
tacattttctggcaaagga

SEQ ID NO: 147390 - DNA, 19 bp, Artificial sequence
  SiRNA target sequence
acattttctggcaaaggaa

SEQ ID NO: 147391 - DNA, 19 bp, Artificial sequence
  SiRNA target sequence
cattttctggcaaaggaaa

SEQ ID NO: 147392 - DNA, 19 bp, Artificial sequence
  SiRNA target sequence
attttctggcaaaggaaat

SEQ ID NO: 147393 - DNA, 19 bp, Artificial sequence
  SiRNA target sequence
ttttctggcaaaggaaatc

SEQ ID NO: 147394 - DNA, 19 bp, Artificial sequence
  SiRNA target sequence
tttctggcaaaggaaatca

SEQ ID NO: 147395 - DNA, 19 bp, Artificial sequence
  SiRNA target sequence
ttctggcaaaggaaatcat

SEQ ID NO: 147396 - DNA, 19 bp, Artificial sequence
  SiRNA target sequence
tctggcaaaggaaatcata

SEQ ID NO: 147397 - DNA, 19 bp, Artificial sequence
  SiRNA target sequence
ctggcaaaggaaatcataa

SEQ ID NO: 147398 - DNA, 19 bp, Artificial sequence
  SiRNA target sequence
tggcaaaggaaatcataaa

SEQ ID NO: 147399 - DNA, 19 bp, Artificial sequence
  SiRNA target sequence
ggcaaaggaaatcataaaa

SEQ ID NO: 147400 - DNA, 19 bp, Artificial sequence
  SiRNA target sequence
gcaaaggaaatcataaaaa

SEQ ID NO: 147401 - DNA, 19 bp, Artificial sequence
  SiRNA target sequence
caaaggaaatcataaaaaa

SEQ ID NO: 147402 - DNA, 19 bp, Artificial sequence
  SiRNA target sequence
aaaggaaatcataaaaaaa

SEQ ID NO: 147403 - DNA, 19 bp, Artificial sequence
  SiRNA target sequence
aaggaaatcataaaaaaaa

SEQ ID NO: 147404 - DNA, 19 bp, Artificial sequence
  SiRNA target sequence
aggaaatcataaaaaaaat

SEQ ID NO: 147405 - DNA, 19 bp, Artificial sequence
  SiRNA target sequence
ggaaatcataaaaaaaatt

SEQ ID NO: 147406 - DNA, 19 bp, Artificial sequence
  SiRNA target sequence
gaaatcataaaaaaaattg

SEQ ID NO: 147407 - DNA, 19 bp, Artificial sequence
  SiRNA target sequence
aaatcataaaaaaaattgt

SEQ ID NO: 147408 - DNA, 19 bp, Artificial sequence
  SiRNA target sequence
aatcataaaaaaaattgtg

SEQ ID NO: 147409 - DNA, 19 bp, Artificial sequence
  SiRNA target sequence
atcataaaaaaaattgtgt

SEQ ID NO: 147410 - DNA, 19 bp, Artificial sequence
  SiRNA target sequence
tcataaaaaaaattgtgta

SEQ ID NO: 147411 - DNA, 19 bp, Artificial sequence
  SiRNA target sequence
cataaaaaaaattgtgtac

SEQ ID NO: 147412 - DNA, 19 bp, Artificial sequence
  SiRNA target sequence
ataaaaaaaattgtgtacc

SEQ ID NO: 147413 - DNA, 19 bp, Artificial sequence
  SiRNA target sequence
taaaaaaaattgtgtaccg

SEQ ID NO: 147414 - DNA, 19 bp, Artificial sequence
  SiRNA target sequence
aaaaaaaattgtgtaccgg

SEQ ID NO: 147415 - DNA, 19 bp, Artificial sequence
  SiRNA target sequence
aaaaaaattgtgtaccggg

SEQ ID NO: 147416 - DNA, 19 bp, Artificial sequence
  SiRNA target sequence
aaaaaattgtgtaccgggt

SEQ ID NO: 147417 - DNA, 19 bp, Artificial sequence
  SiRNA target sequence
aaaaattgtgtaccgggtg

SEQ ID NO: 147418 - DNA, 19 bp, Artificial sequence
  SiRNA target sequence
aaaattgtgtaccgggtga

SEQ ID NO: 147419 - DNA, 19 bp, Artificial sequence
  SiRNA target sequence
aaattgtgtaccgggtgat

SEQ ID NO: 147420 - DNA, 19 bp, Artificial sequence
  SiRNA target sequence
aattgtgtaccgggtgatg

SEQ ID NO: 147421 - DNA, 19 bp, Artificial sequence
  SiRNA target sequence
attgtgtaccgggtgatgt

SEQ ID NO: 147422 - DNA, 19 bp, Artificial sequence
  SiRNA target sequence
ttgtgtaccgggtgatgtg

SEQ ID NO: 147423 - DNA, 19 bp, Artificial sequence
  SiRNA target sequence
tgtgtaccgggtgatgtga

SEQ ID NO: 147424 - DNA, 19 bp, Artificial sequence
  SiRNA target sequence
gtgtaccgggtgatgtgat

SEQ ID NO: 147425 - DNA, 19 bp, Artificial sequence
  SiRNA target sequence
tgtaccgggtgatgtgatt

SEQ ID NO: 147426 - DNA, 19 bp, Artificial sequence
  SiRNA target sequence
gtaccgggtgatgtgattc

SEQ ID NO: 147427 - DNA, 19 bp, Artificial sequence
  SiRNA target sequence
taccgggtgatgtgattct

SEQ ID NO: 147428 - DNA, 19 bp, Artificial sequence
  SiRNA target sequence
accgggtgatgtgattctt

SEQ ID NO: 147429 - DNA, 19 bp, Artificial sequence
  SiRNA target sequence
ccgggtgatgtgattctta

SEQ ID NO: 147430 - DNA, 19 bp, Artificial sequence
  SiRNA target sequence
cgggtgatgtgattcttat

SEQ ID NO: 147431 - DNA, 19 bp, Artificial sequence
  SiRNA target sequence
gggtgatgtgattcttatt

SEQ ID NO: 147432 - DNA, 19 bp, Artificial sequence
  SiRNA target sequence
ggtgatgtgattcttattg

SEQ ID NO: 147433 - DNA, 19 bp, Artificial sequence
  SiRNA target sequence
gtgatgtgattcttattgt

SEQ ID NO: 147434 - DNA, 19 bp, Artificial sequence
  SiRNA target sequence
tgatgtgattcttattgta

SEQ ID NO: 147435 - DNA, 19 bp, Artificial sequence
  SiRNA target sequence
gatgtgattcttattgtaa

SEQ ID NO: 147436 - DNA, 19 bp, Artificial sequence
  SiRNA target sequence
atgtgattcttattgtaaa

SEQ ID NO: 147437 - DNA, 19 bp, Artificial sequence
  SiRNA target sequence
tgtgattcttattgtaaac

SEQ ID NO: 147438 - DNA, 19 bp, Artificial sequence
  SiRNA target sequence
gtgattcttattgtaaaca

SEQ ID NO: 147439 - DNA, 19 bp, Artificial sequence
  SiRNA target sequence
tgattcttattgtaaacat

SEQ ID NO: 147440 - DNA, 19 bp, Artificial sequence
  SiRNA target sequence
gattcttattgtaaacatt

SEQ ID NO: 147441 - DNA, 19 bp, Artificial sequence
  SiRNA target sequence
attcttattgtaaacatta

SEQ ID NO: 147442 - DNA, 19 bp, Artificial sequence
  SiRNA target sequence
ttcttattgtaaacattac

SEQ ID NO: 147443 - DNA, 19 bp, Artificial sequence
  SiRNA target sequence
tcttattgtaaacattaca

SEQ ID NO: 147444 - DNA, 19 bp, Artificial sequence
  SiRNA target sequence
cttattgtaaacattacaa

SEQ ID NO: 147445 - DNA, 19 bp, Artificial sequence
  SiRNA target sequence
ttattgtaaacattacaaa

SEQ ID NO: 147446 - DNA, 19 bp, Artificial sequence
  SiRNA target sequence
tattgtaaacattacaaat

SEQ ID NO: 147447 - DNA, 19 bp, Artificial sequence
  SiRNA target sequence
attgtaaacattacaaatg

SEQ ID NO: 147448 - DNA, 19 bp, Artificial sequence
  SiRNA target sequence
ttgtaaacattacaaatga

SEQ ID NO: 147449 - DNA, 19 bp, Artificial sequence
  SiRNA target sequence
tgtaaacattacaaatgat

SEQ ID NO: 147450 - DNA, 19 bp, Artificial sequence
  SiRNA target sequence
gtaaacattacaaatgatc

SEQ ID NO: 147451 - DNA, 19 bp, Artificial sequence
  SiRNA target sequence
taaacattacaaatgatcc

SEQ ID NO: 147452 - DNA, 19 bp, Artificial sequence
  SiRNA target sequence
aaacattacaaatgatcca

SEQ ID NO: 147453 - DNA, 19 bp, Artificial sequence
  SiRNA target sequence
aacattacaaatgatccaa

SEQ ID NO: 147454 - DNA, 19 bp, Artificial sequence
  SiRNA target sequence
acattacaaatgatccaag

SEQ ID NO: 147455 - DNA, 19 bp, Artificial sequence
  SiRNA target sequence
cattacaaatgatccaaga

SEQ ID NO: 147456 - DNA, 19 bp, Artificial sequence
  SiRNA target sequence
attacaaatgatccaagat

SEQ ID NO: 147457 - DNA, 19 bp, Artificial sequence
  SiRNA target sequence
ttacaaatgatccaagatt

SEQ ID NO: 147458 - DNA, 19 bp, Artificial sequence
  SiRNA target sequence
tacaaatgatccaagattt

SEQ ID NO: 147459 - DNA, 19 bp, Artificial sequence
  SiRNA target sequence
acaaatgatccaagattta

SEQ ID NO: 147460 - DNA, 19 bp, Artificial sequence
  SiRNA target sequence
caaatgatccaagatttag

SEQ ID NO: 147461 - DNA, 19 bp, Artificial sequence
  SiRNA target sequence
aaatgatccaagatttaga

SEQ ID NO: 147462 - DNA, 19 bp, Artificial sequence
  SiRNA target sequence
aatgatccaagatttagaa

SEQ ID NO: 147463 - DNA, 19 bp, Artificial sequence
  SiRNA target sequence
atgatccaagatttagaaa

SEQ ID NO: 147464 - DNA, 19 bp, Artificial sequence
  SiRNA target sequence
tgatccaagatttagaaaa

SEQ ID NO: 147465 - DNA, 19 bp, Artificial sequence
  SiRNA target sequence
gatccaagatttagaaaaa

SEQ ID NO: 147466 - DNA, 19 bp, Artificial sequence
  SiRNA target sequence
atccaagatttagaaaaag

SEQ ID NO: 147467 - DNA, 19 bp, Artificial sequence
  SiRNA target sequence
tccaagatttagaaaaagt

SEQ ID NO: 147468 - DNA, 19 bp, Artificial sequence
  SiRNA target sequence
ccaagatttagaaaaagtg

SEQ ID NO: 147469 - DNA, 19 bp, Artificial sequence
  SiRNA target sequence
caagatttagaaaaagtgg

SEQ ID NO: 147470 - DNA, 19 bp, Artificial sequence
  SiRNA target sequence
aagatttagaaaaagtgga

SEQ ID NO: 147471 - DNA, 19 bp, Artificial sequence
  SiRNA target sequence
agatttagaaaaagtggat

SEQ ID NO: 147472 - DNA, 19 bp, Artificial sequence
  SiRNA target sequence
gatttagaaaaagtggata

SEQ ID NO: 147473 - DNA, 19 bp, Artificial sequence
  SiRNA target sequence
atttagaaaaagtggatat

SEQ ID NO: 147474 - DNA, 19 bp, Artificial sequence
  SiRNA target sequence
tttagaaaaagtggatata

SEQ ID NO: 147475 - DNA, 19 bp, Artificial sequence
  SiRNA target sequence
ttagaaaaagtggatataa

SEQ ID NO: 147476 - DNA, 19 bp, Artificial sequence
  SiRNA target sequence
tagaaaaagtggatataat

SEQ ID NO: 147477 - DNA, 19 bp, Artificial sequence
  SiRNA target sequence
agaaaaagtggatataatt

SEQ ID NO: 147478 - DNA, 19 bp, Artificial sequence
  SiRNA target sequence
gaaaaagtggatataattt

SEQ ID NO: 147479 - DNA, 19 bp, Artificial sequence
  SiRNA target sequence
aaaaagtggatataattta

SEQ ID NO: 147480 - DNA, 19 bp, Artificial sequence
  SiRNA target sequence
aaaagtggatataatttaa

SEQ ID NO: 147481 - DNA, 19 bp, Artificial sequence
  SiRNA target sequence
aaagtggatataatttaat

SEQ ID NO: 147482 - DNA, 19 bp, Artificial sequence
  SiRNA target sequence
aagtggatataatttaatt

SEQ ID NO: 147483 - DNA, 19 bp, Artificial sequence
  SiRNA target sequence
agtggatataatttaatta

SEQ ID NO: 147484 - DNA, 19 bp, Artificial sequence
  SiRNA target sequence
gtggatataatttaattag

SEQ ID NO: 147485 - DNA, 19 bp, Artificial sequence
  SiRNA target sequence
tggatataatttaattagt

SEQ ID NO: 147486 - DNA, 19 bp, Artificial sequence
  SiRNA target sequence
ggatataatttaattagta

SEQ ID NO: 147487 - DNA, 19 bp, Artificial sequence
  SiRNA target sequence
gatataatttaattagtaa

SEQ ID NO: 147488 - DNA, 19 bp, Artificial sequence
  SiRNA target sequence
atataatttaattagtaag

SEQ ID NO: 147489 - DNA, 19 bp, Artificial sequence
  SiRNA target sequence
tataatttaattagtaagg

SEQ ID NO: 147490 - DNA, 19 bp, Artificial sequence
  SiRNA target sequence
ataatttaattagtaaggt

SEQ ID NO: 147491 - DNA, 19 bp, Artificial sequence
  SiRNA target sequence
taatttaattagtaaggtt

SEQ ID NO: 147492 - DNA, 19 bp, Artificial sequence
  SiRNA target sequence
aatttaattagtaaggttg

SEQ ID NO: 147493 - DNA, 19 bp, Artificial sequence
  SiRNA target sequence
atttaattagtaaggttga

SEQ ID NO: 147494 - DNA, 19 bp, Artificial sequence
  SiRNA target sequence
tttaattagtaaggttgat

SEQ ID NO: 147495 - DNA, 19 bp, Artificial sequence
  SiRNA target sequence
ttaattagtaaggttgata

SEQ ID NO: 147496 - DNA, 19 bp, Artificial sequence
  SiRNA target sequence
taattagtaaggttgatat

SEQ ID NO: 147497 - DNA, 19 bp, Artificial sequence
  SiRNA target sequence
aattagtaaggttgatatt

SEQ ID NO: 147498 - DNA, 19 bp, Artificial sequence
  SiRNA target sequence
attagtaaggttgatattc

SEQ ID NO: 147499 - DNA, 19 bp, Artificial sequence
  SiRNA target sequence
ttagtaaggttgatattcc

SEQ ID NO: 147500 - DNA, 19 bp, Artificial sequence
  SiRNA target sequence
tagtaaggttgatattcca

SEQ ID NO: 147501 - DNA, 19 bp, Artificial sequence
  SiRNA target sequence
agtaaggttgatattccat

SEQ ID NO: 147502 - DNA, 19 bp, Artificial sequence
  SiRNA target sequence
gtaaggttgatattccatt

SEQ ID NO: 147503 - DNA, 19 bp, Artificial sequence
  SiRNA target sequence
taaggttgatattccattg

SEQ ID NO: 147504 - DNA, 19 bp, Artificial sequence
  SiRNA target sequence
aaggttgatattccattgt

SEQ ID NO: 147505 - DNA, 19 bp, Artificial sequence
  SiRNA target sequence
aggttgatattccattgta

SEQ ID NO: 147506 - DNA, 19 bp, Artificial sequence
  SiRNA target sequence
ggttgatattccattgtat

SEQ ID NO: 147507 - DNA, 19 bp, Artificial sequence
  SiRNA target sequence
gttgatattccattgtatg

SEQ ID NO: 147508 - DNA, 19 bp, Artificial sequence
  SiRNA target sequence
ttgatattccattgtatgt

SEQ ID NO: 147509 - DNA, 19 bp, Artificial sequence
  SiRNA target sequence
tgatattccattgtatgtt

SEQ ID NO: 147510 - DNA, 19 bp, Artificial sequence
  SiRNA target sequence
gatattccattgtatgttg

SEQ ID NO: 147511 - DNA, 19 bp, Artificial sequence
  SiRNA target sequence
atattccattgtatgttgc

SEQ ID NO: 147512 - DNA, 19 bp, Artificial sequence
  SiRNA target sequence
tattccattgtatgttgct

SEQ ID NO: 147513 - DNA, 19 bp, Artificial sequence
  SiRNA target sequence
attccattgtatgttgctt

SEQ ID NO: 147514 - DNA, 19 bp, Artificial sequence
  SiRNA target sequence
ttccattgtatgttgcttt

SEQ ID NO: 147515 - DNA, 19 bp, Artificial sequence
  SiRNA target sequence
tccattgtatgttgctttg

SEQ ID NO: 147516 - DNA, 19 bp, Artificial sequence
  SiRNA target sequence
ccattgtatgttgctttgg

SEQ ID NO: 147517 - DNA, 19 bp, Artificial sequence
  SiRNA target sequence
cattgtatgttgctttggc

SEQ ID NO: 147518 - DNA, 19 bp, Artificial sequence
  SiRNA target sequence
attgtatgttgctttggca

SEQ ID NO: 147519 - DNA, 19 bp, Artificial sequence
  SiRNA target sequence
ttgtatgttgctttggcag

SEQ ID NO: 147520 - DNA, 19 bp, Artificial sequence
  SiRNA target sequence
tgtatgttgctttggcagg

SEQ ID NO: 147521 - DNA, 19 bp, Artificial sequence
  SiRNA target sequence
gtatgttgctttggcaggc

SEQ ID NO: 147522 - DNA, 19 bp, Artificial sequence
  SiRNA target sequence
tatgttgctttggcaggcg

SEQ ID NO: 147523 - DNA, 19 bp, Artificial sequence
  SiRNA target sequence
atgttgctttggcaggcgg

SEQ ID NO: 147524 - DNA, 19 bp, Artificial sequence
  SiRNA target sequence
tgttgctttggcaggcgga

SEQ ID NO: 147525 - DNA, 19 bp, Artificial sequence
  SiRNA target sequence
gttgctttggcaggcggac

SEQ ID NO: 147526 - DNA, 19 bp, Artificial sequence
  SiRNA target sequence
ttgctttggcaggcggaca

SEQ ID NO: 147527 - DNA, 19 bp, Artificial sequence
  SiRNA target sequence
tgctttggcaggcggacag

SEQ ID NO: 147528 - DNA, 19 bp, Artificial sequence
  SiRNA target sequence
gctttggcaggcggacaga

SEQ ID NO: 147529 - DNA, 19 bp, Artificial sequence
  SiRNA target sequence
ctttggcaggcggacagat

SEQ ID NO: 147530 - DNA, 19 bp, Artificial sequence
  SiRNA target sequence
tttggcaggcggacagatt

SEQ ID NO: 147531 - DNA, 19 bp, Artificial sequence
  SiRNA target sequence
ttggcaggcggacagatta

SEQ ID NO: 147532 - DNA, 19 bp, Artificial sequence
  SiRNA target sequence
tggcaggcggacagattat

SEQ ID NO: 147533 - DNA, 19 bp, Artificial sequence
  SiRNA target sequence
ggcaggcggacagattata

SEQ ID NO: 147534 - DNA, 19 bp, Artificial sequence
  SiRNA target sequence
gcaggcggacagattatat

SEQ ID NO: 147535 - DNA, 19 bp, Artificial sequence
  SiRNA target sequence
caggcggacagattatatt

SEQ ID NO: 147536 - DNA, 19 bp, Artificial sequence
  SiRNA target sequence
aggcggacagattatattt

SEQ ID NO: 147537 - DNA, 19 bp, Artificial sequence
  SiRNA target sequence
ggcggacagattatatttg

SEQ ID NO: 147538 - DNA, 19 bp, Artificial sequence
  SiRNA target sequence
gcggacagattatatttga

SEQ ID NO: 147539 - DNA, 19 bp, Artificial sequence
  SiRNA target sequence
cggacagattatatttgaa

SEQ ID NO: 147540 - DNA, 19 bp, Artificial sequence
  SiRNA target sequence
ggacagattatatttgaac

SEQ ID NO: 147541 - DNA, 19 bp, Artificial sequence
  SiRNA target sequence
gacagattatatttgaaca

SEQ ID NO: 147542 - DNA, 19 bp, Artificial sequence
  SiRNA target sequence
acagattatatttgaacat

SEQ ID NO: 147543 - DNA, 19 bp, Artificial sequence
  SiRNA target sequence
cagattatatttgaacata

SEQ ID NO: 147544 - DNA, 19 bp, Artificial sequence
  SiRNA target sequence
agattatatttgaacatat

SEQ ID NO: 147545 - DNA, 19 bp, Artificial sequence
  SiRNA target sequence
gattatatttgaacatatc

SEQ ID NO: 147546 - DNA, 19 bp, Artificial sequence
  SiRNA target sequence
attatatttgaacatatca

SEQ ID NO: 147547 - DNA, 19 bp, Artificial sequence
  SiRNA target sequence
ttatatttgaacatatcac

SEQ ID NO: 147548 - DNA, 19 bp, Artificial sequence
  SiRNA target sequence
tatatttgaacatatcact

SEQ ID NO: 147549 - DNA, 19 bp, Artificial sequence
  SiRNA target sequence
atatttgaacatatcactg

SEQ ID NO: 147550 - DNA, 19 bp, Artificial sequence
  SiRNA target sequence
tatttgaacatatcactgg

SEQ ID NO: 147551 - DNA, 19 bp, Artificial sequence
  SiRNA target sequence
atttgaacatatcactggt

SEQ ID NO: 147552 - DNA, 19 bp, Artificial sequence
  SiRNA target sequence
tttgaacatatcactggta

SEQ ID NO: 147553 - DNA, 19 bp, Artificial sequence
  SiRNA target sequence
ttgaacatatcactggtaa

SEQ ID NO: 147554 - DNA, 19 bp, Artificial sequence
  SiRNA target sequence
tgaacatatcactggtaag

SEQ ID NO: 147555 - DNA, 19 bp, Artificial sequence
  SiRNA target sequence
gaacatatcactggtaaga

SEQ ID NO: 147556 - DNA, 19 bp, Artificial sequence
  SiRNA target sequence
aacatatcactggtaagaa

SEQ ID NO: 147557 - DNA, 19 bp, Artificial sequence
  SiRNA target sequence
acatatcactggtaagaaa

SEQ ID NO: 147558 - DNA, 19 bp, Artificial sequence
  SiRNA target sequence
catatcactggtaagaaat

SEQ ID NO: 147559 - DNA, 19 bp, Artificial sequence
  SiRNA target sequence
atatcactggtaagaaatt

SEQ ID NO: 147560 - DNA, 19 bp, Artificial sequence
  SiRNA target sequence
tatcactggtaagaaattt

SEQ ID NO: 147561 - DNA, 19 bp, Artificial sequence
  SiRNA target sequence
atcactggtaagaaatttg

SEQ ID NO: 147562 - DNA, 19 bp, Artificial sequence
  SiRNA target sequence
tcactggtaagaaatttga

SEQ ID NO: 147563 - DNA, 19 bp, Artificial sequence
  SiRNA target sequence
cactggtaagaaatttgaa

SEQ ID NO: 147564 - DNA, 19 bp, Artificial sequence
  SiRNA target sequence
actggtaagaaatttgaaa

SEQ ID NO: 147565 - DNA, 19 bp, Artificial sequence
  SiRNA target sequence
ctggtaagaaatttgaaat

SEQ ID NO: 147566 - DNA, 19 bp, Artificial sequence
  SiRNA target sequence
tggtaagaaatttgaaatt

SEQ ID NO: 147567 - DNA, 19 bp, Artificial sequence
  SiRNA target sequence
ggtaagaaatttgaaatta

SEQ ID NO: 147568 - DNA, 19 bp, Artificial sequence
  SiRNA target sequence
gtaagaaatttgaaattac

SEQ ID NO: 147569 - DNA, 19 bp, Artificial sequence
  SiRNA target sequence
taagaaatttgaaattact

SEQ ID NO: 147570 - DNA, 19 bp, Artificial sequence
  SiRNA target sequence
aagaaatttgaaattactt

SEQ ID NO: 147571 - DNA, 19 bp, Artificial sequence
  SiRNA target sequence
agaaatttgaaattacttt

SEQ ID NO: 147572 - DNA, 19 bp, Artificial sequence
  SiRNA target sequence
gaaatttgaaattacttta

SEQ ID NO: 147573 - DNA, 19 bp, Artificial sequence
  SiRNA target sequence
aaatttgaaattactttat

SEQ ID NO: 147574 - DNA, 19 bp, Artificial sequence
  SiRNA target sequence
aatttgaaattactttata

SEQ ID NO: 147575 - DNA, 19 bp, Artificial sequence
  SiRNA target sequence
atttgaaattactttatat

SEQ ID NO: 147576 - DNA, 19 bp, Artificial sequence
  SiRNA target sequence
tttgaaattactttatatc

SEQ ID NO: 147577 - DNA, 19 bp, Artificial sequence
  SiRNA target sequence
ttgaaattactttatatcc

SEQ ID NO: 147578 - DNA, 19 bp, Artificial sequence
  SiRNA target sequence
tgaaattactttatatcca

SEQ ID NO: 147579 - DNA, 19 bp, Artificial sequence
  SiRNA target sequence
gaaattactttatatccat

SEQ ID NO: 147580 - DNA, 19 bp, Artificial sequence
  SiRNA target sequence
aaattactttatatccatt

SEQ ID NO: 147581 - DNA, 19 bp, Artificial sequence
  SiRNA target sequence
aattactttatatccattt

SEQ ID NO: 147582 - DNA, 19 bp, Artificial sequence
  SiRNA target sequence
attactttatatccattta

SEQ ID NO: 147583 - DNA, 19 bp, Artificial sequence
  SiRNA target sequence
ttactttatatccatttaa

SEQ ID NO: 147584 - DNA, 19 bp, Artificial sequence
  SiRNA target sequence
tactttatatccatttaaa

SEQ ID NO: 147585 - DNA, 19 bp, Artificial sequence
  SiRNA target sequence
actttatatccatttaaag

SEQ ID NO: 147586 - DNA, 19 bp, Artificial sequence
  SiRNA target sequence
ctttatatccatttaaaga

SEQ ID NO: 147587 - DNA, 19 bp, Artificial sequence
  SiRNA target sequence
tttatatccatttaaagat

SEQ ID NO: 147588 - DNA, 19 bp, Artificial sequence
  SiRNA target sequence
ttatatccatttaaagatt

SEQ ID NO: 147589 - DNA, 19 bp, Artificial sequence
  SiRNA target sequence
tatatccatttaaagattt

SEQ ID NO: 147590 - DNA, 19 bp, Artificial sequence
  SiRNA target sequence
atatccatttaaagattta

SEQ ID NO: 147591 - DNA, 19 bp, Artificial sequence
  SiRNA target sequence
tatccatttaaagatttaa

SEQ ID NO: 147592 - DNA, 19 bp, Artificial sequence
  SiRNA target sequence
atccatttaaagatttaaa

SEQ ID NO: 147593 - DNA, 19 bp, Artificial sequence
  SiRNA target sequence
tccatttaaagatttaaag

SEQ ID NO: 147594 - DNA, 19 bp, Artificial sequence
  SiRNA target sequence
ccatttaaagatttaaaga

SEQ ID NO: 147595 - DNA, 19 bp, Artificial sequence
  SiRNA target sequence
catttaaagatttaaagaa

SEQ ID NO: 147596 - DNA, 19 bp, Artificial sequence
  SiRNA target sequence
atttaaagatttaaagaaa

SEQ ID NO: 147597 - DNA, 19 bp, Artificial sequence
  SiRNA target sequence
tttaaagatttaaagaaat

SEQ ID NO: 147598 - DNA, 19 bp, Artificial sequence
  SiRNA target sequence
ttaaagatttaaagaaatg

SEQ ID NO: 147599 - DNA, 19 bp, Artificial sequence
  SiRNA target sequence
taaagatttaaagaaatgt

SEQ ID NO: 147600 - DNA, 19 bp, Artificial sequence
  SiRNA target sequence
aaagatttaaagaaatgta

SEQ ID NO: 147601 - DNA, 19 bp, Artificial sequence
  SiRNA target sequence
aagatttaaagaaatgtat

SEQ ID NO: 147602 - DNA, 19 bp, Artificial sequence
  SiRNA target sequence
agatttaaagaaatgtatt

SEQ ID NO: 147603 - DNA, 19 bp, Artificial sequence
  SiRNA target sequence
gatttaaagaaatgtatta

SEQ ID NO: 147604 - DNA, 19 bp, Artificial sequence
  SiRNA target sequence
atttaaagaaatgtattat

SEQ ID NO: 147605 - DNA, 19 bp, Artificial sequence
  SiRNA target sequence
tttaaagaaatgtattatt

SEQ ID NO: 147606 - DNA, 19 bp, Artificial sequence
  SiRNA target sequence
ttaaagaaatgtattattt

SEQ ID NO: 147607 - DNA, 19 bp, Artificial sequence
  SiRNA target sequence
taaagaaatgtattatttt

SEQ ID NO: 147608 - DNA, 19 bp, Artificial sequence
  SiRNA target sequence
aaagaaatgtattatttta

SEQ ID NO: 147609 - DNA, 19 bp, Artificial sequence
  SiRNA target sequence
aagaaatgtattattttaa

SEQ ID NO: 147610 - DNA, 19 bp, Artificial sequence
  SiRNA target sequence
agaaatgtattattttaaa

SEQ ID NO: 147611 - DNA, 19 bp, Artificial sequence
  SiRNA target sequence
gaaatgtattattttaaaa

SEQ ID NO: 147612 - DNA, 19 bp, Artificial sequence
  SiRNA target sequence
aaatgtattattttaaaag

SEQ ID NO: 147613 - DNA, 19 bp, Artificial sequence
  SiRNA target sequence
aatgtattattttaaaagg

SEQ ID NO: 147614 - DNA, 19 bp, Artificial sequence
  SiRNA target sequence
atgtattattttaaaaggc

SEQ ID NO: 147615 - DNA, 19 bp, Artificial sequence
  SiRNA target sequence
tgtattattttaaaaggcg

SEQ ID NO: 147616 - DNA, 19 bp, Artificial sequence
  SiRNA target sequence
gtattattttaaaaggcga

SEQ ID NO: 147617 - DNA, 19 bp, Artificial sequence
  SiRNA target sequence
tattattttaaaaggcgaa

SEQ ID NO: 147618 - DNA, 19 bp, Artificial sequence
  SiRNA target sequence
attattttaaaaggcgaag

SEQ ID NO: 147619 - DNA, 19 bp, Artificial sequence
  SiRNA target sequence
ttattttaaaaggcgaagg

SEQ ID NO: 147620 - DNA, 19 bp, Artificial sequence
  SiRNA target sequence
tattttaaaaggcgaaggt

SEQ ID NO: 147621 - DNA, 19 bp, Artificial sequence
  SiRNA target sequence
attttaaaaggcgaaggtt

SEQ ID NO: 147622 - DNA, 19 bp, Artificial sequence
  SiRNA target sequence
ttttaaaaggcgaaggttt

SEQ ID NO: 147623 - DNA, 19 bp, Artificial sequence
  SiRNA target sequence
tttaaaaggcgaaggtttt

SEQ ID NO: 147624 - DNA, 19 bp, Artificial sequence
  SiRNA target sequence
ttaaaaggcgaaggtttta

SEQ ID NO: 147625 - DNA, 19 bp, Artificial sequence
  SiRNA target sequence
taaaaggcgaaggttttaa

SEQ ID NO: 147626 - DNA, 19 bp, Artificial sequence
  SiRNA target sequence
aaaaggcgaaggttttaaa

SEQ ID NO: 147627 - DNA, 19 bp, Artificial sequence
  SiRNA target sequence
aaaggcgaaggttttaaaa

SEQ ID NO: 147628 - DNA, 19 bp, Artificial sequence
  SiRNA target sequence
aaggcgaaggttttaaaat

SEQ ID NO: 147629 - DNA, 19 bp, Artificial sequence
  SiRNA target sequence
aggcgaaggttttaaaata

SEQ ID NO: 147630 - DNA, 19 bp, Artificial sequence
  SiRNA target sequence
ggcgaaggttttaaaataa

SEQ ID NO: 147631 - DNA, 19 bp, Artificial sequence
  SiRNA target sequence
gcgaaggttttaaaataaa

SEQ ID NO: 147632 - DNA, 19 bp, Artificial sequence
  SiRNA target sequence
cgaaggttttaaaataaaa

SEQ ID NO: 147633 - DNA, 19 bp, Artificial sequence
  SiRNA target sequence
gaaggttttaaaataaaaa

SEQ ID NO: 147634 - DNA, 19 bp, Artificial sequence
  SiRNA target sequence
aaggttttaaaataaaaaa

SEQ ID NO: 147635 - DNA, 19 bp, Artificial sequence
  SiRNA target sequence
aggttttaaaataaaaaat

SEQ ID NO: 147636 - DNA, 19 bp, Artificial sequence
  SiRNA target sequence
ggttttaaaataaaaaata

SEQ ID NO: 147637 - DNA, 19 bp, Artificial sequence
  SiRNA target sequence
gttttaaaataaaaaatag

SEQ ID NO: 147638 - DNA, 19 bp, Artificial sequence
  SiRNA target sequence
ttttaaaataaaaaatagt

SEQ ID NO: 147639 - DNA, 19 bp, Artificial sequence
  SiRNA target sequence
tttaaaataaaaaatagtt

SEQ ID NO: 147640 - DNA, 19 bp, Artificial sequence
  SiRNA target sequence
ttaaaataaaaaatagtta

SEQ ID NO: 147641 - DNA, 19 bp, Artificial sequence
  SiRNA target sequence
taaaataaaaaatagttat

SEQ ID NO: 147642 - DNA, 19 bp, Artificial sequence
  SiRNA target sequence
aaaataaaaaatagttatt

SEQ ID NO: 147643 - DNA, 19 bp, Artificial sequence
  SiRNA target sequence
aaataaaaaatagttattc

SEQ ID NO: 147644 - DNA, 19 bp, Artificial sequence
  SiRNA target sequence
aataaaaaatagttattcg

SEQ ID NO: 147645 - DNA, 19 bp, Artificial sequence
  SiRNA target sequence
ataaaaaatagttattcgg

SEQ ID NO: 147646 - DNA, 19 bp, Artificial sequence
  SiRNA target sequence
taaaaaatagttattcggg

SEQ ID NO: 147647 - DNA, 19 bp, Artificial sequence
  SiRNA target sequence
aaaaaatagttattcgggt

SEQ ID NO: 147648 - DNA, 19 bp, Artificial sequence
  SiRNA target sequence
aaaaatagttattcgggtg

SEQ ID NO: 147649 - DNA, 19 bp, Artificial sequence
  SiRNA target sequence
aaaatagttattcgggtgg

SEQ ID NO: 147650 - DNA, 19 bp, Artificial sequence
  SiRNA target sequence
aaatagttattcgggtggt

SEQ ID NO: 147651 - DNA, 19 bp, Artificial sequence
  SiRNA target sequence
aatagttattcgggtggtg

SEQ ID NO: 147652 - DNA, 19 bp, Artificial sequence
  SiRNA target sequence
atagttattcgggtggtga

SEQ ID NO: 147653 - DNA, 19 bp, Artificial sequence
  SiRNA target sequence
tagttattcgggtggtgat

SEQ ID NO: 147654 - DNA, 19 bp, Artificial sequence
  SiRNA target sequence
agttattcgggtggtgatc

SEQ ID NO: 147655 - DNA, 19 bp, Artificial sequence
  SiRNA target sequence
gttattcgggtggtgatct

SEQ ID NO: 147656 - DNA, 19 bp, Artificial sequence
  SiRNA target sequence
ttattcgggtggtgatctt

SEQ ID NO: 147657 - DNA, 19 bp, Artificial sequence
  SiRNA target sequence
tattcgggtggtgatctta

SEQ ID NO: 147658 - DNA, 19 bp, Artificial sequence
  SiRNA target sequence
attcgggtggtgatcttat

SEQ ID NO: 147659 - DNA, 19 bp, Artificial sequence
  SiRNA target sequence
ttcgggtggtgatcttatt

SEQ ID NO: 147660 - DNA, 19 bp, Artificial sequence
  SiRNA target sequence
tcgggtggtgatcttattc

SEQ ID NO: 147661 - DNA, 19 bp, Artificial sequence
  SiRNA target sequence
cgggtggtgatcttattct

SEQ ID NO: 147662 - DNA, 19 bp, Artificial sequence
  SiRNA target sequence
gggtggtgatcttattctc

SEQ ID NO: 147663 - DNA, 19 bp, Artificial sequence
  SiRNA target sequence
ggtggtgatcttattctcg

SEQ ID NO: 147664 - DNA, 19 bp, Artificial sequence
  SiRNA target sequence
gtggtgatcttattctcga

SEQ ID NO: 147665 - DNA, 19 bp, Artificial sequence
  SiRNA target sequence
tggtgatcttattctcgaa

SEQ ID NO: 147666 - DNA, 19 bp, Artificial sequence
  SiRNA target sequence
ggtgatcttattctcgaac

SEQ ID NO: 147667 - DNA, 19 bp, Artificial sequence
  SiRNA target sequence
gtgatcttattctcgaacc

SEQ ID NO: 147668 - DNA, 19 bp, Artificial sequence
  SiRNA target sequence
tgatcttattctcgaacct

SEQ ID NO: 147669 - DNA, 19 bp, Artificial sequence
  SiRNA target sequence
gatcttattctcgaaccta

SEQ ID NO: 147670 - DNA, 19 bp, Artificial sequence
  SiRNA target sequence
atcttattctcgaacctaa

SEQ ID NO: 147671 - DNA, 19 bp, Artificial sequence
  SiRNA target sequence
tcttattctcgaacctaat

SEQ ID NO: 147672 - DNA, 19 bp, Artificial sequence
  SiRNA target sequence
cttattctcgaacctaata

SEQ ID NO: 147673 - DNA, 19 bp, Artificial sequence
  SiRNA target sequence
ttattctcgaacctaatat

SEQ ID NO: 147674 - DNA, 19 bp, Artificial sequence
  SiRNA target sequence
tattctcgaacctaatata

SEQ ID NO: 147675 - DNA, 19 bp, Artificial sequence
  SiRNA target sequence
attctcgaacctaatataa

SEQ ID NO: 147676 - DNA, 19 bp, Artificial sequence
  SiRNA target sequence
ttctcgaacctaatataat

SEQ ID NO: 147677 - DNA, 19 bp, Artificial sequence
  SiRNA target sequence
tctcgaacctaatataatt

SEQ ID NO: 147678 - DNA, 19 bp, Artificial sequence
  SiRNA target sequence
ctcgaacctaatataatta

SEQ ID NO: 147679 - DNA, 19 bp, Artificial sequence
  SiRNA target sequence
tcgaacctaatataattat

SEQ ID NO: 147680 - DNA, 19 bp, Artificial sequence
  SiRNA target sequence
cgaacctaatataattata

SEQ ID NO: 147681 - DNA, 19 bp, Artificial sequence
  SiRNA target sequence
gaacctaatataattatag

SEQ ID NO: 147682 - DNA, 19 bp, Artificial sequence
  SiRNA target sequence
aacctaatataattataga

SEQ ID NO: 147683 - DNA, 19 bp, Artificial sequence
  SiRNA target sequence
acctaatataattatagat

SEQ ID NO: 147684 - DNA, 19 bp, Artificial sequence
  SiRNA target sequence
cctaatataattatagata

SEQ ID NO: 147685 - DNA, 19 bp, Artificial sequence
  SiRNA target sequence
ctaatataattatagataa

SEQ ID NO: 147686 - DNA, 19 bp, Artificial sequence
  SiRNA target sequence
taatataattatagataag

SEQ ID NO: 147687 - DNA, 19 bp, Artificial sequence
  SiRNA target sequence
aatataattatagataaga

SEQ ID NO: 147688 - DNA, 19 bp, Artificial sequence
  SiRNA target sequence
atataattatagataagaa

SEQ ID NO: 147689 - DNA, 19 bp, Artificial sequence
  SiRNA target sequence
tataattatagataagaat

SEQ ID NO: 147690 - DNA, 19 bp, Artificial sequence
  SiRNA target sequence
ataattatagataagaata

SEQ ID NO: 147691 - DNA, 19 bp, Artificial sequence
  SiRNA target sequence
taattatagataagaatat

SEQ ID NO: 147692 - DNA, 19 bp, Artificial sequence
  SiRNA target sequence
aattatagataagaatatt

SEQ ID NO: 147693 - DNA, 19 bp, Artificial sequence
  SiRNA target sequence
attatagataagaatattg

SEQ ID NO: 147694 - DNA, 19 bp, Artificial sequence
  SiRNA target sequence
ttatagataagaatattga

SEQ ID NO: 147695 - DNA, 19 bp, Artificial sequence
  SiRNA target sequence
tatagataagaatattgat

SEQ ID NO: 147696 - DNA, 19 bp, Artificial sequence
  SiRNA target sequence
atagataagaatattgata

SEQ ID NO: 147697 - DNA, 19 bp, Artificial sequence
  SiRNA target sequence
tagataagaatattgataa

SEQ ID NO: 147698 - DNA, 19 bp, Artificial sequence
  SiRNA target sequence
agataagaatattgataaa

SEQ ID NO: 147699 - DNA, 19 bp, Artificial sequence
  SiRNA target sequence
gataagaatattgataaag

SEQ ID NO: 147700 - DNA, 19 bp, Artificial sequence
  SiRNA target sequence
ataagaatattgataaaga

SEQ ID NO: 147701 - DNA, 19 bp, Artificial sequence
  SiRNA target sequence
taagaatattgataaagat

SEQ ID NO: 147702 - DNA, 19 bp, Artificial sequence
  SiRNA target sequence
aagaatattgataaagatt

SEQ ID NO: 147703 - DNA, 19 bp, Artificial sequence
  SiRNA target sequence
agaatattgataaagattt

SEQ ID NO: 147704 - DNA, 19 bp, Artificial sequence
  SiRNA target sequence
gaatattgataaagattta

SEQ ID NO: 147705 - DNA, 19 bp, Artificial sequence
  SiRNA target sequence
aatattgataaagatttat

SEQ ID NO: 147706 - DNA, 19 bp, Artificial sequence
  SiRNA target sequence
atattgataaagatttatt

SEQ ID NO: 147707 - DNA, 19 bp, Artificial sequence
  SiRNA target sequence
tattgataaagatttatta

SEQ ID NO: 147708 - DNA, 19 bp, Artificial sequence
  SiRNA target sequence
attgataaagatttattag

SEQ ID NO: 147709 - DNA, 19 bp, Artificial sequence
  SiRNA target sequence
ttgataaagatttattagc

SEQ ID NO: 147710 - DNA, 19 bp, Artificial sequence
  SiRNA target sequence
tgataaagatttattagca

SEQ ID NO: 147711 - DNA, 19 bp, Artificial sequence
  SiRNA target sequence
gataaagatttattagcac

SEQ ID NO: 147712 - DNA, 19 bp, Artificial sequence
  SiRNA target sequence
ataaagatttattagcacg

SEQ ID NO: 147713 - DNA, 19 bp, Artificial sequence
  SiRNA target sequence
taaagatttattagcacgc

SEQ ID NO: 147714 - DNA, 19 bp, Artificial sequence
  SiRNA target sequence
aaagatttattagcacgcg

SEQ ID NO: 147715 - DNA, 19 bp, Artificial sequence
  SiRNA target sequence
aagatttattagcacgcgc

SEQ ID NO: 147716 - DNA, 19 bp, Artificial sequence
  SiRNA target sequence
agatttattagcacgcgcc

SEQ ID NO: 147717 - DNA, 19 bp, Artificial sequence
  SiRNA target sequence
gatttattagcacgcgcct

SEQ ID NO: 147718 - DNA, 19 bp, Artificial sequence
  SiRNA target sequence
atttattagcacgcgcctt

SEQ ID NO: 147719 - DNA, 19 bp, Artificial sequence
  SiRNA target sequence
tttattagcacgcgccttg

SEQ ID NO: 147720 - DNA, 19 bp, Artificial sequence
  SiRNA target sequence
ttattagcacgcgccttga

SEQ ID NO: 147721 - DNA, 19 bp, Artificial sequence
  SiRNA target sequence
tattagcacgcgccttgaa

SEQ ID NO: 147722 - DNA, 19 bp, Artificial sequence
  SiRNA target sequence
attagcacgcgccttgaat

SEQ ID NO: 147723 - DNA, 19 bp, Artificial sequence
  SiRNA target sequence
ttagcacgcgccttgaatt

SEQ ID NO: 147724 - DNA, 19 bp, Artificial sequence
  SiRNA target sequence
tagcacgcgccttgaatta

SEQ ID NO: 147725 - DNA, 19 bp, Artificial sequence
  SiRNA target sequence
agcacgcgccttgaattat

SEQ ID NO: 147726 - DNA, 19 bp, Artificial sequence
  SiRNA target sequence
gcacgcgccttgaattatg

SEQ ID NO: 147727 - DNA, 19 bp, Artificial sequence
  SiRNA target sequence
cacgcgccttgaattatgt

SEQ ID NO: 147728 - DNA, 19 bp, Artificial sequence
  SiRNA target sequence
acgcgccttgaattatgtt

SEQ ID NO: 147729 - DNA, 19 bp, Artificial sequence
  SiRNA target sequence
cgcgccttgaattatgttc

SEQ ID NO: 147730 - DNA, 19 bp, Artificial sequence
  SiRNA target sequence
gcgccttgaattatgttcc

SEQ ID NO: 147731 - DNA, 19 bp, Artificial sequence
  SiRNA target sequence
cgccttgaattatgttcct

SEQ ID NO: 147732 - DNA, 19 bp, Artificial sequence
  SiRNA target sequence
gccttgaattatgttcctg

SEQ ID NO: 147733 - DNA, 19 bp, Artificial sequence
  SiRNA target sequence
ccttgaattatgttcctgt

SEQ ID NO: 147734 - DNA, 19 bp, Artificial sequence
  SiRNA target sequence
cttgaattatgttcctgta

SEQ ID NO: 147735 - DNA, 19 bp, Artificial sequence
  SiRNA target sequence
ttgaattatgttcctgtaa

SEQ ID NO: 147736 - DNA, 19 bp, Artificial sequence
  SiRNA target sequence
tgaattatgttcctgtaag

SEQ ID NO: 147737 - DNA, 19 bp, Artificial sequence
  SiRNA target sequence
gaattatgttcctgtaaga

SEQ ID NO: 147738 - DNA, 19 bp, Artificial sequence
  SiRNA target sequence
aattatgttcctgtaagaa

SEQ ID NO: 147739 - DNA, 19 bp, Artificial sequence
  SiRNA target sequence
attatgttcctgtaagaaa

SEQ ID NO: 147740 - DNA, 19 bp, Artificial sequence
  SiRNA target sequence
ttatgttcctgtaagaaaa

SEQ ID NO: 147741 - DNA, 19 bp, Artificial sequence
  SiRNA target sequence
tatgttcctgtaagaaaag

SEQ ID NO: 147742 - DNA, 19 bp, Artificial sequence
  SiRNA target sequence
atgttcctgtaagaaaaga

SEQ ID NO: 147743 - DNA, 19 bp, Artificial sequence
  SiRNA target sequence
tgttcctgtaagaaaagat

SEQ ID NO: 147744 - DNA, 19 bp, Artificial sequence
  SiRNA target sequence
gttcctgtaagaaaagatt

SEQ ID NO: 147745 - DNA, 19 bp, Artificial sequence
  SiRNA target sequence
ttcctgtaagaaaagattt

SEQ ID NO: 147746 - DNA, 19 bp, Artificial sequence
  SiRNA target sequence
tcctgtaagaaaagatttt

SEQ ID NO: 147747 - DNA, 19 bp, Artificial sequence
  SiRNA target sequence
cctgtaagaaaagatttta

SEQ ID NO: 147748 - DNA, 19 bp, Artificial sequence
  SiRNA target sequence
ctgtaagaaaagattttac

SEQ ID NO: 147749 - DNA, 19 bp, Artificial sequence
  SiRNA target sequence
tgtaagaaaagattttaca

SEQ ID NO: 147750 - DNA, 19 bp, Artificial sequence
  SiRNA target sequence
gtaagaaaagattttacag

SEQ ID NO: 147751 - DNA, 19 bp, Artificial sequence
  SiRNA target sequence
taagaaaagattttacagg

SEQ ID NO: 147752 - DNA, 19 bp, Artificial sequence
  SiRNA target sequence
aagaaaagattttacagga

SEQ ID NO: 147753 - DNA, 19 bp, Artificial sequence
  SiRNA target sequence
agaaaagattttacaggaa

SEQ ID NO: 147754 - DNA, 19 bp, Artificial sequence
  SiRNA target sequence
gaaaagattttacaggaac

SEQ ID NO: 147755 - DNA, 19 bp, Artificial sequence
  SiRNA target sequence
aaaagattttacaggaact

SEQ ID NO: 147756 - DNA, 19 bp, Artificial sequence
  SiRNA target sequence
aaagattttacaggaactg

SEQ ID NO: 147757 - DNA, 19 bp, Artificial sequence
  SiRNA target sequence
aagattttacaggaactgc

SEQ ID NO: 147758 - DNA, 19 bp, Artificial sequence
  SiRNA target sequence
agattttacaggaactgct

SEQ ID NO: 147759 - DNA, 19 bp, Artificial sequence
  SiRNA target sequence
gattttacaggaactgctg

SEQ ID NO: 147760 - DNA, 19 bp, Artificial sequence
  SiRNA target sequence
attttacaggaactgctgt

SEQ ID NO: 147761 - DNA, 19 bp, Artificial sequence
  SiRNA target sequence
ttttacaggaactgctgtt

SEQ ID NO: 147762 - DNA, 19 bp, Artificial sequence
  SiRNA target sequence
tttacaggaactgctgttc

SEQ ID NO: 147763 - DNA, 19 bp, Artificial sequence
  SiRNA target sequence
ttacaggaactgctgttcc

SEQ ID NO: 147764 - DNA, 19 bp, Artificial sequence
  SiRNA target sequence
tacaggaactgctgttcca

SEQ ID NO: 147765 - DNA, 19 bp, Artificial sequence
  SiRNA target sequence
acaggaactgctgttccaa

SEQ ID NO: 147766 - DNA, 19 bp, Artificial sequence
  SiRNA target sequence
caggaactgctgttccaaa

SEQ ID NO: 147767 - DNA, 19 bp, Artificial sequence
  SiRNA target sequence
aggaactgctgttccaaaa

SEQ ID NO: 147768 - DNA, 19 bp, Artificial sequence
  SiRNA target sequence
ggaactgctgttccaaaat

SEQ ID NO: 147769 - DNA, 19 bp, Artificial sequence
  SiRNA target sequence
gaactgctgttccaaaata

SEQ ID NO: 147770 - DNA, 19 bp, Artificial sequence
  SiRNA target sequence
aactgctgttccaaaatat

SEQ ID NO: 147771 - DNA, 19 bp, Artificial sequence
  SiRNA target sequence
actgctgttccaaaatatg

SEQ ID NO: 147772 - DNA, 19 bp, Artificial sequence
  SiRNA target sequence
ctgctgttccaaaatatgc

SEQ ID NO: 147773 - DNA, 19 bp, Artificial sequence
  SiRNA target sequence
tgctgttccaaaatatgca

SEQ ID NO: 147774 - DNA, 19 bp, Artificial sequence
  SiRNA target sequence
gctgttccaaaatatgcag

SEQ ID NO: 147775 - DNA, 19 bp, Artificial sequence
  SiRNA target sequence
ctgttccaaaatatgcaga

SEQ ID NO: 147776 - DNA, 19 bp, Artificial sequence
  SiRNA target sequence
tgttccaaaatatgcagaa

SEQ ID NO: 147777 - DNA, 19 bp, Artificial sequence
  SiRNA target sequence
gttccaaaatatgcagaat

SEQ ID NO: 147778 - DNA, 19 bp, Artificial sequence
  SiRNA target sequence
ttccaaaatatgcagaatt

SEQ ID NO: 147779 - DNA, 19 bp, Artificial sequence
  SiRNA target sequence
tccaaaatatgcagaattt

SEQ ID NO: 147780 - DNA, 19 bp, Artificial sequence
  SiRNA target sequence
ccaaaatatgcagaatttg

SEQ ID NO: 147781 - DNA, 19 bp, Artificial sequence
  SiRNA target sequence
caaaatatgcagaatttgg

SEQ ID NO: 147782 - DNA, 19 bp, Artificial sequence
  SiRNA target sequence
aaaatatgcagaatttggt

SEQ ID NO: 147783 - DNA, 19 bp, Artificial sequence
  SiRNA target sequence
aaatatgcagaatttggtg

SEQ ID NO: 147784 - DNA, 19 bp, Artificial sequence
  SiRNA target sequence
aatatgcagaatttggtgt

SEQ ID NO: 147785 - DNA, 19 bp, Artificial sequence
  SiRNA target sequence
atatgcagaatttggtgtt

SEQ ID NO: 147786 - DNA, 19 bp, Artificial sequence
  SiRNA target sequence
tatgcagaatttggtgtta

SEQ ID NO: 147787 - DNA, 19 bp, Artificial sequence
  SiRNA target sequence
atgcagaatttggtgttat

SEQ ID NO: 147788 - DNA, 19 bp, Artificial sequence
  SiRNA target sequence
tgcagaatttggtgttatg

SEQ ID NO: 147789 - DNA, 19 bp, Artificial sequence
  SiRNA target sequence
gcagaatttggtgttatgc

SEQ ID NO: 147790 - DNA, 19 bp, Artificial sequence
  SiRNA target sequence
cagaatttggtgttatgcc

SEQ ID NO: 147791 - DNA, 19 bp, Artificial sequence
  SiRNA target sequence
agaatttggtgttatgcct

SEQ ID NO: 147792 - DNA, 19 bp, Artificial sequence
  SiRNA target sequence
gaatttggtgttatgccta

SEQ ID NO: 147793 - DNA, 19 bp, Artificial sequence
  SiRNA target sequence
aatttggtgttatgcctaa

SEQ ID NO: 147794 - DNA, 19 bp, Artificial sequence
  SiRNA target sequence
atttggtgttatgcctaaa

SEQ ID NO: 147795 - DNA, 19 bp, Artificial sequence
  SiRNA target sequence
tttggtgttatgcctaaag

SEQ ID NO: 147796 - DNA, 19 bp, Artificial sequence
  SiRNA target sequence
ttggtgttatgcctaaaga

SEQ ID NO: 147797 - DNA, 19 bp, Artificial sequence
  SiRNA target sequence
tggtgttatgcctaaagaa

SEQ ID NO: 147798 - DNA, 19 bp, Artificial sequence
  SiRNA target sequence
ggtgttatgcctaaagaac

SEQ ID NO: 147799 - DNA, 19 bp, Artificial sequence
  SiRNA target sequence
gtgttatgcctaaagaaca

SEQ ID NO: 147800 - DNA, 19 bp, Artificial sequence
  SiRNA target sequence
tgttatgcctaaagaacag

SEQ ID NO: 147801 - DNA, 19 bp, Artificial sequence
  SiRNA target sequence
gttatgcctaaagaacagg

SEQ ID NO: 147802 - DNA, 19 bp, Artificial sequence
  SiRNA target sequence
ttatgcctaaagaacagga

SEQ ID NO: 147803 - DNA, 19 bp, Artificial sequence
  SiRNA target sequence
tatgcctaaagaacaggaa

SEQ ID NO: 147804 - DNA, 19 bp, Artificial sequence
  SiRNA target sequence
atgcctaaagaacaggaag

SEQ ID NO: 147805 - DNA, 19 bp, Artificial sequence
  SiRNA target sequence
tgcctaaagaacaggaaga

SEQ ID NO: 147806 - DNA, 19 bp, Artificial sequence
  SiRNA target sequence
gcctaaagaacaggaagaa

SEQ ID NO: 147807 - DNA, 19 bp, Artificial sequence
  SiRNA target sequence
cctaaagaacaggaagaac

SEQ ID NO: 147808 - DNA, 19 bp, Artificial sequence
  SiRNA target sequence
ctaaagaacaggaagaaca

SEQ ID NO: 147809 - DNA, 19 bp, Artificial sequence
  SiRNA target sequence
taaagaacaggaagaacaa

SEQ ID NO: 147810 - DNA, 19 bp, Artificial sequence
  SiRNA target sequence
aaagaacaggaagaacaaa

SEQ ID NO: 147811 - DNA, 19 bp, Artificial sequence
  SiRNA target sequence
aagaacaggaagaacaaaa

SEQ ID NO: 147812 - DNA, 19 bp, Artificial sequence
  SiRNA target sequence
agaacaggaagaacaaaac

SEQ ID NO: 147813 - DNA, 19 bp, Artificial sequence
  SiRNA target sequence
gaacaggaagaacaaaacg

SEQ ID NO: 147814 - DNA, 19 bp, Artificial sequence
  SiRNA target sequence
aacaggaagaacaaaacga

SEQ ID NO: 147815 - DNA, 19 bp, Artificial sequence
  SiRNA target sequence
acaggaagaacaaaacgaa

SEQ ID NO: 147816 - DNA, 19 bp, Artificial sequence
  SiRNA target sequence
caggaagaacaaaacgaaa

SEQ ID NO: 147817 - DNA, 19 bp, Artificial sequence
  SiRNA target sequence
aggaagaacaaaacgaaag

SEQ ID NO: 147818 - DNA, 19 bp, Artificial sequence
  SiRNA target sequence
ggaagaacaaaacgaaaga

SEQ ID NO: 147819 - DNA, 19 bp, Artificial sequence
  SiRNA target sequence
gaagaacaaaacgaaagag

SEQ ID NO: 147820 - DNA, 19 bp, Artificial sequence
  SiRNA target sequence
aagaacaaaacgaaagaga

SEQ ID NO: 147821 - DNA, 19 bp, Artificial sequence
  SiRNA target sequence
agaacaaaacgaaagagaa

SEQ ID NO: 147822 - DNA, 19 bp, Artificial sequence
  SiRNA target sequence
gaacaaaacgaaagagaaa

SEQ ID NO: 147823 - DNA, 19 bp, Artificial sequence
  SiRNA target sequence
aacaaaacgaaagagaaag

SEQ ID NO: 147824 - DNA, 19 bp, Artificial sequence
  SiRNA target sequence
acaaaacgaaagagaaaga

SEQ ID NO: 147825 - DNA, 19 bp, Artificial sequence
  SiRNA target sequence
caaaacgaaagagaaagat

SEQ ID NO: 147826 - DNA, 19 bp, Artificial sequence
  SiRNA target sequence
aaaacgaaagagaaagatt

SEQ ID NO: 147827 - DNA, 19 bp, Artificial sequence
  SiRNA target sequence
aaacgaaagagaaagattc

SEQ ID NO: 147828 - DNA, 19 bp, Artificial sequence
  SiRNA target sequence
aacgaaagagaaagattcg

SEQ ID NO: 147829 - DNA, 19 bp, Artificial sequence
  SiRNA target sequence
acgaaagagaaagattcga

SEQ ID NO: 147830 - DNA, 19 bp, Artificial sequence
  SiRNA target sequence
cgaaagagaaagattcgaa

SEQ ID NO: 147831 - DNA, 19 bp, Artificial sequence
  SiRNA target sequence
gaaagagaaagattcgaag

SEQ ID NO: 147832 - DNA, 19 bp, Artificial sequence
  SiRNA target sequence
aaagagaaagattcgaagg

SEQ ID NO: 147833 - DNA, 19 bp, Artificial sequence
  SiRNA target sequence
aagagaaagattcgaaggt

SEQ ID NO: 147834 - DNA, 19 bp, Artificial sequence
  SiRNA target sequence
agagaaagattcgaaggtg

SEQ ID NO: 147835 - DNA, 19 bp, Artificial sequence
  SiRNA target sequence
gagaaagattcgaaggtgc

SEQ ID NO: 147836 - DNA, 19 bp, Artificial sequence
  SiRNA target sequence
agaaagattcgaaggtgca

SEQ ID NO: 147837 - DNA, 19 bp, Artificial sequence
  SiRNA target sequence
gaaagattcgaaggtgcag

SEQ ID NO: 147838 - DNA, 19 bp, Artificial sequence
  SiRNA target sequence
aaagattcgaaggtgcaga

SEQ ID NO: 147839 - DNA, 19 bp, Artificial sequence
  SiRNA target sequence
aagattcgaaggtgcagaa

SEQ ID NO: 147840 - DNA, 19 bp, Artificial sequence
  SiRNA target sequence
agattcgaaggtgcagaag

SEQ ID NO: 147841 - DNA, 19 bp, Artificial sequence
  SiRNA target sequence
gattcgaaggtgcagaaga

SEQ ID NO: 147842 - DNA, 19 bp, Artificial sequence
  SiRNA target sequence
attcgaaggtgcagaagag

SEQ ID NO: 147843 - DNA, 19 bp, Artificial sequence
  SiRNA target sequence
ttcgaaggtgcagaagagt

SEQ ID NO: 147844 - DNA, 19 bp, Artificial sequence
  SiRNA target sequence
tcgaaggtgcagaagagtt

SEQ ID NO: 147845 - DNA, 19 bp, Artificial sequence
  SiRNA target sequence
cgaaggtgcagaagagttt

SEQ ID NO: 147846 - DNA, 19 bp, Artificial sequence
  SiRNA target sequence
gaaggtgcagaagagtttt

SEQ ID NO: 147847 - DNA, 19 bp, Artificial sequence
  SiRNA target sequence
aaggtgcagaagagttttt

SEQ ID NO: 147848 - DNA, 19 bp, Artificial sequence
  SiRNA target sequence
aggtgcagaagagtttttt

SEQ ID NO: 147849 - DNA, 19 bp, Artificial sequence
  SiRNA target sequence
ggtgcagaagagttttttg

SEQ ID NO: 147850 - DNA, 19 bp, Artificial sequence
  SiRNA target sequence
gtgcagaagagttttttgg

SEQ ID NO: 147851 - DNA, 19 bp, Artificial sequence
  SiRNA target sequence
tgcagaagagttttttgga

SEQ ID NO: 147852 - DNA, 19 bp, Artificial sequence
  SiRNA target sequence
gcagaagagttttttggag

SEQ ID NO: 147853 - DNA, 19 bp, Artificial sequence
  SiRNA target sequence
cagaagagttttttggagg

SEQ ID NO: 147854 - DNA, 19 bp, Artificial sequence
  SiRNA target sequence
agaagagttttttggagga

SEQ ID NO: 147855 - DNA, 19 bp, Artificial sequence
  SiRNA target sequence
gaagagttttttggaggaa

SEQ ID NO: 147856 - DNA, 19 bp, Artificial sequence
  SiRNA target sequence
aagagttttttggaggaaa

SEQ ID NO: 147857 - DNA, 19 bp, Artificial sequence
  SiRNA target sequence
agagttttttggaggaaat

SEQ ID NO: 147858 - DNA, 19 bp, Artificial sequence
  SiRNA target sequence
gagttttttggaggaaatg

SEQ ID NO: 147859 - DNA, 19 bp, Artificial sequence
  SiRNA target sequence
agttttttggaggaaatgg

SEQ ID NO: 147860 - DNA, 19 bp, Artificial sequence
  SiRNA target sequence
gttttttggaggaaatggt

SEQ ID NO: 147861 - DNA, 19 bp, Artificial sequence
  SiRNA target sequence
ttttttggaggaaatggta

SEQ ID NO: 147862 - DNA, 19 bp, Artificial sequence
  SiRNA target sequence
tttttggaggaaatggtag

SEQ ID NO: 147863 - DNA, 19 bp, Artificial sequence
  SiRNA target sequence
ttttggaggaaatggtaga

SEQ ID NO: 147864 - DNA, 19 bp, Artificial sequence
  SiRNA target sequence
tttggaggaaatggtagag

SEQ ID NO: 147865 - DNA, 19 bp, Artificial sequence
  SiRNA target sequence
ttggaggaaatggtagaga

SEQ ID NO: 147866 - DNA, 19 bp, Artificial sequence
  SiRNA target sequence
tggaggaaatggtagagat

SEQ ID NO: 147867 - DNA, 19 bp, Artificial sequence
  SiRNA target sequence
ggaggaaatggtagagatt

SEQ ID NO: 147868 - DNA, 19 bp, Artificial sequence
  SiRNA target sequence
gaggaaatggtagagattt

SEQ ID NO: 147869 - DNA, 19 bp, Artificial sequence
  SiRNA target sequence
aggaaatggtagagatttt

SEQ ID NO: 147870 - DNA, 19 bp, Artificial sequence
  SiRNA target sequence
ggaaatggtagagattttt

SEQ ID NO: 147871 - DNA, 19 bp, Artificial sequence
  SiRNA target sequence
gaaatggtagagatttttt

SEQ ID NO: 147872 - DNA, 19 bp, Artificial sequence
  SiRNA target sequence
aaatggtagagattttttt

SEQ ID NO: 147873 - DNA, 19 bp, Artificial sequence
  SiRNA target sequence
aatggtagagattttttta

SEQ ID NO: 147874 - DNA, 19 bp, Artificial sequence
  SiRNA target sequence
atggtagagatttttttag

SEQ ID NO: 147875 - DNA, 19 bp, Artificial sequence
  SiRNA target sequence
tggtagagatttttttagc

SEQ ID NO: 147876 - DNA, 19 bp, Artificial sequence
  SiRNA target sequence
ggtagagatttttttagca

SEQ ID NO: 147877 - DNA, 19 bp, Artificial sequence
  SiRNA target sequence
gtagagatttttttagcaa

SEQ ID NO: 147878 - DNA, 19 bp, Artificial sequence
  SiRNA target sequence
tagagatttttttagcaag

SEQ ID NO: 147879 - DNA, 19 bp, Artificial sequence
  SiRNA target sequence
agagatttttttagcaagt

SEQ ID NO: 147880 - DNA, 19 bp, Artificial sequence
  SiRNA target sequence
gagatttttttagcaagtt

SEQ ID NO: 147881 - DNA, 19 bp, Artificial sequence
  SiRNA target sequence
agatttttttagcaagttt

SEQ ID NO: 147882 - DNA, 19 bp, Artificial sequence
  SiRNA target sequence
gatttttttagcaagtttg

SEQ ID NO: 147883 - DNA, 19 bp, Artificial sequence
  SiRNA target sequence
atttttttagcaagtttgg

SEQ ID NO: 147884 - DNA, 19 bp, Artificial sequence
  SiRNA target sequence
tttttttagcaagtttgga

SEQ ID NO: 147885 - DNA, 19 bp, Artificial sequence
  SiRNA target sequence
ttttttagcaagtttggat

SEQ ID NO: 147886 - DNA, 19 bp, Artificial sequence
  SiRNA target sequence
tttttagcaagtttggatt

SEQ ID NO: 147887 - DNA, 19 bp, Artificial sequence
  SiRNA target sequence
ttttagcaagtttggattt

SEQ ID NO: 147888 - DNA, 19 bp, Artificial sequence
  SiRNA target sequence
tttagcaagtttggatttt

SEQ ID NO: 147889 - DNA, 19 bp, Artificial sequence
  SiRNA target sequence
ttagcaagtttggattttt

SEQ ID NO: 147890 - DNA, 19 bp, Artificial sequence
  SiRNA target sequence
tagcaagtttggatttttc

SEQ ID NO: 147891 - DNA, 19 bp, Artificial sequence
  SiRNA target sequence
agcaagtttggatttttct

SEQ ID NO: 147892 - DNA, 19 bp, Artificial sequence
  SiRNA target sequence
gcaagtttggatttttcta

SEQ ID NO: 147893 - DNA, 19 bp, Artificial sequence
  SiRNA target sequence
caagtttggatttttctaa

SEQ ID NO: 147894 - DNA, 20 bp, Artificial sequence
  SiRNA target sequence
atggcacaagacccccaagg

SEQ ID NO: 147895 - DNA, 20 bp, Artificial sequence
  SiRNA target sequence
tggcacaagacccccaagga

SEQ ID NO: 147896 - DNA, 20 bp, Artificial sequence
  SiRNA target sequence
ggcacaagacccccaaggac

SEQ ID NO: 147897 - DNA, 20 bp, Artificial sequence
  SiRNA target sequence
gcacaagacccccaaggact

SEQ ID NO: 147898 - DNA, 20 bp, Artificial sequence
  SiRNA target sequence
cacaagacccccaaggactt

SEQ ID NO: 147899 - DNA, 20 bp, Artificial sequence
  SiRNA target sequence
acaagacccccaaggacttt

SEQ ID NO: 147900 - DNA, 20 bp, Artificial sequence
  SiRNA target sequence
caagacccccaaggacttta

SEQ ID NO: 147901 - DNA, 20 bp, Artificial sequence
  SiRNA target sequence
aagacccccaaggactttat

SEQ ID NO: 147902 - DNA, 20 bp, Artificial sequence
  SiRNA target sequence
agacccccaaggactttatg

SEQ ID NO: 147903 - DNA, 20 bp, Artificial sequence
  SiRNA target sequence
gacccccaaggactttatga

SEQ ID NO: 147904 - DNA, 20 bp, Artificial sequence
  SiRNA target sequence
acccccaaggactttatgaa

SEQ ID NO: 147905 - DNA, 20 bp, Artificial sequence
  SiRNA target sequence
cccccaaggactttatgaag

SEQ ID NO: 147906 - DNA, 20 bp, Artificial sequence
  SiRNA target sequence
ccccaaggactttatgaagt

SEQ ID NO: 147907 - DNA, 20 bp, Artificial sequence
  SiRNA target sequence
cccaaggactttatgaagta

SEQ ID NO: 147908 - DNA, 20 bp, Artificial sequence
  SiRNA target sequence
ccaaggactttatgaagtat

SEQ ID NO: 147909 - DNA, 20 bp, Artificial sequence
  SiRNA target sequence
caaggactttatgaagtatt

SEQ ID NO: 147910 - DNA, 20 bp, Artificial sequence
  SiRNA target sequence
aaggactttatgaagtatta

SEQ ID NO: 147911 - DNA, 20 bp, Artificial sequence
  SiRNA target sequence
aggactttatgaagtattag

SEQ ID NO: 147912 - DNA, 20 bp, Artificial sequence
  SiRNA target sequence
ggactttatgaagtattagg

SEQ ID NO: 147913 - DNA, 20 bp, Artificial sequence
  SiRNA target sequence
gactttatgaagtattagga

SEQ ID NO: 147914 - DNA, 20 bp, Artificial sequence
  SiRNA target sequence
actttatgaagtattaggac

SEQ ID NO: 147915 - DNA, 20 bp, Artificial sequence
  SiRNA target sequence
ctttatgaagtattaggact

SEQ ID NO: 147916 - DNA, 20 bp, Artificial sequence
  SiRNA target sequence
tttatgaagtattaggactt

SEQ ID NO: 147917 - DNA, 20 bp, Artificial sequence
  SiRNA target sequence
ttatgaagtattaggactta

SEQ ID NO: 147918 - DNA, 20 bp, Artificial sequence
  SiRNA target sequence
tatgaagtattaggacttaa

SEQ ID NO: 147919 - DNA, 20 bp, Artificial sequence
  SiRNA target sequence
atgaagtattaggacttaaa

SEQ ID NO: 147920 - DNA, 20 bp, Artificial sequence
  SiRNA target sequence
tgaagtattaggacttaaag

SEQ ID NO: 147921 - DNA, 20 bp, Artificial sequence
  SiRNA target sequence
gaagtattaggacttaaagc

SEQ ID NO: 147922 - DNA, 20 bp, Artificial sequence
  SiRNA target sequence
aagtattaggacttaaagct

SEQ ID NO: 147923 - DNA, 20 bp, Artificial sequence
  SiRNA target sequence
agtattaggacttaaagctg

SEQ ID NO: 147924 - DNA, 20 bp, Artificial sequence
  SiRNA target sequence
gtattaggacttaaagctgg

SEQ ID NO: 147925 - DNA, 20 bp, Artificial sequence
  SiRNA target sequence
tattaggacttaaagctggt

SEQ ID NO: 147926 - DNA, 20 bp, Artificial sequence
  SiRNA target sequence
attaggacttaaagctggtg

SEQ ID NO: 147927 - DNA, 20 bp, Artificial sequence
  SiRNA target sequence
ttaggacttaaagctggtgc

SEQ ID NO: 147928 - DNA, 20 bp, Artificial sequence
  SiRNA target sequence
taggacttaaagctggtgca

SEQ ID NO: 147929 - DNA, 20 bp, Artificial sequence
  SiRNA target sequence
aggacttaaagctggtgcaa

SEQ ID NO: 147930 - DNA, 20 bp, Artificial sequence
  SiRNA target sequence
ggacttaaagctggtgcaag

SEQ ID NO: 147931 - DNA, 20 bp, Artificial sequence
  SiRNA target sequence
gacttaaagctggtgcaagc

SEQ ID NO: 147932 - DNA, 20 bp, Artificial sequence
  SiRNA target sequence
acttaaagctggtgcaagca

SEQ ID NO: 147933 - DNA, 20 bp, Artificial sequence
  SiRNA target sequence
cttaaagctggtgcaagcat

SEQ ID NO: 147934 - DNA, 20 bp, Artificial sequence
  SiRNA target sequence
ttaaagctggtgcaagcatt

SEQ ID NO: 147935 - DNA, 20 bp, Artificial sequence
  SiRNA target sequence
taaagctggtgcaagcattg

SEQ ID NO: 147936 - DNA, 20 bp, Artificial sequence
  SiRNA target sequence
aaagctggtgcaagcattga

SEQ ID NO: 147937 - DNA, 20 bp, Artificial sequence
  SiRNA target sequence
aagctggtgcaagcattgat

SEQ ID NO: 147938 - DNA, 20 bp, Artificial sequence
  SiRNA target sequence
agctggtgcaagcattgatg

SEQ ID NO: 147939 - DNA, 20 bp, Artificial sequence
  SiRNA target sequence
gctggtgcaagcattgatga

SEQ ID NO: 147940 - DNA, 20 bp, Artificial sequence
  SiRNA target sequence
ctggtgcaagcattgatgaa

SEQ ID NO: 147941 - DNA, 20 bp, Artificial sequence
  SiRNA target sequence
tggtgcaagcattgatgaag

SEQ ID NO: 147942 - DNA, 20 bp, Artificial sequence
  SiRNA target sequence
ggtgcaagcattgatgaagt

SEQ ID NO: 147943 - DNA, 20 bp, Artificial sequence
  SiRNA target sequence
gtgcaagcattgatgaagtt

SEQ ID NO: 147944 - DNA, 20 bp, Artificial sequence
  SiRNA target sequence
tgcaagcattgatgaagtta

SEQ ID NO: 147945 - DNA, 20 bp, Artificial sequence
  SiRNA target sequence
gcaagcattgatgaagttaa

SEQ ID NO: 147946 - DNA, 20 bp, Artificial sequence
  SiRNA target sequence
caagcattgatgaagttaaa

SEQ ID NO: 147947 - DNA, 20 bp, Artificial sequence
  SiRNA target sequence
aagcattgatgaagttaaaa

SEQ ID NO: 147948 - DNA, 20 bp, Artificial sequence
  SiRNA target sequence
agcattgatgaagttaaaaa

SEQ ID NO: 147949 - DNA, 20 bp, Artificial sequence
  SiRNA target sequence
gcattgatgaagttaaaaaa

SEQ ID NO: 147950 - DNA, 20 bp, Artificial sequence
  SiRNA target sequence
cattgatgaagttaaaaaag

SEQ ID NO: 147951 - DNA, 20 bp, Artificial sequence
  SiRNA target sequence
attgatgaagttaaaaaagc

SEQ ID NO: 147952 - DNA, 20 bp, Artificial sequence
  SiRNA target sequence
ttgatgaagttaaaaaagca

SEQ ID NO: 147953 - DNA, 20 bp, Artificial sequence
  SiRNA target sequence
tgatgaagttaaaaaagcat

SEQ ID NO: 147954 - DNA, 20 bp, Artificial sequence
  SiRNA target sequence
gatgaagttaaaaaagcatt

SEQ ID NO: 147955 - DNA, 20 bp, Artificial sequence
  SiRNA target sequence
atgaagttaaaaaagcattt

SEQ ID NO: 147956 - DNA, 20 bp, Artificial sequence
  SiRNA target sequence
tgaagttaaaaaagcattta

SEQ ID NO: 147957 - DNA, 20 bp, Artificial sequence
  SiRNA target sequence
gaagttaaaaaagcatttac

SEQ ID NO: 147958 - DNA, 20 bp, Artificial sequence
  SiRNA target sequence
aagttaaaaaagcatttaca

SEQ ID NO: 147959 - DNA, 20 bp, Artificial sequence
  SiRNA target sequence
agttaaaaaagcatttacaa

SEQ ID NO: 147960 - DNA, 20 bp, Artificial sequence
  SiRNA target sequence
gttaaaaaagcatttacaaa

SEQ ID NO: 147961 - DNA, 20 bp, Artificial sequence
  SiRNA target sequence
ttaaaaaagcatttacaaaa

SEQ ID NO: 147962 - DNA, 20 bp, Artificial sequence
  SiRNA target sequence
taaaaaagcatttacaaaaa

SEQ ID NO: 147963 - DNA, 20 bp, Artificial sequence
  SiRNA target sequence
aaaaaagcatttacaaaaaa

SEQ ID NO: 147964 - DNA, 20 bp, Artificial sequence
  SiRNA target sequence
aaaaagcatttacaaaaaaa

SEQ ID NO: 147965 - DNA, 20 bp, Artificial sequence
  SiRNA target sequence
aaaagcatttacaaaaaaac

SEQ ID NO: 147966 - DNA, 20 bp, Artificial sequence
  SiRNA target sequence
aaagcatttacaaaaaaaca

SEQ ID NO: 147967 - DNA, 20 bp, Artificial sequence
  SiRNA target sequence
aagcatttacaaaaaaacaa

SEQ ID NO: 147968 - DNA, 20 bp, Artificial sequence
  SiRNA target sequence
agcatttacaaaaaaacaaa

SEQ ID NO: 147969 - DNA, 20 bp, Artificial sequence
  SiRNA target sequence
gcatttacaaaaaaacaaag

SEQ ID NO: 147970 - DNA, 20 bp, Artificial sequence
  SiRNA target sequence
catttacaaaaaaacaaagg

SEQ ID NO: 147971 - DNA, 20 bp, Artificial sequence
  SiRNA target sequence
atttacaaaaaaacaaaggg

SEQ ID NO: 147972 - DNA, 20 bp, Artificial sequence
  SiRNA target sequence
tttacaaaaaaacaaaggga

SEQ ID NO: 147973 - DNA, 20 bp, Artificial sequence
  SiRNA target sequence
ttacaaaaaaacaaagggaa

SEQ ID NO: 147974 - DNA, 20 bp, Artificial sequence
  SiRNA target sequence
tacaaaaaaacaaagggaat

SEQ ID NO: 147975 - DNA, 20 bp, Artificial sequence
  SiRNA target sequence
acaaaaaaacaaagggaatg

SEQ ID NO: 147976 - DNA, 20 bp, Artificial sequence
  SiRNA target sequence
caaaaaaacaaagggaatgt

SEQ ID NO: 147977 - DNA, 20 bp, Artificial sequence
  SiRNA target sequence
aaaaaaacaaagggaatgtc

SEQ ID NO: 147978 - DNA, 20 bp, Artificial sequence
  SiRNA target sequence
aaaaaacaaagggaatgtca

SEQ ID NO: 147979 - DNA, 20 bp, Artificial sequence
  SiRNA target sequence
aaaaacaaagggaatgtcat

SEQ ID NO: 147980 - DNA, 20 bp, Artificial sequence
  SiRNA target sequence
aaaacaaagggaatgtcatc

SEQ ID NO: 147981 - DNA, 20 bp, Artificial sequence
  SiRNA target sequence
aaacaaagggaatgtcatcc

SEQ ID NO: 147982 - DNA, 20 bp, Artificial sequence
  SiRNA target sequence
aacaaagggaatgtcatccc

SEQ ID NO: 147983 - DNA, 20 bp, Artificial sequence
  SiRNA target sequence
acaaagggaatgtcatcccg

SEQ ID NO: 147984 - DNA, 20 bp, Artificial sequence
  SiRNA target sequence
caaagggaatgtcatcccga

SEQ ID NO: 147985 - DNA, 20 bp, Artificial sequence
  SiRNA target sequence
aaagggaatgtcatcccgat

SEQ ID NO: 147986 - DNA, 20 bp, Artificial sequence
  SiRNA target sequence
aagggaatgtcatcccgatg

SEQ ID NO: 147987 - DNA, 20 bp, Artificial sequence
  SiRNA target sequence
agggaatgtcatcccgatgg

SEQ ID NO: 147988 - DNA, 20 bp, Artificial sequence
  SiRNA target sequence
gggaatgtcatcccgatggt

SEQ ID NO: 147989 - DNA, 20 bp, Artificial sequence
  SiRNA target sequence
ggaatgtcatcccgatggtg

SEQ ID NO: 147990 - DNA, 20 bp, Artificial sequence
  SiRNA target sequence
gaatgtcatcccgatggtgc

SEQ ID NO: 147991 - DNA, 20 bp, Artificial sequence
  SiRNA target sequence
aatgtcatcccgatggtgca

SEQ ID NO: 147992 - DNA, 20 bp, Artificial sequence
  SiRNA target sequence
atgtcatcccgatggtgcat

SEQ ID NO: 147993 - DNA, 20 bp, Artificial sequence
  SiRNA target sequence
tgtcatcccgatggtgcatt

SEQ ID NO: 147994 - DNA, 20 bp, Artificial sequence
  SiRNA target sequence
gtcatcccgatggtgcattt

SEQ ID NO: 147995 - DNA, 20 bp, Artificial sequence
  SiRNA target sequence
tcatcccgatggtgcatttt

SEQ ID NO: 147996 - DNA, 20 bp, Artificial sequence
  SiRNA target sequence
catcccgatggtgcattttt

SEQ ID NO: 147997 - DNA, 20 bp, Artificial sequence
  SiRNA target sequence
atcccgatggtgcatttttt

SEQ ID NO: 147998 - DNA, 20 bp, Artificial sequence
  SiRNA target sequence
tcccgatggtgcatttttta

SEQ ID NO: 147999 - DNA, 20 bp, Artificial sequence
  SiRNA target sequence
cccgatggtgcattttttaa

SEQ ID NO: 148000 - DNA, 20 bp, Artificial sequence
  SiRNA target sequence
ccgatggtgcattttttaaa

SEQ ID NO: 148001 - DNA, 20 bp, Artificial sequence
  SiRNA target sequence
cgatggtgcattttttaaag

SEQ ID NO: 148002 - DNA, 20 bp, Artificial sequence
  SiRNA target sequence
gatggtgcattttttaaagc

SEQ ID NO: 148003 - DNA, 20 bp, Artificial sequence
  SiRNA target sequence
atggtgcattttttaaagct

SEQ ID NO: 148004 - DNA, 20 bp, Artificial sequence
  SiRNA target sequence
tggtgcattttttaaagctg

SEQ ID NO: 148005 - DNA, 20 bp, Artificial sequence
  SiRNA target sequence
ggtgcattttttaaagctgc

SEQ ID NO: 148006 - DNA, 20 bp, Artificial sequence
  SiRNA target sequence
gtgcattttttaaagctgct

SEQ ID NO: 148007 - DNA, 20 bp, Artificial sequence
  SiRNA target sequence
tgcattttttaaagctgctc

SEQ ID NO: 148008 - DNA, 20 bp, Artificial sequence
  SiRNA target sequence
gcattttttaaagctgctct

SEQ ID NO: 148009 - DNA, 20 bp, Artificial sequence
  SiRNA target sequence
cattttttaaagctgctctt

SEQ ID NO: 148010 - DNA, 20 bp, Artificial sequence
  SiRNA target sequence
attttttaaagctgctctta

SEQ ID NO: 148011 - DNA, 20 bp, Artificial sequence
  SiRNA target sequence
ttttttaaagctgctcttag

SEQ ID NO: 148012 - DNA, 20 bp, Artificial sequence
  SiRNA target sequence
tttttaaagctgctcttaga

SEQ ID NO: 148013 - DNA, 20 bp, Artificial sequence
  SiRNA target sequence
ttttaaagctgctcttagaa

SEQ ID NO: 148014 - DNA, 20 bp, Artificial sequence
  SiRNA target sequence
tttaaagctgctcttagaaa

SEQ ID NO: 148015 - DNA, 20 bp, Artificial sequence
  SiRNA target sequence
ttaaagctgctcttagaaaa

SEQ ID NO: 148016 - DNA, 20 bp, Artificial sequence
  SiRNA target sequence
taaagctgctcttagaaaat

SEQ ID NO: 148017 - DNA, 20 bp, Artificial sequence
  SiRNA target sequence
aaagctgctcttagaaaatg

SEQ ID NO: 148018 - DNA, 20 bp, Artificial sequence
  SiRNA target sequence
aagctgctcttagaaaatgt

SEQ ID NO: 148019 - DNA, 20 bp, Artificial sequence
  SiRNA target sequence
agctgctcttagaaaatgta

SEQ ID NO: 148020 - DNA, 20 bp, Artificial sequence
  SiRNA target sequence
gctgctcttagaaaatgtaa

SEQ ID NO: 148021 - DNA, 20 bp, Artificial sequence
  SiRNA target sequence
ctgctcttagaaaatgtaaa

SEQ ID NO: 148022 - DNA, 20 bp, Artificial sequence
  SiRNA target sequence
tgctcttagaaaatgtaaaa

SEQ ID NO: 148023 - DNA, 20 bp, Artificial sequence
  SiRNA target sequence
gctcttagaaaatgtaaaac

SEQ ID NO: 148024 - DNA, 20 bp, Artificial sequence
  SiRNA target sequence
ctcttagaaaatgtaaaaca

SEQ ID NO: 148025 - DNA, 20 bp, Artificial sequence
  SiRNA target sequence
tcttagaaaatgtaaaacag

SEQ ID NO: 148026 - DNA, 20 bp, Artificial sequence
  SiRNA target sequence
cttagaaaatgtaaaacaga

SEQ ID NO: 148027 - DNA, 20 bp, Artificial sequence
  SiRNA target sequence
ttagaaaatgtaaaacagat

SEQ ID NO: 148028 - DNA, 20 bp, Artificial sequence
  SiRNA target sequence
tagaaaatgtaaaacagatg

SEQ ID NO: 148029 - DNA, 20 bp, Artificial sequence
  SiRNA target sequence
agaaaatgtaaaacagatga

SEQ ID NO: 148030 - DNA, 20 bp, Artificial sequence
  SiRNA target sequence
gaaaatgtaaaacagatgaa

SEQ ID NO: 148031 - DNA, 20 bp, Artificial sequence
  SiRNA target sequence
aaaatgtaaaacagatgaag

SEQ ID NO: 148032 - DNA, 20 bp, Artificial sequence
  SiRNA target sequence
aaatgtaaaacagatgaaga

SEQ ID NO: 148033 - DNA, 20 bp, Artificial sequence
  SiRNA target sequence
aatgtaaaacagatgaagaa

SEQ ID NO: 148034 - DNA, 20 bp, Artificial sequence
  SiRNA target sequence
atgtaaaacagatgaagaaa

SEQ ID NO: 148035 - DNA, 20 bp, Artificial sequence
  SiRNA target sequence
tgtaaaacagatgaagaaag

SEQ ID NO: 148036 - DNA, 20 bp, Artificial sequence
  SiRNA target sequence
gtaaaacagatgaagaaaga

SEQ ID NO: 148037 - DNA, 20 bp, Artificial sequence
  SiRNA target sequence
taaaacagatgaagaaagag

SEQ ID NO: 148038 - DNA, 20 bp, Artificial sequence
  SiRNA target sequence
aaaacagatgaagaaagagc

SEQ ID NO: 148039 - DNA, 20 bp, Artificial sequence
  SiRNA target sequence
aaacagatgaagaaagagca

SEQ ID NO: 148040 - DNA, 20 bp, Artificial sequence
  SiRNA target sequence
aacagatgaagaaagagcaa

SEQ ID NO: 148041 - DNA, 20 bp, Artificial sequence
  SiRNA target sequence
acagatgaagaaagagcaaa

SEQ ID NO: 148042 - DNA, 20 bp, Artificial sequence
  SiRNA target sequence
cagatgaagaaagagcaaaa

SEQ ID NO: 148043 - DNA, 20 bp, Artificial sequence
  SiRNA target sequence
agatgaagaaagagcaaaag

SEQ ID NO: 148044 - DNA, 20 bp, Artificial sequence
  SiRNA target sequence
gatgaagaaagagcaaaagt

SEQ ID NO: 148045 - DNA, 20 bp, Artificial sequence
  SiRNA target sequence
atgaagaaagagcaaaagtt

SEQ ID NO: 148046 - DNA, 20 bp, Artificial sequence
  SiRNA target sequence
tgaagaaagagcaaaagttg

SEQ ID NO: 148047 - DNA, 20 bp, Artificial sequence
  SiRNA target sequence
gaagaaagagcaaaagttga

SEQ ID NO: 148048 - DNA, 20 bp, Artificial sequence
  SiRNA target sequence
aagaaagagcaaaagttgaa

SEQ ID NO: 148049 - DNA, 20 bp, Artificial sequence
  SiRNA target sequence
agaaagagcaaaagttgaaa

SEQ ID NO: 148050 - DNA, 20 bp, Artificial sequence
  SiRNA target sequence
gaaagagcaaaagttgaaaa

SEQ ID NO: 148051 - DNA, 20 bp, Artificial sequence
  SiRNA target sequence
aaagagcaaaagttgaaaaa

SEQ ID NO: 148052 - DNA, 20 bp, Artificial sequence
  SiRNA target sequence
aagagcaaaagttgaaaaag

SEQ ID NO: 148053 - DNA, 20 bp, Artificial sequence
  SiRNA target sequence
agagcaaaagttgaaaaaga

SEQ ID NO: 148054 - DNA, 20 bp, Artificial sequence
  SiRNA target sequence
gagcaaaagttgaaaaagaa

SEQ ID NO: 148055 - DNA, 20 bp, Artificial sequence
  SiRNA target sequence
agcaaaagttgaaaaagaat

SEQ ID NO: 148056 - DNA, 20 bp, Artificial sequence
  SiRNA target sequence
gcaaaagttgaaaaagaatt

SEQ ID NO: 148057 - DNA, 20 bp, Artificial sequence
  SiRNA target sequence
caaaagttgaaaaagaattt

SEQ ID NO: 148058 - DNA, 20 bp, Artificial sequence
  SiRNA target sequence
aaaagttgaaaaagaattta

SEQ ID NO: 148059 - DNA, 20 bp, Artificial sequence
  SiRNA target sequence
aaagttgaaaaagaatttaa

SEQ ID NO: 148060 - DNA, 20 bp, Artificial sequence
  SiRNA target sequence
aagttgaaaaagaatttaaa

SEQ ID NO: 148061 - DNA, 20 bp, Artificial sequence
  SiRNA target sequence
agttgaaaaagaatttaaag

SEQ ID NO: 148062 - DNA, 20 bp, Artificial sequence
  SiRNA target sequence
gttgaaaaagaatttaaaga

SEQ ID NO: 148063 - DNA, 20 bp, Artificial sequence
  SiRNA target sequence
ttgaaaaagaatttaaagaa

SEQ ID NO: 148064 - DNA, 20 bp, Artificial sequence
  SiRNA target sequence
tgaaaaagaatttaaagaaa

SEQ ID NO: 148065 - DNA, 20 bp, Artificial sequence
  SiRNA target sequence
gaaaaagaatttaaagaaaa

SEQ ID NO: 148066 - DNA, 20 bp, Artificial sequence
  SiRNA target sequence
aaaaagaatttaaagaaaaa

SEQ ID NO: 148067 - DNA, 20 bp, Artificial sequence
  SiRNA target sequence
aaaagaatttaaagaaaaat

SEQ ID NO: 148068 - DNA, 20 bp, Artificial sequence
  SiRNA target sequence
aaagaatttaaagaaaaatc

SEQ ID NO: 148069 - DNA, 20 bp, Artificial sequence
  SiRNA target sequence
aagaatttaaagaaaaatca

SEQ ID NO: 148070 - DNA, 20 bp, Artificial sequence
  SiRNA target sequence
agaatttaaagaaaaatcac

SEQ ID NO: 148071 - DNA, 20 bp, Artificial sequence
  SiRNA target sequence
gaatttaaagaaaaatcaca

SEQ ID NO: 148072 - DNA, 20 bp, Artificial sequence
  SiRNA target sequence
aatttaaagaaaaatcacaa

SEQ ID NO: 148073 - DNA, 20 bp, Artificial sequence
  SiRNA target sequence
atttaaagaaaaatcacaaa

SEQ ID NO: 148074 - DNA, 20 bp, Artificial sequence
  SiRNA target sequence
tttaaagaaaaatcacaaaa

SEQ ID NO: 148075 - DNA, 20 bp, Artificial sequence
  SiRNA target sequence
ttaaagaaaaatcacaaaaa

SEQ ID NO: 148076 - DNA, 20 bp, Artificial sequence
  SiRNA target sequence
taaagaaaaatcacaaaaat

SEQ ID NO: 148077 - DNA, 20 bp, Artificial sequence
  SiRNA target sequence
aaagaaaaatcacaaaaatg

SEQ ID NO: 148078 - DNA, 20 bp, Artificial sequence
  SiRNA target sequence
aagaaaaatcacaaaaatgt

SEQ ID NO: 148079 - DNA, 20 bp, Artificial sequence
  SiRNA target sequence
agaaaaatcacaaaaatgta

SEQ ID NO: 148080 - DNA, 20 bp, Artificial sequence
  SiRNA target sequence
gaaaaatcacaaaaatgtaa

SEQ ID NO: 148081 - DNA, 20 bp, Artificial sequence
  SiRNA target sequence
aaaaatcacaaaaatgtaat

SEQ ID NO: 148082 - DNA, 20 bp, Artificial sequence
  SiRNA target sequence
aaaatcacaaaaatgtaatc

SEQ ID NO: 148083 - DNA, 20 bp, Artificial sequence
  SiRNA target sequence
aaatcacaaaaatgtaatca

SEQ ID NO: 148084 - DNA, 20 bp, Artificial sequence
  SiRNA target sequence
aatcacaaaaatgtaatcaa

SEQ ID NO: 148085 - DNA, 20 bp, Artificial sequence
  SiRNA target sequence
atcacaaaaatgtaatcaag

SEQ ID NO: 148086 - DNA, 20 bp, Artificial sequence
  SiRNA target sequence
tcacaaaaatgtaatcaagc

SEQ ID NO: 148087 - DNA, 20 bp, Artificial sequence
  SiRNA target sequence
cacaaaaatgtaatcaagct

SEQ ID NO: 148088 - DNA, 20 bp, Artificial sequence
  SiRNA target sequence
acaaaaatgtaatcaagcta

SEQ ID NO: 148089 - DNA, 20 bp, Artificial sequence
  SiRNA target sequence
caaaaatgtaatcaagctaa

SEQ ID NO: 148090 - DNA, 20 bp, Artificial sequence
  SiRNA target sequence
aaaaatgtaatcaagctaaa

SEQ ID NO: 148091 - DNA, 20 bp, Artificial sequence
  SiRNA target sequence
aaaatgtaatcaagctaaag

SEQ ID NO: 148092 - DNA, 20 bp, Artificial sequence
  SiRNA target sequence
aaatgtaatcaagctaaagc

SEQ ID NO: 148093 - DNA, 20 bp, Artificial sequence
  SiRNA target sequence
aatgtaatcaagctaaagca

SEQ ID NO: 148094 - DNA, 20 bp, Artificial sequence
  SiRNA target sequence
atgtaatcaagctaaagcag

SEQ ID NO: 148095 - DNA, 20 bp, Artificial sequence
  SiRNA target sequence
tgtaatcaagctaaagcagt

SEQ ID NO: 148096 - DNA, 20 bp, Artificial sequence
  SiRNA target sequence
gtaatcaagctaaagcagtt

SEQ ID NO: 148097 - DNA, 20 bp, Artificial sequence
  SiRNA target sequence
taatcaagctaaagcagttt

SEQ ID NO: 148098 - DNA, 20 bp, Artificial sequence
  SiRNA target sequence
aatcaagctaaagcagtttt

SEQ ID NO: 148099 - DNA, 20 bp, Artificial sequence
  SiRNA target sequence
atcaagctaaagcagtttta

SEQ ID NO: 148100 - DNA, 20 bp, Artificial sequence
  SiRNA target sequence
tcaagctaaagcagttttat

SEQ ID NO: 148101 - DNA, 20 bp, Artificial sequence
  SiRNA target sequence
caagctaaagcagttttatt

SEQ ID NO: 148102 - DNA, 20 bp, Artificial sequence
  SiRNA target sequence
aagctaaagcagttttattt

SEQ ID NO: 148103 - DNA, 20 bp, Artificial sequence
  SiRNA target sequence
agctaaagcagttttatttg

SEQ ID NO: 148104 - DNA, 20 bp, Artificial sequence
  SiRNA target sequence
gctaaagcagttttatttga

SEQ ID NO: 148105 - DNA, 20 bp, Artificial sequence
  SiRNA target sequence
ctaaagcagttttatttgat

SEQ ID NO: 148106 - DNA, 20 bp, Artificial sequence
  SiRNA target sequence
taaagcagttttatttgatg

SEQ ID NO: 148107 - DNA, 20 bp, Artificial sequence
  SiRNA target sequence
aaagcagttttatttgatga

SEQ ID NO: 148108 - DNA, 20 bp, Artificial sequence
  SiRNA target sequence
aagcagttttatttgatgag

SEQ ID NO: 148109 - DNA, 20 bp, Artificial sequence
  SiRNA target sequence
agcagttttatttgatgaga

SEQ ID NO: 148110 - DNA, 20 bp, Artificial sequence
  SiRNA target sequence
gcagttttatttgatgagaa

SEQ ID NO: 148111 - DNA, 20 bp, Artificial sequence
  SiRNA target sequence
cagttttatttgatgagaaa

SEQ ID NO: 148112 - DNA, 20 bp, Artificial sequence
  SiRNA target sequence
agttttatttgatgagaaaa

SEQ ID NO: 148113 - DNA, 20 bp, Artificial sequence
  SiRNA target sequence
gttttatttgatgagaaaaa

SEQ ID NO: 148114 - DNA, 20 bp, Artificial sequence
  SiRNA target sequence
ttttatttgatgagaaaaaa

SEQ ID NO: 148115 - DNA, 20 bp, Artificial sequence
  SiRNA target sequence
tttatttgatgagaaaaaaa

SEQ ID NO: 148116 - DNA, 20 bp, Artificial sequence
  SiRNA target sequence
ttatttgatgagaaaaaaaa

SEQ ID NO: 148117 - DNA, 20 bp, Artificial sequence
  SiRNA target sequence
tatttgatgagaaaaaaaag

SEQ ID NO: 148118 - DNA, 20 bp, Artificial sequence
  SiRNA target sequence
atttgatgagaaaaaaaagc

SEQ ID NO: 148119 - DNA, 20 bp, Artificial sequence
  SiRNA target sequence
tttgatgagaaaaaaaagca

SEQ ID NO: 148120 - DNA, 20 bp, Artificial sequence
  SiRNA target sequence
ttgatgagaaaaaaaagcaa

SEQ ID NO: 148121 - DNA, 20 bp, Artificial sequence
  SiRNA target sequence
tgatgagaaaaaaaagcaag

SEQ ID NO: 148122 - DNA, 20 bp, Artificial sequence
  SiRNA target sequence
gatgagaaaaaaaagcaaga

SEQ ID NO: 148123 - DNA, 20 bp, Artificial sequence
  SiRNA target sequence
atgagaaaaaaaagcaagag

SEQ ID NO: 148124 - DNA, 20 bp, Artificial sequence
  SiRNA target sequence
tgagaaaaaaaagcaagagt

SEQ ID NO: 148125 - DNA, 20 bp, Artificial sequence
  SiRNA target sequence
gagaaaaaaaagcaagagta

SEQ ID NO: 148126 - DNA, 20 bp, Artificial sequence
  SiRNA target sequence
agaaaaaaaagcaagagtat

SEQ ID NO: 148127 - DNA, 20 bp, Artificial sequence
  SiRNA target sequence
gaaaaaaaagcaagagtatg

SEQ ID NO: 148128 - DNA, 20 bp, Artificial sequence
  SiRNA target sequence
aaaaaaaagcaagagtatga

SEQ ID NO: 148129 - DNA, 20 bp, Artificial sequence
  SiRNA target sequence
aaaaaaagcaagagtatgat

SEQ ID NO: 148130 - DNA, 20 bp, Artificial sequence
  SiRNA target sequence
aaaaaagcaagagtatgata

SEQ ID NO: 148131 - DNA, 20 bp, Artificial sequence
  SiRNA target sequence
aaaaagcaagagtatgatat

SEQ ID NO: 148132 - DNA, 20 bp, Artificial sequence
  SiRNA target sequence
aaaagcaagagtatgatatg

SEQ ID NO: 148133 - DNA, 20 bp, Artificial sequence
  SiRNA target sequence
aaagcaagagtatgatatgg

SEQ ID NO: 148134 - DNA, 20 bp, Artificial sequence
  SiRNA target sequence
aagcaagagtatgatatggg

SEQ ID NO: 148135 - DNA, 20 bp, Artificial sequence
  SiRNA target sequence
agcaagagtatgatatggga

SEQ ID NO: 148136 - DNA, 20 bp, Artificial sequence
  SiRNA target sequence
gcaagagtatgatatgggaa

SEQ ID NO: 148137 - DNA, 20 bp, Artificial sequence
  SiRNA target sequence
caagagtatgatatgggaat

SEQ ID NO: 148138 - DNA, 20 bp, Artificial sequence
  SiRNA target sequence
aagagtatgatatgggaatg

SEQ ID NO: 148139 - DNA, 20 bp, Artificial sequence
  SiRNA target sequence
agagtatgatatgggaatga

SEQ ID NO: 148140 - DNA, 20 bp, Artificial sequence
  SiRNA target sequence
gagtatgatatgggaatgac

SEQ ID NO: 148141 - DNA, 20 bp, Artificial sequence
  SiRNA target sequence
agtatgatatgggaatgact

SEQ ID NO: 148142 - DNA, 20 bp, Artificial sequence
  SiRNA target sequence
gtatgatatgggaatgactg

SEQ ID NO: 148143 - DNA, 20 bp, Artificial sequence
  SiRNA target sequence
tatgatatgggaatgactgg

SEQ ID NO: 148144 - DNA, 20 bp, Artificial sequence
  SiRNA target sequence
atgatatgggaatgactggc

SEQ ID NO: 148145 - DNA, 20 bp, Artificial sequence
  SiRNA target sequence
tgatatgggaatgactggcg

SEQ ID NO: 148146 - DNA, 20 bp, Artificial sequence
  SiRNA target sequence
gatatgggaatgactggcga

SEQ ID NO: 148147 - DNA, 20 bp, Artificial sequence
  SiRNA target sequence
atatgggaatgactggcgat

SEQ ID NO: 148148 - DNA, 20 bp, Artificial sequence
  SiRNA target sequence
tatgggaatgactggcgatt

SEQ ID NO: 148149 - DNA, 20 bp, Artificial sequence
  SiRNA target sequence
atgggaatgactggcgattt

SEQ ID NO: 148150 - DNA, 20 bp, Artificial sequence
  SiRNA target sequence
tgggaatgactggcgatttt

SEQ ID NO: 148151 - DNA, 20 bp, Artificial sequence
  SiRNA target sequence
gggaatgactggcgattttg

SEQ ID NO: 148152 - DNA, 20 bp, Artificial sequence
  SiRNA target sequence
ggaatgactggcgattttgg

SEQ ID NO: 148153 - DNA, 20 bp, Artificial sequence
  SiRNA target sequence
gaatgactggcgattttgga

SEQ ID NO: 148154 - DNA, 20 bp, Artificial sequence
  SiRNA target sequence
aatgactggcgattttggat

SEQ ID NO: 148155 - DNA, 20 bp, Artificial sequence
  SiRNA target sequence
atgactggcgattttggatt

SEQ ID NO: 148156 - DNA, 20 bp, Artificial sequence
  SiRNA target sequence
tgactggcgattttggattt

SEQ ID NO: 148157 - DNA, 20 bp, Artificial sequence
  SiRNA target sequence
gactggcgattttggatttt

SEQ ID NO: 148158 - DNA, 20 bp, Artificial sequence
  SiRNA target sequence
actggcgattttggattttc

SEQ ID NO: 148159 - DNA, 20 bp, Artificial sequence
  SiRNA target sequence
ctggcgattttggattttct

SEQ ID NO: 148160 - DNA, 20 bp, Artificial sequence
  SiRNA target sequence
tggcgattttggattttctg

SEQ ID NO: 148161 - DNA, 20 bp, Artificial sequence
  SiRNA target sequence
ggcgattttggattttctgc

SEQ ID NO: 148162 - DNA, 20 bp, Artificial sequence
  SiRNA target sequence
gcgattttggattttctgca

SEQ ID NO: 148163 - DNA, 20 bp, Artificial sequence
  SiRNA target sequence
cgattttggattttctgcag

SEQ ID NO: 148164 - DNA, 20 bp, Artificial sequence
  SiRNA target sequence
gattttggattttctgcagg

SEQ ID NO: 148165 - DNA, 20 bp, Artificial sequence
  SiRNA target sequence
attttggattttctgcaggt

SEQ ID NO: 148166 - DNA, 20 bp, Artificial sequence
  SiRNA target sequence
ttttggattttctgcaggtg

SEQ ID NO: 148167 - DNA, 20 bp, Artificial sequence
  SiRNA target sequence
tttggattttctgcaggtgg

SEQ ID NO: 148168 - DNA, 20 bp, Artificial sequence
  SiRNA target sequence
ttggattttctgcaggtggt

SEQ ID NO: 148169 - DNA, 20 bp, Artificial sequence
  SiRNA target sequence
tggattttctgcaggtggtg

SEQ ID NO: 148170 - DNA, 20 bp, Artificial sequence
  SiRNA target sequence
ggattttctgcaggtggtgg

SEQ ID NO: 148171 - DNA, 20 bp, Artificial sequence
  SiRNA target sequence
gattttctgcaggtggtgga

SEQ ID NO: 148172 - DNA, 20 bp, Artificial sequence
  SiRNA target sequence
attttctgcaggtggtggag

SEQ ID NO: 148173 - DNA, 20 bp, Artificial sequence
  SiRNA target sequence
ttttctgcaggtggtggaga

SEQ ID NO: 148174 - DNA, 20 bp, Artificial sequence
  SiRNA target sequence
tttctgcaggtggtggagac

SEQ ID NO: 148175 - DNA, 20 bp, Artificial sequence
  SiRNA target sequence
ttctgcaggtggtggagact

SEQ ID NO: 148176 - DNA, 20 bp, Artificial sequence
  SiRNA target sequence
tctgcaggtggtggagactt

SEQ ID NO: 148177 - DNA, 20 bp, Artificial sequence
  SiRNA target sequence
ctgcaggtggtggagacttt

SEQ ID NO: 148178 - DNA, 20 bp, Artificial sequence
  SiRNA target sequence
tgcaggtggtggagactttt

SEQ ID NO: 148179 - DNA, 20 bp, Artificial sequence
  SiRNA target sequence
gcaggtggtggagacttttt

SEQ ID NO: 148180 - DNA, 20 bp, Artificial sequence
  SiRNA target sequence
caggtggtggagactttttc

SEQ ID NO: 148181 - DNA, 20 bp, Artificial sequence
  SiRNA target sequence
aggtggtggagactttttcg

SEQ ID NO: 148182 - DNA, 20 bp, Artificial sequence
  SiRNA target sequence
ggtggtggagactttttcga

SEQ ID NO: 148183 - DNA, 20 bp, Artificial sequence
  SiRNA target sequence
gtggtggagactttttcgat

SEQ ID NO: 148184 - DNA, 20 bp, Artificial sequence
  SiRNA target sequence
tggtggagactttttcgata

SEQ ID NO: 148185 - DNA, 20 bp, Artificial sequence
  SiRNA target sequence
ggtggagactttttcgatat

SEQ ID NO: 148186 - DNA, 20 bp, Artificial sequence
  SiRNA target sequence
gtggagactttttcgatatt

SEQ ID NO: 148187 - DNA, 20 bp, Artificial sequence
  SiRNA target sequence
tggagactttttcgatattt

SEQ ID NO: 148188 - DNA, 20 bp, Artificial sequence
  SiRNA target sequence
ggagactttttcgatatttt

SEQ ID NO: 148189 - DNA, 20 bp, Artificial sequence
  SiRNA target sequence
gagactttttcgatattttt

SEQ ID NO: 148190 - DNA, 20 bp, Artificial sequence
  SiRNA target sequence
agactttttcgatatttttt

SEQ ID NO: 148191 - DNA, 20 bp, Artificial sequence
  SiRNA target sequence
gactttttcgatattttttc

SEQ ID NO: 148192 - DNA, 20 bp, Artificial sequence
  SiRNA target sequence
actttttcgatattttttca

SEQ ID NO: 148193 - DNA, 20 bp, Artificial sequence
  SiRNA target sequence
ctttttcgatattttttcaa

SEQ ID NO: 148194 - DNA, 20 bp, Artificial sequence
  SiRNA target sequence
tttttcgatattttttcaag

SEQ ID NO: 148195 - DNA, 20 bp, Artificial sequence
  SiRNA target sequence
ttttcgatattttttcaagt

SEQ ID NO: 148196 - DNA, 20 bp, Artificial sequence
  SiRNA target sequence
tttcgatattttttcaagtt

SEQ ID NO: 148197 - DNA, 20 bp, Artificial sequence
  SiRNA target sequence
ttcgatattttttcaagttt

SEQ ID NO: 148198 - DNA, 20 bp, Artificial sequence
  SiRNA target sequence
tcgatattttttcaagtttt

SEQ ID NO: 148199 - DNA, 20 bp, Artificial sequence
  SiRNA target sequence
cgatattttttcaagtttta

SEQ ID NO: 148200 - DNA, 20 bp, Artificial sequence
  SiRNA target sequence
gatattttttcaagttttac

SEQ ID NO: 148201 - DNA, 20 bp, Artificial sequence
  SiRNA target sequence
atattttttcaagttttact

SEQ ID NO: 148202 - DNA, 20 bp, Artificial sequence
  SiRNA target sequence
tattttttcaagttttactg

SEQ ID NO: 148203 - DNA, 20 bp, Artificial sequence
  SiRNA target sequence
attttttcaagttttactgg

SEQ ID NO: 148204 - DNA, 20 bp, Artificial sequence
  SiRNA target sequence
ttttttcaagttttactggt

SEQ ID NO: 148205 - DNA, 20 bp, Artificial sequence
  SiRNA target sequence
tttttcaagttttactggtg

SEQ ID NO: 148206 - DNA, 20 bp, Artificial sequence
  SiRNA target sequence
ttttcaagttttactggtgg

SEQ ID NO: 148207 - DNA, 20 bp, Artificial sequence
  SiRNA target sequence
tttcaagttttactggtgga

SEQ ID NO: 148208 - DNA, 20 bp, Artificial sequence
  SiRNA target sequence
ttcaagttttactggtggag

SEQ ID NO: 148209 - DNA, 20 bp, Artificial sequence
  SiRNA target sequence
tcaagttttactggtggagg

SEQ ID NO: 148210 - DNA, 20 bp, Artificial sequence
  SiRNA target sequence
caagttttactggtggagga

SEQ ID NO: 148211 - DNA, 20 bp, Artificial sequence
  SiRNA target sequence
aagttttactggtggaggaa

SEQ ID NO: 148212 - DNA, 20 bp, Artificial sequence
  SiRNA target sequence
agttttactggtggaggaag

SEQ ID NO: 148213 - DNA, 20 bp, Artificial sequence
  SiRNA target sequence
gttttactggtggaggaaga

SEQ ID NO: 148214 - DNA, 20 bp, Artificial sequence
  SiRNA target sequence
ttttactggtggaggaagaa

SEQ ID NO: 148215 - DNA, 20 bp, Artificial sequence
  SiRNA target sequence
tttactggtggaggaagaag

SEQ ID NO: 148216 - DNA, 20 bp, Artificial sequence
  SiRNA target sequence
ttactggtggaggaagaaga

SEQ ID NO: 148217 - DNA, 20 bp, Artificial sequence
  SiRNA target sequence
tactggtggaggaagaagaa

SEQ ID NO: 148218 - DNA, 20 bp, Artificial sequence
  SiRNA target sequence
actggtggaggaagaagaaa

SEQ ID NO: 148219 - DNA, 20 bp, Artificial sequence
  SiRNA target sequence
ctggtggaggaagaagaaat

SEQ ID NO: 148220 - DNA, 20 bp, Artificial sequence
  SiRNA target sequence
tggtggaggaagaagaaatc

SEQ ID NO: 148221 - DNA, 20 bp, Artificial sequence
  SiRNA target sequence
ggtggaggaagaagaaatcg

SEQ ID NO: 148222 - DNA, 20 bp, Artificial sequence
  SiRNA target sequence
gtggaggaagaagaaatcga

SEQ ID NO: 148223 - DNA, 20 bp, Artificial sequence
  SiRNA target sequence
tggaggaagaagaaatcgag

SEQ ID NO: 148224 - DNA, 20 bp, Artificial sequence
  SiRNA target sequence
ggaggaagaagaaatcgagt

SEQ ID NO: 148225 - DNA, 20 bp, Artificial sequence
  SiRNA target sequence
gaggaagaagaaatcgagta

SEQ ID NO: 148226 - DNA, 20 bp, Artificial sequence
  SiRNA target sequence
aggaagaagaaatcgagtac

SEQ ID NO: 148227 - DNA, 20 bp, Artificial sequence
  SiRNA target sequence
ggaagaagaaatcgagtaca

SEQ ID NO: 148228 - DNA, 20 bp, Artificial sequence
  SiRNA target sequence
gaagaagaaatcgagtacaa

SEQ ID NO: 148229 - DNA, 20 bp, Artificial sequence
  SiRNA target sequence
aagaagaaatcgagtacaaa

SEQ ID NO: 148230 - DNA, 20 bp, Artificial sequence
  SiRNA target sequence
agaagaaatcgagtacaaaa

SEQ ID NO: 148231 - DNA, 20 bp, Artificial sequence
  SiRNA target sequence
gaagaaatcgagtacaaaaa

SEQ ID NO: 148232 - DNA, 20 bp, Artificial sequence
  SiRNA target sequence
aagaaatcgagtacaaaaag

SEQ ID NO: 148233 - DNA, 20 bp, Artificial sequence
  SiRNA target sequence
agaaatcgagtacaaaaagt

SEQ ID NO: 148234 - DNA, 20 bp, Artificial sequence
  SiRNA target sequence
gaaatcgagtacaaaaagtt

SEQ ID NO: 148235 - DNA, 20 bp, Artificial sequence
  SiRNA target sequence
aaatcgagtacaaaaagttc

SEQ ID NO: 148236 - DNA, 20 bp, Artificial sequence
  SiRNA target sequence
aatcgagtacaaaaagttca

SEQ ID NO: 148237 - DNA, 20 bp, Artificial sequence
  SiRNA target sequence
atcgagtacaaaaagttcaa

SEQ ID NO: 148238 - DNA, 20 bp, Artificial sequence
  SiRNA target sequence
tcgagtacaaaaagttcaag

SEQ ID NO: 148239 - DNA, 20 bp, Artificial sequence
  SiRNA target sequence
cgagtacaaaaagttcaaga

SEQ ID NO: 148240 - DNA, 20 bp, Artificial sequence
  SiRNA target sequence
gagtacaaaaagttcaagat

SEQ ID NO: 148241 - DNA, 20 bp, Artificial sequence
  SiRNA target sequence
agtacaaaaagttcaagata

SEQ ID NO: 148242 - DNA, 20 bp, Artificial sequence
  SiRNA target sequence
gtacaaaaagttcaagatac

SEQ ID NO: 148243 - DNA, 20 bp, Artificial sequence
  SiRNA target sequence
tacaaaaagttcaagataca

SEQ ID NO: 148244 - DNA, 20 bp, Artificial sequence
  SiRNA target sequence
acaaaaagttcaagatacag

SEQ ID NO: 148245 - DNA, 20 bp, Artificial sequence
  SiRNA target sequence
caaaaagttcaagatacaga

SEQ ID NO: 148246 - DNA, 20 bp, Artificial sequence
  SiRNA target sequence
aaaaagttcaagatacagaa

SEQ ID NO: 148247 - DNA, 20 bp, Artificial sequence
  SiRNA target sequence
aaaagttcaagatacagaat

SEQ ID NO: 148248 - DNA, 20 bp, Artificial sequence
  SiRNA target sequence
aaagttcaagatacagaata

SEQ ID NO: 148249 - DNA, 20 bp, Artificial sequence
  SiRNA target sequence
aagttcaagatacagaatac

SEQ ID NO: 148250 - DNA, 20 bp, Artificial sequence
  SiRNA target sequence
agttcaagatacagaatacg

SEQ ID NO: 148251 - DNA, 20 bp, Artificial sequence
  SiRNA target sequence
gttcaagatacagaatacga

SEQ ID NO: 148252 - DNA, 20 bp, Artificial sequence
  SiRNA target sequence
ttcaagatacagaatacgag

SEQ ID NO: 148253 - DNA, 20 bp, Artificial sequence
  SiRNA target sequence
tcaagatacagaatacgagt

SEQ ID NO: 148254 - DNA, 20 bp, Artificial sequence
  SiRNA target sequence
caagatacagaatacgagtt

SEQ ID NO: 148255 - DNA, 20 bp, Artificial sequence
  SiRNA target sequence
aagatacagaatacgagttt

SEQ ID NO: 148256 - DNA, 20 bp, Artificial sequence
  SiRNA target sequence
agatacagaatacgagttta

SEQ ID NO: 148257 - DNA, 20 bp, Artificial sequence
  SiRNA target sequence
gatacagaatacgagtttaa

SEQ ID NO: 148258 - DNA, 20 bp, Artificial sequence
  SiRNA target sequence
atacagaatacgagtttaat

SEQ ID NO: 148259 - DNA, 20 bp, Artificial sequence
  SiRNA target sequence
tacagaatacgagtttaata

SEQ ID NO: 148260 - DNA, 20 bp, Artificial sequence
  SiRNA target sequence
acagaatacgagtttaatat

SEQ ID NO: 148261 - DNA, 20 bp, Artificial sequence
  SiRNA target sequence
cagaatacgagtttaatatt

SEQ ID NO: 148262 - DNA, 20 bp, Artificial sequence
  SiRNA target sequence
agaatacgagtttaatattt

SEQ ID NO: 148263 - DNA, 20 bp, Artificial sequence
  SiRNA target sequence
gaatacgagtttaatatttc

SEQ ID NO: 148264 - DNA, 20 bp, Artificial sequence
  SiRNA target sequence
aatacgagtttaatatttcg

SEQ ID NO: 148265 - DNA, 20 bp, Artificial sequence
  SiRNA target sequence
atacgagtttaatatttcgt

SEQ ID NO: 148266 - DNA, 20 bp, Artificial sequence
  SiRNA target sequence
tacgagtttaatatttcgtt

SEQ ID NO: 148267 - DNA, 20 bp, Artificial sequence
  SiRNA target sequence
acgagtttaatatttcgttg

SEQ ID NO: 148268 - DNA, 20 bp, Artificial sequence
  SiRNA target sequence
cgagtttaatatttcgttga

SEQ ID NO: 148269 - DNA, 20 bp, Artificial sequence
  SiRNA target sequence
gagtttaatatttcgttgaa

SEQ ID NO: 148270 - DNA, 20 bp, Artificial sequence
  SiRNA target sequence
agtttaatatttcgttgaag

SEQ ID NO: 148271 - DNA, 20 bp, Artificial sequence
  SiRNA target sequence
gtttaatatttcgttgaagg

SEQ ID NO: 148272 - DNA, 20 bp, Artificial sequence
  SiRNA target sequence
tttaatatttcgttgaagga

SEQ ID NO: 148273 - DNA, 20 bp, Artificial sequence
  SiRNA target sequence
ttaatatttcgttgaaggaa

SEQ ID NO: 148274 - DNA, 20 bp, Artificial sequence
  SiRNA target sequence
taatatttcgttgaaggaag

SEQ ID NO: 148275 - DNA, 20 bp, Artificial sequence
  SiRNA target sequence
aatatttcgttgaaggaagc

SEQ ID NO: 148276 - DNA, 20 bp, Artificial sequence
  SiRNA target sequence
atatttcgttgaaggaagct

SEQ ID NO: 148277 - DNA, 20 bp, Artificial sequence
  SiRNA target sequence
tatttcgttgaaggaagctt

SEQ ID NO: 148278 - DNA, 20 bp, Artificial sequence
  SiRNA target sequence
atttcgttgaaggaagctta

SEQ ID NO: 148279 - DNA, 20 bp, Artificial sequence
  SiRNA target sequence
tttcgttgaaggaagcttat

SEQ ID NO: 148280 - DNA, 20 bp, Artificial sequence
  SiRNA target sequence
ttcgttgaaggaagcttata

SEQ ID NO: 148281 - DNA, 20 bp, Artificial sequence
  SiRNA target sequence
tcgttgaaggaagcttatat

SEQ ID NO: 148282 - DNA, 20 bp, Artificial sequence
  SiRNA target sequence
cgttgaaggaagcttatatg

SEQ ID NO: 148283 - DNA, 20 bp, Artificial sequence
  SiRNA target sequence
gttgaaggaagcttatatgg

SEQ ID NO: 148284 - DNA, 20 bp, Artificial sequence
  SiRNA target sequence
ttgaaggaagcttatatggg

SEQ ID NO: 148285 - DNA, 20 bp, Artificial sequence
  SiRNA target sequence
tgaaggaagcttatatggga

SEQ ID NO: 148286 - DNA, 20 bp, Artificial sequence
  SiRNA target sequence
gaaggaagcttatatgggaa

SEQ ID NO: 148287 - DNA, 20 bp, Artificial sequence
  SiRNA target sequence
aaggaagcttatatgggaaa

SEQ ID NO: 148288 - DNA, 20 bp, Artificial sequence
  SiRNA target sequence
aggaagcttatatgggaaag

SEQ ID NO: 148289 - DNA, 20 bp, Artificial sequence
  SiRNA target sequence
ggaagcttatatgggaaagc

SEQ ID NO: 148290 - DNA, 20 bp, Artificial sequence
  SiRNA target sequence
gaagcttatatgggaaagcg

SEQ ID NO: 148291 - DNA, 20 bp, Artificial sequence
  SiRNA target sequence
aagcttatatgggaaagcga

SEQ ID NO: 148292 - DNA, 20 bp, Artificial sequence
  SiRNA target sequence
agcttatatgggaaagcgag

SEQ ID NO: 148293 - DNA, 20 bp, Artificial sequence
  SiRNA target sequence
gcttatatgggaaagcgagc

SEQ ID NO: 148294 - DNA, 20 bp, Artificial sequence
  SiRNA target sequence
cttatatgggaaagcgagct

SEQ ID NO: 148295 - DNA, 20 bp, Artificial sequence
  SiRNA target sequence
ttatatgggaaagcgagcta

SEQ ID NO: 148296 - DNA, 20 bp, Artificial sequence
  SiRNA target sequence
tatatgggaaagcgagctag

SEQ ID NO: 148297 - DNA, 20 bp, Artificial sequence
  SiRNA target sequence
atatgggaaagcgagctagt

SEQ ID NO: 148298 - DNA, 20 bp, Artificial sequence
  SiRNA target sequence
tatgggaaagcgagctagtt

SEQ ID NO: 148299 - DNA, 20 bp, Artificial sequence
  SiRNA target sequence
atgggaaagcgagctagttt

SEQ ID NO: 148300 - DNA, 20 bp, Artificial sequence
  SiRNA target sequence
tgggaaagcgagctagtttt

SEQ ID NO: 148301 - DNA, 20 bp, Artificial sequence
  SiRNA target sequence
gggaaagcgagctagtttta

SEQ ID NO: 148302 - DNA, 20 bp, Artificial sequence
  SiRNA target sequence
ggaaagcgagctagttttaa

SEQ ID NO: 148303 - DNA, 20 bp, Artificial sequence
  SiRNA target sequence
gaaagcgagctagttttaat

SEQ ID NO: 148304 - DNA, 20 bp, Artificial sequence
  SiRNA target sequence
aaagcgagctagttttaatg

SEQ ID NO: 148305 - DNA, 20 bp, Artificial sequence
  SiRNA target sequence
aagcgagctagttttaatgt

SEQ ID NO: 148306 - DNA, 20 bp, Artificial sequence
  SiRNA target sequence
agcgagctagttttaatgta

SEQ ID NO: 148307 - DNA, 20 bp, Artificial sequence
  SiRNA target sequence
gcgagctagttttaatgtaa

SEQ ID NO: 148308 - DNA, 20 bp, Artificial sequence
  SiRNA target sequence
cgagctagttttaatgtaaa

SEQ ID NO: 148309 - DNA, 20 bp, Artificial sequence
  SiRNA target sequence
gagctagttttaatgtaaaa

SEQ ID NO: 148310 - DNA, 20 bp, Artificial sequence
  SiRNA target sequence
agctagttttaatgtaaaag

SEQ ID NO: 148311 - DNA, 20 bp, Artificial sequence
  SiRNA target sequence
gctagttttaatgtaaaagt

SEQ ID NO: 148312 - DNA, 20 bp, Artificial sequence
  SiRNA target sequence
ctagttttaatgtaaaagtg

SEQ ID NO: 148313 - DNA, 20 bp, Artificial sequence
  SiRNA target sequence
tagttttaatgtaaaagtgc

SEQ ID NO: 148314 - DNA, 20 bp, Artificial sequence
  SiRNA target sequence
agttttaatgtaaaagtgca

SEQ ID NO: 148315 - DNA, 20 bp, Artificial sequence
  SiRNA target sequence
gttttaatgtaaaagtgcaa

SEQ ID NO: 148316 - DNA, 20 bp, Artificial sequence
  SiRNA target sequence
ttttaatgtaaaagtgcaaa

SEQ ID NO: 148317 - DNA, 20 bp, Artificial sequence
  SiRNA target sequence
tttaatgtaaaagtgcaaag

SEQ ID NO: 148318 - DNA, 20 bp, Artificial sequence
  SiRNA target sequence
ttaatgtaaaagtgcaaaga

SEQ ID NO: 148319 - DNA, 20 bp, Artificial sequence
  SiRNA target sequence
taatgtaaaagtgcaaagag

SEQ ID NO: 148320 - DNA, 20 bp, Artificial sequence
  SiRNA target sequence
aatgtaaaagtgcaaagaga

SEQ ID NO: 148321 - DNA, 20 bp, Artificial sequence
  SiRNA target sequence
atgtaaaagtgcaaagagaa

SEQ ID NO: 148322 - DNA, 20 bp, Artificial sequence
  SiRNA target sequence
tgtaaaagtgcaaagagaat

SEQ ID NO: 148323 - DNA, 20 bp, Artificial sequence
  SiRNA target sequence
gtaaaagtgcaaagagaatg

SEQ ID NO: 148324 - DNA, 20 bp, Artificial sequence
  SiRNA target sequence
taaaagtgcaaagagaatgt

SEQ ID NO: 148325 - DNA, 20 bp, Artificial sequence
  SiRNA target sequence
aaaagtgcaaagagaatgtt

SEQ ID NO: 148326 - DNA, 20 bp, Artificial sequence
  SiRNA target sequence
aaagtgcaaagagaatgttc

SEQ ID NO: 148327 - DNA, 20 bp, Artificial sequence
  SiRNA target sequence
aagtgcaaagagaatgttct

SEQ ID NO: 148328 - DNA, 20 bp, Artificial sequence
  SiRNA target sequence
agtgcaaagagaatgttctg

SEQ ID NO: 148329 - DNA, 20 bp, Artificial sequence
  SiRNA target sequence
gtgcaaagagaatgttctgc

SEQ ID NO: 148330 - DNA, 20 bp, Artificial sequence
  SiRNA target sequence
tgcaaagagaatgttctgcg

SEQ ID NO: 148331 - DNA, 20 bp, Artificial sequence
  SiRNA target sequence
gcaaagagaatgttctgcgt

SEQ ID NO: 148332 - DNA, 20 bp, Artificial sequence
  SiRNA target sequence
caaagagaatgttctgcgtg

SEQ ID NO: 148333 - DNA, 20 bp, Artificial sequence
  SiRNA target sequence
aaagagaatgttctgcgtgt

SEQ ID NO: 148334 - DNA, 20 bp, Artificial sequence
  SiRNA target sequence
aagagaatgttctgcgtgta

SEQ ID NO: 148335 - DNA, 20 bp, Artificial sequence
  SiRNA target sequence
agagaatgttctgcgtgtaa

SEQ ID NO: 148336 - DNA, 20 bp, Artificial sequence
  SiRNA target sequence
gagaatgttctgcgtgtaac

SEQ ID NO: 148337 - DNA, 20 bp, Artificial sequence
  SiRNA target sequence
agaatgttctgcgtgtaacg

SEQ ID NO: 148338 - DNA, 20 bp, Artificial sequence
  SiRNA target sequence
gaatgttctgcgtgtaacgg

SEQ ID NO: 148339 - DNA, 20 bp, Artificial sequence
  SiRNA target sequence
aatgttctgcgtgtaacggt

SEQ ID NO: 148340 - DNA, 20 bp, Artificial sequence
  SiRNA target sequence
atgttctgcgtgtaacggta

SEQ ID NO: 148341 - DNA, 20 bp, Artificial sequence
  SiRNA target sequence
tgttctgcgtgtaacggtaa

SEQ ID NO: 148342 - DNA, 20 bp, Artificial sequence
  SiRNA target sequence
gttctgcgtgtaacggtaaa

SEQ ID NO: 148343 - DNA, 20 bp, Artificial sequence
  SiRNA target sequence
ttctgcgtgtaacggtaaag

SEQ ID NO: 148344 - DNA, 20 bp, Artificial sequence
  SiRNA target sequence
tctgcgtgtaacggtaaagg

SEQ ID NO: 148345 - DNA, 20 bp, Artificial sequence
  SiRNA target sequence
ctgcgtgtaacggtaaagga

SEQ ID NO: 148346 - DNA, 20 bp, Artificial sequence
  SiRNA target sequence
tgcgtgtaacggtaaaggag

SEQ ID NO: 148347 - DNA, 20 bp, Artificial sequence
  SiRNA target sequence
gcgtgtaacggtaaaggagg

SEQ ID NO: 148348 - DNA, 20 bp, Artificial sequence
  SiRNA target sequence
cgtgtaacggtaaaggagga

SEQ ID NO: 148349 - DNA, 20 bp, Artificial sequence
  SiRNA target sequence
gtgtaacggtaaaggaggag

SEQ ID NO: 148350 - DNA, 20 bp, Artificial sequence
  SiRNA target sequence
tgtaacggtaaaggaggaga

SEQ ID NO: 148351 - DNA, 20 bp, Artificial sequence
  SiRNA target sequence
gtaacggtaaaggaggagac

SEQ ID NO: 148352 - DNA, 20 bp, Artificial sequence
  SiRNA target sequence
taacggtaaaggaggagaca

SEQ ID NO: 148353 - DNA, 20 bp, Artificial sequence
  SiRNA target sequence
aacggtaaaggaggagacag

SEQ ID NO: 148354 - DNA, 20 bp, Artificial sequence
  SiRNA target sequence
acggtaaaggaggagacagt

SEQ ID NO: 148355 - DNA, 20 bp, Artificial sequence
  SiRNA target sequence
cggtaaaggaggagacagtg

SEQ ID NO: 148356 - DNA, 20 bp, Artificial sequence
  SiRNA target sequence
ggtaaaggaggagacagtgt

SEQ ID NO: 148357 - DNA, 20 bp, Artificial sequence
  SiRNA target sequence
gtaaaggaggagacagtgtt

SEQ ID NO: 148358 - DNA, 20 bp, Artificial sequence
  SiRNA target sequence
taaaggaggagacagtgttg

SEQ ID NO: 148359 - DNA, 20 bp, Artificial sequence
  SiRNA target sequence
aaaggaggagacagtgttga

SEQ ID NO: 148360 - DNA, 20 bp, Artificial sequence
  SiRNA target sequence
aaggaggagacagtgttgaa

SEQ ID NO: 148361 - DNA, 20 bp, Artificial sequence
  SiRNA target sequence
aggaggagacagtgttgaaa

SEQ ID NO: 148362 - DNA, 20 bp, Artificial sequence
  SiRNA target sequence
ggaggagacagtgttgaaac

SEQ ID NO: 148363 - DNA, 20 bp, Artificial sequence
  SiRNA target sequence
gaggagacagtgttgaaaca

SEQ ID NO: 148364 - DNA, 20 bp, Artificial sequence
  SiRNA target sequence
aggagacagtgttgaaacat

SEQ ID NO: 148365 - DNA, 20 bp, Artificial sequence
  SiRNA target sequence
ggagacagtgttgaaacatg

SEQ ID NO: 148366 - DNA, 20 bp, Artificial sequence
  SiRNA target sequence
gagacagtgttgaaacatgt

SEQ ID NO: 148367 - DNA, 20 bp, Artificial sequence
  SiRNA target sequence
agacagtgttgaaacatgtg

SEQ ID NO: 148368 - DNA, 20 bp, Artificial sequence
  SiRNA target sequence
gacagtgttgaaacatgtga

SEQ ID NO: 148369 - DNA, 20 bp, Artificial sequence
  SiRNA target sequence
acagtgttgaaacatgtgaa

SEQ ID NO: 148370 - DNA, 20 bp, Artificial sequence
  SiRNA target sequence
cagtgttgaaacatgtgaac

SEQ ID NO: 148371 - DNA, 20 bp, Artificial sequence
  SiRNA target sequence
agtgttgaaacatgtgaacc

SEQ ID NO: 148372 - DNA, 20 bp, Artificial sequence
  SiRNA target sequence
gtgttgaaacatgtgaacca

SEQ ID NO: 148373 - DNA, 20 bp, Artificial sequence
  SiRNA target sequence
tgttgaaacatgtgaaccat

SEQ ID NO: 148374 - DNA, 20 bp, Artificial sequence
  SiRNA target sequence
gttgaaacatgtgaaccatg

SEQ ID NO: 148375 - DNA, 20 bp, Artificial sequence
  SiRNA target sequence
ttgaaacatgtgaaccatgt

SEQ ID NO: 148376 - DNA, 20 bp, Artificial sequence
  SiRNA target sequence
tgaaacatgtgaaccatgta

SEQ ID NO: 148377 - DNA, 20 bp, Artificial sequence
  SiRNA target sequence
gaaacatgtgaaccatgtaa

SEQ ID NO: 148378 - DNA, 20 bp, Artificial sequence
  SiRNA target sequence
aaacatgtgaaccatgtaaa

SEQ ID NO: 148379 - DNA, 20 bp, Artificial sequence
  SiRNA target sequence
aacatgtgaaccatgtaaag

SEQ ID NO: 148380 - DNA, 20 bp, Artificial sequence
  SiRNA target sequence
acatgtgaaccatgtaaagg

SEQ ID NO: 148381 - DNA, 20 bp, Artificial sequence
  SiRNA target sequence
catgtgaaccatgtaaaggt

SEQ ID NO: 148382 - DNA, 20 bp, Artificial sequence
  SiRNA target sequence
atgtgaaccatgtaaaggta

SEQ ID NO: 148383 - DNA, 20 bp, Artificial sequence
  SiRNA target sequence
tgtgaaccatgtaaaggtaa

SEQ ID NO: 148384 - DNA, 20 bp, Artificial sequence
  SiRNA target sequence
gtgaaccatgtaaaggtaaa

SEQ ID NO: 148385 - DNA, 20 bp, Artificial sequence
  SiRNA target sequence
tgaaccatgtaaaggtaaag

SEQ ID NO: 148386 - DNA, 20 bp, Artificial sequence
  SiRNA target sequence
gaaccatgtaaaggtaaagg

SEQ ID NO: 148387 - DNA, 20 bp, Artificial sequence
  SiRNA target sequence
aaccatgtaaaggtaaaggt

SEQ ID NO: 148388 - DNA, 20 bp, Artificial sequence
  SiRNA target sequence
accatgtaaaggtaaaggta

SEQ ID NO: 148389 - DNA, 20 bp, Artificial sequence
  SiRNA target sequence
ccatgtaaaggtaaaggtaa

SEQ ID NO: 148390 - DNA, 20 bp, Artificial sequence
  SiRNA target sequence
catgtaaaggtaaaggtaag

SEQ ID NO: 148391 - DNA, 20 bp, Artificial sequence
  SiRNA target sequence
atgtaaaggtaaaggtaagg

SEQ ID NO: 148392 - DNA, 20 bp, Artificial sequence
  SiRNA target sequence
tgtaaaggtaaaggtaaggt

SEQ ID NO: 148393 - DNA, 20 bp, Artificial sequence
  SiRNA target sequence
gtaaaggtaaaggtaaggta

SEQ ID NO: 148394 - DNA, 20 bp, Artificial sequence
  SiRNA target sequence
taaaggtaaaggtaaggtag

SEQ ID NO: 148395 - DNA, 20 bp, Artificial sequence
  SiRNA target sequence
aaaggtaaaggtaaggtaga

SEQ ID NO: 148396 - DNA, 20 bp, Artificial sequence
  SiRNA target sequence
aaggtaaaggtaaggtagaa

SEQ ID NO: 148397 - DNA, 20 bp, Artificial sequence
  SiRNA target sequence
aggtaaaggtaaggtagaac

SEQ ID NO: 148398 - DNA, 20 bp, Artificial sequence
  SiRNA target sequence
ggtaaaggtaaggtagaaca

SEQ ID NO: 148399 - DNA, 20 bp, Artificial sequence
  SiRNA target sequence
gtaaaggtaaggtagaacat

SEQ ID NO: 148400 - DNA, 20 bp, Artificial sequence
  SiRNA target sequence
taaaggtaaggtagaacatc

SEQ ID NO: 148401 - DNA, 20 bp, Artificial sequence
  SiRNA target sequence
aaaggtaaggtagaacatca

SEQ ID NO: 148402 - DNA, 20 bp, Artificial sequence
  SiRNA target sequence
aaggtaaggtagaacatcat

SEQ ID NO: 148403 - DNA, 20 bp, Artificial sequence
  SiRNA target sequence
aggtaaggtagaacatcata

SEQ ID NO: 148404 - DNA, 20 bp, Artificial sequence
  SiRNA target sequence
ggtaaggtagaacatcatag

SEQ ID NO: 148405 - DNA, 20 bp, Artificial sequence
  SiRNA target sequence
gtaaggtagaacatcatagg

SEQ ID NO: 148406 - DNA, 20 bp, Artificial sequence
  SiRNA target sequence
taaggtagaacatcatagga

SEQ ID NO: 148407 - DNA, 20 bp, Artificial sequence
  SiRNA target sequence
aaggtagaacatcataggag

SEQ ID NO: 148408 - DNA, 20 bp, Artificial sequence
  SiRNA target sequence
aggtagaacatcataggaga

SEQ ID NO: 148409 - DNA, 20 bp, Artificial sequence
  SiRNA target sequence
ggtagaacatcataggagac

SEQ ID NO: 148410 - DNA, 20 bp, Artificial sequence
  SiRNA target sequence
gtagaacatcataggagact

SEQ ID NO: 148411 - DNA, 20 bp, Artificial sequence
  SiRNA target sequence
tagaacatcataggagacta

SEQ ID NO: 148412 - DNA, 20 bp, Artificial sequence
  SiRNA target sequence
agaacatcataggagactag

SEQ ID NO: 148413 - DNA, 20 bp, Artificial sequence
  SiRNA target sequence
gaacatcataggagactagg

SEQ ID NO: 148414 - DNA, 20 bp, Artificial sequence
  SiRNA target sequence
aacatcataggagactaggt

SEQ ID NO: 148415 - DNA, 20 bp, Artificial sequence
  SiRNA target sequence
acatcataggagactaggtc

SEQ ID NO: 148416 - DNA, 20 bp, Artificial sequence
  SiRNA target sequence
catcataggagactaggtcc

SEQ ID NO: 148417 - DNA, 20 bp, Artificial sequence
  SiRNA target sequence
atcataggagactaggtcct

SEQ ID NO: 148418 - DNA, 20 bp, Artificial sequence
  SiRNA target sequence
tcataggagactaggtcctt

SEQ ID NO: 148419 - DNA, 20 bp, Artificial sequence
  SiRNA target sequence
cataggagactaggtccttt

SEQ ID NO: 148420 - DNA, 20 bp, Artificial sequence
  SiRNA target sequence
ataggagactaggtccttta

SEQ ID NO: 148421 - DNA, 20 bp, Artificial sequence
  SiRNA target sequence
taggagactaggtcctttaa

SEQ ID NO: 148422 - DNA, 20 bp, Artificial sequence
  SiRNA target sequence
aggagactaggtcctttaat

SEQ ID NO: 148423 - DNA, 20 bp, Artificial sequence
  SiRNA target sequence
ggagactaggtcctttaatt

SEQ ID NO: 148424 - DNA, 20 bp, Artificial sequence
  SiRNA target sequence
gagactaggtcctttaattt

SEQ ID NO: 148425 - DNA, 20 bp, Artificial sequence
  SiRNA target sequence
agactaggtcctttaatttc

SEQ ID NO: 148426 - DNA, 20 bp, Artificial sequence
  SiRNA target sequence
gactaggtcctttaatttct

SEQ ID NO: 148427 - DNA, 20 bp, Artificial sequence
  SiRNA target sequence
actaggtcctttaatttctg

SEQ ID NO: 148428 - DNA, 20 bp, Artificial sequence
  SiRNA target sequence
ctaggtcctttaatttctgt

SEQ ID NO: 148429 - DNA, 20 bp, Artificial sequence
  SiRNA target sequence
taggtcctttaatttctgta

SEQ ID NO: 148430 - DNA, 20 bp, Artificial sequence
  SiRNA target sequence
aggtcctttaatttctgtac

SEQ ID NO: 148431 - DNA, 20 bp, Artificial sequence
  SiRNA target sequence
ggtcctttaatttctgtaca

SEQ ID NO: 148432 - DNA, 20 bp, Artificial sequence
  SiRNA target sequence
gtcctttaatttctgtacaa

SEQ ID NO: 148433 - DNA, 20 bp, Artificial sequence
  SiRNA target sequence
tcctttaatttctgtacaag

SEQ ID NO: 148434 - DNA, 20 bp, Artificial sequence
  SiRNA target sequence
cctttaatttctgtacaaga

SEQ ID NO: 148435 - DNA, 20 bp, Artificial sequence
  SiRNA target sequence
ctttaatttctgtacaagaa

SEQ ID NO: 148436 - DNA, 20 bp, Artificial sequence
  SiRNA target sequence
tttaatttctgtacaagaag

SEQ ID NO: 148437 - DNA, 20 bp, Artificial sequence
  SiRNA target sequence
ttaatttctgtacaagaagc

SEQ ID NO: 148438 - DNA, 20 bp, Artificial sequence
  SiRNA target sequence
taatttctgtacaagaagca

SEQ ID NO: 148439 - DNA, 20 bp, Artificial sequence
  SiRNA target sequence
aatttctgtacaagaagcac

SEQ ID NO: 148440 - DNA, 20 bp, Artificial sequence
  SiRNA target sequence
atttctgtacaagaagcacc

SEQ ID NO: 148441 - DNA, 20 bp, Artificial sequence
  SiRNA target sequence
tttctgtacaagaagcacct

SEQ ID NO: 148442 - DNA, 20 bp, Artificial sequence
  SiRNA target sequence
ttctgtacaagaagcacctt

SEQ ID NO: 148443 - DNA, 20 bp, Artificial sequence
  SiRNA target sequence
tctgtacaagaagcaccttg

SEQ ID NO: 148444 - DNA, 20 bp, Artificial sequence
  SiRNA target sequence
ctgtacaagaagcaccttgt

SEQ ID NO: 148445 - DNA, 20 bp, Artificial sequence
  SiRNA target sequence
tgtacaagaagcaccttgta

SEQ ID NO: 148446 - DNA, 20 bp, Artificial sequence
  SiRNA target sequence
gtacaagaagcaccttgtaa

SEQ ID NO: 148447 - DNA, 20 bp, Artificial sequence
  SiRNA target sequence
tacaagaagcaccttgtaat

SEQ ID NO: 148448 - DNA, 20 bp, Artificial sequence
  SiRNA target sequence
acaagaagcaccttgtaata

SEQ ID NO: 148449 - DNA, 20 bp, Artificial sequence
  SiRNA target sequence
caagaagcaccttgtaataa

SEQ ID NO: 148450 - DNA, 20 bp, Artificial sequence
  SiRNA target sequence
aagaagcaccttgtaataat

SEQ ID NO: 148451 - DNA, 20 bp, Artificial sequence
  SiRNA target sequence
agaagcaccttgtaataatt

SEQ ID NO: 148452 - DNA, 20 bp, Artificial sequence
  SiRNA target sequence
gaagcaccttgtaataattg

SEQ ID NO: 148453 - DNA, 20 bp, Artificial sequence
  SiRNA target sequence
aagcaccttgtaataattgt

SEQ ID NO: 148454 - DNA, 20 bp, Artificial sequence
  SiRNA target sequence
agcaccttgtaataattgta

SEQ ID NO: 148455 - DNA, 20 bp, Artificial sequence
  SiRNA target sequence
gcaccttgtaataattgtaa

SEQ ID NO: 148456 - DNA, 20 bp, Artificial sequence
  SiRNA target sequence
caccttgtaataattgtaat

SEQ ID NO: 148457 - DNA, 20 bp, Artificial sequence
  SiRNA target sequence
accttgtaataattgtaatt

SEQ ID NO: 148458 - DNA, 20 bp, Artificial sequence
  SiRNA target sequence
ccttgtaataattgtaattc

SEQ ID NO: 148459 - DNA, 20 bp, Artificial sequence
  SiRNA target sequence
cttgtaataattgtaattct

SEQ ID NO: 148460 - DNA, 20 bp, Artificial sequence
  SiRNA target sequence
ttgtaataattgtaattcta

SEQ ID NO: 148461 - DNA, 20 bp, Artificial sequence
  SiRNA target sequence
tgtaataattgtaattctac

SEQ ID NO: 148462 - DNA, 20 bp, Artificial sequence
  SiRNA target sequence
gtaataattgtaattctact

SEQ ID NO: 148463 - DNA, 20 bp, Artificial sequence
  SiRNA target sequence
taataattgtaattctactg

SEQ ID NO: 148464 - DNA, 20 bp, Artificial sequence
  SiRNA target sequence
aataattgtaattctactgg

SEQ ID NO: 148465 - DNA, 20 bp, Artificial sequence
  SiRNA target sequence
ataattgtaattctactgga

SEQ ID NO: 148466 - DNA, 20 bp, Artificial sequence
  SiRNA target sequence
taattgtaattctactggat

SEQ ID NO: 148467 - DNA, 20 bp, Artificial sequence
  SiRNA target sequence
aattgtaattctactggatt

SEQ ID NO: 148468 - DNA, 20 bp, Artificial sequence
  SiRNA target sequence
attgtaattctactggattt

SEQ ID NO: 148469 - DNA, 20 bp, Artificial sequence
  SiRNA target sequence
ttgtaattctactggatttg

SEQ ID NO: 148470 - DNA, 20 bp, Artificial sequence
  SiRNA target sequence
tgtaattctactggatttgt

SEQ ID NO: 148471 - DNA, 20 bp, Artificial sequence
  SiRNA target sequence
gtaattctactggatttgtt

SEQ ID NO: 148472 - DNA, 20 bp, Artificial sequence
  SiRNA target sequence
taattctactggatttgttg

SEQ ID NO: 148473 - DNA, 20 bp, Artificial sequence
  SiRNA target sequence
aattctactggatttgttgt

SEQ ID NO: 148474 - DNA, 20 bp, Artificial sequence
  SiRNA target sequence
attctactggatttgttgtt

SEQ ID NO: 148475 - DNA, 20 bp, Artificial sequence
  SiRNA target sequence
ttctactggatttgttgtta

SEQ ID NO: 148476 - DNA, 20 bp, Artificial sequence
  SiRNA target sequence
tctactggatttgttgttaa

SEQ ID NO: 148477 - DNA, 20 bp, Artificial sequence
  SiRNA target sequence
ctactggatttgttgttaaa

SEQ ID NO: 148478 - DNA, 20 bp, Artificial sequence
  SiRNA target sequence
tactggatttgttgttaaag

SEQ ID NO: 148479 - DNA, 20 bp, Artificial sequence
  SiRNA target sequence
actggatttgttgttaaagg

SEQ ID NO: 148480 - DNA, 20 bp, Artificial sequence
  SiRNA target sequence
ctggatttgttgttaaagga

SEQ ID NO: 148481 - DNA, 20 bp, Artificial sequence
  SiRNA target sequence
tggatttgttgttaaaggaa

SEQ ID NO: 148482 - DNA, 20 bp, Artificial sequence
  SiRNA target sequence
ggatttgttgttaaaggaaa

SEQ ID NO: 148483 - DNA, 20 bp, Artificial sequence
  SiRNA target sequence
gatttgttgttaaaggaaag

SEQ ID NO: 148484 - DNA, 20 bp, Artificial sequence
  SiRNA target sequence
atttgttgttaaaggaaagc

SEQ ID NO: 148485 - DNA, 20 bp, Artificial sequence
  SiRNA target sequence
tttgttgttaaaggaaagct

SEQ ID NO: 148486 - DNA, 20 bp, Artificial sequence
  SiRNA target sequence
ttgttgttaaaggaaagctt

SEQ ID NO: 148487 - DNA, 20 bp, Artificial sequence
  SiRNA target sequence
tgttgttaaaggaaagcttt

SEQ ID NO: 148488 - DNA, 20 bp, Artificial sequence
  SiRNA target sequence
gttgttaaaggaaagctttg

SEQ ID NO: 148489 - DNA, 20 bp, Artificial sequence
  SiRNA target sequence
ttgttaaaggaaagctttgt

SEQ ID NO: 148490 - DNA, 20 bp, Artificial sequence
  SiRNA target sequence
tgttaaaggaaagctttgtc

SEQ ID NO: 148491 - DNA, 20 bp, Artificial sequence
  SiRNA target sequence
gttaaaggaaagctttgtca

SEQ ID NO: 148492 - DNA, 20 bp, Artificial sequence
  SiRNA target sequence
ttaaaggaaagctttgtcaa

SEQ ID NO: 148493 - DNA, 20 bp, Artificial sequence
  SiRNA target sequence
taaaggaaagctttgtcaaa

SEQ ID NO: 148494 - DNA, 20 bp, Artificial sequence
  SiRNA target sequence
aaaggaaagctttgtcaaag

SEQ ID NO: 148495 - DNA, 20 bp, Artificial sequence
  SiRNA target sequence
aaggaaagctttgtcaaagt

SEQ ID NO: 148496 - DNA, 20 bp, Artificial sequence
  SiRNA target sequence
aggaaagctttgtcaaagtt

SEQ ID NO: 148497 - DNA, 20 bp, Artificial sequence
  SiRNA target sequence
ggaaagctttgtcaaagttg

SEQ ID NO: 148498 - DNA, 20 bp, Artificial sequence
  SiRNA target sequence
gaaagctttgtcaaagttgt

SEQ ID NO: 148499 - DNA, 20 bp, Artificial sequence
  SiRNA target sequence
aaagctttgtcaaagttgta

SEQ ID NO: 148500 - DNA, 20 bp, Artificial sequence
  SiRNA target sequence
aagctttgtcaaagttgtaa

SEQ ID NO: 148501 - DNA, 20 bp, Artificial sequence
  SiRNA target sequence
agctttgtcaaagttgtaaa

SEQ ID NO: 148502 - DNA, 20 bp, Artificial sequence
  SiRNA target sequence
gctttgtcaaagttgtaaag

SEQ ID NO: 148503 - DNA, 20 bp, Artificial sequence
  SiRNA target sequence
ctttgtcaaagttgtaaagg

SEQ ID NO: 148504 - DNA, 20 bp, Artificial sequence
  SiRNA target sequence
tttgtcaaagttgtaaaggt

SEQ ID NO: 148505 - DNA, 20 bp, Artificial sequence
  SiRNA target sequence
ttgtcaaagttgtaaaggta

SEQ ID NO: 148506 - DNA, 20 bp, Artificial sequence
  SiRNA target sequence
tgtcaaagttgtaaaggtaa

SEQ ID NO: 148507 - DNA, 20 bp, Artificial sequence
  SiRNA target sequence
gtcaaagttgtaaaggtaaa

SEQ ID NO: 148508 - DNA, 20 bp, Artificial sequence
  SiRNA target sequence
tcaaagttgtaaaggtaaac

SEQ ID NO: 148509 - DNA, 20 bp, Artificial sequence
  SiRNA target sequence
caaagttgtaaaggtaaaca

SEQ ID NO: 148510 - DNA, 20 bp, Artificial sequence
  SiRNA target sequence
aaagttgtaaaggtaaacaa

SEQ ID NO: 148511 - DNA, 20 bp, Artificial sequence
  SiRNA target sequence
aagttgtaaaggtaaacaat

SEQ ID NO: 148512 - DNA, 20 bp, Artificial sequence
  SiRNA target sequence
agttgtaaaggtaaacaata

SEQ ID NO: 148513 - DNA, 20 bp, Artificial sequence
  SiRNA target sequence
gttgtaaaggtaaacaatac

SEQ ID NO: 148514 - DNA, 20 bp, Artificial sequence
  SiRNA target sequence
ttgtaaaggtaaacaatacg

SEQ ID NO: 148515 - DNA, 20 bp, Artificial sequence
  SiRNA target sequence
tgtaaaggtaaacaatacgt

SEQ ID NO: 148516 - DNA, 20 bp, Artificial sequence
  SiRNA target sequence
gtaaaggtaaacaatacgtt

SEQ ID NO: 148517 - DNA, 20 bp, Artificial sequence
  SiRNA target sequence
taaaggtaaacaatacgttg

SEQ ID NO: 148518 - DNA, 20 bp, Artificial sequence
  SiRNA target sequence
aaaggtaaacaatacgttga

SEQ ID NO: 148519 - DNA, 20 bp, Artificial sequence
  SiRNA target sequence
aaggtaaacaatacgttgag

SEQ ID NO: 148520 - DNA, 20 bp, Artificial sequence
  SiRNA target sequence
aggtaaacaatacgttgaga

SEQ ID NO: 148521 - DNA, 20 bp, Artificial sequence
  SiRNA target sequence
ggtaaacaatacgttgagac

SEQ ID NO: 148522 - DNA, 20 bp, Artificial sequence
  SiRNA target sequence
gtaaacaatacgttgagact

SEQ ID NO: 148523 - DNA, 20 bp, Artificial sequence
  SiRNA target sequence
taaacaatacgttgagacta

SEQ ID NO: 148524 - DNA, 20 bp, Artificial sequence
  SiRNA target sequence
aaacaatacgttgagactaa

SEQ ID NO: 148525 - DNA, 20 bp, Artificial sequence
  SiRNA target sequence
aacaatacgttgagactaaa

SEQ ID NO: 148526 - DNA, 20 bp, Artificial sequence
  SiRNA target sequence
acaatacgttgagactaaag

SEQ ID NO: 148527 - DNA, 20 bp, Artificial sequence
  SiRNA target sequence
caatacgttgagactaaaga

SEQ ID NO: 148528 - DNA, 20 bp, Artificial sequence
  SiRNA target sequence
aatacgttgagactaaagaa

SEQ ID NO: 148529 - DNA, 20 bp, Artificial sequence
  SiRNA target sequence
atacgttgagactaaagaac

SEQ ID NO: 148530 - DNA, 20 bp, Artificial sequence
  SiRNA target sequence
tacgttgagactaaagaaca

SEQ ID NO: 148531 - DNA, 20 bp, Artificial sequence
  SiRNA target sequence
acgttgagactaaagaacat

SEQ ID NO: 148532 - DNA, 20 bp, Artificial sequence
  SiRNA target sequence
cgttgagactaaagaacata

SEQ ID NO: 148533 - DNA, 20 bp, Artificial sequence
  SiRNA target sequence
gttgagactaaagaacatat

SEQ ID NO: 148534 - DNA, 20 bp, Artificial sequence
  SiRNA target sequence
ttgagactaaagaacatatt

SEQ ID NO: 148535 - DNA, 20 bp, Artificial sequence
  SiRNA target sequence
tgagactaaagaacatattg

SEQ ID NO: 148536 - DNA, 20 bp, Artificial sequence
  SiRNA target sequence
gagactaaagaacatattga

SEQ ID NO: 148537 - DNA, 20 bp, Artificial sequence
  SiRNA target sequence
agactaaagaacatattgaa

SEQ ID NO: 148538 - DNA, 20 bp, Artificial sequence
  SiRNA target sequence
gactaaagaacatattgaag

SEQ ID NO: 148539 - DNA, 20 bp, Artificial sequence
  SiRNA target sequence
actaaagaacatattgaagt

SEQ ID NO: 148540 - DNA, 20 bp, Artificial sequence
  SiRNA target sequence
ctaaagaacatattgaagtg

SEQ ID NO: 148541 - DNA, 20 bp, Artificial sequence
  SiRNA target sequence
taaagaacatattgaagtgg

SEQ ID NO: 148542 - DNA, 20 bp, Artificial sequence
  SiRNA target sequence
aaagaacatattgaagtgga

SEQ ID NO: 148543 - DNA, 20 bp, Artificial sequence
  SiRNA target sequence
aagaacatattgaagtggaa

SEQ ID NO: 148544 - DNA, 20 bp, Artificial sequence
  SiRNA target sequence
agaacatattgaagtggaag

SEQ ID NO: 148545 - DNA, 20 bp, Artificial sequence
  SiRNA target sequence
gaacatattgaagtggaagt

SEQ ID NO: 148546 - DNA, 20 bp, Artificial sequence
  SiRNA target sequence
aacatattgaagtggaagta

SEQ ID NO: 148547 - DNA, 20 bp, Artificial sequence
  SiRNA target sequence
acatattgaagtggaagtag

SEQ ID NO: 148548 - DNA, 20 bp, Artificial sequence
  SiRNA target sequence
catattgaagtggaagtaga

SEQ ID NO: 148549 - DNA, 20 bp, Artificial sequence
  SiRNA target sequence
atattgaagtggaagtagag

SEQ ID NO: 148550 - DNA, 20 bp, Artificial sequence
  SiRNA target sequence
tattgaagtggaagtagagc

SEQ ID NO: 148551 - DNA, 20 bp, Artificial sequence
  SiRNA target sequence
attgaagtggaagtagagcc

SEQ ID NO: 148552 - DNA, 20 bp, Artificial sequence
  SiRNA target sequence
ttgaagtggaagtagagcca

SEQ ID NO: 148553 - DNA, 20 bp, Artificial sequence
  SiRNA target sequence
tgaagtggaagtagagccag

SEQ ID NO: 148554 - DNA, 20 bp, Artificial sequence
  SiRNA target sequence
gaagtggaagtagagccagg

SEQ ID NO: 148555 - DNA, 20 bp, Artificial sequence
  SiRNA target sequence
aagtggaagtagagccagga

SEQ ID NO: 148556 - DNA, 20 bp, Artificial sequence
  SiRNA target sequence
agtggaagtagagccaggag

SEQ ID NO: 148557 - DNA, 20 bp, Artificial sequence
  SiRNA target sequence
gtggaagtagagccaggagt

SEQ ID NO: 148558 - DNA, 20 bp, Artificial sequence
  SiRNA target sequence
tggaagtagagccaggagta

SEQ ID NO: 148559 - DNA, 20 bp, Artificial sequence
  SiRNA target sequence
ggaagtagagccaggagtac

SEQ ID NO: 148560 - DNA, 20 bp, Artificial sequence
  SiRNA target sequence
gaagtagagccaggagtaca

SEQ ID NO: 148561 - DNA, 20 bp, Artificial sequence
  SiRNA target sequence
aagtagagccaggagtacag

SEQ ID NO: 148562 - DNA, 20 bp, Artificial sequence
  SiRNA target sequence
agtagagccaggagtacaga

SEQ ID NO: 148563 - DNA, 20 bp, Artificial sequence
  SiRNA target sequence
gtagagccaggagtacagaa

SEQ ID NO: 148564 - DNA, 20 bp, Artificial sequence
  SiRNA target sequence
tagagccaggagtacagaac

SEQ ID NO: 148565 - DNA, 20 bp, Artificial sequence
  SiRNA target sequence
agagccaggagtacagaacg

SEQ ID NO: 148566 - DNA, 20 bp, Artificial sequence
  SiRNA target sequence
gagccaggagtacagaacgg

SEQ ID NO: 148567 - DNA, 20 bp, Artificial sequence
  SiRNA target sequence
agccaggagtacagaacggt

SEQ ID NO: 148568 - DNA, 20 bp, Artificial sequence
  SiRNA target sequence
gccaggagtacagaacggta

SEQ ID NO: 148569 - DNA, 20 bp, Artificial sequence
  SiRNA target sequence
ccaggagtacagaacggtag

SEQ ID NO: 148570 - DNA, 20 bp, Artificial sequence
  SiRNA target sequence
caggagtacagaacggtaga

SEQ ID NO: 148571 - DNA, 20 bp, Artificial sequence
  SiRNA target sequence
aggagtacagaacggtagaa

SEQ ID NO: 148572 - DNA, 20 bp, Artificial sequence
  SiRNA target sequence
ggagtacagaacggtagaaa

SEQ ID NO: 148573 - DNA, 20 bp, Artificial sequence
  SiRNA target sequence
gagtacagaacggtagaaaa

SEQ ID NO: 148574 - DNA, 20 bp, Artificial sequence
  SiRNA target sequence
agtacagaacggtagaaaat

SEQ ID NO: 148575 - DNA, 20 bp, Artificial sequence
  SiRNA target sequence
gtacagaacggtagaaaata

SEQ ID NO: 148576 - DNA, 20 bp, Artificial sequence
  SiRNA target sequence
tacagaacggtagaaaatat

SEQ ID NO: 148577 - DNA, 20 bp, Artificial sequence
  SiRNA target sequence
acagaacggtagaaaatata

SEQ ID NO: 148578 - DNA, 20 bp, Artificial sequence
  SiRNA target sequence
cagaacggtagaaaatatac

SEQ ID NO: 148579 - DNA, 20 bp, Artificial sequence
  SiRNA target sequence
agaacggtagaaaatataca

SEQ ID NO: 148580 - DNA, 20 bp, Artificial sequence
  SiRNA target sequence
gaacggtagaaaatatacat

SEQ ID NO: 148581 - DNA, 20 bp, Artificial sequence
  SiRNA target sequence
aacggtagaaaatatacatt

SEQ ID NO: 148582 - DNA, 20 bp, Artificial sequence
  SiRNA target sequence
acggtagaaaatatacattt

SEQ ID NO: 148583 - DNA, 20 bp, Artificial sequence
  SiRNA target sequence
cggtagaaaatatacatttt

SEQ ID NO: 148584 - DNA, 20 bp, Artificial sequence
  SiRNA target sequence
ggtagaaaatatacattttc

SEQ ID NO: 148585 - DNA, 20 bp, Artificial sequence
  SiRNA target sequence
gtagaaaatatacattttct

SEQ ID NO: 148586 - DNA, 20 bp, Artificial sequence
  SiRNA target sequence
tagaaaatatacattttctg

SEQ ID NO: 148587 - DNA, 20 bp, Artificial sequence
  SiRNA target sequence
agaaaatatacattttctgg

SEQ ID NO: 148588 - DNA, 20 bp, Artificial sequence
  SiRNA target sequence
gaaaatatacattttctggc

SEQ ID NO: 148589 - DNA, 20 bp, Artificial sequence
  SiRNA target sequence
aaaatatacattttctggca

SEQ ID NO: 148590 - DNA, 20 bp, Artificial sequence
  SiRNA target sequence
aaatatacattttctggcaa

SEQ ID NO: 148591 - DNA, 20 bp, Artificial sequence
  SiRNA target sequence
aatatacattttctggcaaa

SEQ ID NO: 148592 - DNA, 20 bp, Artificial sequence
  SiRNA target sequence
atatacattttctggcaaag

SEQ ID NO: 148593 - DNA, 20 bp, Artificial sequence
  SiRNA target sequence
tatacattttctggcaaagg

SEQ ID NO: 148594 - DNA, 20 bp, Artificial sequence
  SiRNA target sequence
atacattttctggcaaagga

SEQ ID NO: 148595 - DNA, 20 bp, Artificial sequence
  SiRNA target sequence
tacattttctggcaaaggaa

SEQ ID NO: 148596 - DNA, 20 bp, Artificial sequence
  SiRNA target sequence
acattttctggcaaaggaaa

SEQ ID NO: 148597 - DNA, 20 bp, Artificial sequence
  SiRNA target sequence
cattttctggcaaaggaaat

SEQ ID NO: 148598 - DNA, 20 bp, Artificial sequence
  SiRNA target sequence
attttctggcaaaggaaatc

SEQ ID NO: 148599 - DNA, 20 bp, Artificial sequence
  SiRNA target sequence
ttttctggcaaaggaaatca

SEQ ID NO: 148600 - DNA, 20 bp, Artificial sequence
  SiRNA target sequence
tttctggcaaaggaaatcat

SEQ ID NO: 148601 - DNA, 20 bp, Artificial sequence
  SiRNA target sequence
ttctggcaaaggaaatcata

SEQ ID NO: 148602 - DNA, 20 bp, Artificial sequence
  SiRNA target sequence
tctggcaaaggaaatcataa

SEQ ID NO: 148603 - DNA, 20 bp, Artificial sequence
  SiRNA target sequence
ctggcaaaggaaatcataaa

SEQ ID NO: 148604 - DNA, 20 bp, Artificial sequence
  SiRNA target sequence
tggcaaaggaaatcataaaa

SEQ ID NO: 148605 - DNA, 20 bp, Artificial sequence
  SiRNA target sequence
ggcaaaggaaatcataaaaa

SEQ ID NO: 148606 - DNA, 20 bp, Artificial sequence
  SiRNA target sequence
gcaaaggaaatcataaaaaa

SEQ ID NO: 148607 - DNA, 20 bp, Artificial sequence
  SiRNA target sequence
caaaggaaatcataaaaaaa

SEQ ID NO: 148608 - DNA, 20 bp, Artificial sequence
  SiRNA target sequence
aaaggaaatcataaaaaaaa

SEQ ID NO: 148609 - DNA, 20 bp, Artificial sequence
  SiRNA target sequence
aaggaaatcataaaaaaaat

SEQ ID NO: 148610 - DNA, 20 bp, Artificial sequence
  SiRNA target sequence
aggaaatcataaaaaaaatt

SEQ ID NO: 148611 - DNA, 20 bp, Artificial sequence
  SiRNA target sequence
ggaaatcataaaaaaaattg

SEQ ID NO: 148612 - DNA, 20 bp, Artificial sequence
  SiRNA target sequence
gaaatcataaaaaaaattgt

SEQ ID NO: 148613 - DNA, 20 bp, Artificial sequence
  SiRNA target sequence
aaatcataaaaaaaattgtg

SEQ ID NO: 148614 - DNA, 20 bp, Artificial sequence
  SiRNA target sequence
aatcataaaaaaaattgtgt

SEQ ID NO: 148615 - DNA, 20 bp, Artificial sequence
  SiRNA target sequence
atcataaaaaaaattgtgta

SEQ ID NO: 148616 - DNA, 20 bp, Artificial sequence
  SiRNA target sequence
tcataaaaaaaattgtgtac

SEQ ID NO: 148617 - DNA, 20 bp, Artificial sequence
  SiRNA target sequence
cataaaaaaaattgtgtacc

SEQ ID NO: 148618 - DNA, 20 bp, Artificial sequence
  SiRNA target sequence
ataaaaaaaattgtgtaccg

SEQ ID NO: 148619 - DNA, 20 bp, Artificial sequence
  SiRNA target sequence
taaaaaaaattgtgtaccgg

SEQ ID NO: 148620 - DNA, 20 bp, Artificial sequence
  SiRNA target sequence
aaaaaaaattgtgtaccggg

SEQ ID NO: 148621 - DNA, 20 bp, Artificial sequence
  SiRNA target sequence
aaaaaaattgtgtaccgggt

SEQ ID NO: 148622 - DNA, 20 bp, Artificial sequence
  SiRNA target sequence
aaaaaattgtgtaccgggtg

SEQ ID NO: 148623 - DNA, 20 bp, Artificial sequence
  SiRNA target sequence
aaaaattgtgtaccgggtga

SEQ ID NO: 148624 - DNA, 20 bp, Artificial sequence
  SiRNA target sequence
aaaattgtgtaccgggtgat

SEQ ID NO: 148625 - DNA, 20 bp, Artificial sequence
  SiRNA target sequence
aaattgtgtaccgggtgatg

SEQ ID NO: 148626 - DNA, 20 bp, Artificial sequence
  SiRNA target sequence
aattgtgtaccgggtgatgt

SEQ ID NO: 148627 - DNA, 20 bp, Artificial sequence
  SiRNA target sequence
attgtgtaccgggtgatgtg

SEQ ID NO: 148628 - DNA, 20 bp, Artificial sequence
  SiRNA target sequence
ttgtgtaccgggtgatgtga

SEQ ID NO: 148629 - DNA, 20 bp, Artificial sequence
  SiRNA target sequence
tgtgtaccgggtgatgtgat

SEQ ID NO: 148630 - DNA, 20 bp, Artificial sequence
  SiRNA target sequence
gtgtaccgggtgatgtgatt

SEQ ID NO: 148631 - DNA, 20 bp, Artificial sequence
  SiRNA target sequence
tgtaccgggtgatgtgattc

SEQ ID NO: 148632 - DNA, 20 bp, Artificial sequence
  SiRNA target sequence
gtaccgggtgatgtgattct

SEQ ID NO: 148633 - DNA, 20 bp, Artificial sequence
  SiRNA target sequence
taccgggtgatgtgattctt

SEQ ID NO: 148634 - DNA, 20 bp, Artificial sequence
  SiRNA target sequence
accgggtgatgtgattctta

SEQ ID NO: 148635 - DNA, 20 bp, Artificial sequence
  SiRNA target sequence
ccgggtgatgtgattcttat

SEQ ID NO: 148636 - DNA, 20 bp, Artificial sequence
  SiRNA target sequence
cgggtgatgtgattcttatt

SEQ ID NO: 148637 - DNA, 20 bp, Artificial sequence
  SiRNA target sequence
gggtgatgtgattcttattg

SEQ ID NO: 148638 - DNA, 20 bp, Artificial sequence
  SiRNA target sequence
ggtgatgtgattcttattgt

SEQ ID NO: 148639 - DNA, 20 bp, Artificial sequence
  SiRNA target sequence
gtgatgtgattcttattgta

SEQ ID NO: 148640 - DNA, 20 bp, Artificial sequence
  SiRNA target sequence
tgatgtgattcttattgtaa

SEQ ID NO: 148641 - DNA, 20 bp, Artificial sequence
  SiRNA target sequence
gatgtgattcttattgtaaa

SEQ ID NO: 148642 - DNA, 20 bp, Artificial sequence
  SiRNA target sequence
atgtgattcttattgtaaac

SEQ ID NO: 148643 - DNA, 20 bp, Artificial sequence
  SiRNA target sequence
tgtgattcttattgtaaaca

SEQ ID NO: 148644 - DNA, 20 bp, Artificial sequence
  SiRNA target sequence
gtgattcttattgtaaacat

SEQ ID NO: 148645 - DNA, 20 bp, Artificial sequence
  SiRNA target sequence
tgattcttattgtaaacatt

SEQ ID NO: 148646 - DNA, 20 bp, Artificial sequence
  SiRNA target sequence
gattcttattgtaaacatta

SEQ ID NO: 148647 - DNA, 20 bp, Artificial sequence
  SiRNA target sequence
attcttattgtaaacattac

SEQ ID NO: 148648 - DNA, 20 bp, Artificial sequence
  SiRNA target sequence
ttcttattgtaaacattaca

SEQ ID NO: 148649 - DNA, 20 bp, Artificial sequence
  SiRNA target sequence
tcttattgtaaacattacaa

SEQ ID NO: 148650 - DNA, 20 bp, Artificial sequence
  SiRNA target sequence
cttattgtaaacattacaaa

SEQ ID NO: 148651 - DNA, 20 bp, Artificial sequence
  SiRNA target sequence
ttattgtaaacattacaaat

SEQ ID NO: 148652 - DNA, 20 bp, Artificial sequence
  SiRNA target sequence
tattgtaaacattacaaatg

SEQ ID NO: 148653 - DNA, 20 bp, Artificial sequence
  SiRNA target sequence
attgtaaacattacaaatga

SEQ ID NO: 148654 - DNA, 20 bp, Artificial sequence
  SiRNA target sequence
ttgtaaacattacaaatgat

SEQ ID NO: 148655 - DNA, 20 bp, Artificial sequence
  SiRNA target sequence
tgtaaacattacaaatgatc

SEQ ID NO: 148656 - DNA, 20 bp, Artificial sequence
  SiRNA target sequence
gtaaacattacaaatgatcc

SEQ ID NO: 148657 - DNA, 20 bp, Artificial sequence
  SiRNA target sequence
taaacattacaaatgatcca

SEQ ID NO: 148658 - DNA, 20 bp, Artificial sequence
  SiRNA target sequence
aaacattacaaatgatccaa

SEQ ID NO: 148659 - DNA, 20 bp, Artificial sequence
  SiRNA target sequence
aacattacaaatgatccaag

SEQ ID NO: 148660 - DNA, 20 bp, Artificial sequence
  SiRNA target sequence
acattacaaatgatccaaga

SEQ ID NO: 148661 - DNA, 20 bp, Artificial sequence
  SiRNA target sequence
cattacaaatgatccaagat

SEQ ID NO: 148662 - DNA, 20 bp, Artificial sequence
  SiRNA target sequence
attacaaatgatccaagatt

SEQ ID NO: 148663 - DNA, 20 bp, Artificial sequence
  SiRNA target sequence
ttacaaatgatccaagattt

SEQ ID NO: 148664 - DNA, 20 bp, Artificial sequence
  SiRNA target sequence
tacaaatgatccaagattta

SEQ ID NO: 148665 - DNA, 20 bp, Artificial sequence
  SiRNA target sequence
acaaatgatccaagatttag

SEQ ID NO: 148666 - DNA, 20 bp, Artificial sequence
  SiRNA target sequence
caaatgatccaagatttaga

SEQ ID NO: 148667 - DNA, 20 bp, Artificial sequence
  SiRNA target sequence
aaatgatccaagatttagaa

SEQ ID NO: 148668 - DNA, 20 bp, Artificial sequence
  SiRNA target sequence
aatgatccaagatttagaaa

SEQ ID NO: 148669 - DNA, 20 bp, Artificial sequence
  SiRNA target sequence
atgatccaagatttagaaaa

SEQ ID NO: 148670 - DNA, 20 bp, Artificial sequence
  SiRNA target sequence
tgatccaagatttagaaaaa

SEQ ID NO: 148671 - DNA, 20 bp, Artificial sequence
  SiRNA target sequence
gatccaagatttagaaaaag

SEQ ID NO: 148672 - DNA, 20 bp, Artificial sequence
  SiRNA target sequence
atccaagatttagaaaaagt

SEQ ID NO: 148673 - DNA, 20 bp, Artificial sequence
  SiRNA target sequence
tccaagatttagaaaaagtg

SEQ ID NO: 148674 - DNA, 20 bp, Artificial sequence
  SiRNA target sequence
ccaagatttagaaaaagtgg

SEQ ID NO: 148675 - DNA, 20 bp, Artificial sequence
  SiRNA target sequence
caagatttagaaaaagtgga

SEQ ID NO: 148676 - DNA, 20 bp, Artificial sequence
  SiRNA target sequence
aagatttagaaaaagtggat

SEQ ID NO: 148677 - DNA, 20 bp, Artificial sequence
  SiRNA target sequence
agatttagaaaaagtggata

SEQ ID NO: 148678 - DNA, 20 bp, Artificial sequence
  SiRNA target sequence
gatttagaaaaagtggatat

SEQ ID NO: 148679 - DNA, 20 bp, Artificial sequence
  SiRNA target sequence
atttagaaaaagtggatata

SEQ ID NO: 148680 - DNA, 20 bp, Artificial sequence
  SiRNA target sequence
tttagaaaaagtggatataa

SEQ ID NO: 148681 - DNA, 20 bp, Artificial sequence
  SiRNA target sequence
ttagaaaaagtggatataat

SEQ ID NO: 148682 - DNA, 20 bp, Artificial sequence
  SiRNA target sequence
tagaaaaagtggatataatt

SEQ ID NO: 148683 - DNA, 20 bp, Artificial sequence
  SiRNA target sequence
agaaaaagtggatataattt

SEQ ID NO: 148684 - DNA, 20 bp, Artificial sequence
  SiRNA target sequence
gaaaaagtggatataattta

SEQ ID NO: 148685 - DNA, 20 bp, Artificial sequence
  SiRNA target sequence
aaaaagtggatataatttaa

SEQ ID NO: 148686 - DNA, 20 bp, Artificial sequence
  SiRNA target sequence
aaaagtggatataatttaat

SEQ ID NO: 148687 - DNA, 20 bp, Artificial sequence
  SiRNA target sequence
aaagtggatataatttaatt

SEQ ID NO: 148688 - DNA, 20 bp, Artificial sequence
  SiRNA target sequence
aagtggatataatttaatta

SEQ ID NO: 148689 - DNA, 20 bp, Artificial sequence
  SiRNA target sequence
agtggatataatttaattag

SEQ ID NO: 148690 - DNA, 20 bp, Artificial sequence
  SiRNA target sequence
gtggatataatttaattagt

SEQ ID NO: 148691 - DNA, 20 bp, Artificial sequence
  SiRNA target sequence
tggatataatttaattagta

SEQ ID NO: 148692 - DNA, 20 bp, Artificial sequence
  SiRNA target sequence
ggatataatttaattagtaa

SEQ ID NO: 148693 - DNA, 20 bp, Artificial sequence
  SiRNA target sequence
gatataatttaattagtaag

SEQ ID NO: 148694 - DNA, 20 bp, Artificial sequence
  SiRNA target sequence
atataatttaattagtaagg

SEQ ID NO: 148695 - DNA, 20 bp, Artificial sequence
  SiRNA target sequence
tataatttaattagtaaggt

SEQ ID NO: 148696 - DNA, 20 bp, Artificial sequence
  SiRNA target sequence
ataatttaattagtaaggtt

SEQ ID NO: 148697 - DNA, 20 bp, Artificial sequence
  SiRNA target sequence
taatttaattagtaaggttg

SEQ ID NO: 148698 - DNA, 20 bp, Artificial sequence
  SiRNA target sequence
aatttaattagtaaggttga

SEQ ID NO: 148699 - DNA, 20 bp, Artificial sequence
  SiRNA target sequence
atttaattagtaaggttgat

SEQ ID NO: 148700 - DNA, 20 bp, Artificial sequence
  SiRNA target sequence
tttaattagtaaggttgata

SEQ ID NO: 148701 - DNA, 20 bp, Artificial sequence
  SiRNA target sequence
ttaattagtaaggttgatat

SEQ ID NO: 148702 - DNA, 20 bp, Artificial sequence
  SiRNA target sequence
taattagtaaggttgatatt

SEQ ID NO: 148703 - DNA, 20 bp, Artificial sequence
  SiRNA target sequence
aattagtaaggttgatattc

SEQ ID NO: 148704 - DNA, 20 bp, Artificial sequence
  SiRNA target sequence
attagtaaggttgatattcc

SEQ ID NO: 148705 - DNA, 20 bp, Artificial sequence
  SiRNA target sequence
ttagtaaggttgatattcca

SEQ ID NO: 148706 - DNA, 20 bp, Artificial sequence
  SiRNA target sequence
tagtaaggttgatattccat

SEQ ID NO: 148707 - DNA, 20 bp, Artificial sequence
  SiRNA target sequence
agtaaggttgatattccatt

SEQ ID NO: 148708 - DNA, 20 bp, Artificial sequence
  SiRNA target sequence
gtaaggttgatattccattg

SEQ ID NO: 148709 - DNA, 20 bp, Artificial sequence
  SiRNA target sequence
taaggttgatattccattgt

SEQ ID NO: 148710 - DNA, 20 bp, Artificial sequence
  SiRNA target sequence
aaggttgatattccattgta

SEQ ID NO: 148711 - DNA, 20 bp, Artificial sequence
  SiRNA target sequence
aggttgatattccattgtat

SEQ ID NO: 148712 - DNA, 20 bp, Artificial sequence
  SiRNA target sequence
ggttgatattccattgtatg

SEQ ID NO: 148713 - DNA, 20 bp, Artificial sequence
  SiRNA target sequence
gttgatattccattgtatgt

SEQ ID NO: 148714 - DNA, 20 bp, Artificial sequence
  SiRNA target sequence
ttgatattccattgtatgtt

SEQ ID NO: 148715 - DNA, 20 bp, Artificial sequence
  SiRNA target sequence
tgatattccattgtatgttg

SEQ ID NO: 148716 - DNA, 20 bp, Artificial sequence
  SiRNA target sequence
gatattccattgtatgttgc

SEQ ID NO: 148717 - DNA, 20 bp, Artificial sequence
  SiRNA target sequence
atattccattgtatgttgct

SEQ ID NO: 148718 - DNA, 20 bp, Artificial sequence
  SiRNA target sequence
tattccattgtatgttgctt

SEQ ID NO: 148719 - DNA, 20 bp, Artificial sequence
  SiRNA target sequence
attccattgtatgttgcttt

SEQ ID NO: 148720 - DNA, 20 bp, Artificial sequence
  SiRNA target sequence
ttccattgtatgttgctttg

SEQ ID NO: 148721 - DNA, 20 bp, Artificial sequence
  SiRNA target sequence
tccattgtatgttgctttgg

SEQ ID NO: 148722 - DNA, 20 bp, Artificial sequence
  SiRNA target sequence
ccattgtatgttgctttggc

SEQ ID NO: 148723 - DNA, 20 bp, Artificial sequence
  SiRNA target sequence
cattgtatgttgctttggca

SEQ ID NO: 148724 - DNA, 20 bp, Artificial sequence
  SiRNA target sequence
attgtatgttgctttggcag

SEQ ID NO: 148725 - DNA, 20 bp, Artificial sequence
  SiRNA target sequence
ttgtatgttgctttggcagg

SEQ ID NO: 148726 - DNA, 20 bp, Artificial sequence
  SiRNA target sequence
tgtatgttgctttggcaggc

SEQ ID NO: 148727 - DNA, 20 bp, Artificial sequence
  SiRNA target sequence
gtatgttgctttggcaggcg

SEQ ID NO: 148728 - DNA, 20 bp, Artificial sequence
  SiRNA target sequence
tatgttgctttggcaggcgg

SEQ ID NO: 148729 - DNA, 20 bp, Artificial sequence
  SiRNA target sequence
atgttgctttggcaggcgga

SEQ ID NO: 148730 - DNA, 20 bp, Artificial sequence
  SiRNA target sequence
tgttgctttggcaggcggac

SEQ ID NO: 148731 - DNA, 20 bp, Artificial sequence
  SiRNA target sequence
gttgctttggcaggcggaca

SEQ ID NO: 148732 - DNA, 20 bp, Artificial sequence
  SiRNA target sequence
ttgctttggcaggcggacag

SEQ ID NO: 148733 - DNA, 20 bp, Artificial sequence
  SiRNA target sequence
tgctttggcaggcggacaga

SEQ ID NO: 148734 - DNA, 20 bp, Artificial sequence
  SiRNA target sequence
gctttggcaggcggacagat

SEQ ID NO: 148735 - DNA, 20 bp, Artificial sequence
  SiRNA target sequence
ctttggcaggcggacagatt

SEQ ID NO: 148736 - DNA, 20 bp, Artificial sequence
  SiRNA target sequence
tttggcaggcggacagatta

SEQ ID NO: 148737 - DNA, 20 bp, Artificial sequence
  SiRNA target sequence
ttggcaggcggacagattat

SEQ ID NO: 148738 - DNA, 20 bp, Artificial sequence
  SiRNA target sequence
tggcaggcggacagattata

SEQ ID NO: 148739 - DNA, 20 bp, Artificial sequence
  SiRNA target sequence
ggcaggcggacagattatat

SEQ ID NO: 148740 - DNA, 20 bp, Artificial sequence
  SiRNA target sequence
gcaggcggacagattatatt

SEQ ID NO: 148741 - DNA, 20 bp, Artificial sequence
  SiRNA target sequence
caggcggacagattatattt

SEQ ID NO: 148742 - DNA, 20 bp, Artificial sequence
  SiRNA target sequence
aggcggacagattatatttg

SEQ ID NO: 148743 - DNA, 20 bp, Artificial sequence
  SiRNA target sequence
ggcggacagattatatttga

SEQ ID NO: 148744 - DNA, 20 bp, Artificial sequence
  SiRNA target sequence
gcggacagattatatttgaa

SEQ ID NO: 148745 - DNA, 20 bp, Artificial sequence
  SiRNA target sequence
cggacagattatatttgaac

SEQ ID NO: 148746 - DNA, 20 bp, Artificial sequence
  SiRNA target sequence
ggacagattatatttgaaca

SEQ ID NO: 148747 - DNA, 20 bp, Artificial sequence
  SiRNA target sequence
gacagattatatttgaacat

SEQ ID NO: 148748 - DNA, 20 bp, Artificial sequence
  SiRNA target sequence
acagattatatttgaacata

SEQ ID NO: 148749 - DNA, 20 bp, Artificial sequence
  SiRNA target sequence
cagattatatttgaacatat

SEQ ID NO: 148750 - DNA, 20 bp, Artificial sequence
  SiRNA target sequence
agattatatttgaacatatc

SEQ ID NO: 148751 - DNA, 20 bp, Artificial sequence
  SiRNA target sequence
gattatatttgaacatatca

SEQ ID NO: 148752 - DNA, 20 bp, Artificial sequence
  SiRNA target sequence
attatatttgaacatatcac

SEQ ID NO: 148753 - DNA, 20 bp, Artificial sequence
  SiRNA target sequence
ttatatttgaacatatcact

SEQ ID NO: 148754 - DNA, 20 bp, Artificial sequence
  SiRNA target sequence
tatatttgaacatatcactg

SEQ ID NO: 148755 - DNA, 20 bp, Artificial sequence
  SiRNA target sequence
atatttgaacatatcactgg

SEQ ID NO: 148756 - DNA, 20 bp, Artificial sequence
  SiRNA target sequence
tatttgaacatatcactggt

SEQ ID NO: 148757 - DNA, 20 bp, Artificial sequence
  SiRNA target sequence
atttgaacatatcactggta

SEQ ID NO: 148758 - DNA, 20 bp, Artificial sequence
  SiRNA target sequence
tttgaacatatcactggtaa

SEQ ID NO: 148759 - DNA, 20 bp, Artificial sequence
  SiRNA target sequence
ttgaacatatcactggtaag

SEQ ID NO: 148760 - DNA, 20 bp, Artificial sequence
  SiRNA target sequence
tgaacatatcactggtaaga

SEQ ID NO: 148761 - DNA, 20 bp, Artificial sequence
  SiRNA target sequence
gaacatatcactggtaagaa

SEQ ID NO: 148762 - DNA, 20 bp, Artificial sequence
  SiRNA target sequence
aacatatcactggtaagaaa

SEQ ID NO: 148763 - DNA, 20 bp, Artificial sequence
  SiRNA target sequence
acatatcactggtaagaaat

SEQ ID NO: 148764 - DNA, 20 bp, Artificial sequence
  SiRNA target sequence
catatcactggtaagaaatt

SEQ ID NO: 148765 - DNA, 20 bp, Artificial sequence
  SiRNA target sequence
atatcactggtaagaaattt

SEQ ID NO: 148766 - DNA, 20 bp, Artificial sequence
  SiRNA target sequence
tatcactggtaagaaatttg

SEQ ID NO: 148767 - DNA, 20 bp, Artificial sequence
  SiRNA target sequence
atcactggtaagaaatttga

SEQ ID NO: 148768 - DNA, 20 bp, Artificial sequence
  SiRNA target sequence
tcactggtaagaaatttgaa

SEQ ID NO: 148769 - DNA, 20 bp, Artificial sequence
  SiRNA target sequence
cactggtaagaaatttgaaa

SEQ ID NO: 148770 - DNA, 20 bp, Artificial sequence
  SiRNA target sequence
actggtaagaaatttgaaat

SEQ ID NO: 148771 - DNA, 20 bp, Artificial sequence
  SiRNA target sequence
ctggtaagaaatttgaaatt

SEQ ID NO: 148772 - DNA, 20 bp, Artificial sequence
  SiRNA target sequence
tggtaagaaatttgaaatta

SEQ ID NO: 148773 - DNA, 20 bp, Artificial sequence
  SiRNA target sequence
ggtaagaaatttgaaattac

SEQ ID NO: 148774 - DNA, 20 bp, Artificial sequence
  SiRNA target sequence
gtaagaaatttgaaattact

SEQ ID NO: 148775 - DNA, 20 bp, Artificial sequence
  SiRNA target sequence
taagaaatttgaaattactt

SEQ ID NO: 148776 - DNA, 20 bp, Artificial sequence
  SiRNA target sequence
aagaaatttgaaattacttt

SEQ ID NO: 148777 - DNA, 20 bp, Artificial sequence
  SiRNA target sequence
agaaatttgaaattacttta

SEQ ID NO: 148778 - DNA, 20 bp, Artificial sequence
  SiRNA target sequence
gaaatttgaaattactttat

SEQ ID NO: 148779 - DNA, 20 bp, Artificial sequence
  SiRNA target sequence
aaatttgaaattactttata

SEQ ID NO: 148780 - DNA, 20 bp, Artificial sequence
  SiRNA target sequence
aatttgaaattactttatat

SEQ ID NO: 148781 - DNA, 20 bp, Artificial sequence
  SiRNA target sequence
atttgaaattactttatatc

SEQ ID NO: 148782 - DNA, 20 bp, Artificial sequence
  SiRNA target sequence
tttgaaattactttatatcc

SEQ ID NO: 148783 - DNA, 20 bp, Artificial sequence
  SiRNA target sequence
ttgaaattactttatatcca

SEQ ID NO: 148784 - DNA, 20 bp, Artificial sequence
  SiRNA target sequence
tgaaattactttatatccat

SEQ ID NO: 148785 - DNA, 20 bp, Artificial sequence
  SiRNA target sequence
gaaattactttatatccatt

SEQ ID NO: 148786 - DNA, 20 bp, Artificial sequence
  SiRNA target sequence
aaattactttatatccattt

SEQ ID NO: 148787 - DNA, 20 bp, Artificial sequence
  SiRNA target sequence
aattactttatatccattta

SEQ ID NO: 148788 - DNA, 20 bp, Artificial sequence
  SiRNA target sequence
attactttatatccatttaa

SEQ ID NO: 148789 - DNA, 20 bp, Artificial sequence
  SiRNA target sequence
ttactttatatccatttaaa

SEQ ID NO: 148790 - DNA, 20 bp, Artificial sequence
  SiRNA target sequence
tactttatatccatttaaag

SEQ ID NO: 148791 - DNA, 20 bp, Artificial sequence
  SiRNA target sequence
actttatatccatttaaaga

SEQ ID NO: 148792 - DNA, 20 bp, Artificial sequence
  SiRNA target sequence
ctttatatccatttaaagat

SEQ ID NO: 148793 - DNA, 20 bp, Artificial sequence
  SiRNA target sequence
tttatatccatttaaagatt

SEQ ID NO: 148794 - DNA, 20 bp, Artificial sequence
  SiRNA target sequence
ttatatccatttaaagattt

SEQ ID NO: 148795 - DNA, 20 bp, Artificial sequence
  SiRNA target sequence
tatatccatttaaagattta

SEQ ID NO: 148796 - DNA, 20 bp, Artificial sequence
  SiRNA target sequence
atatccatttaaagatttaa

SEQ ID NO: 148797 - DNA, 20 bp, Artificial sequence
  SiRNA target sequence
tatccatttaaagatttaaa

SEQ ID NO: 148798 - DNA, 20 bp, Artificial sequence
  SiRNA target sequence
atccatttaaagatttaaag

SEQ ID NO: 148799 - DNA, 20 bp, Artificial sequence
  SiRNA target sequence
tccatttaaagatttaaaga

SEQ ID NO: 148800 - DNA, 20 bp, Artificial sequence
  SiRNA target sequence
ccatttaaagatttaaagaa

SEQ ID NO: 148801 - DNA, 20 bp, Artificial sequence
  SiRNA target sequence
catttaaagatttaaagaaa

SEQ ID NO: 148802 - DNA, 20 bp, Artificial sequence
  SiRNA target sequence
atttaaagatttaaagaaat

SEQ ID NO: 148803 - DNA, 20 bp, Artificial sequence
  SiRNA target sequence
tttaaagatttaaagaaatg

SEQ ID NO: 148804 - DNA, 20 bp, Artificial sequence
  SiRNA target sequence
ttaaagatttaaagaaatgt

SEQ ID NO: 148805 - DNA, 20 bp, Artificial sequence
  SiRNA target sequence
taaagatttaaagaaatgta

SEQ ID NO: 148806 - DNA, 20 bp, Artificial sequence
  SiRNA target sequence
aaagatttaaagaaatgtat

SEQ ID NO: 148807 - DNA, 20 bp, Artificial sequence
  SiRNA target sequence
aagatttaaagaaatgtatt

SEQ ID NO: 148808 - DNA, 20 bp, Artificial sequence
  SiRNA target sequence
agatttaaagaaatgtatta

SEQ ID NO: 148809 - DNA, 20 bp, Artificial sequence
  SiRNA target sequence
gatttaaagaaatgtattat

SEQ ID NO: 148810 - DNA, 20 bp, Artificial sequence
  SiRNA target sequence
atttaaagaaatgtattatt

SEQ ID NO: 148811 - DNA, 20 bp, Artificial sequence
  SiRNA target sequence
tttaaagaaatgtattattt

SEQ ID NO: 148812 - DNA, 20 bp, Artificial sequence
  SiRNA target sequence
ttaaagaaatgtattatttt

SEQ ID NO: 148813 - DNA, 20 bp, Artificial sequence
  SiRNA target sequence
taaagaaatgtattatttta

SEQ ID NO: 148814 - DNA, 20 bp, Artificial sequence
  SiRNA target sequence
aaagaaatgtattattttaa

SEQ ID NO: 148815 - DNA, 20 bp, Artificial sequence
  SiRNA target sequence
aagaaatgtattattttaaa

SEQ ID NO: 148816 - DNA, 20 bp, Artificial sequence
  SiRNA target sequence
agaaatgtattattttaaaa

SEQ ID NO: 148817 - DNA, 20 bp, Artificial sequence
  SiRNA target sequence
gaaatgtattattttaaaag

SEQ ID NO: 148818 - DNA, 20 bp, Artificial sequence
  SiRNA target sequence
aaatgtattattttaaaagg

SEQ ID NO: 148819 - DNA, 20 bp, Artificial sequence
  SiRNA target sequence
aatgtattattttaaaaggc

SEQ ID NO: 148820 - DNA, 20 bp, Artificial sequence
  SiRNA target sequence
atgtattattttaaaaggcg

SEQ ID NO: 148821 - DNA, 20 bp, Artificial sequence
  SiRNA target sequence
tgtattattttaaaaggcga

SEQ ID NO: 148822 - DNA, 20 bp, Artificial sequence
  SiRNA target sequence
gtattattttaaaaggcgaa

SEQ ID NO: 148823 - DNA, 20 bp, Artificial sequence
  SiRNA target sequence
tattattttaaaaggcgaag

SEQ ID NO: 148824 - DNA, 20 bp, Artificial sequence
  SiRNA target sequence
attattttaaaaggcgaagg

SEQ ID NO: 148825 - DNA, 20 bp, Artificial sequence
  SiRNA target sequence
ttattttaaaaggcgaaggt

SEQ ID NO: 148826 - DNA, 20 bp, Artificial sequence
  SiRNA target sequence
tattttaaaaggcgaaggtt

SEQ ID NO: 148827 - DNA, 20 bp, Artificial sequence
  SiRNA target sequence
attttaaaaggcgaaggttt

SEQ ID NO: 148828 - DNA, 20 bp, Artificial sequence
  SiRNA target sequence
ttttaaaaggcgaaggtttt

SEQ ID NO: 148829 - DNA, 20 bp, Artificial sequence
  SiRNA target sequence
tttaaaaggcgaaggtttta

SEQ ID NO: 148830 - DNA, 20 bp, Artificial sequence
  SiRNA target sequence
ttaaaaggcgaaggttttaa

SEQ ID NO: 148831 - DNA, 20 bp, Artificial sequence
  SiRNA target sequence
taaaaggcgaaggttttaaa

SEQ ID NO: 148832 - DNA, 20 bp, Artificial sequence
  SiRNA target sequence
aaaaggcgaaggttttaaaa

SEQ ID NO: 148833 - DNA, 20 bp, Artificial sequence
  SiRNA target sequence
aaaggcgaaggttttaaaat

SEQ ID NO: 148834 - DNA, 20 bp, Artificial sequence
  SiRNA target sequence
aaggcgaaggttttaaaata

SEQ ID NO: 148835 - DNA, 20 bp, Artificial sequence
  SiRNA target sequence
aggcgaaggttttaaaataa

SEQ ID NO: 148836 - DNA, 20 bp, Artificial sequence
  SiRNA target sequence
ggcgaaggttttaaaataaa

SEQ ID NO: 148837 - DNA, 20 bp, Artificial sequence
  SiRNA target sequence
gcgaaggttttaaaataaaa

SEQ ID NO: 148838 - DNA, 20 bp, Artificial sequence
  SiRNA target sequence
cgaaggttttaaaataaaaa

SEQ ID NO: 148839 - DNA, 20 bp, Artificial sequence
  SiRNA target sequence
gaaggttttaaaataaaaaa

SEQ ID NO: 148840 - DNA, 20 bp, Artificial sequence
  SiRNA target sequence
aaggttttaaaataaaaaat

SEQ ID NO: 148841 - DNA, 20 bp, Artificial sequence
  SiRNA target sequence
aggttttaaaataaaaaata

SEQ ID NO: 148842 - DNA, 20 bp, Artificial sequence
  SiRNA target sequence
ggttttaaaataaaaaatag

SEQ ID NO: 148843 - DNA, 20 bp, Artificial sequence
  SiRNA target sequence
gttttaaaataaaaaatagt

SEQ ID NO: 148844 - DNA, 20 bp, Artificial sequence
  SiRNA target sequence
ttttaaaataaaaaatagtt

SEQ ID NO: 148845 - DNA, 20 bp, Artificial sequence
  SiRNA target sequence
tttaaaataaaaaatagtta

SEQ ID NO: 148846 - DNA, 20 bp, Artificial sequence
  SiRNA target sequence
ttaaaataaaaaatagttat

SEQ ID NO: 148847 - DNA, 20 bp, Artificial sequence
  SiRNA target sequence
taaaataaaaaatagttatt

SEQ ID NO: 148848 - DNA, 20 bp, Artificial sequence
  SiRNA target sequence
aaaataaaaaatagttattc

SEQ ID NO: 148849 - DNA, 20 bp, Artificial sequence
  SiRNA target sequence
aaataaaaaatagttattcg

SEQ ID NO: 148850 - DNA, 20 bp, Artificial sequence
  SiRNA target sequence
aataaaaaatagttattcgg

SEQ ID NO: 148851 - DNA, 20 bp, Artificial sequence
  SiRNA target sequence
ataaaaaatagttattcggg

SEQ ID NO: 148852 - DNA, 20 bp, Artificial sequence
  SiRNA target sequence
taaaaaatagttattcgggt

SEQ ID NO: 148853 - DNA, 20 bp, Artificial sequence
  SiRNA target sequence
aaaaaatagttattcgggtg

SEQ ID NO: 148854 - DNA, 20 bp, Artificial sequence
  SiRNA target sequence
aaaaatagttattcgggtgg

SEQ ID NO: 148855 - DNA, 20 bp, Artificial sequence
  SiRNA target sequence
aaaatagttattcgggtggt

SEQ ID NO: 148856 - DNA, 20 bp, Artificial sequence
  SiRNA target sequence
aaatagttattcgggtggtg

SEQ ID NO: 148857 - DNA, 20 bp, Artificial sequence
  SiRNA target sequence
aatagttattcgggtggtga

SEQ ID NO: 148858 - DNA, 20 bp, Artificial sequence
  SiRNA target sequence
atagttattcgggtggtgat

SEQ ID NO: 148859 - DNA, 20 bp, Artificial sequence
  SiRNA target sequence
tagttattcgggtggtgatc

SEQ ID NO: 148860 - DNA, 20 bp, Artificial sequence
  SiRNA target sequence
agttattcgggtggtgatct

SEQ ID NO: 148861 - DNA, 20 bp, Artificial sequence
  SiRNA target sequence
gttattcgggtggtgatctt

SEQ ID NO: 148862 - DNA, 20 bp, Artificial sequence
  SiRNA target sequence
ttattcgggtggtgatctta

SEQ ID NO: 148863 - DNA, 20 bp, Artificial sequence
  SiRNA target sequence
tattcgggtggtgatcttat

SEQ ID NO: 148864 - DNA, 20 bp, Artificial sequence
  SiRNA target sequence
attcgggtggtgatcttatt

SEQ ID NO: 148865 - DNA, 20 bp, Artificial sequence
  SiRNA target sequence
ttcgggtggtgatcttattc

SEQ ID NO: 148866 - DNA, 20 bp, Artificial sequence
  SiRNA target sequence
tcgggtggtgatcttattct

SEQ ID NO: 148867 - DNA, 20 bp, Artificial sequence
  SiRNA target sequence
cgggtggtgatcttattctc

SEQ ID NO: 148868 - DNA, 20 bp, Artificial sequence
  SiRNA target sequence
gggtggtgatcttattctcg

SEQ ID NO: 148869 - DNA, 20 bp, Artificial sequence
  SiRNA target sequence
ggtggtgatcttattctcga

SEQ ID NO: 148870 - DNA, 20 bp, Artificial sequence
  SiRNA target sequence
gtggtgatcttattctcgaa

SEQ ID NO: 148871 - DNA, 20 bp, Artificial sequence
  SiRNA target sequence
tggtgatcttattctcgaac

SEQ ID NO: 148872 - DNA, 20 bp, Artificial sequence
  SiRNA target sequence
ggtgatcttattctcgaacc

SEQ ID NO: 148873 - DNA, 20 bp, Artificial sequence
  SiRNA target sequence
gtgatcttattctcgaacct

SEQ ID NO: 148874 - DNA, 20 bp, Artificial sequence
  SiRNA target sequence
tgatcttattctcgaaccta

SEQ ID NO: 148875 - DNA, 20 bp, Artificial sequence
  SiRNA target sequence
gatcttattctcgaacctaa

SEQ ID NO: 148876 - DNA, 20 bp, Artificial sequence
  SiRNA target sequence
atcttattctcgaacctaat

SEQ ID NO: 148877 - DNA, 20 bp, Artificial sequence
  SiRNA target sequence
tcttattctcgaacctaata

SEQ ID NO: 148878 - DNA, 20 bp, Artificial sequence
  SiRNA target sequence
cttattctcgaacctaatat

SEQ ID NO: 148879 - DNA, 20 bp, Artificial sequence
  SiRNA target sequence
ttattctcgaacctaatata

SEQ ID NO: 148880 - DNA, 20 bp, Artificial sequence
  SiRNA target sequence
tattctcgaacctaatataa

SEQ ID NO: 148881 - DNA, 20 bp, Artificial sequence
  SiRNA target sequence
attctcgaacctaatataat

SEQ ID NO: 148882 - DNA, 20 bp, Artificial sequence
  SiRNA target sequence
ttctcgaacctaatataatt

SEQ ID NO: 148883 - DNA, 20 bp, Artificial sequence
  SiRNA target sequence
tctcgaacctaatataatta

SEQ ID NO: 148884 - DNA, 20 bp, Artificial sequence
  SiRNA target sequence
ctcgaacctaatataattat

SEQ ID NO: 148885 - DNA, 20 bp, Artificial sequence
  SiRNA target sequence
tcgaacctaatataattata

SEQ ID NO: 148886 - DNA, 20 bp, Artificial sequence
  SiRNA target sequence
cgaacctaatataattatag

SEQ ID NO: 148887 - DNA, 20 bp, Artificial sequence
  SiRNA target sequence
gaacctaatataattataga

SEQ ID NO: 148888 - DNA, 20 bp, Artificial sequence
  SiRNA target sequence
aacctaatataattatagat

SEQ ID NO: 148889 - DNA, 20 bp, Artificial sequence
  SiRNA target sequence
acctaatataattatagata

SEQ ID NO: 148890 - DNA, 20 bp, Artificial sequence
  SiRNA target sequence
cctaatataattatagataa

SEQ ID NO: 148891 - DNA, 20 bp, Artificial sequence
  SiRNA target sequence
ctaatataattatagataag

SEQ ID NO: 148892 - DNA, 20 bp, Artificial sequence
  SiRNA target sequence
taatataattatagataaga

SEQ ID NO: 148893 - DNA, 20 bp, Artificial sequence
  SiRNA target sequence
aatataattatagataagaa

SEQ ID NO: 148894 - DNA, 20 bp, Artificial sequence
  SiRNA target sequence
atataattatagataagaat

SEQ ID NO: 148895 - DNA, 20 bp, Artificial sequence
  SiRNA target sequence
tataattatagataagaata

SEQ ID NO: 148896 - DNA, 20 bp, Artificial sequence
  SiRNA target sequence
ataattatagataagaatat

SEQ ID NO: 148897 - DNA, 20 bp, Artificial sequence
  SiRNA target sequence
taattatagataagaatatt

SEQ ID NO: 148898 - DNA, 20 bp, Artificial sequence
  SiRNA target sequence
aattatagataagaatattg

SEQ ID NO: 148899 - DNA, 20 bp, Artificial sequence
  SiRNA target sequence
attatagataagaatattga

SEQ ID NO: 148900 - DNA, 20 bp, Artificial sequence
  SiRNA target sequence
ttatagataagaatattgat

SEQ ID NO: 148901 - DNA, 20 bp, Artificial sequence
  SiRNA target sequence
tatagataagaatattgata

SEQ ID NO: 148902 - DNA, 20 bp, Artificial sequence
  SiRNA target sequence
atagataagaatattgataa

SEQ ID NO: 148903 - DNA, 20 bp, Artificial sequence
  SiRNA target sequence
tagataagaatattgataaa

SEQ ID NO: 148904 - DNA, 20 bp, Artificial sequence
  SiRNA target sequence
agataagaatattgataaag

SEQ ID NO: 148905 - DNA, 20 bp, Artificial sequence
  SiRNA target sequence
gataagaatattgataaaga

SEQ ID NO: 148906 - DNA, 20 bp, Artificial sequence
  SiRNA target sequence
ataagaatattgataaagat

SEQ ID NO: 148907 - DNA, 20 bp, Artificial sequence
  SiRNA target sequence
taagaatattgataaagatt

SEQ ID NO: 148908 - DNA, 20 bp, Artificial sequence
  SiRNA target sequence
aagaatattgataaagattt

SEQ ID NO: 148909 - DNA, 20 bp, Artificial sequence
  SiRNA target sequence
agaatattgataaagattta

SEQ ID NO: 148910 - DNA, 20 bp, Artificial sequence
  SiRNA target sequence
gaatattgataaagatttat

SEQ ID NO: 148911 - DNA, 20 bp, Artificial sequence
  SiRNA target sequence
aatattgataaagatttatt

SEQ ID NO: 148912 - DNA, 20 bp, Artificial sequence
  SiRNA target sequence
atattgataaagatttatta

SEQ ID NO: 148913 - DNA, 20 bp, Artificial sequence
  SiRNA target sequence
tattgataaagatttattag

SEQ ID NO: 148914 - DNA, 20 bp, Artificial sequence
  SiRNA target sequence
attgataaagatttattagc

SEQ ID NO: 148915 - DNA, 20 bp, Artificial sequence
  SiRNA target sequence
ttgataaagatttattagca

SEQ ID NO: 148916 - DNA, 20 bp, Artificial sequence
  SiRNA target sequence
tgataaagatttattagcac

SEQ ID NO: 148917 - DNA, 20 bp, Artificial sequence
  SiRNA target sequence
gataaagatttattagcacg

SEQ ID NO: 148918 - DNA, 20 bp, Artificial sequence
  SiRNA target sequence
ataaagatttattagcacgc

SEQ ID NO: 148919 - DNA, 20 bp, Artificial sequence
  SiRNA target sequence
taaagatttattagcacgcg

SEQ ID NO: 148920 - DNA, 20 bp, Artificial sequence
  SiRNA target sequence
aaagatttattagcacgcgc

SEQ ID NO: 148921 - DNA, 20 bp, Artificial sequence
  SiRNA target sequence
aagatttattagcacgcgcc

SEQ ID NO: 148922 - DNA, 20 bp, Artificial sequence
  SiRNA target sequence
agatttattagcacgcgcct

SEQ ID NO: 148923 - DNA, 20 bp, Artificial sequence
  SiRNA target sequence
gatttattagcacgcgcctt

SEQ ID NO: 148924 - DNA, 20 bp, Artificial sequence
  SiRNA target sequence
atttattagcacgcgccttg

SEQ ID NO: 148925 - DNA, 20 bp, Artificial sequence
  SiRNA target sequence
tttattagcacgcgccttga

SEQ ID NO: 148926 - DNA, 20 bp, Artificial sequence
  SiRNA target sequence
ttattagcacgcgccttgaa

SEQ ID NO: 148927 - DNA, 20 bp, Artificial sequence
  SiRNA target sequence
tattagcacgcgccttgaat

SEQ ID NO: 148928 - DNA, 20 bp, Artificial sequence
  SiRNA target sequence
attagcacgcgccttgaatt

SEQ ID NO: 148929 - DNA, 20 bp, Artificial sequence
  SiRNA target sequence
ttagcacgcgccttgaatta

SEQ ID NO: 148930 - DNA, 20 bp, Artificial sequence
  SiRNA target sequence
tagcacgcgccttgaattat

SEQ ID NO: 148931 - DNA, 20 bp, Artificial sequence
  SiRNA target sequence
agcacgcgccttgaattatg

SEQ ID NO: 148932 - DNA, 20 bp, Artificial sequence
  SiRNA target sequence
gcacgcgccttgaattatgt

SEQ ID NO: 148933 - DNA, 20 bp, Artificial sequence
  SiRNA target sequence
cacgcgccttgaattatgtt

SEQ ID NO: 148934 - DNA, 20 bp, Artificial sequence
  SiRNA target sequence
acgcgccttgaattatgttc

SEQ ID NO: 148935 - DNA, 20 bp, Artificial sequence
  SiRNA target sequence
cgcgccttgaattatgttcc

SEQ ID NO: 148936 - DNA, 20 bp, Artificial sequence
  SiRNA target sequence
gcgccttgaattatgttcct

SEQ ID NO: 148937 - DNA, 20 bp, Artificial sequence
  SiRNA target sequence
cgccttgaattatgttcctg

SEQ ID NO: 148938 - DNA, 20 bp, Artificial sequence
  SiRNA target sequence
gccttgaattatgttcctgt

SEQ ID NO: 148939 - DNA, 20 bp, Artificial sequence
  SiRNA target sequence
ccttgaattatgttcctgta

SEQ ID NO: 148940 - DNA, 20 bp, Artificial sequence
  SiRNA target sequence
cttgaattatgttcctgtaa

SEQ ID NO: 148941 - DNA, 20 bp, Artificial sequence
  SiRNA target sequence
ttgaattatgttcctgtaag

SEQ ID NO: 148942 - DNA, 20 bp, Artificial sequence
  SiRNA target sequence
tgaattatgttcctgtaaga

SEQ ID NO: 148943 - DNA, 20 bp, Artificial sequence
  SiRNA target sequence
gaattatgttcctgtaagaa

SEQ ID NO: 148944 - DNA, 20 bp, Artificial sequence
  SiRNA target sequence
aattatgttcctgtaagaaa

SEQ ID NO: 148945 - DNA, 20 bp, Artificial sequence
  SiRNA target sequence
attatgttcctgtaagaaaa

SEQ ID NO: 148946 - DNA, 20 bp, Artificial sequence
  SiRNA target sequence
ttatgttcctgtaagaaaag

SEQ ID NO: 148947 - DNA, 20 bp, Artificial sequence
  SiRNA target sequence
tatgttcctgtaagaaaaga

SEQ ID NO: 148948 - DNA, 20 bp, Artificial sequence
  SiRNA target sequence
atgttcctgtaagaaaagat

SEQ ID NO: 148949 - DNA, 20 bp, Artificial sequence
  SiRNA target sequence
tgttcctgtaagaaaagatt

SEQ ID NO: 148950 - DNA, 20 bp, Artificial sequence
  SiRNA target sequence
gttcctgtaagaaaagattt

SEQ ID NO: 148951 - DNA, 20 bp, Artificial sequence
  SiRNA target sequence
ttcctgtaagaaaagatttt

SEQ ID NO: 148952 - DNA, 20 bp, Artificial sequence
  SiRNA target sequence
tcctgtaagaaaagatttta

SEQ ID NO: 148953 - DNA, 20 bp, Artificial sequence
  SiRNA target sequence
cctgtaagaaaagattttac

SEQ ID NO: 148954 - DNA, 20 bp, Artificial sequence
  SiRNA target sequence
ctgtaagaaaagattttaca

SEQ ID NO: 148955 - DNA, 20 bp, Artificial sequence
  SiRNA target sequence
tgtaagaaaagattttacag

SEQ ID NO: 148956 - DNA, 20 bp, Artificial sequence
  SiRNA target sequence
gtaagaaaagattttacagg

SEQ ID NO: 148957 - DNA, 20 bp, Artificial sequence
  SiRNA target sequence
taagaaaagattttacagga

SEQ ID NO: 148958 - DNA, 20 bp, Artificial sequence
  SiRNA target sequence
aagaaaagattttacaggaa

SEQ ID NO: 148959 - DNA, 20 bp, Artificial sequence
  SiRNA target sequence
agaaaagattttacaggaac

SEQ ID NO: 148960 - DNA, 20 bp, Artificial sequence
  SiRNA target sequence
gaaaagattttacaggaact

SEQ ID NO: 148961 - DNA, 20 bp, Artificial sequence
  SiRNA target sequence
aaaagattttacaggaactg

SEQ ID NO: 148962 - DNA, 20 bp, Artificial sequence
  SiRNA target sequence
aaagattttacaggaactgc

SEQ ID NO: 148963 - DNA, 20 bp, Artificial sequence
  SiRNA target sequence
aagattttacaggaactgct

SEQ ID NO: 148964 - DNA, 20 bp, Artificial sequence
  SiRNA target sequence
agattttacaggaactgctg

SEQ ID NO: 148965 - DNA, 20 bp, Artificial sequence
  SiRNA target sequence
gattttacaggaactgctgt

SEQ ID NO: 148966 - DNA, 20 bp, Artificial sequence
  SiRNA target sequence
attttacaggaactgctgtt

SEQ ID NO: 148967 - DNA, 20 bp, Artificial sequence
  SiRNA target sequence
ttttacaggaactgctgttc

SEQ ID NO: 148968 - DNA, 20 bp, Artificial sequence
  SiRNA target sequence
tttacaggaactgctgttcc

SEQ ID NO: 148969 - DNA, 20 bp, Artificial sequence
  SiRNA target sequence
ttacaggaactgctgttcca

SEQ ID NO: 148970 - DNA, 20 bp, Artificial sequence
  SiRNA target sequence
tacaggaactgctgttccaa

SEQ ID NO: 148971 - DNA, 20 bp, Artificial sequence
  SiRNA target sequence
acaggaactgctgttccaaa

SEQ ID NO: 148972 - DNA, 20 bp, Artificial sequence
  SiRNA target sequence
caggaactgctgttccaaaa

SEQ ID NO: 148973 - DNA, 20 bp, Artificial sequence
  SiRNA target sequence
aggaactgctgttccaaaat

SEQ ID NO: 148974 - DNA, 20 bp, Artificial sequence
  SiRNA target sequence
ggaactgctgttccaaaata

SEQ ID NO: 148975 - DNA, 20 bp, Artificial sequence
  SiRNA target sequence
gaactgctgttccaaaatat

SEQ ID NO: 148976 - DNA, 20 bp, Artificial sequence
  SiRNA target sequence
aactgctgttccaaaatatg

SEQ ID NO: 148977 - DNA, 20 bp, Artificial sequence
  SiRNA target sequence
actgctgttccaaaatatgc

SEQ ID NO: 148978 - DNA, 20 bp, Artificial sequence
  SiRNA target sequence
ctgctgttccaaaatatgca

SEQ ID NO: 148979 - DNA, 20 bp, Artificial sequence
  SiRNA target sequence
tgctgttccaaaatatgcag

SEQ ID NO: 148980 - DNA, 20 bp, Artificial sequence
  SiRNA target sequence
gctgttccaaaatatgcaga

SEQ ID NO: 148981 - DNA, 20 bp, Artificial sequence
  SiRNA target sequence
ctgttccaaaatatgcagaa

SEQ ID NO: 148982 - DNA, 20 bp, Artificial sequence
  SiRNA target sequence
tgttccaaaatatgcagaat

SEQ ID NO: 148983 - DNA, 20 bp, Artificial sequence
  SiRNA target sequence
gttccaaaatatgcagaatt

SEQ ID NO: 148984 - DNA, 20 bp, Artificial sequence
  SiRNA target sequence
ttccaaaatatgcagaattt

SEQ ID NO: 148985 - DNA, 20 bp, Artificial sequence
  SiRNA target sequence
tccaaaatatgcagaatttg

SEQ ID NO: 148986 - DNA, 20 bp, Artificial sequence
  SiRNA target sequence
ccaaaatatgcagaatttgg

SEQ ID NO: 148987 - DNA, 20 bp, Artificial sequence
  SiRNA target sequence
caaaatatgcagaatttggt

SEQ ID NO: 148988 - DNA, 20 bp, Artificial sequence
  SiRNA target sequence
aaaatatgcagaatttggtg

SEQ ID NO: 148989 - DNA, 20 bp, Artificial sequence
  SiRNA target sequence
aaatatgcagaatttggtgt

SEQ ID NO: 148990 - DNA, 20 bp, Artificial sequence
  SiRNA target sequence
aatatgcagaatttggtgtt

SEQ ID NO: 148991 - DNA, 20 bp, Artificial sequence
  SiRNA target sequence
atatgcagaatttggtgtta

SEQ ID NO: 148992 - DNA, 20 bp, Artificial sequence
  SiRNA target sequence
tatgcagaatttggtgttat

SEQ ID NO: 148993 - DNA, 20 bp, Artificial sequence
  SiRNA target sequence
atgcagaatttggtgttatg

SEQ ID NO: 148994 - DNA, 20 bp, Artificial sequence
  SiRNA target sequence
tgcagaatttggtgttatgc

SEQ ID NO: 148995 - DNA, 20 bp, Artificial sequence
  SiRNA target sequence
gcagaatttggtgttatgcc

SEQ ID NO: 148996 - DNA, 20 bp, Artificial sequence
  SiRNA target sequence
cagaatttggtgttatgcct

SEQ ID NO: 148997 - DNA, 20 bp, Artificial sequence
  SiRNA target sequence
agaatttggtgttatgccta

SEQ ID NO: 148998 - DNA, 20 bp, Artificial sequence
  SiRNA target sequence
gaatttggtgttatgcctaa

SEQ ID NO: 148999 - DNA, 20 bp, Artificial sequence
  SiRNA target sequence
aatttggtgttatgcctaaa

SEQ ID NO: 149000 - DNA, 20 bp, Artificial sequence
  SiRNA target sequence
atttggtgttatgcctaaag

SEQ ID NO: 149001 - DNA, 20 bp, Artificial sequence
  SiRNA target sequence
tttggtgttatgcctaaaga

SEQ ID NO: 149002 - DNA, 20 bp, Artificial sequence
  SiRNA target sequence
ttggtgttatgcctaaagaa

SEQ ID NO: 149003 - DNA, 20 bp, Artificial sequence
  SiRNA target sequence
tggtgttatgcctaaagaac

SEQ ID NO: 149004 - DNA, 20 bp, Artificial sequence
  SiRNA target sequence
ggtgttatgcctaaagaaca

SEQ ID NO: 149005 - DNA, 20 bp, Artificial sequence
  SiRNA target sequence
gtgttatgcctaaagaacag

SEQ ID NO: 149006 - DNA, 20 bp, Artificial sequence
  SiRNA target sequence
tgttatgcctaaagaacagg

SEQ ID NO: 149007 - DNA, 20 bp, Artificial sequence
  SiRNA target sequence
gttatgcctaaagaacagga

SEQ ID NO: 149008 - DNA, 20 bp, Artificial sequence
  SiRNA target sequence
ttatgcctaaagaacaggaa

SEQ ID NO: 149009 - DNA, 20 bp, Artificial sequence
  SiRNA target sequence
tatgcctaaagaacaggaag

SEQ ID NO: 149010 - DNA, 20 bp, Artificial sequence
  SiRNA target sequence
atgcctaaagaacaggaaga

SEQ ID NO: 149011 - DNA, 20 bp, Artificial sequence
  SiRNA target sequence
tgcctaaagaacaggaagaa

SEQ ID NO: 149012 - DNA, 20 bp, Artificial sequence
  SiRNA target sequence
gcctaaagaacaggaagaac

SEQ ID NO: 149013 - DNA, 20 bp, Artificial sequence
  SiRNA target sequence
cctaaagaacaggaagaaca

SEQ ID NO: 149014 - DNA, 20 bp, Artificial sequence
  SiRNA target sequence
ctaaagaacaggaagaacaa

SEQ ID NO: 149015 - DNA, 20 bp, Artificial sequence
  SiRNA target sequence
taaagaacaggaagaacaaa

SEQ ID NO: 149016 - DNA, 20 bp, Artificial sequence
  SiRNA target sequence
aaagaacaggaagaacaaaa

SEQ ID NO: 149017 - DNA, 20 bp, Artificial sequence
  SiRNA target sequence
aagaacaggaagaacaaaac

SEQ ID NO: 149018 - DNA, 20 bp, Artificial sequence
  SiRNA target sequence
agaacaggaagaacaaaacg

SEQ ID NO: 149019 - DNA, 20 bp, Artificial sequence
  SiRNA target sequence
gaacaggaagaacaaaacga

SEQ ID NO: 149020 - DNA, 20 bp, Artificial sequence
  SiRNA target sequence
aacaggaagaacaaaacgaa

SEQ ID NO: 149021 - DNA, 20 bp, Artificial sequence
  SiRNA target sequence
acaggaagaacaaaacgaaa

SEQ ID NO: 149022 - DNA, 20 bp, Artificial sequence
  SiRNA target sequence
caggaagaacaaaacgaaag

SEQ ID NO: 149023 - DNA, 20 bp, Artificial sequence
  SiRNA target sequence
aggaagaacaaaacgaaaga

SEQ ID NO: 149024 - DNA, 20 bp, Artificial sequence
  SiRNA target sequence
ggaagaacaaaacgaaagag

SEQ ID NO: 149025 - DNA, 20 bp, Artificial sequence
  SiRNA target sequence
gaagaacaaaacgaaagaga

SEQ ID NO: 149026 - DNA, 20 bp, Artificial sequence
  SiRNA target sequence
aagaacaaaacgaaagagaa

SEQ ID NO: 149027 - DNA, 20 bp, Artificial sequence
  SiRNA target sequence
agaacaaaacgaaagagaaa

SEQ ID NO: 149028 - DNA, 20 bp, Artificial sequence
  SiRNA target sequence
gaacaaaacgaaagagaaag

SEQ ID NO: 149029 - DNA, 20 bp, Artificial sequence
  SiRNA target sequence
aacaaaacgaaagagaaaga

SEQ ID NO: 149030 - DNA, 20 bp, Artificial sequence
  SiRNA target sequence
acaaaacgaaagagaaagat

SEQ ID NO: 149031 - DNA, 20 bp, Artificial sequence
  SiRNA target sequence
caaaacgaaagagaaagatt

SEQ ID NO: 149032 - DNA, 20 bp, Artificial sequence
  SiRNA target sequence
aaaacgaaagagaaagattc

SEQ ID NO: 149033 - DNA, 20 bp, Artificial sequence
  SiRNA target sequence
aaacgaaagagaaagattcg

SEQ ID NO: 149034 - DNA, 20 bp, Artificial sequence
  SiRNA target sequence
aacgaaagagaaagattcga

SEQ ID NO: 149035 - DNA, 20 bp, Artificial sequence
  SiRNA target sequence
acgaaagagaaagattcgaa

SEQ ID NO: 149036 - DNA, 20 bp, Artificial sequence
  SiRNA target sequence
cgaaagagaaagattcgaag

SEQ ID NO: 149037 - DNA, 20 bp, Artificial sequence
  SiRNA target sequence
gaaagagaaagattcgaagg

SEQ ID NO: 149038 - DNA, 20 bp, Artificial sequence
  SiRNA target sequence
aaagagaaagattcgaaggt

SEQ ID NO: 149039 - DNA, 20 bp, Artificial sequence
  SiRNA target sequence
aagagaaagattcgaaggtg

SEQ ID NO: 149040 - DNA, 20 bp, Artificial sequence
  SiRNA target sequence
agagaaagattcgaaggtgc

SEQ ID NO: 149041 - DNA, 20 bp, Artificial sequence
  SiRNA target sequence
gagaaagattcgaaggtgca

SEQ ID NO: 149042 - DNA, 20 bp, Artificial sequence
  SiRNA target sequence
agaaagattcgaaggtgcag

SEQ ID NO: 149043 - DNA, 20 bp, Artificial sequence
  SiRNA target sequence
gaaagattcgaaggtgcaga

SEQ ID NO: 149044 - DNA, 20 bp, Artificial sequence
  SiRNA target sequence
aaagattcgaaggtgcagaa

SEQ ID NO: 149045 - DNA, 20 bp, Artificial sequence
  SiRNA target sequence
aagattcgaaggtgcagaag

SEQ ID NO: 149046 - DNA, 20 bp, Artificial sequence
  SiRNA target sequence
agattcgaaggtgcagaaga

SEQ ID NO: 149047 - DNA, 20 bp, Artificial sequence
  SiRNA target sequence
gattcgaaggtgcagaagag

SEQ ID NO: 149048 - DNA, 20 bp, Artificial sequence
  SiRNA target sequence
attcgaaggtgcagaagagt

SEQ ID NO: 149049 - DNA, 20 bp, Artificial sequence
  SiRNA target sequence
ttcgaaggtgcagaagagtt

SEQ ID NO: 149050 - DNA, 20 bp, Artificial sequence
  SiRNA target sequence
tcgaaggtgcagaagagttt

SEQ ID NO: 149051 - DNA, 20 bp, Artificial sequence
  SiRNA target sequence
cgaaggtgcagaagagtttt

SEQ ID NO: 149052 - DNA, 20 bp, Artificial sequence
  SiRNA target sequence
gaaggtgcagaagagttttt

SEQ ID NO: 149053 - DNA, 20 bp, Artificial sequence
  SiRNA target sequence
aaggtgcagaagagtttttt

SEQ ID NO: 149054 - DNA, 20 bp, Artificial sequence
  SiRNA target sequence
aggtgcagaagagttttttg

SEQ ID NO: 149055 - DNA, 20 bp, Artificial sequence
  SiRNA target sequence
ggtgcagaagagttttttgg

SEQ ID NO: 149056 - DNA, 20 bp, Artificial sequence
  SiRNA target sequence
gtgcagaagagttttttgga

SEQ ID NO: 149057 - DNA, 20 bp, Artificial sequence
  SiRNA target sequence
tgcagaagagttttttggag

SEQ ID NO: 149058 - DNA, 20 bp, Artificial sequence
  SiRNA target sequence
gcagaagagttttttggagg

SEQ ID NO: 149059 - DNA, 20 bp, Artificial sequence
  SiRNA target sequence
cagaagagttttttggagga

SEQ ID NO: 149060 - DNA, 20 bp, Artificial sequence
  SiRNA target sequence
agaagagttttttggaggaa

SEQ ID NO: 149061 - DNA, 20 bp, Artificial sequence
  SiRNA target sequence
gaagagttttttggaggaaa

SEQ ID NO: 149062 - DNA, 20 bp, Artificial sequence
  SiRNA target sequence
aagagttttttggaggaaat

SEQ ID NO: 149063 - DNA, 20 bp, Artificial sequence
  SiRNA target sequence
agagttttttggaggaaatg

SEQ ID NO: 149064 - DNA, 20 bp, Artificial sequence
  SiRNA target sequence
gagttttttggaggaaatgg

SEQ ID NO: 149065 - DNA, 20 bp, Artificial sequence
  SiRNA target sequence
agttttttggaggaaatggt

SEQ ID NO: 149066 - DNA, 20 bp, Artificial sequence
  SiRNA target sequence
gttttttggaggaaatggta

SEQ ID NO: 149067 - DNA, 20 bp, Artificial sequence
  SiRNA target sequence
ttttttggaggaaatggtag

SEQ ID NO: 149068 - DNA, 20 bp, Artificial sequence
  SiRNA target sequence
tttttggaggaaatggtaga

SEQ ID NO: 149069 - DNA, 20 bp, Artificial sequence
  SiRNA target sequence
ttttggaggaaatggtagag

SEQ ID NO: 149070 - DNA, 20 bp, Artificial sequence
  SiRNA target sequence
tttggaggaaatggtagaga

SEQ ID NO: 149071 - DNA, 20 bp, Artificial sequence
  SiRNA target sequence
ttggaggaaatggtagagat

SEQ ID NO: 149072 - DNA, 20 bp, Artificial sequence
  SiRNA target sequence
tggaggaaatggtagagatt

SEQ ID NO: 149073 - DNA, 20 bp, Artificial sequence
  SiRNA target sequence
ggaggaaatggtagagattt

SEQ ID NO: 149074 - DNA, 20 bp, Artificial sequence
  SiRNA target sequence
gaggaaatggtagagatttt

SEQ ID NO: 149075 - DNA, 20 bp, Artificial sequence
  SiRNA target sequence
aggaaatggtagagattttt

SEQ ID NO: 149076 - DNA, 20 bp, Artificial sequence
  SiRNA target sequence
ggaaatggtagagatttttt

SEQ ID NO: 149077 - DNA, 20 bp, Artificial sequence
  SiRNA target sequence
gaaatggtagagattttttt

SEQ ID NO: 149078 - DNA, 20 bp, Artificial sequence
  SiRNA target sequence
aaatggtagagattttttta

SEQ ID NO: 149079 - DNA, 20 bp, Artificial sequence
  SiRNA target sequence
aatggtagagatttttttag

SEQ ID NO: 149080 - DNA, 20 bp, Artificial sequence
  SiRNA target sequence
atggtagagatttttttagc

SEQ ID NO: 149081 - DNA, 20 bp, Artificial sequence
  SiRNA target sequence
tggtagagatttttttagca

SEQ ID NO: 149082 - DNA, 20 bp, Artificial sequence
  SiRNA target sequence
ggtagagatttttttagcaa

SEQ ID NO: 149083 - DNA, 20 bp, Artificial sequence
  SiRNA target sequence
gtagagatttttttagcaag

SEQ ID NO: 149084 - DNA, 20 bp, Artificial sequence
  SiRNA target sequence
tagagatttttttagcaagt

SEQ ID NO: 149085 - DNA, 20 bp, Artificial sequence
  SiRNA target sequence
agagatttttttagcaagtt

SEQ ID NO: 149086 - DNA, 20 bp, Artificial sequence
  SiRNA target sequence
gagatttttttagcaagttt

SEQ ID NO: 149087 - DNA, 20 bp, Artificial sequence
  SiRNA target sequence
agatttttttagcaagtttg

SEQ ID NO: 149088 - DNA, 20 bp, Artificial sequence
  SiRNA target sequence
gatttttttagcaagtttgg

SEQ ID NO: 149089 - DNA, 20 bp, Artificial sequence
  SiRNA target sequence
atttttttagcaagtttgga

SEQ ID NO: 149090 - DNA, 20 bp, Artificial sequence
  SiRNA target sequence
tttttttagcaagtttggat

SEQ ID NO: 149091 - DNA, 20 bp, Artificial sequence
  SiRNA target sequence
ttttttagcaagtttggatt

SEQ ID NO: 149092 - DNA, 20 bp, Artificial sequence
  SiRNA target sequence
tttttagcaagtttggattt

SEQ ID NO: 149093 - DNA, 20 bp, Artificial sequence
  SiRNA target sequence
ttttagcaagtttggatttt

SEQ ID NO: 149094 - DNA, 20 bp, Artificial sequence
  SiRNA target sequence
tttagcaagtttggattttt

SEQ ID NO: 149095 - DNA, 20 bp, Artificial sequence
  SiRNA target sequence
ttagcaagtttggatttttc

SEQ ID NO: 149096 - DNA, 20 bp, Artificial sequence
  SiRNA target sequence
tagcaagtttggatttttct

SEQ ID NO: 149097 - DNA, 20 bp, Artificial sequence
  SiRNA target sequence
agcaagtttggatttttcta

SEQ ID NO: 149098 - DNA, 20 bp, Artificial sequence
  SiRNA target sequence
gcaagtttggatttttctaa

SEQ ID NO: 149099 - DNA, 21 bp, Artificial sequence
  SiRNA target sequence
atggcacaagacccccaagga

SEQ ID NO: 149100 - DNA, 21 bp, Artificial sequence
  SiRNA target sequence
tggcacaagacccccaaggac

SEQ ID NO: 149101 - DNA, 21 bp, Artificial sequence
  SiRNA target sequence
ggcacaagacccccaaggact

SEQ ID NO: 149102 - DNA, 21 bp, Artificial sequence
  SiRNA target sequence
gcacaagacccccaaggactt

SEQ ID NO: 149103 - DNA, 21 bp, Artificial sequence
  SiRNA target sequence
cacaagacccccaaggacttt

SEQ ID NO: 149104 - DNA, 21 bp, Artificial sequence
  SiRNA target sequence
acaagacccccaaggacttta

SEQ ID NO: 149105 - DNA, 21 bp, Artificial sequence
  SiRNA target sequence
caagacccccaaggactttat

SEQ ID NO: 149106 - DNA, 21 bp, Artificial sequence
  SiRNA target sequence
aagacccccaaggactttatg

SEQ ID NO: 149107 - DNA, 21 bp, Artificial sequence
  SiRNA target sequence
agacccccaaggactttatga

SEQ ID NO: 149108 - DNA, 21 bp, Artificial sequence
  SiRNA target sequence
gacccccaaggactttatgaa

SEQ ID NO: 149109 - DNA, 21 bp, Artificial sequence
  SiRNA target sequence
acccccaaggactttatgaag

SEQ ID NO: 149110 - DNA, 21 bp, Artificial sequence
  SiRNA target sequence
cccccaaggactttatgaagt

SEQ ID NO: 149111 - DNA, 21 bp, Artificial sequence
  SiRNA target sequence
ccccaaggactttatgaagta

SEQ ID NO: 149112 - DNA, 21 bp, Artificial sequence
  SiRNA target sequence
cccaaggactttatgaagtat

SEQ ID NO: 149113 - DNA, 21 bp, Artificial sequence
  SiRNA target sequence
ccaaggactttatgaagtatt

SEQ ID NO: 149114 - DNA, 21 bp, Artificial sequence
  SiRNA target sequence
caaggactttatgaagtatta

SEQ ID NO: 149115 - DNA, 21 bp, Artificial sequence
  SiRNA target sequence
aaggactttatgaagtattag

SEQ ID NO: 149116 - DNA, 21 bp, Artificial sequence
  SiRNA target sequence
aggactttatgaagtattagg

SEQ ID NO: 149117 - DNA, 21 bp, Artificial sequence
  SiRNA target sequence
ggactttatgaagtattagga

SEQ ID NO: 149118 - DNA, 21 bp, Artificial sequence
  SiRNA target sequence
gactttatgaagtattaggac

SEQ ID NO: 149119 - DNA, 21 bp, Artificial sequence
  SiRNA target sequence
actttatgaagtattaggact

SEQ ID NO: 149120 - DNA, 21 bp, Artificial sequence
  SiRNA target sequence
ctttatgaagtattaggactt

SEQ ID NO: 149121 - DNA, 21 bp, Artificial sequence
  SiRNA target sequence
tttatgaagtattaggactta

SEQ ID NO: 149122 - DNA, 21 bp, Artificial sequence
  SiRNA target sequence
ttatgaagtattaggacttaa

SEQ ID NO: 149123 - DNA, 21 bp, Artificial sequence
  SiRNA target sequence
tatgaagtattaggacttaaa

SEQ ID NO: 149124 - DNA, 21 bp, Artificial sequence
  SiRNA target sequence
atgaagtattaggacttaaag

SEQ ID NO: 149125 - DNA, 21 bp, Artificial sequence
  SiRNA target sequence
tgaagtattaggacttaaagc

SEQ ID NO: 149126 - DNA, 21 bp, Artificial sequence
  SiRNA target sequence
gaagtattaggacttaaagct

SEQ ID NO: 149127 - DNA, 21 bp, Artificial sequence
  SiRNA target sequence
aagtattaggacttaaagctg

SEQ ID NO: 149128 - DNA, 21 bp, Artificial sequence
  SiRNA target sequence
agtattaggacttaaagctgg

SEQ ID NO: 149129 - DNA, 21 bp, Artificial sequence
  SiRNA target sequence
gtattaggacttaaagctggt

SEQ ID NO: 149130 - DNA, 21 bp, Artificial sequence
  SiRNA target sequence
tattaggacttaaagctggtg

SEQ ID NO: 149131 - DNA, 21 bp, Artificial sequence
  SiRNA target sequence
attaggacttaaagctggtgc

SEQ ID NO: 149132 - DNA, 21 bp, Artificial sequence
  SiRNA target sequence
ttaggacttaaagctggtgca

SEQ ID NO: 149133 - DNA, 21 bp, Artificial sequence
  SiRNA target sequence
taggacttaaagctggtgcaa

SEQ ID NO: 149134 - DNA, 21 bp, Artificial sequence
  SiRNA target sequence
aggacttaaagctggtgcaag

SEQ ID NO: 149135 - DNA, 21 bp, Artificial sequence
  SiRNA target sequence
ggacttaaagctggtgcaagc

SEQ ID NO: 149136 - DNA, 21 bp, Artificial sequence
  SiRNA target sequence
gacttaaagctggtgcaagca

SEQ ID NO: 149137 - DNA, 21 bp, Artificial sequence
  SiRNA target sequence
acttaaagctggtgcaagcat

SEQ ID NO: 149138 - DNA, 21 bp, Artificial sequence
  SiRNA target sequence
cttaaagctggtgcaagcatt

SEQ ID NO: 149139 - DNA, 21 bp, Artificial sequence
  SiRNA target sequence
ttaaagctggtgcaagcattg

SEQ ID NO: 149140 - DNA, 21 bp, Artificial sequence
  SiRNA target sequence
taaagctggtgcaagcattga

SEQ ID NO: 149141 - DNA, 21 bp, Artificial sequence
  SiRNA target sequence
aaagctggtgcaagcattgat

SEQ ID NO: 149142 - DNA, 21 bp, Artificial sequence
  SiRNA target sequence
aagctggtgcaagcattgatg

SEQ ID NO: 149143 - DNA, 21 bp, Artificial sequence
  SiRNA target sequence
agctggtgcaagcattgatga

SEQ ID NO: 149144 - DNA, 21 bp, Artificial sequence
  SiRNA target sequence
gctggtgcaagcattgatgaa

SEQ ID NO: 149145 - DNA, 21 bp, Artificial sequence
  SiRNA target sequence
ctggtgcaagcattgatgaag

SEQ ID NO: 149146 - DNA, 21 bp, Artificial sequence
  SiRNA target sequence
tggtgcaagcattgatgaagt

SEQ ID NO: 149147 - DNA, 21 bp, Artificial sequence
  SiRNA target sequence
ggtgcaagcattgatgaagtt

SEQ ID NO: 149148 - DNA, 21 bp, Artificial sequence
  SiRNA target sequence
gtgcaagcattgatgaagtta

SEQ ID NO: 149149 - DNA, 21 bp, Artificial sequence
  SiRNA target sequence
tgcaagcattgatgaagttaa

SEQ ID NO: 149150 - DNA, 21 bp, Artificial sequence
  SiRNA target sequence
gcaagcattgatgaagttaaa

SEQ ID NO: 149151 - DNA, 21 bp, Artificial sequence
  SiRNA target sequence
caagcattgatgaagttaaaa

SEQ ID NO: 149152 - DNA, 21 bp, Artificial sequence
  SiRNA target sequence
aagcattgatgaagttaaaaa

SEQ ID NO: 149153 - DNA, 21 bp, Artificial sequence
  SiRNA target sequence
agcattgatgaagttaaaaaa

SEQ ID NO: 149154 - DNA, 21 bp, Artificial sequence
  SiRNA target sequence
gcattgatgaagttaaaaaag

SEQ ID NO: 149155 - DNA, 21 bp, Artificial sequence
  SiRNA target sequence
cattgatgaagttaaaaaagc

SEQ ID NO: 149156 - DNA, 21 bp, Artificial sequence
  SiRNA target sequence
attgatgaagttaaaaaagca

SEQ ID NO: 149157 - DNA, 21 bp, Artificial sequence
  SiRNA target sequence
ttgatgaagttaaaaaagcat

SEQ ID NO: 149158 - DNA, 21 bp, Artificial sequence
  SiRNA target sequence
tgatgaagttaaaaaagcatt

SEQ ID NO: 149159 - DNA, 21 bp, Artificial sequence
  SiRNA target sequence
gatgaagttaaaaaagcattt

SEQ ID NO: 149160 - DNA, 21 bp, Artificial sequence
  SiRNA target sequence
atgaagttaaaaaagcattta

SEQ ID NO: 149161 - DNA, 21 bp, Artificial sequence
  SiRNA target sequence
tgaagttaaaaaagcatttac

SEQ ID NO: 149162 - DNA, 21 bp, Artificial sequence
  SiRNA target sequence
gaagttaaaaaagcatttaca

SEQ ID NO: 149163 - DNA, 21 bp, Artificial sequence
  SiRNA target sequence
aagttaaaaaagcatttacaa

SEQ ID NO: 149164 - DNA, 21 bp, Artificial sequence
  SiRNA target sequence
agttaaaaaagcatttacaaa

SEQ ID NO: 149165 - DNA, 21 bp, Artificial sequence
  SiRNA target sequence
gttaaaaaagcatttacaaaa

SEQ ID NO: 149166 - DNA, 21 bp, Artificial sequence
  SiRNA target sequence
ttaaaaaagcatttacaaaaa

SEQ ID NO: 149167 - DNA, 21 bp, Artificial sequence
  SiRNA target sequence
taaaaaagcatttacaaaaaa

SEQ ID NO: 149168 - DNA, 21 bp, Artificial sequence
  SiRNA target sequence
aaaaaagcatttacaaaaaaa

SEQ ID NO: 149169 - DNA, 21 bp, Artificial sequence
  SiRNA target sequence
aaaaagcatttacaaaaaaac

SEQ ID NO: 149170 - DNA, 21 bp, Artificial sequence
  SiRNA target sequence
aaaagcatttacaaaaaaaca

SEQ ID NO: 149171 - DNA, 21 bp, Artificial sequence
  SiRNA target sequence
aaagcatttacaaaaaaacaa

SEQ ID NO: 149172 - DNA, 21 bp, Artificial sequence
  SiRNA target sequence
aagcatttacaaaaaaacaaa

SEQ ID NO: 149173 - DNA, 21 bp, Artificial sequence
  SiRNA target sequence
agcatttacaaaaaaacaaag

SEQ ID NO: 149174 - DNA, 21 bp, Artificial sequence
  SiRNA target sequence
gcatttacaaaaaaacaaagg

SEQ ID NO: 149175 - DNA, 21 bp, Artificial sequence
  SiRNA target sequence
catttacaaaaaaacaaaggg

SEQ ID NO: 149176 - DNA, 21 bp, Artificial sequence
  SiRNA target sequence
atttacaaaaaaacaaaggga

SEQ ID NO: 149177 - DNA, 21 bp, Artificial sequence
  SiRNA target sequence
tttacaaaaaaacaaagggaa

SEQ ID NO: 149178 - DNA, 21 bp, Artificial sequence
  SiRNA target sequence
ttacaaaaaaacaaagggaat

SEQ ID NO: 149179 - DNA, 21 bp, Artificial sequence
  SiRNA target sequence
tacaaaaaaacaaagggaatg

SEQ ID NO: 149180 - DNA, 21 bp, Artificial sequence
  SiRNA target sequence
acaaaaaaacaaagggaatgt

SEQ ID NO: 149181 - DNA, 21 bp, Artificial sequence
  SiRNA target sequence
caaaaaaacaaagggaatgtc

SEQ ID NO: 149182 - DNA, 21 bp, Artificial sequence
  SiRNA target sequence
aaaaaaacaaagggaatgtca

SEQ ID NO: 149183 - DNA, 21 bp, Artificial sequence
  SiRNA target sequence
aaaaaacaaagggaatgtcat

SEQ ID NO: 149184 - DNA, 21 bp, Artificial sequence
  SiRNA target sequence
aaaaacaaagggaatgtcatc

SEQ ID NO: 149185 - DNA, 21 bp, Artificial sequence
  SiRNA target sequence
aaaacaaagggaatgtcatcc

SEQ ID NO: 149186 - DNA, 21 bp, Artificial sequence
  SiRNA target sequence
aaacaaagggaatgtcatccc

SEQ ID NO: 149187 - DNA, 21 bp, Artificial sequence
  SiRNA target sequence
aacaaagggaatgtcatcccg

SEQ ID NO: 149188 - DNA, 21 bp, Artificial sequence
  SiRNA target sequence
acaaagggaatgtcatcccga

SEQ ID NO: 149189 - DNA, 21 bp, Artificial sequence
  SiRNA target sequence
caaagggaatgtcatcccgat

SEQ ID NO: 149190 - DNA, 21 bp, Artificial sequence
  SiRNA target sequence
aaagggaatgtcatcccgatg

SEQ ID NO: 149191 - DNA, 21 bp, Artificial sequence
  SiRNA target sequence
aagggaatgtcatcccgatgg

SEQ ID NO: 149192 - DNA, 21 bp, Artificial sequence
  SiRNA target sequence
agggaatgtcatcccgatggt

SEQ ID NO: 149193 - DNA, 21 bp, Artificial sequence
  SiRNA target sequence
gggaatgtcatcccgatggtg

SEQ ID NO: 149194 - DNA, 21 bp, Artificial sequence
  SiRNA target sequence
ggaatgtcatcccgatggtgc

SEQ ID NO: 149195 - DNA, 21 bp, Artificial sequence
  SiRNA target sequence
gaatgtcatcccgatggtgca

SEQ ID NO: 149196 - DNA, 21 bp, Artificial sequence
  SiRNA target sequence
aatgtcatcccgatggtgcat

SEQ ID NO: 149197 - DNA, 21 bp, Artificial sequence
  SiRNA target sequence
atgtcatcccgatggtgcatt

SEQ ID NO: 149198 - DNA, 21 bp, Artificial sequence
  SiRNA target sequence
tgtcatcccgatggtgcattt

SEQ ID NO: 149199 - DNA, 21 bp, Artificial sequence
  SiRNA target sequence
gtcatcccgatggtgcatttt

SEQ ID NO: 149200 - DNA, 21 bp, Artificial sequence
  SiRNA target sequence
tcatcccgatggtgcattttt

SEQ ID NO: 149201 - DNA, 21 bp, Artificial sequence
  SiRNA target sequence
catcccgatggtgcatttttt

SEQ ID NO: 149202 - DNA, 21 bp, Artificial sequence
  SiRNA target sequence
atcccgatggtgcatttttta

SEQ ID NO: 149203 - DNA, 21 bp, Artificial sequence
  SiRNA target sequence
tcccgatggtgcattttttaa

SEQ ID NO: 149204 - DNA, 21 bp, Artificial sequence
  SiRNA target sequence
cccgatggtgcattttttaaa

SEQ ID NO: 149205 - DNA, 21 bp, Artificial sequence
  SiRNA target sequence
ccgatggtgcattttttaaag

SEQ ID NO: 149206 - DNA, 21 bp, Artificial sequence
  SiRNA target sequence
cgatggtgcattttttaaagc

SEQ ID NO: 149207 - DNA, 21 bp, Artificial sequence
  SiRNA target sequence
gatggtgcattttttaaagct

SEQ ID NO: 149208 - DNA, 21 bp, Artificial sequence
  SiRNA target sequence
atggtgcattttttaaagctg

SEQ ID NO: 149209 - DNA, 21 bp, Artificial sequence
  SiRNA target sequence
tggtgcattttttaaagctgc

SEQ ID NO: 149210 - DNA, 21 bp, Artificial sequence
  SiRNA target sequence
ggtgcattttttaaagctgct

SEQ ID NO: 149211 - DNA, 21 bp, Artificial sequence
  SiRNA target sequence
gtgcattttttaaagctgctc

SEQ ID NO: 149212 - DNA, 21 bp, Artificial sequence
  SiRNA target sequence
tgcattttttaaagctgctct

SEQ ID NO: 149213 - DNA, 21 bp, Artificial sequence
  SiRNA target sequence
gcattttttaaagctgctctt

SEQ ID NO: 149214 - DNA, 21 bp, Artificial sequence
  SiRNA target sequence
cattttttaaagctgctctta

SEQ ID NO: 149215 - DNA, 21 bp, Artificial sequence
  SiRNA target sequence
attttttaaagctgctcttag

SEQ ID NO: 149216 - DNA, 21 bp, Artificial sequence
  SiRNA target sequence
ttttttaaagctgctcttaga

SEQ ID NO: 149217 - DNA, 21 bp, Artificial sequence
  SiRNA target sequence
tttttaaagctgctcttagaa

SEQ ID NO: 149218 - DNA, 21 bp, Artificial sequence
  SiRNA target sequence
ttttaaagctgctcttagaaa

SEQ ID NO: 149219 - DNA, 21 bp, Artificial sequence
  SiRNA target sequence
tttaaagctgctcttagaaaa

SEQ ID NO: 149220 - DNA, 21 bp, Artificial sequence
  SiRNA target sequence
ttaaagctgctcttagaaaat

SEQ ID NO: 149221 - DNA, 21 bp, Artificial sequence
  SiRNA target sequence
taaagctgctcttagaaaatg

SEQ ID NO: 149222 - DNA, 21 bp, Artificial sequence
  SiRNA target sequence
aaagctgctcttagaaaatgt

SEQ ID NO: 149223 - DNA, 21 bp, Artificial sequence
  SiRNA target sequence
aagctgctcttagaaaatgta

SEQ ID NO: 149224 - DNA, 21 bp, Artificial sequence
  SiRNA target sequence
agctgctcttagaaaatgtaa

SEQ ID NO: 149225 - DNA, 21 bp, Artificial sequence
  SiRNA target sequence
gctgctcttagaaaatgtaaa

SEQ ID NO: 149226 - DNA, 21 bp, Artificial sequence
  SiRNA target sequence
ctgctcttagaaaatgtaaaa

SEQ ID NO: 149227 - DNA, 21 bp, Artificial sequence
  SiRNA target sequence
tgctcttagaaaatgtaaaac

SEQ ID NO: 149228 - DNA, 21 bp, Artificial sequence
  SiRNA target sequence
gctcttagaaaatgtaaaaca

SEQ ID NO: 149229 - DNA, 21 bp, Artificial sequence
  SiRNA target sequence
ctcttagaaaatgtaaaacag

SEQ ID NO: 149230 - DNA, 21 bp, Artificial sequence
  SiRNA target sequence
tcttagaaaatgtaaaacaga

SEQ ID NO: 149231 - DNA, 21 bp, Artificial sequence
  SiRNA target sequence
cttagaaaatgtaaaacagat

SEQ ID NO: 149232 - DNA, 21 bp, Artificial sequence
  SiRNA target sequence
ttagaaaatgtaaaacagatg

SEQ ID NO: 149233 - DNA, 21 bp, Artificial sequence
  SiRNA target sequence
tagaaaatgtaaaacagatga

SEQ ID NO: 149234 - DNA, 21 bp, Artificial sequence
  SiRNA target sequence
agaaaatgtaaaacagatgaa

SEQ ID NO: 149235 - DNA, 21 bp, Artificial sequence
  SiRNA target sequence
gaaaatgtaaaacagatgaag

SEQ ID NO: 149236 - DNA, 21 bp, Artificial sequence
  SiRNA target sequence
aaaatgtaaaacagatgaaga

SEQ ID NO: 149237 - DNA, 21 bp, Artificial sequence
  SiRNA target sequence
aaatgtaaaacagatgaagaa

SEQ ID NO: 149238 - DNA, 21 bp, Artificial sequence
  SiRNA target sequence
aatgtaaaacagatgaagaaa

SEQ ID NO: 149239 - DNA, 21 bp, Artificial sequence
  SiRNA target sequence
atgtaaaacagatgaagaaag

SEQ ID NO: 149240 - DNA, 21 bp, Artificial sequence
  SiRNA target sequence
tgtaaaacagatgaagaaaga

SEQ ID NO: 149241 - DNA, 21 bp, Artificial sequence
  SiRNA target sequence
gtaaaacagatgaagaaagag

SEQ ID NO: 149242 - DNA, 21 bp, Artificial sequence
  SiRNA target sequence
taaaacagatgaagaaagagc

SEQ ID NO: 149243 - DNA, 21 bp, Artificial sequence
  SiRNA target sequence
aaaacagatgaagaaagagca

SEQ ID NO: 149244 - DNA, 21 bp, Artificial sequence
  SiRNA target sequence
aaacagatgaagaaagagcaa

SEQ ID NO: 149245 - DNA, 21 bp, Artificial sequence
  SiRNA target sequence
aacagatgaagaaagagcaaa

SEQ ID NO: 149246 - DNA, 21 bp, Artificial sequence
  SiRNA target sequence
acagatgaagaaagagcaaaa

SEQ ID NO: 149247 - DNA, 21 bp, Artificial sequence
  SiRNA target sequence
cagatgaagaaagagcaaaag

SEQ ID NO: 149248 - DNA, 21 bp, Artificial sequence
  SiRNA target sequence
agatgaagaaagagcaaaagt

SEQ ID NO: 149249 - DNA, 21 bp, Artificial sequence
  SiRNA target sequence
gatgaagaaagagcaaaagtt

SEQ ID NO: 149250 - DNA, 21 bp, Artificial sequence
  SiRNA target sequence
atgaagaaagagcaaaagttg

SEQ ID NO: 149251 - DNA, 21 bp, Artificial sequence
  SiRNA target sequence
tgaagaaagagcaaaagttga

SEQ ID NO: 149252 - DNA, 21 bp, Artificial sequence
  SiRNA target sequence
gaagaaagagcaaaagttgaa

SEQ ID NO: 149253 - DNA, 21 bp, Artificial sequence
  SiRNA target sequence
aagaaagagcaaaagttgaaa

SEQ ID NO: 149254 - DNA, 21 bp, Artificial sequence
  SiRNA target sequence
agaaagagcaaaagttgaaaa

SEQ ID NO: 149255 - DNA, 21 bp, Artificial sequence
  SiRNA target sequence
gaaagagcaaaagttgaaaaa

SEQ ID NO: 149256 - DNA, 21 bp, Artificial sequence
  SiRNA target sequence
aaagagcaaaagttgaaaaag

SEQ ID NO: 149257 - DNA, 21 bp, Artificial sequence
  SiRNA target sequence
aagagcaaaagttgaaaaaga

SEQ ID NO: 149258 - DNA, 21 bp, Artificial sequence
  SiRNA target sequence
agagcaaaagttgaaaaagaa

SEQ ID NO: 149259 - DNA, 21 bp, Artificial sequence
  SiRNA target sequence
gagcaaaagttgaaaaagaat

SEQ ID NO: 149260 - DNA, 21 bp, Artificial sequence
  SiRNA target sequence
agcaaaagttgaaaaagaatt

SEQ ID NO: 149261 - DNA, 21 bp, Artificial sequence
  SiRNA target sequence
gcaaaagttgaaaaagaattt

SEQ ID NO: 149262 - DNA, 21 bp, Artificial sequence
  SiRNA target sequence
caaaagttgaaaaagaattta

SEQ ID NO: 149263 - DNA, 21 bp, Artificial sequence
  SiRNA target sequence
aaaagttgaaaaagaatttaa

SEQ ID NO: 149264 - DNA, 21 bp, Artificial sequence
  SiRNA target sequence
aaagttgaaaaagaatttaaa

SEQ ID NO: 149265 - DNA, 21 bp, Artificial sequence
  SiRNA target sequence
aagttgaaaaagaatttaaag

SEQ ID NO: 149266 - DNA, 21 bp, Artificial sequence
  SiRNA target sequence
agttgaaaaagaatttaaaga

SEQ ID NO: 149267 - DNA, 21 bp, Artificial sequence
  SiRNA target sequence
gttgaaaaagaatttaaagaa

SEQ ID NO: 149268 - DNA, 21 bp, Artificial sequence
  SiRNA target sequence
ttgaaaaagaatttaaagaaa

SEQ ID NO: 149269 - DNA, 21 bp, Artificial sequence
  SiRNA target sequence
tgaaaaagaatttaaagaaaa

SEQ ID NO: 149270 - DNA, 21 bp, Artificial sequence
  SiRNA target sequence
gaaaaagaatttaaagaaaaa

SEQ ID NO: 149271 - DNA, 21 bp, Artificial sequence
  SiRNA target sequence
aaaaagaatttaaagaaaaat

SEQ ID NO: 149272 - DNA, 21 bp, Artificial sequence
  SiRNA target sequence
aaaagaatttaaagaaaaatc

SEQ ID NO: 149273 - DNA, 21 bp, Artificial sequence
  SiRNA target sequence
aaagaatttaaagaaaaatca

SEQ ID NO: 149274 - DNA, 21 bp, Artificial sequence
  SiRNA target sequence
aagaatttaaagaaaaatcac

SEQ ID NO: 149275 - DNA, 21 bp, Artificial sequence
  SiRNA target sequence
agaatttaaagaaaaatcaca

SEQ ID NO: 149276 - DNA, 21 bp, Artificial sequence
  SiRNA target sequence
gaatttaaagaaaaatcacaa

SEQ ID NO: 149277 - DNA, 21 bp, Artificial sequence
  SiRNA target sequence
aatttaaagaaaaatcacaaa

SEQ ID NO: 149278 - DNA, 21 bp, Artificial sequence
  SiRNA target sequence
atttaaagaaaaatcacaaaa

SEQ ID NO: 149279 - DNA, 21 bp, Artificial sequence
  SiRNA target sequence
tttaaagaaaaatcacaaaaa

SEQ ID NO: 149280 - DNA, 21 bp, Artificial sequence
  SiRNA target sequence
ttaaagaaaaatcacaaaaat

SEQ ID NO: 149281 - DNA, 21 bp, Artificial sequence
  SiRNA target sequence
taaagaaaaatcacaaaaatg

SEQ ID NO: 149282 - DNA, 21 bp, Artificial sequence
  SiRNA target sequence
aaagaaaaatcacaaaaatgt

SEQ ID NO: 149283 - DNA, 21 bp, Artificial sequence
  SiRNA target sequence
aagaaaaatcacaaaaatgta

SEQ ID NO: 149284 - DNA, 21 bp, Artificial sequence
  SiRNA target sequence
agaaaaatcacaaaaatgtaa

SEQ ID NO: 149285 - DNA, 21 bp, Artificial sequence
  SiRNA target sequence
gaaaaatcacaaaaatgtaat

SEQ ID NO: 149286 - DNA, 21 bp, Artificial sequence
  SiRNA target sequence
aaaaatcacaaaaatgtaatc

SEQ ID NO: 149287 - DNA, 21 bp, Artificial sequence
  SiRNA target sequence
aaaatcacaaaaatgtaatca

SEQ ID NO: 149288 - DNA, 21 bp, Artificial sequence
  SiRNA target sequence
aaatcacaaaaatgtaatcaa

SEQ ID NO: 149289 - DNA, 21 bp, Artificial sequence
  SiRNA target sequence
aatcacaaaaatgtaatcaag

SEQ ID NO: 149290 - DNA, 21 bp, Artificial sequence
  SiRNA target sequence
atcacaaaaatgtaatcaagc

SEQ ID NO: 149291 - DNA, 21 bp, Artificial sequence
  SiRNA target sequence
tcacaaaaatgtaatcaagct

SEQ ID NO: 149292 - DNA, 21 bp, Artificial sequence
  SiRNA target sequence
cacaaaaatgtaatcaagcta

SEQ ID NO: 149293 - DNA, 21 bp, Artificial sequence
  SiRNA target sequence
acaaaaatgtaatcaagctaa

SEQ ID NO: 149294 - DNA, 21 bp, Artificial sequence
  SiRNA target sequence
caaaaatgtaatcaagctaaa

SEQ ID NO: 149295 - DNA, 21 bp, Artificial sequence
  SiRNA target sequence
aaaaatgtaatcaagctaaag

SEQ ID NO: 149296 - DNA, 21 bp, Artificial sequence
  SiRNA target sequence
aaaatgtaatcaagctaaagc

SEQ ID NO: 149297 - DNA, 21 bp, Artificial sequence
  SiRNA target sequence
aaatgtaatcaagctaaagca

SEQ ID NO: 149298 - DNA, 21 bp, Artificial sequence
  SiRNA target sequence
aatgtaatcaagctaaagcag

SEQ ID NO: 149299 - DNA, 21 bp, Artificial sequence
  SiRNA target sequence
atgtaatcaagctaaagcagt

SEQ ID NO: 149300 - DNA, 21 bp, Artificial sequence
  SiRNA target sequence
tgtaatcaagctaaagcagtt

SEQ ID NO: 149301 - DNA, 21 bp, Artificial sequence
  SiRNA target sequence
gtaatcaagctaaagcagttt

SEQ ID NO: 149302 - DNA, 21 bp, Artificial sequence
  SiRNA target sequence
taatcaagctaaagcagtttt

SEQ ID NO: 149303 - DNA, 21 bp, Artificial sequence
  SiRNA target sequence
aatcaagctaaagcagtttta

SEQ ID NO: 149304 - DNA, 21 bp, Artificial sequence
  SiRNA target sequence
atcaagctaaagcagttttat

SEQ ID NO: 149305 - DNA, 21 bp, Artificial sequence
  SiRNA target sequence
tcaagctaaagcagttttatt

SEQ ID NO: 149306 - DNA, 21 bp, Artificial sequence
  SiRNA target sequence
caagctaaagcagttttattt

SEQ ID NO: 149307 - DNA, 21 bp, Artificial sequence
  SiRNA target sequence
aagctaaagcagttttatttg

SEQ ID NO: 149308 - DNA, 21 bp, Artificial sequence
  SiRNA target sequence
agctaaagcagttttatttga

SEQ ID NO: 149309 - DNA, 21 bp, Artificial sequence
  SiRNA target sequence
gctaaagcagttttatttgat

SEQ ID NO: 149310 - DNA, 21 bp, Artificial sequence
  SiRNA target sequence
ctaaagcagttttatttgatg

SEQ ID NO: 149311 - DNA, 21 bp, Artificial sequence
  SiRNA target sequence
taaagcagttttatttgatga

SEQ ID NO: 149312 - DNA, 21 bp, Artificial sequence
  SiRNA target sequence
aaagcagttttatttgatgag

SEQ ID NO: 149313 - DNA, 21 bp, Artificial sequence
  SiRNA target sequence
aagcagttttatttgatgaga

SEQ ID NO: 149314 - DNA, 21 bp, Artificial sequence
  SiRNA target sequence
agcagttttatttgatgagaa

SEQ ID NO: 149315 - DNA, 21 bp, Artificial sequence
  SiRNA target sequence
gcagttttatttgatgagaaa

SEQ ID NO: 149316 - DNA, 21 bp, Artificial sequence
  SiRNA target sequence
cagttttatttgatgagaaaa

SEQ ID NO: 149317 - DNA, 21 bp, Artificial sequence
  SiRNA target sequence
agttttatttgatgagaaaaa

SEQ ID NO: 149318 - DNA, 21 bp, Artificial sequence
  SiRNA target sequence
gttttatttgatgagaaaaaa

SEQ ID NO: 149319 - DNA, 21 bp, Artificial sequence
  SiRNA target sequence
ttttatttgatgagaaaaaaa

SEQ ID NO: 149320 - DNA, 21 bp, Artificial sequence
  SiRNA target sequence
tttatttgatgagaaaaaaaa

SEQ ID NO: 149321 - DNA, 21 bp, Artificial sequence
  SiRNA target sequence
ttatttgatgagaaaaaaaag

SEQ ID NO: 149322 - DNA, 21 bp, Artificial sequence
  SiRNA target sequence
tatttgatgagaaaaaaaagc

SEQ ID NO: 149323 - DNA, 21 bp, Artificial sequence
  SiRNA target sequence
atttgatgagaaaaaaaagca

SEQ ID NO: 149324 - DNA, 21 bp, Artificial sequence
  SiRNA target sequence
tttgatgagaaaaaaaagcaa

SEQ ID NO: 149325 - DNA, 21 bp, Artificial sequence
  SiRNA target sequence
ttgatgagaaaaaaaagcaag

SEQ ID NO: 149326 - DNA, 21 bp, Artificial sequence
  SiRNA target sequence
tgatgagaaaaaaaagcaaga

SEQ ID NO: 149327 - DNA, 21 bp, Artificial sequence
  SiRNA target sequence
gatgagaaaaaaaagcaagag

SEQ ID NO: 149328 - DNA, 21 bp, Artificial sequence
  SiRNA target sequence
atgagaaaaaaaagcaagagt

SEQ ID NO: 149329 - DNA, 21 bp, Artificial sequence
  SiRNA target sequence
tgagaaaaaaaagcaagagta

SEQ ID NO: 149330 - DNA, 21 bp, Artificial sequence
  SiRNA target sequence
gagaaaaaaaagcaagagtat

SEQ ID NO: 149331 - DNA, 21 bp, Artificial sequence
  SiRNA target sequence
agaaaaaaaagcaagagtatg

SEQ ID NO: 149332 - DNA, 21 bp, Artificial sequence
  SiRNA target sequence
gaaaaaaaagcaagagtatga

SEQ ID NO: 149333 - DNA, 21 bp, Artificial sequence
  SiRNA target sequence
aaaaaaaagcaagagtatgat

SEQ ID NO: 149334 - DNA, 21 bp, Artificial sequence
  SiRNA target sequence
aaaaaaagcaagagtatgata

SEQ ID NO: 149335 - DNA, 21 bp, Artificial sequence
  SiRNA target sequence
aaaaaagcaagagtatgatat

SEQ ID NO: 149336 - DNA, 21 bp, Artificial sequence
  SiRNA target sequence
aaaaagcaagagtatgatatg

SEQ ID NO: 149337 - DNA, 21 bp, Artificial sequence
  SiRNA target sequence
aaaagcaagagtatgatatgg

SEQ ID NO: 149338 - DNA, 21 bp, Artificial sequence
  SiRNA target sequence
aaagcaagagtatgatatggg

SEQ ID NO: 149339 - DNA, 21 bp, Artificial sequence
  SiRNA target sequence
aagcaagagtatgatatggga

SEQ ID NO: 149340 - DNA, 21 bp, Artificial sequence
  SiRNA target sequence
agcaagagtatgatatgggaa

SEQ ID NO: 149341 - DNA, 21 bp, Artificial sequence
  SiRNA target sequence
gcaagagtatgatatgggaat

SEQ ID NO: 149342 - DNA, 21 bp, Artificial sequence
  SiRNA target sequence
caagagtatgatatgggaatg

SEQ ID NO: 149343 - DNA, 21 bp, Artificial sequence
  SiRNA target sequence
aagagtatgatatgggaatga

SEQ ID NO: 149344 - DNA, 21 bp, Artificial sequence
  SiRNA target sequence
agagtatgatatgggaatgac

SEQ ID NO: 149345 - DNA, 21 bp, Artificial sequence
  SiRNA target sequence
gagtatgatatgggaatgact

SEQ ID NO: 149346 - DNA, 21 bp, Artificial sequence
  SiRNA target sequence
agtatgatatgggaatgactg

SEQ ID NO: 149347 - DNA, 21 bp, Artificial sequence
  SiRNA target sequence
gtatgatatgggaatgactgg

SEQ ID NO: 149348 - DNA, 21 bp, Artificial sequence
  SiRNA target sequence
tatgatatgggaatgactggc

SEQ ID NO: 149349 - DNA, 21 bp, Artificial sequence
  SiRNA target sequence
atgatatgggaatgactggcg

SEQ ID NO: 149350 - DNA, 21 bp, Artificial sequence
  SiRNA target sequence
tgatatgggaatgactggcga

SEQ ID NO: 149351 - DNA, 21 bp, Artificial sequence
  SiRNA target sequence
gatatgggaatgactggcgat

SEQ ID NO: 149352 - DNA, 21 bp, Artificial sequence
  SiRNA target sequence
atatgggaatgactggcgatt

SEQ ID NO: 149353 - DNA, 21 bp, Artificial sequence
  SiRNA target sequence
tatgggaatgactggcgattt

SEQ ID NO: 149354 - DNA, 21 bp, Artificial sequence
  SiRNA target sequence
atgggaatgactggcgatttt

SEQ ID NO: 149355 - DNA, 21 bp, Artificial sequence
  SiRNA target sequence
tgggaatgactggcgattttg

SEQ ID NO: 149356 - DNA, 21 bp, Artificial sequence
  SiRNA target sequence
gggaatgactggcgattttgg

SEQ ID NO: 149357 - DNA, 21 bp, Artificial sequence
  SiRNA target sequence
ggaatgactggcgattttgga

SEQ ID NO: 149358 - DNA, 21 bp, Artificial sequence
  SiRNA target sequence
gaatgactggcgattttggat

SEQ ID NO: 149359 - DNA, 21 bp, Artificial sequence
  SiRNA target sequence
aatgactggcgattttggatt

SEQ ID NO: 149360 - DNA, 21 bp, Artificial sequence
  SiRNA target sequence
atgactggcgattttggattt

SEQ ID NO: 149361 - DNA, 21 bp, Artificial sequence
  SiRNA target sequence
tgactggcgattttggatttt

SEQ ID NO: 149362 - DNA, 21 bp, Artificial sequence
  SiRNA target sequence
gactggcgattttggattttc

SEQ ID NO: 149363 - DNA, 21 bp, Artificial sequence
  SiRNA target sequence
actggcgattttggattttct

SEQ ID NO: 149364 - DNA, 21 bp, Artificial sequence
  SiRNA target sequence
ctggcgattttggattttctg

SEQ ID NO: 149365 - DNA, 21 bp, Artificial sequence
  SiRNA target sequence
tggcgattttggattttctgc

SEQ ID NO: 149366 - DNA, 21 bp, Artificial sequence
  SiRNA target sequence
ggcgattttggattttctgca

SEQ ID NO: 149367 - DNA, 21 bp, Artificial sequence
  SiRNA target sequence
gcgattttggattttctgcag

SEQ ID NO: 149368 - DNA, 21 bp, Artificial sequence
  SiRNA target sequence
cgattttggattttctgcagg

SEQ ID NO: 149369 - DNA, 21 bp, Artificial sequence
  SiRNA target sequence
gattttggattttctgcaggt

SEQ ID NO: 149370 - DNA, 21 bp, Artificial sequence
  SiRNA target sequence
attttggattttctgcaggtg

SEQ ID NO: 149371 - DNA, 21 bp, Artificial sequence
  SiRNA target sequence
ttttggattttctgcaggtgg

SEQ ID NO: 149372 - DNA, 21 bp, Artificial sequence
  SiRNA target sequence
tttggattttctgcaggtggt

SEQ ID NO: 149373 - DNA, 21 bp, Artificial sequence
  SiRNA target sequence
ttggattttctgcaggtggtg

SEQ ID NO: 149374 - DNA, 21 bp, Artificial sequence
  SiRNA target sequence
tggattttctgcaggtggtgg

SEQ ID NO: 149375 - DNA, 21 bp, Artificial sequence
  SiRNA target sequence
ggattttctgcaggtggtgga

SEQ ID NO: 149376 - DNA, 21 bp, Artificial sequence
  SiRNA target sequence
gattttctgcaggtggtggag

SEQ ID NO: 149377 - DNA, 21 bp, Artificial sequence
  SiRNA target sequence
attttctgcaggtggtggaga

SEQ ID NO: 149378 - DNA, 21 bp, Artificial sequence
  SiRNA target sequence
ttttctgcaggtggtggagac

SEQ ID NO: 149379 - DNA, 21 bp, Artificial sequence
  SiRNA target sequence
tttctgcaggtggtggagact

SEQ ID NO: 149380 - DNA, 21 bp, Artificial sequence
  SiRNA target sequence
ttctgcaggtggtggagactt

SEQ ID NO: 149381 - DNA, 21 bp, Artificial sequence
  SiRNA target sequence
tctgcaggtggtggagacttt

SEQ ID NO: 149382 - DNA, 21 bp, Artificial sequence
  SiRNA target sequence
ctgcaggtggtggagactttt

SEQ ID NO: 149383 - DNA, 21 bp, Artificial sequence
  SiRNA target sequence
tgcaggtggtggagacttttt

SEQ ID NO: 149384 - DNA, 21 bp, Artificial sequence
  SiRNA target sequence
gcaggtggtggagactttttc

SEQ ID NO: 149385 - DNA, 21 bp, Artificial sequence
  SiRNA target sequence
caggtggtggagactttttcg

SEQ ID NO: 149386 - DNA, 21 bp, Artificial sequence
  SiRNA target sequence
aggtggtggagactttttcga

SEQ ID NO: 149387 - DNA, 21 bp, Artificial sequence
  SiRNA target sequence
ggtggtggagactttttcgat

SEQ ID NO: 149388 - DNA, 21 bp, Artificial sequence
  SiRNA target sequence
gtggtggagactttttcgata

SEQ ID NO: 149389 - DNA, 21 bp, Artificial sequence
  SiRNA target sequence
tggtggagactttttcgatat

SEQ ID NO: 149390 - DNA, 21 bp, Artificial sequence
  SiRNA target sequence
ggtggagactttttcgatatt

SEQ ID NO: 149391 - DNA, 21 bp, Artificial sequence
  SiRNA target sequence
gtggagactttttcgatattt

SEQ ID NO: 149392 - DNA, 21 bp, Artificial sequence
  SiRNA target sequence
tggagactttttcgatatttt

SEQ ID NO: 149393 - DNA, 21 bp, Artificial sequence
  SiRNA target sequence
ggagactttttcgatattttt

SEQ ID NO: 149394 - DNA, 21 bp, Artificial sequence
  SiRNA target sequence
gagactttttcgatatttttt

SEQ ID NO: 149395 - DNA, 21 bp, Artificial sequence
  SiRNA target sequence
agactttttcgatattttttc

SEQ ID NO: 149396 - DNA, 21 bp, Artificial sequence
  SiRNA target sequence
gactttttcgatattttttca

SEQ ID NO: 149397 - DNA, 21 bp, Artificial sequence
  SiRNA target sequence
actttttcgatattttttcaa

SEQ ID NO: 149398 - DNA, 21 bp, Artificial sequence
  SiRNA target sequence
ctttttcgatattttttcaag

SEQ ID NO: 149399 - DNA, 21 bp, Artificial sequence
  SiRNA target sequence
tttttcgatattttttcaagt

SEQ ID NO: 149400 - DNA, 21 bp, Artificial sequence
  SiRNA target sequence
ttttcgatattttttcaagtt

SEQ ID NO: 149401 - DNA, 21 bp, Artificial sequence
  SiRNA target sequence
tttcgatattttttcaagttt

SEQ ID NO: 149402 - DNA, 21 bp, Artificial sequence
  SiRNA target sequence
ttcgatattttttcaagtttt

SEQ ID NO: 149403 - DNA, 21 bp, Artificial sequence
  SiRNA target sequence
tcgatattttttcaagtttta

SEQ ID NO: 149404 - DNA, 21 bp, Artificial sequence
  SiRNA target sequence
cgatattttttcaagttttac

SEQ ID NO: 149405 - DNA, 21 bp, Artificial sequence
  SiRNA target sequence
gatattttttcaagttttact

SEQ ID NO: 149406 - DNA, 21 bp, Artificial sequence
  SiRNA target sequence
atattttttcaagttttactg

SEQ ID NO: 149407 - DNA, 21 bp, Artificial sequence
  SiRNA target sequence
tattttttcaagttttactgg

SEQ ID NO: 149408 - DNA, 21 bp, Artificial sequence
  SiRNA target sequence
attttttcaagttttactggt

SEQ ID NO: 149409 - DNA, 21 bp, Artificial sequence
  SiRNA target sequence
ttttttcaagttttactggtg

SEQ ID NO: 149410 - DNA, 21 bp, Artificial sequence
  SiRNA target sequence
tttttcaagttttactggtgg

SEQ ID NO: 149411 - DNA, 21 bp, Artificial sequence
  SiRNA target sequence
ttttcaagttttactggtgga

SEQ ID NO: 149412 - DNA, 21 bp, Artificial sequence
  SiRNA target sequence
tttcaagttttactggtggag

SEQ ID NO: 149413 - DNA, 21 bp, Artificial sequence
  SiRNA target sequence
ttcaagttttactggtggagg

SEQ ID NO: 149414 - DNA, 21 bp, Artificial sequence
  SiRNA target sequence
tcaagttttactggtggagga

SEQ ID NO: 149415 - DNA, 21 bp, Artificial sequence
  SiRNA target sequence
caagttttactggtggaggaa

SEQ ID NO: 149416 - DNA, 21 bp, Artificial sequence
  SiRNA target sequence
aagttttactggtggaggaag

SEQ ID NO: 149417 - DNA, 21 bp, Artificial sequence
  SiRNA target sequence
agttttactggtggaggaaga

SEQ ID NO: 149418 - DNA, 21 bp, Artificial sequence
  SiRNA target sequence
gttttactggtggaggaagaa

SEQ ID NO: 149419 - DNA, 21 bp, Artificial sequence
  SiRNA target sequence
ttttactggtggaggaagaag

SEQ ID NO: 149420 - DNA, 21 bp, Artificial sequence
  SiRNA target sequence
tttactggtggaggaagaaga

SEQ ID NO: 149421 - DNA, 21 bp, Artificial sequence
  SiRNA target sequence
ttactggtggaggaagaagaa

SEQ ID NO: 149422 - DNA, 21 bp, Artificial sequence
  SiRNA target sequence
tactggtggaggaagaagaaa

SEQ ID NO: 149423 - DNA, 21 bp, Artificial sequence
  SiRNA target sequence
actggtggaggaagaagaaat

SEQ ID NO: 149424 - DNA, 21 bp, Artificial sequence
  SiRNA target sequence
ctggtggaggaagaagaaatc

SEQ ID NO: 149425 - DNA, 21 bp, Artificial sequence
  SiRNA target sequence
tggtggaggaagaagaaatcg

SEQ ID NO: 149426 - DNA, 21 bp, Artificial sequence
  SiRNA target sequence
ggtggaggaagaagaaatcga

SEQ ID NO: 149427 - DNA, 21 bp, Artificial sequence
  SiRNA target sequence
gtggaggaagaagaaatcgag

SEQ ID NO: 149428 - DNA, 21 bp, Artificial sequence
  SiRNA target sequence
tggaggaagaagaaatcgagt

SEQ ID NO: 149429 - DNA, 21 bp, Artificial sequence
  SiRNA target sequence
ggaggaagaagaaatcgagta

SEQ ID NO: 149430 - DNA, 21 bp, Artificial sequence
  SiRNA target sequence
gaggaagaagaaatcgagtac

SEQ ID NO: 149431 - DNA, 21 bp, Artificial sequence
  SiRNA target sequence
aggaagaagaaatcgagtaca

SEQ ID NO: 149432 - DNA, 21 bp, Artificial sequence
  SiRNA target sequence
ggaagaagaaatcgagtacaa

SEQ ID NO: 149433 - DNA, 21 bp, Artificial sequence
  SiRNA target sequence
gaagaagaaatcgagtacaaa

SEQ ID NO: 149434 - DNA, 21 bp, Artificial sequence
  SiRNA target sequence
aagaagaaatcgagtacaaaa

SEQ ID NO: 149435 - DNA, 21 bp, Artificial sequence
  SiRNA target sequence
agaagaaatcgagtacaaaaa

SEQ ID NO: 149436 - DNA, 21 bp, Artificial sequence
  SiRNA target sequence
gaagaaatcgagtacaaaaag

SEQ ID NO: 149437 - DNA, 21 bp, Artificial sequence
  SiRNA target sequence
aagaaatcgagtacaaaaagt

SEQ ID NO: 149438 - DNA, 21 bp, Artificial sequence
  SiRNA target sequence
agaaatcgagtacaaaaagtt

SEQ ID NO: 149439 - DNA, 21 bp, Artificial sequence
  SiRNA target sequence
gaaatcgagtacaaaaagttc

SEQ ID NO: 149440 - DNA, 21 bp, Artificial sequence
  SiRNA target sequence
aaatcgagtacaaaaagttca

SEQ ID NO: 149441 - DNA, 21 bp, Artificial sequence
  SiRNA target sequence
aatcgagtacaaaaagttcaa

SEQ ID NO: 149442 - DNA, 21 bp, Artificial sequence
  SiRNA target sequence
atcgagtacaaaaagttcaag

SEQ ID NO: 149443 - DNA, 21 bp, Artificial sequence
  SiRNA target sequence
tcgagtacaaaaagttcaaga

SEQ ID NO: 149444 - DNA, 21 bp, Artificial sequence
  SiRNA target sequence
cgagtacaaaaagttcaagat

SEQ ID NO: 149445 - DNA, 21 bp, Artificial sequence
  SiRNA target sequence
gagtacaaaaagttcaagata

SEQ ID NO: 149446 - DNA, 21 bp, Artificial sequence
  SiRNA target sequence
agtacaaaaagttcaagatac

SEQ ID NO: 149447 - DNA, 21 bp, Artificial sequence
  SiRNA target sequence
gtacaaaaagttcaagataca

SEQ ID NO: 149448 - DNA, 21 bp, Artificial sequence
  SiRNA target sequence
tacaaaaagttcaagatacag

SEQ ID NO: 149449 - DNA, 21 bp, Artificial sequence
  SiRNA target sequence
acaaaaagttcaagatacaga

SEQ ID NO: 149450 - DNA, 21 bp, Artificial sequence
  SiRNA target sequence
caaaaagttcaagatacagaa

SEQ ID NO: 149451 - DNA, 21 bp, Artificial sequence
  SiRNA target sequence
aaaaagttcaagatacagaat

SEQ ID NO: 149452 - DNA, 21 bp, Artificial sequence
  SiRNA target sequence
aaaagttcaagatacagaata

SEQ ID NO: 149453 - DNA, 21 bp, Artificial sequence
  SiRNA target sequence
aaagttcaagatacagaatac

SEQ ID NO: 149454 - DNA, 21 bp, Artificial sequence
  SiRNA target sequence
aagttcaagatacagaatacg

SEQ ID NO: 149455 - DNA, 21 bp, Artificial sequence
  SiRNA target sequence
agttcaagatacagaatacga

SEQ ID NO: 149456 - DNA, 21 bp, Artificial sequence
  SiRNA target sequence
gttcaagatacagaatacgag

SEQ ID NO: 149457 - DNA, 21 bp, Artificial sequence
  SiRNA target sequence
ttcaagatacagaatacgagt

SEQ ID NO: 149458 - DNA, 21 bp, Artificial sequence
  SiRNA target sequence
tcaagatacagaatacgagtt

SEQ ID NO: 149459 - DNA, 21 bp, Artificial sequence
  SiRNA target sequence
caagatacagaatacgagttt

SEQ ID NO: 149460 - DNA, 21 bp, Artificial sequence
  SiRNA target sequence
aagatacagaatacgagttta

SEQ ID NO: 149461 - DNA, 21 bp, Artificial sequence
  SiRNA target sequence
agatacagaatacgagtttaa

SEQ ID NO: 149462 - DNA, 21 bp, Artificial sequence
  SiRNA target sequence
gatacagaatacgagtttaat

SEQ ID NO: 149463 - DNA, 21 bp, Artificial sequence
  SiRNA target sequence
atacagaatacgagtttaata

SEQ ID NO: 149464 - DNA, 21 bp, Artificial sequence
  SiRNA target sequence
tacagaatacgagtttaatat

SEQ ID NO: 149465 - DNA, 21 bp, Artificial sequence
  SiRNA target sequence
acagaatacgagtttaatatt

SEQ ID NO: 149466 - DNA, 21 bp, Artificial sequence
  SiRNA target sequence
cagaatacgagtttaatattt

SEQ ID NO: 149467 - DNA, 21 bp, Artificial sequence
  SiRNA target sequence
agaatacgagtttaatatttc

SEQ ID NO: 149468 - DNA, 21 bp, Artificial sequence
  SiRNA target sequence
gaatacgagtttaatatttcg

SEQ ID NO: 149469 - DNA, 21 bp, Artificial sequence
  SiRNA target sequence
aatacgagtttaatatttcgt

SEQ ID NO: 149470 - DNA, 21 bp, Artificial sequence
  SiRNA target sequence
atacgagtttaatatttcgtt

SEQ ID NO: 149471 - DNA, 21 bp, Artificial sequence
  SiRNA target sequence
tacgagtttaatatttcgttg

SEQ ID NO: 149472 - DNA, 21 bp, Artificial sequence
  SiRNA target sequence
acgagtttaatatttcgttga

SEQ ID NO: 149473 - DNA, 21 bp, Artificial sequence
  SiRNA target sequence
cgagtttaatatttcgttgaa

SEQ ID NO: 149474 - DNA, 21 bp, Artificial sequence
  SiRNA target sequence
gagtttaatatttcgttgaag

SEQ ID NO: 149475 - DNA, 21 bp, Artificial sequence
  SiRNA target sequence
agtttaatatttcgttgaagg

SEQ ID NO: 149476 - DNA, 21 bp, Artificial sequence
  SiRNA target sequence
gtttaatatttcgttgaagga

SEQ ID NO: 149477 - DNA, 21 bp, Artificial sequence
  SiRNA target sequence
tttaatatttcgttgaaggaa

SEQ ID NO: 149478 - DNA, 21 bp, Artificial sequence
  SiRNA target sequence
ttaatatttcgttgaaggaag

SEQ ID NO: 149479 - DNA, 21 bp, Artificial sequence
  SiRNA target sequence
taatatttcgttgaaggaagc

SEQ ID NO: 149480 - DNA, 21 bp, Artificial sequence
  SiRNA target sequence
aatatttcgttgaaggaagct

SEQ ID NO: 149481 - DNA, 21 bp, Artificial sequence
  SiRNA target sequence
atatttcgttgaaggaagctt

SEQ ID NO: 149482 - DNA, 21 bp, Artificial sequence
  SiRNA target sequence
tatttcgttgaaggaagctta

SEQ ID NO: 149483 - DNA, 21 bp, Artificial sequence
  SiRNA target sequence
atttcgttgaaggaagcttat

SEQ ID NO: 149484 - DNA, 21 bp, Artificial sequence
  SiRNA target sequence
tttcgttgaaggaagcttata

SEQ ID NO: 149485 - DNA, 21 bp, Artificial sequence
  SiRNA target sequence
ttcgttgaaggaagcttatat

SEQ ID NO: 149486 - DNA, 21 bp, Artificial sequence
  SiRNA target sequence
tcgttgaaggaagcttatatg

SEQ ID NO: 149487 - DNA, 21 bp, Artificial sequence
  SiRNA target sequence
cgttgaaggaagcttatatgg

SEQ ID NO: 149488 - DNA, 21 bp, Artificial sequence
  SiRNA target sequence
gttgaaggaagcttatatggg

SEQ ID NO: 149489 - DNA, 21 bp, Artificial sequence
  SiRNA target sequence
ttgaaggaagcttatatggga

SEQ ID NO: 149490 - DNA, 21 bp, Artificial sequence
  SiRNA target sequence
tgaaggaagcttatatgggaa

SEQ ID NO: 149491 - DNA, 21 bp, Artificial sequence
  SiRNA target sequence
gaaggaagcttatatgggaaa

SEQ ID NO: 149492 - DNA, 21 bp, Artificial sequence
  SiRNA target sequence
aaggaagcttatatgggaaag

SEQ ID NO: 149493 - DNA, 21 bp, Artificial sequence
  SiRNA target sequence
aggaagcttatatgggaaagc

SEQ ID NO: 149494 - DNA, 21 bp, Artificial sequence
  SiRNA target sequence
ggaagcttatatgggaaagcg

SEQ ID NO: 149495 - DNA, 21 bp, Artificial sequence
  SiRNA target sequence
gaagcttatatgggaaagcga

SEQ ID NO: 149496 - DNA, 21 bp, Artificial sequence
  SiRNA target sequence
aagcttatatgggaaagcgag

SEQ ID NO: 149497 - DNA, 21 bp, Artificial sequence
  SiRNA target sequence
agcttatatgggaaagcgagc

SEQ ID NO: 149498 - DNA, 21 bp, Artificial sequence
  SiRNA target sequence
gcttatatgggaaagcgagct

SEQ ID NO: 149499 - DNA, 21 bp, Artificial sequence
  SiRNA target sequence
cttatatgggaaagcgagcta

SEQ ID NO: 149500 - DNA, 21 bp, Artificial sequence
  SiRNA target sequence
ttatatgggaaagcgagctag

SEQ ID NO: 149501 - DNA, 21 bp, Artificial sequence
  SiRNA target sequence
tatatgggaaagcgagctagt

SEQ ID NO: 149502 - DNA, 21 bp, Artificial sequence
  SiRNA target sequence
atatgggaaagcgagctagtt

SEQ ID NO: 149503 - DNA, 21 bp, Artificial sequence
  SiRNA target sequence
tatgggaaagcgagctagttt

SEQ ID NO: 149504 - DNA, 21 bp, Artificial sequence
  SiRNA target sequence
atgggaaagcgagctagtttt

SEQ ID NO: 149505 - DNA, 21 bp, Artificial sequence
  SiRNA target sequence
tgggaaagcgagctagtttta

SEQ ID NO: 149506 - DNA, 21 bp, Artificial sequence
  SiRNA target sequence
gggaaagcgagctagttttaa

SEQ ID NO: 149507 - DNA, 21 bp, Artificial sequence
  SiRNA target sequence
ggaaagcgagctagttttaat

SEQ ID NO: 149508 - DNA, 21 bp, Artificial sequence
  SiRNA target sequence
gaaagcgagctagttttaatg

SEQ ID NO: 149509 - DNA, 21 bp, Artificial sequence
  SiRNA target sequence
aaagcgagctagttttaatgt

SEQ ID NO: 149510 - DNA, 21 bp, Artificial sequence
  SiRNA target sequence
aagcgagctagttttaatgta

SEQ ID NO: 149511 - DNA, 21 bp, Artificial sequence
  SiRNA target sequence
agcgagctagttttaatgtaa

SEQ ID NO: 149512 - DNA, 21 bp, Artificial sequence
  SiRNA target sequence
gcgagctagttttaatgtaaa

SEQ ID NO: 149513 - DNA, 21 bp, Artificial sequence
  SiRNA target sequence
cgagctagttttaatgtaaaa

SEQ ID NO: 149514 - DNA, 21 bp, Artificial sequence
  SiRNA target sequence
gagctagttttaatgtaaaag

SEQ ID NO: 149515 - DNA, 21 bp, Artificial sequence
  SiRNA target sequence
agctagttttaatgtaaaagt

SEQ ID NO: 149516 - DNA, 21 bp, Artificial sequence
  SiRNA target sequence
gctagttttaatgtaaaagtg

SEQ ID NO: 149517 - DNA, 21 bp, Artificial sequence
  SiRNA target sequence
ctagttttaatgtaaaagtgc

SEQ ID NO: 149518 - DNA, 21 bp, Artificial sequence
  SiRNA target sequence
tagttttaatgtaaaagtgca

SEQ ID NO: 149519 - DNA, 21 bp, Artificial sequence
  SiRNA target sequence
agttttaatgtaaaagtgcaa

SEQ ID NO: 149520 - DNA, 21 bp, Artificial sequence
  SiRNA target sequence
gttttaatgtaaaagtgcaaa

SEQ ID NO: 149521 - DNA, 21 bp, Artificial sequence
  SiRNA target sequence
ttttaatgtaaaagtgcaaag

SEQ ID NO: 149522 - DNA, 21 bp, Artificial sequence
  SiRNA target sequence
tttaatgtaaaagtgcaaaga

SEQ ID NO: 149523 - DNA, 21 bp, Artificial sequence
  SiRNA target sequence
ttaatgtaaaagtgcaaagag

SEQ ID NO: 149524 - DNA, 21 bp, Artificial sequence
  SiRNA target sequence
taatgtaaaagtgcaaagaga

SEQ ID NO: 149525 - DNA, 21 bp, Artificial sequence
  SiRNA target sequence
aatgtaaaagtgcaaagagaa

SEQ ID NO: 149526 - DNA, 21 bp, Artificial sequence
  SiRNA target sequence
atgtaaaagtgcaaagagaat

SEQ ID NO: 149527 - DNA, 21 bp, Artificial sequence
  SiRNA target sequence
tgtaaaagtgcaaagagaatg

SEQ ID NO: 149528 - DNA, 21 bp, Artificial sequence
  SiRNA target sequence
gtaaaagtgcaaagagaatgt

SEQ ID NO: 149529 - DNA, 21 bp, Artificial sequence
  SiRNA target sequence
taaaagtgcaaagagaatgtt

SEQ ID NO: 149530 - DNA, 21 bp, Artificial sequence
  SiRNA target sequence
aaaagtgcaaagagaatgttc

SEQ ID NO: 149531 - DNA, 21 bp, Artificial sequence
  SiRNA target sequence
aaagtgcaaagagaatgttct

SEQ ID NO: 149532 - DNA, 21 bp, Artificial sequence
  SiRNA target sequence
aagtgcaaagagaatgttctg

SEQ ID NO: 149533 - DNA, 21 bp, Artificial sequence
  SiRNA target sequence
agtgcaaagagaatgttctgc

SEQ ID NO: 149534 - DNA, 21 bp, Artificial sequence
  SiRNA target sequence
gtgcaaagagaatgttctgcg

SEQ ID NO: 149535 - DNA, 21 bp, Artificial sequence
  SiRNA target sequence
tgcaaagagaatgttctgcgt

SEQ ID NO: 149536 - DNA, 21 bp, Artificial sequence
  SiRNA target sequence
gcaaagagaatgttctgcgtg

SEQ ID NO: 149537 - DNA, 21 bp, Artificial sequence
  SiRNA target sequence
caaagagaatgttctgcgtgt

SEQ ID NO: 149538 - DNA, 21 bp, Artificial sequence
  SiRNA target sequence
aaagagaatgttctgcgtgta

SEQ ID NO: 149539 - DNA, 21 bp, Artificial sequence
  SiRNA target sequence
aagagaatgttctgcgtgtaa

SEQ ID NO: 149540 - DNA, 21 bp, Artificial sequence
  SiRNA target sequence
agagaatgttctgcgtgtaac

SEQ ID NO: 149541 - DNA, 21 bp, Artificial sequence
  SiRNA target sequence
gagaatgttctgcgtgtaacg

SEQ ID NO: 149542 - DNA, 21 bp, Artificial sequence
  SiRNA target sequence
agaatgttctgcgtgtaacgg

SEQ ID NO: 149543 - DNA, 21 bp, Artificial sequence
  SiRNA target sequence
gaatgttctgcgtgtaacggt

SEQ ID NO: 149544 - DNA, 21 bp, Artificial sequence
  SiRNA target sequence
aatgttctgcgtgtaacggta

SEQ ID NO: 149545 - DNA, 21 bp, Artificial sequence
  SiRNA target sequence
atgttctgcgtgtaacggtaa

SEQ ID NO: 149546 - DNA, 21 bp, Artificial sequence
  SiRNA target sequence
tgttctgcgtgtaacggtaaa

SEQ ID NO: 149547 - DNA, 21 bp, Artificial sequence
  SiRNA target sequence
gttctgcgtgtaacggtaaag

SEQ ID NO: 149548 - DNA, 21 bp, Artificial sequence
  SiRNA target sequence
ttctgcgtgtaacggtaaagg

SEQ ID NO: 149549 - DNA, 21 bp, Artificial sequence
  SiRNA target sequence
tctgcgtgtaacggtaaagga

SEQ ID NO: 149550 - DNA, 21 bp, Artificial sequence
  SiRNA target sequence
ctgcgtgtaacggtaaaggag

SEQ ID NO: 149551 - DNA, 21 bp, Artificial sequence
  SiRNA target sequence
tgcgtgtaacggtaaaggagg

SEQ ID NO: 149552 - DNA, 21 bp, Artificial sequence
  SiRNA target sequence
gcgtgtaacggtaaaggagga

SEQ ID NO: 149553 - DNA, 21 bp, Artificial sequence
  SiRNA target sequence
cgtgtaacggtaaaggaggag

SEQ ID NO: 149554 - DNA, 21 bp, Artificial sequence
  SiRNA target sequence
gtgtaacggtaaaggaggaga

SEQ ID NO: 149555 - DNA, 21 bp, Artificial sequence
  SiRNA target sequence
tgtaacggtaaaggaggagac

SEQ ID NO: 149556 - DNA, 21 bp, Artificial sequence
  SiRNA target sequence
gtaacggtaaaggaggagaca

SEQ ID NO: 149557 - DNA, 21 bp, Artificial sequence
  SiRNA target sequence
taacggtaaaggaggagacag

SEQ ID NO: 149558 - DNA, 21 bp, Artificial sequence
  SiRNA target sequence
aacggtaaaggaggagacagt

SEQ ID NO: 149559 - DNA, 21 bp, Artificial sequence
  SiRNA target sequence
acggtaaaggaggagacagtg

SEQ ID NO: 149560 - DNA, 21 bp, Artificial sequence
  SiRNA target sequence
cggtaaaggaggagacagtgt

SEQ ID NO: 149561 - DNA, 21 bp, Artificial sequence
  SiRNA target sequence
ggtaaaggaggagacagtgtt

SEQ ID NO: 149562 - DNA, 21 bp, Artificial sequence
  SiRNA target sequence
gtaaaggaggagacagtgttg

SEQ ID NO: 149563 - DNA, 21 bp, Artificial sequence
  SiRNA target sequence
taaaggaggagacagtgttga

SEQ ID NO: 149564 - DNA, 21 bp, Artificial sequence
  SiRNA target sequence
aaaggaggagacagtgttgaa

SEQ ID NO: 149565 - DNA, 21 bp, Artificial sequence
  SiRNA target sequence
aaggaggagacagtgttgaaa

SEQ ID NO: 149566 - DNA, 21 bp, Artificial sequence
  SiRNA target sequence
aggaggagacagtgttgaaac

SEQ ID NO: 149567 - DNA, 21 bp, Artificial sequence
  SiRNA target sequence
ggaggagacagtgttgaaaca

SEQ ID NO: 149568 - DNA, 21 bp, Artificial sequence
  SiRNA target sequence
gaggagacagtgttgaaacat

SEQ ID NO: 149569 - DNA, 21 bp, Artificial sequence
  SiRNA target sequence
aggagacagtgttgaaacatg

SEQ ID NO: 149570 - DNA, 21 bp, Artificial sequence
  SiRNA target sequence
ggagacagtgttgaaacatgt

SEQ ID NO: 149571 - DNA, 21 bp, Artificial sequence
  SiRNA target sequence
gagacagtgttgaaacatgtg

SEQ ID NO: 149572 - DNA, 21 bp, Artificial sequence
  SiRNA target sequence
agacagtgttgaaacatgtga

SEQ ID NO: 149573 - DNA, 21 bp, Artificial sequence
  SiRNA target sequence
gacagtgttgaaacatgtgaa

SEQ ID NO: 149574 - DNA, 21 bp, Artificial sequence
  SiRNA target sequence
acagtgttgaaacatgtgaac

SEQ ID NO: 149575 - DNA, 21 bp, Artificial sequence
  SiRNA target sequence
cagtgttgaaacatgtgaacc

SEQ ID NO: 149576 - DNA, 21 bp, Artificial sequence
  SiRNA target sequence
agtgttgaaacatgtgaacca

SEQ ID NO: 149577 - DNA, 21 bp, Artificial sequence
  SiRNA target sequence
gtgttgaaacatgtgaaccat

SEQ ID NO: 149578 - DNA, 21 bp, Artificial sequence
  SiRNA target sequence
tgttgaaacatgtgaaccatg

SEQ ID NO: 149579 - DNA, 21 bp, Artificial sequence
  SiRNA target sequence
gttgaaacatgtgaaccatgt

SEQ ID NO: 149580 - DNA, 21 bp, Artificial sequence
  SiRNA target sequence
ttgaaacatgtgaaccatgta

SEQ ID NO: 149581 - DNA, 21 bp, Artificial sequence
  SiRNA target sequence
tgaaacatgtgaaccatgtaa

SEQ ID NO: 149582 - DNA, 21 bp, Artificial sequence
  SiRNA target sequence
gaaacatgtgaaccatgtaaa

SEQ ID NO: 149583 - DNA, 21 bp, Artificial sequence
  SiRNA target sequence
aaacatgtgaaccatgtaaag

SEQ ID NO: 149584 - DNA, 21 bp, Artificial sequence
  SiRNA target sequence
aacatgtgaaccatgtaaagg

SEQ ID NO: 149585 - DNA, 21 bp, Artificial sequence
  SiRNA target sequence
acatgtgaaccatgtaaaggt

SEQ ID NO: 149586 - DNA, 21 bp, Artificial sequence
  SiRNA target sequence
catgtgaaccatgtaaaggta

SEQ ID NO: 149587 - DNA, 21 bp, Artificial sequence
  SiRNA target sequence
atgtgaaccatgtaaaggtaa

SEQ ID NO: 149588 - DNA, 21 bp, Artificial sequence
  SiRNA target sequence
tgtgaaccatgtaaaggtaaa

SEQ ID NO: 149589 - DNA, 21 bp, Artificial sequence
  SiRNA target sequence
gtgaaccatgtaaaggtaaag

SEQ ID NO: 149590 - DNA, 21 bp, Artificial sequence
  SiRNA target sequence
tgaaccatgtaaaggtaaagg

SEQ ID NO: 149591 - DNA, 21 bp, Artificial sequence
  SiRNA target sequence
gaaccatgtaaaggtaaaggt

SEQ ID NO: 149592 - DNA, 21 bp, Artificial sequence
  SiRNA target sequence
aaccatgtaaaggtaaaggta

SEQ ID NO: 149593 - DNA, 21 bp, Artificial sequence
  SiRNA target sequence
accatgtaaaggtaaaggtaa

SEQ ID NO: 149594 - DNA, 21 bp, Artificial sequence
  SiRNA target sequence
ccatgtaaaggtaaaggtaag

SEQ ID NO: 149595 - DNA, 21 bp, Artificial sequence
  SiRNA target sequence
catgtaaaggtaaaggtaagg

SEQ ID NO: 149596 - DNA, 21 bp, Artificial sequence
  SiRNA target sequence
atgtaaaggtaaaggtaaggt

SEQ ID NO: 149597 - DNA, 21 bp, Artificial sequence
  SiRNA target sequence
tgtaaaggtaaaggtaaggta

SEQ ID NO: 149598 - DNA, 21 bp, Artificial sequence
  SiRNA target sequence
gtaaaggtaaaggtaaggtag

SEQ ID NO: 149599 - DNA, 21 bp, Artificial sequence
  SiRNA target sequence
taaaggtaaaggtaaggtaga

SEQ ID NO: 149600 - DNA, 21 bp, Artificial sequence
  SiRNA target sequence
aaaggtaaaggtaaggtagaa

SEQ ID NO: 149601 - DNA, 21 bp, Artificial sequence
  SiRNA target sequence
aaggtaaaggtaaggtagaac

SEQ ID NO: 149602 - DNA, 21 bp, Artificial sequence
  SiRNA target sequence
aggtaaaggtaaggtagaaca

SEQ ID NO: 149603 - DNA, 21 bp, Artificial sequence
  SiRNA target sequence
ggtaaaggtaaggtagaacat

SEQ ID NO: 149604 - DNA, 21 bp, Artificial sequence
  SiRNA target sequence
gtaaaggtaaggtagaacatc

SEQ ID NO: 149605 - DNA, 21 bp, Artificial sequence
  SiRNA target sequence
taaaggtaaggtagaacatca

SEQ ID NO: 149606 - DNA, 21 bp, Artificial sequence
  SiRNA target sequence
aaaggtaaggtagaacatcat

SEQ ID NO: 149607 - DNA, 21 bp, Artificial sequence
  SiRNA target sequence
aaggtaaggtagaacatcata

SEQ ID NO: 149608 - DNA, 21 bp, Artificial sequence
  SiRNA target sequence
aggtaaggtagaacatcatag

SEQ ID NO: 149609 - DNA, 21 bp, Artificial sequence
  SiRNA target sequence
ggtaaggtagaacatcatagg

SEQ ID NO: 149610 - DNA, 21 bp, Artificial sequence
  SiRNA target sequence
gtaaggtagaacatcatagga

SEQ ID NO: 149611 - DNA, 21 bp, Artificial sequence
  SiRNA target sequence
taaggtagaacatcataggag

SEQ ID NO: 149612 - DNA, 21 bp, Artificial sequence
  SiRNA target sequence
aaggtagaacatcataggaga

SEQ ID NO: 149613 - DNA, 21 bp, Artificial sequence
  SiRNA target sequence
aggtagaacatcataggagac

SEQ ID NO: 149614 - DNA, 21 bp, Artificial sequence
  SiRNA target sequence
ggtagaacatcataggagact

SEQ ID NO: 149615 - DNA, 21 bp, Artificial sequence
  SiRNA target sequence
gtagaacatcataggagacta

SEQ ID NO: 149616 - DNA, 21 bp, Artificial sequence
  SiRNA target sequence
tagaacatcataggagactag

SEQ ID NO: 149617 - DNA, 21 bp, Artificial sequence
  SiRNA target sequence
agaacatcataggagactagg

SEQ ID NO: 149618 - DNA, 21 bp, Artificial sequence
  SiRNA target sequence
gaacatcataggagactaggt

SEQ ID NO: 149619 - DNA, 21 bp, Artificial sequence
  SiRNA target sequence
aacatcataggagactaggtc

SEQ ID NO: 149620 - DNA, 21 bp, Artificial sequence
  SiRNA target sequence
acatcataggagactaggtcc

SEQ ID NO: 149621 - DNA, 21 bp, Artificial sequence
  SiRNA target sequence
catcataggagactaggtcct

SEQ ID NO: 149622 - DNA, 21 bp, Artificial sequence
  SiRNA target sequence
atcataggagactaggtcctt

SEQ ID NO: 149623 - DNA, 21 bp, Artificial sequence
  SiRNA target sequence
tcataggagactaggtccttt

SEQ ID NO: 149624 - DNA, 21 bp, Artificial sequence
  SiRNA target sequence
cataggagactaggtccttta

SEQ ID NO: 149625 - DNA, 21 bp, Artificial sequence
  SiRNA target sequence
ataggagactaggtcctttaa

SEQ ID NO: 149626 - DNA, 21 bp, Artificial sequence
  SiRNA target sequence
taggagactaggtcctttaat

SEQ ID NO: 149627 - DNA, 21 bp, Artificial sequence
  SiRNA target sequence
aggagactaggtcctttaatt

SEQ ID NO: 149628 - DNA, 21 bp, Artificial sequence
  SiRNA target sequence
ggagactaggtcctttaattt

SEQ ID NO: 149629 - DNA, 21 bp, Artificial sequence
  SiRNA target sequence
gagactaggtcctttaatttc

SEQ ID NO: 149630 - DNA, 21 bp, Artificial sequence
  SiRNA target sequence
agactaggtcctttaatttct

SEQ ID NO: 149631 - DNA, 21 bp, Artificial sequence
  SiRNA target sequence
gactaggtcctttaatttctg

SEQ ID NO: 149632 - DNA, 21 bp, Artificial sequence
  SiRNA target sequence
actaggtcctttaatttctgt

SEQ ID NO: 149633 - DNA, 21 bp, Artificial sequence
  SiRNA target sequence
ctaggtcctttaatttctgta

SEQ ID NO: 149634 - DNA, 21 bp, Artificial sequence
  SiRNA target sequence
taggtcctttaatttctgtac

SEQ ID NO: 149635 - DNA, 21 bp, Artificial sequence
  SiRNA target sequence
aggtcctttaatttctgtaca

SEQ ID NO: 149636 - DNA, 21 bp, Artificial sequence
  SiRNA target sequence
ggtcctttaatttctgtacaa

SEQ ID NO: 149637 - DNA, 21 bp, Artificial sequence
  SiRNA target sequence
gtcctttaatttctgtacaag

SEQ ID NO: 149638 - DNA, 21 bp, Artificial sequence
  SiRNA target sequence
tcctttaatttctgtacaaga

SEQ ID NO: 149639 - DNA, 21 bp, Artificial sequence
  SiRNA target sequence
cctttaatttctgtacaagaa

SEQ ID NO: 149640 - DNA, 21 bp, Artificial sequence
  SiRNA target sequence
ctttaatttctgtacaagaag

SEQ ID NO: 149641 - DNA, 21 bp, Artificial sequence
  SiRNA target sequence
tttaatttctgtacaagaagc

SEQ ID NO: 149642 - DNA, 21 bp, Artificial sequence
  SiRNA target sequence
ttaatttctgtacaagaagca

SEQ ID NO: 149643 - DNA, 21 bp, Artificial sequence
  SiRNA target sequence
taatttctgtacaagaagcac

SEQ ID NO: 149644 - DNA, 21 bp, Artificial sequence
  SiRNA target sequence
aatttctgtacaagaagcacc

SEQ ID NO: 149645 - DNA, 21 bp, Artificial sequence
  SiRNA target sequence
atttctgtacaagaagcacct

SEQ ID NO: 149646 - DNA, 21 bp, Artificial sequence
  SiRNA target sequence
tttctgtacaagaagcacctt

SEQ ID NO: 149647 - DNA, 21 bp, Artificial sequence
  SiRNA target sequence
ttctgtacaagaagcaccttg

SEQ ID NO: 149648 - DNA, 21 bp, Artificial sequence
  SiRNA target sequence
tctgtacaagaagcaccttgt

SEQ ID NO: 149649 - DNA, 21 bp, Artificial sequence
  SiRNA target sequence
ctgtacaagaagcaccttgta

SEQ ID NO: 149650 - DNA, 21 bp, Artificial sequence
  SiRNA target sequence
tgtacaagaagcaccttgtaa

SEQ ID NO: 149651 - DNA, 21 bp, Artificial sequence
  SiRNA target sequence
gtacaagaagcaccttgtaat

SEQ ID NO: 149652 - DNA, 21 bp, Artificial sequence
  SiRNA target sequence
tacaagaagcaccttgtaata

SEQ ID NO: 149653 - DNA, 21 bp, Artificial sequence
  SiRNA target sequence
acaagaagcaccttgtaataa

SEQ ID NO: 149654 - DNA, 21 bp, Artificial sequence
  SiRNA target sequence
caagaagcaccttgtaataat

SEQ ID NO: 149655 - DNA, 21 bp, Artificial sequence
  SiRNA target sequence
aagaagcaccttgtaataatt

SEQ ID NO: 149656 - DNA, 21 bp, Artificial sequence
  SiRNA target sequence
agaagcaccttgtaataattg

SEQ ID NO: 149657 - DNA, 21 bp, Artificial sequence
  SiRNA target sequence
gaagcaccttgtaataattgt

SEQ ID NO: 149658 - DNA, 21 bp, Artificial sequence
  SiRNA target sequence
aagcaccttgtaataattgta

SEQ ID NO: 149659 - DNA, 21 bp, Artificial sequence
  SiRNA target sequence
agcaccttgtaataattgtaa

SEQ ID NO: 149660 - DNA, 21 bp, Artificial sequence
  SiRNA target sequence
gcaccttgtaataattgtaat

SEQ ID NO: 149661 - DNA, 21 bp, Artificial sequence
  SiRNA target sequence
caccttgtaataattgtaatt

SEQ ID NO: 149662 - DNA, 21 bp, Artificial sequence
  SiRNA target sequence
accttgtaataattgtaattc

SEQ ID NO: 149663 - DNA, 21 bp, Artificial sequence
  SiRNA target sequence
ccttgtaataattgtaattct

SEQ ID NO: 149664 - DNA, 21 bp, Artificial sequence
  SiRNA target sequence
cttgtaataattgtaattcta

SEQ ID NO: 149665 - DNA, 21 bp, Artificial sequence
  SiRNA target sequence
ttgtaataattgtaattctac

SEQ ID NO: 149666 - DNA, 21 bp, Artificial sequence
  SiRNA target sequence
tgtaataattgtaattctact

SEQ ID NO: 149667 - DNA, 21 bp, Artificial sequence
  SiRNA target sequence
gtaataattgtaattctactg

SEQ ID NO: 149668 - DNA, 21 bp, Artificial sequence
  SiRNA target sequence
taataattgtaattctactgg

SEQ ID NO: 149669 - DNA, 21 bp, Artificial sequence
  SiRNA target sequence
aataattgtaattctactgga

SEQ ID NO: 149670 - DNA, 21 bp, Artificial sequence
  SiRNA target sequence
ataattgtaattctactggat

SEQ ID NO: 149671 - DNA, 21 bp, Artificial sequence
  SiRNA target sequence
taattgtaattctactggatt

SEQ ID NO: 149672 - DNA, 21 bp, Artificial sequence
  SiRNA target sequence
aattgtaattctactggattt

SEQ ID NO: 149673 - DNA, 21 bp, Artificial sequence
  SiRNA target sequence
attgtaattctactggatttg

SEQ ID NO: 149674 - DNA, 21 bp, Artificial sequence
  SiRNA target sequence
ttgtaattctactggatttgt

SEQ ID NO: 149675 - DNA, 21 bp, Artificial sequence
  SiRNA target sequence
tgtaattctactggatttgtt

SEQ ID NO: 149676 - DNA, 21 bp, Artificial sequence
  SiRNA target sequence
gtaattctactggatttgttg

SEQ ID NO: 149677 - DNA, 21 bp, Artificial sequence
  SiRNA target sequence
taattctactggatttgttgt

SEQ ID NO: 149678 - DNA, 21 bp, Artificial sequence
  SiRNA target sequence
aattctactggatttgttgtt

SEQ ID NO: 149679 - DNA, 21 bp, Artificial sequence
  SiRNA target sequence
attctactggatttgttgtta

SEQ ID NO: 149680 - DNA, 21 bp, Artificial sequence
  SiRNA target sequence
ttctactggatttgttgttaa

SEQ ID NO: 149681 - DNA, 21 bp, Artificial sequence
  SiRNA target sequence
tctactggatttgttgttaaa

SEQ ID NO: 149682 - DNA, 21 bp, Artificial sequence
  SiRNA target sequence
ctactggatttgttgttaaag

SEQ ID NO: 149683 - DNA, 21 bp, Artificial sequence
  SiRNA target sequence
tactggatttgttgttaaagg

SEQ ID NO: 149684 - DNA, 21 bp, Artificial sequence
  SiRNA target sequence
actggatttgttgttaaagga

SEQ ID NO: 149685 - DNA, 21 bp, Artificial sequence
  SiRNA target sequence
ctggatttgttgttaaaggaa

SEQ ID NO: 149686 - DNA, 21 bp, Artificial sequence
  SiRNA target sequence
tggatttgttgttaaaggaaa

SEQ ID NO: 149687 - DNA, 21 bp, Artificial sequence
  SiRNA target sequence
ggatttgttgttaaaggaaag

SEQ ID NO: 149688 - DNA, 21 bp, Artificial sequence
  SiRNA target sequence
gatttgttgttaaaggaaagc

SEQ ID NO: 149689 - DNA, 21 bp, Artificial sequence
  SiRNA target sequence
atttgttgttaaaggaaagct

SEQ ID NO: 149690 - DNA, 21 bp, Artificial sequence
  SiRNA target sequence
tttgttgttaaaggaaagctt

SEQ ID NO: 149691 - DNA, 21 bp, Artificial sequence
  SiRNA target sequence
ttgttgttaaaggaaagcttt

SEQ ID NO: 149692 - DNA, 21 bp, Artificial sequence
  SiRNA target sequence
tgttgttaaaggaaagctttg

SEQ ID NO: 149693 - DNA, 21 bp, Artificial sequence
  SiRNA target sequence
gttgttaaaggaaagctttgt

SEQ ID NO: 149694 - DNA, 21 bp, Artificial sequence
  SiRNA target sequence
ttgttaaaggaaagctttgtc

SEQ ID NO: 149695 - DNA, 21 bp, Artificial sequence
  SiRNA target sequence
tgttaaaggaaagctttgtca

SEQ ID NO: 149696 - DNA, 21 bp, Artificial sequence
  SiRNA target sequence
gttaaaggaaagctttgtcaa

SEQ ID NO: 149697 - DNA, 21 bp, Artificial sequence
  SiRNA target sequence
ttaaaggaaagctttgtcaaa

SEQ ID NO: 149698 - DNA, 21 bp, Artificial sequence
  SiRNA target sequence
taaaggaaagctttgtcaaag

SEQ ID NO: 149699 - DNA, 21 bp, Artificial sequence
  SiRNA target sequence
aaaggaaagctttgtcaaagt

SEQ ID NO: 149700 - DNA, 21 bp, Artificial sequence
  SiRNA target sequence
aaggaaagctttgtcaaagtt

SEQ ID NO: 149701 - DNA, 21 bp, Artificial sequence
  SiRNA target sequence
aggaaagctttgtcaaagttg

SEQ ID NO: 149702 - DNA, 21 bp, Artificial sequence
  SiRNA target sequence
ggaaagctttgtcaaagttgt

SEQ ID NO: 149703 - DNA, 21 bp, Artificial sequence
  SiRNA target sequence
gaaagctttgtcaaagttgta

SEQ ID NO: 149704 - DNA, 21 bp, Artificial sequence
  SiRNA target sequence
aaagctttgtcaaagttgtaa

SEQ ID NO: 149705 - DNA, 21 bp, Artificial sequence
  SiRNA target sequence
aagctttgtcaaagttgtaaa

SEQ ID NO: 149706 - DNA, 21 bp, Artificial sequence
  SiRNA target sequence
agctttgtcaaagttgtaaag

SEQ ID NO: 149707 - DNA, 21 bp, Artificial sequence
  SiRNA target sequence
gctttgtcaaagttgtaaagg

SEQ ID NO: 149708 - DNA, 21 bp, Artificial sequence
  SiRNA target sequence
ctttgtcaaagttgtaaaggt

SEQ ID NO: 149709 - DNA, 21 bp, Artificial sequence
  SiRNA target sequence
tttgtcaaagttgtaaaggta

SEQ ID NO: 149710 - DNA, 21 bp, Artificial sequence
  SiRNA target sequence
ttgtcaaagttgtaaaggtaa

SEQ ID NO: 149711 - DNA, 21 bp, Artificial sequence
  SiRNA target sequence
tgtcaaagttgtaaaggtaaa

SEQ ID NO: 149712 - DNA, 21 bp, Artificial sequence
  SiRNA target sequence
gtcaaagttgtaaaggtaaac

SEQ ID NO: 149713 - DNA, 21 bp, Artificial sequence
  SiRNA target sequence
tcaaagttgtaaaggtaaaca

SEQ ID NO: 149714 - DNA, 21 bp, Artificial sequence
  SiRNA target sequence
caaagttgtaaaggtaaacaa

SEQ ID NO: 149715 - DNA, 21 bp, Artificial sequence
  SiRNA target sequence
aaagttgtaaaggtaaacaat

SEQ ID NO: 149716 - DNA, 21 bp, Artificial sequence
  SiRNA target sequence
aagttgtaaaggtaaacaata

SEQ ID NO: 149717 - DNA, 21 bp, Artificial sequence
  SiRNA target sequence
agttgtaaaggtaaacaatac

SEQ ID NO: 149718 - DNA, 21 bp, Artificial sequence
  SiRNA target sequence
gttgtaaaggtaaacaatacg

SEQ ID NO: 149719 - DNA, 21 bp, Artificial sequence
  SiRNA target sequence
ttgtaaaggtaaacaatacgt

SEQ ID NO: 149720 - DNA, 21 bp, Artificial sequence
  SiRNA target sequence
tgtaaaggtaaacaatacgtt

SEQ ID NO: 149721 - DNA, 21 bp, Artificial sequence
  SiRNA target sequence
gtaaaggtaaacaatacgttg

SEQ ID NO: 149722 - DNA, 21 bp, Artificial sequence
  SiRNA target sequence
taaaggtaaacaatacgttga

SEQ ID NO: 149723 - DNA, 21 bp, Artificial sequence
  SiRNA target sequence
aaaggtaaacaatacgttgag

SEQ ID NO: 149724 - DNA, 21 bp, Artificial sequence
  SiRNA target sequence
aaggtaaacaatacgttgaga

SEQ ID NO: 149725 - DNA, 21 bp, Artificial sequence
  SiRNA target sequence
aggtaaacaatacgttgagac

SEQ ID NO: 149726 - DNA, 21 bp, Artificial sequence
  SiRNA target sequence
ggtaaacaatacgttgagact

SEQ ID NO: 149727 - DNA, 21 bp, Artificial sequence
  SiRNA target sequence
gtaaacaatacgttgagacta

SEQ ID NO: 149728 - DNA, 21 bp, Artificial sequence
  SiRNA target sequence
taaacaatacgttgagactaa

SEQ ID NO: 149729 - DNA, 21 bp, Artificial sequence
  SiRNA target sequence
aaacaatacgttgagactaaa

SEQ ID NO: 149730 - DNA, 21 bp, Artificial sequence
  SiRNA target sequence
aacaatacgttgagactaaag

SEQ ID NO: 149731 - DNA, 21 bp, Artificial sequence
  SiRNA target sequence
acaatacgttgagactaaaga

SEQ ID NO: 149732 - DNA, 21 bp, Artificial sequence
  SiRNA target sequence
caatacgttgagactaaagaa

SEQ ID NO: 149733 - DNA, 21 bp, Artificial sequence
  SiRNA target sequence
aatacgttgagactaaagaac

SEQ ID NO: 149734 - DNA, 21 bp, Artificial sequence
  SiRNA target sequence
atacgttgagactaaagaaca

SEQ ID NO: 149735 - DNA, 21 bp, Artificial sequence
  SiRNA target sequence
tacgttgagactaaagaacat

SEQ ID NO: 149736 - DNA, 21 bp, Artificial sequence
  SiRNA target sequence
acgttgagactaaagaacata

SEQ ID NO: 149737 - DNA, 21 bp, Artificial sequence
  SiRNA target sequence
cgttgagactaaagaacatat

SEQ ID NO: 149738 - DNA, 21 bp, Artificial sequence
  SiRNA target sequence
gttgagactaaagaacatatt

SEQ ID NO: 149739 - DNA, 21 bp, Artificial sequence
  SiRNA target sequence
ttgagactaaagaacatattg

SEQ ID NO: 149740 - DNA, 21 bp, Artificial sequence
  SiRNA target sequence
tgagactaaagaacatattga

SEQ ID NO: 149741 - DNA, 21 bp, Artificial sequence
  SiRNA target sequence
gagactaaagaacatattgaa

SEQ ID NO: 149742 - DNA, 21 bp, Artificial sequence
  SiRNA target sequence
agactaaagaacatattgaag

SEQ ID NO: 149743 - DNA, 21 bp, Artificial sequence
  SiRNA target sequence
gactaaagaacatattgaagt

SEQ ID NO: 149744 - DNA, 21 bp, Artificial sequence
  SiRNA target sequence
actaaagaacatattgaagtg

SEQ ID NO: 149745 - DNA, 21 bp, Artificial sequence
  SiRNA target sequence
ctaaagaacatattgaagtgg

SEQ ID NO: 149746 - DNA, 21 bp, Artificial sequence
  SiRNA target sequence
taaagaacatattgaagtgga

SEQ ID NO: 149747 - DNA, 21 bp, Artificial sequence
  SiRNA target sequence
aaagaacatattgaagtggaa

SEQ ID NO: 149748 - DNA, 21 bp, Artificial sequence
  SiRNA target sequence
aagaacatattgaagtggaag

SEQ ID NO: 149749 - DNA, 21 bp, Artificial sequence
  SiRNA target sequence
agaacatattgaagtggaagt

SEQ ID NO: 149750 - DNA, 21 bp, Artificial sequence
  SiRNA target sequence
gaacatattgaagtggaagta

SEQ ID NO: 149751 - DNA, 21 bp, Artificial sequence
  SiRNA target sequence
aacatattgaagtggaagtag

SEQ ID NO: 149752 - DNA, 21 bp, Artificial sequence
  SiRNA target sequence
acatattgaagtggaagtaga

SEQ ID NO: 149753 - DNA, 21 bp, Artificial sequence
  SiRNA target sequence
catattgaagtggaagtagag

SEQ ID NO: 149754 - DNA, 21 bp, Artificial sequence
  SiRNA target sequence
atattgaagtggaagtagagc

SEQ ID NO: 149755 - DNA, 21 bp, Artificial sequence
  SiRNA target sequence
tattgaagtggaagtagagcc

SEQ ID NO: 149756 - DNA, 21 bp, Artificial sequence
  SiRNA target sequence
attgaagtggaagtagagcca

SEQ ID NO: 149757 - DNA, 21 bp, Artificial sequence
  SiRNA target sequence
ttgaagtggaagtagagccag

SEQ ID NO: 149758 - DNA, 21 bp, Artificial sequence
  SiRNA target sequence
tgaagtggaagtagagccagg

SEQ ID NO: 149759 - DNA, 21 bp, Artificial sequence
  SiRNA target sequence
gaagtggaagtagagccagga

SEQ ID NO: 149760 - DNA, 21 bp, Artificial sequence
  SiRNA target sequence
aagtggaagtagagccaggag

SEQ ID NO: 149761 - DNA, 21 bp, Artificial sequence
  SiRNA target sequence
agtggaagtagagccaggagt

SEQ ID NO: 149762 - DNA, 21 bp, Artificial sequence
  SiRNA target sequence
gtggaagtagagccaggagta

SEQ ID NO: 149763 - DNA, 21 bp, Artificial sequence
  SiRNA target sequence
tggaagtagagccaggagtac

SEQ ID NO: 149764 - DNA, 21 bp, Artificial sequence
  SiRNA target sequence
ggaagtagagccaggagtaca

SEQ ID NO: 149765 - DNA, 21 bp, Artificial sequence
  SiRNA target sequence
gaagtagagccaggagtacag

SEQ ID NO: 149766 - DNA, 21 bp, Artificial sequence
  SiRNA target sequence
aagtagagccaggagtacaga

SEQ ID NO: 149767 - DNA, 21 bp, Artificial sequence
  SiRNA target sequence
agtagagccaggagtacagaa

SEQ ID NO: 149768 - DNA, 21 bp, Artificial sequence
  SiRNA target sequence
gtagagccaggagtacagaac

SEQ ID NO: 149769 - DNA, 21 bp, Artificial sequence
  SiRNA target sequence
tagagccaggagtacagaacg

SEQ ID NO: 149770 - DNA, 21 bp, Artificial sequence
  SiRNA target sequence
agagccaggagtacagaacgg

SEQ ID NO: 149771 - DNA, 21 bp, Artificial sequence
  SiRNA target sequence
gagccaggagtacagaacggt

SEQ ID NO: 149772 - DNA, 21 bp, Artificial sequence
  SiRNA target sequence
agccaggagtacagaacggta

SEQ ID NO: 149773 - DNA, 21 bp, Artificial sequence
  SiRNA target sequence
gccaggagtacagaacggtag

SEQ ID NO: 149774 - DNA, 21 bp, Artificial sequence
  SiRNA target sequence
ccaggagtacagaacggtaga

SEQ ID NO: 149775 - DNA, 21 bp, Artificial sequence
  SiRNA target sequence
caggagtacagaacggtagaa

SEQ ID NO: 149776 - DNA, 21 bp, Artificial sequence
  SiRNA target sequence
aggagtacagaacggtagaaa

SEQ ID NO: 149777 - DNA, 21 bp, Artificial sequence
  SiRNA target sequence
ggagtacagaacggtagaaaa

SEQ ID NO: 149778 - DNA, 21 bp, Artificial sequence
  SiRNA target sequence
gagtacagaacggtagaaaat

SEQ ID NO: 149779 - DNA, 21 bp, Artificial sequence
  SiRNA target sequence
agtacagaacggtagaaaata

SEQ ID NO: 149780 - DNA, 21 bp, Artificial sequence
  SiRNA target sequence
gtacagaacggtagaaaatat

SEQ ID NO: 149781 - DNA, 21 bp, Artificial sequence
  SiRNA target sequence
tacagaacggtagaaaatata

SEQ ID NO: 149782 - DNA, 21 bp, Artificial sequence
  SiRNA target sequence
acagaacggtagaaaatatac

SEQ ID NO: 149783 - DNA, 21 bp, Artificial sequence
  SiRNA target sequence
cagaacggtagaaaatataca

SEQ ID NO: 149784 - DNA, 21 bp, Artificial sequence
  SiRNA target sequence
agaacggtagaaaatatacat

SEQ ID NO: 149785 - DNA, 21 bp, Artificial sequence
  SiRNA target sequence
gaacggtagaaaatatacatt

SEQ ID NO: 149786 - DNA, 21 bp, Artificial sequence
  SiRNA target sequence
aacggtagaaaatatacattt

SEQ ID NO: 149787 - DNA, 21 bp, Artificial sequence
  SiRNA target sequence
acggtagaaaatatacatttt

SEQ ID NO: 149788 - DNA, 21 bp, Artificial sequence
  SiRNA target sequence
cggtagaaaatatacattttc

SEQ ID NO: 149789 - DNA, 21 bp, Artificial sequence
  SiRNA target sequence
ggtagaaaatatacattttct

SEQ ID NO: 149790 - DNA, 21 bp, Artificial sequence
  SiRNA target sequence
gtagaaaatatacattttctg

SEQ ID NO: 149791 - DNA, 21 bp, Artificial sequence
  SiRNA target sequence
tagaaaatatacattttctgg

SEQ ID NO: 149792 - DNA, 21 bp, Artificial sequence
  SiRNA target sequence
agaaaatatacattttctggc

SEQ ID NO: 149793 - DNA, 21 bp, Artificial sequence
  SiRNA target sequence
gaaaatatacattttctggca

SEQ ID NO: 149794 - DNA, 21 bp, Artificial sequence
  SiRNA target sequence
aaaatatacattttctggcaa

SEQ ID NO: 149795 - DNA, 21 bp, Artificial sequence
  SiRNA target sequence
aaatatacattttctggcaaa

SEQ ID NO: 149796 - DNA, 21 bp, Artificial sequence
  SiRNA target sequence
aatatacattttctggcaaag

SEQ ID NO: 149797 - DNA, 21 bp, Artificial sequence
  SiRNA target sequence
atatacattttctggcaaagg

SEQ ID NO: 149798 - DNA, 21 bp, Artificial sequence
  SiRNA target sequence
tatacattttctggcaaagga

SEQ ID NO: 149799 - DNA, 21 bp, Artificial sequence
  SiRNA target sequence
atacattttctggcaaaggaa

SEQ ID NO: 149800 - DNA, 21 bp, Artificial sequence
  SiRNA target sequence
tacattttctggcaaaggaaa

SEQ ID NO: 149801 - DNA, 21 bp, Artificial sequence
  SiRNA target sequence
acattttctggcaaaggaaat

SEQ ID NO: 149802 - DNA, 21 bp, Artificial sequence
  SiRNA target sequence
cattttctggcaaaggaaatc

SEQ ID NO: 149803 - DNA, 21 bp, Artificial sequence
  SiRNA target sequence
attttctggcaaaggaaatca

SEQ ID NO: 149804 - DNA, 21 bp, Artificial sequence
  SiRNA target sequence
ttttctggcaaaggaaatcat

SEQ ID NO: 149805 - DNA, 21 bp, Artificial sequence
  SiRNA target sequence
tttctggcaaaggaaatcata

SEQ ID NO: 149806 - DNA, 21 bp, Artificial sequence
  SiRNA target sequence
ttctggcaaaggaaatcataa

SEQ ID NO: 149807 - DNA, 21 bp, Artificial sequence
  SiRNA target sequence
tctggcaaaggaaatcataaa

SEQ ID NO: 149808 - DNA, 21 bp, Artificial sequence
  SiRNA target sequence
ctggcaaaggaaatcataaaa

SEQ ID NO: 149809 - DNA, 21 bp, Artificial sequence
  SiRNA target sequence
tggcaaaggaaatcataaaaa

SEQ ID NO: 149810 - DNA, 21 bp, Artificial sequence
  SiRNA target sequence
ggcaaaggaaatcataaaaaa

SEQ ID NO: 149811 - DNA, 21 bp, Artificial sequence
  SiRNA target sequence
gcaaaggaaatcataaaaaaa

SEQ ID NO: 149812 - DNA, 21 bp, Artificial sequence
  SiRNA target sequence
caaaggaaatcataaaaaaaa

SEQ ID NO: 149813 - DNA, 21 bp, Artificial sequence
  SiRNA target sequence
aaaggaaatcataaaaaaaat

SEQ ID NO: 149814 - DNA, 21 bp, Artificial sequence
  SiRNA target sequence
aaggaaatcataaaaaaaatt

SEQ ID NO: 149815 - DNA, 21 bp, Artificial sequence
  SiRNA target sequence
aggaaatcataaaaaaaattg

SEQ ID NO: 149816 - DNA, 21 bp, Artificial sequence
  SiRNA target sequence
ggaaatcataaaaaaaattgt

SEQ ID NO: 149817 - DNA, 21 bp, Artificial sequence
  SiRNA target sequence
gaaatcataaaaaaaattgtg

SEQ ID NO: 149818 - DNA, 21 bp, Artificial sequence
  SiRNA target sequence
aaatcataaaaaaaattgtgt

SEQ ID NO: 149819 - DNA, 21 bp, Artificial sequence
  SiRNA target sequence
aatcataaaaaaaattgtgta

SEQ ID NO: 149820 - DNA, 21 bp, Artificial sequence
  SiRNA target sequence
atcataaaaaaaattgtgtac

SEQ ID NO: 149821 - DNA, 21 bp, Artificial sequence
  SiRNA target sequence
tcataaaaaaaattgtgtacc

SEQ ID NO: 149822 - DNA, 21 bp, Artificial sequence
  SiRNA target sequence
cataaaaaaaattgtgtaccg

SEQ ID NO: 149823 - DNA, 21 bp, Artificial sequence
  SiRNA target sequence
ataaaaaaaattgtgtaccgg

SEQ ID NO: 149824 - DNA, 21 bp, Artificial sequence
  SiRNA target sequence
taaaaaaaattgtgtaccggg

SEQ ID NO: 149825 - DNA, 21 bp, Artificial sequence
  SiRNA target sequence
aaaaaaaattgtgtaccgggt

SEQ ID NO: 149826 - DNA, 21 bp, Artificial sequence
  SiRNA target sequence
aaaaaaattgtgtaccgggtg

SEQ ID NO: 149827 - DNA, 21 bp, Artificial sequence
  SiRNA target sequence
aaaaaattgtgtaccgggtga

SEQ ID NO: 149828 - DNA, 21 bp, Artificial sequence
  SiRNA target sequence
aaaaattgtgtaccgggtgat

SEQ ID NO: 149829 - DNA, 21 bp, Artificial sequence
  SiRNA target sequence
aaaattgtgtaccgggtgatg

SEQ ID NO: 149830 - DNA, 21 bp, Artificial sequence
  SiRNA target sequence
aaattgtgtaccgggtgatgt

SEQ ID NO: 149831 - DNA, 21 bp, Artificial sequence
  SiRNA target sequence
aattgtgtaccgggtgatgtg

SEQ ID NO: 149832 - DNA, 21 bp, Artificial sequence
  SiRNA target sequence
attgtgtaccgggtgatgtga

SEQ ID NO: 149833 - DNA, 21 bp, Artificial sequence
  SiRNA target sequence
ttgtgtaccgggtgatgtgat

SEQ ID NO: 149834 - DNA, 21 bp, Artificial sequence
  SiRNA target sequence
tgtgtaccgggtgatgtgatt

SEQ ID NO: 149835 - DNA, 21 bp, Artificial sequence
  SiRNA target sequence
gtgtaccgggtgatgtgattc

SEQ ID NO: 149836 - DNA, 21 bp, Artificial sequence
  SiRNA target sequence
tgtaccgggtgatgtgattct

SEQ ID NO: 149837 - DNA, 21 bp, Artificial sequence
  SiRNA target sequence
gtaccgggtgatgtgattctt

SEQ ID NO: 149838 - DNA, 21 bp, Artificial sequence
  SiRNA target sequence
taccgggtgatgtgattctta

SEQ ID NO: 149839 - DNA, 21 bp, Artificial sequence
  SiRNA target sequence
accgggtgatgtgattcttat

SEQ ID NO: 149840 - DNA, 21 bp, Artificial sequence
  SiRNA target sequence
ccgggtgatgtgattcttatt

SEQ ID NO: 149841 - DNA, 21 bp, Artificial sequence
  SiRNA target sequence
cgggtgatgtgattcttattg

SEQ ID NO: 149842 - DNA, 21 bp, Artificial sequence
  SiRNA target sequence
gggtgatgtgattcttattgt

SEQ ID NO: 149843 - DNA, 21 bp, Artificial sequence
  SiRNA target sequence
ggtgatgtgattcttattgta

SEQ ID NO: 149844 - DNA, 21 bp, Artificial sequence
  SiRNA target sequence
gtgatgtgattcttattgtaa

SEQ ID NO: 149845 - DNA, 21 bp, Artificial sequence
  SiRNA target sequence
tgatgtgattcttattgtaaa

SEQ ID NO: 149846 - DNA, 21 bp, Artificial sequence
  SiRNA target sequence
gatgtgattcttattgtaaac

SEQ ID NO: 149847 - DNA, 21 bp, Artificial sequence
  SiRNA target sequence
atgtgattcttattgtaaaca

SEQ ID NO: 149848 - DNA, 21 bp, Artificial sequence
  SiRNA target sequence
tgtgattcttattgtaaacat

SEQ ID NO: 149849 - DNA, 21 bp, Artificial sequence
  SiRNA target sequence
gtgattcttattgtaaacatt

SEQ ID NO: 149850 - DNA, 21 bp, Artificial sequence
  SiRNA target sequence
tgattcttattgtaaacatta

SEQ ID NO: 149851 - DNA, 21 bp, Artificial sequence
  SiRNA target sequence
gattcttattgtaaacattac

SEQ ID NO: 149852 - DNA, 21 bp, Artificial sequence
  SiRNA target sequence
attcttattgtaaacattaca

SEQ ID NO: 149853 - DNA, 21 bp, Artificial sequence
  SiRNA target sequence
ttcttattgtaaacattacaa

SEQ ID NO: 149854 - DNA, 21 bp, Artificial sequence
  SiRNA target sequence
tcttattgtaaacattacaaa

SEQ ID NO: 149855 - DNA, 21 bp, Artificial sequence
  SiRNA target sequence
cttattgtaaacattacaaat

SEQ ID NO: 149856 - DNA, 21 bp, Artificial sequence
  SiRNA target sequence
ttattgtaaacattacaaatg

SEQ ID NO: 149857 - DNA, 21 bp, Artificial sequence
  SiRNA target sequence
tattgtaaacattacaaatga

SEQ ID NO: 149858 - DNA, 21 bp, Artificial sequence
  SiRNA target sequence
attgtaaacattacaaatgat

SEQ ID NO: 149859 - DNA, 21 bp, Artificial sequence
  SiRNA target sequence
ttgtaaacattacaaatgatc

SEQ ID NO: 149860 - DNA, 21 bp, Artificial sequence
  SiRNA target sequence
tgtaaacattacaaatgatcc

SEQ ID NO: 149861 - DNA, 21 bp, Artificial sequence
  SiRNA target sequence
gtaaacattacaaatgatcca

SEQ ID NO: 149862 - DNA, 21 bp, Artificial sequence
  SiRNA target sequence
taaacattacaaatgatccaa

SEQ ID NO: 149863 - DNA, 21 bp, Artificial sequence
  SiRNA target sequence
aaacattacaaatgatccaag

SEQ ID NO: 149864 - DNA, 21 bp, Artificial sequence
  SiRNA target sequence
aacattacaaatgatccaaga

SEQ ID NO: 149865 - DNA, 21 bp, Artificial sequence
  SiRNA target sequence
acattacaaatgatccaagat

SEQ ID NO: 149866 - DNA, 21 bp, Artificial sequence
  SiRNA target sequence
cattacaaatgatccaagatt

SEQ ID NO: 149867 - DNA, 21 bp, Artificial sequence
  SiRNA target sequence
attacaaatgatccaagattt

SEQ ID NO: 149868 - DNA, 21 bp, Artificial sequence
  SiRNA target sequence
ttacaaatgatccaagattta

SEQ ID NO: 149869 - DNA, 21 bp, Artificial sequence
  SiRNA target sequence
tacaaatgatccaagatttag

SEQ ID NO: 149870 - DNA, 21 bp, Artificial sequence
  SiRNA target sequence
acaaatgatccaagatttaga

SEQ ID NO: 149871 - DNA, 21 bp, Artificial sequence
  SiRNA target sequence
caaatgatccaagatttagaa

SEQ ID NO: 149872 - DNA, 21 bp, Artificial sequence
  SiRNA target sequence
aaatgatccaagatttagaaa

SEQ ID NO: 149873 - DNA, 21 bp, Artificial sequence
  SiRNA target sequence
aatgatccaagatttagaaaa

SEQ ID NO: 149874 - DNA, 21 bp, Artificial sequence
  SiRNA target sequence
atgatccaagatttagaaaaa

SEQ ID NO: 149875 - DNA, 21 bp, Artificial sequence
  SiRNA target sequence
tgatccaagatttagaaaaag

SEQ ID NO: 149876 - DNA, 21 bp, Artificial sequence
  SiRNA target sequence
gatccaagatttagaaaaagt

SEQ ID NO: 149877 - DNA, 21 bp, Artificial sequence
  SiRNA target sequence
atccaagatttagaaaaagtg

SEQ ID NO: 149878 - DNA, 21 bp, Artificial sequence
  SiRNA target sequence
tccaagatttagaaaaagtgg

SEQ ID NO: 149879 - DNA, 21 bp, Artificial sequence
  SiRNA target sequence
ccaagatttagaaaaagtgga

SEQ ID NO: 149880 - DNA, 21 bp, Artificial sequence
  SiRNA target sequence
caagatttagaaaaagtggat

SEQ ID NO: 149881 - DNA, 21 bp, Artificial sequence
  SiRNA target sequence
aagatttagaaaaagtggata

SEQ ID NO: 149882 - DNA, 21 bp, Artificial sequence
  SiRNA target sequence
agatttagaaaaagtggatat

SEQ ID NO: 149883 - DNA, 21 bp, Artificial sequence
  SiRNA target sequence
gatttagaaaaagtggatata

SEQ ID NO: 149884 - DNA, 21 bp, Artificial sequence
  SiRNA target sequence
atttagaaaaagtggatataa

SEQ ID NO: 149885 - DNA, 21 bp, Artificial sequence
  SiRNA target sequence
tttagaaaaagtggatataat

SEQ ID NO: 149886 - DNA, 21 bp, Artificial sequence
  SiRNA target sequence
ttagaaaaagtggatataatt

SEQ ID NO: 149887 - DNA, 21 bp, Artificial sequence
  SiRNA target sequence
tagaaaaagtggatataattt

SEQ ID NO: 149888 - DNA, 21 bp, Artificial sequence
  SiRNA target sequence
agaaaaagtggatataattta

SEQ ID NO: 149889 - DNA, 21 bp, Artificial sequence
  SiRNA target sequence
gaaaaagtggatataatttaa

SEQ ID NO: 149890 - DNA, 21 bp, Artificial sequence
  SiRNA target sequence
aaaaagtggatataatttaat

SEQ ID NO: 149891 - DNA, 21 bp, Artificial sequence
  SiRNA target sequence
aaaagtggatataatttaatt

SEQ ID NO: 149892 - DNA, 21 bp, Artificial sequence
  SiRNA target sequence
aaagtggatataatttaatta

SEQ ID NO: 149893 - DNA, 21 bp, Artificial sequence
  SiRNA target sequence
aagtggatataatttaattag

SEQ ID NO: 149894 - DNA, 21 bp, Artificial sequence
  SiRNA target sequence
agtggatataatttaattagt

SEQ ID NO: 149895 - DNA, 21 bp, Artificial sequence
  SiRNA target sequence
gtggatataatttaattagta

SEQ ID NO: 149896 - DNA, 21 bp, Artificial sequence
  SiRNA target sequence
tggatataatttaattagtaa

SEQ ID NO: 149897 - DNA, 21 bp, Artificial sequence
  SiRNA target sequence
ggatataatttaattagtaag

SEQ ID NO: 149898 - DNA, 21 bp, Artificial sequence
  SiRNA target sequence
gatataatttaattagtaagg

SEQ ID NO: 149899 - DNA, 21 bp, Artificial sequence
  SiRNA target sequence
atataatttaattagtaaggt

SEQ ID NO: 149900 - DNA, 21 bp, Artificial sequence
  SiRNA target sequence
tataatttaattagtaaggtt

SEQ ID NO: 149901 - DNA, 21 bp, Artificial sequence
  SiRNA target sequence
ataatttaattagtaaggttg

SEQ ID NO: 149902 - DNA, 21 bp, Artificial sequence
  SiRNA target sequence
taatttaattagtaaggttga

SEQ ID NO: 149903 - DNA, 21 bp, Artificial sequence
  SiRNA target sequence
aatttaattagtaaggttgat

SEQ ID NO: 149904 - DNA, 21 bp, Artificial sequence
  SiRNA target sequence
atttaattagtaaggttgata

SEQ ID NO: 149905 - DNA, 21 bp, Artificial sequence
  SiRNA target sequence
tttaattagtaaggttgatat

SEQ ID NO: 149906 - DNA, 21 bp, Artificial sequence
  SiRNA target sequence
ttaattagtaaggttgatatt

SEQ ID NO: 149907 - DNA, 21 bp, Artificial sequence
  SiRNA target sequence
taattagtaaggttgatattc

SEQ ID NO: 149908 - DNA, 21 bp, Artificial sequence
  SiRNA target sequence
aattagtaaggttgatattcc

SEQ ID NO: 149909 - DNA, 21 bp, Artificial sequence
  SiRNA target sequence
attagtaaggttgatattcca

SEQ ID NO: 149910 - DNA, 21 bp, Artificial sequence
  SiRNA target sequence
ttagtaaggttgatattccat

SEQ ID NO: 149911 - DNA, 21 bp, Artificial sequence
  SiRNA target sequence
tagtaaggttgatattccatt

SEQ ID NO: 149912 - DNA, 21 bp, Artificial sequence
  SiRNA target sequence
agtaaggttgatattccattg

SEQ ID NO: 149913 - DNA, 21 bp, Artificial sequence
  SiRNA target sequence
gtaaggttgatattccattgt

SEQ ID NO: 149914 - DNA, 21 bp, Artificial sequence
  SiRNA target sequence
taaggttgatattccattgta

SEQ ID NO: 149915 - DNA, 21 bp, Artificial sequence
  SiRNA target sequence
aaggttgatattccattgtat

SEQ ID NO: 149916 - DNA, 21 bp, Artificial sequence
  SiRNA target sequence
aggttgatattccattgtatg

SEQ ID NO: 149917 - DNA, 21 bp, Artificial sequence
  SiRNA target sequence
ggttgatattccattgtatgt

SEQ ID NO: 149918 - DNA, 21 bp, Artificial sequence
  SiRNA target sequence
gttgatattccattgtatgtt

SEQ ID NO: 149919 - DNA, 21 bp, Artificial sequence
  SiRNA target sequence
ttgatattccattgtatgttg

SEQ ID NO: 149920 - DNA, 21 bp, Artificial sequence
  SiRNA target sequence
tgatattccattgtatgttgc

SEQ ID NO: 149921 - DNA, 21 bp, Artificial sequence
  SiRNA target sequence
gatattccattgtatgttgct

SEQ ID NO: 149922 - DNA, 21 bp, Artificial sequence
  SiRNA target sequence
atattccattgtatgttgctt

SEQ ID NO: 149923 - DNA, 21 bp, Artificial sequence
  SiRNA target sequence
tattccattgtatgttgcttt

SEQ ID NO: 149924 - DNA, 21 bp, Artificial sequence
  SiRNA target sequence
attccattgtatgttgctttg

SEQ ID NO: 149925 - DNA, 21 bp, Artificial sequence
  SiRNA target sequence
ttccattgtatgttgctttgg

SEQ ID NO: 149926 - DNA, 21 bp, Artificial sequence
  SiRNA target sequence
tccattgtatgttgctttggc

SEQ ID NO: 149927 - DNA, 21 bp, Artificial sequence
  SiRNA target sequence
ccattgtatgttgctttggca

SEQ ID NO: 149928 - DNA, 21 bp, Artificial sequence
  SiRNA target sequence
cattgtatgttgctttggcag

SEQ ID NO: 149929 - DNA, 21 bp, Artificial sequence
  SiRNA target sequence
attgtatgttgctttggcagg

SEQ ID NO: 149930 - DNA, 21 bp, Artificial sequence
  SiRNA target sequence
ttgtatgttgctttggcaggc

SEQ ID NO: 149931 - DNA, 21 bp, Artificial sequence
  SiRNA target sequence
tgtatgttgctttggcaggcg

SEQ ID NO: 149932 - DNA, 21 bp, Artificial sequence
  SiRNA target sequence
gtatgttgctttggcaggcgg

SEQ ID NO: 149933 - DNA, 21 bp, Artificial sequence
  SiRNA target sequence
tatgttgctttggcaggcgga

SEQ ID NO: 149934 - DNA, 21 bp, Artificial sequence
  SiRNA target sequence
atgttgctttggcaggcggac

SEQ ID NO: 149935 - DNA, 21 bp, Artificial sequence
  SiRNA target sequence
tgttgctttggcaggcggaca

SEQ ID NO: 149936 - DNA, 21 bp, Artificial sequence
  SiRNA target sequence
gttgctttggcaggcggacag

SEQ ID NO: 149937 - DNA, 21 bp, Artificial sequence
  SiRNA target sequence
ttgctttggcaggcggacaga

SEQ ID NO: 149938 - DNA, 21 bp, Artificial sequence
  SiRNA target sequence
tgctttggcaggcggacagat

SEQ ID NO: 149939 - DNA, 21 bp, Artificial sequence
  SiRNA target sequence
gctttggcaggcggacagatt

SEQ ID NO: 149940 - DNA, 21 bp, Artificial sequence
  SiRNA target sequence
ctttggcaggcggacagatta

SEQ ID NO: 149941 - DNA, 21 bp, Artificial sequence
  SiRNA target sequence
tttggcaggcggacagattat

SEQ ID NO: 149942 - DNA, 21 bp, Artificial sequence
  SiRNA target sequence
ttggcaggcggacagattata

SEQ ID NO: 149943 - DNA, 21 bp, Artificial sequence
  SiRNA target sequence
tggcaggcggacagattatat

SEQ ID NO: 149944 - DNA, 21 bp, Artificial sequence
  SiRNA target sequence
ggcaggcggacagattatatt

SEQ ID NO: 149945 - DNA, 21 bp, Artificial sequence
  SiRNA target sequence
gcaggcggacagattatattt

SEQ ID NO: 149946 - DNA, 21 bp, Artificial sequence
  SiRNA target sequence
caggcggacagattatatttg

SEQ ID NO: 149947 - DNA, 21 bp, Artificial sequence
  SiRNA target sequence
aggcggacagattatatttga

SEQ ID NO: 149948 - DNA, 21 bp, Artificial sequence
  SiRNA target sequence
ggcggacagattatatttgaa

SEQ ID NO: 149949 - DNA, 21 bp, Artificial sequence
  SiRNA target sequence
gcggacagattatatttgaac

SEQ ID NO: 149950 - DNA, 21 bp, Artificial sequence
  SiRNA target sequence
cggacagattatatttgaaca

SEQ ID NO: 149951 - DNA, 21 bp, Artificial sequence
  SiRNA target sequence
ggacagattatatttgaacat

SEQ ID NO: 149952 - DNA, 21 bp, Artificial sequence
  SiRNA target sequence
gacagattatatttgaacata

SEQ ID NO: 149953 - DNA, 21 bp, Artificial sequence
  SiRNA target sequence
acagattatatttgaacatat

SEQ ID NO: 149954 - DNA, 21 bp, Artificial sequence
  SiRNA target sequence
cagattatatttgaacatatc

SEQ ID NO: 149955 - DNA, 21 bp, Artificial sequence
  SiRNA target sequence
agattatatttgaacatatca

SEQ ID NO: 149956 - DNA, 21 bp, Artificial sequence
  SiRNA target sequence
gattatatttgaacatatcac

SEQ ID NO: 149957 - DNA, 21 bp, Artificial sequence
  SiRNA target sequence
attatatttgaacatatcact

SEQ ID NO: 149958 - DNA, 21 bp, Artificial sequence
  SiRNA target sequence
ttatatttgaacatatcactg

SEQ ID NO: 149959 - DNA, 21 bp, Artificial sequence
  SiRNA target sequence
tatatttgaacatatcactgg

SEQ ID NO: 149960 - DNA, 21 bp, Artificial sequence
  SiRNA target sequence
atatttgaacatatcactggt

SEQ ID NO: 149961 - DNA, 21 bp, Artificial sequence
  SiRNA target sequence
tatttgaacatatcactggta

SEQ ID NO: 149962 - DNA, 21 bp, Artificial sequence
  SiRNA target sequence
atttgaacatatcactggtaa

SEQ ID NO: 149963 - DNA, 21 bp, Artificial sequence
  SiRNA target sequence
tttgaacatatcactggtaag

SEQ ID NO: 149964 - DNA, 21 bp, Artificial sequence
  SiRNA target sequence
ttgaacatatcactggtaaga

SEQ ID NO: 149965 - DNA, 21 bp, Artificial sequence
  SiRNA target sequence
tgaacatatcactggtaagaa

SEQ ID NO: 149966 - DNA, 21 bp, Artificial sequence
  SiRNA target sequence
gaacatatcactggtaagaaa

SEQ ID NO: 149967 - DNA, 21 bp, Artificial sequence
  SiRNA target sequence
aacatatcactggtaagaaat

SEQ ID NO: 149968 - DNA, 21 bp, Artificial sequence
  SiRNA target sequence
acatatcactggtaagaaatt

SEQ ID NO: 149969 - DNA, 21 bp, Artificial sequence
  SiRNA target sequence
catatcactggtaagaaattt

SEQ ID NO: 149970 - DNA, 21 bp, Artificial sequence
  SiRNA target sequence
atatcactggtaagaaatttg

SEQ ID NO: 149971 - DNA, 21 bp, Artificial sequence
  SiRNA target sequence
tatcactggtaagaaatttga

SEQ ID NO: 149972 - DNA, 21 bp, Artificial sequence
  SiRNA target sequence
atcactggtaagaaatttgaa

SEQ ID NO: 149973 - DNA, 21 bp, Artificial sequence
  SiRNA target sequence
tcactggtaagaaatttgaaa

SEQ ID NO: 149974 - DNA, 21 bp, Artificial sequence
  SiRNA target sequence
cactggtaagaaatttgaaat

SEQ ID NO: 149975 - DNA, 21 bp, Artificial sequence
  SiRNA target sequence
actggtaagaaatttgaaatt

SEQ ID NO: 149976 - DNA, 21 bp, Artificial sequence
  SiRNA target sequence
ctggtaagaaatttgaaatta

SEQ ID NO: 149977 - DNA, 21 bp, Artificial sequence
  SiRNA target sequence
tggtaagaaatttgaaattac

SEQ ID NO: 149978 - DNA, 21 bp, Artificial sequence
  SiRNA target sequence
ggtaagaaatttgaaattact

SEQ ID NO: 149979 - DNA, 21 bp, Artificial sequence
  SiRNA target sequence
gtaagaaatttgaaattactt

SEQ ID NO: 149980 - DNA, 21 bp, Artificial sequence
  SiRNA target sequence
taagaaatttgaaattacttt

SEQ ID NO: 149981 - DNA, 21 bp, Artificial sequence
  SiRNA target sequence
aagaaatttgaaattacttta

SEQ ID NO: 149982 - DNA, 21 bp, Artificial sequence
  SiRNA target sequence
agaaatttgaaattactttat

SEQ ID NO: 149983 - DNA, 21 bp, Artificial sequence
  SiRNA target sequence
gaaatttgaaattactttata

SEQ ID NO: 149984 - DNA, 21 bp, Artificial sequence
  SiRNA target sequence
aaatttgaaattactttatat

SEQ ID NO: 149985 - DNA, 21 bp, Artificial sequence
  SiRNA target sequence
aatttgaaattactttatatc

SEQ ID NO: 149986 - DNA, 21 bp, Artificial sequence
  SiRNA target sequence
atttgaaattactttatatcc

SEQ ID NO: 149987 - DNA, 21 bp, Artificial sequence
  SiRNA target sequence
tttgaaattactttatatcca

SEQ ID NO: 149988 - DNA, 21 bp, Artificial sequence
  SiRNA target sequence
ttgaaattactttatatccat

SEQ ID NO: 149989 - DNA, 21 bp, Artificial sequence
  SiRNA target sequence
tgaaattactttatatccatt

SEQ ID NO: 149990 - DNA, 21 bp, Artificial sequence
  SiRNA target sequence
gaaattactttatatccattt

SEQ ID NO: 149991 - DNA, 21 bp, Artificial sequence
  SiRNA target sequence
aaattactttatatccattta

SEQ ID NO: 149992 - DNA, 21 bp, Artificial sequence
  SiRNA target sequence
aattactttatatccatttaa

SEQ ID NO: 149993 - DNA, 21 bp, Artificial sequence
  SiRNA target sequence
attactttatatccatttaaa

SEQ ID NO: 149994 - DNA, 21 bp, Artificial sequence
  SiRNA target sequence
ttactttatatccatttaaag

SEQ ID NO: 149995 - DNA, 21 bp, Artificial sequence
  SiRNA target sequence
tactttatatccatttaaaga

SEQ ID NO: 149996 - DNA, 21 bp, Artificial sequence
  SiRNA target sequence
actttatatccatttaaagat

SEQ ID NO: 149997 - DNA, 21 bp, Artificial sequence
  SiRNA target sequence
ctttatatccatttaaagatt

SEQ ID NO: 149998 - DNA, 21 bp, Artificial sequence
  SiRNA target sequence
tttatatccatttaaagattt

SEQ ID NO: 149999 - DNA, 21 bp, Artificial sequence
  SiRNA target sequence
ttatatccatttaaagattta

SEQ ID NO: 150000 - DNA, 21 bp, Artificial sequence
  SiRNA target sequence
tatatccatttaaagatttaa

SEQ ID NO: 150001 - DNA, 21 bp, Artificial sequence
  SiRNA target sequence
atatccatttaaagatttaaa

SEQ ID NO: 150002 - DNA, 21 bp, Artificial sequence
  SiRNA target sequence
tatccatttaaagatttaaag

SEQ ID NO: 150003 - DNA, 21 bp, Artificial sequence
  SiRNA target sequence
atccatttaaagatttaaaga

SEQ ID NO: 150004 - DNA, 21 bp, Artificial sequence
  SiRNA target sequence
tccatttaaagatttaaagaa

SEQ ID NO: 150005 - DNA, 21 bp, Artificial sequence
  SiRNA target sequence
ccatttaaagatttaaagaaa

SEQ ID NO: 150006 - DNA, 21 bp, Artificial sequence
  SiRNA target sequence
catttaaagatttaaagaaat

SEQ ID NO: 150007 - DNA, 21 bp, Artificial sequence
  SiRNA target sequence
atttaaagatttaaagaaatg

SEQ ID NO: 150008 - DNA, 21 bp, Artificial sequence
  SiRNA target sequence
tttaaagatttaaagaaatgt

SEQ ID NO: 150009 - DNA, 21 bp, Artificial sequence
  SiRNA target sequence
ttaaagatttaaagaaatgta

SEQ ID NO: 150010 - DNA, 21 bp, Artificial sequence
  SiRNA target sequence
taaagatttaaagaaatgtat

SEQ ID NO: 150011 - DNA, 21 bp, Artificial sequence
  SiRNA target sequence
aaagatttaaagaaatgtatt

SEQ ID NO: 150012 - DNA, 21 bp, Artificial sequence
  SiRNA target sequence
aagatttaaagaaatgtatta

SEQ ID NO: 150013 - DNA, 21 bp, Artificial sequence
  SiRNA target sequence
agatttaaagaaatgtattat

SEQ ID NO: 150014 - DNA, 21 bp, Artificial sequence
  SiRNA target sequence
gatttaaagaaatgtattatt

SEQ ID NO: 150015 - DNA, 21 bp, Artificial sequence
  SiRNA target sequence
atttaaagaaatgtattattt

SEQ ID NO: 150016 - DNA, 21 bp, Artificial sequence
  SiRNA target sequence
tttaaagaaatgtattatttt

SEQ ID NO: 150017 - DNA, 21 bp, Artificial sequence
  SiRNA target sequence
ttaaagaaatgtattatttta

SEQ ID NO: 150018 - DNA, 21 bp, Artificial sequence
  SiRNA target sequence
taaagaaatgtattattttaa

SEQ ID NO: 150019 - DNA, 21 bp, Artificial sequence
  SiRNA target sequence
aaagaaatgtattattttaaa

SEQ ID NO: 150020 - DNA, 21 bp, Artificial sequence
  SiRNA target sequence
aagaaatgtattattttaaaa

SEQ ID NO: 150021 - DNA, 21 bp, Artificial sequence
  SiRNA target sequence
agaaatgtattattttaaaag

SEQ ID NO: 150022 - DNA, 21 bp, Artificial sequence
  SiRNA target sequence
gaaatgtattattttaaaagg

SEQ ID NO: 150023 - DNA, 21 bp, Artificial sequence
  SiRNA target sequence
aaatgtattattttaaaaggc

SEQ ID NO: 150024 - DNA, 21 bp, Artificial sequence
  SiRNA target sequence
aatgtattattttaaaaggcg

SEQ ID NO: 150025 - DNA, 21 bp, Artificial sequence
  SiRNA target sequence
atgtattattttaaaaggcga

SEQ ID NO: 150026 - DNA, 21 bp, Artificial sequence
  SiRNA target sequence
tgtattattttaaaaggcgaa

SEQ ID NO: 150027 - DNA, 21 bp, Artificial sequence
  SiRNA target sequence
gtattattttaaaaggcgaag

SEQ ID NO: 150028 - DNA, 21 bp, Artificial sequence
  SiRNA target sequence
tattattttaaaaggcgaagg

SEQ ID NO: 150029 - DNA, 21 bp, Artificial sequence
  SiRNA target sequence
attattttaaaaggcgaaggt

SEQ ID NO: 150030 - DNA, 21 bp, Artificial sequence
  SiRNA target sequence
ttattttaaaaggcgaaggtt

SEQ ID NO: 150031 - DNA, 21 bp, Artificial sequence
  SiRNA target sequence
tattttaaaaggcgaaggttt

SEQ ID NO: 150032 - DNA, 21 bp, Artificial sequence
  SiRNA target sequence
attttaaaaggcgaaggtttt

SEQ ID NO: 150033 - DNA, 21 bp, Artificial sequence
  SiRNA target sequence
ttttaaaaggcgaaggtttta

SEQ ID NO: 150034 - DNA, 21 bp, Artificial sequence
  SiRNA target sequence
tttaaaaggcgaaggttttaa

SEQ ID NO: 150035 - DNA, 21 bp, Artificial sequence
  SiRNA target sequence
ttaaaaggcgaaggttttaaa

SEQ ID NO: 150036 - DNA, 21 bp, Artificial sequence
  SiRNA target sequence
taaaaggcgaaggttttaaaa

SEQ ID NO: 150037 - DNA, 21 bp, Artificial sequence
  SiRNA target sequence
aaaaggcgaaggttttaaaat

SEQ ID NO: 150038 - DNA, 21 bp, Artificial sequence
  SiRNA target sequence
aaaggcgaaggttttaaaata

SEQ ID NO: 150039 - DNA, 21 bp, Artificial sequence
  SiRNA target sequence
aaggcgaaggttttaaaataa

SEQ ID NO: 150040 - DNA, 21 bp, Artificial sequence
  SiRNA target sequence
aggcgaaggttttaaaataaa

SEQ ID NO: 150041 - DNA, 21 bp, Artificial sequence
  SiRNA target sequence
ggcgaaggttttaaaataaaa

SEQ ID NO: 150042 - DNA, 21 bp, Artificial sequence
  SiRNA target sequence
gcgaaggttttaaaataaaaa

SEQ ID NO: 150043 - DNA, 21 bp, Artificial sequence
  SiRNA target sequence
cgaaggttttaaaataaaaaa

SEQ ID NO: 150044 - DNA, 21 bp, Artificial sequence
  SiRNA target sequence
gaaggttttaaaataaaaaat

SEQ ID NO: 150045 - DNA, 21 bp, Artificial sequence
  SiRNA target sequence
aaggttttaaaataaaaaata

SEQ ID NO: 150046 - DNA, 21 bp, Artificial sequence
  SiRNA target sequence
aggttttaaaataaaaaatag

SEQ ID NO: 150047 - DNA, 21 bp, Artificial sequence
  SiRNA target sequence
ggttttaaaataaaaaatagt

SEQ ID NO: 150048 - DNA, 21 bp, Artificial sequence
  SiRNA target sequence
gttttaaaataaaaaatagtt

SEQ ID NO: 150049 - DNA, 21 bp, Artificial sequence
  SiRNA target sequence
ttttaaaataaaaaatagtta

SEQ ID NO: 150050 - DNA, 21 bp, Artificial sequence
  SiRNA target sequence
tttaaaataaaaaatagttat

SEQ ID NO: 150051 - DNA, 21 bp, Artificial sequence
  SiRNA target sequence
ttaaaataaaaaatagttatt

SEQ ID NO: 150052 - DNA, 21 bp, Artificial sequence
  SiRNA target sequence
taaaataaaaaatagttattc

SEQ ID NO: 150053 - DNA, 21 bp, Artificial sequence
  SiRNA target sequence
aaaataaaaaatagttattcg

SEQ ID NO: 150054 - DNA, 21 bp, Artificial sequence
  SiRNA target sequence
aaataaaaaatagttattcgg

SEQ ID NO: 150055 - DNA, 21 bp, Artificial sequence
  SiRNA target sequence
aataaaaaatagttattcggg

SEQ ID NO: 150056 - DNA, 21 bp, Artificial sequence
  SiRNA target sequence
ataaaaaatagttattcgggt

SEQ ID NO: 150057 - DNA, 21 bp, Artificial sequence
  SiRNA target sequence
taaaaaatagttattcgggtg

SEQ ID NO: 150058 - DNA, 21 bp, Artificial sequence
  SiRNA target sequence
aaaaaatagttattcgggtgg

SEQ ID NO: 150059 - DNA, 21 bp, Artificial sequence
  SiRNA target sequence
aaaaatagttattcgggtggt

SEQ ID NO: 150060 - DNA, 21 bp, Artificial sequence
  SiRNA target sequence
aaaatagttattcgggtggtg

SEQ ID NO: 150061 - DNA, 21 bp, Artificial sequence
  SiRNA target sequence
aaatagttattcgggtggtga

SEQ ID NO: 150062 - DNA, 21 bp, Artificial sequence
  SiRNA target sequence
aatagttattcgggtggtgat

SEQ ID NO: 150063 - DNA, 21 bp, Artificial sequence
  SiRNA target sequence
atagttattcgggtggtgatc

SEQ ID NO: 150064 - DNA, 21 bp, Artificial sequence
  SiRNA target sequence
tagttattcgggtggtgatct

SEQ ID NO: 150065 - DNA, 21 bp, Artificial sequence
  SiRNA target sequence
agttattcgggtggtgatctt

SEQ ID NO: 150066 - DNA, 21 bp, Artificial sequence
  SiRNA target sequence
gttattcgggtggtgatctta

SEQ ID NO: 150067 - DNA, 21 bp, Artificial sequence
  SiRNA target sequence
ttattcgggtggtgatcttat

SEQ ID NO: 150068 - DNA, 21 bp, Artificial sequence
  SiRNA target sequence
tattcgggtggtgatcttatt

SEQ ID NO: 150069 - DNA, 21 bp, Artificial sequence
  SiRNA target sequence
attcgggtggtgatcttattc

SEQ ID NO: 150070 - DNA, 21 bp, Artificial sequence
  SiRNA target sequence
ttcgggtggtgatcttattct

SEQ ID NO: 150071 - DNA, 21 bp, Artificial sequence
  SiRNA target sequence
tcgggtggtgatcttattctc

SEQ ID NO: 150072 - DNA, 21 bp, Artificial sequence
  SiRNA target sequence
cgggtggtgatcttattctcg

SEQ ID NO: 150073 - DNA, 21 bp, Artificial sequence
  SiRNA target sequence
gggtggtgatcttattctcga

SEQ ID NO: 150074 - DNA, 21 bp, Artificial sequence
  SiRNA target sequence
ggtggtgatcttattctcgaa

SEQ ID NO: 150075 - DNA, 21 bp, Artificial sequence
  SiRNA target sequence
gtggtgatcttattctcgaac

SEQ ID NO: 150076 - DNA, 21 bp, Artificial sequence
  SiRNA target sequence
tggtgatcttattctcgaacc

SEQ ID NO: 150077 - DNA, 21 bp, Artificial sequence
  SiRNA target sequence
ggtgatcttattctcgaacct

SEQ ID NO: 150078 - DNA, 21 bp, Artificial sequence
  SiRNA target sequence
gtgatcttattctcgaaccta

SEQ ID NO: 150079 - DNA, 21 bp, Artificial sequence
  SiRNA target sequence
tgatcttattctcgaacctaa

SEQ ID NO: 150080 - DNA, 21 bp, Artificial sequence
  SiRNA target sequence
gatcttattctcgaacctaat

SEQ ID NO: 150081 - DNA, 21 bp, Artificial sequence
  SiRNA target sequence
atcttattctcgaacctaata

SEQ ID NO: 150082 - DNA, 21 bp, Artificial sequence
  SiRNA target sequence
tcttattctcgaacctaatat

SEQ ID NO: 150083 - DNA, 21 bp, Artificial sequence
  SiRNA target sequence
cttattctcgaacctaatata

SEQ ID NO: 150084 - DNA, 21 bp, Artificial sequence
  SiRNA target sequence
ttattctcgaacctaatataa

SEQ ID NO: 150085 - DNA, 21 bp, Artificial sequence
  SiRNA target sequence
tattctcgaacctaatataat

SEQ ID NO: 150086 - DNA, 21 bp, Artificial sequence
  SiRNA target sequence
attctcgaacctaatataatt

SEQ ID NO: 150087 - DNA, 21 bp, Artificial sequence
  SiRNA target sequence
ttctcgaacctaatataatta

SEQ ID NO: 150088 - DNA, 21 bp, Artificial sequence
  SiRNA target sequence
tctcgaacctaatataattat

SEQ ID NO: 150089 - DNA, 21 bp, Artificial sequence
  SiRNA target sequence
ctcgaacctaatataattata

SEQ ID NO: 150090 - DNA, 21 bp, Artificial sequence
  SiRNA target sequence
tcgaacctaatataattatag

SEQ ID NO: 150091 - DNA, 21 bp, Artificial sequence
  SiRNA target sequence
cgaacctaatataattataga

SEQ ID NO: 150092 - DNA, 21 bp, Artificial sequence
  SiRNA target sequence
gaacctaatataattatagat

SEQ ID NO: 150093 - DNA, 21 bp, Artificial sequence
  SiRNA target sequence
aacctaatataattatagata

SEQ ID NO: 150094 - DNA, 21 bp, Artificial sequence
  SiRNA target sequence
acctaatataattatagataa

SEQ ID NO: 150095 - DNA, 21 bp, Artificial sequence
  SiRNA target sequence
cctaatataattatagataag

SEQ ID NO: 150096 - DNA, 21 bp, Artificial sequence
  SiRNA target sequence
ctaatataattatagataaga

SEQ ID NO: 150097 - DNA, 21 bp, Artificial sequence
  SiRNA target sequence
taatataattatagataagaa

SEQ ID NO: 150098 - DNA, 21 bp, Artificial sequence
  SiRNA target sequence
aatataattatagataagaat

SEQ ID NO: 150099 - DNA, 21 bp, Artificial sequence
  SiRNA target sequence
atataattatagataagaata

SEQ ID NO: 150100 - DNA, 21 bp, Artificial sequence
  SiRNA target sequence
tataattatagataagaatat

SEQ ID NO: 150101 - DNA, 21 bp, Artificial sequence
  SiRNA target sequence
ataattatagataagaatatt

SEQ ID NO: 150102 - DNA, 21 bp, Artificial sequence
  SiRNA target sequence
taattatagataagaatattg

SEQ ID NO: 150103 - DNA, 21 bp, Artificial sequence
  SiRNA target sequence
aattatagataagaatattga

SEQ ID NO: 150104 - DNA, 21 bp, Artificial sequence
  SiRNA target sequence
attatagataagaatattgat

SEQ ID NO: 150105 - DNA, 21 bp, Artificial sequence
  SiRNA target sequence
ttatagataagaatattgata

SEQ ID NO: 150106 - DNA, 21 bp, Artificial sequence
  SiRNA target sequence
tatagataagaatattgataa

SEQ ID NO: 150107 - DNA, 21 bp, Artificial sequence
  SiRNA target sequence
atagataagaatattgataaa

SEQ ID NO: 150108 - DNA, 21 bp, Artificial sequence
  SiRNA target sequence
tagataagaatattgataaag

SEQ ID NO: 150109 - DNA, 21 bp, Artificial sequence
  SiRNA target sequence
agataagaatattgataaaga

SEQ ID NO: 150110 - DNA, 21 bp, Artificial sequence
  SiRNA target sequence
gataagaatattgataaagat

SEQ ID NO: 150111 - DNA, 21 bp, Artificial sequence
  SiRNA target sequence
ataagaatattgataaagatt

SEQ ID NO: 150112 - DNA, 21 bp, Artificial sequence
  SiRNA target sequence
taagaatattgataaagattt

SEQ ID NO: 150113 - DNA, 21 bp, Artificial sequence
  SiRNA target sequence
aagaatattgataaagattta

SEQ ID NO: 150114 - DNA, 21 bp, Artificial sequence
  SiRNA target sequence
agaatattgataaagatttat

SEQ ID NO: 150115 - DNA, 21 bp, Artificial sequence
  SiRNA target sequence
gaatattgataaagatttatt

SEQ ID NO: 150116 - DNA, 21 bp, Artificial sequence
  SiRNA target sequence
aatattgataaagatttatta

SEQ ID NO: 150117 - DNA, 21 bp, Artificial sequence
  SiRNA target sequence
atattgataaagatttattag

SEQ ID NO: 150118 - DNA, 21 bp, Artificial sequence
  SiRNA target sequence
tattgataaagatttattagc

SEQ ID NO: 150119 - DNA, 21 bp, Artificial sequence
  SiRNA target sequence
attgataaagatttattagca

SEQ ID NO: 150120 - DNA, 21 bp, Artificial sequence
  SiRNA target sequence
ttgataaagatttattagcac

SEQ ID NO: 150121 - DNA, 21 bp, Artificial sequence
  SiRNA target sequence
tgataaagatttattagcacg

SEQ ID NO: 150122 - DNA, 21 bp, Artificial sequence
  SiRNA target sequence
gataaagatttattagcacgc

SEQ ID NO: 150123 - DNA, 21 bp, Artificial sequence
  SiRNA target sequence
ataaagatttattagcacgcg

SEQ ID NO: 150124 - DNA, 21 bp, Artificial sequence
  SiRNA target sequence
taaagatttattagcacgcgc

SEQ ID NO: 150125 - DNA, 21 bp, Artificial sequence
  SiRNA target sequence
aaagatttattagcacgcgcc

SEQ ID NO: 150126 - DNA, 21 bp, Artificial sequence
  SiRNA target sequence
aagatttattagcacgcgcct

SEQ ID NO: 150127 - DNA, 21 bp, Artificial sequence
  SiRNA target sequence
agatttattagcacgcgcctt

SEQ ID NO: 150128 - DNA, 21 bp, Artificial sequence
  SiRNA target sequence
gatttattagcacgcgccttg

SEQ ID NO: 150129 - DNA, 21 bp, Artificial sequence
  SiRNA target sequence
atttattagcacgcgccttga

SEQ ID NO: 150130 - DNA, 21 bp, Artificial sequence
  SiRNA target sequence
tttattagcacgcgccttgaa

SEQ ID NO: 150131 - DNA, 21 bp, Artificial sequence
  SiRNA target sequence
ttattagcacgcgccttgaat

SEQ ID NO: 150132 - DNA, 21 bp, Artificial sequence
  SiRNA target sequence
tattagcacgcgccttgaatt

SEQ ID NO: 150133 - DNA, 21 bp, Artificial sequence
  SiRNA target sequence
attagcacgcgccttgaatta

SEQ ID NO: 150134 - DNA, 21 bp, Artificial sequence
  SiRNA target sequence
ttagcacgcgccttgaattat

SEQ ID NO: 150135 - DNA, 21 bp, Artificial sequence
  SiRNA target sequence
tagcacgcgccttgaattatg

SEQ ID NO: 150136 - DNA, 21 bp, Artificial sequence
  SiRNA target sequence
agcacgcgccttgaattatgt

SEQ ID NO: 150137 - DNA, 21 bp, Artificial sequence
  SiRNA target sequence
gcacgcgccttgaattatgtt

SEQ ID NO: 150138 - DNA, 21 bp, Artificial sequence
  SiRNA target sequence
cacgcgccttgaattatgttc

SEQ ID NO: 150139 - DNA, 21 bp, Artificial sequence
  SiRNA target sequence
acgcgccttgaattatgttcc

SEQ ID NO: 150140 - DNA, 21 bp, Artificial sequence
  SiRNA target sequence
cgcgccttgaattatgttcct

SEQ ID NO: 150141 - DNA, 21 bp, Artificial sequence
  SiRNA target sequence
gcgccttgaattatgttcctg

SEQ ID NO: 150142 - DNA, 21 bp, Artificial sequence
  SiRNA target sequence
cgccttgaattatgttcctgt

SEQ ID NO: 150143 - DNA, 21 bp, Artificial sequence
  SiRNA target sequence
gccttgaattatgttcctgta

SEQ ID NO: 150144 - DNA, 21 bp, Artificial sequence
  SiRNA target sequence
ccttgaattatgttcctgtaa

SEQ ID NO: 150145 - DNA, 21 bp, Artificial sequence
  SiRNA target sequence
cttgaattatgttcctgtaag

SEQ ID NO: 150146 - DNA, 21 bp, Artificial sequence
  SiRNA target sequence
ttgaattatgttcctgtaaga

SEQ ID NO: 150147 - DNA, 21 bp, Artificial sequence
  SiRNA target sequence
tgaattatgttcctgtaagaa

SEQ ID NO: 150148 - DNA, 21 bp, Artificial sequence
  SiRNA target sequence
gaattatgttcctgtaagaaa

SEQ ID NO: 150149 - DNA, 21 bp, Artificial sequence
  SiRNA target sequence
aattatgttcctgtaagaaaa

SEQ ID NO: 150150 - DNA, 21 bp, Artificial sequence
  SiRNA target sequence
attatgttcctgtaagaaaag

SEQ ID NO: 150151 - DNA, 21 bp, Artificial sequence
  SiRNA target sequence
ttatgttcctgtaagaaaaga

SEQ ID NO: 150152 - DNA, 21 bp, Artificial sequence
  SiRNA target sequence
tatgttcctgtaagaaaagat

SEQ ID NO: 150153 - DNA, 21 bp, Artificial sequence
  SiRNA target sequence
atgttcctgtaagaaaagatt

SEQ ID NO: 150154 - DNA, 21 bp, Artificial sequence
  SiRNA target sequence
tgttcctgtaagaaaagattt

SEQ ID NO: 150155 - DNA, 21 bp, Artificial sequence
  SiRNA target sequence
gttcctgtaagaaaagatttt

SEQ ID NO: 150156 - DNA, 21 bp, Artificial sequence
  SiRNA target sequence
ttcctgtaagaaaagatttta

SEQ ID NO: 150157 - DNA, 21 bp, Artificial sequence
  SiRNA target sequence
tcctgtaagaaaagattttac

SEQ ID NO: 150158 - DNA, 21 bp, Artificial sequence
  SiRNA target sequence
cctgtaagaaaagattttaca

SEQ ID NO: 150159 - DNA, 21 bp, Artificial sequence
  SiRNA target sequence
ctgtaagaaaagattttacag

SEQ ID NO: 150160 - DNA, 21 bp, Artificial sequence
  SiRNA target sequence
tgtaagaaaagattttacagg

SEQ ID NO: 150161 - DNA, 21 bp, Artificial sequence
  SiRNA target sequence
gtaagaaaagattttacagga

SEQ ID NO: 150162 - DNA, 21 bp, Artificial sequence
  SiRNA target sequence
taagaaaagattttacaggaa

SEQ ID NO: 150163 - DNA, 21 bp, Artificial sequence
  SiRNA target sequence
aagaaaagattttacaggaac

SEQ ID NO: 150164 - DNA, 21 bp, Artificial sequence
  SiRNA target sequence
agaaaagattttacaggaact

SEQ ID NO: 150165 - DNA, 21 bp, Artificial sequence
  SiRNA target sequence
gaaaagattttacaggaactg

SEQ ID NO: 150166 - DNA, 21 bp, Artificial sequence
  SiRNA target sequence
aaaagattttacaggaactgc

SEQ ID NO: 150167 - DNA, 21 bp, Artificial sequence
  SiRNA target sequence
aaagattttacaggaactgct

SEQ ID NO: 150168 - DNA, 21 bp, Artificial sequence
  SiRNA target sequence
aagattttacaggaactgctg

SEQ ID NO: 150169 - DNA, 21 bp, Artificial sequence
  SiRNA target sequence
agattttacaggaactgctgt

SEQ ID NO: 150170 - DNA, 21 bp, Artificial sequence
  SiRNA target sequence
gattttacaggaactgctgtt

SEQ ID NO: 150171 - DNA, 21 bp, Artificial sequence
  SiRNA target sequence
attttacaggaactgctgttc

SEQ ID NO: 150172 - DNA, 21 bp, Artificial sequence
  SiRNA target sequence
ttttacaggaactgctgttcc

SEQ ID NO: 150173 - DNA, 21 bp, Artificial sequence
  SiRNA target sequence
tttacaggaactgctgttcca

SEQ ID NO: 150174 - DNA, 21 bp, Artificial sequence
  SiRNA target sequence
ttacaggaactgctgttccaa

SEQ ID NO: 150175 - DNA, 21 bp, Artificial sequence
  SiRNA target sequence
tacaggaactgctgttccaaa

SEQ ID NO: 150176 - DNA, 21 bp, Artificial sequence
  SiRNA target sequence
acaggaactgctgttccaaaa

SEQ ID NO: 150177 - DNA, 21 bp, Artificial sequence
  SiRNA target sequence
caggaactgctgttccaaaat

SEQ ID NO: 150178 - DNA, 21 bp, Artificial sequence
  SiRNA target sequence
aggaactgctgttccaaaata

SEQ ID NO: 150179 - DNA, 21 bp, Artificial sequence
  SiRNA target sequence
ggaactgctgttccaaaatat

SEQ ID NO: 150180 - DNA, 21 bp, Artificial sequence
  SiRNA target sequence
gaactgctgttccaaaatatg

SEQ ID NO: 150181 - DNA, 21 bp, Artificial sequence
  SiRNA target sequence
aactgctgttccaaaatatgc

SEQ ID NO: 150182 - DNA, 21 bp, Artificial sequence
  SiRNA target sequence
actgctgttccaaaatatgca

SEQ ID NO: 150183 - DNA, 21 bp, Artificial sequence
  SiRNA target sequence
ctgctgttccaaaatatgcag

SEQ ID NO: 150184 - DNA, 21 bp, Artificial sequence
  SiRNA target sequence
tgctgttccaaaatatgcaga

SEQ ID NO: 150185 - DNA, 21 bp, Artificial sequence
  SiRNA target sequence
gctgttccaaaatatgcagaa

SEQ ID NO: 150186 - DNA, 21 bp, Artificial sequence
  SiRNA target sequence
ctgttccaaaatatgcagaat

SEQ ID NO: 150187 - DNA, 21 bp, Artificial sequence
  SiRNA target sequence
tgttccaaaatatgcagaatt

SEQ ID NO: 150188 - DNA, 21 bp, Artificial sequence
  SiRNA target sequence
gttccaaaatatgcagaattt

SEQ ID NO: 150189 - DNA, 21 bp, Artificial sequence
  SiRNA target sequence
ttccaaaatatgcagaatttg

SEQ ID NO: 150190 - DNA, 21 bp, Artificial sequence
  SiRNA target sequence
tccaaaatatgcagaatttgg

SEQ ID NO: 150191 - DNA, 21 bp, Artificial sequence
  SiRNA target sequence
ccaaaatatgcagaatttggt

SEQ ID NO: 150192 - DNA, 21 bp, Artificial sequence
  SiRNA target sequence
caaaatatgcagaatttggtg

SEQ ID NO: 150193 - DNA, 21 bp, Artificial sequence
  SiRNA target sequence
aaaatatgcagaatttggtgt

SEQ ID NO: 150194 - DNA, 21 bp, Artificial sequence
  SiRNA target sequence
aaatatgcagaatttggtgtt

SEQ ID NO: 150195 - DNA, 21 bp, Artificial sequence
  SiRNA target sequence
aatatgcagaatttggtgtta

SEQ ID NO: 150196 - DNA, 21 bp, Artificial sequence
  SiRNA target sequence
atatgcagaatttggtgttat

SEQ ID NO: 150197 - DNA, 21 bp, Artificial sequence
  SiRNA target sequence
tatgcagaatttggtgttatg

SEQ ID NO: 150198 - DNA, 21 bp, Artificial sequence
  SiRNA target sequence
atgcagaatttggtgttatgc

SEQ ID NO: 150199 - DNA, 21 bp, Artificial sequence
  SiRNA target sequence
tgcagaatttggtgttatgcc

SEQ ID NO: 150200 - DNA, 21 bp, Artificial sequence
  SiRNA target sequence
gcagaatttggtgttatgcct

SEQ ID NO: 150201 - DNA, 21 bp, Artificial sequence
  SiRNA target sequence
cagaatttggtgttatgccta

SEQ ID NO: 150202 - DNA, 21 bp, Artificial sequence
  SiRNA target sequence
agaatttggtgttatgcctaa

SEQ ID NO: 150203 - DNA, 21 bp, Artificial sequence
  SiRNA target sequence
gaatttggtgttatgcctaaa

SEQ ID NO: 150204 - DNA, 21 bp, Artificial sequence
  SiRNA target sequence
aatttggtgttatgcctaaag

SEQ ID NO: 150205 - DNA, 21 bp, Artificial sequence
  SiRNA target sequence
atttggtgttatgcctaaaga

SEQ ID NO: 150206 - DNA, 21 bp, Artificial sequence
  SiRNA target sequence
tttggtgttatgcctaaagaa

SEQ ID NO: 150207 - DNA, 21 bp, Artificial sequence
  SiRNA target sequence
ttggtgttatgcctaaagaac

SEQ ID NO: 150208 - DNA, 21 bp, Artificial sequence
  SiRNA target sequence
tggtgttatgcctaaagaaca

SEQ ID NO: 150209 - DNA, 21 bp, Artificial sequence
  SiRNA target sequence
ggtgttatgcctaaagaacag

SEQ ID NO: 150210 - DNA, 21 bp, Artificial sequence
  SiRNA target sequence
gtgttatgcctaaagaacagg

SEQ ID NO: 150211 - DNA, 21 bp, Artificial sequence
  SiRNA target sequence
tgttatgcctaaagaacagga

SEQ ID NO: 150212 - DNA, 21 bp, Artificial sequence
  SiRNA target sequence
gttatgcctaaagaacaggaa

SEQ ID NO: 150213 - DNA, 21 bp, Artificial sequence
  SiRNA target sequence
ttatgcctaaagaacaggaag

SEQ ID NO: 150214 - DNA, 21 bp, Artificial sequence
  SiRNA target sequence
tatgcctaaagaacaggaaga

SEQ ID NO: 150215 - DNA, 21 bp, Artificial sequence
  SiRNA target sequence
atgcctaaagaacaggaagaa

SEQ ID NO: 150216 - DNA, 21 bp, Artificial sequence
  SiRNA target sequence
tgcctaaagaacaggaagaac

SEQ ID NO: 150217 - DNA, 21 bp, Artificial sequence
  SiRNA target sequence
gcctaaagaacaggaagaaca

SEQ ID NO: 150218 - DNA, 21 bp, Artificial sequence
  SiRNA target sequence
cctaaagaacaggaagaacaa

SEQ ID NO: 150219 - DNA, 21 bp, Artificial sequence
  SiRNA target sequence
ctaaagaacaggaagaacaaa

SEQ ID NO: 150220 - DNA, 21 bp, Artificial sequence
  SiRNA target sequence
taaagaacaggaagaacaaaa

SEQ ID NO: 150221 - DNA, 21 bp, Artificial sequence
  SiRNA target sequence
aaagaacaggaagaacaaaac

SEQ ID NO: 150222 - DNA, 21 bp, Artificial sequence
  SiRNA target sequence
aagaacaggaagaacaaaacg

SEQ ID NO: 150223 - DNA, 21 bp, Artificial sequence
  SiRNA target sequence
agaacaggaagaacaaaacga

SEQ ID NO: 150224 - DNA, 21 bp, Artificial sequence
  SiRNA target sequence
gaacaggaagaacaaaacgaa

SEQ ID NO: 150225 - DNA, 21 bp, Artificial sequence
  SiRNA target sequence
aacaggaagaacaaaacgaaa

SEQ ID NO: 150226 - DNA, 21 bp, Artificial sequence
  SiRNA target sequence
acaggaagaacaaaacgaaag

SEQ ID NO: 150227 - DNA, 21 bp, Artificial sequence
  SiRNA target sequence
caggaagaacaaaacgaaaga

SEQ ID NO: 150228 - DNA, 21 bp, Artificial sequence
  SiRNA target sequence
aggaagaacaaaacgaaagag

SEQ ID NO: 150229 - DNA, 21 bp, Artificial sequence
  SiRNA target sequence
ggaagaacaaaacgaaagaga

SEQ ID NO: 150230 - DNA, 21 bp, Artificial sequence
  SiRNA target sequence
gaagaacaaaacgaaagagaa

SEQ ID NO: 150231 - DNA, 21 bp, Artificial sequence
  SiRNA target sequence
aagaacaaaacgaaagagaaa

SEQ ID NO: 150232 - DNA, 21 bp, Artificial sequence
  SiRNA target sequence
agaacaaaacgaaagagaaag

SEQ ID NO: 150233 - DNA, 21 bp, Artificial sequence
  SiRNA target sequence
gaacaaaacgaaagagaaaga

SEQ ID NO: 150234 - DNA, 21 bp, Artificial sequence
  SiRNA target sequence
aacaaaacgaaagagaaagat

SEQ ID NO: 150235 - DNA, 21 bp, Artificial sequence
  SiRNA target sequence
acaaaacgaaagagaaagatt

SEQ ID NO: 150236 - DNA, 21 bp, Artificial sequence
  SiRNA target sequence
caaaacgaaagagaaagattc

SEQ ID NO: 150237 - DNA, 21 bp, Artificial sequence
  SiRNA target sequence
aaaacgaaagagaaagattcg

SEQ ID NO: 150238 - DNA, 21 bp, Artificial sequence
  SiRNA target sequence
aaacgaaagagaaagattcga

SEQ ID NO: 150239 - DNA, 21 bp, Artificial sequence
  SiRNA target sequence
aacgaaagagaaagattcgaa

SEQ ID NO: 150240 - DNA, 21 bp, Artificial sequence
  SiRNA target sequence
acgaaagagaaagattcgaag

SEQ ID NO: 150241 - DNA, 21 bp, Artificial sequence
  SiRNA target sequence
cgaaagagaaagattcgaagg

SEQ ID NO: 150242 - DNA, 21 bp, Artificial sequence
  SiRNA target sequence
gaaagagaaagattcgaaggt

SEQ ID NO: 150243 - DNA, 21 bp, Artificial sequence
  SiRNA target sequence
aaagagaaagattcgaaggtg

SEQ ID NO: 150244 - DNA, 21 bp, Artificial sequence
  SiRNA target sequence
aagagaaagattcgaaggtgc

SEQ ID NO: 150245 - DNA, 21 bp, Artificial sequence
  SiRNA target sequence
agagaaagattcgaaggtgca

SEQ ID NO: 150246 - DNA, 21 bp, Artificial sequence
  SiRNA target sequence
gagaaagattcgaaggtgcag

SEQ ID NO: 150247 - DNA, 21 bp, Artificial sequence
  SiRNA target sequence
agaaagattcgaaggtgcaga

SEQ ID NO: 150248 - DNA, 21 bp, Artificial sequence
  SiRNA target sequence
gaaagattcgaaggtgcagaa

SEQ ID NO: 150249 - DNA, 21 bp, Artificial sequence
  SiRNA target sequence
aaagattcgaaggtgcagaag

SEQ ID NO: 150250 - DNA, 21 bp, Artificial sequence
  SiRNA target sequence
aagattcgaaggtgcagaaga

SEQ ID NO: 150251 - DNA, 21 bp, Artificial sequence
  SiRNA target sequence
agattcgaaggtgcagaagag

SEQ ID NO: 150252 - DNA, 21 bp, Artificial sequence
  SiRNA target sequence
gattcgaaggtgcagaagagt

SEQ ID NO: 150253 - DNA, 21 bp, Artificial sequence
  SiRNA target sequence
attcgaaggtgcagaagagtt

SEQ ID NO: 150254 - DNA, 21 bp, Artificial sequence
  SiRNA target sequence
ttcgaaggtgcagaagagttt

SEQ ID NO: 150255 - DNA, 21 bp, Artificial sequence
  SiRNA target sequence
tcgaaggtgcagaagagtttt

SEQ ID NO: 150256 - DNA, 21 bp, Artificial sequence
  SiRNA target sequence
cgaaggtgcagaagagttttt

SEQ ID NO: 150257 - DNA, 21 bp, Artificial sequence
  SiRNA target sequence
gaaggtgcagaagagtttttt

SEQ ID NO: 150258 - DNA, 21 bp, Artificial sequence
  SiRNA target sequence
aaggtgcagaagagttttttg

SEQ ID NO: 150259 - DNA, 21 bp, Artificial sequence
  SiRNA target sequence
aggtgcagaagagttttttgg

SEQ ID NO: 150260 - DNA, 21 bp, Artificial sequence
  SiRNA target sequence
ggtgcagaagagttttttgga

SEQ ID NO: 150261 - DNA, 21 bp, Artificial sequence
  SiRNA target sequence
gtgcagaagagttttttggag

SEQ ID NO: 150262 - DNA, 21 bp, Artificial sequence
  SiRNA target sequence
tgcagaagagttttttggagg

SEQ ID NO: 150263 - DNA, 21 bp, Artificial sequence
  SiRNA target sequence
gcagaagagttttttggagga

SEQ ID NO: 150264 - DNA, 21 bp, Artificial sequence
  SiRNA target sequence
cagaagagttttttggaggaa

SEQ ID NO: 150265 - DNA, 21 bp, Artificial sequence
  SiRNA target sequence
agaagagttttttggaggaaa

SEQ ID NO: 150266 - DNA, 21 bp, Artificial sequence
  SiRNA target sequence
gaagagttttttggaggaaat

SEQ ID NO: 150267 - DNA, 21 bp, Artificial sequence
  SiRNA target sequence
aagagttttttggaggaaatg

SEQ ID NO: 150268 - DNA, 21 bp, Artificial sequence
  SiRNA target sequence
agagttttttggaggaaatgg

SEQ ID NO: 150269 - DNA, 21 bp, Artificial sequence
  SiRNA target sequence
gagttttttggaggaaatggt

SEQ ID NO: 150270 - DNA, 21 bp, Artificial sequence
  SiRNA target sequence
agttttttggaggaaatggta

SEQ ID NO: 150271 - DNA, 21 bp, Artificial sequence
  SiRNA target sequence
gttttttggaggaaatggtag

SEQ ID NO: 150272 - DNA, 21 bp, Artificial sequence
  SiRNA target sequence
ttttttggaggaaatggtaga

SEQ ID NO: 150273 - DNA, 21 bp, Artificial sequence
  SiRNA target sequence
tttttggaggaaatggtagag

SEQ ID NO: 150274 - DNA, 21 bp, Artificial sequence
  SiRNA target sequence
ttttggaggaaatggtagaga

SEQ ID NO: 150275 - DNA, 21 bp, Artificial sequence
  SiRNA target sequence
tttggaggaaatggtagagat

SEQ ID NO: 150276 - DNA, 21 bp, Artificial sequence
  SiRNA target sequence
ttggaggaaatggtagagatt

SEQ ID NO: 150277 - DNA, 21 bp, Artificial sequence
  SiRNA target sequence
tggaggaaatggtagagattt

SEQ ID NO: 150278 - DNA, 21 bp, Artificial sequence
  SiRNA target sequence
ggaggaaatggtagagatttt

SEQ ID NO: 150279 - DNA, 21 bp, Artificial sequence
  SiRNA target sequence
gaggaaatggtagagattttt

SEQ ID NO: 150280 - DNA, 21 bp, Artificial sequence
  SiRNA target sequence
aggaaatggtagagatttttt

SEQ ID NO: 150281 - DNA, 21 bp, Artificial sequence
  SiRNA target sequence
ggaaatggtagagattttttt

SEQ ID NO: 150282 - DNA, 21 bp, Artificial sequence
  SiRNA target sequence
gaaatggtagagattttttta

SEQ ID NO: 150283 - DNA, 21 bp, Artificial sequence
  SiRNA target sequence
aaatggtagagatttttttag

SEQ ID NO: 150284 - DNA, 21 bp, Artificial sequence
  SiRNA target sequence
aatggtagagatttttttagc

SEQ ID NO: 150285 - DNA, 21 bp, Artificial sequence
  SiRNA target sequence
atggtagagatttttttagca

SEQ ID NO: 150286 - DNA, 21 bp, Artificial sequence
  SiRNA target sequence
tggtagagatttttttagcaa

SEQ ID NO: 150287 - DNA, 21 bp, Artificial sequence
  SiRNA target sequence
ggtagagatttttttagcaag

SEQ ID NO: 150288 - DNA, 21 bp, Artificial sequence
  SiRNA target sequence
gtagagatttttttagcaagt

SEQ ID NO: 150289 - DNA, 21 bp, Artificial sequence
  SiRNA target sequence
tagagatttttttagcaagtt

SEQ ID NO: 150290 - DNA, 21 bp, Artificial sequence
  SiRNA target sequence
agagatttttttagcaagttt

SEQ ID NO: 150291 - DNA, 21 bp, Artificial sequence
  SiRNA target sequence
gagatttttttagcaagtttg

SEQ ID NO: 150292 - DNA, 21 bp, Artificial sequence
  SiRNA target sequence
agatttttttagcaagtttgg

SEQ ID NO: 150293 - DNA, 21 bp, Artificial sequence
  SiRNA target sequence
gatttttttagcaagtttgga

SEQ ID NO: 150294 - DNA, 21 bp, Artificial sequence
  SiRNA target sequence
atttttttagcaagtttggat

SEQ ID NO: 150295 - DNA, 21 bp, Artificial sequence
  SiRNA target sequence
tttttttagcaagtttggatt

SEQ ID NO: 150296 - DNA, 21 bp, Artificial sequence
  SiRNA target sequence
ttttttagcaagtttggattt

SEQ ID NO: 150297 - DNA, 21 bp, Artificial sequence
  SiRNA target sequence
tttttagcaagtttggatttt

SEQ ID NO: 150298 - DNA, 21 bp, Artificial sequence
  SiRNA target sequence
ttttagcaagtttggattttt

SEQ ID NO: 150299 - DNA, 21 bp, Artificial sequence
  SiRNA target sequence
tttagcaagtttggatttttc

SEQ ID NO: 150300 - DNA, 21 bp, Artificial sequence
  SiRNA target sequence
ttagcaagtttggatttttct

SEQ ID NO: 150301 - DNA, 21 bp, Artificial sequence
  SiRNA target sequence
tagcaagtttggatttttcta

SEQ ID NO: 150302 - DNA, 21 bp, Artificial sequence
  SiRNA target sequence
agcaagtttggatttttctaa

SEQ ID NO: 150303 - DNA, 22 bp, Artificial sequence
  SiRNA target sequence
atggcacaagacccccaaggac

SEQ ID NO: 150304 - DNA, 22 bp, Artificial sequence
  SiRNA target sequence
tggcacaagacccccaaggact

SEQ ID NO: 150305 - DNA, 22 bp, Artificial sequence
  SiRNA target sequence
ggcacaagacccccaaggactt

SEQ ID NO: 150306 - DNA, 22 bp, Artificial sequence
  SiRNA target sequence
gcacaagacccccaaggacttt

SEQ ID NO: 150307 - DNA, 22 bp, Artificial sequence
  SiRNA target sequence
cacaagacccccaaggacttta

SEQ ID NO: 150308 - DNA, 22 bp, Artificial sequence
  SiRNA target sequence
acaagacccccaaggactttat

SEQ ID NO: 150309 - DNA, 22 bp, Artificial sequence
  SiRNA target sequence
caagacccccaaggactttatg

SEQ ID NO: 150310 - DNA, 22 bp, Artificial sequence
  SiRNA target sequence
aagacccccaaggactttatga

SEQ ID NO: 150311 - DNA, 22 bp, Artificial sequence
  SiRNA target sequence
agacccccaaggactttatgaa

SEQ ID NO: 150312 - DNA, 22 bp, Artificial sequence
  SiRNA target sequence
gacccccaaggactttatgaag

SEQ ID NO: 150313 - DNA, 22 bp, Artificial sequence
  SiRNA target sequence
acccccaaggactttatgaagt

SEQ ID NO: 150314 - DNA, 22 bp, Artificial sequence
  SiRNA target sequence
cccccaaggactttatgaagta

SEQ ID NO: 150315 - DNA, 22 bp, Artificial sequence
  SiRNA target sequence
ccccaaggactttatgaagtat

SEQ ID NO: 150316 - DNA, 22 bp, Artificial sequence
  SiRNA target sequence
cccaaggactttatgaagtatt

SEQ ID NO: 150317 - DNA, 22 bp, Artificial sequence
  SiRNA target sequence
ccaaggactttatgaagtatta

SEQ ID NO: 150318 - DNA, 22 bp, Artificial sequence
  SiRNA target sequence
caaggactttatgaagtattag

SEQ ID NO: 150319 - DNA, 22 bp, Artificial sequence
  SiRNA target sequence
aaggactttatgaagtattagg

SEQ ID NO: 150320 - DNA, 22 bp, Artificial sequence
  SiRNA target sequence
aggactttatgaagtattagga

SEQ ID NO: 150321 - DNA, 22 bp, Artificial sequence
  SiRNA target sequence
ggactttatgaagtattaggac

SEQ ID NO: 150322 - DNA, 22 bp, Artificial sequence
  SiRNA target sequence
gactttatgaagtattaggact

SEQ ID NO: 150323 - DNA, 22 bp, Artificial sequence
  SiRNA target sequence
actttatgaagtattaggactt

SEQ ID NO: 150324 - DNA, 22 bp, Artificial sequence
  SiRNA target sequence
ctttatgaagtattaggactta

SEQ ID NO: 150325 - DNA, 22 bp, Artificial sequence
  SiRNA target sequence
tttatgaagtattaggacttaa

SEQ ID NO: 150326 - DNA, 22 bp, Artificial sequence
  SiRNA target sequence
ttatgaagtattaggacttaaa

SEQ ID NO: 150327 - DNA, 22 bp, Artificial sequence
  SiRNA target sequence
tatgaagtattaggacttaaag

SEQ ID NO: 150328 - DNA, 22 bp, Artificial sequence
  SiRNA target sequence
atgaagtattaggacttaaagc

SEQ ID NO: 150329 - DNA, 22 bp, Artificial sequence
  SiRNA target sequence
tgaagtattaggacttaaagct

SEQ ID NO: 150330 - DNA, 22 bp, Artificial sequence
  SiRNA target sequence
gaagtattaggacttaaagctg

SEQ ID NO: 150331 - DNA, 22 bp, Artificial sequence
  SiRNA target sequence
aagtattaggacttaaagctgg

SEQ ID NO: 150332 - DNA, 22 bp, Artificial sequence
  SiRNA target sequence
agtattaggacttaaagctggt

SEQ ID NO: 150333 - DNA, 22 bp, Artificial sequence
  SiRNA target sequence
gtattaggacttaaagctggtg

SEQ ID NO: 150334 - DNA, 22 bp, Artificial sequence
  SiRNA target sequence
tattaggacttaaagctggtgc

SEQ ID NO: 150335 - DNA, 22 bp, Artificial sequence
  SiRNA target sequence
attaggacttaaagctggtgca

SEQ ID NO: 150336 - DNA, 22 bp, Artificial sequence
  SiRNA target sequence
ttaggacttaaagctggtgcaa

SEQ ID NO: 150337 - DNA, 22 bp, Artificial sequence
  SiRNA target sequence
taggacttaaagctggtgcaag

SEQ ID NO: 150338 - DNA, 22 bp, Artificial sequence
  SiRNA target sequence
aggacttaaagctggtgcaagc

SEQ ID NO: 150339 - DNA, 22 bp, Artificial sequence
  SiRNA target sequence
ggacttaaagctggtgcaagca

SEQ ID NO: 150340 - DNA, 22 bp, Artificial sequence
  SiRNA target sequence
gacttaaagctggtgcaagcat

SEQ ID NO: 150341 - DNA, 22 bp, Artificial sequence
  SiRNA target sequence
acttaaagctggtgcaagcatt

SEQ ID NO: 150342 - DNA, 22 bp, Artificial sequence
  SiRNA target sequence
cttaaagctggtgcaagcattg

SEQ ID NO: 150343 - DNA, 22 bp, Artificial sequence
  SiRNA target sequence
ttaaagctggtgcaagcattga

SEQ ID NO: 150344 - DNA, 22 bp, Artificial sequence
  SiRNA target sequence
taaagctggtgcaagcattgat

SEQ ID NO: 150345 - DNA, 22 bp, Artificial sequence
  SiRNA target sequence
aaagctggtgcaagcattgatg

SEQ ID NO: 150346 - DNA, 22 bp, Artificial sequence
  SiRNA target sequence
aagctggtgcaagcattgatga

SEQ ID NO: 150347 - DNA, 22 bp, Artificial sequence
  SiRNA target sequence
agctggtgcaagcattgatgaa

SEQ ID NO: 150348 - DNA, 22 bp, Artificial sequence
  SiRNA target sequence
gctggtgcaagcattgatgaag

SEQ ID NO: 150349 - DNA, 22 bp, Artificial sequence
  SiRNA target sequence
ctggtgcaagcattgatgaagt

SEQ ID NO: 150350 - DNA, 22 bp, Artificial sequence
  SiRNA target sequence
tggtgcaagcattgatgaagtt

SEQ ID NO: 150351 - DNA, 22 bp, Artificial sequence
  SiRNA target sequence
ggtgcaagcattgatgaagtta

SEQ ID NO: 150352 - DNA, 22 bp, Artificial sequence
  SiRNA target sequence
gtgcaagcattgatgaagttaa

SEQ ID NO: 150353 - DNA, 22 bp, Artificial sequence
  SiRNA target sequence
tgcaagcattgatgaagttaaa

SEQ ID NO: 150354 - DNA, 22 bp, Artificial sequence
  SiRNA target sequence
gcaagcattgatgaagttaaaa

SEQ ID NO: 150355 - DNA, 22 bp, Artificial sequence
  SiRNA target sequence
caagcattgatgaagttaaaaa

SEQ ID NO: 150356 - DNA, 22 bp, Artificial sequence
  SiRNA target sequence
aagcattgatgaagttaaaaaa

SEQ ID NO: 150357 - DNA, 22 bp, Artificial sequence
  SiRNA target sequence
agcattgatgaagttaaaaaag

SEQ ID NO: 150358 - DNA, 22 bp, Artificial sequence
  SiRNA target sequence
gcattgatgaagttaaaaaagc

SEQ ID NO: 150359 - DNA, 22 bp, Artificial sequence
  SiRNA target sequence
cattgatgaagttaaaaaagca

SEQ ID NO: 150360 - DNA, 22 bp, Artificial sequence
  SiRNA target sequence
attgatgaagttaaaaaagcat

SEQ ID NO: 150361 - DNA, 22 bp, Artificial sequence
  SiRNA target sequence
ttgatgaagttaaaaaagcatt

SEQ ID NO: 150362 - DNA, 22 bp, Artificial sequence
  SiRNA target sequence
tgatgaagttaaaaaagcattt

SEQ ID NO: 150363 - DNA, 22 bp, Artificial sequence
  SiRNA target sequence
gatgaagttaaaaaagcattta

SEQ ID NO: 150364 - DNA, 22 bp, Artificial sequence
  SiRNA target sequence
atgaagttaaaaaagcatttac

SEQ ID NO: 150365 - DNA, 22 bp, Artificial sequence
  SiRNA target sequence
tgaagttaaaaaagcatttaca

SEQ ID NO: 150366 - DNA, 22 bp, Artificial sequence
  SiRNA target sequence
gaagttaaaaaagcatttacaa

SEQ ID NO: 150367 - DNA, 22 bp, Artificial sequence
  SiRNA target sequence
aagttaaaaaagcatttacaaa

SEQ ID NO: 150368 - DNA, 22 bp, Artificial sequence
  SiRNA target sequence
agttaaaaaagcatttacaaaa

SEQ ID NO: 150369 - DNA, 22 bp, Artificial sequence
  SiRNA target sequence
gttaaaaaagcatttacaaaaa

SEQ ID NO: 150370 - DNA, 22 bp, Artificial sequence
  SiRNA target sequence
ttaaaaaagcatttacaaaaaa

SEQ ID NO: 150371 - DNA, 22 bp, Artificial sequence
  SiRNA target sequence
taaaaaagcatttacaaaaaaa

SEQ ID NO: 150372 - DNA, 22 bp, Artificial sequence
  SiRNA target sequence
aaaaaagcatttacaaaaaaac

SEQ ID NO: 150373 - DNA, 22 bp, Artificial sequence
  SiRNA target sequence
aaaaagcatttacaaaaaaaca

SEQ ID NO: 150374 - DNA, 22 bp, Artificial sequence
  SiRNA target sequence
aaaagcatttacaaaaaaacaa

SEQ ID NO: 150375 - DNA, 22 bp, Artificial sequence
  SiRNA target sequence
aaagcatttacaaaaaaacaaa

SEQ ID NO: 150376 - DNA, 22 bp, Artificial sequence
  SiRNA target sequence
aagcatttacaaaaaaacaaag

SEQ ID NO: 150377 - DNA, 22 bp, Artificial sequence
  SiRNA target sequence
agcatttacaaaaaaacaaagg

SEQ ID NO: 150378 - DNA, 22 bp, Artificial sequence
  SiRNA target sequence
gcatttacaaaaaaacaaaggg

SEQ ID NO: 150379 - DNA, 22 bp, Artificial sequence
  SiRNA target sequence
catttacaaaaaaacaaaggga

SEQ ID NO: 150380 - DNA, 22 bp, Artificial sequence
  SiRNA target sequence
atttacaaaaaaacaaagggaa

SEQ ID NO: 150381 - DNA, 22 bp, Artificial sequence
  SiRNA target sequence
tttacaaaaaaacaaagggaat

SEQ ID NO: 150382 - DNA, 22 bp, Artificial sequence
  SiRNA target sequence
ttacaaaaaaacaaagggaatg

SEQ ID NO: 150383 - DNA, 22 bp, Artificial sequence
  SiRNA target sequence
tacaaaaaaacaaagggaatgt

SEQ ID NO: 150384 - DNA, 22 bp, Artificial sequence
  SiRNA target sequence
acaaaaaaacaaagggaatgtc

SEQ ID NO: 150385 - DNA, 22 bp, Artificial sequence
  SiRNA target sequence
caaaaaaacaaagggaatgtca

SEQ ID NO: 150386 - DNA, 22 bp, Artificial sequence
  SiRNA target sequence
aaaaaaacaaagggaatgtcat

SEQ ID NO: 150387 - DNA, 22 bp, Artificial sequence
  SiRNA target sequence
aaaaaacaaagggaatgtcatc

SEQ ID NO: 150388 - DNA, 22 bp, Artificial sequence
  SiRNA target sequence
aaaaacaaagggaatgtcatcc

SEQ ID NO: 150389 - DNA, 22 bp, Artificial sequence
  SiRNA target sequence
aaaacaaagggaatgtcatccc

SEQ ID NO: 150390 - DNA, 22 bp, Artificial sequence
  SiRNA target sequence
aaacaaagggaatgtcatcccg

SEQ ID NO: 150391 - DNA, 22 bp, Artificial sequence
  SiRNA target sequence
aacaaagggaatgtcatcccga

SEQ ID NO: 150392 - DNA, 22 bp, Artificial sequence
  SiRNA target sequence
acaaagggaatgtcatcccgat

SEQ ID NO: 150393 - DNA, 22 bp, Artificial sequence
  SiRNA target sequence
caaagggaatgtcatcccgatg

SEQ ID NO: 150394 - DNA, 22 bp, Artificial sequence
  SiRNA target sequence
aaagggaatgtcatcccgatgg

SEQ ID NO: 150395 - DNA, 22 bp, Artificial sequence
  SiRNA target sequence
aagggaatgtcatcccgatggt

SEQ ID NO: 150396 - DNA, 22 bp, Artificial sequence
  SiRNA target sequence
agggaatgtcatcccgatggtg

SEQ ID NO: 150397 - DNA, 22 bp, Artificial sequence
  SiRNA target sequence
gggaatgtcatcccgatggtgc

SEQ ID NO: 150398 - DNA, 22 bp, Artificial sequence
  SiRNA target sequence
ggaatgtcatcccgatggtgca

SEQ ID NO: 150399 - DNA, 22 bp, Artificial sequence
  SiRNA target sequence
gaatgtcatcccgatggtgcat

SEQ ID NO: 150400 - DNA, 22 bp, Artificial sequence
  SiRNA target sequence
aatgtcatcccgatggtgcatt

SEQ ID NO: 150401 - DNA, 22 bp, Artificial sequence
  SiRNA target sequence
atgtcatcccgatggtgcattt

SEQ ID NO: 150402 - DNA, 22 bp, Artificial sequence
  SiRNA target sequence
tgtcatcccgatggtgcatttt

SEQ ID NO: 150403 - DNA, 22 bp, Artificial sequence
  SiRNA target sequence
gtcatcccgatggtgcattttt

SEQ ID NO: 150404 - DNA, 22 bp, Artificial sequence
  SiRNA target sequence
tcatcccgatggtgcatttttt

SEQ ID NO: 150405 - DNA, 22 bp, Artificial sequence
  SiRNA target sequence
catcccgatggtgcatttttta

SEQ ID NO: 150406 - DNA, 22 bp, Artificial sequence
  SiRNA target sequence
atcccgatggtgcattttttaa

SEQ ID NO: 150407 - DNA, 22 bp, Artificial sequence
  SiRNA target sequence
tcccgatggtgcattttttaaa

SEQ ID NO: 150408 - DNA, 22 bp, Artificial sequence
  SiRNA target sequence
cccgatggtgcattttttaaag

SEQ ID NO: 150409 - DNA, 22 bp, Artificial sequence
  SiRNA target sequence
ccgatggtgcattttttaaagc

SEQ ID NO: 150410 - DNA, 22 bp, Artificial sequence
  SiRNA target sequence
cgatggtgcattttttaaagct

SEQ ID NO: 150411 - DNA, 22 bp, Artificial sequence
  SiRNA target sequence
gatggtgcattttttaaagctg

SEQ ID NO: 150412 - DNA, 22 bp, Artificial sequence
  SiRNA target sequence
atggtgcattttttaaagctgc

SEQ ID NO: 150413 - DNA, 22 bp, Artificial sequence
  SiRNA target sequence
tggtgcattttttaaagctgct

SEQ ID NO: 150414 - DNA, 22 bp, Artificial sequence
  SiRNA target sequence
ggtgcattttttaaagctgctc

SEQ ID NO: 150415 - DNA, 22 bp, Artificial sequence
  SiRNA target sequence
gtgcattttttaaagctgctct

SEQ ID NO: 150416 - DNA, 22 bp, Artificial sequence
  SiRNA target sequence
tgcattttttaaagctgctctt

SEQ ID NO: 150417 - DNA, 22 bp, Artificial sequence
  SiRNA target sequence
gcattttttaaagctgctctta

SEQ ID NO: 150418 - DNA, 22 bp, Artificial sequence
  SiRNA target sequence
cattttttaaagctgctcttag

SEQ ID NO: 150419 - DNA, 22 bp, Artificial sequence
  SiRNA target sequence
attttttaaagctgctcttaga

SEQ ID NO: 150420 - DNA, 22 bp, Artificial sequence
  SiRNA target sequence
ttttttaaagctgctcttagaa

SEQ ID NO: 150421 - DNA, 22 bp, Artificial sequence
  SiRNA target sequence
tttttaaagctgctcttagaaa

SEQ ID NO: 150422 - DNA, 22 bp, Artificial sequence
  SiRNA target sequence
ttttaaagctgctcttagaaaa

SEQ ID NO: 150423 - DNA, 22 bp, Artificial sequence
  SiRNA target sequence
tttaaagctgctcttagaaaat

SEQ ID NO: 150424 - DNA, 22 bp, Artificial sequence
  SiRNA target sequence
ttaaagctgctcttagaaaatg

SEQ ID NO: 150425 - DNA, 22 bp, Artificial sequence
  SiRNA target sequence
taaagctgctcttagaaaatgt

SEQ ID NO: 150426 - DNA, 22 bp, Artificial sequence
  SiRNA target sequence
aaagctgctcttagaaaatgta

SEQ ID NO: 150427 - DNA, 22 bp, Artificial sequence
  SiRNA target sequence
aagctgctcttagaaaatgtaa

SEQ ID NO: 150428 - DNA, 22 bp, Artificial sequence
  SiRNA target sequence
agctgctcttagaaaatgtaaa

SEQ ID NO: 150429 - DNA, 22 bp, Artificial sequence
  SiRNA target sequence
gctgctcttagaaaatgtaaaa

SEQ ID NO: 150430 - DNA, 22 bp, Artificial sequence
  SiRNA target sequence
ctgctcttagaaaatgtaaaac

SEQ ID NO: 150431 - DNA, 22 bp, Artificial sequence
  SiRNA target sequence
tgctcttagaaaatgtaaaaca

SEQ ID NO: 150432 - DNA, 22 bp, Artificial sequence
  SiRNA target sequence
gctcttagaaaatgtaaaacag

SEQ ID NO: 150433 - DNA, 22 bp, Artificial sequence
  SiRNA target sequence
ctcttagaaaatgtaaaacaga

SEQ ID NO: 150434 - DNA, 22 bp, Artificial sequence
  SiRNA target sequence
tcttagaaaatgtaaaacagat

SEQ ID NO: 150435 - DNA, 22 bp, Artificial sequence
  SiRNA target sequence
cttagaaaatgtaaaacagatg

SEQ ID NO: 150436 - DNA, 22 bp, Artificial sequence
  SiRNA target sequence
ttagaaaatgtaaaacagatga

SEQ ID NO: 150437 - DNA, 22 bp, Artificial sequence
  SiRNA target sequence
tagaaaatgtaaaacagatgaa

SEQ ID NO: 150438 - DNA, 22 bp, Artificial sequence
  SiRNA target sequence
agaaaatgtaaaacagatgaag

SEQ ID NO: 150439 - DNA, 22 bp, Artificial sequence
  SiRNA target sequence
gaaaatgtaaaacagatgaaga

SEQ ID NO: 150440 - DNA, 22 bp, Artificial sequence
  SiRNA target sequence
aaaatgtaaaacagatgaagaa

SEQ ID NO: 150441 - DNA, 22 bp, Artificial sequence
  SiRNA target sequence
aaatgtaaaacagatgaagaaa

SEQ ID NO: 150442 - DNA, 22 bp, Artificial sequence
  SiRNA target sequence
aatgtaaaacagatgaagaaag

SEQ ID NO: 150443 - DNA, 22 bp, Artificial sequence
  SiRNA target sequence
atgtaaaacagatgaagaaaga

SEQ ID NO: 150444 - DNA, 22 bp, Artificial sequence
  SiRNA target sequence
tgtaaaacagatgaagaaagag

SEQ ID NO: 150445 - DNA, 22 bp, Artificial sequence
  SiRNA target sequence
gtaaaacagatgaagaaagagc

SEQ ID NO: 150446 - DNA, 22 bp, Artificial sequence
  SiRNA target sequence
taaaacagatgaagaaagagca

SEQ ID NO: 150447 - DNA, 22 bp, Artificial sequence
  SiRNA target sequence
aaaacagatgaagaaagagcaa

SEQ ID NO: 150448 - DNA, 22 bp, Artificial sequence
  SiRNA target sequence
aaacagatgaagaaagagcaaa

SEQ ID NO: 150449 - DNA, 22 bp, Artificial sequence
  SiRNA target sequence
aacagatgaagaaagagcaaaa

SEQ ID NO: 150450 - DNA, 22 bp, Artificial sequence
  SiRNA target sequence
acagatgaagaaagagcaaaag

SEQ ID NO: 150451 - DNA, 22 bp, Artificial sequence
  SiRNA target sequence
cagatgaagaaagagcaaaagt

SEQ ID NO: 150452 - DNA, 22 bp, Artificial sequence
  SiRNA target sequence
agatgaagaaagagcaaaagtt

SEQ ID NO: 150453 - DNA, 22 bp, Artificial sequence
  SiRNA target sequence
gatgaagaaagagcaaaagttg

SEQ ID NO: 150454 - DNA, 22 bp, Artificial sequence
  SiRNA target sequence
atgaagaaagagcaaaagttga

SEQ ID NO: 150455 - DNA, 22 bp, Artificial sequence
  SiRNA target sequence
tgaagaaagagcaaaagttgaa

SEQ ID NO: 150456 - DNA, 22 bp, Artificial sequence
  SiRNA target sequence
gaagaaagagcaaaagttgaaa

SEQ ID NO: 150457 - DNA, 22 bp, Artificial sequence
  SiRNA target sequence
aagaaagagcaaaagttgaaaa

SEQ ID NO: 150458 - DNA, 22 bp, Artificial sequence
  SiRNA target sequence
agaaagagcaaaagttgaaaaa

SEQ ID NO: 150459 - DNA, 22 bp, Artificial sequence
  SiRNA target sequence
gaaagagcaaaagttgaaaaag

SEQ ID NO: 150460 - DNA, 22 bp, Artificial sequence
  SiRNA target sequence
aaagagcaaaagttgaaaaaga

SEQ ID NO: 150461 - DNA, 22 bp, Artificial sequence
  SiRNA target sequence
aagagcaaaagttgaaaaagaa

SEQ ID NO: 150462 - DNA, 22 bp, Artificial sequence
  SiRNA target sequence
agagcaaaagttgaaaaagaat

SEQ ID NO: 150463 - DNA, 22 bp, Artificial sequence
  SiRNA target sequence
gagcaaaagttgaaaaagaatt

SEQ ID NO: 150464 - DNA, 22 bp, Artificial sequence
  SiRNA target sequence
agcaaaagttgaaaaagaattt

SEQ ID NO: 150465 - DNA, 22 bp, Artificial sequence
  SiRNA target sequence
gcaaaagttgaaaaagaattta

SEQ ID NO: 150466 - DNA, 22 bp, Artificial sequence
  SiRNA target sequence
caaaagttgaaaaagaatttaa

SEQ ID NO: 150467 - DNA, 22 bp, Artificial sequence
  SiRNA target sequence
aaaagttgaaaaagaatttaaa

SEQ ID NO: 150468 - DNA, 22 bp, Artificial sequence
  SiRNA target sequence
aaagttgaaaaagaatttaaag

SEQ ID NO: 150469 - DNA, 22 bp, Artificial sequence
  SiRNA target sequence
aagttgaaaaagaatttaaaga

SEQ ID NO: 150470 - DNA, 22 bp, Artificial sequence
  SiRNA target sequence
agttgaaaaagaatttaaagaa

SEQ ID NO: 150471 - DNA, 22 bp, Artificial sequence
  SiRNA target sequence
gttgaaaaagaatttaaagaaa

SEQ ID NO: 150472 - DNA, 22 bp, Artificial sequence
  SiRNA target sequence
ttgaaaaagaatttaaagaaaa

SEQ ID NO: 150473 - DNA, 22 bp, Artificial sequence
  SiRNA target sequence
tgaaaaagaatttaaagaaaaa

SEQ ID NO: 150474 - DNA, 22 bp, Artificial sequence
  SiRNA target sequence
gaaaaagaatttaaagaaaaat

SEQ ID NO: 150475 - DNA, 22 bp, Artificial sequence
  SiRNA target sequence
aaaaagaatttaaagaaaaatc

SEQ ID NO: 150476 - DNA, 22 bp, Artificial sequence
  SiRNA target sequence
aaaagaatttaaagaaaaatca

SEQ ID NO: 150477 - DNA, 22 bp, Artificial sequence
  SiRNA target sequence
aaagaatttaaagaaaaatcac

SEQ ID NO: 150478 - DNA, 22 bp, Artificial sequence
  SiRNA target sequence
aagaatttaaagaaaaatcaca

SEQ ID NO: 150479 - DNA, 22 bp, Artificial sequence
  SiRNA target sequence
agaatttaaagaaaaatcacaa

SEQ ID NO: 150480 - DNA, 22 bp, Artificial sequence
  SiRNA target sequence
gaatttaaagaaaaatcacaaa

SEQ ID NO: 150481 - DNA, 22 bp, Artificial sequence
  SiRNA target sequence
aatttaaagaaaaatcacaaaa

SEQ ID NO: 150482 - DNA, 22 bp, Artificial sequence
  SiRNA target sequence
atttaaagaaaaatcacaaaaa

SEQ ID NO: 150483 - DNA, 22 bp, Artificial sequence
  SiRNA target sequence
tttaaagaaaaatcacaaaaat

SEQ ID NO: 150484 - DNA, 22 bp, Artificial sequence
  SiRNA target sequence
ttaaagaaaaatcacaaaaatg

SEQ ID NO: 150485 - DNA, 22 bp, Artificial sequence
  SiRNA target sequence
taaagaaaaatcacaaaaatgt

SEQ ID NO: 150486 - DNA, 22 bp, Artificial sequence
  SiRNA target sequence
aaagaaaaatcacaaaaatgta

SEQ ID NO: 150487 - DNA, 22 bp, Artificial sequence
  SiRNA target sequence
aagaaaaatcacaaaaatgtaa

SEQ ID NO: 150488 - DNA, 22 bp, Artificial sequence
  SiRNA target sequence
agaaaaatcacaaaaatgtaat

SEQ ID NO: 150489 - DNA, 22 bp, Artificial sequence
  SiRNA target sequence
gaaaaatcacaaaaatgtaatc

SEQ ID NO: 150490 - DNA, 22 bp, Artificial sequence
  SiRNA target sequence
aaaaatcacaaaaatgtaatca

SEQ ID NO: 150491 - DNA, 22 bp, Artificial sequence
  SiRNA target sequence
aaaatcacaaaaatgtaatcaa

SEQ ID NO: 150492 - DNA, 22 bp, Artificial sequence
  SiRNA target sequence
aaatcacaaaaatgtaatcaag

SEQ ID NO: 150493 - DNA, 22 bp, Artificial sequence
  SiRNA target sequence
aatcacaaaaatgtaatcaagc

SEQ ID NO: 150494 - DNA, 22 bp, Artificial sequence
  SiRNA target sequence
atcacaaaaatgtaatcaagct

SEQ ID NO: 150495 - DNA, 22 bp, Artificial sequence
  SiRNA target sequence
tcacaaaaatgtaatcaagcta

SEQ ID NO: 150496 - DNA, 22 bp, Artificial sequence
  SiRNA target sequence
cacaaaaatgtaatcaagctaa

SEQ ID NO: 150497 - DNA, 22 bp, Artificial sequence
  SiRNA target sequence
acaaaaatgtaatcaagctaaa

SEQ ID NO: 150498 - DNA, 22 bp, Artificial sequence
  SiRNA target sequence
caaaaatgtaatcaagctaaag

SEQ ID NO: 150499 - DNA, 22 bp, Artificial sequence
  SiRNA target sequence
aaaaatgtaatcaagctaaagc

SEQ ID NO: 150500 - DNA, 22 bp, Artificial sequence
  SiRNA target sequence
aaaatgtaatcaagctaaagca

SEQ ID NO: 150501 - DNA, 22 bp, Artificial sequence
  SiRNA target sequence
aaatgtaatcaagctaaagcag

SEQ ID NO: 150502 - DNA, 22 bp, Artificial sequence
  SiRNA target sequence
aatgtaatcaagctaaagcagt

SEQ ID NO: 150503 - DNA, 22 bp, Artificial sequence
  SiRNA target sequence
atgtaatcaagctaaagcagtt

SEQ ID NO: 150504 - DNA, 22 bp, Artificial sequence
  SiRNA target sequence
tgtaatcaagctaaagcagttt

SEQ ID NO: 150505 - DNA, 22 bp, Artificial sequence
  SiRNA target sequence
gtaatcaagctaaagcagtttt

SEQ ID NO: 150506 - DNA, 22 bp, Artificial sequence
  SiRNA target sequence
taatcaagctaaagcagtttta

SEQ ID NO: 150507 - DNA, 22 bp, Artificial sequence
  SiRNA target sequence
aatcaagctaaagcagttttat

SEQ ID NO: 150508 - DNA, 22 bp, Artificial sequence
  SiRNA target sequence
atcaagctaaagcagttttatt

SEQ ID NO: 150509 - DNA, 22 bp, Artificial sequence
  SiRNA target sequence
tcaagctaaagcagttttattt

SEQ ID NO: 150510 - DNA, 22 bp, Artificial sequence
  SiRNA target sequence
caagctaaagcagttttatttg

SEQ ID NO: 150511 - DNA, 22 bp, Artificial sequence
  SiRNA target sequence
aagctaaagcagttttatttga

SEQ ID NO: 150512 - DNA, 22 bp, Artificial sequence
  SiRNA target sequence
agctaaagcagttttatttgat

SEQ ID NO: 150513 - DNA, 22 bp, Artificial sequence
  SiRNA target sequence
gctaaagcagttttatttgatg

SEQ ID NO: 150514 - DNA, 22 bp, Artificial sequence
  SiRNA target sequence
ctaaagcagttttatttgatga

SEQ ID NO: 150515 - DNA, 22 bp, Artificial sequence
  SiRNA target sequence
taaagcagttttatttgatgag

SEQ ID NO: 150516 - DNA, 22 bp, Artificial sequence
  SiRNA target sequence
aaagcagttttatttgatgaga

SEQ ID NO: 150517 - DNA, 22 bp, Artificial sequence
  SiRNA target sequence
aagcagttttatttgatgagaa

SEQ ID NO: 150518 - DNA, 22 bp, Artificial sequence
  SiRNA target sequence
agcagttttatttgatgagaaa

SEQ ID NO: 150519 - DNA, 22 bp, Artificial sequence
  SiRNA target sequence
gcagttttatttgatgagaaaa

SEQ ID NO: 150520 - DNA, 22 bp, Artificial sequence
  SiRNA target sequence
cagttttatttgatgagaaaaa

SEQ ID NO: 150521 - DNA, 22 bp, Artificial sequence
  SiRNA target sequence
agttttatttgatgagaaaaaa

SEQ ID NO: 150522 - DNA, 22 bp, Artificial sequence
  SiRNA target sequence
gttttatttgatgagaaaaaaa

SEQ ID NO: 150523 - DNA, 22 bp, Artificial sequence
  SiRNA target sequence
ttttatttgatgagaaaaaaaa

SEQ ID NO: 150524 - DNA, 22 bp, Artificial sequence
  SiRNA target sequence
tttatttgatgagaaaaaaaag

SEQ ID NO: 150525 - DNA, 22 bp, Artificial sequence
  SiRNA target sequence
ttatttgatgagaaaaaaaagc

SEQ ID NO: 150526 - DNA, 22 bp, Artificial sequence
  SiRNA target sequence
tatttgatgagaaaaaaaagca

SEQ ID NO: 150527 - DNA, 22 bp, Artificial sequence
  SiRNA target sequence
atttgatgagaaaaaaaagcaa

SEQ ID NO: 150528 - DNA, 22 bp, Artificial sequence
  SiRNA target sequence
tttgatgagaaaaaaaagcaag

SEQ ID NO: 150529 - DNA, 22 bp, Artificial sequence
  SiRNA target sequence
ttgatgagaaaaaaaagcaaga

SEQ ID NO: 150530 - DNA, 22 bp, Artificial sequence
  SiRNA target sequence
tgatgagaaaaaaaagcaagag

SEQ ID NO: 150531 - DNA, 22 bp, Artificial sequence
  SiRNA target sequence
gatgagaaaaaaaagcaagagt

SEQ ID NO: 150532 - DNA, 22 bp, Artificial sequence
  SiRNA target sequence
atgagaaaaaaaagcaagagta

SEQ ID NO: 150533 - DNA, 22 bp, Artificial sequence
  SiRNA target sequence
tgagaaaaaaaagcaagagtat

SEQ ID NO: 150534 - DNA, 22 bp, Artificial sequence
  SiRNA target sequence
gagaaaaaaaagcaagagtatg

SEQ ID NO: 150535 - DNA, 22 bp, Artificial sequence
  SiRNA target sequence
agaaaaaaaagcaagagtatga

SEQ ID NO: 150536 - DNA, 22 bp, Artificial sequence
  SiRNA target sequence
gaaaaaaaagcaagagtatgat

SEQ ID NO: 150537 - DNA, 22 bp, Artificial sequence
  SiRNA target sequence
aaaaaaaagcaagagtatgata

SEQ ID NO: 150538 - DNA, 22 bp, Artificial sequence
  SiRNA target sequence
aaaaaaagcaagagtatgatat

SEQ ID NO: 150539 - DNA, 22 bp, Artificial sequence
  SiRNA target sequence
aaaaaagcaagagtatgatatg

SEQ ID NO: 150540 - DNA, 22 bp, Artificial sequence
  SiRNA target sequence
aaaaagcaagagtatgatatgg

SEQ ID NO: 150541 - DNA, 22 bp, Artificial sequence
  SiRNA target sequence
aaaagcaagagtatgatatggg

SEQ ID NO: 150542 - DNA, 22 bp, Artificial sequence
  SiRNA target sequence
aaagcaagagtatgatatggga

SEQ ID NO: 150543 - DNA, 22 bp, Artificial sequence
  SiRNA target sequence
aagcaagagtatgatatgggaa

SEQ ID NO: 150544 - DNA, 22 bp, Artificial sequence
  SiRNA target sequence
agcaagagtatgatatgggaat

SEQ ID NO: 150545 - DNA, 22 bp, Artificial sequence
  SiRNA target sequence
gcaagagtatgatatgggaatg

SEQ ID NO: 150546 - DNA, 22 bp, Artificial sequence
  SiRNA target sequence
caagagtatgatatgggaatga

SEQ ID NO: 150547 - DNA, 22 bp, Artificial sequence
  SiRNA target sequence
aagagtatgatatgggaatgac

SEQ ID NO: 150548 - DNA, 22 bp, Artificial sequence
  SiRNA target sequence
agagtatgatatgggaatgact

SEQ ID NO: 150549 - DNA, 22 bp, Artificial sequence
  SiRNA target sequence
gagtatgatatgggaatgactg

SEQ ID NO: 150550 - DNA, 22 bp, Artificial sequence
  SiRNA target sequence
agtatgatatgggaatgactgg

SEQ ID NO: 150551 - DNA, 22 bp, Artificial sequence
  SiRNA target sequence
gtatgatatgggaatgactggc

SEQ ID NO: 150552 - DNA, 22 bp, Artificial sequence
  SiRNA target sequence
tatgatatgggaatgactggcg

SEQ ID NO: 150553 - DNA, 22 bp, Artificial sequence
  SiRNA target sequence
atgatatgggaatgactggcga

SEQ ID NO: 150554 - DNA, 22 bp, Artificial sequence
  SiRNA target sequence
tgatatgggaatgactggcgat

SEQ ID NO: 150555 - DNA, 22 bp, Artificial sequence
  SiRNA target sequence
gatatgggaatgactggcgatt

SEQ ID NO: 150556 - DNA, 22 bp, Artificial sequence
  SiRNA target sequence
atatgggaatgactggcgattt

SEQ ID NO: 150557 - DNA, 22 bp, Artificial sequence
  SiRNA target sequence
tatgggaatgactggcgatttt

SEQ ID NO: 150558 - DNA, 22 bp, Artificial sequence
  SiRNA target sequence
atgggaatgactggcgattttg

SEQ ID NO: 150559 - DNA, 22 bp, Artificial sequence
  SiRNA target sequence
tgggaatgactggcgattttgg

SEQ ID NO: 150560 - DNA, 22 bp, Artificial sequence
  SiRNA target sequence
gggaatgactggcgattttgga

SEQ ID NO: 150561 - DNA, 22 bp, Artificial sequence
  SiRNA target sequence
ggaatgactggcgattttggat

SEQ ID NO: 150562 - DNA, 22 bp, Artificial sequence
  SiRNA target sequence
gaatgactggcgattttggatt

SEQ ID NO: 150563 - DNA, 22 bp, Artificial sequence
  SiRNA target sequence
aatgactggcgattttggattt

SEQ ID NO: 150564 - DNA, 22 bp, Artificial sequence
  SiRNA target sequence
atgactggcgattttggatttt

SEQ ID NO: 150565 - DNA, 22 bp, Artificial sequence
  SiRNA target sequence
tgactggcgattttggattttc

SEQ ID NO: 150566 - DNA, 22 bp, Artificial sequence
  SiRNA target sequence
gactggcgattttggattttct

SEQ ID NO: 150567 - DNA, 22 bp, Artificial sequence
  SiRNA target sequence
actggcgattttggattttctg

SEQ ID NO: 150568 - DNA, 22 bp, Artificial sequence
  SiRNA target sequence
ctggcgattttggattttctgc

SEQ ID NO: 150569 - DNA, 22 bp, Artificial sequence
  SiRNA target sequence
tggcgattttggattttctgca

SEQ ID NO: 150570 - DNA, 22 bp, Artificial sequence
  SiRNA target sequence
ggcgattttggattttctgcag

SEQ ID NO: 150571 - DNA, 22 bp, Artificial sequence
  SiRNA target sequence
gcgattttggattttctgcagg

SEQ ID NO: 150572 - DNA, 22 bp, Artificial sequence
  SiRNA target sequence
cgattttggattttctgcaggt

SEQ ID NO: 150573 - DNA, 22 bp, Artificial sequence
  SiRNA target sequence
gattttggattttctgcaggtg

SEQ ID NO: 150574 - DNA, 22 bp, Artificial sequence
  SiRNA target sequence
attttggattttctgcaggtgg

SEQ ID NO: 150575 - DNA, 22 bp, Artificial sequence
  SiRNA target sequence
ttttggattttctgcaggtggt

SEQ ID NO: 150576 - DNA, 22 bp, Artificial sequence
  SiRNA target sequence
tttggattttctgcaggtggtg

SEQ ID NO: 150577 - DNA, 22 bp, Artificial sequence
  SiRNA target sequence
ttggattttctgcaggtggtgg

SEQ ID NO: 150578 - DNA, 22 bp, Artificial sequence
  SiRNA target sequence
tggattttctgcaggtggtgga

SEQ ID NO: 150579 - DNA, 22 bp, Artificial sequence
  SiRNA target sequence
ggattttctgcaggtggtggag

SEQ ID NO: 150580 - DNA, 22 bp, Artificial sequence
  SiRNA target sequence
gattttctgcaggtggtggaga

SEQ ID NO: 150581 - DNA, 22 bp, Artificial sequence
  SiRNA target sequence
attttctgcaggtggtggagac

SEQ ID NO: 150582 - DNA, 22 bp, Artificial sequence
  SiRNA target sequence
ttttctgcaggtggtggagact

SEQ ID NO: 150583 - DNA, 22 bp, Artificial sequence
  SiRNA target sequence
tttctgcaggtggtggagactt

SEQ ID NO: 150584 - DNA, 22 bp, Artificial sequence
  SiRNA target sequence
ttctgcaggtggtggagacttt

SEQ ID NO: 150585 - DNA, 22 bp, Artificial sequence
  SiRNA target sequence
tctgcaggtggtggagactttt

SEQ ID NO: 150586 - DNA, 22 bp, Artificial sequence
  SiRNA target sequence
ctgcaggtggtggagacttttt

SEQ ID NO: 150587 - DNA, 22 bp, Artificial sequence
  SiRNA target sequence
tgcaggtggtggagactttttc

SEQ ID NO: 150588 - DNA, 22 bp, Artificial sequence
  SiRNA target sequence
gcaggtggtggagactttttcg

SEQ ID NO: 150589 - DNA, 22 bp, Artificial sequence
  SiRNA target sequence
caggtggtggagactttttcga

SEQ ID NO: 150590 - DNA, 22 bp, Artificial sequence
  SiRNA target sequence
aggtggtggagactttttcgat

SEQ ID NO: 150591 - DNA, 22 bp, Artificial sequence
  SiRNA target sequence
ggtggtggagactttttcgata

SEQ ID NO: 150592 - DNA, 22 bp, Artificial sequence
  SiRNA target sequence
gtggtggagactttttcgatat

SEQ ID NO: 150593 - DNA, 22 bp, Artificial sequence
  SiRNA target sequence
tggtggagactttttcgatatt

SEQ ID NO: 150594 - DNA, 22 bp, Artificial sequence
  SiRNA target sequence
ggtggagactttttcgatattt

SEQ ID NO: 150595 - DNA, 22 bp, Artificial sequence
  SiRNA target sequence
gtggagactttttcgatatttt

SEQ ID NO: 150596 - DNA, 22 bp, Artificial sequence
  SiRNA target sequence
tggagactttttcgatattttt

SEQ ID NO: 150597 - DNA, 22 bp, Artificial sequence
  SiRNA target sequence
ggagactttttcgatatttttt

SEQ ID NO: 150598 - DNA, 22 bp, Artificial sequence
  SiRNA target sequence
gagactttttcgatattttttc

SEQ ID NO: 150599 - DNA, 22 bp, Artificial sequence
  SiRNA target sequence
agactttttcgatattttttca

SEQ ID NO: 150600 - DNA, 22 bp, Artificial sequence
  SiRNA target sequence
gactttttcgatattttttcaa

SEQ ID NO: 150601 - DNA, 22 bp, Artificial sequence
  SiRNA target sequence
actttttcgatattttttcaag

SEQ ID NO: 150602 - DNA, 22 bp, Artificial sequence
  SiRNA target sequence
ctttttcgatattttttcaagt

SEQ ID NO: 150603 - DNA, 22 bp, Artificial sequence
  SiRNA target sequence
tttttcgatattttttcaagtt

SEQ ID NO: 150604 - DNA, 22 bp, Artificial sequence
  SiRNA target sequence
ttttcgatattttttcaagttt

SEQ ID NO: 150605 - DNA, 22 bp, Artificial sequence
  SiRNA target sequence
tttcgatattttttcaagtttt

SEQ ID NO: 150606 - DNA, 22 bp, Artificial sequence
  SiRNA target sequence
ttcgatattttttcaagtttta

SEQ ID NO: 150607 - DNA, 22 bp, Artificial sequence
  SiRNA target sequence
tcgatattttttcaagttttac

SEQ ID NO: 150608 - DNA, 22 bp, Artificial sequence
  SiRNA target sequence
cgatattttttcaagttttact

SEQ ID NO: 150609 - DNA, 22 bp, Artificial sequence
  SiRNA target sequence
gatattttttcaagttttactg

SEQ ID NO: 150610 - DNA, 22 bp, Artificial sequence
  SiRNA target sequence
atattttttcaagttttactgg

SEQ ID NO: 150611 - DNA, 22 bp, Artificial sequence
  SiRNA target sequence
tattttttcaagttttactggt

SEQ ID NO: 150612 - DNA, 22 bp, Artificial sequence
  SiRNA target sequence
attttttcaagttttactggtg

SEQ ID NO: 150613 - DNA, 22 bp, Artificial sequence
  SiRNA target sequence
ttttttcaagttttactggtgg

SEQ ID NO: 150614 - DNA, 22 bp, Artificial sequence
  SiRNA target sequence
tttttcaagttttactggtgga

SEQ ID NO: 150615 - DNA, 22 bp, Artificial sequence
  SiRNA target sequence
ttttcaagttttactggtggag

SEQ ID NO: 150616 - DNA, 22 bp, Artificial sequence
  SiRNA target sequence
tttcaagttttactggtggagg

SEQ ID NO: 150617 - DNA, 22 bp, Artificial sequence
  SiRNA target sequence
ttcaagttttactggtggagga

SEQ ID NO: 150618 - DNA, 22 bp, Artificial sequence
  SiRNA target sequence
tcaagttttactggtggaggaa

SEQ ID NO: 150619 - DNA, 22 bp, Artificial sequence
  SiRNA target sequence
caagttttactggtggaggaag

SEQ ID NO: 150620 - DNA, 22 bp, Artificial sequence
  SiRNA target sequence
aagttttactggtggaggaaga

SEQ ID NO: 150621 - DNA, 22 bp, Artificial sequence
  SiRNA target sequence
agttttactggtggaggaagaa

SEQ ID NO: 150622 - DNA, 22 bp, Artificial sequence
  SiRNA target sequence
gttttactggtggaggaagaag

SEQ ID NO: 150623 - DNA, 22 bp, Artificial sequence
  SiRNA target sequence
ttttactggtggaggaagaaga

SEQ ID NO: 150624 - DNA, 22 bp, Artificial sequence
  SiRNA target sequence
tttactggtggaggaagaagaa

SEQ ID NO: 150625 - DNA, 22 bp, Artificial sequence
  SiRNA target sequence
ttactggtggaggaagaagaaa

SEQ ID NO: 150626 - DNA, 22 bp, Artificial sequence
  SiRNA target sequence
tactggtggaggaagaagaaat

SEQ ID NO: 150627 - DNA, 22 bp, Artificial sequence
  SiRNA target sequence
actggtggaggaagaagaaatc

SEQ ID NO: 150628 - DNA, 22 bp, Artificial sequence
  SiRNA target sequence
ctggtggaggaagaagaaatcg

SEQ ID NO: 150629 - DNA, 22 bp, Artificial sequence
  SiRNA target sequence
tggtggaggaagaagaaatcga

SEQ ID NO: 150630 - DNA, 22 bp, Artificial sequence
  SiRNA target sequence
ggtggaggaagaagaaatcgag

SEQ ID NO: 150631 - DNA, 22 bp, Artificial sequence
  SiRNA target sequence
gtggaggaagaagaaatcgagt

SEQ ID NO: 150632 - DNA, 22 bp, Artificial sequence
  SiRNA target sequence
tggaggaagaagaaatcgagta

SEQ ID NO: 150633 - DNA, 22 bp, Artificial sequence
  SiRNA target sequence
ggaggaagaagaaatcgagtac

SEQ ID NO: 150634 - DNA, 22 bp, Artificial sequence
  SiRNA target sequence
gaggaagaagaaatcgagtaca

SEQ ID NO: 150635 - DNA, 22 bp, Artificial sequence
  SiRNA target sequence
aggaagaagaaatcgagtacaa

SEQ ID NO: 150636 - DNA, 22 bp, Artificial sequence
  SiRNA target sequence
ggaagaagaaatcgagtacaaa

SEQ ID NO: 150637 - DNA, 22 bp, Artificial sequence
  SiRNA target sequence
gaagaagaaatcgagtacaaaa

SEQ ID NO: 150638 - DNA, 22 bp, Artificial sequence
  SiRNA target sequence
aagaagaaatcgagtacaaaaa

SEQ ID NO: 150639 - DNA, 22 bp, Artificial sequence
  SiRNA target sequence
agaagaaatcgagtacaaaaag

SEQ ID NO: 150640 - DNA, 22 bp, Artificial sequence
  SiRNA target sequence
gaagaaatcgagtacaaaaagt

SEQ ID NO: 150641 - DNA, 22 bp, Artificial sequence
  SiRNA target sequence
aagaaatcgagtacaaaaagtt

SEQ ID NO: 150642 - DNA, 22 bp, Artificial sequence
  SiRNA target sequence
agaaatcgagtacaaaaagttc

SEQ ID NO: 150643 - DNA, 22 bp, Artificial sequence
  SiRNA target sequence
gaaatcgagtacaaaaagttca

SEQ ID NO: 150644 - DNA, 22 bp, Artificial sequence
  SiRNA target sequence
aaatcgagtacaaaaagttcaa

SEQ ID NO: 150645 - DNA, 22 bp, Artificial sequence
  SiRNA target sequence
aatcgagtacaaaaagttcaag

SEQ ID NO: 150646 - DNA, 22 bp, Artificial sequence
  SiRNA target sequence
atcgagtacaaaaagttcaaga

SEQ ID NO: 150647 - DNA, 22 bp, Artificial sequence
  SiRNA target sequence
tcgagtacaaaaagttcaagat

SEQ ID NO: 150648 - DNA, 22 bp, Artificial sequence
  SiRNA target sequence
cgagtacaaaaagttcaagata

SEQ ID NO: 150649 - DNA, 22 bp, Artificial sequence
  SiRNA target sequence
gagtacaaaaagttcaagatac

SEQ ID NO: 150650 - DNA, 22 bp, Artificial sequence
  SiRNA target sequence
agtacaaaaagttcaagataca

SEQ ID NO: 150651 - DNA, 22 bp, Artificial sequence
  SiRNA target sequence
gtacaaaaagttcaagatacag

SEQ ID NO: 150652 - DNA, 22 bp, Artificial sequence
  SiRNA target sequence
tacaaaaagttcaagatacaga

SEQ ID NO: 150653 - DNA, 22 bp, Artificial sequence
  SiRNA target sequence
acaaaaagttcaagatacagaa

SEQ ID NO: 150654 - DNA, 22 bp, Artificial sequence
  SiRNA target sequence
caaaaagttcaagatacagaat

SEQ ID NO: 150655 - DNA, 22 bp, Artificial sequence
  SiRNA target sequence
aaaaagttcaagatacagaata

SEQ ID NO: 150656 - DNA, 22 bp, Artificial sequence
  SiRNA target sequence
aaaagttcaagatacagaatac

SEQ ID NO: 150657 - DNA, 22 bp, Artificial sequence
  SiRNA target sequence
aaagttcaagatacagaatacg

SEQ ID NO: 150658 - DNA, 22 bp, Artificial sequence
  SiRNA target sequence
aagttcaagatacagaatacga

SEQ ID NO: 150659 - DNA, 22 bp, Artificial sequence
  SiRNA target sequence
agttcaagatacagaatacgag

SEQ ID NO: 150660 - DNA, 22 bp, Artificial sequence
  SiRNA target sequence
gttcaagatacagaatacgagt

SEQ ID NO: 150661 - DNA, 22 bp, Artificial sequence
  SiRNA target sequence
ttcaagatacagaatacgagtt

SEQ ID NO: 150662 - DNA, 22 bp, Artificial sequence
  SiRNA target sequence
tcaagatacagaatacgagttt

SEQ ID NO: 150663 - DNA, 22 bp, Artificial sequence
  SiRNA target sequence
caagatacagaatacgagttta

SEQ ID NO: 150664 - DNA, 22 bp, Artificial sequence
  SiRNA target sequence
aagatacagaatacgagtttaa

SEQ ID NO: 150665 - DNA, 22 bp, Artificial sequence
  SiRNA target sequence
agatacagaatacgagtttaat

SEQ ID NO: 150666 - DNA, 22 bp, Artificial sequence
  SiRNA target sequence
gatacagaatacgagtttaata

SEQ ID NO: 150667 - DNA, 22 bp, Artificial sequence
  SiRNA target sequence
atacagaatacgagtttaatat

SEQ ID NO: 150668 - DNA, 22 bp, Artificial sequence
  SiRNA target sequence
tacagaatacgagtttaatatt

SEQ ID NO: 150669 - DNA, 22 bp, Artificial sequence
  SiRNA target sequence
acagaatacgagtttaatattt

SEQ ID NO: 150670 - DNA, 22 bp, Artificial sequence
  SiRNA target sequence
cagaatacgagtttaatatttc

SEQ ID NO: 150671 - DNA, 22 bp, Artificial sequence
  SiRNA target sequence
agaatacgagtttaatatttcg

SEQ ID NO: 150672 - DNA, 22 bp, Artificial sequence
  SiRNA target sequence
gaatacgagtttaatatttcgt

SEQ ID NO: 150673 - DNA, 22 bp, Artificial sequence
  SiRNA target sequence
aatacgagtttaatatttcgtt

SEQ ID NO: 150674 - DNA, 22 bp, Artificial sequence
  SiRNA target sequence
atacgagtttaatatttcgttg

SEQ ID NO: 150675 - DNA, 22 bp, Artificial sequence
  SiRNA target sequence
tacgagtttaatatttcgttga

SEQ ID NO: 150676 - DNA, 22 bp, Artificial sequence
  SiRNA target sequence
acgagtttaatatttcgttgaa

SEQ ID NO: 150677 - DNA, 22 bp, Artificial sequence
  SiRNA target sequence
cgagtttaatatttcgttgaag

SEQ ID NO: 150678 - DNA, 22 bp, Artificial sequence
  SiRNA target sequence
gagtttaatatttcgttgaagg

SEQ ID NO: 150679 - DNA, 22 bp, Artificial sequence
  SiRNA target sequence
agtttaatatttcgttgaagga

SEQ ID NO: 150680 - DNA, 22 bp, Artificial sequence
  SiRNA target sequence
gtttaatatttcgttgaaggaa

SEQ ID NO: 150681 - DNA, 22 bp, Artificial sequence
  SiRNA target sequence
tttaatatttcgttgaaggaag

SEQ ID NO: 150682 - DNA, 22 bp, Artificial sequence
  SiRNA target sequence
ttaatatttcgttgaaggaagc

SEQ ID NO: 150683 - DNA, 22 bp, Artificial sequence
  SiRNA target sequence
taatatttcgttgaaggaagct

SEQ ID NO: 150684 - DNA, 22 bp, Artificial sequence
  SiRNA target sequence
aatatttcgttgaaggaagctt

SEQ ID NO: 150685 - DNA, 22 bp, Artificial sequence
  SiRNA target sequence
atatttcgttgaaggaagctta

SEQ ID NO: 150686 - DNA, 22 bp, Artificial sequence
  SiRNA target sequence
tatttcgttgaaggaagcttat

SEQ ID NO: 150687 - DNA, 22 bp, Artificial sequence
  SiRNA target sequence
atttcgttgaaggaagcttata

SEQ ID NO: 150688 - DNA, 22 bp, Artificial sequence
  SiRNA target sequence
tttcgttgaaggaagcttatat

SEQ ID NO: 150689 - DNA, 22 bp, Artificial sequence
  SiRNA target sequence
ttcgttgaaggaagcttatatg

SEQ ID NO: 150690 - DNA, 22 bp, Artificial sequence
  SiRNA target sequence
tcgttgaaggaagcttatatgg

SEQ ID NO: 150691 - DNA, 22 bp, Artificial sequence
  SiRNA target sequence
cgttgaaggaagcttatatggg

SEQ ID NO: 150692 - DNA, 22 bp, Artificial sequence
  SiRNA target sequence
gttgaaggaagcttatatggga

SEQ ID NO: 150693 - DNA, 22 bp, Artificial sequence
  SiRNA target sequence
ttgaaggaagcttatatgggaa

SEQ ID NO: 150694 - DNA, 22 bp, Artificial sequence
  SiRNA target sequence
tgaaggaagcttatatgggaaa

SEQ ID NO: 150695 - DNA, 22 bp, Artificial sequence
  SiRNA target sequence
gaaggaagcttatatgggaaag

SEQ ID NO: 150696 - DNA, 22 bp, Artificial sequence
  SiRNA target sequence
aaggaagcttatatgggaaagc

SEQ ID NO: 150697 - DNA, 22 bp, Artificial sequence
  SiRNA target sequence
aggaagcttatatgggaaagcg

SEQ ID NO: 150698 - DNA, 22 bp, Artificial sequence
  SiRNA target sequence
ggaagcttatatgggaaagcga

SEQ ID NO: 150699 - DNA, 22 bp, Artificial sequence
  SiRNA target sequence
gaagcttatatgggaaagcgag

SEQ ID NO: 150700 - DNA, 22 bp, Artificial sequence
  SiRNA target sequence
aagcttatatgggaaagcgagc

SEQ ID NO: 150701 - DNA, 22 bp, Artificial sequence
  SiRNA target sequence
agcttatatgggaaagcgagct

SEQ ID NO: 150702 - DNA, 22 bp, Artificial sequence
  SiRNA target sequence
gcttatatgggaaagcgagcta

SEQ ID NO: 150703 - DNA, 22 bp, Artificial sequence
  SiRNA target sequence
cttatatgggaaagcgagctag

SEQ ID NO: 150704 - DNA, 22 bp, Artificial sequence
  SiRNA target sequence
ttatatgggaaagcgagctagt

SEQ ID NO: 150705 - DNA, 22 bp, Artificial sequence
  SiRNA target sequence
tatatgggaaagcgagctagtt

SEQ ID NO: 150706 - DNA, 22 bp, Artificial sequence
  SiRNA target sequence
atatgggaaagcgagctagttt

SEQ ID NO: 150707 - DNA, 22 bp, Artificial sequence
  SiRNA target sequence
tatgggaaagcgagctagtttt

SEQ ID NO: 150708 - DNA, 22 bp, Artificial sequence
  SiRNA target sequence
atgggaaagcgagctagtttta

SEQ ID NO: 150709 - DNA, 22 bp, Artificial sequence
  SiRNA target sequence
tgggaaagcgagctagttttaa

SEQ ID NO: 150710 - DNA, 22 bp, Artificial sequence
  SiRNA target sequence
gggaaagcgagctagttttaat

SEQ ID NO: 150711 - DNA, 22 bp, Artificial sequence
  SiRNA target sequence
ggaaagcgagctagttttaatg

SEQ ID NO: 150712 - DNA, 22 bp, Artificial sequence
  SiRNA target sequence
gaaagcgagctagttttaatgt

SEQ ID NO: 150713 - DNA, 22 bp, Artificial sequence
  SiRNA target sequence
aaagcgagctagttttaatgta

SEQ ID NO: 150714 - DNA, 22 bp, Artificial sequence
  SiRNA target sequence
aagcgagctagttttaatgtaa

SEQ ID NO: 150715 - DNA, 22 bp, Artificial sequence
  SiRNA target sequence
agcgagctagttttaatgtaaa

SEQ ID NO: 150716 - DNA, 22 bp, Artificial sequence
  SiRNA target sequence
gcgagctagttttaatgtaaaa

SEQ ID NO: 150717 - DNA, 22 bp, Artificial sequence
  SiRNA target sequence
cgagctagttttaatgtaaaag

SEQ ID NO: 150718 - DNA, 22 bp, Artificial sequence
  SiRNA target sequence
gagctagttttaatgtaaaagt

SEQ ID NO: 150719 - DNA, 22 bp, Artificial sequence
  SiRNA target sequence
agctagttttaatgtaaaagtg

SEQ ID NO: 150720 - DNA, 22 bp, Artificial sequence
  SiRNA target sequence
gctagttttaatgtaaaagtgc

SEQ ID NO: 150721 - DNA, 22 bp, Artificial sequence
  SiRNA target sequence
ctagttttaatgtaaaagtgca

SEQ ID NO: 150722 - DNA, 22 bp, Artificial sequence
  SiRNA target sequence
tagttttaatgtaaaagtgcaa

SEQ ID NO: 150723 - DNA, 22 bp, Artificial sequence
  SiRNA target sequence
agttttaatgtaaaagtgcaaa

SEQ ID NO: 150724 - DNA, 22 bp, Artificial sequence
  SiRNA target sequence
gttttaatgtaaaagtgcaaag

SEQ ID NO: 150725 - DNA, 22 bp, Artificial sequence
  SiRNA target sequence
ttttaatgtaaaagtgcaaaga

SEQ ID NO: 150726 - DNA, 22 bp, Artificial sequence
  SiRNA target sequence
tttaatgtaaaagtgcaaagag

SEQ ID NO: 150727 - DNA, 22 bp, Artificial sequence
  SiRNA target sequence
ttaatgtaaaagtgcaaagaga

SEQ ID NO: 150728 - DNA, 22 bp, Artificial sequence
  SiRNA target sequence
taatgtaaaagtgcaaagagaa

SEQ ID NO: 150729 - DNA, 22 bp, Artificial sequence
  SiRNA target sequence
aatgtaaaagtgcaaagagaat

SEQ ID NO: 150730 - DNA, 22 bp, Artificial sequence
  SiRNA target sequence
atgtaaaagtgcaaagagaatg

SEQ ID NO: 150731 - DNA, 22 bp, Artificial sequence
  SiRNA target sequence
tgtaaaagtgcaaagagaatgt

SEQ ID NO: 150732 - DNA, 22 bp, Artificial sequence
  SiRNA target sequence
gtaaaagtgcaaagagaatgtt

SEQ ID NO: 150733 - DNA, 22 bp, Artificial sequence
  SiRNA target sequence
taaaagtgcaaagagaatgttc

SEQ ID NO: 150734 - DNA, 22 bp, Artificial sequence
  SiRNA target sequence
aaaagtgcaaagagaatgttct

SEQ ID NO: 150735 - DNA, 22 bp, Artificial sequence
  SiRNA target sequence
aaagtgcaaagagaatgttctg

SEQ ID NO: 150736 - DNA, 22 bp, Artificial sequence
  SiRNA target sequence
aagtgcaaagagaatgttctgc

SEQ ID NO: 150737 - DNA, 22 bp, Artificial sequence
  SiRNA target sequence
agtgcaaagagaatgttctgcg

SEQ ID NO: 150738 - DNA, 22 bp, Artificial sequence
  SiRNA target sequence
gtgcaaagagaatgttctgcgt

SEQ ID NO: 150739 - DNA, 22 bp, Artificial sequence
  SiRNA target sequence
tgcaaagagaatgttctgcgtg

SEQ ID NO: 150740 - DNA, 22 bp, Artificial sequence
  SiRNA target sequence
gcaaagagaatgttctgcgtgt

SEQ ID NO: 150741 - DNA, 22 bp, Artificial sequence
  SiRNA target sequence
caaagagaatgttctgcgtgta

SEQ ID NO: 150742 - DNA, 22 bp, Artificial sequence
  SiRNA target sequence
aaagagaatgttctgcgtgtaa

SEQ ID NO: 150743 - DNA, 22 bp, Artificial sequence
  SiRNA target sequence
aagagaatgttctgcgtgtaac

SEQ ID NO: 150744 - DNA, 22 bp, Artificial sequence
  SiRNA target sequence
agagaatgttctgcgtgtaacg

SEQ ID NO: 150745 - DNA, 22 bp, Artificial sequence
  SiRNA target sequence
gagaatgttctgcgtgtaacgg

SEQ ID NO: 150746 - DNA, 22 bp, Artificial sequence
  SiRNA target sequence
agaatgttctgcgtgtaacggt

SEQ ID NO: 150747 - DNA, 22 bp, Artificial sequence
  SiRNA target sequence
gaatgttctgcgtgtaacggta

SEQ ID NO: 150748 - DNA, 22 bp, Artificial sequence
  SiRNA target sequence
aatgttctgcgtgtaacggtaa

SEQ ID NO: 150749 - DNA, 22 bp, Artificial sequence
  SiRNA target sequence
atgttctgcgtgtaacggtaaa

SEQ ID NO: 150750 - DNA, 22 bp, Artificial sequence
  SiRNA target sequence
tgttctgcgtgtaacggtaaag

SEQ ID NO: 150751 - DNA, 22 bp, Artificial sequence
  SiRNA target sequence
gttctgcgtgtaacggtaaagg

SEQ ID NO: 150752 - DNA, 22 bp, Artificial sequence
  SiRNA target sequence
ttctgcgtgtaacggtaaagga

SEQ ID NO: 150753 - DNA, 22 bp, Artificial sequence
  SiRNA target sequence
tctgcgtgtaacggtaaaggag

SEQ ID NO: 150754 - DNA, 22 bp, Artificial sequence
  SiRNA target sequence
ctgcgtgtaacggtaaaggagg

SEQ ID NO: 150755 - DNA, 22 bp, Artificial sequence
  SiRNA target sequence
tgcgtgtaacggtaaaggagga

SEQ ID NO: 150756 - DNA, 22 bp, Artificial sequence
  SiRNA target sequence
gcgtgtaacggtaaaggaggag

SEQ ID NO: 150757 - DNA, 22 bp, Artificial sequence
  SiRNA target sequence
cgtgtaacggtaaaggaggaga

SEQ ID NO: 150758 - DNA, 22 bp, Artificial sequence
  SiRNA target sequence
gtgtaacggtaaaggaggagac

SEQ ID NO: 150759 - DNA, 22 bp, Artificial sequence
  SiRNA target sequence
tgtaacggtaaaggaggagaca

SEQ ID NO: 150760 - DNA, 22 bp, Artificial sequence
  SiRNA target sequence
gtaacggtaaaggaggagacag

SEQ ID NO: 150761 - DNA, 22 bp, Artificial sequence
  SiRNA target sequence
taacggtaaaggaggagacagt

SEQ ID NO: 150762 - DNA, 22 bp, Artificial sequence
  SiRNA target sequence
aacggtaaaggaggagacagtg

SEQ ID NO: 150763 - DNA, 22 bp, Artificial sequence
  SiRNA target sequence
acggtaaaggaggagacagtgt

SEQ ID NO: 150764 - DNA, 22 bp, Artificial sequence
  SiRNA target sequence
cggtaaaggaggagacagtgtt

SEQ ID NO: 150765 - DNA, 22 bp, Artificial sequence
  SiRNA target sequence
ggtaaaggaggagacagtgttg

SEQ ID NO: 150766 - DNA, 22 bp, Artificial sequence
  SiRNA target sequence
gtaaaggaggagacagtgttga

SEQ ID NO: 150767 - DNA, 22 bp, Artificial sequence
  SiRNA target sequence
taaaggaggagacagtgttgaa

SEQ ID NO: 150768 - DNA, 22 bp, Artificial sequence
  SiRNA target sequence
aaaggaggagacagtgttgaaa

SEQ ID NO: 150769 - DNA, 22 bp, Artificial sequence
  SiRNA target sequence
aaggaggagacagtgttgaaac

SEQ ID NO: 150770 - DNA, 22 bp, Artificial sequence
  SiRNA target sequence
aggaggagacagtgttgaaaca

SEQ ID NO: 150771 - DNA, 22 bp, Artificial sequence
  SiRNA target sequence
ggaggagacagtgttgaaacat

SEQ ID NO: 150772 - DNA, 22 bp, Artificial sequence
  SiRNA target sequence
gaggagacagtgttgaaacatg

SEQ ID NO: 150773 - DNA, 22 bp, Artificial sequence
  SiRNA target sequence
aggagacagtgttgaaacatgt

SEQ ID NO: 150774 - DNA, 22 bp, Artificial sequence
  SiRNA target sequence
ggagacagtgttgaaacatgtg

SEQ ID NO: 150775 - DNA, 22 bp, Artificial sequence
  SiRNA target sequence
gagacagtgttgaaacatgtga

SEQ ID NO: 150776 - DNA, 22 bp, Artificial sequence
  SiRNA target sequence
agacagtgttgaaacatgtgaa

SEQ ID NO: 150777 - DNA, 22 bp, Artificial sequence
  SiRNA target sequence
gacagtgttgaaacatgtgaac

SEQ ID NO: 150778 - DNA, 22 bp, Artificial sequence
  SiRNA target sequence
acagtgttgaaacatgtgaacc

SEQ ID NO: 150779 - DNA, 22 bp, Artificial sequence
  SiRNA target sequence
cagtgttgaaacatgtgaacca

SEQ ID NO: 150780 - DNA, 22 bp, Artificial sequence
  SiRNA target sequence
agtgttgaaacatgtgaaccat

SEQ ID NO: 150781 - DNA, 22 bp, Artificial sequence
  SiRNA target sequence
gtgttgaaacatgtgaaccatg

SEQ ID NO: 150782 - DNA, 22 bp, Artificial sequence
  SiRNA target sequence
tgttgaaacatgtgaaccatgt

SEQ ID NO: 150783 - DNA, 22 bp, Artificial sequence
  SiRNA target sequence
gttgaaacatgtgaaccatgta

SEQ ID NO: 150784 - DNA, 22 bp, Artificial sequence
  SiRNA target sequence
ttgaaacatgtgaaccatgtaa

SEQ ID NO: 150785 - DNA, 22 bp, Artificial sequence
  SiRNA target sequence
tgaaacatgtgaaccatgtaaa

SEQ ID NO: 150786 - DNA, 22 bp, Artificial sequence
  SiRNA target sequence
gaaacatgtgaaccatgtaaag

SEQ ID NO: 150787 - DNA, 22 bp, Artificial sequence
  SiRNA target sequence
aaacatgtgaaccatgtaaagg

SEQ ID NO: 150788 - DNA, 22 bp, Artificial sequence
  SiRNA target sequence
aacatgtgaaccatgtaaaggt

SEQ ID NO: 150789 - DNA, 22 bp, Artificial sequence
  SiRNA target sequence
acatgtgaaccatgtaaaggta

SEQ ID NO: 150790 - DNA, 22 bp, Artificial sequence
  SiRNA target sequence
catgtgaaccatgtaaaggtaa

SEQ ID NO: 150791 - DNA, 22 bp, Artificial sequence
  SiRNA target sequence
atgtgaaccatgtaaaggtaaa

SEQ ID NO: 150792 - DNA, 22 bp, Artificial sequence
  SiRNA target sequence
tgtgaaccatgtaaaggtaaag

SEQ ID NO: 150793 - DNA, 22 bp, Artificial sequence
  SiRNA target sequence
gtgaaccatgtaaaggtaaagg

SEQ ID NO: 150794 - DNA, 22 bp, Artificial sequence
  SiRNA target sequence
tgaaccatgtaaaggtaaaggt

SEQ ID NO: 150795 - DNA, 22 bp, Artificial sequence
  SiRNA target sequence
gaaccatgtaaaggtaaaggta

SEQ ID NO: 150796 - DNA, 22 bp, Artificial sequence
  SiRNA target sequence
aaccatgtaaaggtaaaggtaa

SEQ ID NO: 150797 - DNA, 22 bp, Artificial sequence
  SiRNA target sequence
accatgtaaaggtaaaggtaag

SEQ ID NO: 150798 - DNA, 22 bp, Artificial sequence
  SiRNA target sequence
ccatgtaaaggtaaaggtaagg

SEQ ID NO: 150799 - DNA, 22 bp, Artificial sequence
  SiRNA target sequence
catgtaaaggtaaaggtaaggt

SEQ ID NO: 150800 - DNA, 22 bp, Artificial sequence
  SiRNA target sequence
atgtaaaggtaaaggtaaggta

SEQ ID NO: 150801 - DNA, 22 bp, Artificial sequence
  SiRNA target sequence
tgtaaaggtaaaggtaaggtag

SEQ ID NO: 150802 - DNA, 22 bp, Artificial sequence
  SiRNA target sequence
gtaaaggtaaaggtaaggtaga

SEQ ID NO: 150803 - DNA, 22 bp, Artificial sequence
  SiRNA target sequence
taaaggtaaaggtaaggtagaa

SEQ ID NO: 150804 - DNA, 22 bp, Artificial sequence
  SiRNA target sequence
aaaggtaaaggtaaggtagaac

SEQ ID NO: 150805 - DNA, 22 bp, Artificial sequence
  SiRNA target sequence
aaggtaaaggtaaggtagaaca

SEQ ID NO: 150806 - DNA, 22 bp, Artificial sequence
  SiRNA target sequence
aggtaaaggtaaggtagaacat

SEQ ID NO: 150807 - DNA, 22 bp, Artificial sequence
  SiRNA target sequence
ggtaaaggtaaggtagaacatc

SEQ ID NO: 150808 - DNA, 22 bp, Artificial sequence
  SiRNA target sequence
gtaaaggtaaggtagaacatca

SEQ ID NO: 150809 - DNA, 22 bp, Artificial sequence
  SiRNA target sequence
taaaggtaaggtagaacatcat

SEQ ID NO: 150810 - DNA, 22 bp, Artificial sequence
  SiRNA target sequence
aaaggtaaggtagaacatcata

SEQ ID NO: 150811 - DNA, 22 bp, Artificial sequence
  SiRNA target sequence
aaggtaaggtagaacatcatag

SEQ ID NO: 150812 - DNA, 22 bp, Artificial sequence
  SiRNA target sequence
aggtaaggtagaacatcatagg

SEQ ID NO: 150813 - DNA, 22 bp, Artificial sequence
  SiRNA target sequence
ggtaaggtagaacatcatagga

SEQ ID NO: 150814 - DNA, 22 bp, Artificial sequence
  SiRNA target sequence
gtaaggtagaacatcataggag

SEQ ID NO: 150815 - DNA, 22 bp, Artificial sequence
  SiRNA target sequence
taaggtagaacatcataggaga

SEQ ID NO: 150816 - DNA, 22 bp, Artificial sequence
  SiRNA target sequence
aaggtagaacatcataggagac

SEQ ID NO: 150817 - DNA, 22 bp, Artificial sequence
  SiRNA target sequence
aggtagaacatcataggagact

SEQ ID NO: 150818 - DNA, 22 bp, Artificial sequence
  SiRNA target sequence
ggtagaacatcataggagacta

SEQ ID NO: 150819 - DNA, 22 bp, Artificial sequence
  SiRNA target sequence
gtagaacatcataggagactag

SEQ ID NO: 150820 - DNA, 22 bp, Artificial sequence
  SiRNA target sequence
tagaacatcataggagactagg

SEQ ID NO: 150821 - DNA, 22 bp, Artificial sequence
  SiRNA target sequence
agaacatcataggagactaggt

SEQ ID NO: 150822 - DNA, 22 bp, Artificial sequence
  SiRNA target sequence
gaacatcataggagactaggtc

SEQ ID NO: 150823 - DNA, 22 bp, Artificial sequence
  SiRNA target sequence
aacatcataggagactaggtcc

SEQ ID NO: 150824 - DNA, 22 bp, Artificial sequence
  SiRNA target sequence
acatcataggagactaggtcct

SEQ ID NO: 150825 - DNA, 22 bp, Artificial sequence
  SiRNA target sequence
catcataggagactaggtcctt

SEQ ID NO: 150826 - DNA, 22 bp, Artificial sequence
  SiRNA target sequence
atcataggagactaggtccttt

SEQ ID NO: 150827 - DNA, 22 bp, Artificial sequence
  SiRNA target sequence
tcataggagactaggtccttta

SEQ ID NO: 150828 - DNA, 22 bp, Artificial sequence
  SiRNA target sequence
cataggagactaggtcctttaa

SEQ ID NO: 150829 - DNA, 22 bp, Artificial sequence
  SiRNA target sequence
ataggagactaggtcctttaat

SEQ ID NO: 150830 - DNA, 22 bp, Artificial sequence
  SiRNA target sequence
taggagactaggtcctttaatt

SEQ ID NO: 150831 - DNA, 22 bp, Artificial sequence
  SiRNA target sequence
aggagactaggtcctttaattt

SEQ ID NO: 150832 - DNA, 22 bp, Artificial sequence
  SiRNA target sequence
ggagactaggtcctttaatttc

SEQ ID NO: 150833 - DNA, 22 bp, Artificial sequence
  SiRNA target sequence
gagactaggtcctttaatttct

SEQ ID NO: 150834 - DNA, 22 bp, Artificial sequence
  SiRNA target sequence
agactaggtcctttaatttctg

SEQ ID NO: 150835 - DNA, 22 bp, Artificial sequence
  SiRNA target sequence
gactaggtcctttaatttctgt

SEQ ID NO: 150836 - DNA, 22 bp, Artificial sequence
  SiRNA target sequence
actaggtcctttaatttctgta

SEQ ID NO: 150837 - DNA, 22 bp, Artificial sequence
  SiRNA target sequence
ctaggtcctttaatttctgtac

SEQ ID NO: 150838 - DNA, 22 bp, Artificial sequence
  SiRNA target sequence
taggtcctttaatttctgtaca

SEQ ID NO: 150839 - DNA, 22 bp, Artificial sequence
  SiRNA target sequence
aggtcctttaatttctgtacaa

SEQ ID NO: 150840 - DNA, 22 bp, Artificial sequence
  SiRNA target sequence
ggtcctttaatttctgtacaag

SEQ ID NO: 150841 - DNA, 22 bp, Artificial sequence
  SiRNA target sequence
gtcctttaatttctgtacaaga

SEQ ID NO: 150842 - DNA, 22 bp, Artificial sequence
  SiRNA target sequence
tcctttaatttctgtacaagaa

SEQ ID NO: 150843 - DNA, 22 bp, Artificial sequence
  SiRNA target sequence
cctttaatttctgtacaagaag

SEQ ID NO: 150844 - DNA, 22 bp, Artificial sequence
  SiRNA target sequence
ctttaatttctgtacaagaagc

SEQ ID NO: 150845 - DNA, 22 bp, Artificial sequence
  SiRNA target sequence
tttaatttctgtacaagaagca

SEQ ID NO: 150846 - DNA, 22 bp, Artificial sequence
  SiRNA target sequence
ttaatttctgtacaagaagcac

SEQ ID NO: 150847 - DNA, 22 bp, Artificial sequence
  SiRNA target sequence
taatttctgtacaagaagcacc

SEQ ID NO: 150848 - DNA, 22 bp, Artificial sequence
  SiRNA target sequence
aatttctgtacaagaagcacct

SEQ ID NO: 150849 - DNA, 22 bp, Artificial sequence
  SiRNA target sequence
atttctgtacaagaagcacctt

SEQ ID NO: 150850 - DNA, 22 bp, Artificial sequence
  SiRNA target sequence
tttctgtacaagaagcaccttg

SEQ ID NO: 150851 - DNA, 22 bp, Artificial sequence
  SiRNA target sequence
ttctgtacaagaagcaccttgt

SEQ ID NO: 150852 - DNA, 22 bp, Artificial sequence
  SiRNA target sequence
tctgtacaagaagcaccttgta

SEQ ID NO: 150853 - DNA, 22 bp, Artificial sequence
  SiRNA target sequence
ctgtacaagaagcaccttgtaa

SEQ ID NO: 150854 - DNA, 22 bp, Artificial sequence
  SiRNA target sequence
tgtacaagaagcaccttgtaat

SEQ ID NO: 150855 - DNA, 22 bp, Artificial sequence
  SiRNA target sequence
gtacaagaagcaccttgtaata

SEQ ID NO: 150856 - DNA, 22 bp, Artificial sequence
  SiRNA target sequence
tacaagaagcaccttgtaataa

SEQ ID NO: 150857 - DNA, 22 bp, Artificial sequence
  SiRNA target sequence
acaagaagcaccttgtaataat

SEQ ID NO: 150858 - DNA, 22 bp, Artificial sequence
  SiRNA target sequence
caagaagcaccttgtaataatt

SEQ ID NO: 150859 - DNA, 22 bp, Artificial sequence
  SiRNA target sequence
aagaagcaccttgtaataattg

SEQ ID NO: 150860 - DNA, 22 bp, Artificial sequence
  SiRNA target sequence
agaagcaccttgtaataattgt

SEQ ID NO: 150861 - DNA, 22 bp, Artificial sequence
  SiRNA target sequence
gaagcaccttgtaataattgta

SEQ ID NO: 150862 - DNA, 22 bp, Artificial sequence
  SiRNA target sequence
aagcaccttgtaataattgtaa

SEQ ID NO: 150863 - DNA, 22 bp, Artificial sequence
  SiRNA target sequence
agcaccttgtaataattgtaat

SEQ ID NO: 150864 - DNA, 22 bp, Artificial sequence
  SiRNA target sequence
gcaccttgtaataattgtaatt

SEQ ID NO: 150865 - DNA, 22 bp, Artificial sequence
  SiRNA target sequence
caccttgtaataattgtaattc

SEQ ID NO: 150866 - DNA, 22 bp, Artificial sequence
  SiRNA target sequence
accttgtaataattgtaattct

SEQ ID NO: 150867 - DNA, 22 bp, Artificial sequence
  SiRNA target sequence
ccttgtaataattgtaattcta

SEQ ID NO: 150868 - DNA, 22 bp, Artificial sequence
  SiRNA target sequence
cttgtaataattgtaattctac

SEQ ID NO: 150869 - DNA, 22 bp, Artificial sequence
  SiRNA target sequence
ttgtaataattgtaattctact

SEQ ID NO: 150870 - DNA, 22 bp, Artificial sequence
  SiRNA target sequence
tgtaataattgtaattctactg

SEQ ID NO: 150871 - DNA, 22 bp, Artificial sequence
  SiRNA target sequence
gtaataattgtaattctactgg

SEQ ID NO: 150872 - DNA, 22 bp, Artificial sequence
  SiRNA target sequence
taataattgtaattctactgga

SEQ ID NO: 150873 - DNA, 22 bp, Artificial sequence
  SiRNA target sequence
aataattgtaattctactggat

SEQ ID NO: 150874 - DNA, 22 bp, Artificial sequence
  SiRNA target sequence
ataattgtaattctactggatt

SEQ ID NO: 150875 - DNA, 22 bp, Artificial sequence
  SiRNA target sequence
taattgtaattctactggattt

SEQ ID NO: 150876 - DNA, 22 bp, Artificial sequence
  SiRNA target sequence
aattgtaattctactggatttg

SEQ ID NO: 150877 - DNA, 22 bp, Artificial sequence
  SiRNA target sequence
attgtaattctactggatttgt

SEQ ID NO: 150878 - DNA, 22 bp, Artificial sequence
  SiRNA target sequence
ttgtaattctactggatttgtt

SEQ ID NO: 150879 - DNA, 22 bp, Artificial sequence
  SiRNA target sequence
tgtaattctactggatttgttg

SEQ ID NO: 150880 - DNA, 22 bp, Artificial sequence
  SiRNA target sequence
gtaattctactggatttgttgt

SEQ ID NO: 150881 - DNA, 22 bp, Artificial sequence
  SiRNA target sequence
taattctactggatttgttgtt

SEQ ID NO: 150882 - DNA, 22 bp, Artificial sequence
  SiRNA target sequence
aattctactggatttgttgtta

SEQ ID NO: 150883 - DNA, 22 bp, Artificial sequence
  SiRNA target sequence
attctactggatttgttgttaa

SEQ ID NO: 150884 - DNA, 22 bp, Artificial sequence
  SiRNA target sequence
ttctactggatttgttgttaaa

SEQ ID NO: 150885 - DNA, 22 bp, Artificial sequence
  SiRNA target sequence
tctactggatttgttgttaaag

SEQ ID NO: 150886 - DNA, 22 bp, Artificial sequence
  SiRNA target sequence
ctactggatttgttgttaaagg

SEQ ID NO: 150887 - DNA, 22 bp, Artificial sequence
  SiRNA target sequence
tactggatttgttgttaaagga

SEQ ID NO: 150888 - DNA, 22 bp, Artificial sequence
  SiRNA target sequence
actggatttgttgttaaaggaa

SEQ ID NO: 150889 - DNA, 22 bp, Artificial sequence
  SiRNA target sequence
ctggatttgttgttaaaggaaa

SEQ ID NO: 150890 - DNA, 22 bp, Artificial sequence
  SiRNA target sequence
tggatttgttgttaaaggaaag

SEQ ID NO: 150891 - DNA, 22 bp, Artificial sequence
  SiRNA target sequence
ggatttgttgttaaaggaaagc

SEQ ID NO: 150892 - DNA, 22 bp, Artificial sequence
  SiRNA target sequence
gatttgttgttaaaggaaagct

SEQ ID NO: 150893 - DNA, 22 bp, Artificial sequence
  SiRNA target sequence
atttgttgttaaaggaaagctt

SEQ ID NO: 150894 - DNA, 22 bp, Artificial sequence
  SiRNA target sequence
tttgttgttaaaggaaagcttt

SEQ ID NO: 150895 - DNA, 22 bp, Artificial sequence
  SiRNA target sequence
ttgttgttaaaggaaagctttg

SEQ ID NO: 150896 - DNA, 22 bp, Artificial sequence
  SiRNA target sequence
tgttgttaaaggaaagctttgt

SEQ ID NO: 150897 - DNA, 22 bp, Artificial sequence
  SiRNA target sequence
gttgttaaaggaaagctttgtc

SEQ ID NO: 150898 - DNA, 22 bp, Artificial sequence
  SiRNA target sequence
ttgttaaaggaaagctttgtca

SEQ ID NO: 150899 - DNA, 22 bp, Artificial sequence
  SiRNA target sequence
tgttaaaggaaagctttgtcaa

SEQ ID NO: 150900 - DNA, 22 bp, Artificial sequence
  SiRNA target sequence
gttaaaggaaagctttgtcaaa

SEQ ID NO: 150901 - DNA, 22 bp, Artificial sequence
  SiRNA target sequence
ttaaaggaaagctttgtcaaag

SEQ ID NO: 150902 - DNA, 22 bp, Artificial sequence
  SiRNA target sequence
taaaggaaagctttgtcaaagt

SEQ ID NO: 150903 - DNA, 22 bp, Artificial sequence
  SiRNA target sequence
aaaggaaagctttgtcaaagtt

SEQ ID NO: 150904 - DNA, 22 bp, Artificial sequence
  SiRNA target sequence
aaggaaagctttgtcaaagttg

SEQ ID NO: 150905 - DNA, 22 bp, Artificial sequence
  SiRNA target sequence
aggaaagctttgtcaaagttgt

SEQ ID NO: 150906 - DNA, 22 bp, Artificial sequence
  SiRNA target sequence
ggaaagctttgtcaaagttgta

SEQ ID NO: 150907 - DNA, 22 bp, Artificial sequence
  SiRNA target sequence
gaaagctttgtcaaagttgtaa

SEQ ID NO: 150908 - DNA, 22 bp, Artificial sequence
  SiRNA target sequence
aaagctttgtcaaagttgtaaa

SEQ ID NO: 150909 - DNA, 22 bp, Artificial sequence
  SiRNA target sequence
aagctttgtcaaagttgtaaag

SEQ ID NO: 150910 - DNA, 22 bp, Artificial sequence
  SiRNA target sequence
agctttgtcaaagttgtaaagg

SEQ ID NO: 150911 - DNA, 22 bp, Artificial sequence
  SiRNA target sequence
gctttgtcaaagttgtaaaggt

SEQ ID NO: 150912 - DNA, 22 bp, Artificial sequence
  SiRNA target sequence
ctttgtcaaagttgtaaaggta

SEQ ID NO: 150913 - DNA, 22 bp, Artificial sequence
  SiRNA target sequence
tttgtcaaagttgtaaaggtaa

SEQ ID NO: 150914 - DNA, 22 bp, Artificial sequence
  SiRNA target sequence
ttgtcaaagttgtaaaggtaaa

SEQ ID NO: 150915 - DNA, 22 bp, Artificial sequence
  SiRNA target sequence
tgtcaaagttgtaaaggtaaac

SEQ ID NO: 150916 - DNA, 22 bp, Artificial sequence
  SiRNA target sequence
gtcaaagttgtaaaggtaaaca

SEQ ID NO: 150917 - DNA, 22 bp, Artificial sequence
  SiRNA target sequence
tcaaagttgtaaaggtaaacaa

SEQ ID NO: 150918 - DNA, 22 bp, Artificial sequence
  SiRNA target sequence
caaagttgtaaaggtaaacaat

SEQ ID NO: 150919 - DNA, 22 bp, Artificial sequence
  SiRNA target sequence
aaagttgtaaaggtaaacaata

SEQ ID NO: 150920 - DNA, 22 bp, Artificial sequence
  SiRNA target sequence
aagttgtaaaggtaaacaatac

SEQ ID NO: 150921 - DNA, 22 bp, Artificial sequence
  SiRNA target sequence
agttgtaaaggtaaacaatacg

SEQ ID NO: 150922 - DNA, 22 bp, Artificial sequence
  SiRNA target sequence
gttgtaaaggtaaacaatacgt

SEQ ID NO: 150923 - DNA, 22 bp, Artificial sequence
  SiRNA target sequence
ttgtaaaggtaaacaatacgtt

SEQ ID NO: 150924 - DNA, 22 bp, Artificial sequence
  SiRNA target sequence
tgtaaaggtaaacaatacgttg

SEQ ID NO: 150925 - DNA, 22 bp, Artificial sequence
  SiRNA target sequence
gtaaaggtaaacaatacgttga

SEQ ID NO: 150926 - DNA, 22 bp, Artificial sequence
  SiRNA target sequence
taaaggtaaacaatacgttgag

SEQ ID NO: 150927 - DNA, 22 bp, Artificial sequence
  SiRNA target sequence
aaaggtaaacaatacgttgaga

SEQ ID NO: 150928 - DNA, 22 bp, Artificial sequence
  SiRNA target sequence
aaggtaaacaatacgttgagac

SEQ ID NO: 150929 - DNA, 22 bp, Artificial sequence
  SiRNA target sequence
aggtaaacaatacgttgagact

SEQ ID NO: 150930 - DNA, 22 bp, Artificial sequence
  SiRNA target sequence
ggtaaacaatacgttgagacta

SEQ ID NO: 150931 - DNA, 22 bp, Artificial sequence
  SiRNA target sequence
gtaaacaatacgttgagactaa

SEQ ID NO: 150932 - DNA, 22 bp, Artificial sequence
  SiRNA target sequence
taaacaatacgttgagactaaa

SEQ ID NO: 150933 - DNA, 22 bp, Artificial sequence
  SiRNA target sequence
aaacaatacgttgagactaaag

SEQ ID NO: 150934 - DNA, 22 bp, Artificial sequence
  SiRNA target sequence
aacaatacgttgagactaaaga

SEQ ID NO: 150935 - DNA, 22 bp, Artificial sequence
  SiRNA target sequence
acaatacgttgagactaaagaa

SEQ ID NO: 150936 - DNA, 22 bp, Artificial sequence
  SiRNA target sequence
caatacgttgagactaaagaac

SEQ ID NO: 150937 - DNA, 22 bp, Artificial sequence
  SiRNA target sequence
aatacgttgagactaaagaaca

SEQ ID NO: 150938 - DNA, 22 bp, Artificial sequence
  SiRNA target sequence
atacgttgagactaaagaacat

SEQ ID NO: 150939 - DNA, 22 bp, Artificial sequence
  SiRNA target sequence
tacgttgagactaaagaacata

SEQ ID NO: 150940 - DNA, 22 bp, Artificial sequence
  SiRNA target sequence
acgttgagactaaagaacatat

SEQ ID NO: 150941 - DNA, 22 bp, Artificial sequence
  SiRNA target sequence
cgttgagactaaagaacatatt

SEQ ID NO: 150942 - DNA, 22 bp, Artificial sequence
  SiRNA target sequence
gttgagactaaagaacatattg

SEQ ID NO: 150943 - DNA, 22 bp, Artificial sequence
  SiRNA target sequence
ttgagactaaagaacatattga

SEQ ID NO: 150944 - DNA, 22 bp, Artificial sequence
  SiRNA target sequence
tgagactaaagaacatattgaa

SEQ ID NO: 150945 - DNA, 22 bp, Artificial sequence
  SiRNA target sequence
gagactaaagaacatattgaag

SEQ ID NO: 150946 - DNA, 22 bp, Artificial sequence
  SiRNA target sequence
agactaaagaacatattgaagt

SEQ ID NO: 150947 - DNA, 22 bp, Artificial sequence
  SiRNA target sequence
gactaaagaacatattgaagtg

SEQ ID NO: 150948 - DNA, 22 bp, Artificial sequence
  SiRNA target sequence
actaaagaacatattgaagtgg

SEQ ID NO: 150949 - DNA, 22 bp, Artificial sequence
  SiRNA target sequence
ctaaagaacatattgaagtgga

SEQ ID NO: 150950 - DNA, 22 bp, Artificial sequence
  SiRNA target sequence
taaagaacatattgaagtggaa

SEQ ID NO: 150951 - DNA, 22 bp, Artificial sequence
  SiRNA target sequence
aaagaacatattgaagtggaag

SEQ ID NO: 150952 - DNA, 22 bp, Artificial sequence
  SiRNA target sequence
aagaacatattgaagtggaagt

SEQ ID NO: 150953 - DNA, 22 bp, Artificial sequence
  SiRNA target sequence
agaacatattgaagtggaagta

SEQ ID NO: 150954 - DNA, 22 bp, Artificial sequence
  SiRNA target sequence
gaacatattgaagtggaagtag

SEQ ID NO: 150955 - DNA, 22 bp, Artificial sequence
  SiRNA target sequence
aacatattgaagtggaagtaga

SEQ ID NO: 150956 - DNA, 22 bp, Artificial sequence
  SiRNA target sequence
acatattgaagtggaagtagag

SEQ ID NO: 150957 - DNA, 22 bp, Artificial sequence
  SiRNA target sequence
catattgaagtggaagtagagc

SEQ ID NO: 150958 - DNA, 22 bp, Artificial sequence
  SiRNA target sequence
atattgaagtggaagtagagcc

SEQ ID NO: 150959 - DNA, 22 bp, Artificial sequence
  SiRNA target sequence
tattgaagtggaagtagagcca

SEQ ID NO: 150960 - DNA, 22 bp, Artificial sequence
  SiRNA target sequence
attgaagtggaagtagagccag

SEQ ID NO: 150961 - DNA, 22 bp, Artificial sequence
  SiRNA target sequence
ttgaagtggaagtagagccagg

SEQ ID NO: 150962 - DNA, 22 bp, Artificial sequence
  SiRNA target sequence
tgaagtggaagtagagccagga

SEQ ID NO: 150963 - DNA, 22 bp, Artificial sequence
  SiRNA target sequence
gaagtggaagtagagccaggag

SEQ ID NO: 150964 - DNA, 22 bp, Artificial sequence
  SiRNA target sequence
aagtggaagtagagccaggagt

SEQ ID NO: 150965 - DNA, 22 bp, Artificial sequence
  SiRNA target sequence
agtggaagtagagccaggagta

SEQ ID NO: 150966 - DNA, 22 bp, Artificial sequence
  SiRNA target sequence
gtggaagtagagccaggagtac

SEQ ID NO: 150967 - DNA, 22 bp, Artificial sequence
  SiRNA target sequence
tggaagtagagccaggagtaca

SEQ ID NO: 150968 - DNA, 22 bp, Artificial sequence
  SiRNA target sequence
ggaagtagagccaggagtacag

SEQ ID NO: 150969 - DNA, 22 bp, Artificial sequence
  SiRNA target sequence
gaagtagagccaggagtacaga

SEQ ID NO: 150970 - DNA, 22 bp, Artificial sequence
  SiRNA target sequence
aagtagagccaggagtacagaa

SEQ ID NO: 150971 - DNA, 22 bp, Artificial sequence
  SiRNA target sequence
agtagagccaggagtacagaac

SEQ ID NO: 150972 - DNA, 22 bp, Artificial sequence
  SiRNA target sequence
gtagagccaggagtacagaacg

SEQ ID NO: 150973 - DNA, 22 bp, Artificial sequence
  SiRNA target sequence
tagagccaggagtacagaacgg

SEQ ID NO: 150974 - DNA, 22 bp, Artificial sequence
  SiRNA target sequence
agagccaggagtacagaacggt

SEQ ID NO: 150975 - DNA, 22 bp, Artificial sequence
  SiRNA target sequence
gagccaggagtacagaacggta

SEQ ID NO: 150976 - DNA, 22 bp, Artificial sequence
  SiRNA target sequence
agccaggagtacagaacggtag

SEQ ID NO: 150977 - DNA, 22 bp, Artificial sequence
  SiRNA target sequence
gccaggagtacagaacggtaga

SEQ ID NO: 150978 - DNA, 22 bp, Artificial sequence
  SiRNA target sequence
ccaggagtacagaacggtagaa

SEQ ID NO: 150979 - DNA, 22 bp, Artificial sequence
  SiRNA target sequence
caggagtacagaacggtagaaa

SEQ ID NO: 150980 - DNA, 22 bp, Artificial sequence
  SiRNA target sequence
aggagtacagaacggtagaaaa

SEQ ID NO: 150981 - DNA, 22 bp, Artificial sequence
  SiRNA target sequence
ggagtacagaacggtagaaaat

SEQ ID NO: 150982 - DNA, 22 bp, Artificial sequence
  SiRNA target sequence
gagtacagaacggtagaaaata

SEQ ID NO: 150983 - DNA, 22 bp, Artificial sequence
  SiRNA target sequence
agtacagaacggtagaaaatat

SEQ ID NO: 150984 - DNA, 22 bp, Artificial sequence
  SiRNA target sequence
gtacagaacggtagaaaatata

SEQ ID NO: 150985 - DNA, 22 bp, Artificial sequence
  SiRNA target sequence
tacagaacggtagaaaatatac

SEQ ID NO: 150986 - DNA, 22 bp, Artificial sequence
  SiRNA target sequence
acagaacggtagaaaatataca

SEQ ID NO: 150987 - DNA, 22 bp, Artificial sequence
  SiRNA target sequence
cagaacggtagaaaatatacat

SEQ ID NO: 150988 - DNA, 22 bp, Artificial sequence
  SiRNA target sequence
agaacggtagaaaatatacatt

SEQ ID NO: 150989 - DNA, 22 bp, Artificial sequence
  SiRNA target sequence
gaacggtagaaaatatacattt

SEQ ID NO: 150990 - DNA, 22 bp, Artificial sequence
  SiRNA target sequence
aacggtagaaaatatacatttt

SEQ ID NO: 150991 - DNA, 22 bp, Artificial sequence
  SiRNA target sequence
acggtagaaaatatacattttc

SEQ ID NO: 150992 - DNA, 22 bp, Artificial sequence
  SiRNA target sequence
cggtagaaaatatacattttct

SEQ ID NO: 150993 - DNA, 22 bp, Artificial sequence
  SiRNA target sequence
ggtagaaaatatacattttctg

SEQ ID NO: 150994 - DNA, 22 bp, Artificial sequence
  SiRNA target sequence
gtagaaaatatacattttctgg

SEQ ID NO: 150995 - DNA, 22 bp, Artificial sequence
  SiRNA target sequence
tagaaaatatacattttctggc

SEQ ID NO: 150996 - DNA, 22 bp, Artificial sequence
  SiRNA target sequence
agaaaatatacattttctggca

SEQ ID NO: 150997 - DNA, 22 bp, Artificial sequence
  SiRNA target sequence
gaaaatatacattttctggcaa

SEQ ID NO: 150998 - DNA, 22 bp, Artificial sequence
  SiRNA target sequence
aaaatatacattttctggcaaa

SEQ ID NO: 150999 - DNA, 22 bp, Artificial sequence
  SiRNA target sequence
aaatatacattttctggcaaag

SEQ ID NO: 151000 - DNA, 22 bp, Artificial sequence
  SiRNA target sequence
aatatacattttctggcaaagg

SEQ ID NO: 151001 - DNA, 22 bp, Artificial sequence
  SiRNA target sequence
atatacattttctggcaaagga

SEQ ID NO: 151002 - DNA, 22 bp, Artificial sequence
  SiRNA target sequence
tatacattttctggcaaaggaa

SEQ ID NO: 151003 - DNA, 22 bp, Artificial sequence
  SiRNA target sequence
atacattttctggcaaaggaaa

SEQ ID NO: 151004 - DNA, 22 bp, Artificial sequence
  SiRNA target sequence
tacattttctggcaaaggaaat

SEQ ID NO: 151005 - DNA, 22 bp, Artificial sequence
  SiRNA target sequence
acattttctggcaaaggaaatc

SEQ ID NO: 151006 - DNA, 22 bp, Artificial sequence
  SiRNA target sequence
cattttctggcaaaggaaatca

SEQ ID NO: 151007 - DNA, 22 bp, Artificial sequence
  SiRNA target sequence
attttctggcaaaggaaatcat

SEQ ID NO: 151008 - DNA, 22 bp, Artificial sequence
  SiRNA target sequence
ttttctggcaaaggaaatcata

SEQ ID NO: 151009 - DNA, 22 bp, Artificial sequence
  SiRNA target sequence
tttctggcaaaggaaatcataa

SEQ ID NO: 151010 - DNA, 22 bp, Artificial sequence
  SiRNA target sequence
ttctggcaaaggaaatcataaa

SEQ ID NO: 151011 - DNA, 22 bp, Artificial sequence
  SiRNA target sequence
tctggcaaaggaaatcataaaa

SEQ ID NO: 151012 - DNA, 22 bp, Artificial sequence
  SiRNA target sequence
ctggcaaaggaaatcataaaaa

SEQ ID NO: 151013 - DNA, 22 bp, Artificial sequence
  SiRNA target sequence
tggcaaaggaaatcataaaaaa

SEQ ID NO: 151014 - DNA, 22 bp, Artificial sequence
  SiRNA target sequence
ggcaaaggaaatcataaaaaaa

SEQ ID NO: 151015 - DNA, 22 bp, Artificial sequence
  SiRNA target sequence
gcaaaggaaatcataaaaaaaa

SEQ ID NO: 151016 - DNA, 22 bp, Artificial sequence
  SiRNA target sequence
caaaggaaatcataaaaaaaat

SEQ ID NO: 151017 - DNA, 22 bp, Artificial sequence
  SiRNA target sequence
aaaggaaatcataaaaaaaatt

SEQ ID NO: 151018 - DNA, 22 bp, Artificial sequence
  SiRNA target sequence
aaggaaatcataaaaaaaattg

SEQ ID NO: 151019 - DNA, 22 bp, Artificial sequence
  SiRNA target sequence
aggaaatcataaaaaaaattgt

SEQ ID NO: 151020 - DNA, 22 bp, Artificial sequence
  SiRNA target sequence
ggaaatcataaaaaaaattgtg

SEQ ID NO: 151021 - DNA, 22 bp, Artificial sequence
  SiRNA target sequence
gaaatcataaaaaaaattgtgt

SEQ ID NO: 151022 - DNA, 22 bp, Artificial sequence
  SiRNA target sequence
aaatcataaaaaaaattgtgta

SEQ ID NO: 151023 - DNA, 22 bp, Artificial sequence
  SiRNA target sequence
aatcataaaaaaaattgtgtac

SEQ ID NO: 151024 - DNA, 22 bp, Artificial sequence
  SiRNA target sequence
atcataaaaaaaattgtgtacc

SEQ ID NO: 151025 - DNA, 22 bp, Artificial sequence
  SiRNA target sequence
tcataaaaaaaattgtgtaccg

SEQ ID NO: 151026 - DNA, 22 bp, Artificial sequence
  SiRNA target sequence
cataaaaaaaattgtgtaccgg

SEQ ID NO: 151027 - DNA, 22 bp, Artificial sequence
  SiRNA target sequence
ataaaaaaaattgtgtaccggg

SEQ ID NO: 151028 - DNA, 22 bp, Artificial sequence
  SiRNA target sequence
taaaaaaaattgtgtaccgggt

SEQ ID NO: 151029 - DNA, 22 bp, Artificial sequence
  SiRNA target sequence
aaaaaaaattgtgtaccgggtg

SEQ ID NO: 151030 - DNA, 22 bp, Artificial sequence
  SiRNA target sequence
aaaaaaattgtgtaccgggtga

SEQ ID NO: 151031 - DNA, 22 bp, Artificial sequence
  SiRNA target sequence
aaaaaattgtgtaccgggtgat

SEQ ID NO: 151032 - DNA, 22 bp, Artificial sequence
  SiRNA target sequence
aaaaattgtgtaccgggtgatg

SEQ ID NO: 151033 - DNA, 22 bp, Artificial sequence
  SiRNA target sequence
aaaattgtgtaccgggtgatgt

SEQ ID NO: 151034 - DNA, 22 bp, Artificial sequence
  SiRNA target sequence
aaattgtgtaccgggtgatgtg

SEQ ID NO: 151035 - DNA, 22 bp, Artificial sequence
  SiRNA target sequence
aattgtgtaccgggtgatgtga

SEQ ID NO: 151036 - DNA, 22 bp, Artificial sequence
  SiRNA target sequence
attgtgtaccgggtgatgtgat

SEQ ID NO: 151037 - DNA, 22 bp, Artificial sequence
  SiRNA target sequence
ttgtgtaccgggtgatgtgatt

SEQ ID NO: 151038 - DNA, 22 bp, Artificial sequence
  SiRNA target sequence
tgtgtaccgggtgatgtgattc

SEQ ID NO: 151039 - DNA, 22 bp, Artificial sequence
  SiRNA target sequence
gtgtaccgggtgatgtgattct

SEQ ID NO: 151040 - DNA, 22 bp, Artificial sequence
  SiRNA target sequence
tgtaccgggtgatgtgattctt

SEQ ID NO: 151041 - DNA, 22 bp, Artificial sequence
  SiRNA target sequence
gtaccgggtgatgtgattctta

SEQ ID NO: 151042 - DNA, 22 bp, Artificial sequence
  SiRNA target sequence
taccgggtgatgtgattcttat

SEQ ID NO: 151043 - DNA, 22 bp, Artificial sequence
  SiRNA target sequence
accgggtgatgtgattcttatt

SEQ ID NO: 151044 - DNA, 22 bp, Artificial sequence
  SiRNA target sequence
ccgggtgatgtgattcttattg

SEQ ID NO: 151045 - DNA, 22 bp, Artificial sequence
  SiRNA target sequence
cgggtgatgtgattcttattgt

SEQ ID NO: 151046 - DNA, 22 bp, Artificial sequence
  SiRNA target sequence
gggtgatgtgattcttattgta

SEQ ID NO: 151047 - DNA, 22 bp, Artificial sequence
  SiRNA target sequence
ggtgatgtgattcttattgtaa

SEQ ID NO: 151048 - DNA, 22 bp, Artificial sequence
  SiRNA target sequence
gtgatgtgattcttattgtaaa

SEQ ID NO: 151049 - DNA, 22 bp, Artificial sequence
  SiRNA target sequence
tgatgtgattcttattgtaaac

SEQ ID NO: 151050 - DNA, 22 bp, Artificial sequence
  SiRNA target sequence
gatgtgattcttattgtaaaca

SEQ ID NO: 151051 - DNA, 22 bp, Artificial sequence
  SiRNA target sequence
atgtgattcttattgtaaacat

SEQ ID NO: 151052 - DNA, 22 bp, Artificial sequence
  SiRNA target sequence
tgtgattcttattgtaaacatt

SEQ ID NO: 151053 - DNA, 22 bp, Artificial sequence
  SiRNA target sequence
gtgattcttattgtaaacatta

SEQ ID NO: 151054 - DNA, 22 bp, Artificial sequence
  SiRNA target sequence
tgattcttattgtaaacattac

SEQ ID NO: 151055 - DNA, 22 bp, Artificial sequence
  SiRNA target sequence
gattcttattgtaaacattaca

SEQ ID NO: 151056 - DNA, 22 bp, Artificial sequence
  SiRNA target sequence
attcttattgtaaacattacaa

SEQ ID NO: 151057 - DNA, 22 bp, Artificial sequence
  SiRNA target sequence
ttcttattgtaaacattacaaa

SEQ ID NO: 151058 - DNA, 22 bp, Artificial sequence
  SiRNA target sequence
tcttattgtaaacattacaaat

SEQ ID NO: 151059 - DNA, 22 bp, Artificial sequence
  SiRNA target sequence
cttattgtaaacattacaaatg

SEQ ID NO: 151060 - DNA, 22 bp, Artificial sequence
  SiRNA target sequence
ttattgtaaacattacaaatga

SEQ ID NO: 151061 - DNA, 22 bp, Artificial sequence
  SiRNA target sequence
tattgtaaacattacaaatgat

SEQ ID NO: 151062 - DNA, 22 bp, Artificial sequence
  SiRNA target sequence
attgtaaacattacaaatgatc

SEQ ID NO: 151063 - DNA, 22 bp, Artificial sequence
  SiRNA target sequence
ttgtaaacattacaaatgatcc

SEQ ID NO: 151064 - DNA, 22 bp, Artificial sequence
  SiRNA target sequence
tgtaaacattacaaatgatcca

SEQ ID NO: 151065 - DNA, 22 bp, Artificial sequence
  SiRNA target sequence
gtaaacattacaaatgatccaa

SEQ ID NO: 151066 - DNA, 22 bp, Artificial sequence
  SiRNA target sequence
taaacattacaaatgatccaag

SEQ ID NO: 151067 - DNA, 22 bp, Artificial sequence
  SiRNA target sequence
aaacattacaaatgatccaaga

SEQ ID NO: 151068 - DNA, 22 bp, Artificial sequence
  SiRNA target sequence
aacattacaaatgatccaagat

SEQ ID NO: 151069 - DNA, 22 bp, Artificial sequence
  SiRNA target sequence
acattacaaatgatccaagatt

SEQ ID NO: 151070 - DNA, 22 bp, Artificial sequence
  SiRNA target sequence
cattacaaatgatccaagattt

SEQ ID NO: 151071 - DNA, 22 bp, Artificial sequence
  SiRNA target sequence
attacaaatgatccaagattta

SEQ ID NO: 151072 - DNA, 22 bp, Artificial sequence
  SiRNA target sequence
ttacaaatgatccaagatttag

SEQ ID NO: 151073 - DNA, 22 bp, Artificial sequence
  SiRNA target sequence
tacaaatgatccaagatttaga

SEQ ID NO: 151074 - DNA, 22 bp, Artificial sequence
  SiRNA target sequence
acaaatgatccaagatttagaa

SEQ ID NO: 151075 - DNA, 22 bp, Artificial sequence
  SiRNA target sequence
caaatgatccaagatttagaaa

SEQ ID NO: 151076 - DNA, 22 bp, Artificial sequence
  SiRNA target sequence
aaatgatccaagatttagaaaa

SEQ ID NO: 151077 - DNA, 22 bp, Artificial sequence
  SiRNA target sequence
aatgatccaagatttagaaaaa

SEQ ID NO: 151078 - DNA, 22 bp, Artificial sequence
  SiRNA target sequence
atgatccaagatttagaaaaag

SEQ ID NO: 151079 - DNA, 22 bp, Artificial sequence
  SiRNA target sequence
tgatccaagatttagaaaaagt

SEQ ID NO: 151080 - DNA, 22 bp, Artificial sequence
  SiRNA target sequence
gatccaagatttagaaaaagtg

SEQ ID NO: 151081 - DNA, 22 bp, Artificial sequence
  SiRNA target sequence
atccaagatttagaaaaagtgg

SEQ ID NO: 151082 - DNA, 22 bp, Artificial sequence
  SiRNA target sequence
tccaagatttagaaaaagtgga

SEQ ID NO: 151083 - DNA, 22 bp, Artificial sequence
  SiRNA target sequence
ccaagatttagaaaaagtggat

SEQ ID NO: 151084 - DNA, 22 bp, Artificial sequence
  SiRNA target sequence
caagatttagaaaaagtggata

SEQ ID NO: 151085 - DNA, 22 bp, Artificial sequence
  SiRNA target sequence
aagatttagaaaaagtggatat

SEQ ID NO: 151086 - DNA, 22 bp, Artificial sequence
  SiRNA target sequence
agatttagaaaaagtggatata

SEQ ID NO: 151087 - DNA, 22 bp, Artificial sequence
  SiRNA target sequence
gatttagaaaaagtggatataa

SEQ ID NO: 151088 - DNA, 22 bp, Artificial sequence
  SiRNA target sequence
atttagaaaaagtggatataat

SEQ ID NO: 151089 - DNA, 22 bp, Artificial sequence
  SiRNA target sequence
tttagaaaaagtggatataatt

SEQ ID NO: 151090 - DNA, 22 bp, Artificial sequence
  SiRNA target sequence
ttagaaaaagtggatataattt

SEQ ID NO: 151091 - DNA, 22 bp, Artificial sequence
  SiRNA target sequence
tagaaaaagtggatataattta

SEQ ID NO: 151092 - DNA, 22 bp, Artificial sequence
  SiRNA target sequence
agaaaaagtggatataatttaa

SEQ ID NO: 151093 - DNA, 22 bp, Artificial sequence
  SiRNA target sequence
gaaaaagtggatataatttaat

SEQ ID NO: 151094 - DNA, 22 bp, Artificial sequence
  SiRNA target sequence
aaaaagtggatataatttaatt

SEQ ID NO: 151095 - DNA, 22 bp, Artificial sequence
  SiRNA target sequence
aaaagtggatataatttaatta

SEQ ID NO: 151096 - DNA, 22 bp, Artificial sequence
  SiRNA target sequence
aaagtggatataatttaattag

SEQ ID NO: 151097 - DNA, 22 bp, Artificial sequence
  SiRNA target sequence
aagtggatataatttaattagt

SEQ ID NO: 151098 - DNA, 22 bp, Artificial sequence
  SiRNA target sequence
agtggatataatttaattagta

SEQ ID NO: 151099 - DNA, 22 bp, Artificial sequence
  SiRNA target sequence
gtggatataatttaattagtaa

SEQ ID NO: 151100 - DNA, 22 bp, Artificial sequence
  SiRNA target sequence
tggatataatttaattagtaag

SEQ ID NO: 151101 - DNA, 22 bp, Artificial sequence
  SiRNA target sequence
ggatataatttaattagtaagg

SEQ ID NO: 151102 - DNA, 22 bp, Artificial sequence
  SiRNA target sequence
gatataatttaattagtaaggt

SEQ ID NO: 151103 - DNA, 22 bp, Artificial sequence
  SiRNA target sequence
atataatttaattagtaaggtt

SEQ ID NO: 151104 - DNA, 22 bp, Artificial sequence
  SiRNA target sequence
tataatttaattagtaaggttg

SEQ ID NO: 151105 - DNA, 22 bp, Artificial sequence
  SiRNA target sequence
ataatttaattagtaaggttga

SEQ ID NO: 151106 - DNA, 22 bp, Artificial sequence
  SiRNA target sequence
taatttaattagtaaggttgat

SEQ ID NO: 151107 - DNA, 22 bp, Artificial sequence
  SiRNA target sequence
aatttaattagtaaggttgata

SEQ ID NO: 151108 - DNA, 22 bp, Artificial sequence
  SiRNA target sequence
atttaattagtaaggttgatat

SEQ ID NO: 151109 - DNA, 22 bp, Artificial sequence
  SiRNA target sequence
tttaattagtaaggttgatatt

SEQ ID NO: 151110 - DNA, 22 bp, Artificial sequence
  SiRNA target sequence
ttaattagtaaggttgatattc

SEQ ID NO: 151111 - DNA, 22 bp, Artificial sequence
  SiRNA target sequence
taattagtaaggttgatattcc

SEQ ID NO: 151112 - DNA, 22 bp, Artificial sequence
  SiRNA target sequence
aattagtaaggttgatattcca

SEQ ID NO: 151113 - DNA, 22 bp, Artificial sequence
  SiRNA target sequence
attagtaaggttgatattccat

SEQ ID NO: 151114 - DNA, 22 bp, Artificial sequence
  SiRNA target sequence
ttagtaaggttgatattccatt

SEQ ID NO: 151115 - DNA, 22 bp, Artificial sequence
  SiRNA target sequence
tagtaaggttgatattccattg

SEQ ID NO: 151116 - DNA, 22 bp, Artificial sequence
  SiRNA target sequence
agtaaggttgatattccattgt

SEQ ID NO: 151117 - DNA, 22 bp, Artificial sequence
  SiRNA target sequence
gtaaggttgatattccattgta

SEQ ID NO: 151118 - DNA, 22 bp, Artificial sequence
  SiRNA target sequence
taaggttgatattccattgtat

SEQ ID NO: 151119 - DNA, 22 bp, Artificial sequence
  SiRNA target sequence
aaggttgatattccattgtatg

SEQ ID NO: 151120 - DNA, 22 bp, Artificial sequence
  SiRNA target sequence
aggttgatattccattgtatgt

SEQ ID NO: 151121 - DNA, 22 bp, Artificial sequence
  SiRNA target sequence
ggttgatattccattgtatgtt

SEQ ID NO: 151122 - DNA, 22 bp, Artificial sequence
  SiRNA target sequence
gttgatattccattgtatgttg

SEQ ID NO: 151123 - DNA, 22 bp, Artificial sequence
  SiRNA target sequence
ttgatattccattgtatgttgc

SEQ ID NO: 151124 - DNA, 22 bp, Artificial sequence
  SiRNA target sequence
tgatattccattgtatgttgct

SEQ ID NO: 151125 - DNA, 22 bp, Artificial sequence
  SiRNA target sequence
gatattccattgtatgttgctt

SEQ ID NO: 151126 - DNA, 22 bp, Artificial sequence
  SiRNA target sequence
atattccattgtatgttgcttt

SEQ ID NO: 151127 - DNA, 22 bp, Artificial sequence
  SiRNA target sequence
tattccattgtatgttgctttg

SEQ ID NO: 151128 - DNA, 22 bp, Artificial sequence
  SiRNA target sequence
attccattgtatgttgctttgg

SEQ ID NO: 151129 - DNA, 22 bp, Artificial sequence
  SiRNA target sequence
ttccattgtatgttgctttggc

SEQ ID NO: 151130 - DNA, 22 bp, Artificial sequence
  SiRNA target sequence
tccattgtatgttgctttggca

SEQ ID NO: 151131 - DNA, 22 bp, Artificial sequence
  SiRNA target sequence
ccattgtatgttgctttggcag

SEQ ID NO: 151132 - DNA, 22 bp, Artificial sequence
  SiRNA target sequence
cattgtatgttgctttggcagg

SEQ ID NO: 151133 - DNA, 22 bp, Artificial sequence
  SiRNA target sequence
attgtatgttgctttggcaggc

SEQ ID NO: 151134 - DNA, 22 bp, Artificial sequence
  SiRNA target sequence
ttgtatgttgctttggcaggcg

SEQ ID NO: 151135 - DNA, 22 bp, Artificial sequence
  SiRNA target sequence
tgtatgttgctttggcaggcgg

SEQ ID NO: 151136 - DNA, 22 bp, Artificial sequence
  SiRNA target sequence
gtatgttgctttggcaggcgga

SEQ ID NO: 151137 - DNA, 22 bp, Artificial sequence
  SiRNA target sequence
tatgttgctttggcaggcggac

SEQ ID NO: 151138 - DNA, 22 bp, Artificial sequence
  SiRNA target sequence
atgttgctttggcaggcggaca

SEQ ID NO: 151139 - DNA, 22 bp, Artificial sequence
  SiRNA target sequence
tgttgctttggcaggcggacag

SEQ ID NO: 151140 - DNA, 22 bp, Artificial sequence
  SiRNA target sequence
gttgctttggcaggcggacaga

SEQ ID NO: 151141 - DNA, 22 bp, Artificial sequence
  SiRNA target sequence
ttgctttggcaggcggacagat

SEQ ID NO: 151142 - DNA, 22 bp, Artificial sequence
  SiRNA target sequence
tgctttggcaggcggacagatt

SEQ ID NO: 151143 - DNA, 22 bp, Artificial sequence
  SiRNA target sequence
gctttggcaggcggacagatta

SEQ ID NO: 151144 - DNA, 22 bp, Artificial sequence
  SiRNA target sequence
ctttggcaggcggacagattat

SEQ ID NO: 151145 - DNA, 22 bp, Artificial sequence
  SiRNA target sequence
tttggcaggcggacagattata

SEQ ID NO: 151146 - DNA, 22 bp, Artificial sequence
  SiRNA target sequence
ttggcaggcggacagattatat

SEQ ID NO: 151147 - DNA, 22 bp, Artificial sequence
  SiRNA target sequence
tggcaggcggacagattatatt

SEQ ID NO: 151148 - DNA, 22 bp, Artificial sequence
  SiRNA target sequence
ggcaggcggacagattatattt

SEQ ID NO: 151149 - DNA, 22 bp, Artificial sequence
  SiRNA target sequence
gcaggcggacagattatatttg

SEQ ID NO: 151150 - DNA, 22 bp, Artificial sequence
  SiRNA target sequence
caggcggacagattatatttga

SEQ ID NO: 151151 - DNA, 22 bp, Artificial sequence
  SiRNA target sequence
aggcggacagattatatttgaa

SEQ ID NO: 151152 - DNA, 22 bp, Artificial sequence
  SiRNA target sequence
ggcggacagattatatttgaac

SEQ ID NO: 151153 - DNA, 22 bp, Artificial sequence
  SiRNA target sequence
gcggacagattatatttgaaca

SEQ ID NO: 151154 - DNA, 22 bp, Artificial sequence
  SiRNA target sequence
cggacagattatatttgaacat

SEQ ID NO: 151155 - DNA, 22 bp, Artificial sequence
  SiRNA target sequence
ggacagattatatttgaacata

SEQ ID NO: 151156 - DNA, 22 bp, Artificial sequence
  SiRNA target sequence
gacagattatatttgaacatat

SEQ ID NO: 151157 - DNA, 22 bp, Artificial sequence
  SiRNA target sequence
acagattatatttgaacatatc

SEQ ID NO: 151158 - DNA, 22 bp, Artificial sequence
  SiRNA target sequence
cagattatatttgaacatatca

SEQ ID NO: 151159 - DNA, 22 bp, Artificial sequence
  SiRNA target sequence
agattatatttgaacatatcac

SEQ ID NO: 151160 - DNA, 22 bp, Artificial sequence
  SiRNA target sequence
gattatatttgaacatatcact

SEQ ID NO: 151161 - DNA, 22 bp, Artificial sequence
  SiRNA target sequence
attatatttgaacatatcactg

SEQ ID NO: 151162 - DNA, 22 bp, Artificial sequence
  SiRNA target sequence
ttatatttgaacatatcactgg

SEQ ID NO: 151163 - DNA, 22 bp, Artificial sequence
  SiRNA target sequence
tatatttgaacatatcactggt

SEQ ID NO: 151164 - DNA, 22 bp, Artificial sequence
  SiRNA target sequence
atatttgaacatatcactggta

SEQ ID NO: 151165 - DNA, 22 bp, Artificial sequence
  SiRNA target sequence
tatttgaacatatcactggtaa

SEQ ID NO: 151166 - DNA, 22 bp, Artificial sequence
  SiRNA target sequence
atttgaacatatcactggtaag

SEQ ID NO: 151167 - DNA, 22 bp, Artificial sequence
  SiRNA target sequence
tttgaacatatcactggtaaga

SEQ ID NO: 151168 - DNA, 22 bp, Artificial sequence
  SiRNA target sequence
ttgaacatatcactggtaagaa

SEQ ID NO: 151169 - DNA, 22 bp, Artificial sequence
  SiRNA target sequence
tgaacatatcactggtaagaaa

SEQ ID NO: 151170 - DNA, 22 bp, Artificial sequence
  SiRNA target sequence
gaacatatcactggtaagaaat

SEQ ID NO: 151171 - DNA, 22 bp, Artificial sequence
  SiRNA target sequence
aacatatcactggtaagaaatt

SEQ ID NO: 151172 - DNA, 22 bp, Artificial sequence
  SiRNA target sequence
acatatcactggtaagaaattt

SEQ ID NO: 151173 - DNA, 22 bp, Artificial sequence
  SiRNA target sequence
catatcactggtaagaaatttg

SEQ ID NO: 151174 - DNA, 22 bp, Artificial sequence
  SiRNA target sequence
atatcactggtaagaaatttga

SEQ ID NO: 151175 - DNA, 22 bp, Artificial sequence
  SiRNA target sequence
tatcactggtaagaaatttgaa

SEQ ID NO: 151176 - DNA, 22 bp, Artificial sequence
  SiRNA target sequence
atcactggtaagaaatttgaaa

SEQ ID NO: 151177 - DNA, 22 bp, Artificial sequence
  SiRNA target sequence
tcactggtaagaaatttgaaat

SEQ ID NO: 151178 - DNA, 22 bp, Artificial sequence
  SiRNA target sequence
cactggtaagaaatttgaaatt

SEQ ID NO: 151179 - DNA, 22 bp, Artificial sequence
  SiRNA target sequence
actggtaagaaatttgaaatta

SEQ ID NO: 151180 - DNA, 22 bp, Artificial sequence
  SiRNA target sequence
ctggtaagaaatttgaaattac

SEQ ID NO: 151181 - DNA, 22 bp, Artificial sequence
  SiRNA target sequence
tggtaagaaatttgaaattact

SEQ ID NO: 151182 - DNA, 22 bp, Artificial sequence
  SiRNA target sequence
ggtaagaaatttgaaattactt

SEQ ID NO: 151183 - DNA, 22 bp, Artificial sequence
  SiRNA target sequence
gtaagaaatttgaaattacttt

SEQ ID NO: 151184 - DNA, 22 bp, Artificial sequence
  SiRNA target sequence
taagaaatttgaaattacttta

SEQ ID NO: 151185 - DNA, 22 bp, Artificial sequence
  SiRNA target sequence
aagaaatttgaaattactttat

SEQ ID NO: 151186 - DNA, 22 bp, Artificial sequence
  SiRNA target sequence
agaaatttgaaattactttata

SEQ ID NO: 151187 - DNA, 22 bp, Artificial sequence
  SiRNA target sequence
gaaatttgaaattactttatat

SEQ ID NO: 151188 - DNA, 22 bp, Artificial sequence
  SiRNA target sequence
aaatttgaaattactttatatc

SEQ ID NO: 151189 - DNA, 22 bp, Artificial sequence
  SiRNA target sequence
aatttgaaattactttatatcc

SEQ ID NO: 151190 - DNA, 22 bp, Artificial sequence
  SiRNA target sequence
atttgaaattactttatatcca

SEQ ID NO: 151191 - DNA, 22 bp, Artificial sequence
  SiRNA target sequence
tttgaaattactttatatccat

SEQ ID NO: 151192 - DNA, 22 bp, Artificial sequence
  SiRNA target sequence
ttgaaattactttatatccatt

SEQ ID NO: 151193 - DNA, 22 bp, Artificial sequence
  SiRNA target sequence
tgaaattactttatatccattt

SEQ ID NO: 151194 - DNA, 22 bp, Artificial sequence
  SiRNA target sequence
gaaattactttatatccattta

SEQ ID NO: 151195 - DNA, 22 bp, Artificial sequence
  SiRNA target sequence
aaattactttatatccatttaa

SEQ ID NO: 151196 - DNA, 22 bp, Artificial sequence
  SiRNA target sequence
aattactttatatccatttaaa

SEQ ID NO: 151197 - DNA, 22 bp, Artificial sequence
  SiRNA target sequence
attactttatatccatttaaag

SEQ ID NO: 151198 - DNA, 22 bp, Artificial sequence
  SiRNA target sequence
ttactttatatccatttaaaga

SEQ ID NO: 151199 - DNA, 22 bp, Artificial sequence
  SiRNA target sequence
tactttatatccatttaaagat

SEQ ID NO: 151200 - DNA, 22 bp, Artificial sequence
  SiRNA target sequence
actttatatccatttaaagatt

SEQ ID NO: 151201 - DNA, 22 bp, Artificial sequence
  SiRNA target sequence
ctttatatccatttaaagattt

SEQ ID NO: 151202 - DNA, 22 bp, Artificial sequence
  SiRNA target sequence
tttatatccatttaaagattta

SEQ ID NO: 151203 - DNA, 22 bp, Artificial sequence
  SiRNA target sequence
ttatatccatttaaagatttaa

SEQ ID NO: 151204 - DNA, 22 bp, Artificial sequence
  SiRNA target sequence
tatatccatttaaagatttaaa

SEQ ID NO: 151205 - DNA, 22 bp, Artificial sequence
  SiRNA target sequence
atatccatttaaagatttaaag

SEQ ID NO: 151206 - DNA, 22 bp, Artificial sequence
  SiRNA target sequence
tatccatttaaagatttaaaga

SEQ ID NO: 151207 - DNA, 22 bp, Artificial sequence
  SiRNA target sequence
atccatttaaagatttaaagaa

SEQ ID NO: 151208 - DNA, 22 bp, Artificial sequence
  SiRNA target sequence
tccatttaaagatttaaagaaa

SEQ ID NO: 151209 - DNA, 22 bp, Artificial sequence
  SiRNA target sequence
ccatttaaagatttaaagaaat

SEQ ID NO: 151210 - DNA, 22 bp, Artificial sequence
  SiRNA target sequence
catttaaagatttaaagaaatg

SEQ ID NO: 151211 - DNA, 22 bp, Artificial sequence
  SiRNA target sequence
atttaaagatttaaagaaatgt

SEQ ID NO: 151212 - DNA, 22 bp, Artificial sequence
  SiRNA target sequence
tttaaagatttaaagaaatgta

SEQ ID NO: 151213 - DNA, 22 bp, Artificial sequence
  SiRNA target sequence
ttaaagatttaaagaaatgtat

SEQ ID NO: 151214 - DNA, 22 bp, Artificial sequence
  SiRNA target sequence
taaagatttaaagaaatgtatt

SEQ ID NO: 151215 - DNA, 22 bp, Artificial sequence
  SiRNA target sequence
aaagatttaaagaaatgtatta

SEQ ID NO: 151216 - DNA, 22 bp, Artificial sequence
  SiRNA target sequence
aagatttaaagaaatgtattat

SEQ ID NO: 151217 - DNA, 22 bp, Artificial sequence
  SiRNA target sequence
agatttaaagaaatgtattatt

SEQ ID NO: 151218 - DNA, 22 bp, Artificial sequence
  SiRNA target sequence
gatttaaagaaatgtattattt

SEQ ID NO: 151219 - DNA, 22 bp, Artificial sequence
  SiRNA target sequence
atttaaagaaatgtattatttt

SEQ ID NO: 151220 - DNA, 22 bp, Artificial sequence
  SiRNA target sequence
tttaaagaaatgtattatttta

SEQ ID NO: 151221 - DNA, 22 bp, Artificial sequence
  SiRNA target sequence
ttaaagaaatgtattattttaa

SEQ ID NO: 151222 - DNA, 22 bp, Artificial sequence
  SiRNA target sequence
taaagaaatgtattattttaaa

SEQ ID NO: 151223 - DNA, 22 bp, Artificial sequence
  SiRNA target sequence
aaagaaatgtattattttaaaa

SEQ ID NO: 151224 - DNA, 22 bp, Artificial sequence
  SiRNA target sequence
aagaaatgtattattttaaaag

SEQ ID NO: 151225 - DNA, 22 bp, Artificial sequence
  SiRNA target sequence
agaaatgtattattttaaaagg

SEQ ID NO: 151226 - DNA, 22 bp, Artificial sequence
  SiRNA target sequence
gaaatgtattattttaaaaggc

SEQ ID NO: 151227 - DNA, 22 bp, Artificial sequence
  SiRNA target sequence
aaatgtattattttaaaaggcg

SEQ ID NO: 151228 - DNA, 22 bp, Artificial sequence
  SiRNA target sequence
aatgtattattttaaaaggcga

SEQ ID NO: 151229 - DNA, 22 bp, Artificial sequence
  SiRNA target sequence
atgtattattttaaaaggcgaa

SEQ ID NO: 151230 - DNA, 22 bp, Artificial sequence
  SiRNA target sequence
tgtattattttaaaaggcgaag

SEQ ID NO: 151231 - DNA, 22 bp, Artificial sequence
  SiRNA target sequence
gtattattttaaaaggcgaagg

SEQ ID NO: 151232 - DNA, 22 bp, Artificial sequence
  SiRNA target sequence
tattattttaaaaggcgaaggt

SEQ ID NO: 151233 - DNA, 22 bp, Artificial sequence
  SiRNA target sequence
attattttaaaaggcgaaggtt

SEQ ID NO: 151234 - DNA, 22 bp, Artificial sequence
  SiRNA target sequence
ttattttaaaaggcgaaggttt

SEQ ID NO: 151235 - DNA, 22 bp, Artificial sequence
  SiRNA target sequence
tattttaaaaggcgaaggtttt

SEQ ID NO: 151236 - DNA, 22 bp, Artificial sequence
  SiRNA target sequence
attttaaaaggcgaaggtttta

SEQ ID NO: 151237 - DNA, 22 bp, Artificial sequence
  SiRNA target sequence
ttttaaaaggcgaaggttttaa

SEQ ID NO: 151238 - DNA, 22 bp, Artificial sequence
  SiRNA target sequence
tttaaaaggcgaaggttttaaa

SEQ ID NO: 151239 - DNA, 22 bp, Artificial sequence
  SiRNA target sequence
ttaaaaggcgaaggttttaaaa

SEQ ID NO: 151240 - DNA, 22 bp, Artificial sequence
  SiRNA target sequence
taaaaggcgaaggttttaaaat

SEQ ID NO: 151241 - DNA, 22 bp, Artificial sequence
  SiRNA target sequence
aaaaggcgaaggttttaaaata

SEQ ID NO: 151242 - DNA, 22 bp, Artificial sequence
  SiRNA target sequence
aaaggcgaaggttttaaaataa

SEQ ID NO: 151243 - DNA, 22 bp, Artificial sequence
  SiRNA target sequence
aaggcgaaggttttaaaataaa

SEQ ID NO: 151244 - DNA, 22 bp, Artificial sequence
  SiRNA target sequence
aggcgaaggttttaaaataaaa

SEQ ID NO: 151245 - DNA, 22 bp, Artificial sequence
  SiRNA target sequence
ggcgaaggttttaaaataaaaa

SEQ ID NO: 151246 - DNA, 22 bp, Artificial sequence
  SiRNA target sequence
gcgaaggttttaaaataaaaaa

SEQ ID NO: 151247 - DNA, 22 bp, Artificial sequence
  SiRNA target sequence
cgaaggttttaaaataaaaaat

SEQ ID NO: 151248 - DNA, 22 bp, Artificial sequence
  SiRNA target sequence
gaaggttttaaaataaaaaata

SEQ ID NO: 151249 - DNA, 22 bp, Artificial sequence
  SiRNA target sequence
aaggttttaaaataaaaaatag

SEQ ID NO: 151250 - DNA, 22 bp, Artificial sequence
  SiRNA target sequence
aggttttaaaataaaaaatagt

SEQ ID NO: 151251 - DNA, 22 bp, Artificial sequence
  SiRNA target sequence
ggttttaaaataaaaaatagtt

SEQ ID NO: 151252 - DNA, 22 bp, Artificial sequence
  SiRNA target sequence
gttttaaaataaaaaatagtta

SEQ ID NO: 151253 - DNA, 22 bp, Artificial sequence
  SiRNA target sequence
ttttaaaataaaaaatagttat

SEQ ID NO: 151254 - DNA, 22 bp, Artificial sequence
  SiRNA target sequence
tttaaaataaaaaatagttatt

SEQ ID NO: 151255 - DNA, 22 bp, Artificial sequence
  SiRNA target sequence
ttaaaataaaaaatagttattc

SEQ ID NO: 151256 - DNA, 22 bp, Artificial sequence
  SiRNA target sequence
taaaataaaaaatagttattcg

SEQ ID NO: 151257 - DNA, 22 bp, Artificial sequence
  SiRNA target sequence
aaaataaaaaatagttattcgg

SEQ ID NO: 151258 - DNA, 22 bp, Artificial sequence
  SiRNA target sequence
aaataaaaaatagttattcggg

SEQ ID NO: 151259 - DNA, 22 bp, Artificial sequence
  SiRNA target sequence
aataaaaaatagttattcgggt

SEQ ID NO: 151260 - DNA, 22 bp, Artificial sequence
  SiRNA target sequence
ataaaaaatagttattcgggtg

SEQ ID NO: 151261 - DNA, 22 bp, Artificial sequence
  SiRNA target sequence
taaaaaatagttattcgggtgg

SEQ ID NO: 151262 - DNA, 22 bp, Artificial sequence
  SiRNA target sequence
aaaaaatagttattcgggtggt

SEQ ID NO: 151263 - DNA, 22 bp, Artificial sequence
  SiRNA target sequence
aaaaatagttattcgggtggtg

SEQ ID NO: 151264 - DNA, 22 bp, Artificial sequence
  SiRNA target sequence
aaaatagttattcgggtggtga

SEQ ID NO: 151265 - DNA, 22 bp, Artificial sequence
  SiRNA target sequence
aaatagttattcgggtggtgat

SEQ ID NO: 151266 - DNA, 22 bp, Artificial sequence
  SiRNA target sequence
aatagttattcgggtggtgatc

SEQ ID NO: 151267 - DNA, 22 bp, Artificial sequence
  SiRNA target sequence
atagttattcgggtggtgatct

SEQ ID NO: 151268 - DNA, 22 bp, Artificial sequence
  SiRNA target sequence
tagttattcgggtggtgatctt

SEQ ID NO: 151269 - DNA, 22 bp, Artificial sequence
  SiRNA target sequence
agttattcgggtggtgatctta

SEQ ID NO: 151270 - DNA, 22 bp, Artificial sequence
  SiRNA target sequence
gttattcgggtggtgatcttat

SEQ ID NO: 151271 - DNA, 22 bp, Artificial sequence
  SiRNA target sequence
ttattcgggtggtgatcttatt

SEQ ID NO: 151272 - DNA, 22 bp, Artificial sequence
  SiRNA target sequence
tattcgggtggtgatcttattc

SEQ ID NO: 151273 - DNA, 22 bp, Artificial sequence
  SiRNA target sequence
attcgggtggtgatcttattct

SEQ ID NO: 151274 - DNA, 22 bp, Artificial sequence
  SiRNA target sequence
ttcgggtggtgatcttattctc

SEQ ID NO: 151275 - DNA, 22 bp, Artificial sequence
  SiRNA target sequence
tcgggtggtgatcttattctcg

SEQ ID NO: 151276 - DNA, 22 bp, Artificial sequence
  SiRNA target sequence
cgggtggtgatcttattctcga

SEQ ID NO: 151277 - DNA, 22 bp, Artificial sequence
  SiRNA target sequence
gggtggtgatcttattctcgaa

SEQ ID NO: 151278 - DNA, 22 bp, Artificial sequence
  SiRNA target sequence
ggtggtgatcttattctcgaac

SEQ ID NO: 151279 - DNA, 22 bp, Artificial sequence
  SiRNA target sequence
gtggtgatcttattctcgaacc

SEQ ID NO: 151280 - DNA, 22 bp, Artificial sequence
  SiRNA target sequence
tggtgatcttattctcgaacct

SEQ ID NO: 151281 - DNA, 22 bp, Artificial sequence
  SiRNA target sequence
ggtgatcttattctcgaaccta

SEQ ID NO: 151282 - DNA, 22 bp, Artificial sequence
  SiRNA target sequence
gtgatcttattctcgaacctaa

SEQ ID NO: 151283 - DNA, 22 bp, Artificial sequence
  SiRNA target sequence
tgatcttattctcgaacctaat

SEQ ID NO: 151284 - DNA, 22 bp, Artificial sequence
  SiRNA target sequence
gatcttattctcgaacctaata

SEQ ID NO: 151285 - DNA, 22 bp, Artificial sequence
  SiRNA target sequence
atcttattctcgaacctaatat

SEQ ID NO: 151286 - DNA, 22 bp, Artificial sequence
  SiRNA target sequence
tcttattctcgaacctaatata

SEQ ID NO: 151287 - DNA, 22 bp, Artificial sequence
  SiRNA target sequence
cttattctcgaacctaatataa

SEQ ID NO: 151288 - DNA, 22 bp, Artificial sequence
  SiRNA target sequence
ttattctcgaacctaatataat

SEQ ID NO: 151289 - DNA, 22 bp, Artificial sequence
  SiRNA target sequence
tattctcgaacctaatataatt

SEQ ID NO: 151290 - DNA, 22 bp, Artificial sequence
  SiRNA target sequence
attctcgaacctaatataatta

SEQ ID NO: 151291 - DNA, 22 bp, Artificial sequence
  SiRNA target sequence
ttctcgaacctaatataattat

SEQ ID NO: 151292 - DNA, 22 bp, Artificial sequence
  SiRNA target sequence
tctcgaacctaatataattata

SEQ ID NO: 151293 - DNA, 22 bp, Artificial sequence
  SiRNA target sequence
ctcgaacctaatataattatag

SEQ ID NO: 151294 - DNA, 22 bp, Artificial sequence
  SiRNA target sequence
tcgaacctaatataattataga

SEQ ID NO: 151295 - DNA, 22 bp, Artificial sequence
  SiRNA target sequence
cgaacctaatataattatagat

SEQ ID NO: 151296 - DNA, 22 bp, Artificial sequence
  SiRNA target sequence
gaacctaatataattatagata

SEQ ID NO: 151297 - DNA, 22 bp, Artificial sequence
  SiRNA target sequence
aacctaatataattatagataa

SEQ ID NO: 151298 - DNA, 22 bp, Artificial sequence
  SiRNA target sequence
acctaatataattatagataag

SEQ ID NO: 151299 - DNA, 22 bp, Artificial sequence
  SiRNA target sequence
cctaatataattatagataaga

SEQ ID NO: 151300 - DNA, 22 bp, Artificial sequence
  SiRNA target sequence
ctaatataattatagataagaa

SEQ ID NO: 151301 - DNA, 22 bp, Artificial sequence
  SiRNA target sequence
taatataattatagataagaat

SEQ ID NO: 151302 - DNA, 22 bp, Artificial sequence
  SiRNA target sequence
aatataattatagataagaata

SEQ ID NO: 151303 - DNA, 22 bp, Artificial sequence
  SiRNA target sequence
atataattatagataagaatat

SEQ ID NO: 151304 - DNA, 22 bp, Artificial sequence
  SiRNA target sequence
tataattatagataagaatatt

SEQ ID NO: 151305 - DNA, 22 bp, Artificial sequence
  SiRNA target sequence
ataattatagataagaatattg

SEQ ID NO: 151306 - DNA, 22 bp, Artificial sequence
  SiRNA target sequence
taattatagataagaatattga

SEQ ID NO: 151307 - DNA, 22 bp, Artificial sequence
  SiRNA target sequence
aattatagataagaatattgat

SEQ ID NO: 151308 - DNA, 22 bp, Artificial sequence
  SiRNA target sequence
attatagataagaatattgata

SEQ ID NO: 151309 - DNA, 22 bp, Artificial sequence
  SiRNA target sequence
ttatagataagaatattgataa

SEQ ID NO: 151310 - DNA, 22 bp, Artificial sequence
  SiRNA target sequence
tatagataagaatattgataaa

SEQ ID NO: 151311 - DNA, 22 bp, Artificial sequence
  SiRNA target sequence
atagataagaatattgataaag

SEQ ID NO: 151312 - DNA, 22 bp, Artificial sequence
  SiRNA target sequence
tagataagaatattgataaaga

SEQ ID NO: 151313 - DNA, 22 bp, Artificial sequence
  SiRNA target sequence
agataagaatattgataaagat

SEQ ID NO: 151314 - DNA, 22 bp, Artificial sequence
  SiRNA target sequence
gataagaatattgataaagatt

SEQ ID NO: 151315 - DNA, 22 bp, Artificial sequence
  SiRNA target sequence
ataagaatattgataaagattt

SEQ ID NO: 151316 - DNA, 22 bp, Artificial sequence
  SiRNA target sequence
taagaatattgataaagattta

SEQ ID NO: 151317 - DNA, 22 bp, Artificial sequence
  SiRNA target sequence
aagaatattgataaagatttat

SEQ ID NO: 151318 - DNA, 22 bp, Artificial sequence
  SiRNA target sequence
agaatattgataaagatttatt

SEQ ID NO: 151319 - DNA, 22 bp, Artificial sequence
  SiRNA target sequence
gaatattgataaagatttatta

SEQ ID NO: 151320 - DNA, 22 bp, Artificial sequence
  SiRNA target sequence
aatattgataaagatttattag

SEQ ID NO: 151321 - DNA, 22 bp, Artificial sequence
  SiRNA target sequence
atattgataaagatttattagc

SEQ ID NO: 151322 - DNA, 22 bp, Artificial sequence
  SiRNA target sequence
tattgataaagatttattagca

SEQ ID NO: 151323 - DNA, 22 bp, Artificial sequence
  SiRNA target sequence
attgataaagatttattagcac

SEQ ID NO: 151324 - DNA, 22 bp, Artificial sequence
  SiRNA target sequence
ttgataaagatttattagcacg

SEQ ID NO: 151325 - DNA, 22 bp, Artificial sequence
  SiRNA target sequence
tgataaagatttattagcacgc

SEQ ID NO: 151326 - DNA, 22 bp, Artificial sequence
  SiRNA target sequence
gataaagatttattagcacgcg

SEQ ID NO: 151327 - DNA, 22 bp, Artificial sequence
  SiRNA target sequence
ataaagatttattagcacgcgc

SEQ ID NO: 151328 - DNA, 22 bp, Artificial sequence
  SiRNA target sequence
taaagatttattagcacgcgcc

SEQ ID NO: 151329 - DNA, 22 bp, Artificial sequence
  SiRNA target sequence
aaagatttattagcacgcgcct

SEQ ID NO: 151330 - DNA, 22 bp, Artificial sequence
  SiRNA target sequence
aagatttattagcacgcgcctt

SEQ ID NO: 151331 - DNA, 22 bp, Artificial sequence
  SiRNA target sequence
agatttattagcacgcgccttg

SEQ ID NO: 151332 - DNA, 22 bp, Artificial sequence
  SiRNA target sequence
gatttattagcacgcgccttga

SEQ ID NO: 151333 - DNA, 22 bp, Artificial sequence
  SiRNA target sequence
atttattagcacgcgccttgaa

SEQ ID NO: 151334 - DNA, 22 bp, Artificial sequence
  SiRNA target sequence
tttattagcacgcgccttgaat

SEQ ID NO: 151335 - DNA, 22 bp, Artificial sequence
  SiRNA target sequence
ttattagcacgcgccttgaatt

SEQ ID NO: 151336 - DNA, 22 bp, Artificial sequence
  SiRNA target sequence
tattagcacgcgccttgaatta

SEQ ID NO: 151337 - DNA, 22 bp, Artificial sequence
  SiRNA target sequence
attagcacgcgccttgaattat

SEQ ID NO: 151338 - DNA, 22 bp, Artificial sequence
  SiRNA target sequence
ttagcacgcgccttgaattatg

SEQ ID NO: 151339 - DNA, 22 bp, Artificial sequence
  SiRNA target sequence
tagcacgcgccttgaattatgt

SEQ ID NO: 151340 - DNA, 22 bp, Artificial sequence
  SiRNA target sequence
agcacgcgccttgaattatgtt

SEQ ID NO: 151341 - DNA, 22 bp, Artificial sequence
  SiRNA target sequence
gcacgcgccttgaattatgttc

SEQ ID NO: 151342 - DNA, 22 bp, Artificial sequence
  SiRNA target sequence
cacgcgccttgaattatgttcc

SEQ ID NO: 151343 - DNA, 22 bp, Artificial sequence
  SiRNA target sequence
acgcgccttgaattatgttcct

SEQ ID NO: 151344 - DNA, 22 bp, Artificial sequence
  SiRNA target sequence
cgcgccttgaattatgttcctg

SEQ ID NO: 151345 - DNA, 22 bp, Artificial sequence
  SiRNA target sequence
gcgccttgaattatgttcctgt

SEQ ID NO: 151346 - DNA, 22 bp, Artificial sequence
  SiRNA target sequence
cgccttgaattatgttcctgta

SEQ ID NO: 151347 - DNA, 22 bp, Artificial sequence
  SiRNA target sequence
gccttgaattatgttcctgtaa

SEQ ID NO: 151348 - DNA, 22 bp, Artificial sequence
  SiRNA target sequence
ccttgaattatgttcctgtaag

SEQ ID NO: 151349 - DNA, 22 bp, Artificial sequence
  SiRNA target sequence
cttgaattatgttcctgtaaga

SEQ ID NO: 151350 - DNA, 22 bp, Artificial sequence
  SiRNA target sequence
ttgaattatgttcctgtaagaa

SEQ ID NO: 151351 - DNA, 22 bp, Artificial sequence
  SiRNA target sequence
tgaattatgttcctgtaagaaa

SEQ ID NO: 151352 - DNA, 22 bp, Artificial sequence
  SiRNA target sequence
gaattatgttcctgtaagaaaa

SEQ ID NO: 151353 - DNA, 22 bp, Artificial sequence
  SiRNA target sequence
aattatgttcctgtaagaaaag

SEQ ID NO: 151354 - DNA, 22 bp, Artificial sequence
  SiRNA target sequence
attatgttcctgtaagaaaaga

SEQ ID NO: 151355 - DNA, 22 bp, Artificial sequence
  SiRNA target sequence
ttatgttcctgtaagaaaagat

SEQ ID NO: 151356 - DNA, 22 bp, Artificial sequence
  SiRNA target sequence
tatgttcctgtaagaaaagatt

SEQ ID NO: 151357 - DNA, 22 bp, Artificial sequence
  SiRNA target sequence
atgttcctgtaagaaaagattt

SEQ ID NO: 151358 - DNA, 22 bp, Artificial sequence
  SiRNA target sequence
tgttcctgtaagaaaagatttt

SEQ ID NO: 151359 - DNA, 22 bp, Artificial sequence
  SiRNA target sequence
gttcctgtaagaaaagatttta

SEQ ID NO: 151360 - DNA, 22 bp, Artificial sequence
  SiRNA target sequence
ttcctgtaagaaaagattttac

SEQ ID NO: 151361 - DNA, 22 bp, Artificial sequence
  SiRNA target sequence
tcctgtaagaaaagattttaca

SEQ ID NO: 151362 - DNA, 22 bp, Artificial sequence
  SiRNA target sequence
cctgtaagaaaagattttacag

SEQ ID NO: 151363 - DNA, 22 bp, Artificial sequence
  SiRNA target sequence
ctgtaagaaaagattttacagg

SEQ ID NO: 151364 - DNA, 22 bp, Artificial sequence
  SiRNA target sequence
tgtaagaaaagattttacagga

SEQ ID NO: 151365 - DNA, 22 bp, Artificial sequence
  SiRNA target sequence
gtaagaaaagattttacaggaa

SEQ ID NO: 151366 - DNA, 22 bp, Artificial sequence
  SiRNA target sequence
taagaaaagattttacaggaac

SEQ ID NO: 151367 - DNA, 22 bp, Artificial sequence
  SiRNA target sequence
aagaaaagattttacaggaact

SEQ ID NO: 151368 - DNA, 22 bp, Artificial sequence
  SiRNA target sequence
agaaaagattttacaggaactg

SEQ ID NO: 151369 - DNA, 22 bp, Artificial sequence
  SiRNA target sequence
gaaaagattttacaggaactgc

SEQ ID NO: 151370 - DNA, 22 bp, Artificial sequence
  SiRNA target sequence
aaaagattttacaggaactgct

SEQ ID NO: 151371 - DNA, 22 bp, Artificial sequence
  SiRNA target sequence
aaagattttacaggaactgctg

SEQ ID NO: 151372 - DNA, 22 bp, Artificial sequence
  SiRNA target sequence
aagattttacaggaactgctgt

SEQ ID NO: 151373 - DNA, 22 bp, Artificial sequence
  SiRNA target sequence
agattttacaggaactgctgtt

SEQ ID NO: 151374 - DNA, 22 bp, Artificial sequence
  SiRNA target sequence
gattttacaggaactgctgttc

SEQ ID NO: 151375 - DNA, 22 bp, Artificial sequence
  SiRNA target sequence
attttacaggaactgctgttcc

SEQ ID NO: 151376 - DNA, 22 bp, Artificial sequence
  SiRNA target sequence
ttttacaggaactgctgttcca

SEQ ID NO: 151377 - DNA, 22 bp, Artificial sequence
  SiRNA target sequence
tttacaggaactgctgttccaa

SEQ ID NO: 151378 - DNA, 22 bp, Artificial sequence
  SiRNA target sequence
ttacaggaactgctgttccaaa

SEQ ID NO: 151379 - DNA, 22 bp, Artificial sequence
  SiRNA target sequence
tacaggaactgctgttccaaaa

SEQ ID NO: 151380 - DNA, 22 bp, Artificial sequence
  SiRNA target sequence
acaggaactgctgttccaaaat

SEQ ID NO: 151381 - DNA, 22 bp, Artificial sequence
  SiRNA target sequence
caggaactgctgttccaaaata

SEQ ID NO: 151382 - DNA, 22 bp, Artificial sequence
  SiRNA target sequence
aggaactgctgttccaaaatat

SEQ ID NO: 151383 - DNA, 22 bp, Artificial sequence
  SiRNA target sequence
ggaactgctgttccaaaatatg

SEQ ID NO: 151384 - DNA, 22 bp, Artificial sequence
  SiRNA target sequence
gaactgctgttccaaaatatgc

SEQ ID NO: 151385 - DNA, 22 bp, Artificial sequence
  SiRNA target sequence
aactgctgttccaaaatatgca

SEQ ID NO: 151386 - DNA, 22 bp, Artificial sequence
  SiRNA target sequence
actgctgttccaaaatatgcag

SEQ ID NO: 151387 - DNA, 22 bp, Artificial sequence
  SiRNA target sequence
ctgctgttccaaaatatgcaga

SEQ ID NO: 151388 - DNA, 22 bp, Artificial sequence
  SiRNA target sequence
tgctgttccaaaatatgcagaa

SEQ ID NO: 151389 - DNA, 22 bp, Artificial sequence
  SiRNA target sequence
gctgttccaaaatatgcagaat

SEQ ID NO: 151390 - DNA, 22 bp, Artificial sequence
  SiRNA target sequence
ctgttccaaaatatgcagaatt

SEQ ID NO: 151391 - DNA, 22 bp, Artificial sequence
  SiRNA target sequence
tgttccaaaatatgcagaattt

SEQ ID NO: 151392 - DNA, 22 bp, Artificial sequence
  SiRNA target sequence
gttccaaaatatgcagaatttg

SEQ ID NO: 151393 - DNA, 22 bp, Artificial sequence
  SiRNA target sequence
ttccaaaatatgcagaatttgg

SEQ ID NO: 151394 - DNA, 22 bp, Artificial sequence
  SiRNA target sequence
tccaaaatatgcagaatttggt

SEQ ID NO: 151395 - DNA, 22 bp, Artificial sequence
  SiRNA target sequence
ccaaaatatgcagaatttggtg

SEQ ID NO: 151396 - DNA, 22 bp, Artificial sequence
  SiRNA target sequence
caaaatatgcagaatttggtgt

SEQ ID NO: 151397 - DNA, 22 bp, Artificial sequence
  SiRNA target sequence
aaaatatgcagaatttggtgtt

SEQ ID NO: 151398 - DNA, 22 bp, Artificial sequence
  SiRNA target sequence
aaatatgcagaatttggtgtta

SEQ ID NO: 151399 - DNA, 22 bp, Artificial sequence
  SiRNA target sequence
aatatgcagaatttggtgttat

SEQ ID NO: 151400 - DNA, 22 bp, Artificial sequence
  SiRNA target sequence
atatgcagaatttggtgttatg

SEQ ID NO: 151401 - DNA, 22 bp, Artificial sequence
  SiRNA target sequence
tatgcagaatttggtgttatgc

SEQ ID NO: 151402 - DNA, 22 bp, Artificial sequence
  SiRNA target sequence
atgcagaatttggtgttatgcc

SEQ ID NO: 151403 - DNA, 22 bp, Artificial sequence
  SiRNA target sequence
tgcagaatttggtgttatgcct

SEQ ID NO: 151404 - DNA, 22 bp, Artificial sequence
  SiRNA target sequence
gcagaatttggtgttatgccta

SEQ ID NO: 151405 - DNA, 22 bp, Artificial sequence
  SiRNA target sequence
cagaatttggtgttatgcctaa

SEQ ID NO: 151406 - DNA, 22 bp, Artificial sequence
  SiRNA target sequence
agaatttggtgttatgcctaaa

SEQ ID NO: 151407 - DNA, 22 bp, Artificial sequence
  SiRNA target sequence
gaatttggtgttatgcctaaag

SEQ ID NO: 151408 - DNA, 22 bp, Artificial sequence
  SiRNA target sequence
aatttggtgttatgcctaaaga

SEQ ID NO: 151409 - DNA, 22 bp, Artificial sequence
  SiRNA target sequence
atttggtgttatgcctaaagaa

SEQ ID NO: 151410 - DNA, 22 bp, Artificial sequence
  SiRNA target sequence
tttggtgttatgcctaaagaac

SEQ ID NO: 151411 - DNA, 22 bp, Artificial sequence
  SiRNA target sequence
ttggtgttatgcctaaagaaca

SEQ ID NO: 151412 - DNA, 22 bp, Artificial sequence
  SiRNA target sequence
tggtgttatgcctaaagaacag

SEQ ID NO: 151413 - DNA, 22 bp, Artificial sequence
  SiRNA target sequence
ggtgttatgcctaaagaacagg

SEQ ID NO: 151414 - DNA, 22 bp, Artificial sequence
  SiRNA target sequence
gtgttatgcctaaagaacagga

SEQ ID NO: 151415 - DNA, 22 bp, Artificial sequence
  SiRNA target sequence
tgttatgcctaaagaacaggaa

SEQ ID NO: 151416 - DNA, 22 bp, Artificial sequence
  SiRNA target sequence
gttatgcctaaagaacaggaag

SEQ ID NO: 151417 - DNA, 22 bp, Artificial sequence
  SiRNA target sequence
ttatgcctaaagaacaggaaga

SEQ ID NO: 151418 - DNA, 22 bp, Artificial sequence
  SiRNA target sequence
tatgcctaaagaacaggaagaa

SEQ ID NO: 151419 - DNA, 22 bp, Artificial sequence
  SiRNA target sequence
atgcctaaagaacaggaagaac

SEQ ID NO: 151420 - DNA, 22 bp, Artificial sequence
  SiRNA target sequence
tgcctaaagaacaggaagaaca

SEQ ID NO: 151421 - DNA, 22 bp, Artificial sequence
  SiRNA target sequence
gcctaaagaacaggaagaacaa

SEQ ID NO: 151422 - DNA, 22 bp, Artificial sequence
  SiRNA target sequence
cctaaagaacaggaagaacaaa

SEQ ID NO: 151423 - DNA, 22 bp, Artificial sequence
  SiRNA target sequence
ctaaagaacaggaagaacaaaa

SEQ ID NO: 151424 - DNA, 22 bp, Artificial sequence
  SiRNA target sequence
taaagaacaggaagaacaaaac

SEQ ID NO: 151425 - DNA, 22 bp, Artificial sequence
  SiRNA target sequence
aaagaacaggaagaacaaaacg

SEQ ID NO: 151426 - DNA, 22 bp, Artificial sequence
  SiRNA target sequence
aagaacaggaagaacaaaacga

SEQ ID NO: 151427 - DNA, 22 bp, Artificial sequence
  SiRNA target sequence
agaacaggaagaacaaaacgaa

SEQ ID NO: 151428 - DNA, 22 bp, Artificial sequence
  SiRNA target sequence
gaacaggaagaacaaaacgaaa

SEQ ID NO: 151429 - DNA, 22 bp, Artificial sequence
  SiRNA target sequence
aacaggaagaacaaaacgaaag

SEQ ID NO: 151430 - DNA, 22 bp, Artificial sequence
  SiRNA target sequence
acaggaagaacaaaacgaaaga

SEQ ID NO: 151431 - DNA, 22 bp, Artificial sequence
  SiRNA target sequence
caggaagaacaaaacgaaagag

SEQ ID NO: 151432 - DNA, 22 bp, Artificial sequence
  SiRNA target sequence
aggaagaacaaaacgaaagaga

SEQ ID NO: 151433 - DNA, 22 bp, Artificial sequence
  SiRNA target sequence
ggaagaacaaaacgaaagagaa

SEQ ID NO: 151434 - DNA, 22 bp, Artificial sequence
  SiRNA target sequence
gaagaacaaaacgaaagagaaa

SEQ ID NO: 151435 - DNA, 22 bp, Artificial sequence
  SiRNA target sequence
aagaacaaaacgaaagagaaag

SEQ ID NO: 151436 - DNA, 22 bp, Artificial sequence
  SiRNA target sequence
agaacaaaacgaaagagaaaga

SEQ ID NO: 151437 - DNA, 22 bp, Artificial sequence
  SiRNA target sequence
gaacaaaacgaaagagaaagat

SEQ ID NO: 151438 - DNA, 22 bp, Artificial sequence
  SiRNA target sequence
aacaaaacgaaagagaaagatt

SEQ ID NO: 151439 - DNA, 22 bp, Artificial sequence
  SiRNA target sequence
acaaaacgaaagagaaagattc

SEQ ID NO: 151440 - DNA, 22 bp, Artificial sequence
  SiRNA target sequence
caaaacgaaagagaaagattcg

SEQ ID NO: 151441 - DNA, 22 bp, Artificial sequence
  SiRNA target sequence
aaaacgaaagagaaagattcga

SEQ ID NO: 151442 - DNA, 22 bp, Artificial sequence
  SiRNA target sequence
aaacgaaagagaaagattcgaa

SEQ ID NO: 151443 - DNA, 22 bp, Artificial sequence
  SiRNA target sequence
aacgaaagagaaagattcgaag

SEQ ID NO: 151444 - DNA, 22 bp, Artificial sequence
  SiRNA target sequence
acgaaagagaaagattcgaagg

SEQ ID NO: 151445 - DNA, 22 bp, Artificial sequence
  SiRNA target sequence
cgaaagagaaagattcgaaggt

SEQ ID NO: 151446 - DNA, 22 bp, Artificial sequence
  SiRNA target sequence
gaaagagaaagattcgaaggtg

SEQ ID NO: 151447 - DNA, 22 bp, Artificial sequence
  SiRNA target sequence
aaagagaaagattcgaaggtgc

SEQ ID NO: 151448 - DNA, 22 bp, Artificial sequence
  SiRNA target sequence
aagagaaagattcgaaggtgca

SEQ ID NO: 151449 - DNA, 22 bp, Artificial sequence
  SiRNA target sequence
agagaaagattcgaaggtgcag

SEQ ID NO: 151450 - DNA, 22 bp, Artificial sequence
  SiRNA target sequence
gagaaagattcgaaggtgcaga

SEQ ID NO: 151451 - DNA, 22 bp, Artificial sequence
  SiRNA target sequence
agaaagattcgaaggtgcagaa

SEQ ID NO: 151452 - DNA, 22 bp, Artificial sequence
  SiRNA target sequence
gaaagattcgaaggtgcagaag

SEQ ID NO: 151453 - DNA, 22 bp, Artificial sequence
  SiRNA target sequence
aaagattcgaaggtgcagaaga

SEQ ID NO: 151454 - DNA, 22 bp, Artificial sequence
  SiRNA target sequence
aagattcgaaggtgcagaagag

SEQ ID NO: 151455 - DNA, 22 bp, Artificial sequence
  SiRNA target sequence
agattcgaaggtgcagaagagt

SEQ ID NO: 151456 - DNA, 22 bp, Artificial sequence
  SiRNA target sequence
gattcgaaggtgcagaagagtt

SEQ ID NO: 151457 - DNA, 22 bp, Artificial sequence
  SiRNA target sequence
attcgaaggtgcagaagagttt

SEQ ID NO: 151458 - DNA, 22 bp, Artificial sequence
  SiRNA target sequence
ttcgaaggtgcagaagagtttt

SEQ ID NO: 151459 - DNA, 22 bp, Artificial sequence
  SiRNA target sequence
tcgaaggtgcagaagagttttt

SEQ ID NO: 151460 - DNA, 22 bp, Artificial sequence
  SiRNA target sequence
cgaaggtgcagaagagtttttt

SEQ ID NO: 151461 - DNA, 22 bp, Artificial sequence
  SiRNA target sequence
gaaggtgcagaagagttttttg

SEQ ID NO: 151462 - DNA, 22 bp, Artificial sequence
  SiRNA target sequence
aaggtgcagaagagttttttgg

SEQ ID NO: 151463 - DNA, 22 bp, Artificial sequence
  SiRNA target sequence
aggtgcagaagagttttttgga

SEQ ID NO: 151464 - DNA, 22 bp, Artificial sequence
  SiRNA target sequence
ggtgcagaagagttttttggag

SEQ ID NO: 151465 - DNA, 22 bp, Artificial sequence
  SiRNA target sequence
gtgcagaagagttttttggagg

SEQ ID NO: 151466 - DNA, 22 bp, Artificial sequence
  SiRNA target sequence
tgcagaagagttttttggagga

SEQ ID NO: 151467 - DNA, 22 bp, Artificial sequence
  SiRNA target sequence
gcagaagagttttttggaggaa

SEQ ID NO: 151468 - DNA, 22 bp, Artificial sequence
  SiRNA target sequence
cagaagagttttttggaggaaa

SEQ ID NO: 151469 - DNA, 22 bp, Artificial sequence
  SiRNA target sequence
agaagagttttttggaggaaat

SEQ ID NO: 151470 - DNA, 22 bp, Artificial sequence
  SiRNA target sequence
gaagagttttttggaggaaatg

SEQ ID NO: 151471 - DNA, 22 bp, Artificial sequence
  SiRNA target sequence
aagagttttttggaggaaatgg

SEQ ID NO: 151472 - DNA, 22 bp, Artificial sequence
  SiRNA target sequence
agagttttttggaggaaatggt

SEQ ID NO: 151473 - DNA, 22 bp, Artificial sequence
  SiRNA target sequence
gagttttttggaggaaatggta

SEQ ID NO: 151474 - DNA, 22 bp, Artificial sequence
  SiRNA target sequence
agttttttggaggaaatggtag

SEQ ID NO: 151475 - DNA, 22 bp, Artificial sequence
  SiRNA target sequence
gttttttggaggaaatggtaga

SEQ ID NO: 151476 - DNA, 22 bp, Artificial sequence
  SiRNA target sequence
ttttttggaggaaatggtagag

SEQ ID NO: 151477 - DNA, 22 bp, Artificial sequence
  SiRNA target sequence
tttttggaggaaatggtagaga

SEQ ID NO: 151478 - DNA, 22 bp, Artificial sequence
  SiRNA target sequence
ttttggaggaaatggtagagat

SEQ ID NO: 151479 - DNA, 22 bp, Artificial sequence
  SiRNA target sequence
tttggaggaaatggtagagatt

SEQ ID NO: 151480 - DNA, 22 bp, Artificial sequence
  SiRNA target sequence
ttggaggaaatggtagagattt

SEQ ID NO: 151481 - DNA, 22 bp, Artificial sequence
  SiRNA target sequence
tggaggaaatggtagagatttt

SEQ ID NO: 151482 - DNA, 22 bp, Artificial sequence
  SiRNA target sequence
ggaggaaatggtagagattttt

SEQ ID NO: 151483 - DNA, 22 bp, Artificial sequence
  SiRNA target sequence
gaggaaatggtagagatttttt

SEQ ID NO: 151484 - DNA, 22 bp, Artificial sequence
  SiRNA target sequence
aggaaatggtagagattttttt

SEQ ID NO: 151485 - DNA, 22 bp, Artificial sequence
  SiRNA target sequence
ggaaatggtagagattttttta

SEQ ID NO: 151486 - DNA, 22 bp, Artificial sequence
  SiRNA target sequence
gaaatggtagagatttttttag

SEQ ID NO: 151487 - DNA, 22 bp, Artificial sequence
  SiRNA target sequence
aaatggtagagatttttttagc

SEQ ID NO: 151488 - DNA, 22 bp, Artificial sequence
  SiRNA target sequence
aatggtagagatttttttagca

SEQ ID NO: 151489 - DNA, 22 bp, Artificial sequence
  SiRNA target sequence
atggtagagatttttttagcaa

SEQ ID NO: 151490 - DNA, 22 bp, Artificial sequence
  SiRNA target sequence
tggtagagatttttttagcaag

SEQ ID NO: 151491 - DNA, 22 bp, Artificial sequence
  SiRNA target sequence
ggtagagatttttttagcaagt

SEQ ID NO: 151492 - DNA, 22 bp, Artificial sequence
  SiRNA target sequence
gtagagatttttttagcaagtt

SEQ ID NO: 151493 - DNA, 22 bp, Artificial sequence
  SiRNA target sequence
tagagatttttttagcaagttt

SEQ ID NO: 151494 - DNA, 22 bp, Artificial sequence
  SiRNA target sequence
agagatttttttagcaagtttg

SEQ ID NO: 151495 - DNA, 22 bp, Artificial sequence
  SiRNA target sequence
gagatttttttagcaagtttgg

SEQ ID NO: 151496 - DNA, 22 bp, Artificial sequence
  SiRNA target sequence
agatttttttagcaagtttgga

SEQ ID NO: 151497 - DNA, 22 bp, Artificial sequence
  SiRNA target sequence
gatttttttagcaagtttggat

SEQ ID NO: 151498 - DNA, 22 bp, Artificial sequence
  SiRNA target sequence
atttttttagcaagtttggatt

SEQ ID NO: 151499 - DNA, 22 bp, Artificial sequence
  SiRNA target sequence
tttttttagcaagtttggattt

SEQ ID NO: 151500 - DNA, 22 bp, Artificial sequence
  SiRNA target sequence
ttttttagcaagtttggatttt

SEQ ID NO: 151501 - DNA, 22 bp, Artificial sequence
  SiRNA target sequence
tttttagcaagtttggattttt

SEQ ID NO: 151502 - DNA, 22 bp, Artificial sequence
  SiRNA target sequence
ttttagcaagtttggatttttc

SEQ ID NO: 151503 - DNA, 22 bp, Artificial sequence
  SiRNA target sequence
tttagcaagtttggatttttct

SEQ ID NO: 151504 - DNA, 22 bp, Artificial sequence
  SiRNA target sequence
ttagcaagtttggatttttcta

SEQ ID NO: 151505 - DNA, 22 bp, Artificial sequence
  SiRNA target sequence
tagcaagtttggatttttctaa

SEQ ID NO: 151506 - DNA, 23 bp, Artificial sequence
  SiRNA target sequence
atggcacaagacccccaaggact

SEQ ID NO: 151507 - DNA, 23 bp, Artificial sequence
  SiRNA target sequence
tggcacaagacccccaaggactt

SEQ ID NO: 151508 - DNA, 23 bp, Artificial sequence
  SiRNA target sequence
ggcacaagacccccaaggacttt

SEQ ID NO: 151509 - DNA, 23 bp, Artificial sequence
  SiRNA target sequence
gcacaagacccccaaggacttta

SEQ ID NO: 151510 - DNA, 23 bp, Artificial sequence
  SiRNA target sequence
cacaagacccccaaggactttat

SEQ ID NO: 151511 - DNA, 23 bp, Artificial sequence
  SiRNA target sequence
acaagacccccaaggactttatg

SEQ ID NO: 151512 - DNA, 23 bp, Artificial sequence
  SiRNA target sequence
caagacccccaaggactttatga

SEQ ID NO: 151513 - DNA, 23 bp, Artificial sequence
  SiRNA target sequence
aagacccccaaggactttatgaa

SEQ ID NO: 151514 - DNA, 23 bp, Artificial sequence
  SiRNA target sequence
agacccccaaggactttatgaag

SEQ ID NO: 151515 - DNA, 23 bp, Artificial sequence
  SiRNA target sequence
gacccccaaggactttatgaagt

SEQ ID NO: 151516 - DNA, 23 bp, Artificial sequence
  SiRNA target sequence
acccccaaggactttatgaagta

SEQ ID NO: 151517 - DNA, 23 bp, Artificial sequence
  SiRNA target sequence
cccccaaggactttatgaagtat

SEQ ID NO: 151518 - DNA, 23 bp, Artificial sequence
  SiRNA target sequence
ccccaaggactttatgaagtatt

SEQ ID NO: 151519 - DNA, 23 bp, Artificial sequence
  SiRNA target sequence
cccaaggactttatgaagtatta

SEQ ID NO: 151520 - DNA, 23 bp, Artificial sequence
  SiRNA target sequence
ccaaggactttatgaagtattag

SEQ ID NO: 151521 - DNA, 23 bp, Artificial sequence
  SiRNA target sequence
caaggactttatgaagtattagg

SEQ ID NO: 151522 - DNA, 23 bp, Artificial sequence
  SiRNA target sequence
aaggactttatgaagtattagga

SEQ ID NO: 151523 - DNA, 23 bp, Artificial sequence
  SiRNA target sequence
aggactttatgaagtattaggac

SEQ ID NO: 151524 - DNA, 23 bp, Artificial sequence
  SiRNA target sequence
ggactttatgaagtattaggact

SEQ ID NO: 151525 - DNA, 23 bp, Artificial sequence
  SiRNA target sequence
gactttatgaagtattaggactt

SEQ ID NO: 151526 - DNA, 23 bp, Artificial sequence
  SiRNA target sequence
actttatgaagtattaggactta

SEQ ID NO: 151527 - DNA, 23 bp, Artificial sequence
  SiRNA target sequence
ctttatgaagtattaggacttaa

SEQ ID NO: 151528 - DNA, 23 bp, Artificial sequence
  SiRNA target sequence
tttatgaagtattaggacttaaa

SEQ ID NO: 151529 - DNA, 23 bp, Artificial sequence
  SiRNA target sequence
ttatgaagtattaggacttaaag

SEQ ID NO: 151530 - DNA, 23 bp, Artificial sequence
  SiRNA target sequence
tatgaagtattaggacttaaagc

SEQ ID NO: 151531 - DNA, 23 bp, Artificial sequence
  SiRNA target sequence
atgaagtattaggacttaaagct

SEQ ID NO: 151532 - DNA, 23 bp, Artificial sequence
  SiRNA target sequence
tgaagtattaggacttaaagctg

SEQ ID NO: 151533 - DNA, 23 bp, Artificial sequence
  SiRNA target sequence
gaagtattaggacttaaagctgg

SEQ ID NO: 151534 - DNA, 23 bp, Artificial sequence
  SiRNA target sequence
aagtattaggacttaaagctggt

SEQ ID NO: 151535 - DNA, 23 bp, Artificial sequence
  SiRNA target sequence
agtattaggacttaaagctggtg

SEQ ID NO: 151536 - DNA, 23 bp, Artificial sequence
  SiRNA target sequence
gtattaggacttaaagctggtgc

SEQ ID NO: 151537 - DNA, 23 bp, Artificial sequence
  SiRNA target sequence
tattaggacttaaagctggtgca

SEQ ID NO: 151538 - DNA, 23 bp, Artificial sequence
  SiRNA target sequence
attaggacttaaagctggtgcaa

SEQ ID NO: 151539 - DNA, 23 bp, Artificial sequence
  SiRNA target sequence
ttaggacttaaagctggtgcaag

SEQ ID NO: 151540 - DNA, 23 bp, Artificial sequence
  SiRNA target sequence
taggacttaaagctggtgcaagc

SEQ ID NO: 151541 - DNA, 23 bp, Artificial sequence
  SiRNA target sequence
aggacttaaagctggtgcaagca

SEQ ID NO: 151542 - DNA, 23 bp, Artificial sequence
  SiRNA target sequence
ggacttaaagctggtgcaagcat

SEQ ID NO: 151543 - DNA, 23 bp, Artificial sequence
  SiRNA target sequence
gacttaaagctggtgcaagcatt

SEQ ID NO: 151544 - DNA, 23 bp, Artificial sequence
  SiRNA target sequence
acttaaagctggtgcaagcattg

SEQ ID NO: 151545 - DNA, 23 bp, Artificial sequence
  SiRNA target sequence
cttaaagctggtgcaagcattga

SEQ ID NO: 151546 - DNA, 23 bp, Artificial sequence
  SiRNA target sequence
ttaaagctggtgcaagcattgat

SEQ ID NO: 151547 - DNA, 23 bp, Artificial sequence
  SiRNA target sequence
taaagctggtgcaagcattgatg

SEQ ID NO: 151548 - DNA, 23 bp, Artificial sequence
  SiRNA target sequence
aaagctggtgcaagcattgatga

SEQ ID NO: 151549 - DNA, 23 bp, Artificial sequence
  SiRNA target sequence
aagctggtgcaagcattgatgaa

SEQ ID NO: 151550 - DNA, 23 bp, Artificial sequence
  SiRNA target sequence
agctggtgcaagcattgatgaag

SEQ ID NO: 151551 - DNA, 23 bp, Artificial sequence
  SiRNA target sequence
gctggtgcaagcattgatgaagt

SEQ ID NO: 151552 - DNA, 23 bp, Artificial sequence
  SiRNA target sequence
ctggtgcaagcattgatgaagtt

SEQ ID NO: 151553 - DNA, 23 bp, Artificial sequence
  SiRNA target sequence
tggtgcaagcattgatgaagtta

SEQ ID NO: 151554 - DNA, 23 bp, Artificial sequence
  SiRNA target sequence
ggtgcaagcattgatgaagttaa

SEQ ID NO: 151555 - DNA, 23 bp, Artificial sequence
  SiRNA target sequence
gtgcaagcattgatgaagttaaa

SEQ ID NO: 151556 - DNA, 23 bp, Artificial sequence
  SiRNA target sequence
tgcaagcattgatgaagttaaaa

SEQ ID NO: 151557 - DNA, 23 bp, Artificial sequence
  SiRNA target sequence
gcaagcattgatgaagttaaaaa

SEQ ID NO: 151558 - DNA, 23 bp, Artificial sequence
  SiRNA target sequence
caagcattgatgaagttaaaaaa

SEQ ID NO: 151559 - DNA, 23 bp, Artificial sequence
  SiRNA target sequence
aagcattgatgaagttaaaaaag

SEQ ID NO: 151560 - DNA, 23 bp, Artificial sequence
  SiRNA target sequence
agcattgatgaagttaaaaaagc

SEQ ID NO: 151561 - DNA, 23 bp, Artificial sequence
  SiRNA target sequence
gcattgatgaagttaaaaaagca

SEQ ID NO: 151562 - DNA, 23 bp, Artificial sequence
  SiRNA target sequence
cattgatgaagttaaaaaagcat

SEQ ID NO: 151563 - DNA, 23 bp, Artificial sequence
  SiRNA target sequence
attgatgaagttaaaaaagcatt

SEQ ID NO: 151564 - DNA, 23 bp, Artificial sequence
  SiRNA target sequence
ttgatgaagttaaaaaagcattt

SEQ ID NO: 151565 - DNA, 23 bp, Artificial sequence
  SiRNA target sequence
tgatgaagttaaaaaagcattta

SEQ ID NO: 151566 - DNA, 23 bp, Artificial sequence
  SiRNA target sequence
gatgaagttaaaaaagcatttac

SEQ ID NO: 151567 - DNA, 23 bp, Artificial sequence
  SiRNA target sequence
atgaagttaaaaaagcatttaca

SEQ ID NO: 151568 - DNA, 23 bp, Artificial sequence
  SiRNA target sequence
tgaagttaaaaaagcatttacaa

SEQ ID NO: 151569 - DNA, 23 bp, Artificial sequence
  SiRNA target sequence
gaagttaaaaaagcatttacaaa

SEQ ID NO: 151570 - DNA, 23 bp, Artificial sequence
  SiRNA target sequence
aagttaaaaaagcatttacaaaa

SEQ ID NO: 151571 - DNA, 23 bp, Artificial sequence
  SiRNA target sequence
agttaaaaaagcatttacaaaaa

SEQ ID NO: 151572 - DNA, 23 bp, Artificial sequence
  SiRNA target sequence
gttaaaaaagcatttacaaaaaa

SEQ ID NO: 151573 - DNA, 23 bp, Artificial sequence
  SiRNA target sequence
ttaaaaaagcatttacaaaaaaa

SEQ ID NO: 151574 - DNA, 23 bp, Artificial sequence
  SiRNA target sequence
taaaaaagcatttacaaaaaaac

SEQ ID NO: 151575 - DNA, 23 bp, Artificial sequence
  SiRNA target sequence
aaaaaagcatttacaaaaaaaca

SEQ ID NO: 151576 - DNA, 23 bp, Artificial sequence
  SiRNA target sequence
aaaaagcatttacaaaaaaacaa

SEQ ID NO: 151577 - DNA, 23 bp, Artificial sequence
  SiRNA target sequence
aaaagcatttacaaaaaaacaaa

SEQ ID NO: 151578 - DNA, 23 bp, Artificial sequence
  SiRNA target sequence
aaagcatttacaaaaaaacaaag

SEQ ID NO: 151579 - DNA, 23 bp, Artificial sequence
  SiRNA target sequence
aagcatttacaaaaaaacaaagg

SEQ ID NO: 151580 - DNA, 23 bp, Artificial sequence
  SiRNA target sequence
agcatttacaaaaaaacaaaggg

SEQ ID NO: 151581 - DNA, 23 bp, Artificial sequence
  SiRNA target sequence
gcatttacaaaaaaacaaaggga

SEQ ID NO: 151582 - DNA, 23 bp, Artificial sequence
  SiRNA target sequence
catttacaaaaaaacaaagggaa

SEQ ID NO: 151583 - DNA, 23 bp, Artificial sequence
  SiRNA target sequence
atttacaaaaaaacaaagggaat

SEQ ID NO: 151584 - DNA, 23 bp, Artificial sequence
  SiRNA target sequence
tttacaaaaaaacaaagggaatg

SEQ ID NO: 151585 - DNA, 23 bp, Artificial sequence
  SiRNA target sequence
ttacaaaaaaacaaagggaatgt

SEQ ID NO: 151586 - DNA, 23 bp, Artificial sequence
  SiRNA target sequence
tacaaaaaaacaaagggaatgtc

SEQ ID NO: 151587 - DNA, 23 bp, Artificial sequence
  SiRNA target sequence
acaaaaaaacaaagggaatgtca

SEQ ID NO: 151588 - DNA, 23 bp, Artificial sequence
  SiRNA target sequence
caaaaaaacaaagggaatgtcat

SEQ ID NO: 151589 - DNA, 23 bp, Artificial sequence
  SiRNA target sequence
aaaaaaacaaagggaatgtcatc

SEQ ID NO: 151590 - DNA, 23 bp, Artificial sequence
  SiRNA target sequence
aaaaaacaaagggaatgtcatcc

SEQ ID NO: 151591 - DNA, 23 bp, Artificial sequence
  SiRNA target sequence
aaaaacaaagggaatgtcatccc

SEQ ID NO: 151592 - DNA, 23 bp, Artificial sequence
  SiRNA target sequence
aaaacaaagggaatgtcatcccg

SEQ ID NO: 151593 - DNA, 23 bp, Artificial sequence
  SiRNA target sequence
aaacaaagggaatgtcatcccga

SEQ ID NO: 151594 - DNA, 23 bp, Artificial sequence
  SiRNA target sequence
aacaaagggaatgtcatcccgat

SEQ ID NO: 151595 - DNA, 23 bp, Artificial sequence
  SiRNA target sequence
acaaagggaatgtcatcccgatg

SEQ ID NO: 151596 - DNA, 23 bp, Artificial sequence
  SiRNA target sequence
caaagggaatgtcatcccgatgg

SEQ ID NO: 151597 - DNA, 23 bp, Artificial sequence
  SiRNA target sequence
aaagggaatgtcatcccgatggt

SEQ ID NO: 151598 - DNA, 23 bp, Artificial sequence
  SiRNA target sequence
aagggaatgtcatcccgatggtg

SEQ ID NO: 151599 - DNA, 23 bp, Artificial sequence
  SiRNA target sequence
agggaatgtcatcccgatggtgc

SEQ ID NO: 151600 - DNA, 23 bp, Artificial sequence
  SiRNA target sequence
gggaatgtcatcccgatggtgca

SEQ ID NO: 151601 - DNA, 23 bp, Artificial sequence
  SiRNA target sequence
ggaatgtcatcccgatggtgcat

SEQ ID NO: 151602 - DNA, 23 bp, Artificial sequence
  SiRNA target sequence
gaatgtcatcccgatggtgcatt

SEQ ID NO: 151603 - DNA, 23 bp, Artificial sequence
  SiRNA target sequence
aatgtcatcccgatggtgcattt

SEQ ID NO: 151604 - DNA, 23 bp, Artificial sequence
  SiRNA target sequence
atgtcatcccgatggtgcatttt

SEQ ID NO: 151605 - DNA, 23 bp, Artificial sequence
  SiRNA target sequence
tgtcatcccgatggtgcattttt

SEQ ID NO: 151606 - DNA, 23 bp, Artificial sequence
  SiRNA target sequence
gtcatcccgatggtgcatttttt

SEQ ID NO: 151607 - DNA, 23 bp, Artificial sequence
  SiRNA target sequence
tcatcccgatggtgcatttttta

SEQ ID NO: 151608 - DNA, 23 bp, Artificial sequence
  SiRNA target sequence
catcccgatggtgcattttttaa

SEQ ID NO: 151609 - DNA, 23 bp, Artificial sequence
  SiRNA target sequence
atcccgatggtgcattttttaaa

SEQ ID NO: 151610 - DNA, 23 bp, Artificial sequence
  SiRNA target sequence
tcccgatggtgcattttttaaag

SEQ ID NO: 151611 - DNA, 23 bp, Artificial sequence
  SiRNA target sequence
cccgatggtgcattttttaaagc

SEQ ID NO: 151612 - DNA, 23 bp, Artificial sequence
  SiRNA target sequence
ccgatggtgcattttttaaagct

SEQ ID NO: 151613 - DNA, 23 bp, Artificial sequence
  SiRNA target sequence
cgatggtgcattttttaaagctg

SEQ ID NO: 151614 - DNA, 23 bp, Artificial sequence
  SiRNA target sequence
gatggtgcattttttaaagctgc

SEQ ID NO: 151615 - DNA, 23 bp, Artificial sequence
  SiRNA target sequence
atggtgcattttttaaagctgct

SEQ ID NO: 151616 - DNA, 23 bp, Artificial sequence
  SiRNA target sequence
tggtgcattttttaaagctgctc

SEQ ID NO: 151617 - DNA, 23 bp, Artificial sequence
  SiRNA target sequence
ggtgcattttttaaagctgctct

SEQ ID NO: 151618 - DNA, 23 bp, Artificial sequence
  SiRNA target sequence
gtgcattttttaaagctgctctt

SEQ ID NO: 151619 - DNA, 23 bp, Artificial sequence
  SiRNA target sequence
tgcattttttaaagctgctctta

SEQ ID NO: 151620 - DNA, 23 bp, Artificial sequence
  SiRNA target sequence
gcattttttaaagctgctcttag

SEQ ID NO: 151621 - DNA, 23 bp, Artificial sequence
  SiRNA target sequence
cattttttaaagctgctcttaga

SEQ ID NO: 151622 - DNA, 23 bp, Artificial sequence
  SiRNA target sequence
attttttaaagctgctcttagaa

SEQ ID NO: 151623 - DNA, 23 bp, Artificial sequence
  SiRNA target sequence
ttttttaaagctgctcttagaaa

SEQ ID NO: 151624 - DNA, 23 bp, Artificial sequence
  SiRNA target sequence
tttttaaagctgctcttagaaaa

SEQ ID NO: 151625 - DNA, 23 bp, Artificial sequence
  SiRNA target sequence
ttttaaagctgctcttagaaaat

SEQ ID NO: 151626 - DNA, 23 bp, Artificial sequence
  SiRNA target sequence
tttaaagctgctcttagaaaatg

SEQ ID NO: 151627 - DNA, 23 bp, Artificial sequence
  SiRNA target sequence
ttaaagctgctcttagaaaatgt

SEQ ID NO: 151628 - DNA, 23 bp, Artificial sequence
  SiRNA target sequence
taaagctgctcttagaaaatgta

SEQ ID NO: 151629 - DNA, 23 bp, Artificial sequence
  SiRNA target sequence
aaagctgctcttagaaaatgtaa

SEQ ID NO: 151630 - DNA, 23 bp, Artificial sequence
  SiRNA target sequence
aagctgctcttagaaaatgtaaa

SEQ ID NO: 151631 - DNA, 23 bp, Artificial sequence
  SiRNA target sequence
agctgctcttagaaaatgtaaaa

SEQ ID NO: 151632 - DNA, 23 bp, Artificial sequence
  SiRNA target sequence
gctgctcttagaaaatgtaaaac

SEQ ID NO: 151633 - DNA, 23 bp, Artificial sequence
  SiRNA target sequence
ctgctcttagaaaatgtaaaaca

SEQ ID NO: 151634 - DNA, 23 bp, Artificial sequence
  SiRNA target sequence
tgctcttagaaaatgtaaaacag

SEQ ID NO: 151635 - DNA, 23 bp, Artificial sequence
  SiRNA target sequence
gctcttagaaaatgtaaaacaga

SEQ ID NO: 151636 - DNA, 23 bp, Artificial sequence
  SiRNA target sequence
ctcttagaaaatgtaaaacagat

SEQ ID NO: 151637 - DNA, 23 bp, Artificial sequence
  SiRNA target sequence
tcttagaaaatgtaaaacagatg

SEQ ID NO: 151638 - DNA, 23 bp, Artificial sequence
  SiRNA target sequence
cttagaaaatgtaaaacagatga

SEQ ID NO: 151639 - DNA, 23 bp, Artificial sequence
  SiRNA target sequence
ttagaaaatgtaaaacagatgaa

SEQ ID NO: 151640 - DNA, 23 bp, Artificial sequence
  SiRNA target sequence
tagaaaatgtaaaacagatgaag

SEQ ID NO: 151641 - DNA, 23 bp, Artificial sequence
  SiRNA target sequence
agaaaatgtaaaacagatgaaga

SEQ ID NO: 151642 - DNA, 23 bp, Artificial sequence
  SiRNA target sequence
gaaaatgtaaaacagatgaagaa

SEQ ID NO: 151643 - DNA, 23 bp, Artificial sequence
  SiRNA target sequence
aaaatgtaaaacagatgaagaaa

SEQ ID NO: 151644 - DNA, 23 bp, Artificial sequence
  SiRNA target sequence
aaatgtaaaacagatgaagaaag

SEQ ID NO: 151645 - DNA, 23 bp, Artificial sequence
  SiRNA target sequence
aatgtaaaacagatgaagaaaga

SEQ ID NO: 151646 - DNA, 23 bp, Artificial sequence
  SiRNA target sequence
atgtaaaacagatgaagaaagag

SEQ ID NO: 151647 - DNA, 23 bp, Artificial sequence
  SiRNA target sequence
tgtaaaacagatgaagaaagagc

SEQ ID NO: 151648 - DNA, 23 bp, Artificial sequence
  SiRNA target sequence
gtaaaacagatgaagaaagagca

SEQ ID NO: 151649 - DNA, 23 bp, Artificial sequence
  SiRNA target sequence
taaaacagatgaagaaagagcaa

SEQ ID NO: 151650 - DNA, 23 bp, Artificial sequence
  SiRNA target sequence
aaaacagatgaagaaagagcaaa

SEQ ID NO: 151651 - DNA, 23 bp, Artificial sequence
  SiRNA target sequence
aaacagatgaagaaagagcaaaa

SEQ ID NO: 151652 - DNA, 23 bp, Artificial sequence
  SiRNA target sequence
aacagatgaagaaagagcaaaag

SEQ ID NO: 151653 - DNA, 23 bp, Artificial sequence
  SiRNA target sequence
acagatgaagaaagagcaaaagt

SEQ ID NO: 151654 - DNA, 23 bp, Artificial sequence
  SiRNA target sequence
cagatgaagaaagagcaaaagtt

SEQ ID NO: 151655 - DNA, 23 bp, Artificial sequence
  SiRNA target sequence
agatgaagaaagagcaaaagttg

SEQ ID NO: 151656 - DNA, 23 bp, Artificial sequence
  SiRNA target sequence
gatgaagaaagagcaaaagttga

SEQ ID NO: 151657 - DNA, 23 bp, Artificial sequence
  SiRNA target sequence
atgaagaaagagcaaaagttgaa

SEQ ID NO: 151658 - DNA, 23 bp, Artificial sequence
  SiRNA target sequence
tgaagaaagagcaaaagttgaaa

SEQ ID NO: 151659 - DNA, 23 bp, Artificial sequence
  SiRNA target sequence
gaagaaagagcaaaagttgaaaa

SEQ ID NO: 151660 - DNA, 23 bp, Artificial sequence
  SiRNA target sequence
aagaaagagcaaaagttgaaaaa

SEQ ID NO: 151661 - DNA, 23 bp, Artificial sequence
  SiRNA target sequence
agaaagagcaaaagttgaaaaag

SEQ ID NO: 151662 - DNA, 23 bp, Artificial sequence
  SiRNA target sequence
gaaagagcaaaagttgaaaaaga

SEQ ID NO: 151663 - DNA, 23 bp, Artificial sequence
  SiRNA target sequence
aaagagcaaaagttgaaaaagaa

SEQ ID NO: 151664 - DNA, 23 bp, Artificial sequence
  SiRNA target sequence
aagagcaaaagttgaaaaagaat

SEQ ID NO: 151665 - DNA, 23 bp, Artificial sequence
  SiRNA target sequence
agagcaaaagttgaaaaagaatt

SEQ ID NO: 151666 - DNA, 23 bp, Artificial sequence
  SiRNA target sequence
gagcaaaagttgaaaaagaattt

SEQ ID NO: 151667 - DNA, 23 bp, Artificial sequence
  SiRNA target sequence
agcaaaagttgaaaaagaattta

SEQ ID NO: 151668 - DNA, 23 bp, Artificial sequence
  SiRNA target sequence
gcaaaagttgaaaaagaatttaa

SEQ ID NO: 151669 - DNA, 23 bp, Artificial sequence
  SiRNA target sequence
caaaagttgaaaaagaatttaaa

SEQ ID NO: 151670 - DNA, 23 bp, Artificial sequence
  SiRNA target sequence
aaaagttgaaaaagaatttaaag

SEQ ID NO: 151671 - DNA, 23 bp, Artificial sequence
  SiRNA target sequence
aaagttgaaaaagaatttaaaga

SEQ ID NO: 151672 - DNA, 23 bp, Artificial sequence
  SiRNA target sequence
aagttgaaaaagaatttaaagaa

SEQ ID NO: 151673 - DNA, 23 bp, Artificial sequence
  SiRNA target sequence
agttgaaaaagaatttaaagaaa

SEQ ID NO: 151674 - DNA, 23 bp, Artificial sequence
  SiRNA target sequence
gttgaaaaagaatttaaagaaaa

SEQ ID NO: 151675 - DNA, 23 bp, Artificial sequence
  SiRNA target sequence
ttgaaaaagaatttaaagaaaaa

SEQ ID NO: 151676 - DNA, 23 bp, Artificial sequence
  SiRNA target sequence
tgaaaaagaatttaaagaaaaat

SEQ ID NO: 151677 - DNA, 23 bp, Artificial sequence
  SiRNA target sequence
gaaaaagaatttaaagaaaaatc

SEQ ID NO: 151678 - DNA, 23 bp, Artificial sequence
  SiRNA target sequence
aaaaagaatttaaagaaaaatca

SEQ ID NO: 151679 - DNA, 23 bp, Artificial sequence
  SiRNA target sequence
aaaagaatttaaagaaaaatcac

SEQ ID NO: 151680 - DNA, 23 bp, Artificial sequence
  SiRNA target sequence
aaagaatttaaagaaaaatcaca

SEQ ID NO: 151681 - DNA, 23 bp, Artificial sequence
  SiRNA target sequence
aagaatttaaagaaaaatcacaa

SEQ ID NO: 151682 - DNA, 23 bp, Artificial sequence
  SiRNA target sequence
agaatttaaagaaaaatcacaaa

SEQ ID NO: 151683 - DNA, 23 bp, Artificial sequence
  SiRNA target sequence
gaatttaaagaaaaatcacaaaa

SEQ ID NO: 151684 - DNA, 23 bp, Artificial sequence
  SiRNA target sequence
aatttaaagaaaaatcacaaaaa

SEQ ID NO: 151685 - DNA, 23 bp, Artificial sequence
  SiRNA target sequence
atttaaagaaaaatcacaaaaat

SEQ ID NO: 151686 - DNA, 23 bp, Artificial sequence
  SiRNA target sequence
tttaaagaaaaatcacaaaaatg

SEQ ID NO: 151687 - DNA, 23 bp, Artificial sequence
  SiRNA target sequence
ttaaagaaaaatcacaaaaatgt

SEQ ID NO: 151688 - DNA, 23 bp, Artificial sequence
  SiRNA target sequence
taaagaaaaatcacaaaaatgta

SEQ ID NO: 151689 - DNA, 23 bp, Artificial sequence
  SiRNA target sequence
aaagaaaaatcacaaaaatgtaa

SEQ ID NO: 151690 - DNA, 23 bp, Artificial sequence
  SiRNA target sequence
aagaaaaatcacaaaaatgtaat

SEQ ID NO: 151691 - DNA, 23 bp, Artificial sequence
  SiRNA target sequence
agaaaaatcacaaaaatgtaatc

SEQ ID NO: 151692 - DNA, 23 bp, Artificial sequence
  SiRNA target sequence
gaaaaatcacaaaaatgtaatca

SEQ ID NO: 151693 - DNA, 23 bp, Artificial sequence
  SiRNA target sequence
aaaaatcacaaaaatgtaatcaa

SEQ ID NO: 151694 - DNA, 23 bp, Artificial sequence
  SiRNA target sequence
aaaatcacaaaaatgtaatcaag

SEQ ID NO: 151695 - DNA, 23 bp, Artificial sequence
  SiRNA target sequence
aaatcacaaaaatgtaatcaagc

SEQ ID NO: 151696 - DNA, 23 bp, Artificial sequence
  SiRNA target sequence
aatcacaaaaatgtaatcaagct

SEQ ID NO: 151697 - DNA, 23 bp, Artificial sequence
  SiRNA target sequence
atcacaaaaatgtaatcaagcta

SEQ ID NO: 151698 - DNA, 23 bp, Artificial sequence
  SiRNA target sequence
tcacaaaaatgtaatcaagctaa

SEQ ID NO: 151699 - DNA, 23 bp, Artificial sequence
  SiRNA target sequence
cacaaaaatgtaatcaagctaaa

SEQ ID NO: 151700 - DNA, 23 bp, Artificial sequence
  SiRNA target sequence
acaaaaatgtaatcaagctaaag

SEQ ID NO: 151701 - DNA, 23 bp, Artificial sequence
  SiRNA target sequence
caaaaatgtaatcaagctaaagc

SEQ ID NO: 151702 - DNA, 23 bp, Artificial sequence
  SiRNA target sequence
aaaaatgtaatcaagctaaagca

SEQ ID NO: 151703 - DNA, 23 bp, Artificial sequence
  SiRNA target sequence
aaaatgtaatcaagctaaagcag

SEQ ID NO: 151704 - DNA, 23 bp, Artificial sequence
  SiRNA target sequence
aaatgtaatcaagctaaagcagt

SEQ ID NO: 151705 - DNA, 23 bp, Artificial sequence
  SiRNA target sequence
aatgtaatcaagctaaagcagtt

SEQ ID NO: 151706 - DNA, 23 bp, Artificial sequence
  SiRNA target sequence
atgtaatcaagctaaagcagttt

SEQ ID NO: 151707 - DNA, 23 bp, Artificial sequence
  SiRNA target sequence
tgtaatcaagctaaagcagtttt

SEQ ID NO: 151708 - DNA, 23 bp, Artificial sequence
  SiRNA target sequence
gtaatcaagctaaagcagtttta

SEQ ID NO: 151709 - DNA, 23 bp, Artificial sequence
  SiRNA target sequence
taatcaagctaaagcagttttat

SEQ ID NO: 151710 - DNA, 23 bp, Artificial sequence
  SiRNA target sequence
aatcaagctaaagcagttttatt

SEQ ID NO: 151711 - DNA, 23 bp, Artificial sequence
  SiRNA target sequence
atcaagctaaagcagttttattt

SEQ ID NO: 151712 - DNA, 23 bp, Artificial sequence
  SiRNA target sequence
tcaagctaaagcagttttatttg

SEQ ID NO: 151713 - DNA, 23 bp, Artificial sequence
  SiRNA target sequence
caagctaaagcagttttatttga

SEQ ID NO: 151714 - DNA, 23 bp, Artificial sequence
  SiRNA target sequence
aagctaaagcagttttatttgat

SEQ ID NO: 151715 - DNA, 23 bp, Artificial sequence
  SiRNA target sequence
agctaaagcagttttatttgatg

SEQ ID NO: 151716 - DNA, 23 bp, Artificial sequence
  SiRNA target sequence
gctaaagcagttttatttgatga

SEQ ID NO: 151717 - DNA, 23 bp, Artificial sequence
  SiRNA target sequence
ctaaagcagttttatttgatgag

SEQ ID NO: 151718 - DNA, 23 bp, Artificial sequence
  SiRNA target sequence
taaagcagttttatttgatgaga

SEQ ID NO: 151719 - DNA, 23 bp, Artificial sequence
  SiRNA target sequence
aaagcagttttatttgatgagaa

SEQ ID NO: 151720 - DNA, 23 bp, Artificial sequence
  SiRNA target sequence
aagcagttttatttgatgagaaa

SEQ ID NO: 151721 - DNA, 23 bp, Artificial sequence
  SiRNA target sequence
agcagttttatttgatgagaaaa

SEQ ID NO: 151722 - DNA, 23 bp, Artificial sequence
  SiRNA target sequence
gcagttttatttgatgagaaaaa

SEQ ID NO: 151723 - DNA, 23 bp, Artificial sequence
  SiRNA target sequence
cagttttatttgatgagaaaaaa

SEQ ID NO: 151724 - DNA, 23 bp, Artificial sequence
  SiRNA target sequence
agttttatttgatgagaaaaaaa

SEQ ID NO: 151725 - DNA, 23 bp, Artificial sequence
  SiRNA target sequence
gttttatttgatgagaaaaaaaa

SEQ ID NO: 151726 - DNA, 23 bp, Artificial sequence
  SiRNA target sequence
ttttatttgatgagaaaaaaaag

SEQ ID NO: 151727 - DNA, 23 bp, Artificial sequence
  SiRNA target sequence
tttatttgatgagaaaaaaaagc

SEQ ID NO: 151728 - DNA, 23 bp, Artificial sequence
  SiRNA target sequence
ttatttgatgagaaaaaaaagca

SEQ ID NO: 151729 - DNA, 23 bp, Artificial sequence
  SiRNA target sequence
tatttgatgagaaaaaaaagcaa

SEQ ID NO: 151730 - DNA, 23 bp, Artificial sequence
  SiRNA target sequence
atttgatgagaaaaaaaagcaag

SEQ ID NO: 151731 - DNA, 23 bp, Artificial sequence
  SiRNA target sequence
tttgatgagaaaaaaaagcaaga

SEQ ID NO: 151732 - DNA, 23 bp, Artificial sequence
  SiRNA target sequence
ttgatgagaaaaaaaagcaagag

SEQ ID NO: 151733 - DNA, 23 bp, Artificial sequence
  SiRNA target sequence
tgatgagaaaaaaaagcaagagt

SEQ ID NO: 151734 - DNA, 23 bp, Artificial sequence
  SiRNA target sequence
gatgagaaaaaaaagcaagagta

SEQ ID NO: 151735 - DNA, 23 bp, Artificial sequence
  SiRNA target sequence
atgagaaaaaaaagcaagagtat

SEQ ID NO: 151736 - DNA, 23 bp, Artificial sequence
  SiRNA target sequence
tgagaaaaaaaagcaagagtatg

SEQ ID NO: 151737 - DNA, 23 bp, Artificial sequence
  SiRNA target sequence
gagaaaaaaaagcaagagtatga

SEQ ID NO: 151738 - DNA, 23 bp, Artificial sequence
  SiRNA target sequence
agaaaaaaaagcaagagtatgat

SEQ ID NO: 151739 - DNA, 23 bp, Artificial sequence
  SiRNA target sequence
gaaaaaaaagcaagagtatgata

SEQ ID NO: 151740 - DNA, 23 bp, Artificial sequence
  SiRNA target sequence
aaaaaaaagcaagagtatgatat

SEQ ID NO: 151741 - DNA, 23 bp, Artificial sequence
  SiRNA target sequence
aaaaaaagcaagagtatgatatg

SEQ ID NO: 151742 - DNA, 23 bp, Artificial sequence
  SiRNA target sequence
aaaaaagcaagagtatgatatgg

SEQ ID NO: 151743 - DNA, 23 bp, Artificial sequence
  SiRNA target sequence
aaaaagcaagagtatgatatggg

SEQ ID NO: 151744 - DNA, 23 bp, Artificial sequence
  SiRNA target sequence
aaaagcaagagtatgatatggga

SEQ ID NO: 151745 - DNA, 23 bp, Artificial sequence
  SiRNA target sequence
aaagcaagagtatgatatgggaa

SEQ ID NO: 151746 - DNA, 23 bp, Artificial sequence
  SiRNA target sequence
aagcaagagtatgatatgggaat

SEQ ID NO: 151747 - DNA, 23 bp, Artificial sequence
  SiRNA target sequence
agcaagagtatgatatgggaatg

SEQ ID NO: 151748 - DNA, 23 bp, Artificial sequence
  SiRNA target sequence
gcaagagtatgatatgggaatga

SEQ ID NO: 151749 - DNA, 23 bp, Artificial sequence
  SiRNA target sequence
caagagtatgatatgggaatgac

SEQ ID NO: 151750 - DNA, 23 bp, Artificial sequence
  SiRNA target sequence
aagagtatgatatgggaatgact

SEQ ID NO: 151751 - DNA, 23 bp, Artificial sequence
  SiRNA target sequence
agagtatgatatgggaatgactg

SEQ ID NO: 151752 - DNA, 23 bp, Artificial sequence
  SiRNA target sequence
gagtatgatatgggaatgactgg

SEQ ID NO: 151753 - DNA, 23 bp, Artificial sequence
  SiRNA target sequence
agtatgatatgggaatgactggc

SEQ ID NO: 151754 - DNA, 23 bp, Artificial sequence
  SiRNA target sequence
gtatgatatgggaatgactggcg

SEQ ID NO: 151755 - DNA, 23 bp, Artificial sequence
  SiRNA target sequence
tatgatatgggaatgactggcga

SEQ ID NO: 151756 - DNA, 23 bp, Artificial sequence
  SiRNA target sequence
atgatatgggaatgactggcgat

SEQ ID NO: 151757 - DNA, 23 bp, Artificial sequence
  SiRNA target sequence
tgatatgggaatgactggcgatt

SEQ ID NO: 151758 - DNA, 23 bp, Artificial sequence
  SiRNA target sequence
gatatgggaatgactggcgattt

SEQ ID NO: 151759 - DNA, 23 bp, Artificial sequence
  SiRNA target sequence
atatgggaatgactggcgatttt

SEQ ID NO: 151760 - DNA, 23 bp, Artificial sequence
  SiRNA target sequence
tatgggaatgactggcgattttg

SEQ ID NO: 151761 - DNA, 23 bp, Artificial sequence
  SiRNA target sequence
atgggaatgactggcgattttgg

SEQ ID NO: 151762 - DNA, 23 bp, Artificial sequence
  SiRNA target sequence
tgggaatgactggcgattttgga

SEQ ID NO: 151763 - DNA, 23 bp, Artificial sequence
  SiRNA target sequence
gggaatgactggcgattttggat

SEQ ID NO: 151764 - DNA, 23 bp, Artificial sequence
  SiRNA target sequence
ggaatgactggcgattttggatt

SEQ ID NO: 151765 - DNA, 23 bp, Artificial sequence
  SiRNA target sequence
gaatgactggcgattttggattt

SEQ ID NO: 151766 - DNA, 23 bp, Artificial sequence
  SiRNA target sequence
aatgactggcgattttggatttt

SEQ ID NO: 151767 - DNA, 23 bp, Artificial sequence
  SiRNA target sequence
atgactggcgattttggattttc

SEQ ID NO: 151768 - DNA, 23 bp, Artificial sequence
  SiRNA target sequence
tgactggcgattttggattttct

SEQ ID NO: 151769 - DNA, 23 bp, Artificial sequence
  SiRNA target sequence
gactggcgattttggattttctg

SEQ ID NO: 151770 - DNA, 23 bp, Artificial sequence
  SiRNA target sequence
actggcgattttggattttctgc

SEQ ID NO: 151771 - DNA, 23 bp, Artificial sequence
  SiRNA target sequence
ctggcgattttggattttctgca

SEQ ID NO: 151772 - DNA, 23 bp, Artificial sequence
  SiRNA target sequence
tggcgattttggattttctgcag

SEQ ID NO: 151773 - DNA, 23 bp, Artificial sequence
  SiRNA target sequence
ggcgattttggattttctgcagg

SEQ ID NO: 151774 - DNA, 23 bp, Artificial sequence
  SiRNA target sequence
gcgattttggattttctgcaggt

SEQ ID NO: 151775 - DNA, 23 bp, Artificial sequence
  SiRNA target sequence
cgattttggattttctgcaggtg

SEQ ID NO: 151776 - DNA, 23 bp, Artificial sequence
  SiRNA target sequence
gattttggattttctgcaggtgg

SEQ ID NO: 151777 - DNA, 23 bp, Artificial sequence
  SiRNA target sequence
attttggattttctgcaggtggt

SEQ ID NO: 151778 - DNA, 23 bp, Artificial sequence
  SiRNA target sequence
ttttggattttctgcaggtggtg

SEQ ID NO: 151779 - DNA, 23 bp, Artificial sequence
  SiRNA target sequence
tttggattttctgcaggtggtgg

SEQ ID NO: 151780 - DNA, 23 bp, Artificial sequence
  SiRNA target sequence
ttggattttctgcaggtggtgga

SEQ ID NO: 151781 - DNA, 23 bp, Artificial sequence
  SiRNA target sequence
tggattttctgcaggtggtggag

SEQ ID NO: 151782 - DNA, 23 bp, Artificial sequence
  SiRNA target sequence
ggattttctgcaggtggtggaga

SEQ ID NO: 151783 - DNA, 23 bp, Artificial sequence
  SiRNA target sequence
gattttctgcaggtggtggagac

SEQ ID NO: 151784 - DNA, 23 bp, Artificial sequence
  SiRNA target sequence
attttctgcaggtggtggagact

SEQ ID NO: 151785 - DNA, 23 bp, Artificial sequence
  SiRNA target sequence
ttttctgcaggtggtggagactt

SEQ ID NO: 151786 - DNA, 23 bp, Artificial sequence
  SiRNA target sequence
tttctgcaggtggtggagacttt

SEQ ID NO: 151787 - DNA, 23 bp, Artificial sequence
  SiRNA target sequence
ttctgcaggtggtggagactttt

SEQ ID NO: 151788 - DNA, 23 bp, Artificial sequence
  SiRNA target sequence
tctgcaggtggtggagacttttt

SEQ ID NO: 151789 - DNA, 23 bp, Artificial sequence
  SiRNA target sequence
ctgcaggtggtggagactttttc

SEQ ID NO: 151790 - DNA, 23 bp, Artificial sequence
  SiRNA target sequence
tgcaggtggtggagactttttcg

SEQ ID NO: 151791 - DNA, 23 bp, Artificial sequence
  SiRNA target sequence
gcaggtggtggagactttttcga

SEQ ID NO: 151792 - DNA, 23 bp, Artificial sequence
  SiRNA target sequence
caggtggtggagactttttcgat

SEQ ID NO: 151793 - DNA, 23 bp, Artificial sequence
  SiRNA target sequence
aggtggtggagactttttcgata

SEQ ID NO: 151794 - DNA, 23 bp, Artificial sequence
  SiRNA target sequence
ggtggtggagactttttcgatat

SEQ ID NO: 151795 - DNA, 23 bp, Artificial sequence
  SiRNA target sequence
gtggtggagactttttcgatatt

SEQ ID NO: 151796 - DNA, 23 bp, Artificial sequence
  SiRNA target sequence
tggtggagactttttcgatattt

SEQ ID NO: 151797 - DNA, 23 bp, Artificial sequence
  SiRNA target sequence
ggtggagactttttcgatatttt

SEQ ID NO: 151798 - DNA, 23 bp, Artificial sequence
  SiRNA target sequence
gtggagactttttcgatattttt

SEQ ID NO: 151799 - DNA, 23 bp, Artificial sequence
  SiRNA target sequence
tggagactttttcgatatttttt

SEQ ID NO: 151800 - DNA, 23 bp, Artificial sequence
  SiRNA target sequence
ggagactttttcgatattttttc

SEQ ID NO: 151801 - DNA, 23 bp, Artificial sequence
  SiRNA target sequence
gagactttttcgatattttttca

SEQ ID NO: 151802 - DNA, 23 bp, Artificial sequence
  SiRNA target sequence
agactttttcgatattttttcaa

SEQ ID NO: 151803 - DNA, 23 bp, Artificial sequence
  SiRNA target sequence
gactttttcgatattttttcaag

SEQ ID NO: 151804 - DNA, 23 bp, Artificial sequence
  SiRNA target sequence
actttttcgatattttttcaagt

SEQ ID NO: 151805 - DNA, 23 bp, Artificial sequence
  SiRNA target sequence
ctttttcgatattttttcaagtt

SEQ ID NO: 151806 - DNA, 23 bp, Artificial sequence
  SiRNA target sequence
tttttcgatattttttcaagttt

SEQ ID NO: 151807 - DNA, 23 bp, Artificial sequence
  SiRNA target sequence
ttttcgatattttttcaagtttt

SEQ ID NO: 151808 - DNA, 23 bp, Artificial sequence
  SiRNA target sequence
tttcgatattttttcaagtttta

SEQ ID NO: 151809 - DNA, 23 bp, Artificial sequence
  SiRNA target sequence
ttcgatattttttcaagttttac

SEQ ID NO: 151810 - DNA, 23 bp, Artificial sequence
  SiRNA target sequence
tcgatattttttcaagttttact

SEQ ID NO: 151811 - DNA, 23 bp, Artificial sequence
  SiRNA target sequence
cgatattttttcaagttttactg

SEQ ID NO: 151812 - DNA, 23 bp, Artificial sequence
  SiRNA target sequence
gatattttttcaagttttactgg

SEQ ID NO: 151813 - DNA, 23 bp, Artificial sequence
  SiRNA target sequence
atattttttcaagttttactggt

SEQ ID NO: 151814 - DNA, 23 bp, Artificial sequence
  SiRNA target sequence
tattttttcaagttttactggtg

SEQ ID NO: 151815 - DNA, 23 bp, Artificial sequence
  SiRNA target sequence
attttttcaagttttactggtgg

SEQ ID NO: 151816 - DNA, 23 bp, Artificial sequence
  SiRNA target sequence
ttttttcaagttttactggtgga

SEQ ID NO: 151817 - DNA, 23 bp, Artificial sequence
  SiRNA target sequence
tttttcaagttttactggtggag

SEQ ID NO: 151818 - DNA, 23 bp, Artificial sequence
  SiRNA target sequence
ttttcaagttttactggtggagg

SEQ ID NO: 151819 - DNA, 23 bp, Artificial sequence
  SiRNA target sequence
tttcaagttttactggtggagga

SEQ ID NO: 151820 - DNA, 23 bp, Artificial sequence
  SiRNA target sequence
ttcaagttttactggtggaggaa

SEQ ID NO: 151821 - DNA, 23 bp, Artificial sequence
  SiRNA target sequence
tcaagttttactggtggaggaag

SEQ ID NO: 151822 - DNA, 23 bp, Artificial sequence
  SiRNA target sequence
caagttttactggtggaggaaga

SEQ ID NO: 151823 - DNA, 23 bp, Artificial sequence
  SiRNA target sequence
aagttttactggtggaggaagaa

SEQ ID NO: 151824 - DNA, 23 bp, Artificial sequence
  SiRNA target sequence
agttttactggtggaggaagaag

SEQ ID NO: 151825 - DNA, 23 bp, Artificial sequence
  SiRNA target sequence
gttttactggtggaggaagaaga

SEQ ID NO: 151826 - DNA, 23 bp, Artificial sequence
  SiRNA target sequence
ttttactggtggaggaagaagaa

SEQ ID NO: 151827 - DNA, 23 bp, Artificial sequence
  SiRNA target sequence
tttactggtggaggaagaagaaa

SEQ ID NO: 151828 - DNA, 23 bp, Artificial sequence
  SiRNA target sequence
ttactggtggaggaagaagaaat

SEQ ID NO: 151829 - DNA, 23 bp, Artificial sequence
  SiRNA target sequence
tactggtggaggaagaagaaatc

SEQ ID NO: 151830 - DNA, 23 bp, Artificial sequence
  SiRNA target sequence
actggtggaggaagaagaaatcg

SEQ ID NO: 151831 - DNA, 23 bp, Artificial sequence
  SiRNA target sequence
ctggtggaggaagaagaaatcga

SEQ ID NO: 151832 - DNA, 23 bp, Artificial sequence
  SiRNA target sequence
tggtggaggaagaagaaatcgag

SEQ ID NO: 151833 - DNA, 23 bp, Artificial sequence
  SiRNA target sequence
ggtggaggaagaagaaatcgagt

SEQ ID NO: 151834 - DNA, 23 bp, Artificial sequence
  SiRNA target sequence
gtggaggaagaagaaatcgagta

SEQ ID NO: 151835 - DNA, 23 bp, Artificial sequence
  SiRNA target sequence
tggaggaagaagaaatcgagtac

SEQ ID NO: 151836 - DNA, 23 bp, Artificial sequence
  SiRNA target sequence
ggaggaagaagaaatcgagtaca

SEQ ID NO: 151837 - DNA, 23 bp, Artificial sequence
  SiRNA target sequence
gaggaagaagaaatcgagtacaa

SEQ ID NO: 151838 - DNA, 23 bp, Artificial sequence
  SiRNA target sequence
aggaagaagaaatcgagtacaaa

SEQ ID NO: 151839 - DNA, 23 bp, Artificial sequence
  SiRNA target sequence
ggaagaagaaatcgagtacaaaa

SEQ ID NO: 151840 - DNA, 23 bp, Artificial sequence
  SiRNA target sequence
gaagaagaaatcgagtacaaaaa

SEQ ID NO: 151841 - DNA, 23 bp, Artificial sequence
  SiRNA target sequence
aagaagaaatcgagtacaaaaag

SEQ ID NO: 151842 - DNA, 23 bp, Artificial sequence
  SiRNA target sequence
agaagaaatcgagtacaaaaagt

SEQ ID NO: 151843 - DNA, 23 bp, Artificial sequence
  SiRNA target sequence
gaagaaatcgagtacaaaaagtt

SEQ ID NO: 151844 - DNA, 23 bp, Artificial sequence
  SiRNA target sequence
aagaaatcgagtacaaaaagttc

SEQ ID NO: 151845 - DNA, 23 bp, Artificial sequence
  SiRNA target sequence
agaaatcgagtacaaaaagttca

SEQ ID NO: 151846 - DNA, 23 bp, Artificial sequence
  SiRNA target sequence
gaaatcgagtacaaaaagttcaa

SEQ ID NO: 151847 - DNA, 23 bp, Artificial sequence
  SiRNA target sequence
aaatcgagtacaaaaagttcaag

SEQ ID NO: 151848 - DNA, 23 bp, Artificial sequence
  SiRNA target sequence
aatcgagtacaaaaagttcaaga

SEQ ID NO: 151849 - DNA, 23 bp, Artificial sequence
  SiRNA target sequence
atcgagtacaaaaagttcaagat

SEQ ID NO: 151850 - DNA, 23 bp, Artificial sequence
  SiRNA target sequence
tcgagtacaaaaagttcaagata

SEQ ID NO: 151851 - DNA, 23 bp, Artificial sequence
  SiRNA target sequence
cgagtacaaaaagttcaagatac

SEQ ID NO: 151852 - DNA, 23 bp, Artificial sequence
  SiRNA target sequence
gagtacaaaaagttcaagataca

SEQ ID NO: 151853 - DNA, 23 bp, Artificial sequence
  SiRNA target sequence
agtacaaaaagttcaagatacag

SEQ ID NO: 151854 - DNA, 23 bp, Artificial sequence
  SiRNA target sequence
gtacaaaaagttcaagatacaga

SEQ ID NO: 151855 - DNA, 23 bp, Artificial sequence
  SiRNA target sequence
tacaaaaagttcaagatacagaa

SEQ ID NO: 151856 - DNA, 23 bp, Artificial sequence
  SiRNA target sequence
acaaaaagttcaagatacagaat

SEQ ID NO: 151857 - DNA, 23 bp, Artificial sequence
  SiRNA target sequence
caaaaagttcaagatacagaata

SEQ ID NO: 151858 - DNA, 23 bp, Artificial sequence
  SiRNA target sequence
aaaaagttcaagatacagaatac

SEQ ID NO: 151859 - DNA, 23 bp, Artificial sequence
  SiRNA target sequence
aaaagttcaagatacagaatacg

SEQ ID NO: 151860 - DNA, 23 bp, Artificial sequence
  SiRNA target sequence
aaagttcaagatacagaatacga

SEQ ID NO: 151861 - DNA, 23 bp, Artificial sequence
  SiRNA target sequence
aagttcaagatacagaatacgag

SEQ ID NO: 151862 - DNA, 23 bp, Artificial sequence
  SiRNA target sequence
agttcaagatacagaatacgagt

SEQ ID NO: 151863 - DNA, 23 bp, Artificial sequence
  SiRNA target sequence
gttcaagatacagaatacgagtt

SEQ ID NO: 151864 - DNA, 23 bp, Artificial sequence
  SiRNA target sequence
ttcaagatacagaatacgagttt

SEQ ID NO: 151865 - DNA, 23 bp, Artificial sequence
  SiRNA target sequence
tcaagatacagaatacgagttta

SEQ ID NO: 151866 - DNA, 23 bp, Artificial sequence
  SiRNA target sequence
caagatacagaatacgagtttaa

SEQ ID NO: 151867 - DNA, 23 bp, Artificial sequence
  SiRNA target sequence
aagatacagaatacgagtttaat

SEQ ID NO: 151868 - DNA, 23 bp, Artificial sequence
  SiRNA target sequence
agatacagaatacgagtttaata

SEQ ID NO: 151869 - DNA, 23 bp, Artificial sequence
  SiRNA target sequence
gatacagaatacgagtttaatat

SEQ ID NO: 151870 - DNA, 23 bp, Artificial sequence
  SiRNA target sequence
atacagaatacgagtttaatatt

SEQ ID NO: 151871 - DNA, 23 bp, Artificial sequence
  SiRNA target sequence
tacagaatacgagtttaatattt

SEQ ID NO: 151872 - DNA, 23 bp, Artificial sequence
  SiRNA target sequence
acagaatacgagtttaatatttc

SEQ ID NO: 151873 - DNA, 23 bp, Artificial sequence
  SiRNA target sequence
cagaatacgagtttaatatttcg

SEQ ID NO: 151874 - DNA, 23 bp, Artificial sequence
  SiRNA target sequence
agaatacgagtttaatatttcgt

SEQ ID NO: 151875 - DNA, 23 bp, Artificial sequence
  SiRNA target sequence
gaatacgagtttaatatttcgtt

SEQ ID NO: 151876 - DNA, 23 bp, Artificial sequence
  SiRNA target sequence
aatacgagtttaatatttcgttg

SEQ ID NO: 151877 - DNA, 23 bp, Artificial sequence
  SiRNA target sequence
atacgagtttaatatttcgttga

SEQ ID NO: 151878 - DNA, 23 bp, Artificial sequence
  SiRNA target sequence
tacgagtttaatatttcgttgaa

SEQ ID NO: 151879 - DNA, 23 bp, Artificial sequence
  SiRNA target sequence
acgagtttaatatttcgttgaag

SEQ ID NO: 151880 - DNA, 23 bp, Artificial sequence
  SiRNA target sequence
cgagtttaatatttcgttgaagg

SEQ ID NO: 151881 - DNA, 23 bp, Artificial sequence
  SiRNA target sequence
gagtttaatatttcgttgaagga

SEQ ID NO: 151882 - DNA, 23 bp, Artificial sequence
  SiRNA target sequence
agtttaatatttcgttgaaggaa

SEQ ID NO: 151883 - DNA, 23 bp, Artificial sequence
  SiRNA target sequence
gtttaatatttcgttgaaggaag

SEQ ID NO: 151884 - DNA, 23 bp, Artificial sequence
  SiRNA target sequence
tttaatatttcgttgaaggaagc

SEQ ID NO: 151885 - DNA, 23 bp, Artificial sequence
  SiRNA target sequence
ttaatatttcgttgaaggaagct

SEQ ID NO: 151886 - DNA, 23 bp, Artificial sequence
  SiRNA target sequence
taatatttcgttgaaggaagctt

SEQ ID NO: 151887 - DNA, 23 bp, Artificial sequence
  SiRNA target sequence
aatatttcgttgaaggaagctta

SEQ ID NO: 151888 - DNA, 23 bp, Artificial sequence
  SiRNA target sequence
atatttcgttgaaggaagcttat

SEQ ID NO: 151889 - DNA, 23 bp, Artificial sequence
  SiRNA target sequence
tatttcgttgaaggaagcttata

SEQ ID NO: 151890 - DNA, 23 bp, Artificial sequence
  SiRNA target sequence
atttcgttgaaggaagcttatat

SEQ ID NO: 151891 - DNA, 23 bp, Artificial sequence
  SiRNA target sequence
tttcgttgaaggaagcttatatg

SEQ ID NO: 151892 - DNA, 23 bp, Artificial sequence
  SiRNA target sequence
ttcgttgaaggaagcttatatgg

SEQ ID NO: 151893 - DNA, 23 bp, Artificial sequence
  SiRNA target sequence
tcgttgaaggaagcttatatggg

SEQ ID NO: 151894 - DNA, 23 bp, Artificial sequence
  SiRNA target sequence
cgttgaaggaagcttatatggga

SEQ ID NO: 151895 - DNA, 23 bp, Artificial sequence
  SiRNA target sequence
gttgaaggaagcttatatgggaa

SEQ ID NO: 151896 - DNA, 23 bp, Artificial sequence
  SiRNA target sequence
ttgaaggaagcttatatgggaaa

SEQ ID NO: 151897 - DNA, 23 bp, Artificial sequence
  SiRNA target sequence
tgaaggaagcttatatgggaaag

SEQ ID NO: 151898 - DNA, 23 bp, Artificial sequence
  SiRNA target sequence
gaaggaagcttatatgggaaagc

SEQ ID NO: 151899 - DNA, 23 bp, Artificial sequence
  SiRNA target sequence
aaggaagcttatatgggaaagcg

SEQ ID NO: 151900 - DNA, 23 bp, Artificial sequence
  SiRNA target sequence
aggaagcttatatgggaaagcga

SEQ ID NO: 151901 - DNA, 23 bp, Artificial sequence
  SiRNA target sequence
ggaagcttatatgggaaagcgag

SEQ ID NO: 151902 - DNA, 23 bp, Artificial sequence
  SiRNA target sequence
gaagcttatatgggaaagcgagc

SEQ ID NO: 151903 - DNA, 23 bp, Artificial sequence
  SiRNA target sequence
aagcttatatgggaaagcgagct

SEQ ID NO: 151904 - DNA, 23 bp, Artificial sequence
  SiRNA target sequence
agcttatatgggaaagcgagcta

SEQ ID NO: 151905 - DNA, 23 bp, Artificial sequence
  SiRNA target sequence
gcttatatgggaaagcgagctag

SEQ ID NO: 151906 - DNA, 23 bp, Artificial sequence
  SiRNA target sequence
cttatatgggaaagcgagctagt

SEQ ID NO: 151907 - DNA, 23 bp, Artificial sequence
  SiRNA target sequence
ttatatgggaaagcgagctagtt

SEQ ID NO: 151908 - DNA, 23 bp, Artificial sequence
  SiRNA target sequence
tatatgggaaagcgagctagttt

SEQ ID NO: 151909 - DNA, 23 bp, Artificial sequence
  SiRNA target sequence
atatgggaaagcgagctagtttt

SEQ ID NO: 151910 - DNA, 23 bp, Artificial sequence
  SiRNA target sequence
tatgggaaagcgagctagtttta

SEQ ID NO: 151911 - DNA, 23 bp, Artificial sequence
  SiRNA target sequence
atgggaaagcgagctagttttaa

SEQ ID NO: 151912 - DNA, 23 bp, Artificial sequence
  SiRNA target sequence
tgggaaagcgagctagttttaat

SEQ ID NO: 151913 - DNA, 23 bp, Artificial sequence
  SiRNA target sequence
gggaaagcgagctagttttaatg

SEQ ID NO: 151914 - DNA, 23 bp, Artificial sequence
  SiRNA target sequence
ggaaagcgagctagttttaatgt

SEQ ID NO: 151915 - DNA, 23 bp, Artificial sequence
  SiRNA target sequence
gaaagcgagctagttttaatgta

SEQ ID NO: 151916 - DNA, 23 bp, Artificial sequence
  SiRNA target sequence
aaagcgagctagttttaatgtaa

SEQ ID NO: 151917 - DNA, 23 bp, Artificial sequence
  SiRNA target sequence
aagcgagctagttttaatgtaaa

SEQ ID NO: 151918 - DNA, 23 bp, Artificial sequence
  SiRNA target sequence
agcgagctagttttaatgtaaaa

SEQ ID NO: 151919 - DNA, 23 bp, Artificial sequence
  SiRNA target sequence
gcgagctagttttaatgtaaaag

SEQ ID NO: 151920 - DNA, 23 bp, Artificial sequence
  SiRNA target sequence
cgagctagttttaatgtaaaagt

SEQ ID NO: 151921 - DNA, 23 bp, Artificial sequence
  SiRNA target sequence
gagctagttttaatgtaaaagtg

SEQ ID NO: 151922 - DNA, 23 bp, Artificial sequence
  SiRNA target sequence
agctagttttaatgtaaaagtgc

SEQ ID NO: 151923 - DNA, 23 bp, Artificial sequence
  SiRNA target sequence
gctagttttaatgtaaaagtgca

SEQ ID NO: 151924 - DNA, 23 bp, Artificial sequence
  SiRNA target sequence
ctagttttaatgtaaaagtgcaa

SEQ ID NO: 151925 - DNA, 23 bp, Artificial sequence
  SiRNA target sequence
tagttttaatgtaaaagtgcaaa

SEQ ID NO: 151926 - DNA, 23 bp, Artificial sequence
  SiRNA target sequence
agttttaatgtaaaagtgcaaag

SEQ ID NO: 151927 - DNA, 23 bp, Artificial sequence
  SiRNA target sequence
gttttaatgtaaaagtgcaaaga

SEQ ID NO: 151928 - DNA, 23 bp, Artificial sequence
  SiRNA target sequence
ttttaatgtaaaagtgcaaagag

SEQ ID NO: 151929 - DNA, 23 bp, Artificial sequence
  SiRNA target sequence
tttaatgtaaaagtgcaaagaga

SEQ ID NO: 151930 - DNA, 23 bp, Artificial sequence
  SiRNA target sequence
ttaatgtaaaagtgcaaagagaa

SEQ ID NO: 151931 - DNA, 23 bp, Artificial sequence
  SiRNA target sequence
taatgtaaaagtgcaaagagaat

SEQ ID NO: 151932 - DNA, 23 bp, Artificial sequence
  SiRNA target sequence
aatgtaaaagtgcaaagagaatg

SEQ ID NO: 151933 - DNA, 23 bp, Artificial sequence
  SiRNA target sequence
atgtaaaagtgcaaagagaatgt

SEQ ID NO: 151934 - DNA, 23 bp, Artificial sequence
  SiRNA target sequence
tgtaaaagtgcaaagagaatgtt

SEQ ID NO: 151935 - DNA, 23 bp, Artificial sequence
  SiRNA target sequence
gtaaaagtgcaaagagaatgttc

SEQ ID NO: 151936 - DNA, 23 bp, Artificial sequence
  SiRNA target sequence
taaaagtgcaaagagaatgttct

SEQ ID NO: 151937 - DNA, 23 bp, Artificial sequence
  SiRNA target sequence
aaaagtgcaaagagaatgttctg

SEQ ID NO: 151938 - DNA, 23 bp, Artificial sequence
  SiRNA target sequence
aaagtgcaaagagaatgttctgc

SEQ ID NO: 151939 - DNA, 23 bp, Artificial sequence
  SiRNA target sequence
aagtgcaaagagaatgttctgcg

SEQ ID NO: 151940 - DNA, 23 bp, Artificial sequence
  SiRNA target sequence
agtgcaaagagaatgttctgcgt

SEQ ID NO: 151941 - DNA, 23 bp, Artificial sequence
  SiRNA target sequence
gtgcaaagagaatgttctgcgtg

SEQ ID NO: 151942 - DNA, 23 bp, Artificial sequence
  SiRNA target sequence
tgcaaagagaatgttctgcgtgt

SEQ ID NO: 151943 - DNA, 23 bp, Artificial sequence
  SiRNA target sequence
gcaaagagaatgttctgcgtgta

SEQ ID NO: 151944 - DNA, 23 bp, Artificial sequence
  SiRNA target sequence
caaagagaatgttctgcgtgtaa

SEQ ID NO: 151945 - DNA, 23 bp, Artificial sequence
  SiRNA target sequence
aaagagaatgttctgcgtgtaac

SEQ ID NO: 151946 - DNA, 23 bp, Artificial sequence
  SiRNA target sequence
aagagaatgttctgcgtgtaacg

SEQ ID NO: 151947 - DNA, 23 bp, Artificial sequence
  SiRNA target sequence
agagaatgttctgcgtgtaacgg

SEQ ID NO: 151948 - DNA, 23 bp, Artificial sequence
  SiRNA target sequence
gagaatgttctgcgtgtaacggt

SEQ ID NO: 151949 - DNA, 23 bp, Artificial sequence
  SiRNA target sequence
agaatgttctgcgtgtaacggta

SEQ ID NO: 151950 - DNA, 23 bp, Artificial sequence
  SiRNA target sequence
gaatgttctgcgtgtaacggtaa

SEQ ID NO: 151951 - DNA, 23 bp, Artificial sequence
  SiRNA target sequence
aatgttctgcgtgtaacggtaaa

SEQ ID NO: 151952 - DNA, 23 bp, Artificial sequence
  SiRNA target sequence
atgttctgcgtgtaacggtaaag

SEQ ID NO: 151953 - DNA, 23 bp, Artificial sequence
  SiRNA target sequence
tgttctgcgtgtaacggtaaagg

SEQ ID NO: 151954 - DNA, 23 bp, Artificial sequence
  SiRNA target sequence
gttctgcgtgtaacggtaaagga

SEQ ID NO: 151955 - DNA, 23 bp, Artificial sequence
  SiRNA target sequence
ttctgcgtgtaacggtaaaggag

SEQ ID NO: 151956 - DNA, 23 bp, Artificial sequence
  SiRNA target sequence
tctgcgtgtaacggtaaaggagg

SEQ ID NO: 151957 - DNA, 23 bp, Artificial sequence
  SiRNA target sequence
ctgcgtgtaacggtaaaggagga

SEQ ID NO: 151958 - DNA, 23 bp, Artificial sequence
  SiRNA target sequence
tgcgtgtaacggtaaaggaggag

SEQ ID NO: 151959 - DNA, 23 bp, Artificial sequence
  SiRNA target sequence
gcgtgtaacggtaaaggaggaga

SEQ ID NO: 151960 - DNA, 23 bp, Artificial sequence
  SiRNA target sequence
cgtgtaacggtaaaggaggagac

SEQ ID NO: 151961 - DNA, 23 bp, Artificial sequence
  SiRNA target sequence
gtgtaacggtaaaggaggagaca

SEQ ID NO: 151962 - DNA, 23 bp, Artificial sequence
  SiRNA target sequence
tgtaacggtaaaggaggagacag

SEQ ID NO: 151963 - DNA, 23 bp, Artificial sequence
  SiRNA target sequence
gtaacggtaaaggaggagacagt

SEQ ID NO: 151964 - DNA, 23 bp, Artificial sequence
  SiRNA target sequence
taacggtaaaggaggagacagtg

SEQ ID NO: 151965 - DNA, 23 bp, Artificial sequence
  SiRNA target sequence
aacggtaaaggaggagacagtgt

SEQ ID NO: 151966 - DNA, 23 bp, Artificial sequence
  SiRNA target sequence
acggtaaaggaggagacagtgtt

SEQ ID NO: 151967 - DNA, 23 bp, Artificial sequence
  SiRNA target sequence
cggtaaaggaggagacagtgttg

SEQ ID NO: 151968 - DNA, 23 bp, Artificial sequence
  SiRNA target sequence
ggtaaaggaggagacagtgttga

SEQ ID NO: 151969 - DNA, 23 bp, Artificial sequence
  SiRNA target sequence
gtaaaggaggagacagtgttgaa

SEQ ID NO: 151970 - DNA, 23 bp, Artificial sequence
  SiRNA target sequence
taaaggaggagacagtgttgaaa

SEQ ID NO: 151971 - DNA, 23 bp, Artificial sequence
  SiRNA target sequence
aaaggaggagacagtgttgaaac

SEQ ID NO: 151972 - DNA, 23 bp, Artificial sequence
  SiRNA target sequence
aaggaggagacagtgttgaaaca

SEQ ID NO: 151973 - DNA, 23 bp, Artificial sequence
  SiRNA target sequence
aggaggagacagtgttgaaacat

SEQ ID NO: 151974 - DNA, 23 bp, Artificial sequence
  SiRNA target sequence
ggaggagacagtgttgaaacatg

SEQ ID NO: 151975 - DNA, 23 bp, Artificial sequence
  SiRNA target sequence
gaggagacagtgttgaaacatgt

SEQ ID NO: 151976 - DNA, 23 bp, Artificial sequence
  SiRNA target sequence
aggagacagtgttgaaacatgtg

SEQ ID NO: 151977 - DNA, 23 bp, Artificial sequence
  SiRNA target sequence
ggagacagtgttgaaacatgtga

SEQ ID NO: 151978 - DNA, 23 bp, Artificial sequence
  SiRNA target sequence
gagacagtgttgaaacatgtgaa

SEQ ID NO: 151979 - DNA, 23 bp, Artificial sequence
  SiRNA target sequence
agacagtgttgaaacatgtgaac

SEQ ID NO: 151980 - DNA, 23 bp, Artificial sequence
  SiRNA target sequence
gacagtgttgaaacatgtgaacc

SEQ ID NO: 151981 - DNA, 23 bp, Artificial sequence
  SiRNA target sequence
acagtgttgaaacatgtgaacca

SEQ ID NO: 151982 - DNA, 23 bp, Artificial sequence
  SiRNA target sequence
cagtgttgaaacatgtgaaccat

SEQ ID NO: 151983 - DNA, 23 bp, Artificial sequence
  SiRNA target sequence
agtgttgaaacatgtgaaccatg

SEQ ID NO: 151984 - DNA, 23 bp, Artificial sequence
  SiRNA target sequence
gtgttgaaacatgtgaaccatgt

SEQ ID NO: 151985 - DNA, 23 bp, Artificial sequence
  SiRNA target sequence
tgttgaaacatgtgaaccatgta

SEQ ID NO: 151986 - DNA, 23 bp, Artificial sequence
  SiRNA target sequence
gttgaaacatgtgaaccatgtaa

SEQ ID NO: 151987 - DNA, 23 bp, Artificial sequence
  SiRNA target sequence
ttgaaacatgtgaaccatgtaaa

SEQ ID NO: 151988 - DNA, 23 bp, Artificial sequence
  SiRNA target sequence
tgaaacatgtgaaccatgtaaag

SEQ ID NO: 151989 - DNA, 23 bp, Artificial sequence
  SiRNA target sequence
gaaacatgtgaaccatgtaaagg

SEQ ID NO: 151990 - DNA, 23 bp, Artificial sequence
  SiRNA target sequence
aaacatgtgaaccatgtaaaggt

SEQ ID NO: 151991 - DNA, 23 bp, Artificial sequence
  SiRNA target sequence
aacatgtgaaccatgtaaaggta

SEQ ID NO: 151992 - DNA, 23 bp, Artificial sequence
  SiRNA target sequence
acatgtgaaccatgtaaaggtaa

SEQ ID NO: 151993 - DNA, 23 bp, Artificial sequence
  SiRNA target sequence
catgtgaaccatgtaaaggtaaa

SEQ ID NO: 151994 - DNA, 23 bp, Artificial sequence
  SiRNA target sequence
atgtgaaccatgtaaaggtaaag

SEQ ID NO: 151995 - DNA, 23 bp, Artificial sequence
  SiRNA target sequence
tgtgaaccatgtaaaggtaaagg

SEQ ID NO: 151996 - DNA, 23 bp, Artificial sequence
  SiRNA target sequence
gtgaaccatgtaaaggtaaaggt

SEQ ID NO: 151997 - DNA, 23 bp, Artificial sequence
  SiRNA target sequence
tgaaccatgtaaaggtaaaggta

SEQ ID NO: 151998 - DNA, 23 bp, Artificial sequence
  SiRNA target sequence
gaaccatgtaaaggtaaaggtaa

SEQ ID NO: 151999 - DNA, 23 bp, Artificial sequence
  SiRNA target sequence
aaccatgtaaaggtaaaggtaag

SEQ ID NO: 152000 - DNA, 23 bp, Artificial sequence
  SiRNA target sequence
accatgtaaaggtaaaggtaagg

SEQ ID NO: 152001 - DNA, 23 bp, Artificial sequence
  SiRNA target sequence
ccatgtaaaggtaaaggtaaggt

SEQ ID NO: 152002 - DNA, 23 bp, Artificial sequence
  SiRNA target sequence
catgtaaaggtaaaggtaaggta

SEQ ID NO: 152003 - DNA, 23 bp, Artificial sequence
  SiRNA target sequence
atgtaaaggtaaaggtaaggtag

SEQ ID NO: 152004 - DNA, 23 bp, Artificial sequence
  SiRNA target sequence
tgtaaaggtaaaggtaaggtaga

SEQ ID NO: 152005 - DNA, 23 bp, Artificial sequence
  SiRNA target sequence
gtaaaggtaaaggtaaggtagaa

SEQ ID NO: 152006 - DNA, 23 bp, Artificial sequence
  SiRNA target sequence
taaaggtaaaggtaaggtagaac

SEQ ID NO: 152007 - DNA, 23 bp, Artificial sequence
  SiRNA target sequence
aaaggtaaaggtaaggtagaaca

SEQ ID NO: 152008 - DNA, 23 bp, Artificial sequence
  SiRNA target sequence
aaggtaaaggtaaggtagaacat

SEQ ID NO: 152009 - DNA, 23 bp, Artificial sequence
  SiRNA target sequence
aggtaaaggtaaggtagaacatc

SEQ ID NO: 152010 - DNA, 23 bp, Artificial sequence
  SiRNA target sequence
ggtaaaggtaaggtagaacatca

SEQ ID NO: 152011 - DNA, 23 bp, Artificial sequence
  SiRNA target sequence
gtaaaggtaaggtagaacatcat

SEQ ID NO: 152012 - DNA, 23 bp, Artificial sequence
  SiRNA target sequence
taaaggtaaggtagaacatcata

SEQ ID NO: 152013 - DNA, 23 bp, Artificial sequence
  SiRNA target sequence
aaaggtaaggtagaacatcatag

SEQ ID NO: 152014 - DNA, 23 bp, Artificial sequence
  SiRNA target sequence
aaggtaaggtagaacatcatagg

SEQ ID NO: 152015 - DNA, 23 bp, Artificial sequence
  SiRNA target sequence
aggtaaggtagaacatcatagga

SEQ ID NO: 152016 - DNA, 23 bp, Artificial sequence
  SiRNA target sequence
ggtaaggtagaacatcataggag

SEQ ID NO: 152017 - DNA, 23 bp, Artificial sequence
  SiRNA target sequence
gtaaggtagaacatcataggaga

SEQ ID NO: 152018 - DNA, 23 bp, Artificial sequence
  SiRNA target sequence
taaggtagaacatcataggagac

SEQ ID NO: 152019 - DNA, 23 bp, Artificial sequence
  SiRNA target sequence
aaggtagaacatcataggagact

SEQ ID NO: 152020 - DNA, 23 bp, Artificial sequence
  SiRNA target sequence
aggtagaacatcataggagacta

SEQ ID NO: 152021 - DNA, 23 bp, Artificial sequence
  SiRNA target sequence
ggtagaacatcataggagactag

SEQ ID NO: 152022 - DNA, 23 bp, Artificial sequence
  SiRNA target sequence
gtagaacatcataggagactagg

SEQ ID NO: 152023 - DNA, 23 bp, Artificial sequence
  SiRNA target sequence
tagaacatcataggagactaggt

SEQ ID NO: 152024 - DNA, 23 bp, Artificial sequence
  SiRNA target sequence
agaacatcataggagactaggtc

SEQ ID NO: 152025 - DNA, 23 bp, Artificial sequence
  SiRNA target sequence
gaacatcataggagactaggtcc

SEQ ID NO: 152026 - DNA, 23 bp, Artificial sequence
  SiRNA target sequence
aacatcataggagactaggtcct

SEQ ID NO: 152027 - DNA, 23 bp, Artificial sequence
  SiRNA target sequence
acatcataggagactaggtcctt

SEQ ID NO: 152028 - DNA, 23 bp, Artificial sequence
  SiRNA target sequence
catcataggagactaggtccttt

SEQ ID NO: 152029 - DNA, 23 bp, Artificial sequence
  SiRNA target sequence
atcataggagactaggtccttta

SEQ ID NO: 152030 - DNA, 23 bp, Artificial sequence
  SiRNA target sequence
tcataggagactaggtcctttaa

SEQ ID NO: 152031 - DNA, 23 bp, Artificial sequence
  SiRNA target sequence
cataggagactaggtcctttaat

SEQ ID NO: 152032 - DNA, 23 bp, Artificial sequence
  SiRNA target sequence
ataggagactaggtcctttaatt

SEQ ID NO: 152033 - DNA, 23 bp, Artificial sequence
  SiRNA target sequence
taggagactaggtcctttaattt

SEQ ID NO: 152034 - DNA, 23 bp, Artificial sequence
  SiRNA target sequence
aggagactaggtcctttaatttc

SEQ ID NO: 152035 - DNA, 23 bp, Artificial sequence
  SiRNA target sequence
ggagactaggtcctttaatttct

SEQ ID NO: 152036 - DNA, 23 bp, Artificial sequence
  SiRNA target sequence
gagactaggtcctttaatttctg

SEQ ID NO: 152037 - DNA, 23 bp, Artificial sequence
  SiRNA target sequence
agactaggtcctttaatttctgt

SEQ ID NO: 152038 - DNA, 23 bp, Artificial sequence
  SiRNA target sequence
gactaggtcctttaatttctgta

SEQ ID NO: 152039 - DNA, 23 bp, Artificial sequence
  SiRNA target sequence
actaggtcctttaatttctgtac

SEQ ID NO: 152040 - DNA, 23 bp, Artificial sequence
  SiRNA target sequence
ctaggtcctttaatttctgtaca

SEQ ID NO: 152041 - DNA, 23 bp, Artificial sequence
  SiRNA target sequence
taggtcctttaatttctgtacaa

SEQ ID NO: 152042 - DNA, 23 bp, Artificial sequence
  SiRNA target sequence
aggtcctttaatttctgtacaag

SEQ ID NO: 152043 - DNA, 23 bp, Artificial sequence
  SiRNA target sequence
ggtcctttaatttctgtacaaga

SEQ ID NO: 152044 - DNA, 23 bp, Artificial sequence
  SiRNA target sequence
gtcctttaatttctgtacaagaa

SEQ ID NO: 152045 - DNA, 23 bp, Artificial sequence
  SiRNA target sequence
tcctttaatttctgtacaagaag

SEQ ID NO: 152046 - DNA, 23 bp, Artificial sequence
  SiRNA target sequence
cctttaatttctgtacaagaagc

SEQ ID NO: 152047 - DNA, 23 bp, Artificial sequence
  SiRNA target sequence
ctttaatttctgtacaagaagca

SEQ ID NO: 152048 - DNA, 23 bp, Artificial sequence
  SiRNA target sequence
tttaatttctgtacaagaagcac

SEQ ID NO: 152049 - DNA, 23 bp, Artificial sequence
  SiRNA target sequence
ttaatttctgtacaagaagcacc

SEQ ID NO: 152050 - DNA, 23 bp, Artificial sequence
  SiRNA target sequence
taatttctgtacaagaagcacct

SEQ ID NO: 152051 - DNA, 23 bp, Artificial sequence
  SiRNA target sequence
aatttctgtacaagaagcacctt

SEQ ID NO: 152052 - DNA, 23 bp, Artificial sequence
  SiRNA target sequence
atttctgtacaagaagcaccttg

SEQ ID NO: 152053 - DNA, 23 bp, Artificial sequence
  SiRNA target sequence
tttctgtacaagaagcaccttgt

SEQ ID NO: 152054 - DNA, 23 bp, Artificial sequence
  SiRNA target sequence
ttctgtacaagaagcaccttgta

SEQ ID NO: 152055 - DNA, 23 bp, Artificial sequence
  SiRNA target sequence
tctgtacaagaagcaccttgtaa

SEQ ID NO: 152056 - DNA, 23 bp, Artificial sequence
  SiRNA target sequence
ctgtacaagaagcaccttgtaat

SEQ ID NO: 152057 - DNA, 23 bp, Artificial sequence
  SiRNA target sequence
tgtacaagaagcaccttgtaata

SEQ ID NO: 152058 - DNA, 23 bp, Artificial sequence
  SiRNA target sequence
gtacaagaagcaccttgtaataa

SEQ ID NO: 152059 - DNA, 23 bp, Artificial sequence
  SiRNA target sequence
tacaagaagcaccttgtaataat

SEQ ID NO: 152060 - DNA, 23 bp, Artificial sequence
  SiRNA target sequence
acaagaagcaccttgtaataatt

SEQ ID NO: 152061 - DNA, 23 bp, Artificial sequence
  SiRNA target sequence
caagaagcaccttgtaataattg

SEQ ID NO: 152062 - DNA, 23 bp, Artificial sequence
  SiRNA target sequence
aagaagcaccttgtaataattgt

SEQ ID NO: 152063 - DNA, 23 bp, Artificial sequence
  SiRNA target sequence
agaagcaccttgtaataattgta

SEQ ID NO: 152064 - DNA, 23 bp, Artificial sequence
  SiRNA target sequence
gaagcaccttgtaataattgtaa

SEQ ID NO: 152065 - DNA, 23 bp, Artificial sequence
  SiRNA target sequence
aagcaccttgtaataattgtaat

SEQ ID NO: 152066 - DNA, 23 bp, Artificial sequence
  SiRNA target sequence
agcaccttgtaataattgtaatt

SEQ ID NO: 152067 - DNA, 23 bp, Artificial sequence
  SiRNA target sequence
gcaccttgtaataattgtaattc

SEQ ID NO: 152068 - DNA, 23 bp, Artificial sequence
  SiRNA target sequence
caccttgtaataattgtaattct

SEQ ID NO: 152069 - DNA, 23 bp, Artificial sequence
  SiRNA target sequence
accttgtaataattgtaattcta

SEQ ID NO: 152070 - DNA, 23 bp, Artificial sequence
  SiRNA target sequence
ccttgtaataattgtaattctac

SEQ ID NO: 152071 - DNA, 23 bp, Artificial sequence
  SiRNA target sequence
cttgtaataattgtaattctact

SEQ ID NO: 152072 - DNA, 23 bp, Artificial sequence
  SiRNA target sequence
ttgtaataattgtaattctactg

SEQ ID NO: 152073 - DNA, 23 bp, Artificial sequence
  SiRNA target sequence
tgtaataattgtaattctactgg

SEQ ID NO: 152074 - DNA, 23 bp, Artificial sequence
  SiRNA target sequence
gtaataattgtaattctactgga

SEQ ID NO: 152075 - DNA, 23 bp, Artificial sequence
  SiRNA target sequence
taataattgtaattctactggat

SEQ ID NO: 152076 - DNA, 23 bp, Artificial sequence
  SiRNA target sequence
aataattgtaattctactggatt

SEQ ID NO: 152077 - DNA, 23 bp, Artificial sequence
  SiRNA target sequence
ataattgtaattctactggattt

SEQ ID NO: 152078 - DNA, 23 bp, Artificial sequence
  SiRNA target sequence
taattgtaattctactggatttg

SEQ ID NO: 152079 - DNA, 23 bp, Artificial sequence
  SiRNA target sequence
aattgtaattctactggatttgt

SEQ ID NO: 152080 - DNA, 23 bp, Artificial sequence
  SiRNA target sequence
attgtaattctactggatttgtt

SEQ ID NO: 152081 - DNA, 23 bp, Artificial sequence
  SiRNA target sequence
ttgtaattctactggatttgttg

SEQ ID NO: 152082 - DNA, 23 bp, Artificial sequence
  SiRNA target sequence
tgtaattctactggatttgttgt

SEQ ID NO: 152083 - DNA, 23 bp, Artificial sequence
  SiRNA target sequence
gtaattctactggatttgttgtt

SEQ ID NO: 152084 - DNA, 23 bp, Artificial sequence
  SiRNA target sequence
taattctactggatttgttgtta

SEQ ID NO: 152085 - DNA, 23 bp, Artificial sequence
  SiRNA target sequence
aattctactggatttgttgttaa

SEQ ID NO: 152086 - DNA, 23 bp, Artificial sequence
  SiRNA target sequence
attctactggatttgttgttaaa

SEQ ID NO: 152087 - DNA, 23 bp, Artificial sequence
  SiRNA target sequence
ttctactggatttgttgttaaag

SEQ ID NO: 152088 - DNA, 23 bp, Artificial sequence
  SiRNA target sequence
tctactggatttgttgttaaagg

SEQ ID NO: 152089 - DNA, 23 bp, Artificial sequence
  SiRNA target sequence
ctactggatttgttgttaaagga

SEQ ID NO: 152090 - DNA, 23 bp, Artificial sequence
  SiRNA target sequence
tactggatttgttgttaaaggaa

SEQ ID NO: 152091 - DNA, 23 bp, Artificial sequence
  SiRNA target sequence
actggatttgttgttaaaggaaa

SEQ ID NO: 152092 - DNA, 23 bp, Artificial sequence
  SiRNA target sequence
ctggatttgttgttaaaggaaag

SEQ ID NO: 152093 - DNA, 23 bp, Artificial sequence
  SiRNA target sequence
tggatttgttgttaaaggaaagc

SEQ ID NO: 152094 - DNA, 23 bp, Artificial sequence
  SiRNA target sequence
ggatttgttgttaaaggaaagct

SEQ ID NO: 152095 - DNA, 23 bp, Artificial sequence
  SiRNA target sequence
gatttgttgttaaaggaaagctt

SEQ ID NO: 152096 - DNA, 23 bp, Artificial sequence
  SiRNA target sequence
atttgttgttaaaggaaagcttt

SEQ ID NO: 152097 - DNA, 23 bp, Artificial sequence
  SiRNA target sequence
tttgttgttaaaggaaagctttg

SEQ ID NO: 152098 - DNA, 23 bp, Artificial sequence
  SiRNA target sequence
ttgttgttaaaggaaagctttgt

SEQ ID NO: 152099 - DNA, 23 bp, Artificial sequence
  SiRNA target sequence
tgttgttaaaggaaagctttgtc

SEQ ID NO: 152100 - DNA, 23 bp, Artificial sequence
  SiRNA target sequence
gttgttaaaggaaagctttgtca

SEQ ID NO: 152101 - DNA, 23 bp, Artificial sequence
  SiRNA target sequence
ttgttaaaggaaagctttgtcaa

SEQ ID NO: 152102 - DNA, 23 bp, Artificial sequence
  SiRNA target sequence
tgttaaaggaaagctttgtcaaa

SEQ ID NO: 152103 - DNA, 23 bp, Artificial sequence
  SiRNA target sequence
gttaaaggaaagctttgtcaaag

SEQ ID NO: 152104 - DNA, 23 bp, Artificial sequence
  SiRNA target sequence
ttaaaggaaagctttgtcaaagt

SEQ ID NO: 152105 - DNA, 23 bp, Artificial sequence
  SiRNA target sequence
taaaggaaagctttgtcaaagtt

SEQ ID NO: 152106 - DNA, 23 bp, Artificial sequence
  SiRNA target sequence
aaaggaaagctttgtcaaagttg

SEQ ID NO: 152107 - DNA, 23 bp, Artificial sequence
  SiRNA target sequence
aaggaaagctttgtcaaagttgt

SEQ ID NO: 152108 - DNA, 23 bp, Artificial sequence
  SiRNA target sequence
aggaaagctttgtcaaagttgta

SEQ ID NO: 152109 - DNA, 23 bp, Artificial sequence
  SiRNA target sequence
ggaaagctttgtcaaagttgtaa

SEQ ID NO: 152110 - DNA, 23 bp, Artificial sequence
  SiRNA target sequence
gaaagctttgtcaaagttgtaaa

SEQ ID NO: 152111 - DNA, 23 bp, Artificial sequence
  SiRNA target sequence
aaagctttgtcaaagttgtaaag

SEQ ID NO: 152112 - DNA, 23 bp, Artificial sequence
  SiRNA target sequence
aagctttgtcaaagttgtaaagg

SEQ ID NO: 152113 - DNA, 23 bp, Artificial sequence
  SiRNA target sequence
agctttgtcaaagttgtaaaggt

SEQ ID NO: 152114 - DNA, 23 bp, Artificial sequence
  SiRNA target sequence
gctttgtcaaagttgtaaaggta

SEQ ID NO: 152115 - DNA, 23 bp, Artificial sequence
  SiRNA target sequence
ctttgtcaaagttgtaaaggtaa

SEQ ID NO: 152116 - DNA, 23 bp, Artificial sequence
  SiRNA target sequence
tttgtcaaagttgtaaaggtaaa

SEQ ID NO: 152117 - DNA, 23 bp, Artificial sequence
  SiRNA target sequence
ttgtcaaagttgtaaaggtaaac

SEQ ID NO: 152118 - DNA, 23 bp, Artificial sequence
  SiRNA target sequence
tgtcaaagttgtaaaggtaaaca

SEQ ID NO: 152119 - DNA, 23 bp, Artificial sequence
  SiRNA target sequence
gtcaaagttgtaaaggtaaacaa

SEQ ID NO: 152120 - DNA, 23 bp, Artificial sequence
  SiRNA target sequence
tcaaagttgtaaaggtaaacaat

SEQ ID NO: 152121 - DNA, 23 bp, Artificial sequence
  SiRNA target sequence
caaagttgtaaaggtaaacaata

SEQ ID NO: 152122 - DNA, 23 bp, Artificial sequence
  SiRNA target sequence
aaagttgtaaaggtaaacaatac

SEQ ID NO: 152123 - DNA, 23 bp, Artificial sequence
  SiRNA target sequence
aagttgtaaaggtaaacaatacg

SEQ ID NO: 152124 - DNA, 23 bp, Artificial sequence
  SiRNA target sequence
agttgtaaaggtaaacaatacgt

SEQ ID NO: 152125 - DNA, 23 bp, Artificial sequence
  SiRNA target sequence
gttgtaaaggtaaacaatacgtt

SEQ ID NO: 152126 - DNA, 23 bp, Artificial sequence
  SiRNA target sequence
ttgtaaaggtaaacaatacgttg

SEQ ID NO: 152127 - DNA, 23 bp, Artificial sequence
  SiRNA target sequence
tgtaaaggtaaacaatacgttga

SEQ ID NO: 152128 - DNA, 23 bp, Artificial sequence
  SiRNA target sequence
gtaaaggtaaacaatacgttgag

SEQ ID NO: 152129 - DNA, 23 bp, Artificial sequence
  SiRNA target sequence
taaaggtaaacaatacgttgaga

SEQ ID NO: 152130 - DNA, 23 bp, Artificial sequence
  SiRNA target sequence
aaaggtaaacaatacgttgagac

SEQ ID NO: 152131 - DNA, 23 bp, Artificial sequence
  SiRNA target sequence
aaggtaaacaatacgttgagact

SEQ ID NO: 152132 - DNA, 23 bp, Artificial sequence
  SiRNA target sequence
aggtaaacaatacgttgagacta

SEQ ID NO: 152133 - DNA, 23 bp, Artificial sequence
  SiRNA target sequence
ggtaaacaatacgttgagactaa

SEQ ID NO: 152134 - DNA, 23 bp, Artificial sequence
  SiRNA target sequence
gtaaacaatacgttgagactaaa

SEQ ID NO: 152135 - DNA, 23 bp, Artificial sequence
  SiRNA target sequence
taaacaatacgttgagactaaag

SEQ ID NO: 152136 - DNA, 23 bp, Artificial sequence
  SiRNA target sequence
aaacaatacgttgagactaaaga

SEQ ID NO: 152137 - DNA, 23 bp, Artificial sequence
  SiRNA target sequence
aacaatacgttgagactaaagaa

SEQ ID NO: 152138 - DNA, 23 bp, Artificial sequence
  SiRNA target sequence
acaatacgttgagactaaagaac

SEQ ID NO: 152139 - DNA, 23 bp, Artificial sequence
  SiRNA target sequence
caatacgttgagactaaagaaca

SEQ ID NO: 152140 - DNA, 23 bp, Artificial sequence
  SiRNA target sequence
aatacgttgagactaaagaacat

SEQ ID NO: 152141 - DNA, 23 bp, Artificial sequence
  SiRNA target sequence
atacgttgagactaaagaacata

SEQ ID NO: 152142 - DNA, 23 bp, Artificial sequence
  SiRNA target sequence
tacgttgagactaaagaacatat

SEQ ID NO: 152143 - DNA, 23 bp, Artificial sequence
  SiRNA target sequence
acgttgagactaaagaacatatt

SEQ ID NO: 152144 - DNA, 23 bp, Artificial sequence
  SiRNA target sequence
cgttgagactaaagaacatattg

SEQ ID NO: 152145 - DNA, 23 bp, Artificial sequence
  SiRNA target sequence
gttgagactaaagaacatattga

SEQ ID NO: 152146 - DNA, 23 bp, Artificial sequence
  SiRNA target sequence
ttgagactaaagaacatattgaa

SEQ ID NO: 152147 - DNA, 23 bp, Artificial sequence
  SiRNA target sequence
tgagactaaagaacatattgaag

SEQ ID NO: 152148 - DNA, 23 bp, Artificial sequence
  SiRNA target sequence
gagactaaagaacatattgaagt

SEQ ID NO: 152149 - DNA, 23 bp, Artificial sequence
  SiRNA target sequence
agactaaagaacatattgaagtg

SEQ ID NO: 152150 - DNA, 23 bp, Artificial sequence
  SiRNA target sequence
gactaaagaacatattgaagtgg

SEQ ID NO: 152151 - DNA, 23 bp, Artificial sequence
  SiRNA target sequence
actaaagaacatattgaagtgga

SEQ ID NO: 152152 - DNA, 23 bp, Artificial sequence
  SiRNA target sequence
ctaaagaacatattgaagtggaa

SEQ ID NO: 152153 - DNA, 23 bp, Artificial sequence
  SiRNA target sequence
taaagaacatattgaagtggaag

SEQ ID NO: 152154 - DNA, 23 bp, Artificial sequence
  SiRNA target sequence
aaagaacatattgaagtggaagt

SEQ ID NO: 152155 - DNA, 23 bp, Artificial sequence
  SiRNA target sequence
aagaacatattgaagtggaagta

SEQ ID NO: 152156 - DNA, 23 bp, Artificial sequence
  SiRNA target sequence
agaacatattgaagtggaagtag

SEQ ID NO: 152157 - DNA, 23 bp, Artificial sequence
  SiRNA target sequence
gaacatattgaagtggaagtaga

SEQ ID NO: 152158 - DNA, 23 bp, Artificial sequence
  SiRNA target sequence
aacatattgaagtggaagtagag

SEQ ID NO: 152159 - DNA, 23 bp, Artificial sequence
  SiRNA target sequence
acatattgaagtggaagtagagc

SEQ ID NO: 152160 - DNA, 23 bp, Artificial sequence
  SiRNA target sequence
catattgaagtggaagtagagcc

SEQ ID NO: 152161 - DNA, 23 bp, Artificial sequence
  SiRNA target sequence
atattgaagtggaagtagagcca

SEQ ID NO: 152162 - DNA, 23 bp, Artificial sequence
  SiRNA target sequence
tattgaagtggaagtagagccag

SEQ ID NO: 152163 - DNA, 23 bp, Artificial sequence
  SiRNA target sequence
attgaagtggaagtagagccagg

SEQ ID NO: 152164 - DNA, 23 bp, Artificial sequence
  SiRNA target sequence
ttgaagtggaagtagagccagga

SEQ ID NO: 152165 - DNA, 23 bp, Artificial sequence
  SiRNA target sequence
tgaagtggaagtagagccaggag

SEQ ID NO: 152166 - DNA, 23 bp, Artificial sequence
  SiRNA target sequence
gaagtggaagtagagccaggagt

SEQ ID NO: 152167 - DNA, 23 bp, Artificial sequence
  SiRNA target sequence
aagtggaagtagagccaggagta

SEQ ID NO: 152168 - DNA, 23 bp, Artificial sequence
  SiRNA target sequence
agtggaagtagagccaggagtac

SEQ ID NO: 152169 - DNA, 23 bp, Artificial sequence
  SiRNA target sequence
gtggaagtagagccaggagtaca

SEQ ID NO: 152170 - DNA, 23 bp, Artificial sequence
  SiRNA target sequence
tggaagtagagccaggagtacag

SEQ ID NO: 152171 - DNA, 23 bp, Artificial sequence
  SiRNA target sequence
ggaagtagagccaggagtacaga

SEQ ID NO: 152172 - DNA, 23 bp, Artificial sequence
  SiRNA target sequence
gaagtagagccaggagtacagaa

SEQ ID NO: 152173 - DNA, 23 bp, Artificial sequence
  SiRNA target sequence
aagtagagccaggagtacagaac

SEQ ID NO: 152174 - DNA, 23 bp, Artificial sequence
  SiRNA target sequence
agtagagccaggagtacagaacg

SEQ ID NO: 152175 - DNA, 23 bp, Artificial sequence
  SiRNA target sequence
gtagagccaggagtacagaacgg

SEQ ID NO: 152176 - DNA, 23 bp, Artificial sequence
  SiRNA target sequence
tagagccaggagtacagaacggt

SEQ ID NO: 152177 - DNA, 23 bp, Artificial sequence
  SiRNA target sequence
agagccaggagtacagaacggta

SEQ ID NO: 152178 - DNA, 23 bp, Artificial sequence
  SiRNA target sequence
gagccaggagtacagaacggtag

SEQ ID NO: 152179 - DNA, 23 bp, Artificial sequence
  SiRNA target sequence
agccaggagtacagaacggtaga

SEQ ID NO: 152180 - DNA, 23 bp, Artificial sequence
  SiRNA target sequence
gccaggagtacagaacggtagaa

SEQ ID NO: 152181 - DNA, 23 bp, Artificial sequence
  SiRNA target sequence
ccaggagtacagaacggtagaaa

SEQ ID NO: 152182 - DNA, 23 bp, Artificial sequence
  SiRNA target sequence
caggagtacagaacggtagaaaa

SEQ ID NO: 152183 - DNA, 23 bp, Artificial sequence
  SiRNA target sequence
aggagtacagaacggtagaaaat

SEQ ID NO: 152184 - DNA, 23 bp, Artificial sequence
  SiRNA target sequence
ggagtacagaacggtagaaaata

SEQ ID NO: 152185 - DNA, 23 bp, Artificial sequence
  SiRNA target sequence
gagtacagaacggtagaaaatat

SEQ ID NO: 152186 - DNA, 23 bp, Artificial sequence
  SiRNA target sequence
agtacagaacggtagaaaatata

SEQ ID NO: 152187 - DNA, 23 bp, Artificial sequence
  SiRNA target sequence
gtacagaacggtagaaaatatac

SEQ ID NO: 152188 - DNA, 23 bp, Artificial sequence
  SiRNA target sequence
tacagaacggtagaaaatataca

SEQ ID NO: 152189 - DNA, 23 bp, Artificial sequence
  SiRNA target sequence
acagaacggtagaaaatatacat

SEQ ID NO: 152190 - DNA, 23 bp, Artificial sequence
  SiRNA target sequence
cagaacggtagaaaatatacatt

SEQ ID NO: 152191 - DNA, 23 bp, Artificial sequence
  SiRNA target sequence
agaacggtagaaaatatacattt

SEQ ID NO: 152192 - DNA, 23 bp, Artificial sequence
  SiRNA target sequence
gaacggtagaaaatatacatttt

SEQ ID NO: 152193 - DNA, 23 bp, Artificial sequence
  SiRNA target sequence
aacggtagaaaatatacattttc

SEQ ID NO: 152194 - DNA, 23 bp, Artificial sequence
  SiRNA target sequence
acggtagaaaatatacattttct

SEQ ID NO: 152195 - DNA, 23 bp, Artificial sequence
  SiRNA target sequence
cggtagaaaatatacattttctg

SEQ ID NO: 152196 - DNA, 23 bp, Artificial sequence
  SiRNA target sequence
ggtagaaaatatacattttctgg

SEQ ID NO: 152197 - DNA, 23 bp, Artificial sequence
  SiRNA target sequence
gtagaaaatatacattttctggc

SEQ ID NO: 152198 - DNA, 23 bp, Artificial sequence
  SiRNA target sequence
tagaaaatatacattttctggca

SEQ ID NO: 152199 - DNA, 23 bp, Artificial sequence
  SiRNA target sequence
agaaaatatacattttctggcaa

SEQ ID NO: 152200 - DNA, 23 bp, Artificial sequence
  SiRNA target sequence
gaaaatatacattttctggcaaa

SEQ ID NO: 152201 - DNA, 23 bp, Artificial sequence
  SiRNA target sequence
aaaatatacattttctggcaaag

SEQ ID NO: 152202 - DNA, 23 bp, Artificial sequence
  SiRNA target sequence
aaatatacattttctggcaaagg

SEQ ID NO: 152203 - DNA, 23 bp, Artificial sequence
  SiRNA target sequence
aatatacattttctggcaaagga

SEQ ID NO: 152204 - DNA, 23 bp, Artificial sequence
  SiRNA target sequence
atatacattttctggcaaaggaa

SEQ ID NO: 152205 - DNA, 23 bp, Artificial sequence
  SiRNA target sequence
tatacattttctggcaaaggaaa

SEQ ID NO: 152206 - DNA, 23 bp, Artificial sequence
  SiRNA target sequence
atacattttctggcaaaggaaat

SEQ ID NO: 152207 - DNA, 23 bp, Artificial sequence
  SiRNA target sequence
tacattttctggcaaaggaaatc

SEQ ID NO: 152208 - DNA, 23 bp, Artificial sequence
  SiRNA target sequence
acattttctggcaaaggaaatca

SEQ ID NO: 152209 - DNA, 23 bp, Artificial sequence
  SiRNA target sequence
cattttctggcaaaggaaatcat

SEQ ID NO: 152210 - DNA, 23 bp, Artificial sequence
  SiRNA target sequence
attttctggcaaaggaaatcata

SEQ ID NO: 152211 - DNA, 23 bp, Artificial sequence
  SiRNA target sequence
ttttctggcaaaggaaatcataa

SEQ ID NO: 152212 - DNA, 23 bp, Artificial sequence
  SiRNA target sequence
tttctggcaaaggaaatcataaa

SEQ ID NO: 152213 - DNA, 23 bp, Artificial sequence
  SiRNA target sequence
ttctggcaaaggaaatcataaaa

SEQ ID NO: 152214 - DNA, 23 bp, Artificial sequence
  SiRNA target sequence
tctggcaaaggaaatcataaaaa

SEQ ID NO: 152215 - DNA, 23 bp, Artificial sequence
  SiRNA target sequence
ctggcaaaggaaatcataaaaaa

SEQ ID NO: 152216 - DNA, 23 bp, Artificial sequence
  SiRNA target sequence
tggcaaaggaaatcataaaaaaa

SEQ ID NO: 152217 - DNA, 23 bp, Artificial sequence
  SiRNA target sequence
ggcaaaggaaatcataaaaaaaa

SEQ ID NO: 152218 - DNA, 23 bp, Artificial sequence
  SiRNA target sequence
gcaaaggaaatcataaaaaaaat

SEQ ID NO: 152219 - DNA, 23 bp, Artificial sequence
  SiRNA target sequence
caaaggaaatcataaaaaaaatt

SEQ ID NO: 152220 - DNA, 23 bp, Artificial sequence
  SiRNA target sequence
aaaggaaatcataaaaaaaattg

SEQ ID NO: 152221 - DNA, 23 bp, Artificial sequence
  SiRNA target sequence
aaggaaatcataaaaaaaattgt

SEQ ID NO: 152222 - DNA, 23 bp, Artificial sequence
  SiRNA target sequence
aggaaatcataaaaaaaattgtg

SEQ ID NO: 152223 - DNA, 23 bp, Artificial sequence
  SiRNA target sequence
ggaaatcataaaaaaaattgtgt

SEQ ID NO: 152224 - DNA, 23 bp, Artificial sequence
  SiRNA target sequence
gaaatcataaaaaaaattgtgta

SEQ ID NO: 152225 - DNA, 23 bp, Artificial sequence
  SiRNA target sequence
aaatcataaaaaaaattgtgtac

SEQ ID NO: 152226 - DNA, 23 bp, Artificial sequence
  SiRNA target sequence
aatcataaaaaaaattgtgtacc

SEQ ID NO: 152227 - DNA, 23 bp, Artificial sequence
  SiRNA target sequence
atcataaaaaaaattgtgtaccg

SEQ ID NO: 152228 - DNA, 23 bp, Artificial sequence
  SiRNA target sequence
tcataaaaaaaattgtgtaccgg

SEQ ID NO: 152229 - DNA, 23 bp, Artificial sequence
  SiRNA target sequence
cataaaaaaaattgtgtaccggg

SEQ ID NO: 152230 - DNA, 23 bp, Artificial sequence
  SiRNA target sequence
ataaaaaaaattgtgtaccgggt

SEQ ID NO: 152231 - DNA, 23 bp, Artificial sequence
  SiRNA target sequence
taaaaaaaattgtgtaccgggtg

SEQ ID NO: 152232 - DNA, 23 bp, Artificial sequence
  SiRNA target sequence
aaaaaaaattgtgtaccgggtga

SEQ ID NO: 152233 - DNA, 23 bp, Artificial sequence
  SiRNA target sequence
aaaaaaattgtgtaccgggtgat

SEQ ID NO: 152234 - DNA, 23 bp, Artificial sequence
  SiRNA target sequence
aaaaaattgtgtaccgggtgatg

SEQ ID NO: 152235 - DNA, 23 bp, Artificial sequence
  SiRNA target sequence
aaaaattgtgtaccgggtgatgt

SEQ ID NO: 152236 - DNA, 23 bp, Artificial sequence
  SiRNA target sequence
aaaattgtgtaccgggtgatgtg

SEQ ID NO: 152237 - DNA, 23 bp, Artificial sequence
  SiRNA target sequence
aaattgtgtaccgggtgatgtga

SEQ ID NO: 152238 - DNA, 23 bp, Artificial sequence
  SiRNA target sequence
aattgtgtaccgggtgatgtgat

SEQ ID NO: 152239 - DNA, 23 bp, Artificial sequence
  SiRNA target sequence
attgtgtaccgggtgatgtgatt

SEQ ID NO: 152240 - DNA, 23 bp, Artificial sequence
  SiRNA target sequence
ttgtgtaccgggtgatgtgattc

SEQ ID NO: 152241 - DNA, 23 bp, Artificial sequence
  SiRNA target sequence
tgtgtaccgggtgatgtgattct

SEQ ID NO: 152242 - DNA, 23 bp, Artificial sequence
  SiRNA target sequence
gtgtaccgggtgatgtgattctt

SEQ ID NO: 152243 - DNA, 23 bp, Artificial sequence
  SiRNA target sequence
tgtaccgggtgatgtgattctta

SEQ ID NO: 152244 - DNA, 23 bp, Artificial sequence
  SiRNA target sequence
gtaccgggtgatgtgattcttat

SEQ ID NO: 152245 - DNA, 23 bp, Artificial sequence
  SiRNA target sequence
taccgggtgatgtgattcttatt

SEQ ID NO: 152246 - DNA, 23 bp, Artificial sequence
  SiRNA target sequence
accgggtgatgtgattcttattg

SEQ ID NO: 152247 - DNA, 23 bp, Artificial sequence
  SiRNA target sequence
ccgggtgatgtgattcttattgt

SEQ ID NO: 152248 - DNA, 23 bp, Artificial sequence
  SiRNA target sequence
cgggtgatgtgattcttattgta

SEQ ID NO: 152249 - DNA, 23 bp, Artificial sequence
  SiRNA target sequence
gggtgatgtgattcttattgtaa

SEQ ID NO: 152250 - DNA, 23 bp, Artificial sequence
  SiRNA target sequence
ggtgatgtgattcttattgtaaa

SEQ ID NO: 152251 - DNA, 23 bp, Artificial sequence
  SiRNA target sequence
gtgatgtgattcttattgtaaac

SEQ ID NO: 152252 - DNA, 23 bp, Artificial sequence
  SiRNA target sequence
tgatgtgattcttattgtaaaca

SEQ ID NO: 152253 - DNA, 23 bp, Artificial sequence
  SiRNA target sequence
gatgtgattcttattgtaaacat

SEQ ID NO: 152254 - DNA, 23 bp, Artificial sequence
  SiRNA target sequence
atgtgattcttattgtaaacatt

SEQ ID NO: 152255 - DNA, 23 bp, Artificial sequence
  SiRNA target sequence
tgtgattcttattgtaaacatta

SEQ ID NO: 152256 - DNA, 23 bp, Artificial sequence
  SiRNA target sequence
gtgattcttattgtaaacattac

SEQ ID NO: 152257 - DNA, 23 bp, Artificial sequence
  SiRNA target sequence
tgattcttattgtaaacattaca

SEQ ID NO: 152258 - DNA, 23 bp, Artificial sequence
  SiRNA target sequence
gattcttattgtaaacattacaa

SEQ ID NO: 152259 - DNA, 23 bp, Artificial sequence
  SiRNA target sequence
attcttattgtaaacattacaaa

SEQ ID NO: 152260 - DNA, 23 bp, Artificial sequence
  SiRNA target sequence
ttcttattgtaaacattacaaat

SEQ ID NO: 152261 - DNA, 23 bp, Artificial sequence
  SiRNA target sequence
tcttattgtaaacattacaaatg

SEQ ID NO: 152262 - DNA, 23 bp, Artificial sequence
  SiRNA target sequence
cttattgtaaacattacaaatga

SEQ ID NO: 152263 - DNA, 23 bp, Artificial sequence
  SiRNA target sequence
ttattgtaaacattacaaatgat

SEQ ID NO: 152264 - DNA, 23 bp, Artificial sequence
  SiRNA target sequence
tattgtaaacattacaaatgatc

SEQ ID NO: 152265 - DNA, 23 bp, Artificial sequence
  SiRNA target sequence
attgtaaacattacaaatgatcc

SEQ ID NO: 152266 - DNA, 23 bp, Artificial sequence
  SiRNA target sequence
ttgtaaacattacaaatgatcca

SEQ ID NO: 152267 - DNA, 23 bp, Artificial sequence
  SiRNA target sequence
tgtaaacattacaaatgatccaa

SEQ ID NO: 152268 - DNA, 23 bp, Artificial sequence
  SiRNA target sequence
gtaaacattacaaatgatccaag

SEQ ID NO: 152269 - DNA, 23 bp, Artificial sequence
  SiRNA target sequence
taaacattacaaatgatccaaga

SEQ ID NO: 152270 - DNA, 23 bp, Artificial sequence
  SiRNA target sequence
aaacattacaaatgatccaagat

SEQ ID NO: 152271 - DNA, 23 bp, Artificial sequence
  SiRNA target sequence
aacattacaaatgatccaagatt

SEQ ID NO: 152272 - DNA, 23 bp, Artificial sequence
  SiRNA target sequence
acattacaaatgatccaagattt

SEQ ID NO: 152273 - DNA, 23 bp, Artificial sequence
  SiRNA target sequence
cattacaaatgatccaagattta

SEQ ID NO: 152274 - DNA, 23 bp, Artificial sequence
  SiRNA target sequence
attacaaatgatccaagatttag

SEQ ID NO: 152275 - DNA, 23 bp, Artificial sequence
  SiRNA target sequence
ttacaaatgatccaagatttaga

SEQ ID NO: 152276 - DNA, 23 bp, Artificial sequence
  SiRNA target sequence
tacaaatgatccaagatttagaa

SEQ ID NO: 152277 - DNA, 23 bp, Artificial sequence
  SiRNA target sequence
acaaatgatccaagatttagaaa

SEQ ID NO: 152278 - DNA, 23 bp, Artificial sequence
  SiRNA target sequence
caaatgatccaagatttagaaaa

SEQ ID NO: 152279 - DNA, 23 bp, Artificial sequence
  SiRNA target sequence
aaatgatccaagatttagaaaaa

SEQ ID NO: 152280 - DNA, 23 bp, Artificial sequence
  SiRNA target sequence
aatgatccaagatttagaaaaag

SEQ ID NO: 152281 - DNA, 23 bp, Artificial sequence
  SiRNA target sequence
atgatccaagatttagaaaaagt

SEQ ID NO: 152282 - DNA, 23 bp, Artificial sequence
  SiRNA target sequence
tgatccaagatttagaaaaagtg

SEQ ID NO: 152283 - DNA, 23 bp, Artificial sequence
  SiRNA target sequence
gatccaagatttagaaaaagtgg

SEQ ID NO: 152284 - DNA, 23 bp, Artificial sequence
  SiRNA target sequence
atccaagatttagaaaaagtgga

SEQ ID NO: 152285 - DNA, 23 bp, Artificial sequence
  SiRNA target sequence
tccaagatttagaaaaagtggat

SEQ ID NO: 152286 - DNA, 23 bp, Artificial sequence
  SiRNA target sequence
ccaagatttagaaaaagtggata

SEQ ID NO: 152287 - DNA, 23 bp, Artificial sequence
  SiRNA target sequence
caagatttagaaaaagtggatat

SEQ ID NO: 152288 - DNA, 23 bp, Artificial sequence
  SiRNA target sequence
aagatttagaaaaagtggatata

SEQ ID NO: 152289 - DNA, 23 bp, Artificial sequence
  SiRNA target sequence
agatttagaaaaagtggatataa

SEQ ID NO: 152290 - DNA, 23 bp, Artificial sequence
  SiRNA target sequence
gatttagaaaaagtggatataat

SEQ ID NO: 152291 - DNA, 23 bp, Artificial sequence
  SiRNA target sequence
atttagaaaaagtggatataatt

SEQ ID NO: 152292 - DNA, 23 bp, Artificial sequence
  SiRNA target sequence
tttagaaaaagtggatataattt

SEQ ID NO: 152293 - DNA, 23 bp, Artificial sequence
  SiRNA target sequence
ttagaaaaagtggatataattta

SEQ ID NO: 152294 - DNA, 23 bp, Artificial sequence
  SiRNA target sequence
tagaaaaagtggatataatttaa

SEQ ID NO: 152295 - DNA, 23 bp, Artificial sequence
  SiRNA target sequence
agaaaaagtggatataatttaat

SEQ ID NO: 152296 - DNA, 23 bp, Artificial sequence
  SiRNA target sequence
gaaaaagtggatataatttaatt

SEQ ID NO: 152297 - DNA, 23 bp, Artificial sequence
  SiRNA target sequence
aaaaagtggatataatttaatta

SEQ ID NO: 152298 - DNA, 23 bp, Artificial sequence
  SiRNA target sequence
aaaagtggatataatttaattag

SEQ ID NO: 152299 - DNA, 23 bp, Artificial sequence
  SiRNA target sequence
aaagtggatataatttaattagt

SEQ ID NO: 152300 - DNA, 23 bp, Artificial sequence
  SiRNA target sequence
aagtggatataatttaattagta

SEQ ID NO: 152301 - DNA, 23 bp, Artificial sequence
  SiRNA target sequence
agtggatataatttaattagtaa

SEQ ID NO: 152302 - DNA, 23 bp, Artificial sequence
  SiRNA target sequence
gtggatataatttaattagtaag

SEQ ID NO: 152303 - DNA, 23 bp, Artificial sequence
  SiRNA target sequence
tggatataatttaattagtaagg

SEQ ID NO: 152304 - DNA, 23 bp, Artificial sequence
  SiRNA target sequence
ggatataatttaattagtaaggt

SEQ ID NO: 152305 - DNA, 23 bp, Artificial sequence
  SiRNA target sequence
gatataatttaattagtaaggtt

SEQ ID NO: 152306 - DNA, 23 bp, Artificial sequence
  SiRNA target sequence
atataatttaattagtaaggttg

SEQ ID NO: 152307 - DNA, 23 bp, Artificial sequence
  SiRNA target sequence
tataatttaattagtaaggttga

SEQ ID NO: 152308 - DNA, 23 bp, Artificial sequence
  SiRNA target sequence
ataatttaattagtaaggttgat

SEQ ID NO: 152309 - DNA, 23 bp, Artificial sequence
  SiRNA target sequence
taatttaattagtaaggttgata

SEQ ID NO: 152310 - DNA, 23 bp, Artificial sequence
  SiRNA target sequence
aatttaattagtaaggttgatat

SEQ ID NO: 152311 - DNA, 23 bp, Artificial sequence
  SiRNA target sequence
atttaattagtaaggttgatatt

SEQ ID NO: 152312 - DNA, 23 bp, Artificial sequence
  SiRNA target sequence
tttaattagtaaggttgatattc

SEQ ID NO: 152313 - DNA, 23 bp, Artificial sequence
  SiRNA target sequence
ttaattagtaaggttgatattcc

SEQ ID NO: 152314 - DNA, 23 bp, Artificial sequence
  SiRNA target sequence
taattagtaaggttgatattcca

SEQ ID NO: 152315 - DNA, 23 bp, Artificial sequence
  SiRNA target sequence
aattagtaaggttgatattccat

SEQ ID NO: 152316 - DNA, 23 bp, Artificial sequence
  SiRNA target sequence
attagtaaggttgatattccatt

SEQ ID NO: 152317 - DNA, 23 bp, Artificial sequence
  SiRNA target sequence
ttagtaaggttgatattccattg

SEQ ID NO: 152318 - DNA, 23 bp, Artificial sequence
  SiRNA target sequence
tagtaaggttgatattccattgt

SEQ ID NO: 152319 - DNA, 23 bp, Artificial sequence
  SiRNA target sequence
agtaaggttgatattccattgta

SEQ ID NO: 152320 - DNA, 23 bp, Artificial sequence
  SiRNA target sequence
gtaaggttgatattccattgtat

SEQ ID NO: 152321 - DNA, 23 bp, Artificial sequence
  SiRNA target sequence
taaggttgatattccattgtatg

SEQ ID NO: 152322 - DNA, 23 bp, Artificial sequence
  SiRNA target sequence
aaggttgatattccattgtatgt

SEQ ID NO: 152323 - DNA, 23 bp, Artificial sequence
  SiRNA target sequence
aggttgatattccattgtatgtt

SEQ ID NO: 152324 - DNA, 23 bp, Artificial sequence
  SiRNA target sequence
ggttgatattccattgtatgttg

SEQ ID NO: 152325 - DNA, 23 bp, Artificial sequence
  SiRNA target sequence
gttgatattccattgtatgttgc

SEQ ID NO: 152326 - DNA, 23 bp, Artificial sequence
  SiRNA target sequence
ttgatattccattgtatgttgct

SEQ ID NO: 152327 - DNA, 23 bp, Artificial sequence
  SiRNA target sequence
tgatattccattgtatgttgctt

SEQ ID NO: 152328 - DNA, 23 bp, Artificial sequence
  SiRNA target sequence
gatattccattgtatgttgcttt

SEQ ID NO: 152329 - DNA, 23 bp, Artificial sequence
  SiRNA target sequence
atattccattgtatgttgctttg

SEQ ID NO: 152330 - DNA, 23 bp, Artificial sequence
  SiRNA target sequence
tattccattgtatgttgctttgg

SEQ ID NO: 152331 - DNA, 23 bp, Artificial sequence
  SiRNA target sequence
attccattgtatgttgctttggc

SEQ ID NO: 152332 - DNA, 23 bp, Artificial sequence
  SiRNA target sequence
ttccattgtatgttgctttggca

SEQ ID NO: 152333 - DNA, 23 bp, Artificial sequence
  SiRNA target sequence
tccattgtatgttgctttggcag

SEQ ID NO: 152334 - DNA, 23 bp, Artificial sequence
  SiRNA target sequence
ccattgtatgttgctttggcagg

SEQ ID NO: 152335 - DNA, 23 bp, Artificial sequence
  SiRNA target sequence
cattgtatgttgctttggcaggc

SEQ ID NO: 152336 - DNA, 23 bp, Artificial sequence
  SiRNA target sequence
attgtatgttgctttggcaggcg

SEQ ID NO: 152337 - DNA, 23 bp, Artificial sequence
  SiRNA target sequence
ttgtatgttgctttggcaggcgg

SEQ ID NO: 152338 - DNA, 23 bp, Artificial sequence
  SiRNA target sequence
tgtatgttgctttggcaggcgga

SEQ ID NO: 152339 - DNA, 23 bp, Artificial sequence
  SiRNA target sequence
gtatgttgctttggcaggcggac

SEQ ID NO: 152340 - DNA, 23 bp, Artificial sequence
  SiRNA target sequence
tatgttgctttggcaggcggaca

SEQ ID NO: 152341 - DNA, 23 bp, Artificial sequence
  SiRNA target sequence
atgttgctttggcaggcggacag

SEQ ID NO: 152342 - DNA, 23 bp, Artificial sequence
  SiRNA target sequence
tgttgctttggcaggcggacaga

SEQ ID NO: 152343 - DNA, 23 bp, Artificial sequence
  SiRNA target sequence
gttgctttggcaggcggacagat

SEQ ID NO: 152344 - DNA, 23 bp, Artificial sequence
  SiRNA target sequence
ttgctttggcaggcggacagatt

SEQ ID NO: 152345 - DNA, 23 bp, Artificial sequence
  SiRNA target sequence
tgctttggcaggcggacagatta

SEQ ID NO: 152346 - DNA, 23 bp, Artificial sequence
  SiRNA target sequence
gctttggcaggcggacagattat

SEQ ID NO: 152347 - DNA, 23 bp, Artificial sequence
  SiRNA target sequence
ctttggcaggcggacagattata

SEQ ID NO: 152348 - DNA, 23 bp, Artificial sequence
  SiRNA target sequence
tttggcaggcggacagattatat

SEQ ID NO: 152349 - DNA, 23 bp, Artificial sequence
  SiRNA target sequence
ttggcaggcggacagattatatt

SEQ ID NO: 152350 - DNA, 23 bp, Artificial sequence
  SiRNA target sequence
tggcaggcggacagattatattt

SEQ ID NO: 152351 - DNA, 23 bp, Artificial sequence
  SiRNA target sequence
ggcaggcggacagattatatttg

SEQ ID NO: 152352 - DNA, 23 bp, Artificial sequence
  SiRNA target sequence
gcaggcggacagattatatttga

SEQ ID NO: 152353 - DNA, 23 bp, Artificial sequence
  SiRNA target sequence
caggcggacagattatatttgaa

SEQ ID NO: 152354 - DNA, 23 bp, Artificial sequence
  SiRNA target sequence
aggcggacagattatatttgaac

SEQ ID NO: 152355 - DNA, 23 bp, Artificial sequence
  SiRNA target sequence
ggcggacagattatatttgaaca

SEQ ID NO: 152356 - DNA, 23 bp, Artificial sequence
  SiRNA target sequence
gcggacagattatatttgaacat

SEQ ID NO: 152357 - DNA, 23 bp, Artificial sequence
  SiRNA target sequence
cggacagattatatttgaacata

SEQ ID NO: 152358 - DNA, 23 bp, Artificial sequence
  SiRNA target sequence
ggacagattatatttgaacatat

SEQ ID NO: 152359 - DNA, 23 bp, Artificial sequence
  SiRNA target sequence
gacagattatatttgaacatatc

SEQ ID NO: 152360 - DNA, 23 bp, Artificial sequence
  SiRNA target sequence
acagattatatttgaacatatca

SEQ ID NO: 152361 - DNA, 23 bp, Artificial sequence
  SiRNA target sequence
cagattatatttgaacatatcac

SEQ ID NO: 152362 - DNA, 23 bp, Artificial sequence
  SiRNA target sequence
agattatatttgaacatatcact

SEQ ID NO: 152363 - DNA, 23 bp, Artificial sequence
  SiRNA target sequence
gattatatttgaacatatcactg

SEQ ID NO: 152364 - DNA, 23 bp, Artificial sequence
  SiRNA target sequence
attatatttgaacatatcactgg

SEQ ID NO: 152365 - DNA, 23 bp, Artificial sequence
  SiRNA target sequence
ttatatttgaacatatcactggt

SEQ ID NO: 152366 - DNA, 23 bp, Artificial sequence
  SiRNA target sequence
tatatttgaacatatcactggta

SEQ ID NO: 152367 - DNA, 23 bp, Artificial sequence
  SiRNA target sequence
atatttgaacatatcactggtaa

SEQ ID NO: 152368 - DNA, 23 bp, Artificial sequence
  SiRNA target sequence
tatttgaacatatcactggtaag

SEQ ID NO: 152369 - DNA, 23 bp, Artificial sequence
  SiRNA target sequence
atttgaacatatcactggtaaga

SEQ ID NO: 152370 - DNA, 23 bp, Artificial sequence
  SiRNA target sequence
tttgaacatatcactggtaagaa

SEQ ID NO: 152371 - DNA, 23 bp, Artificial sequence
  SiRNA target sequence
ttgaacatatcactggtaagaaa

SEQ ID NO: 152372 - DNA, 23 bp, Artificial sequence
  SiRNA target sequence
tgaacatatcactggtaagaaat

SEQ ID NO: 152373 - DNA, 23 bp, Artificial sequence
  SiRNA target sequence
gaacatatcactggtaagaaatt

SEQ ID NO: 152374 - DNA, 23 bp, Artificial sequence
  SiRNA target sequence
aacatatcactggtaagaaattt

SEQ ID NO: 152375 - DNA, 23 bp, Artificial sequence
  SiRNA target sequence
acatatcactggtaagaaatttg

SEQ ID NO: 152376 - DNA, 23 bp, Artificial sequence
  SiRNA target sequence
catatcactggtaagaaatttga

SEQ ID NO: 152377 - DNA, 23 bp, Artificial sequence
  SiRNA target sequence
atatcactggtaagaaatttgaa

SEQ ID NO: 152378 - DNA, 23 bp, Artificial sequence
  SiRNA target sequence
tatcactggtaagaaatttgaaa

SEQ ID NO: 152379 - DNA, 23 bp, Artificial sequence
  SiRNA target sequence
atcactggtaagaaatttgaaat

SEQ ID NO: 152380 - DNA, 23 bp, Artificial sequence
  SiRNA target sequence
tcactggtaagaaatttgaaatt

SEQ ID NO: 152381 - DNA, 23 bp, Artificial sequence
  SiRNA target sequence
cactggtaagaaatttgaaatta

SEQ ID NO: 152382 - DNA, 23 bp, Artificial sequence
  SiRNA target sequence
actggtaagaaatttgaaattac

SEQ ID NO: 152383 - DNA, 23 bp, Artificial sequence
  SiRNA target sequence
ctggtaagaaatttgaaattact

SEQ ID NO: 152384 - DNA, 23 bp, Artificial sequence
  SiRNA target sequence
tggtaagaaatttgaaattactt

SEQ ID NO: 152385 - DNA, 23 bp, Artificial sequence
  SiRNA target sequence
ggtaagaaatttgaaattacttt

SEQ ID NO: 152386 - DNA, 23 bp, Artificial sequence
  SiRNA target sequence
gtaagaaatttgaaattacttta

SEQ ID NO: 152387 - DNA, 23 bp, Artificial sequence
  SiRNA target sequence
taagaaatttgaaattactttat

SEQ ID NO: 152388 - DNA, 23 bp, Artificial sequence
  SiRNA target sequence
aagaaatttgaaattactttata

SEQ ID NO: 152389 - DNA, 23 bp, Artificial sequence
  SiRNA target sequence
agaaatttgaaattactttatat

SEQ ID NO: 152390 - DNA, 23 bp, Artificial sequence
  SiRNA target sequence
gaaatttgaaattactttatatc

SEQ ID NO: 152391 - DNA, 23 bp, Artificial sequence
  SiRNA target sequence
aaatttgaaattactttatatcc

SEQ ID NO: 152392 - DNA, 23 bp, Artificial sequence
  SiRNA target sequence
aatttgaaattactttatatcca

SEQ ID NO: 152393 - DNA, 23 bp, Artificial sequence
  SiRNA target sequence
atttgaaattactttatatccat

SEQ ID NO: 152394 - DNA, 23 bp, Artificial sequence
  SiRNA target sequence
tttgaaattactttatatccatt

SEQ ID NO: 152395 - DNA, 23 bp, Artificial sequence
  SiRNA target sequence
ttgaaattactttatatccattt

SEQ ID NO: 152396 - DNA, 23 bp, Artificial sequence
  SiRNA target sequence
tgaaattactttatatccattta

SEQ ID NO: 152397 - DNA, 23 bp, Artificial sequence
  SiRNA target sequence
gaaattactttatatccatttaa

SEQ ID NO: 152398 - DNA, 23 bp, Artificial sequence
  SiRNA target sequence
aaattactttatatccatttaaa

SEQ ID NO: 152399 - DNA, 23 bp, Artificial sequence
  SiRNA target sequence
aattactttatatccatttaaag

SEQ ID NO: 152400 - DNA, 23 bp, Artificial sequence
  SiRNA target sequence
attactttatatccatttaaaga

SEQ ID NO: 152401 - DNA, 23 bp, Artificial sequence
  SiRNA target sequence
ttactttatatccatttaaagat

SEQ ID NO: 152402 - DNA, 23 bp, Artificial sequence
  SiRNA target sequence
tactttatatccatttaaagatt

SEQ ID NO: 152403 - DNA, 23 bp, Artificial sequence
  SiRNA target sequence
actttatatccatttaaagattt

SEQ ID NO: 152404 - DNA, 23 bp, Artificial sequence
  SiRNA target sequence
ctttatatccatttaaagattta

SEQ ID NO: 152405 - DNA, 23 bp, Artificial sequence
  SiRNA target sequence
tttatatccatttaaagatttaa

SEQ ID NO: 152406 - DNA, 23 bp, Artificial sequence
  SiRNA target sequence
ttatatccatttaaagatttaaa

SEQ ID NO: 152407 - DNA, 23 bp, Artificial sequence
  SiRNA target sequence
tatatccatttaaagatttaaag

SEQ ID NO: 152408 - DNA, 23 bp, Artificial sequence
  SiRNA target sequence
atatccatttaaagatttaaaga

SEQ ID NO: 152409 - DNA, 23 bp, Artificial sequence
  SiRNA target sequence
tatccatttaaagatttaaagaa

SEQ ID NO: 152410 - DNA, 23 bp, Artificial sequence
  SiRNA target sequence
atccatttaaagatttaaagaaa

SEQ ID NO: 152411 - DNA, 23 bp, Artificial sequence
  SiRNA target sequence
tccatttaaagatttaaagaaat

SEQ ID NO: 152412 - DNA, 23 bp, Artificial sequence
  SiRNA target sequence
ccatttaaagatttaaagaaatg

SEQ ID NO: 152413 - DNA, 23 bp, Artificial sequence
  SiRNA target sequence
catttaaagatttaaagaaatgt

SEQ ID NO: 152414 - DNA, 23 bp, Artificial sequence
  SiRNA target sequence
atttaaagatttaaagaaatgta

SEQ ID NO: 152415 - DNA, 23 bp, Artificial sequence
  SiRNA target sequence
tttaaagatttaaagaaatgtat

SEQ ID NO: 152416 - DNA, 23 bp, Artificial sequence
  SiRNA target sequence
ttaaagatttaaagaaatgtatt

SEQ ID NO: 152417 - DNA, 23 bp, Artificial sequence
  SiRNA target sequence
taaagatttaaagaaatgtatta

SEQ ID NO: 152418 - DNA, 23 bp, Artificial sequence
  SiRNA target sequence
aaagatttaaagaaatgtattat

SEQ ID NO: 152419 - DNA, 23 bp, Artificial sequence
  SiRNA target sequence
aagatttaaagaaatgtattatt

SEQ ID NO: 152420 - DNA, 23 bp, Artificial sequence
  SiRNA target sequence
agatttaaagaaatgtattattt

SEQ ID NO: 152421 - DNA, 23 bp, Artificial sequence
  SiRNA target sequence
gatttaaagaaatgtattatttt

SEQ ID NO: 152422 - DNA, 23 bp, Artificial sequence
  SiRNA target sequence
atttaaagaaatgtattatttta

SEQ ID NO: 152423 - DNA, 23 bp, Artificial sequence
  SiRNA target sequence
tttaaagaaatgtattattttaa

SEQ ID NO: 152424 - DNA, 23 bp, Artificial sequence
  SiRNA target sequence
ttaaagaaatgtattattttaaa

SEQ ID NO: 152425 - DNA, 23 bp, Artificial sequence
  SiRNA target sequence
taaagaaatgtattattttaaaa

SEQ ID NO: 152426 - DNA, 23 bp, Artificial sequence
  SiRNA target sequence
aaagaaatgtattattttaaaag

SEQ ID NO: 152427 - DNA, 23 bp, Artificial sequence
  SiRNA target sequence
aagaaatgtattattttaaaagg

SEQ ID NO: 152428 - DNA, 23 bp, Artificial sequence
  SiRNA target sequence
agaaatgtattattttaaaaggc

SEQ ID NO: 152429 - DNA, 23 bp, Artificial sequence
  SiRNA target sequence
gaaatgtattattttaaaaggcg

SEQ ID NO: 152430 - DNA, 23 bp, Artificial sequence
  SiRNA target sequence
aaatgtattattttaaaaggcga

SEQ ID NO: 152431 - DNA, 23 bp, Artificial sequence
  SiRNA target sequence
aatgtattattttaaaaggcgaa

SEQ ID NO: 152432 - DNA, 23 bp, Artificial sequence
  SiRNA target sequence
atgtattattttaaaaggcgaag

SEQ ID NO: 152433 - DNA, 23 bp, Artificial sequence
  SiRNA target sequence
tgtattattttaaaaggcgaagg

SEQ ID NO: 152434 - DNA, 23 bp, Artificial sequence
  SiRNA target sequence
gtattattttaaaaggcgaaggt

SEQ ID NO: 152435 - DNA, 23 bp, Artificial sequence
  SiRNA target sequence
tattattttaaaaggcgaaggtt

SEQ ID NO: 152436 - DNA, 23 bp, Artificial sequence
  SiRNA target sequence
attattttaaaaggcgaaggttt

SEQ ID NO: 152437 - DNA, 23 bp, Artificial sequence
  SiRNA target sequence
ttattttaaaaggcgaaggtttt

SEQ ID NO: 152438 - DNA, 23 bp, Artificial sequence
  SiRNA target sequence
tattttaaaaggcgaaggtttta

SEQ ID NO: 152439 - DNA, 23 bp, Artificial sequence
  SiRNA target sequence
attttaaaaggcgaaggttttaa

SEQ ID NO: 152440 - DNA, 23 bp, Artificial sequence
  SiRNA target sequence
ttttaaaaggcgaaggttttaaa

SEQ ID NO: 152441 - DNA, 23 bp, Artificial sequence
  SiRNA target sequence
tttaaaaggcgaaggttttaaaa

SEQ ID NO: 152442 - DNA, 23 bp, Artificial sequence
  SiRNA target sequence
ttaaaaggcgaaggttttaaaat

SEQ ID NO: 152443 - DNA, 23 bp, Artificial sequence
  SiRNA target sequence
taaaaggcgaaggttttaaaata

SEQ ID NO: 152444 - DNA, 23 bp, Artificial sequence
  SiRNA target sequence
aaaaggcgaaggttttaaaataa

SEQ ID NO: 152445 - DNA, 23 bp, Artificial sequence
  SiRNA target sequence
aaaggcgaaggttttaaaataaa

SEQ ID NO: 152446 - DNA, 23 bp, Artificial sequence
  SiRNA target sequence
aaggcgaaggttttaaaataaaa

SEQ ID NO: 152447 - DNA, 23 bp, Artificial sequence
  SiRNA target sequence
aggcgaaggttttaaaataaaaa

SEQ ID NO: 152448 - DNA, 23 bp, Artificial sequence
  SiRNA target sequence
ggcgaaggttttaaaataaaaaa

SEQ ID NO: 152449 - DNA, 23 bp, Artificial sequence
  SiRNA target sequence
gcgaaggttttaaaataaaaaat

SEQ ID NO: 152450 - DNA, 23 bp, Artificial sequence
  SiRNA target sequence
cgaaggttttaaaataaaaaata

SEQ ID NO: 152451 - DNA, 23 bp, Artificial sequence
  SiRNA target sequence
gaaggttttaaaataaaaaatag

SEQ ID NO: 152452 - DNA, 23 bp, Artificial sequence
  SiRNA target sequence
aaggttttaaaataaaaaatagt

SEQ ID NO: 152453 - DNA, 23 bp, Artificial sequence
  SiRNA target sequence
aggttttaaaataaaaaatagtt

SEQ ID NO: 152454 - DNA, 23 bp, Artificial sequence
  SiRNA target sequence
ggttttaaaataaaaaatagtta

SEQ ID NO: 152455 - DNA, 23 bp, Artificial sequence
  SiRNA target sequence
gttttaaaataaaaaatagttat

SEQ ID NO: 152456 - DNA, 23 bp, Artificial sequence
  SiRNA target sequence
ttttaaaataaaaaatagttatt

SEQ ID NO: 152457 - DNA, 23 bp, Artificial sequence
  SiRNA target sequence
tttaaaataaaaaatagttattc

SEQ ID NO: 152458 - DNA, 23 bp, Artificial sequence
  SiRNA target sequence
ttaaaataaaaaatagttattcg

SEQ ID NO: 152459 - DNA, 23 bp, Artificial sequence
  SiRNA target sequence
taaaataaaaaatagttattcgg

SEQ ID NO: 152460 - DNA, 23 bp, Artificial sequence
  SiRNA target sequence
aaaataaaaaatagttattcggg

SEQ ID NO: 152461 - DNA, 23 bp, Artificial sequence
  SiRNA target sequence
aaataaaaaatagttattcgggt

SEQ ID NO: 152462 - DNA, 23 bp, Artificial sequence
  SiRNA target sequence
aataaaaaatagttattcgggtg

SEQ ID NO: 152463 - DNA, 23 bp, Artificial sequence
  SiRNA target sequence
ataaaaaatagttattcgggtgg

SEQ ID NO: 152464 - DNA, 23 bp, Artificial sequence
  SiRNA target sequence
taaaaaatagttattcgggtggt

SEQ ID NO: 152465 - DNA, 23 bp, Artificial sequence
  SiRNA target sequence
aaaaaatagttattcgggtggtg

SEQ ID NO: 152466 - DNA, 23 bp, Artificial sequence
  SiRNA target sequence
aaaaatagttattcgggtggtga

SEQ ID NO: 152467 - DNA, 23 bp, Artificial sequence
  SiRNA target sequence
aaaatagttattcgggtggtgat

SEQ ID NO: 152468 - DNA, 23 bp, Artificial sequence
  SiRNA target sequence
aaatagttattcgggtggtgatc

SEQ ID NO: 152469 - DNA, 23 bp, Artificial sequence
  SiRNA target sequence
aatagttattcgggtggtgatct

SEQ ID NO: 152470 - DNA, 23 bp, Artificial sequence
  SiRNA target sequence
atagttattcgggtggtgatctt

SEQ ID NO: 152471 - DNA, 23 bp, Artificial sequence
  SiRNA target sequence
tagttattcgggtggtgatctta

SEQ ID NO: 152472 - DNA, 23 bp, Artificial sequence
  SiRNA target sequence
agttattcgggtggtgatcttat

SEQ ID NO: 152473 - DNA, 23 bp, Artificial sequence
  SiRNA target sequence
gttattcgggtggtgatcttatt

SEQ ID NO: 152474 - DNA, 23 bp, Artificial sequence
  SiRNA target sequence
ttattcgggtggtgatcttattc

SEQ ID NO: 152475 - DNA, 23 bp, Artificial sequence
  SiRNA target sequence
tattcgggtggtgatcttattct

SEQ ID NO: 152476 - DNA, 23 bp, Artificial sequence
  SiRNA target sequence
attcgggtggtgatcttattctc

SEQ ID NO: 152477 - DNA, 23 bp, Artificial sequence
  SiRNA target sequence
ttcgggtggtgatcttattctcg

SEQ ID NO: 152478 - DNA, 23 bp, Artificial sequence
  SiRNA target sequence
tcgggtggtgatcttattctcga

SEQ ID NO: 152479 - DNA, 23 bp, Artificial sequence
  SiRNA target sequence
cgggtggtgatcttattctcgaa

SEQ ID NO: 152480 - DNA, 23 bp, Artificial sequence
  SiRNA target sequence
gggtggtgatcttattctcgaac

SEQ ID NO: 152481 - DNA, 23 bp, Artificial sequence
  SiRNA target sequence
ggtggtgatcttattctcgaacc

SEQ ID NO: 152482 - DNA, 23 bp, Artificial sequence
  SiRNA target sequence
gtggtgatcttattctcgaacct

SEQ ID NO: 152483 - DNA, 23 bp, Artificial sequence
  SiRNA target sequence
tggtgatcttattctcgaaccta

SEQ ID NO: 152484 - DNA, 23 bp, Artificial sequence
  SiRNA target sequence
ggtgatcttattctcgaacctaa

SEQ ID NO: 152485 - DNA, 23 bp, Artificial sequence
  SiRNA target sequence
gtgatcttattctcgaacctaat

SEQ ID NO: 152486 - DNA, 23 bp, Artificial sequence
  SiRNA target sequence
tgatcttattctcgaacctaata

SEQ ID NO: 152487 - DNA, 23 bp, Artificial sequence
  SiRNA target sequence
gatcttattctcgaacctaatat

SEQ ID NO: 152488 - DNA, 23 bp, Artificial sequence
  SiRNA target sequence
atcttattctcgaacctaatata

SEQ ID NO: 152489 - DNA, 23 bp, Artificial sequence
  SiRNA target sequence
tcttattctcgaacctaatataa

SEQ ID NO: 152490 - DNA, 23 bp, Artificial sequence
  SiRNA target sequence
cttattctcgaacctaatataat

SEQ ID NO: 152491 - DNA, 23 bp, Artificial sequence
  SiRNA target sequence
ttattctcgaacctaatataatt

SEQ ID NO: 152492 - DNA, 23 bp, Artificial sequence
  SiRNA target sequence
tattctcgaacctaatataatta

SEQ ID NO: 152493 - DNA, 23 bp, Artificial sequence
  SiRNA target sequence
attctcgaacctaatataattat

SEQ ID NO: 152494 - DNA, 23 bp, Artificial sequence
  SiRNA target sequence
ttctcgaacctaatataattata

SEQ ID NO: 152495 - DNA, 23 bp, Artificial sequence
  SiRNA target sequence
tctcgaacctaatataattatag

SEQ ID NO: 152496 - DNA, 23 bp, Artificial sequence
  SiRNA target sequence
ctcgaacctaatataattataga

SEQ ID NO: 152497 - DNA, 23 bp, Artificial sequence
  SiRNA target sequence
tcgaacctaatataattatagat

SEQ ID NO: 152498 - DNA, 23 bp, Artificial sequence
  SiRNA target sequence
cgaacctaatataattatagata

SEQ ID NO: 152499 - DNA, 23 bp, Artificial sequence
  SiRNA target sequence
gaacctaatataattatagataa

SEQ ID NO: 152500 - DNA, 23 bp, Artificial sequence
  SiRNA target sequence
aacctaatataattatagataag

SEQ ID NO: 152501 - DNA, 23 bp, Artificial sequence
  SiRNA target sequence
acctaatataattatagataaga

SEQ ID NO: 152502 - DNA, 23 bp, Artificial sequence
  SiRNA target sequence
cctaatataattatagataagaa

SEQ ID NO: 152503 - DNA, 23 bp, Artificial sequence
  SiRNA target sequence
ctaatataattatagataagaat

SEQ ID NO: 152504 - DNA, 23 bp, Artificial sequence
  SiRNA target sequence
taatataattatagataagaata

SEQ ID NO: 152505 - DNA, 23 bp, Artificial sequence
  SiRNA target sequence
aatataattatagataagaatat

SEQ ID NO: 152506 - DNA, 23 bp, Artificial sequence
  SiRNA target sequence
atataattatagataagaatatt

SEQ ID NO: 152507 - DNA, 23 bp, Artificial sequence
  SiRNA target sequence
tataattatagataagaatattg

SEQ ID NO: 152508 - DNA, 23 bp, Artificial sequence
  SiRNA target sequence
ataattatagataagaatattga

SEQ ID NO: 152509 - DNA, 23 bp, Artificial sequence
  SiRNA target sequence
taattatagataagaatattgat

SEQ ID NO: 152510 - DNA, 23 bp, Artificial sequence
  SiRNA target sequence
aattatagataagaatattgata

SEQ ID NO: 152511 - DNA, 23 bp, Artificial sequence
  SiRNA target sequence
attatagataagaatattgataa

SEQ ID NO: 152512 - DNA, 23 bp, Artificial sequence
  SiRNA target sequence
ttatagataagaatattgataaa

SEQ ID NO: 152513 - DNA, 23 bp, Artificial sequence
  SiRNA target sequence
tatagataagaatattgataaag

SEQ ID NO: 152514 - DNA, 23 bp, Artificial sequence
  SiRNA target sequence
atagataagaatattgataaaga

SEQ ID NO: 152515 - DNA, 23 bp, Artificial sequence
  SiRNA target sequence
tagataagaatattgataaagat

SEQ ID NO: 152516 - DNA, 23 bp, Artificial sequence
  SiRNA target sequence
agataagaatattgataaagatt

SEQ ID NO: 152517 - DNA, 23 bp, Artificial sequence
  SiRNA target sequence
gataagaatattgataaagattt

SEQ ID NO: 152518 - DNA, 23 bp, Artificial sequence
  SiRNA target sequence
ataagaatattgataaagattta

SEQ ID NO: 152519 - DNA, 23 bp, Artificial sequence
  SiRNA target sequence
taagaatattgataaagatttat

SEQ ID NO: 152520 - DNA, 23 bp, Artificial sequence
  SiRNA target sequence
aagaatattgataaagatttatt

SEQ ID NO: 152521 - DNA, 23 bp, Artificial sequence
  SiRNA target sequence
agaatattgataaagatttatta

SEQ ID NO: 152522 - DNA, 23 bp, Artificial sequence
  SiRNA target sequence
gaatattgataaagatttattag

SEQ ID NO: 152523 - DNA, 23 bp, Artificial sequence
  SiRNA target sequence
aatattgataaagatttattagc

SEQ ID NO: 152524 - DNA, 23 bp, Artificial sequence
  SiRNA target sequence
atattgataaagatttattagca

SEQ ID NO: 152525 - DNA, 23 bp, Artificial sequence
  SiRNA target sequence
tattgataaagatttattagcac

SEQ ID NO: 152526 - DNA, 23 bp, Artificial sequence
  SiRNA target sequence
attgataaagatttattagcacg

SEQ ID NO: 152527 - DNA, 23 bp, Artificial sequence
  SiRNA target sequence
ttgataaagatttattagcacgc

SEQ ID NO: 152528 - DNA, 23 bp, Artificial sequence
  SiRNA target sequence
tgataaagatttattagcacgcg

SEQ ID NO: 152529 - DNA, 23 bp, Artificial sequence
  SiRNA target sequence
gataaagatttattagcacgcgc

SEQ ID NO: 152530 - DNA, 23 bp, Artificial sequence
  SiRNA target sequence
ataaagatttattagcacgcgcc

SEQ ID NO: 152531 - DNA, 23 bp, Artificial sequence
  SiRNA target sequence
taaagatttattagcacgcgcct

SEQ ID NO: 152532 - DNA, 23 bp, Artificial sequence
  SiRNA target sequence
aaagatttattagcacgcgcctt

SEQ ID NO: 152533 - DNA, 23 bp, Artificial sequence
  SiRNA target sequence
aagatttattagcacgcgccttg

SEQ ID NO: 152534 - DNA, 23 bp, Artificial sequence
  SiRNA target sequence
agatttattagcacgcgccttga

SEQ ID NO: 152535 - DNA, 23 bp, Artificial sequence
  SiRNA target sequence
gatttattagcacgcgccttgaa

SEQ ID NO: 152536 - DNA, 23 bp, Artificial sequence
  SiRNA target sequence
atttattagcacgcgccttgaat

SEQ ID NO: 152537 - DNA, 23 bp, Artificial sequence
  SiRNA target sequence
tttattagcacgcgccttgaatt

SEQ ID NO: 152538 - DNA, 23 bp, Artificial sequence
  SiRNA target sequence
ttattagcacgcgccttgaatta

SEQ ID NO: 152539 - DNA, 23 bp, Artificial sequence
  SiRNA target sequence
tattagcacgcgccttgaattat

SEQ ID NO: 152540 - DNA, 23 bp, Artificial sequence
  SiRNA target sequence
attagcacgcgccttgaattatg

SEQ ID NO: 152541 - DNA, 23 bp, Artificial sequence
  SiRNA target sequence
ttagcacgcgccttgaattatgt

SEQ ID NO: 152542 - DNA, 23 bp, Artificial sequence
  SiRNA target sequence
tagcacgcgccttgaattatgtt

SEQ ID NO: 152543 - DNA, 23 bp, Artificial sequence
  SiRNA target sequence
agcacgcgccttgaattatgttc

SEQ ID NO: 152544 - DNA, 23 bp, Artificial sequence
  SiRNA target sequence
gcacgcgccttgaattatgttcc

SEQ ID NO: 152545 - DNA, 23 bp, Artificial sequence
  SiRNA target sequence
cacgcgccttgaattatgttcct

SEQ ID NO: 152546 - DNA, 23 bp, Artificial sequence
  SiRNA target sequence
acgcgccttgaattatgttcctg

SEQ ID NO: 152547 - DNA, 23 bp, Artificial sequence
  SiRNA target sequence
cgcgccttgaattatgttcctgt

SEQ ID NO: 152548 - DNA, 23 bp, Artificial sequence
  SiRNA target sequence
gcgccttgaattatgttcctgta

SEQ ID NO: 152549 - DNA, 23 bp, Artificial sequence
  SiRNA target sequence
cgccttgaattatgttcctgtaa

SEQ ID NO: 152550 - DNA, 23 bp, Artificial sequence
  SiRNA target sequence
gccttgaattatgttcctgtaag

SEQ ID NO: 152551 - DNA, 23 bp, Artificial sequence
  SiRNA target sequence
ccttgaattatgttcctgtaaga

SEQ ID NO: 152552 - DNA, 23 bp, Artificial sequence
  SiRNA target sequence
cttgaattatgttcctgtaagaa

SEQ ID NO: 152553 - DNA, 23 bp, Artificial sequence
  SiRNA target sequence
ttgaattatgttcctgtaagaaa

SEQ ID NO: 152554 - DNA, 23 bp, Artificial sequence
  SiRNA target sequence
tgaattatgttcctgtaagaaaa

SEQ ID NO: 152555 - DNA, 23 bp, Artificial sequence
  SiRNA target sequence
gaattatgttcctgtaagaaaag

SEQ ID NO: 152556 - DNA, 23 bp, Artificial sequence
  SiRNA target sequence
aattatgttcctgtaagaaaaga

SEQ ID NO: 152557 - DNA, 23 bp, Artificial sequence
  SiRNA target sequence
attatgttcctgtaagaaaagat

SEQ ID NO: 152558 - DNA, 23 bp, Artificial sequence
  SiRNA target sequence
ttatgttcctgtaagaaaagatt

SEQ ID NO: 152559 - DNA, 23 bp, Artificial sequence
  SiRNA target sequence
tatgttcctgtaagaaaagattt

SEQ ID NO: 152560 - DNA, 23 bp, Artificial sequence
  SiRNA target sequence
atgttcctgtaagaaaagatttt

SEQ ID NO: 152561 - DNA, 23 bp, Artificial sequence
  SiRNA target sequence
tgttcctgtaagaaaagatttta

SEQ ID NO: 152562 - DNA, 23 bp, Artificial sequence
  SiRNA target sequence
gttcctgtaagaaaagattttac

SEQ ID NO: 152563 - DNA, 23 bp, Artificial sequence
  SiRNA target sequence
ttcctgtaagaaaagattttaca

SEQ ID NO: 152564 - DNA, 23 bp, Artificial sequence
  SiRNA target sequence
tcctgtaagaaaagattttacag

SEQ ID NO: 152565 - DNA, 23 bp, Artificial sequence
  SiRNA target sequence
cctgtaagaaaagattttacagg

SEQ ID NO: 152566 - DNA, 23 bp, Artificial sequence
  SiRNA target sequence
ctgtaagaaaagattttacagga

SEQ ID NO: 152567 - DNA, 23 bp, Artificial sequence
  SiRNA target sequence
tgtaagaaaagattttacaggaa

SEQ ID NO: 152568 - DNA, 23 bp, Artificial sequence
  SiRNA target sequence
gtaagaaaagattttacaggaac

SEQ ID NO: 152569 - DNA, 23 bp, Artificial sequence
  SiRNA target sequence
taagaaaagattttacaggaact

SEQ ID NO: 152570 - DNA, 23 bp, Artificial sequence
  SiRNA target sequence
aagaaaagattttacaggaactg

SEQ ID NO: 152571 - DNA, 23 bp, Artificial sequence
  SiRNA target sequence
agaaaagattttacaggaactgc

SEQ ID NO: 152572 - DNA, 23 bp, Artificial sequence
  SiRNA target sequence
gaaaagattttacaggaactgct

SEQ ID NO: 152573 - DNA, 23 bp, Artificial sequence
  SiRNA target sequence
aaaagattttacaggaactgctg

SEQ ID NO: 152574 - DNA, 23 bp, Artificial sequence
  SiRNA target sequence
aaagattttacaggaactgctgt

SEQ ID NO: 152575 - DNA, 23 bp, Artificial sequence
  SiRNA target sequence
aagattttacaggaactgctgtt

SEQ ID NO: 152576 - DNA, 23 bp, Artificial sequence
  SiRNA target sequence
agattttacaggaactgctgttc

SEQ ID NO: 152577 - DNA, 23 bp, Artificial sequence
  SiRNA target sequence
gattttacaggaactgctgttcc

SEQ ID NO: 152578 - DNA, 23 bp, Artificial sequence
  SiRNA target sequence
attttacaggaactgctgttcca

SEQ ID NO: 152579 - DNA, 23 bp, Artificial sequence
  SiRNA target sequence
ttttacaggaactgctgttccaa

SEQ ID NO: 152580 - DNA, 23 bp, Artificial sequence
  SiRNA target sequence
tttacaggaactgctgttccaaa

SEQ ID NO: 152581 - DNA, 23 bp, Artificial sequence
  SiRNA target sequence
ttacaggaactgctgttccaaaa

SEQ ID NO: 152582 - DNA, 23 bp, Artificial sequence
  SiRNA target sequence
tacaggaactgctgttccaaaat

SEQ ID NO: 152583 - DNA, 23 bp, Artificial sequence
  SiRNA target sequence
acaggaactgctgttccaaaata

SEQ ID NO: 152584 - DNA, 23 bp, Artificial sequence
  SiRNA target sequence
caggaactgctgttccaaaatat

SEQ ID NO: 152585 - DNA, 23 bp, Artificial sequence
  SiRNA target sequence
aggaactgctgttccaaaatatg

SEQ ID NO: 152586 - DNA, 23 bp, Artificial sequence
  SiRNA target sequence
ggaactgctgttccaaaatatgc

SEQ ID NO: 152587 - DNA, 23 bp, Artificial sequence
  SiRNA target sequence
gaactgctgttccaaaatatgca

SEQ ID NO: 152588 - DNA, 23 bp, Artificial sequence
  SiRNA target sequence
aactgctgttccaaaatatgcag

SEQ ID NO: 152589 - DNA, 23 bp, Artificial sequence
  SiRNA target sequence
actgctgttccaaaatatgcaga

SEQ ID NO: 152590 - DNA, 23 bp, Artificial sequence
  SiRNA target sequence
ctgctgttccaaaatatgcagaa

SEQ ID NO: 152591 - DNA, 23 bp, Artificial sequence
  SiRNA target sequence
tgctgttccaaaatatgcagaat

SEQ ID NO: 152592 - DNA, 23 bp, Artificial sequence
  SiRNA target sequence
gctgttccaaaatatgcagaatt

SEQ ID NO: 152593 - DNA, 23 bp, Artificial sequence
  SiRNA target sequence
ctgttccaaaatatgcagaattt

SEQ ID NO: 152594 - DNA, 23 bp, Artificial sequence
  SiRNA target sequence
tgttccaaaatatgcagaatttg

SEQ ID NO: 152595 - DNA, 23 bp, Artificial sequence
  SiRNA target sequence
gttccaaaatatgcagaatttgg

SEQ ID NO: 152596 - DNA, 23 bp, Artificial sequence
  SiRNA target sequence
ttccaaaatatgcagaatttggt

SEQ ID NO: 152597 - DNA, 23 bp, Artificial sequence
  SiRNA target sequence
tccaaaatatgcagaatttggtg

SEQ ID NO: 152598 - DNA, 23 bp, Artificial sequence
  SiRNA target sequence
ccaaaatatgcagaatttggtgt

SEQ ID NO: 152599 - DNA, 23 bp, Artificial sequence
  SiRNA target sequence
caaaatatgcagaatttggtgtt

SEQ ID NO: 152600 - DNA, 23 bp, Artificial sequence
  SiRNA target sequence
aaaatatgcagaatttggtgtta

SEQ ID NO: 152601 - DNA, 23 bp, Artificial sequence
  SiRNA target sequence
aaatatgcagaatttggtgttat

SEQ ID NO: 152602 - DNA, 23 bp, Artificial sequence
  SiRNA target sequence
aatatgcagaatttggtgttatg

SEQ ID NO: 152603 - DNA, 23 bp, Artificial sequence
  SiRNA target sequence
atatgcagaatttggtgttatgc

SEQ ID NO: 152604 - DNA, 23 bp, Artificial sequence
  SiRNA target sequence
tatgcagaatttggtgttatgcc

SEQ ID NO: 152605 - DNA, 23 bp, Artificial sequence
  SiRNA target sequence
atgcagaatttggtgttatgcct

SEQ ID NO: 152606 - DNA, 23 bp, Artificial sequence
  SiRNA target sequence
tgcagaatttggtgttatgccta

SEQ ID NO: 152607 - DNA, 23 bp, Artificial sequence
  SiRNA target sequence
gcagaatttggtgttatgcctaa

SEQ ID NO: 152608 - DNA, 23 bp, Artificial sequence
  SiRNA target sequence
cagaatttggtgttatgcctaaa

SEQ ID NO: 152609 - DNA, 23 bp, Artificial sequence
  SiRNA target sequence
agaatttggtgttatgcctaaag

SEQ ID NO: 152610 - DNA, 23 bp, Artificial sequence
  SiRNA target sequence
gaatttggtgttatgcctaaaga

SEQ ID NO: 152611 - DNA, 23 bp, Artificial sequence
  SiRNA target sequence
aatttggtgttatgcctaaagaa

SEQ ID NO: 152612 - DNA, 23 bp, Artificial sequence
  SiRNA target sequence
atttggtgttatgcctaaagaac

SEQ ID NO: 152613 - DNA, 23 bp, Artificial sequence
  SiRNA target sequence
tttggtgttatgcctaaagaaca

SEQ ID NO: 152614 - DNA, 23 bp, Artificial sequence
  SiRNA target sequence
ttggtgttatgcctaaagaacag

SEQ ID NO: 152615 - DNA, 23 bp, Artificial sequence
  SiRNA target sequence
tggtgttatgcctaaagaacagg

SEQ ID NO: 152616 - DNA, 23 bp, Artificial sequence
  SiRNA target sequence
ggtgttatgcctaaagaacagga

SEQ ID NO: 152617 - DNA, 23 bp, Artificial sequence
  SiRNA target sequence
gtgttatgcctaaagaacaggaa

SEQ ID NO: 152618 - DNA, 23 bp, Artificial sequence
  SiRNA target sequence
tgttatgcctaaagaacaggaag

SEQ ID NO: 152619 - DNA, 23 bp, Artificial sequence
  SiRNA target sequence
gttatgcctaaagaacaggaaga

SEQ ID NO: 152620 - DNA, 23 bp, Artificial sequence
  SiRNA target sequence
ttatgcctaaagaacaggaagaa

SEQ ID NO: 152621 - DNA, 23 bp, Artificial sequence
  SiRNA target sequence
tatgcctaaagaacaggaagaac

SEQ ID NO: 152622 - DNA, 23 bp, Artificial sequence
  SiRNA target sequence
atgcctaaagaacaggaagaaca

SEQ ID NO: 152623 - DNA, 23 bp, Artificial sequence
  SiRNA target sequence
tgcctaaagaacaggaagaacaa

SEQ ID NO: 152624 - DNA, 23 bp, Artificial sequence
  SiRNA target sequence
gcctaaagaacaggaagaacaaa

SEQ ID NO: 152625 - DNA, 23 bp, Artificial sequence
  SiRNA target sequence
cctaaagaacaggaagaacaaaa

SEQ ID NO: 152626 - DNA, 23 bp, Artificial sequence
  SiRNA target sequence
ctaaagaacaggaagaacaaaac

SEQ ID NO: 152627 - DNA, 23 bp, Artificial sequence
  SiRNA target sequence
taaagaacaggaagaacaaaacg

SEQ ID NO: 152628 - DNA, 23 bp, Artificial sequence
  SiRNA target sequence
aaagaacaggaagaacaaaacga

SEQ ID NO: 152629 - DNA, 23 bp, Artificial sequence
  SiRNA target sequence
aagaacaggaagaacaaaacgaa

SEQ ID NO: 152630 - DNA, 23 bp, Artificial sequence
  SiRNA target sequence
agaacaggaagaacaaaacgaaa

SEQ ID NO: 152631 - DNA, 23 bp, Artificial sequence
  SiRNA target sequence
gaacaggaagaacaaaacgaaag

SEQ ID NO: 152632 - DNA, 23 bp, Artificial sequence
  SiRNA target sequence
aacaggaagaacaaaacgaaaga

SEQ ID NO: 152633 - DNA, 23 bp, Artificial sequence
  SiRNA target sequence
acaggaagaacaaaacgaaagag

SEQ ID NO: 152634 - DNA, 23 bp, Artificial sequence
  SiRNA target sequence
caggaagaacaaaacgaaagaga

SEQ ID NO: 152635 - DNA, 23 bp, Artificial sequence
  SiRNA target sequence
aggaagaacaaaacgaaagagaa

SEQ ID NO: 152636 - DNA, 23 bp, Artificial sequence
  SiRNA target sequence
ggaagaacaaaacgaaagagaaa

SEQ ID NO: 152637 - DNA, 23 bp, Artificial sequence
  SiRNA target sequence
gaagaacaaaacgaaagagaaag

SEQ ID NO: 152638 - DNA, 23 bp, Artificial sequence
  SiRNA target sequence
aagaacaaaacgaaagagaaaga

SEQ ID NO: 152639 - DNA, 23 bp, Artificial sequence
  SiRNA target sequence
agaacaaaacgaaagagaaagat

SEQ ID NO: 152640 - DNA, 23 bp, Artificial sequence
  SiRNA target sequence
gaacaaaacgaaagagaaagatt

SEQ ID NO: 152641 - DNA, 23 bp, Artificial sequence
  SiRNA target sequence
aacaaaacgaaagagaaagattc

SEQ ID NO: 152642 - DNA, 23 bp, Artificial sequence
  SiRNA target sequence
acaaaacgaaagagaaagattcg

SEQ ID NO: 152643 - DNA, 23 bp, Artificial sequence
  SiRNA target sequence
caaaacgaaagagaaagattcga

SEQ ID NO: 152644 - DNA, 23 bp, Artificial sequence
  SiRNA target sequence
aaaacgaaagagaaagattcgaa

SEQ ID NO: 152645 - DNA, 23 bp, Artificial sequence
  SiRNA target sequence
aaacgaaagagaaagattcgaag

SEQ ID NO: 152646 - DNA, 23 bp, Artificial sequence
  SiRNA target sequence
aacgaaagagaaagattcgaagg

SEQ ID NO: 152647 - DNA, 23 bp, Artificial sequence
  SiRNA target sequence
acgaaagagaaagattcgaaggt

SEQ ID NO: 152648 - DNA, 23 bp, Artificial sequence
  SiRNA target sequence
cgaaagagaaagattcgaaggtg

SEQ ID NO: 152649 - DNA, 23 bp, Artificial sequence
  SiRNA target sequence
gaaagagaaagattcgaaggtgc

SEQ ID NO: 152650 - DNA, 23 bp, Artificial sequence
  SiRNA target sequence
aaagagaaagattcgaaggtgca

SEQ ID NO: 152651 - DNA, 23 bp, Artificial sequence
  SiRNA target sequence
aagagaaagattcgaaggtgcag

SEQ ID NO: 152652 - DNA, 23 bp, Artificial sequence
  SiRNA target sequence
agagaaagattcgaaggtgcaga

SEQ ID NO: 152653 - DNA, 23 bp, Artificial sequence
  SiRNA target sequence
gagaaagattcgaaggtgcagaa

SEQ ID NO: 152654 - DNA, 23 bp, Artificial sequence
  SiRNA target sequence
agaaagattcgaaggtgcagaag

SEQ ID NO: 152655 - DNA, 23 bp, Artificial sequence
  SiRNA target sequence
gaaagattcgaaggtgcagaaga

SEQ ID NO: 152656 - DNA, 23 bp, Artificial sequence
  SiRNA target sequence
aaagattcgaaggtgcagaagag

SEQ ID NO: 152657 - DNA, 23 bp, Artificial sequence
  SiRNA target sequence
aagattcgaaggtgcagaagagt

SEQ ID NO: 152658 - DNA, 23 bp, Artificial sequence
  SiRNA target sequence
agattcgaaggtgcagaagagtt

SEQ ID NO: 152659 - DNA, 23 bp, Artificial sequence
  SiRNA target sequence
gattcgaaggtgcagaagagttt

SEQ ID NO: 152660 - DNA, 23 bp, Artificial sequence
  SiRNA target sequence
attcgaaggtgcagaagagtttt

SEQ ID NO: 152661 - DNA, 23 bp, Artificial sequence
  SiRNA target sequence
ttcgaaggtgcagaagagttttt

SEQ ID NO: 152662 - DNA, 23 bp, Artificial sequence
  SiRNA target sequence
tcgaaggtgcagaagagtttttt

SEQ ID NO: 152663 - DNA, 23 bp, Artificial sequence
  SiRNA target sequence
cgaaggtgcagaagagttttttg

SEQ ID NO: 152664 - DNA, 23 bp, Artificial sequence
  SiRNA target sequence
gaaggtgcagaagagttttttgg

SEQ ID NO: 152665 - DNA, 23 bp, Artificial sequence
  SiRNA target sequence
aaggtgcagaagagttttttgga

SEQ ID NO: 152666 - DNA, 23 bp, Artificial sequence
  SiRNA target sequence
aggtgcagaagagttttttggag

SEQ ID NO: 152667 - DNA, 23 bp, Artificial sequence
  SiRNA target sequence
ggtgcagaagagttttttggagg

SEQ ID NO: 152668 - DNA, 23 bp, Artificial sequence
  SiRNA target sequence
gtgcagaagagttttttggagga

SEQ ID NO: 152669 - DNA, 23 bp, Artificial sequence
  SiRNA target sequence
tgcagaagagttttttggaggaa

SEQ ID NO: 152670 - DNA, 23 bp, Artificial sequence
  SiRNA target sequence
gcagaagagttttttggaggaaa

SEQ ID NO: 152671 - DNA, 23 bp, Artificial sequence
  SiRNA target sequence
cagaagagttttttggaggaaat

SEQ ID NO: 152672 - DNA, 23 bp, Artificial sequence
  SiRNA target sequence
agaagagttttttggaggaaatg

SEQ ID NO: 152673 - DNA, 23 bp, Artificial sequence
  SiRNA target sequence
gaagagttttttggaggaaatgg

SEQ ID NO: 152674 - DNA, 23 bp, Artificial sequence
  SiRNA target sequence
aagagttttttggaggaaatggt

SEQ ID NO: 152675 - DNA, 23 bp, Artificial sequence
  SiRNA target sequence
agagttttttggaggaaatggta

SEQ ID NO: 152676 - DNA, 23 bp, Artificial sequence
  SiRNA target sequence
gagttttttggaggaaatggtag

SEQ ID NO: 152677 - DNA, 23 bp, Artificial sequence
  SiRNA target sequence
agttttttggaggaaatggtaga

SEQ ID NO: 152678 - DNA, 23 bp, Artificial sequence
  SiRNA target sequence
gttttttggaggaaatggtagag

SEQ ID NO: 152679 - DNA, 23 bp, Artificial sequence
  SiRNA target sequence
ttttttggaggaaatggtagaga

SEQ ID NO: 152680 - DNA, 23 bp, Artificial sequence
  SiRNA target sequence
tttttggaggaaatggtagagat

SEQ ID NO: 152681 - DNA, 23 bp, Artificial sequence
  SiRNA target sequence
ttttggaggaaatggtagagatt

SEQ ID NO: 152682 - DNA, 23 bp, Artificial sequence
  SiRNA target sequence
tttggaggaaatggtagagattt

SEQ ID NO: 152683 - DNA, 23 bp, Artificial sequence
  SiRNA target sequence
ttggaggaaatggtagagatttt

SEQ ID NO: 152684 - DNA, 23 bp, Artificial sequence
  SiRNA target sequence
tggaggaaatggtagagattttt

SEQ ID NO: 152685 - DNA, 23 bp, Artificial sequence
  SiRNA target sequence
ggaggaaatggtagagatttttt

SEQ ID NO: 152686 - DNA, 23 bp, Artificial sequence
  SiRNA target sequence
gaggaaatggtagagattttttt

SEQ ID NO: 152687 - DNA, 23 bp, Artificial sequence
  SiRNA target sequence
aggaaatggtagagattttttta

SEQ ID NO: 152688 - DNA, 23 bp, Artificial sequence
  SiRNA target sequence
ggaaatggtagagatttttttag

SEQ ID NO: 152689 - DNA, 23 bp, Artificial sequence
  SiRNA target sequence
gaaatggtagagatttttttagc

SEQ ID NO: 152690 - DNA, 23 bp, Artificial sequence
  SiRNA target sequence
aaatggtagagatttttttagca

SEQ ID NO: 152691 - DNA, 23 bp, Artificial sequence
  SiRNA target sequence
aatggtagagatttttttagcaa

SEQ ID NO: 152692 - DNA, 23 bp, Artificial sequence
  SiRNA target sequence
atggtagagatttttttagcaag

SEQ ID NO: 152693 - DNA, 23 bp, Artificial sequence
  SiRNA target sequence
tggtagagatttttttagcaagt

SEQ ID NO: 152694 - DNA, 23 bp, Artificial sequence
  SiRNA target sequence
ggtagagatttttttagcaagtt

SEQ ID NO: 152695 - DNA, 23 bp, Artificial sequence
  SiRNA target sequence
gtagagatttttttagcaagttt

SEQ ID NO: 152696 - DNA, 23 bp, Artificial sequence
  SiRNA target sequence
tagagatttttttagcaagtttg

SEQ ID NO: 152697 - DNA, 23 bp, Artificial sequence
  SiRNA target sequence
agagatttttttagcaagtttgg

SEQ ID NO: 152698 - DNA, 23 bp, Artificial sequence
  SiRNA target sequence
gagatttttttagcaagtttgga

SEQ ID NO: 152699 - DNA, 23 bp, Artificial sequence
  SiRNA target sequence
agatttttttagcaagtttggat

SEQ ID NO: 152700 - DNA, 23 bp, Artificial sequence
  SiRNA target sequence
gatttttttagcaagtttggatt

SEQ ID NO: 152701 - DNA, 23 bp, Artificial sequence
  SiRNA target sequence
atttttttagcaagtttggattt

SEQ ID NO: 152702 - DNA, 23 bp, Artificial sequence
  SiRNA target sequence
tttttttagcaagtttggatttt

SEQ ID NO: 152703 - DNA, 23 bp, Artificial sequence
  SiRNA target sequence
ttttttagcaagtttggattttt

SEQ ID NO: 152704 - DNA, 23 bp, Artificial sequence
  SiRNA target sequence
tttttagcaagtttggatttttc

SEQ ID NO: 152705 - DNA, 23 bp, Artificial sequence
  SiRNA target sequence
ttttagcaagtttggatttttct

SEQ ID NO: 152706 - DNA, 23 bp, Artificial sequence
  SiRNA target sequence
tttagcaagtttggatttttcta

SEQ ID NO: 152707 - DNA, 23 bp, Artificial sequence
  SiRNA target sequence
ttagcaagtttggatttttctaa

SEQ ID NO: 152708 - DNA, 24 bp, Artificial sequence
  SiRNA target sequence
atggcacaagacccccaaggactt

SEQ ID NO: 152709 - DNA, 24 bp, Artificial sequence
  SiRNA target sequence
tggcacaagacccccaaggacttt

SEQ ID NO: 152710 - DNA, 24 bp, Artificial sequence
  SiRNA target sequence
ggcacaagacccccaaggacttta

SEQ ID NO: 152711 - DNA, 24 bp, Artificial sequence
  SiRNA target sequence
gcacaagacccccaaggactttat

SEQ ID NO: 152712 - DNA, 24 bp, Artificial sequence
  SiRNA target sequence
cacaagacccccaaggactttatg

SEQ ID NO: 152713 - DNA, 24 bp, Artificial sequence
  SiRNA target sequence
acaagacccccaaggactttatga

SEQ ID NO: 152714 - DNA, 24 bp, Artificial sequence
  SiRNA target sequence
caagacccccaaggactttatgaa

SEQ ID NO: 152715 - DNA, 24 bp, Artificial sequence
  SiRNA target sequence
aagacccccaaggactttatgaag

SEQ ID NO: 152716 - DNA, 24 bp, Artificial sequence
  SiRNA target sequence
agacccccaaggactttatgaagt

SEQ ID NO: 152717 - DNA, 24 bp, Artificial sequence
  SiRNA target sequence
gacccccaaggactttatgaagta

SEQ ID NO: 152718 - DNA, 24 bp, Artificial sequence
  SiRNA target sequence
acccccaaggactttatgaagtat

SEQ ID NO: 152719 - DNA, 24 bp, Artificial sequence
  SiRNA target sequence
cccccaaggactttatgaagtatt

SEQ ID NO: 152720 - DNA, 24 bp, Artificial sequence
  SiRNA target sequence
ccccaaggactttatgaagtatta

SEQ ID NO: 152721 - DNA, 24 bp, Artificial sequence
  SiRNA target sequence
cccaaggactttatgaagtattag

SEQ ID NO: 152722 - DNA, 24 bp, Artificial sequence
  SiRNA target sequence
ccaaggactttatgaagtattagg

SEQ ID NO: 152723 - DNA, 24 bp, Artificial sequence
  SiRNA target sequence
caaggactttatgaagtattagga

SEQ ID NO: 152724 - DNA, 24 bp, Artificial sequence
  SiRNA target sequence
aaggactttatgaagtattaggac

SEQ ID NO: 152725 - DNA, 24 bp, Artificial sequence
  SiRNA target sequence
aggactttatgaagtattaggact

SEQ ID NO: 152726 - DNA, 24 bp, Artificial sequence
  SiRNA target sequence
ggactttatgaagtattaggactt

SEQ ID NO: 152727 - DNA, 24 bp, Artificial sequence
  SiRNA target sequence
gactttatgaagtattaggactta

SEQ ID NO: 152728 - DNA, 24 bp, Artificial sequence
  SiRNA target sequence
actttatgaagtattaggacttaa

SEQ ID NO: 152729 - DNA, 24 bp, Artificial sequence
  SiRNA target sequence
ctttatgaagtattaggacttaaa

SEQ ID NO: 152730 - DNA, 24 bp, Artificial sequence
  SiRNA target sequence
tttatgaagtattaggacttaaag

SEQ ID NO: 152731 - DNA, 24 bp, Artificial sequence
  SiRNA target sequence
ttatgaagtattaggacttaaagc

SEQ ID NO: 152732 - DNA, 24 bp, Artificial sequence
  SiRNA target sequence
tatgaagtattaggacttaaagct

SEQ ID NO: 152733 - DNA, 24 bp, Artificial sequence
  SiRNA target sequence
atgaagtattaggacttaaagctg

SEQ ID NO: 152734 - DNA, 24 bp, Artificial sequence
  SiRNA target sequence
tgaagtattaggacttaaagctgg

SEQ ID NO: 152735 - DNA, 24 bp, Artificial sequence
  SiRNA target sequence
gaagtattaggacttaaagctggt

SEQ ID NO: 152736 - DNA, 24 bp, Artificial sequence
  SiRNA target sequence
aagtattaggacttaaagctggtg

SEQ ID NO: 152737 - DNA, 24 bp, Artificial sequence
  SiRNA target sequence
agtattaggacttaaagctggtgc

SEQ ID NO: 152738 - DNA, 24 bp, Artificial sequence
  SiRNA target sequence
gtattaggacttaaagctggtgca

SEQ ID NO: 152739 - DNA, 24 bp, Artificial sequence
  SiRNA target sequence
tattaggacttaaagctggtgcaa

SEQ ID NO: 152740 - DNA, 24 bp, Artificial sequence
  SiRNA target sequence
attaggacttaaagctggtgcaag

SEQ ID NO: 152741 - DNA, 24 bp, Artificial sequence
  SiRNA target sequence
ttaggacttaaagctggtgcaagc

SEQ ID NO: 152742 - DNA, 24 bp, Artificial sequence
  SiRNA target sequence
taggacttaaagctggtgcaagca

SEQ ID NO: 152743 - DNA, 24 bp, Artificial sequence
  SiRNA target sequence
aggacttaaagctggtgcaagcat

SEQ ID NO: 152744 - DNA, 24 bp, Artificial sequence
  SiRNA target sequence
ggacttaaagctggtgcaagcatt

SEQ ID NO: 152745 - DNA, 24 bp, Artificial sequence
  SiRNA target sequence
gacttaaagctggtgcaagcattg

SEQ ID NO: 152746 - DNA, 24 bp, Artificial sequence
  SiRNA target sequence
acttaaagctggtgcaagcattga

SEQ ID NO: 152747 - DNA, 24 bp, Artificial sequence
  SiRNA target sequence
cttaaagctggtgcaagcattgat

SEQ ID NO: 152748 - DNA, 24 bp, Artificial sequence
  SiRNA target sequence
ttaaagctggtgcaagcattgatg

SEQ ID NO: 152749 - DNA, 24 bp, Artificial sequence
  SiRNA target sequence
taaagctggtgcaagcattgatga

SEQ ID NO: 152750 - DNA, 24 bp, Artificial sequence
  SiRNA target sequence
aaagctggtgcaagcattgatgaa

SEQ ID NO: 152751 - DNA, 24 bp, Artificial sequence
  SiRNA target sequence
aagctggtgcaagcattgatgaag

SEQ ID NO: 152752 - DNA, 24 bp, Artificial sequence
  SiRNA target sequence
agctggtgcaagcattgatgaagt

SEQ ID NO: 152753 - DNA, 24 bp, Artificial sequence
  SiRNA target sequence
gctggtgcaagcattgatgaagtt

SEQ ID NO: 152754 - DNA, 24 bp, Artificial sequence
  SiRNA target sequence
ctggtgcaagcattgatgaagtta

SEQ ID NO: 152755 - DNA, 24 bp, Artificial sequence
  SiRNA target sequence
tggtgcaagcattgatgaagttaa

SEQ ID NO: 152756 - DNA, 24 bp, Artificial sequence
  SiRNA target sequence
ggtgcaagcattgatgaagttaaa

SEQ ID NO: 152757 - DNA, 24 bp, Artificial sequence
  SiRNA target sequence
gtgcaagcattgatgaagttaaaa

SEQ ID NO: 152758 - DNA, 24 bp, Artificial sequence
  SiRNA target sequence
tgcaagcattgatgaagttaaaaa

SEQ ID NO: 152759 - DNA, 24 bp, Artificial sequence
  SiRNA target sequence
gcaagcattgatgaagttaaaaaa

SEQ ID NO: 152760 - DNA, 24 bp, Artificial sequence
  SiRNA target sequence
caagcattgatgaagttaaaaaag

SEQ ID NO: 152761 - DNA, 24 bp, Artificial sequence
  SiRNA target sequence
aagcattgatgaagttaaaaaagc

SEQ ID NO: 152762 - DNA, 24 bp, Artificial sequence
  SiRNA target sequence
agcattgatgaagttaaaaaagca

SEQ ID NO: 152763 - DNA, 24 bp, Artificial sequence
  SiRNA target sequence
gcattgatgaagttaaaaaagcat

SEQ ID NO: 152764 - DNA, 24 bp, Artificial sequence
  SiRNA target sequence
cattgatgaagttaaaaaagcatt

SEQ ID NO: 152765 - DNA, 24 bp, Artificial sequence
  SiRNA target sequence
attgatgaagttaaaaaagcattt

SEQ ID NO: 152766 - DNA, 24 bp, Artificial sequence
  SiRNA target sequence
ttgatgaagttaaaaaagcattta

SEQ ID NO: 152767 - DNA, 24 bp, Artificial sequence
  SiRNA target sequence
tgatgaagttaaaaaagcatttac

SEQ ID NO: 152768 - DNA, 24 bp, Artificial sequence
  SiRNA target sequence
gatgaagttaaaaaagcatttaca

SEQ ID NO: 152769 - DNA, 24 bp, Artificial sequence
  SiRNA target sequence
atgaagttaaaaaagcatttacaa

SEQ ID NO: 152770 - DNA, 24 bp, Artificial sequence
  SiRNA target sequence
tgaagttaaaaaagcatttacaaa

SEQ ID NO: 152771 - DNA, 24 bp, Artificial sequence
  SiRNA target sequence
gaagttaaaaaagcatttacaaaa

SEQ ID NO: 152772 - DNA, 24 bp, Artificial sequence
  SiRNA target sequence
aagttaaaaaagcatttacaaaaa

SEQ ID NO: 152773 - DNA, 24 bp, Artificial sequence
  SiRNA target sequence
agttaaaaaagcatttacaaaaaa

SEQ ID NO: 152774 - DNA, 24 bp, Artificial sequence
  SiRNA target sequence
gttaaaaaagcatttacaaaaaaa

SEQ ID NO: 152775 - DNA, 24 bp, Artificial sequence
  SiRNA target sequence
ttaaaaaagcatttacaaaaaaac

SEQ ID NO: 152776 - DNA, 24 bp, Artificial sequence
  SiRNA target sequence
taaaaaagcatttacaaaaaaaca

SEQ ID NO: 152777 - DNA, 24 bp, Artificial sequence
  SiRNA target sequence
aaaaaagcatttacaaaaaaacaa

SEQ ID NO: 152778 - DNA, 24 bp, Artificial sequence
  SiRNA target sequence
aaaaagcatttacaaaaaaacaaa

SEQ ID NO: 152779 - DNA, 24 bp, Artificial sequence
  SiRNA target sequence
aaaagcatttacaaaaaaacaaag

SEQ ID NO: 152780 - DNA, 24 bp, Artificial sequence
  SiRNA target sequence
aaagcatttacaaaaaaacaaagg

SEQ ID NO: 152781 - DNA, 24 bp, Artificial sequence
  SiRNA target sequence
aagcatttacaaaaaaacaaaggg

SEQ ID NO: 152782 - DNA, 24 bp, Artificial sequence
  SiRNA target sequence
agcatttacaaaaaaacaaaggga

SEQ ID NO: 152783 - DNA, 24 bp, Artificial sequence
  SiRNA target sequence
gcatttacaaaaaaacaaagggaa

SEQ ID NO: 152784 - DNA, 24 bp, Artificial sequence
  SiRNA target sequence
catttacaaaaaaacaaagggaat

SEQ ID NO: 152785 - DNA, 24 bp, Artificial sequence
  SiRNA target sequence
atttacaaaaaaacaaagggaatg

SEQ ID NO: 152786 - DNA, 24 bp, Artificial sequence
  SiRNA target sequence
tttacaaaaaaacaaagggaatgt

SEQ ID NO: 152787 - DNA, 24 bp, Artificial sequence
  SiRNA target sequence
ttacaaaaaaacaaagggaatgtc

SEQ ID NO: 152788 - DNA, 24 bp, Artificial sequence
  SiRNA target sequence
tacaaaaaaacaaagggaatgtca

SEQ ID NO: 152789 - DNA, 24 bp, Artificial sequence
  SiRNA target sequence
acaaaaaaacaaagggaatgtcat

SEQ ID NO: 152790 - DNA, 24 bp, Artificial sequence
  SiRNA target sequence
caaaaaaacaaagggaatgtcatc

SEQ ID NO: 152791 - DNA, 24 bp, Artificial sequence
  SiRNA target sequence
aaaaaaacaaagggaatgtcatcc

SEQ ID NO: 152792 - DNA, 24 bp, Artificial sequence
  SiRNA target sequence
aaaaaacaaagggaatgtcatccc

SEQ ID NO: 152793 - DNA, 24 bp, Artificial sequence
  SiRNA target sequence
aaaaacaaagggaatgtcatcccg

SEQ ID NO: 152794 - DNA, 24 bp, Artificial sequence
  SiRNA target sequence
aaaacaaagggaatgtcatcccga

SEQ ID NO: 152795 - DNA, 24 bp, Artificial sequence
  SiRNA target sequence
aaacaaagggaatgtcatcccgat

SEQ ID NO: 152796 - DNA, 24 bp, Artificial sequence
  SiRNA target sequence
aacaaagggaatgtcatcccgatg

SEQ ID NO: 152797 - DNA, 24 bp, Artificial sequence
  SiRNA target sequence
acaaagggaatgtcatcccgatgg

SEQ ID NO: 152798 - DNA, 24 bp, Artificial sequence
  SiRNA target sequence
caaagggaatgtcatcccgatggt

SEQ ID NO: 152799 - DNA, 24 bp, Artificial sequence
  SiRNA target sequence
aaagggaatgtcatcccgatggtg

SEQ ID NO: 152800 - DNA, 24 bp, Artificial sequence
  SiRNA target sequence
aagggaatgtcatcccgatggtgc

SEQ ID NO: 152801 - DNA, 24 bp, Artificial sequence
  SiRNA target sequence
agggaatgtcatcccgatggtgca

SEQ ID NO: 152802 - DNA, 24 bp, Artificial sequence
  SiRNA target sequence
gggaatgtcatcccgatggtgcat

SEQ ID NO: 152803 - DNA, 24 bp, Artificial sequence
  SiRNA target sequence
ggaatgtcatcccgatggtgcatt

SEQ ID NO: 152804 - DNA, 24 bp, Artificial sequence
  SiRNA target sequence
gaatgtcatcccgatggtgcattt

SEQ ID NO: 152805 - DNA, 24 bp, Artificial sequence
  SiRNA target sequence
aatgtcatcccgatggtgcatttt

SEQ ID NO: 152806 - DNA, 24 bp, Artificial sequence
  SiRNA target sequence
atgtcatcccgatggtgcattttt

SEQ ID NO: 152807 - DNA, 24 bp, Artificial sequence
  SiRNA target sequence
tgtcatcccgatggtgcatttttt

SEQ ID NO: 152808 - DNA, 24 bp, Artificial sequence
  SiRNA target sequence
gtcatcccgatggtgcatttttta

SEQ ID NO: 152809 - DNA, 24 bp, Artificial sequence
  SiRNA target sequence
tcatcccgatggtgcattttttaa

SEQ ID NO: 152810 - DNA, 24 bp, Artificial sequence
  SiRNA target sequence
catcccgatggtgcattttttaaa

SEQ ID NO: 152811 - DNA, 24 bp, Artificial sequence
  SiRNA target sequence
atcccgatggtgcattttttaaag

SEQ ID NO: 152812 - DNA, 24 bp, Artificial sequence
  SiRNA target sequence
tcccgatggtgcattttttaaagc

SEQ ID NO: 152813 - DNA, 24 bp, Artificial sequence
  SiRNA target sequence
cccgatggtgcattttttaaagct

SEQ ID NO: 152814 - DNA, 24 bp, Artificial sequence
  SiRNA target sequence
ccgatggtgcattttttaaagctg

SEQ ID NO: 152815 - DNA, 24 bp, Artificial sequence
  SiRNA target sequence
cgatggtgcattttttaaagctgc

SEQ ID NO: 152816 - DNA, 24 bp, Artificial sequence
  SiRNA target sequence
gatggtgcattttttaaagctgct

SEQ ID NO: 152817 - DNA, 24 bp, Artificial sequence
  SiRNA target sequence
atggtgcattttttaaagctgctc

SEQ ID NO: 152818 - DNA, 24 bp, Artificial sequence
  SiRNA target sequence
tggtgcattttttaaagctgctct

SEQ ID NO: 152819 - DNA, 24 bp, Artificial sequence
  SiRNA target sequence
ggtgcattttttaaagctgctctt

SEQ ID NO: 152820 - DNA, 24 bp, Artificial sequence
  SiRNA target sequence
gtgcattttttaaagctgctctta

SEQ ID NO: 152821 - DNA, 24 bp, Artificial sequence
  SiRNA target sequence
tgcattttttaaagctgctcttag

SEQ ID NO: 152822 - DNA, 24 bp, Artificial sequence
  SiRNA target sequence
gcattttttaaagctgctcttaga

SEQ ID NO: 152823 - DNA, 24 bp, Artificial sequence
  SiRNA target sequence
cattttttaaagctgctcttagaa

SEQ ID NO: 152824 - DNA, 24 bp, Artificial sequence
  SiRNA target sequence
attttttaaagctgctcttagaaa

SEQ ID NO: 152825 - DNA, 24 bp, Artificial sequence
  SiRNA target sequence
ttttttaaagctgctcttagaaaa

SEQ ID NO: 152826 - DNA, 24 bp, Artificial sequence
  SiRNA target sequence
tttttaaagctgctcttagaaaat

SEQ ID NO: 152827 - DNA, 24 bp, Artificial sequence
  SiRNA target sequence
ttttaaagctgctcttagaaaatg

SEQ ID NO: 152828 - DNA, 24 bp, Artificial sequence
  SiRNA target sequence
tttaaagctgctcttagaaaatgt

SEQ ID NO: 152829 - DNA, 24 bp, Artificial sequence
  SiRNA target sequence
ttaaagctgctcttagaaaatgta

SEQ ID NO: 152830 - DNA, 24 bp, Artificial sequence
  SiRNA target sequence
taaagctgctcttagaaaatgtaa

SEQ ID NO: 152831 - DNA, 24 bp, Artificial sequence
  SiRNA target sequence
aaagctgctcttagaaaatgtaaa

SEQ ID NO: 152832 - DNA, 24 bp, Artificial sequence
  SiRNA target sequence
aagctgctcttagaaaatgtaaaa

SEQ ID NO: 152833 - DNA, 24 bp, Artificial sequence
  SiRNA target sequence
agctgctcttagaaaatgtaaaac

SEQ ID NO: 152834 - DNA, 24 bp, Artificial sequence
  SiRNA target sequence
gctgctcttagaaaatgtaaaaca

SEQ ID NO: 152835 - DNA, 24 bp, Artificial sequence
  SiRNA target sequence
ctgctcttagaaaatgtaaaacag

SEQ ID NO: 152836 - DNA, 24 bp, Artificial sequence
  SiRNA target sequence
tgctcttagaaaatgtaaaacaga

SEQ ID NO: 152837 - DNA, 24 bp, Artificial sequence
  SiRNA target sequence
gctcttagaaaatgtaaaacagat

SEQ ID NO: 152838 - DNA, 24 bp, Artificial sequence
  SiRNA target sequence
ctcttagaaaatgtaaaacagatg

SEQ ID NO: 152839 - DNA, 24 bp, Artificial sequence
  SiRNA target sequence
tcttagaaaatgtaaaacagatga

SEQ ID NO: 152840 - DNA, 24 bp, Artificial sequence
  SiRNA target sequence
cttagaaaatgtaaaacagatgaa

SEQ ID NO: 152841 - DNA, 24 bp, Artificial sequence
  SiRNA target sequence
ttagaaaatgtaaaacagatgaag

SEQ ID NO: 152842 - DNA, 24 bp, Artificial sequence
  SiRNA target sequence
tagaaaatgtaaaacagatgaaga

SEQ ID NO: 152843 - DNA, 24 bp, Artificial sequence
  SiRNA target sequence
agaaaatgtaaaacagatgaagaa

SEQ ID NO: 152844 - DNA, 24 bp, Artificial sequence
  SiRNA target sequence
gaaaatgtaaaacagatgaagaaa

SEQ ID NO: 152845 - DNA, 24 bp, Artificial sequence
  SiRNA target sequence
aaaatgtaaaacagatgaagaaag

SEQ ID NO: 152846 - DNA, 24 bp, Artificial sequence
  SiRNA target sequence
aaatgtaaaacagatgaagaaaga

SEQ ID NO: 152847 - DNA, 24 bp, Artificial sequence
  SiRNA target sequence
aatgtaaaacagatgaagaaagag

SEQ ID NO: 152848 - DNA, 24 bp, Artificial sequence
  SiRNA target sequence
atgtaaaacagatgaagaaagagc

SEQ ID NO: 152849 - DNA, 24 bp, Artificial sequence
  SiRNA target sequence
tgtaaaacagatgaagaaagagca

SEQ ID NO: 152850 - DNA, 24 bp, Artificial sequence
  SiRNA target sequence
gtaaaacagatgaagaaagagcaa

SEQ ID NO: 152851 - DNA, 24 bp, Artificial sequence
  SiRNA target sequence
taaaacagatgaagaaagagcaaa

SEQ ID NO: 152852 - DNA, 24 bp, Artificial sequence
  SiRNA target sequence
aaaacagatgaagaaagagcaaaa

SEQ ID NO: 152853 - DNA, 24 bp, Artificial sequence
  SiRNA target sequence
aaacagatgaagaaagagcaaaag

SEQ ID NO: 152854 - DNA, 24 bp, Artificial sequence
  SiRNA target sequence
aacagatgaagaaagagcaaaagt

SEQ ID NO: 152855 - DNA, 24 bp, Artificial sequence
  SiRNA target sequence
acagatgaagaaagagcaaaagtt

SEQ ID NO: 152856 - DNA, 24 bp, Artificial sequence
  SiRNA target sequence
cagatgaagaaagagcaaaagttg

SEQ ID NO: 152857 - DNA, 24 bp, Artificial sequence
  SiRNA target sequence
agatgaagaaagagcaaaagttga

SEQ ID NO: 152858 - DNA, 24 bp, Artificial sequence
  SiRNA target sequence
gatgaagaaagagcaaaagttgaa

SEQ ID NO: 152859 - DNA, 24 bp, Artificial sequence
  SiRNA target sequence
atgaagaaagagcaaaagttgaaa

SEQ ID NO: 152860 - DNA, 24 bp, Artificial sequence
  SiRNA target sequence
tgaagaaagagcaaaagttgaaaa

SEQ ID NO: 152861 - DNA, 24 bp, Artificial sequence
  SiRNA target sequence
gaagaaagagcaaaagttgaaaaa

SEQ ID NO: 152862 - DNA, 24 bp, Artificial sequence
  SiRNA target sequence
aagaaagagcaaaagttgaaaaag

SEQ ID NO: 152863 - DNA, 24 bp, Artificial sequence
  SiRNA target sequence
agaaagagcaaaagttgaaaaaga

SEQ ID NO: 152864 - DNA, 24 bp, Artificial sequence
  SiRNA target sequence
gaaagagcaaaagttgaaaaagaa

SEQ ID NO: 152865 - DNA, 24 bp, Artificial sequence
  SiRNA target sequence
aaagagcaaaagttgaaaaagaat

SEQ ID NO: 152866 - DNA, 24 bp, Artificial sequence
  SiRNA target sequence
aagagcaaaagttgaaaaagaatt

SEQ ID NO: 152867 - DNA, 24 bp, Artificial sequence
  SiRNA target sequence
agagcaaaagttgaaaaagaattt

SEQ ID NO: 152868 - DNA, 24 bp, Artificial sequence
  SiRNA target sequence
gagcaaaagttgaaaaagaattta

SEQ ID NO: 152869 - DNA, 24 bp, Artificial sequence
  SiRNA target sequence
agcaaaagttgaaaaagaatttaa

SEQ ID NO: 152870 - DNA, 24 bp, Artificial sequence
  SiRNA target sequence
gcaaaagttgaaaaagaatttaaa

SEQ ID NO: 152871 - DNA, 24 bp, Artificial sequence
  SiRNA target sequence
caaaagttgaaaaagaatttaaag

SEQ ID NO: 152872 - DNA, 24 bp, Artificial sequence
  SiRNA target sequence
aaaagttgaaaaagaatttaaaga

SEQ ID NO: 152873 - DNA, 24 bp, Artificial sequence
  SiRNA target sequence
aaagttgaaaaagaatttaaagaa

SEQ ID NO: 152874 - DNA, 24 bp, Artificial sequence
  SiRNA target sequence
aagttgaaaaagaatttaaagaaa

SEQ ID NO: 152875 - DNA, 24 bp, Artificial sequence
  SiRNA target sequence
agttgaaaaagaatttaaagaaaa

SEQ ID NO: 152876 - DNA, 24 bp, Artificial sequence
  SiRNA target sequence
gttgaaaaagaatttaaagaaaaa

SEQ ID NO: 152877 - DNA, 24 bp, Artificial sequence
  SiRNA target sequence
ttgaaaaagaatttaaagaaaaat

SEQ ID NO: 152878 - DNA, 24 bp, Artificial sequence
  SiRNA target sequence
tgaaaaagaatttaaagaaaaatc

SEQ ID NO: 152879 - DNA, 24 bp, Artificial sequence
  SiRNA target sequence
gaaaaagaatttaaagaaaaatca

SEQ ID NO: 152880 - DNA, 24 bp, Artificial sequence
  SiRNA target sequence
aaaaagaatttaaagaaaaatcac

SEQ ID NO: 152881 - DNA, 24 bp, Artificial sequence
  SiRNA target sequence
aaaagaatttaaagaaaaatcaca

SEQ ID NO: 152882 - DNA, 24 bp, Artificial sequence
  SiRNA target sequence
aaagaatttaaagaaaaatcacaa

SEQ ID NO: 152883 - DNA, 24 bp, Artificial sequence
  SiRNA target sequence
aagaatttaaagaaaaatcacaaa

SEQ ID NO: 152884 - DNA, 24 bp, Artificial sequence
  SiRNA target sequence
agaatttaaagaaaaatcacaaaa

SEQ ID NO: 152885 - DNA, 24 bp, Artificial sequence
  SiRNA target sequence
gaatttaaagaaaaatcacaaaaa

SEQ ID NO: 152886 - DNA, 24 bp, Artificial sequence
  SiRNA target sequence
aatttaaagaaaaatcacaaaaat

SEQ ID NO: 152887 - DNA, 24 bp, Artificial sequence
  SiRNA target sequence
atttaaagaaaaatcacaaaaatg

SEQ ID NO: 152888 - DNA, 24 bp, Artificial sequence
  SiRNA target sequence
tttaaagaaaaatcacaaaaatgt

SEQ ID NO: 152889 - DNA, 24 bp, Artificial sequence
  SiRNA target sequence
ttaaagaaaaatcacaaaaatgta

SEQ ID NO: 152890 - DNA, 24 bp, Artificial sequence
  SiRNA target sequence
taaagaaaaatcacaaaaatgtaa

SEQ ID NO: 152891 - DNA, 24 bp, Artificial sequence
  SiRNA target sequence
aaagaaaaatcacaaaaatgtaat

SEQ ID NO: 152892 - DNA, 24 bp, Artificial sequence
  SiRNA target sequence
aagaaaaatcacaaaaatgtaatc

SEQ ID NO: 152893 - DNA, 24 bp, Artificial sequence
  SiRNA target sequence
agaaaaatcacaaaaatgtaatca

SEQ ID NO: 152894 - DNA, 24 bp, Artificial sequence
  SiRNA target sequence
gaaaaatcacaaaaatgtaatcaa

SEQ ID NO: 152895 - DNA, 24 bp, Artificial sequence
  SiRNA target sequence
aaaaatcacaaaaatgtaatcaag

SEQ ID NO: 152896 - DNA, 24 bp, Artificial sequence
  SiRNA target sequence
aaaatcacaaaaatgtaatcaagc

SEQ ID NO: 152897 - DNA, 24 bp, Artificial sequence
  SiRNA target sequence
aaatcacaaaaatgtaatcaagct

SEQ ID NO: 152898 - DNA, 24 bp, Artificial sequence
  SiRNA target sequence
aatcacaaaaatgtaatcaagcta

SEQ ID NO: 152899 - DNA, 24 bp, Artificial sequence
  SiRNA target sequence
atcacaaaaatgtaatcaagctaa

SEQ ID NO: 152900 - DNA, 24 bp, Artificial sequence
  SiRNA target sequence
tcacaaaaatgtaatcaagctaaa

SEQ ID NO: 152901 - DNA, 24 bp, Artificial sequence
  SiRNA target sequence
cacaaaaatgtaatcaagctaaag

SEQ ID NO: 152902 - DNA, 24 bp, Artificial sequence
  SiRNA target sequence
acaaaaatgtaatcaagctaaagc

SEQ ID NO: 152903 - DNA, 24 bp, Artificial sequence
  SiRNA target sequence
caaaaatgtaatcaagctaaagca

SEQ ID NO: 152904 - DNA, 24 bp, Artificial sequence
  SiRNA target sequence
aaaaatgtaatcaagctaaagcag

SEQ ID NO: 152905 - DNA, 24 bp, Artificial sequence
  SiRNA target sequence
aaaatgtaatcaagctaaagcagt

SEQ ID NO: 152906 - DNA, 24 bp, Artificial sequence
  SiRNA target sequence
aaatgtaatcaagctaaagcagtt

SEQ ID NO: 152907 - DNA, 24 bp, Artificial sequence
  SiRNA target sequence
aatgtaatcaagctaaagcagttt

SEQ ID NO: 152908 - DNA, 24 bp, Artificial sequence
  SiRNA target sequence
atgtaatcaagctaaagcagtttt

SEQ ID NO: 152909 - DNA, 24 bp, Artificial sequence
  SiRNA target sequence
tgtaatcaagctaaagcagtttta

SEQ ID NO: 152910 - DNA, 24 bp, Artificial sequence
  SiRNA target sequence
gtaatcaagctaaagcagttttat

SEQ ID NO: 152911 - DNA, 24 bp, Artificial sequence
  SiRNA target sequence
taatcaagctaaagcagttttatt

SEQ ID NO: 152912 - DNA, 24 bp, Artificial sequence
  SiRNA target sequence
aatcaagctaaagcagttttattt

SEQ ID NO: 152913 - DNA, 24 bp, Artificial sequence
  SiRNA target sequence
atcaagctaaagcagttttatttg

SEQ ID NO: 152914 - DNA, 24 bp, Artificial sequence
  SiRNA target sequence
tcaagctaaagcagttttatttga

SEQ ID NO: 152915 - DNA, 24 bp, Artificial sequence
  SiRNA target sequence
caagctaaagcagttttatttgat

SEQ ID NO: 152916 - DNA, 24 bp, Artificial sequence
  SiRNA target sequence
aagctaaagcagttttatttgatg

SEQ ID NO: 152917 - DNA, 24 bp, Artificial sequence
  SiRNA target sequence
agctaaagcagttttatttgatga

SEQ ID NO: 152918 - DNA, 24 bp, Artificial sequence
  SiRNA target sequence
gctaaagcagttttatttgatgag

SEQ ID NO: 152919 - DNA, 24 bp, Artificial sequence
  SiRNA target sequence
ctaaagcagttttatttgatgaga

SEQ ID NO: 152920 - DNA, 24 bp, Artificial sequence
  SiRNA target sequence
taaagcagttttatttgatgagaa

SEQ ID NO: 152921 - DNA, 24 bp, Artificial sequence
  SiRNA target sequence
aaagcagttttatttgatgagaaa

SEQ ID NO: 152922 - DNA, 24 bp, Artificial sequence
  SiRNA target sequence
aagcagttttatttgatgagaaaa

SEQ ID NO: 152923 - DNA, 24 bp, Artificial sequence
  SiRNA target sequence
agcagttttatttgatgagaaaaa

SEQ ID NO: 152924 - DNA, 24 bp, Artificial sequence
  SiRNA target sequence
gcagttttatttgatgagaaaaaa

SEQ ID NO: 152925 - DNA, 24 bp, Artificial sequence
  SiRNA target sequence
cagttttatttgatgagaaaaaaa

SEQ ID NO: 152926 - DNA, 24 bp, Artificial sequence
  SiRNA target sequence
agttttatttgatgagaaaaaaaa

SEQ ID NO: 152927 - DNA, 24 bp, Artificial sequence
  SiRNA target sequence
gttttatttgatgagaaaaaaaag

SEQ ID NO: 152928 - DNA, 24 bp, Artificial sequence
  SiRNA target sequence
ttttatttgatgagaaaaaaaagc

SEQ ID NO: 152929 - DNA, 24 bp, Artificial sequence
  SiRNA target sequence
tttatttgatgagaaaaaaaagca

SEQ ID NO: 152930 - DNA, 24 bp, Artificial sequence
  SiRNA target sequence
ttatttgatgagaaaaaaaagcaa

SEQ ID NO: 152931 - DNA, 24 bp, Artificial sequence
  SiRNA target sequence
tatttgatgagaaaaaaaagcaag

SEQ ID NO: 152932 - DNA, 24 bp, Artificial sequence
  SiRNA target sequence
atttgatgagaaaaaaaagcaaga

SEQ ID NO: 152933 - DNA, 24 bp, Artificial sequence
  SiRNA target sequence
tttgatgagaaaaaaaagcaagag

SEQ ID NO: 152934 - DNA, 24 bp, Artificial sequence
  SiRNA target sequence
ttgatgagaaaaaaaagcaagagt

SEQ ID NO: 152935 - DNA, 24 bp, Artificial sequence
  SiRNA target sequence
tgatgagaaaaaaaagcaagagta

SEQ ID NO: 152936 - DNA, 24 bp, Artificial sequence
  SiRNA target sequence
gatgagaaaaaaaagcaagagtat

SEQ ID NO: 152937 - DNA, 24 bp, Artificial sequence
  SiRNA target sequence
atgagaaaaaaaagcaagagtatg

SEQ ID NO: 152938 - DNA, 24 bp, Artificial sequence
  SiRNA target sequence
tgagaaaaaaaagcaagagtatga

SEQ ID NO: 152939 - DNA, 24 bp, Artificial sequence
  SiRNA target sequence
gagaaaaaaaagcaagagtatgat

SEQ ID NO: 152940 - DNA, 24 bp, Artificial sequence
  SiRNA target sequence
agaaaaaaaagcaagagtatgata

SEQ ID NO: 152941 - DNA, 24 bp, Artificial sequence
  SiRNA target sequence
gaaaaaaaagcaagagtatgatat

SEQ ID NO: 152942 - DNA, 24 bp, Artificial sequence
  SiRNA target sequence
aaaaaaaagcaagagtatgatatg

SEQ ID NO: 152943 - DNA, 24 bp, Artificial sequence
  SiRNA target sequence
aaaaaaagcaagagtatgatatgg

SEQ ID NO: 152944 - DNA, 24 bp, Artificial sequence
  SiRNA target sequence
aaaaaagcaagagtatgatatggg

SEQ ID NO: 152945 - DNA, 24 bp, Artificial sequence
  SiRNA target sequence
aaaaagcaagagtatgatatggga

SEQ ID NO: 152946 - DNA, 24 bp, Artificial sequence
  SiRNA target sequence
aaaagcaagagtatgatatgggaa

SEQ ID NO: 152947 - DNA, 24 bp, Artificial sequence
  SiRNA target sequence
aaagcaagagtatgatatgggaat

SEQ ID NO: 152948 - DNA, 24 bp, Artificial sequence
  SiRNA target sequence
aagcaagagtatgatatgggaatg

SEQ ID NO: 152949 - DNA, 24 bp, Artificial sequence
  SiRNA target sequence
agcaagagtatgatatgggaatga

SEQ ID NO: 152950 - DNA, 24 bp, Artificial sequence
  SiRNA target sequence
gcaagagtatgatatgggaatgac

SEQ ID NO: 152951 - DNA, 24 bp, Artificial sequence
  SiRNA target sequence
caagagtatgatatgggaatgact

SEQ ID NO: 152952 - DNA, 24 bp, Artificial sequence
  SiRNA target sequence
aagagtatgatatgggaatgactg

SEQ ID NO: 152953 - DNA, 24 bp, Artificial sequence
  SiRNA target sequence
agagtatgatatgggaatgactgg

SEQ ID NO: 152954 - DNA, 24 bp, Artificial sequence
  SiRNA target sequence
gagtatgatatgggaatgactggc

SEQ ID NO: 152955 - DNA, 24 bp, Artificial sequence
  SiRNA target sequence
agtatgatatgggaatgactggcg

SEQ ID NO: 152956 - DNA, 24 bp, Artificial sequence
  SiRNA target sequence
gtatgatatgggaatgactggcga

SEQ ID NO: 152957 - DNA, 24 bp, Artificial sequence
  SiRNA target sequence
tatgatatgggaatgactggcgat

SEQ ID NO: 152958 - DNA, 24 bp, Artificial sequence
  SiRNA target sequence
atgatatgggaatgactggcgatt

SEQ ID NO: 152959 - DNA, 24 bp, Artificial sequence
  SiRNA target sequence
tgatatgggaatgactggcgattt

SEQ ID NO: 152960 - DNA, 24 bp, Artificial sequence
  SiRNA target sequence
gatatgggaatgactggcgatttt

SEQ ID NO: 152961 - DNA, 24 bp, Artificial sequence
  SiRNA target sequence
atatgggaatgactggcgattttg

SEQ ID NO: 152962 - DNA, 24 bp, Artificial sequence
  SiRNA target sequence
tatgggaatgactggcgattttgg

SEQ ID NO: 152963 - DNA, 24 bp, Artificial sequence
  SiRNA target sequence
atgggaatgactggcgattttgga

SEQ ID NO: 152964 - DNA, 24 bp, Artificial sequence
  SiRNA target sequence
tgggaatgactggcgattttggat

SEQ ID NO: 152965 - DNA, 24 bp, Artificial sequence
  SiRNA target sequence
gggaatgactggcgattttggatt

SEQ ID NO: 152966 - DNA, 24 bp, Artificial sequence
  SiRNA target sequence
ggaatgactggcgattttggattt

SEQ ID NO: 152967 - DNA, 24 bp, Artificial sequence
  SiRNA target sequence
gaatgactggcgattttggatttt

SEQ ID NO: 152968 - DNA, 24 bp, Artificial sequence
  SiRNA target sequence
aatgactggcgattttggattttc

SEQ ID NO: 152969 - DNA, 24 bp, Artificial sequence
  SiRNA target sequence
atgactggcgattttggattttct

SEQ ID NO: 152970 - DNA, 24 bp, Artificial sequence
  SiRNA target sequence
tgactggcgattttggattttctg

SEQ ID NO: 152971 - DNA, 24 bp, Artificial sequence
  SiRNA target sequence
gactggcgattttggattttctgc

SEQ ID NO: 152972 - DNA, 24 bp, Artificial sequence
  SiRNA target sequence
actggcgattttggattttctgca

SEQ ID NO: 152973 - DNA, 24 bp, Artificial sequence
  SiRNA target sequence
ctggcgattttggattttctgcag

SEQ ID NO: 152974 - DNA, 24 bp, Artificial sequence
  SiRNA target sequence
tggcgattttggattttctgcagg

SEQ ID NO: 152975 - DNA, 24 bp, Artificial sequence
  SiRNA target sequence
ggcgattttggattttctgcaggt

SEQ ID NO: 152976 - DNA, 24 bp, Artificial sequence
  SiRNA target sequence
gcgattttggattttctgcaggtg

SEQ ID NO: 152977 - DNA, 24 bp, Artificial sequence
  SiRNA target sequence
cgattttggattttctgcaggtgg

SEQ ID NO: 152978 - DNA, 24 bp, Artificial sequence
  SiRNA target sequence
gattttggattttctgcaggtggt

SEQ ID NO: 152979 - DNA, 24 bp, Artificial sequence
  SiRNA target sequence
attttggattttctgcaggtggtg

SEQ ID NO: 152980 - DNA, 24 bp, Artificial sequence
  SiRNA target sequence
ttttggattttctgcaggtggtgg

SEQ ID NO: 152981 - DNA, 24 bp, Artificial sequence
  SiRNA target sequence
tttggattttctgcaggtggtgga

SEQ ID NO: 152982 - DNA, 24 bp, Artificial sequence
  SiRNA target sequence
ttggattttctgcaggtggtggag

SEQ ID NO: 152983 - DNA, 24 bp, Artificial sequence
  SiRNA target sequence
tggattttctgcaggtggtggaga

SEQ ID NO: 152984 - DNA, 24 bp, Artificial sequence
  SiRNA target sequence
ggattttctgcaggtggtggagac

SEQ ID NO: 152985 - DNA, 24 bp, Artificial sequence
  SiRNA target sequence
gattttctgcaggtggtggagact

SEQ ID NO: 152986 - DNA, 24 bp, Artificial sequence
  SiRNA target sequence
attttctgcaggtggtggagactt

SEQ ID NO: 152987 - DNA, 24 bp, Artificial sequence
  SiRNA target sequence
ttttctgcaggtggtggagacttt

SEQ ID NO: 152988 - DNA, 24 bp, Artificial sequence
  SiRNA target sequence
tttctgcaggtggtggagactttt

SEQ ID NO: 152989 - DNA, 24 bp, Artificial sequence
  SiRNA target sequence
ttctgcaggtggtggagacttttt

SEQ ID NO: 152990 - DNA, 24 bp, Artificial sequence
  SiRNA target sequence
tctgcaggtggtggagactttttc

SEQ ID NO: 152991 - DNA, 24 bp, Artificial sequence
  SiRNA target sequence
ctgcaggtggtggagactttttcg

SEQ ID NO: 152992 - DNA, 24 bp, Artificial sequence
  SiRNA target sequence
tgcaggtggtggagactttttcga

SEQ ID NO: 152993 - DNA, 24 bp, Artificial sequence
  SiRNA target sequence
gcaggtggtggagactttttcgat

SEQ ID NO: 152994 - DNA, 24 bp, Artificial sequence
  SiRNA target sequence
caggtggtggagactttttcgata

SEQ ID NO: 152995 - DNA, 24 bp, Artificial sequence
  SiRNA target sequence
aggtggtggagactttttcgatat

SEQ ID NO: 152996 - DNA, 24 bp, Artificial sequence
  SiRNA target sequence
ggtggtggagactttttcgatatt

SEQ ID NO: 152997 - DNA, 24 bp, Artificial sequence
  SiRNA target sequence
gtggtggagactttttcgatattt

SEQ ID NO: 152998 - DNA, 24 bp, Artificial sequence
  SiRNA target sequence
tggtggagactttttcgatatttt

SEQ ID NO: 152999 - DNA, 24 bp, Artificial sequence
  SiRNA target sequence
ggtggagactttttcgatattttt

SEQ ID NO: 153000 - DNA, 24 bp, Artificial sequence
  SiRNA target sequence
gtggagactttttcgatatttttt

SEQ ID NO: 153001 - DNA, 24 bp, Artificial sequence
  SiRNA target sequence
tggagactttttcgatattttttc

SEQ ID NO: 153002 - DNA, 24 bp, Artificial sequence
  SiRNA target sequence
ggagactttttcgatattttttca

SEQ ID NO: 153003 - DNA, 24 bp, Artificial sequence
  SiRNA target sequence
gagactttttcgatattttttcaa

SEQ ID NO: 153004 - DNA, 24 bp, Artificial sequence
  SiRNA target sequence
agactttttcgatattttttcaag

SEQ ID NO: 153005 - DNA, 24 bp, Artificial sequence
  SiRNA target sequence
gactttttcgatattttttcaagt

SEQ ID NO: 153006 - DNA, 24 bp, Artificial sequence
  SiRNA target sequence
actttttcgatattttttcaagtt

SEQ ID NO: 153007 - DNA, 24 bp, Artificial sequence
  SiRNA target sequence
ctttttcgatattttttcaagttt

SEQ ID NO: 153008 - DNA, 24 bp, Artificial sequence
  SiRNA target sequence
tttttcgatattttttcaagtttt

SEQ ID NO: 153009 - DNA, 24 bp, Artificial sequence
  SiRNA target sequence
ttttcgatattttttcaagtttta

SEQ ID NO: 153010 - DNA, 24 bp, Artificial sequence
  SiRNA target sequence
tttcgatattttttcaagttttac

SEQ ID NO: 153011 - DNA, 24 bp, Artificial sequence
  SiRNA target sequence
ttcgatattttttcaagttttact

SEQ ID NO: 153012 - DNA, 24 bp, Artificial sequence
  SiRNA target sequence
tcgatattttttcaagttttactg

SEQ ID NO: 153013 - DNA, 24 bp, Artificial sequence
  SiRNA target sequence
cgatattttttcaagttttactgg

SEQ ID NO: 153014 - DNA, 24 bp, Artificial sequence
  SiRNA target sequence
gatattttttcaagttttactggt

SEQ ID NO: 153015 - DNA, 24 bp, Artificial sequence
  SiRNA target sequence
atattttttcaagttttactggtg

SEQ ID NO: 153016 - DNA, 24 bp, Artificial sequence
  SiRNA target sequence
tattttttcaagttttactggtgg

SEQ ID NO: 153017 - DNA, 24 bp, Artificial sequence
  SiRNA target sequence
attttttcaagttttactggtgga

SEQ ID NO: 153018 - DNA, 24 bp, Artificial sequence
  SiRNA target sequence
ttttttcaagttttactggtggag

SEQ ID NO: 153019 - DNA, 24 bp, Artificial sequence
  SiRNA target sequence
tttttcaagttttactggtggagg

SEQ ID NO: 153020 - DNA, 24 bp, Artificial sequence
  SiRNA target sequence
ttttcaagttttactggtggagga

SEQ ID NO: 153021 - DNA, 24 bp, Artificial sequence
  SiRNA target sequence
tttcaagttttactggtggaggaa

SEQ ID NO: 153022 - DNA, 24 bp, Artificial sequence
  SiRNA target sequence
ttcaagttttactggtggaggaag

SEQ ID NO: 153023 - DNA, 24 bp, Artificial sequence
  SiRNA target sequence
tcaagttttactggtggaggaaga

SEQ ID NO: 153024 - DNA, 24 bp, Artificial sequence
  SiRNA target sequence
caagttttactggtggaggaagaa

SEQ ID NO: 153025 - DNA, 24 bp, Artificial sequence
  SiRNA target sequence
aagttttactggtggaggaagaag

SEQ ID NO: 153026 - DNA, 24 bp, Artificial sequence
  SiRNA target sequence
agttttactggtggaggaagaaga

SEQ ID NO: 153027 - DNA, 24 bp, Artificial sequence
  SiRNA target sequence
gttttactggtggaggaagaagaa

SEQ ID NO: 153028 - DNA, 24 bp, Artificial sequence
  SiRNA target sequence
ttttactggtggaggaagaagaaa

SEQ ID NO: 153029 - DNA, 24 bp, Artificial sequence
  SiRNA target sequence
tttactggtggaggaagaagaaat

SEQ ID NO: 153030 - DNA, 24 bp, Artificial sequence
  SiRNA target sequence
ttactggtggaggaagaagaaatc

SEQ ID NO: 153031 - DNA, 24 bp, Artificial sequence
  SiRNA target sequence
tactggtggaggaagaagaaatcg

SEQ ID NO: 153032 - DNA, 24 bp, Artificial sequence
  SiRNA target sequence
actggtggaggaagaagaaatcga

SEQ ID NO: 153033 - DNA, 24 bp, Artificial sequence
  SiRNA target sequence
ctggtggaggaagaagaaatcgag

SEQ ID NO: 153034 - DNA, 24 bp, Artificial sequence
  SiRNA target sequence
tggtggaggaagaagaaatcgagt

SEQ ID NO: 153035 - DNA, 24 bp, Artificial sequence
  SiRNA target sequence
ggtggaggaagaagaaatcgagta

SEQ ID NO: 153036 - DNA, 24 bp, Artificial sequence
  SiRNA target sequence
gtggaggaagaagaaatcgagtac

SEQ ID NO: 153037 - DNA, 24 bp, Artificial sequence
  SiRNA target sequence
tggaggaagaagaaatcgagtaca

SEQ ID NO: 153038 - DNA, 24 bp, Artificial sequence
  SiRNA target sequence
ggaggaagaagaaatcgagtacaa

SEQ ID NO: 153039 - DNA, 24 bp, Artificial sequence
  SiRNA target sequence
gaggaagaagaaatcgagtacaaa

SEQ ID NO: 153040 - DNA, 24 bp, Artificial sequence
  SiRNA target sequence
aggaagaagaaatcgagtacaaaa

SEQ ID NO: 153041 - DNA, 24 bp, Artificial sequence
  SiRNA target sequence
ggaagaagaaatcgagtacaaaaa

SEQ ID NO: 153042 - DNA, 24 bp, Artificial sequence
  SiRNA target sequence
gaagaagaaatcgagtacaaaaag

SEQ ID NO: 153043 - DNA, 24 bp, Artificial sequence
  SiRNA target sequence
aagaagaaatcgagtacaaaaagt

SEQ ID NO: 153044 - DNA, 24 bp, Artificial sequence
  SiRNA target sequence
agaagaaatcgagtacaaaaagtt

SEQ ID NO: 153045 - DNA, 24 bp, Artificial sequence
  SiRNA target sequence
gaagaaatcgagtacaaaaagttc

SEQ ID NO: 153046 - DNA, 24 bp, Artificial sequence
  SiRNA target sequence
aagaaatcgagtacaaaaagttca

SEQ ID NO: 153047 - DNA, 24 bp, Artificial sequence
  SiRNA target sequence
agaaatcgagtacaaaaagttcaa

SEQ ID NO: 153048 - DNA, 24 bp, Artificial sequence
  SiRNA target sequence
gaaatcgagtacaaaaagttcaag

SEQ ID NO: 153049 - DNA, 24 bp, Artificial sequence
  SiRNA target sequence
aaatcgagtacaaaaagttcaaga

SEQ ID NO: 153050 - DNA, 24 bp, Artificial sequence
  SiRNA target sequence
aatcgagtacaaaaagttcaagat

SEQ ID NO: 153051 - DNA, 24 bp, Artificial sequence
  SiRNA target sequence
atcgagtacaaaaagttcaagata

SEQ ID NO: 153052 - DNA, 24 bp, Artificial sequence
  SiRNA target sequence
tcgagtacaaaaagttcaagatac

SEQ ID NO: 153053 - DNA, 24 bp, Artificial sequence
  SiRNA target sequence
cgagtacaaaaagttcaagataca

SEQ ID NO: 153054 - DNA, 24 bp, Artificial sequence
  SiRNA target sequence
gagtacaaaaagttcaagatacag

SEQ ID NO: 153055 - DNA, 24 bp, Artificial sequence
  SiRNA target sequence
agtacaaaaagttcaagatacaga

SEQ ID NO: 153056 - DNA, 24 bp, Artificial sequence
  SiRNA target sequence
gtacaaaaagttcaagatacagaa

SEQ ID NO: 153057 - DNA, 24 bp, Artificial sequence
  SiRNA target sequence
tacaaaaagttcaagatacagaat

SEQ ID NO: 153058 - DNA, 24 bp, Artificial sequence
  SiRNA target sequence
acaaaaagttcaagatacagaata

SEQ ID NO: 153059 - DNA, 24 bp, Artificial sequence
  SiRNA target sequence
caaaaagttcaagatacagaatac

SEQ ID NO: 153060 - DNA, 24 bp, Artificial sequence
  SiRNA target sequence
aaaaagttcaagatacagaatacg

SEQ ID NO: 153061 - DNA, 24 bp, Artificial sequence
  SiRNA target sequence
aaaagttcaagatacagaatacga

SEQ ID NO: 153062 - DNA, 24 bp, Artificial sequence
  SiRNA target sequence
aaagttcaagatacagaatacgag

SEQ ID NO: 153063 - DNA, 24 bp, Artificial sequence
  SiRNA target sequence
aagttcaagatacagaatacgagt

SEQ ID NO: 153064 - DNA, 24 bp, Artificial sequence
  SiRNA target sequence
agttcaagatacagaatacgagtt

SEQ ID NO: 153065 - DNA, 24 bp, Artificial sequence
  SiRNA target sequence
gttcaagatacagaatacgagttt

SEQ ID NO: 153066 - DNA, 24 bp, Artificial sequence
  SiRNA target sequence
ttcaagatacagaatacgagttta

SEQ ID NO: 153067 - DNA, 24 bp, Artificial sequence
  SiRNA target sequence
tcaagatacagaatacgagtttaa

SEQ ID NO: 153068 - DNA, 24 bp, Artificial sequence
  SiRNA target sequence
caagatacagaatacgagtttaat

SEQ ID NO: 153069 - DNA, 24 bp, Artificial sequence
  SiRNA target sequence
aagatacagaatacgagtttaata

SEQ ID NO: 153070 - DNA, 24 bp, Artificial sequence
  SiRNA target sequence
agatacagaatacgagtttaatat

SEQ ID NO: 153071 - DNA, 24 bp, Artificial sequence
  SiRNA target sequence
gatacagaatacgagtttaatatt

SEQ ID NO: 153072 - DNA, 24 bp, Artificial sequence
  SiRNA target sequence
atacagaatacgagtttaatattt

SEQ ID NO: 153073 - DNA, 24 bp, Artificial sequence
  SiRNA target sequence
tacagaatacgagtttaatatttc

SEQ ID NO: 153074 - DNA, 24 bp, Artificial sequence
  SiRNA target sequence
acagaatacgagtttaatatttcg

SEQ ID NO: 153075 - DNA, 24 bp, Artificial sequence
  SiRNA target sequence
cagaatacgagtttaatatttcgt

SEQ ID NO: 153076 - DNA, 24 bp, Artificial sequence
  SiRNA target sequence
agaatacgagtttaatatttcgtt

SEQ ID NO: 153077 - DNA, 24 bp, Artificial sequence
  SiRNA target sequence
gaatacgagtttaatatttcgttg

SEQ ID NO: 153078 - DNA, 24 bp, Artificial sequence
  SiRNA target sequence
aatacgagtttaatatttcgttga

SEQ ID NO: 153079 - DNA, 24 bp, Artificial sequence
  SiRNA target sequence
atacgagtttaatatttcgttgaa

SEQ ID NO: 153080 - DNA, 24 bp, Artificial sequence
  SiRNA target sequence
tacgagtttaatatttcgttgaag

SEQ ID NO: 153081 - DNA, 24 bp, Artificial sequence
  SiRNA target sequence
acgagtttaatatttcgttgaagg

SEQ ID NO: 153082 - DNA, 24 bp, Artificial sequence
  SiRNA target sequence
cgagtttaatatttcgttgaagga

SEQ ID NO: 153083 - DNA, 24 bp, Artificial sequence
  SiRNA target sequence
gagtttaatatttcgttgaaggaa

SEQ ID NO: 153084 - DNA, 24 bp, Artificial sequence
  SiRNA target sequence
agtttaatatttcgttgaaggaag

SEQ ID NO: 153085 - DNA, 24 bp, Artificial sequence
  SiRNA target sequence
gtttaatatttcgttgaaggaagc

SEQ ID NO: 153086 - DNA, 24 bp, Artificial sequence
  SiRNA target sequence
tttaatatttcgttgaaggaagct

SEQ ID NO: 153087 - DNA, 24 bp, Artificial sequence
  SiRNA target sequence
ttaatatttcgttgaaggaagctt

SEQ ID NO: 153088 - DNA, 24 bp, Artificial sequence
  SiRNA target sequence
taatatttcgttgaaggaagctta

SEQ ID NO: 153089 - DNA, 24 bp, Artificial sequence
  SiRNA target sequence
aatatttcgttgaaggaagcttat

SEQ ID NO: 153090 - DNA, 24 bp, Artificial sequence
  SiRNA target sequence
atatttcgttgaaggaagcttata

SEQ ID NO: 153091 - DNA, 24 bp, Artificial sequence
  SiRNA target sequence
tatttcgttgaaggaagcttatat

SEQ ID NO: 153092 - DNA, 24 bp, Artificial sequence
  SiRNA target sequence
atttcgttgaaggaagcttatatg

SEQ ID NO: 153093 - DNA, 24 bp, Artificial sequence
  SiRNA target sequence
tttcgttgaaggaagcttatatgg

SEQ ID NO: 153094 - DNA, 24 bp, Artificial sequence
  SiRNA target sequence
ttcgttgaaggaagcttatatggg

SEQ ID NO: 153095 - DNA, 24 bp, Artificial sequence
  SiRNA target sequence
tcgttgaaggaagcttatatggga

SEQ ID NO: 153096 - DNA, 24 bp, Artificial sequence
  SiRNA target sequence
cgttgaaggaagcttatatgggaa

SEQ ID NO: 153097 - DNA, 24 bp, Artificial sequence
  SiRNA target sequence
gttgaaggaagcttatatgggaaa

SEQ ID NO: 153098 - DNA, 24 bp, Artificial sequence
  SiRNA target sequence
ttgaaggaagcttatatgggaaag

SEQ ID NO: 153099 - DNA, 24 bp, Artificial sequence
  SiRNA target sequence
tgaaggaagcttatatgggaaagc

SEQ ID NO: 153100 - DNA, 24 bp, Artificial sequence
  SiRNA target sequence
gaaggaagcttatatgggaaagcg

SEQ ID NO: 153101 - DNA, 24 bp, Artificial sequence
  SiRNA target sequence
aaggaagcttatatgggaaagcga

SEQ ID NO: 153102 - DNA, 24 bp, Artificial sequence
  SiRNA target sequence
aggaagcttatatgggaaagcgag

SEQ ID NO: 153103 - DNA, 24 bp, Artificial sequence
  SiRNA target sequence
ggaagcttatatgggaaagcgagc

SEQ ID NO: 153104 - DNA, 24 bp, Artificial sequence
  SiRNA target sequence
gaagcttatatgggaaagcgagct

SEQ ID NO: 153105 - DNA, 24 bp, Artificial sequence
  SiRNA target sequence
aagcttatatgggaaagcgagcta

SEQ ID NO: 153106 - DNA, 24 bp, Artificial sequence
  SiRNA target sequence
agcttatatgggaaagcgagctag

SEQ ID NO: 153107 - DNA, 24 bp, Artificial sequence
  SiRNA target sequence
gcttatatgggaaagcgagctagt

SEQ ID NO: 153108 - DNA, 24 bp, Artificial sequence
  SiRNA target sequence
cttatatgggaaagcgagctagtt

SEQ ID NO: 153109 - DNA, 24 bp, Artificial sequence
  SiRNA target sequence
ttatatgggaaagcgagctagttt

SEQ ID NO: 153110 - DNA, 24 bp, Artificial sequence
  SiRNA target sequence
tatatgggaaagcgagctagtttt

SEQ ID NO: 153111 - DNA, 24 bp, Artificial sequence
  SiRNA target sequence
atatgggaaagcgagctagtttta

SEQ ID NO: 153112 - DNA, 24 bp, Artificial sequence
  SiRNA target sequence
tatgggaaagcgagctagttttaa

SEQ ID NO: 153113 - DNA, 24 bp, Artificial sequence
  SiRNA target sequence
atgggaaagcgagctagttttaat

SEQ ID NO: 153114 - DNA, 24 bp, Artificial sequence
  SiRNA target sequence
tgggaaagcgagctagttttaatg

SEQ ID NO: 153115 - DNA, 24 bp, Artificial sequence
  SiRNA target sequence
gggaaagcgagctagttttaatgt

SEQ ID NO: 153116 - DNA, 24 bp, Artificial sequence
  SiRNA target sequence
ggaaagcgagctagttttaatgta

SEQ ID NO: 153117 - DNA, 24 bp, Artificial sequence
  SiRNA target sequence
gaaagcgagctagttttaatgtaa

SEQ ID NO: 153118 - DNA, 24 bp, Artificial sequence
  SiRNA target sequence
aaagcgagctagttttaatgtaaa

SEQ ID NO: 153119 - DNA, 24 bp, Artificial sequence
  SiRNA target sequence
aagcgagctagttttaatgtaaaa

SEQ ID NO: 153120 - DNA, 24 bp, Artificial sequence
  SiRNA target sequence
agcgagctagttttaatgtaaaag

SEQ ID NO: 153121 - DNA, 24 bp, Artificial sequence
  SiRNA target sequence
gcgagctagttttaatgtaaaagt

SEQ ID NO: 153122 - DNA, 24 bp, Artificial sequence
  SiRNA target sequence
cgagctagttttaatgtaaaagtg

SEQ ID NO: 153123 - DNA, 24 bp, Artificial sequence
  SiRNA target sequence
gagctagttttaatgtaaaagtgc

SEQ ID NO: 153124 - DNA, 24 bp, Artificial sequence
  SiRNA target sequence
agctagttttaatgtaaaagtgca

SEQ ID NO: 153125 - DNA, 24 bp, Artificial sequence
  SiRNA target sequence
gctagttttaatgtaaaagtgcaa

SEQ ID NO: 153126 - DNA, 24 bp, Artificial sequence
  SiRNA target sequence
ctagttttaatgtaaaagtgcaaa

SEQ ID NO: 153127 - DNA, 24 bp, Artificial sequence
  SiRNA target sequence
tagttttaatgtaaaagtgcaaag

SEQ ID NO: 153128 - DNA, 24 bp, Artificial sequence
  SiRNA target sequence
agttttaatgtaaaagtgcaaaga

SEQ ID NO: 153129 - DNA, 24 bp, Artificial sequence
  SiRNA target sequence
gttttaatgtaaaagtgcaaagag

SEQ ID NO: 153130 - DNA, 24 bp, Artificial sequence
  SiRNA target sequence
ttttaatgtaaaagtgcaaagaga

SEQ ID NO: 153131 - DNA, 24 bp, Artificial sequence
  SiRNA target sequence
tttaatgtaaaagtgcaaagagaa

SEQ ID NO: 153132 - DNA, 24 bp, Artificial sequence
  SiRNA target sequence
ttaatgtaaaagtgcaaagagaat

SEQ ID NO: 153133 - DNA, 24 bp, Artificial sequence
  SiRNA target sequence
taatgtaaaagtgcaaagagaatg

SEQ ID NO: 153134 - DNA, 24 bp, Artificial sequence
  SiRNA target sequence
aatgtaaaagtgcaaagagaatgt

SEQ ID NO: 153135 - DNA, 24 bp, Artificial sequence
  SiRNA target sequence
atgtaaaagtgcaaagagaatgtt

SEQ ID NO: 153136 - DNA, 24 bp, Artificial sequence
  SiRNA target sequence
tgtaaaagtgcaaagagaatgttc

SEQ ID NO: 153137 - DNA, 24 bp, Artificial sequence
  SiRNA target sequence
gtaaaagtgcaaagagaatgttct

SEQ ID NO: 153138 - DNA, 24 bp, Artificial sequence
  SiRNA target sequence
taaaagtgcaaagagaatgttctg

SEQ ID NO: 153139 - DNA, 24 bp, Artificial sequence
  SiRNA target sequence
aaaagtgcaaagagaatgttctgc

SEQ ID NO: 153140 - DNA, 24 bp, Artificial sequence
  SiRNA target sequence
aaagtgcaaagagaatgttctgcg

SEQ ID NO: 153141 - DNA, 24 bp, Artificial sequence
  SiRNA target sequence
aagtgcaaagagaatgttctgcgt

SEQ ID NO: 153142 - DNA, 24 bp, Artificial sequence
  SiRNA target sequence
agtgcaaagagaatgttctgcgtg

SEQ ID NO: 153143 - DNA, 24 bp, Artificial sequence
  SiRNA target sequence
gtgcaaagagaatgttctgcgtgt

SEQ ID NO: 153144 - DNA, 24 bp, Artificial sequence
  SiRNA target sequence
tgcaaagagaatgttctgcgtgta

SEQ ID NO: 153145 - DNA, 24 bp, Artificial sequence
  SiRNA target sequence
gcaaagagaatgttctgcgtgtaa

SEQ ID NO: 153146 - DNA, 24 bp, Artificial sequence
  SiRNA target sequence
caaagagaatgttctgcgtgtaac

SEQ ID NO: 153147 - DNA, 24 bp, Artificial sequence
  SiRNA target sequence
aaagagaatgttctgcgtgtaacg

SEQ ID NO: 153148 - DNA, 24 bp, Artificial sequence
  SiRNA target sequence
aagagaatgttctgcgtgtaacgg

SEQ ID NO: 153149 - DNA, 24 bp, Artificial sequence
  SiRNA target sequence
agagaatgttctgcgtgtaacggt

SEQ ID NO: 153150 - DNA, 24 bp, Artificial sequence
  SiRNA target sequence
gagaatgttctgcgtgtaacggta

SEQ ID NO: 153151 - DNA, 24 bp, Artificial sequence
  SiRNA target sequence
agaatgttctgcgtgtaacggtaa

SEQ ID NO: 153152 - DNA, 24 bp, Artificial sequence
  SiRNA target sequence
gaatgttctgcgtgtaacggtaaa

SEQ ID NO: 153153 - DNA, 24 bp, Artificial sequence
  SiRNA target sequence
aatgttctgcgtgtaacggtaaag

SEQ ID NO: 153154 - DNA, 24 bp, Artificial sequence
  SiRNA target sequence
atgttctgcgtgtaacggtaaagg

SEQ ID NO: 153155 - DNA, 24 bp, Artificial sequence
  SiRNA target sequence
tgttctgcgtgtaacggtaaagga

SEQ ID NO: 153156 - DNA, 24 bp, Artificial sequence
  SiRNA target sequence
gttctgcgtgtaacggtaaaggag

SEQ ID NO: 153157 - DNA, 24 bp, Artificial sequence
  SiRNA target sequence
ttctgcgtgtaacggtaaaggagg

SEQ ID NO: 153158 - DNA, 24 bp, Artificial sequence
  SiRNA target sequence
tctgcgtgtaacggtaaaggagga

SEQ ID NO: 153159 - DNA, 24 bp, Artificial sequence
  SiRNA target sequence
ctgcgtgtaacggtaaaggaggag

SEQ ID NO: 153160 - DNA, 24 bp, Artificial sequence
  SiRNA target sequence
tgcgtgtaacggtaaaggaggaga

SEQ ID NO: 153161 - DNA, 24 bp, Artificial sequence
  SiRNA target sequence
gcgtgtaacggtaaaggaggagac

SEQ ID NO: 153162 - DNA, 24 bp, Artificial sequence
  SiRNA target sequence
cgtgtaacggtaaaggaggagaca

SEQ ID NO: 153163 - DNA, 24 bp, Artificial sequence
  SiRNA target sequence
gtgtaacggtaaaggaggagacag

SEQ ID NO: 153164 - DNA, 24 bp, Artificial sequence
  SiRNA target sequence
tgtaacggtaaaggaggagacagt

SEQ ID NO: 153165 - DNA, 24 bp, Artificial sequence
  SiRNA target sequence
gtaacggtaaaggaggagacagtg

SEQ ID NO: 153166 - DNA, 24 bp, Artificial sequence
  SiRNA target sequence
taacggtaaaggaggagacagtgt

SEQ ID NO: 153167 - DNA, 24 bp, Artificial sequence
  SiRNA target sequence
aacggtaaaggaggagacagtgtt

SEQ ID NO: 153168 - DNA, 24 bp, Artificial sequence
  SiRNA target sequence
acggtaaaggaggagacagtgttg

SEQ ID NO: 153169 - DNA, 24 bp, Artificial sequence
  SiRNA target sequence
cggtaaaggaggagacagtgttga

SEQ ID NO: 153170 - DNA, 24 bp, Artificial sequence
  SiRNA target sequence
ggtaaaggaggagacagtgttgaa

SEQ ID NO: 153171 - DNA, 24 bp, Artificial sequence
  SiRNA target sequence
gtaaaggaggagacagtgttgaaa

SEQ ID NO: 153172 - DNA, 24 bp, Artificial sequence
  SiRNA target sequence
taaaggaggagacagtgttgaaac

SEQ ID NO: 153173 - DNA, 24 bp, Artificial sequence
  SiRNA target sequence
aaaggaggagacagtgttgaaaca

SEQ ID NO: 153174 - DNA, 24 bp, Artificial sequence
  SiRNA target sequence
aaggaggagacagtgttgaaacat

SEQ ID NO: 153175 - DNA, 24 bp, Artificial sequence
  SiRNA target sequence
aggaggagacagtgttgaaacatg

SEQ ID NO: 153176 - DNA, 24 bp, Artificial sequence
  SiRNA target sequence
ggaggagacagtgttgaaacatgt

SEQ ID NO: 153177 - DNA, 24 bp, Artificial sequence
  SiRNA target sequence
gaggagacagtgttgaaacatgtg

SEQ ID NO: 153178 - DNA, 24 bp, Artificial sequence
  SiRNA target sequence
aggagacagtgttgaaacatgtga

SEQ ID NO: 153179 - DNA, 24 bp, Artificial sequence
  SiRNA target sequence
ggagacagtgttgaaacatgtgaa

SEQ ID NO: 153180 - DNA, 24 bp, Artificial sequence
  SiRNA target sequence
gagacagtgttgaaacatgtgaac

SEQ ID NO: 153181 - DNA, 24 bp, Artificial sequence
  SiRNA target sequence
agacagtgttgaaacatgtgaacc

SEQ ID NO: 153182 - DNA, 24 bp, Artificial sequence
  SiRNA target sequence
gacagtgttgaaacatgtgaacca

SEQ ID NO: 153183 - DNA, 24 bp, Artificial sequence
  SiRNA target sequence
acagtgttgaaacatgtgaaccat

SEQ ID NO: 153184 - DNA, 24 bp, Artificial sequence
  SiRNA target sequence
cagtgttgaaacatgtgaaccatg

SEQ ID NO: 153185 - DNA, 24 bp, Artificial sequence
  SiRNA target sequence
agtgttgaaacatgtgaaccatgt

SEQ ID NO: 153186 - DNA, 24 bp, Artificial sequence
  SiRNA target sequence
gtgttgaaacatgtgaaccatgta

SEQ ID NO: 153187 - DNA, 24 bp, Artificial sequence
  SiRNA target sequence
tgttgaaacatgtgaaccatgtaa

SEQ ID NO: 153188 - DNA, 24 bp, Artificial sequence
  SiRNA target sequence
gttgaaacatgtgaaccatgtaaa

SEQ ID NO: 153189 - DNA, 24 bp, Artificial sequence
  SiRNA target sequence
ttgaaacatgtgaaccatgtaaag

SEQ ID NO: 153190 - DNA, 24 bp, Artificial sequence
  SiRNA target sequence
tgaaacatgtgaaccatgtaaagg

SEQ ID NO: 153191 - DNA, 24 bp, Artificial sequence
  SiRNA target sequence
gaaacatgtgaaccatgtaaaggt

SEQ ID NO: 153192 - DNA, 24 bp, Artificial sequence
  SiRNA target sequence
aaacatgtgaaccatgtaaaggta

SEQ ID NO: 153193 - DNA, 24 bp, Artificial sequence
  SiRNA target sequence
aacatgtgaaccatgtaaaggtaa

SEQ ID NO: 153194 - DNA, 24 bp, Artificial sequence
  SiRNA target sequence
acatgtgaaccatgtaaaggtaaa

SEQ ID NO: 153195 - DNA, 24 bp, Artificial sequence
  SiRNA target sequence
catgtgaaccatgtaaaggtaaag

SEQ ID NO: 153196 - DNA, 24 bp, Artificial sequence
  SiRNA target sequence
atgtgaaccatgtaaaggtaaagg

SEQ ID NO: 153197 - DNA, 24 bp, Artificial sequence
  SiRNA target sequence
tgtgaaccatgtaaaggtaaaggt

SEQ ID NO: 153198 - DNA, 24 bp, Artificial sequence
  SiRNA target sequence
gtgaaccatgtaaaggtaaaggta

SEQ ID NO: 153199 - DNA, 24 bp, Artificial sequence
  SiRNA target sequence
tgaaccatgtaaaggtaaaggtaa

SEQ ID NO: 153200 - DNA, 24 bp, Artificial sequence
  SiRNA target sequence
gaaccatgtaaaggtaaaggtaag

SEQ ID NO: 153201 - DNA, 24 bp, Artificial sequence
  SiRNA target sequence
aaccatgtaaaggtaaaggtaagg

SEQ ID NO: 153202 - DNA, 24 bp, Artificial sequence
  SiRNA target sequence
accatgtaaaggtaaaggtaaggt

SEQ ID NO: 153203 - DNA, 24 bp, Artificial sequence
  SiRNA target sequence
ccatgtaaaggtaaaggtaaggta

SEQ ID NO: 153204 - DNA, 24 bp, Artificial sequence
  SiRNA target sequence
catgtaaaggtaaaggtaaggtag

SEQ ID NO: 153205 - DNA, 24 bp, Artificial sequence
  SiRNA target sequence
atgtaaaggtaaaggtaaggtaga

SEQ ID NO: 153206 - DNA, 24 bp, Artificial sequence
  SiRNA target sequence
tgtaaaggtaaaggtaaggtagaa

SEQ ID NO: 153207 - DNA, 24 bp, Artificial sequence
  SiRNA target sequence
gtaaaggtaaaggtaaggtagaac

SEQ ID NO: 153208 - DNA, 24 bp, Artificial sequence
  SiRNA target sequence
taaaggtaaaggtaaggtagaaca

SEQ ID NO: 153209 - DNA, 24 bp, Artificial sequence
  SiRNA target sequence
aaaggtaaaggtaaggtagaacat

SEQ ID NO: 153210 - DNA, 24 bp, Artificial sequence
  SiRNA target sequence
aaggtaaaggtaaggtagaacatc

SEQ ID NO: 153211 - DNA, 24 bp, Artificial sequence
  SiRNA target sequence
aggtaaaggtaaggtagaacatca

SEQ ID NO: 153212 - DNA, 24 bp, Artificial sequence
  SiRNA target sequence
ggtaaaggtaaggtagaacatcat

SEQ ID NO: 153213 - DNA, 24 bp, Artificial sequence
  SiRNA target sequence
gtaaaggtaaggtagaacatcata

SEQ ID NO: 153214 - DNA, 24 bp, Artificial sequence
  SiRNA target sequence
taaaggtaaggtagaacatcatag

SEQ ID NO: 153215 - DNA, 24 bp, Artificial sequence
  SiRNA target sequence
aaaggtaaggtagaacatcatagg

SEQ ID NO: 153216 - DNA, 24 bp, Artificial sequence
  SiRNA target sequence
aaggtaaggtagaacatcatagga

SEQ ID NO: 153217 - DNA, 24 bp, Artificial sequence
  SiRNA target sequence
aggtaaggtagaacatcataggag

SEQ ID NO: 153218 - DNA, 24 bp, Artificial sequence
  SiRNA target sequence
ggtaaggtagaacatcataggaga

SEQ ID NO: 153219 - DNA, 24 bp, Artificial sequence
  SiRNA target sequence
gtaaggtagaacatcataggagac

SEQ ID NO: 153220 - DNA, 24 bp, Artificial sequence
  SiRNA target sequence
taaggtagaacatcataggagact

SEQ ID NO: 153221 - DNA, 24 bp, Artificial sequence
  SiRNA target sequence
aaggtagaacatcataggagacta

SEQ ID NO: 153222 - DNA, 24 bp, Artificial sequence
  SiRNA target sequence
aggtagaacatcataggagactag

SEQ ID NO: 153223 - DNA, 24 bp, Artificial sequence
  SiRNA target sequence
ggtagaacatcataggagactagg

SEQ ID NO: 153224 - DNA, 24 bp, Artificial sequence
  SiRNA target sequence
gtagaacatcataggagactaggt

SEQ ID NO: 153225 - DNA, 24 bp, Artificial sequence
  SiRNA target sequence
tagaacatcataggagactaggtc

SEQ ID NO: 153226 - DNA, 24 bp, Artificial sequence
  SiRNA target sequence
agaacatcataggagactaggtcc

SEQ ID NO: 153227 - DNA, 24 bp, Artificial sequence
  SiRNA target sequence
gaacatcataggagactaggtcct

SEQ ID NO: 153228 - DNA, 24 bp, Artificial sequence
  SiRNA target sequence
aacatcataggagactaggtcctt

SEQ ID NO: 153229 - DNA, 24 bp, Artificial sequence
  SiRNA target sequence
acatcataggagactaggtccttt

SEQ ID NO: 153230 - DNA, 24 bp, Artificial sequence
  SiRNA target sequence
catcataggagactaggtccttta

SEQ ID NO: 153231 - DNA, 24 bp, Artificial sequence
  SiRNA target sequence
atcataggagactaggtcctttaa

SEQ ID NO: 153232 - DNA, 24 bp, Artificial sequence
  SiRNA target sequence
tcataggagactaggtcctttaat

SEQ ID NO: 153233 - DNA, 24 bp, Artificial sequence
  SiRNA target sequence
cataggagactaggtcctttaatt

SEQ ID NO: 153234 - DNA, 24 bp, Artificial sequence
  SiRNA target sequence
ataggagactaggtcctttaattt

SEQ ID NO: 153235 - DNA, 24 bp, Artificial sequence
  SiRNA target sequence
taggagactaggtcctttaatttc

SEQ ID NO: 153236 - DNA, 24 bp, Artificial sequence
  SiRNA target sequence
aggagactaggtcctttaatttct

SEQ ID NO: 153237 - DNA, 24 bp, Artificial sequence
  SiRNA target sequence
ggagactaggtcctttaatttctg

SEQ ID NO: 153238 - DNA, 24 bp, Artificial sequence
  SiRNA target sequence
gagactaggtcctttaatttctgt

SEQ ID NO: 153239 - DNA, 24 bp, Artificial sequence
  SiRNA target sequence
agactaggtcctttaatttctgta

SEQ ID NO: 153240 - DNA, 24 bp, Artificial sequence
  SiRNA target sequence
gactaggtcctttaatttctgtac

SEQ ID NO: 153241 - DNA, 24 bp, Artificial sequence
  SiRNA target sequence
actaggtcctttaatttctgtaca

SEQ ID NO: 153242 - DNA, 24 bp, Artificial sequence
  SiRNA target sequence
ctaggtcctttaatttctgtacaa

SEQ ID NO: 153243 - DNA, 24 bp, Artificial sequence
  SiRNA target sequence
taggtcctttaatttctgtacaag

SEQ ID NO: 153244 - DNA, 24 bp, Artificial sequence
  SiRNA target sequence
aggtcctttaatttctgtacaaga

SEQ ID NO: 153245 - DNA, 24 bp, Artificial sequence
  SiRNA target sequence
ggtcctttaatttctgtacaagaa

SEQ ID NO: 153246 - DNA, 24 bp, Artificial sequence
  SiRNA target sequence
gtcctttaatttctgtacaagaag

SEQ ID NO: 153247 - DNA, 24 bp, Artificial sequence
  SiRNA target sequence
tcctttaatttctgtacaagaagc

SEQ ID NO: 153248 - DNA, 24 bp, Artificial sequence
  SiRNA target sequence
cctttaatttctgtacaagaagca

SEQ ID NO: 153249 - DNA, 24 bp, Artificial sequence
  SiRNA target sequence
ctttaatttctgtacaagaagcac

SEQ ID NO: 153250 - DNA, 24 bp, Artificial sequence
  SiRNA target sequence
tttaatttctgtacaagaagcacc

SEQ ID NO: 153251 - DNA, 24 bp, Artificial sequence
  SiRNA target sequence
ttaatttctgtacaagaagcacct

SEQ ID NO: 153252 - DNA, 24 bp, Artificial sequence
  SiRNA target sequence
taatttctgtacaagaagcacctt

SEQ ID NO: 153253 - DNA, 24 bp, Artificial sequence
  SiRNA target sequence
aatttctgtacaagaagcaccttg

SEQ ID NO: 153254 - DNA, 24 bp, Artificial sequence
  SiRNA target sequence
atttctgtacaagaagcaccttgt

SEQ ID NO: 153255 - DNA, 24 bp, Artificial sequence
  SiRNA target sequence
tttctgtacaagaagcaccttgta

SEQ ID NO: 153256 - DNA, 24 bp, Artificial sequence
  SiRNA target sequence
ttctgtacaagaagcaccttgtaa

SEQ ID NO: 153257 - DNA, 24 bp, Artificial sequence
  SiRNA target sequence
tctgtacaagaagcaccttgtaat

SEQ ID NO: 153258 - DNA, 24 bp, Artificial sequence
  SiRNA target sequence
ctgtacaagaagcaccttgtaata

SEQ ID NO: 153259 - DNA, 24 bp, Artificial sequence
  SiRNA target sequence
tgtacaagaagcaccttgtaataa

SEQ ID NO: 153260 - DNA, 24 bp, Artificial sequence
  SiRNA target sequence
gtacaagaagcaccttgtaataat

SEQ ID NO: 153261 - DNA, 24 bp, Artificial sequence
  SiRNA target sequence
tacaagaagcaccttgtaataatt

SEQ ID NO: 153262 - DNA, 24 bp, Artificial sequence
  SiRNA target sequence
acaagaagcaccttgtaataattg

SEQ ID NO: 153263 - DNA, 24 bp, Artificial sequence
  SiRNA target sequence
caagaagcaccttgtaataattgt

SEQ ID NO: 153264 - DNA, 24 bp, Artificial sequence
  SiRNA target sequence
aagaagcaccttgtaataattgta

SEQ ID NO: 153265 - DNA, 24 bp, Artificial sequence
  SiRNA target sequence
agaagcaccttgtaataattgtaa

SEQ ID NO: 153266 - DNA, 24 bp, Artificial sequence
  SiRNA target sequence
gaagcaccttgtaataattgtaat

SEQ ID NO: 153267 - DNA, 24 bp, Artificial sequence
  SiRNA target sequence
aagcaccttgtaataattgtaatt

SEQ ID NO: 153268 - DNA, 24 bp, Artificial sequence
  SiRNA target sequence
agcaccttgtaataattgtaattc

SEQ ID NO: 153269 - DNA, 24 bp, Artificial sequence
  SiRNA target sequence
gcaccttgtaataattgtaattct

SEQ ID NO: 153270 - DNA, 24 bp, Artificial sequence
  SiRNA target sequence
caccttgtaataattgtaattcta

SEQ ID NO: 153271 - DNA, 24 bp, Artificial sequence
  SiRNA target sequence
accttgtaataattgtaattctac

SEQ ID NO: 153272 - DNA, 24 bp, Artificial sequence
  SiRNA target sequence
ccttgtaataattgtaattctact

SEQ ID NO: 153273 - DNA, 24 bp, Artificial sequence
  SiRNA target sequence
cttgtaataattgtaattctactg

SEQ ID NO: 153274 - DNA, 24 bp, Artificial sequence
  SiRNA target sequence
ttgtaataattgtaattctactgg

SEQ ID NO: 153275 - DNA, 24 bp, Artificial sequence
  SiRNA target sequence
tgtaataattgtaattctactgga

SEQ ID NO: 153276 - DNA, 24 bp, Artificial sequence
  SiRNA target sequence
gtaataattgtaattctactggat

SEQ ID NO: 153277 - DNA, 24 bp, Artificial sequence
  SiRNA target sequence
taataattgtaattctactggatt

SEQ ID NO: 153278 - DNA, 24 bp, Artificial sequence
  SiRNA target sequence
aataattgtaattctactggattt

SEQ ID NO: 153279 - DNA, 24 bp, Artificial sequence
  SiRNA target sequence
ataattgtaattctactggatttg

SEQ ID NO: 153280 - DNA, 24 bp, Artificial sequence
  SiRNA target sequence
taattgtaattctactggatttgt

SEQ ID NO: 153281 - DNA, 24 bp, Artificial sequence
  SiRNA target sequence
aattgtaattctactggatttgtt

SEQ ID NO: 153282 - DNA, 24 bp, Artificial sequence
  SiRNA target sequence
attgtaattctactggatttgttg

SEQ ID NO: 153283 - DNA, 24 bp, Artificial sequence
  SiRNA target sequence
ttgtaattctactggatttgttgt

SEQ ID NO: 153284 - DNA, 24 bp, Artificial sequence
  SiRNA target sequence
tgtaattctactggatttgttgtt

SEQ ID NO: 153285 - DNA, 24 bp, Artificial sequence
  SiRNA target sequence
gtaattctactggatttgttgtta

SEQ ID NO: 153286 - DNA, 24 bp, Artificial sequence
  SiRNA target sequence
taattctactggatttgttgttaa

SEQ ID NO: 153287 - DNA, 24 bp, Artificial sequence
  SiRNA target sequence
aattctactggatttgttgttaaa

SEQ ID NO: 153288 - DNA, 24 bp, Artificial sequence
  SiRNA target sequence
attctactggatttgttgttaaag

SEQ ID NO: 153289 - DNA, 24 bp, Artificial sequence
  SiRNA target sequence
ttctactggatttgttgttaaagg

SEQ ID NO: 153290 - DNA, 24 bp, Artificial sequence
  SiRNA target sequence
tctactggatttgttgttaaagga

SEQ ID NO: 153291 - DNA, 24 bp, Artificial sequence
  SiRNA target sequence
ctactggatttgttgttaaaggaa

SEQ ID NO: 153292 - DNA, 24 bp, Artificial sequence
  SiRNA target sequence
tactggatttgttgttaaaggaaa

SEQ ID NO: 153293 - DNA, 24 bp, Artificial sequence
  SiRNA target sequence
actggatttgttgttaaaggaaag

SEQ ID NO: 153294 - DNA, 24 bp, Artificial sequence
  SiRNA target sequence
ctggatttgttgttaaaggaaagc

SEQ ID NO: 153295 - DNA, 24 bp, Artificial sequence
  SiRNA target sequence
tggatttgttgttaaaggaaagct

SEQ ID NO: 153296 - DNA, 24 bp, Artificial sequence
  SiRNA target sequence
ggatttgttgttaaaggaaagctt

SEQ ID NO: 153297 - DNA, 24 bp, Artificial sequence
  SiRNA target sequence
gatttgttgttaaaggaaagcttt

SEQ ID NO: 153298 - DNA, 24 bp, Artificial sequence
  SiRNA target sequence
atttgttgttaaaggaaagctttg

SEQ ID NO: 153299 - DNA, 24 bp, Artificial sequence
  SiRNA target sequence
tttgttgttaaaggaaagctttgt

SEQ ID NO: 153300 - DNA, 24 bp, Artificial sequence
  SiRNA target sequence
ttgttgttaaaggaaagctttgtc

SEQ ID NO: 153301 - DNA, 24 bp, Artificial sequence
  SiRNA target sequence
tgttgttaaaggaaagctttgtca

SEQ ID NO: 153302 - DNA, 24 bp, Artificial sequence
  SiRNA target sequence
gttgttaaaggaaagctttgtcaa

SEQ ID NO: 153303 - DNA, 24 bp, Artificial sequence
  SiRNA target sequence
ttgttaaaggaaagctttgtcaaa

SEQ ID NO: 153304 - DNA, 24 bp, Artificial sequence
  SiRNA target sequence
tgttaaaggaaagctttgtcaaag

SEQ ID NO: 153305 - DNA, 24 bp, Artificial sequence
  SiRNA target sequence
gttaaaggaaagctttgtcaaagt

SEQ ID NO: 153306 - DNA, 24 bp, Artificial sequence
  SiRNA target sequence
ttaaaggaaagctttgtcaaagtt

SEQ ID NO: 153307 - DNA, 24 bp, Artificial sequence
  SiRNA target sequence
taaaggaaagctttgtcaaagttg

SEQ ID NO: 153308 - DNA, 24 bp, Artificial sequence
  SiRNA target sequence
aaaggaaagctttgtcaaagttgt

SEQ ID NO: 153309 - DNA, 24 bp, Artificial sequence
  SiRNA target sequence
aaggaaagctttgtcaaagttgta

SEQ ID NO: 153310 - DNA, 24 bp, Artificial sequence
  SiRNA target sequence
aggaaagctttgtcaaagttgtaa

SEQ ID NO: 153311 - DNA, 24 bp, Artificial sequence
  SiRNA target sequence
ggaaagctttgtcaaagttgtaaa

SEQ ID NO: 153312 - DNA, 24 bp, Artificial sequence
  SiRNA target sequence
gaaagctttgtcaaagttgtaaag

SEQ ID NO: 153313 - DNA, 24 bp, Artificial sequence
  SiRNA target sequence
aaagctttgtcaaagttgtaaagg

SEQ ID NO: 153314 - DNA, 24 bp, Artificial sequence
  SiRNA target sequence
aagctttgtcaaagttgtaaaggt

SEQ ID NO: 153315 - DNA, 24 bp, Artificial sequence
  SiRNA target sequence
agctttgtcaaagttgtaaaggta

SEQ ID NO: 153316 - DNA, 24 bp, Artificial sequence
  SiRNA target sequence
gctttgtcaaagttgtaaaggtaa

SEQ ID NO: 153317 - DNA, 24 bp, Artificial sequence
  SiRNA target sequence
ctttgtcaaagttgtaaaggtaaa

SEQ ID NO: 153318 - DNA, 24 bp, Artificial sequence
  SiRNA target sequence
tttgtcaaagttgtaaaggtaaac

SEQ ID NO: 153319 - DNA, 24 bp, Artificial sequence
  SiRNA target sequence
ttgtcaaagttgtaaaggtaaaca

SEQ ID NO: 153320 - DNA, 24 bp, Artificial sequence
  SiRNA target sequence
tgtcaaagttgtaaaggtaaacaa

SEQ ID NO: 153321 - DNA, 24 bp, Artificial sequence
  SiRNA target sequence
gtcaaagttgtaaaggtaaacaat

SEQ ID NO: 153322 - DNA, 24 bp, Artificial sequence
  SiRNA target sequence
tcaaagttgtaaaggtaaacaata

SEQ ID NO: 153323 - DNA, 24 bp, Artificial sequence
  SiRNA target sequence
caaagttgtaaaggtaaacaatac

SEQ ID NO: 153324 - DNA, 24 bp, Artificial sequence
  SiRNA target sequence
aaagttgtaaaggtaaacaatacg

SEQ ID NO: 153325 - DNA, 24 bp, Artificial sequence
  SiRNA target sequence
aagttgtaaaggtaaacaatacgt

SEQ ID NO: 153326 - DNA, 24 bp, Artificial sequence
  SiRNA target sequence
agttgtaaaggtaaacaatacgtt

SEQ ID NO: 153327 - DNA, 24 bp, Artificial sequence
  SiRNA target sequence
gttgtaaaggtaaacaatacgttg

SEQ ID NO: 153328 - DNA, 24 bp, Artificial sequence
  SiRNA target sequence
ttgtaaaggtaaacaatacgttga

SEQ ID NO: 153329 - DNA, 24 bp, Artificial sequence
  SiRNA target sequence
tgtaaaggtaaacaatacgttgag

SEQ ID NO: 153330 - DNA, 24 bp, Artificial sequence
  SiRNA target sequence
gtaaaggtaaacaatacgttgaga

SEQ ID NO: 153331 - DNA, 24 bp, Artificial sequence
  SiRNA target sequence
taaaggtaaacaatacgttgagac

SEQ ID NO: 153332 - DNA, 24 bp, Artificial sequence
  SiRNA target sequence
aaaggtaaacaatacgttgagact

SEQ ID NO: 153333 - DNA, 24 bp, Artificial sequence
  SiRNA target sequence
aaggtaaacaatacgttgagacta

SEQ ID NO: 153334 - DNA, 24 bp, Artificial sequence
  SiRNA target sequence
aggtaaacaatacgttgagactaa

SEQ ID NO: 153335 - DNA, 24 bp, Artificial sequence
  SiRNA target sequence
ggtaaacaatacgttgagactaaa

SEQ ID NO: 153336 - DNA, 24 bp, Artificial sequence
  SiRNA target sequence
gtaaacaatacgttgagactaaag

SEQ ID NO: 153337 - DNA, 24 bp, Artificial sequence
  SiRNA target sequence
taaacaatacgttgagactaaaga

SEQ ID NO: 153338 - DNA, 24 bp, Artificial sequence
  SiRNA target sequence
aaacaatacgttgagactaaagaa

SEQ ID NO: 153339 - DNA, 24 bp, Artificial sequence
  SiRNA target sequence
aacaatacgttgagactaaagaac

SEQ ID NO: 153340 - DNA, 24 bp, Artificial sequence
  SiRNA target sequence
acaatacgttgagactaaagaaca

SEQ ID NO: 153341 - DNA, 24 bp, Artificial sequence
  SiRNA target sequence
caatacgttgagactaaagaacat

SEQ ID NO: 153342 - DNA, 24 bp, Artificial sequence
  SiRNA target sequence
aatacgttgagactaaagaacata

SEQ ID NO: 153343 - DNA, 24 bp, Artificial sequence
  SiRNA target sequence
atacgttgagactaaagaacatat

SEQ ID NO: 153344 - DNA, 24 bp, Artificial sequence
  SiRNA target sequence
tacgttgagactaaagaacatatt

SEQ ID NO: 153345 - DNA, 24 bp, Artificial sequence
  SiRNA target sequence
acgttgagactaaagaacatattg

SEQ ID NO: 153346 - DNA, 24 bp, Artificial sequence
  SiRNA target sequence
cgttgagactaaagaacatattga

SEQ ID NO: 153347 - DNA, 24 bp, Artificial sequence
  SiRNA target sequence
gttgagactaaagaacatattgaa

SEQ ID NO: 153348 - DNA, 24 bp, Artificial sequence
  SiRNA target sequence
ttgagactaaagaacatattgaag

SEQ ID NO: 153349 - DNA, 24 bp, Artificial sequence
  SiRNA target sequence
tgagactaaagaacatattgaagt

SEQ ID NO: 153350 - DNA, 24 bp, Artificial sequence
  SiRNA target sequence
gagactaaagaacatattgaagtg

SEQ ID NO: 153351 - DNA, 24 bp, Artificial sequence
  SiRNA target sequence
agactaaagaacatattgaagtgg

SEQ ID NO: 153352 - DNA, 24 bp, Artificial sequence
  SiRNA target sequence
gactaaagaacatattgaagtgga

SEQ ID NO: 153353 - DNA, 24 bp, Artificial sequence
  SiRNA target sequence
actaaagaacatattgaagtggaa

SEQ ID NO: 153354 - DNA, 24 bp, Artificial sequence
  SiRNA target sequence
ctaaagaacatattgaagtggaag

SEQ ID NO: 153355 - DNA, 24 bp, Artificial sequence
  SiRNA target sequence
taaagaacatattgaagtggaagt

SEQ ID NO: 153356 - DNA, 24 bp, Artificial sequence
  SiRNA target sequence
aaagaacatattgaagtggaagta

SEQ ID NO: 153357 - DNA, 24 bp, Artificial sequence
  SiRNA target sequence
aagaacatattgaagtggaagtag

SEQ ID NO: 153358 - DNA, 24 bp, Artificial sequence
  SiRNA target sequence
agaacatattgaagtggaagtaga

SEQ ID NO: 153359 - DNA, 24 bp, Artificial sequence
  SiRNA target sequence
gaacatattgaagtggaagtagag

SEQ ID NO: 153360 - DNA, 24 bp, Artificial sequence
  SiRNA target sequence
aacatattgaagtggaagtagagc

SEQ ID NO: 153361 - DNA, 24 bp, Artificial sequence
  SiRNA target sequence
acatattgaagtggaagtagagcc

SEQ ID NO: 153362 - DNA, 24 bp, Artificial sequence
  SiRNA target sequence
catattgaagtggaagtagagcca

SEQ ID NO: 153363 - DNA, 24 bp, Artificial sequence
  SiRNA target sequence
atattgaagtggaagtagagccag

SEQ ID NO: 153364 - DNA, 24 bp, Artificial sequence
  SiRNA target sequence
tattgaagtggaagtagagccagg

SEQ ID NO: 153365 - DNA, 24 bp, Artificial sequence
  SiRNA target sequence
attgaagtggaagtagagccagga

SEQ ID NO: 153366 - DNA, 24 bp, Artificial sequence
  SiRNA target sequence
ttgaagtggaagtagagccaggag

SEQ ID NO: 153367 - DNA, 24 bp, Artificial sequence
  SiRNA target sequence
tgaagtggaagtagagccaggagt

SEQ ID NO: 153368 - DNA, 24 bp, Artificial sequence
  SiRNA target sequence
gaagtggaagtagagccaggagta

SEQ ID NO: 153369 - DNA, 24 bp, Artificial sequence
  SiRNA target sequence
aagtggaagtagagccaggagtac

SEQ ID NO: 153370 - DNA, 24 bp, Artificial sequence
  SiRNA target sequence
agtggaagtagagccaggagtaca

SEQ ID NO: 153371 - DNA, 24 bp, Artificial sequence
  SiRNA target sequence
gtggaagtagagccaggagtacag

SEQ ID NO: 153372 - DNA, 24 bp, Artificial sequence
  SiRNA target sequence
tggaagtagagccaggagtacaga

SEQ ID NO: 153373 - DNA, 24 bp, Artificial sequence
  SiRNA target sequence
ggaagtagagccaggagtacagaa

SEQ ID NO: 153374 - DNA, 24 bp, Artificial sequence
  SiRNA target sequence
gaagtagagccaggagtacagaac

SEQ ID NO: 153375 - DNA, 24 bp, Artificial sequence
  SiRNA target sequence
aagtagagccaggagtacagaacg

SEQ ID NO: 153376 - DNA, 24 bp, Artificial sequence
  SiRNA target sequence
agtagagccaggagtacagaacgg

SEQ ID NO: 153377 - DNA, 24 bp, Artificial sequence
  SiRNA target sequence
gtagagccaggagtacagaacggt

SEQ ID NO: 153378 - DNA, 24 bp, Artificial sequence
  SiRNA target sequence
tagagccaggagtacagaacggta

SEQ ID NO: 153379 - DNA, 24 bp, Artificial sequence
  SiRNA target sequence
agagccaggagtacagaacggtag

SEQ ID NO: 153380 - DNA, 24 bp, Artificial sequence
  SiRNA target sequence
gagccaggagtacagaacggtaga

SEQ ID NO: 153381 - DNA, 24 bp, Artificial sequence
  SiRNA target sequence
agccaggagtacagaacggtagaa

SEQ ID NO: 153382 - DNA, 24 bp, Artificial sequence
  SiRNA target sequence
gccaggagtacagaacggtagaaa

SEQ ID NO: 153383 - DNA, 24 bp, Artificial sequence
  SiRNA target sequence
ccaggagtacagaacggtagaaaa

SEQ ID NO: 153384 - DNA, 24 bp, Artificial sequence
  SiRNA target sequence
caggagtacagaacggtagaaaat

SEQ ID NO: 153385 - DNA, 24 bp, Artificial sequence
  SiRNA target sequence
aggagtacagaacggtagaaaata

SEQ ID NO: 153386 - DNA, 24 bp, Artificial sequence
  SiRNA target sequence
ggagtacagaacggtagaaaatat

SEQ ID NO: 153387 - DNA, 24 bp, Artificial sequence
  SiRNA target sequence
gagtacagaacggtagaaaatata

SEQ ID NO: 153388 - DNA, 24 bp, Artificial sequence
  SiRNA target sequence
agtacagaacggtagaaaatatac

SEQ ID NO: 153389 - DNA, 24 bp, Artificial sequence
  SiRNA target sequence
gtacagaacggtagaaaatataca

SEQ ID NO: 153390 - DNA, 24 bp, Artificial sequence
  SiRNA target sequence
tacagaacggtagaaaatatacat

SEQ ID NO: 153391 - DNA, 24 bp, Artificial sequence
  SiRNA target sequence
acagaacggtagaaaatatacatt

SEQ ID NO: 153392 - DNA, 24 bp, Artificial sequence
  SiRNA target sequence
cagaacggtagaaaatatacattt

SEQ ID NO: 153393 - DNA, 24 bp, Artificial sequence
  SiRNA target sequence
agaacggtagaaaatatacatttt

SEQ ID NO: 153394 - DNA, 24 bp, Artificial sequence
  SiRNA target sequence
gaacggtagaaaatatacattttc

SEQ ID NO: 153395 - DNA, 24 bp, Artificial sequence
  SiRNA target sequence
aacggtagaaaatatacattttct

SEQ ID NO: 153396 - DNA, 24 bp, Artificial sequence
  SiRNA target sequence
acggtagaaaatatacattttctg

SEQ ID NO: 153397 - DNA, 24 bp, Artificial sequence
  SiRNA target sequence
cggtagaaaatatacattttctgg

SEQ ID NO: 153398 - DNA, 24 bp, Artificial sequence
  SiRNA target sequence
ggtagaaaatatacattttctggc

SEQ ID NO: 153399 - DNA, 24 bp, Artificial sequence
  SiRNA target sequence
gtagaaaatatacattttctggca

SEQ ID NO: 153400 - DNA, 24 bp, Artificial sequence
  SiRNA target sequence
tagaaaatatacattttctggcaa

SEQ ID NO: 153401 - DNA, 24 bp, Artificial sequence
  SiRNA target sequence
agaaaatatacattttctggcaaa

SEQ ID NO: 153402 - DNA, 24 bp, Artificial sequence
  SiRNA target sequence
gaaaatatacattttctggcaaag

SEQ ID NO: 153403 - DNA, 24 bp, Artificial sequence
  SiRNA target sequence
aaaatatacattttctggcaaagg

SEQ ID NO: 153404 - DNA, 24 bp, Artificial sequence
  SiRNA target sequence
aaatatacattttctggcaaagga

SEQ ID NO: 153405 - DNA, 24 bp, Artificial sequence
  SiRNA target sequence
aatatacattttctggcaaaggaa

SEQ ID NO: 153406 - DNA, 24 bp, Artificial sequence
  SiRNA target sequence
atatacattttctggcaaaggaaa

SEQ ID NO: 153407 - DNA, 24 bp, Artificial sequence
  SiRNA target sequence
tatacattttctggcaaaggaaat

SEQ ID NO: 153408 - DNA, 24 bp, Artificial sequence
  SiRNA target sequence
atacattttctggcaaaggaaatc

SEQ ID NO: 153409 - DNA, 24 bp, Artificial sequence
  SiRNA target sequence
tacattttctggcaaaggaaatca

SEQ ID NO: 153410 - DNA, 24 bp, Artificial sequence
  SiRNA target sequence
acattttctggcaaaggaaatcat

SEQ ID NO: 153411 - DNA, 24 bp, Artificial sequence
  SiRNA target sequence
cattttctggcaaaggaaatcata

SEQ ID NO: 153412 - DNA, 24 bp, Artificial sequence
  SiRNA target sequence
attttctggcaaaggaaatcataa

SEQ ID NO: 153413 - DNA, 24 bp, Artificial sequence
  SiRNA target sequence
ttttctggcaaaggaaatcataaa

SEQ ID NO: 153414 - DNA, 24 bp, Artificial sequence
  SiRNA target sequence
tttctggcaaaggaaatcataaaa

SEQ ID NO: 153415 - DNA, 24 bp, Artificial sequence
  SiRNA target sequence
ttctggcaaaggaaatcataaaaa

SEQ ID NO: 153416 - DNA, 24 bp, Artificial sequence
  SiRNA target sequence
tctggcaaaggaaatcataaaaaa

SEQ ID NO: 153417 - DNA, 24 bp, Artificial sequence
  SiRNA target sequence
ctggcaaaggaaatcataaaaaaa

SEQ ID NO: 153418 - DNA, 24 bp, Artificial sequence
  SiRNA target sequence
tggcaaaggaaatcataaaaaaaa

SEQ ID NO: 153419 - DNA, 24 bp, Artificial sequence
  SiRNA target sequence
ggcaaaggaaatcataaaaaaaat

SEQ ID NO: 153420 - DNA, 24 bp, Artificial sequence
  SiRNA target sequence
gcaaaggaaatcataaaaaaaatt

SEQ ID NO: 153421 - DNA, 24 bp, Artificial sequence
  SiRNA target sequence
caaaggaaatcataaaaaaaattg

SEQ ID NO: 153422 - DNA, 24 bp, Artificial sequence
  SiRNA target sequence
aaaggaaatcataaaaaaaattgt

SEQ ID NO: 153423 - DNA, 24 bp, Artificial sequence
  SiRNA target sequence
aaggaaatcataaaaaaaattgtg

SEQ ID NO: 153424 - DNA, 24 bp, Artificial sequence
  SiRNA target sequence
aggaaatcataaaaaaaattgtgt

SEQ ID NO: 153425 - DNA, 24 bp, Artificial sequence
  SiRNA target sequence
ggaaatcataaaaaaaattgtgta

SEQ ID NO: 153426 - DNA, 24 bp, Artificial sequence
  SiRNA target sequence
gaaatcataaaaaaaattgtgtac

SEQ ID NO: 153427 - DNA, 24 bp, Artificial sequence
  SiRNA target sequence
aaatcataaaaaaaattgtgtacc

SEQ ID NO: 153428 - DNA, 24 bp, Artificial sequence
  SiRNA target sequence
aatcataaaaaaaattgtgtaccg

SEQ ID NO: 153429 - DNA, 24 bp, Artificial sequence
  SiRNA target sequence
atcataaaaaaaattgtgtaccgg

SEQ ID NO: 153430 - DNA, 24 bp, Artificial sequence
  SiRNA target sequence
tcataaaaaaaattgtgtaccggg

SEQ ID NO: 153431 - DNA, 24 bp, Artificial sequence
  SiRNA target sequence
cataaaaaaaattgtgtaccgggt

SEQ ID NO: 153432 - DNA, 24 bp, Artificial sequence
  SiRNA target sequence
ataaaaaaaattgtgtaccgggtg

SEQ ID NO: 153433 - DNA, 24 bp, Artificial sequence
  SiRNA target sequence
taaaaaaaattgtgtaccgggtga

SEQ ID NO: 153434 - DNA, 24 bp, Artificial sequence
  SiRNA target sequence
aaaaaaaattgtgtaccgggtgat

SEQ ID NO: 153435 - DNA, 24 bp, Artificial sequence
  SiRNA target sequence
aaaaaaattgtgtaccgggtgatg

SEQ ID NO: 153436 - DNA, 24 bp, Artificial sequence
  SiRNA target sequence
aaaaaattgtgtaccgggtgatgt

SEQ ID NO: 153437 - DNA, 24 bp, Artificial sequence
  SiRNA target sequence
aaaaattgtgtaccgggtgatgtg

SEQ ID NO: 153438 - DNA, 24 bp, Artificial sequence
  SiRNA target sequence
aaaattgtgtaccgggtgatgtga

SEQ ID NO: 153439 - DNA, 24 bp, Artificial sequence
  SiRNA target sequence
aaattgtgtaccgggtgatgtgat

SEQ ID NO: 153440 - DNA, 24 bp, Artificial sequence
  SiRNA target sequence
aattgtgtaccgggtgatgtgatt

SEQ ID NO: 153441 - DNA, 24 bp, Artificial sequence
  SiRNA target sequence
attgtgtaccgggtgatgtgattc

SEQ ID NO: 153442 - DNA, 24 bp, Artificial sequence
  SiRNA target sequence
ttgtgtaccgggtgatgtgattct

SEQ ID NO: 153443 - DNA, 24 bp, Artificial sequence
  SiRNA target sequence
tgtgtaccgggtgatgtgattctt

SEQ ID NO: 153444 - DNA, 24 bp, Artificial sequence
  SiRNA target sequence
gtgtaccgggtgatgtgattctta

SEQ ID NO: 153445 - DNA, 24 bp, Artificial sequence
  SiRNA target sequence
tgtaccgggtgatgtgattcttat

SEQ ID NO: 153446 - DNA, 24 bp, Artificial sequence
  SiRNA target sequence
gtaccgggtgatgtgattcttatt

SEQ ID NO: 153447 - DNA, 24 bp, Artificial sequence
  SiRNA target sequence
taccgggtgatgtgattcttattg

SEQ ID NO: 153448 - DNA, 24 bp, Artificial sequence
  SiRNA target sequence
accgggtgatgtgattcttattgt

SEQ ID NO: 153449 - DNA, 24 bp, Artificial sequence
  SiRNA target sequence
ccgggtgatgtgattcttattgta

SEQ ID NO: 153450 - DNA, 24 bp, Artificial sequence
  SiRNA target sequence
cgggtgatgtgattcttattgtaa

SEQ ID NO: 153451 - DNA, 24 bp, Artificial sequence
  SiRNA target sequence
gggtgatgtgattcttattgtaaa

SEQ ID NO: 153452 - DNA, 24 bp, Artificial sequence
  SiRNA target sequence
ggtgatgtgattcttattgtaaac

SEQ ID NO: 153453 - DNA, 24 bp, Artificial sequence
  SiRNA target sequence
gtgatgtgattcttattgtaaaca

SEQ ID NO: 153454 - DNA, 24 bp, Artificial sequence
  SiRNA target sequence
tgatgtgattcttattgtaaacat

SEQ ID NO: 153455 - DNA, 24 bp, Artificial sequence
  SiRNA target sequence
gatgtgattcttattgtaaacatt

SEQ ID NO: 153456 - DNA, 24 bp, Artificial sequence
  SiRNA target sequence
atgtgattcttattgtaaacatta

SEQ ID NO: 153457 - DNA, 24 bp, Artificial sequence
  SiRNA target sequence
tgtgattcttattgtaaacattac

SEQ ID NO: 153458 - DNA, 24 bp, Artificial sequence
  SiRNA target sequence
gtgattcttattgtaaacattaca

SEQ ID NO: 153459 - DNA, 24 bp, Artificial sequence
  SiRNA target sequence
tgattcttattgtaaacattacaa

SEQ ID NO: 153460 - DNA, 24 bp, Artificial sequence
  SiRNA target sequence
gattcttattgtaaacattacaaa

SEQ ID NO: 153461 - DNA, 24 bp, Artificial sequence
  SiRNA target sequence
attcttattgtaaacattacaaat

SEQ ID NO: 153462 - DNA, 24 bp, Artificial sequence
  SiRNA target sequence
ttcttattgtaaacattacaaatg

SEQ ID NO: 153463 - DNA, 24 bp, Artificial sequence
  SiRNA target sequence
tcttattgtaaacattacaaatga

SEQ ID NO: 153464 - DNA, 24 bp, Artificial sequence
  SiRNA target sequence
cttattgtaaacattacaaatgat

SEQ ID NO: 153465 - DNA, 24 bp, Artificial sequence
  SiRNA target sequence
ttattgtaaacattacaaatgatc

SEQ ID NO: 153466 - DNA, 24 bp, Artificial sequence
  SiRNA target sequence
tattgtaaacattacaaatgatcc

SEQ ID NO: 153467 - DNA, 24 bp, Artificial sequence
  SiRNA target sequence
attgtaaacattacaaatgatcca

SEQ ID NO: 153468 - DNA, 24 bp, Artificial sequence
  SiRNA target sequence
ttgtaaacattacaaatgatccaa

SEQ ID NO: 153469 - DNA, 24 bp, Artificial sequence
  SiRNA target sequence
tgtaaacattacaaatgatccaag

SEQ ID NO: 153470 - DNA, 24 bp, Artificial sequence
  SiRNA target sequence
gtaaacattacaaatgatccaaga

SEQ ID NO: 153471 - DNA, 24 bp, Artificial sequence
  SiRNA target sequence
taaacattacaaatgatccaagat

SEQ ID NO: 153472 - DNA, 24 bp, Artificial sequence
  SiRNA target sequence
aaacattacaaatgatccaagatt

SEQ ID NO: 153473 - DNA, 24 bp, Artificial sequence
  SiRNA target sequence
aacattacaaatgatccaagattt

SEQ ID NO: 153474 - DNA, 24 bp, Artificial sequence
  SiRNA target sequence
acattacaaatgatccaagattta

SEQ ID NO: 153475 - DNA, 24 bp, Artificial sequence
  SiRNA target sequence
cattacaaatgatccaagatttag

SEQ ID NO: 153476 - DNA, 24 bp, Artificial sequence
  SiRNA target sequence
attacaaatgatccaagatttaga

SEQ ID NO: 153477 - DNA, 24 bp, Artificial sequence
  SiRNA target sequence
ttacaaatgatccaagatttagaa

SEQ ID NO: 153478 - DNA, 24 bp, Artificial sequence
  SiRNA target sequence
tacaaatgatccaagatttagaaa

SEQ ID NO: 153479 - DNA, 24 bp, Artificial sequence
  SiRNA target sequence
acaaatgatccaagatttagaaaa

SEQ ID NO: 153480 - DNA, 24 bp, Artificial sequence
  SiRNA target sequence
caaatgatccaagatttagaaaaa

SEQ ID NO: 153481 - DNA, 24 bp, Artificial sequence
  SiRNA target sequence
aaatgatccaagatttagaaaaag

SEQ ID NO: 153482 - DNA, 24 bp, Artificial sequence
  SiRNA target sequence
aatgatccaagatttagaaaaagt

SEQ ID NO: 153483 - DNA, 24 bp, Artificial sequence
  SiRNA target sequence
atgatccaagatttagaaaaagtg

SEQ ID NO: 153484 - DNA, 24 bp, Artificial sequence
  SiRNA target sequence
tgatccaagatttagaaaaagtgg

SEQ ID NO: 153485 - DNA, 24 bp, Artificial sequence
  SiRNA target sequence
gatccaagatttagaaaaagtgga

SEQ ID NO: 153486 - DNA, 24 bp, Artificial sequence
  SiRNA target sequence
atccaagatttagaaaaagtggat

SEQ ID NO: 153487 - DNA, 24 bp, Artificial sequence
  SiRNA target sequence
tccaagatttagaaaaagtggata

SEQ ID NO: 153488 - DNA, 24 bp, Artificial sequence
  SiRNA target sequence
ccaagatttagaaaaagtggatat

SEQ ID NO: 153489 - DNA, 24 bp, Artificial sequence
  SiRNA target sequence
caagatttagaaaaagtggatata

SEQ ID NO: 153490 - DNA, 24 bp, Artificial sequence
  SiRNA target sequence
aagatttagaaaaagtggatataa

SEQ ID NO: 153491 - DNA, 24 bp, Artificial sequence
  SiRNA target sequence
agatttagaaaaagtggatataat

SEQ ID NO: 153492 - DNA, 24 bp, Artificial sequence
  SiRNA target sequence
gatttagaaaaagtggatataatt

SEQ ID NO: 153493 - DNA, 24 bp, Artificial sequence
  SiRNA target sequence
atttagaaaaagtggatataattt

SEQ ID NO: 153494 - DNA, 24 bp, Artificial sequence
  SiRNA target sequence
tttagaaaaagtggatataattta

SEQ ID NO: 153495 - DNA, 24 bp, Artificial sequence
  SiRNA target sequence
ttagaaaaagtggatataatttaa

SEQ ID NO: 153496 - DNA, 24 bp, Artificial sequence
  SiRNA target sequence
tagaaaaagtggatataatttaat

SEQ ID NO: 153497 - DNA, 24 bp, Artificial sequence
  SiRNA target sequence
agaaaaagtggatataatttaatt

SEQ ID NO: 153498 - DNA, 24 bp, Artificial sequence
  SiRNA target sequence
gaaaaagtggatataatttaatta

SEQ ID NO: 153499 - DNA, 24 bp, Artificial sequence
  SiRNA target sequence
aaaaagtggatataatttaattag

SEQ ID NO: 153500 - DNA, 24 bp, Artificial sequence
  SiRNA target sequence
aaaagtggatataatttaattagt

SEQ ID NO: 153501 - DNA, 24 bp, Artificial sequence
  SiRNA target sequence
aaagtggatataatttaattagta

SEQ ID NO: 153502 - DNA, 24 bp, Artificial sequence
  SiRNA target sequence
aagtggatataatttaattagtaa

SEQ ID NO: 153503 - DNA, 24 bp, Artificial sequence
  SiRNA target sequence
agtggatataatttaattagtaag

SEQ ID NO: 153504 - DNA, 24 bp, Artificial sequence
  SiRNA target sequence
gtggatataatttaattagtaagg

SEQ ID NO: 153505 - DNA, 24 bp, Artificial sequence
  SiRNA target sequence
tggatataatttaattagtaaggt

SEQ ID NO: 153506 - DNA, 24 bp, Artificial sequence
  SiRNA target sequence
ggatataatttaattagtaaggtt

SEQ ID NO: 153507 - DNA, 24 bp, Artificial sequence
  SiRNA target sequence
gatataatttaattagtaaggttg

SEQ ID NO: 153508 - DNA, 24 bp, Artificial sequence
  SiRNA target sequence
atataatttaattagtaaggttga

SEQ ID NO: 153509 - DNA, 24 bp, Artificial sequence
  SiRNA target sequence
tataatttaattagtaaggttgat

SEQ ID NO: 153510 - DNA, 24 bp, Artificial sequence
  SiRNA target sequence
ataatttaattagtaaggttgata

SEQ ID NO: 153511 - DNA, 24 bp, Artificial sequence
  SiRNA target sequence
taatttaattagtaaggttgatat

SEQ ID NO: 153512 - DNA, 24 bp, Artificial sequence
  SiRNA target sequence
aatttaattagtaaggttgatatt

SEQ ID NO: 153513 - DNA, 24 bp, Artificial sequence
  SiRNA target sequence
atttaattagtaaggttgatattc

SEQ ID NO: 153514 - DNA, 24 bp, Artificial sequence
  SiRNA target sequence
tttaattagtaaggttgatattcc

SEQ ID NO: 153515 - DNA, 24 bp, Artificial sequence
  SiRNA target sequence
ttaattagtaaggttgatattcca

SEQ ID NO: 153516 - DNA, 24 bp, Artificial sequence
  SiRNA target sequence
taattagtaaggttgatattccat

SEQ ID NO: 153517 - DNA, 24 bp, Artificial sequence
  SiRNA target sequence
aattagtaaggttgatattccatt

SEQ ID NO: 153518 - DNA, 24 bp, Artificial sequence
  SiRNA target sequence
attagtaaggttgatattccattg

SEQ ID NO: 153519 - DNA, 24 bp, Artificial sequence
  SiRNA target sequence
ttagtaaggttgatattccattgt

SEQ ID NO: 153520 - DNA, 24 bp, Artificial sequence
  SiRNA target sequence
tagtaaggttgatattccattgta

SEQ ID NO: 153521 - DNA, 24 bp, Artificial sequence
  SiRNA target sequence
agtaaggttgatattccattgtat

SEQ ID NO: 153522 - DNA, 24 bp, Artificial sequence
  SiRNA target sequence
gtaaggttgatattccattgtatg

SEQ ID NO: 153523 - DNA, 24 bp, Artificial sequence
  SiRNA target sequence
taaggttgatattccattgtatgt

SEQ ID NO: 153524 - DNA, 24 bp, Artificial sequence
  SiRNA target sequence
aaggttgatattccattgtatgtt

SEQ ID NO: 153525 - DNA, 24 bp, Artificial sequence
  SiRNA target sequence
aggttgatattccattgtatgttg

SEQ ID NO: 153526 - DNA, 24 bp, Artificial sequence
  SiRNA target sequence
ggttgatattccattgtatgttgc

SEQ ID NO: 153527 - DNA, 24 bp, Artificial sequence
  SiRNA target sequence
gttgatattccattgtatgttgct

SEQ ID NO: 153528 - DNA, 24 bp, Artificial sequence
  SiRNA target sequence
ttgatattccattgtatgttgctt

SEQ ID NO: 153529 - DNA, 24 bp, Artificial sequence
  SiRNA target sequence
tgatattccattgtatgttgcttt

SEQ ID NO: 153530 - DNA, 24 bp, Artificial sequence
  SiRNA target sequence
gatattccattgtatgttgctttg

SEQ ID NO: 153531 - DNA, 24 bp, Artificial sequence
  SiRNA target sequence
atattccattgtatgttgctttgg

SEQ ID NO: 153532 - DNA, 24 bp, Artificial sequence
  SiRNA target sequence
tattccattgtatgttgctttggc

SEQ ID NO: 153533 - DNA, 24 bp, Artificial sequence
  SiRNA target sequence
attccattgtatgttgctttggca

SEQ ID NO: 153534 - DNA, 24 bp, Artificial sequence
  SiRNA target sequence
ttccattgtatgttgctttggcag

SEQ ID NO: 153535 - DNA, 24 bp, Artificial sequence
  SiRNA target sequence
tccattgtatgttgctttggcagg

SEQ ID NO: 153536 - DNA, 24 bp, Artificial sequence
  SiRNA target sequence
ccattgtatgttgctttggcaggc

SEQ ID NO: 153537 - DNA, 24 bp, Artificial sequence
  SiRNA target sequence
cattgtatgttgctttggcaggcg

SEQ ID NO: 153538 - DNA, 24 bp, Artificial sequence
  SiRNA target sequence
attgtatgttgctttggcaggcgg

SEQ ID NO: 153539 - DNA, 24 bp, Artificial sequence
  SiRNA target sequence
ttgtatgttgctttggcaggcgga

SEQ ID NO: 153540 - DNA, 24 bp, Artificial sequence
  SiRNA target sequence
tgtatgttgctttggcaggcggac

SEQ ID NO: 153541 - DNA, 24 bp, Artificial sequence
  SiRNA target sequence
gtatgttgctttggcaggcggaca

SEQ ID NO: 153542 - DNA, 24 bp, Artificial sequence
  SiRNA target sequence
tatgttgctttggcaggcggacag

SEQ ID NO: 153543 - DNA, 24 bp, Artificial sequence
  SiRNA target sequence
atgttgctttggcaggcggacaga

SEQ ID NO: 153544 - DNA, 24 bp, Artificial sequence
  SiRNA target sequence
tgttgctttggcaggcggacagat

SEQ ID NO: 153545 - DNA, 24 bp, Artificial sequence
  SiRNA target sequence
gttgctttggcaggcggacagatt

SEQ ID NO: 153546 - DNA, 24 bp, Artificial sequence
  SiRNA target sequence
ttgctttggcaggcggacagatta

SEQ ID NO: 153547 - DNA, 24 bp, Artificial sequence
  SiRNA target sequence
tgctttggcaggcggacagattat

SEQ ID NO: 153548 - DNA, 24 bp, Artificial sequence
  SiRNA target sequence
gctttggcaggcggacagattata

SEQ ID NO: 153549 - DNA, 24 bp, Artificial sequence
  SiRNA target sequence
ctttggcaggcggacagattatat

SEQ ID NO: 153550 - DNA, 24 bp, Artificial sequence
  SiRNA target sequence
tttggcaggcggacagattatatt

SEQ ID NO: 153551 - DNA, 24 bp, Artificial sequence
  SiRNA target sequence
ttggcaggcggacagattatattt

SEQ ID NO: 153552 - DNA, 24 bp, Artificial sequence
  SiRNA target sequence
tggcaggcggacagattatatttg

SEQ ID NO: 153553 - DNA, 24 bp, Artificial sequence
  SiRNA target sequence
ggcaggcggacagattatatttga

SEQ ID NO: 153554 - DNA, 24 bp, Artificial sequence
  SiRNA target sequence
gcaggcggacagattatatttgaa

SEQ ID NO: 153555 - DNA, 24 bp, Artificial sequence
  SiRNA target sequence
caggcggacagattatatttgaac

SEQ ID NO: 153556 - DNA, 24 bp, Artificial sequence
  SiRNA target sequence
aggcggacagattatatttgaaca

SEQ ID NO: 153557 - DNA, 24 bp, Artificial sequence
  SiRNA target sequence
ggcggacagattatatttgaacat

SEQ ID NO: 153558 - DNA, 24 bp, Artificial sequence
  SiRNA target sequence
gcggacagattatatttgaacata

SEQ ID NO: 153559 - DNA, 24 bp, Artificial sequence
  SiRNA target sequence
cggacagattatatttgaacatat

SEQ ID NO: 153560 - DNA, 24 bp, Artificial sequence
  SiRNA target sequence
ggacagattatatttgaacatatc

SEQ ID NO: 153561 - DNA, 24 bp, Artificial sequence
  SiRNA target sequence
gacagattatatttgaacatatca

SEQ ID NO: 153562 - DNA, 24 bp, Artificial sequence
  SiRNA target sequence
acagattatatttgaacatatcac

SEQ ID NO: 153563 - DNA, 24 bp, Artificial sequence
  SiRNA target sequence
cagattatatttgaacatatcact

SEQ ID NO: 153564 - DNA, 24 bp, Artificial sequence
  SiRNA target sequence
agattatatttgaacatatcactg

SEQ ID NO: 153565 - DNA, 24 bp, Artificial sequence
  SiRNA target sequence
gattatatttgaacatatcactgg

SEQ ID NO: 153566 - DNA, 24 bp, Artificial sequence
  SiRNA target sequence
attatatttgaacatatcactggt

SEQ ID NO: 153567 - DNA, 24 bp, Artificial sequence
  SiRNA target sequence
ttatatttgaacatatcactggta

SEQ ID NO: 153568 - DNA, 24 bp, Artificial sequence
  SiRNA target sequence
tatatttgaacatatcactggtaa

SEQ ID NO: 153569 - DNA, 24 bp, Artificial sequence
  SiRNA target sequence
atatttgaacatatcactggtaag

SEQ ID NO: 153570 - DNA, 24 bp, Artificial sequence
  SiRNA target sequence
tatttgaacatatcactggtaaga

SEQ ID NO: 153571 - DNA, 24 bp, Artificial sequence
  SiRNA target sequence
atttgaacatatcactggtaagaa

SEQ ID NO: 153572 - DNA, 24 bp, Artificial sequence
  SiRNA target sequence
tttgaacatatcactggtaagaaa

SEQ ID NO: 153573 - DNA, 24 bp, Artificial sequence
  SiRNA target sequence
ttgaacatatcactggtaagaaat

SEQ ID NO: 153574 - DNA, 24 bp, Artificial sequence
  SiRNA target sequence
tgaacatatcactggtaagaaatt

SEQ ID NO: 153575 - DNA, 24 bp, Artificial sequence
  SiRNA target sequence
gaacatatcactggtaagaaattt

SEQ ID NO: 153576 - DNA, 24 bp, Artificial sequence
  SiRNA target sequence
aacatatcactggtaagaaatttg

SEQ ID NO: 153577 - DNA, 24 bp, Artificial sequence
  SiRNA target sequence
acatatcactggtaagaaatttga

SEQ ID NO: 153578 - DNA, 24 bp, Artificial sequence
  SiRNA target sequence
catatcactggtaagaaatttgaa

SEQ ID NO: 153579 - DNA, 24 bp, Artificial sequence
  SiRNA target sequence
atatcactggtaagaaatttgaaa

SEQ ID NO: 153580 - DNA, 24 bp, Artificial sequence
  SiRNA target sequence
tatcactggtaagaaatttgaaat

SEQ ID NO: 153581 - DNA, 24 bp, Artificial sequence
  SiRNA target sequence
atcactggtaagaaatttgaaatt

SEQ ID NO: 153582 - DNA, 24 bp, Artificial sequence
  SiRNA target sequence
tcactggtaagaaatttgaaatta

SEQ ID NO: 153583 - DNA, 24 bp, Artificial sequence
  SiRNA target sequence
cactggtaagaaatttgaaattac

SEQ ID NO: 153584 - DNA, 24 bp, Artificial sequence
  SiRNA target sequence
actggtaagaaatttgaaattact

SEQ ID NO: 153585 - DNA, 24 bp, Artificial sequence
  SiRNA target sequence
ctggtaagaaatttgaaattactt

SEQ ID NO: 153586 - DNA, 24 bp, Artificial sequence
  SiRNA target sequence
tggtaagaaatttgaaattacttt

SEQ ID NO: 153587 - DNA, 24 bp, Artificial sequence
  SiRNA target sequence
ggtaagaaatttgaaattacttta

SEQ ID NO: 153588 - DNA, 24 bp, Artificial sequence
  SiRNA target sequence
gtaagaaatttgaaattactttat

SEQ ID NO: 153589 - DNA, 24 bp, Artificial sequence
  SiRNA target sequence
taagaaatttgaaattactttata

SEQ ID NO: 153590 - DNA, 24 bp, Artificial sequence
  SiRNA target sequence
aagaaatttgaaattactttatat

SEQ ID NO: 153591 - DNA, 24 bp, Artificial sequence
  SiRNA target sequence
agaaatttgaaattactttatatc

SEQ ID NO: 153592 - DNA, 24 bp, Artificial sequence
  SiRNA target sequence
gaaatttgaaattactttatatcc

SEQ ID NO: 153593 - DNA, 24 bp, Artificial sequence
  SiRNA target sequence
aaatttgaaattactttatatcca

SEQ ID NO: 153594 - DNA, 24 bp, Artificial sequence
  SiRNA target sequence
aatttgaaattactttatatccat

SEQ ID NO: 153595 - DNA, 24 bp, Artificial sequence
  SiRNA target sequence
atttgaaattactttatatccatt

SEQ ID NO: 153596 - DNA, 24 bp, Artificial sequence
  SiRNA target sequence
tttgaaattactttatatccattt

SEQ ID NO: 153597 - DNA, 24 bp, Artificial sequence
  SiRNA target sequence
ttgaaattactttatatccattta

SEQ ID NO: 153598 - DNA, 24 bp, Artificial sequence
  SiRNA target sequence
tgaaattactttatatccatttaa

SEQ ID NO: 153599 - DNA, 24 bp, Artificial sequence
  SiRNA target sequence
gaaattactttatatccatttaaa

SEQ ID NO: 153600 - DNA, 24 bp, Artificial sequence
  SiRNA target sequence
aaattactttatatccatttaaag

SEQ ID NO: 153601 - DNA, 24 bp, Artificial sequence
  SiRNA target sequence
aattactttatatccatttaaaga

SEQ ID NO: 153602 - DNA, 24 bp, Artificial sequence
  SiRNA target sequence
attactttatatccatttaaagat

SEQ ID NO: 153603 - DNA, 24 bp, Artificial sequence
  SiRNA target sequence
ttactttatatccatttaaagatt

SEQ ID NO: 153604 - DNA, 24 bp, Artificial sequence
  SiRNA target sequence
tactttatatccatttaaagattt

SEQ ID NO: 153605 - DNA, 24 bp, Artificial sequence
  SiRNA target sequence
actttatatccatttaaagattta

SEQ ID NO: 153606 - DNA, 24 bp, Artificial sequence
  SiRNA target sequence
ctttatatccatttaaagatttaa

SEQ ID NO: 153607 - DNA, 24 bp, Artificial sequence
  SiRNA target sequence
tttatatccatttaaagatttaaa

SEQ ID NO: 153608 - DNA, 24 bp, Artificial sequence
  SiRNA target sequence
ttatatccatttaaagatttaaag

SEQ ID NO: 153609 - DNA, 24 bp, Artificial sequence
  SiRNA target sequence
tatatccatttaaagatttaaaga

SEQ ID NO: 153610 - DNA, 24 bp, Artificial sequence
  SiRNA target sequence
atatccatttaaagatttaaagaa

SEQ ID NO: 153611 - DNA, 24 bp, Artificial sequence
  SiRNA target sequence
tatccatttaaagatttaaagaaa

SEQ ID NO: 153612 - DNA, 24 bp, Artificial sequence
  SiRNA target sequence
atccatttaaagatttaaagaaat

SEQ ID NO: 153613 - DNA, 24 bp, Artificial sequence
  SiRNA target sequence
tccatttaaagatttaaagaaatg

SEQ ID NO: 153614 - DNA, 24 bp, Artificial sequence
  SiRNA target sequence
ccatttaaagatttaaagaaatgt

SEQ ID NO: 153615 - DNA, 24 bp, Artificial sequence
  SiRNA target sequence
catttaaagatttaaagaaatgta

SEQ ID NO: 153616 - DNA, 24 bp, Artificial sequence
  SiRNA target sequence
atttaaagatttaaagaaatgtat

SEQ ID NO: 153617 - DNA, 24 bp, Artificial sequence
  SiRNA target sequence
tttaaagatttaaagaaatgtatt

SEQ ID NO: 153618 - DNA, 24 bp, Artificial sequence
  SiRNA target sequence
ttaaagatttaaagaaatgtatta

SEQ ID NO: 153619 - DNA, 24 bp, Artificial sequence
  SiRNA target sequence
taaagatttaaagaaatgtattat

SEQ ID NO: 153620 - DNA, 24 bp, Artificial sequence
  SiRNA target sequence
aaagatttaaagaaatgtattatt

SEQ ID NO: 153621 - DNA, 24 bp, Artificial sequence
  SiRNA target sequence
aagatttaaagaaatgtattattt

SEQ ID NO: 153622 - DNA, 24 bp, Artificial sequence
  SiRNA target sequence
agatttaaagaaatgtattatttt

SEQ ID NO: 153623 - DNA, 24 bp, Artificial sequence
  SiRNA target sequence
gatttaaagaaatgtattatttta

SEQ ID NO: 153624 - DNA, 24 bp, Artificial sequence
  SiRNA target sequence
atttaaagaaatgtattattttaa

SEQ ID NO: 153625 - DNA, 24 bp, Artificial sequence
  SiRNA target sequence
tttaaagaaatgtattattttaaa

SEQ ID NO: 153626 - DNA, 24 bp, Artificial sequence
  SiRNA target sequence
ttaaagaaatgtattattttaaaa

SEQ ID NO: 153627 - DNA, 24 bp, Artificial sequence
  SiRNA target sequence
taaagaaatgtattattttaaaag

SEQ ID NO: 153628 - DNA, 24 bp, Artificial sequence
  SiRNA target sequence
aaagaaatgtattattttaaaagg

SEQ ID NO: 153629 - DNA, 24 bp, Artificial sequence
  SiRNA target sequence
aagaaatgtattattttaaaaggc

SEQ ID NO: 153630 - DNA, 24 bp, Artificial sequence
  SiRNA target sequence
agaaatgtattattttaaaaggcg

SEQ ID NO: 153631 - DNA, 24 bp, Artificial sequence
  SiRNA target sequence
gaaatgtattattttaaaaggcga

SEQ ID NO: 153632 - DNA, 24 bp, Artificial sequence
  SiRNA target sequence
aaatgtattattttaaaaggcgaa

SEQ ID NO: 153633 - DNA, 24 bp, Artificial sequence
  SiRNA target sequence
aatgtattattttaaaaggcgaag

SEQ ID NO: 153634 - DNA, 24 bp, Artificial sequence
  SiRNA target sequence
atgtattattttaaaaggcgaagg

SEQ ID NO: 153635 - DNA, 24 bp, Artificial sequence
  SiRNA target sequence
tgtattattttaaaaggcgaaggt

SEQ ID NO: 153636 - DNA, 24 bp, Artificial sequence
  SiRNA target sequence
gtattattttaaaaggcgaaggtt

SEQ ID NO: 153637 - DNA, 24 bp, Artificial sequence
  SiRNA target sequence
tattattttaaaaggcgaaggttt

SEQ ID NO: 153638 - DNA, 24 bp, Artificial sequence
  SiRNA target sequence
attattttaaaaggcgaaggtttt

SEQ ID NO: 153639 - DNA, 24 bp, Artificial sequence
  SiRNA target sequence
ttattttaaaaggcgaaggtttta

SEQ ID NO: 153640 - DNA, 24 bp, Artificial sequence
  SiRNA target sequence
tattttaaaaggcgaaggttttaa

SEQ ID NO: 153641 - DNA, 24 bp, Artificial sequence
  SiRNA target sequence
attttaaaaggcgaaggttttaaa

SEQ ID NO: 153642 - DNA, 24 bp, Artificial sequence
  SiRNA target sequence
ttttaaaaggcgaaggttttaaaa

SEQ ID NO: 153643 - DNA, 24 bp, Artificial sequence
  SiRNA target sequence
tttaaaaggcgaaggttttaaaat

SEQ ID NO: 153644 - DNA, 24 bp, Artificial sequence
  SiRNA target sequence
ttaaaaggcgaaggttttaaaata

SEQ ID NO: 153645 - DNA, 24 bp, Artificial sequence
  SiRNA target sequence
taaaaggcgaaggttttaaaataa

SEQ ID NO: 153646 - DNA, 24 bp, Artificial sequence
  SiRNA target sequence
aaaaggcgaaggttttaaaataaa

SEQ ID NO: 153647 - DNA, 24 bp, Artificial sequence
  SiRNA target sequence
aaaggcgaaggttttaaaataaaa

SEQ ID NO: 153648 - DNA, 24 bp, Artificial sequence
  SiRNA target sequence
aaggcgaaggttttaaaataaaaa

SEQ ID NO: 153649 - DNA, 24 bp, Artificial sequence
  SiRNA target sequence
aggcgaaggttttaaaataaaaaa

SEQ ID NO: 153650 - DNA, 24 bp, Artificial sequence
  SiRNA target sequence
ggcgaaggttttaaaataaaaaat

SEQ ID NO: 153651 - DNA, 24 bp, Artificial sequence
  SiRNA target sequence
gcgaaggttttaaaataaaaaata

SEQ ID NO: 153652 - DNA, 24 bp, Artificial sequence
  SiRNA target sequence
cgaaggttttaaaataaaaaatag

SEQ ID NO: 153653 - DNA, 24 bp, Artificial sequence
  SiRNA target sequence
gaaggttttaaaataaaaaatagt

SEQ ID NO: 153654 - DNA, 24 bp, Artificial sequence
  SiRNA target sequence
aaggttttaaaataaaaaatagtt

SEQ ID NO: 153655 - DNA, 24 bp, Artificial sequence
  SiRNA target sequence
aggttttaaaataaaaaatagtta

SEQ ID NO: 153656 - DNA, 24 bp, Artificial sequence
  SiRNA target sequence
ggttttaaaataaaaaatagttat

SEQ ID NO: 153657 - DNA, 24 bp, Artificial sequence
  SiRNA target sequence
gttttaaaataaaaaatagttatt

SEQ ID NO: 153658 - DNA, 24 bp, Artificial sequence
  SiRNA target sequence
ttttaaaataaaaaatagttattc

SEQ ID NO: 153659 - DNA, 24 bp, Artificial sequence
  SiRNA target sequence
tttaaaataaaaaatagttattcg

SEQ ID NO: 153660 - DNA, 24 bp, Artificial sequence
  SiRNA target sequence
ttaaaataaaaaatagttattcgg

SEQ ID NO: 153661 - DNA, 24 bp, Artificial sequence
  SiRNA target sequence
taaaataaaaaatagttattcggg

SEQ ID NO: 153662 - DNA, 24 bp, Artificial sequence
  SiRNA target sequence
aaaataaaaaatagttattcgggt

SEQ ID NO: 153663 - DNA, 24 bp, Artificial sequence
  SiRNA target sequence
aaataaaaaatagttattcgggtg

SEQ ID NO: 153664 - DNA, 24 bp, Artificial sequence
  SiRNA target sequence
aataaaaaatagttattcgggtgg

SEQ ID NO: 153665 - DNA, 24 bp, Artificial sequence
  SiRNA target sequence
ataaaaaatagttattcgggtggt

SEQ ID NO: 153666 - DNA, 24 bp, Artificial sequence
  SiRNA target sequence
taaaaaatagttattcgggtggtg

SEQ ID NO: 153667 - DNA, 24 bp, Artificial sequence
  SiRNA target sequence
aaaaaatagttattcgggtggtga

SEQ ID NO: 153668 - DNA, 24 bp, Artificial sequence
  SiRNA target sequence
aaaaatagttattcgggtggtgat

SEQ ID NO: 153669 - DNA, 24 bp, Artificial sequence
  SiRNA target sequence
aaaatagttattcgggtggtgatc

SEQ ID NO: 153670 - DNA, 24 bp, Artificial sequence
  SiRNA target sequence
aaatagttattcgggtggtgatct

SEQ ID NO: 153671 - DNA, 24 bp, Artificial sequence
  SiRNA target sequence
aatagttattcgggtggtgatctt

SEQ ID NO: 153672 - DNA, 24 bp, Artificial sequence
  SiRNA target sequence
atagttattcgggtggtgatctta

SEQ ID NO: 153673 - DNA, 24 bp, Artificial sequence
  SiRNA target sequence
tagttattcgggtggtgatcttat

SEQ ID NO: 153674 - DNA, 24 bp, Artificial sequence
  SiRNA target sequence
agttattcgggtggtgatcttatt

SEQ ID NO: 153675 - DNA, 24 bp, Artificial sequence
  SiRNA target sequence
gttattcgggtggtgatcttattc

SEQ ID NO: 153676 - DNA, 24 bp, Artificial sequence
  SiRNA target sequence
ttattcgggtggtgatcttattct

SEQ ID NO: 153677 - DNA, 24 bp, Artificial sequence
  SiRNA target sequence
tattcgggtggtgatcttattctc

SEQ ID NO: 153678 - DNA, 24 bp, Artificial sequence
  SiRNA target sequence
attcgggtggtgatcttattctcg

SEQ ID NO: 153679 - DNA, 24 bp, Artificial sequence
  SiRNA target sequence
ttcgggtggtgatcttattctcga

SEQ ID NO: 153680 - DNA, 24 bp, Artificial sequence
  SiRNA target sequence
tcgggtggtgatcttattctcgaa

SEQ ID NO: 153681 - DNA, 24 bp, Artificial sequence
  SiRNA target sequence
cgggtggtgatcttattctcgaac

SEQ ID NO: 153682 - DNA, 24 bp, Artificial sequence
  SiRNA target sequence
gggtggtgatcttattctcgaacc

SEQ ID NO: 153683 - DNA, 24 bp, Artificial sequence
  SiRNA target sequence
ggtggtgatcttattctcgaacct

SEQ ID NO: 153684 - DNA, 24 bp, Artificial sequence
  SiRNA target sequence
gtggtgatcttattctcgaaccta

SEQ ID NO: 153685 - DNA, 24 bp, Artificial sequence
  SiRNA target sequence
tggtgatcttattctcgaacctaa

SEQ ID NO: 153686 - DNA, 24 bp, Artificial sequence
  SiRNA target sequence
ggtgatcttattctcgaacctaat

SEQ ID NO: 153687 - DNA, 24 bp, Artificial sequence
  SiRNA target sequence
gtgatcttattctcgaacctaata

SEQ ID NO: 153688 - DNA, 24 bp, Artificial sequence
  SiRNA target sequence
tgatcttattctcgaacctaatat

SEQ ID NO: 153689 - DNA, 24 bp, Artificial sequence
  SiRNA target sequence
gatcttattctcgaacctaatata

SEQ ID NO: 153690 - DNA, 24 bp, Artificial sequence
  SiRNA target sequence
atcttattctcgaacctaatataa

SEQ ID NO: 153691 - DNA, 24 bp, Artificial sequence
  SiRNA target sequence
tcttattctcgaacctaatataat

SEQ ID NO: 153692 - DNA, 24 bp, Artificial sequence
  SiRNA target sequence
cttattctcgaacctaatataatt

SEQ ID NO: 153693 - DNA, 24 bp, Artificial sequence
  SiRNA target sequence
ttattctcgaacctaatataatta

SEQ ID NO: 153694 - DNA, 24 bp, Artificial sequence
  SiRNA target sequence
tattctcgaacctaatataattat

SEQ ID NO: 153695 - DNA, 24 bp, Artificial sequence
  SiRNA target sequence
attctcgaacctaatataattata

SEQ ID NO: 153696 - DNA, 24 bp, Artificial sequence
  SiRNA target sequence
ttctcgaacctaatataattatag

SEQ ID NO: 153697 - DNA, 24 bp, Artificial sequence
  SiRNA target sequence
tctcgaacctaatataattataga

SEQ ID NO: 153698 - DNA, 24 bp, Artificial sequence
  SiRNA target sequence
ctcgaacctaatataattatagat

SEQ ID NO: 153699 - DNA, 24 bp, Artificial sequence
  SiRNA target sequence
tcgaacctaatataattatagata

SEQ ID NO: 153700 - DNA, 24 bp, Artificial sequence
  SiRNA target sequence
cgaacctaatataattatagataa

SEQ ID NO: 153701 - DNA, 24 bp, Artificial sequence
  SiRNA target sequence
gaacctaatataattatagataag

SEQ ID NO: 153702 - DNA, 24 bp, Artificial sequence
  SiRNA target sequence
aacctaatataattatagataaga

SEQ ID NO: 153703 - DNA, 24 bp, Artificial sequence
  SiRNA target sequence
acctaatataattatagataagaa

SEQ ID NO: 153704 - DNA, 24 bp, Artificial sequence
  SiRNA target sequence
cctaatataattatagataagaat

SEQ ID NO: 153705 - DNA, 24 bp, Artificial sequence
  SiRNA target sequence
ctaatataattatagataagaata

SEQ ID NO: 153706 - DNA, 24 bp, Artificial sequence
  SiRNA target sequence
taatataattatagataagaatat

SEQ ID NO: 153707 - DNA, 24 bp, Artificial sequence
  SiRNA target sequence
aatataattatagataagaatatt

SEQ ID NO: 153708 - DNA, 24 bp, Artificial sequence
  SiRNA target sequence
atataattatagataagaatattg

SEQ ID NO: 153709 - DNA, 24 bp, Artificial sequence
  SiRNA target sequence
tataattatagataagaatattga

SEQ ID NO: 153710 - DNA, 24 bp, Artificial sequence
  SiRNA target sequence
ataattatagataagaatattgat

SEQ ID NO: 153711 - DNA, 24 bp, Artificial sequence
  SiRNA target sequence
taattatagataagaatattgata

SEQ ID NO: 153712 - DNA, 24 bp, Artificial sequence
  SiRNA target sequence
aattatagataagaatattgataa

SEQ ID NO: 153713 - DNA, 24 bp, Artificial sequence
  SiRNA target sequence
attatagataagaatattgataaa

SEQ ID NO: 153714 - DNA, 24 bp, Artificial sequence
  SiRNA target sequence
ttatagataagaatattgataaag

SEQ ID NO: 153715 - DNA, 24 bp, Artificial sequence
  SiRNA target sequence
tatagataagaatattgataaaga

SEQ ID NO: 153716 - DNA, 24 bp, Artificial sequence
  SiRNA target sequence
atagataagaatattgataaagat

SEQ ID NO: 153717 - DNA, 24 bp, Artificial sequence
  SiRNA target sequence
tagataagaatattgataaagatt

SEQ ID NO: 153718 - DNA, 24 bp, Artificial sequence
  SiRNA target sequence
agataagaatattgataaagattt

SEQ ID NO: 153719 - DNA, 24 bp, Artificial sequence
  SiRNA target sequence
gataagaatattgataaagattta

SEQ ID NO: 153720 - DNA, 24 bp, Artificial sequence
  SiRNA target sequence
ataagaatattgataaagatttat

SEQ ID NO: 153721 - DNA, 24 bp, Artificial sequence
  SiRNA target sequence
taagaatattgataaagatttatt

SEQ ID NO: 153722 - DNA, 24 bp, Artificial sequence
  SiRNA target sequence
aagaatattgataaagatttatta

SEQ ID NO: 153723 - DNA, 24 bp, Artificial sequence
  SiRNA target sequence
agaatattgataaagatttattag

SEQ ID NO: 153724 - DNA, 24 bp, Artificial sequence
  SiRNA target sequence
gaatattgataaagatttattagc

SEQ ID NO: 153725 - DNA, 24 bp, Artificial sequence
  SiRNA target sequence
aatattgataaagatttattagca

SEQ ID NO: 153726 - DNA, 24 bp, Artificial sequence
  SiRNA target sequence
atattgataaagatttattagcac

SEQ ID NO: 153727 - DNA, 24 bp, Artificial sequence
  SiRNA target sequence
tattgataaagatttattagcacg

SEQ ID NO: 153728 - DNA, 24 bp, Artificial sequence
  SiRNA target sequence
attgataaagatttattagcacgc

SEQ ID NO: 153729 - DNA, 24 bp, Artificial sequence
  SiRNA target sequence
ttgataaagatttattagcacgcg

SEQ ID NO: 153730 - DNA, 24 bp, Artificial sequence
  SiRNA target sequence
tgataaagatttattagcacgcgc

SEQ ID NO: 153731 - DNA, 24 bp, Artificial sequence
  SiRNA target sequence
gataaagatttattagcacgcgcc

SEQ ID NO: 153732 - DNA, 24 bp, Artificial sequence
  SiRNA target sequence
ataaagatttattagcacgcgcct

SEQ ID NO: 153733 - DNA, 24 bp, Artificial sequence
  SiRNA target sequence
taaagatttattagcacgcgcctt

SEQ ID NO: 153734 - DNA, 24 bp, Artificial sequence
  SiRNA target sequence
aaagatttattagcacgcgccttg

SEQ ID NO: 153735 - DNA, 24 bp, Artificial sequence
  SiRNA target sequence
aagatttattagcacgcgccttga

SEQ ID NO: 153736 - DNA, 24 bp, Artificial sequence
  SiRNA target sequence
agatttattagcacgcgccttgaa

SEQ ID NO: 153737 - DNA, 24 bp, Artificial sequence
  SiRNA target sequence
gatttattagcacgcgccttgaat

SEQ ID NO: 153738 - DNA, 24 bp, Artificial sequence
  SiRNA target sequence
atttattagcacgcgccttgaatt

SEQ ID NO: 153739 - DNA, 24 bp, Artificial sequence
  SiRNA target sequence
tttattagcacgcgccttgaatta

SEQ ID NO: 153740 - DNA, 24 bp, Artificial sequence
  SiRNA target sequence
ttattagcacgcgccttgaattat

SEQ ID NO: 153741 - DNA, 24 bp, Artificial sequence
  SiRNA target sequence
tattagcacgcgccttgaattatg

SEQ ID NO: 153742 - DNA, 24 bp, Artificial sequence
  SiRNA target sequence
attagcacgcgccttgaattatgt

SEQ ID NO: 153743 - DNA, 24 bp, Artificial sequence
  SiRNA target sequence
ttagcacgcgccttgaattatgtt

SEQ ID NO: 153744 - DNA, 24 bp, Artificial sequence
  SiRNA target sequence
tagcacgcgccttgaattatgttc

SEQ ID NO: 153745 - DNA, 24 bp, Artificial sequence
  SiRNA target sequence
agcacgcgccttgaattatgttcc

SEQ ID NO: 153746 - DNA, 24 bp, Artificial sequence
  SiRNA target sequence
gcacgcgccttgaattatgttcct

SEQ ID NO: 153747 - DNA, 24 bp, Artificial sequence
  SiRNA target sequence
cacgcgccttgaattatgttcctg

SEQ ID NO: 153748 - DNA, 24 bp, Artificial sequence
  SiRNA target sequence
acgcgccttgaattatgttcctgt

SEQ ID NO: 153749 - DNA, 24 bp, Artificial sequence
  SiRNA target sequence
cgcgccttgaattatgttcctgta

SEQ ID NO: 153750 - DNA, 24 bp, Artificial sequence
  SiRNA target sequence
gcgccttgaattatgttcctgtaa

SEQ ID NO: 153751 - DNA, 24 bp, Artificial sequence
  SiRNA target sequence
cgccttgaattatgttcctgtaag

SEQ ID NO: 153752 - DNA, 24 bp, Artificial sequence
  SiRNA target sequence
gccttgaattatgttcctgtaaga

SEQ ID NO: 153753 - DNA, 24 bp, Artificial sequence
  SiRNA target sequence
ccttgaattatgttcctgtaagaa

SEQ ID NO: 153754 - DNA, 24 bp, Artificial sequence
  SiRNA target sequence
cttgaattatgttcctgtaagaaa

SEQ ID NO: 153755 - DNA, 24 bp, Artificial sequence
  SiRNA target sequence
ttgaattatgttcctgtaagaaaa

SEQ ID NO: 153756 - DNA, 24 bp, Artificial sequence
  SiRNA target sequence
tgaattatgttcctgtaagaaaag

SEQ ID NO: 153757 - DNA, 24 bp, Artificial sequence
  SiRNA target sequence
gaattatgttcctgtaagaaaaga

SEQ ID NO: 153758 - DNA, 24 bp, Artificial sequence
  SiRNA target sequence
aattatgttcctgtaagaaaagat

SEQ ID NO: 153759 - DNA, 24 bp, Artificial sequence
  SiRNA target sequence
attatgttcctgtaagaaaagatt

SEQ ID NO: 153760 - DNA, 24 bp, Artificial sequence
  SiRNA target sequence
ttatgttcctgtaagaaaagattt

SEQ ID NO: 153761 - DNA, 24 bp, Artificial sequence
  SiRNA target sequence
tatgttcctgtaagaaaagatttt

SEQ ID NO: 153762 - DNA, 24 bp, Artificial sequence
  SiRNA target sequence
atgttcctgtaagaaaagatttta

SEQ ID NO: 153763 - DNA, 24 bp, Artificial sequence
  SiRNA target sequence
tgttcctgtaagaaaagattttac

SEQ ID NO: 153764 - DNA, 24 bp, Artificial sequence
  SiRNA target sequence
gttcctgtaagaaaagattttaca

SEQ ID NO: 153765 - DNA, 24 bp, Artificial sequence
  SiRNA target sequence
ttcctgtaagaaaagattttacag

SEQ ID NO: 153766 - DNA, 24 bp, Artificial sequence
  SiRNA target sequence
tcctgtaagaaaagattttacagg

SEQ ID NO: 153767 - DNA, 24 bp, Artificial sequence
  SiRNA target sequence
cctgtaagaaaagattttacagga

SEQ ID NO: 153768 - DNA, 24 bp, Artificial sequence
  SiRNA target sequence
ctgtaagaaaagattttacaggaa

SEQ ID NO: 153769 - DNA, 24 bp, Artificial sequence
  SiRNA target sequence
tgtaagaaaagattttacaggaac

SEQ ID NO: 153770 - DNA, 24 bp, Artificial sequence
  SiRNA target sequence
gtaagaaaagattttacaggaact

SEQ ID NO: 153771 - DNA, 24 bp, Artificial sequence
  SiRNA target sequence
taagaaaagattttacaggaactg

SEQ ID NO: 153772 - DNA, 24 bp, Artificial sequence
  SiRNA target sequence
aagaaaagattttacaggaactgc

SEQ ID NO: 153773 - DNA, 24 bp, Artificial sequence
  SiRNA target sequence
agaaaagattttacaggaactgct

SEQ ID NO: 153774 - DNA, 24 bp, Artificial sequence
  SiRNA target sequence
gaaaagattttacaggaactgctg

SEQ ID NO: 153775 - DNA, 24 bp, Artificial sequence
  SiRNA target sequence
aaaagattttacaggaactgctgt

SEQ ID NO: 153776 - DNA, 24 bp, Artificial sequence
  SiRNA target sequence
aaagattttacaggaactgctgtt

SEQ ID NO: 153777 - DNA, 24 bp, Artificial sequence
  SiRNA target sequence
aagattttacaggaactgctgttc

SEQ ID NO: 153778 - DNA, 24 bp, Artificial sequence
  SiRNA target sequence
agattttacaggaactgctgttcc

SEQ ID NO: 153779 - DNA, 24 bp, Artificial sequence
  SiRNA target sequence
gattttacaggaactgctgttcca

SEQ ID NO: 153780 - DNA, 24 bp, Artificial sequence
  SiRNA target sequence
attttacaggaactgctgttccaa

SEQ ID NO: 153781 - DNA, 24 bp, Artificial sequence
  SiRNA target sequence
ttttacaggaactgctgttccaaa

SEQ ID NO: 153782 - DNA, 24 bp, Artificial sequence
  SiRNA target sequence
tttacaggaactgctgttccaaaa

SEQ ID NO: 153783 - DNA, 24 bp, Artificial sequence
  SiRNA target sequence
ttacaggaactgctgttccaaaat

SEQ ID NO: 153784 - DNA, 24 bp, Artificial sequence
  SiRNA target sequence
tacaggaactgctgttccaaaata

SEQ ID NO: 153785 - DNA, 24 bp, Artificial sequence
  SiRNA target sequence
acaggaactgctgttccaaaatat

SEQ ID NO: 153786 - DNA, 24 bp, Artificial sequence
  SiRNA target sequence
caggaactgctgttccaaaatatg

SEQ ID NO: 153787 - DNA, 24 bp, Artificial sequence
  SiRNA target sequence
aggaactgctgttccaaaatatgc

SEQ ID NO: 153788 - DNA, 24 bp, Artificial sequence
  SiRNA target sequence
ggaactgctgttccaaaatatgca

SEQ ID NO: 153789 - DNA, 24 bp, Artificial sequence
  SiRNA target sequence
gaactgctgttccaaaatatgcag

SEQ ID NO: 153790 - DNA, 24 bp, Artificial sequence
  SiRNA target sequence
aactgctgttccaaaatatgcaga

SEQ ID NO: 153791 - DNA, 24 bp, Artificial sequence
  SiRNA target sequence
actgctgttccaaaatatgcagaa

SEQ ID NO: 153792 - DNA, 24 bp, Artificial sequence
  SiRNA target sequence
ctgctgttccaaaatatgcagaat

SEQ ID NO: 153793 - DNA, 24 bp, Artificial sequence
  SiRNA target sequence
tgctgttccaaaatatgcagaatt

SEQ ID NO: 153794 - DNA, 24 bp, Artificial sequence
  SiRNA target sequence
gctgttccaaaatatgcagaattt

SEQ ID NO: 153795 - DNA, 24 bp, Artificial sequence
  SiRNA target sequence
ctgttccaaaatatgcagaatttg

SEQ ID NO: 153796 - DNA, 24 bp, Artificial sequence
  SiRNA target sequence
tgttccaaaatatgcagaatttgg

SEQ ID NO: 153797 - DNA, 24 bp, Artificial sequence
  SiRNA target sequence
gttccaaaatatgcagaatttggt

SEQ ID NO: 153798 - DNA, 24 bp, Artificial sequence
  SiRNA target sequence
ttccaaaatatgcagaatttggtg

SEQ ID NO: 153799 - DNA, 24 bp, Artificial sequence
  SiRNA target sequence
tccaaaatatgcagaatttggtgt

SEQ ID NO: 153800 - DNA, 24 bp, Artificial sequence
  SiRNA target sequence
ccaaaatatgcagaatttggtgtt

SEQ ID NO: 153801 - DNA, 24 bp, Artificial sequence
  SiRNA target sequence
caaaatatgcagaatttggtgtta

SEQ ID NO: 153802 - DNA, 24 bp, Artificial sequence
  SiRNA target sequence
aaaatatgcagaatttggtgttat

SEQ ID NO: 153803 - DNA, 24 bp, Artificial sequence
  SiRNA target sequence
aaatatgcagaatttggtgttatg

SEQ ID NO: 153804 - DNA, 24 bp, Artificial sequence
  SiRNA target sequence
aatatgcagaatttggtgttatgc

SEQ ID NO: 153805 - DNA, 24 bp, Artificial sequence
  SiRNA target sequence
atatgcagaatttggtgttatgcc

SEQ ID NO: 153806 - DNA, 24 bp, Artificial sequence
  SiRNA target sequence
tatgcagaatttggtgttatgcct

SEQ ID NO: 153807 - DNA, 24 bp, Artificial sequence
  SiRNA target sequence
atgcagaatttggtgttatgccta

SEQ ID NO: 153808 - DNA, 24 bp, Artificial sequence
  SiRNA target sequence
tgcagaatttggtgttatgcctaa

SEQ ID NO: 153809 - DNA, 24 bp, Artificial sequence
  SiRNA target sequence
gcagaatttggtgttatgcctaaa

SEQ ID NO: 153810 - DNA, 24 bp, Artificial sequence
  SiRNA target sequence
cagaatttggtgttatgcctaaag

SEQ ID NO: 153811 - DNA, 24 bp, Artificial sequence
  SiRNA target sequence
agaatttggtgttatgcctaaaga

SEQ ID NO: 153812 - DNA, 24 bp, Artificial sequence
  SiRNA target sequence
gaatttggtgttatgcctaaagaa

SEQ ID NO: 153813 - DNA, 24 bp, Artificial sequence
  SiRNA target sequence
aatttggtgttatgcctaaagaac

SEQ ID NO: 153814 - DNA, 24 bp, Artificial sequence
  SiRNA target sequence
atttggtgttatgcctaaagaaca

SEQ ID NO: 153815 - DNA, 24 bp, Artificial sequence
  SiRNA target sequence
tttggtgttatgcctaaagaacag

SEQ ID NO: 153816 - DNA, 24 bp, Artificial sequence
  SiRNA target sequence
ttggtgttatgcctaaagaacagg

SEQ ID NO: 153817 - DNA, 24 bp, Artificial sequence
  SiRNA target sequence
tggtgttatgcctaaagaacagga

SEQ ID NO: 153818 - DNA, 24 bp, Artificial sequence
  SiRNA target sequence
ggtgttatgcctaaagaacaggaa

SEQ ID NO: 153819 - DNA, 24 bp, Artificial sequence
  SiRNA target sequence
gtgttatgcctaaagaacaggaag

SEQ ID NO: 153820 - DNA, 24 bp, Artificial sequence
  SiRNA target sequence
tgttatgcctaaagaacaggaaga

SEQ ID NO: 153821 - DNA, 24 bp, Artificial sequence
  SiRNA target sequence
gttatgcctaaagaacaggaagaa

SEQ ID NO: 153822 - DNA, 24 bp, Artificial sequence
  SiRNA target sequence
ttatgcctaaagaacaggaagaac

SEQ ID NO: 153823 - DNA, 24 bp, Artificial sequence
  SiRNA target sequence
tatgcctaaagaacaggaagaaca

SEQ ID NO: 153824 - DNA, 24 bp, Artificial sequence
  SiRNA target sequence
atgcctaaagaacaggaagaacaa

SEQ ID NO: 153825 - DNA, 24 bp, Artificial sequence
  SiRNA target sequence
tgcctaaagaacaggaagaacaaa

SEQ ID NO: 153826 - DNA, 24 bp, Artificial sequence
  SiRNA target sequence
gcctaaagaacaggaagaacaaaa

SEQ ID NO: 153827 - DNA, 24 bp, Artificial sequence
  SiRNA target sequence
cctaaagaacaggaagaacaaaac

SEQ ID NO: 153828 - DNA, 24 bp, Artificial sequence
  SiRNA target sequence
ctaaagaacaggaagaacaaaacg

SEQ ID NO: 153829 - DNA, 24 bp, Artificial sequence
  SiRNA target sequence
taaagaacaggaagaacaaaacga

SEQ ID NO: 153830 - DNA, 24 bp, Artificial sequence
  SiRNA target sequence
aaagaacaggaagaacaaaacgaa

SEQ ID NO: 153831 - DNA, 24 bp, Artificial sequence
  SiRNA target sequence
aagaacaggaagaacaaaacgaaa

SEQ ID NO: 153832 - DNA, 24 bp, Artificial sequence
  SiRNA target sequence
agaacaggaagaacaaaacgaaag

SEQ ID NO: 153833 - DNA, 24 bp, Artificial sequence
  SiRNA target sequence
gaacaggaagaacaaaacgaaaga

SEQ ID NO: 153834 - DNA, 24 bp, Artificial sequence
  SiRNA target sequence
aacaggaagaacaaaacgaaagag

SEQ ID NO: 153835 - DNA, 24 bp, Artificial sequence
  SiRNA target sequence
acaggaagaacaaaacgaaagaga

SEQ ID NO: 153836 - DNA, 24 bp, Artificial sequence
  SiRNA target sequence
caggaagaacaaaacgaaagagaa

SEQ ID NO: 153837 - DNA, 24 bp, Artificial sequence
  SiRNA target sequence
aggaagaacaaaacgaaagagaaa

SEQ ID NO: 153838 - DNA, 24 bp, Artificial sequence
  SiRNA target sequence
ggaagaacaaaacgaaagagaaag

SEQ ID NO: 153839 - DNA, 24 bp, Artificial sequence
  SiRNA target sequence
gaagaacaaaacgaaagagaaaga

SEQ ID NO: 153840 - DNA, 24 bp, Artificial sequence
  SiRNA target sequence
aagaacaaaacgaaagagaaagat

SEQ ID NO: 153841 - DNA, 24 bp, Artificial sequence
  SiRNA target sequence
agaacaaaacgaaagagaaagatt

SEQ ID NO: 153842 - DNA, 24 bp, Artificial sequence
  SiRNA target sequence
gaacaaaacgaaagagaaagattc

SEQ ID NO: 153843 - DNA, 24 bp, Artificial sequence
  SiRNA target sequence
aacaaaacgaaagagaaagattcg

SEQ ID NO: 153844 - DNA, 24 bp, Artificial sequence
  SiRNA target sequence
acaaaacgaaagagaaagattcga

SEQ ID NO: 153845 - DNA, 24 bp, Artificial sequence
  SiRNA target sequence
caaaacgaaagagaaagattcgaa

SEQ ID NO: 153846 - DNA, 24 bp, Artificial sequence
  SiRNA target sequence
aaaacgaaagagaaagattcgaag

SEQ ID NO: 153847 - DNA, 24 bp, Artificial sequence
  SiRNA target sequence
aaacgaaagagaaagattcgaagg

SEQ ID NO: 153848 - DNA, 24 bp, Artificial sequence
  SiRNA target sequence
aacgaaagagaaagattcgaaggt

SEQ ID NO: 153849 - DNA, 24 bp, Artificial sequence
  SiRNA target sequence
acgaaagagaaagattcgaaggtg

SEQ ID NO: 153850 - DNA, 24 bp, Artificial sequence
  SiRNA target sequence
cgaaagagaaagattcgaaggtgc

SEQ ID NO: 153851 - DNA, 24 bp, Artificial sequence
  SiRNA target sequence
gaaagagaaagattcgaaggtgca

SEQ ID NO: 153852 - DNA, 24 bp, Artificial sequence
  SiRNA target sequence
aaagagaaagattcgaaggtgcag

SEQ ID NO: 153853 - DNA, 24 bp, Artificial sequence
  SiRNA target sequence
aagagaaagattcgaaggtgcaga

SEQ ID NO: 153854 - DNA, 24 bp, Artificial sequence
  SiRNA target sequence
agagaaagattcgaaggtgcagaa

SEQ ID NO: 153855 - DNA, 24 bp, Artificial sequence
  SiRNA target sequence
gagaaagattcgaaggtgcagaag

SEQ ID NO: 153856 - DNA, 24 bp, Artificial sequence
  SiRNA target sequence
agaaagattcgaaggtgcagaaga

SEQ ID NO: 153857 - DNA, 24 bp, Artificial sequence
  SiRNA target sequence
gaaagattcgaaggtgcagaagag

SEQ ID NO: 153858 - DNA, 24 bp, Artificial sequence
  SiRNA target sequence
aaagattcgaaggtgcagaagagt

SEQ ID NO: 153859 - DNA, 24 bp, Artificial sequence
  SiRNA target sequence
aagattcgaaggtgcagaagagtt

SEQ ID NO: 153860 - DNA, 24 bp, Artificial sequence
  SiRNA target sequence
agattcgaaggtgcagaagagttt

SEQ ID NO: 153861 - DNA, 24 bp, Artificial sequence
  SiRNA target sequence
gattcgaaggtgcagaagagtttt

SEQ ID NO: 153862 - DNA, 24 bp, Artificial sequence
  SiRNA target sequence
attcgaaggtgcagaagagttttt

SEQ ID NO: 153863 - DNA, 24 bp, Artificial sequence
  SiRNA target sequence
ttcgaaggtgcagaagagtttttt

SEQ ID NO: 153864 - DNA, 24 bp, Artificial sequence
  SiRNA target sequence
tcgaaggtgcagaagagttttttg

SEQ ID NO: 153865 - DNA, 24 bp, Artificial sequence
  SiRNA target sequence
cgaaggtgcagaagagttttttgg

SEQ ID NO: 153866 - DNA, 24 bp, Artificial sequence
  SiRNA target sequence
gaaggtgcagaagagttttttgga

SEQ ID NO: 153867 - DNA, 24 bp, Artificial sequence
  SiRNA target sequence
aaggtgcagaagagttttttggag

SEQ ID NO: 153868 - DNA, 24 bp, Artificial sequence
  SiRNA target sequence
aggtgcagaagagttttttggagg

SEQ ID NO: 153869 - DNA, 24 bp, Artificial sequence
  SiRNA target sequence
ggtgcagaagagttttttggagga

SEQ ID NO: 153870 - DNA, 24 bp, Artificial sequence
  SiRNA target sequence
gtgcagaagagttttttggaggaa

SEQ ID NO: 153871 - DNA, 24 bp, Artificial sequence
  SiRNA target sequence
tgcagaagagttttttggaggaaa

SEQ ID NO: 153872 - DNA, 24 bp, Artificial sequence
  SiRNA target sequence
gcagaagagttttttggaggaaat

SEQ ID NO: 153873 - DNA, 24 bp, Artificial sequence
  SiRNA target sequence
cagaagagttttttggaggaaatg

SEQ ID NO: 153874 - DNA, 24 bp, Artificial sequence
  SiRNA target sequence
agaagagttttttggaggaaatgg

SEQ ID NO: 153875 - DNA, 24 bp, Artificial sequence
  SiRNA target sequence
gaagagttttttggaggaaatggt

SEQ ID NO: 153876 - DNA, 24 bp, Artificial sequence
  SiRNA target sequence
aagagttttttggaggaaatggta

SEQ ID NO: 153877 - DNA, 24 bp, Artificial sequence
  SiRNA target sequence
agagttttttggaggaaatggtag

SEQ ID NO: 153878 - DNA, 24 bp, Artificial sequence
  SiRNA target sequence
gagttttttggaggaaatggtaga

SEQ ID NO: 153879 - DNA, 24 bp, Artificial sequence
  SiRNA target sequence
agttttttggaggaaatggtagag

SEQ ID NO: 153880 - DNA, 24 bp, Artificial sequence
  SiRNA target sequence
gttttttggaggaaatggtagaga

SEQ ID NO: 153881 - DNA, 24 bp, Artificial sequence
  SiRNA target sequence
ttttttggaggaaatggtagagat

SEQ ID NO: 153882 - DNA, 24 bp, Artificial sequence
  SiRNA target sequence
tttttggaggaaatggtagagatt

SEQ ID NO: 153883 - DNA, 24 bp, Artificial sequence
  SiRNA target sequence
ttttggaggaaatggtagagattt

SEQ ID NO: 153884 - DNA, 24 bp, Artificial sequence
  SiRNA target sequence
tttggaggaaatggtagagatttt

SEQ ID NO: 153885 - DNA, 24 bp, Artificial sequence
  SiRNA target sequence
ttggaggaaatggtagagattttt

SEQ ID NO: 153886 - DNA, 24 bp, Artificial sequence
  SiRNA target sequence
tggaggaaatggtagagatttttt

SEQ ID NO: 153887 - DNA, 24 bp, Artificial sequence
  SiRNA target sequence
ggaggaaatggtagagattttttt

SEQ ID NO: 153888 - DNA, 24 bp, Artificial sequence
  SiRNA target sequence
gaggaaatggtagagattttttta

SEQ ID NO: 153889 - DNA, 24 bp, Artificial sequence
  SiRNA target sequence
aggaaatggtagagatttttttag

SEQ ID NO: 153890 - DNA, 24 bp, Artificial sequence
  SiRNA target sequence
ggaaatggtagagatttttttagc

SEQ ID NO: 153891 - DNA, 24 bp, Artificial sequence
  SiRNA target sequence
gaaatggtagagatttttttagca

SEQ ID NO: 153892 - DNA, 24 bp, Artificial sequence
  SiRNA target sequence
aaatggtagagatttttttagcaa

SEQ ID NO: 153893 - DNA, 24 bp, Artificial sequence
  SiRNA target sequence
aatggtagagatttttttagcaag

SEQ ID NO: 153894 - DNA, 24 bp, Artificial sequence
  SiRNA target sequence
atggtagagatttttttagcaagt

SEQ ID NO: 153895 - DNA, 24 bp, Artificial sequence
  SiRNA target sequence
tggtagagatttttttagcaagtt

SEQ ID NO: 153896 - DNA, 24 bp, Artificial sequence
  SiRNA target sequence
ggtagagatttttttagcaagttt

SEQ ID NO: 153897 - DNA, 24 bp, Artificial sequence
  SiRNA target sequence
gtagagatttttttagcaagtttg

SEQ ID NO: 153898 - DNA, 24 bp, Artificial sequence
  SiRNA target sequence
tagagatttttttagcaagtttgg

SEQ ID NO: 153899 - DNA, 24 bp, Artificial sequence
  SiRNA target sequence
agagatttttttagcaagtttgga

SEQ ID NO: 153900 - DNA, 24 bp, Artificial sequence
  SiRNA target sequence
gagatttttttagcaagtttggat

SEQ ID NO: 153901 - DNA, 24 bp, Artificial sequence
  SiRNA target sequence
agatttttttagcaagtttggatt

SEQ ID NO: 153902 - DNA, 24 bp, Artificial sequence
  SiRNA target sequence
gatttttttagcaagtttggattt

SEQ ID NO: 153903 - DNA, 24 bp, Artificial sequence
  SiRNA target sequence
atttttttagcaagtttggatttt

SEQ ID NO: 153904 - DNA, 24 bp, Artificial sequence
  SiRNA target sequence
tttttttagcaagtttggattttt

SEQ ID NO: 153905 - DNA, 24 bp, Artificial sequence
  SiRNA target sequence
ttttttagcaagtttggatttttc

SEQ ID NO: 153906 - DNA, 24 bp, Artificial sequence
  SiRNA target sequence
tttttagcaagtttggatttttct

SEQ ID NO: 153907 - DNA, 24 bp, Artificial sequence
  SiRNA target sequence
ttttagcaagtttggatttttcta

SEQ ID NO: 153908 - DNA, 24 bp, Artificial sequence
  SiRNA target sequence
tttagcaagtttggatttttctaa

SEQ ID NO: 153909 - DNA, 25 bp, Artificial sequence
  SiRNA target sequence
atggcacaagacccccaaggacttt

SEQ ID NO: 153910 - DNA, 25 bp, Artificial sequence
  SiRNA target sequence
tggcacaagacccccaaggacttta

SEQ ID NO: 153911 - DNA, 25 bp, Artificial sequence
  SiRNA target sequence
ggcacaagacccccaaggactttat

SEQ ID NO: 153912 - DNA, 25 bp, Artificial sequence
  SiRNA target sequence
gcacaagacccccaaggactttatg

SEQ ID NO: 153913 - DNA, 25 bp, Artificial sequence
  SiRNA target sequence
cacaagacccccaaggactttatga

SEQ ID NO: 153914 - DNA, 25 bp, Artificial sequence
  SiRNA target sequence
acaagacccccaaggactttatgaa

SEQ ID NO: 153915 - DNA, 25 bp, Artificial sequence
  SiRNA target sequence
caagacccccaaggactttatgaag

SEQ ID NO: 153916 - DNA, 25 bp, Artificial sequence
  SiRNA target sequence
aagacccccaaggactttatgaagt

SEQ ID NO: 153917 - DNA, 25 bp, Artificial sequence
  SiRNA target sequence
agacccccaaggactttatgaagta

SEQ ID NO: 153918 - DNA, 25 bp, Artificial sequence
  SiRNA target sequence
gacccccaaggactttatgaagtat

SEQ ID NO: 153919 - DNA, 25 bp, Artificial sequence
  SiRNA target sequence
acccccaaggactttatgaagtatt

SEQ ID NO: 153920 - DNA, 25 bp, Artificial sequence
  SiRNA target sequence
cccccaaggactttatgaagtatta

SEQ ID NO: 153921 - DNA, 25 bp, Artificial sequence
  SiRNA target sequence
ccccaaggactttatgaagtattag

SEQ ID NO: 153922 - DNA, 25 bp, Artificial sequence
  SiRNA target sequence
cccaaggactttatgaagtattagg

SEQ ID NO: 153923 - DNA, 25 bp, Artificial sequence
  SiRNA target sequence
ccaaggactttatgaagtattagga

SEQ ID NO: 153924 - DNA, 25 bp, Artificial sequence
  SiRNA target sequence
caaggactttatgaagtattaggac

SEQ ID NO: 153925 - DNA, 25 bp, Artificial sequence
  SiRNA target sequence
aaggactttatgaagtattaggact

SEQ ID NO: 153926 - DNA, 25 bp, Artificial sequence
  SiRNA target sequence
aggactttatgaagtattaggactt

SEQ ID NO: 153927 - DNA, 25 bp, Artificial sequence
  SiRNA target sequence
ggactttatgaagtattaggactta

SEQ ID NO: 153928 - DNA, 25 bp, Artificial sequence
  SiRNA target sequence
gactttatgaagtattaggacttaa

SEQ ID NO: 153929 - DNA, 25 bp, Artificial sequence
  SiRNA target sequence
actttatgaagtattaggacttaaa

SEQ ID NO: 153930 - DNA, 25 bp, Artificial sequence
  SiRNA target sequence
ctttatgaagtattaggacttaaag

SEQ ID NO: 153931 - DNA, 25 bp, Artificial sequence
  SiRNA target sequence
tttatgaagtattaggacttaaagc

SEQ ID NO: 153932 - DNA, 25 bp, Artificial sequence
  SiRNA target sequence
ttatgaagtattaggacttaaagct

SEQ ID NO: 153933 - DNA, 25 bp, Artificial sequence
  SiRNA target sequence
tatgaagtattaggacttaaagctg

SEQ ID NO: 153934 - DNA, 25 bp, Artificial sequence
  SiRNA target sequence
atgaagtattaggacttaaagctgg

SEQ ID NO: 153935 - DNA, 25 bp, Artificial sequence
  SiRNA target sequence
tgaagtattaggacttaaagctggt

SEQ ID NO: 153936 - DNA, 25 bp, Artificial sequence
  SiRNA target sequence
gaagtattaggacttaaagctggtg

SEQ ID NO: 153937 - DNA, 25 bp, Artificial sequence
  SiRNA target sequence
aagtattaggacttaaagctggtgc

SEQ ID NO: 153938 - DNA, 25 bp, Artificial sequence
  SiRNA target sequence
agtattaggacttaaagctggtgca

SEQ ID NO: 153939 - DNA, 25 bp, Artificial sequence
  SiRNA target sequence
gtattaggacttaaagctggtgcaa

SEQ ID NO: 153940 - DNA, 25 bp, Artificial sequence
  SiRNA target sequence
tattaggacttaaagctggtgcaag

SEQ ID NO: 153941 - DNA, 25 bp, Artificial sequence
  SiRNA target sequence
attaggacttaaagctggtgcaagc

SEQ ID NO: 153942 - DNA, 25 bp, Artificial sequence
  SiRNA target sequence
ttaggacttaaagctggtgcaagca

SEQ ID NO: 153943 - DNA, 25 bp, Artificial sequence
  SiRNA target sequence
taggacttaaagctggtgcaagcat

SEQ ID NO: 153944 - DNA, 25 bp, Artificial sequence
  SiRNA target sequence
aggacttaaagctggtgcaagcatt

SEQ ID NO: 153945 - DNA, 25 bp, Artificial sequence
  SiRNA target sequence
ggacttaaagctggtgcaagcattg

SEQ ID NO: 153946 - DNA, 25 bp, Artificial sequence
  SiRNA target sequence
gacttaaagctggtgcaagcattga

SEQ ID NO: 153947 - DNA, 25 bp, Artificial sequence
  SiRNA target sequence
acttaaagctggtgcaagcattgat

SEQ ID NO: 153948 - DNA, 25 bp, Artificial sequence
  SiRNA target sequence
cttaaagctggtgcaagcattgatg

SEQ ID NO: 153949 - DNA, 25 bp, Artificial sequence
  SiRNA target sequence
ttaaagctggtgcaagcattgatga

SEQ ID NO: 153950 - DNA, 25 bp, Artificial sequence
  SiRNA target sequence
taaagctggtgcaagcattgatgaa

SEQ ID NO: 153951 - DNA, 25 bp, Artificial sequence
  SiRNA target sequence
aaagctggtgcaagcattgatgaag

SEQ ID NO: 153952 - DNA, 25 bp, Artificial sequence
  SiRNA target sequence
aagctggtgcaagcattgatgaagt

SEQ ID NO: 153953 - DNA, 25 bp, Artificial sequence
  SiRNA target sequence
agctggtgcaagcattgatgaagtt

SEQ ID NO: 153954 - DNA, 25 bp, Artificial sequence
  SiRNA target sequence
gctggtgcaagcattgatgaagtta

SEQ ID NO: 153955 - DNA, 25 bp, Artificial sequence
  SiRNA target sequence
ctggtgcaagcattgatgaagttaa

SEQ ID NO: 153956 - DNA, 25 bp, Artificial sequence
  SiRNA target sequence
tggtgcaagcattgatgaagttaaa

SEQ ID NO: 153957 - DNA, 25 bp, Artificial sequence
  SiRNA target sequence
ggtgcaagcattgatgaagttaaaa

SEQ ID NO: 153958 - DNA, 25 bp, Artificial sequence
  SiRNA target sequence
gtgcaagcattgatgaagttaaaaa

SEQ ID NO: 153959 - DNA, 25 bp, Artificial sequence
  SiRNA target sequence
tgcaagcattgatgaagttaaaaaa

SEQ ID NO: 153960 - DNA, 25 bp, Artificial sequence
  SiRNA target sequence
gcaagcattgatgaagttaaaaaag

SEQ ID NO: 153961 - DNA, 25 bp, Artificial sequence
  SiRNA target sequence
caagcattgatgaagttaaaaaagc

SEQ ID NO: 153962 - DNA, 25 bp, Artificial sequence
  SiRNA target sequence
aagcattgatgaagttaaaaaagca

SEQ ID NO: 153963 - DNA, 25 bp, Artificial sequence
  SiRNA target sequence
agcattgatgaagttaaaaaagcat

SEQ ID NO: 153964 - DNA, 25 bp, Artificial sequence
  SiRNA target sequence
gcattgatgaagttaaaaaagcatt

SEQ ID NO: 153965 - DNA, 25 bp, Artificial sequence
  SiRNA target sequence
cattgatgaagttaaaaaagcattt

SEQ ID NO: 153966 - DNA, 25 bp, Artificial sequence
  SiRNA target sequence
attgatgaagttaaaaaagcattta

SEQ ID NO: 153967 - DNA, 25 bp, Artificial sequence
  SiRNA target sequence
ttgatgaagttaaaaaagcatttac

SEQ ID NO: 153968 - DNA, 25 bp, Artificial sequence
  SiRNA target sequence
tgatgaagttaaaaaagcatttaca

SEQ ID NO: 153969 - DNA, 25 bp, Artificial sequence
  SiRNA target sequence
gatgaagttaaaaaagcatttacaa

SEQ ID NO: 153970 - DNA, 25 bp, Artificial sequence
  SiRNA target sequence
atgaagttaaaaaagcatttacaaa

SEQ ID NO: 153971 - DNA, 25 bp, Artificial sequence
  SiRNA target sequence
tgaagttaaaaaagcatttacaaaa

SEQ ID NO: 153972 - DNA, 25 bp, Artificial sequence
  SiRNA target sequence
gaagttaaaaaagcatttacaaaaa

SEQ ID NO: 153973 - DNA, 25 bp, Artificial sequence
  SiRNA target sequence
aagttaaaaaagcatttacaaaaaa

SEQ ID NO: 153974 - DNA, 25 bp, Artificial sequence
  SiRNA target sequence
agttaaaaaagcatttacaaaaaaa

SEQ ID NO: 153975 - DNA, 25 bp, Artificial sequence
  SiRNA target sequence
gttaaaaaagcatttacaaaaaaac

SEQ ID NO: 153976 - DNA, 25 bp, Artificial sequence
  SiRNA target sequence
ttaaaaaagcatttacaaaaaaaca

SEQ ID NO: 153977 - DNA, 25 bp, Artificial sequence
  SiRNA target sequence
taaaaaagcatttacaaaaaaacaa

SEQ ID NO: 153978 - DNA, 25 bp, Artificial sequence
  SiRNA target sequence
aaaaaagcatttacaaaaaaacaaa

SEQ ID NO: 153979 - DNA, 25 bp, Artificial sequence
  SiRNA target sequence
aaaaagcatttacaaaaaaacaaag

SEQ ID NO: 153980 - DNA, 25 bp, Artificial sequence
  SiRNA target sequence
aaaagcatttacaaaaaaacaaagg

SEQ ID NO: 153981 - DNA, 25 bp, Artificial sequence
  SiRNA target sequence
aaagcatttacaaaaaaacaaaggg

SEQ ID NO: 153982 - DNA, 25 bp, Artificial sequence
  SiRNA target sequence
aagcatttacaaaaaaacaaaggga

SEQ ID NO: 153983 - DNA, 25 bp, Artificial sequence
  SiRNA target sequence
agcatttacaaaaaaacaaagggaa

SEQ ID NO: 153984 - DNA, 25 bp, Artificial sequence
  SiRNA target sequence
gcatttacaaaaaaacaaagggaat

SEQ ID NO: 153985 - DNA, 25 bp, Artificial sequence
  SiRNA target sequence
catttacaaaaaaacaaagggaatg

SEQ ID NO: 153986 - DNA, 25 bp, Artificial sequence
  SiRNA target sequence
atttacaaaaaaacaaagggaatgt

SEQ ID NO: 153987 - DNA, 25 bp, Artificial sequence
  SiRNA target sequence
tttacaaaaaaacaaagggaatgtc

SEQ ID NO: 153988 - DNA, 25 bp, Artificial sequence
  SiRNA target sequence
ttacaaaaaaacaaagggaatgtca

SEQ ID NO: 153989 - DNA, 25 bp, Artificial sequence
  SiRNA target sequence
tacaaaaaaacaaagggaatgtcat

SEQ ID NO: 153990 - DNA, 25 bp, Artificial sequence
  SiRNA target sequence
acaaaaaaacaaagggaatgtcatc

SEQ ID NO: 153991 - DNA, 25 bp, Artificial sequence
  SiRNA target sequence
caaaaaaacaaagggaatgtcatcc

SEQ ID NO: 153992 - DNA, 25 bp, Artificial sequence
  SiRNA target sequence
aaaaaaacaaagggaatgtcatccc

SEQ ID NO: 153993 - DNA, 25 bp, Artificial sequence
  SiRNA target sequence
aaaaaacaaagggaatgtcatcccg

SEQ ID NO: 153994 - DNA, 25 bp, Artificial sequence
  SiRNA target sequence
aaaaacaaagggaatgtcatcccga

SEQ ID NO: 153995 - DNA, 25 bp, Artificial sequence
  SiRNA target sequence
aaaacaaagggaatgtcatcccgat

SEQ ID NO: 153996 - DNA, 25 bp, Artificial sequence
  SiRNA target sequence
aaacaaagggaatgtcatcccgatg

SEQ ID NO: 153997 - DNA, 25 bp, Artificial sequence
  SiRNA target sequence
aacaaagggaatgtcatcccgatgg

SEQ ID NO: 153998 - DNA, 25 bp, Artificial sequence
  SiRNA target sequence
acaaagggaatgtcatcccgatggt

SEQ ID NO: 153999 - DNA, 25 bp, Artificial sequence
  SiRNA target sequence
caaagggaatgtcatcccgatggtg

SEQ ID NO: 154000 - DNA, 25 bp, Artificial sequence
  SiRNA target sequence
aaagggaatgtcatcccgatggtgc

SEQ ID NO: 154001 - DNA, 25 bp, Artificial sequence
  SiRNA target sequence
aagggaatgtcatcccgatggtgca

SEQ ID NO: 154002 - DNA, 25 bp, Artificial sequence
  SiRNA target sequence
agggaatgtcatcccgatggtgcat

SEQ ID NO: 154003 - DNA, 25 bp, Artificial sequence
  SiRNA target sequence
gggaatgtcatcccgatggtgcatt

SEQ ID NO: 154004 - DNA, 25 bp, Artificial sequence
  SiRNA target sequence
ggaatgtcatcccgatggtgcattt

SEQ ID NO: 154005 - DNA, 25 bp, Artificial sequence
  SiRNA target sequence
gaatgtcatcccgatggtgcatttt

SEQ ID NO: 154006 - DNA, 25 bp, Artificial sequence
  SiRNA target sequence
aatgtcatcccgatggtgcattttt

SEQ ID NO: 154007 - DNA, 25 bp, Artificial sequence
  SiRNA target sequence
atgtcatcccgatggtgcatttttt

SEQ ID NO: 154008 - DNA, 25 bp, Artificial sequence
  SiRNA target sequence
tgtcatcccgatggtgcatttttta

SEQ ID NO: 154009 - DNA, 25 bp, Artificial sequence
  SiRNA target sequence
gtcatcccgatggtgcattttttaa

SEQ ID NO: 154010 - DNA, 25 bp, Artificial sequence
  SiRNA target sequence
tcatcccgatggtgcattttttaaa

SEQ ID NO: 154011 - DNA, 25 bp, Artificial sequence
  SiRNA target sequence
catcccgatggtgcattttttaaag

SEQ ID NO: 154012 - DNA, 25 bp, Artificial sequence
  SiRNA target sequence
atcccgatggtgcattttttaaagc

SEQ ID NO: 154013 - DNA, 25 bp, Artificial sequence
  SiRNA target sequence
tcccgatggtgcattttttaaagct

SEQ ID NO: 154014 - DNA, 25 bp, Artificial sequence
  SiRNA target sequence
cccgatggtgcattttttaaagctg

SEQ ID NO: 154015 - DNA, 25 bp, Artificial sequence
  SiRNA target sequence
ccgatggtgcattttttaaagctgc

SEQ ID NO: 154016 - DNA, 25 bp, Artificial sequence
  SiRNA target sequence
cgatggtgcattttttaaagctgct

SEQ ID NO: 154017 - DNA, 25 bp, Artificial sequence
  SiRNA target sequence
gatggtgcattttttaaagctgctc

SEQ ID NO: 154018 - DNA, 25 bp, Artificial sequence
  SiRNA target sequence
atggtgcattttttaaagctgctct

SEQ ID NO: 154019 - DNA, 25 bp, Artificial sequence
  SiRNA target sequence
tggtgcattttttaaagctgctctt

SEQ ID NO: 154020 - DNA, 25 bp, Artificial sequence
  SiRNA target sequence
ggtgcattttttaaagctgctctta

SEQ ID NO: 154021 - DNA, 25 bp, Artificial sequence
  SiRNA target sequence
gtgcattttttaaagctgctcttag

SEQ ID NO: 154022 - DNA, 25 bp, Artificial sequence
  SiRNA target sequence
tgcattttttaaagctgctcttaga

SEQ ID NO: 154023 - DNA, 25 bp, Artificial sequence
  SiRNA target sequence
gcattttttaaagctgctcttagaa

SEQ ID NO: 154024 - DNA, 25 bp, Artificial sequence
  SiRNA target sequence
cattttttaaagctgctcttagaaa

SEQ ID NO: 154025 - DNA, 25 bp, Artificial sequence
  SiRNA target sequence
attttttaaagctgctcttagaaaa

SEQ ID NO: 154026 - DNA, 25 bp, Artificial sequence
  SiRNA target sequence
ttttttaaagctgctcttagaaaat

SEQ ID NO: 154027 - DNA, 25 bp, Artificial sequence
  SiRNA target sequence
tttttaaagctgctcttagaaaatg

SEQ ID NO: 154028 - DNA, 25 bp, Artificial sequence
  SiRNA target sequence
ttttaaagctgctcttagaaaatgt

SEQ ID NO: 154029 - DNA, 25 bp, Artificial sequence
  SiRNA target sequence
tttaaagctgctcttagaaaatgta

SEQ ID NO: 154030 - DNA, 25 bp, Artificial sequence
  SiRNA target sequence
ttaaagctgctcttagaaaatgtaa

SEQ ID NO: 154031 - DNA, 25 bp, Artificial sequence
  SiRNA target sequence
taaagctgctcttagaaaatgtaaa

SEQ ID NO: 154032 - DNA, 25 bp, Artificial sequence
  SiRNA target sequence
aaagctgctcttagaaaatgtaaaa

SEQ ID NO: 154033 - DNA, 25 bp, Artificial sequence
  SiRNA target sequence
aagctgctcttagaaaatgtaaaac

SEQ ID NO: 154034 - DNA, 25 bp, Artificial sequence
  SiRNA target sequence
agctgctcttagaaaatgtaaaaca

SEQ ID NO: 154035 - DNA, 25 bp, Artificial sequence
  SiRNA target sequence
gctgctcttagaaaatgtaaaacag

SEQ ID NO: 154036 - DNA, 25 bp, Artificial sequence
  SiRNA target sequence
ctgctcttagaaaatgtaaaacaga

SEQ ID NO: 154037 - DNA, 25 bp, Artificial sequence
  SiRNA target sequence
tgctcttagaaaatgtaaaacagat

SEQ ID NO: 154038 - DNA, 25 bp, Artificial sequence
  SiRNA target sequence
gctcttagaaaatgtaaaacagatg

SEQ ID NO: 154039 - DNA, 25 bp, Artificial sequence
  SiRNA target sequence
ctcttagaaaatgtaaaacagatga

SEQ ID NO: 154040 - DNA, 25 bp, Artificial sequence
  SiRNA target sequence
tcttagaaaatgtaaaacagatgaa

SEQ ID NO: 154041 - DNA, 25 bp, Artificial sequence
  SiRNA target sequence
cttagaaaatgtaaaacagatgaag

SEQ ID NO: 154042 - DNA, 25 bp, Artificial sequence
  SiRNA target sequence
ttagaaaatgtaaaacagatgaaga

SEQ ID NO: 154043 - DNA, 25 bp, Artificial sequence
  SiRNA target sequence
tagaaaatgtaaaacagatgaagaa

SEQ ID NO: 154044 - DNA, 25 bp, Artificial sequence
  SiRNA target sequence
agaaaatgtaaaacagatgaagaaa

SEQ ID NO: 154045 - DNA, 25 bp, Artificial sequence
  SiRNA target sequence
gaaaatgtaaaacagatgaagaaag

SEQ ID NO: 154046 - DNA, 25 bp, Artificial sequence
  SiRNA target sequence
aaaatgtaaaacagatgaagaaaga

SEQ ID NO: 154047 - DNA, 25 bp, Artificial sequence
  SiRNA target sequence
aaatgtaaaacagatgaagaaagag

SEQ ID NO: 154048 - DNA, 25 bp, Artificial sequence
  SiRNA target sequence
aatgtaaaacagatgaagaaagagc

SEQ ID NO: 154049 - DNA, 25 bp, Artificial sequence
  SiRNA target sequence
atgtaaaacagatgaagaaagagca

SEQ ID NO: 154050 - DNA, 25 bp, Artificial sequence
  SiRNA target sequence
tgtaaaacagatgaagaaagagcaa

SEQ ID NO: 154051 - DNA, 25 bp, Artificial sequence
  SiRNA target sequence
gtaaaacagatgaagaaagagcaaa

SEQ ID NO: 154052 - DNA, 25 bp, Artificial sequence
  SiRNA target sequence
taaaacagatgaagaaagagcaaaa

SEQ ID NO: 154053 - DNA, 25 bp, Artificial sequence
  SiRNA target sequence
aaaacagatgaagaaagagcaaaag

SEQ ID NO: 154054 - DNA, 25 bp, Artificial sequence
  SiRNA target sequence
aaacagatgaagaaagagcaaaagt

SEQ ID NO: 154055 - DNA, 25 bp, Artificial sequence
  SiRNA target sequence
aacagatgaagaaagagcaaaagtt

SEQ ID NO: 154056 - DNA, 25 bp, Artificial sequence
  SiRNA target sequence
acagatgaagaaagagcaaaagttg

SEQ ID NO: 154057 - DNA, 25 bp, Artificial sequence
  SiRNA target sequence
cagatgaagaaagagcaaaagttga

SEQ ID NO: 154058 - DNA, 25 bp, Artificial sequence
  SiRNA target sequence
agatgaagaaagagcaaaagttgaa

SEQ ID NO: 154059 - DNA, 25 bp, Artificial sequence
  SiRNA target sequence
gatgaagaaagagcaaaagttgaaa

SEQ ID NO: 154060 - DNA, 25 bp, Artificial sequence
  SiRNA target sequence
atgaagaaagagcaaaagttgaaaa

SEQ ID NO: 154061 - DNA, 25 bp, Artificial sequence
  SiRNA target sequence
tgaagaaagagcaaaagttgaaaaa

SEQ ID NO: 154062 - DNA, 25 bp, Artificial sequence
  SiRNA target sequence
gaagaaagagcaaaagttgaaaaag

SEQ ID NO: 154063 - DNA, 25 bp, Artificial sequence
  SiRNA target sequence
aagaaagagcaaaagttgaaaaaga

SEQ ID NO: 154064 - DNA, 25 bp, Artificial sequence
  SiRNA target sequence
agaaagagcaaaagttgaaaaagaa

SEQ ID NO: 154065 - DNA, 25 bp, Artificial sequence
  SiRNA target sequence
gaaagagcaaaagttgaaaaagaat

SEQ ID NO: 154066 - DNA, 25 bp, Artificial sequence
  SiRNA target sequence
aaagagcaaaagttgaaaaagaatt

SEQ ID NO: 154067 - DNA, 25 bp, Artificial sequence
  SiRNA target sequence
aagagcaaaagttgaaaaagaattt

SEQ ID NO: 154068 - DNA, 25 bp, Artificial sequence
  SiRNA target sequence
agagcaaaagttgaaaaagaattta

SEQ ID NO: 154069 - DNA, 25 bp, Artificial sequence
  SiRNA target sequence
gagcaaaagttgaaaaagaatttaa

SEQ ID NO: 154070 - DNA, 25 bp, Artificial sequence
  SiRNA target sequence
agcaaaagttgaaaaagaatttaaa

SEQ ID NO: 154071 - DNA, 25 bp, Artificial sequence
  SiRNA target sequence
gcaaaagttgaaaaagaatttaaag

SEQ ID NO: 154072 - DNA, 25 bp, Artificial sequence
  SiRNA target sequence
caaaagttgaaaaagaatttaaaga

SEQ ID NO: 154073 - DNA, 25 bp, Artificial sequence
  SiRNA target sequence
aaaagttgaaaaagaatttaaagaa

SEQ ID NO: 154074 - DNA, 25 bp, Artificial sequence
  SiRNA target sequence
aaagttgaaaaagaatttaaagaaa

SEQ ID NO: 154075 - DNA, 25 bp, Artificial sequence
  SiRNA target sequence
aagttgaaaaagaatttaaagaaaa

SEQ ID NO: 154076 - DNA, 25 bp, Artificial sequence
  SiRNA target sequence
agttgaaaaagaatttaaagaaaaa

SEQ ID NO: 154077 - DNA, 25 bp, Artificial sequence
  SiRNA target sequence
gttgaaaaagaatttaaagaaaaat

SEQ ID NO: 154078 - DNA, 25 bp, Artificial sequence
  SiRNA target sequence
ttgaaaaagaatttaaagaaaaatc

SEQ ID NO: 154079 - DNA, 25 bp, Artificial sequence
  SiRNA target sequence
tgaaaaagaatttaaagaaaaatca

SEQ ID NO: 154080 - DNA, 25 bp, Artificial sequence
  SiRNA target sequence
gaaaaagaatttaaagaaaaatcac

SEQ ID NO: 154081 - DNA, 25 bp, Artificial sequence
  SiRNA target sequence
aaaaagaatttaaagaaaaatcaca

SEQ ID NO: 154082 - DNA, 25 bp, Artificial sequence
  SiRNA target sequence
aaaagaatttaaagaaaaatcacaa

SEQ ID NO: 154083 - DNA, 25 bp, Artificial sequence
  SiRNA target sequence
aaagaatttaaagaaaaatcacaaa

SEQ ID NO: 154084 - DNA, 25 bp, Artificial sequence
  SiRNA target sequence
aagaatttaaagaaaaatcacaaaa

SEQ ID NO: 154085 - DNA, 25 bp, Artificial sequence
  SiRNA target sequence
agaatttaaagaaaaatcacaaaaa

SEQ ID NO: 154086 - DNA, 25 bp, Artificial sequence
  SiRNA target sequence
gaatttaaagaaaaatcacaaaaat

SEQ ID NO: 154087 - DNA, 25 bp, Artificial sequence
  SiRNA target sequence
aatttaaagaaaaatcacaaaaatg

SEQ ID NO: 154088 - DNA, 25 bp, Artificial sequence
  SiRNA target sequence
atttaaagaaaaatcacaaaaatgt

SEQ ID NO: 154089 - DNA, 25 bp, Artificial sequence
  SiRNA target sequence
tttaaagaaaaatcacaaaaatgta

SEQ ID NO: 154090 - DNA, 25 bp, Artificial sequence
  SiRNA target sequence
ttaaagaaaaatcacaaaaatgtaa

SEQ ID NO: 154091 - DNA, 25 bp, Artificial sequence
  SiRNA target sequence
taaagaaaaatcacaaaaatgtaat

SEQ ID NO: 154092 - DNA, 25 bp, Artificial sequence
  SiRNA target sequence
aaagaaaaatcacaaaaatgtaatc

SEQ ID NO: 154093 - DNA, 25 bp, Artificial sequence
  SiRNA target sequence
aagaaaaatcacaaaaatgtaatca

SEQ ID NO: 154094 - DNA, 25 bp, Artificial sequence
  SiRNA target sequence
agaaaaatcacaaaaatgtaatcaa

SEQ ID NO: 154095 - DNA, 25 bp, Artificial sequence
  SiRNA target sequence
gaaaaatcacaaaaatgtaatcaag

SEQ ID NO: 154096 - DNA, 25 bp, Artificial sequence
  SiRNA target sequence
aaaaatcacaaaaatgtaatcaagc

SEQ ID NO: 154097 - DNA, 25 bp, Artificial sequence
  SiRNA target sequence
aaaatcacaaaaatgtaatcaagct

SEQ ID NO: 154098 - DNA, 25 bp, Artificial sequence
  SiRNA target sequence
aaatcacaaaaatgtaatcaagcta

SEQ ID NO: 154099 - DNA, 25 bp, Artificial sequence
  SiRNA target sequence
aatcacaaaaatgtaatcaagctaa

SEQ ID NO: 154100 - DNA, 25 bp, Artificial sequence
  SiRNA target sequence
atcacaaaaatgtaatcaagctaaa

SEQ ID NO: 154101 - DNA, 25 bp, Artificial sequence
  SiRNA target sequence
tcacaaaaatgtaatcaagctaaag

SEQ ID NO: 154102 - DNA, 25 bp, Artificial sequence
  SiRNA target sequence
cacaaaaatgtaatcaagctaaagc

SEQ ID NO: 154103 - DNA, 25 bp, Artificial sequence
  SiRNA target sequence
acaaaaatgtaatcaagctaaagca

SEQ ID NO: 154104 - DNA, 25 bp, Artificial sequence
  SiRNA target sequence
caaaaatgtaatcaagctaaagcag

SEQ ID NO: 154105 - DNA, 25 bp, Artificial sequence
  SiRNA target sequence
aaaaatgtaatcaagctaaagcagt

SEQ ID NO: 154106 - DNA, 25 bp, Artificial sequence
  SiRNA target sequence
aaaatgtaatcaagctaaagcagtt

SEQ ID NO: 154107 - DNA, 25 bp, Artificial sequence
  SiRNA target sequence
aaatgtaatcaagctaaagcagttt

SEQ ID NO: 154108 - DNA, 25 bp, Artificial sequence
  SiRNA target sequence
aatgtaatcaagctaaagcagtttt

SEQ ID NO: 154109 - DNA, 25 bp, Artificial sequence
  SiRNA target sequence
atgtaatcaagctaaagcagtttta

SEQ ID NO: 154110 - DNA, 25 bp, Artificial sequence
  SiRNA target sequence
tgtaatcaagctaaagcagttttat

SEQ ID NO: 154111 - DNA, 25 bp, Artificial sequence
  SiRNA target sequence
gtaatcaagctaaagcagttttatt

SEQ ID NO: 154112 - DNA, 25 bp, Artificial sequence
  SiRNA target sequence
taatcaagctaaagcagttttattt

SEQ ID NO: 154113 - DNA, 25 bp, Artificial sequence
  SiRNA target sequence
aatcaagctaaagcagttttatttg

SEQ ID NO: 154114 - DNA, 25 bp, Artificial sequence
  SiRNA target sequence
atcaagctaaagcagttttatttga

SEQ ID NO: 154115 - DNA, 25 bp, Artificial sequence
  SiRNA target sequence
tcaagctaaagcagttttatttgat

SEQ ID NO: 154116 - DNA, 25 bp, Artificial sequence
  SiRNA target sequence
caagctaaagcagttttatttgatg

SEQ ID NO: 154117 - DNA, 25 bp, Artificial sequence
  SiRNA target sequence
aagctaaagcagttttatttgatga

SEQ ID NO: 154118 - DNA, 25 bp, Artificial sequence
  SiRNA target sequence
agctaaagcagttttatttgatgag

SEQ ID NO: 154119 - DNA, 25 bp, Artificial sequence
  SiRNA target sequence
gctaaagcagttttatttgatgaga

SEQ ID NO: 154120 - DNA, 25 bp, Artificial sequence
  SiRNA target sequence
ctaaagcagttttatttgatgagaa

SEQ ID NO: 154121 - DNA, 25 bp, Artificial sequence
  SiRNA target sequence
taaagcagttttatttgatgagaaa

SEQ ID NO: 154122 - DNA, 25 bp, Artificial sequence
  SiRNA target sequence
aaagcagttttatttgatgagaaaa

SEQ ID NO: 154123 - DNA, 25 bp, Artificial sequence
  SiRNA target sequence
aagcagttttatttgatgagaaaaa

SEQ ID NO: 154124 - DNA, 25 bp, Artificial sequence
  SiRNA target sequence
agcagttttatttgatgagaaaaaa

SEQ ID NO: 154125 - DNA, 25 bp, Artificial sequence
  SiRNA target sequence
gcagttttatttgatgagaaaaaaa

SEQ ID NO: 154126 - DNA, 25 bp, Artificial sequence
  SiRNA target sequence
cagttttatttgatgagaaaaaaaa

SEQ ID NO: 154127 - DNA, 25 bp, Artificial sequence
  SiRNA target sequence
agttttatttgatgagaaaaaaaag

SEQ ID NO: 154128 - DNA, 25 bp, Artificial sequence
  SiRNA target sequence
gttttatttgatgagaaaaaaaagc

SEQ ID NO: 154129 - DNA, 25 bp, Artificial sequence
  SiRNA target sequence
ttttatttgatgagaaaaaaaagca

SEQ ID NO: 154130 - DNA, 25 bp, Artificial sequence
  SiRNA target sequence
tttatttgatgagaaaaaaaagcaa

SEQ ID NO: 154131 - DNA, 25 bp, Artificial sequence
  SiRNA target sequence
ttatttgatgagaaaaaaaagcaag

SEQ ID NO: 154132 - DNA, 25 bp, Artificial sequence
  SiRNA target sequence
tatttgatgagaaaaaaaagcaaga

SEQ ID NO: 154133 - DNA, 25 bp, Artificial sequence
  SiRNA target sequence
atttgatgagaaaaaaaagcaagag

SEQ ID NO: 154134 - DNA, 25 bp, Artificial sequence
  SiRNA target sequence
tttgatgagaaaaaaaagcaagagt

SEQ ID NO: 154135 - DNA, 25 bp, Artificial sequence
  SiRNA target sequence
ttgatgagaaaaaaaagcaagagta

SEQ ID NO: 154136 - DNA, 25 bp, Artificial sequence
  SiRNA target sequence
tgatgagaaaaaaaagcaagagtat

SEQ ID NO: 154137 - DNA, 25 bp, Artificial sequence
  SiRNA target sequence
gatgagaaaaaaaagcaagagtatg

SEQ ID NO: 154138 - DNA, 25 bp, Artificial sequence
  SiRNA target sequence
atgagaaaaaaaagcaagagtatga

SEQ ID NO: 154139 - DNA, 25 bp, Artificial sequence
  SiRNA target sequence
tgagaaaaaaaagcaagagtatgat

SEQ ID NO: 154140 - DNA, 25 bp, Artificial sequence
  SiRNA target sequence
gagaaaaaaaagcaagagtatgata

SEQ ID NO: 154141 - DNA, 25 bp, Artificial sequence
  SiRNA target sequence
agaaaaaaaagcaagagtatgatat

SEQ ID NO: 154142 - DNA, 25 bp, Artificial sequence
  SiRNA target sequence
gaaaaaaaagcaagagtatgatatg

SEQ ID NO: 154143 - DNA, 25 bp, Artificial sequence
  SiRNA target sequence
aaaaaaaagcaagagtatgatatgg

SEQ ID NO: 154144 - DNA, 25 bp, Artificial sequence
  SiRNA target sequence
aaaaaaagcaagagtatgatatggg

SEQ ID NO: 154145 - DNA, 25 bp, Artificial sequence
  SiRNA target sequence
aaaaaagcaagagtatgatatggga

SEQ ID NO: 154146 - DNA, 25 bp, Artificial sequence
  SiRNA target sequence
aaaaagcaagagtatgatatgggaa

SEQ ID NO: 154147 - DNA, 25 bp, Artificial sequence
  SiRNA target sequence
aaaagcaagagtatgatatgggaat

SEQ ID NO: 154148 - DNA, 25 bp, Artificial sequence
  SiRNA target sequence
aaagcaagagtatgatatgggaatg

SEQ ID NO: 154149 - DNA, 25 bp, Artificial sequence
  SiRNA target sequence
aagcaagagtatgatatgggaatga

SEQ ID NO: 154150 - DNA, 25 bp, Artificial sequence
  SiRNA target sequence
agcaagagtatgatatgggaatgac

SEQ ID NO: 154151 - DNA, 25 bp, Artificial sequence
  SiRNA target sequence
gcaagagtatgatatgggaatgact

SEQ ID NO: 154152 - DNA, 25 bp, Artificial sequence
  SiRNA target sequence
caagagtatgatatgggaatgactg

SEQ ID NO: 154153 - DNA, 25 bp, Artificial sequence
  SiRNA target sequence
aagagtatgatatgggaatgactgg

SEQ ID NO: 154154 - DNA, 25 bp, Artificial sequence
  SiRNA target sequence
agagtatgatatgggaatgactggc

SEQ ID NO: 154155 - DNA, 25 bp, Artificial sequence
  SiRNA target sequence
gagtatgatatgggaatgactggcg

SEQ ID NO: 154156 - DNA, 25 bp, Artificial sequence
  SiRNA target sequence
agtatgatatgggaatgactggcga

SEQ ID NO: 154157 - DNA, 25 bp, Artificial sequence
  SiRNA target sequence
gtatgatatgggaatgactggcgat

SEQ ID NO: 154158 - DNA, 25 bp, Artificial sequence
  SiRNA target sequence
tatgatatgggaatgactggcgatt

SEQ ID NO: 154159 - DNA, 25 bp, Artificial sequence
  SiRNA target sequence
atgatatgggaatgactggcgattt

SEQ ID NO: 154160 - DNA, 25 bp, Artificial sequence
  SiRNA target sequence
tgatatgggaatgactggcgatttt

SEQ ID NO: 154161 - DNA, 25 bp, Artificial sequence
  SiRNA target sequence
gatatgggaatgactggcgattttg

SEQ ID NO: 154162 - DNA, 25 bp, Artificial sequence
  SiRNA target sequence
atatgggaatgactggcgattttgg

SEQ ID NO: 154163 - DNA, 25 bp, Artificial sequence
  SiRNA target sequence
tatgggaatgactggcgattttgga

SEQ ID NO: 154164 - DNA, 25 bp, Artificial sequence
  SiRNA target sequence
atgggaatgactggcgattttggat

SEQ ID NO: 154165 - DNA, 25 bp, Artificial sequence
  SiRNA target sequence
tgggaatgactggcgattttggatt

SEQ ID NO: 154166 - DNA, 25 bp, Artificial sequence
  SiRNA target sequence
gggaatgactggcgattttggattt

SEQ ID NO: 154167 - DNA, 25 bp, Artificial sequence
  SiRNA target sequence
ggaatgactggcgattttggatttt

SEQ ID NO: 154168 - DNA, 25 bp, Artificial sequence
  SiRNA target sequence
gaatgactggcgattttggattttc

SEQ ID NO: 154169 - DNA, 25 bp, Artificial sequence
  SiRNA target sequence
aatgactggcgattttggattttct

SEQ ID NO: 154170 - DNA, 25 bp, Artificial sequence
  SiRNA target sequence
atgactggcgattttggattttctg

SEQ ID NO: 154171 - DNA, 25 bp, Artificial sequence
  SiRNA target sequence
tgactggcgattttggattttctgc

SEQ ID NO: 154172 - DNA, 25 bp, Artificial sequence
  SiRNA target sequence
gactggcgattttggattttctgca

SEQ ID NO: 154173 - DNA, 25 bp, Artificial sequence
  SiRNA target sequence
actggcgattttggattttctgcag

SEQ ID NO: 154174 - DNA, 25 bp, Artificial sequence
  SiRNA target sequence
ctggcgattttggattttctgcagg

SEQ ID NO: 154175 - DNA, 25 bp, Artificial sequence
  SiRNA target sequence
tggcgattttggattttctgcaggt

SEQ ID NO: 154176 - DNA, 25 bp, Artificial sequence
  SiRNA target sequence
ggcgattttggattttctgcaggtg

SEQ ID NO: 154177 - DNA, 25 bp, Artificial sequence
  SiRNA target sequence
gcgattttggattttctgcaggtgg

SEQ ID NO: 154178 - DNA, 25 bp, Artificial sequence
  SiRNA target sequence
cgattttggattttctgcaggtggt

SEQ ID NO: 154179 - DNA, 25 bp, Artificial sequence
  SiRNA target sequence
gattttggattttctgcaggtggtg

SEQ ID NO: 154180 - DNA, 25 bp, Artificial sequence
  SiRNA target sequence
attttggattttctgcaggtggtgg

SEQ ID NO: 154181 - DNA, 25 bp, Artificial sequence
  SiRNA target sequence
ttttggattttctgcaggtggtgga

SEQ ID NO: 154182 - DNA, 25 bp, Artificial sequence
  SiRNA target sequence
tttggattttctgcaggtggtggag

SEQ ID NO: 154183 - DNA, 25 bp, Artificial sequence
  SiRNA target sequence
ttggattttctgcaggtggtggaga

SEQ ID NO: 154184 - DNA, 25 bp, Artificial sequence
  SiRNA target sequence
tggattttctgcaggtggtggagac

SEQ ID NO: 154185 - DNA, 25 bp, Artificial sequence
  SiRNA target sequence
ggattttctgcaggtggtggagact

SEQ ID NO: 154186 - DNA, 25 bp, Artificial sequence
  SiRNA target sequence
gattttctgcaggtggtggagactt

SEQ ID NO: 154187 - DNA, 25 bp, Artificial sequence
  SiRNA target sequence
attttctgcaggtggtggagacttt

SEQ ID NO: 154188 - DNA, 25 bp, Artificial sequence
  SiRNA target sequence
ttttctgcaggtggtggagactttt

SEQ ID NO: 154189 - DNA, 25 bp, Artificial sequence
  SiRNA target sequence
tttctgcaggtggtggagacttttt

SEQ ID NO: 154190 - DNA, 25 bp, Artificial sequence
  SiRNA target sequence
ttctgcaggtggtggagactttttc

SEQ ID NO: 154191 - DNA, 25 bp, Artificial sequence
  SiRNA target sequence
tctgcaggtggtggagactttttcg

SEQ ID NO: 154192 - DNA, 25 bp, Artificial sequence
  SiRNA target sequence
ctgcaggtggtggagactttttcga

SEQ ID NO: 154193 - DNA, 25 bp, Artificial sequence
  SiRNA target sequence
tgcaggtggtggagactttttcgat

SEQ ID NO: 154194 - DNA, 25 bp, Artificial sequence
  SiRNA target sequence
gcaggtggtggagactttttcgata

SEQ ID NO: 154195 - DNA, 25 bp, Artificial sequence
  SiRNA target sequence
caggtggtggagactttttcgatat

SEQ ID NO: 154196 - DNA, 25 bp, Artificial sequence
  SiRNA target sequence
aggtggtggagactttttcgatatt

SEQ ID NO: 154197 - DNA, 25 bp, Artificial sequence
  SiRNA target sequence
ggtggtggagactttttcgatattt

SEQ ID NO: 154198 - DNA, 25 bp, Artificial sequence
  SiRNA target sequence
gtggtggagactttttcgatatttt

SEQ ID NO: 154199 - DNA, 25 bp, Artificial sequence
  SiRNA target sequence
tggtggagactttttcgatattttt

SEQ ID NO: 154200 - DNA, 25 bp, Artificial sequence
  SiRNA target sequence
ggtggagactttttcgatatttttt

SEQ ID NO: 154201 - DNA, 25 bp, Artificial sequence
  SiRNA target sequence
gtggagactttttcgatattttttc

SEQ ID NO: 154202 - DNA, 25 bp, Artificial sequence
  SiRNA target sequence
tggagactttttcgatattttttca

SEQ ID NO: 154203 - DNA, 25 bp, Artificial sequence
  SiRNA target sequence
ggagactttttcgatattttttcaa

SEQ ID NO: 154204 - DNA, 25 bp, Artificial sequence
  SiRNA target sequence
gagactttttcgatattttttcaag

SEQ ID NO: 154205 - DNA, 25 bp, Artificial sequence
  SiRNA target sequence
agactttttcgatattttttcaagt

SEQ ID NO: 154206 - DNA, 25 bp, Artificial sequence
  SiRNA target sequence
gactttttcgatattttttcaagtt

SEQ ID NO: 154207 - DNA, 25 bp, Artificial sequence
  SiRNA target sequence
actttttcgatattttttcaagttt

SEQ ID NO: 154208 - DNA, 25 bp, Artificial sequence
  SiRNA target sequence
ctttttcgatattttttcaagtttt

SEQ ID NO: 154209 - DNA, 25 bp, Artificial sequence
  SiRNA target sequence
tttttcgatattttttcaagtttta

SEQ ID NO: 154210 - DNA, 25 bp, Artificial sequence
  SiRNA target sequence
ttttcgatattttttcaagttttac

SEQ ID NO: 154211 - DNA, 25 bp, Artificial sequence
  SiRNA target sequence
tttcgatattttttcaagttttact

SEQ ID NO: 154212 - DNA, 25 bp, Artificial sequence
  SiRNA target sequence
ttcgatattttttcaagttttactg

SEQ ID NO: 154213 - DNA, 25 bp, Artificial sequence
  SiRNA target sequence
tcgatattttttcaagttttactgg

SEQ ID NO: 154214 - DNA, 25 bp, Artificial sequence
  SiRNA target sequence
cgatattttttcaagttttactggt

SEQ ID NO: 154215 - DNA, 25 bp, Artificial sequence
  SiRNA target sequence
gatattttttcaagttttactggtg

SEQ ID NO: 154216 - DNA, 25 bp, Artificial sequence
  SiRNA target sequence
atattttttcaagttttactggtgg

SEQ ID NO: 154217 - DNA, 25 bp, Artificial sequence
  SiRNA target sequence
tattttttcaagttttactggtgga

SEQ ID NO: 154218 - DNA, 25 bp, Artificial sequence
  SiRNA target sequence
attttttcaagttttactggtggag

SEQ ID NO: 154219 - DNA, 25 bp, Artificial sequence
  SiRNA target sequence
ttttttcaagttttactggtggagg

SEQ ID NO: 154220 - DNA, 25 bp, Artificial sequence
  SiRNA target sequence
tttttcaagttttactggtggagga

SEQ ID NO: 154221 - DNA, 25 bp, Artificial sequence
  SiRNA target sequence
ttttcaagttttactggtggaggaa

SEQ ID NO: 154222 - DNA, 25 bp, Artificial sequence
  SiRNA target sequence
tttcaagttttactggtggaggaag

SEQ ID NO: 154223 - DNA, 25 bp, Artificial sequence
  SiRNA target sequence
ttcaagttttactggtggaggaaga

SEQ ID NO: 154224 - DNA, 25 bp, Artificial sequence
  SiRNA target sequence
tcaagttttactggtggaggaagaa

SEQ ID NO: 154225 - DNA, 25 bp, Artificial sequence
  SiRNA target sequence
caagttttactggtggaggaagaag

SEQ ID NO: 154226 - DNA, 25 bp, Artificial sequence
  SiRNA target sequence
aagttttactggtggaggaagaaga

SEQ ID NO: 154227 - DNA, 25 bp, Artificial sequence
  SiRNA target sequence
agttttactggtggaggaagaagaa

SEQ ID NO: 154228 - DNA, 25 bp, Artificial sequence
  SiRNA target sequence
gttttactggtggaggaagaagaaa

SEQ ID NO: 154229 - DNA, 25 bp, Artificial sequence
  SiRNA target sequence
ttttactggtggaggaagaagaaat

SEQ ID NO: 154230 - DNA, 25 bp, Artificial sequence
  SiRNA target sequence
tttactggtggaggaagaagaaatc

SEQ ID NO: 154231 - DNA, 25 bp, Artificial sequence
  SiRNA target sequence
ttactggtggaggaagaagaaatcg

SEQ ID NO: 154232 - DNA, 25 bp, Artificial sequence
  SiRNA target sequence
tactggtggaggaagaagaaatcga

SEQ ID NO: 154233 - DNA, 25 bp, Artificial sequence
  SiRNA target sequence
actggtggaggaagaagaaatcgag

SEQ ID NO: 154234 - DNA, 25 bp, Artificial sequence
  SiRNA target sequence
ctggtggaggaagaagaaatcgagt

SEQ ID NO: 154235 - DNA, 25 bp, Artificial sequence
  SiRNA target sequence
tggtggaggaagaagaaatcgagta

SEQ ID NO: 154236 - DNA, 25 bp, Artificial sequence
  SiRNA target sequence
ggtggaggaagaagaaatcgagtac

SEQ ID NO: 154237 - DNA, 25 bp, Artificial sequence
  SiRNA target sequence
gtggaggaagaagaaatcgagtaca

SEQ ID NO: 154238 - DNA, 25 bp, Artificial sequence
  SiRNA target sequence
tggaggaagaagaaatcgagtacaa

SEQ ID NO: 154239 - DNA, 25 bp, Artificial sequence
  SiRNA target sequence
ggaggaagaagaaatcgagtacaaa

SEQ ID NO: 154240 - DNA, 25 bp, Artificial sequence
  SiRNA target sequence
gaggaagaagaaatcgagtacaaaa

SEQ ID NO: 154241 - DNA, 25 bp, Artificial sequence
  SiRNA target sequence
aggaagaagaaatcgagtacaaaaa

SEQ ID NO: 154242 - DNA, 25 bp, Artificial sequence
  SiRNA target sequence
ggaagaagaaatcgagtacaaaaag

SEQ ID NO: 154243 - DNA, 25 bp, Artificial sequence
  SiRNA target sequence
gaagaagaaatcgagtacaaaaagt

SEQ ID NO: 154244 - DNA, 25 bp, Artificial sequence
  SiRNA target sequence
aagaagaaatcgagtacaaaaagtt

SEQ ID NO: 154245 - DNA, 25 bp, Artificial sequence
  SiRNA target sequence
agaagaaatcgagtacaaaaagttc

SEQ ID NO: 154246 - DNA, 25 bp, Artificial sequence
  SiRNA target sequence
gaagaaatcgagtacaaaaagttca

SEQ ID NO: 154247 - DNA, 25 bp, Artificial sequence
  SiRNA target sequence
aagaaatcgagtacaaaaagttcaa

SEQ ID NO: 154248 - DNA, 25 bp, Artificial sequence
  SiRNA target sequence
agaaatcgagtacaaaaagttcaag

SEQ ID NO: 154249 - DNA, 25 bp, Artificial sequence
  SiRNA target sequence
gaaatcgagtacaaaaagttcaaga

SEQ ID NO: 154250 - DNA, 25 bp, Artificial sequence
  SiRNA target sequence
aaatcgagtacaaaaagttcaagat

SEQ ID NO: 154251 - DNA, 25 bp, Artificial sequence
  SiRNA target sequence
aatcgagtacaaaaagttcaagata

SEQ ID NO: 154252 - DNA, 25 bp, Artificial sequence
  SiRNA target sequence
atcgagtacaaaaagttcaagatac

SEQ ID NO: 154253 - DNA, 25 bp, Artificial sequence
  SiRNA target sequence
tcgagtacaaaaagttcaagataca

SEQ ID NO: 154254 - DNA, 25 bp, Artificial sequence
  SiRNA target sequence
cgagtacaaaaagttcaagatacag

SEQ ID NO: 154255 - DNA, 25 bp, Artificial sequence
  SiRNA target sequence
gagtacaaaaagttcaagatacaga

SEQ ID NO: 154256 - DNA, 25 bp, Artificial sequence
  SiRNA target sequence
agtacaaaaagttcaagatacagaa

SEQ ID NO: 154257 - DNA, 25 bp, Artificial sequence
  SiRNA target sequence
gtacaaaaagttcaagatacagaat

SEQ ID NO: 154258 - DNA, 25 bp, Artificial sequence
  SiRNA target sequence
tacaaaaagttcaagatacagaata

SEQ ID NO: 154259 - DNA, 25 bp, Artificial sequence
  SiRNA target sequence
acaaaaagttcaagatacagaatac

SEQ ID NO: 154260 - DNA, 25 bp, Artificial sequence
  SiRNA target sequence
caaaaagttcaagatacagaatacg

SEQ ID NO: 154261 - DNA, 25 bp, Artificial sequence
  SiRNA target sequence
aaaaagttcaagatacagaatacga

SEQ ID NO: 154262 - DNA, 25 bp, Artificial sequence
  SiRNA target sequence
aaaagttcaagatacagaatacgag

SEQ ID NO: 154263 - DNA, 25 bp, Artificial sequence
  SiRNA target sequence
aaagttcaagatacagaatacgagt

SEQ ID NO: 154264 - DNA, 25 bp, Artificial sequence
  SiRNA target sequence
aagttcaagatacagaatacgagtt

SEQ ID NO: 154265 - DNA, 25 bp, Artificial sequence
  SiRNA target sequence
agttcaagatacagaatacgagttt

SEQ ID NO: 154266 - DNA, 25 bp, Artificial sequence
  SiRNA target sequence
gttcaagatacagaatacgagttta

SEQ ID NO: 154267 - DNA, 25 bp, Artificial sequence
  SiRNA target sequence
ttcaagatacagaatacgagtttaa

SEQ ID NO: 154268 - DNA, 25 bp, Artificial sequence
  SiRNA target sequence
tcaagatacagaatacgagtttaat

SEQ ID NO: 154269 - DNA, 25 bp, Artificial sequence
  SiRNA target sequence
caagatacagaatacgagtttaata

SEQ ID NO: 154270 - DNA, 25 bp, Artificial sequence
  SiRNA target sequence
aagatacagaatacgagtttaatat

SEQ ID NO: 154271 - DNA, 25 bp, Artificial sequence
  SiRNA target sequence
agatacagaatacgagtttaatatt

SEQ ID NO: 154272 - DNA, 25 bp, Artificial sequence
  SiRNA target sequence
gatacagaatacgagtttaatattt

SEQ ID NO: 154273 - DNA, 25 bp, Artificial sequence
  SiRNA target sequence
atacagaatacgagtttaatatttc

SEQ ID NO: 154274 - DNA, 25 bp, Artificial sequence
  SiRNA target sequence
tacagaatacgagtttaatatttcg

SEQ ID NO: 154275 - DNA, 25 bp, Artificial sequence
  SiRNA target sequence
acagaatacgagtttaatatttcgt

SEQ ID NO: 154276 - DNA, 25 bp, Artificial sequence
  SiRNA target sequence
cagaatacgagtttaatatttcgtt

SEQ ID NO: 154277 - DNA, 25 bp, Artificial sequence
  SiRNA target sequence
agaatacgagtttaatatttcgttg

SEQ ID NO: 154278 - DNA, 25 bp, Artificial sequence
  SiRNA target sequence
gaatacgagtttaatatttcgttga

SEQ ID NO: 154279 - DNA, 25 bp, Artificial sequence
  SiRNA target sequence
aatacgagtttaatatttcgttgaa

SEQ ID NO: 154280 - DNA, 25 bp, Artificial sequence
  SiRNA target sequence
atacgagtttaatatttcgttgaag

SEQ ID NO: 154281 - DNA, 25 bp, Artificial sequence
  SiRNA target sequence
tacgagtttaatatttcgttgaagg

SEQ ID NO: 154282 - DNA, 25 bp, Artificial sequence
  SiRNA target sequence
acgagtttaatatttcgttgaagga

SEQ ID NO: 154283 - DNA, 25 bp, Artificial sequence
  SiRNA target sequence
cgagtttaatatttcgttgaaggaa

SEQ ID NO: 154284 - DNA, 25 bp, Artificial sequence
  SiRNA target sequence
gagtttaatatttcgttgaaggaag

SEQ ID NO: 154285 - DNA, 25 bp, Artificial sequence
  SiRNA target sequence
agtttaatatttcgttgaaggaagc

SEQ ID NO: 154286 - DNA, 25 bp, Artificial sequence
  SiRNA target sequence
gtttaatatttcgttgaaggaagct

SEQ ID NO: 154287 - DNA, 25 bp, Artificial sequence
  SiRNA target sequence
tttaatatttcgttgaaggaagctt

SEQ ID NO: 154288 - DNA, 25 bp, Artificial sequence
  SiRNA target sequence
ttaatatttcgttgaaggaagctta

SEQ ID NO: 154289 - DNA, 25 bp, Artificial sequence
  SiRNA target sequence
taatatttcgttgaaggaagcttat

SEQ ID NO: 154290 - DNA, 25 bp, Artificial sequence
  SiRNA target sequence
aatatttcgttgaaggaagcttata

SEQ ID NO: 154291 - DNA, 25 bp, Artificial sequence
  SiRNA target sequence
atatttcgttgaaggaagcttatat

SEQ ID NO: 154292 - DNA, 25 bp, Artificial sequence
  SiRNA target sequence
tatttcgttgaaggaagcttatatg

SEQ ID NO: 154293 - DNA, 25 bp, Artificial sequence
  SiRNA target sequence
atttcgttgaaggaagcttatatgg

SEQ ID NO: 154294 - DNA, 25 bp, Artificial sequence
  SiRNA target sequence
tttcgttgaaggaagcttatatggg

SEQ ID NO: 154295 - DNA, 25 bp, Artificial sequence
  SiRNA target sequence
ttcgttgaaggaagcttatatggga

SEQ ID NO: 154296 - DNA, 25 bp, Artificial sequence
  SiRNA target sequence
tcgttgaaggaagcttatatgggaa

SEQ ID NO: 154297 - DNA, 25 bp, Artificial sequence
  SiRNA target sequence
cgttgaaggaagcttatatgggaaa

SEQ ID NO: 154298 - DNA, 25 bp, Artificial sequence
  SiRNA target sequence
gttgaaggaagcttatatgggaaag

SEQ ID NO: 154299 - DNA, 25 bp, Artificial sequence
  SiRNA target sequence
ttgaaggaagcttatatgggaaagc

SEQ ID NO: 154300 - DNA, 25 bp, Artificial sequence
  SiRNA target sequence
tgaaggaagcttatatgggaaagcg

SEQ ID NO: 154301 - DNA, 25 bp, Artificial sequence
  SiRNA target sequence
gaaggaagcttatatgggaaagcga

SEQ ID NO: 154302 - DNA, 25 bp, Artificial sequence
  SiRNA target sequence
aaggaagcttatatgggaaagcgag

SEQ ID NO: 154303 - DNA, 25 bp, Artificial sequence
  SiRNA target sequence
aggaagcttatatgggaaagcgagc

SEQ ID NO: 154304 - DNA, 25 bp, Artificial sequence
  SiRNA target sequence
ggaagcttatatgggaaagcgagct

SEQ ID NO: 154305 - DNA, 25 bp, Artificial sequence
  SiRNA target sequence
gaagcttatatgggaaagcgagcta

SEQ ID NO: 154306 - DNA, 25 bp, Artificial sequence
  SiRNA target sequence
aagcttatatgggaaagcgagctag

SEQ ID NO: 154307 - DNA, 25 bp, Artificial sequence
  SiRNA target sequence
agcttatatgggaaagcgagctagt

SEQ ID NO: 154308 - DNA, 25 bp, Artificial sequence
  SiRNA target sequence
gcttatatgggaaagcgagctagtt

SEQ ID NO: 154309 - DNA, 25 bp, Artificial sequence
  SiRNA target sequence
cttatatgggaaagcgagctagttt

SEQ ID NO: 154310 - DNA, 25 bp, Artificial sequence
  SiRNA target sequence
ttatatgggaaagcgagctagtttt

SEQ ID NO: 154311 - DNA, 25 bp, Artificial sequence
  SiRNA target sequence
tatatgggaaagcgagctagtttta

SEQ ID NO: 154312 - DNA, 25 bp, Artificial sequence
  SiRNA target sequence
atatgggaaagcgagctagttttaa

SEQ ID NO: 154313 - DNA, 25 bp, Artificial sequence
  SiRNA target sequence
tatgggaaagcgagctagttttaat

SEQ ID NO: 154314 - DNA, 25 bp, Artificial sequence
  SiRNA target sequence
atgggaaagcgagctagttttaatg

SEQ ID NO: 154315 - DNA, 25 bp, Artificial sequence
  SiRNA target sequence
tgggaaagcgagctagttttaatgt

SEQ ID NO: 154316 - DNA, 25 bp, Artificial sequence
  SiRNA target sequence
gggaaagcgagctagttttaatgta

SEQ ID NO: 154317 - DNA, 25 bp, Artificial sequence
  SiRNA target sequence
ggaaagcgagctagttttaatgtaa

SEQ ID NO: 154318 - DNA, 25 bp, Artificial sequence
  SiRNA target sequence
gaaagcgagctagttttaatgtaaa

SEQ ID NO: 154319 - DNA, 25 bp, Artificial sequence
  SiRNA target sequence
aaagcgagctagttttaatgtaaaa

SEQ ID NO: 154320 - DNA, 25 bp, Artificial sequence
  SiRNA target sequence
aagcgagctagttttaatgtaaaag

SEQ ID NO: 154321 - DNA, 25 bp, Artificial sequence
  SiRNA target sequence
agcgagctagttttaatgtaaaagt

SEQ ID NO: 154322 - DNA, 25 bp, Artificial sequence
  SiRNA target sequence
gcgagctagttttaatgtaaaagtg

SEQ ID NO: 154323 - DNA, 25 bp, Artificial sequence
  SiRNA target sequence
cgagctagttttaatgtaaaagtgc

SEQ ID NO: 154324 - DNA, 25 bp, Artificial sequence
  SiRNA target sequence
gagctagttttaatgtaaaagtgca

SEQ ID NO: 154325 - DNA, 25 bp, Artificial sequence
  SiRNA target sequence
agctagttttaatgtaaaagtgcaa

SEQ ID NO: 154326 - DNA, 25 bp, Artificial sequence
  SiRNA target sequence
gctagttttaatgtaaaagtgcaaa

SEQ ID NO: 154327 - DNA, 25 bp, Artificial sequence
  SiRNA target sequence
ctagttttaatgtaaaagtgcaaag

SEQ ID NO: 154328 - DNA, 25 bp, Artificial sequence
  SiRNA target sequence
tagttttaatgtaaaagtgcaaaga

SEQ ID NO: 154329 - DNA, 25 bp, Artificial sequence
  SiRNA target sequence
agttttaatgtaaaagtgcaaagag

SEQ ID NO: 154330 - DNA, 25 bp, Artificial sequence
  SiRNA target sequence
gttttaatgtaaaagtgcaaagaga

SEQ ID NO: 154331 - DNA, 25 bp, Artificial sequence
  SiRNA target sequence
ttttaatgtaaaagtgcaaagagaa

SEQ ID NO: 154332 - DNA, 25 bp, Artificial sequence
  SiRNA target sequence
tttaatgtaaaagtgcaaagagaat

SEQ ID NO: 154333 - DNA, 25 bp, Artificial sequence
  SiRNA target sequence
ttaatgtaaaagtgcaaagagaatg

SEQ ID NO: 154334 - DNA, 25 bp, Artificial sequence
  SiRNA target sequence
taatgtaaaagtgcaaagagaatgt

SEQ ID NO: 154335 - DNA, 25 bp, Artificial sequence
  SiRNA target sequence
aatgtaaaagtgcaaagagaatgtt

SEQ ID NO: 154336 - DNA, 25 bp, Artificial sequence
  SiRNA target sequence
atgtaaaagtgcaaagagaatgttc

SEQ ID NO: 154337 - DNA, 25 bp, Artificial sequence
  SiRNA target sequence
tgtaaaagtgcaaagagaatgttct

SEQ ID NO: 154338 - DNA, 25 bp, Artificial sequence
  SiRNA target sequence
gtaaaagtgcaaagagaatgttctg

SEQ ID NO: 154339 - DNA, 25 bp, Artificial sequence
  SiRNA target sequence
taaaagtgcaaagagaatgttctgc

SEQ ID NO: 154340 - DNA, 25 bp, Artificial sequence
  SiRNA target sequence
aaaagtgcaaagagaatgttctgcg

SEQ ID NO: 154341 - DNA, 25 bp, Artificial sequence
  SiRNA target sequence
aaagtgcaaagagaatgttctgcgt

SEQ ID NO: 154342 - DNA, 25 bp, Artificial sequence
  SiRNA target sequence
aagtgcaaagagaatgttctgcgtg

SEQ ID NO: 154343 - DNA, 25 bp, Artificial sequence
  SiRNA target sequence
agtgcaaagagaatgttctgcgtgt

SEQ ID NO: 154344 - DNA, 25 bp, Artificial sequence
  SiRNA target sequence
gtgcaaagagaatgttctgcgtgta

SEQ ID NO: 154345 - DNA, 25 bp, Artificial sequence
  SiRNA target sequence
tgcaaagagaatgttctgcgtgtaa

SEQ ID NO: 154346 - DNA, 25 bp, Artificial sequence
  SiRNA target sequence
gcaaagagaatgttctgcgtgtaac

SEQ ID NO: 154347 - DNA, 25 bp, Artificial sequence
  SiRNA target sequence
caaagagaatgttctgcgtgtaacg

SEQ ID NO: 154348 - DNA, 25 bp, Artificial sequence
  SiRNA target sequence
aaagagaatgttctgcgtgtaacgg

SEQ ID NO: 154349 - DNA, 25 bp, Artificial sequence
  SiRNA target sequence
aagagaatgttctgcgtgtaacggt

SEQ ID NO: 154350 - DNA, 25 bp, Artificial sequence
  SiRNA target sequence
agagaatgttctgcgtgtaacggta

SEQ ID NO: 154351 - DNA, 25 bp, Artificial sequence
  SiRNA target sequence
gagaatgttctgcgtgtaacggtaa

SEQ ID NO: 154352 - DNA, 25 bp, Artificial sequence
  SiRNA target sequence
agaatgttctgcgtgtaacggtaaa

SEQ ID NO: 154353 - DNA, 25 bp, Artificial sequence
  SiRNA target sequence
gaatgttctgcgtgtaacggtaaag

SEQ ID NO: 154354 - DNA, 25 bp, Artificial sequence
  SiRNA target sequence
aatgttctgcgtgtaacggtaaagg

SEQ ID NO: 154355 - DNA, 25 bp, Artificial sequence
  SiRNA target sequence
atgttctgcgtgtaacggtaaagga

SEQ ID NO: 154356 - DNA, 25 bp, Artificial sequence
  SiRNA target sequence
tgttctgcgtgtaacggtaaaggag

SEQ ID NO: 154357 - DNA, 25 bp, Artificial sequence
  SiRNA target sequence
gttctgcgtgtaacggtaaaggagg

SEQ ID NO: 154358 - DNA, 25 bp, Artificial sequence
  SiRNA target sequence
ttctgcgtgtaacggtaaaggagga

SEQ ID NO: 154359 - DNA, 25 bp, Artificial sequence
  SiRNA target sequence
tctgcgtgtaacggtaaaggaggag

SEQ ID NO: 154360 - DNA, 25 bp, Artificial sequence
  SiRNA target sequence
ctgcgtgtaacggtaaaggaggaga

SEQ ID NO: 154361 - DNA, 25 bp, Artificial sequence
  SiRNA target sequence
tgcgtgtaacggtaaaggaggagac

SEQ ID NO: 154362 - DNA, 25 bp, Artificial sequence
  SiRNA target sequence
gcgtgtaacggtaaaggaggagaca

SEQ ID NO: 154363 - DNA, 25 bp, Artificial sequence
  SiRNA target sequence
cgtgtaacggtaaaggaggagacag

SEQ ID NO: 154364 - DNA, 25 bp, Artificial sequence
  SiRNA target sequence
gtgtaacggtaaaggaggagacagt

SEQ ID NO: 154365 - DNA, 25 bp, Artificial sequence
  SiRNA target sequence
tgtaacggtaaaggaggagacagtg

SEQ ID NO: 154366 - DNA, 25 bp, Artificial sequence
  SiRNA target sequence
gtaacggtaaaggaggagacagtgt

SEQ ID NO: 154367 - DNA, 25 bp, Artificial sequence
  SiRNA target sequence
taacggtaaaggaggagacagtgtt

SEQ ID NO: 154368 - DNA, 25 bp, Artificial sequence
  SiRNA target sequence
aacggtaaaggaggagacagtgttg

SEQ ID NO: 154369 - DNA, 25 bp, Artificial sequence
  SiRNA target sequence
acggtaaaggaggagacagtgttga

SEQ ID NO: 154370 - DNA, 25 bp, Artificial sequence
  SiRNA target sequence
cggtaaaggaggagacagtgttgaa

SEQ ID NO: 154371 - DNA, 25 bp, Artificial sequence
  SiRNA target sequence
ggtaaaggaggagacagtgttgaaa

SEQ ID NO: 154372 - DNA, 25 bp, Artificial sequence
  SiRNA target sequence
gtaaaggaggagacagtgttgaaac

SEQ ID NO: 154373 - DNA, 25 bp, Artificial sequence
  SiRNA target sequence
taaaggaggagacagtgttgaaaca

SEQ ID NO: 154374 - DNA, 25 bp, Artificial sequence
  SiRNA target sequence
aaaggaggagacagtgttgaaacat

SEQ ID NO: 154375 - DNA, 25 bp, Artificial sequence
  SiRNA target sequence
aaggaggagacagtgttgaaacatg

SEQ ID NO: 154376 - DNA, 25 bp, Artificial sequence
  SiRNA target sequence
aggaggagacagtgttgaaacatgt

SEQ ID NO: 154377 - DNA, 25 bp, Artificial sequence
  SiRNA target sequence
ggaggagacagtgttgaaacatgtg

SEQ ID NO: 154378 - DNA, 25 bp, Artificial sequence
  SiRNA target sequence
gaggagacagtgttgaaacatgtga

SEQ ID NO: 154379 - DNA, 25 bp, Artificial sequence
  SiRNA target sequence
aggagacagtgttgaaacatgtgaa

SEQ ID NO: 154380 - DNA, 25 bp, Artificial sequence
  SiRNA target sequence
ggagacagtgttgaaacatgtgaac

SEQ ID NO: 154381 - DNA, 25 bp, Artificial sequence
  SiRNA target sequence
gagacagtgttgaaacatgtgaacc

SEQ ID NO: 154382 - DNA, 25 bp, Artificial sequence
  SiRNA target sequence
agacagtgttgaaacatgtgaacca

SEQ ID NO: 154383 - DNA, 25 bp, Artificial sequence
  SiRNA target sequence
gacagtgttgaaacatgtgaaccat

SEQ ID NO: 154384 - DNA, 25 bp, Artificial sequence
  SiRNA target sequence
acagtgttgaaacatgtgaaccatg

SEQ ID NO: 154385 - DNA, 25 bp, Artificial sequence
  SiRNA target sequence
cagtgttgaaacatgtgaaccatgt

SEQ ID NO: 154386 - DNA, 25 bp, Artificial sequence
  SiRNA target sequence
agtgttgaaacatgtgaaccatgta

SEQ ID NO: 154387 - DNA, 25 bp, Artificial sequence
  SiRNA target sequence
gtgttgaaacatgtgaaccatgtaa

SEQ ID NO: 154388 - DNA, 25 bp, Artificial sequence
  SiRNA target sequence
tgttgaaacatgtgaaccatgtaaa

SEQ ID NO: 154389 - DNA, 25 bp, Artificial sequence
  SiRNA target sequence
gttgaaacatgtgaaccatgtaaag

SEQ ID NO: 154390 - DNA, 25 bp, Artificial sequence
  SiRNA target sequence
ttgaaacatgtgaaccatgtaaagg

SEQ ID NO: 154391 - DNA, 25 bp, Artificial sequence
  SiRNA target sequence
tgaaacatgtgaaccatgtaaaggt

SEQ ID NO: 154392 - DNA, 25 bp, Artificial sequence
  SiRNA target sequence
gaaacatgtgaaccatgtaaaggta

SEQ ID NO: 154393 - DNA, 25 bp, Artificial sequence
  SiRNA target sequence
aaacatgtgaaccatgtaaaggtaa

SEQ ID NO: 154394 - DNA, 25 bp, Artificial sequence
  SiRNA target sequence
aacatgtgaaccatgtaaaggtaaa

SEQ ID NO: 154395 - DNA, 25 bp, Artificial sequence
  SiRNA target sequence
acatgtgaaccatgtaaaggtaaag

SEQ ID NO: 154396 - DNA, 25 bp, Artificial sequence
  SiRNA target sequence
catgtgaaccatgtaaaggtaaagg

SEQ ID NO: 154397 - DNA, 25 bp, Artificial sequence
  SiRNA target sequence
atgtgaaccatgtaaaggtaaaggt

SEQ ID NO: 154398 - DNA, 25 bp, Artificial sequence
  SiRNA target sequence
tgtgaaccatgtaaaggtaaaggta

SEQ ID NO: 154399 - DNA, 25 bp, Artificial sequence
  SiRNA target sequence
gtgaaccatgtaaaggtaaaggtaa

SEQ ID NO: 154400 - DNA, 25 bp, Artificial sequence
  SiRNA target sequence
tgaaccatgtaaaggtaaaggtaag

SEQ ID NO: 154401 - DNA, 25 bp, Artificial sequence
  SiRNA target sequence
gaaccatgtaaaggtaaaggtaagg

SEQ ID NO: 154402 - DNA, 25 bp, Artificial sequence
  SiRNA target sequence
aaccatgtaaaggtaaaggtaaggt

SEQ ID NO: 154403 - DNA, 25 bp, Artificial sequence
  SiRNA target sequence
accatgtaaaggtaaaggtaaggta

SEQ ID NO: 154404 - DNA, 25 bp, Artificial sequence
  SiRNA target sequence
ccatgtaaaggtaaaggtaaggtag

SEQ ID NO: 154405 - DNA, 25 bp, Artificial sequence
  SiRNA target sequence
catgtaaaggtaaaggtaaggtaga

SEQ ID NO: 154406 - DNA, 25 bp, Artificial sequence
  SiRNA target sequence
atgtaaaggtaaaggtaaggtagaa

SEQ ID NO: 154407 - DNA, 25 bp, Artificial sequence
  SiRNA target sequence
tgtaaaggtaaaggtaaggtagaac

SEQ ID NO: 154408 - DNA, 25 bp, Artificial sequence
  SiRNA target sequence
gtaaaggtaaaggtaaggtagaaca

SEQ ID NO: 154409 - DNA, 25 bp, Artificial sequence
  SiRNA target sequence
taaaggtaaaggtaaggtagaacat

SEQ ID NO: 154410 - DNA, 25 bp, Artificial sequence
  SiRNA target sequence
aaaggtaaaggtaaggtagaacatc

SEQ ID NO: 154411 - DNA, 25 bp, Artificial sequence
  SiRNA target sequence
aaggtaaaggtaaggtagaacatca

SEQ ID NO: 154412 - DNA, 25 bp, Artificial sequence
  SiRNA target sequence
aggtaaaggtaaggtagaacatcat

SEQ ID NO: 154413 - DNA, 25 bp, Artificial sequence
  SiRNA target sequence
ggtaaaggtaaggtagaacatcata

SEQ ID NO: 154414 - DNA, 25 bp, Artificial sequence
  SiRNA target sequence
gtaaaggtaaggtagaacatcatag

SEQ ID NO: 154415 - DNA, 25 bp, Artificial sequence
  SiRNA target sequence
taaaggtaaggtagaacatcatagg

SEQ ID NO: 154416 - DNA, 25 bp, Artificial sequence
  SiRNA target sequence
aaaggtaaggtagaacatcatagga

SEQ ID NO: 154417 - DNA, 25 bp, Artificial sequence
  SiRNA target sequence
aaggtaaggtagaacatcataggag

SEQ ID NO: 154418 - DNA, 25 bp, Artificial sequence
  SiRNA target sequence
aggtaaggtagaacatcataggaga

SEQ ID NO: 154419 - DNA, 25 bp, Artificial sequence
  SiRNA target sequence
ggtaaggtagaacatcataggagac

SEQ ID NO: 154420 - DNA, 25 bp, Artificial sequence
  SiRNA target sequence
gtaaggtagaacatcataggagact

SEQ ID NO: 154421 - DNA, 25 bp, Artificial sequence
  SiRNA target sequence
taaggtagaacatcataggagacta

SEQ ID NO: 154422 - DNA, 25 bp, Artificial sequence
  SiRNA target sequence
aaggtagaacatcataggagactag

SEQ ID NO: 154423 - DNA, 25 bp, Artificial sequence
  SiRNA target sequence
aggtagaacatcataggagactagg

SEQ ID NO: 154424 - DNA, 25 bp, Artificial sequence
  SiRNA target sequence
ggtagaacatcataggagactaggt

SEQ ID NO: 154425 - DNA, 25 bp, Artificial sequence
  SiRNA target sequence
gtagaacatcataggagactaggtc

SEQ ID NO: 154426 - DNA, 25 bp, Artificial sequence
  SiRNA target sequence
tagaacatcataggagactaggtcc

SEQ ID NO: 154427 - DNA, 25 bp, Artificial sequence
  SiRNA target sequence
agaacatcataggagactaggtcct

SEQ ID NO: 154428 - DNA, 25 bp, Artificial sequence
  SiRNA target sequence
gaacatcataggagactaggtcctt

SEQ ID NO: 154429 - DNA, 25 bp, Artificial sequence
  SiRNA target sequence
aacatcataggagactaggtccttt

SEQ ID NO: 154430 - DNA, 25 bp, Artificial sequence
  SiRNA target sequence
acatcataggagactaggtccttta

SEQ ID NO: 154431 - DNA, 25 bp, Artificial sequence
  SiRNA target sequence
catcataggagactaggtcctttaa

SEQ ID NO: 154432 - DNA, 25 bp, Artificial sequence
  SiRNA target sequence
atcataggagactaggtcctttaat

SEQ ID NO: 154433 - DNA, 25 bp, Artificial sequence
  SiRNA target sequence
tcataggagactaggtcctttaatt

SEQ ID NO: 154434 - DNA, 25 bp, Artificial sequence
  SiRNA target sequence
cataggagactaggtcctttaattt

SEQ ID NO: 154435 - DNA, 25 bp, Artificial sequence
  SiRNA target sequence
ataggagactaggtcctttaatttc

SEQ ID NO: 154436 - DNA, 25 bp, Artificial sequence
  SiRNA target sequence
taggagactaggtcctttaatttct

SEQ ID NO: 154437 - DNA, 25 bp, Artificial sequence
  SiRNA target sequence
aggagactaggtcctttaatttctg

SEQ ID NO: 154438 - DNA, 25 bp, Artificial sequence
  SiRNA target sequence
ggagactaggtcctttaatttctgt

SEQ ID NO: 154439 - DNA, 25 bp, Artificial sequence
  SiRNA target sequence
gagactaggtcctttaatttctgta

SEQ ID NO: 154440 - DNA, 25 bp, Artificial sequence
  SiRNA target sequence
agactaggtcctttaatttctgtac

SEQ ID NO: 154441 - DNA, 25 bp, Artificial sequence
  SiRNA target sequence
gactaggtcctttaatttctgtaca

SEQ ID NO: 154442 - DNA, 25 bp, Artificial sequence
  SiRNA target sequence
actaggtcctttaatttctgtacaa

SEQ ID NO: 154443 - DNA, 25 bp, Artificial sequence
  SiRNA target sequence
ctaggtcctttaatttctgtacaag

SEQ ID NO: 154444 - DNA, 25 bp, Artificial sequence
  SiRNA target sequence
taggtcctttaatttctgtacaaga

SEQ ID NO: 154445 - DNA, 25 bp, Artificial sequence
  SiRNA target sequence
aggtcctttaatttctgtacaagaa

SEQ ID NO: 154446 - DNA, 25 bp, Artificial sequence
  SiRNA target sequence
ggtcctttaatttctgtacaagaag

SEQ ID NO: 154447 - DNA, 25 bp, Artificial sequence
  SiRNA target sequence
gtcctttaatttctgtacaagaagc

SEQ ID NO: 154448 - DNA, 25 bp, Artificial sequence
  SiRNA target sequence
tcctttaatttctgtacaagaagca

SEQ ID NO: 154449 - DNA, 25 bp, Artificial sequence
  SiRNA target sequence
cctttaatttctgtacaagaagcac

SEQ ID NO: 154450 - DNA, 25 bp, Artificial sequence
  SiRNA target sequence
ctttaatttctgtacaagaagcacc

SEQ ID NO: 154451 - DNA, 25 bp, Artificial sequence
  SiRNA target sequence
tttaatttctgtacaagaagcacct

SEQ ID NO: 154452 - DNA, 25 bp, Artificial sequence
  SiRNA target sequence
ttaatttctgtacaagaagcacctt

SEQ ID NO: 154453 - DNA, 25 bp, Artificial sequence
  SiRNA target sequence
taatttctgtacaagaagcaccttg

SEQ ID NO: 154454 - DNA, 25 bp, Artificial sequence
  SiRNA target sequence
aatttctgtacaagaagcaccttgt

SEQ ID NO: 154455 - DNA, 25 bp, Artificial sequence
  SiRNA target sequence
atttctgtacaagaagcaccttgta

SEQ ID NO: 154456 - DNA, 25 bp, Artificial sequence
  SiRNA target sequence
tttctgtacaagaagcaccttgtaa

SEQ ID NO: 154457 - DNA, 25 bp, Artificial sequence
  SiRNA target sequence
ttctgtacaagaagcaccttgtaat

SEQ ID NO: 154458 - DNA, 25 bp, Artificial sequence
  SiRNA target sequence
tctgtacaagaagcaccttgtaata

SEQ ID NO: 154459 - DNA, 25 bp, Artificial sequence
  SiRNA target sequence
ctgtacaagaagcaccttgtaataa

SEQ ID NO: 154460 - DNA, 25 bp, Artificial sequence
  SiRNA target sequence
tgtacaagaagcaccttgtaataat

SEQ ID NO: 154461 - DNA, 25 bp, Artificial sequence
  SiRNA target sequence
gtacaagaagcaccttgtaataatt

SEQ ID NO: 154462 - DNA, 25 bp, Artificial sequence
  SiRNA target sequence
tacaagaagcaccttgtaataattg

SEQ ID NO: 154463 - DNA, 25 bp, Artificial sequence
  SiRNA target sequence
acaagaagcaccttgtaataattgt

SEQ ID NO: 154464 - DNA, 25 bp, Artificial sequence
  SiRNA target sequence
caagaagcaccttgtaataattgta

SEQ ID NO: 154465 - DNA, 25 bp, Artificial sequence
  SiRNA target sequence
aagaagcaccttgtaataattgtaa

SEQ ID NO: 154466 - DNA, 25 bp, Artificial sequence
  SiRNA target sequence
agaagcaccttgtaataattgtaat

SEQ ID NO: 154467 - DNA, 25 bp, Artificial sequence
  SiRNA target sequence
gaagcaccttgtaataattgtaatt

SEQ ID NO: 154468 - DNA, 25 bp, Artificial sequence
  SiRNA target sequence
aagcaccttgtaataattgtaattc

SEQ ID NO: 154469 - DNA, 25 bp, Artificial sequence
  SiRNA target sequence
agcaccttgtaataattgtaattct

SEQ ID NO: 154470 - DNA, 25 bp, Artificial sequence
  SiRNA target sequence
gcaccttgtaataattgtaattcta

SEQ ID NO: 154471 - DNA, 25 bp, Artificial sequence
  SiRNA target sequence
caccttgtaataattgtaattctac

SEQ ID NO: 154472 - DNA, 25 bp, Artificial sequence
  SiRNA target sequence
accttgtaataattgtaattctact

SEQ ID NO: 154473 - DNA, 25 bp, Artificial sequence
  SiRNA target sequence
ccttgtaataattgtaattctactg

SEQ ID NO: 154474 - DNA, 25 bp, Artificial sequence
  SiRNA target sequence
cttgtaataattgtaattctactgg

SEQ ID NO: 154475 - DNA, 25 bp, Artificial sequence
  SiRNA target sequence
ttgtaataattgtaattctactgga

SEQ ID NO: 154476 - DNA, 25 bp, Artificial sequence
  SiRNA target sequence
tgtaataattgtaattctactggat

SEQ ID NO: 154477 - DNA, 25 bp, Artificial sequence
  SiRNA target sequence
gtaataattgtaattctactggatt

SEQ ID NO: 154478 - DNA, 25 bp, Artificial sequence
  SiRNA target sequence
taataattgtaattctactggattt

SEQ ID NO: 154479 - DNA, 25 bp, Artificial sequence
  SiRNA target sequence
aataattgtaattctactggatttg

SEQ ID NO: 154480 - DNA, 25 bp, Artificial sequence
  SiRNA target sequence
ataattgtaattctactggatttgt

SEQ ID NO: 154481 - DNA, 25 bp, Artificial sequence
  SiRNA target sequence
taattgtaattctactggatttgtt

SEQ ID NO: 154482 - DNA, 25 bp, Artificial sequence
  SiRNA target sequence
aattgtaattctactggatttgttg

SEQ ID NO: 154483 - DNA, 25 bp, Artificial sequence
  SiRNA target sequence
attgtaattctactggatttgttgt

SEQ ID NO: 154484 - DNA, 25 bp, Artificial sequence
  SiRNA target sequence
ttgtaattctactggatttgttgtt

SEQ ID NO: 154485 - DNA, 25 bp, Artificial sequence
  SiRNA target sequence
tgtaattctactggatttgttgtta

SEQ ID NO: 154486 - DNA, 25 bp, Artificial sequence
  SiRNA target sequence
gtaattctactggatttgttgttaa

SEQ ID NO: 154487 - DNA, 25 bp, Artificial sequence
  SiRNA target sequence
taattctactggatttgttgttaaa

SEQ ID NO: 154488 - DNA, 25 bp, Artificial sequence
  SiRNA target sequence
aattctactggatttgttgttaaag

SEQ ID NO: 154489 - DNA, 25 bp, Artificial sequence
  SiRNA target sequence
attctactggatttgttgttaaagg

SEQ ID NO: 154490 - DNA, 25 bp, Artificial sequence
  SiRNA target sequence
ttctactggatttgttgttaaagga

SEQ ID NO: 154491 - DNA, 25 bp, Artificial sequence
  SiRNA target sequence
tctactggatttgttgttaaaggaa

SEQ ID NO: 154492 - DNA, 25 bp, Artificial sequence
  SiRNA target sequence
ctactggatttgttgttaaaggaaa

SEQ ID NO: 154493 - DNA, 25 bp, Artificial sequence
  SiRNA target sequence
tactggatttgttgttaaaggaaag

SEQ ID NO: 154494 - DNA, 25 bp, Artificial sequence
  SiRNA target sequence
actggatttgttgttaaaggaaagc

SEQ ID NO: 154495 - DNA, 25 bp, Artificial sequence
  SiRNA target sequence
ctggatttgttgttaaaggaaagct

SEQ ID NO: 154496 - DNA, 25 bp, Artificial sequence
  SiRNA target sequence
tggatttgttgttaaaggaaagctt

SEQ ID NO: 154497 - DNA, 25 bp, Artificial sequence
  SiRNA target sequence
ggatttgttgttaaaggaaagcttt

SEQ ID NO: 154498 - DNA, 25 bp, Artificial sequence
  SiRNA target sequence
gatttgttgttaaaggaaagctttg

SEQ ID NO: 154499 - DNA, 25 bp, Artificial sequence
  SiRNA target sequence
atttgttgttaaaggaaagctttgt

SEQ ID NO: 154500 - DNA, 25 bp, Artificial sequence
  SiRNA target sequence
tttgttgttaaaggaaagctttgtc

SEQ ID NO: 154501 - DNA, 25 bp, Artificial sequence
  SiRNA target sequence
ttgttgttaaaggaaagctttgtca

SEQ ID NO: 154502 - DNA, 25 bp, Artificial sequence
  SiRNA target sequence
tgttgttaaaggaaagctttgtcaa

SEQ ID NO: 154503 - DNA, 25 bp, Artificial sequence
  SiRNA target sequence
gttgttaaaggaaagctttgtcaaa

SEQ ID NO: 154504 - DNA, 25 bp, Artificial sequence
  SiRNA target sequence
ttgttaaaggaaagctttgtcaaag

SEQ ID NO: 154505 - DNA, 25 bp, Artificial sequence
  SiRNA target sequence
tgttaaaggaaagctttgtcaaagt

SEQ ID NO: 154506 - DNA, 25 bp, Artificial sequence
  SiRNA target sequence
gttaaaggaaagctttgtcaaagtt

SEQ ID NO: 154507 - DNA, 25 bp, Artificial sequence
  SiRNA target sequence
ttaaaggaaagctttgtcaaagttg

SEQ ID NO: 154508 - DNA, 25 bp, Artificial sequence
  SiRNA target sequence
taaaggaaagctttgtcaaagttgt

SEQ ID NO: 154509 - DNA, 25 bp, Artificial sequence
  SiRNA target sequence
aaaggaaagctttgtcaaagttgta

SEQ ID NO: 154510 - DNA, 25 bp, Artificial sequence
  SiRNA target sequence
aaggaaagctttgtcaaagttgtaa

SEQ ID NO: 154511 - DNA, 25 bp, Artificial sequence
  SiRNA target sequence
aggaaagctttgtcaaagttgtaaa

SEQ ID NO: 154512 - DNA, 25 bp, Artificial sequence
  SiRNA target sequence
ggaaagctttgtcaaagttgtaaag

SEQ ID NO: 154513 - DNA, 25 bp, Artificial sequence
  SiRNA target sequence
gaaagctttgtcaaagttgtaaagg

SEQ ID NO: 154514 - DNA, 25 bp, Artificial sequence
  SiRNA target sequence
aaagctttgtcaaagttgtaaaggt

SEQ ID NO: 154515 - DNA, 25 bp, Artificial sequence
  SiRNA target sequence
aagctttgtcaaagttgtaaaggta

SEQ ID NO: 154516 - DNA, 25 bp, Artificial sequence
  SiRNA target sequence
agctttgtcaaagttgtaaaggtaa

SEQ ID NO: 154517 - DNA, 25 bp, Artificial sequence
  SiRNA target sequence
gctttgtcaaagttgtaaaggtaaa

SEQ ID NO: 154518 - DNA, 25 bp, Artificial sequence
  SiRNA target sequence
ctttgtcaaagttgtaaaggtaaac

SEQ ID NO: 154519 - DNA, 25 bp, Artificial sequence
  SiRNA target sequence
tttgtcaaagttgtaaaggtaaaca

SEQ ID NO: 154520 - DNA, 25 bp, Artificial sequence
  SiRNA target sequence
ttgtcaaagttgtaaaggtaaacaa

SEQ ID NO: 154521 - DNA, 25 bp, Artificial sequence
  SiRNA target sequence
tgtcaaagttgtaaaggtaaacaat

SEQ ID NO: 154522 - DNA, 25 bp, Artificial sequence
  SiRNA target sequence
gtcaaagttgtaaaggtaaacaata

SEQ ID NO: 154523 - DNA, 25 bp, Artificial sequence
  SiRNA target sequence
tcaaagttgtaaaggtaaacaatac

SEQ ID NO: 154524 - DNA, 25 bp, Artificial sequence
  SiRNA target sequence
caaagttgtaaaggtaaacaatacg

SEQ ID NO: 154525 - DNA, 25 bp, Artificial sequence
  SiRNA target sequence
aaagttgtaaaggtaaacaatacgt

SEQ ID NO: 154526 - DNA, 25 bp, Artificial sequence
  SiRNA target sequence
aagttgtaaaggtaaacaatacgtt

SEQ ID NO: 154527 - DNA, 25 bp, Artificial sequence
  SiRNA target sequence
agttgtaaaggtaaacaatacgttg

SEQ ID NO: 154528 - DNA, 25 bp, Artificial sequence
  SiRNA target sequence
gttgtaaaggtaaacaatacgttga

SEQ ID NO: 154529 - DNA, 25 bp, Artificial sequence
  SiRNA target sequence
ttgtaaaggtaaacaatacgttgag

SEQ ID NO: 154530 - DNA, 25 bp, Artificial sequence
  SiRNA target sequence
tgtaaaggtaaacaatacgttgaga

SEQ ID NO: 154531 - DNA, 25 bp, Artificial sequence
  SiRNA target sequence
gtaaaggtaaacaatacgttgagac

SEQ ID NO: 154532 - DNA, 25 bp, Artificial sequence
  SiRNA target sequence
taaaggtaaacaatacgttgagact

SEQ ID NO: 154533 - DNA, 25 bp, Artificial sequence
  SiRNA target sequence
aaaggtaaacaatacgttgagacta

SEQ ID NO: 154534 - DNA, 25 bp, Artificial sequence
  SiRNA target sequence
aaggtaaacaatacgttgagactaa

SEQ ID NO: 154535 - DNA, 25 bp, Artificial sequence
  SiRNA target sequence
aggtaaacaatacgttgagactaaa

SEQ ID NO: 154536 - DNA, 25 bp, Artificial sequence
  SiRNA target sequence
ggtaaacaatacgttgagactaaag

SEQ ID NO: 154537 - DNA, 25 bp, Artificial sequence
  SiRNA target sequence
gtaaacaatacgttgagactaaaga

SEQ ID NO: 154538 - DNA, 25 bp, Artificial sequence
  SiRNA target sequence
taaacaatacgttgagactaaagaa

SEQ ID NO: 154539 - DNA, 25 bp, Artificial sequence
  SiRNA target sequence
aaacaatacgttgagactaaagaac

SEQ ID NO: 154540 - DNA, 25 bp, Artificial sequence
  SiRNA target sequence
aacaatacgttgagactaaagaaca

SEQ ID NO: 154541 - DNA, 25 bp, Artificial sequence
  SiRNA target sequence
acaatacgttgagactaaagaacat

SEQ ID NO: 154542 - DNA, 25 bp, Artificial sequence
  SiRNA target sequence
caatacgttgagactaaagaacata

SEQ ID NO: 154543 - DNA, 25 bp, Artificial sequence
  SiRNA target sequence
aatacgttgagactaaagaacatat

SEQ ID NO: 154544 - DNA, 25 bp, Artificial sequence
  SiRNA target sequence
atacgttgagactaaagaacatatt

SEQ ID NO: 154545 - DNA, 25 bp, Artificial sequence
  SiRNA target sequence
tacgttgagactaaagaacatattg

SEQ ID NO: 154546 - DNA, 25 bp, Artificial sequence
  SiRNA target sequence
acgttgagactaaagaacatattga

SEQ ID NO: 154547 - DNA, 25 bp, Artificial sequence
  SiRNA target sequence
cgttgagactaaagaacatattgaa

SEQ ID NO: 154548 - DNA, 25 bp, Artificial sequence
  SiRNA target sequence
gttgagactaaagaacatattgaag

SEQ ID NO: 154549 - DNA, 25 bp, Artificial sequence
  SiRNA target sequence
ttgagactaaagaacatattgaagt

SEQ ID NO: 154550 - DNA, 25 bp, Artificial sequence
  SiRNA target sequence
tgagactaaagaacatattgaagtg

SEQ ID NO: 154551 - DNA, 25 bp, Artificial sequence
  SiRNA target sequence
gagactaaagaacatattgaagtgg

SEQ ID NO: 154552 - DNA, 25 bp, Artificial sequence
  SiRNA target sequence
agactaaagaacatattgaagtgga

SEQ ID NO: 154553 - DNA, 25 bp, Artificial sequence
  SiRNA target sequence
gactaaagaacatattgaagtggaa

SEQ ID NO: 154554 - DNA, 25 bp, Artificial sequence
  SiRNA target sequence
actaaagaacatattgaagtggaag

SEQ ID NO: 154555 - DNA, 25 bp, Artificial sequence
  SiRNA target sequence
ctaaagaacatattgaagtggaagt

SEQ ID NO: 154556 - DNA, 25 bp, Artificial sequence
  SiRNA target sequence
taaagaacatattgaagtggaagta

SEQ ID NO: 154557 - DNA, 25 bp, Artificial sequence
  SiRNA target sequence
aaagaacatattgaagtggaagtag

SEQ ID NO: 154558 - DNA, 25 bp, Artificial sequence
  SiRNA target sequence
aagaacatattgaagtggaagtaga

SEQ ID NO: 154559 - DNA, 25 bp, Artificial sequence
  SiRNA target sequence
agaacatattgaagtggaagtagag

SEQ ID NO: 154560 - DNA, 25 bp, Artificial sequence
  SiRNA target sequence
gaacatattgaagtggaagtagagc

SEQ ID NO: 154561 - DNA, 25 bp, Artificial sequence
  SiRNA target sequence
aacatattgaagtggaagtagagcc

SEQ ID NO: 154562 - DNA, 25 bp, Artificial sequence
  SiRNA target sequence
acatattgaagtggaagtagagcca

SEQ ID NO: 154563 - DNA, 25 bp, Artificial sequence
  SiRNA target sequence
catattgaagtggaagtagagccag

SEQ ID NO: 154564 - DNA, 25 bp, Artificial sequence
  SiRNA target sequence
atattgaagtggaagtagagccagg

SEQ ID NO: 154565 - DNA, 25 bp, Artificial sequence
  SiRNA target sequence
tattgaagtggaagtagagccagga

SEQ ID NO: 154566 - DNA, 25 bp, Artificial sequence
  SiRNA target sequence
attgaagtggaagtagagccaggag

SEQ ID NO: 154567 - DNA, 25 bp, Artificial sequence
  SiRNA target sequence
ttgaagtggaagtagagccaggagt

SEQ ID NO: 154568 - DNA, 25 bp, Artificial sequence
  SiRNA target sequence
tgaagtggaagtagagccaggagta

SEQ ID NO: 154569 - DNA, 25 bp, Artificial sequence
  SiRNA target sequence
gaagtggaagtagagccaggagtac

SEQ ID NO: 154570 - DNA, 25 bp, Artificial sequence
  SiRNA target sequence
aagtggaagtagagccaggagtaca

SEQ ID NO: 154571 - DNA, 25 bp, Artificial sequence
  SiRNA target sequence
agtggaagtagagccaggagtacag

SEQ ID NO: 154572 - DNA, 25 bp, Artificial sequence
  SiRNA target sequence
gtggaagtagagccaggagtacaga

SEQ ID NO: 154573 - DNA, 25 bp, Artificial sequence
  SiRNA target sequence
tggaagtagagccaggagtacagaa

SEQ ID NO: 154574 - DNA, 25 bp, Artificial sequence
  SiRNA target sequence
ggaagtagagccaggagtacagaac

SEQ ID NO: 154575 - DNA, 25 bp, Artificial sequence
  SiRNA target sequence
gaagtagagccaggagtacagaacg

SEQ ID NO: 154576 - DNA, 25 bp, Artificial sequence
  SiRNA target sequence
aagtagagccaggagtacagaacgg

SEQ ID NO: 154577 - DNA, 25 bp, Artificial sequence
  SiRNA target sequence
agtagagccaggagtacagaacggt

SEQ ID NO: 154578 - DNA, 25 bp, Artificial sequence
  SiRNA target sequence
gtagagccaggagtacagaacggta

SEQ ID NO: 154579 - DNA, 25 bp, Artificial sequence
  SiRNA target sequence
tagagccaggagtacagaacggtag

SEQ ID NO: 154580 - DNA, 25 bp, Artificial sequence
  SiRNA target sequence
agagccaggagtacagaacggtaga

SEQ ID NO: 154581 - DNA, 25 bp, Artificial sequence
  SiRNA target sequence
gagccaggagtacagaacggtagaa

SEQ ID NO: 154582 - DNA, 25 bp, Artificial sequence
  SiRNA target sequence
agccaggagtacagaacggtagaaa

SEQ ID NO: 154583 - DNA, 25 bp, Artificial sequence
  SiRNA target sequence
gccaggagtacagaacggtagaaaa

SEQ ID NO: 154584 - DNA, 25 bp, Artificial sequence
  SiRNA target sequence
ccaggagtacagaacggtagaaaat

SEQ ID NO: 154585 - DNA, 25 bp, Artificial sequence
  SiRNA target sequence
caggagtacagaacggtagaaaata

SEQ ID NO: 154586 - DNA, 25 bp, Artificial sequence
  SiRNA target sequence
aggagtacagaacggtagaaaatat

SEQ ID NO: 154587 - DNA, 25 bp, Artificial sequence
  SiRNA target sequence
ggagtacagaacggtagaaaatata

SEQ ID NO: 154588 - DNA, 25 bp, Artificial sequence
  SiRNA target sequence
gagtacagaacggtagaaaatatac

SEQ ID NO: 154589 - DNA, 25 bp, Artificial sequence
  SiRNA target sequence
agtacagaacggtagaaaatataca

SEQ ID NO: 154590 - DNA, 25 bp, Artificial sequence
  SiRNA target sequence
gtacagaacggtagaaaatatacat

SEQ ID NO: 154591 - DNA, 25 bp, Artificial sequence
  SiRNA target sequence
tacagaacggtagaaaatatacatt

SEQ ID NO: 154592 - DNA, 25 bp, Artificial sequence
  SiRNA target sequence
acagaacggtagaaaatatacattt

SEQ ID NO: 154593 - DNA, 25 bp, Artificial sequence
  SiRNA target sequence
cagaacggtagaaaatatacatttt

SEQ ID NO: 154594 - DNA, 25 bp, Artificial sequence
  SiRNA target sequence
agaacggtagaaaatatacattttc

SEQ ID NO: 154595 - DNA, 25 bp, Artificial sequence
  SiRNA target sequence
gaacggtagaaaatatacattttct

SEQ ID NO: 154596 - DNA, 25 bp, Artificial sequence
  SiRNA target sequence
aacggtagaaaatatacattttctg

SEQ ID NO: 154597 - DNA, 25 bp, Artificial sequence
  SiRNA target sequence
acggtagaaaatatacattttctgg

SEQ ID NO: 154598 - DNA, 25 bp, Artificial sequence
  SiRNA target sequence
cggtagaaaatatacattttctggc

SEQ ID NO: 154599 - DNA, 25 bp, Artificial sequence
  SiRNA target sequence
ggtagaaaatatacattttctggca

SEQ ID NO: 154600 - DNA, 25 bp, Artificial sequence
  SiRNA target sequence
gtagaaaatatacattttctggcaa

SEQ ID NO: 154601 - DNA, 25 bp, Artificial sequence
  SiRNA target sequence
tagaaaatatacattttctggcaaa

SEQ ID NO: 154602 - DNA, 25 bp, Artificial sequence
  SiRNA target sequence
agaaaatatacattttctggcaaag

SEQ ID NO: 154603 - DNA, 25 bp, Artificial sequence
  SiRNA target sequence
gaaaatatacattttctggcaaagg

SEQ ID NO: 154604 - DNA, 25 bp, Artificial sequence
  SiRNA target sequence
aaaatatacattttctggcaaagga

SEQ ID NO: 154605 - DNA, 25 bp, Artificial sequence
  SiRNA target sequence
aaatatacattttctggcaaaggaa

SEQ ID NO: 154606 - DNA, 25 bp, Artificial sequence
  SiRNA target sequence
aatatacattttctggcaaaggaaa

SEQ ID NO: 154607 - DNA, 25 bp, Artificial sequence
  SiRNA target sequence
atatacattttctggcaaaggaaat

SEQ ID NO: 154608 - DNA, 25 bp, Artificial sequence
  SiRNA target sequence
tatacattttctggcaaaggaaatc

SEQ ID NO: 154609 - DNA, 25 bp, Artificial sequence
  SiRNA target sequence
atacattttctggcaaaggaaatca

SEQ ID NO: 154610 - DNA, 25 bp, Artificial sequence
  SiRNA target sequence
tacattttctggcaaaggaaatcat

SEQ ID NO: 154611 - DNA, 25 bp, Artificial sequence
  SiRNA target sequence
acattttctggcaaaggaaatcata

SEQ ID NO: 154612 - DNA, 25 bp, Artificial sequence
  SiRNA target sequence
cattttctggcaaaggaaatcataa

SEQ ID NO: 154613 - DNA, 25 bp, Artificial sequence
  SiRNA target sequence
attttctggcaaaggaaatcataaa

SEQ ID NO: 154614 - DNA, 25 bp, Artificial sequence
  SiRNA target sequence
ttttctggcaaaggaaatcataaaa

SEQ ID NO: 154615 - DNA, 25 bp, Artificial sequence
  SiRNA target sequence
tttctggcaaaggaaatcataaaaa

SEQ ID NO: 154616 - DNA, 25 bp, Artificial sequence
  SiRNA target sequence
ttctggcaaaggaaatcataaaaaa

SEQ ID NO: 154617 - DNA, 25 bp, Artificial sequence
  SiRNA target sequence
tctggcaaaggaaatcataaaaaaa

SEQ ID NO: 154618 - DNA, 25 bp, Artificial sequence
  SiRNA target sequence
ctggcaaaggaaatcataaaaaaaa

SEQ ID NO: 154619 - DNA, 25 bp, Artificial sequence
  SiRNA target sequence
tggcaaaggaaatcataaaaaaaat

SEQ ID NO: 154620 - DNA, 25 bp, Artificial sequence
  SiRNA target sequence
ggcaaaggaaatcataaaaaaaatt

SEQ ID NO: 154621 - DNA, 25 bp, Artificial sequence
  SiRNA target sequence
gcaaaggaaatcataaaaaaaattg

SEQ ID NO: 154622 - DNA, 25 bp, Artificial sequence
  SiRNA target sequence
caaaggaaatcataaaaaaaattgt

SEQ ID NO: 154623 - DNA, 25 bp, Artificial sequence
  SiRNA target sequence
aaaggaaatcataaaaaaaattgtg

SEQ ID NO: 154624 - DNA, 25 bp, Artificial sequence
  SiRNA target sequence
aaggaaatcataaaaaaaattgtgt

SEQ ID NO: 154625 - DNA, 25 bp, Artificial sequence
  SiRNA target sequence
aggaaatcataaaaaaaattgtgta

SEQ ID NO: 154626 - DNA, 25 bp, Artificial sequence
  SiRNA target sequence
ggaaatcataaaaaaaattgtgtac

SEQ ID NO: 154627 - DNA, 25 bp, Artificial sequence
  SiRNA target sequence
gaaatcataaaaaaaattgtgtacc

SEQ ID NO: 154628 - DNA, 25 bp, Artificial sequence
  SiRNA target sequence
aaatcataaaaaaaattgtgtaccg

SEQ ID NO: 154629 - DNA, 25 bp, Artificial sequence
  SiRNA target sequence
aatcataaaaaaaattgtgtaccgg

SEQ ID NO: 154630 - DNA, 25 bp, Artificial sequence
  SiRNA target sequence
atcataaaaaaaattgtgtaccggg

SEQ ID NO: 154631 - DNA, 25 bp, Artificial sequence
  SiRNA target sequence
tcataaaaaaaattgtgtaccgggt

SEQ ID NO: 154632 - DNA, 25 bp, Artificial sequence
  SiRNA target sequence
cataaaaaaaattgtgtaccgggtg

SEQ ID NO: 154633 - DNA, 25 bp, Artificial sequence
  SiRNA target sequence
ataaaaaaaattgtgtaccgggtga

SEQ ID NO: 154634 - DNA, 25 bp, Artificial sequence
  SiRNA target sequence
taaaaaaaattgtgtaccgggtgat

SEQ ID NO: 154635 - DNA, 25 bp, Artificial sequence
  SiRNA target sequence
aaaaaaaattgtgtaccgggtgatg

SEQ ID NO: 154636 - DNA, 25 bp, Artificial sequence
  SiRNA target sequence
aaaaaaattgtgtaccgggtgatgt

SEQ ID NO: 154637 - DNA, 25 bp, Artificial sequence
  SiRNA target sequence
aaaaaattgtgtaccgggtgatgtg

SEQ ID NO: 154638 - DNA, 25 bp, Artificial sequence
  SiRNA target sequence
aaaaattgtgtaccgggtgatgtga

SEQ ID NO: 154639 - DNA, 25 bp, Artificial sequence
  SiRNA target sequence
aaaattgtgtaccgggtgatgtgat

SEQ ID NO: 154640 - DNA, 25 bp, Artificial sequence
  SiRNA target sequence
aaattgtgtaccgggtgatgtgatt

SEQ ID NO: 154641 - DNA, 25 bp, Artificial sequence
  SiRNA target sequence
aattgtgtaccgggtgatgtgattc

SEQ ID NO: 154642 - DNA, 25 bp, Artificial sequence
  SiRNA target sequence
attgtgtaccgggtgatgtgattct

SEQ ID NO: 154643 - DNA, 25 bp, Artificial sequence
  SiRNA target sequence
ttgtgtaccgggtgatgtgattctt

SEQ ID NO: 154644 - DNA, 25 bp, Artificial sequence
  SiRNA target sequence
tgtgtaccgggtgatgtgattctta

SEQ ID NO: 154645 - DNA, 25 bp, Artificial sequence
  SiRNA target sequence
gtgtaccgggtgatgtgattcttat

SEQ ID NO: 154646 - DNA, 25 bp, Artificial sequence
  SiRNA target sequence
tgtaccgggtgatgtgattcttatt

SEQ ID NO: 154647 - DNA, 25 bp, Artificial sequence
  SiRNA target sequence
gtaccgggtgatgtgattcttattg

SEQ ID NO: 154648 - DNA, 25 bp, Artificial sequence
  SiRNA target sequence
taccgggtgatgtgattcttattgt

SEQ ID NO: 154649 - DNA, 25 bp, Artificial sequence
  SiRNA target sequence
accgggtgatgtgattcttattgta

SEQ ID NO: 154650 - DNA, 25 bp, Artificial sequence
  SiRNA target sequence
ccgggtgatgtgattcttattgtaa

SEQ ID NO: 154651 - DNA, 25 bp, Artificial sequence
  SiRNA target sequence
cgggtgatgtgattcttattgtaaa

SEQ ID NO: 154652 - DNA, 25 bp, Artificial sequence
  SiRNA target sequence
gggtgatgtgattcttattgtaaac

SEQ ID NO: 154653 - DNA, 25 bp, Artificial sequence
  SiRNA target sequence
ggtgatgtgattcttattgtaaaca

SEQ ID NO: 154654 - DNA, 25 bp, Artificial sequence
  SiRNA target sequence
gtgatgtgattcttattgtaaacat

SEQ ID NO: 154655 - DNA, 25 bp, Artificial sequence
  SiRNA target sequence
tgatgtgattcttattgtaaacatt

SEQ ID NO: 154656 - DNA, 25 bp, Artificial sequence
  SiRNA target sequence
gatgtgattcttattgtaaacatta

SEQ ID NO: 154657 - DNA, 25 bp, Artificial sequence
  SiRNA target sequence
atgtgattcttattgtaaacattac

SEQ ID NO: 154658 - DNA, 25 bp, Artificial sequence
  SiRNA target sequence
tgtgattcttattgtaaacattaca

SEQ ID NO: 154659 - DNA, 25 bp, Artificial sequence
  SiRNA target sequence
gtgattcttattgtaaacattacaa

SEQ ID NO: 154660 - DNA, 25 bp, Artificial sequence
  SiRNA target sequence
tgattcttattgtaaacattacaaa

SEQ ID NO: 154661 - DNA, 25 bp, Artificial sequence
  SiRNA target sequence
gattcttattgtaaacattacaaat

SEQ ID NO: 154662 - DNA, 25 bp, Artificial sequence
  SiRNA target sequence
attcttattgtaaacattacaaatg

SEQ ID NO: 154663 - DNA, 25 bp, Artificial sequence
  SiRNA target sequence
ttcttattgtaaacattacaaatga

SEQ ID NO: 154664 - DNA, 25 bp, Artificial sequence
  SiRNA target sequence
tcttattgtaaacattacaaatgat

SEQ ID NO: 154665 - DNA, 25 bp, Artificial sequence
  SiRNA target sequence
cttattgtaaacattacaaatgatc

SEQ ID NO: 154666 - DNA, 25 bp, Artificial sequence
  SiRNA target sequence
ttattgtaaacattacaaatgatcc

SEQ ID NO: 154667 - DNA, 25 bp, Artificial sequence
  SiRNA target sequence
tattgtaaacattacaaatgatcca

SEQ ID NO: 154668 - DNA, 25 bp, Artificial sequence
  SiRNA target sequence
attgtaaacattacaaatgatccaa

SEQ ID NO: 154669 - DNA, 25 bp, Artificial sequence
  SiRNA target sequence
ttgtaaacattacaaatgatccaag

SEQ ID NO: 154670 - DNA, 25 bp, Artificial sequence
  SiRNA target sequence
tgtaaacattacaaatgatccaaga

SEQ ID NO: 154671 - DNA, 25 bp, Artificial sequence
  SiRNA target sequence
gtaaacattacaaatgatccaagat

SEQ ID NO: 154672 - DNA, 25 bp, Artificial sequence
  SiRNA target sequence
taaacattacaaatgatccaagatt

SEQ ID NO: 154673 - DNA, 25 bp, Artificial sequence
  SiRNA target sequence
aaacattacaaatgatccaagattt

SEQ ID NO: 154674 - DNA, 25 bp, Artificial sequence
  SiRNA target sequence
aacattacaaatgatccaagattta

SEQ ID NO: 154675 - DNA, 25 bp, Artificial sequence
  SiRNA target sequence
acattacaaatgatccaagatttag

SEQ ID NO: 154676 - DNA, 25 bp, Artificial sequence
  SiRNA target sequence
cattacaaatgatccaagatttaga

SEQ ID NO: 154677 - DNA, 25 bp, Artificial sequence
  SiRNA target sequence
attacaaatgatccaagatttagaa

SEQ ID NO: 154678 - DNA, 25 bp, Artificial sequence
  SiRNA target sequence
ttacaaatgatccaagatttagaaa

SEQ ID NO: 154679 - DNA, 25 bp, Artificial sequence
  SiRNA target sequence
tacaaatgatccaagatttagaaaa

SEQ ID NO: 154680 - DNA, 25 bp, Artificial sequence
  SiRNA target sequence
acaaatgatccaagatttagaaaaa

SEQ ID NO: 154681 - DNA, 25 bp, Artificial sequence
  SiRNA target sequence
caaatgatccaagatttagaaaaag

SEQ ID NO: 154682 - DNA, 25 bp, Artificial sequence
  SiRNA target sequence
aaatgatccaagatttagaaaaagt

SEQ ID NO: 154683 - DNA, 25 bp, Artificial sequence
  SiRNA target sequence
aatgatccaagatttagaaaaagtg

SEQ ID NO: 154684 - DNA, 25 bp, Artificial sequence
  SiRNA target sequence
atgatccaagatttagaaaaagtgg

SEQ ID NO: 154685 - DNA, 25 bp, Artificial sequence
  SiRNA target sequence
tgatccaagatttagaaaaagtgga

SEQ ID NO: 154686 - DNA, 25 bp, Artificial sequence
  SiRNA target sequence
gatccaagatttagaaaaagtggat

SEQ ID NO: 154687 - DNA, 25 bp, Artificial sequence
  SiRNA target sequence
atccaagatttagaaaaagtggata

SEQ ID NO: 154688 - DNA, 25 bp, Artificial sequence
  SiRNA target sequence
tccaagatttagaaaaagtggatat

SEQ ID NO: 154689 - DNA, 25 bp, Artificial sequence
  SiRNA target sequence
ccaagatttagaaaaagtggatata

SEQ ID NO: 154690 - DNA, 25 bp, Artificial sequence
  SiRNA target sequence
caagatttagaaaaagtggatataa

SEQ ID NO: 154691 - DNA, 25 bp, Artificial sequence
  SiRNA target sequence
aagatttagaaaaagtggatataat

SEQ ID NO: 154692 - DNA, 25 bp, Artificial sequence
  SiRNA target sequence
agatttagaaaaagtggatataatt

SEQ ID NO: 154693 - DNA, 25 bp, Artificial sequence
  SiRNA target sequence
gatttagaaaaagtggatataattt

SEQ ID NO: 154694 - DNA, 25 bp, Artificial sequence
  SiRNA target sequence
atttagaaaaagtggatataattta

SEQ ID NO: 154695 - DNA, 25 bp, Artificial sequence
  SiRNA target sequence
tttagaaaaagtggatataatttaa

SEQ ID NO: 154696 - DNA, 25 bp, Artificial sequence
  SiRNA target sequence
ttagaaaaagtggatataatttaat

SEQ ID NO: 154697 - DNA, 25 bp, Artificial sequence
  SiRNA target sequence
tagaaaaagtggatataatttaatt

SEQ ID NO: 154698 - DNA, 25 bp, Artificial sequence
  SiRNA target sequence
agaaaaagtggatataatttaatta

SEQ ID NO: 154699 - DNA, 25 bp, Artificial sequence
  SiRNA target sequence
gaaaaagtggatataatttaattag

SEQ ID NO: 154700 - DNA, 25 bp, Artificial sequence
  SiRNA target sequence
aaaaagtggatataatttaattagt

SEQ ID NO: 154701 - DNA, 25 bp, Artificial sequence
  SiRNA target sequence
aaaagtggatataatttaattagta

SEQ ID NO: 154702 - DNA, 25 bp, Artificial sequence
  SiRNA target sequence
aaagtggatataatttaattagtaa

SEQ ID NO: 154703 - DNA, 25 bp, Artificial sequence
  SiRNA target sequence
aagtggatataatttaattagtaag

SEQ ID NO: 154704 - DNA, 25 bp, Artificial sequence
  SiRNA target sequence
agtggatataatttaattagtaagg

SEQ ID NO: 154705 - DNA, 25 bp, Artificial sequence
  SiRNA target sequence
gtggatataatttaattagtaaggt

SEQ ID NO: 154706 - DNA, 25 bp, Artificial sequence
  SiRNA target sequence
tggatataatttaattagtaaggtt

SEQ ID NO: 154707 - DNA, 25 bp, Artificial sequence
  SiRNA target sequence
ggatataatttaattagtaaggttg

SEQ ID NO: 154708 - DNA, 25 bp, Artificial sequence
  SiRNA target sequence
gatataatttaattagtaaggttga

SEQ ID NO: 154709 - DNA, 25 bp, Artificial sequence
  SiRNA target sequence
atataatttaattagtaaggttgat

SEQ ID NO: 154710 - DNA, 25 bp, Artificial sequence
  SiRNA target sequence
tataatttaattagtaaggttgata

SEQ ID NO: 154711 - DNA, 25 bp, Artificial sequence
  SiRNA target sequence
ataatttaattagtaaggttgatat

SEQ ID NO: 154712 - DNA, 25 bp, Artificial sequence
  SiRNA target sequence
taatttaattagtaaggttgatatt

SEQ ID NO: 154713 - DNA, 25 bp, Artificial sequence
  SiRNA target sequence
aatttaattagtaaggttgatattc

SEQ ID NO: 154714 - DNA, 25 bp, Artificial sequence
  SiRNA target sequence
atttaattagtaaggttgatattcc

SEQ ID NO: 154715 - DNA, 25 bp, Artificial sequence
  SiRNA target sequence
tttaattagtaaggttgatattcca

SEQ ID NO: 154716 - DNA, 25 bp, Artificial sequence
  SiRNA target sequence
ttaattagtaaggttgatattccat

SEQ ID NO: 154717 - DNA, 25 bp, Artificial sequence
  SiRNA target sequence
taattagtaaggttgatattccatt

SEQ ID NO: 154718 - DNA, 25 bp, Artificial sequence
  SiRNA target sequence
aattagtaaggttgatattccattg

SEQ ID NO: 154719 - DNA, 25 bp, Artificial sequence
  SiRNA target sequence
attagtaaggttgatattccattgt

SEQ ID NO: 154720 - DNA, 25 bp, Artificial sequence
  SiRNA target sequence
ttagtaaggttgatattccattgta

SEQ ID NO: 154721 - DNA, 25 bp, Artificial sequence
  SiRNA target sequence
tagtaaggttgatattccattgtat

SEQ ID NO: 154722 - DNA, 25 bp, Artificial sequence
  SiRNA target sequence
agtaaggttgatattccattgtatg

SEQ ID NO: 154723 - DNA, 25 bp, Artificial sequence
  SiRNA target sequence
gtaaggttgatattccattgtatgt

SEQ ID NO: 154724 - DNA, 25 bp, Artificial sequence
  SiRNA target sequence
taaggttgatattccattgtatgtt

SEQ ID NO: 154725 - DNA, 25 bp, Artificial sequence
  SiRNA target sequence
aaggttgatattccattgtatgttg

SEQ ID NO: 154726 - DNA, 25 bp, Artificial sequence
  SiRNA target sequence
aggttgatattccattgtatgttgc

SEQ ID NO: 154727 - DNA, 25 bp, Artificial sequence
  SiRNA target sequence
ggttgatattccattgtatgttgct

SEQ ID NO: 154728 - DNA, 25 bp, Artificial sequence
  SiRNA target sequence
gttgatattccattgtatgttgctt

SEQ ID NO: 154729 - DNA, 25 bp, Artificial sequence
  SiRNA target sequence
ttgatattccattgtatgttgcttt

SEQ ID NO: 154730 - DNA, 25 bp, Artificial sequence
  SiRNA target sequence
tgatattccattgtatgttgctttg

SEQ ID NO: 154731 - DNA, 25 bp, Artificial sequence
  SiRNA target sequence
gatattccattgtatgttgctttgg

SEQ ID NO: 154732 - DNA, 25 bp, Artificial sequence
  SiRNA target sequence
atattccattgtatgttgctttggc

SEQ ID NO: 154733 - DNA, 25 bp, Artificial sequence
  SiRNA target sequence
tattccattgtatgttgctttggca

SEQ ID NO: 154734 - DNA, 25 bp, Artificial sequence
  SiRNA target sequence
attccattgtatgttgctttggcag

SEQ ID NO: 154735 - DNA, 25 bp, Artificial sequence
  SiRNA target sequence
ttccattgtatgttgctttggcagg

SEQ ID NO: 154736 - DNA, 25 bp, Artificial sequence
  SiRNA target sequence
tccattgtatgttgctttggcaggc

SEQ ID NO: 154737 - DNA, 25 bp, Artificial sequence
  SiRNA target sequence
ccattgtatgttgctttggcaggcg

SEQ ID NO: 154738 - DNA, 25 bp, Artificial sequence
  SiRNA target sequence
cattgtatgttgctttggcaggcgg

SEQ ID NO: 154739 - DNA, 25 bp, Artificial sequence
  SiRNA target sequence
attgtatgttgctttggcaggcgga

SEQ ID NO: 154740 - DNA, 25 bp, Artificial sequence
  SiRNA target sequence
ttgtatgttgctttggcaggcggac

SEQ ID NO: 154741 - DNA, 25 bp, Artificial sequence
  SiRNA target sequence
tgtatgttgctttggcaggcggaca

SEQ ID NO: 154742 - DNA, 25 bp, Artificial sequence
  SiRNA target sequence
gtatgttgctttggcaggcggacag

SEQ ID NO: 154743 - DNA, 25 bp, Artificial sequence
  SiRNA target sequence
tatgttgctttggcaggcggacaga

SEQ ID NO: 154744 - DNA, 25 bp, Artificial sequence
  SiRNA target sequence
atgttgctttggcaggcggacagat

SEQ ID NO: 154745 - DNA, 25 bp, Artificial sequence
  SiRNA target sequence
tgttgctttggcaggcggacagatt

SEQ ID NO: 154746 - DNA, 25 bp, Artificial sequence
  SiRNA target sequence
gttgctttggcaggcggacagatta

SEQ ID NO: 154747 - DNA, 25 bp, Artificial sequence
  SiRNA target sequence
ttgctttggcaggcggacagattat

SEQ ID NO: 154748 - DNA, 25 bp, Artificial sequence
  SiRNA target sequence
tgctttggcaggcggacagattata

SEQ ID NO: 154749 - DNA, 25 bp, Artificial sequence
  SiRNA target sequence
gctttggcaggcggacagattatat

SEQ ID NO: 154750 - DNA, 25 bp, Artificial sequence
  SiRNA target sequence
ctttggcaggcggacagattatatt

SEQ ID NO: 154751 - DNA, 25 bp, Artificial sequence
  SiRNA target sequence
tttggcaggcggacagattatattt

SEQ ID NO: 154752 - DNA, 25 bp, Artificial sequence
  SiRNA target sequence
ttggcaggcggacagattatatttg

SEQ ID NO: 154753 - DNA, 25 bp, Artificial sequence
  SiRNA target sequence
tggcaggcggacagattatatttga

SEQ ID NO: 154754 - DNA, 25 bp, Artificial sequence
  SiRNA target sequence
ggcaggcggacagattatatttgaa

SEQ ID NO: 154755 - DNA, 25 bp, Artificial sequence
  SiRNA target sequence
gcaggcggacagattatatttgaac

SEQ ID NO: 154756 - DNA, 25 bp, Artificial sequence
  SiRNA target sequence
caggcggacagattatatttgaaca

SEQ ID NO: 154757 - DNA, 25 bp, Artificial sequence
  SiRNA target sequence
aggcggacagattatatttgaacat

SEQ ID NO: 154758 - DNA, 25 bp, Artificial sequence
  SiRNA target sequence
ggcggacagattatatttgaacata

SEQ ID NO: 154759 - DNA, 25 bp, Artificial sequence
  SiRNA target sequence
gcggacagattatatttgaacatat

SEQ ID NO: 154760 - DNA, 25 bp, Artificial sequence
  SiRNA target sequence
cggacagattatatttgaacatatc

SEQ ID NO: 154761 - DNA, 25 bp, Artificial sequence
  SiRNA target sequence
ggacagattatatttgaacatatca

SEQ ID NO: 154762 - DNA, 25 bp, Artificial sequence
  SiRNA target sequence
gacagattatatttgaacatatcac

SEQ ID NO: 154763 - DNA, 25 bp, Artificial sequence
  SiRNA target sequence
acagattatatttgaacatatcact

SEQ ID NO: 154764 - DNA, 25 bp, Artificial sequence
  SiRNA target sequence
cagattatatttgaacatatcactg

SEQ ID NO: 154765 - DNA, 25 bp, Artificial sequence
  SiRNA target sequence
agattatatttgaacatatcactgg

SEQ ID NO: 154766 - DNA, 25 bp, Artificial sequence
  SiRNA target sequence
gattatatttgaacatatcactggt

SEQ ID NO: 154767 - DNA, 25 bp, Artificial sequence
  SiRNA target sequence
attatatttgaacatatcactggta

SEQ ID NO: 154768 - DNA, 25 bp, Artificial sequence
  SiRNA target sequence
ttatatttgaacatatcactggtaa

SEQ ID NO: 154769 - DNA, 25 bp, Artificial sequence
  SiRNA target sequence
tatatttgaacatatcactggtaag

SEQ ID NO: 154770 - DNA, 25 bp, Artificial sequence
  SiRNA target sequence
atatttgaacatatcactggtaaga

SEQ ID NO: 154771 - DNA, 25 bp, Artificial sequence
  SiRNA target sequence
tatttgaacatatcactggtaagaa

SEQ ID NO: 154772 - DNA, 25 bp, Artificial sequence
  SiRNA target sequence
atttgaacatatcactggtaagaaa

SEQ ID NO: 154773 - DNA, 25 bp, Artificial sequence
  SiRNA target sequence
tttgaacatatcactggtaagaaat

SEQ ID NO: 154774 - DNA, 25 bp, Artificial sequence
  SiRNA target sequence
ttgaacatatcactggtaagaaatt

SEQ ID NO: 154775 - DNA, 25 bp, Artificial sequence
  SiRNA target sequence
tgaacatatcactggtaagaaattt

SEQ ID NO: 154776 - DNA, 25 bp, Artificial sequence
  SiRNA target sequence
gaacatatcactggtaagaaatttg

SEQ ID NO: 154777 - DNA, 25 bp, Artificial sequence
  SiRNA target sequence
aacatatcactggtaagaaatttga

SEQ ID NO: 154778 - DNA, 25 bp, Artificial sequence
  SiRNA target sequence
acatatcactggtaagaaatttgaa

SEQ ID NO: 154779 - DNA, 25 bp, Artificial sequence
  SiRNA target sequence
catatcactggtaagaaatttgaaa

SEQ ID NO: 154780 - DNA, 25 bp, Artificial sequence
  SiRNA target sequence
atatcactggtaagaaatttgaaat

SEQ ID NO: 154781 - DNA, 25 bp, Artificial sequence
  SiRNA target sequence
tatcactggtaagaaatttgaaatt

SEQ ID NO: 154782 - DNA, 25 bp, Artificial sequence
  SiRNA target sequence
atcactggtaagaaatttgaaatta

SEQ ID NO: 154783 - DNA, 25 bp, Artificial sequence
  SiRNA target sequence
tcactggtaagaaatttgaaattac

SEQ ID NO: 154784 - DNA, 25 bp, Artificial sequence
  SiRNA target sequence
cactggtaagaaatttgaaattact

SEQ ID NO: 154785 - DNA, 25 bp, Artificial sequence
  SiRNA target sequence
actggtaagaaatttgaaattactt

SEQ ID NO: 154786 - DNA, 25 bp, Artificial sequence
  SiRNA target sequence
ctggtaagaaatttgaaattacttt

SEQ ID NO: 154787 - DNA, 25 bp, Artificial sequence
  SiRNA target sequence
tggtaagaaatttgaaattacttta

SEQ ID NO: 154788 - DNA, 25 bp, Artificial sequence
  SiRNA target sequence
ggtaagaaatttgaaattactttat

SEQ ID NO: 154789 - DNA, 25 bp, Artificial sequence
  SiRNA target sequence
gtaagaaatttgaaattactttata

SEQ ID NO: 154790 - DNA, 25 bp, Artificial sequence
  SiRNA target sequence
taagaaatttgaaattactttatat

SEQ ID NO: 154791 - DNA, 25 bp, Artificial sequence
  SiRNA target sequence
aagaaatttgaaattactttatatc

SEQ ID NO: 154792 - DNA, 25 bp, Artificial sequence
  SiRNA target sequence
agaaatttgaaattactttatatcc

SEQ ID NO: 154793 - DNA, 25 bp, Artificial sequence
  SiRNA target sequence
gaaatttgaaattactttatatcca

SEQ ID NO: 154794 - DNA, 25 bp, Artificial sequence
  SiRNA target sequence
aaatttgaaattactttatatccat

SEQ ID NO: 154795 - DNA, 25 bp, Artificial sequence
  SiRNA target sequence
aatttgaaattactttatatccatt

SEQ ID NO: 154796 - DNA, 25 bp, Artificial sequence
  SiRNA target sequence
atttgaaattactttatatccattt

SEQ ID NO: 154797 - DNA, 25 bp, Artificial sequence
  SiRNA target sequence
tttgaaattactttatatccattta

SEQ ID NO: 154798 - DNA, 25 bp, Artificial sequence
  SiRNA target sequence
ttgaaattactttatatccatttaa

SEQ ID NO: 154799 - DNA, 25 bp, Artificial sequence
  SiRNA target sequence
tgaaattactttatatccatttaaa

SEQ ID NO: 154800 - DNA, 25 bp, Artificial sequence
  SiRNA target sequence
gaaattactttatatccatttaaag

SEQ ID NO: 154801 - DNA, 25 bp, Artificial sequence
  SiRNA target sequence
aaattactttatatccatttaaaga

SEQ ID NO: 154802 - DNA, 25 bp, Artificial sequence
  SiRNA target sequence
aattactttatatccatttaaagat

SEQ ID NO: 154803 - DNA, 25 bp, Artificial sequence
  SiRNA target sequence
attactttatatccatttaaagatt

SEQ ID NO: 154804 - DNA, 25 bp, Artificial sequence
  SiRNA target sequence
ttactttatatccatttaaagattt

SEQ ID NO: 154805 - DNA, 25 bp, Artificial sequence
  SiRNA target sequence
tactttatatccatttaaagattta

SEQ ID NO: 154806 - DNA, 25 bp, Artificial sequence
  SiRNA target sequence
actttatatccatttaaagatttaa

SEQ ID NO: 154807 - DNA, 25 bp, Artificial sequence
  SiRNA target sequence
ctttatatccatttaaagatttaaa

SEQ ID NO: 154808 - DNA, 25 bp, Artificial sequence
  SiRNA target sequence
tttatatccatttaaagatttaaag

SEQ ID NO: 154809 - DNA, 25 bp, Artificial sequence
  SiRNA target sequence
ttatatccatttaaagatttaaaga

SEQ ID NO: 154810 - DNA, 25 bp, Artificial sequence
  SiRNA target sequence
tatatccatttaaagatttaaagaa

SEQ ID NO: 154811 - DNA, 25 bp, Artificial sequence
  SiRNA target sequence
atatccatttaaagatttaaagaaa

SEQ ID NO: 154812 - DNA, 25 bp, Artificial sequence
  SiRNA target sequence
tatccatttaaagatttaaagaaat

SEQ ID NO: 154813 - DNA, 25 bp, Artificial sequence
  SiRNA target sequence
atccatttaaagatttaaagaaatg

SEQ ID NO: 154814 - DNA, 25 bp, Artificial sequence
  SiRNA target sequence
tccatttaaagatttaaagaaatgt

SEQ ID NO: 154815 - DNA, 25 bp, Artificial sequence
  SiRNA target sequence
ccatttaaagatttaaagaaatgta

SEQ ID NO: 154816 - DNA, 25 bp, Artificial sequence
  SiRNA target sequence
catttaaagatttaaagaaatgtat

SEQ ID NO: 154817 - DNA, 25 bp, Artificial sequence
  SiRNA target sequence
atttaaagatttaaagaaatgtatt

SEQ ID NO: 154818 - DNA, 25 bp, Artificial sequence
  SiRNA target sequence
tttaaagatttaaagaaatgtatta

SEQ ID NO: 154819 - DNA, 25 bp, Artificial sequence
  SiRNA target sequence
ttaaagatttaaagaaatgtattat

SEQ ID NO: 154820 - DNA, 25 bp, Artificial sequence
  SiRNA target sequence
taaagatttaaagaaatgtattatt

SEQ ID NO: 154821 - DNA, 25 bp, Artificial sequence
  SiRNA target sequence
aaagatttaaagaaatgtattattt

SEQ ID NO: 154822 - DNA, 25 bp, Artificial sequence
  SiRNA target sequence
aagatttaaagaaatgtattatttt

SEQ ID NO: 154823 - DNA, 25 bp, Artificial sequence
  SiRNA target sequence
agatttaaagaaatgtattatttta

SEQ ID NO: 154824 - DNA, 25 bp, Artificial sequence
  SiRNA target sequence
gatttaaagaaatgtattattttaa

SEQ ID NO: 154825 - DNA, 25 bp, Artificial sequence
  SiRNA target sequence
atttaaagaaatgtattattttaaa

SEQ ID NO: 154826 - DNA, 25 bp, Artificial sequence
  SiRNA target sequence
tttaaagaaatgtattattttaaaa

SEQ ID NO: 154827 - DNA, 25 bp, Artificial sequence
  SiRNA target sequence
ttaaagaaatgtattattttaaaag

SEQ ID NO: 154828 - DNA, 25 bp, Artificial sequence
  SiRNA target sequence
taaagaaatgtattattttaaaagg

SEQ ID NO: 154829 - DNA, 25 bp, Artificial sequence
  SiRNA target sequence
aaagaaatgtattattttaaaaggc

SEQ ID NO: 154830 - DNA, 25 bp, Artificial sequence
  SiRNA target sequence
aagaaatgtattattttaaaaggcg

SEQ ID NO: 154831 - DNA, 25 bp, Artificial sequence
  SiRNA target sequence
agaaatgtattattttaaaaggcga

SEQ ID NO: 154832 - DNA, 25 bp, Artificial sequence
  SiRNA target sequence
gaaatgtattattttaaaaggcgaa

SEQ ID NO: 154833 - DNA, 25 bp, Artificial sequence
  SiRNA target sequence
aaatgtattattttaaaaggcgaag

SEQ ID NO: 154834 - DNA, 25 bp, Artificial sequence
  SiRNA target sequence
aatgtattattttaaaaggcgaagg

SEQ ID NO: 154835 - DNA, 25 bp, Artificial sequence
  SiRNA target sequence
atgtattattttaaaaggcgaaggt

SEQ ID NO: 154836 - DNA, 25 bp, Artificial sequence
  SiRNA target sequence
tgtattattttaaaaggcgaaggtt

SEQ ID NO: 154837 - DNA, 25 bp, Artificial sequence
  SiRNA target sequence
gtattattttaaaaggcgaaggttt

SEQ ID NO: 154838 - DNA, 25 bp, Artificial sequence
  SiRNA target sequence
tattattttaaaaggcgaaggtttt

SEQ ID NO: 154839 - DNA, 25 bp, Artificial sequence
  SiRNA target sequence
attattttaaaaggcgaaggtttta

SEQ ID NO: 154840 - DNA, 25 bp, Artificial sequence
  SiRNA target sequence
ttattttaaaaggcgaaggttttaa

SEQ ID NO: 154841 - DNA, 25 bp, Artificial sequence
  SiRNA target sequence
tattttaaaaggcgaaggttttaaa

SEQ ID NO: 154842 - DNA, 25 bp, Artificial sequence
  SiRNA target sequence
attttaaaaggcgaaggttttaaaa

SEQ ID NO: 154843 - DNA, 25 bp, Artificial sequence
  SiRNA target sequence
ttttaaaaggcgaaggttttaaaat

SEQ ID NO: 154844 - DNA, 25 bp, Artificial sequence
  SiRNA target sequence
tttaaaaggcgaaggttttaaaata

SEQ ID NO: 154845 - DNA, 25 bp, Artificial sequence
  SiRNA target sequence
ttaaaaggcgaaggttttaaaataa

SEQ ID NO: 154846 - DNA, 25 bp, Artificial sequence
  SiRNA target sequence
taaaaggcgaaggttttaaaataaa

SEQ ID NO: 154847 - DNA, 25 bp, Artificial sequence
  SiRNA target sequence
aaaaggcgaaggttttaaaataaaa

SEQ ID NO: 154848 - DNA, 25 bp, Artificial sequence
  SiRNA target sequence
aaaggcgaaggttttaaaataaaaa

SEQ ID NO: 154849 - DNA, 25 bp, Artificial sequence
  SiRNA target sequence
aaggcgaaggttttaaaataaaaaa

SEQ ID NO: 154850 - DNA, 25 bp, Artificial sequence
  SiRNA target sequence
aggcgaaggttttaaaataaaaaat

SEQ ID NO: 154851 - DNA, 25 bp, Artificial sequence
  SiRNA target sequence
ggcgaaggttttaaaataaaaaata

SEQ ID NO: 154852 - DNA, 25 bp, Artificial sequence
  SiRNA target sequence
gcgaaggttttaaaataaaaaatag

SEQ ID NO: 154853 - DNA, 25 bp, Artificial sequence
  SiRNA target sequence
cgaaggttttaaaataaaaaatagt

SEQ ID NO: 154854 - DNA, 25 bp, Artificial sequence
  SiRNA target sequence
gaaggttttaaaataaaaaatagtt

SEQ ID NO: 154855 - DNA, 25 bp, Artificial sequence
  SiRNA target sequence
aaggttttaaaataaaaaatagtta

SEQ ID NO: 154856 - DNA, 25 bp, Artificial sequence
  SiRNA target sequence
aggttttaaaataaaaaatagttat

SEQ ID NO: 154857 - DNA, 25 bp, Artificial sequence
  SiRNA target sequence
ggttttaaaataaaaaatagttatt

SEQ ID NO: 154858 - DNA, 25 bp, Artificial sequence
  SiRNA target sequence
gttttaaaataaaaaatagttattc

SEQ ID NO: 154859 - DNA, 25 bp, Artificial sequence
  SiRNA target sequence
ttttaaaataaaaaatagttattcg

SEQ ID NO: 154860 - DNA, 25 bp, Artificial sequence
  SiRNA target sequence
tttaaaataaaaaatagttattcgg

SEQ ID NO: 154861 - DNA, 25 bp, Artificial sequence
  SiRNA target sequence
ttaaaataaaaaatagttattcggg

SEQ ID NO: 154862 - DNA, 25 bp, Artificial sequence
  SiRNA target sequence
taaaataaaaaatagttattcgggt

SEQ ID NO: 154863 - DNA, 25 bp, Artificial sequence
  SiRNA target sequence
aaaataaaaaatagttattcgggtg

SEQ ID NO: 154864 - DNA, 25 bp, Artificial sequence
  SiRNA target sequence
aaataaaaaatagttattcgggtgg

SEQ ID NO: 154865 - DNA, 25 bp, Artificial sequence
  SiRNA target sequence
aataaaaaatagttattcgggtggt

SEQ ID NO: 154866 - DNA, 25 bp, Artificial sequence
  SiRNA target sequence
ataaaaaatagttattcgggtggtg

SEQ ID NO: 154867 - DNA, 25 bp, Artificial sequence
  SiRNA target sequence
taaaaaatagttattcgggtggtga

SEQ ID NO: 154868 - DNA, 25 bp, Artificial sequence
  SiRNA target sequence
aaaaaatagttattcgggtggtgat

SEQ ID NO: 154869 - DNA, 25 bp, Artificial sequence
  SiRNA target sequence
aaaaatagttattcgggtggtgatc

SEQ ID NO: 154870 - DNA, 25 bp, Artificial sequence
  SiRNA target sequence
aaaatagttattcgggtggtgatct

SEQ ID NO: 154871 - DNA, 25 bp, Artificial sequence
  SiRNA target sequence
aaatagttattcgggtggtgatctt

SEQ ID NO: 154872 - DNA, 25 bp, Artificial sequence
  SiRNA target sequence
aatagttattcgggtggtgatctta

SEQ ID NO: 154873 - DNA, 25 bp, Artificial sequence
  SiRNA target sequence
atagttattcgggtggtgatcttat

SEQ ID NO: 154874 - DNA, 25 bp, Artificial sequence
  SiRNA target sequence
tagttattcgggtggtgatcttatt

SEQ ID NO: 154875 - DNA, 25 bp, Artificial sequence
  SiRNA target sequence
agttattcgggtggtgatcttattc

SEQ ID NO: 154876 - DNA, 25 bp, Artificial sequence
  SiRNA target sequence
gttattcgggtggtgatcttattct

SEQ ID NO: 154877 - DNA, 25 bp, Artificial sequence
  SiRNA target sequence
ttattcgggtggtgatcttattctc

SEQ ID NO: 154878 - DNA, 25 bp, Artificial sequence
  SiRNA target sequence
tattcgggtggtgatcttattctcg

SEQ ID NO: 154879 - DNA, 25 bp, Artificial sequence
  SiRNA target sequence
attcgggtggtgatcttattctcga

SEQ ID NO: 154880 - DNA, 25 bp, Artificial sequence
  SiRNA target sequence
ttcgggtggtgatcttattctcgaa

SEQ ID NO: 154881 - DNA, 25 bp, Artificial sequence
  SiRNA target sequence
tcgggtggtgatcttattctcgaac

SEQ ID NO: 154882 - DNA, 25 bp, Artificial sequence
  SiRNA target sequence
cgggtggtgatcttattctcgaacc

SEQ ID NO: 154883 - DNA, 25 bp, Artificial sequence
  SiRNA target sequence
gggtggtgatcttattctcgaacct

SEQ ID NO: 154884 - DNA, 25 bp, Artificial sequence
  SiRNA target sequence
ggtggtgatcttattctcgaaccta

SEQ ID NO: 154885 - DNA, 25 bp, Artificial sequence
  SiRNA target sequence
gtggtgatcttattctcgaacctaa

SEQ ID NO: 154886 - DNA, 25 bp, Artificial sequence
  SiRNA target sequence
tggtgatcttattctcgaacctaat

SEQ ID NO: 154887 - DNA, 25 bp, Artificial sequence
  SiRNA target sequence
ggtgatcttattctcgaacctaata

SEQ ID NO: 154888 - DNA, 25 bp, Artificial sequence
  SiRNA target sequence
gtgatcttattctcgaacctaatat

SEQ ID NO: 154889 - DNA, 25 bp, Artificial sequence
  SiRNA target sequence
tgatcttattctcgaacctaatata

SEQ ID NO: 154890 - DNA, 25 bp, Artificial sequence
  SiRNA target sequence
gatcttattctcgaacctaatataa

SEQ ID NO: 154891 - DNA, 25 bp, Artificial sequence
  SiRNA target sequence
atcttattctcgaacctaatataat

SEQ ID NO: 154892 - DNA, 25 bp, Artificial sequence
  SiRNA target sequence
tcttattctcgaacctaatataatt

SEQ ID NO: 154893 - DNA, 25 bp, Artificial sequence
  SiRNA target sequence
cttattctcgaacctaatataatta

SEQ ID NO: 154894 - DNA, 25 bp, Artificial sequence
  SiRNA target sequence
ttattctcgaacctaatataattat

SEQ ID NO: 154895 - DNA, 25 bp, Artificial sequence
  SiRNA target sequence
tattctcgaacctaatataattata

SEQ ID NO: 154896 - DNA, 25 bp, Artificial sequence
  SiRNA target sequence
attctcgaacctaatataattatag

SEQ ID NO: 154897 - DNA, 25 bp, Artificial sequence
  SiRNA target sequence
ttctcgaacctaatataattataga

SEQ ID NO: 154898 - DNA, 25 bp, Artificial sequence
  SiRNA target sequence
tctcgaacctaatataattatagat

SEQ ID NO: 154899 - DNA, 25 bp, Artificial sequence
  SiRNA target sequence
ctcgaacctaatataattatagata

SEQ ID NO: 154900 - DNA, 25 bp, Artificial sequence
  SiRNA target sequence
tcgaacctaatataattatagataa

SEQ ID NO: 154901 - DNA, 25 bp, Artificial sequence
  SiRNA target sequence
cgaacctaatataattatagataag

SEQ ID NO: 154902 - DNA, 25 bp, Artificial sequence
  SiRNA target sequence
gaacctaatataattatagataaga

SEQ ID NO: 154903 - DNA, 25 bp, Artificial sequence
  SiRNA target sequence
aacctaatataattatagataagaa

SEQ ID NO: 154904 - DNA, 25 bp, Artificial sequence
  SiRNA target sequence
acctaatataattatagataagaat

SEQ ID NO: 154905 - DNA, 25 bp, Artificial sequence
  SiRNA target sequence
cctaatataattatagataagaata

SEQ ID NO: 154906 - DNA, 25 bp, Artificial sequence
  SiRNA target sequence
ctaatataattatagataagaatat

SEQ ID NO: 154907 - DNA, 25 bp, Artificial sequence
  SiRNA target sequence
taatataattatagataagaatatt

SEQ ID NO: 154908 - DNA, 25 bp, Artificial sequence
  SiRNA target sequence
aatataattatagataagaatattg

SEQ ID NO: 154909 - DNA, 25 bp, Artificial sequence
  SiRNA target sequence
atataattatagataagaatattga

SEQ ID NO: 154910 - DNA, 25 bp, Artificial sequence
  SiRNA target sequence
tataattatagataagaatattgat

SEQ ID NO: 154911 - DNA, 25 bp, Artificial sequence
  SiRNA target sequence
ataattatagataagaatattgata

SEQ ID NO: 154912 - DNA, 25 bp, Artificial sequence
  SiRNA target sequence
taattatagataagaatattgataa

SEQ ID NO: 154913 - DNA, 25 bp, Artificial sequence
  SiRNA target sequence
aattatagataagaatattgataaa

SEQ ID NO: 154914 - DNA, 25 bp, Artificial sequence
  SiRNA target sequence
attatagataagaatattgataaag

SEQ ID NO: 154915 - DNA, 25 bp, Artificial sequence
  SiRNA target sequence
ttatagataagaatattgataaaga

SEQ ID NO: 154916 - DNA, 25 bp, Artificial sequence
  SiRNA target sequence
tatagataagaatattgataaagat

SEQ ID NO: 154917 - DNA, 25 bp, Artificial sequence
  SiRNA target sequence
atagataagaatattgataaagatt

SEQ ID NO: 154918 - DNA, 25 bp, Artificial sequence
  SiRNA target sequence
tagataagaatattgataaagattt

SEQ ID NO: 154919 - DNA, 25 bp, Artificial sequence
  SiRNA target sequence
agataagaatattgataaagattta

SEQ ID NO: 154920 - DNA, 25 bp, Artificial sequence
  SiRNA target sequence
gataagaatattgataaagatttat

SEQ ID NO: 154921 - DNA, 25 bp, Artificial sequence
  SiRNA target sequence
ataagaatattgataaagatttatt

SEQ ID NO: 154922 - DNA, 25 bp, Artificial sequence
  SiRNA target sequence
taagaatattgataaagatttatta

SEQ ID NO: 154923 - DNA, 25 bp, Artificial sequence
  SiRNA target sequence
aagaatattgataaagatttattag

SEQ ID NO: 154924 - DNA, 25 bp, Artificial sequence
  SiRNA target sequence
agaatattgataaagatttattagc

SEQ ID NO: 154925 - DNA, 25 bp, Artificial sequence
  SiRNA target sequence
gaatattgataaagatttattagca

SEQ ID NO: 154926 - DNA, 25 bp, Artificial sequence
  SiRNA target sequence
aatattgataaagatttattagcac

SEQ ID NO: 154927 - DNA, 25 bp, Artificial sequence
  SiRNA target sequence
atattgataaagatttattagcacg

SEQ ID NO: 154928 - DNA, 25 bp, Artificial sequence
  SiRNA target sequence
tattgataaagatttattagcacgc

SEQ ID NO: 154929 - DNA, 25 bp, Artificial sequence
  SiRNA target sequence
attgataaagatttattagcacgcg

SEQ ID NO: 154930 - DNA, 25 bp, Artificial sequence
  SiRNA target sequence
ttgataaagatttattagcacgcgc

SEQ ID NO: 154931 - DNA, 25 bp, Artificial sequence
  SiRNA target sequence
tgataaagatttattagcacgcgcc

SEQ ID NO: 154932 - DNA, 25 bp, Artificial sequence
  SiRNA target sequence
gataaagatttattagcacgcgcct

SEQ ID NO: 154933 - DNA, 25 bp, Artificial sequence
  SiRNA target sequence
ataaagatttattagcacgcgcctt

SEQ ID NO: 154934 - DNA, 25 bp, Artificial sequence
  SiRNA target sequence
taaagatttattagcacgcgccttg

SEQ ID NO: 154935 - DNA, 25 bp, Artificial sequence
  SiRNA target sequence
aaagatttattagcacgcgccttga

SEQ ID NO: 154936 - DNA, 25 bp, Artificial sequence
  SiRNA target sequence
aagatttattagcacgcgccttgaa

SEQ ID NO: 154937 - DNA, 25 bp, Artificial sequence
  SiRNA target sequence
agatttattagcacgcgccttgaat

SEQ ID NO: 154938 - DNA, 25 bp, Artificial sequence
  SiRNA target sequence
gatttattagcacgcgccttgaatt

SEQ ID NO: 154939 - DNA, 25 bp, Artificial sequence
  SiRNA target sequence
atttattagcacgcgccttgaatta

SEQ ID NO: 154940 - DNA, 25 bp, Artificial sequence
  SiRNA target sequence
tttattagcacgcgccttgaattat

SEQ ID NO: 154941 - DNA, 25 bp, Artificial sequence
  SiRNA target sequence
ttattagcacgcgccttgaattatg

SEQ ID NO: 154942 - DNA, 25 bp, Artificial sequence
  SiRNA target sequence
tattagcacgcgccttgaattatgt

SEQ ID NO: 154943 - DNA, 25 bp, Artificial sequence
  SiRNA target sequence
attagcacgcgccttgaattatgtt

SEQ ID NO: 154944 - DNA, 25 bp, Artificial sequence
  SiRNA target sequence
ttagcacgcgccttgaattatgttc

SEQ ID NO: 154945 - DNA, 25 bp, Artificial sequence
  SiRNA target sequence
tagcacgcgccttgaattatgttcc

SEQ ID NO: 154946 - DNA, 25 bp, Artificial sequence
  SiRNA target sequence
agcacgcgccttgaattatgttcct

SEQ ID NO: 154947 - DNA, 25 bp, Artificial sequence
  SiRNA target sequence
gcacgcgccttgaattatgttcctg

SEQ ID NO: 154948 - DNA, 25 bp, Artificial sequence
  SiRNA target sequence
cacgcgccttgaattatgttcctgt

SEQ ID NO: 154949 - DNA, 25 bp, Artificial sequence
  SiRNA target sequence
acgcgccttgaattatgttcctgta

SEQ ID NO: 154950 - DNA, 25 bp, Artificial sequence
  SiRNA target sequence
cgcgccttgaattatgttcctgtaa

SEQ ID NO: 154951 - DNA, 25 bp, Artificial sequence
  SiRNA target sequence
gcgccttgaattatgttcctgtaag

SEQ ID NO: 154952 - DNA, 25 bp, Artificial sequence
  SiRNA target sequence
cgccttgaattatgttcctgtaaga

SEQ ID NO: 154953 - DNA, 25 bp, Artificial sequence
  SiRNA target sequence
gccttgaattatgttcctgtaagaa

SEQ ID NO: 154954 - DNA, 25 bp, Artificial sequence
  SiRNA target sequence
ccttgaattatgttcctgtaagaaa

SEQ ID NO: 154955 - DNA, 25 bp, Artificial sequence
  SiRNA target sequence
cttgaattatgttcctgtaagaaaa

SEQ ID NO: 154956 - DNA, 25 bp, Artificial sequence
  SiRNA target sequence
ttgaattatgttcctgtaagaaaag

SEQ ID NO: 154957 - DNA, 25 bp, Artificial sequence
  SiRNA target sequence
tgaattatgttcctgtaagaaaaga

SEQ ID NO: 154958 - DNA, 25 bp, Artificial sequence
  SiRNA target sequence
gaattatgttcctgtaagaaaagat

SEQ ID NO: 154959 - DNA, 25 bp, Artificial sequence
  SiRNA target sequence
aattatgttcctgtaagaaaagatt

SEQ ID NO: 154960 - DNA, 25 bp, Artificial sequence
  SiRNA target sequence
attatgttcctgtaagaaaagattt

SEQ ID NO: 154961 - DNA, 25 bp, Artificial sequence
  SiRNA target sequence
ttatgttcctgtaagaaaagatttt

SEQ ID NO: 154962 - DNA, 25 bp, Artificial sequence
  SiRNA target sequence
tatgttcctgtaagaaaagatttta

SEQ ID NO: 154963 - DNA, 25 bp, Artificial sequence
  SiRNA target sequence
atgttcctgtaagaaaagattttac

SEQ ID NO: 154964 - DNA, 25 bp, Artificial sequence
  SiRNA target sequence
tgttcctgtaagaaaagattttaca

SEQ ID NO: 154965 - DNA, 25 bp, Artificial sequence
  SiRNA target sequence
gttcctgtaagaaaagattttacag

SEQ ID NO: 154966 - DNA, 25 bp, Artificial sequence
  SiRNA target sequence
ttcctgtaagaaaagattttacagg

SEQ ID NO: 154967 - DNA, 25 bp, Artificial sequence
  SiRNA target sequence
tcctgtaagaaaagattttacagga

SEQ ID NO: 154968 - DNA, 25 bp, Artificial sequence
  SiRNA target sequence
cctgtaagaaaagattttacaggaa

SEQ ID NO: 154969 - DNA, 25 bp, Artificial sequence
  SiRNA target sequence
ctgtaagaaaagattttacaggaac

SEQ ID NO: 154970 - DNA, 25 bp, Artificial sequence
  SiRNA target sequence
tgtaagaaaagattttacaggaact

SEQ ID NO: 154971 - DNA, 25 bp, Artificial sequence
  SiRNA target sequence
gtaagaaaagattttacaggaactg

SEQ ID NO: 154972 - DNA, 25 bp, Artificial sequence
  SiRNA target sequence
taagaaaagattttacaggaactgc

SEQ ID NO: 154973 - DNA, 25 bp, Artificial sequence
  SiRNA target sequence
aagaaaagattttacaggaactgct

SEQ ID NO: 154974 - DNA, 25 bp, Artificial sequence
  SiRNA target sequence
agaaaagattttacaggaactgctg

SEQ ID NO: 154975 - DNA, 25 bp, Artificial sequence
  SiRNA target sequence
gaaaagattttacaggaactgctgt

SEQ ID NO: 154976 - DNA, 25 bp, Artificial sequence
  SiRNA target sequence
aaaagattttacaggaactgctgtt

SEQ ID NO: 154977 - DNA, 25 bp, Artificial sequence
  SiRNA target sequence
aaagattttacaggaactgctgttc

SEQ ID NO: 154978 - DNA, 25 bp, Artificial sequence
  SiRNA target sequence
aagattttacaggaactgctgttcc

SEQ ID NO: 154979 - DNA, 25 bp, Artificial sequence
  SiRNA target sequence
agattttacaggaactgctgttcca

SEQ ID NO: 154980 - DNA, 25 bp, Artificial sequence
  SiRNA target sequence
gattttacaggaactgctgttccaa

SEQ ID NO: 154981 - DNA, 25 bp, Artificial sequence
  SiRNA target sequence
attttacaggaactgctgttccaaa

SEQ ID NO: 154982 - DNA, 25 bp, Artificial sequence
  SiRNA target sequence
ttttacaggaactgctgttccaaaa

SEQ ID NO: 154983 - DNA, 25 bp, Artificial sequence
  SiRNA target sequence
tttacaggaactgctgttccaaaat

SEQ ID NO: 154984 - DNA, 25 bp, Artificial sequence
  SiRNA target sequence
ttacaggaactgctgttccaaaata

SEQ ID NO: 154985 - DNA, 25 bp, Artificial sequence
  SiRNA target sequence
tacaggaactgctgttccaaaatat

SEQ ID NO: 154986 - DNA, 25 bp, Artificial sequence
  SiRNA target sequence
acaggaactgctgttccaaaatatg

SEQ ID NO: 154987 - DNA, 25 bp, Artificial sequence
  SiRNA target sequence
caggaactgctgttccaaaatatgc

SEQ ID NO: 154988 - DNA, 25 bp, Artificial sequence
  SiRNA target sequence
aggaactgctgttccaaaatatgca

SEQ ID NO: 154989 - DNA, 25 bp, Artificial sequence
  SiRNA target sequence
ggaactgctgttccaaaatatgcag

SEQ ID NO: 154990 - DNA, 25 bp, Artificial sequence
  SiRNA target sequence
gaactgctgttccaaaatatgcaga

SEQ ID NO: 154991 - DNA, 25 bp, Artificial sequence
  SiRNA target sequence
aactgctgttccaaaatatgcagaa

SEQ ID NO: 154992 - DNA, 25 bp, Artificial sequence
  SiRNA target sequence
actgctgttccaaaatatgcagaat

SEQ ID NO: 154993 - DNA, 25 bp, Artificial sequence
  SiRNA target sequence
ctgctgttccaaaatatgcagaatt

SEQ ID NO: 154994 - DNA, 25 bp, Artificial sequence
  SiRNA target sequence
tgctgttccaaaatatgcagaattt

SEQ ID NO: 154995 - DNA, 25 bp, Artificial sequence
  SiRNA target sequence
gctgttccaaaatatgcagaatttg

SEQ ID NO: 154996 - DNA, 25 bp, Artificial sequence
  SiRNA target sequence
ctgttccaaaatatgcagaatttgg

SEQ ID NO: 154997 - DNA, 25 bp, Artificial sequence
  SiRNA target sequence
tgttccaaaatatgcagaatttggt

SEQ ID NO: 154998 - DNA, 25 bp, Artificial sequence
  SiRNA target sequence
gttccaaaatatgcagaatttggtg

SEQ ID NO: 154999 - DNA, 25 bp, Artificial sequence
  SiRNA target sequence
ttccaaaatatgcagaatttggtgt

SEQ ID NO: 155000 - DNA, 25 bp, Artificial sequence
  SiRNA target sequence
tccaaaatatgcagaatttggtgtt

SEQ ID NO: 155001 - DNA, 25 bp, Artificial sequence
  SiRNA target sequence
ccaaaatatgcagaatttggtgtta

SEQ ID NO: 155002 - DNA, 25 bp, Artificial sequence
  SiRNA target sequence
caaaatatgcagaatttggtgttat

SEQ ID NO: 155003 - DNA, 25 bp, Artificial sequence
  SiRNA target sequence
aaaatatgcagaatttggtgttatg

SEQ ID NO: 155004 - DNA, 25 bp, Artificial sequence
  SiRNA target sequence
aaatatgcagaatttggtgttatgc

SEQ ID NO: 155005 - DNA, 25 bp, Artificial sequence
  SiRNA target sequence
aatatgcagaatttggtgttatgcc

SEQ ID NO: 155006 - DNA, 25 bp, Artificial sequence
  SiRNA target sequence
atatgcagaatttggtgttatgcct

SEQ ID NO: 155007 - DNA, 25 bp, Artificial sequence
  SiRNA target sequence
tatgcagaatttggtgttatgccta

SEQ ID NO: 155008 - DNA, 25 bp, Artificial sequence
  SiRNA target sequence
atgcagaatttggtgttatgcctaa

SEQ ID NO: 155009 - DNA, 25 bp, Artificial sequence
  SiRNA target sequence
tgcagaatttggtgttatgcctaaa

SEQ ID NO: 155010 - DNA, 25 bp, Artificial sequence
  SiRNA target sequence
gcagaatttggtgttatgcctaaag

SEQ ID NO: 155011 - DNA, 25 bp, Artificial sequence
  SiRNA target sequence
cagaatttggtgttatgcctaaaga

SEQ ID NO: 155012 - DNA, 25 bp, Artificial sequence
  SiRNA target sequence
agaatttggtgttatgcctaaagaa

SEQ ID NO: 155013 - DNA, 25 bp, Artificial sequence
  SiRNA target sequence
gaatttggtgttatgcctaaagaac

SEQ ID NO: 155014 - DNA, 25 bp, Artificial sequence
  SiRNA target sequence
aatttggtgttatgcctaaagaaca

SEQ ID NO: 155015 - DNA, 25 bp, Artificial sequence
  SiRNA target sequence
atttggtgttatgcctaaagaacag

SEQ ID NO: 155016 - DNA, 25 bp, Artificial sequence
  SiRNA target sequence
tttggtgttatgcctaaagaacagg

SEQ ID NO: 155017 - DNA, 25 bp, Artificial sequence
  SiRNA target sequence
ttggtgttatgcctaaagaacagga

SEQ ID NO: 155018 - DNA, 25 bp, Artificial sequence
  SiRNA target sequence
tggtgttatgcctaaagaacaggaa

SEQ ID NO: 155019 - DNA, 25 bp, Artificial sequence
  SiRNA target sequence
ggtgttatgcctaaagaacaggaag

SEQ ID NO: 155020 - DNA, 25 bp, Artificial sequence
  SiRNA target sequence
gtgttatgcctaaagaacaggaaga

SEQ ID NO: 155021 - DNA, 25 bp, Artificial sequence
  SiRNA target sequence
tgttatgcctaaagaacaggaagaa

SEQ ID NO: 155022 - DNA, 25 bp, Artificial sequence
  SiRNA target sequence
gttatgcctaaagaacaggaagaac

SEQ ID NO: 155023 - DNA, 25 bp, Artificial sequence
  SiRNA target sequence
ttatgcctaaagaacaggaagaaca

SEQ ID NO: 155024 - DNA, 25 bp, Artificial sequence
  SiRNA target sequence
tatgcctaaagaacaggaagaacaa

SEQ ID NO: 155025 - DNA, 25 bp, Artificial sequence
  SiRNA target sequence
atgcctaaagaacaggaagaacaaa

SEQ ID NO: 155026 - DNA, 25 bp, Artificial sequence
  SiRNA target sequence
tgcctaaagaacaggaagaacaaaa

SEQ ID NO: 155027 - DNA, 25 bp, Artificial sequence
  SiRNA target sequence
gcctaaagaacaggaagaacaaaac

SEQ ID NO: 155028 - DNA, 25 bp, Artificial sequence
  SiRNA target sequence
cctaaagaacaggaagaacaaaacg

SEQ ID NO: 155029 - DNA, 25 bp, Artificial sequence
  SiRNA target sequence
ctaaagaacaggaagaacaaaacga

SEQ ID NO: 155030 - DNA, 25 bp, Artificial sequence
  SiRNA target sequence
taaagaacaggaagaacaaaacgaa

SEQ ID NO: 155031 - DNA, 25 bp, Artificial sequence
  SiRNA target sequence
aaagaacaggaagaacaaaacgaaa

SEQ ID NO: 155032 - DNA, 25 bp, Artificial sequence
  SiRNA target sequence
aagaacaggaagaacaaaacgaaag

SEQ ID NO: 155033 - DNA, 25 bp, Artificial sequence
  SiRNA target sequence
agaacaggaagaacaaaacgaaaga

SEQ ID NO: 155034 - DNA, 25 bp, Artificial sequence
  SiRNA target sequence
gaacaggaagaacaaaacgaaagag

SEQ ID NO: 155035 - DNA, 25 bp, Artificial sequence
  SiRNA target sequence
aacaggaagaacaaaacgaaagaga

SEQ ID NO: 155036 - DNA, 25 bp, Artificial sequence
  SiRNA target sequence
acaggaagaacaaaacgaaagagaa

SEQ ID NO: 155037 - DNA, 25 bp, Artificial sequence
  SiRNA target sequence
caggaagaacaaaacgaaagagaaa

SEQ ID NO: 155038 - DNA, 25 bp, Artificial sequence
  SiRNA target sequence
aggaagaacaaaacgaaagagaaag

SEQ ID NO: 155039 - DNA, 25 bp, Artificial sequence
  SiRNA target sequence
ggaagaacaaaacgaaagagaaaga

SEQ ID NO: 155040 - DNA, 25 bp, Artificial sequence
  SiRNA target sequence
gaagaacaaaacgaaagagaaagat

SEQ ID NO: 155041 - DNA, 25 bp, Artificial sequence
  SiRNA target sequence
aagaacaaaacgaaagagaaagatt

SEQ ID NO: 155042 - DNA, 25 bp, Artificial sequence
  SiRNA target sequence
agaacaaaacgaaagagaaagattc

SEQ ID NO: 155043 - DNA, 25 bp, Artificial sequence
  SiRNA target sequence
gaacaaaacgaaagagaaagattcg

SEQ ID NO: 155044 - DNA, 25 bp, Artificial sequence
  SiRNA target sequence
aacaaaacgaaagagaaagattcga

SEQ ID NO: 155045 - DNA, 25 bp, Artificial sequence
  SiRNA target sequence
acaaaacgaaagagaaagattcgaa

SEQ ID NO: 155046 - DNA, 25 bp, Artificial sequence
  SiRNA target sequence
caaaacgaaagagaaagattcgaag

SEQ ID NO: 155047 - DNA, 25 bp, Artificial sequence
  SiRNA target sequence
aaaacgaaagagaaagattcgaagg

SEQ ID NO: 155048 - DNA, 25 bp, Artificial sequence
  SiRNA target sequence
aaacgaaagagaaagattcgaaggt

SEQ ID NO: 155049 - DNA, 25 bp, Artificial sequence
  SiRNA target sequence
aacgaaagagaaagattcgaaggtg

SEQ ID NO: 155050 - DNA, 25 bp, Artificial sequence
  SiRNA target sequence
acgaaagagaaagattcgaaggtgc

SEQ ID NO: 155051 - DNA, 25 bp, Artificial sequence
  SiRNA target sequence
cgaaagagaaagattcgaaggtgca

SEQ ID NO: 155052 - DNA, 25 bp, Artificial sequence
  SiRNA target sequence
gaaagagaaagattcgaaggtgcag

SEQ ID NO: 155053 - DNA, 25 bp, Artificial sequence
  SiRNA target sequence
aaagagaaagattcgaaggtgcaga

SEQ ID NO: 155054 - DNA, 25 bp, Artificial sequence
  SiRNA target sequence
aagagaaagattcgaaggtgcagaa

SEQ ID NO: 155055 - DNA, 25 bp, Artificial sequence
  SiRNA target sequence
agagaaagattcgaaggtgcagaag

SEQ ID NO: 155056 - DNA, 25 bp, Artificial sequence
  SiRNA target sequence
gagaaagattcgaaggtgcagaaga

SEQ ID NO: 155057 - DNA, 25 bp, Artificial sequence
  SiRNA target sequence
agaaagattcgaaggtgcagaagag

SEQ ID NO: 155058 - DNA, 25 bp, Artificial sequence
  SiRNA target sequence
gaaagattcgaaggtgcagaagagt

SEQ ID NO: 155059 - DNA, 25 bp, Artificial sequence
  SiRNA target sequence
aaagattcgaaggtgcagaagagtt

SEQ ID NO: 155060 - DNA, 25 bp, Artificial sequence
  SiRNA target sequence
aagattcgaaggtgcagaagagttt

SEQ ID NO: 155061 - DNA, 25 bp, Artificial sequence
  SiRNA target sequence
agattcgaaggtgcagaagagtttt

SEQ ID NO: 155062 - DNA, 25 bp, Artificial sequence
  SiRNA target sequence
gattcgaaggtgcagaagagttttt

SEQ ID NO: 155063 - DNA, 25 bp, Artificial sequence
  SiRNA target sequence
attcgaaggtgcagaagagtttttt

SEQ ID NO: 155064 - DNA, 25 bp, Artificial sequence
  SiRNA target sequence
ttcgaaggtgcagaagagttttttg

SEQ ID NO: 155065 - DNA, 25 bp, Artificial sequence
  SiRNA target sequence
tcgaaggtgcagaagagttttttgg

SEQ ID NO: 155066 - DNA, 25 bp, Artificial sequence
  SiRNA target sequence
cgaaggtgcagaagagttttttgga

SEQ ID NO: 155067 - DNA, 25 bp, Artificial sequence
  SiRNA target sequence
gaaggtgcagaagagttttttggag

SEQ ID NO: 155068 - DNA, 25 bp, Artificial sequence
  SiRNA target sequence
aaggtgcagaagagttttttggagg

SEQ ID NO: 155069 - DNA, 25 bp, Artificial sequence
  SiRNA target sequence
aggtgcagaagagttttttggagga

SEQ ID NO: 155070 - DNA, 25 bp, Artificial sequence
  SiRNA target sequence
ggtgcagaagagttttttggaggaa

SEQ ID NO: 155071 - DNA, 25 bp, Artificial sequence
  SiRNA target sequence
gtgcagaagagttttttggaggaaa

SEQ ID NO: 155072 - DNA, 25 bp, Artificial sequence
  SiRNA target sequence
tgcagaagagttttttggaggaaat

SEQ ID NO: 155073 - DNA, 25 bp, Artificial sequence
  SiRNA target sequence
gcagaagagttttttggaggaaatg

SEQ ID NO: 155074 - DNA, 25 bp, Artificial sequence
  SiRNA target sequence
cagaagagttttttggaggaaatgg

SEQ ID NO: 155075 - DNA, 25 bp, Artificial sequence
  SiRNA target sequence
agaagagttttttggaggaaatggt

SEQ ID NO: 155076 - DNA, 25 bp, Artificial sequence
  SiRNA target sequence
gaagagttttttggaggaaatggta

SEQ ID NO: 155077 - DNA, 25 bp, Artificial sequence
  SiRNA target sequence
aagagttttttggaggaaatggtag

SEQ ID NO: 155078 - DNA, 25 bp, Artificial sequence
  SiRNA target sequence
agagttttttggaggaaatggtaga

SEQ ID NO: 155079 - DNA, 25 bp, Artificial sequence
  SiRNA target sequence
gagttttttggaggaaatggtagag

SEQ ID NO: 155080 - DNA, 25 bp, Artificial sequence
  SiRNA target sequence
agttttttggaggaaatggtagaga

SEQ ID NO: 155081 - DNA, 25 bp, Artificial sequence
  SiRNA target sequence
gttttttggaggaaatggtagagat

SEQ ID NO: 155082 - DNA, 25 bp, Artificial sequence
  SiRNA target sequence
ttttttggaggaaatggtagagatt

SEQ ID NO: 155083 - DNA, 25 bp, Artificial sequence
  SiRNA target sequence
tttttggaggaaatggtagagattt

SEQ ID NO: 155084 - DNA, 25 bp, Artificial sequence
  SiRNA target sequence
ttttggaggaaatggtagagatttt

SEQ ID NO: 155085 - DNA, 25 bp, Artificial sequence
  SiRNA target sequence
tttggaggaaatggtagagattttt

SEQ ID NO: 155086 - DNA, 25 bp, Artificial sequence
  SiRNA target sequence
ttggaggaaatggtagagatttttt

SEQ ID NO: 155087 - DNA, 25 bp, Artificial sequence
  SiRNA target sequence
tggaggaaatggtagagattttttt

SEQ ID NO: 155088 - DNA, 25 bp, Artificial sequence
  SiRNA target sequence
ggaggaaatggtagagattttttta

SEQ ID NO: 155089 - DNA, 25 bp, Artificial sequence
  SiRNA target sequence
gaggaaatggtagagatttttttag

SEQ ID NO: 155090 - DNA, 25 bp, Artificial sequence
  SiRNA target sequence
aggaaatggtagagatttttttagc

SEQ ID NO: 155091 - DNA, 25 bp, Artificial sequence
  SiRNA target sequence
ggaaatggtagagatttttttagca

SEQ ID NO: 155092 - DNA, 25 bp, Artificial sequence
  SiRNA target sequence
gaaatggtagagatttttttagcaa

SEQ ID NO: 155093 - DNA, 25 bp, Artificial sequence
  SiRNA target sequence
aaatggtagagatttttttagcaag

SEQ ID NO: 155094 - DNA, 25 bp, Artificial sequence
  SiRNA target sequence
aatggtagagatttttttagcaagt

SEQ ID NO: 155095 - DNA, 25 bp, Artificial sequence
  SiRNA target sequence
atggtagagatttttttagcaagtt

SEQ ID NO: 155096 - DNA, 25 bp, Artificial sequence
  SiRNA target sequence
tggtagagatttttttagcaagttt

SEQ ID NO: 155097 - DNA, 25 bp, Artificial sequence
  SiRNA target sequence
ggtagagatttttttagcaagtttg

SEQ ID NO: 155098 - DNA, 25 bp, Artificial sequence
  SiRNA target sequence
gtagagatttttttagcaagtttgg

SEQ ID NO: 155099 - DNA, 25 bp, Artificial sequence
  SiRNA target sequence
tagagatttttttagcaagtttgga

SEQ ID NO: 155100 - DNA, 25 bp, Artificial sequence
  SiRNA target sequence
agagatttttttagcaagtttggat

SEQ ID NO: 155101 - DNA, 25 bp, Artificial sequence
  SiRNA target sequence
gagatttttttagcaagtttggatt

SEQ ID NO: 155102 - DNA, 25 bp, Artificial sequence
  SiRNA target sequence
agatttttttagcaagtttggattt

SEQ ID NO: 155103 - DNA, 25 bp, Artificial sequence
  SiRNA target sequence
gatttttttagcaagtttggatttt

SEQ ID NO: 155104 - DNA, 25 bp, Artificial sequence
  SiRNA target sequence
atttttttagcaagtttggattttt

SEQ ID NO: 155105 - DNA, 25 bp, Artificial sequence
  SiRNA target sequence
tttttttagcaagtttggatttttc

SEQ ID NO: 155106 - DNA, 25 bp, Artificial sequence
  SiRNA target sequence
ttttttagcaagtttggatttttct

SEQ ID NO: 155107 - DNA, 25 bp, Artificial sequence
  SiRNA target sequence
tttttagcaagtttggatttttcta

SEQ ID NO: 155108 - DNA, 25 bp, Artificial sequence
  SiRNA target sequence
ttttagcaagtttggatttttctaa

SEQ ID NO: 155109 - DNA, 26 bp, Artificial sequence
  SiRNA target sequence
atggcacaagacccccaaggacttta

SEQ ID NO: 155110 - DNA, 26 bp, Artificial sequence
  SiRNA target sequence
tggcacaagacccccaaggactttat

SEQ ID NO: 155111 - DNA, 26 bp, Artificial sequence
  SiRNA target sequence
ggcacaagacccccaaggactttatg

SEQ ID NO: 155112 - DNA, 26 bp, Artificial sequence
  SiRNA target sequence
gcacaagacccccaaggactttatga

SEQ ID NO: 155113 - DNA, 26 bp, Artificial sequence
  SiRNA target sequence
cacaagacccccaaggactttatgaa

SEQ ID NO: 155114 - DNA, 26 bp, Artificial sequence
  SiRNA target sequence
acaagacccccaaggactttatgaag

SEQ ID NO: 155115 - DNA, 26 bp, Artificial sequence
  SiRNA target sequence
caagacccccaaggactttatgaagt

SEQ ID NO: 155116 - DNA, 26 bp, Artificial sequence
  SiRNA target sequence
aagacccccaaggactttatgaagta

SEQ ID NO: 155117 - DNA, 26 bp, Artificial sequence
  SiRNA target sequence
agacccccaaggactttatgaagtat

SEQ ID NO: 155118 - DNA, 26 bp, Artificial sequence
  SiRNA target sequence
gacccccaaggactttatgaagtatt

SEQ ID NO: 155119 - DNA, 26 bp, Artificial sequence
  SiRNA target sequence
acccccaaggactttatgaagtatta

SEQ ID NO: 155120 - DNA, 26 bp, Artificial sequence
  SiRNA target sequence
cccccaaggactttatgaagtattag

SEQ ID NO: 155121 - DNA, 26 bp, Artificial sequence
  SiRNA target sequence
ccccaaggactttatgaagtattagg

SEQ ID NO: 155122 - DNA, 26 bp, Artificial sequence
  SiRNA target sequence
cccaaggactttatgaagtattagga

SEQ ID NO: 155123 - DNA, 26 bp, Artificial sequence
  SiRNA target sequence
ccaaggactttatgaagtattaggac

SEQ ID NO: 155124 - DNA, 26 bp, Artificial sequence
  SiRNA target sequence
caaggactttatgaagtattaggact

SEQ ID NO: 155125 - DNA, 26 bp, Artificial sequence
  SiRNA target sequence
aaggactttatgaagtattaggactt

SEQ ID NO: 155126 - DNA, 26 bp, Artificial sequence
  SiRNA target sequence
aggactttatgaagtattaggactta

SEQ ID NO: 155127 - DNA, 26 bp, Artificial sequence
  SiRNA target sequence
ggactttatgaagtattaggacttaa

SEQ ID NO: 155128 - DNA, 26 bp, Artificial sequence
  SiRNA target sequence
gactttatgaagtattaggacttaaa

SEQ ID NO: 155129 - DNA, 26 bp, Artificial sequence
  SiRNA target sequence
actttatgaagtattaggacttaaag

SEQ ID NO: 155130 - DNA, 26 bp, Artificial sequence
  SiRNA target sequence
ctttatgaagtattaggacttaaagc

SEQ ID NO: 155131 - DNA, 26 bp, Artificial sequence
  SiRNA target sequence
tttatgaagtattaggacttaaagct

SEQ ID NO: 155132 - DNA, 26 bp, Artificial sequence
  SiRNA target sequence
ttatgaagtattaggacttaaagctg

SEQ ID NO: 155133 - DNA, 26 bp, Artificial sequence
  SiRNA target sequence
tatgaagtattaggacttaaagctgg

SEQ ID NO: 155134 - DNA, 26 bp, Artificial sequence
  SiRNA target sequence
atgaagtattaggacttaaagctggt

SEQ ID NO: 155135 - DNA, 26 bp, Artificial sequence
  SiRNA target sequence
tgaagtattaggacttaaagctggtg

SEQ ID NO: 155136 - DNA, 26 bp, Artificial sequence
  SiRNA target sequence
gaagtattaggacttaaagctggtgc

SEQ ID NO: 155137 - DNA, 26 bp, Artificial sequence
  SiRNA target sequence
aagtattaggacttaaagctggtgca

SEQ ID NO: 155138 - DNA, 26 bp, Artificial sequence
  SiRNA target sequence
agtattaggacttaaagctggtgcaa

SEQ ID NO: 155139 - DNA, 26 bp, Artificial sequence
  SiRNA target sequence
gtattaggacttaaagctggtgcaag

SEQ ID NO: 155140 - DNA, 26 bp, Artificial sequence
  SiRNA target sequence
tattaggacttaaagctggtgcaagc

SEQ ID NO: 155141 - DNA, 26 bp, Artificial sequence
  SiRNA target sequence
attaggacttaaagctggtgcaagca

SEQ ID NO: 155142 - DNA, 26 bp, Artificial sequence
  SiRNA target sequence
ttaggacttaaagctggtgcaagcat

SEQ ID NO: 155143 - DNA, 26 bp, Artificial sequence
  SiRNA target sequence
taggacttaaagctggtgcaagcatt

SEQ ID NO: 155144 - DNA, 26 bp, Artificial sequence
  SiRNA target sequence
aggacttaaagctggtgcaagcattg

SEQ ID NO: 155145 - DNA, 26 bp, Artificial sequence
  SiRNA target sequence
ggacttaaagctggtgcaagcattga

SEQ ID NO: 155146 - DNA, 26 bp, Artificial sequence
  SiRNA target sequence
gacttaaagctggtgcaagcattgat

SEQ ID NO: 155147 - DNA, 26 bp, Artificial sequence
  SiRNA target sequence
acttaaagctggtgcaagcattgatg

SEQ ID NO: 155148 - DNA, 26 bp, Artificial sequence
  SiRNA target sequence
cttaaagctggtgcaagcattgatga

SEQ ID NO: 155149 - DNA, 26 bp, Artificial sequence
  SiRNA target sequence
ttaaagctggtgcaagcattgatgaa

SEQ ID NO: 155150 - DNA, 26 bp, Artificial sequence
  SiRNA target sequence
taaagctggtgcaagcattgatgaag

SEQ ID NO: 155151 - DNA, 26 bp, Artificial sequence
  SiRNA target sequence
aaagctggtgcaagcattgatgaagt

SEQ ID NO: 155152 - DNA, 26 bp, Artificial sequence
  SiRNA target sequence
aagctggtgcaagcattgatgaagtt

SEQ ID NO: 155153 - DNA, 26 bp, Artificial sequence
  SiRNA target sequence
agctggtgcaagcattgatgaagtta

SEQ ID NO: 155154 - DNA, 26 bp, Artificial sequence
  SiRNA target sequence
gctggtgcaagcattgatgaagttaa

SEQ ID NO: 155155 - DNA, 26 bp, Artificial sequence
  SiRNA target sequence
ctggtgcaagcattgatgaagttaaa

SEQ ID NO: 155156 - DNA, 26 bp, Artificial sequence
  SiRNA target sequence
tggtgcaagcattgatgaagttaaaa

SEQ ID NO: 155157 - DNA, 26 bp, Artificial sequence
  SiRNA target sequence
ggtgcaagcattgatgaagttaaaaa

SEQ ID NO: 155158 - DNA, 26 bp, Artificial sequence
  SiRNA target sequence
gtgcaagcattgatgaagttaaaaaa

SEQ ID NO: 155159 - DNA, 26 bp, Artificial sequence
  SiRNA target sequence
tgcaagcattgatgaagttaaaaaag

SEQ ID NO: 155160 - DNA, 26 bp, Artificial sequence
  SiRNA target sequence
gcaagcattgatgaagttaaaaaagc

SEQ ID NO: 155161 - DNA, 26 bp, Artificial sequence
  SiRNA target sequence
caagcattgatgaagttaaaaaagca

SEQ ID NO: 155162 - DNA, 26 bp, Artificial sequence
  SiRNA target sequence
aagcattgatgaagttaaaaaagcat

SEQ ID NO: 155163 - DNA, 26 bp, Artificial sequence
  SiRNA target sequence
agcattgatgaagttaaaaaagcatt

SEQ ID NO: 155164 - DNA, 26 bp, Artificial sequence
  SiRNA target sequence
gcattgatgaagttaaaaaagcattt

SEQ ID NO: 155165 - DNA, 26 bp, Artificial sequence
  SiRNA target sequence
cattgatgaagttaaaaaagcattta

SEQ ID NO: 155166 - DNA, 26 bp, Artificial sequence
  SiRNA target sequence
attgatgaagttaaaaaagcatttac

SEQ ID NO: 155167 - DNA, 26 bp, Artificial sequence
  SiRNA target sequence
ttgatgaagttaaaaaagcatttaca

SEQ ID NO: 155168 - DNA, 26 bp, Artificial sequence
  SiRNA target sequence
tgatgaagttaaaaaagcatttacaa

SEQ ID NO: 155169 - DNA, 26 bp, Artificial sequence
  SiRNA target sequence
gatgaagttaaaaaagcatttacaaa

SEQ ID NO: 155170 - DNA, 26 bp, Artificial sequence
  SiRNA target sequence
atgaagttaaaaaagcatttacaaaa

SEQ ID NO: 155171 - DNA, 26 bp, Artificial sequence
  SiRNA target sequence
tgaagttaaaaaagcatttacaaaaa

SEQ ID NO: 155172 - DNA, 26 bp, Artificial sequence
  SiRNA target sequence
gaagttaaaaaagcatttacaaaaaa

SEQ ID NO: 155173 - DNA, 26 bp, Artificial sequence
  SiRNA target sequence
aagttaaaaaagcatttacaaaaaaa

SEQ ID NO: 155174 - DNA, 26 bp, Artificial sequence
  SiRNA target sequence
agttaaaaaagcatttacaaaaaaac

SEQ ID NO: 155175 - DNA, 26 bp, Artificial sequence
  SiRNA target sequence
gttaaaaaagcatttacaaaaaaaca

SEQ ID NO: 155176 - DNA, 26 bp, Artificial sequence
  SiRNA target sequence
ttaaaaaagcatttacaaaaaaacaa

SEQ ID NO: 155177 - DNA, 26 bp, Artificial sequence
  SiRNA target sequence
taaaaaagcatttacaaaaaaacaaa

SEQ ID NO: 155178 - DNA, 26 bp, Artificial sequence
  SiRNA target sequence
aaaaaagcatttacaaaaaaacaaag

SEQ ID NO: 155179 - DNA, 26 bp, Artificial sequence
  SiRNA target sequence
aaaaagcatttacaaaaaaacaaagg

SEQ ID NO: 155180 - DNA, 26 bp, Artificial sequence
  SiRNA target sequence
aaaagcatttacaaaaaaacaaaggg

SEQ ID NO: 155181 - DNA, 26 bp, Artificial sequence
  SiRNA target sequence
aaagcatttacaaaaaaacaaaggga

SEQ ID NO: 155182 - DNA, 26 bp, Artificial sequence
  SiRNA target sequence
aagcatttacaaaaaaacaaagggaa

SEQ ID NO: 155183 - DNA, 26 bp, Artificial sequence
  SiRNA target sequence
agcatttacaaaaaaacaaagggaat

SEQ ID NO: 155184 - DNA, 26 bp, Artificial sequence
  SiRNA target sequence
gcatttacaaaaaaacaaagggaatg

SEQ ID NO: 155185 - DNA, 26 bp, Artificial sequence
  SiRNA target sequence
catttacaaaaaaacaaagggaatgt

SEQ ID NO: 155186 - DNA, 26 bp, Artificial sequence
  SiRNA target sequence
atttacaaaaaaacaaagggaatgtc

SEQ ID NO: 155187 - DNA, 26 bp, Artificial sequence
  SiRNA target sequence
tttacaaaaaaacaaagggaatgtca

SEQ ID NO: 155188 - DNA, 26 bp, Artificial sequence
  SiRNA target sequence
ttacaaaaaaacaaagggaatgtcat

SEQ ID NO: 155189 - DNA, 26 bp, Artificial sequence
  SiRNA target sequence
tacaaaaaaacaaagggaatgtcatc

SEQ ID NO: 155190 - DNA, 26 bp, Artificial sequence
  SiRNA target sequence
acaaaaaaacaaagggaatgtcatcc

SEQ ID NO: 155191 - DNA, 26 bp, Artificial sequence
  SiRNA target sequence
caaaaaaacaaagggaatgtcatccc

SEQ ID NO: 155192 - DNA, 26 bp, Artificial sequence
  SiRNA target sequence
aaaaaaacaaagggaatgtcatcccg

SEQ ID NO: 155193 - DNA, 26 bp, Artificial sequence
  SiRNA target sequence
aaaaaacaaagggaatgtcatcccga

SEQ ID NO: 155194 - DNA, 26 bp, Artificial sequence
  SiRNA target sequence
aaaaacaaagggaatgtcatcccgat

SEQ ID NO: 155195 - DNA, 26 bp, Artificial sequence
  SiRNA target sequence
aaaacaaagggaatgtcatcccgatg

SEQ ID NO: 155196 - DNA, 26 bp, Artificial sequence
  SiRNA target sequence
aaacaaagggaatgtcatcccgatgg

SEQ ID NO: 155197 - DNA, 26 bp, Artificial sequence
  SiRNA target sequence
aacaaagggaatgtcatcccgatggt

SEQ ID NO: 155198 - DNA, 26 bp, Artificial sequence
  SiRNA target sequence
acaaagggaatgtcatcccgatggtg

SEQ ID NO: 155199 - DNA, 26 bp, Artificial sequence
  SiRNA target sequence
caaagggaatgtcatcccgatggtgc

SEQ ID NO: 155200 - DNA, 26 bp, Artificial sequence
  SiRNA target sequence
aaagggaatgtcatcccgatggtgca

SEQ ID NO: 155201 - DNA, 26 bp, Artificial sequence
  SiRNA target sequence
aagggaatgtcatcccgatggtgcat

SEQ ID NO: 155202 - DNA, 26 bp, Artificial sequence
  SiRNA target sequence
agggaatgtcatcccgatggtgcatt

SEQ ID NO: 155203 - DNA, 26 bp, Artificial sequence
  SiRNA target sequence
gggaatgtcatcccgatggtgcattt

SEQ ID NO: 155204 - DNA, 26 bp, Artificial sequence
  SiRNA target sequence
ggaatgtcatcccgatggtgcatttt

SEQ ID NO: 155205 - DNA, 26 bp, Artificial sequence
  SiRNA target sequence
gaatgtcatcccgatggtgcattttt

SEQ ID NO: 155206 - DNA, 26 bp, Artificial sequence
  SiRNA target sequence
aatgtcatcccgatggtgcatttttt

SEQ ID NO: 155207 - DNA, 26 bp, Artificial sequence
  SiRNA target sequence
atgtcatcccgatggtgcatttttta

SEQ ID NO: 155208 - DNA, 26 bp, Artificial sequence
  SiRNA target sequence
tgtcatcccgatggtgcattttttaa

SEQ ID NO: 155209 - DNA, 26 bp, Artificial sequence
  SiRNA target sequence
gtcatcccgatggtgcattttttaaa

SEQ ID NO: 155210 - DNA, 26 bp, Artificial sequence
  SiRNA target sequence
tcatcccgatggtgcattttttaaag

SEQ ID NO: 155211 - DNA, 26 bp, Artificial sequence
  SiRNA target sequence
catcccgatggtgcattttttaaagc

SEQ ID NO: 155212 - DNA, 26 bp, Artificial sequence
  SiRNA target sequence
atcccgatggtgcattttttaaagct

SEQ ID NO: 155213 - DNA, 26 bp, Artificial sequence
  SiRNA target sequence
tcccgatggtgcattttttaaagctg

SEQ ID NO: 155214 - DNA, 26 bp, Artificial sequence
  SiRNA target sequence
cccgatggtgcattttttaaagctgc

SEQ ID NO: 155215 - DNA, 26 bp, Artificial sequence
  SiRNA target sequence
ccgatggtgcattttttaaagctgct

SEQ ID NO: 155216 - DNA, 26 bp, Artificial sequence
  SiRNA target sequence
cgatggtgcattttttaaagctgctc

SEQ ID NO: 155217 - DNA, 26 bp, Artificial sequence
  SiRNA target sequence
gatggtgcattttttaaagctgctct

SEQ ID NO: 155218 - DNA, 26 bp, Artificial sequence
  SiRNA target sequence
atggtgcattttttaaagctgctctt

SEQ ID NO: 155219 - DNA, 26 bp, Artificial sequence
  SiRNA target sequence
tggtgcattttttaaagctgctctta

SEQ ID NO: 155220 - DNA, 26 bp, Artificial sequence
  SiRNA target sequence
ggtgcattttttaaagctgctcttag

SEQ ID NO: 155221 - DNA, 26 bp, Artificial sequence
  SiRNA target sequence
gtgcattttttaaagctgctcttaga

SEQ ID NO: 155222 - DNA, 26 bp, Artificial sequence
  SiRNA target sequence
tgcattttttaaagctgctcttagaa

SEQ ID NO: 155223 - DNA, 26 bp, Artificial sequence
  SiRNA target sequence
gcattttttaaagctgctcttagaaa

SEQ ID NO: 155224 - DNA, 26 bp, Artificial sequence
  SiRNA target sequence
cattttttaaagctgctcttagaaaa

SEQ ID NO: 155225 - DNA, 26 bp, Artificial sequence
  SiRNA target sequence
attttttaaagctgctcttagaaaat

SEQ ID NO: 155226 - DNA, 26 bp, Artificial sequence
  SiRNA target sequence
ttttttaaagctgctcttagaaaatg

SEQ ID NO: 155227 - DNA, 26 bp, Artificial sequence
  SiRNA target sequence
tttttaaagctgctcttagaaaatgt

SEQ ID NO: 155228 - DNA, 26 bp, Artificial sequence
  SiRNA target sequence
ttttaaagctgctcttagaaaatgta

SEQ ID NO: 155229 - DNA, 26 bp, Artificial sequence
  SiRNA target sequence
tttaaagctgctcttagaaaatgtaa

SEQ ID NO: 155230 - DNA, 26 bp, Artificial sequence
  SiRNA target sequence
ttaaagctgctcttagaaaatgtaaa

SEQ ID NO: 155231 - DNA, 26 bp, Artificial sequence
  SiRNA target sequence
taaagctgctcttagaaaatgtaaaa

SEQ ID NO: 155232 - DNA, 26 bp, Artificial sequence
  SiRNA target sequence
aaagctgctcttagaaaatgtaaaac

SEQ ID NO: 155233 - DNA, 26 bp, Artificial sequence
  SiRNA target sequence
aagctgctcttagaaaatgtaaaaca

SEQ ID NO: 155234 - DNA, 26 bp, Artificial sequence
  SiRNA target sequence
agctgctcttagaaaatgtaaaacag

SEQ ID NO: 155235 - DNA, 26 bp, Artificial sequence
  SiRNA target sequence
gctgctcttagaaaatgtaaaacaga

SEQ ID NO: 155236 - DNA, 26 bp, Artificial sequence
  SiRNA target sequence
ctgctcttagaaaatgtaaaacagat

SEQ ID NO: 155237 - DNA, 26 bp, Artificial sequence
  SiRNA target sequence
tgctcttagaaaatgtaaaacagatg

SEQ ID NO: 155238 - DNA, 26 bp, Artificial sequence
  SiRNA target sequence
gctcttagaaaatgtaaaacagatga

SEQ ID NO: 155239 - DNA, 26 bp, Artificial sequence
  SiRNA target sequence
ctcttagaaaatgtaaaacagatgaa

SEQ ID NO: 155240 - DNA, 26 bp, Artificial sequence
  SiRNA target sequence
tcttagaaaatgtaaaacagatgaag

SEQ ID NO: 155241 - DNA, 26 bp, Artificial sequence
  SiRNA target sequence
cttagaaaatgtaaaacagatgaaga

SEQ ID NO: 155242 - DNA, 26 bp, Artificial sequence
  SiRNA target sequence
ttagaaaatgtaaaacagatgaagaa

SEQ ID NO: 155243 - DNA, 26 bp, Artificial sequence
  SiRNA target sequence
tagaaaatgtaaaacagatgaagaaa

SEQ ID NO: 155244 - DNA, 26 bp, Artificial sequence
  SiRNA target sequence
agaaaatgtaaaacagatgaagaaag

SEQ ID NO: 155245 - DNA, 26 bp, Artificial sequence
  SiRNA target sequence
gaaaatgtaaaacagatgaagaaaga

SEQ ID NO: 155246 - DNA, 26 bp, Artificial sequence
  SiRNA target sequence
aaaatgtaaaacagatgaagaaagag

SEQ ID NO: 155247 - DNA, 26 bp, Artificial sequence
  SiRNA target sequence
aaatgtaaaacagatgaagaaagagc

SEQ ID NO: 155248 - DNA, 26 bp, Artificial sequence
  SiRNA target sequence
aatgtaaaacagatgaagaaagagca

SEQ ID NO: 155249 - DNA, 26 bp, Artificial sequence
  SiRNA target sequence
atgtaaaacagatgaagaaagagcaa

SEQ ID NO: 155250 - DNA, 26 bp, Artificial sequence
  SiRNA target sequence
tgtaaaacagatgaagaaagagcaaa

SEQ ID NO: 155251 - DNA, 26 bp, Artificial sequence
  SiRNA target sequence
gtaaaacagatgaagaaagagcaaaa

SEQ ID NO: 155252 - DNA, 26 bp, Artificial sequence
  SiRNA target sequence
taaaacagatgaagaaagagcaaaag

SEQ ID NO: 155253 - DNA, 26 bp, Artificial sequence
  SiRNA target sequence
aaaacagatgaagaaagagcaaaagt

SEQ ID NO: 155254 - DNA, 26 bp, Artificial sequence
  SiRNA target sequence
aaacagatgaagaaagagcaaaagtt

SEQ ID NO: 155255 - DNA, 26 bp, Artificial sequence
  SiRNA target sequence
aacagatgaagaaagagcaaaagttg

SEQ ID NO: 155256 - DNA, 26 bp, Artificial sequence
  SiRNA target sequence
acagatgaagaaagagcaaaagttga

SEQ ID NO: 155257 - DNA, 26 bp, Artificial sequence
  SiRNA target sequence
cagatgaagaaagagcaaaagttgaa

SEQ ID NO: 155258 - DNA, 26 bp, Artificial sequence
  SiRNA target sequence
agatgaagaaagagcaaaagttgaaa

SEQ ID NO: 155259 - DNA, 26 bp, Artificial sequence
  SiRNA target sequence
gatgaagaaagagcaaaagttgaaaa

SEQ ID NO: 155260 - DNA, 26 bp, Artificial sequence
  SiRNA target sequence
atgaagaaagagcaaaagttgaaaaa

SEQ ID NO: 155261 - DNA, 26 bp, Artificial sequence
  SiRNA target sequence
tgaagaaagagcaaaagttgaaaaag

SEQ ID NO: 155262 - DNA, 26 bp, Artificial sequence
  SiRNA target sequence
gaagaaagagcaaaagttgaaaaaga

SEQ ID NO: 155263 - DNA, 26 bp, Artificial sequence
  SiRNA target sequence
aagaaagagcaaaagttgaaaaagaa

SEQ ID NO: 155264 - DNA, 26 bp, Artificial sequence
  SiRNA target sequence
agaaagagcaaaagttgaaaaagaat

SEQ ID NO: 155265 - DNA, 26 bp, Artificial sequence
  SiRNA target sequence
gaaagagcaaaagttgaaaaagaatt

SEQ ID NO: 155266 - DNA, 26 bp, Artificial sequence
  SiRNA target sequence
aaagagcaaaagttgaaaaagaattt

SEQ ID NO: 155267 - DNA, 26 bp, Artificial sequence
  SiRNA target sequence
aagagcaaaagttgaaaaagaattta

SEQ ID NO: 155268 - DNA, 26 bp, Artificial sequence
  SiRNA target sequence
agagcaaaagttgaaaaagaatttaa

SEQ ID NO: 155269 - DNA, 26 bp, Artificial sequence
  SiRNA target sequence
gagcaaaagttgaaaaagaatttaaa

SEQ ID NO: 155270 - DNA, 26 bp, Artificial sequence
  SiRNA target sequence
agcaaaagttgaaaaagaatttaaag

SEQ ID NO: 155271 - DNA, 26 bp, Artificial sequence
  SiRNA target sequence
gcaaaagttgaaaaagaatttaaaga

SEQ ID NO: 155272 - DNA, 26 bp, Artificial sequence
  SiRNA target sequence
caaaagttgaaaaagaatttaaagaa

SEQ ID NO: 155273 - DNA, 26 bp, Artificial sequence
  SiRNA target sequence
aaaagttgaaaaagaatttaaagaaa

SEQ ID NO: 155274 - DNA, 26 bp, Artificial sequence
  SiRNA target sequence
aaagttgaaaaagaatttaaagaaaa

SEQ ID NO: 155275 - DNA, 26 bp, Artificial sequence
  SiRNA target sequence
aagttgaaaaagaatttaaagaaaaa

SEQ ID NO: 155276 - DNA, 26 bp, Artificial sequence
  SiRNA target sequence
agttgaaaaagaatttaaagaaaaat

SEQ ID NO: 155277 - DNA, 26 bp, Artificial sequence
  SiRNA target sequence
gttgaaaaagaatttaaagaaaaatc

SEQ ID NO: 155278 - DNA, 26 bp, Artificial sequence
  SiRNA target sequence
ttgaaaaagaatttaaagaaaaatca

SEQ ID NO: 155279 - DNA, 26 bp, Artificial sequence
  SiRNA target sequence
tgaaaaagaatttaaagaaaaatcac

SEQ ID NO: 155280 - DNA, 26 bp, Artificial sequence
  SiRNA target sequence
gaaaaagaatttaaagaaaaatcaca

SEQ ID NO: 155281 - DNA, 26 bp, Artificial sequence
  SiRNA target sequence
aaaaagaatttaaagaaaaatcacaa

SEQ ID NO: 155282 - DNA, 26 bp, Artificial sequence
  SiRNA target sequence
aaaagaatttaaagaaaaatcacaaa

SEQ ID NO: 155283 - DNA, 26 bp, Artificial sequence
  SiRNA target sequence
aaagaatttaaagaaaaatcacaaaa

SEQ ID NO: 155284 - DNA, 26 bp, Artificial sequence
  SiRNA target sequence
aagaatttaaagaaaaatcacaaaaa

SEQ ID NO: 155285 - DNA, 26 bp, Artificial sequence
  SiRNA target sequence
agaatttaaagaaaaatcacaaaaat

SEQ ID NO: 155286 - DNA, 26 bp, Artificial sequence
  SiRNA target sequence
gaatttaaagaaaaatcacaaaaatg

SEQ ID NO: 155287 - DNA, 26 bp, Artificial sequence
  SiRNA target sequence
aatttaaagaaaaatcacaaaaatgt

SEQ ID NO: 155288 - DNA, 26 bp, Artificial sequence
  SiRNA target sequence
atttaaagaaaaatcacaaaaatgta

SEQ ID NO: 155289 - DNA, 26 bp, Artificial sequence
  SiRNA target sequence
tttaaagaaaaatcacaaaaatgtaa

SEQ ID NO: 155290 - DNA, 26 bp, Artificial sequence
  SiRNA target sequence
ttaaagaaaaatcacaaaaatgtaat

SEQ ID NO: 155291 - DNA, 26 bp, Artificial sequence
  SiRNA target sequence
taaagaaaaatcacaaaaatgtaatc

SEQ ID NO: 155292 - DNA, 26 bp, Artificial sequence
  SiRNA target sequence
aaagaaaaatcacaaaaatgtaatca

SEQ ID NO: 155293 - DNA, 26 bp, Artificial sequence
  SiRNA target sequence
aagaaaaatcacaaaaatgtaatcaa

SEQ ID NO: 155294 - DNA, 26 bp, Artificial sequence
  SiRNA target sequence
agaaaaatcacaaaaatgtaatcaag

SEQ ID NO: 155295 - DNA, 26 bp, Artificial sequence
  SiRNA target sequence
gaaaaatcacaaaaatgtaatcaagc

SEQ ID NO: 155296 - DNA, 26 bp, Artificial sequence
  SiRNA target sequence
aaaaatcacaaaaatgtaatcaagct

SEQ ID NO: 155297 - DNA, 26 bp, Artificial sequence
  SiRNA target sequence
aaaatcacaaaaatgtaatcaagcta

SEQ ID NO: 155298 - DNA, 26 bp, Artificial sequence
  SiRNA target sequence
aaatcacaaaaatgtaatcaagctaa

SEQ ID NO: 155299 - DNA, 26 bp, Artificial sequence
  SiRNA target sequence
aatcacaaaaatgtaatcaagctaaa

SEQ ID NO: 155300 - DNA, 26 bp, Artificial sequence
  SiRNA target sequence
atcacaaaaatgtaatcaagctaaag

SEQ ID NO: 155301 - DNA, 26 bp, Artificial sequence
  SiRNA target sequence
tcacaaaaatgtaatcaagctaaagc

SEQ ID NO: 155302 - DNA, 26 bp, Artificial sequence
  SiRNA target sequence
cacaaaaatgtaatcaagctaaagca

SEQ ID NO: 155303 - DNA, 26 bp, Artificial sequence
  SiRNA target sequence
acaaaaatgtaatcaagctaaagcag

SEQ ID NO: 155304 - DNA, 26 bp, Artificial sequence
  SiRNA target sequence
caaaaatgtaatcaagctaaagcagt

SEQ ID NO: 155305 - DNA, 26 bp, Artificial sequence
  SiRNA target sequence
aaaaatgtaatcaagctaaagcagtt

SEQ ID NO: 155306 - DNA, 26 bp, Artificial sequence
  SiRNA target sequence
aaaatgtaatcaagctaaagcagttt

SEQ ID NO: 155307 - DNA, 26 bp, Artificial sequence
  SiRNA target sequence
aaatgtaatcaagctaaagcagtttt

SEQ ID NO: 155308 - DNA, 26 bp, Artificial sequence
  SiRNA target sequence
aatgtaatcaagctaaagcagtttta

SEQ ID NO: 155309 - DNA, 26 bp, Artificial sequence
  SiRNA target sequence
atgtaatcaagctaaagcagttttat

SEQ ID NO: 155310 - DNA, 26 bp, Artificial sequence
  SiRNA target sequence
tgtaatcaagctaaagcagttttatt

SEQ ID NO: 155311 - DNA, 26 bp, Artificial sequence
  SiRNA target sequence
gtaatcaagctaaagcagttttattt

SEQ ID NO: 155312 - DNA, 26 bp, Artificial sequence
  SiRNA target sequence
taatcaagctaaagcagttttatttg

SEQ ID NO: 155313 - DNA, 26 bp, Artificial sequence
  SiRNA target sequence
aatcaagctaaagcagttttatttga

SEQ ID NO: 155314 - DNA, 26 bp, Artificial sequence
  SiRNA target sequence
atcaagctaaagcagttttatttgat

SEQ ID NO: 155315 - DNA, 26 bp, Artificial sequence
  SiRNA target sequence
tcaagctaaagcagttttatttgatg

SEQ ID NO: 155316 - DNA, 26 bp, Artificial sequence
  SiRNA target sequence
caagctaaagcagttttatttgatga

SEQ ID NO: 155317 - DNA, 26 bp, Artificial sequence
  SiRNA target sequence
aagctaaagcagttttatttgatgag

SEQ ID NO: 155318 - DNA, 26 bp, Artificial sequence
  SiRNA target sequence
agctaaagcagttttatttgatgaga

SEQ ID NO: 155319 - DNA, 26 bp, Artificial sequence
  SiRNA target sequence
gctaaagcagttttatttgatgagaa

SEQ ID NO: 155320 - DNA, 26 bp, Artificial sequence
  SiRNA target sequence
ctaaagcagttttatttgatgagaaa

SEQ ID NO: 155321 - DNA, 26 bp, Artificial sequence
  SiRNA target sequence
taaagcagttttatttgatgagaaaa

SEQ ID NO: 155322 - DNA, 26 bp, Artificial sequence
  SiRNA target sequence
aaagcagttttatttgatgagaaaaa

SEQ ID NO: 155323 - DNA, 26 bp, Artificial sequence
  SiRNA target sequence
aagcagttttatttgatgagaaaaaa

SEQ ID NO: 155324 - DNA, 26 bp, Artificial sequence
  SiRNA target sequence
agcagttttatttgatgagaaaaaaa

SEQ ID NO: 155325 - DNA, 26 bp, Artificial sequence
  SiRNA target sequence
gcagttttatttgatgagaaaaaaaa

SEQ ID NO: 155326 - DNA, 26 bp, Artificial sequence
  SiRNA target sequence
cagttttatttgatgagaaaaaaaag

SEQ ID NO: 155327 - DNA, 26 bp, Artificial sequence
  SiRNA target sequence
agttttatttgatgagaaaaaaaagc

SEQ ID NO: 155328 - DNA, 26 bp, Artificial sequence
  SiRNA target sequence
gttttatttgatgagaaaaaaaagca

SEQ ID NO: 155329 - DNA, 26 bp, Artificial sequence
  SiRNA target sequence
ttttatttgatgagaaaaaaaagcaa

SEQ ID NO: 155330 - DNA, 26 bp, Artificial sequence
  SiRNA target sequence
tttatttgatgagaaaaaaaagcaag

SEQ ID NO: 155331 - DNA, 26 bp, Artificial sequence
  SiRNA target sequence
ttatttgatgagaaaaaaaagcaaga

SEQ ID NO: 155332 - DNA, 26 bp, Artificial sequence
  SiRNA target sequence
tatttgatgagaaaaaaaagcaagag

SEQ ID NO: 155333 - DNA, 26 bp, Artificial sequence
  SiRNA target sequence
atttgatgagaaaaaaaagcaagagt

SEQ ID NO: 155334 - DNA, 26 bp, Artificial sequence
  SiRNA target sequence
tttgatgagaaaaaaaagcaagagta

SEQ ID NO: 155335 - DNA, 26 bp, Artificial sequence
  SiRNA target sequence
ttgatgagaaaaaaaagcaagagtat

SEQ ID NO: 155336 - DNA, 26 bp, Artificial sequence
  SiRNA target sequence
tgatgagaaaaaaaagcaagagtatg

SEQ ID NO: 155337 - DNA, 26 bp, Artificial sequence
  SiRNA target sequence
gatgagaaaaaaaagcaagagtatga

SEQ ID NO: 155338 - DNA, 26 bp, Artificial sequence
  SiRNA target sequence
atgagaaaaaaaagcaagagtatgat

SEQ ID NO: 155339 - DNA, 26 bp, Artificial sequence
  SiRNA target sequence
tgagaaaaaaaagcaagagtatgata

SEQ ID NO: 155340 - DNA, 26 bp, Artificial sequence
  SiRNA target sequence
gagaaaaaaaagcaagagtatgatat

SEQ ID NO: 155341 - DNA, 26 bp, Artificial sequence
  SiRNA target sequence
agaaaaaaaagcaagagtatgatatg

SEQ ID NO: 155342 - DNA, 26 bp, Artificial sequence
  SiRNA target sequence
gaaaaaaaagcaagagtatgatatgg

SEQ ID NO: 155343 - DNA, 26 bp, Artificial sequence
  SiRNA target sequence
aaaaaaaagcaagagtatgatatggg

SEQ ID NO: 155344 - DNA, 26 bp, Artificial sequence
  SiRNA target sequence
aaaaaaagcaagagtatgatatggga

SEQ ID NO: 155345 - DNA, 26 bp, Artificial sequence
  SiRNA target sequence
aaaaaagcaagagtatgatatgggaa

SEQ ID NO: 155346 - DNA, 26 bp, Artificial sequence
  SiRNA target sequence
aaaaagcaagagtatgatatgggaat

SEQ ID NO: 155347 - DNA, 26 bp, Artificial sequence
  SiRNA target sequence
aaaagcaagagtatgatatgggaatg

SEQ ID NO: 155348 - DNA, 26 bp, Artificial sequence
  SiRNA target sequence
aaagcaagagtatgatatgggaatga

SEQ ID NO: 155349 - DNA, 26 bp, Artificial sequence
  SiRNA target sequence
aagcaagagtatgatatgggaatgac

SEQ ID NO: 155350 - DNA, 26 bp, Artificial sequence
  SiRNA target sequence
agcaagagtatgatatgggaatgact

SEQ ID NO: 155351 - DNA, 26 bp, Artificial sequence
  SiRNA target sequence
gcaagagtatgatatgggaatgactg

SEQ ID NO: 155352 - DNA, 26 bp, Artificial sequence
  SiRNA target sequence
caagagtatgatatgggaatgactgg

SEQ ID NO: 155353 - DNA, 26 bp, Artificial sequence
  SiRNA target sequence
aagagtatgatatgggaatgactggc

SEQ ID NO: 155354 - DNA, 26 bp, Artificial sequence
  SiRNA target sequence
agagtatgatatgggaatgactggcg

SEQ ID NO: 155355 - DNA, 26 bp, Artificial sequence
  SiRNA target sequence
gagtatgatatgggaatgactggcga

SEQ ID NO: 155356 - DNA, 26 bp, Artificial sequence
  SiRNA target sequence
agtatgatatgggaatgactggcgat

SEQ ID NO: 155357 - DNA, 26 bp, Artificial sequence
  SiRNA target sequence
gtatgatatgggaatgactggcgatt

SEQ ID NO: 155358 - DNA, 26 bp, Artificial sequence
  SiRNA target sequence
tatgatatgggaatgactggcgattt

SEQ ID NO: 155359 - DNA, 26 bp, Artificial sequence
  SiRNA target sequence
atgatatgggaatgactggcgatttt

SEQ ID NO: 155360 - DNA, 26 bp, Artificial sequence
  SiRNA target sequence
tgatatgggaatgactggcgattttg

SEQ ID NO: 155361 - DNA, 26 bp, Artificial sequence
  SiRNA target sequence
gatatgggaatgactggcgattttgg

SEQ ID NO: 155362 - DNA, 26 bp, Artificial sequence
  SiRNA target sequence
atatgggaatgactggcgattttgga

SEQ ID NO: 155363 - DNA, 26 bp, Artificial sequence
  SiRNA target sequence
tatgggaatgactggcgattttggat

SEQ ID NO: 155364 - DNA, 26 bp, Artificial sequence
  SiRNA target sequence
atgggaatgactggcgattttggatt

SEQ ID NO: 155365 - DNA, 26 bp, Artificial sequence
  SiRNA target sequence
tgggaatgactggcgattttggattt

SEQ ID NO: 155366 - DNA, 26 bp, Artificial sequence
  SiRNA target sequence
gggaatgactggcgattttggatttt

SEQ ID NO: 155367 - DNA, 26 bp, Artificial sequence
  SiRNA target sequence
ggaatgactggcgattttggattttc

SEQ ID NO: 155368 - DNA, 26 bp, Artificial sequence
  SiRNA target sequence
gaatgactggcgattttggattttct

SEQ ID NO: 155369 - DNA, 26 bp, Artificial sequence
  SiRNA target sequence
aatgactggcgattttggattttctg

SEQ ID NO: 155370 - DNA, 26 bp, Artificial sequence
  SiRNA target sequence
atgactggcgattttggattttctgc

SEQ ID NO: 155371 - DNA, 26 bp, Artificial sequence
  SiRNA target sequence
tgactggcgattttggattttctgca

SEQ ID NO: 155372 - DNA, 26 bp, Artificial sequence
  SiRNA target sequence
gactggcgattttggattttctgcag

SEQ ID NO: 155373 - DNA, 26 bp, Artificial sequence
  SiRNA target sequence
actggcgattttggattttctgcagg

SEQ ID NO: 155374 - DNA, 26 bp, Artificial sequence
  SiRNA target sequence
ctggcgattttggattttctgcaggt

SEQ ID NO: 155375 - DNA, 26 bp, Artificial sequence
  SiRNA target sequence
tggcgattttggattttctgcaggtg

SEQ ID NO: 155376 - DNA, 26 bp, Artificial sequence
  SiRNA target sequence
ggcgattttggattttctgcaggtgg

SEQ ID NO: 155377 - DNA, 26 bp, Artificial sequence
  SiRNA target sequence
gcgattttggattttctgcaggtggt

SEQ ID NO: 155378 - DNA, 26 bp, Artificial sequence
  SiRNA target sequence
cgattttggattttctgcaggtggtg

SEQ ID NO: 155379 - DNA, 26 bp, Artificial sequence
  SiRNA target sequence
gattttggattttctgcaggtggtgg

SEQ ID NO: 155380 - DNA, 26 bp, Artificial sequence
  SiRNA target sequence
attttggattttctgcaggtggtgga

SEQ ID NO: 155381 - DNA, 26 bp, Artificial sequence
  SiRNA target sequence
ttttggattttctgcaggtggtggag

SEQ ID NO: 155382 - DNA, 26 bp, Artificial sequence
  SiRNA target sequence
tttggattttctgcaggtggtggaga

SEQ ID NO: 155383 - DNA, 26 bp, Artificial sequence
  SiRNA target sequence
ttggattttctgcaggtggtggagac

SEQ ID NO: 155384 - DNA, 26 bp, Artificial sequence
  SiRNA target sequence
tggattttctgcaggtggtggagact

SEQ ID NO: 155385 - DNA, 26 bp, Artificial sequence
  SiRNA target sequence
ggattttctgcaggtggtggagactt

SEQ ID NO: 155386 - DNA, 26 bp, Artificial sequence
  SiRNA target sequence
gattttctgcaggtggtggagacttt

SEQ ID NO: 155387 - DNA, 26 bp, Artificial sequence
  SiRNA target sequence
attttctgcaggtggtggagactttt

SEQ ID NO: 155388 - DNA, 26 bp, Artificial sequence
  SiRNA target sequence
ttttctgcaggtggtggagacttttt

SEQ ID NO: 155389 - DNA, 26 bp, Artificial sequence
  SiRNA target sequence
tttctgcaggtggtggagactttttc

SEQ ID NO: 155390 - DNA, 26 bp, Artificial sequence
  SiRNA target sequence
ttctgcaggtggtggagactttttcg

SEQ ID NO: 155391 - DNA, 26 bp, Artificial sequence
  SiRNA target sequence
tctgcaggtggtggagactttttcga

SEQ ID NO: 155392 - DNA, 26 bp, Artificial sequence
  SiRNA target sequence
ctgcaggtggtggagactttttcgat

SEQ ID NO: 155393 - DNA, 26 bp, Artificial sequence
  SiRNA target sequence
tgcaggtggtggagactttttcgata

SEQ ID NO: 155394 - DNA, 26 bp, Artificial sequence
  SiRNA target sequence
gcaggtggtggagactttttcgatat

SEQ ID NO: 155395 - DNA, 26 bp, Artificial sequence
  SiRNA target sequence
caggtggtggagactttttcgatatt

SEQ ID NO: 155396 - DNA, 26 bp, Artificial sequence
  SiRNA target sequence
aggtggtggagactttttcgatattt

SEQ ID NO: 155397 - DNA, 26 bp, Artificial sequence
  SiRNA target sequence
ggtggtggagactttttcgatatttt

SEQ ID NO: 155398 - DNA, 26 bp, Artificial sequence
  SiRNA target sequence
gtggtggagactttttcgatattttt

SEQ ID NO: 155399 - DNA, 26 bp, Artificial sequence
  SiRNA target sequence
tggtggagactttttcgatatttttt

SEQ ID NO: 155400 - DNA, 26 bp, Artificial sequence
  SiRNA target sequence
ggtggagactttttcgatattttttc

SEQ ID NO: 155401 - DNA, 26 bp, Artificial sequence
  SiRNA target sequence
gtggagactttttcgatattttttca

SEQ ID NO: 155402 - DNA, 26 bp, Artificial sequence
  SiRNA target sequence
tggagactttttcgatattttttcaa

SEQ ID NO: 155403 - DNA, 26 bp, Artificial sequence
  SiRNA target sequence
ggagactttttcgatattttttcaag

SEQ ID NO: 155404 - DNA, 26 bp, Artificial sequence
  SiRNA target sequence
gagactttttcgatattttttcaagt

SEQ ID NO: 155405 - DNA, 26 bp, Artificial sequence
  SiRNA target sequence
agactttttcgatattttttcaagtt

SEQ ID NO: 155406 - DNA, 26 bp, Artificial sequence
  SiRNA target sequence
gactttttcgatattttttcaagttt

SEQ ID NO: 155407 - DNA, 26 bp, Artificial sequence
  SiRNA target sequence
actttttcgatattttttcaagtttt

SEQ ID NO: 155408 - DNA, 26 bp, Artificial sequence
  SiRNA target sequence
ctttttcgatattttttcaagtttta

SEQ ID NO: 155409 - DNA, 26 bp, Artificial sequence
  SiRNA target sequence
tttttcgatattttttcaagttttac

SEQ ID NO: 155410 - DNA, 26 bp, Artificial sequence
  SiRNA target sequence
ttttcgatattttttcaagttttact

SEQ ID NO: 155411 - DNA, 26 bp, Artificial sequence
  SiRNA target sequence
tttcgatattttttcaagttttactg

SEQ ID NO: 155412 - DNA, 26 bp, Artificial sequence
  SiRNA target sequence
ttcgatattttttcaagttttactgg

SEQ ID NO: 155413 - DNA, 26 bp, Artificial sequence
  SiRNA target sequence
tcgatattttttcaagttttactggt

SEQ ID NO: 155414 - DNA, 26 bp, Artificial sequence
  SiRNA target sequence
cgatattttttcaagttttactggtg

SEQ ID NO: 155415 - DNA, 26 bp, Artificial sequence
  SiRNA target sequence
gatattttttcaagttttactggtgg

SEQ ID NO: 155416 - DNA, 26 bp, Artificial sequence
  SiRNA target sequence
atattttttcaagttttactggtgga

SEQ ID NO: 155417 - DNA, 26 bp, Artificial sequence
  SiRNA target sequence
tattttttcaagttttactggtggag

SEQ ID NO: 155418 - DNA, 26 bp, Artificial sequence
  SiRNA target sequence
attttttcaagttttactggtggagg

SEQ ID NO: 155419 - DNA, 26 bp, Artificial sequence
  SiRNA target sequence
ttttttcaagttttactggtggagga

SEQ ID NO: 155420 - DNA, 26 bp, Artificial sequence
  SiRNA target sequence
tttttcaagttttactggtggaggaa

SEQ ID NO: 155421 - DNA, 26 bp, Artificial sequence
  SiRNA target sequence
ttttcaagttttactggtggaggaag

SEQ ID NO: 155422 - DNA, 26 bp, Artificial sequence
  SiRNA target sequence
tttcaagttttactggtggaggaaga

SEQ ID NO: 155423 - DNA, 26 bp, Artificial sequence
  SiRNA target sequence
ttcaagttttactggtggaggaagaa

SEQ ID NO: 155424 - DNA, 26 bp, Artificial sequence
  SiRNA target sequence
tcaagttttactggtggaggaagaag

SEQ ID NO: 155425 - DNA, 26 bp, Artificial sequence
  SiRNA target sequence
caagttttactggtggaggaagaaga

SEQ ID NO: 155426 - DNA, 26 bp, Artificial sequence
  SiRNA target sequence
aagttttactggtggaggaagaagaa

SEQ ID NO: 155427 - DNA, 26 bp, Artificial sequence
  SiRNA target sequence
agttttactggtggaggaagaagaaa

SEQ ID NO: 155428 - DNA, 26 bp, Artificial sequence
  SiRNA target sequence
gttttactggtggaggaagaagaaat

SEQ ID NO: 155429 - DNA, 26 bp, Artificial sequence
  SiRNA target sequence
ttttactggtggaggaagaagaaatc

SEQ ID NO: 155430 - DNA, 26 bp, Artificial sequence
  SiRNA target sequence
tttactggtggaggaagaagaaatcg

SEQ ID NO: 155431 - DNA, 26 bp, Artificial sequence
  SiRNA target sequence
ttactggtggaggaagaagaaatcga

SEQ ID NO: 155432 - DNA, 26 bp, Artificial sequence
  SiRNA target sequence
tactggtggaggaagaagaaatcgag

SEQ ID NO: 155433 - DNA, 26 bp, Artificial sequence
  SiRNA target sequence
actggtggaggaagaagaaatcgagt

SEQ ID NO: 155434 - DNA, 26 bp, Artificial sequence
  SiRNA target sequence
ctggtggaggaagaagaaatcgagta

SEQ ID NO: 155435 - DNA, 26 bp, Artificial sequence
  SiRNA target sequence
tggtggaggaagaagaaatcgagtac

SEQ ID NO: 155436 - DNA, 26 bp, Artificial sequence
  SiRNA target sequence
ggtggaggaagaagaaatcgagtaca

SEQ ID NO: 155437 - DNA, 26 bp, Artificial sequence
  SiRNA target sequence
gtggaggaagaagaaatcgagtacaa

SEQ ID NO: 155438 - DNA, 26 bp, Artificial sequence
  SiRNA target sequence
tggaggaagaagaaatcgagtacaaa

SEQ ID NO: 155439 - DNA, 26 bp, Artificial sequence
  SiRNA target sequence
ggaggaagaagaaatcgagtacaaaa

SEQ ID NO: 155440 - DNA, 26 bp, Artificial sequence
  SiRNA target sequence
gaggaagaagaaatcgagtacaaaaa

SEQ ID NO: 155441 - DNA, 26 bp, Artificial sequence
  SiRNA target sequence
aggaagaagaaatcgagtacaaaaag

SEQ ID NO: 155442 - DNA, 26 bp, Artificial sequence
  SiRNA target sequence
ggaagaagaaatcgagtacaaaaagt

SEQ ID NO: 155443 - DNA, 26 bp, Artificial sequence
  SiRNA target sequence
gaagaagaaatcgagtacaaaaagtt

SEQ ID NO: 155444 - DNA, 26 bp, Artificial sequence
  SiRNA target sequence
aagaagaaatcgagtacaaaaagttc

SEQ ID NO: 155445 - DNA, 26 bp, Artificial sequence
  SiRNA target sequence
agaagaaatcgagtacaaaaagttca

SEQ ID NO: 155446 - DNA, 26 bp, Artificial sequence
  SiRNA target sequence
gaagaaatcgagtacaaaaagttcaa

SEQ ID NO: 155447 - DNA, 26 bp, Artificial sequence
  SiRNA target sequence
aagaaatcgagtacaaaaagttcaag

SEQ ID NO: 155448 - DNA, 26 bp, Artificial sequence
  SiRNA target sequence
agaaatcgagtacaaaaagttcaaga

SEQ ID NO: 155449 - DNA, 26 bp, Artificial sequence
  SiRNA target sequence
gaaatcgagtacaaaaagttcaagat

SEQ ID NO: 155450 - DNA, 26 bp, Artificial sequence
  SiRNA target sequence
aaatcgagtacaaaaagttcaagata

SEQ ID NO: 155451 - DNA, 26 bp, Artificial sequence
  SiRNA target sequence
aatcgagtacaaaaagttcaagatac

SEQ ID NO: 155452 - DNA, 26 bp, Artificial sequence
  SiRNA target sequence
atcgagtacaaaaagttcaagataca

SEQ ID NO: 155453 - DNA, 26 bp, Artificial sequence
  SiRNA target sequence
tcgagtacaaaaagttcaagatacag

SEQ ID NO: 155454 - DNA, 26 bp, Artificial sequence
  SiRNA target sequence
cgagtacaaaaagttcaagatacaga

SEQ ID NO: 155455 - DNA, 26 bp, Artificial sequence
  SiRNA target sequence
gagtacaaaaagttcaagatacagaa

SEQ ID NO: 155456 - DNA, 26 bp, Artificial sequence
  SiRNA target sequence
agtacaaaaagttcaagatacagaat

SEQ ID NO: 155457 - DNA, 26 bp, Artificial sequence
  SiRNA target sequence
gtacaaaaagttcaagatacagaata

SEQ ID NO: 155458 - DNA, 26 bp, Artificial sequence
  SiRNA target sequence
tacaaaaagttcaagatacagaatac

SEQ ID NO: 155459 - DNA, 26 bp, Artificial sequence
  SiRNA target sequence
acaaaaagttcaagatacagaatacg

SEQ ID NO: 155460 - DNA, 26 bp, Artificial sequence
  SiRNA target sequence
caaaaagttcaagatacagaatacga

SEQ ID NO: 155461 - DNA, 26 bp, Artificial sequence
  SiRNA target sequence
aaaaagttcaagatacagaatacgag

SEQ ID NO: 155462 - DNA, 26 bp, Artificial sequence
  SiRNA target sequence
aaaagttcaagatacagaatacgagt

SEQ ID NO: 155463 - DNA, 26 bp, Artificial sequence
  SiRNA target sequence
aaagttcaagatacagaatacgagtt

SEQ ID NO: 155464 - DNA, 26 bp, Artificial sequence
  SiRNA target sequence
aagttcaagatacagaatacgagttt

SEQ ID NO: 155465 - DNA, 26 bp, Artificial sequence
  SiRNA target sequence
agttcaagatacagaatacgagttta

SEQ ID NO: 155466 - DNA, 26 bp, Artificial sequence
  SiRNA target sequence
gttcaagatacagaatacgagtttaa

SEQ ID NO: 155467 - DNA, 26 bp, Artificial sequence
  SiRNA target sequence
ttcaagatacagaatacgagtttaat

SEQ ID NO: 155468 - DNA, 26 bp, Artificial sequence
  SiRNA target sequence
tcaagatacagaatacgagtttaata

SEQ ID NO: 155469 - DNA, 26 bp, Artificial sequence
  SiRNA target sequence
caagatacagaatacgagtttaatat

SEQ ID NO: 155470 - DNA, 26 bp, Artificial sequence
  SiRNA target sequence
aagatacagaatacgagtttaatatt

SEQ ID NO: 155471 - DNA, 26 bp, Artificial sequence
  SiRNA target sequence
agatacagaatacgagtttaatattt

SEQ ID NO: 155472 - DNA, 26 bp, Artificial sequence
  SiRNA target sequence
gatacagaatacgagtttaatatttc

SEQ ID NO: 155473 - DNA, 26 bp, Artificial sequence
  SiRNA target sequence
atacagaatacgagtttaatatttcg

SEQ ID NO: 155474 - DNA, 26 bp, Artificial sequence
  SiRNA target sequence
tacagaatacgagtttaatatttcgt

SEQ ID NO: 155475 - DNA, 26 bp, Artificial sequence
  SiRNA target sequence
acagaatacgagtttaatatttcgtt

SEQ ID NO: 155476 - DNA, 26 bp, Artificial sequence
  SiRNA target sequence
cagaatacgagtttaatatttcgttg

SEQ ID NO: 155477 - DNA, 26 bp, Artificial sequence
  SiRNA target sequence
agaatacgagtttaatatttcgttga

SEQ ID NO: 155478 - DNA, 26 bp, Artificial sequence
  SiRNA target sequence
gaatacgagtttaatatttcgttgaa

SEQ ID NO: 155479 - DNA, 26 bp, Artificial sequence
  SiRNA target sequence
aatacgagtttaatatttcgttgaag

SEQ ID NO: 155480 - DNA, 26 bp, Artificial sequence
  SiRNA target sequence
atacgagtttaatatttcgttgaagg

SEQ ID NO: 155481 - DNA, 26 bp, Artificial sequence
  SiRNA target sequence
tacgagtttaatatttcgttgaagga

SEQ ID NO: 155482 - DNA, 26 bp, Artificial sequence
  SiRNA target sequence
acgagtttaatatttcgttgaaggaa

SEQ ID NO: 155483 - DNA, 26 bp, Artificial sequence
  SiRNA target sequence
cgagtttaatatttcgttgaaggaag

SEQ ID NO: 155484 - DNA, 26 bp, Artificial sequence
  SiRNA target sequence
gagtttaatatttcgttgaaggaagc

SEQ ID NO: 155485 - DNA, 26 bp, Artificial sequence
  SiRNA target sequence
agtttaatatttcgttgaaggaagct

SEQ ID NO: 155486 - DNA, 26 bp, Artificial sequence
  SiRNA target sequence
gtttaatatttcgttgaaggaagctt

SEQ ID NO: 155487 - DNA, 26 bp, Artificial sequence
  SiRNA target sequence
tttaatatttcgttgaaggaagctta

SEQ ID NO: 155488 - DNA, 26 bp, Artificial sequence
  SiRNA target sequence
ttaatatttcgttgaaggaagcttat

SEQ ID NO: 155489 - DNA, 26 bp, Artificial sequence
  SiRNA target sequence
taatatttcgttgaaggaagcttata

SEQ ID NO: 155490 - DNA, 26 bp, Artificial sequence
  SiRNA target sequence
aatatttcgttgaaggaagcttatat

SEQ ID NO: 155491 - DNA, 26 bp, Artificial sequence
  SiRNA target sequence
atatttcgttgaaggaagcttatatg

SEQ ID NO: 155492 - DNA, 26 bp, Artificial sequence
  SiRNA target sequence
tatttcgttgaaggaagcttatatgg

SEQ ID NO: 155493 - DNA, 26 bp, Artificial sequence
  SiRNA target sequence
atttcgttgaaggaagcttatatggg

SEQ ID NO: 155494 - DNA, 26 bp, Artificial sequence
  SiRNA target sequence
tttcgttgaaggaagcttatatggga

SEQ ID NO: 155495 - DNA, 26 bp, Artificial sequence
  SiRNA target sequence
ttcgttgaaggaagcttatatgggaa

SEQ ID NO: 155496 - DNA, 26 bp, Artificial sequence
  SiRNA target sequence
tcgttgaaggaagcttatatgggaaa

SEQ ID NO: 155497 - DNA, 26 bp, Artificial sequence
  SiRNA target sequence
cgttgaaggaagcttatatgggaaag

SEQ ID NO: 155498 - DNA, 26 bp, Artificial sequence
  SiRNA target sequence
gttgaaggaagcttatatgggaaagc

SEQ ID NO: 155499 - DNA, 26 bp, Artificial sequence
  SiRNA target sequence
ttgaaggaagcttatatgggaaagcg

SEQ ID NO: 155500 - DNA, 26 bp, Artificial sequence
  SiRNA target sequence
tgaaggaagcttatatgggaaagcga

SEQ ID NO: 155501 - DNA, 26 bp, Artificial sequence
  SiRNA target sequence
gaaggaagcttatatgggaaagcgag

SEQ ID NO: 155502 - DNA, 26 bp, Artificial sequence
  SiRNA target sequence
aaggaagcttatatgggaaagcgagc

SEQ ID NO: 155503 - DNA, 26 bp, Artificial sequence
  SiRNA target sequence
aggaagcttatatgggaaagcgagct

SEQ ID NO: 155504 - DNA, 26 bp, Artificial sequence
  SiRNA target sequence
ggaagcttatatgggaaagcgagcta

SEQ ID NO: 155505 - DNA, 26 bp, Artificial sequence
  SiRNA target sequence
gaagcttatatgggaaagcgagctag

SEQ ID NO: 155506 - DNA, 26 bp, Artificial sequence
  SiRNA target sequence
aagcttatatgggaaagcgagctagt

SEQ ID NO: 155507 - DNA, 26 bp, Artificial sequence
  SiRNA target sequence
agcttatatgggaaagcgagctagtt

SEQ ID NO: 155508 - DNA, 26 bp, Artificial sequence
  SiRNA target sequence
gcttatatgggaaagcgagctagttt

SEQ ID NO: 155509 - DNA, 26 bp, Artificial sequence
  SiRNA target sequence
cttatatgggaaagcgagctagtttt

SEQ ID NO: 155510 - DNA, 26 bp, Artificial sequence
  SiRNA target sequence
ttatatgggaaagcgagctagtttta

SEQ ID NO: 155511 - DNA, 26 bp, Artificial sequence
  SiRNA target sequence
tatatgggaaagcgagctagttttaa

SEQ ID NO: 155512 - DNA, 26 bp, Artificial sequence
  SiRNA target sequence
atatgggaaagcgagctagttttaat

SEQ ID NO: 155513 - DNA, 26 bp, Artificial sequence
  SiRNA target sequence
tatgggaaagcgagctagttttaatg

SEQ ID NO: 155514 - DNA, 26 bp, Artificial sequence
  SiRNA target sequence
atgggaaagcgagctagttttaatgt

SEQ ID NO: 155515 - DNA, 26 bp, Artificial sequence
  SiRNA target sequence
tgggaaagcgagctagttttaatgta

SEQ ID NO: 155516 - DNA, 26 bp, Artificial sequence
  SiRNA target sequence
gggaaagcgagctagttttaatgtaa

SEQ ID NO: 155517 - DNA, 26 bp, Artificial sequence
  SiRNA target sequence
ggaaagcgagctagttttaatgtaaa

SEQ ID NO: 155518 - DNA, 26 bp, Artificial sequence
  SiRNA target sequence
gaaagcgagctagttttaatgtaaaa

SEQ ID NO: 155519 - DNA, 26 bp, Artificial sequence
  SiRNA target sequence
aaagcgagctagttttaatgtaaaag

SEQ ID NO: 155520 - DNA, 26 bp, Artificial sequence
  SiRNA target sequence
aagcgagctagttttaatgtaaaagt

SEQ ID NO: 155521 - DNA, 26 bp, Artificial sequence
  SiRNA target sequence
agcgagctagttttaatgtaaaagtg

SEQ ID NO: 155522 - DNA, 26 bp, Artificial sequence
  SiRNA target sequence
gcgagctagttttaatgtaaaagtgc

SEQ ID NO: 155523 - DNA, 26 bp, Artificial sequence
  SiRNA target sequence
cgagctagttttaatgtaaaagtgca

SEQ ID NO: 155524 - DNA, 26 bp, Artificial sequence
  SiRNA target sequence
gagctagttttaatgtaaaagtgcaa

SEQ ID NO: 155525 - DNA, 26 bp, Artificial sequence
  SiRNA target sequence
agctagttttaatgtaaaagtgcaaa

SEQ ID NO: 155526 - DNA, 26 bp, Artificial sequence
  SiRNA target sequence
gctagttttaatgtaaaagtgcaaag

SEQ ID NO: 155527 - DNA, 26 bp, Artificial sequence
  SiRNA target sequence
ctagttttaatgtaaaagtgcaaaga

SEQ ID NO: 155528 - DNA, 26 bp, Artificial sequence
  SiRNA target sequence
tagttttaatgtaaaagtgcaaagag

SEQ ID NO: 155529 - DNA, 26 bp, Artificial sequence
  SiRNA target sequence
agttttaatgtaaaagtgcaaagaga

SEQ ID NO: 155530 - DNA, 26 bp, Artificial sequence
  SiRNA target sequence
gttttaatgtaaaagtgcaaagagaa

SEQ ID NO: 155531 - DNA, 26 bp, Artificial sequence
  SiRNA target sequence
ttttaatgtaaaagtgcaaagagaat

SEQ ID NO: 155532 - DNA, 26 bp, Artificial sequence
  SiRNA target sequence
tttaatgtaaaagtgcaaagagaatg

SEQ ID NO: 155533 - DNA, 26 bp, Artificial sequence
  SiRNA target sequence
ttaatgtaaaagtgcaaagagaatgt

SEQ ID NO: 155534 - DNA, 26 bp, Artificial sequence
  SiRNA target sequence
taatgtaaaagtgcaaagagaatgtt

SEQ ID NO: 155535 - DNA, 26 bp, Artificial sequence
  SiRNA target sequence
aatgtaaaagtgcaaagagaatgttc

SEQ ID NO: 155536 - DNA, 26 bp, Artificial sequence
  SiRNA target sequence
atgtaaaagtgcaaagagaatgttct

SEQ ID NO: 155537 - DNA, 26 bp, Artificial sequence
  SiRNA target sequence
tgtaaaagtgcaaagagaatgttctg

SEQ ID NO: 155538 - DNA, 26 bp, Artificial sequence
  SiRNA target sequence
gtaaaagtgcaaagagaatgttctgc

SEQ ID NO: 155539 - DNA, 26 bp, Artificial sequence
  SiRNA target sequence
taaaagtgcaaagagaatgttctgcg

SEQ ID NO: 155540 - DNA, 26 bp, Artificial sequence
  SiRNA target sequence
aaaagtgcaaagagaatgttctgcgt

SEQ ID NO: 155541 - DNA, 26 bp, Artificial sequence
  SiRNA target sequence
aaagtgcaaagagaatgttctgcgtg

SEQ ID NO: 155542 - DNA, 26 bp, Artificial sequence
  SiRNA target sequence
aagtgcaaagagaatgttctgcgtgt

SEQ ID NO: 155543 - DNA, 26 bp, Artificial sequence
  SiRNA target sequence
agtgcaaagagaatgttctgcgtgta

SEQ ID NO: 155544 - DNA, 26 bp, Artificial sequence
  SiRNA target sequence
gtgcaaagagaatgttctgcgtgtaa

SEQ ID NO: 155545 - DNA, 26 bp, Artificial sequence
  SiRNA target sequence
tgcaaagagaatgttctgcgtgtaac

SEQ ID NO: 155546 - DNA, 26 bp, Artificial sequence
  SiRNA target sequence
gcaaagagaatgttctgcgtgtaacg

SEQ ID NO: 155547 - DNA, 26 bp, Artificial sequence
  SiRNA target sequence
caaagagaatgttctgcgtgtaacgg

SEQ ID NO: 155548 - DNA, 26 bp, Artificial sequence
  SiRNA target sequence
aaagagaatgttctgcgtgtaacggt

SEQ ID NO: 155549 - DNA, 26 bp, Artificial sequence
  SiRNA target sequence
aagagaatgttctgcgtgtaacggta

SEQ ID NO: 155550 - DNA, 26 bp, Artificial sequence
  SiRNA target sequence
agagaatgttctgcgtgtaacggtaa

SEQ ID NO: 155551 - DNA, 26 bp, Artificial sequence
  SiRNA target sequence
gagaatgttctgcgtgtaacggtaaa

SEQ ID NO: 155552 - DNA, 26 bp, Artificial sequence
  SiRNA target sequence
agaatgttctgcgtgtaacggtaaag

SEQ ID NO: 155553 - DNA, 26 bp, Artificial sequence
  SiRNA target sequence
gaatgttctgcgtgtaacggtaaagg

SEQ ID NO: 155554 - DNA, 26 bp, Artificial sequence
  SiRNA target sequence
aatgttctgcgtgtaacggtaaagga

SEQ ID NO: 155555 - DNA, 26 bp, Artificial sequence
  SiRNA target sequence
atgttctgcgtgtaacggtaaaggag

SEQ ID NO: 155556 - DNA, 26 bp, Artificial sequence
  SiRNA target sequence
tgttctgcgtgtaacggtaaaggagg

SEQ ID NO: 155557 - DNA, 26 bp, Artificial sequence
  SiRNA target sequence
gttctgcgtgtaacggtaaaggagga

SEQ ID NO: 155558 - DNA, 26 bp, Artificial sequence
  SiRNA target sequence
ttctgcgtgtaacggtaaaggaggag

SEQ ID NO: 155559 - DNA, 26 bp, Artificial sequence
  SiRNA target sequence
tctgcgtgtaacggtaaaggaggaga

SEQ ID NO: 155560 - DNA, 26 bp, Artificial sequence
  SiRNA target sequence
ctgcgtgtaacggtaaaggaggagac

SEQ ID NO: 155561 - DNA, 26 bp, Artificial sequence
  SiRNA target sequence
tgcgtgtaacggtaaaggaggagaca

SEQ ID NO: 155562 - DNA, 26 bp, Artificial sequence
  SiRNA target sequence
gcgtgtaacggtaaaggaggagacag

SEQ ID NO: 155563 - DNA, 26 bp, Artificial sequence
  SiRNA target sequence
cgtgtaacggtaaaggaggagacagt

SEQ ID NO: 155564 - DNA, 26 bp, Artificial sequence
  SiRNA target sequence
gtgtaacggtaaaggaggagacagtg

SEQ ID NO: 155565 - DNA, 26 bp, Artificial sequence
  SiRNA target sequence
tgtaacggtaaaggaggagacagtgt

SEQ ID NO: 155566 - DNA, 26 bp, Artificial sequence
  SiRNA target sequence
gtaacggtaaaggaggagacagtgtt

SEQ ID NO: 155567 - DNA, 26 bp, Artificial sequence
  SiRNA target sequence
taacggtaaaggaggagacagtgttg

SEQ ID NO: 155568 - DNA, 26 bp, Artificial sequence
  SiRNA target sequence
aacggtaaaggaggagacagtgttga

SEQ ID NO: 155569 - DNA, 26 bp, Artificial sequence
  SiRNA target sequence
acggtaaaggaggagacagtgttgaa

SEQ ID NO: 155570 - DNA, 26 bp, Artificial sequence
  SiRNA target sequence
cggtaaaggaggagacagtgttgaaa

SEQ ID NO: 155571 - DNA, 26 bp, Artificial sequence
  SiRNA target sequence
ggtaaaggaggagacagtgttgaaac

SEQ ID NO: 155572 - DNA, 26 bp, Artificial sequence
  SiRNA target sequence
gtaaaggaggagacagtgttgaaaca

SEQ ID NO: 155573 - DNA, 26 bp, Artificial sequence
  SiRNA target sequence
taaaggaggagacagtgttgaaacat

SEQ ID NO: 155574 - DNA, 26 bp, Artificial sequence
  SiRNA target sequence
aaaggaggagacagtgttgaaacatg

SEQ ID NO: 155575 - DNA, 26 bp, Artificial sequence
  SiRNA target sequence
aaggaggagacagtgttgaaacatgt

SEQ ID NO: 155576 - DNA, 26 bp, Artificial sequence
  SiRNA target sequence
aggaggagacagtgttgaaacatgtg

SEQ ID NO: 155577 - DNA, 26 bp, Artificial sequence
  SiRNA target sequence
ggaggagacagtgttgaaacatgtga

SEQ ID NO: 155578 - DNA, 26 bp, Artificial sequence
  SiRNA target sequence
gaggagacagtgttgaaacatgtgaa

SEQ ID NO: 155579 - DNA, 26 bp, Artificial sequence
  SiRNA target sequence
aggagacagtgttgaaacatgtgaac

SEQ ID NO: 155580 - DNA, 26 bp, Artificial sequence
  SiRNA target sequence
ggagacagtgttgaaacatgtgaacc

SEQ ID NO: 155581 - DNA, 26 bp, Artificial sequence
  SiRNA target sequence
gagacagtgttgaaacatgtgaacca

SEQ ID NO: 155582 - DNA, 26 bp, Artificial sequence
  SiRNA target sequence
agacagtgttgaaacatgtgaaccat

SEQ ID NO: 155583 - DNA, 26 bp, Artificial sequence
  SiRNA target sequence
gacagtgttgaaacatgtgaaccatg

SEQ ID NO: 155584 - DNA, 26 bp, Artificial sequence
  SiRNA target sequence
acagtgttgaaacatgtgaaccatgt

SEQ ID NO: 155585 - DNA, 26 bp, Artificial sequence
  SiRNA target sequence
cagtgttgaaacatgtgaaccatgta

SEQ ID NO: 155586 - DNA, 26 bp, Artificial sequence
  SiRNA target sequence
agtgttgaaacatgtgaaccatgtaa

SEQ ID NO: 155587 - DNA, 26 bp, Artificial sequence
  SiRNA target sequence
gtgttgaaacatgtgaaccatgtaaa

SEQ ID NO: 155588 - DNA, 26 bp, Artificial sequence
  SiRNA target sequence
tgttgaaacatgtgaaccatgtaaag

SEQ ID NO: 155589 - DNA, 26 bp, Artificial sequence
  SiRNA target sequence
gttgaaacatgtgaaccatgtaaagg

SEQ ID NO: 155590 - DNA, 26 bp, Artificial sequence
  SiRNA target sequence
ttgaaacatgtgaaccatgtaaaggt

SEQ ID NO: 155591 - DNA, 26 bp, Artificial sequence
  SiRNA target sequence
tgaaacatgtgaaccatgtaaaggta

SEQ ID NO: 155592 - DNA, 26 bp, Artificial sequence
  SiRNA target sequence
gaaacatgtgaaccatgtaaaggtaa

SEQ ID NO: 155593 - DNA, 26 bp, Artificial sequence
  SiRNA target sequence
aaacatgtgaaccatgtaaaggtaaa

SEQ ID NO: 155594 - DNA, 26 bp, Artificial sequence
  SiRNA target sequence
aacatgtgaaccatgtaaaggtaaag

SEQ ID NO: 155595 - DNA, 26 bp, Artificial sequence
  SiRNA target sequence
acatgtgaaccatgtaaaggtaaagg

SEQ ID NO: 155596 - DNA, 26 bp, Artificial sequence
  SiRNA target sequence
catgtgaaccatgtaaaggtaaaggt

SEQ ID NO: 155597 - DNA, 26 bp, Artificial sequence
  SiRNA target sequence
atgtgaaccatgtaaaggtaaaggta

SEQ ID NO: 155598 - DNA, 26 bp, Artificial sequence
  SiRNA target sequence
tgtgaaccatgtaaaggtaaaggtaa

SEQ ID NO: 155599 - DNA, 26 bp, Artificial sequence
  SiRNA target sequence
gtgaaccatgtaaaggtaaaggtaag

SEQ ID NO: 155600 - DNA, 26 bp, Artificial sequence
  SiRNA target sequence
tgaaccatgtaaaggtaaaggtaagg

SEQ ID NO: 155601 - DNA, 26 bp, Artificial sequence
  SiRNA target sequence
gaaccatgtaaaggtaaaggtaaggt

SEQ ID NO: 155602 - DNA, 26 bp, Artificial sequence
  SiRNA target sequence
aaccatgtaaaggtaaaggtaaggta

SEQ ID NO: 155603 - DNA, 26 bp, Artificial sequence
  SiRNA target sequence
accatgtaaaggtaaaggtaaggtag

SEQ ID NO: 155604 - DNA, 26 bp, Artificial sequence
  SiRNA target sequence
ccatgtaaaggtaaaggtaaggtaga

SEQ ID NO: 155605 - DNA, 26 bp, Artificial sequence
  SiRNA target sequence
catgtaaaggtaaaggtaaggtagaa

SEQ ID NO: 155606 - DNA, 26 bp, Artificial sequence
  SiRNA target sequence
atgtaaaggtaaaggtaaggtagaac

SEQ ID NO: 155607 - DNA, 26 bp, Artificial sequence
  SiRNA target sequence
tgtaaaggtaaaggtaaggtagaaca

SEQ ID NO: 155608 - DNA, 26 bp, Artificial sequence
  SiRNA target sequence
gtaaaggtaaaggtaaggtagaacat

SEQ ID NO: 155609 - DNA, 26 bp, Artificial sequence
  SiRNA target sequence
taaaggtaaaggtaaggtagaacatc

SEQ ID NO: 155610 - DNA, 26 bp, Artificial sequence
  SiRNA target sequence
aaaggtaaaggtaaggtagaacatca

SEQ ID NO: 155611 - DNA, 26 bp, Artificial sequence
  SiRNA target sequence
aaggtaaaggtaaggtagaacatcat

SEQ ID NO: 155612 - DNA, 26 bp, Artificial sequence
  SiRNA target sequence
aggtaaaggtaaggtagaacatcata

SEQ ID NO: 155613 - DNA, 26 bp, Artificial sequence
  SiRNA target sequence
ggtaaaggtaaggtagaacatcatag

SEQ ID NO: 155614 - DNA, 26 bp, Artificial sequence
  SiRNA target sequence
gtaaaggtaaggtagaacatcatagg

SEQ ID NO: 155615 - DNA, 26 bp, Artificial sequence
  SiRNA target sequence
taaaggtaaggtagaacatcatagga

SEQ ID NO: 155616 - DNA, 26 bp, Artificial sequence
  SiRNA target sequence
aaaggtaaggtagaacatcataggag

SEQ ID NO: 155617 - DNA, 26 bp, Artificial sequence
  SiRNA target sequence
aaggtaaggtagaacatcataggaga

SEQ ID NO: 155618 - DNA, 26 bp, Artificial sequence
  SiRNA target sequence
aggtaaggtagaacatcataggagac

SEQ ID NO: 155619 - DNA, 26 bp, Artificial sequence
  SiRNA target sequence
ggtaaggtagaacatcataggagact

SEQ ID NO: 155620 - DNA, 26 bp, Artificial sequence
  SiRNA target sequence
gtaaggtagaacatcataggagacta

SEQ ID NO: 155621 - DNA, 26 bp, Artificial sequence
  SiRNA target sequence
taaggtagaacatcataggagactag

SEQ ID NO: 155622 - DNA, 26 bp, Artificial sequence
  SiRNA target sequence
aaggtagaacatcataggagactagg

SEQ ID NO: 155623 - DNA, 26 bp, Artificial sequence
  SiRNA target sequence
aggtagaacatcataggagactaggt

SEQ ID NO: 155624 - DNA, 26 bp, Artificial sequence
  SiRNA target sequence
ggtagaacatcataggagactaggtc

SEQ ID NO: 155625 - DNA, 26 bp, Artificial sequence
  SiRNA target sequence
gtagaacatcataggagactaggtcc

SEQ ID NO: 155626 - DNA, 26 bp, Artificial sequence
  SiRNA target sequence
tagaacatcataggagactaggtcct

SEQ ID NO: 155627 - DNA, 26 bp, Artificial sequence
  SiRNA target sequence
agaacatcataggagactaggtcctt

SEQ ID NO: 155628 - DNA, 26 bp, Artificial sequence
  SiRNA target sequence
gaacatcataggagactaggtccttt

SEQ ID NO: 155629 - DNA, 26 bp, Artificial sequence
  SiRNA target sequence
aacatcataggagactaggtccttta

SEQ ID NO: 155630 - DNA, 26 bp, Artificial sequence
  SiRNA target sequence
acatcataggagactaggtcctttaa

SEQ ID NO: 155631 - DNA, 26 bp, Artificial sequence
  SiRNA target sequence
catcataggagactaggtcctttaat

SEQ ID NO: 155632 - DNA, 26 bp, Artificial sequence
  SiRNA target sequence
atcataggagactaggtcctttaatt

SEQ ID NO: 155633 - DNA, 26 bp, Artificial sequence
  SiRNA target sequence
tcataggagactaggtcctttaattt

SEQ ID NO: 155634 - DNA, 26 bp, Artificial sequence
  SiRNA target sequence
cataggagactaggtcctttaatttc

SEQ ID NO: 155635 - DNA, 26 bp, Artificial sequence
  SiRNA target sequence
ataggagactaggtcctttaatttct

SEQ ID NO: 155636 - DNA, 26 bp, Artificial sequence
  SiRNA target sequence
taggagactaggtcctttaatttctg

SEQ ID NO: 155637 - DNA, 26 bp, Artificial sequence
  SiRNA target sequence
aggagactaggtcctttaatttctgt

SEQ ID NO: 155638 - DNA, 26 bp, Artificial sequence
  SiRNA target sequence
ggagactaggtcctttaatttctgta

SEQ ID NO: 155639 - DNA, 26 bp, Artificial sequence
  SiRNA target sequence
gagactaggtcctttaatttctgtac

SEQ ID NO: 155640 - DNA, 26 bp, Artificial sequence
  SiRNA target sequence
agactaggtcctttaatttctgtaca

SEQ ID NO: 155641 - DNA, 26 bp, Artificial sequence
  SiRNA target sequence
gactaggtcctttaatttctgtacaa

SEQ ID NO: 155642 - DNA, 26 bp, Artificial sequence
  SiRNA target sequence
actaggtcctttaatttctgtacaag

SEQ ID NO: 155643 - DNA, 26 bp, Artificial sequence
  SiRNA target sequence
ctaggtcctttaatttctgtacaaga

SEQ ID NO: 155644 - DNA, 26 bp, Artificial sequence
  SiRNA target sequence
taggtcctttaatttctgtacaagaa

SEQ ID NO: 155645 - DNA, 26 bp, Artificial sequence
  SiRNA target sequence
aggtcctttaatttctgtacaagaag

SEQ ID NO: 155646 - DNA, 26 bp, Artificial sequence
  SiRNA target sequence
ggtcctttaatttctgtacaagaagc

SEQ ID NO: 155647 - DNA, 26 bp, Artificial sequence
  SiRNA target sequence
gtcctttaatttctgtacaagaagca

SEQ ID NO: 155648 - DNA, 26 bp, Artificial sequence
  SiRNA target sequence
tcctttaatttctgtacaagaagcac

SEQ ID NO: 155649 - DNA, 26 bp, Artificial sequence
  SiRNA target sequence
cctttaatttctgtacaagaagcacc

SEQ ID NO: 155650 - DNA, 26 bp, Artificial sequence
  SiRNA target sequence
ctttaatttctgtacaagaagcacct

SEQ ID NO: 155651 - DNA, 26 bp, Artificial sequence
  SiRNA target sequence
tttaatttctgtacaagaagcacctt

SEQ ID NO: 155652 - DNA, 26 bp, Artificial sequence
  SiRNA target sequence
ttaatttctgtacaagaagcaccttg

SEQ ID NO: 155653 - DNA, 26 bp, Artificial sequence
  SiRNA target sequence
taatttctgtacaagaagcaccttgt

SEQ ID NO: 155654 - DNA, 26 bp, Artificial sequence
  SiRNA target sequence
aatttctgtacaagaagcaccttgta

SEQ ID NO: 155655 - DNA, 26 bp, Artificial sequence
  SiRNA target sequence
atttctgtacaagaagcaccttgtaa

SEQ ID NO: 155656 - DNA, 26 bp, Artificial sequence
  SiRNA target sequence
tttctgtacaagaagcaccttgtaat

SEQ ID NO: 155657 - DNA, 26 bp, Artificial sequence
  SiRNA target sequence
ttctgtacaagaagcaccttgtaata

SEQ ID NO: 155658 - DNA, 26 bp, Artificial sequence
  SiRNA target sequence
tctgtacaagaagcaccttgtaataa

SEQ ID NO: 155659 - DNA, 26 bp, Artificial sequence
  SiRNA target sequence
ctgtacaagaagcaccttgtaataat

SEQ ID NO: 155660 - DNA, 26 bp, Artificial sequence
  SiRNA target sequence
tgtacaagaagcaccttgtaataatt

SEQ ID NO: 155661 - DNA, 26 bp, Artificial sequence
  SiRNA target sequence
gtacaagaagcaccttgtaataattg

SEQ ID NO: 155662 - DNA, 26 bp, Artificial sequence
  SiRNA target sequence
tacaagaagcaccttgtaataattgt

SEQ ID NO: 155663 - DNA, 26 bp, Artificial sequence
  SiRNA target sequence
acaagaagcaccttgtaataattgta

SEQ ID NO: 155664 - DNA, 26 bp, Artificial sequence
  SiRNA target sequence
caagaagcaccttgtaataattgtaa

SEQ ID NO: 155665 - DNA, 26 bp, Artificial sequence
  SiRNA target sequence
aagaagcaccttgtaataattgtaat

SEQ ID NO: 155666 - DNA, 26 bp, Artificial sequence
  SiRNA target sequence
agaagcaccttgtaataattgtaatt

SEQ ID NO: 155667 - DNA, 26 bp, Artificial sequence
  SiRNA target sequence
gaagcaccttgtaataattgtaattc

SEQ ID NO: 155668 - DNA, 26 bp, Artificial sequence
  SiRNA target sequence
aagcaccttgtaataattgtaattct

SEQ ID NO: 155669 - DNA, 26 bp, Artificial sequence
  SiRNA target sequence
agcaccttgtaataattgtaattcta

SEQ ID NO: 155670 - DNA, 26 bp, Artificial sequence
  SiRNA target sequence
gcaccttgtaataattgtaattctac

SEQ ID NO: 155671 - DNA, 26 bp, Artificial sequence
  SiRNA target sequence
caccttgtaataattgtaattctact

SEQ ID NO: 155672 - DNA, 26 bp, Artificial sequence
  SiRNA target sequence
accttgtaataattgtaattctactg

SEQ ID NO: 155673 - DNA, 26 bp, Artificial sequence
  SiRNA target sequence
ccttgtaataattgtaattctactgg

SEQ ID NO: 155674 - DNA, 26 bp, Artificial sequence
  SiRNA target sequence
cttgtaataattgtaattctactgga

SEQ ID NO: 155675 - DNA, 26 bp, Artificial sequence
  SiRNA target sequence
ttgtaataattgtaattctactggat

SEQ ID NO: 155676 - DNA, 26 bp, Artificial sequence
  SiRNA target sequence
tgtaataattgtaattctactggatt

SEQ ID NO: 155677 - DNA, 26 bp, Artificial sequence
  SiRNA target sequence
gtaataattgtaattctactggattt

SEQ ID NO: 155678 - DNA, 26 bp, Artificial sequence
  SiRNA target sequence
taataattgtaattctactggatttg

SEQ ID NO: 155679 - DNA, 26 bp, Artificial sequence
  SiRNA target sequence
aataattgtaattctactggatttgt

SEQ ID NO: 155680 - DNA, 26 bp, Artificial sequence
  SiRNA target sequence
ataattgtaattctactggatttgtt

SEQ ID NO: 155681 - DNA, 26 bp, Artificial sequence
  SiRNA target sequence
taattgtaattctactggatttgttg

SEQ ID NO: 155682 - DNA, 26 bp, Artificial sequence
  SiRNA target sequence
aattgtaattctactggatttgttgt

SEQ ID NO: 155683 - DNA, 26 bp, Artificial sequence
  SiRNA target sequence
attgtaattctactggatttgttgtt

SEQ ID NO: 155684 - DNA, 26 bp, Artificial sequence
  SiRNA target sequence
ttgtaattctactggatttgttgtta

SEQ ID NO: 155685 - DNA, 26 bp, Artificial sequence
  SiRNA target sequence
tgtaattctactggatttgttgttaa

SEQ ID NO: 155686 - DNA, 26 bp, Artificial sequence
  SiRNA target sequence
gtaattctactggatttgttgttaaa

SEQ ID NO: 155687 - DNA, 26 bp, Artificial sequence
  SiRNA target sequence
taattctactggatttgttgttaaag

SEQ ID NO: 155688 - DNA, 26 bp, Artificial sequence
  SiRNA target sequence
aattctactggatttgttgttaaagg

SEQ ID NO: 155689 - DNA, 26 bp, Artificial sequence
  SiRNA target sequence
attctactggatttgttgttaaagga

SEQ ID NO: 155690 - DNA, 26 bp, Artificial sequence
  SiRNA target sequence
ttctactggatttgttgttaaaggaa

SEQ ID NO: 155691 - DNA, 26 bp, Artificial sequence
  SiRNA target sequence
tctactggatttgttgttaaaggaaa

SEQ ID NO: 155692 - DNA, 26 bp, Artificial sequence
  SiRNA target sequence
ctactggatttgttgttaaaggaaag

SEQ ID NO: 155693 - DNA, 26 bp, Artificial sequence
  SiRNA target sequence
tactggatttgttgttaaaggaaagc

SEQ ID NO: 155694 - DNA, 26 bp, Artificial sequence
  SiRNA target sequence
actggatttgttgttaaaggaaagct

SEQ ID NO: 155695 - DNA, 26 bp, Artificial sequence
  SiRNA target sequence
ctggatttgttgttaaaggaaagctt

SEQ ID NO: 155696 - DNA, 26 bp, Artificial sequence
  SiRNA target sequence
tggatttgttgttaaaggaaagcttt

SEQ ID NO: 155697 - DNA, 26 bp, Artificial sequence
  SiRNA target sequence
ggatttgttgttaaaggaaagctttg

SEQ ID NO: 155698 - DNA, 26 bp, Artificial sequence
  SiRNA target sequence
gatttgttgttaaaggaaagctttgt

SEQ ID NO: 155699 - DNA, 26 bp, Artificial sequence
  SiRNA target sequence
atttgttgttaaaggaaagctttgtc

SEQ ID NO: 155700 - DNA, 26 bp, Artificial sequence
  SiRNA target sequence
tttgttgttaaaggaaagctttgtca

SEQ ID NO: 155701 - DNA, 26 bp, Artificial sequence
  SiRNA target sequence
ttgttgttaaaggaaagctttgtcaa

SEQ ID NO: 155702 - DNA, 26 bp, Artificial sequence
  SiRNA target sequence
tgttgttaaaggaaagctttgtcaaa

SEQ ID NO: 155703 - DNA, 26 bp, Artificial sequence
  SiRNA target sequence
gttgttaaaggaaagctttgtcaaag

SEQ ID NO: 155704 - DNA, 26 bp, Artificial sequence
  SiRNA target sequence
ttgttaaaggaaagctttgtcaaagt

SEQ ID NO: 155705 - DNA, 26 bp, Artificial sequence
  SiRNA target sequence
tgttaaaggaaagctttgtcaaagtt

SEQ ID NO: 155706 - DNA, 26 bp, Artificial sequence
  SiRNA target sequence
gttaaaggaaagctttgtcaaagttg

SEQ ID NO: 155707 - DNA, 26 bp, Artificial sequence
  SiRNA target sequence
ttaaaggaaagctttgtcaaagttgt

SEQ ID NO: 155708 - DNA, 26 bp, Artificial sequence
  SiRNA target sequence
taaaggaaagctttgtcaaagttgta

SEQ ID NO: 155709 - DNA, 26 bp, Artificial sequence
  SiRNA target sequence
aaaggaaagctttgtcaaagttgtaa

SEQ ID NO: 155710 - DNA, 26 bp, Artificial sequence
  SiRNA target sequence
aaggaaagctttgtcaaagttgtaaa

SEQ ID NO: 155711 - DNA, 26 bp, Artificial sequence
  SiRNA target sequence
aggaaagctttgtcaaagttgtaaag

SEQ ID NO: 155712 - DNA, 26 bp, Artificial sequence
  SiRNA target sequence
ggaaagctttgtcaaagttgtaaagg

SEQ ID NO: 155713 - DNA, 26 bp, Artificial sequence
  SiRNA target sequence
gaaagctttgtcaaagttgtaaaggt

SEQ ID NO: 155714 - DNA, 26 bp, Artificial sequence
  SiRNA target sequence
aaagctttgtcaaagttgtaaaggta

SEQ ID NO: 155715 - DNA, 26 bp, Artificial sequence
  SiRNA target sequence
aagctttgtcaaagttgtaaaggtaa

SEQ ID NO: 155716 - DNA, 26 bp, Artificial sequence
  SiRNA target sequence
agctttgtcaaagttgtaaaggtaaa

SEQ ID NO: 155717 - DNA, 26 bp, Artificial sequence
  SiRNA target sequence
gctttgtcaaagttgtaaaggtaaac

SEQ ID NO: 155718 - DNA, 26 bp, Artificial sequence
  SiRNA target sequence
ctttgtcaaagttgtaaaggtaaaca

SEQ ID NO: 155719 - DNA, 26 bp, Artificial sequence
  SiRNA target sequence
tttgtcaaagttgtaaaggtaaacaa

SEQ ID NO: 155720 - DNA, 26 bp, Artificial sequence
  SiRNA target sequence
ttgtcaaagttgtaaaggtaaacaat

SEQ ID NO: 155721 - DNA, 26 bp, Artificial sequence
  SiRNA target sequence
tgtcaaagttgtaaaggtaaacaata

SEQ ID NO: 155722 - DNA, 26 bp, Artificial sequence
  SiRNA target sequence
gtcaaagttgtaaaggtaaacaatac

SEQ ID NO: 155723 - DNA, 26 bp, Artificial sequence
  SiRNA target sequence
tcaaagttgtaaaggtaaacaatacg

SEQ ID NO: 155724 - DNA, 26 bp, Artificial sequence
  SiRNA target sequence
caaagttgtaaaggtaaacaatacgt

SEQ ID NO: 155725 - DNA, 26 bp, Artificial sequence
  SiRNA target sequence
aaagttgtaaaggtaaacaatacgtt

SEQ ID NO: 155726 - DNA, 26 bp, Artificial sequence
  SiRNA target sequence
aagttgtaaaggtaaacaatacgttg

SEQ ID NO: 155727 - DNA, 26 bp, Artificial sequence
  SiRNA target sequence
agttgtaaaggtaaacaatacgttga

SEQ ID NO: 155728 - DNA, 26 bp, Artificial sequence
  SiRNA target sequence
gttgtaaaggtaaacaatacgttgag

SEQ ID NO: 155729 - DNA, 26 bp, Artificial sequence
  SiRNA target sequence
ttgtaaaggtaaacaatacgttgaga

SEQ ID NO: 155730 - DNA, 26 bp, Artificial sequence
  SiRNA target sequence
tgtaaaggtaaacaatacgttgagac

SEQ ID NO: 155731 - DNA, 26 bp, Artificial sequence
  SiRNA target sequence
gtaaaggtaaacaatacgttgagact

SEQ ID NO: 155732 - DNA, 26 bp, Artificial sequence
  SiRNA target sequence
taaaggtaaacaatacgttgagacta

SEQ ID NO: 155733 - DNA, 26 bp, Artificial sequence
  SiRNA target sequence
aaaggtaaacaatacgttgagactaa

SEQ ID NO: 155734 - DNA, 26 bp, Artificial sequence
  SiRNA target sequence
aaggtaaacaatacgttgagactaaa

SEQ ID NO: 155735 - DNA, 26 bp, Artificial sequence
  SiRNA target sequence
aggtaaacaatacgttgagactaaag

SEQ ID NO: 155736 - DNA, 26 bp, Artificial sequence
  SiRNA target sequence
ggtaaacaatacgttgagactaaaga

SEQ ID NO: 155737 - DNA, 26 bp, Artificial sequence
  SiRNA target sequence
gtaaacaatacgttgagactaaagaa

SEQ ID NO: 155738 - DNA, 26 bp, Artificial sequence
  SiRNA target sequence
taaacaatacgttgagactaaagaac

SEQ ID NO: 155739 - DNA, 26 bp, Artificial sequence
  SiRNA target sequence
aaacaatacgttgagactaaagaaca

SEQ ID NO: 155740 - DNA, 26 bp, Artificial sequence
  SiRNA target sequence
aacaatacgttgagactaaagaacat

SEQ ID NO: 155741 - DNA, 26 bp, Artificial sequence
  SiRNA target sequence
acaatacgttgagactaaagaacata

SEQ ID NO: 155742 - DNA, 26 bp, Artificial sequence
  SiRNA target sequence
caatacgttgagactaaagaacatat

SEQ ID NO: 155743 - DNA, 26 bp, Artificial sequence
  SiRNA target sequence
aatacgttgagactaaagaacatatt

SEQ ID NO: 155744 - DNA, 26 bp, Artificial sequence
  SiRNA target sequence
atacgttgagactaaagaacatattg

SEQ ID NO: 155745 - DNA, 26 bp, Artificial sequence
  SiRNA target sequence
tacgttgagactaaagaacatattga

SEQ ID NO: 155746 - DNA, 26 bp, Artificial sequence
  SiRNA target sequence
acgttgagactaaagaacatattgaa

SEQ ID NO: 155747 - DNA, 26 bp, Artificial sequence
  SiRNA target sequence
cgttgagactaaagaacatattgaag

SEQ ID NO: 155748 - DNA, 26 bp, Artificial sequence
  SiRNA target sequence
gttgagactaaagaacatattgaagt

SEQ ID NO: 155749 - DNA, 26 bp, Artificial sequence
  SiRNA target sequence
ttgagactaaagaacatattgaagtg

SEQ ID NO: 155750 - DNA, 26 bp, Artificial sequence
  SiRNA target sequence
tgagactaaagaacatattgaagtgg

SEQ ID NO: 155751 - DNA, 26 bp, Artificial sequence
  SiRNA target sequence
gagactaaagaacatattgaagtgga

SEQ ID NO: 155752 - DNA, 26 bp, Artificial sequence
  SiRNA target sequence
agactaaagaacatattgaagtggaa

SEQ ID NO: 155753 - DNA, 26 bp, Artificial sequence
  SiRNA target sequence
gactaaagaacatattgaagtggaag

SEQ ID NO: 155754 - DNA, 26 bp, Artificial sequence
  SiRNA target sequence
actaaagaacatattgaagtggaagt

SEQ ID NO: 155755 - DNA, 26 bp, Artificial sequence
  SiRNA target sequence
ctaaagaacatattgaagtggaagta

SEQ ID NO: 155756 - DNA, 26 bp, Artificial sequence
  SiRNA target sequence
taaagaacatattgaagtggaagtag

SEQ ID NO: 155757 - DNA, 26 bp, Artificial sequence
  SiRNA target sequence
aaagaacatattgaagtggaagtaga

SEQ ID NO: 155758 - DNA, 26 bp, Artificial sequence
  SiRNA target sequence
aagaacatattgaagtggaagtagag

SEQ ID NO: 155759 - DNA, 26 bp, Artificial sequence
  SiRNA target sequence
agaacatattgaagtggaagtagagc

SEQ ID NO: 155760 - DNA, 26 bp, Artificial sequence
  SiRNA target sequence
gaacatattgaagtggaagtagagcc

SEQ ID NO: 155761 - DNA, 26 bp, Artificial sequence
  SiRNA target sequence
aacatattgaagtggaagtagagcca

SEQ ID NO: 155762 - DNA, 26 bp, Artificial sequence
  SiRNA target sequence
acatattgaagtggaagtagagccag

SEQ ID NO: 155763 - DNA, 26 bp, Artificial sequence
  SiRNA target sequence
catattgaagtggaagtagagccagg

SEQ ID NO: 155764 - DNA, 26 bp, Artificial sequence
  SiRNA target sequence
atattgaagtggaagtagagccagga

SEQ ID NO: 155765 - DNA, 26 bp, Artificial sequence
  SiRNA target sequence
tattgaagtggaagtagagccaggag

SEQ ID NO: 155766 - DNA, 26 bp, Artificial sequence
  SiRNA target sequence
attgaagtggaagtagagccaggagt

SEQ ID NO: 155767 - DNA, 26 bp, Artificial sequence
  SiRNA target sequence
ttgaagtggaagtagagccaggagta

SEQ ID NO: 155768 - DNA, 26 bp, Artificial sequence
  SiRNA target sequence
tgaagtggaagtagagccaggagtac

SEQ ID NO: 155769 - DNA, 26 bp, Artificial sequence
  SiRNA target sequence
gaagtggaagtagagccaggagtaca

SEQ ID NO: 155770 - DNA, 26 bp, Artificial sequence
  SiRNA target sequence
aagtggaagtagagccaggagtacag

SEQ ID NO: 155771 - DNA, 26 bp, Artificial sequence
  SiRNA target sequence
agtggaagtagagccaggagtacaga

SEQ ID NO: 155772 - DNA, 26 bp, Artificial sequence
  SiRNA target sequence
gtggaagtagagccaggagtacagaa

SEQ ID NO: 155773 - DNA, 26 bp, Artificial sequence
  SiRNA target sequence
tggaagtagagccaggagtacagaac

SEQ ID NO: 155774 - DNA, 26 bp, Artificial sequence
  SiRNA target sequence
ggaagtagagccaggagtacagaacg

SEQ ID NO: 155775 - DNA, 26 bp, Artificial sequence
  SiRNA target sequence
gaagtagagccaggagtacagaacgg

SEQ ID NO: 155776 - DNA, 26 bp, Artificial sequence
  SiRNA target sequence
aagtagagccaggagtacagaacggt

SEQ ID NO: 155777 - DNA, 26 bp, Artificial sequence
  SiRNA target sequence
agtagagccaggagtacagaacggta

SEQ ID NO: 155778 - DNA, 26 bp, Artificial sequence
  SiRNA target sequence
gtagagccaggagtacagaacggtag

SEQ ID NO: 155779 - DNA, 26 bp, Artificial sequence
  SiRNA target sequence
tagagccaggagtacagaacggtaga

SEQ ID NO: 155780 - DNA, 26 bp, Artificial sequence
  SiRNA target sequence
agagccaggagtacagaacggtagaa

SEQ ID NO: 155781 - DNA, 26 bp, Artificial sequence
  SiRNA target sequence
gagccaggagtacagaacggtagaaa

SEQ ID NO: 155782 - DNA, 26 bp, Artificial sequence
  SiRNA target sequence
agccaggagtacagaacggtagaaaa

SEQ ID NO: 155783 - DNA, 26 bp, Artificial sequence
  SiRNA target sequence
gccaggagtacagaacggtagaaaat

SEQ ID NO: 155784 - DNA, 26 bp, Artificial sequence
  SiRNA target sequence
ccaggagtacagaacggtagaaaata

SEQ ID NO: 155785 - DNA, 26 bp, Artificial sequence
  SiRNA target sequence
caggagtacagaacggtagaaaatat

SEQ ID NO: 155786 - DNA, 26 bp, Artificial sequence
  SiRNA target sequence
aggagtacagaacggtagaaaatata

SEQ ID NO: 155787 - DNA, 26 bp, Artificial sequence
  SiRNA target sequence
ggagtacagaacggtagaaaatatac

SEQ ID NO: 155788 - DNA, 26 bp, Artificial sequence
  SiRNA target sequence
gagtacagaacggtagaaaatataca

SEQ ID NO: 155789 - DNA, 26 bp, Artificial sequence
  SiRNA target sequence
agtacagaacggtagaaaatatacat

SEQ ID NO: 155790 - DNA, 26 bp, Artificial sequence
  SiRNA target sequence
gtacagaacggtagaaaatatacatt

SEQ ID NO: 155791 - DNA, 26 bp, Artificial sequence
  SiRNA target sequence
tacagaacggtagaaaatatacattt

SEQ ID NO: 155792 - DNA, 26 bp, Artificial sequence
  SiRNA target sequence
acagaacggtagaaaatatacatttt

SEQ ID NO: 155793 - DNA, 26 bp, Artificial sequence
  SiRNA target sequence
cagaacggtagaaaatatacattttc

SEQ ID NO: 155794 - DNA, 26 bp, Artificial sequence
  SiRNA target sequence
agaacggtagaaaatatacattttct

SEQ ID NO: 155795 - DNA, 26 bp, Artificial sequence
  SiRNA target sequence
gaacggtagaaaatatacattttctg

SEQ ID NO: 155796 - DNA, 26 bp, Artificial sequence
  SiRNA target sequence
aacggtagaaaatatacattttctgg

SEQ ID NO: 155797 - DNA, 26 bp, Artificial sequence
  SiRNA target sequence
acggtagaaaatatacattttctggc

SEQ ID NO: 155798 - DNA, 26 bp, Artificial sequence
  SiRNA target sequence
cggtagaaaatatacattttctggca

SEQ ID NO: 155799 - DNA, 26 bp, Artificial sequence
  SiRNA target sequence
ggtagaaaatatacattttctggcaa

SEQ ID NO: 155800 - DNA, 26 bp, Artificial sequence
  SiRNA target sequence
gtagaaaatatacattttctggcaaa

SEQ ID NO: 155801 - DNA, 26 bp, Artificial sequence
  SiRNA target sequence
tagaaaatatacattttctggcaaag

SEQ ID NO: 155802 - DNA, 26 bp, Artificial sequence
  SiRNA target sequence
agaaaatatacattttctggcaaagg

SEQ ID NO: 155803 - DNA, 26 bp, Artificial sequence
  SiRNA target sequence
gaaaatatacattttctggcaaagga

SEQ ID NO: 155804 - DNA, 26 bp, Artificial sequence
  SiRNA target sequence
aaaatatacattttctggcaaaggaa

SEQ ID NO: 155805 - DNA, 26 bp, Artificial sequence
  SiRNA target sequence
aaatatacattttctggcaaaggaaa

SEQ ID NO: 155806 - DNA, 26 bp, Artificial sequence
  SiRNA target sequence
aatatacattttctggcaaaggaaat

SEQ ID NO: 155807 - DNA, 26 bp, Artificial sequence
  SiRNA target sequence
atatacattttctggcaaaggaaatc

SEQ ID NO: 155808 - DNA, 26 bp, Artificial sequence
  SiRNA target sequence
tatacattttctggcaaaggaaatca

SEQ ID NO: 155809 - DNA, 26 bp, Artificial sequence
  SiRNA target sequence
atacattttctggcaaaggaaatcat

SEQ ID NO: 155810 - DNA, 26 bp, Artificial sequence
  SiRNA target sequence
tacattttctggcaaaggaaatcata

SEQ ID NO: 155811 - DNA, 26 bp, Artificial sequence
  SiRNA target sequence
acattttctggcaaaggaaatcataa

SEQ ID NO: 155812 - DNA, 26 bp, Artificial sequence
  SiRNA target sequence
cattttctggcaaaggaaatcataaa

SEQ ID NO: 155813 - DNA, 26 bp, Artificial sequence
  SiRNA target sequence
attttctggcaaaggaaatcataaaa

SEQ ID NO: 155814 - DNA, 26 bp, Artificial sequence
  SiRNA target sequence
ttttctggcaaaggaaatcataaaaa

SEQ ID NO: 155815 - DNA, 26 bp, Artificial sequence
  SiRNA target sequence
tttctggcaaaggaaatcataaaaaa

SEQ ID NO: 155816 - DNA, 26 bp, Artificial sequence
  SiRNA target sequence
ttctggcaaaggaaatcataaaaaaa

SEQ ID NO: 155817 - DNA, 26 bp, Artificial sequence
  SiRNA target sequence
tctggcaaaggaaatcataaaaaaaa

SEQ ID NO: 155818 - DNA, 26 bp, Artificial sequence
  SiRNA target sequence
ctggcaaaggaaatcataaaaaaaat

SEQ ID NO: 155819 - DNA, 26 bp, Artificial sequence
  SiRNA target sequence
tggcaaaggaaatcataaaaaaaatt

SEQ ID NO: 155820 - DNA, 26 bp, Artificial sequence
  SiRNA target sequence
ggcaaaggaaatcataaaaaaaattg

SEQ ID NO: 155821 - DNA, 26 bp, Artificial sequence
  SiRNA target sequence
gcaaaggaaatcataaaaaaaattgt

SEQ ID NO: 155822 - DNA, 26 bp, Artificial sequence
  SiRNA target sequence
caaaggaaatcataaaaaaaattgtg

SEQ ID NO: 155823 - DNA, 26 bp, Artificial sequence
  SiRNA target sequence
aaaggaaatcataaaaaaaattgtgt

SEQ ID NO: 155824 - DNA, 26 bp, Artificial sequence
  SiRNA target sequence
aaggaaatcataaaaaaaattgtgta

SEQ ID NO: 155825 - DNA, 26 bp, Artificial sequence
  SiRNA target sequence
aggaaatcataaaaaaaattgtgtac

SEQ ID NO: 155826 - DNA, 26 bp, Artificial sequence
  SiRNA target sequence
ggaaatcataaaaaaaattgtgtacc

SEQ ID NO: 155827 - DNA, 26 bp, Artificial sequence
  SiRNA target sequence
gaaatcataaaaaaaattgtgtaccg

SEQ ID NO: 155828 - DNA, 26 bp, Artificial sequence
  SiRNA target sequence
aaatcataaaaaaaattgtgtaccgg

SEQ ID NO: 155829 - DNA, 26 bp, Artificial sequence
  SiRNA target sequence
aatcataaaaaaaattgtgtaccggg

SEQ ID NO: 155830 - DNA, 26 bp, Artificial sequence
  SiRNA target sequence
atcataaaaaaaattgtgtaccgggt

SEQ ID NO: 155831 - DNA, 26 bp, Artificial sequence
  SiRNA target sequence
tcataaaaaaaattgtgtaccgggtg

SEQ ID NO: 155832 - DNA, 26 bp, Artificial sequence
  SiRNA target sequence
cataaaaaaaattgtgtaccgggtga

SEQ ID NO: 155833 - DNA, 26 bp, Artificial sequence
  SiRNA target sequence
ataaaaaaaattgtgtaccgggtgat

SEQ ID NO: 155834 - DNA, 26 bp, Artificial sequence
  SiRNA target sequence
taaaaaaaattgtgtaccgggtgatg

SEQ ID NO: 155835 - DNA, 26 bp, Artificial sequence
  SiRNA target sequence
aaaaaaaattgtgtaccgggtgatgt

SEQ ID NO: 155836 - DNA, 26 bp, Artificial sequence
  SiRNA target sequence
aaaaaaattgtgtaccgggtgatgtg

SEQ ID NO: 155837 - DNA, 26 bp, Artificial sequence
  SiRNA target sequence
aaaaaattgtgtaccgggtgatgtga

SEQ ID NO: 155838 - DNA, 26 bp, Artificial sequence
  SiRNA target sequence
aaaaattgtgtaccgggtgatgtgat

SEQ ID NO: 155839 - DNA, 26 bp, Artificial sequence
  SiRNA target sequence
aaaattgtgtaccgggtgatgtgatt

SEQ ID NO: 155840 - DNA, 26 bp, Artificial sequence
  SiRNA target sequence
aaattgtgtaccgggtgatgtgattc

SEQ ID NO: 155841 - DNA, 26 bp, Artificial sequence
  SiRNA target sequence
aattgtgtaccgggtgatgtgattct

SEQ ID NO: 155842 - DNA, 26 bp, Artificial sequence
  SiRNA target sequence
attgtgtaccgggtgatgtgattctt

SEQ ID NO: 155843 - DNA, 26 bp, Artificial sequence
  SiRNA target sequence
ttgtgtaccgggtgatgtgattctta

SEQ ID NO: 155844 - DNA, 26 bp, Artificial sequence
  SiRNA target sequence
tgtgtaccgggtgatgtgattcttat

SEQ ID NO: 155845 - DNA, 26 bp, Artificial sequence
  SiRNA target sequence
gtgtaccgggtgatgtgattcttatt

SEQ ID NO: 155846 - DNA, 26 bp, Artificial sequence
  SiRNA target sequence
tgtaccgggtgatgtgattcttattg

SEQ ID NO: 155847 - DNA, 26 bp, Artificial sequence
  SiRNA target sequence
gtaccgggtgatgtgattcttattgt

SEQ ID NO: 155848 - DNA, 26 bp, Artificial sequence
  SiRNA target sequence
taccgggtgatgtgattcttattgta

SEQ ID NO: 155849 - DNA, 26 bp, Artificial sequence
  SiRNA target sequence
accgggtgatgtgattcttattgtaa

SEQ ID NO: 155850 - DNA, 26 bp, Artificial sequence
  SiRNA target sequence
ccgggtgatgtgattcttattgtaaa

SEQ ID NO: 155851 - DNA, 26 bp, Artificial sequence
  SiRNA target sequence
cgggtgatgtgattcttattgtaaac

SEQ ID NO: 155852 - DNA, 26 bp, Artificial sequence
  SiRNA target sequence
gggtgatgtgattcttattgtaaaca

SEQ ID NO: 155853 - DNA, 26 bp, Artificial sequence
  SiRNA target sequence
ggtgatgtgattcttattgtaaacat

SEQ ID NO: 155854 - DNA, 26 bp, Artificial sequence
  SiRNA target sequence
gtgatgtgattcttattgtaaacatt

SEQ ID NO: 155855 - DNA, 26 bp, Artificial sequence
  SiRNA target sequence
tgatgtgattcttattgtaaacatta

SEQ ID NO: 155856 - DNA, 26 bp, Artificial sequence
  SiRNA target sequence
gatgtgattcttattgtaaacattac

SEQ ID NO: 155857 - DNA, 26 bp, Artificial sequence
  SiRNA target sequence
atgtgattcttattgtaaacattaca

SEQ ID NO: 155858 - DNA, 26 bp, Artificial sequence
  SiRNA target sequence
tgtgattcttattgtaaacattacaa

SEQ ID NO: 155859 - DNA, 26 bp, Artificial sequence
  SiRNA target sequence
gtgattcttattgtaaacattacaaa

SEQ ID NO: 155860 - DNA, 26 bp, Artificial sequence
  SiRNA target sequence
tgattcttattgtaaacattacaaat

SEQ ID NO: 155861 - DNA, 26 bp, Artificial sequence
  SiRNA target sequence
gattcttattgtaaacattacaaatg

SEQ ID NO: 155862 - DNA, 26 bp, Artificial sequence
  SiRNA target sequence
attcttattgtaaacattacaaatga

SEQ ID NO: 155863 - DNA, 26 bp, Artificial sequence
  SiRNA target sequence
ttcttattgtaaacattacaaatgat

SEQ ID NO: 155864 - DNA, 26 bp, Artificial sequence
  SiRNA target sequence
tcttattgtaaacattacaaatgatc

SEQ ID NO: 155865 - DNA, 26 bp, Artificial sequence
  SiRNA target sequence
cttattgtaaacattacaaatgatcc

SEQ ID NO: 155866 - DNA, 26 bp, Artificial sequence
  SiRNA target sequence
ttattgtaaacattacaaatgatcca

SEQ ID NO: 155867 - DNA, 26 bp, Artificial sequence
  SiRNA target sequence
tattgtaaacattacaaatgatccaa

SEQ ID NO: 155868 - DNA, 26 bp, Artificial sequence
  SiRNA target sequence
attgtaaacattacaaatgatccaag

SEQ ID NO: 155869 - DNA, 26 bp, Artificial sequence
  SiRNA target sequence
ttgtaaacattacaaatgatccaaga

SEQ ID NO: 155870 - DNA, 26 bp, Artificial sequence
  SiRNA target sequence
tgtaaacattacaaatgatccaagat

SEQ ID NO: 155871 - DNA, 26 bp, Artificial sequence
  SiRNA target sequence
gtaaacattacaaatgatccaagatt

SEQ ID NO: 155872 - DNA, 26 bp, Artificial sequence
  SiRNA target sequence
taaacattacaaatgatccaagattt

SEQ ID NO: 155873 - DNA, 26 bp, Artificial sequence
  SiRNA target sequence
aaacattacaaatgatccaagattta

SEQ ID NO: 155874 - DNA, 26 bp, Artificial sequence
  SiRNA target sequence
aacattacaaatgatccaagatttag

SEQ ID NO: 155875 - DNA, 26 bp, Artificial sequence
  SiRNA target sequence
acattacaaatgatccaagatttaga

SEQ ID NO: 155876 - DNA, 26 bp, Artificial sequence
  SiRNA target sequence
cattacaaatgatccaagatttagaa

SEQ ID NO: 155877 - DNA, 26 bp, Artificial sequence
  SiRNA target sequence
attacaaatgatccaagatttagaaa

SEQ ID NO: 155878 - DNA, 26 bp, Artificial sequence
  SiRNA target sequence
ttacaaatgatccaagatttagaaaa

SEQ ID NO: 155879 - DNA, 26 bp, Artificial sequence
  SiRNA target sequence
tacaaatgatccaagatttagaaaaa

SEQ ID NO: 155880 - DNA, 26 bp, Artificial sequence
  SiRNA target sequence
acaaatgatccaagatttagaaaaag

SEQ ID NO: 155881 - DNA, 26 bp, Artificial sequence
  SiRNA target sequence
caaatgatccaagatttagaaaaagt

SEQ ID NO: 155882 - DNA, 26 bp, Artificial sequence
  SiRNA target sequence
aaatgatccaagatttagaaaaagtg

SEQ ID NO: 155883 - DNA, 26 bp, Artificial sequence
  SiRNA target sequence
aatgatccaagatttagaaaaagtgg

SEQ ID NO: 155884 - DNA, 26 bp, Artificial sequence
  SiRNA target sequence
atgatccaagatttagaaaaagtgga

SEQ ID NO: 155885 - DNA, 26 bp, Artificial sequence
  SiRNA target sequence
tgatccaagatttagaaaaagtggat

SEQ ID NO: 155886 - DNA, 26 bp, Artificial sequence
  SiRNA target sequence
gatccaagatttagaaaaagtggata

SEQ ID NO: 155887 - DNA, 26 bp, Artificial sequence
  SiRNA target sequence
atccaagatttagaaaaagtggatat

SEQ ID NO: 155888 - DNA, 26 bp, Artificial sequence
  SiRNA target sequence
tccaagatttagaaaaagtggatata

SEQ ID NO: 155889 - DNA, 26 bp, Artificial sequence
  SiRNA target sequence
ccaagatttagaaaaagtggatataa

SEQ ID NO: 155890 - DNA, 26 bp, Artificial sequence
  SiRNA target sequence
caagatttagaaaaagtggatataat

SEQ ID NO: 155891 - DNA, 26 bp, Artificial sequence
  SiRNA target sequence
aagatttagaaaaagtggatataatt

SEQ ID NO: 155892 - DNA, 26 bp, Artificial sequence
  SiRNA target sequence
agatttagaaaaagtggatataattt

SEQ ID NO: 155893 - DNA, 26 bp, Artificial sequence
  SiRNA target sequence
gatttagaaaaagtggatataattta

SEQ ID NO: 155894 - DNA, 26 bp, Artificial sequence
  SiRNA target sequence
atttagaaaaagtggatataatttaa

SEQ ID NO: 155895 - DNA, 26 bp, Artificial sequence
  SiRNA target sequence
tttagaaaaagtggatataatttaat

SEQ ID NO: 155896 - DNA, 26 bp, Artificial sequence
  SiRNA target sequence
ttagaaaaagtggatataatttaatt

SEQ ID NO: 155897 - DNA, 26 bp, Artificial sequence
  SiRNA target sequence
tagaaaaagtggatataatttaatta

SEQ ID NO: 155898 - DNA, 26 bp, Artificial sequence
  SiRNA target sequence
agaaaaagtggatataatttaattag

SEQ ID NO: 155899 - DNA, 26 bp, Artificial sequence
  SiRNA target sequence
gaaaaagtggatataatttaattagt

SEQ ID NO: 155900 - DNA, 26 bp, Artificial sequence
  SiRNA target sequence
aaaaagtggatataatttaattagta

SEQ ID NO: 155901 - DNA, 26 bp, Artificial sequence
  SiRNA target sequence
aaaagtggatataatttaattagtaa

SEQ ID NO: 155902 - DNA, 26 bp, Artificial sequence
  SiRNA target sequence
aaagtggatataatttaattagtaag

SEQ ID NO: 155903 - DNA, 26 bp, Artificial sequence
  SiRNA target sequence
aagtggatataatttaattagtaagg

SEQ ID NO: 155904 - DNA, 26 bp, Artificial sequence
  SiRNA target sequence
agtggatataatttaattagtaaggt

SEQ ID NO: 155905 - DNA, 26 bp, Artificial sequence
  SiRNA target sequence
gtggatataatttaattagtaaggtt

SEQ ID NO: 155906 - DNA, 26 bp, Artificial sequence
  SiRNA target sequence
tggatataatttaattagtaaggttg

SEQ ID NO: 155907 - DNA, 26 bp, Artificial sequence
  SiRNA target sequence
ggatataatttaattagtaaggttga

SEQ ID NO: 155908 - DNA, 26 bp, Artificial sequence
  SiRNA target sequence
gatataatttaattagtaaggttgat

SEQ ID NO: 155909 - DNA, 26 bp, Artificial sequence
  SiRNA target sequence
atataatttaattagtaaggttgata

SEQ ID NO: 155910 - DNA, 26 bp, Artificial sequence
  SiRNA target sequence
tataatttaattagtaaggttgatat

SEQ ID NO: 155911 - DNA, 26 bp, Artificial sequence
  SiRNA target sequence
ataatttaattagtaaggttgatatt

SEQ ID NO: 155912 - DNA, 26 bp, Artificial sequence
  SiRNA target sequence
taatttaattagtaaggttgatattc

SEQ ID NO: 155913 - DNA, 26 bp, Artificial sequence
  SiRNA target sequence
aatttaattagtaaggttgatattcc

SEQ ID NO: 155914 - DNA, 26 bp, Artificial sequence
  SiRNA target sequence
atttaattagtaaggttgatattcca

SEQ ID NO: 155915 - DNA, 26 bp, Artificial sequence
  SiRNA target sequence
tttaattagtaaggttgatattccat

SEQ ID NO: 155916 - DNA, 26 bp, Artificial sequence
  SiRNA target sequence
ttaattagtaaggttgatattccatt

SEQ ID NO: 155917 - DNA, 26 bp, Artificial sequence
  SiRNA target sequence
taattagtaaggttgatattccattg

SEQ ID NO: 155918 - DNA, 26 bp, Artificial sequence
  SiRNA target sequence
aattagtaaggttgatattccattgt

SEQ ID NO: 155919 - DNA, 26 bp, Artificial sequence
  SiRNA target sequence
attagtaaggttgatattccattgta

SEQ ID NO: 155920 - DNA, 26 bp, Artificial sequence
  SiRNA target sequence
ttagtaaggttgatattccattgtat

SEQ ID NO: 155921 - DNA, 26 bp, Artificial sequence
  SiRNA target sequence
tagtaaggttgatattccattgtatg

SEQ ID NO: 155922 - DNA, 26 bp, Artificial sequence
  SiRNA target sequence
agtaaggttgatattccattgtatgt

SEQ ID NO: 155923 - DNA, 26 bp, Artificial sequence
  SiRNA target sequence
gtaaggttgatattccattgtatgtt

SEQ ID NO: 155924 - DNA, 26 bp, Artificial sequence
  SiRNA target sequence
taaggttgatattccattgtatgttg

SEQ ID NO: 155925 - DNA, 26 bp, Artificial sequence
  SiRNA target sequence
aaggttgatattccattgtatgttgc

SEQ ID NO: 155926 - DNA, 26 bp, Artificial sequence
  SiRNA target sequence
aggttgatattccattgtatgttgct

SEQ ID NO: 155927 - DNA, 26 bp, Artificial sequence
  SiRNA target sequence
ggttgatattccattgtatgttgctt

SEQ ID NO: 155928 - DNA, 26 bp, Artificial sequence
  SiRNA target sequence
gttgatattccattgtatgttgcttt

SEQ ID NO: 155929 - DNA, 26 bp, Artificial sequence
  SiRNA target sequence
ttgatattccattgtatgttgctttg

SEQ ID NO: 155930 - DNA, 26 bp, Artificial sequence
  SiRNA target sequence
tgatattccattgtatgttgctttgg

SEQ ID NO: 155931 - DNA, 26 bp, Artificial sequence
  SiRNA target sequence
gatattccattgtatgttgctttggc

SEQ ID NO: 155932 - DNA, 26 bp, Artificial sequence
  SiRNA target sequence
atattccattgtatgttgctttggca

SEQ ID NO: 155933 - DNA, 26 bp, Artificial sequence
  SiRNA target sequence
tattccattgtatgttgctttggcag

SEQ ID NO: 155934 - DNA, 26 bp, Artificial sequence
  SiRNA target sequence
attccattgtatgttgctttggcagg

SEQ ID NO: 155935 - DNA, 26 bp, Artificial sequence
  SiRNA target sequence
ttccattgtatgttgctttggcaggc

SEQ ID NO: 155936 - DNA, 26 bp, Artificial sequence
  SiRNA target sequence
tccattgtatgttgctttggcaggcg

SEQ ID NO: 155937 - DNA, 26 bp, Artificial sequence
  SiRNA target sequence
ccattgtatgttgctttggcaggcgg

SEQ ID NO: 155938 - DNA, 26 bp, Artificial sequence
  SiRNA target sequence
cattgtatgttgctttggcaggcgga

SEQ ID NO: 155939 - DNA, 26 bp, Artificial sequence
  SiRNA target sequence
attgtatgttgctttggcaggcggac

SEQ ID NO: 155940 - DNA, 26 bp, Artificial sequence
  SiRNA target sequence
ttgtatgttgctttggcaggcggaca

SEQ ID NO: 155941 - DNA, 26 bp, Artificial sequence
  SiRNA target sequence
tgtatgttgctttggcaggcggacag

SEQ ID NO: 155942 - DNA, 26 bp, Artificial sequence
  SiRNA target sequence
gtatgttgctttggcaggcggacaga

SEQ ID NO: 155943 - DNA, 26 bp, Artificial sequence
  SiRNA target sequence
tatgttgctttggcaggcggacagat

SEQ ID NO: 155944 - DNA, 26 bp, Artificial sequence
  SiRNA target sequence
atgttgctttggcaggcggacagatt

SEQ ID NO: 155945 - DNA, 26 bp, Artificial sequence
  SiRNA target sequence
tgttgctttggcaggcggacagatta

SEQ ID NO: 155946 - DNA, 26 bp, Artificial sequence
  SiRNA target sequence
gttgctttggcaggcggacagattat

SEQ ID NO: 155947 - DNA, 26 bp, Artificial sequence
  SiRNA target sequence
ttgctttggcaggcggacagattata

SEQ ID NO: 155948 - DNA, 26 bp, Artificial sequence
  SiRNA target sequence
tgctttggcaggcggacagattatat

SEQ ID NO: 155949 - DNA, 26 bp, Artificial sequence
  SiRNA target sequence
gctttggcaggcggacagattatatt

SEQ ID NO: 155950 - DNA, 26 bp, Artificial sequence
  SiRNA target sequence
ctttggcaggcggacagattatattt

SEQ ID NO: 155951 - DNA, 26 bp, Artificial sequence
  SiRNA target sequence
tttggcaggcggacagattatatttg

SEQ ID NO: 155952 - DNA, 26 bp, Artificial sequence
  SiRNA target sequence
ttggcaggcggacagattatatttga

SEQ ID NO: 155953 - DNA, 26 bp, Artificial sequence
  SiRNA target sequence
tggcaggcggacagattatatttgaa

SEQ ID NO: 155954 - DNA, 26 bp, Artificial sequence
  SiRNA target sequence
ggcaggcggacagattatatttgaac

SEQ ID NO: 155955 - DNA, 26 bp, Artificial sequence
  SiRNA target sequence
gcaggcggacagattatatttgaaca

SEQ ID NO: 155956 - DNA, 26 bp, Artificial sequence
  SiRNA target sequence
caggcggacagattatatttgaacat

SEQ ID NO: 155957 - DNA, 26 bp, Artificial sequence
  SiRNA target sequence
aggcggacagattatatttgaacata

SEQ ID NO: 155958 - DNA, 26 bp, Artificial sequence
  SiRNA target sequence
ggcggacagattatatttgaacatat

SEQ ID NO: 155959 - DNA, 26 bp, Artificial sequence
  SiRNA target sequence
gcggacagattatatttgaacatatc

SEQ ID NO: 155960 - DNA, 26 bp, Artificial sequence
  SiRNA target sequence
cggacagattatatttgaacatatca

SEQ ID NO: 155961 - DNA, 26 bp, Artificial sequence
  SiRNA target sequence
ggacagattatatttgaacatatcac

SEQ ID NO: 155962 - DNA, 26 bp, Artificial sequence
  SiRNA target sequence
gacagattatatttgaacatatcact

SEQ ID NO: 155963 - DNA, 26 bp, Artificial sequence
  SiRNA target sequence
acagattatatttgaacatatcactg

SEQ ID NO: 155964 - DNA, 26 bp, Artificial sequence
  SiRNA target sequence
cagattatatttgaacatatcactgg

SEQ ID NO: 155965 - DNA, 26 bp, Artificial sequence
  SiRNA target sequence
agattatatttgaacatatcactggt

SEQ ID NO: 155966 - DNA, 26 bp, Artificial sequence
  SiRNA target sequence
gattatatttgaacatatcactggta

SEQ ID NO: 155967 - DNA, 26 bp, Artificial sequence
  SiRNA target sequence
attatatttgaacatatcactggtaa

SEQ ID NO: 155968 - DNA, 26 bp, Artificial sequence
  SiRNA target sequence
ttatatttgaacatatcactggtaag

SEQ ID NO: 155969 - DNA, 26 bp, Artificial sequence
  SiRNA target sequence
tatatttgaacatatcactggtaaga

SEQ ID NO: 155970 - DNA, 26 bp, Artificial sequence
  SiRNA target sequence
atatttgaacatatcactggtaagaa

SEQ ID NO: 155971 - DNA, 26 bp, Artificial sequence
  SiRNA target sequence
tatttgaacatatcactggtaagaaa

SEQ ID NO: 155972 - DNA, 26 bp, Artificial sequence
  SiRNA target sequence
atttgaacatatcactggtaagaaat

SEQ ID NO: 155973 - DNA, 26 bp, Artificial sequence
  SiRNA target sequence
tttgaacatatcactggtaagaaatt

SEQ ID NO: 155974 - DNA, 26 bp, Artificial sequence
  SiRNA target sequence
ttgaacatatcactggtaagaaattt

SEQ ID NO: 155975 - DNA, 26 bp, Artificial sequence
  SiRNA target sequence
tgaacatatcactggtaagaaatttg

SEQ ID NO: 155976 - DNA, 26 bp, Artificial sequence
  SiRNA target sequence
gaacatatcactggtaagaaatttga

SEQ ID NO: 155977 - DNA, 26 bp, Artificial sequence
  SiRNA target sequence
aacatatcactggtaagaaatttgaa

SEQ ID NO: 155978 - DNA, 26 bp, Artificial sequence
  SiRNA target sequence
acatatcactggtaagaaatttgaaa

SEQ ID NO: 155979 - DNA, 26 bp, Artificial sequence
  SiRNA target sequence
catatcactggtaagaaatttgaaat

SEQ ID NO: 155980 - DNA, 26 bp, Artificial sequence
  SiRNA target sequence
atatcactggtaagaaatttgaaatt

SEQ ID NO: 155981 - DNA, 26 bp, Artificial sequence
  SiRNA target sequence
tatcactggtaagaaatttgaaatta

SEQ ID NO: 155982 - DNA, 26 bp, Artificial sequence
  SiRNA target sequence
atcactggtaagaaatttgaaattac

SEQ ID NO: 155983 - DNA, 26 bp, Artificial sequence
  SiRNA target sequence
tcactggtaagaaatttgaaattact

SEQ ID NO: 155984 - DNA, 26 bp, Artificial sequence
  SiRNA target sequence
cactggtaagaaatttgaaattactt

SEQ ID NO: 155985 - DNA, 26 bp, Artificial sequence
  SiRNA target sequence
actggtaagaaatttgaaattacttt

SEQ ID NO: 155986 - DNA, 26 bp, Artificial sequence
  SiRNA target sequence
ctggtaagaaatttgaaattacttta

SEQ ID NO: 155987 - DNA, 26 bp, Artificial sequence
  SiRNA target sequence
tggtaagaaatttgaaattactttat

SEQ ID NO: 155988 - DNA, 26 bp, Artificial sequence
  SiRNA target sequence
ggtaagaaatttgaaattactttata

SEQ ID NO: 155989 - DNA, 26 bp, Artificial sequence
  SiRNA target sequence
gtaagaaatttgaaattactttatat

SEQ ID NO: 155990 - DNA, 26 bp, Artificial sequence
  SiRNA target sequence
taagaaatttgaaattactttatatc

SEQ ID NO: 155991 - DNA, 26 bp, Artificial sequence
  SiRNA target sequence
aagaaatttgaaattactttatatcc

SEQ ID NO: 155992 - DNA, 26 bp, Artificial sequence
  SiRNA target sequence
agaaatttgaaattactttatatcca

SEQ ID NO: 155993 - DNA, 26 bp, Artificial sequence
  SiRNA target sequence
gaaatttgaaattactttatatccat

SEQ ID NO: 155994 - DNA, 26 bp, Artificial sequence
  SiRNA target sequence
aaatttgaaattactttatatccatt

SEQ ID NO: 155995 - DNA, 26 bp, Artificial sequence
  SiRNA target sequence
aatttgaaattactttatatccattt

SEQ ID NO: 155996 - DNA, 26 bp, Artificial sequence
  SiRNA target sequence
atttgaaattactttatatccattta

SEQ ID NO: 155997 - DNA, 26 bp, Artificial sequence
  SiRNA target sequence
tttgaaattactttatatccatttaa

SEQ ID NO: 155998 - DNA, 26 bp, Artificial sequence
  SiRNA target sequence
ttgaaattactttatatccatttaaa

SEQ ID NO: 155999 - DNA, 26 bp, Artificial sequence
  SiRNA target sequence
tgaaattactttatatccatttaaag

SEQ ID NO: 156000 - DNA, 26 bp, Artificial sequence
  SiRNA target sequence
gaaattactttatatccatttaaaga

SEQ ID NO: 156001 - DNA, 26 bp, Artificial sequence
  SiRNA target sequence
aaattactttatatccatttaaagat

SEQ ID NO: 156002 - DNA, 26 bp, Artificial sequence
  SiRNA target sequence
aattactttatatccatttaaagatt

SEQ ID NO: 156003 - DNA, 26 bp, Artificial sequence
  SiRNA target sequence
attactttatatccatttaaagattt

SEQ ID NO: 156004 - DNA, 26 bp, Artificial sequence
  SiRNA target sequence
ttactttatatccatttaaagattta

SEQ ID NO: 156005 - DNA, 26 bp, Artificial sequence
  SiRNA target sequence
tactttatatccatttaaagatttaa

SEQ ID NO: 156006 - DNA, 26 bp, Artificial sequence
  SiRNA target sequence
actttatatccatttaaagatttaaa

SEQ ID NO: 156007 - DNA, 26 bp, Artificial sequence
  SiRNA target sequence
ctttatatccatttaaagatttaaag

SEQ ID NO: 156008 - DNA, 26 bp, Artificial sequence
  SiRNA target sequence
tttatatccatttaaagatttaaaga

SEQ ID NO: 156009 - DNA, 26 bp, Artificial sequence
  SiRNA target sequence
ttatatccatttaaagatttaaagaa

SEQ ID NO: 156010 - DNA, 26 bp, Artificial sequence
  SiRNA target sequence
tatatccatttaaagatttaaagaaa

SEQ ID NO: 156011 - DNA, 26 bp, Artificial sequence
  SiRNA target sequence
atatccatttaaagatttaaagaaat

SEQ ID NO: 156012 - DNA, 26 bp, Artificial sequence
  SiRNA target sequence
tatccatttaaagatttaaagaaatg

SEQ ID NO: 156013 - DNA, 26 bp, Artificial sequence
  SiRNA target sequence
atccatttaaagatttaaagaaatgt

SEQ ID NO: 156014 - DNA, 26 bp, Artificial sequence
  SiRNA target sequence
tccatttaaagatttaaagaaatgta

SEQ ID NO: 156015 - DNA, 26 bp, Artificial sequence
  SiRNA target sequence
ccatttaaagatttaaagaaatgtat

SEQ ID NO: 156016 - DNA, 26 bp, Artificial sequence
  SiRNA target sequence
catttaaagatttaaagaaatgtatt

SEQ ID NO: 156017 - DNA, 26 bp, Artificial sequence
  SiRNA target sequence
atttaaagatttaaagaaatgtatta

SEQ ID NO: 156018 - DNA, 26 bp, Artificial sequence
  SiRNA target sequence
tttaaagatttaaagaaatgtattat

SEQ ID NO: 156019 - DNA, 26 bp, Artificial sequence
  SiRNA target sequence
ttaaagatttaaagaaatgtattatt

SEQ ID NO: 156020 - DNA, 26 bp, Artificial sequence
  SiRNA target sequence
taaagatttaaagaaatgtattattt

SEQ ID NO: 156021 - DNA, 26 bp, Artificial sequence
  SiRNA target sequence
aaagatttaaagaaatgtattatttt

SEQ ID NO: 156022 - DNA, 26 bp, Artificial sequence
  SiRNA target sequence
aagatttaaagaaatgtattatttta

SEQ ID NO: 156023 - DNA, 26 bp, Artificial sequence
  SiRNA target sequence
agatttaaagaaatgtattattttaa

SEQ ID NO: 156024 - DNA, 26 bp, Artificial sequence
  SiRNA target sequence
gatttaaagaaatgtattattttaaa

SEQ ID NO: 156025 - DNA, 26 bp, Artificial sequence
  SiRNA target sequence
atttaaagaaatgtattattttaaaa

SEQ ID NO: 156026 - DNA, 26 bp, Artificial sequence
  SiRNA target sequence
tttaaagaaatgtattattttaaaag

SEQ ID NO: 156027 - DNA, 26 bp, Artificial sequence
  SiRNA target sequence
ttaaagaaatgtattattttaaaagg

SEQ ID NO: 156028 - DNA, 26 bp, Artificial sequence
  SiRNA target sequence
taaagaaatgtattattttaaaaggc

SEQ ID NO: 156029 - DNA, 26 bp, Artificial sequence
  SiRNA target sequence
aaagaaatgtattattttaaaaggcg

SEQ ID NO: 156030 - DNA, 26 bp, Artificial sequence
  SiRNA target sequence
aagaaatgtattattttaaaaggcga

SEQ ID NO: 156031 - DNA, 26 bp, Artificial sequence
  SiRNA target sequence
agaaatgtattattttaaaaggcgaa

SEQ ID NO: 156032 - DNA, 26 bp, Artificial sequence
  SiRNA target sequence
gaaatgtattattttaaaaggcgaag

SEQ ID NO: 156033 - DNA, 26 bp, Artificial sequence
  SiRNA target sequence
aaatgtattattttaaaaggcgaagg

SEQ ID NO: 156034 - DNA, 26 bp, Artificial sequence
  SiRNA target sequence
aatgtattattttaaaaggcgaaggt

SEQ ID NO: 156035 - DNA, 26 bp, Artificial sequence
  SiRNA target sequence
atgtattattttaaaaggcgaaggtt

SEQ ID NO: 156036 - DNA, 26 bp, Artificial sequence
  SiRNA target sequence
tgtattattttaaaaggcgaaggttt

SEQ ID NO: 156037 - DNA, 26 bp, Artificial sequence
  SiRNA target sequence
gtattattttaaaaggcgaaggtttt

SEQ ID NO: 156038 - DNA, 26 bp, Artificial sequence
  SiRNA target sequence
tattattttaaaaggcgaaggtttta

SEQ ID NO: 156039 - DNA, 26 bp, Artificial sequence
  SiRNA target sequence
attattttaaaaggcgaaggttttaa

SEQ ID NO: 156040 - DNA, 26 bp, Artificial sequence
  SiRNA target sequence
ttattttaaaaggcgaaggttttaaa

SEQ ID NO: 156041 - DNA, 26 bp, Artificial sequence
  SiRNA target sequence
tattttaaaaggcgaaggttttaaaa

SEQ ID NO: 156042 - DNA, 26 bp, Artificial sequence
  SiRNA target sequence
attttaaaaggcgaaggttttaaaat

SEQ ID NO: 156043 - DNA, 26 bp, Artificial sequence
  SiRNA target sequence
ttttaaaaggcgaaggttttaaaata

SEQ ID NO: 156044 - DNA, 26 bp, Artificial sequence
  SiRNA target sequence
tttaaaaggcgaaggttttaaaataa

SEQ ID NO: 156045 - DNA, 26 bp, Artificial sequence
  SiRNA target sequence
ttaaaaggcgaaggttttaaaataaa

SEQ ID NO: 156046 - DNA, 26 bp, Artificial sequence
  SiRNA target sequence
taaaaggcgaaggttttaaaataaaa

SEQ ID NO: 156047 - DNA, 26 bp, Artificial sequence
  SiRNA target sequence
aaaaggcgaaggttttaaaataaaaa

SEQ ID NO: 156048 - DNA, 26 bp, Artificial sequence
  SiRNA target sequence
aaaggcgaaggttttaaaataaaaaa

SEQ ID NO: 156049 - DNA, 26 bp, Artificial sequence
  SiRNA target sequence
aaggcgaaggttttaaaataaaaaat

SEQ ID NO: 156050 - DNA, 26 bp, Artificial sequence
  SiRNA target sequence
aggcgaaggttttaaaataaaaaata

SEQ ID NO: 156051 - DNA, 26 bp, Artificial sequence
  SiRNA target sequence
ggcgaaggttttaaaataaaaaatag

SEQ ID NO: 156052 - DNA, 26 bp, Artificial sequence
  SiRNA target sequence
gcgaaggttttaaaataaaaaatagt

SEQ ID NO: 156053 - DNA, 26 bp, Artificial sequence
  SiRNA target sequence
cgaaggttttaaaataaaaaatagtt

SEQ ID NO: 156054 - DNA, 26 bp, Artificial sequence
  SiRNA target sequence
gaaggttttaaaataaaaaatagtta

SEQ ID NO: 156055 - DNA, 26 bp, Artificial sequence
  SiRNA target sequence
aaggttttaaaataaaaaatagttat

SEQ ID NO: 156056 - DNA, 26 bp, Artificial sequence
  SiRNA target sequence
aggttttaaaataaaaaatagttatt

SEQ ID NO: 156057 - DNA, 26 bp, Artificial sequence
  SiRNA target sequence
ggttttaaaataaaaaatagttattc

SEQ ID NO: 156058 - DNA, 26 bp, Artificial sequence
  SiRNA target sequence
gttttaaaataaaaaatagttattcg

SEQ ID NO: 156059 - DNA, 26 bp, Artificial sequence
  SiRNA target sequence
ttttaaaataaaaaatagttattcgg

SEQ ID NO: 156060 - DNA, 26 bp, Artificial sequence
  SiRNA target sequence
tttaaaataaaaaatagttattcggg

SEQ ID NO: 156061 - DNA, 26 bp, Artificial sequence
  SiRNA target sequence
ttaaaataaaaaatagttattcgggt

SEQ ID NO: 156062 - DNA, 26 bp, Artificial sequence
  SiRNA target sequence
taaaataaaaaatagttattcgggtg

SEQ ID NO: 156063 - DNA, 26 bp, Artificial sequence
  SiRNA target sequence
aaaataaaaaatagttattcgggtgg

SEQ ID NO: 156064 - DNA, 26 bp, Artificial sequence
  SiRNA target sequence
aaataaaaaatagttattcgggtggt

SEQ ID NO: 156065 - DNA, 26 bp, Artificial sequence
  SiRNA target sequence
aataaaaaatagttattcgggtggtg

SEQ ID NO: 156066 - DNA, 26 bp, Artificial sequence
  SiRNA target sequence
ataaaaaatagttattcgggtggtga

SEQ ID NO: 156067 - DNA, 26 bp, Artificial sequence
  SiRNA target sequence
taaaaaatagttattcgggtggtgat

SEQ ID NO: 156068 - DNA, 26 bp, Artificial sequence
  SiRNA target sequence
aaaaaatagttattcgggtggtgatc

SEQ ID NO: 156069 - DNA, 26 bp, Artificial sequence
  SiRNA target sequence
aaaaatagttattcgggtggtgatct

SEQ ID NO: 156070 - DNA, 26 bp, Artificial sequence
  SiRNA target sequence
aaaatagttattcgggtggtgatctt

SEQ ID NO: 156071 - DNA, 26 bp, Artificial sequence
  SiRNA target sequence
aaatagttattcgggtggtgatctta

SEQ ID NO: 156072 - DNA, 26 bp, Artificial sequence
  SiRNA target sequence
aatagttattcgggtggtgatcttat

SEQ ID NO: 156073 - DNA, 26 bp, Artificial sequence
  SiRNA target sequence
atagttattcgggtggtgatcttatt

SEQ ID NO: 156074 - DNA, 26 bp, Artificial sequence
  SiRNA target sequence
tagttattcgggtggtgatcttattc

SEQ ID NO: 156075 - DNA, 26 bp, Artificial sequence
  SiRNA target sequence
agttattcgggtggtgatcttattct

SEQ ID NO: 156076 - DNA, 26 bp, Artificial sequence
  SiRNA target sequence
gttattcgggtggtgatcttattctc

SEQ ID NO: 156077 - DNA, 26 bp, Artificial sequence
  SiRNA target sequence
ttattcgggtggtgatcttattctcg

SEQ ID NO: 156078 - DNA, 26 bp, Artificial sequence
  SiRNA target sequence
tattcgggtggtgatcttattctcga

SEQ ID NO: 156079 - DNA, 26 bp, Artificial sequence
  SiRNA target sequence
attcgggtggtgatcttattctcgaa

SEQ ID NO: 156080 - DNA, 26 bp, Artificial sequence
  SiRNA target sequence
ttcgggtggtgatcttattctcgaac

SEQ ID NO: 156081 - DNA, 26 bp, Artificial sequence
  SiRNA target sequence
tcgggtggtgatcttattctcgaacc

SEQ ID NO: 156082 - DNA, 26 bp, Artificial sequence
  SiRNA target sequence
cgggtggtgatcttattctcgaacct

SEQ ID NO: 156083 - DNA, 26 bp, Artificial sequence
  SiRNA target sequence
gggtggtgatcttattctcgaaccta

SEQ ID NO: 156084 - DNA, 26 bp, Artificial sequence
  SiRNA target sequence
ggtggtgatcttattctcgaacctaa

SEQ ID NO: 156085 - DNA, 26 bp, Artificial sequence
  SiRNA target sequence
gtggtgatcttattctcgaacctaat

SEQ ID NO: 156086 - DNA, 26 bp, Artificial sequence
  SiRNA target sequence
tggtgatcttattctcgaacctaata

SEQ ID NO: 156087 - DNA, 26 bp, Artificial sequence
  SiRNA target sequence
ggtgatcttattctcgaacctaatat

SEQ ID NO: 156088 - DNA, 26 bp, Artificial sequence
  SiRNA target sequence
gtgatcttattctcgaacctaatata

SEQ ID NO: 156089 - DNA, 26 bp, Artificial sequence
  SiRNA target sequence
tgatcttattctcgaacctaatataa

SEQ ID NO: 156090 - DNA, 26 bp, Artificial sequence
  SiRNA target sequence
gatcttattctcgaacctaatataat

SEQ ID NO: 156091 - DNA, 26 bp, Artificial sequence
  SiRNA target sequence
atcttattctcgaacctaatataatt

SEQ ID NO: 156092 - DNA, 26 bp, Artificial sequence
  SiRNA target sequence
tcttattctcgaacctaatataatta

SEQ ID NO: 156093 - DNA, 26 bp, Artificial sequence
  SiRNA target sequence
cttattctcgaacctaatataattat

SEQ ID NO: 156094 - DNA, 26 bp, Artificial sequence
  SiRNA target sequence
ttattctcgaacctaatataattata

SEQ ID NO: 156095 - DNA, 26 bp, Artificial sequence
  SiRNA target sequence
tattctcgaacctaatataattatag

SEQ ID NO: 156096 - DNA, 26 bp, Artificial sequence
  SiRNA target sequence
attctcgaacctaatataattataga

SEQ ID NO: 156097 - DNA, 26 bp, Artificial sequence
  SiRNA target sequence
ttctcgaacctaatataattatagat

SEQ ID NO: 156098 - DNA, 26 bp, Artificial sequence
  SiRNA target sequence
tctcgaacctaatataattatagata

SEQ ID NO: 156099 - DNA, 26 bp, Artificial sequence
  SiRNA target sequence
ctcgaacctaatataattatagataa

SEQ ID NO: 156100 - DNA, 26 bp, Artificial sequence
  SiRNA target sequence
tcgaacctaatataattatagataag

SEQ ID NO: 156101 - DNA, 26 bp, Artificial sequence
  SiRNA target sequence
cgaacctaatataattatagataaga

SEQ ID NO: 156102 - DNA, 26 bp, Artificial sequence
  SiRNA target sequence
gaacctaatataattatagataagaa

SEQ ID NO: 156103 - DNA, 26 bp, Artificial sequence
  SiRNA target sequence
aacctaatataattatagataagaat

SEQ ID NO: 156104 - DNA, 26 bp, Artificial sequence
  SiRNA target sequence
acctaatataattatagataagaata

SEQ ID NO: 156105 - DNA, 26 bp, Artificial sequence
  SiRNA target sequence
cctaatataattatagataagaatat

SEQ ID NO: 156106 - DNA, 26 bp, Artificial sequence
  SiRNA target sequence
ctaatataattatagataagaatatt

SEQ ID NO: 156107 - DNA, 26 bp, Artificial sequence
  SiRNA target sequence
taatataattatagataagaatattg

SEQ ID NO: 156108 - DNA, 26 bp, Artificial sequence
  SiRNA target sequence
aatataattatagataagaatattga

SEQ ID NO: 156109 - DNA, 26 bp, Artificial sequence
  SiRNA target sequence
atataattatagataagaatattgat

SEQ ID NO: 156110 - DNA, 26 bp, Artificial sequence
  SiRNA target sequence
tataattatagataagaatattgata

SEQ ID NO: 156111 - DNA, 26 bp, Artificial sequence
  SiRNA target sequence
ataattatagataagaatattgataa

SEQ ID NO: 156112 - DNA, 26 bp, Artificial sequence
  SiRNA target sequence
taattatagataagaatattgataaa

SEQ ID NO: 156113 - DNA, 26 bp, Artificial sequence
  SiRNA target sequence
aattatagataagaatattgataaag

SEQ ID NO: 156114 - DNA, 26 bp, Artificial sequence
  SiRNA target sequence
attatagataagaatattgataaaga

SEQ ID NO: 156115 - DNA, 26 bp, Artificial sequence
  SiRNA target sequence
ttatagataagaatattgataaagat

SEQ ID NO: 156116 - DNA, 26 bp, Artificial sequence
  SiRNA target sequence
tatagataagaatattgataaagatt

SEQ ID NO: 156117 - DNA, 26 bp, Artificial sequence
  SiRNA target sequence
atagataagaatattgataaagattt

SEQ ID NO: 156118 - DNA, 26 bp, Artificial sequence
  SiRNA target sequence
tagataagaatattgataaagattta

SEQ ID NO: 156119 - DNA, 26 bp, Artificial sequence
  SiRNA target sequence
agataagaatattgataaagatttat

SEQ ID NO: 156120 - DNA, 26 bp, Artificial sequence
  SiRNA target sequence
gataagaatattgataaagatttatt

SEQ ID NO: 156121 - DNA, 26 bp, Artificial sequence
  SiRNA target sequence
ataagaatattgataaagatttatta

SEQ ID NO: 156122 - DNA, 26 bp, Artificial sequence
  SiRNA target sequence
taagaatattgataaagatttattag

SEQ ID NO: 156123 - DNA, 26 bp, Artificial sequence
  SiRNA target sequence
aagaatattgataaagatttattagc

SEQ ID NO: 156124 - DNA, 26 bp, Artificial sequence
  SiRNA target sequence
agaatattgataaagatttattagca

SEQ ID NO: 156125 - DNA, 26 bp, Artificial sequence
  SiRNA target sequence
gaatattgataaagatttattagcac

SEQ ID NO: 156126 - DNA, 26 bp, Artificial sequence
  SiRNA target sequence
aatattgataaagatttattagcacg

SEQ ID NO: 156127 - DNA, 26 bp, Artificial sequence
  SiRNA target sequence
atattgataaagatttattagcacgc

SEQ ID NO: 156128 - DNA, 26 bp, Artificial sequence
  SiRNA target sequence
tattgataaagatttattagcacgcg

SEQ ID NO: 156129 - DNA, 26 bp, Artificial sequence
  SiRNA target sequence
attgataaagatttattagcacgcgc

SEQ ID NO: 156130 - DNA, 26 bp, Artificial sequence
  SiRNA target sequence
ttgataaagatttattagcacgcgcc

SEQ ID NO: 156131 - DNA, 26 bp, Artificial sequence
  SiRNA target sequence
tgataaagatttattagcacgcgcct

SEQ ID NO: 156132 - DNA, 26 bp, Artificial sequence
  SiRNA target sequence
gataaagatttattagcacgcgcctt

SEQ ID NO: 156133 - DNA, 26 bp, Artificial sequence
  SiRNA target sequence
ataaagatttattagcacgcgccttg

SEQ ID NO: 156134 - DNA, 26 bp, Artificial sequence
  SiRNA target sequence
taaagatttattagcacgcgccttga

SEQ ID NO: 156135 - DNA, 26 bp, Artificial sequence
  SiRNA target sequence
aaagatttattagcacgcgccttgaa

SEQ ID NO: 156136 - DNA, 26 bp, Artificial sequence
  SiRNA target sequence
aagatttattagcacgcgccttgaat

SEQ ID NO: 156137 - DNA, 26 bp, Artificial sequence
  SiRNA target sequence
agatttattagcacgcgccttgaatt

SEQ ID NO: 156138 - DNA, 26 bp, Artificial sequence
  SiRNA target sequence
gatttattagcacgcgccttgaatta

SEQ ID NO: 156139 - DNA, 26 bp, Artificial sequence
  SiRNA target sequence
atttattagcacgcgccttgaattat

SEQ ID NO: 156140 - DNA, 26 bp, Artificial sequence
  SiRNA target sequence
tttattagcacgcgccttgaattatg

SEQ ID NO: 156141 - DNA, 26 bp, Artificial sequence
  SiRNA target sequence
ttattagcacgcgccttgaattatgt

SEQ ID NO: 156142 - DNA, 26 bp, Artificial sequence
  SiRNA target sequence
tattagcacgcgccttgaattatgtt

SEQ ID NO: 156143 - DNA, 26 bp, Artificial sequence
  SiRNA target sequence
attagcacgcgccttgaattatgttc

SEQ ID NO: 156144 - DNA, 26 bp, Artificial sequence
  SiRNA target sequence
ttagcacgcgccttgaattatgttcc

SEQ ID NO: 156145 - DNA, 26 bp, Artificial sequence
  SiRNA target sequence
tagcacgcgccttgaattatgttcct

SEQ ID NO: 156146 - DNA, 26 bp, Artificial sequence
  SiRNA target sequence
agcacgcgccttgaattatgttcctg

SEQ ID NO: 156147 - DNA, 26 bp, Artificial sequence
  SiRNA target sequence
gcacgcgccttgaattatgttcctgt

SEQ ID NO: 156148 - DNA, 26 bp, Artificial sequence
  SiRNA target sequence
cacgcgccttgaattatgttcctgta

SEQ ID NO: 156149 - DNA, 26 bp, Artificial sequence
  SiRNA target sequence
acgcgccttgaattatgttcctgtaa

SEQ ID NO: 156150 - DNA, 26 bp, Artificial sequence
  SiRNA target sequence
cgcgccttgaattatgttcctgtaag

SEQ ID NO: 156151 - DNA, 26 bp, Artificial sequence
  SiRNA target sequence
gcgccttgaattatgttcctgtaaga

SEQ ID NO: 156152 - DNA, 26 bp, Artificial sequence
  SiRNA target sequence
cgccttgaattatgttcctgtaagaa

SEQ ID NO: 156153 - DNA, 26 bp, Artificial sequence
  SiRNA target sequence
gccttgaattatgttcctgtaagaaa

SEQ ID NO: 156154 - DNA, 26 bp, Artificial sequence
  SiRNA target sequence
ccttgaattatgttcctgtaagaaaa

SEQ ID NO: 156155 - DNA, 26 bp, Artificial sequence
  SiRNA target sequence
cttgaattatgttcctgtaagaaaag

SEQ ID NO: 156156 - DNA, 26 bp, Artificial sequence
  SiRNA target sequence
ttgaattatgttcctgtaagaaaaga

SEQ ID NO: 156157 - DNA, 26 bp, Artificial sequence
  SiRNA target sequence
tgaattatgttcctgtaagaaaagat

SEQ ID NO: 156158 - DNA, 26 bp, Artificial sequence
  SiRNA target sequence
gaattatgttcctgtaagaaaagatt

SEQ ID NO: 156159 - DNA, 26 bp, Artificial sequence
  SiRNA target sequence
aattatgttcctgtaagaaaagattt

SEQ ID NO: 156160 - DNA, 26 bp, Artificial sequence
  SiRNA target sequence
attatgttcctgtaagaaaagatttt

SEQ ID NO: 156161 - DNA, 26 bp, Artificial sequence
  SiRNA target sequence
ttatgttcctgtaagaaaagatttta

SEQ ID NO: 156162 - DNA, 26 bp, Artificial sequence
  SiRNA target sequence
tatgttcctgtaagaaaagattttac

SEQ ID NO: 156163 - DNA, 26 bp, Artificial sequence
  SiRNA target sequence
atgttcctgtaagaaaagattttaca

SEQ ID NO: 156164 - DNA, 26 bp, Artificial sequence
  SiRNA target sequence
tgttcctgtaagaaaagattttacag

SEQ ID NO: 156165 - DNA, 26 bp, Artificial sequence
  SiRNA target sequence
gttcctgtaagaaaagattttacagg

SEQ ID NO: 156166 - DNA, 26 bp, Artificial sequence
  SiRNA target sequence
ttcctgtaagaaaagattttacagga

SEQ ID NO: 156167 - DNA, 26 bp, Artificial sequence
  SiRNA target sequence
tcctgtaagaaaagattttacaggaa

SEQ ID NO: 156168 - DNA, 26 bp, Artificial sequence
  SiRNA target sequence
cctgtaagaaaagattttacaggaac

SEQ ID NO: 156169 - DNA, 26 bp, Artificial sequence
  SiRNA target sequence
ctgtaagaaaagattttacaggaact

SEQ ID NO: 156170 - DNA, 26 bp, Artificial sequence
  SiRNA target sequence
tgtaagaaaagattttacaggaactg

SEQ ID NO: 156171 - DNA, 26 bp, Artificial sequence
  SiRNA target sequence
gtaagaaaagattttacaggaactgc

SEQ ID NO: 156172 - DNA, 26 bp, Artificial sequence
  SiRNA target sequence
taagaaaagattttacaggaactgct

SEQ ID NO: 156173 - DNA, 26 bp, Artificial sequence
  SiRNA target sequence
aagaaaagattttacaggaactgctg

SEQ ID NO: 156174 - DNA, 26 bp, Artificial sequence
  SiRNA target sequence
agaaaagattttacaggaactgctgt

SEQ ID NO: 156175 - DNA, 26 bp, Artificial sequence
  SiRNA target sequence
gaaaagattttacaggaactgctgtt

SEQ ID NO: 156176 - DNA, 26 bp, Artificial sequence
  SiRNA target sequence
aaaagattttacaggaactgctgttc

SEQ ID NO: 156177 - DNA, 26 bp, Artificial sequence
  SiRNA target sequence
aaagattttacaggaactgctgttcc

SEQ ID NO: 156178 - DNA, 26 bp, Artificial sequence
  SiRNA target sequence
aagattttacaggaactgctgttcca

SEQ ID NO: 156179 - DNA, 26 bp, Artificial sequence
  SiRNA target sequence
agattttacaggaactgctgttccaa

SEQ ID NO: 156180 - DNA, 26 bp, Artificial sequence
  SiRNA target sequence
gattttacaggaactgctgttccaaa

SEQ ID NO: 156181 - DNA, 26 bp, Artificial sequence
  SiRNA target sequence
attttacaggaactgctgttccaaaa

SEQ ID NO: 156182 - DNA, 26 bp, Artificial sequence
  SiRNA target sequence
ttttacaggaactgctgttccaaaat

SEQ ID NO: 156183 - DNA, 26 bp, Artificial sequence
  SiRNA target sequence
tttacaggaactgctgttccaaaata

SEQ ID NO: 156184 - DNA, 26 bp, Artificial sequence
  SiRNA target sequence
ttacaggaactgctgttccaaaatat

SEQ ID NO: 156185 - DNA, 26 bp, Artificial sequence
  SiRNA target sequence
tacaggaactgctgttccaaaatatg

SEQ ID NO: 156186 - DNA, 26 bp, Artificial sequence
  SiRNA target sequence
acaggaactgctgttccaaaatatgc

SEQ ID NO: 156187 - DNA, 26 bp, Artificial sequence
  SiRNA target sequence
caggaactgctgttccaaaatatgca

SEQ ID NO: 156188 - DNA, 26 bp, Artificial sequence
  SiRNA target sequence
aggaactgctgttccaaaatatgcag

SEQ ID NO: 156189 - DNA, 26 bp, Artificial sequence
  SiRNA target sequence
ggaactgctgttccaaaatatgcaga

SEQ ID NO: 156190 - DNA, 26 bp, Artificial sequence
  SiRNA target sequence
gaactgctgttccaaaatatgcagaa

SEQ ID NO: 156191 - DNA, 26 bp, Artificial sequence
  SiRNA target sequence
aactgctgttccaaaatatgcagaat

SEQ ID NO: 156192 - DNA, 26 bp, Artificial sequence
  SiRNA target sequence
actgctgttccaaaatatgcagaatt

SEQ ID NO: 156193 - DNA, 26 bp, Artificial sequence
  SiRNA target sequence
ctgctgttccaaaatatgcagaattt

SEQ ID NO: 156194 - DNA, 26 bp, Artificial sequence
  SiRNA target sequence
tgctgttccaaaatatgcagaatttg

SEQ ID NO: 156195 - DNA, 26 bp, Artificial sequence
  SiRNA target sequence
gctgttccaaaatatgcagaatttgg

SEQ ID NO: 156196 - DNA, 26 bp, Artificial sequence
  SiRNA target sequence
ctgttccaaaatatgcagaatttggt

SEQ ID NO: 156197 - DNA, 26 bp, Artificial sequence
  SiRNA target sequence
tgttccaaaatatgcagaatttggtg

SEQ ID NO: 156198 - DNA, 26 bp, Artificial sequence
  SiRNA target sequence
gttccaaaatatgcagaatttggtgt

SEQ ID NO: 156199 - DNA, 26 bp, Artificial sequence
  SiRNA target sequence
ttccaaaatatgcagaatttggtgtt

SEQ ID NO: 156200 - DNA, 26 bp, Artificial sequence
  SiRNA target sequence
tccaaaatatgcagaatttggtgtta

SEQ ID NO: 156201 - DNA, 26 bp, Artificial sequence
  SiRNA target sequence
ccaaaatatgcagaatttggtgttat

SEQ ID NO: 156202 - DNA, 26 bp, Artificial sequence
  SiRNA target sequence
caaaatatgcagaatttggtgttatg

SEQ ID NO: 156203 - DNA, 26 bp, Artificial sequence
  SiRNA target sequence
aaaatatgcagaatttggtgttatgc

SEQ ID NO: 156204 - DNA, 26 bp, Artificial sequence
  SiRNA target sequence
aaatatgcagaatttggtgttatgcc

SEQ ID NO: 156205 - DNA, 26 bp, Artificial sequence
  SiRNA target sequence
aatatgcagaatttggtgttatgcct

SEQ ID NO: 156206 - DNA, 26 bp, Artificial sequence
  SiRNA target sequence
atatgcagaatttggtgttatgccta

SEQ ID NO: 156207 - DNA, 26 bp, Artificial sequence
  SiRNA target sequence
tatgcagaatttggtgttatgcctaa

SEQ ID NO: 156208 - DNA, 26 bp, Artificial sequence
  SiRNA target sequence
atgcagaatttggtgttatgcctaaa

SEQ ID NO: 156209 - DNA, 26 bp, Artificial sequence
  SiRNA target sequence
tgcagaatttggtgttatgcctaaag

SEQ ID NO: 156210 - DNA, 26 bp, Artificial sequence
  SiRNA target sequence
gcagaatttggtgttatgcctaaaga

SEQ ID NO: 156211 - DNA, 26 bp, Artificial sequence
  SiRNA target sequence
cagaatttggtgttatgcctaaagaa

SEQ ID NO: 156212 - DNA, 26 bp, Artificial sequence
  SiRNA target sequence
agaatttggtgttatgcctaaagaac

SEQ ID NO: 156213 - DNA, 26 bp, Artificial sequence
  SiRNA target sequence
gaatttggtgttatgcctaaagaaca

SEQ ID NO: 156214 - DNA, 26 bp, Artificial sequence
  SiRNA target sequence
aatttggtgttatgcctaaagaacag

SEQ ID NO: 156215 - DNA, 26 bp, Artificial sequence
  SiRNA target sequence
atttggtgttatgcctaaagaacagg

SEQ ID NO: 156216 - DNA, 26 bp, Artificial sequence
  SiRNA target sequence
tttggtgttatgcctaaagaacagga

SEQ ID NO: 156217 - DNA, 26 bp, Artificial sequence
  SiRNA target sequence
ttggtgttatgcctaaagaacaggaa

SEQ ID NO: 156218 - DNA, 26 bp, Artificial sequence
  SiRNA target sequence
tggtgttatgcctaaagaacaggaag

SEQ ID NO: 156219 - DNA, 26 bp, Artificial sequence
  SiRNA target sequence
ggtgttatgcctaaagaacaggaaga

SEQ ID NO: 156220 - DNA, 26 bp, Artificial sequence
  SiRNA target sequence
gtgttatgcctaaagaacaggaagaa

SEQ ID NO: 156221 - DNA, 26 bp, Artificial sequence
  SiRNA target sequence
tgttatgcctaaagaacaggaagaac

SEQ ID NO: 156222 - DNA, 26 bp, Artificial sequence
  SiRNA target sequence
gttatgcctaaagaacaggaagaaca

SEQ ID NO: 156223 - DNA, 26 bp, Artificial sequence
  SiRNA target sequence
ttatgcctaaagaacaggaagaacaa

SEQ ID NO: 156224 - DNA, 26 bp, Artificial sequence
  SiRNA target sequence
tatgcctaaagaacaggaagaacaaa

SEQ ID NO: 156225 - DNA, 26 bp, Artificial sequence
  SiRNA target sequence
atgcctaaagaacaggaagaacaaaa

SEQ ID NO: 156226 - DNA, 26 bp, Artificial sequence
  SiRNA target sequence
tgcctaaagaacaggaagaacaaaac

SEQ ID NO: 156227 - DNA, 26 bp, Artificial sequence
  SiRNA target sequence
gcctaaagaacaggaagaacaaaacg

SEQ ID NO: 156228 - DNA, 26 bp, Artificial sequence
  SiRNA target sequence
cctaaagaacaggaagaacaaaacga

SEQ ID NO: 156229 - DNA, 26 bp, Artificial sequence
  SiRNA target sequence
ctaaagaacaggaagaacaaaacgaa

SEQ ID NO: 156230 - DNA, 26 bp, Artificial sequence
  SiRNA target sequence
taaagaacaggaagaacaaaacgaaa

SEQ ID NO: 156231 - DNA, 26 bp, Artificial sequence
  SiRNA target sequence
aaagaacaggaagaacaaaacgaaag

SEQ ID NO: 156232 - DNA, 26 bp, Artificial sequence
  SiRNA target sequence
aagaacaggaagaacaaaacgaaaga

SEQ ID NO: 156233 - DNA, 26 bp, Artificial sequence
  SiRNA target sequence
agaacaggaagaacaaaacgaaagag

SEQ ID NO: 156234 - DNA, 26 bp, Artificial sequence
  SiRNA target sequence
gaacaggaagaacaaaacgaaagaga

SEQ ID NO: 156235 - DNA, 26 bp, Artificial sequence
  SiRNA target sequence
aacaggaagaacaaaacgaaagagaa

SEQ ID NO: 156236 - DNA, 26 bp, Artificial sequence
  SiRNA target sequence
acaggaagaacaaaacgaaagagaaa

SEQ ID NO: 156237 - DNA, 26 bp, Artificial sequence
  SiRNA target sequence
caggaagaacaaaacgaaagagaaag

SEQ ID NO: 156238 - DNA, 26 bp, Artificial sequence
  SiRNA target sequence
aggaagaacaaaacgaaagagaaaga

SEQ ID NO: 156239 - DNA, 26 bp, Artificial sequence
  SiRNA target sequence
ggaagaacaaaacgaaagagaaagat

SEQ ID NO: 156240 - DNA, 26 bp, Artificial sequence
  SiRNA target sequence
gaagaacaaaacgaaagagaaagatt

SEQ ID NO: 156241 - DNA, 26 bp, Artificial sequence
  SiRNA target sequence
aagaacaaaacgaaagagaaagattc

SEQ ID NO: 156242 - DNA, 26 bp, Artificial sequence
  SiRNA target sequence
agaacaaaacgaaagagaaagattcg

SEQ ID NO: 156243 - DNA, 26 bp, Artificial sequence
  SiRNA target sequence
gaacaaaacgaaagagaaagattcga

SEQ ID NO: 156244 - DNA, 26 bp, Artificial sequence
  SiRNA target sequence
aacaaaacgaaagagaaagattcgaa

SEQ ID NO: 156245 - DNA, 26 bp, Artificial sequence
  SiRNA target sequence
acaaaacgaaagagaaagattcgaag

SEQ ID NO: 156246 - DNA, 26 bp, Artificial sequence
  SiRNA target sequence
caaaacgaaagagaaagattcgaagg

SEQ ID NO: 156247 - DNA, 26 bp, Artificial sequence
  SiRNA target sequence
aaaacgaaagagaaagattcgaaggt

SEQ ID NO: 156248 - DNA, 26 bp, Artificial sequence
  SiRNA target sequence
aaacgaaagagaaagattcgaaggtg

SEQ ID NO: 156249 - DNA, 26 bp, Artificial sequence
  SiRNA target sequence
aacgaaagagaaagattcgaaggtgc

SEQ ID NO: 156250 - DNA, 26 bp, Artificial sequence
  SiRNA target sequence
acgaaagagaaagattcgaaggtgca

SEQ ID NO: 156251 - DNA, 26 bp, Artificial sequence
  SiRNA target sequence
cgaaagagaaagattcgaaggtgcag

SEQ ID NO: 156252 - DNA, 26 bp, Artificial sequence
  SiRNA target sequence
gaaagagaaagattcgaaggtgcaga

SEQ ID NO: 156253 - DNA, 26 bp, Artificial sequence
  SiRNA target sequence
aaagagaaagattcgaaggtgcagaa

SEQ ID NO: 156254 - DNA, 26 bp, Artificial sequence
  SiRNA target sequence
aagagaaagattcgaaggtgcagaag

SEQ ID NO: 156255 - DNA, 26 bp, Artificial sequence
  SiRNA target sequence
agagaaagattcgaaggtgcagaaga

SEQ ID NO: 156256 - DNA, 26 bp, Artificial sequence
  SiRNA target sequence
gagaaagattcgaaggtgcagaagag

SEQ ID NO: 156257 - DNA, 26 bp, Artificial sequence
  SiRNA target sequence
agaaagattcgaaggtgcagaagagt

SEQ ID NO: 156258 - DNA, 26 bp, Artificial sequence
  SiRNA target sequence
gaaagattcgaaggtgcagaagagtt

SEQ ID NO: 156259 - DNA, 26 bp, Artificial sequence
  SiRNA target sequence
aaagattcgaaggtgcagaagagttt

SEQ ID NO: 156260 - DNA, 26 bp, Artificial sequence
  SiRNA target sequence
aagattcgaaggtgcagaagagtttt

SEQ ID NO: 156261 - DNA, 26 bp, Artificial sequence
  SiRNA target sequence
agattcgaaggtgcagaagagttttt

SEQ ID NO: 156262 - DNA, 26 bp, Artificial sequence
  SiRNA target sequence
gattcgaaggtgcagaagagtttttt

SEQ ID NO: 156263 - DNA, 26 bp, Artificial sequence
  SiRNA target sequence
attcgaaggtgcagaagagttttttg

SEQ ID NO: 156264 - DNA, 26 bp, Artificial sequence
  SiRNA target sequence
ttcgaaggtgcagaagagttttttgg

SEQ ID NO: 156265 - DNA, 26 bp, Artificial sequence
  SiRNA target sequence
tcgaaggtgcagaagagttttttgga

SEQ ID NO: 156266 - DNA, 26 bp, Artificial sequence
  SiRNA target sequence
cgaaggtgcagaagagttttttggag

SEQ ID NO: 156267 - DNA, 26 bp, Artificial sequence
  SiRNA target sequence
gaaggtgcagaagagttttttggagg

SEQ ID NO: 156268 - DNA, 26 bp, Artificial sequence
  SiRNA target sequence
aaggtgcagaagagttttttggagga

SEQ ID NO: 156269 - DNA, 26 bp, Artificial sequence
  SiRNA target sequence
aggtgcagaagagttttttggaggaa

SEQ ID NO: 156270 - DNA, 26 bp, Artificial sequence
  SiRNA target sequence
ggtgcagaagagttttttggaggaaa

SEQ ID NO: 156271 - DNA, 26 bp, Artificial sequence
  SiRNA target sequence
gtgcagaagagttttttggaggaaat

SEQ ID NO: 156272 - DNA, 26 bp, Artificial sequence
  SiRNA target sequence
tgcagaagagttttttggaggaaatg

SEQ ID NO: 156273 - DNA, 26 bp, Artificial sequence
  SiRNA target sequence
gcagaagagttttttggaggaaatgg

SEQ ID NO: 156274 - DNA, 26 bp, Artificial sequence
  SiRNA target sequence
cagaagagttttttggaggaaatggt

SEQ ID NO: 156275 - DNA, 26 bp, Artificial sequence
  SiRNA target sequence
agaagagttttttggaggaaatggta

SEQ ID NO: 156276 - DNA, 26 bp, Artificial sequence
  SiRNA target sequence
gaagagttttttggaggaaatggtag

SEQ ID NO: 156277 - DNA, 26 bp, Artificial sequence
  SiRNA target sequence
aagagttttttggaggaaatggtaga

SEQ ID NO: 156278 - DNA, 26 bp, Artificial sequence
  SiRNA target sequence
agagttttttggaggaaatggtagag

SEQ ID NO: 156279 - DNA, 26 bp, Artificial sequence
  SiRNA target sequence
gagttttttggaggaaatggtagaga

SEQ ID NO: 156280 - DNA, 26 bp, Artificial sequence
  SiRNA target sequence
agttttttggaggaaatggtagagat

SEQ ID NO: 156281 - DNA, 26 bp, Artificial sequence
  SiRNA target sequence
gttttttggaggaaatggtagagatt

SEQ ID NO: 156282 - DNA, 26 bp, Artificial sequence
  SiRNA target sequence
ttttttggaggaaatggtagagattt

SEQ ID NO: 156283 - DNA, 26 bp, Artificial sequence
  SiRNA target sequence
tttttggaggaaatggtagagatttt

SEQ ID NO: 156284 - DNA, 26 bp, Artificial sequence
  SiRNA target sequence
ttttggaggaaatggtagagattttt

SEQ ID NO: 156285 - DNA, 26 bp, Artificial sequence
  SiRNA target sequence
tttggaggaaatggtagagatttttt

SEQ ID NO: 156286 - DNA, 26 bp, Artificial sequence
  SiRNA target sequence
ttggaggaaatggtagagattttttt

SEQ ID NO: 156287 - DNA, 26 bp, Artificial sequence
  SiRNA target sequence
tggaggaaatggtagagattttttta

SEQ ID NO: 156288 - DNA, 26 bp, Artificial sequence
  SiRNA target sequence
ggaggaaatggtagagatttttttag

SEQ ID NO: 156289 - DNA, 26 bp, Artificial sequence
  SiRNA target sequence
gaggaaatggtagagatttttttagc

SEQ ID NO: 156290 - DNA, 26 bp, Artificial sequence
  SiRNA target sequence
aggaaatggtagagatttttttagca

SEQ ID NO: 156291 - DNA, 26 bp, Artificial sequence
  SiRNA target sequence
ggaaatggtagagatttttttagcaa

SEQ ID NO: 156292 - DNA, 26 bp, Artificial sequence
  SiRNA target sequence
gaaatggtagagatttttttagcaag

SEQ ID NO: 156293 - DNA, 26 bp, Artificial sequence
  SiRNA target sequence
aaatggtagagatttttttagcaagt

SEQ ID NO: 156294 - DNA, 26 bp, Artificial sequence
  SiRNA target sequence
aatggtagagatttttttagcaagtt

SEQ ID NO: 156295 - DNA, 26 bp, Artificial sequence
  SiRNA target sequence
atggtagagatttttttagcaagttt

SEQ ID NO: 156296 - DNA, 26 bp, Artificial sequence
  SiRNA target sequence
tggtagagatttttttagcaagtttg

SEQ ID NO: 156297 - DNA, 26 bp, Artificial sequence
  SiRNA target sequence
ggtagagatttttttagcaagtttgg

SEQ ID NO: 156298 - DNA, 26 bp, Artificial sequence
  SiRNA target sequence
gtagagatttttttagcaagtttgga

SEQ ID NO: 156299 - DNA, 26 bp, Artificial sequence
  SiRNA target sequence
tagagatttttttagcaagtttggat

SEQ ID NO: 156300 - DNA, 26 bp, Artificial sequence
  SiRNA target sequence
agagatttttttagcaagtttggatt

SEQ ID NO: 156301 - DNA, 26 bp, Artificial sequence
  SiRNA target sequence
gagatttttttagcaagtttggattt

SEQ ID NO: 156302 - DNA, 26 bp, Artificial sequence
  SiRNA target sequence
agatttttttagcaagtttggatttt

SEQ ID NO: 156303 - DNA, 26 bp, Artificial sequence
  SiRNA target sequence
gatttttttagcaagtttggattttt

SEQ ID NO: 156304 - DNA, 26 bp, Artificial sequence
  SiRNA target sequence
atttttttagcaagtttggatttttc

SEQ ID NO: 156305 - DNA, 26 bp, Artificial sequence
  SiRNA target sequence
tttttttagcaagtttggatttttct

SEQ ID NO: 156306 - DNA, 26 bp, Artificial sequence
  SiRNA target sequence
ttttttagcaagtttggatttttcta

SEQ ID NO: 156307 - DNA, 26 bp, Artificial sequence
  SiRNA target sequence
tttttagcaagtttggatttttctaa

SEQ ID NO: 156308 - DNA, 27 bp, Artificial sequence
  SiRNA target sequence
atggcacaagacccccaaggactttat

SEQ ID NO: 156309 - DNA, 27 bp, Artificial sequence
  SiRNA target sequence
tggcacaagacccccaaggactttatg

SEQ ID NO: 156310 - DNA, 27 bp, Artificial sequence
  SiRNA target sequence
ggcacaagacccccaaggactttatga

SEQ ID NO: 156311 - DNA, 27 bp, Artificial sequence
  SiRNA target sequence
gcacaagacccccaaggactttatgaa

SEQ ID NO: 156312 - DNA, 27 bp, Artificial sequence
  SiRNA target sequence
cacaagacccccaaggactttatgaag

SEQ ID NO: 156313 - DNA, 27 bp, Artificial sequence
  SiRNA target sequence
acaagacccccaaggactttatgaagt

SEQ ID NO: 156314 - DNA, 27 bp, Artificial sequence
  SiRNA target sequence
caagacccccaaggactttatgaagta

SEQ ID NO: 156315 - DNA, 27 bp, Artificial sequence
  SiRNA target sequence
aagacccccaaggactttatgaagtat

SEQ ID NO: 156316 - DNA, 27 bp, Artificial sequence
  SiRNA target sequence
agacccccaaggactttatgaagtatt

SEQ ID NO: 156317 - DNA, 27 bp, Artificial sequence
  SiRNA target sequence
gacccccaaggactttatgaagtatta

SEQ ID NO: 156318 - DNA, 27 bp, Artificial sequence
  SiRNA target sequence
acccccaaggactttatgaagtattag

SEQ ID NO: 156319 - DNA, 27 bp, Artificial sequence
  SiRNA target sequence
cccccaaggactttatgaagtattagg

SEQ ID NO: 156320 - DNA, 27 bp, Artificial sequence
  SiRNA target sequence
ccccaaggactttatgaagtattagga

SEQ ID NO: 156321 - DNA, 27 bp, Artificial sequence
  SiRNA target sequence
cccaaggactttatgaagtattaggac

SEQ ID NO: 156322 - DNA, 27 bp, Artificial sequence
  SiRNA target sequence
ccaaggactttatgaagtattaggact

SEQ ID NO: 156323 - DNA, 27 bp, Artificial sequence
  SiRNA target sequence
caaggactttatgaagtattaggactt

SEQ ID NO: 156324 - DNA, 27 bp, Artificial sequence
  SiRNA target sequence
aaggactttatgaagtattaggactta

SEQ ID NO: 156325 - DNA, 27 bp, Artificial sequence
  SiRNA target sequence
aggactttatgaagtattaggacttaa

SEQ ID NO: 156326 - DNA, 27 bp, Artificial sequence
  SiRNA target sequence
ggactttatgaagtattaggacttaaa

SEQ ID NO: 156327 - DNA, 27 bp, Artificial sequence
  SiRNA target sequence
gactttatgaagtattaggacttaaag

SEQ ID NO: 156328 - DNA, 27 bp, Artificial sequence
  SiRNA target sequence
actttatgaagtattaggacttaaagc

SEQ ID NO: 156329 - DNA, 27 bp, Artificial sequence
  SiRNA target sequence
ctttatgaagtattaggacttaaagct

SEQ ID NO: 156330 - DNA, 27 bp, Artificial sequence
  SiRNA target sequence
tttatgaagtattaggacttaaagctg

SEQ ID NO: 156331 - DNA, 27 bp, Artificial sequence
  SiRNA target sequence
ttatgaagtattaggacttaaagctgg

SEQ ID NO: 156332 - DNA, 27 bp, Artificial sequence
  SiRNA target sequence
tatgaagtattaggacttaaagctggt

SEQ ID NO: 156333 - DNA, 27 bp, Artificial sequence
  SiRNA target sequence
atgaagtattaggacttaaagctggtg

SEQ ID NO: 156334 - DNA, 27 bp, Artificial sequence
  SiRNA target sequence
tgaagtattaggacttaaagctggtgc

SEQ ID NO: 156335 - DNA, 27 bp, Artificial sequence
  SiRNA target sequence
gaagtattaggacttaaagctggtgca

SEQ ID NO: 156336 - DNA, 27 bp, Artificial sequence
  SiRNA target sequence
aagtattaggacttaaagctggtgcaa

SEQ ID NO: 156337 - DNA, 27 bp, Artificial sequence
  SiRNA target sequence
agtattaggacttaaagctggtgcaag

SEQ ID NO: 156338 - DNA, 27 bp, Artificial sequence
  SiRNA target sequence
gtattaggacttaaagctggtgcaagc

SEQ ID NO: 156339 - DNA, 27 bp, Artificial sequence
  SiRNA target sequence
tattaggacttaaagctggtgcaagca

SEQ ID NO: 156340 - DNA, 27 bp, Artificial sequence
  SiRNA target sequence
attaggacttaaagctggtgcaagcat

SEQ ID NO: 156341 - DNA, 27 bp, Artificial sequence
  SiRNA target sequence
ttaggacttaaagctggtgcaagcatt

SEQ ID NO: 156342 - DNA, 27 bp, Artificial sequence
  SiRNA target sequence
taggacttaaagctggtgcaagcattg

SEQ ID NO: 156343 - DNA, 27 bp, Artificial sequence
  SiRNA target sequence
aggacttaaagctggtgcaagcattga

SEQ ID NO: 156344 - DNA, 27 bp, Artificial sequence
  SiRNA target sequence
ggacttaaagctggtgcaagcattgat

SEQ ID NO: 156345 - DNA, 27 bp, Artificial sequence
  SiRNA target sequence
gacttaaagctggtgcaagcattgatg

SEQ ID NO: 156346 - DNA, 27 bp, Artificial sequence
  SiRNA target sequence
acttaaagctggtgcaagcattgatga

SEQ ID NO: 156347 - DNA, 27 bp, Artificial sequence
  SiRNA target sequence
cttaaagctggtgcaagcattgatgaa

SEQ ID NO: 156348 - DNA, 27 bp, Artificial sequence
  SiRNA target sequence
ttaaagctggtgcaagcattgatgaag

SEQ ID NO: 156349 - DNA, 27 bp, Artificial sequence
  SiRNA target sequence
taaagctggtgcaagcattgatgaagt

SEQ ID NO: 156350 - DNA, 27 bp, Artificial sequence
  SiRNA target sequence
aaagctggtgcaagcattgatgaagtt

SEQ ID NO: 156351 - DNA, 27 bp, Artificial sequence
  SiRNA target sequence
aagctggtgcaagcattgatgaagtta

SEQ ID NO: 156352 - DNA, 27 bp, Artificial sequence
  SiRNA target sequence
agctggtgcaagcattgatgaagttaa

SEQ ID NO: 156353 - DNA, 27 bp, Artificial sequence
  SiRNA target sequence
gctggtgcaagcattgatgaagttaaa

SEQ ID NO: 156354 - DNA, 27 bp, Artificial sequence
  SiRNA target sequence
ctggtgcaagcattgatgaagttaaaa

SEQ ID NO: 156355 - DNA, 27 bp, Artificial sequence
  SiRNA target sequence
tggtgcaagcattgatgaagttaaaaa

SEQ ID NO: 156356 - DNA, 27 bp, Artificial sequence
  SiRNA target sequence
ggtgcaagcattgatgaagttaaaaaa

SEQ ID NO: 156357 - DNA, 27 bp, Artificial sequence
  SiRNA target sequence
gtgcaagcattgatgaagttaaaaaag

SEQ ID NO: 156358 - DNA, 27 bp, Artificial sequence
  SiRNA target sequence
tgcaagcattgatgaagttaaaaaagc

SEQ ID NO: 156359 - DNA, 27 bp, Artificial sequence
  SiRNA target sequence
gcaagcattgatgaagttaaaaaagca

SEQ ID NO: 156360 - DNA, 27 bp, Artificial sequence
  SiRNA target sequence
caagcattgatgaagttaaaaaagcat

SEQ ID NO: 156361 - DNA, 27 bp, Artificial sequence
  SiRNA target sequence
aagcattgatgaagttaaaaaagcatt

SEQ ID NO: 156362 - DNA, 27 bp, Artificial sequence
  SiRNA target sequence
agcattgatgaagttaaaaaagcattt

SEQ ID NO: 156363 - DNA, 27 bp, Artificial sequence
  SiRNA target sequence
gcattgatgaagttaaaaaagcattta

SEQ ID NO: 156364 - DNA, 27 bp, Artificial sequence
  SiRNA target sequence
cattgatgaagttaaaaaagcatttac

SEQ ID NO: 156365 - DNA, 27 bp, Artificial sequence
  SiRNA target sequence
attgatgaagttaaaaaagcatttaca

SEQ ID NO: 156366 - DNA, 27 bp, Artificial sequence
  SiRNA target sequence
ttgatgaagttaaaaaagcatttacaa

SEQ ID NO: 156367 - DNA, 27 bp, Artificial sequence
  SiRNA target sequence
tgatgaagttaaaaaagcatttacaaa

SEQ ID NO: 156368 - DNA, 27 bp, Artificial sequence
  SiRNA target sequence
gatgaagttaaaaaagcatttacaaaa

SEQ ID NO: 156369 - DNA, 27 bp, Artificial sequence
  SiRNA target sequence
atgaagttaaaaaagcatttacaaaaa

SEQ ID NO: 156370 - DNA, 27 bp, Artificial sequence
  SiRNA target sequence
tgaagttaaaaaagcatttacaaaaaa

SEQ ID NO: 156371 - DNA, 27 bp, Artificial sequence
  SiRNA target sequence
gaagttaaaaaagcatttacaaaaaaa

SEQ ID NO: 156372 - DNA, 27 bp, Artificial sequence
  SiRNA target sequence
aagttaaaaaagcatttacaaaaaaac

SEQ ID NO: 156373 - DNA, 27 bp, Artificial sequence
  SiRNA target sequence
agttaaaaaagcatttacaaaaaaaca

SEQ ID NO: 156374 - DNA, 27 bp, Artificial sequence
  SiRNA target sequence
gttaaaaaagcatttacaaaaaaacaa

SEQ ID NO: 156375 - DNA, 27 bp, Artificial sequence
  SiRNA target sequence
ttaaaaaagcatttacaaaaaaacaaa

SEQ ID NO: 156376 - DNA, 27 bp, Artificial sequence
  SiRNA target sequence
taaaaaagcatttacaaaaaaacaaag

SEQ ID NO: 156377 - DNA, 27 bp, Artificial sequence
  SiRNA target sequence
aaaaaagcatttacaaaaaaacaaagg

SEQ ID NO: 156378 - DNA, 27 bp, Artificial sequence
  SiRNA target sequence
aaaaagcatttacaaaaaaacaaaggg

SEQ ID NO: 156379 - DNA, 27 bp, Artificial sequence
  SiRNA target sequence
aaaagcatttacaaaaaaacaaaggga

SEQ ID NO: 156380 - DNA, 27 bp, Artificial sequence
  SiRNA target sequence
aaagcatttacaaaaaaacaaagggaa

SEQ ID NO: 156381 - DNA, 27 bp, Artificial sequence
  SiRNA target sequence
aagcatttacaaaaaaacaaagggaat

SEQ ID NO: 156382 - DNA, 27 bp, Artificial sequence
  SiRNA target sequence
agcatttacaaaaaaacaaagggaatg

SEQ ID NO: 156383 - DNA, 27 bp, Artificial sequence
  SiRNA target sequence
gcatttacaaaaaaacaaagggaatgt

SEQ ID NO: 156384 - DNA, 27 bp, Artificial sequence
  SiRNA target sequence
catttacaaaaaaacaaagggaatgtc

SEQ ID NO: 156385 - DNA, 27 bp, Artificial sequence
  SiRNA target sequence
atttacaaaaaaacaaagggaatgtca

SEQ ID NO: 156386 - DNA, 27 bp, Artificial sequence
  SiRNA target sequence
tttacaaaaaaacaaagggaatgtcat

SEQ ID NO: 156387 - DNA, 27 bp, Artificial sequence
  SiRNA target sequence
ttacaaaaaaacaaagggaatgtcatc

SEQ ID NO: 156388 - DNA, 27 bp, Artificial sequence
  SiRNA target sequence
tacaaaaaaacaaagggaatgtcatcc

SEQ ID NO: 156389 - DNA, 27 bp, Artificial sequence
  SiRNA target sequence
acaaaaaaacaaagggaatgtcatccc

SEQ ID NO: 156390 - DNA, 27 bp, Artificial sequence
  SiRNA target sequence
caaaaaaacaaagggaatgtcatcccg

SEQ ID NO: 156391 - DNA, 27 bp, Artificial sequence
  SiRNA target sequence
aaaaaaacaaagggaatgtcatcccga

SEQ ID NO: 156392 - DNA, 27 bp, Artificial sequence
  SiRNA target sequence
aaaaaacaaagggaatgtcatcccgat

SEQ ID NO: 156393 - DNA, 27 bp, Artificial sequence
  SiRNA target sequence
aaaaacaaagggaatgtcatcccgatg

SEQ ID NO: 156394 - DNA, 27 bp, Artificial sequence
  SiRNA target sequence
aaaacaaagggaatgtcatcccgatgg

SEQ ID NO: 156395 - DNA, 27 bp, Artificial sequence
  SiRNA target sequence
aaacaaagggaatgtcatcccgatggt

SEQ ID NO: 156396 - DNA, 27 bp, Artificial sequence
  SiRNA target sequence
aacaaagggaatgtcatcccgatggtg

SEQ ID NO: 156397 - DNA, 27 bp, Artificial sequence
  SiRNA target sequence
acaaagggaatgtcatcccgatggtgc

SEQ ID NO: 156398 - DNA, 27 bp, Artificial sequence
  SiRNA target sequence
caaagggaatgtcatcccgatggtgca

SEQ ID NO: 156399 - DNA, 27 bp, Artificial sequence
  SiRNA target sequence
aaagggaatgtcatcccgatggtgcat

SEQ ID NO: 156400 - DNA, 27 bp, Artificial sequence
  SiRNA target sequence
aagggaatgtcatcccgatggtgcatt

SEQ ID NO: 156401 - DNA, 27 bp, Artificial sequence
  SiRNA target sequence
agggaatgtcatcccgatggtgcattt

SEQ ID NO: 156402 - DNA, 27 bp, Artificial sequence
  SiRNA target sequence
gggaatgtcatcccgatggtgcatttt

SEQ ID NO: 156403 - DNA, 27 bp, Artificial sequence
  SiRNA target sequence
ggaatgtcatcccgatggtgcattttt

SEQ ID NO: 156404 - DNA, 27 bp, Artificial sequence
  SiRNA target sequence
gaatgtcatcccgatggtgcatttttt

SEQ ID NO: 156405 - DNA, 27 bp, Artificial sequence
  SiRNA target sequence
aatgtcatcccgatggtgcatttttta

SEQ ID NO: 156406 - DNA, 27 bp, Artificial sequence
  SiRNA target sequence
atgtcatcccgatggtgcattttttaa

SEQ ID NO: 156407 - DNA, 27 bp, Artificial sequence
  SiRNA target sequence
tgtcatcccgatggtgcattttttaaa

SEQ ID NO: 156408 - DNA, 27 bp, Artificial sequence
  SiRNA target sequence
gtcatcccgatggtgcattttttaaag

SEQ ID NO: 156409 - DNA, 27 bp, Artificial sequence
  SiRNA target sequence
tcatcccgatggtgcattttttaaagc

SEQ ID NO: 156410 - DNA, 27 bp, Artificial sequence
  SiRNA target sequence
catcccgatggtgcattttttaaagct

SEQ ID NO: 156411 - DNA, 27 bp, Artificial sequence
  SiRNA target sequence
atcccgatggtgcattttttaaagctg

SEQ ID NO: 156412 - DNA, 27 bp, Artificial sequence
  SiRNA target sequence
tcccgatggtgcattttttaaagctgc

SEQ ID NO: 156413 - DNA, 27 bp, Artificial sequence
  SiRNA target sequence
cccgatggtgcattttttaaagctgct

SEQ ID NO: 156414 - DNA, 27 bp, Artificial sequence
  SiRNA target sequence
ccgatggtgcattttttaaagctgctc

SEQ ID NO: 156415 - DNA, 27 bp, Artificial sequence
  SiRNA target sequence
cgatggtgcattttttaaagctgctct

SEQ ID NO: 156416 - DNA, 27 bp, Artificial sequence
  SiRNA target sequence
gatggtgcattttttaaagctgctctt

SEQ ID NO: 156417 - DNA, 27 bp, Artificial sequence
  SiRNA target sequence
atggtgcattttttaaagctgctctta

SEQ ID NO: 156418 - DNA, 27 bp, Artificial sequence
  SiRNA target sequence
tggtgcattttttaaagctgctcttag

SEQ ID NO: 156419 - DNA, 27 bp, Artificial sequence
  SiRNA target sequence
ggtgcattttttaaagctgctcttaga

SEQ ID NO: 156420 - DNA, 27 bp, Artificial sequence
  SiRNA target sequence
gtgcattttttaaagctgctcttagaa

SEQ ID NO: 156421 - DNA, 27 bp, Artificial sequence
  SiRNA target sequence
tgcattttttaaagctgctcttagaaa

SEQ ID NO: 156422 - DNA, 27 bp, Artificial sequence
  SiRNA target sequence
gcattttttaaagctgctcttagaaaa

SEQ ID NO: 156423 - DNA, 27 bp, Artificial sequence
  SiRNA target sequence
cattttttaaagctgctcttagaaaat

SEQ ID NO: 156424 - DNA, 27 bp, Artificial sequence
  SiRNA target sequence
attttttaaagctgctcttagaaaatg

SEQ ID NO: 156425 - DNA, 27 bp, Artificial sequence
  SiRNA target sequence
ttttttaaagctgctcttagaaaatgt

SEQ ID NO: 156426 - DNA, 27 bp, Artificial sequence
  SiRNA target sequence
tttttaaagctgctcttagaaaatgta

SEQ ID NO: 156427 - DNA, 27 bp, Artificial sequence
  SiRNA target sequence
ttttaaagctgctcttagaaaatgtaa

SEQ ID NO: 156428 - DNA, 27 bp, Artificial sequence
  SiRNA target sequence
tttaaagctgctcttagaaaatgtaaa

SEQ ID NO: 156429 - DNA, 27 bp, Artificial sequence
  SiRNA target sequence
ttaaagctgctcttagaaaatgtaaaa

SEQ ID NO: 156430 - DNA, 27 bp, Artificial sequence
  SiRNA target sequence
taaagctgctcttagaaaatgtaaaac

SEQ ID NO: 156431 - DNA, 27 bp, Artificial sequence
  SiRNA target sequence
aaagctgctcttagaaaatgtaaaaca

SEQ ID NO: 156432 - DNA, 27 bp, Artificial sequence
  SiRNA target sequence
aagctgctcttagaaaatgtaaaacag

SEQ ID NO: 156433 - DNA, 27 bp, Artificial sequence
  SiRNA target sequence
agctgctcttagaaaatgtaaaacaga

SEQ ID NO: 156434 - DNA, 27 bp, Artificial sequence
  SiRNA target sequence
gctgctcttagaaaatgtaaaacagat

SEQ ID NO: 156435 - DNA, 27 bp, Artificial sequence
  SiRNA target sequence
ctgctcttagaaaatgtaaaacagatg

SEQ ID NO: 156436 - DNA, 27 bp, Artificial sequence
  SiRNA target sequence
tgctcttagaaaatgtaaaacagatga

SEQ ID NO: 156437 - DNA, 27 bp, Artificial sequence
  SiRNA target sequence
gctcttagaaaatgtaaaacagatgaa

SEQ ID NO: 156438 - DNA, 27 bp, Artificial sequence
  SiRNA target sequence
ctcttagaaaatgtaaaacagatgaag

SEQ ID NO: 156439 - DNA, 27 bp, Artificial sequence
  SiRNA target sequence
tcttagaaaatgtaaaacagatgaaga

SEQ ID NO: 156440 - DNA, 27 bp, Artificial sequence
  SiRNA target sequence
cttagaaaatgtaaaacagatgaagaa

SEQ ID NO: 156441 - DNA, 27 bp, Artificial sequence
  SiRNA target sequence
ttagaaaatgtaaaacagatgaagaaa

SEQ ID NO: 156442 - DNA, 27 bp, Artificial sequence
  SiRNA target sequence
tagaaaatgtaaaacagatgaagaaag

SEQ ID NO: 156443 - DNA, 27 bp, Artificial sequence
  SiRNA target sequence
agaaaatgtaaaacagatgaagaaaga

SEQ ID NO: 156444 - DNA, 27 bp, Artificial sequence
  SiRNA target sequence
gaaaatgtaaaacagatgaagaaagag

SEQ ID NO: 156445 - DNA, 27 bp, Artificial sequence
  SiRNA target sequence
aaaatgtaaaacagatgaagaaagagc

SEQ ID NO: 156446 - DNA, 27 bp, Artificial sequence
  SiRNA target sequence
aaatgtaaaacagatgaagaaagagca

SEQ ID NO: 156447 - DNA, 27 bp, Artificial sequence
  SiRNA target sequence
aatgtaaaacagatgaagaaagagcaa

SEQ ID NO: 156448 - DNA, 27 bp, Artificial sequence
  SiRNA target sequence
atgtaaaacagatgaagaaagagcaaa

SEQ ID NO: 156449 - DNA, 27 bp, Artificial sequence
  SiRNA target sequence
tgtaaaacagatgaagaaagagcaaaa

SEQ ID NO: 156450 - DNA, 27 bp, Artificial sequence
  SiRNA target sequence
gtaaaacagatgaagaaagagcaaaag

SEQ ID NO: 156451 - DNA, 27 bp, Artificial sequence
  SiRNA target sequence
taaaacagatgaagaaagagcaaaagt

SEQ ID NO: 156452 - DNA, 27 bp, Artificial sequence
  SiRNA target sequence
aaaacagatgaagaaagagcaaaagtt

SEQ ID NO: 156453 - DNA, 27 bp, Artificial sequence
  SiRNA target sequence
aaacagatgaagaaagagcaaaagttg

SEQ ID NO: 156454 - DNA, 27 bp, Artificial sequence
  SiRNA target sequence
aacagatgaagaaagagcaaaagttga

SEQ ID NO: 156455 - DNA, 27 bp, Artificial sequence
  SiRNA target sequence
acagatgaagaaagagcaaaagttgaa

SEQ ID NO: 156456 - DNA, 27 bp, Artificial sequence
  SiRNA target sequence
cagatgaagaaagagcaaaagttgaaa

SEQ ID NO: 156457 - DNA, 27 bp, Artificial sequence
  SiRNA target sequence
agatgaagaaagagcaaaagttgaaaa

SEQ ID NO: 156458 - DNA, 27 bp, Artificial sequence
  SiRNA target sequence
gatgaagaaagagcaaaagttgaaaaa

SEQ ID NO: 156459 - DNA, 27 bp, Artificial sequence
  SiRNA target sequence
atgaagaaagagcaaaagttgaaaaag

SEQ ID NO: 156460 - DNA, 27 bp, Artificial sequence
  SiRNA target sequence
tgaagaaagagcaaaagttgaaaaaga

SEQ ID NO: 156461 - DNA, 27 bp, Artificial sequence
  SiRNA target sequence
gaagaaagagcaaaagttgaaaaagaa

SEQ ID NO: 156462 - DNA, 27 bp, Artificial sequence
  SiRNA target sequence
aagaaagagcaaaagttgaaaaagaat

SEQ ID NO: 156463 - DNA, 27 bp, Artificial sequence
  SiRNA target sequence
agaaagagcaaaagttgaaaaagaatt

SEQ ID NO: 156464 - DNA, 27 bp, Artificial sequence
  SiRNA target sequence
gaaagagcaaaagttgaaaaagaattt

SEQ ID NO: 156465 - DNA, 27 bp, Artificial sequence
  SiRNA target sequence
aaagagcaaaagttgaaaaagaattta

SEQ ID NO: 156466 - DNA, 27 bp, Artificial sequence
  SiRNA target sequence
aagagcaaaagttgaaaaagaatttaa

SEQ ID NO: 156467 - DNA, 27 bp, Artificial sequence
  SiRNA target sequence
agagcaaaagttgaaaaagaatttaaa

SEQ ID NO: 156468 - DNA, 27 bp, Artificial sequence
  SiRNA target sequence
gagcaaaagttgaaaaagaatttaaag

SEQ ID NO: 156469 - DNA, 27 bp, Artificial sequence
  SiRNA target sequence
agcaaaagttgaaaaagaatttaaaga

SEQ ID NO: 156470 - DNA, 27 bp, Artificial sequence
  SiRNA target sequence
gcaaaagttgaaaaagaatttaaagaa

SEQ ID NO: 156471 - DNA, 27 bp, Artificial sequence
  SiRNA target sequence
caaaagttgaaaaagaatttaaagaaa

SEQ ID NO: 156472 - DNA, 27 bp, Artificial sequence
  SiRNA target sequence
aaaagttgaaaaagaatttaaagaaaa

SEQ ID NO: 156473 - DNA, 27 bp, Artificial sequence
  SiRNA target sequence
aaagttgaaaaagaatttaaagaaaaa

SEQ ID NO: 156474 - DNA, 27 bp, Artificial sequence
  SiRNA target sequence
aagttgaaaaagaatttaaagaaaaat

SEQ ID NO: 156475 - DNA, 27 bp, Artificial sequence
  SiRNA target sequence
agttgaaaaagaatttaaagaaaaatc

SEQ ID NO: 156476 - DNA, 27 bp, Artificial sequence
  SiRNA target sequence
gttgaaaaagaatttaaagaaaaatca

SEQ ID NO: 156477 - DNA, 27 bp, Artificial sequence
  SiRNA target sequence
ttgaaaaagaatttaaagaaaaatcac

SEQ ID NO: 156478 - DNA, 27 bp, Artificial sequence
  SiRNA target sequence
tgaaaaagaatttaaagaaaaatcaca

SEQ ID NO: 156479 - DNA, 27 bp, Artificial sequence
  SiRNA target sequence
gaaaaagaatttaaagaaaaatcacaa

SEQ ID NO: 156480 - DNA, 27 bp, Artificial sequence
  SiRNA target sequence
aaaaagaatttaaagaaaaatcacaaa

SEQ ID NO: 156481 - DNA, 27 bp, Artificial sequence
  SiRNA target sequence
aaaagaatttaaagaaaaatcacaaaa

SEQ ID NO: 156482 - DNA, 27 bp, Artificial sequence
  SiRNA target sequence
aaagaatttaaagaaaaatcacaaaaa

SEQ ID NO: 156483 - DNA, 27 bp, Artificial sequence
  SiRNA target sequence
aagaatttaaagaaaaatcacaaaaat

SEQ ID NO: 156484 - DNA, 27 bp, Artificial sequence
  SiRNA target sequence
agaatttaaagaaaaatcacaaaaatg

SEQ ID NO: 156485 - DNA, 27 bp, Artificial sequence
  SiRNA target sequence
gaatttaaagaaaaatcacaaaaatgt

SEQ ID NO: 156486 - DNA, 27 bp, Artificial sequence
  SiRNA target sequence
aatttaaagaaaaatcacaaaaatgta

SEQ ID NO: 156487 - DNA, 27 bp, Artificial sequence
  SiRNA target sequence
atttaaagaaaaatcacaaaaatgtaa

SEQ ID NO: 156488 - DNA, 27 bp, Artificial sequence
  SiRNA target sequence
tttaaagaaaaatcacaaaaatgtaat

SEQ ID NO: 156489 - DNA, 27 bp, Artificial sequence
  SiRNA target sequence
ttaaagaaaaatcacaaaaatgtaatc

SEQ ID NO: 156490 - DNA, 27 bp, Artificial sequence
  SiRNA target sequence
taaagaaaaatcacaaaaatgtaatca

SEQ ID NO: 156491 - DNA, 27 bp, Artificial sequence
  SiRNA target sequence
aaagaaaaatcacaaaaatgtaatcaa

SEQ ID NO: 156492 - DNA, 27 bp, Artificial sequence
  SiRNA target sequence
aagaaaaatcacaaaaatgtaatcaag

SEQ ID NO: 156493 - DNA, 27 bp, Artificial sequence
  SiRNA target sequence
agaaaaatcacaaaaatgtaatcaagc

SEQ ID NO: 156494 - DNA, 27 bp, Artificial sequence
  SiRNA target sequence
gaaaaatcacaaaaatgtaatcaagct

SEQ ID NO: 156495 - DNA, 27 bp, Artificial sequence
  SiRNA target sequence
aaaaatcacaaaaatgtaatcaagcta

SEQ ID NO: 156496 - DNA, 27 bp, Artificial sequence
  SiRNA target sequence
aaaatcacaaaaatgtaatcaagctaa

SEQ ID NO: 156497 - DNA, 27 bp, Artificial sequence
  SiRNA target sequence
aaatcacaaaaatgtaatcaagctaaa

SEQ ID NO: 156498 - DNA, 27 bp, Artificial sequence
  SiRNA target sequence
aatcacaaaaatgtaatcaagctaaag

SEQ ID NO: 156499 - DNA, 27 bp, Artificial sequence
  SiRNA target sequence
atcacaaaaatgtaatcaagctaaagc

SEQ ID NO: 156500 - DNA, 27 bp, Artificial sequence
  SiRNA target sequence
tcacaaaaatgtaatcaagctaaagca

SEQ ID NO: 156501 - DNA, 27 bp, Artificial sequence
  SiRNA target sequence
cacaaaaatgtaatcaagctaaagcag

SEQ ID NO: 156502 - DNA, 27 bp, Artificial sequence
  SiRNA target sequence
acaaaaatgtaatcaagctaaagcagt

SEQ ID NO: 156503 - DNA, 27 bp, Artificial sequence
  SiRNA target sequence
caaaaatgtaatcaagctaaagcagtt

SEQ ID NO: 156504 - DNA, 27 bp, Artificial sequence
  SiRNA target sequence
aaaaatgtaatcaagctaaagcagttt

SEQ ID NO: 156505 - DNA, 27 bp, Artificial sequence
  SiRNA target sequence
aaaatgtaatcaagctaaagcagtttt

SEQ ID NO: 156506 - DNA, 27 bp, Artificial sequence
  SiRNA target sequence
aaatgtaatcaagctaaagcagtttta

SEQ ID NO: 156507 - DNA, 27 bp, Artificial sequence
  SiRNA target sequence
aatgtaatcaagctaaagcagttttat

SEQ ID NO: 156508 - DNA, 27 bp, Artificial sequence
  SiRNA target sequence
atgtaatcaagctaaagcagttttatt

SEQ ID NO: 156509 - DNA, 27 bp, Artificial sequence
  SiRNA target sequence
tgtaatcaagctaaagcagttttattt

SEQ ID NO: 156510 - DNA, 27 bp, Artificial sequence
  SiRNA target sequence
gtaatcaagctaaagcagttttatttg

SEQ ID NO: 156511 - DNA, 27 bp, Artificial sequence
  SiRNA target sequence
taatcaagctaaagcagttttatttga

SEQ ID NO: 156512 - DNA, 27 bp, Artificial sequence
  SiRNA target sequence
aatcaagctaaagcagttttatttgat

SEQ ID NO: 156513 - DNA, 27 bp, Artificial sequence
  SiRNA target sequence
atcaagctaaagcagttttatttgatg

SEQ ID NO: 156514 - DNA, 27 bp, Artificial sequence
  SiRNA target sequence
tcaagctaaagcagttttatttgatga

SEQ ID NO: 156515 - DNA, 27 bp, Artificial sequence
  SiRNA target sequence
caagctaaagcagttttatttgatgag

SEQ ID NO: 156516 - DNA, 27 bp, Artificial sequence
  SiRNA target sequence
aagctaaagcagttttatttgatgaga

SEQ ID NO: 156517 - DNA, 27 bp, Artificial sequence
  SiRNA target sequence
agctaaagcagttttatttgatgagaa

SEQ ID NO: 156518 - DNA, 27 bp, Artificial sequence
  SiRNA target sequence
gctaaagcagttttatttgatgagaaa

SEQ ID NO: 156519 - DNA, 27 bp, Artificial sequence
  SiRNA target sequence
ctaaagcagttttatttgatgagaaaa

SEQ ID NO: 156520 - DNA, 27 bp, Artificial sequence
  SiRNA target sequence
taaagcagttttatttgatgagaaaaa

SEQ ID NO: 156521 - DNA, 27 bp, Artificial sequence
  SiRNA target sequence
aaagcagttttatttgatgagaaaaaa

SEQ ID NO: 156522 - DNA, 27 bp, Artificial sequence
  SiRNA target sequence
aagcagttttatttgatgagaaaaaaa

SEQ ID NO: 156523 - DNA, 27 bp, Artificial sequence
  SiRNA target sequence
agcagttttatttgatgagaaaaaaaa

SEQ ID NO: 156524 - DNA, 27 bp, Artificial sequence
  SiRNA target sequence
gcagttttatttgatgagaaaaaaaag

SEQ ID NO: 156525 - DNA, 27 bp, Artificial sequence
  SiRNA target sequence
cagttttatttgatgagaaaaaaaagc

SEQ ID NO: 156526 - DNA, 27 bp, Artificial sequence
  SiRNA target sequence
agttttatttgatgagaaaaaaaagca

SEQ ID NO: 156527 - DNA, 27 bp, Artificial sequence
  SiRNA target sequence
gttttatttgatgagaaaaaaaagcaa

SEQ ID NO: 156528 - DNA, 27 bp, Artificial sequence
  SiRNA target sequence
ttttatttgatgagaaaaaaaagcaag

SEQ ID NO: 156529 - DNA, 27 bp, Artificial sequence
  SiRNA target sequence
tttatttgatgagaaaaaaaagcaaga

SEQ ID NO: 156530 - DNA, 27 bp, Artificial sequence
  SiRNA target sequence
ttatttgatgagaaaaaaaagcaagag

SEQ ID NO: 156531 - DNA, 27 bp, Artificial sequence
  SiRNA target sequence
tatttgatgagaaaaaaaagcaagagt

SEQ ID NO: 156532 - DNA, 27 bp, Artificial sequence
  SiRNA target sequence
atttgatgagaaaaaaaagcaagagta

SEQ ID NO: 156533 - DNA, 27 bp, Artificial sequence
  SiRNA target sequence
tttgatgagaaaaaaaagcaagagtat

SEQ ID NO: 156534 - DNA, 27 bp, Artificial sequence
  SiRNA target sequence
ttgatgagaaaaaaaagcaagagtatg

SEQ ID NO: 156535 - DNA, 27 bp, Artificial sequence
  SiRNA target sequence
tgatgagaaaaaaaagcaagagtatga

SEQ ID NO: 156536 - DNA, 27 bp, Artificial sequence
  SiRNA target sequence
gatgagaaaaaaaagcaagagtatgat

SEQ ID NO: 156537 - DNA, 27 bp, Artificial sequence
  SiRNA target sequence
atgagaaaaaaaagcaagagtatgata

SEQ ID NO: 156538 - DNA, 27 bp, Artificial sequence
  SiRNA target sequence
tgagaaaaaaaagcaagagtatgatat

SEQ ID NO: 156539 - DNA, 27 bp, Artificial sequence
  SiRNA target sequence
gagaaaaaaaagcaagagtatgatatg

SEQ ID NO: 156540 - DNA, 27 bp, Artificial sequence
  SiRNA target sequence
agaaaaaaaagcaagagtatgatatgg

SEQ ID NO: 156541 - DNA, 27 bp, Artificial sequence
  SiRNA target sequence
gaaaaaaaagcaagagtatgatatggg

SEQ ID NO: 156542 - DNA, 27 bp, Artificial sequence
  SiRNA target sequence
aaaaaaaagcaagagtatgatatggga

SEQ ID NO: 156543 - DNA, 27 bp, Artificial sequence
  SiRNA target sequence
aaaaaaagcaagagtatgatatgggaa

SEQ ID NO: 156544 - DNA, 27 bp, Artificial sequence
  SiRNA target sequence
aaaaaagcaagagtatgatatgggaat

SEQ ID NO: 156545 - DNA, 27 bp, Artificial sequence
  SiRNA target sequence
aaaaagcaagagtatgatatgggaatg

SEQ ID NO: 156546 - DNA, 27 bp, Artificial sequence
  SiRNA target sequence
aaaagcaagagtatgatatgggaatga

SEQ ID NO: 156547 - DNA, 27 bp, Artificial sequence
  SiRNA target sequence
aaagcaagagtatgatatgggaatgac

SEQ ID NO: 156548 - DNA, 27 bp, Artificial sequence
  SiRNA target sequence
aagcaagagtatgatatgggaatgact

SEQ ID NO: 156549 - DNA, 27 bp, Artificial sequence
  SiRNA target sequence
agcaagagtatgatatgggaatgactg

SEQ ID NO: 156550 - DNA, 27 bp, Artificial sequence
  SiRNA target sequence
gcaagagtatgatatgggaatgactgg

SEQ ID NO: 156551 - DNA, 27 bp, Artificial sequence
  SiRNA target sequence
caagagtatgatatgggaatgactggc

SEQ ID NO: 156552 - DNA, 27 bp, Artificial sequence
  SiRNA target sequence
aagagtatgatatgggaatgactggcg

SEQ ID NO: 156553 - DNA, 27 bp, Artificial sequence
  SiRNA target sequence
agagtatgatatgggaatgactggcga

SEQ ID NO: 156554 - DNA, 27 bp, Artificial sequence
  SiRNA target sequence
gagtatgatatgggaatgactggcgat

SEQ ID NO: 156555 - DNA, 27 bp, Artificial sequence
  SiRNA target sequence
agtatgatatgggaatgactggcgatt

SEQ ID NO: 156556 - DNA, 27 bp, Artificial sequence
  SiRNA target sequence
gtatgatatgggaatgactggcgattt

SEQ ID NO: 156557 - DNA, 27 bp, Artificial sequence
  SiRNA target sequence
tatgatatgggaatgactggcgatttt

SEQ ID NO: 156558 - DNA, 27 bp, Artificial sequence
  SiRNA target sequence
atgatatgggaatgactggcgattttg

SEQ ID NO: 156559 - DNA, 27 bp, Artificial sequence
  SiRNA target sequence
tgatatgggaatgactggcgattttgg

SEQ ID NO: 156560 - DNA, 27 bp, Artificial sequence
  SiRNA target sequence
gatatgggaatgactggcgattttgga

SEQ ID NO: 156561 - DNA, 27 bp, Artificial sequence
  SiRNA target sequence
atatgggaatgactggcgattttggat

SEQ ID NO: 156562 - DNA, 27 bp, Artificial sequence
  SiRNA target sequence
tatgggaatgactggcgattttggatt

SEQ ID NO: 156563 - DNA, 27 bp, Artificial sequence
  SiRNA target sequence
atgggaatgactggcgattttggattt

SEQ ID NO: 156564 - DNA, 27 bp, Artificial sequence
  SiRNA target sequence
tgggaatgactggcgattttggatttt

SEQ ID NO: 156565 - DNA, 27 bp, Artificial sequence
  SiRNA target sequence
gggaatgactggcgattttggattttc

SEQ ID NO: 156566 - DNA, 27 bp, Artificial sequence
  SiRNA target sequence
ggaatgactggcgattttggattttct

SEQ ID NO: 156567 - DNA, 27 bp, Artificial sequence
  SiRNA target sequence
gaatgactggcgattttggattttctg

SEQ ID NO: 156568 - DNA, 27 bp, Artificial sequence
  SiRNA target sequence
aatgactggcgattttggattttctgc

SEQ ID NO: 156569 - DNA, 27 bp, Artificial sequence
  SiRNA target sequence
atgactggcgattttggattttctgca

SEQ ID NO: 156570 - DNA, 27 bp, Artificial sequence
  SiRNA target sequence
tgactggcgattttggattttctgcag

SEQ ID NO: 156571 - DNA, 27 bp, Artificial sequence
  SiRNA target sequence
gactggcgattttggattttctgcagg

SEQ ID NO: 156572 - DNA, 27 bp, Artificial sequence
  SiRNA target sequence
actggcgattttggattttctgcaggt

SEQ ID NO: 156573 - DNA, 27 bp, Artificial sequence
  SiRNA target sequence
ctggcgattttggattttctgcaggtg

SEQ ID NO: 156574 - DNA, 27 bp, Artificial sequence
  SiRNA target sequence
tggcgattttggattttctgcaggtgg

SEQ ID NO: 156575 - DNA, 27 bp, Artificial sequence
  SiRNA target sequence
ggcgattttggattttctgcaggtggt

SEQ ID NO: 156576 - DNA, 27 bp, Artificial sequence
  SiRNA target sequence
gcgattttggattttctgcaggtggtg

SEQ ID NO: 156577 - DNA, 27 bp, Artificial sequence
  SiRNA target sequence
cgattttggattttctgcaggtggtgg

SEQ ID NO: 156578 - DNA, 27 bp, Artificial sequence
  SiRNA target sequence
gattttggattttctgcaggtggtgga

SEQ ID NO: 156579 - DNA, 27 bp, Artificial sequence
  SiRNA target sequence
attttggattttctgcaggtggtggag

SEQ ID NO: 156580 - DNA, 27 bp, Artificial sequence
  SiRNA target sequence
ttttggattttctgcaggtggtggaga

SEQ ID NO: 156581 - DNA, 27 bp, Artificial sequence
  SiRNA target sequence
tttggattttctgcaggtggtggagac

SEQ ID NO: 156582 - DNA, 27 bp, Artificial sequence
  SiRNA target sequence
ttggattttctgcaggtggtggagact

SEQ ID NO: 156583 - DNA, 27 bp, Artificial sequence
  SiRNA target sequence
tggattttctgcaggtggtggagactt

SEQ ID NO: 156584 - DNA, 27 bp, Artificial sequence
  SiRNA target sequence
ggattttctgcaggtggtggagacttt

SEQ ID NO: 156585 - DNA, 27 bp, Artificial sequence
  SiRNA target sequence
gattttctgcaggtggtggagactttt

SEQ ID NO: 156586 - DNA, 27 bp, Artificial sequence
  SiRNA target sequence
attttctgcaggtggtggagacttttt

SEQ ID NO: 156587 - DNA, 27 bp, Artificial sequence
  SiRNA target sequence
ttttctgcaggtggtggagactttttc

SEQ ID NO: 156588 - DNA, 27 bp, Artificial sequence
  SiRNA target sequence
tttctgcaggtggtggagactttttcg

SEQ ID NO: 156589 - DNA, 27 bp, Artificial sequence
  SiRNA target sequence
ttctgcaggtggtggagactttttcga

SEQ ID NO: 156590 - DNA, 27 bp, Artificial sequence
  SiRNA target sequence
tctgcaggtggtggagactttttcgat

SEQ ID NO: 156591 - DNA, 27 bp, Artificial sequence
  SiRNA target sequence
ctgcaggtggtggagactttttcgata

SEQ ID NO: 156592 - DNA, 27 bp, Artificial sequence
  SiRNA target sequence
tgcaggtggtggagactttttcgatat

SEQ ID NO: 156593 - DNA, 27 bp, Artificial sequence
  SiRNA target sequence
gcaggtggtggagactttttcgatatt

SEQ ID NO: 156594 - DNA, 27 bp, Artificial sequence
  SiRNA target sequence
caggtggtggagactttttcgatattt

SEQ ID NO: 156595 - DNA, 27 bp, Artificial sequence
  SiRNA target sequence
aggtggtggagactttttcgatatttt

SEQ ID NO: 156596 - DNA, 27 bp, Artificial sequence
  SiRNA target sequence
ggtggtggagactttttcgatattttt

SEQ ID NO: 156597 - DNA, 27 bp, Artificial sequence
  SiRNA target sequence
gtggtggagactttttcgatatttttt

SEQ ID NO: 156598 - DNA, 27 bp, Artificial sequence
  SiRNA target sequence
tggtggagactttttcgatattttttc

SEQ ID NO: 156599 - DNA, 27 bp, Artificial sequence
  SiRNA target sequence
ggtggagactttttcgatattttttca

SEQ ID NO: 156600 - DNA, 27 bp, Artificial sequence
  SiRNA target sequence
gtggagactttttcgatattttttcaa

SEQ ID NO: 156601 - DNA, 27 bp, Artificial sequence
  SiRNA target sequence
tggagactttttcgatattttttcaag

SEQ ID NO: 156602 - DNA, 27 bp, Artificial sequence
  SiRNA target sequence
ggagactttttcgatattttttcaagt

SEQ ID NO: 156603 - DNA, 27 bp, Artificial sequence
  SiRNA target sequence
gagactttttcgatattttttcaagtt

SEQ ID NO: 156604 - DNA, 27 bp, Artificial sequence
  SiRNA target sequence
agactttttcgatattttttcaagttt

SEQ ID NO: 156605 - DNA, 27 bp, Artificial sequence
  SiRNA target sequence
gactttttcgatattttttcaagtttt

SEQ ID NO: 156606 - DNA, 27 bp, Artificial sequence
  SiRNA target sequence
actttttcgatattttttcaagtttta

SEQ ID NO: 156607 - DNA, 27 bp, Artificial sequence
  SiRNA target sequence
ctttttcgatattttttcaagttttac

SEQ ID NO: 156608 - DNA, 27 bp, Artificial sequence
  SiRNA target sequence
tttttcgatattttttcaagttttact

SEQ ID NO: 156609 - DNA, 27 bp, Artificial sequence
  SiRNA target sequence
ttttcgatattttttcaagttttactg

SEQ ID NO: 156610 - DNA, 27 bp, Artificial sequence
  SiRNA target sequence
tttcgatattttttcaagttttactgg

SEQ ID NO: 156611 - DNA, 27 bp, Artificial sequence
  SiRNA target sequence
ttcgatattttttcaagttttactggt

SEQ ID NO: 156612 - DNA, 27 bp, Artificial sequence
  SiRNA target sequence
tcgatattttttcaagttttactggtg

SEQ ID NO: 156613 - DNA, 27 bp, Artificial sequence
  SiRNA target sequence
cgatattttttcaagttttactggtgg

SEQ ID NO: 156614 - DNA, 27 bp, Artificial sequence
  SiRNA target sequence
gatattttttcaagttttactggtgga

SEQ ID NO: 156615 - DNA, 27 bp, Artificial sequence
  SiRNA target sequence
atattttttcaagttttactggtggag

SEQ ID NO: 156616 - DNA, 27 bp, Artificial sequence
  SiRNA target sequence
tattttttcaagttttactggtggagg

SEQ ID NO: 156617 - DNA, 27 bp, Artificial sequence
  SiRNA target sequence
attttttcaagttttactggtggagga

SEQ ID NO: 156618 - DNA, 27 bp, Artificial sequence
  SiRNA target sequence
ttttttcaagttttactggtggaggaa

SEQ ID NO: 156619 - DNA, 27 bp, Artificial sequence
  SiRNA target sequence
tttttcaagttttactggtggaggaag

SEQ ID NO: 156620 - DNA, 27 bp, Artificial sequence
  SiRNA target sequence
ttttcaagttttactggtggaggaaga

SEQ ID NO: 156621 - DNA, 27 bp, Artificial sequence
  SiRNA target sequence
tttcaagttttactggtggaggaagaa

SEQ ID NO: 156622 - DNA, 27 bp, Artificial sequence
  SiRNA target sequence
ttcaagttttactggtggaggaagaag

SEQ ID NO: 156623 - DNA, 27 bp, Artificial sequence
  SiRNA target sequence
tcaagttttactggtggaggaagaaga

SEQ ID NO: 156624 - DNA, 27 bp, Artificial sequence
  SiRNA target sequence
caagttttactggtggaggaagaagaa

SEQ ID NO: 156625 - DNA, 27 bp, Artificial sequence
  SiRNA target sequence
aagttttactggtggaggaagaagaaa

SEQ ID NO: 156626 - DNA, 27 bp, Artificial sequence
  SiRNA target sequence
agttttactggtggaggaagaagaaat

SEQ ID NO: 156627 - DNA, 27 bp, Artificial sequence
  SiRNA target sequence
gttttactggtggaggaagaagaaatc

SEQ ID NO: 156628 - DNA, 27 bp, Artificial sequence
  SiRNA target sequence
ttttactggtggaggaagaagaaatcg

SEQ ID NO: 156629 - DNA, 27 bp, Artificial sequence
  SiRNA target sequence
tttactggtggaggaagaagaaatcga

SEQ ID NO: 156630 - DNA, 27 bp, Artificial sequence
  SiRNA target sequence
ttactggtggaggaagaagaaatcgag

SEQ ID NO: 156631 - DNA, 27 bp, Artificial sequence
  SiRNA target sequence
tactggtggaggaagaagaaatcgagt

SEQ ID NO: 156632 - DNA, 27 bp, Artificial sequence
  SiRNA target sequence
actggtggaggaagaagaaatcgagta

SEQ ID NO: 156633 - DNA, 27 bp, Artificial sequence
  SiRNA target sequence
ctggtggaggaagaagaaatcgagtac

SEQ ID NO: 156634 - DNA, 27 bp, Artificial sequence
  SiRNA target sequence
tggtggaggaagaagaaatcgagtaca

SEQ ID NO: 156635 - DNA, 27 bp, Artificial sequence
  SiRNA target sequence
ggtggaggaagaagaaatcgagtacaa

SEQ ID NO: 156636 - DNA, 27 bp, Artificial sequence
  SiRNA target sequence
gtggaggaagaagaaatcgagtacaaa

SEQ ID NO: 156637 - DNA, 27 bp, Artificial sequence
  SiRNA target sequence
tggaggaagaagaaatcgagtacaaaa

SEQ ID NO: 156638 - DNA, 27 bp, Artificial sequence
  SiRNA target sequence
ggaggaagaagaaatcgagtacaaaaa

SEQ ID NO: 156639 - DNA, 27 bp, Artificial sequence
  SiRNA target sequence
gaggaagaagaaatcgagtacaaaaag

SEQ ID NO: 156640 - DNA, 27 bp, Artificial sequence
  SiRNA target sequence
aggaagaagaaatcgagtacaaaaagt

SEQ ID NO: 156641 - DNA, 27 bp, Artificial sequence
  SiRNA target sequence
ggaagaagaaatcgagtacaaaaagtt

SEQ ID NO: 156642 - DNA, 27 bp, Artificial sequence
  SiRNA target sequence
gaagaagaaatcgagtacaaaaagttc

SEQ ID NO: 156643 - DNA, 27 bp, Artificial sequence
  SiRNA target sequence
aagaagaaatcgagtacaaaaagttca

SEQ ID NO: 156644 - DNA, 27 bp, Artificial sequence
  SiRNA target sequence
agaagaaatcgagtacaaaaagttcaa

SEQ ID NO: 156645 - DNA, 27 bp, Artificial sequence
  SiRNA target sequence
gaagaaatcgagtacaaaaagttcaag

SEQ ID NO: 156646 - DNA, 27 bp, Artificial sequence
  SiRNA target sequence
aagaaatcgagtacaaaaagttcaaga

SEQ ID NO: 156647 - DNA, 27 bp, Artificial sequence
  SiRNA target sequence
agaaatcgagtacaaaaagttcaagat

SEQ ID NO: 156648 - DNA, 27 bp, Artificial sequence
  SiRNA target sequence
gaaatcgagtacaaaaagttcaagata

SEQ ID NO: 156649 - DNA, 27 bp, Artificial sequence
  SiRNA target sequence
aaatcgagtacaaaaagttcaagatac

SEQ ID NO: 156650 - DNA, 27 bp, Artificial sequence
  SiRNA target sequence
aatcgagtacaaaaagttcaagataca

SEQ ID NO: 156651 - DNA, 27 bp, Artificial sequence
  SiRNA target sequence
atcgagtacaaaaagttcaagatacag

SEQ ID NO: 156652 - DNA, 27 bp, Artificial sequence
  SiRNA target sequence
tcgagtacaaaaagttcaagatacaga

SEQ ID NO: 156653 - DNA, 27 bp, Artificial sequence
  SiRNA target sequence
cgagtacaaaaagttcaagatacagaa

SEQ ID NO: 156654 - DNA, 27 bp, Artificial sequence
  SiRNA target sequence
gagtacaaaaagttcaagatacagaat

SEQ ID NO: 156655 - DNA, 27 bp, Artificial sequence
  SiRNA target sequence
agtacaaaaagttcaagatacagaata

SEQ ID NO: 156656 - DNA, 27 bp, Artificial sequence
  SiRNA target sequence
gtacaaaaagttcaagatacagaatac

SEQ ID NO: 156657 - DNA, 27 bp, Artificial sequence
  SiRNA target sequence
tacaaaaagttcaagatacagaatacg

SEQ ID NO: 156658 - DNA, 27 bp, Artificial sequence
  SiRNA target sequence
acaaaaagttcaagatacagaatacga

SEQ ID NO: 156659 - DNA, 27 bp, Artificial sequence
  SiRNA target sequence
caaaaagttcaagatacagaatacgag

SEQ ID NO: 156660 - DNA, 27 bp, Artificial sequence
  SiRNA target sequence
aaaaagttcaagatacagaatacgagt

SEQ ID NO: 156661 - DNA, 27 bp, Artificial sequence
  SiRNA target sequence
aaaagttcaagatacagaatacgagtt

SEQ ID NO: 156662 - DNA, 27 bp, Artificial sequence
  SiRNA target sequence
aaagttcaagatacagaatacgagttt

SEQ ID NO: 156663 - DNA, 27 bp, Artificial sequence
  SiRNA target sequence
aagttcaagatacagaatacgagttta

SEQ ID NO: 156664 - DNA, 27 bp, Artificial sequence
  SiRNA target sequence
agttcaagatacagaatacgagtttaa

SEQ ID NO: 156665 - DNA, 27 bp, Artificial sequence
  SiRNA target sequence
gttcaagatacagaatacgagtttaat

SEQ ID NO: 156666 - DNA, 27 bp, Artificial sequence
  SiRNA target sequence
ttcaagatacagaatacgagtttaata

SEQ ID NO: 156667 - DNA, 27 bp, Artificial sequence
  SiRNA target sequence
tcaagatacagaatacgagtttaatat

SEQ ID NO: 156668 - DNA, 27 bp, Artificial sequence
  SiRNA target sequence
caagatacagaatacgagtttaatatt

SEQ ID NO: 156669 - DNA, 27 bp, Artificial sequence
  SiRNA target sequence
aagatacagaatacgagtttaatattt

SEQ ID NO: 156670 - DNA, 27 bp, Artificial sequence
  SiRNA target sequence
agatacagaatacgagtttaatatttc

SEQ ID NO: 156671 - DNA, 27 bp, Artificial sequence
  SiRNA target sequence
gatacagaatacgagtttaatatttcg

SEQ ID NO: 156672 - DNA, 27 bp, Artificial sequence
  SiRNA target sequence
atacagaatacgagtttaatatttcgt

SEQ ID NO: 156673 - DNA, 27 bp, Artificial sequence
  SiRNA target sequence
tacagaatacgagtttaatatttcgtt

SEQ ID NO: 156674 - DNA, 27 bp, Artificial sequence
  SiRNA target sequence
acagaatacgagtttaatatttcgttg

SEQ ID NO: 156675 - DNA, 27 bp, Artificial sequence
  SiRNA target sequence
cagaatacgagtttaatatttcgttga

SEQ ID NO: 156676 - DNA, 27 bp, Artificial sequence
  SiRNA target sequence
agaatacgagtttaatatttcgttgaa

SEQ ID NO: 156677 - DNA, 27 bp, Artificial sequence
  SiRNA target sequence
gaatacgagtttaatatttcgttgaag

SEQ ID NO: 156678 - DNA, 27 bp, Artificial sequence
  SiRNA target sequence
aatacgagtttaatatttcgttgaagg

SEQ ID NO: 156679 - DNA, 27 bp, Artificial sequence
  SiRNA target sequence
atacgagtttaatatttcgttgaagga

SEQ ID NO: 156680 - DNA, 27 bp, Artificial sequence
  SiRNA target sequence
tacgagtttaatatttcgttgaaggaa

SEQ ID NO: 156681 - DNA, 27 bp, Artificial sequence
  SiRNA target sequence
acgagtttaatatttcgttgaaggaag

SEQ ID NO: 156682 - DNA, 27 bp, Artificial sequence
  SiRNA target sequence
cgagtttaatatttcgttgaaggaagc

SEQ ID NO: 156683 - DNA, 27 bp, Artificial sequence
  SiRNA target sequence
gagtttaatatttcgttgaaggaagct

SEQ ID NO: 156684 - DNA, 27 bp, Artificial sequence
  SiRNA target sequence
agtttaatatttcgttgaaggaagctt

SEQ ID NO: 156685 - DNA, 27 bp, Artificial sequence
  SiRNA target sequence
gtttaatatttcgttgaaggaagctta

SEQ ID NO: 156686 - DNA, 27 bp, Artificial sequence
  SiRNA target sequence
tttaatatttcgttgaaggaagcttat

SEQ ID NO: 156687 - DNA, 27 bp, Artificial sequence
  SiRNA target sequence
ttaatatttcgttgaaggaagcttata

SEQ ID NO: 156688 - DNA, 27 bp, Artificial sequence
  SiRNA target sequence
taatatttcgttgaaggaagcttatat

SEQ ID NO: 156689 - DNA, 27 bp, Artificial sequence
  SiRNA target sequence
aatatttcgttgaaggaagcttatatg

SEQ ID NO: 156690 - DNA, 27 bp, Artificial sequence
  SiRNA target sequence
atatttcgttgaaggaagcttatatgg

SEQ ID NO: 156691 - DNA, 27 bp, Artificial sequence
  SiRNA target sequence
tatttcgttgaaggaagcttatatggg

SEQ ID NO: 156692 - DNA, 27 bp, Artificial sequence
  SiRNA target sequence
atttcgttgaaggaagcttatatggga

SEQ ID NO: 156693 - DNA, 27 bp, Artificial sequence
  SiRNA target sequence
tttcgttgaaggaagcttatatgggaa

SEQ ID NO: 156694 - DNA, 27 bp, Artificial sequence
  SiRNA target sequence
ttcgttgaaggaagcttatatgggaaa

SEQ ID NO: 156695 - DNA, 27 bp, Artificial sequence
  SiRNA target sequence
tcgttgaaggaagcttatatgggaaag

SEQ ID NO: 156696 - DNA, 27 bp, Artificial sequence
  SiRNA target sequence
cgttgaaggaagcttatatgggaaagc

SEQ ID NO: 156697 - DNA, 27 bp, Artificial sequence
  SiRNA target sequence
gttgaaggaagcttatatgggaaagcg

SEQ ID NO: 156698 - DNA, 27 bp, Artificial sequence
  SiRNA target sequence
ttgaaggaagcttatatgggaaagcga

SEQ ID NO: 156699 - DNA, 27 bp, Artificial sequence
  SiRNA target sequence
tgaaggaagcttatatgggaaagcgag

SEQ ID NO: 156700 - DNA, 27 bp, Artificial sequence
  SiRNA target sequence
gaaggaagcttatatgggaaagcgagc

SEQ ID NO: 156701 - DNA, 27 bp, Artificial sequence
  SiRNA target sequence
aaggaagcttatatgggaaagcgagct

SEQ ID NO: 156702 - DNA, 27 bp, Artificial sequence
  SiRNA target sequence
aggaagcttatatgggaaagcgagcta

SEQ ID NO: 156703 - DNA, 27 bp, Artificial sequence
  SiRNA target sequence
ggaagcttatatgggaaagcgagctag

SEQ ID NO: 156704 - DNA, 27 bp, Artificial sequence
  SiRNA target sequence
gaagcttatatgggaaagcgagctagt

SEQ ID NO: 156705 - DNA, 27 bp, Artificial sequence
  SiRNA target sequence
aagcttatatgggaaagcgagctagtt

SEQ ID NO: 156706 - DNA, 27 bp, Artificial sequence
  SiRNA target sequence
agcttatatgggaaagcgagctagttt

SEQ ID NO: 156707 - DNA, 27 bp, Artificial sequence
  SiRNA target sequence
gcttatatgggaaagcgagctagtttt

SEQ ID NO: 156708 - DNA, 27 bp, Artificial sequence
  SiRNA target sequence
cttatatgggaaagcgagctagtttta

SEQ ID NO: 156709 - DNA, 27 bp, Artificial sequence
  SiRNA target sequence
ttatatgggaaagcgagctagttttaa

SEQ ID NO: 156710 - DNA, 27 bp, Artificial sequence
  SiRNA target sequence
tatatgggaaagcgagctagttttaat

SEQ ID NO: 156711 - DNA, 27 bp, Artificial sequence
  SiRNA target sequence
atatgggaaagcgagctagttttaatg

SEQ ID NO: 156712 - DNA, 27 bp, Artificial sequence
  SiRNA target sequence
tatgggaaagcgagctagttttaatgt

SEQ ID NO: 156713 - DNA, 27 bp, Artificial sequence
  SiRNA target sequence
atgggaaagcgagctagttttaatgta

SEQ ID NO: 156714 - DNA, 27 bp, Artificial sequence
  SiRNA target sequence
tgggaaagcgagctagttttaatgtaa

SEQ ID NO: 156715 - DNA, 27 bp, Artificial sequence
  SiRNA target sequence
gggaaagcgagctagttttaatgtaaa

SEQ ID NO: 156716 - DNA, 27 bp, Artificial sequence
  SiRNA target sequence
ggaaagcgagctagttttaatgtaaaa

SEQ ID NO: 156717 - DNA, 27 bp, Artificial sequence
  SiRNA target sequence
gaaagcgagctagttttaatgtaaaag

SEQ ID NO: 156718 - DNA, 27 bp, Artificial sequence
  SiRNA target sequence
aaagcgagctagttttaatgtaaaagt

SEQ ID NO: 156719 - DNA, 27 bp, Artificial sequence
  SiRNA target sequence
aagcgagctagttttaatgtaaaagtg

SEQ ID NO: 156720 - DNA, 27 bp, Artificial sequence
  SiRNA target sequence
agcgagctagttttaatgtaaaagtgc

SEQ ID NO: 156721 - DNA, 27 bp, Artificial sequence
  SiRNA target sequence
gcgagctagttttaatgtaaaagtgca

SEQ ID NO: 156722 - DNA, 27 bp, Artificial sequence
  SiRNA target sequence
cgagctagttttaatgtaaaagtgcaa

SEQ ID NO: 156723 - DNA, 27 bp, Artificial sequence
  SiRNA target sequence
gagctagttttaatgtaaaagtgcaaa

SEQ ID NO: 156724 - DNA, 27 bp, Artificial sequence
  SiRNA target sequence
agctagttttaatgtaaaagtgcaaag

SEQ ID NO: 156725 - DNA, 27 bp, Artificial sequence
  SiRNA target sequence
gctagttttaatgtaaaagtgcaaaga

SEQ ID NO: 156726 - DNA, 27 bp, Artificial sequence
  SiRNA target sequence
ctagttttaatgtaaaagtgcaaagag

SEQ ID NO: 156727 - DNA, 27 bp, Artificial sequence
  SiRNA target sequence
tagttttaatgtaaaagtgcaaagaga

SEQ ID NO: 156728 - DNA, 27 bp, Artificial sequence
  SiRNA target sequence
agttttaatgtaaaagtgcaaagagaa

SEQ ID NO: 156729 - DNA, 27 bp, Artificial sequence
  SiRNA target sequence
gttttaatgtaaaagtgcaaagagaat

SEQ ID NO: 156730 - DNA, 27 bp, Artificial sequence
  SiRNA target sequence
ttttaatgtaaaagtgcaaagagaatg

SEQ ID NO: 156731 - DNA, 27 bp, Artificial sequence
  SiRNA target sequence
tttaatgtaaaagtgcaaagagaatgt

SEQ ID NO: 156732 - DNA, 27 bp, Artificial sequence
  SiRNA target sequence
ttaatgtaaaagtgcaaagagaatgtt

SEQ ID NO: 156733 - DNA, 27 bp, Artificial sequence
  SiRNA target sequence
taatgtaaaagtgcaaagagaatgttc

SEQ ID NO: 156734 - DNA, 27 bp, Artificial sequence
  SiRNA target sequence
aatgtaaaagtgcaaagagaatgttct

SEQ ID NO: 156735 - DNA, 27 bp, Artificial sequence
  SiRNA target sequence
atgtaaaagtgcaaagagaatgttctg

SEQ ID NO: 156736 - DNA, 27 bp, Artificial sequence
  SiRNA target sequence
tgtaaaagtgcaaagagaatgttctgc

SEQ ID NO: 156737 - DNA, 27 bp, Artificial sequence
  SiRNA target sequence
gtaaaagtgcaaagagaatgttctgcg

SEQ ID NO: 156738 - DNA, 27 bp, Artificial sequence
  SiRNA target sequence
taaaagtgcaaagagaatgttctgcgt

SEQ ID NO: 156739 - DNA, 27 bp, Artificial sequence
  SiRNA target sequence
aaaagtgcaaagagaatgttctgcgtg

SEQ ID NO: 156740 - DNA, 27 bp, Artificial sequence
  SiRNA target sequence
aaagtgcaaagagaatgttctgcgtgt

SEQ ID NO: 156741 - DNA, 27 bp, Artificial sequence
  SiRNA target sequence
aagtgcaaagagaatgttctgcgtgta

SEQ ID NO: 156742 - DNA, 27 bp, Artificial sequence
  SiRNA target sequence
agtgcaaagagaatgttctgcgtgtaa

SEQ ID NO: 156743 - DNA, 27 bp, Artificial sequence
  SiRNA target sequence
gtgcaaagagaatgttctgcgtgtaac

SEQ ID NO: 156744 - DNA, 27 bp, Artificial sequence
  SiRNA target sequence
tgcaaagagaatgttctgcgtgtaacg

SEQ ID NO: 156745 - DNA, 27 bp, Artificial sequence
  SiRNA target sequence
gcaaagagaatgttctgcgtgtaacgg

SEQ ID NO: 156746 - DNA, 27 bp, Artificial sequence
  SiRNA target sequence
caaagagaatgttctgcgtgtaacggt

SEQ ID NO: 156747 - DNA, 27 bp, Artificial sequence
  SiRNA target sequence
aaagagaatgttctgcgtgtaacggta

SEQ ID NO: 156748 - DNA, 27 bp, Artificial sequence
  SiRNA target sequence
aagagaatgttctgcgtgtaacggtaa

SEQ ID NO: 156749 - DNA, 27 bp, Artificial sequence
  SiRNA target sequence
agagaatgttctgcgtgtaacggtaaa

SEQ ID NO: 156750 - DNA, 27 bp, Artificial sequence
  SiRNA target sequence
gagaatgttctgcgtgtaacggtaaag

SEQ ID NO: 156751 - DNA, 27 bp, Artificial sequence
  SiRNA target sequence
agaatgttctgcgtgtaacggtaaagg

SEQ ID NO: 156752 - DNA, 27 bp, Artificial sequence
  SiRNA target sequence
gaatgttctgcgtgtaacggtaaagga

SEQ ID NO: 156753 - DNA, 27 bp, Artificial sequence
  SiRNA target sequence
aatgttctgcgtgtaacggtaaaggag

SEQ ID NO: 156754 - DNA, 27 bp, Artificial sequence
  SiRNA target sequence
atgttctgcgtgtaacggtaaaggagg

SEQ ID NO: 156755 - DNA, 27 bp, Artificial sequence
  SiRNA target sequence
tgttctgcgtgtaacggtaaaggagga

SEQ ID NO: 156756 - DNA, 27 bp, Artificial sequence
  SiRNA target sequence
gttctgcgtgtaacggtaaaggaggag

SEQ ID NO: 156757 - DNA, 27 bp, Artificial sequence
  SiRNA target sequence
ttctgcgtgtaacggtaaaggaggaga

SEQ ID NO: 156758 - DNA, 27 bp, Artificial sequence
  SiRNA target sequence
tctgcgtgtaacggtaaaggaggagac

SEQ ID NO: 156759 - DNA, 27 bp, Artificial sequence
  SiRNA target sequence
ctgcgtgtaacggtaaaggaggagaca

SEQ ID NO: 156760 - DNA, 27 bp, Artificial sequence
  SiRNA target sequence
tgcgtgtaacggtaaaggaggagacag

SEQ ID NO: 156761 - DNA, 27 bp, Artificial sequence
  SiRNA target sequence
gcgtgtaacggtaaaggaggagacagt

SEQ ID NO: 156762 - DNA, 27 bp, Artificial sequence
  SiRNA target sequence
cgtgtaacggtaaaggaggagacagtg

SEQ ID NO: 156763 - DNA, 27 bp, Artificial sequence
  SiRNA target sequence
gtgtaacggtaaaggaggagacagtgt

SEQ ID NO: 156764 - DNA, 27 bp, Artificial sequence
  SiRNA target sequence
tgtaacggtaaaggaggagacagtgtt

SEQ ID NO: 156765 - DNA, 27 bp, Artificial sequence
  SiRNA target sequence
gtaacggtaaaggaggagacagtgttg

SEQ ID NO: 156766 - DNA, 27 bp, Artificial sequence
  SiRNA target sequence
taacggtaaaggaggagacagtgttga

SEQ ID NO: 156767 - DNA, 27 bp, Artificial sequence
  SiRNA target sequence
aacggtaaaggaggagacagtgttgaa

SEQ ID NO: 156768 - DNA, 27 bp, Artificial sequence
  SiRNA target sequence
acggtaaaggaggagacagtgttgaaa

SEQ ID NO: 156769 - DNA, 27 bp, Artificial sequence
  SiRNA target sequence
cggtaaaggaggagacagtgttgaaac

SEQ ID NO: 156770 - DNA, 27 bp, Artificial sequence
  SiRNA target sequence
ggtaaaggaggagacagtgttgaaaca

SEQ ID NO: 156771 - DNA, 27 bp, Artificial sequence
  SiRNA target sequence
gtaaaggaggagacagtgttgaaacat

SEQ ID NO: 156772 - DNA, 27 bp, Artificial sequence
  SiRNA target sequence
taaaggaggagacagtgttgaaacatg

SEQ ID NO: 156773 - DNA, 27 bp, Artificial sequence
  SiRNA target sequence
aaaggaggagacagtgttgaaacatgt

SEQ ID NO: 156774 - DNA, 27 bp, Artificial sequence
  SiRNA target sequence
aaggaggagacagtgttgaaacatgtg

SEQ ID NO: 156775 - DNA, 27 bp, Artificial sequence
  SiRNA target sequence
aggaggagacagtgttgaaacatgtga

SEQ ID NO: 156776 - DNA, 27 bp, Artificial sequence
  SiRNA target sequence
ggaggagacagtgttgaaacatgtgaa

SEQ ID NO: 156777 - DNA, 27 bp, Artificial sequence
  SiRNA target sequence
gaggagacagtgttgaaacatgtgaac

SEQ ID NO: 156778 - DNA, 27 bp, Artificial sequence
  SiRNA target sequence
aggagacagtgttgaaacatgtgaacc

SEQ ID NO: 156779 - DNA, 27 bp, Artificial sequence
  SiRNA target sequence
ggagacagtgttgaaacatgtgaacca

SEQ ID NO: 156780 - DNA, 27 bp, Artificial sequence
  SiRNA target sequence
gagacagtgttgaaacatgtgaaccat

SEQ ID NO: 156781 - DNA, 27 bp, Artificial sequence
  SiRNA target sequence
agacagtgttgaaacatgtgaaccatg

SEQ ID NO: 156782 - DNA, 27 bp, Artificial sequence
  SiRNA target sequence
gacagtgttgaaacatgtgaaccatgt

SEQ ID NO: 156783 - DNA, 27 bp, Artificial sequence
  SiRNA target sequence
acagtgttgaaacatgtgaaccatgta

SEQ ID NO: 156784 - DNA, 27 bp, Artificial sequence
  SiRNA target sequence
cagtgttgaaacatgtgaaccatgtaa

SEQ ID NO: 156785 - DNA, 27 bp, Artificial sequence
  SiRNA target sequence
agtgttgaaacatgtgaaccatgtaaa

SEQ ID NO: 156786 - DNA, 27 bp, Artificial sequence
  SiRNA target sequence
gtgttgaaacatgtgaaccatgtaaag

SEQ ID NO: 156787 - DNA, 27 bp, Artificial sequence
  SiRNA target sequence
tgttgaaacatgtgaaccatgtaaagg

SEQ ID NO: 156788 - DNA, 27 bp, Artificial sequence
  SiRNA target sequence
gttgaaacatgtgaaccatgtaaaggt

SEQ ID NO: 156789 - DNA, 27 bp, Artificial sequence
  SiRNA target sequence
ttgaaacatgtgaaccatgtaaaggta

SEQ ID NO: 156790 - DNA, 27 bp, Artificial sequence
  SiRNA target sequence
tgaaacatgtgaaccatgtaaaggtaa

SEQ ID NO: 156791 - DNA, 27 bp, Artificial sequence
  SiRNA target sequence
gaaacatgtgaaccatgtaaaggtaaa

SEQ ID NO: 156792 - DNA, 27 bp, Artificial sequence
  SiRNA target sequence
aaacatgtgaaccatgtaaaggtaaag

SEQ ID NO: 156793 - DNA, 27 bp, Artificial sequence
  SiRNA target sequence
aacatgtgaaccatgtaaaggtaaagg

SEQ ID NO: 156794 - DNA, 27 bp, Artificial sequence
  SiRNA target sequence
acatgtgaaccatgtaaaggtaaaggt

SEQ ID NO: 156795 - DNA, 27 bp, Artificial sequence
  SiRNA target sequence
catgtgaaccatgtaaaggtaaaggta

SEQ ID NO: 156796 - DNA, 27 bp, Artificial sequence
  SiRNA target sequence
atgtgaaccatgtaaaggtaaaggtaa

SEQ ID NO: 156797 - DNA, 27 bp, Artificial sequence
  SiRNA target sequence
tgtgaaccatgtaaaggtaaaggtaag

SEQ ID NO: 156798 - DNA, 27 bp, Artificial sequence
  SiRNA target sequence
gtgaaccatgtaaaggtaaaggtaagg

SEQ ID NO: 156799 - DNA, 27 bp, Artificial sequence
  SiRNA target sequence
tgaaccatgtaaaggtaaaggtaaggt

SEQ ID NO: 156800 - DNA, 27 bp, Artificial sequence
  SiRNA target sequence
gaaccatgtaaaggtaaaggtaaggta

SEQ ID NO: 156801 - DNA, 27 bp, Artificial sequence
  SiRNA target sequence
aaccatgtaaaggtaaaggtaaggtag

SEQ ID NO: 156802 - DNA, 27 bp, Artificial sequence
  SiRNA target sequence
accatgtaaaggtaaaggtaaggtaga

SEQ ID NO: 156803 - DNA, 27 bp, Artificial sequence
  SiRNA target sequence
ccatgtaaaggtaaaggtaaggtagaa

SEQ ID NO: 156804 - DNA, 27 bp, Artificial sequence
  SiRNA target sequence
catgtaaaggtaaaggtaaggtagaac

SEQ ID NO: 156805 - DNA, 27 bp, Artificial sequence
  SiRNA target sequence
atgtaaaggtaaaggtaaggtagaaca

SEQ ID NO: 156806 - DNA, 27 bp, Artificial sequence
  SiRNA target sequence
tgtaaaggtaaaggtaaggtagaacat

SEQ ID NO: 156807 - DNA, 27 bp, Artificial sequence
  SiRNA target sequence
gtaaaggtaaaggtaaggtagaacatc

SEQ ID NO: 156808 - DNA, 27 bp, Artificial sequence
  SiRNA target sequence
taaaggtaaaggtaaggtagaacatca

SEQ ID NO: 156809 - DNA, 27 bp, Artificial sequence
  SiRNA target sequence
aaaggtaaaggtaaggtagaacatcat

SEQ ID NO: 156810 - DNA, 27 bp, Artificial sequence
  SiRNA target sequence
aaggtaaaggtaaggtagaacatcata

SEQ ID NO: 156811 - DNA, 27 bp, Artificial sequence
  SiRNA target sequence
aggtaaaggtaaggtagaacatcatag

SEQ ID NO: 156812 - DNA, 27 bp, Artificial sequence
  SiRNA target sequence
ggtaaaggtaaggtagaacatcatagg

SEQ ID NO: 156813 - DNA, 27 bp, Artificial sequence
  SiRNA target sequence
gtaaaggtaaggtagaacatcatagga

SEQ ID NO: 156814 - DNA, 27 bp, Artificial sequence
  SiRNA target sequence
taaaggtaaggtagaacatcataggag

SEQ ID NO: 156815 - DNA, 27 bp, Artificial sequence
  SiRNA target sequence
aaaggtaaggtagaacatcataggaga

SEQ ID NO: 156816 - DNA, 27 bp, Artificial sequence
  SiRNA target sequence
aaggtaaggtagaacatcataggagac

SEQ ID NO: 156817 - DNA, 27 bp, Artificial sequence
  SiRNA target sequence
aggtaaggtagaacatcataggagact

SEQ ID NO: 156818 - DNA, 27 bp, Artificial sequence
  SiRNA target sequence
ggtaaggtagaacatcataggagacta

SEQ ID NO: 156819 - DNA, 27 bp, Artificial sequence
  SiRNA target sequence
gtaaggtagaacatcataggagactag

SEQ ID NO: 156820 - DNA, 27 bp, Artificial sequence
  SiRNA target sequence
taaggtagaacatcataggagactagg

SEQ ID NO: 156821 - DNA, 27 bp, Artificial sequence
  SiRNA target sequence
aaggtagaacatcataggagactaggt

SEQ ID NO: 156822 - DNA, 27 bp, Artificial sequence
  SiRNA target sequence
aggtagaacatcataggagactaggtc

SEQ ID NO: 156823 - DNA, 27 bp, Artificial sequence
  SiRNA target sequence
ggtagaacatcataggagactaggtcc

SEQ ID NO: 156824 - DNA, 27 bp, Artificial sequence
  SiRNA target sequence
gtagaacatcataggagactaggtcct

SEQ ID NO: 156825 - DNA, 27 bp, Artificial sequence
  SiRNA target sequence
tagaacatcataggagactaggtcctt

SEQ ID NO: 156826 - DNA, 27 bp, Artificial sequence
  SiRNA target sequence
agaacatcataggagactaggtccttt

SEQ ID NO: 156827 - DNA, 27 bp, Artificial sequence
  SiRNA target sequence
gaacatcataggagactaggtccttta

SEQ ID NO: 156828 - DNA, 27 bp, Artificial sequence
  SiRNA target sequence
aacatcataggagactaggtcctttaa

SEQ ID NO: 156829 - DNA, 27 bp, Artificial sequence
  SiRNA target sequence
acatcataggagactaggtcctttaat

SEQ ID NO: 156830 - DNA, 27 bp, Artificial sequence
  SiRNA target sequence
catcataggagactaggtcctttaatt

SEQ ID NO: 156831 - DNA, 27 bp, Artificial sequence
  SiRNA target sequence
atcataggagactaggtcctttaattt

SEQ ID NO: 156832 - DNA, 27 bp, Artificial sequence
  SiRNA target sequence
tcataggagactaggtcctttaatttc

SEQ ID NO: 156833 - DNA, 27 bp, Artificial sequence
  SiRNA target sequence
cataggagactaggtcctttaatttct

SEQ ID NO: 156834 - DNA, 27 bp, Artificial sequence
  SiRNA target sequence
ataggagactaggtcctttaatttctg

SEQ ID NO: 156835 - DNA, 27 bp, Artificial sequence
  SiRNA target sequence
taggagactaggtcctttaatttctgt

SEQ ID NO: 156836 - DNA, 27 bp, Artificial sequence
  SiRNA target sequence
aggagactaggtcctttaatttctgta

SEQ ID NO: 156837 - DNA, 27 bp, Artificial sequence
  SiRNA target sequence
ggagactaggtcctttaatttctgtac

SEQ ID NO: 156838 - DNA, 27 bp, Artificial sequence
  SiRNA target sequence
gagactaggtcctttaatttctgtaca

SEQ ID NO: 156839 - DNA, 27 bp, Artificial sequence
  SiRNA target sequence
agactaggtcctttaatttctgtacaa

SEQ ID NO: 156840 - DNA, 27 bp, Artificial sequence
  SiRNA target sequence
gactaggtcctttaatttctgtacaag

SEQ ID NO: 156841 - DNA, 27 bp, Artificial sequence
  SiRNA target sequence
actaggtcctttaatttctgtacaaga

SEQ ID NO: 156842 - DNA, 27 bp, Artificial sequence
  SiRNA target sequence
ctaggtcctttaatttctgtacaagaa

SEQ ID NO: 156843 - DNA, 27 bp, Artificial sequence
  SiRNA target sequence
taggtcctttaatttctgtacaagaag

SEQ ID NO: 156844 - DNA, 27 bp, Artificial sequence
  SiRNA target sequence
aggtcctttaatttctgtacaagaagc

SEQ ID NO: 156845 - DNA, 27 bp, Artificial sequence
  SiRNA target sequence
ggtcctttaatttctgtacaagaagca

SEQ ID NO: 156846 - DNA, 27 bp, Artificial sequence
  SiRNA target sequence
gtcctttaatttctgtacaagaagcac

SEQ ID NO: 156847 - DNA, 27 bp, Artificial sequence
  SiRNA target sequence
tcctttaatttctgtacaagaagcacc

SEQ ID NO: 156848 - DNA, 27 bp, Artificial sequence
  SiRNA target sequence
cctttaatttctgtacaagaagcacct

SEQ ID NO: 156849 - DNA, 27 bp, Artificial sequence
  SiRNA target sequence
ctttaatttctgtacaagaagcacctt

SEQ ID NO: 156850 - DNA, 27 bp, Artificial sequence
  SiRNA target sequence
tttaatttctgtacaagaagcaccttg

SEQ ID NO: 156851 - DNA, 27 bp, Artificial sequence
  SiRNA target sequence
ttaatttctgtacaagaagcaccttgt

SEQ ID NO: 156852 - DNA, 27 bp, Artificial sequence
  SiRNA target sequence
taatttctgtacaagaagcaccttgta

SEQ ID NO: 156853 - DNA, 27 bp, Artificial sequence
  SiRNA target sequence
aatttctgtacaagaagcaccttgtaa

SEQ ID NO: 156854 - DNA, 27 bp, Artificial sequence
  SiRNA target sequence
atttctgtacaagaagcaccttgtaat

SEQ ID NO: 156855 - DNA, 27 bp, Artificial sequence
  SiRNA target sequence
tttctgtacaagaagcaccttgtaata

SEQ ID NO: 156856 - DNA, 27 bp, Artificial sequence
  SiRNA target sequence
ttctgtacaagaagcaccttgtaataa

SEQ ID NO: 156857 - DNA, 27 bp, Artificial sequence
  SiRNA target sequence
tctgtacaagaagcaccttgtaataat

SEQ ID NO: 156858 - DNA, 27 bp, Artificial sequence
  SiRNA target sequence
ctgtacaagaagcaccttgtaataatt

SEQ ID NO: 156859 - DNA, 27 bp, Artificial sequence
  SiRNA target sequence
tgtacaagaagcaccttgtaataattg

SEQ ID NO: 156860 - DNA, 27 bp, Artificial sequence
  SiRNA target sequence
gtacaagaagcaccttgtaataattgt

SEQ ID NO: 156861 - DNA, 27 bp, Artificial sequence
  SiRNA target sequence
tacaagaagcaccttgtaataattgta

SEQ ID NO: 156862 - DNA, 27 bp, Artificial sequence
  SiRNA target sequence
acaagaagcaccttgtaataattgtaa

SEQ ID NO: 156863 - DNA, 27 bp, Artificial sequence
  SiRNA target sequence
caagaagcaccttgtaataattgtaat

SEQ ID NO: 156864 - DNA, 27 bp, Artificial sequence
  SiRNA target sequence
aagaagcaccttgtaataattgtaatt

SEQ ID NO: 156865 - DNA, 27 bp, Artificial sequence
  SiRNA target sequence
agaagcaccttgtaataattgtaattc

SEQ ID NO: 156866 - DNA, 27 bp, Artificial sequence
  SiRNA target sequence
gaagcaccttgtaataattgtaattct

SEQ ID NO: 156867 - DNA, 27 bp, Artificial sequence
  SiRNA target sequence
aagcaccttgtaataattgtaattcta

SEQ ID NO: 156868 - DNA, 27 bp, Artificial sequence
  SiRNA target sequence
agcaccttgtaataattgtaattctac

SEQ ID NO: 156869 - DNA, 27 bp, Artificial sequence
  SiRNA target sequence
gcaccttgtaataattgtaattctact

SEQ ID NO: 156870 - DNA, 27 bp, Artificial sequence
  SiRNA target sequence
caccttgtaataattgtaattctactg

SEQ ID NO: 156871 - DNA, 27 bp, Artificial sequence
  SiRNA target sequence
accttgtaataattgtaattctactgg

SEQ ID NO: 156872 - DNA, 27 bp, Artificial sequence
  SiRNA target sequence
ccttgtaataattgtaattctactgga

SEQ ID NO: 156873 - DNA, 27 bp, Artificial sequence
  SiRNA target sequence
cttgtaataattgtaattctactggat

SEQ ID NO: 156874 - DNA, 27 bp, Artificial sequence
  SiRNA target sequence
ttgtaataattgtaattctactggatt

SEQ ID NO: 156875 - DNA, 27 bp, Artificial sequence
  SiRNA target sequence
tgtaataattgtaattctactggattt

SEQ ID NO: 156876 - DNA, 27 bp, Artificial sequence
  SiRNA target sequence
gtaataattgtaattctactggatttg

SEQ ID NO: 156877 - DNA, 27 bp, Artificial sequence
  SiRNA target sequence
taataattgtaattctactggatttgt

SEQ ID NO: 156878 - DNA, 27 bp, Artificial sequence
  SiRNA target sequence
aataattgtaattctactggatttgtt

SEQ ID NO: 156879 - DNA, 27 bp, Artificial sequence
  SiRNA target sequence
ataattgtaattctactggatttgttg

SEQ ID NO: 156880 - DNA, 27 bp, Artificial sequence
  SiRNA target sequence
taattgtaattctactggatttgttgt

SEQ ID NO: 156881 - DNA, 27 bp, Artificial sequence
  SiRNA target sequence
aattgtaattctactggatttgttgtt

SEQ ID NO: 156882 - DNA, 27 bp, Artificial sequence
  SiRNA target sequence
attgtaattctactggatttgttgtta

SEQ ID NO: 156883 - DNA, 27 bp, Artificial sequence
  SiRNA target sequence
ttgtaattctactggatttgttgttaa

SEQ ID NO: 156884 - DNA, 27 bp, Artificial sequence
  SiRNA target sequence
tgtaattctactggatttgttgttaaa

SEQ ID NO: 156885 - DNA, 27 bp, Artificial sequence
  SiRNA target sequence
gtaattctactggatttgttgttaaag

SEQ ID NO: 156886 - DNA, 27 bp, Artificial sequence
  SiRNA target sequence
taattctactggatttgttgttaaagg

SEQ ID NO: 156887 - DNA, 27 bp, Artificial sequence
  SiRNA target sequence
aattctactggatttgttgttaaagga

SEQ ID NO: 156888 - DNA, 27 bp, Artificial sequence
  SiRNA target sequence
attctactggatttgttgttaaaggaa

SEQ ID NO: 156889 - DNA, 27 bp, Artificial sequence
  SiRNA target sequence
ttctactggatttgttgttaaaggaaa

SEQ ID NO: 156890 - DNA, 27 bp, Artificial sequence
  SiRNA target sequence
tctactggatttgttgttaaaggaaag

SEQ ID NO: 156891 - DNA, 27 bp, Artificial sequence
  SiRNA target sequence
ctactggatttgttgttaaaggaaagc

SEQ ID NO: 156892 - DNA, 27 bp, Artificial sequence
  SiRNA target sequence
tactggatttgttgttaaaggaaagct

SEQ ID NO: 156893 - DNA, 27 bp, Artificial sequence
  SiRNA target sequence
actggatttgttgttaaaggaaagctt

SEQ ID NO: 156894 - DNA, 27 bp, Artificial sequence
  SiRNA target sequence
ctggatttgttgttaaaggaaagcttt

SEQ ID NO: 156895 - DNA, 27 bp, Artificial sequence
  SiRNA target sequence
tggatttgttgttaaaggaaagctttg

SEQ ID NO: 156896 - DNA, 27 bp, Artificial sequence
  SiRNA target sequence
ggatttgttgttaaaggaaagctttgt

SEQ ID NO: 156897 - DNA, 27 bp, Artificial sequence
  SiRNA target sequence
gatttgttgttaaaggaaagctttgtc

SEQ ID NO: 156898 - DNA, 27 bp, Artificial sequence
  SiRNA target sequence
atttgttgttaaaggaaagctttgtca

SEQ ID NO: 156899 - DNA, 27 bp, Artificial sequence
  SiRNA target sequence
tttgttgttaaaggaaagctttgtcaa

SEQ ID NO: 156900 - DNA, 27 bp, Artificial sequence
  SiRNA target sequence
ttgttgttaaaggaaagctttgtcaaa

SEQ ID NO: 156901 - DNA, 27 bp, Artificial sequence
  SiRNA target sequence
tgttgttaaaggaaagctttgtcaaag

SEQ ID NO: 156902 - DNA, 27 bp, Artificial sequence
  SiRNA target sequence
gttgttaaaggaaagctttgtcaaagt

SEQ ID NO: 156903 - DNA, 27 bp, Artificial sequence
  SiRNA target sequence
ttgttaaaggaaagctttgtcaaagtt

SEQ ID NO: 156904 - DNA, 27 bp, Artificial sequence
  SiRNA target sequence
tgttaaaggaaagctttgtcaaagttg

SEQ ID NO: 156905 - DNA, 27 bp, Artificial sequence
  SiRNA target sequence
gttaaaggaaagctttgtcaaagttgt

SEQ ID NO: 156906 - DNA, 27 bp, Artificial sequence
  SiRNA target sequence
ttaaaggaaagctttgtcaaagttgta

SEQ ID NO: 156907 - DNA, 27 bp, Artificial sequence
  SiRNA target sequence
taaaggaaagctttgtcaaagttgtaa

SEQ ID NO: 156908 - DNA, 27 bp, Artificial sequence
  SiRNA target sequence
aaaggaaagctttgtcaaagttgtaaa

SEQ ID NO: 156909 - DNA, 27 bp, Artificial sequence
  SiRNA target sequence
aaggaaagctttgtcaaagttgtaaag

SEQ ID NO: 156910 - DNA, 27 bp, Artificial sequence
  SiRNA target sequence
aggaaagctttgtcaaagttgtaaagg

SEQ ID NO: 156911 - DNA, 27 bp, Artificial sequence
  SiRNA target sequence
ggaaagctttgtcaaagttgtaaaggt

SEQ ID NO: 156912 - DNA, 27 bp, Artificial sequence
  SiRNA target sequence
gaaagctttgtcaaagttgtaaaggta

SEQ ID NO: 156913 - DNA, 27 bp, Artificial sequence
  SiRNA target sequence
aaagctttgtcaaagttgtaaaggtaa

SEQ ID NO: 156914 - DNA, 27 bp, Artificial sequence
  SiRNA target sequence
aagctttgtcaaagttgtaaaggtaaa

SEQ ID NO: 156915 - DNA, 27 bp, Artificial sequence
  SiRNA target sequence
agctttgtcaaagttgtaaaggtaaac

SEQ ID NO: 156916 - DNA, 27 bp, Artificial sequence
  SiRNA target sequence
gctttgtcaaagttgtaaaggtaaaca

SEQ ID NO: 156917 - DNA, 27 bp, Artificial sequence
  SiRNA target sequence
ctttgtcaaagttgtaaaggtaaacaa

SEQ ID NO: 156918 - DNA, 27 bp, Artificial sequence
  SiRNA target sequence
tttgtcaaagttgtaaaggtaaacaat

SEQ ID NO: 156919 - DNA, 27 bp, Artificial sequence
  SiRNA target sequence
ttgtcaaagttgtaaaggtaaacaata

SEQ ID NO: 156920 - DNA, 27 bp, Artificial sequence
  SiRNA target sequence
tgtcaaagttgtaaaggtaaacaatac

SEQ ID NO: 156921 - DNA, 27 bp, Artificial sequence
  SiRNA target sequence
gtcaaagttgtaaaggtaaacaatacg

SEQ ID NO: 156922 - DNA, 27 bp, Artificial sequence
  SiRNA target sequence
tcaaagttgtaaaggtaaacaatacgt

SEQ ID NO: 156923 - DNA, 27 bp, Artificial sequence
  SiRNA target sequence
caaagttgtaaaggtaaacaatacgtt

SEQ ID NO: 156924 - DNA, 27 bp, Artificial sequence
  SiRNA target sequence
aaagttgtaaaggtaaacaatacgttg

SEQ ID NO: 156925 - DNA, 27 bp, Artificial sequence
  SiRNA target sequence
aagttgtaaaggtaaacaatacgttga

SEQ ID NO: 156926 - DNA, 27 bp, Artificial sequence
  SiRNA target sequence
agttgtaaaggtaaacaatacgttgag

SEQ ID NO: 156927 - DNA, 27 bp, Artificial sequence
  SiRNA target sequence
gttgtaaaggtaaacaatacgttgaga

SEQ ID NO: 156928 - DNA, 27 bp, Artificial sequence
  SiRNA target sequence
ttgtaaaggtaaacaatacgttgagac

SEQ ID NO: 156929 - DNA, 27 bp, Artificial sequence
  SiRNA target sequence
tgtaaaggtaaacaatacgttgagact

SEQ ID NO: 156930 - DNA, 27 bp, Artificial sequence
  SiRNA target sequence
gtaaaggtaaacaatacgttgagacta

SEQ ID NO: 156931 - DNA, 27 bp, Artificial sequence
  SiRNA target sequence
taaaggtaaacaatacgttgagactaa

SEQ ID NO: 156932 - DNA, 27 bp, Artificial sequence
  SiRNA target sequence
aaaggtaaacaatacgttgagactaaa

SEQ ID NO: 156933 - DNA, 27 bp, Artificial sequence
  SiRNA target sequence
aaggtaaacaatacgttgagactaaag

SEQ ID NO: 156934 - DNA, 27 bp, Artificial sequence
  SiRNA target sequence
aggtaaacaatacgttgagactaaaga

SEQ ID NO: 156935 - DNA, 27 bp, Artificial sequence
  SiRNA target sequence
ggtaaacaatacgttgagactaaagaa

SEQ ID NO: 156936 - DNA, 27 bp, Artificial sequence
  SiRNA target sequence
gtaaacaatacgttgagactaaagaac

SEQ ID NO: 156937 - DNA, 27 bp, Artificial sequence
  SiRNA target sequence
taaacaatacgttgagactaaagaaca

SEQ ID NO: 156938 - DNA, 27 bp, Artificial sequence
  SiRNA target sequence
aaacaatacgttgagactaaagaacat

SEQ ID NO: 156939 - DNA, 27 bp, Artificial sequence
  SiRNA target sequence
aacaatacgttgagactaaagaacata

SEQ ID NO: 156940 - DNA, 27 bp, Artificial sequence
  SiRNA target sequence
acaatacgttgagactaaagaacatat

SEQ ID NO: 156941 - DNA, 27 bp, Artificial sequence
  SiRNA target sequence
caatacgttgagactaaagaacatatt

SEQ ID NO: 156942 - DNA, 27 bp, Artificial sequence
  SiRNA target sequence
aatacgttgagactaaagaacatattg

SEQ ID NO: 156943 - DNA, 27 bp, Artificial sequence
  SiRNA target sequence
atacgttgagactaaagaacatattga

SEQ ID NO: 156944 - DNA, 27 bp, Artificial sequence
  SiRNA target sequence
tacgttgagactaaagaacatattgaa

SEQ ID NO: 156945 - DNA, 27 bp, Artificial sequence
  SiRNA target sequence
acgttgagactaaagaacatattgaag

SEQ ID NO: 156946 - DNA, 27 bp, Artificial sequence
  SiRNA target sequence
cgttgagactaaagaacatattgaagt

SEQ ID NO: 156947 - DNA, 27 bp, Artificial sequence
  SiRNA target sequence
gttgagactaaagaacatattgaagtg

SEQ ID NO: 156948 - DNA, 27 bp, Artificial sequence
  SiRNA target sequence
ttgagactaaagaacatattgaagtgg

SEQ ID NO: 156949 - DNA, 27 bp, Artificial sequence
  SiRNA target sequence
tgagactaaagaacatattgaagtgga

SEQ ID NO: 156950 - DNA, 27 bp, Artificial sequence
  SiRNA target sequence
gagactaaagaacatattgaagtggaa

SEQ ID NO: 156951 - DNA, 27 bp, Artificial sequence
  SiRNA target sequence
agactaaagaacatattgaagtggaag

SEQ ID NO: 156952 - DNA, 27 bp, Artificial sequence
  SiRNA target sequence
gactaaagaacatattgaagtggaagt

SEQ ID NO: 156953 - DNA, 27 bp, Artificial sequence
  SiRNA target sequence
actaaagaacatattgaagtggaagta

SEQ ID NO: 156954 - DNA, 27 bp, Artificial sequence
  SiRNA target sequence
ctaaagaacatattgaagtggaagtag

SEQ ID NO: 156955 - DNA, 27 bp, Artificial sequence
  SiRNA target sequence
taaagaacatattgaagtggaagtaga

SEQ ID NO: 156956 - DNA, 27 bp, Artificial sequence
  SiRNA target sequence
aaagaacatattgaagtggaagtagag

SEQ ID NO: 156957 - DNA, 27 bp, Artificial sequence
  SiRNA target sequence
aagaacatattgaagtggaagtagagc

SEQ ID NO: 156958 - DNA, 27 bp, Artificial sequence
  SiRNA target sequence
agaacatattgaagtggaagtagagcc

SEQ ID NO: 156959 - DNA, 27 bp, Artificial sequence
  SiRNA target sequence
gaacatattgaagtggaagtagagcca

SEQ ID NO: 156960 - DNA, 27 bp, Artificial sequence
  SiRNA target sequence
aacatattgaagtggaagtagagccag

SEQ ID NO: 156961 - DNA, 27 bp, Artificial sequence
  SiRNA target sequence
acatattgaagtggaagtagagccagg

SEQ ID NO: 156962 - DNA, 27 bp, Artificial sequence
  SiRNA target sequence
catattgaagtggaagtagagccagga

SEQ ID NO: 156963 - DNA, 27 bp, Artificial sequence
  SiRNA target sequence
atattgaagtggaagtagagccaggag

SEQ ID NO: 156964 - DNA, 27 bp, Artificial sequence
  SiRNA target sequence
tattgaagtggaagtagagccaggagt

SEQ ID NO: 156965 - DNA, 27 bp, Artificial sequence
  SiRNA target sequence
attgaagtggaagtagagccaggagta

SEQ ID NO: 156966 - DNA, 27 bp, Artificial sequence
  SiRNA target sequence
ttgaagtggaagtagagccaggagtac

SEQ ID NO: 156967 - DNA, 27 bp, Artificial sequence
  SiRNA target sequence
tgaagtggaagtagagccaggagtaca

SEQ ID NO: 156968 - DNA, 27 bp, Artificial sequence
  SiRNA target sequence
gaagtggaagtagagccaggagtacag

SEQ ID NO: 156969 - DNA, 27 bp, Artificial sequence
  SiRNA target sequence
aagtggaagtagagccaggagtacaga

SEQ ID NO: 156970 - DNA, 27 bp, Artificial sequence
  SiRNA target sequence
agtggaagtagagccaggagtacagaa

SEQ ID NO: 156971 - DNA, 27 bp, Artificial sequence
  SiRNA target sequence
gtggaagtagagccaggagtacagaac

SEQ ID NO: 156972 - DNA, 27 bp, Artificial sequence
  SiRNA target sequence
tggaagtagagccaggagtacagaacg

SEQ ID NO: 156973 - DNA, 27 bp, Artificial sequence
  SiRNA target sequence
ggaagtagagccaggagtacagaacgg

SEQ ID NO: 156974 - DNA, 27 bp, Artificial sequence
  SiRNA target sequence
gaagtagagccaggagtacagaacggt

SEQ ID NO: 156975 - DNA, 27 bp, Artificial sequence
  SiRNA target sequence
aagtagagccaggagtacagaacggta

SEQ ID NO: 156976 - DNA, 27 bp, Artificial sequence
  SiRNA target sequence
agtagagccaggagtacagaacggtag

SEQ ID NO: 156977 - DNA, 27 bp, Artificial sequence
  SiRNA target sequence
gtagagccaggagtacagaacggtaga

SEQ ID NO: 156978 - DNA, 27 bp, Artificial sequence
  SiRNA target sequence
tagagccaggagtacagaacggtagaa

SEQ ID NO: 156979 - DNA, 27 bp, Artificial sequence
  SiRNA target sequence
agagccaggagtacagaacggtagaaa

SEQ ID NO: 156980 - DNA, 27 bp, Artificial sequence
  SiRNA target sequence
gagccaggagtacagaacggtagaaaa

SEQ ID NO: 156981 - DNA, 27 bp, Artificial sequence
  SiRNA target sequence
agccaggagtacagaacggtagaaaat

SEQ ID NO: 156982 - DNA, 27 bp, Artificial sequence
  SiRNA target sequence
gccaggagtacagaacggtagaaaata

SEQ ID NO: 156983 - DNA, 27 bp, Artificial sequence
  SiRNA target sequence
ccaggagtacagaacggtagaaaatat

SEQ ID NO: 156984 - DNA, 27 bp, Artificial sequence
  SiRNA target sequence
caggagtacagaacggtagaaaatata

SEQ ID NO: 156985 - DNA, 27 bp, Artificial sequence
  SiRNA target sequence
aggagtacagaacggtagaaaatatac

SEQ ID NO: 156986 - DNA, 27 bp, Artificial sequence
  SiRNA target sequence
ggagtacagaacggtagaaaatataca

SEQ ID NO: 156987 - DNA, 27 bp, Artificial sequence
  SiRNA target sequence
gagtacagaacggtagaaaatatacat

SEQ ID NO: 156988 - DNA, 27 bp, Artificial sequence
  SiRNA target sequence
agtacagaacggtagaaaatatacatt

SEQ ID NO: 156989 - DNA, 27 bp, Artificial sequence
  SiRNA target sequence
gtacagaacggtagaaaatatacattt

SEQ ID NO: 156990 - DNA, 27 bp, Artificial sequence
  SiRNA target sequence
tacagaacggtagaaaatatacatttt

SEQ ID NO: 156991 - DNA, 27 bp, Artificial sequence
  SiRNA target sequence
acagaacggtagaaaatatacattttc

SEQ ID NO: 156992 - DNA, 27 bp, Artificial sequence
  SiRNA target sequence
cagaacggtagaaaatatacattttct

SEQ ID NO: 156993 - DNA, 27 bp, Artificial sequence
  SiRNA target sequence
agaacggtagaaaatatacattttctg

SEQ ID NO: 156994 - DNA, 27 bp, Artificial sequence
  SiRNA target sequence
gaacggtagaaaatatacattttctgg

SEQ ID NO: 156995 - DNA, 27 bp, Artificial sequence
  SiRNA target sequence
aacggtagaaaatatacattttctggc

SEQ ID NO: 156996 - DNA, 27 bp, Artificial sequence
  SiRNA target sequence
acggtagaaaatatacattttctggca

SEQ ID NO: 156997 - DNA, 27 bp, Artificial sequence
  SiRNA target sequence
cggtagaaaatatacattttctggcaa

SEQ ID NO: 156998 - DNA, 27 bp, Artificial sequence
  SiRNA target sequence
ggtagaaaatatacattttctggcaaa

SEQ ID NO: 156999 - DNA, 27 bp, Artificial sequence
  SiRNA target sequence
gtagaaaatatacattttctggcaaag

SEQ ID NO: 157000 - DNA, 27 bp, Artificial sequence
  SiRNA target sequence
tagaaaatatacattttctggcaaagg

SEQ ID NO: 157001 - DNA, 27 bp, Artificial sequence
  SiRNA target sequence
agaaaatatacattttctggcaaagga

SEQ ID NO: 157002 - DNA, 27 bp, Artificial sequence
  SiRNA target sequence
gaaaatatacattttctggcaaaggaa

SEQ ID NO: 157003 - DNA, 27 bp, Artificial sequence
  SiRNA target sequence
aaaatatacattttctggcaaaggaaa

SEQ ID NO: 157004 - DNA, 27 bp, Artificial sequence
  SiRNA target sequence
aaatatacattttctggcaaaggaaat

SEQ ID NO: 157005 - DNA, 27 bp, Artificial sequence
  SiRNA target sequence
aatatacattttctggcaaaggaaatc

SEQ ID NO: 157006 - DNA, 27 bp, Artificial sequence
  SiRNA target sequence
atatacattttctggcaaaggaaatca

SEQ ID NO: 157007 - DNA, 27 bp, Artificial sequence
  SiRNA target sequence
tatacattttctggcaaaggaaatcat

SEQ ID NO: 157008 - DNA, 27 bp, Artificial sequence
  SiRNA target sequence
atacattttctggcaaaggaaatcata

SEQ ID NO: 157009 - DNA, 27 bp, Artificial sequence
  SiRNA target sequence
tacattttctggcaaaggaaatcataa

SEQ ID NO: 157010 - DNA, 27 bp, Artificial sequence
  SiRNA target sequence
acattttctggcaaaggaaatcataaa

SEQ ID NO: 157011 - DNA, 27 bp, Artificial sequence
  SiRNA target sequence
cattttctggcaaaggaaatcataaaa

SEQ ID NO: 157012 - DNA, 27 bp, Artificial sequence
  SiRNA target sequence
attttctggcaaaggaaatcataaaaa

SEQ ID NO: 157013 - DNA, 27 bp, Artificial sequence
  SiRNA target sequence
ttttctggcaaaggaaatcataaaaaa

SEQ ID NO: 157014 - DNA, 27 bp, Artificial sequence
  SiRNA target sequence
tttctggcaaaggaaatcataaaaaaa

SEQ ID NO: 157015 - DNA, 27 bp, Artificial sequence
  SiRNA target sequence
ttctggcaaaggaaatcataaaaaaaa

SEQ ID NO: 157016 - DNA, 27 bp, Artificial sequence
  SiRNA target sequence
tctggcaaaggaaatcataaaaaaaat

SEQ ID NO: 157017 - DNA, 27 bp, Artificial sequence
  SiRNA target sequence
ctggcaaaggaaatcataaaaaaaatt

SEQ ID NO: 157018 - DNA, 27 bp, Artificial sequence
  SiRNA target sequence
tggcaaaggaaatcataaaaaaaattg

SEQ ID NO: 157019 - DNA, 27 bp, Artificial sequence
  SiRNA target sequence
ggcaaaggaaatcataaaaaaaattgt

SEQ ID NO: 157020 - DNA, 27 bp, Artificial sequence
  SiRNA target sequence
gcaaaggaaatcataaaaaaaattgtg

SEQ ID NO: 157021 - DNA, 27 bp, Artificial sequence
  SiRNA target sequence
caaaggaaatcataaaaaaaattgtgt

SEQ ID NO: 157022 - DNA, 27 bp, Artificial sequence
  SiRNA target sequence
aaaggaaatcataaaaaaaattgtgta

SEQ ID NO: 157023 - DNA, 27 bp, Artificial sequence
  SiRNA target sequence
aaggaaatcataaaaaaaattgtgtac

SEQ ID NO: 157024 - DNA, 27 bp, Artificial sequence
  SiRNA target sequence
aggaaatcataaaaaaaattgtgtacc

SEQ ID NO: 157025 - DNA, 27 bp, Artificial sequence
  SiRNA target sequence
ggaaatcataaaaaaaattgtgtaccg

SEQ ID NO: 157026 - DNA, 27 bp, Artificial sequence
  SiRNA target sequence
gaaatcataaaaaaaattgtgtaccgg

SEQ ID NO: 157027 - DNA, 27 bp, Artificial sequence
  SiRNA target sequence
aaatcataaaaaaaattgtgtaccggg

SEQ ID NO: 157028 - DNA, 27 bp, Artificial sequence
  SiRNA target sequence
aatcataaaaaaaattgtgtaccgggt

SEQ ID NO: 157029 - DNA, 27 bp, Artificial sequence
  SiRNA target sequence
atcataaaaaaaattgtgtaccgggtg

SEQ ID NO: 157030 - DNA, 27 bp, Artificial sequence
  SiRNA target sequence
tcataaaaaaaattgtgtaccgggtga

SEQ ID NO: 157031 - DNA, 27 bp, Artificial sequence
  SiRNA target sequence
cataaaaaaaattgtgtaccgggtgat

SEQ ID NO: 157032 - DNA, 27 bp, Artificial sequence
  SiRNA target sequence
ataaaaaaaattgtgtaccgggtgatg

SEQ ID NO: 157033 - DNA, 27 bp, Artificial sequence
  SiRNA target sequence
taaaaaaaattgtgtaccgggtgatgt

SEQ ID NO: 157034 - DNA, 27 bp, Artificial sequence
  SiRNA target sequence
aaaaaaaattgtgtaccgggtgatgtg

SEQ ID NO: 157035 - DNA, 27 bp, Artificial sequence
  SiRNA target sequence
aaaaaaattgtgtaccgggtgatgtga

SEQ ID NO: 157036 - DNA, 27 bp, Artificial sequence
  SiRNA target sequence
aaaaaattgtgtaccgggtgatgtgat

SEQ ID NO: 157037 - DNA, 27 bp, Artificial sequence
  SiRNA target sequence
aaaaattgtgtaccgggtgatgtgatt

SEQ ID NO: 157038 - DNA, 27 bp, Artificial sequence
  SiRNA target sequence
aaaattgtgtaccgggtgatgtgattc

SEQ ID NO: 157039 - DNA, 27 bp, Artificial sequence
  SiRNA target sequence
aaattgtgtaccgggtgatgtgattct

SEQ ID NO: 157040 - DNA, 27 bp, Artificial sequence
  SiRNA target sequence
aattgtgtaccgggtgatgtgattctt

SEQ ID NO: 157041 - DNA, 27 bp, Artificial sequence
  SiRNA target sequence
attgtgtaccgggtgatgtgattctta

SEQ ID NO: 157042 - DNA, 27 bp, Artificial sequence
  SiRNA target sequence
ttgtgtaccgggtgatgtgattcttat

SEQ ID NO: 157043 - DNA, 27 bp, Artificial sequence
  SiRNA target sequence
tgtgtaccgggtgatgtgattcttatt

SEQ ID NO: 157044 - DNA, 27 bp, Artificial sequence
  SiRNA target sequence
gtgtaccgggtgatgtgattcttattg

SEQ ID NO: 157045 - DNA, 27 bp, Artificial sequence
  SiRNA target sequence
tgtaccgggtgatgtgattcttattgt

SEQ ID NO: 157046 - DNA, 27 bp, Artificial sequence
  SiRNA target sequence
gtaccgggtgatgtgattcttattgta

SEQ ID NO: 157047 - DNA, 27 bp, Artificial sequence
  SiRNA target sequence
taccgggtgatgtgattcttattgtaa

SEQ ID NO: 157048 - DNA, 27 bp, Artificial sequence
  SiRNA target sequence
accgggtgatgtgattcttattgtaaa

SEQ ID NO: 157049 - DNA, 27 bp, Artificial sequence
  SiRNA target sequence
ccgggtgatgtgattcttattgtaaac

SEQ ID NO: 157050 - DNA, 27 bp, Artificial sequence
  SiRNA target sequence
cgggtgatgtgattcttattgtaaaca

SEQ ID NO: 157051 - DNA, 27 bp, Artificial sequence
  SiRNA target sequence
gggtgatgtgattcttattgtaaacat

SEQ ID NO: 157052 - DNA, 27 bp, Artificial sequence
  SiRNA target sequence
ggtgatgtgattcttattgtaaacatt

SEQ ID NO: 157053 - DNA, 27 bp, Artificial sequence
  SiRNA target sequence
gtgatgtgattcttattgtaaacatta

SEQ ID NO: 157054 - DNA, 27 bp, Artificial sequence
  SiRNA target sequence
tgatgtgattcttattgtaaacattac

SEQ ID NO: 157055 - DNA, 27 bp, Artificial sequence
  SiRNA target sequence
gatgtgattcttattgtaaacattaca

SEQ ID NO: 157056 - DNA, 27 bp, Artificial sequence
  SiRNA target sequence
atgtgattcttattgtaaacattacaa

SEQ ID NO: 157057 - DNA, 27 bp, Artificial sequence
  SiRNA target sequence
tgtgattcttattgtaaacattacaaa

SEQ ID NO: 157058 - DNA, 27 bp, Artificial sequence
  SiRNA target sequence
gtgattcttattgtaaacattacaaat

SEQ ID NO: 157059 - DNA, 27 bp, Artificial sequence
  SiRNA target sequence
tgattcttattgtaaacattacaaatg

SEQ ID NO: 157060 - DNA, 27 bp, Artificial sequence
  SiRNA target sequence
gattcttattgtaaacattacaaatga

SEQ ID NO: 157061 - DNA, 27 bp, Artificial sequence
  SiRNA target sequence
attcttattgtaaacattacaaatgat

SEQ ID NO: 157062 - DNA, 27 bp, Artificial sequence
  SiRNA target sequence
ttcttattgtaaacattacaaatgatc

SEQ ID NO: 157063 - DNA, 27 bp, Artificial sequence
  SiRNA target sequence
tcttattgtaaacattacaaatgatcc

SEQ ID NO: 157064 - DNA, 27 bp, Artificial sequence
  SiRNA target sequence
cttattgtaaacattacaaatgatcca

SEQ ID NO: 157065 - DNA, 27 bp, Artificial sequence
  SiRNA target sequence
ttattgtaaacattacaaatgatccaa

SEQ ID NO: 157066 - DNA, 27 bp, Artificial sequence
  SiRNA target sequence
tattgtaaacattacaaatgatccaag

SEQ ID NO: 157067 - DNA, 27 bp, Artificial sequence
  SiRNA target sequence
attgtaaacattacaaatgatccaaga

SEQ ID NO: 157068 - DNA, 27 bp, Artificial sequence
  SiRNA target sequence
ttgtaaacattacaaatgatccaagat

SEQ ID NO: 157069 - DNA, 27 bp, Artificial sequence
  SiRNA target sequence
tgtaaacattacaaatgatccaagatt

SEQ ID NO: 157070 - DNA, 27 bp, Artificial sequence
  SiRNA target sequence
gtaaacattacaaatgatccaagattt

SEQ ID NO: 157071 - DNA, 27 bp, Artificial sequence
  SiRNA target sequence
taaacattacaaatgatccaagattta

SEQ ID NO: 157072 - DNA, 27 bp, Artificial sequence
  SiRNA target sequence
aaacattacaaatgatccaagatttag

SEQ ID NO: 157073 - DNA, 27 bp, Artificial sequence
  SiRNA target sequence
aacattacaaatgatccaagatttaga

SEQ ID NO: 157074 - DNA, 27 bp, Artificial sequence
  SiRNA target sequence
acattacaaatgatccaagatttagaa

SEQ ID NO: 157075 - DNA, 27 bp, Artificial sequence
  SiRNA target sequence
cattacaaatgatccaagatttagaaa

SEQ ID NO: 157076 - DNA, 27 bp, Artificial sequence
  SiRNA target sequence
attacaaatgatccaagatttagaaaa

SEQ ID NO: 157077 - DNA, 27 bp, Artificial sequence
  SiRNA target sequence
ttacaaatgatccaagatttagaaaaa

SEQ ID NO: 157078 - DNA, 27 bp, Artificial sequence
  SiRNA target sequence
tacaaatgatccaagatttagaaaaag

SEQ ID NO: 157079 - DNA, 27 bp, Artificial sequence
  SiRNA target sequence
acaaatgatccaagatttagaaaaagt

SEQ ID NO: 157080 - DNA, 27 bp, Artificial sequence
  SiRNA target sequence
caaatgatccaagatttagaaaaagtg

SEQ ID NO: 157081 - DNA, 27 bp, Artificial sequence
  SiRNA target sequence
aaatgatccaagatttagaaaaagtgg

SEQ ID NO: 157082 - DNA, 27 bp, Artificial sequence
  SiRNA target sequence
aatgatccaagatttagaaaaagtgga

SEQ ID NO: 157083 - DNA, 27 bp, Artificial sequence
  SiRNA target sequence
atgatccaagatttagaaaaagtggat

SEQ ID NO: 157084 - DNA, 27 bp, Artificial sequence
  SiRNA target sequence
tgatccaagatttagaaaaagtggata

SEQ ID NO: 157085 - DNA, 27 bp, Artificial sequence
  SiRNA target sequence
gatccaagatttagaaaaagtggatat

SEQ ID NO: 157086 - DNA, 27 bp, Artificial sequence
  SiRNA target sequence
atccaagatttagaaaaagtggatata

SEQ ID NO: 157087 - DNA, 27 bp, Artificial sequence
  SiRNA target sequence
tccaagatttagaaaaagtggatataa

SEQ ID NO: 157088 - DNA, 27 bp, Artificial sequence
  SiRNA target sequence
ccaagatttagaaaaagtggatataat

SEQ ID NO: 157089 - DNA, 27 bp, Artificial sequence
  SiRNA target sequence
caagatttagaaaaagtggatataatt

SEQ ID NO: 157090 - DNA, 27 bp, Artificial sequence
  SiRNA target sequence
aagatttagaaaaagtggatataattt

SEQ ID NO: 157091 - DNA, 27 bp, Artificial sequence
  SiRNA target sequence
agatttagaaaaagtggatataattta

SEQ ID NO: 157092 - DNA, 27 bp, Artificial sequence
  SiRNA target sequence
gatttagaaaaagtggatataatttaa

SEQ ID NO: 157093 - DNA, 27 bp, Artificial sequence
  SiRNA target sequence
atttagaaaaagtggatataatttaat

SEQ ID NO: 157094 - DNA, 27 bp, Artificial sequence
  SiRNA target sequence
tttagaaaaagtggatataatttaatt

SEQ ID NO: 157095 - DNA, 27 bp, Artificial sequence
  SiRNA target sequence
ttagaaaaagtggatataatttaatta

SEQ ID NO: 157096 - DNA, 27 bp, Artificial sequence
  SiRNA target sequence
tagaaaaagtggatataatttaattag

SEQ ID NO: 157097 - DNA, 27 bp, Artificial sequence
  SiRNA target sequence
agaaaaagtggatataatttaattagt

SEQ ID NO: 157098 - DNA, 27 bp, Artificial sequence
  SiRNA target sequence
gaaaaagtggatataatttaattagta

SEQ ID NO: 157099 - DNA, 27 bp, Artificial sequence
  SiRNA target sequence
aaaaagtggatataatttaattagtaa

SEQ ID NO: 157100 - DNA, 27 bp, Artificial sequence
  SiRNA target sequence
aaaagtggatataatttaattagtaag

SEQ ID NO: 157101 - DNA, 27 bp, Artificial sequence
  SiRNA target sequence
aaagtggatataatttaattagtaagg

SEQ ID NO: 157102 - DNA, 27 bp, Artificial sequence
  SiRNA target sequence
aagtggatataatttaattagtaaggt

SEQ ID NO: 157103 - DNA, 27 bp, Artificial sequence
  SiRNA target sequence
agtggatataatttaattagtaaggtt

SEQ ID NO: 157104 - DNA, 27 bp, Artificial sequence
  SiRNA target sequence
gtggatataatttaattagtaaggttg

SEQ ID NO: 157105 - DNA, 27 bp, Artificial sequence
  SiRNA target sequence
tggatataatttaattagtaaggttga

SEQ ID NO: 157106 - DNA, 27 bp, Artificial sequence
  SiRNA target sequence
ggatataatttaattagtaaggttgat

SEQ ID NO: 157107 - DNA, 27 bp, Artificial sequence
  SiRNA target sequence
gatataatttaattagtaaggttgata

SEQ ID NO: 157108 - DNA, 27 bp, Artificial sequence
  SiRNA target sequence
atataatttaattagtaaggttgatat

SEQ ID NO: 157109 - DNA, 27 bp, Artificial sequence
  SiRNA target sequence
tataatttaattagtaaggttgatatt

SEQ ID NO: 157110 - DNA, 27 bp, Artificial sequence
  SiRNA target sequence
ataatttaattagtaaggttgatattc

SEQ ID NO: 157111 - DNA, 27 bp, Artificial sequence
  SiRNA target sequence
taatttaattagtaaggttgatattcc

SEQ ID NO: 157112 - DNA, 27 bp, Artificial sequence
  SiRNA target sequence
aatttaattagtaaggttgatattcca

SEQ ID NO: 157113 - DNA, 27 bp, Artificial sequence
  SiRNA target sequence
atttaattagtaaggttgatattccat

SEQ ID NO: 157114 - DNA, 27 bp, Artificial sequence
  SiRNA target sequence
tttaattagtaaggttgatattccatt

SEQ ID NO: 157115 - DNA, 27 bp, Artificial sequence
  SiRNA target sequence
ttaattagtaaggttgatattccattg

SEQ ID NO: 157116 - DNA, 27 bp, Artificial sequence
  SiRNA target sequence
taattagtaaggttgatattccattgt

SEQ ID NO: 157117 - DNA, 27 bp, Artificial sequence
  SiRNA target sequence
aattagtaaggttgatattccattgta

SEQ ID NO: 157118 - DNA, 27 bp, Artificial sequence
  SiRNA target sequence
attagtaaggttgatattccattgtat

SEQ ID NO: 157119 - DNA, 27 bp, Artificial sequence
  SiRNA target sequence
ttagtaaggttgatattccattgtatg

SEQ ID NO: 157120 - DNA, 27 bp, Artificial sequence
  SiRNA target sequence
tagtaaggttgatattccattgtatgt

SEQ ID NO: 157121 - DNA, 27 bp, Artificial sequence
  SiRNA target sequence
agtaaggttgatattccattgtatgtt

SEQ ID NO: 157122 - DNA, 27 bp, Artificial sequence
  SiRNA target sequence
gtaaggttgatattccattgtatgttg

SEQ ID NO: 157123 - DNA, 27 bp, Artificial sequence
  SiRNA target sequence
taaggttgatattccattgtatgttgc

SEQ ID NO: 157124 - DNA, 27 bp, Artificial sequence
  SiRNA target sequence
aaggttgatattccattgtatgttgct

SEQ ID NO: 157125 - DNA, 27 bp, Artificial sequence
  SiRNA target sequence
aggttgatattccattgtatgttgctt

SEQ ID NO: 157126 - DNA, 27 bp, Artificial sequence
  SiRNA target sequence
ggttgatattccattgtatgttgcttt

SEQ ID NO: 157127 - DNA, 27 bp, Artificial sequence
  SiRNA target sequence
gttgatattccattgtatgttgctttg

SEQ ID NO: 157128 - DNA, 27 bp, Artificial sequence
  SiRNA target sequence
ttgatattccattgtatgttgctttgg

SEQ ID NO: 157129 - DNA, 27 bp, Artificial sequence
  SiRNA target sequence
tgatattccattgtatgttgctttggc

SEQ ID NO: 157130 - DNA, 27 bp, Artificial sequence
  SiRNA target sequence
gatattccattgtatgttgctttggca

SEQ ID NO: 157131 - DNA, 27 bp, Artificial sequence
  SiRNA target sequence
atattccattgtatgttgctttggcag

SEQ ID NO: 157132 - DNA, 27 bp, Artificial sequence
  SiRNA target sequence
tattccattgtatgttgctttggcagg

SEQ ID NO: 157133 - DNA, 27 bp, Artificial sequence
  SiRNA target sequence
attccattgtatgttgctttggcaggc

SEQ ID NO: 157134 - DNA, 27 bp, Artificial sequence
  SiRNA target sequence
ttccattgtatgttgctttggcaggcg

SEQ ID NO: 157135 - DNA, 27 bp, Artificial sequence
  SiRNA target sequence
tccattgtatgttgctttggcaggcgg

SEQ ID NO: 157136 - DNA, 27 bp, Artificial sequence
  SiRNA target sequence
ccattgtatgttgctttggcaggcgga

SEQ ID NO: 157137 - DNA, 27 bp, Artificial sequence
  SiRNA target sequence
cattgtatgttgctttggcaggcggac

SEQ ID NO: 157138 - DNA, 27 bp, Artificial sequence
  SiRNA target sequence
attgtatgttgctttggcaggcggaca

SEQ ID NO: 157139 - DNA, 27 bp, Artificial sequence
  SiRNA target sequence
ttgtatgttgctttggcaggcggacag

SEQ ID NO: 157140 - DNA, 27 bp, Artificial sequence
  SiRNA target sequence
tgtatgttgctttggcaggcggacaga

SEQ ID NO: 157141 - DNA, 27 bp, Artificial sequence
  SiRNA target sequence
gtatgttgctttggcaggcggacagat

SEQ ID NO: 157142 - DNA, 27 bp, Artificial sequence
  SiRNA target sequence
tatgttgctttggcaggcggacagatt

SEQ ID NO: 157143 - DNA, 27 bp, Artificial sequence
  SiRNA target sequence
atgttgctttggcaggcggacagatta

SEQ ID NO: 157144 - DNA, 27 bp, Artificial sequence
  SiRNA target sequence
tgttgctttggcaggcggacagattat

SEQ ID NO: 157145 - DNA, 27 bp, Artificial sequence
  SiRNA target sequence
gttgctttggcaggcggacagattata

SEQ ID NO: 157146 - DNA, 27 bp, Artificial sequence
  SiRNA target sequence
ttgctttggcaggcggacagattatat

SEQ ID NO: 157147 - DNA, 27 bp, Artificial sequence
  SiRNA target sequence
tgctttggcaggcggacagattatatt

SEQ ID NO: 157148 - DNA, 27 bp, Artificial sequence
  SiRNA target sequence
gctttggcaggcggacagattatattt

SEQ ID NO: 157149 - DNA, 27 bp, Artificial sequence
  SiRNA target sequence
ctttggcaggcggacagattatatttg

SEQ ID NO: 157150 - DNA, 27 bp, Artificial sequence
  SiRNA target sequence
tttggcaggcggacagattatatttga

SEQ ID NO: 157151 - DNA, 27 bp, Artificial sequence
  SiRNA target sequence
ttggcaggcggacagattatatttgaa

SEQ ID NO: 157152 - DNA, 27 bp, Artificial sequence
  SiRNA target sequence
tggcaggcggacagattatatttgaac

SEQ ID NO: 157153 - DNA, 27 bp, Artificial sequence
  SiRNA target sequence
ggcaggcggacagattatatttgaaca

SEQ ID NO: 157154 - DNA, 27 bp, Artificial sequence
  SiRNA target sequence
gcaggcggacagattatatttgaacat

SEQ ID NO: 157155 - DNA, 27 bp, Artificial sequence
  SiRNA target sequence
caggcggacagattatatttgaacata

SEQ ID NO: 157156 - DNA, 27 bp, Artificial sequence
  SiRNA target sequence
aggcggacagattatatttgaacatat

SEQ ID NO: 157157 - DNA, 27 bp, Artificial sequence
  SiRNA target sequence
ggcggacagattatatttgaacatatc

SEQ ID NO: 157158 - DNA, 27 bp, Artificial sequence
  SiRNA target sequence
gcggacagattatatttgaacatatca

SEQ ID NO: 157159 - DNA, 27 bp, Artificial sequence
  SiRNA target sequence
cggacagattatatttgaacatatcac

SEQ ID NO: 157160 - DNA, 27 bp, Artificial sequence
  SiRNA target sequence
ggacagattatatttgaacatatcact

SEQ ID NO: 157161 - DNA, 27 bp, Artificial sequence
  SiRNA target sequence
gacagattatatttgaacatatcactg

SEQ ID NO: 157162 - DNA, 27 bp, Artificial sequence
  SiRNA target sequence
acagattatatttgaacatatcactgg

SEQ ID NO: 157163 - DNA, 27 bp, Artificial sequence
  SiRNA target sequence
cagattatatttgaacatatcactggt

SEQ ID NO: 157164 - DNA, 27 bp, Artificial sequence
  SiRNA target sequence
agattatatttgaacatatcactggta

SEQ ID NO: 157165 - DNA, 27 bp, Artificial sequence
  SiRNA target sequence
gattatatttgaacatatcactggtaa

SEQ ID NO: 157166 - DNA, 27 bp, Artificial sequence
  SiRNA target sequence
attatatttgaacatatcactggtaag

SEQ ID NO: 157167 - DNA, 27 bp, Artificial sequence
  SiRNA target sequence
ttatatttgaacatatcactggtaaga

SEQ ID NO: 157168 - DNA, 27 bp, Artificial sequence
  SiRNA target sequence
tatatttgaacatatcactggtaagaa

SEQ ID NO: 157169 - DNA, 27 bp, Artificial sequence
  SiRNA target sequence
atatttgaacatatcactggtaagaaa

SEQ ID NO: 157170 - DNA, 27 bp, Artificial sequence
  SiRNA target sequence
tatttgaacatatcactggtaagaaat

SEQ ID NO: 157171 - DNA, 27 bp, Artificial sequence
  SiRNA target sequence
atttgaacatatcactggtaagaaatt

SEQ ID NO: 157172 - DNA, 27 bp, Artificial sequence
  SiRNA target sequence
tttgaacatatcactggtaagaaattt

SEQ ID NO: 157173 - DNA, 27 bp, Artificial sequence
  SiRNA target sequence
ttgaacatatcactggtaagaaatttg

SEQ ID NO: 157174 - DNA, 27 bp, Artificial sequence
  SiRNA target sequence
tgaacatatcactggtaagaaatttga

SEQ ID NO: 157175 - DNA, 27 bp, Artificial sequence
  SiRNA target sequence
gaacatatcactggtaagaaatttgaa

SEQ ID NO: 157176 - DNA, 27 bp, Artificial sequence
  SiRNA target sequence
aacatatcactggtaagaaatttgaaa

SEQ ID NO: 157177 - DNA, 27 bp, Artificial sequence
  SiRNA target sequence
acatatcactggtaagaaatttgaaat

SEQ ID NO: 157178 - DNA, 27 bp, Artificial sequence
  SiRNA target sequence
catatcactggtaagaaatttgaaatt

SEQ ID NO: 157179 - DNA, 27 bp, Artificial sequence
  SiRNA target sequence
atatcactggtaagaaatttgaaatta

SEQ ID NO: 157180 - DNA, 27 bp, Artificial sequence
  SiRNA target sequence
tatcactggtaagaaatttgaaattac

SEQ ID NO: 157181 - DNA, 27 bp, Artificial sequence
  SiRNA target sequence
atcactggtaagaaatttgaaattact

SEQ ID NO: 157182 - DNA, 27 bp, Artificial sequence
  SiRNA target sequence
tcactggtaagaaatttgaaattactt

SEQ ID NO: 157183 - DNA, 27 bp, Artificial sequence
  SiRNA target sequence
cactggtaagaaatttgaaattacttt

SEQ ID NO: 157184 - DNA, 27 bp, Artificial sequence
  SiRNA target sequence
actggtaagaaatttgaaattacttta

SEQ ID NO: 157185 - DNA, 27 bp, Artificial sequence
  SiRNA target sequence
ctggtaagaaatttgaaattactttat

SEQ ID NO: 157186 - DNA, 27 bp, Artificial sequence
  SiRNA target sequence
tggtaagaaatttgaaattactttata

SEQ ID NO: 157187 - DNA, 27 bp, Artificial sequence
  SiRNA target sequence
ggtaagaaatttgaaattactttatat

SEQ ID NO: 157188 - DNA, 27 bp, Artificial sequence
  SiRNA target sequence
gtaagaaatttgaaattactttatatc

SEQ ID NO: 157189 - DNA, 27 bp, Artificial sequence
  SiRNA target sequence
taagaaatttgaaattactttatatcc

SEQ ID NO: 157190 - DNA, 27 bp, Artificial sequence
  SiRNA target sequence
aagaaatttgaaattactttatatcca

SEQ ID NO: 157191 - DNA, 27 bp, Artificial sequence
  SiRNA target sequence
agaaatttgaaattactttatatccat

SEQ ID NO: 157192 - DNA, 27 bp, Artificial sequence
  SiRNA target sequence
gaaatttgaaattactttatatccatt

SEQ ID NO: 157193 - DNA, 27 bp, Artificial sequence
  SiRNA target sequence
aaatttgaaattactttatatccattt

SEQ ID NO: 157194 - DNA, 27 bp, Artificial sequence
  SiRNA target sequence
aatttgaaattactttatatccattta

SEQ ID NO: 157195 - DNA, 27 bp, Artificial sequence
  SiRNA target sequence
atttgaaattactttatatccatttaa

SEQ ID NO: 157196 - DNA, 27 bp, Artificial sequence
  SiRNA target sequence
tttgaaattactttatatccatttaaa

SEQ ID NO: 157197 - DNA, 27 bp, Artificial sequence
  SiRNA target sequence
ttgaaattactttatatccatttaaag

SEQ ID NO: 157198 - DNA, 27 bp, Artificial sequence
  SiRNA target sequence
tgaaattactttatatccatttaaaga

SEQ ID NO: 157199 - DNA, 27 bp, Artificial sequence
  SiRNA target sequence
gaaattactttatatccatttaaagat

SEQ ID NO: 157200 - DNA, 27 bp, Artificial sequence
  SiRNA target sequence
aaattactttatatccatttaaagatt

SEQ ID NO: 157201 - DNA, 27 bp, Artificial sequence
  SiRNA target sequence
aattactttatatccatttaaagattt

SEQ ID NO: 157202 - DNA, 27 bp, Artificial sequence
  SiRNA target sequence
attactttatatccatttaaagattta

SEQ ID NO: 157203 - DNA, 27 bp, Artificial sequence
  SiRNA target sequence
ttactttatatccatttaaagatttaa

SEQ ID NO: 157204 - DNA, 27 bp, Artificial sequence
  SiRNA target sequence
tactttatatccatttaaagatttaaa

SEQ ID NO: 157205 - DNA, 27 bp, Artificial sequence
  SiRNA target sequence
actttatatccatttaaagatttaaag

SEQ ID NO: 157206 - DNA, 27 bp, Artificial sequence
  SiRNA target sequence
ctttatatccatttaaagatttaaaga

SEQ ID NO: 157207 - DNA, 27 bp, Artificial sequence
  SiRNA target sequence
tttatatccatttaaagatttaaagaa

SEQ ID NO: 157208 - DNA, 27 bp, Artificial sequence
  SiRNA target sequence
ttatatccatttaaagatttaaagaaa

SEQ ID NO: 157209 - DNA, 27 bp, Artificial sequence
  SiRNA target sequence
tatatccatttaaagatttaaagaaat

SEQ ID NO: 157210 - DNA, 27 bp, Artificial sequence
  SiRNA target sequence
atatccatttaaagatttaaagaaatg

SEQ ID NO: 157211 - DNA, 27 bp, Artificial sequence
  SiRNA target sequence
tatccatttaaagatttaaagaaatgt

SEQ ID NO: 157212 - DNA, 27 bp, Artificial sequence
  SiRNA target sequence
atccatttaaagatttaaagaaatgta

SEQ ID NO: 157213 - DNA, 27 bp, Artificial sequence
  SiRNA target sequence
tccatttaaagatttaaagaaatgtat

SEQ ID NO: 157214 - DNA, 27 bp, Artificial sequence
  SiRNA target sequence
ccatttaaagatttaaagaaatgtatt

SEQ ID NO: 157215 - DNA, 27 bp, Artificial sequence
  SiRNA target sequence
catttaaagatttaaagaaatgtatta

SEQ ID NO: 157216 - DNA, 27 bp, Artificial sequence
  SiRNA target sequence
atttaaagatttaaagaaatgtattat

SEQ ID NO: 157217 - DNA, 27 bp, Artificial sequence
  SiRNA target sequence
tttaaagatttaaagaaatgtattatt

SEQ ID NO: 157218 - DNA, 27 bp, Artificial sequence
  SiRNA target sequence
ttaaagatttaaagaaatgtattattt

SEQ ID NO: 157219 - DNA, 27 bp, Artificial sequence
  SiRNA target sequence
taaagatttaaagaaatgtattatttt

SEQ ID NO: 157220 - DNA, 27 bp, Artificial sequence
  SiRNA target sequence
aaagatttaaagaaatgtattatttta

SEQ ID NO: 157221 - DNA, 27 bp, Artificial sequence
  SiRNA target sequence
aagatttaaagaaatgtattattttaa

SEQ ID NO: 157222 - DNA, 27 bp, Artificial sequence
  SiRNA target sequence
agatttaaagaaatgtattattttaaa

SEQ ID NO: 157223 - DNA, 27 bp, Artificial sequence
  SiRNA target sequence
gatttaaagaaatgtattattttaaaa

SEQ ID NO: 157224 - DNA, 27 bp, Artificial sequence
  SiRNA target sequence
atttaaagaaatgtattattttaaaag

SEQ ID NO: 157225 - DNA, 27 bp, Artificial sequence
  SiRNA target sequence
tttaaagaaatgtattattttaaaagg

SEQ ID NO: 157226 - DNA, 27 bp, Artificial sequence
  SiRNA target sequence
ttaaagaaatgtattattttaaaaggc

SEQ ID NO: 157227 - DNA, 27 bp, Artificial sequence
  SiRNA target sequence
taaagaaatgtattattttaaaaggcg

SEQ ID NO: 157228 - DNA, 27 bp, Artificial sequence
  SiRNA target sequence
aaagaaatgtattattttaaaaggcga

SEQ ID NO: 157229 - DNA, 27 bp, Artificial sequence
  SiRNA target sequence
aagaaatgtattattttaaaaggcgaa

SEQ ID NO: 157230 - DNA, 27 bp, Artificial sequence
  SiRNA target sequence
agaaatgtattattttaaaaggcgaag

SEQ ID NO: 157231 - DNA, 27 bp, Artificial sequence
  SiRNA target sequence
gaaatgtattattttaaaaggcgaagg

SEQ ID NO: 157232 - DNA, 27 bp, Artificial sequence
  SiRNA target sequence
aaatgtattattttaaaaggcgaaggt

SEQ ID NO: 157233 - DNA, 27 bp, Artificial sequence
  SiRNA target sequence
aatgtattattttaaaaggcgaaggtt

SEQ ID NO: 157234 - DNA, 27 bp, Artificial sequence
  SiRNA target sequence
atgtattattttaaaaggcgaaggttt

SEQ ID NO: 157235 - DNA, 27 bp, Artificial sequence
  SiRNA target sequence
tgtattattttaaaaggcgaaggtttt

SEQ ID NO: 157236 - DNA, 27 bp, Artificial sequence
  SiRNA target sequence
gtattattttaaaaggcgaaggtttta

SEQ ID NO: 157237 - DNA, 27 bp, Artificial sequence
  SiRNA target sequence
tattattttaaaaggcgaaggttttaa

SEQ ID NO: 157238 - DNA, 27 bp, Artificial sequence
  SiRNA target sequence
attattttaaaaggcgaaggttttaaa

SEQ ID NO: 157239 - DNA, 27 bp, Artificial sequence
  SiRNA target sequence
ttattttaaaaggcgaaggttttaaaa

SEQ ID NO: 157240 - DNA, 27 bp, Artificial sequence
  SiRNA target sequence
tattttaaaaggcgaaggttttaaaat

SEQ ID NO: 157241 - DNA, 27 bp, Artificial sequence
  SiRNA target sequence
attttaaaaggcgaaggttttaaaata

SEQ ID NO: 157242 - DNA, 27 bp, Artificial sequence
  SiRNA target sequence
ttttaaaaggcgaaggttttaaaataa

SEQ ID NO: 157243 - DNA, 27 bp, Artificial sequence
  SiRNA target sequence
tttaaaaggcgaaggttttaaaataaa

SEQ ID NO: 157244 - DNA, 27 bp, Artificial sequence
  SiRNA target sequence
ttaaaaggcgaaggttttaaaataaaa

SEQ ID NO: 157245 - DNA, 27 bp, Artificial sequence
  SiRNA target sequence
taaaaggcgaaggttttaaaataaaaa

SEQ ID NO: 157246 - DNA, 27 bp, Artificial sequence
  SiRNA target sequence
aaaaggcgaaggttttaaaataaaaaa

SEQ ID NO: 157247 - DNA, 27 bp, Artificial sequence
  SiRNA target sequence
aaaggcgaaggttttaaaataaaaaat

SEQ ID NO: 157248 - DNA, 27 bp, Artificial sequence
  SiRNA target sequence
aaggcgaaggttttaaaataaaaaata

SEQ ID NO: 157249 - DNA, 27 bp, Artificial sequence
  SiRNA target sequence
aggcgaaggttttaaaataaaaaatag

SEQ ID NO: 157250 - DNA, 27 bp, Artificial sequence
  SiRNA target sequence
ggcgaaggttttaaaataaaaaatagt

SEQ ID NO: 157251 - DNA, 27 bp, Artificial sequence
  SiRNA target sequence
gcgaaggttttaaaataaaaaatagtt

SEQ ID NO: 157252 - DNA, 27 bp, Artificial sequence
  SiRNA target sequence
cgaaggttttaaaataaaaaatagtta

SEQ ID NO: 157253 - DNA, 27 bp, Artificial sequence
  SiRNA target sequence
gaaggttttaaaataaaaaatagttat

SEQ ID NO: 157254 - DNA, 27 bp, Artificial sequence
  SiRNA target sequence
aaggttttaaaataaaaaatagttatt

SEQ ID NO: 157255 - DNA, 27 bp, Artificial sequence
  SiRNA target sequence
aggttttaaaataaaaaatagttattc

SEQ ID NO: 157256 - DNA, 27 bp, Artificial sequence
  SiRNA target sequence
ggttttaaaataaaaaatagttattcg

SEQ ID NO: 157257 - DNA, 27 bp, Artificial sequence
  SiRNA target sequence
gttttaaaataaaaaatagttattcgg

SEQ ID NO: 157258 - DNA, 27 bp, Artificial sequence
  SiRNA target sequence
ttttaaaataaaaaatagttattcggg

SEQ ID NO: 157259 - DNA, 27 bp, Artificial sequence
  SiRNA target sequence
tttaaaataaaaaatagttattcgggt

SEQ ID NO: 157260 - DNA, 27 bp, Artificial sequence
  SiRNA target sequence
ttaaaataaaaaatagttattcgggtg

SEQ ID NO: 157261 - DNA, 27 bp, Artificial sequence
  SiRNA target sequence
taaaataaaaaatagttattcgggtgg

SEQ ID NO: 157262 - DNA, 27 bp, Artificial sequence
  SiRNA target sequence
aaaataaaaaatagttattcgggtggt

SEQ ID NO: 157263 - DNA, 27 bp, Artificial sequence
  SiRNA target sequence
aaataaaaaatagttattcgggtggtg

SEQ ID NO: 157264 - DNA, 27 bp, Artificial sequence
  SiRNA target sequence
aataaaaaatagttattcgggtggtga

SEQ ID NO: 157265 - DNA, 27 bp, Artificial sequence
  SiRNA target sequence
ataaaaaatagttattcgggtggtgat

SEQ ID NO: 157266 - DNA, 27 bp, Artificial sequence
  SiRNA target sequence
taaaaaatagttattcgggtggtgatc

SEQ ID NO: 157267 - DNA, 27 bp, Artificial sequence
  SiRNA target sequence
aaaaaatagttattcgggtggtgatct

SEQ ID NO: 157268 - DNA, 27 bp, Artificial sequence
  SiRNA target sequence
aaaaatagttattcgggtggtgatctt

SEQ ID NO: 157269 - DNA, 27 bp, Artificial sequence
  SiRNA target sequence
aaaatagttattcgggtggtgatctta

SEQ ID NO: 157270 - DNA, 27 bp, Artificial sequence
  SiRNA target sequence
aaatagttattcgggtggtgatcttat

SEQ ID NO: 157271 - DNA, 27 bp, Artificial sequence
  SiRNA target sequence
aatagttattcgggtggtgatcttatt

SEQ ID NO: 157272 - DNA, 27 bp, Artificial sequence
  SiRNA target sequence
atagttattcgggtggtgatcttattc

SEQ ID NO: 157273 - DNA, 27 bp, Artificial sequence
  SiRNA target sequence
tagttattcgggtggtgatcttattct

SEQ ID NO: 157274 - DNA, 27 bp, Artificial sequence
  SiRNA target sequence
agttattcgggtggtgatcttattctc

SEQ ID NO: 157275 - DNA, 27 bp, Artificial sequence
  SiRNA target sequence
gttattcgggtggtgatcttattctcg

SEQ ID NO: 157276 - DNA, 27 bp, Artificial sequence
  SiRNA target sequence
ttattcgggtggtgatcttattctcga

SEQ ID NO: 157277 - DNA, 27 bp, Artificial sequence
  SiRNA target sequence
tattcgggtggtgatcttattctcgaa

SEQ ID NO: 157278 - DNA, 27 bp, Artificial sequence
  SiRNA target sequence
attcgggtggtgatcttattctcgaac

SEQ ID NO: 157279 - DNA, 27 bp, Artificial sequence
  SiRNA target sequence
ttcgggtggtgatcttattctcgaacc

SEQ ID NO: 157280 - DNA, 27 bp, Artificial sequence
  SiRNA target sequence
tcgggtggtgatcttattctcgaacct

SEQ ID NO: 157281 - DNA, 27 bp, Artificial sequence
  SiRNA target sequence
cgggtggtgatcttattctcgaaccta

SEQ ID NO: 157282 - DNA, 27 bp, Artificial sequence
  SiRNA target sequence
gggtggtgatcttattctcgaacctaa

SEQ ID NO: 157283 - DNA, 27 bp, Artificial sequence
  SiRNA target sequence
ggtggtgatcttattctcgaacctaat

SEQ ID NO: 157284 - DNA, 27 bp, Artificial sequence
  SiRNA target sequence
gtggtgatcttattctcgaacctaata

SEQ ID NO: 157285 - DNA, 27 bp, Artificial sequence
  SiRNA target sequence
tggtgatcttattctcgaacctaatat

SEQ ID NO: 157286 - DNA, 27 bp, Artificial sequence
  SiRNA target sequence
ggtgatcttattctcgaacctaatata

SEQ ID NO: 157287 - DNA, 27 bp, Artificial sequence
  SiRNA target sequence
gtgatcttattctcgaacctaatataa

SEQ ID NO: 157288 - DNA, 27 bp, Artificial sequence
  SiRNA target sequence
tgatcttattctcgaacctaatataat

SEQ ID NO: 157289 - DNA, 27 bp, Artificial sequence
  SiRNA target sequence
gatcttattctcgaacctaatataatt

SEQ ID NO: 157290 - DNA, 27 bp, Artificial sequence
  SiRNA target sequence
atcttattctcgaacctaatataatta

SEQ ID NO: 157291 - DNA, 27 bp, Artificial sequence
  SiRNA target sequence
tcttattctcgaacctaatataattat

SEQ ID NO: 157292 - DNA, 27 bp, Artificial sequence
  SiRNA target sequence
cttattctcgaacctaatataattata

SEQ ID NO: 157293 - DNA, 27 bp, Artificial sequence
  SiRNA target sequence
ttattctcgaacctaatataattatag

SEQ ID NO: 157294 - DNA, 27 bp, Artificial sequence
  SiRNA target sequence
tattctcgaacctaatataattataga

SEQ ID NO: 157295 - DNA, 27 bp, Artificial sequence
  SiRNA target sequence
attctcgaacctaatataattatagat

SEQ ID NO: 157296 - DNA, 27 bp, Artificial sequence
  SiRNA target sequence
ttctcgaacctaatataattatagata

SEQ ID NO: 157297 - DNA, 27 bp, Artificial sequence
  SiRNA target sequence
tctcgaacctaatataattatagataa

SEQ ID NO: 157298 - DNA, 27 bp, Artificial sequence
  SiRNA target sequence
ctcgaacctaatataattatagataag

SEQ ID NO: 157299 - DNA, 27 bp, Artificial sequence
  SiRNA target sequence
tcgaacctaatataattatagataaga

SEQ ID NO: 157300 - DNA, 27 bp, Artificial sequence
  SiRNA target sequence
cgaacctaatataattatagataagaa

SEQ ID NO: 157301 - DNA, 27 bp, Artificial sequence
  SiRNA target sequence
gaacctaatataattatagataagaat

SEQ ID NO: 157302 - DNA, 27 bp, Artificial sequence
  SiRNA target sequence
aacctaatataattatagataagaata

SEQ ID NO: 157303 - DNA, 27 bp, Artificial sequence
  SiRNA target sequence
acctaatataattatagataagaatat

SEQ ID NO: 157304 - DNA, 27 bp, Artificial sequence
  SiRNA target sequence
cctaatataattatagataagaatatt

SEQ ID NO: 157305 - DNA, 27 bp, Artificial sequence
  SiRNA target sequence
ctaatataattatagataagaatattg

SEQ ID NO: 157306 - DNA, 27 bp, Artificial sequence
  SiRNA target sequence
taatataattatagataagaatattga

SEQ ID NO: 157307 - DNA, 27 bp, Artificial sequence
  SiRNA target sequence
aatataattatagataagaatattgat

SEQ ID NO: 157308 - DNA, 27 bp, Artificial sequence
  SiRNA target sequence
atataattatagataagaatattgata

SEQ ID NO: 157309 - DNA, 27 bp, Artificial sequence
  SiRNA target sequence
tataattatagataagaatattgataa

SEQ ID NO: 157310 - DNA, 27 bp, Artificial sequence
  SiRNA target sequence
ataattatagataagaatattgataaa

SEQ ID NO: 157311 - DNA, 27 bp, Artificial sequence
  SiRNA target sequence
taattatagataagaatattgataaag

SEQ ID NO: 157312 - DNA, 27 bp, Artificial sequence
  SiRNA target sequence
aattatagataagaatattgataaaga

SEQ ID NO: 157313 - DNA, 27 bp, Artificial sequence
  SiRNA target sequence
attatagataagaatattgataaagat

SEQ ID NO: 157314 - DNA, 27 bp, Artificial sequence
  SiRNA target sequence
ttatagataagaatattgataaagatt

SEQ ID NO: 157315 - DNA, 27 bp, Artificial sequence
  SiRNA target sequence
tatagataagaatattgataaagattt

SEQ ID NO: 157316 - DNA, 27 bp, Artificial sequence
  SiRNA target sequence
atagataagaatattgataaagattta

SEQ ID NO: 157317 - DNA, 27 bp, Artificial sequence
  SiRNA target sequence
tagataagaatattgataaagatttat

SEQ ID NO: 157318 - DNA, 27 bp, Artificial sequence
  SiRNA target sequence
agataagaatattgataaagatttatt

SEQ ID NO: 157319 - DNA, 27 bp, Artificial sequence
  SiRNA target sequence
gataagaatattgataaagatttatta

SEQ ID NO: 157320 - DNA, 27 bp, Artificial sequence
  SiRNA target sequence
ataagaatattgataaagatttattag

SEQ ID NO: 157321 - DNA, 27 bp, Artificial sequence
  SiRNA target sequence
taagaatattgataaagatttattagc

SEQ ID NO: 157322 - DNA, 27 bp, Artificial sequence
  SiRNA target sequence
aagaatattgataaagatttattagca

SEQ ID NO: 157323 - DNA, 27 bp, Artificial sequence
  SiRNA target sequence
agaatattgataaagatttattagcac

SEQ ID NO: 157324 - DNA, 27 bp, Artificial sequence
  SiRNA target sequence
gaatattgataaagatttattagcacg

SEQ ID NO: 157325 - DNA, 27 bp, Artificial sequence
  SiRNA target sequence
aatattgataaagatttattagcacgc

SEQ ID NO: 157326 - DNA, 27 bp, Artificial sequence
  SiRNA target sequence
atattgataaagatttattagcacgcg

SEQ ID NO: 157327 - DNA, 27 bp, Artificial sequence
  SiRNA target sequence
tattgataaagatttattagcacgcgc

SEQ ID NO: 157328 - DNA, 27 bp, Artificial sequence
  SiRNA target sequence
attgataaagatttattagcacgcgcc

SEQ ID NO: 157329 - DNA, 27 bp, Artificial sequence
  SiRNA target sequence
ttgataaagatttattagcacgcgcct

SEQ ID NO: 157330 - DNA, 27 bp, Artificial sequence
  SiRNA target sequence
tgataaagatttattagcacgcgcctt

SEQ ID NO: 157331 - DNA, 27 bp, Artificial sequence
  SiRNA target sequence
gataaagatttattagcacgcgccttg

SEQ ID NO: 157332 - DNA, 27 bp, Artificial sequence
  SiRNA target sequence
ataaagatttattagcacgcgccttga

SEQ ID NO: 157333 - DNA, 27 bp, Artificial sequence
  SiRNA target sequence
taaagatttattagcacgcgccttgaa

SEQ ID NO: 157334 - DNA, 27 bp, Artificial sequence
  SiRNA target sequence
aaagatttattagcacgcgccttgaat

SEQ ID NO: 157335 - DNA, 27 bp, Artificial sequence
  SiRNA target sequence
aagatttattagcacgcgccttgaatt

SEQ ID NO: 157336 - DNA, 27 bp, Artificial sequence
  SiRNA target sequence
agatttattagcacgcgccttgaatta

SEQ ID NO: 157337 - DNA, 27 bp, Artificial sequence
  SiRNA target sequence
gatttattagcacgcgccttgaattat

SEQ ID NO: 157338 - DNA, 27 bp, Artificial sequence
  SiRNA target sequence
atttattagcacgcgccttgaattatg

SEQ ID NO: 157339 - DNA, 27 bp, Artificial sequence
  SiRNA target sequence
tttattagcacgcgccttgaattatgt

SEQ ID NO: 157340 - DNA, 27 bp, Artificial sequence
  SiRNA target sequence
ttattagcacgcgccttgaattatgtt

SEQ ID NO: 157341 - DNA, 27 bp, Artificial sequence
  SiRNA target sequence
tattagcacgcgccttgaattatgttc

SEQ ID NO: 157342 - DNA, 27 bp, Artificial sequence
  SiRNA target sequence
attagcacgcgccttgaattatgttcc

SEQ ID NO: 157343 - DNA, 27 bp, Artificial sequence
  SiRNA target sequence
ttagcacgcgccttgaattatgttcct

SEQ ID NO: 157344 - DNA, 27 bp, Artificial sequence
  SiRNA target sequence
tagcacgcgccttgaattatgttcctg

SEQ ID NO: 157345 - DNA, 27 bp, Artificial sequence
  SiRNA target sequence
agcacgcgccttgaattatgttcctgt

SEQ ID NO: 157346 - DNA, 27 bp, Artificial sequence
  SiRNA target sequence
gcacgcgccttgaattatgttcctgta

SEQ ID NO: 157347 - DNA, 27 bp, Artificial sequence
  SiRNA target sequence
cacgcgccttgaattatgttcctgtaa

SEQ ID NO: 157348 - DNA, 27 bp, Artificial sequence
  SiRNA target sequence
acgcgccttgaattatgttcctgtaag

SEQ ID NO: 157349 - DNA, 27 bp, Artificial sequence
  SiRNA target sequence
cgcgccttgaattatgttcctgtaaga

SEQ ID NO: 157350 - DNA, 27 bp, Artificial sequence
  SiRNA target sequence
gcgccttgaattatgttcctgtaagaa

SEQ ID NO: 157351 - DNA, 27 bp, Artificial sequence
  SiRNA target sequence
cgccttgaattatgttcctgtaagaaa

SEQ ID NO: 157352 - DNA, 27 bp, Artificial sequence
  SiRNA target sequence
gccttgaattatgttcctgtaagaaaa

SEQ ID NO: 157353 - DNA, 27 bp, Artificial sequence
  SiRNA target sequence
ccttgaattatgttcctgtaagaaaag

SEQ ID NO: 157354 - DNA, 27 bp, Artificial sequence
  SiRNA target sequence
cttgaattatgttcctgtaagaaaaga

SEQ ID NO: 157355 - DNA, 27 bp, Artificial sequence
  SiRNA target sequence
ttgaattatgttcctgtaagaaaagat

SEQ ID NO: 157356 - DNA, 27 bp, Artificial sequence
  SiRNA target sequence
tgaattatgttcctgtaagaaaagatt

SEQ ID NO: 157357 - DNA, 27 bp, Artificial sequence
  SiRNA target sequence
gaattatgttcctgtaagaaaagattt

SEQ ID NO: 157358 - DNA, 27 bp, Artificial sequence
  SiRNA target sequence
aattatgttcctgtaagaaaagatttt

SEQ ID NO: 157359 - DNA, 27 bp, Artificial sequence
  SiRNA target sequence
attatgttcctgtaagaaaagatttta

SEQ ID NO: 157360 - DNA, 27 bp, Artificial sequence
  SiRNA target sequence
ttatgttcctgtaagaaaagattttac

SEQ ID NO: 157361 - DNA, 27 bp, Artificial sequence
  SiRNA target sequence
tatgttcctgtaagaaaagattttaca

SEQ ID NO: 157362 - DNA, 27 bp, Artificial sequence
  SiRNA target sequence
atgttcctgtaagaaaagattttacag

SEQ ID NO: 157363 - DNA, 27 bp, Artificial sequence
  SiRNA target sequence
tgttcctgtaagaaaagattttacagg

SEQ ID NO: 157364 - DNA, 27 bp, Artificial sequence
  SiRNA target sequence
gttcctgtaagaaaagattttacagga

SEQ ID NO: 157365 - DNA, 27 bp, Artificial sequence
  SiRNA target sequence
ttcctgtaagaaaagattttacaggaa

SEQ ID NO: 157366 - DNA, 27 bp, Artificial sequence
  SiRNA target sequence
tcctgtaagaaaagattttacaggaac

SEQ ID NO: 157367 - DNA, 27 bp, Artificial sequence
  SiRNA target sequence
cctgtaagaaaagattttacaggaact

SEQ ID NO: 157368 - DNA, 27 bp, Artificial sequence
  SiRNA target sequence
ctgtaagaaaagattttacaggaactg

SEQ ID NO: 157369 - DNA, 27 bp, Artificial sequence
  SiRNA target sequence
tgtaagaaaagattttacaggaactgc

SEQ ID NO: 157370 - DNA, 27 bp, Artificial sequence
  SiRNA target sequence
gtaagaaaagattttacaggaactgct

SEQ ID NO: 157371 - DNA, 27 bp, Artificial sequence
  SiRNA target sequence
taagaaaagattttacaggaactgctg

SEQ ID NO: 157372 - DNA, 27 bp, Artificial sequence
  SiRNA target sequence
aagaaaagattttacaggaactgctgt

SEQ ID NO: 157373 - DNA, 27 bp, Artificial sequence
  SiRNA target sequence
agaaaagattttacaggaactgctgtt

SEQ ID NO: 157374 - DNA, 27 bp, Artificial sequence
  SiRNA target sequence
gaaaagattttacaggaactgctgttc

SEQ ID NO: 157375 - DNA, 27 bp, Artificial sequence
  SiRNA target sequence
aaaagattttacaggaactgctgttcc

SEQ ID NO: 157376 - DNA, 27 bp, Artificial sequence
  SiRNA target sequence
aaagattttacaggaactgctgttcca

SEQ ID NO: 157377 - DNA, 27 bp, Artificial sequence
  SiRNA target sequence
aagattttacaggaactgctgttccaa

SEQ ID NO: 157378 - DNA, 27 bp, Artificial sequence
  SiRNA target sequence
agattttacaggaactgctgttccaaa

SEQ ID NO: 157379 - DNA, 27 bp, Artificial sequence
  SiRNA target sequence
gattttacaggaactgctgttccaaaa

SEQ ID NO: 157380 - DNA, 27 bp, Artificial sequence
  SiRNA target sequence
attttacaggaactgctgttccaaaat

SEQ ID NO: 157381 - DNA, 27 bp, Artificial sequence
  SiRNA target sequence
ttttacaggaactgctgttccaaaata

SEQ ID NO: 157382 - DNA, 27 bp, Artificial sequence
  SiRNA target sequence
tttacaggaactgctgttccaaaatat

SEQ ID NO: 157383 - DNA, 27 bp, Artificial sequence
  SiRNA target sequence
ttacaggaactgctgttccaaaatatg

SEQ ID NO: 157384 - DNA, 27 bp, Artificial sequence
  SiRNA target sequence
tacaggaactgctgttccaaaatatgc

SEQ ID NO: 157385 - DNA, 27 bp, Artificial sequence
  SiRNA target sequence
acaggaactgctgttccaaaatatgca

SEQ ID NO: 157386 - DNA, 27 bp, Artificial sequence
  SiRNA target sequence
caggaactgctgttccaaaatatgcag

SEQ ID NO: 157387 - DNA, 27 bp, Artificial sequence
  SiRNA target sequence
aggaactgctgttccaaaatatgcaga

SEQ ID NO: 157388 - DNA, 27 bp, Artificial sequence
  SiRNA target sequence
ggaactgctgttccaaaatatgcagaa

SEQ ID NO: 157389 - DNA, 27 bp, Artificial sequence
  SiRNA target sequence
gaactgctgttccaaaatatgcagaat

SEQ ID NO: 157390 - DNA, 27 bp, Artificial sequence
  SiRNA target sequence
aactgctgttccaaaatatgcagaatt

SEQ ID NO: 157391 - DNA, 27 bp, Artificial sequence
  SiRNA target sequence
actgctgttccaaaatatgcagaattt

SEQ ID NO: 157392 - DNA, 27 bp, Artificial sequence
  SiRNA target sequence
ctgctgttccaaaatatgcagaatttg

SEQ ID NO: 157393 - DNA, 27 bp, Artificial sequence
  SiRNA target sequence
tgctgttccaaaatatgcagaatttgg

SEQ ID NO: 157394 - DNA, 27 bp, Artificial sequence
  SiRNA target sequence
gctgttccaaaatatgcagaatttggt

SEQ ID NO: 157395 - DNA, 27 bp, Artificial sequence
  SiRNA target sequence
ctgttccaaaatatgcagaatttggtg

SEQ ID NO: 157396 - DNA, 27 bp, Artificial sequence
  SiRNA target sequence
tgttccaaaatatgcagaatttggtgt

SEQ ID NO: 157397 - DNA, 27 bp, Artificial sequence
  SiRNA target sequence
gttccaaaatatgcagaatttggtgtt

SEQ ID NO: 157398 - DNA, 27 bp, Artificial sequence
  SiRNA target sequence
ttccaaaatatgcagaatttggtgtta

SEQ ID NO: 157399 - DNA, 27 bp, Artificial sequence
  SiRNA target sequence
tccaaaatatgcagaatttggtgttat

SEQ ID NO: 157400 - DNA, 27 bp, Artificial sequence
  SiRNA target sequence
ccaaaatatgcagaatttggtgttatg

SEQ ID NO: 157401 - DNA, 27 bp, Artificial sequence
  SiRNA target sequence
caaaatatgcagaatttggtgttatgc

SEQ ID NO: 157402 - DNA, 27 bp, Artificial sequence
  SiRNA target sequence
aaaatatgcagaatttggtgttatgcc

SEQ ID NO: 157403 - DNA, 27 bp, Artificial sequence
  SiRNA target sequence
aaatatgcagaatttggtgttatgcct

SEQ ID NO: 157404 - DNA, 27 bp, Artificial sequence
  SiRNA target sequence
aatatgcagaatttggtgttatgccta

SEQ ID NO: 157405 - DNA, 27 bp, Artificial sequence
  SiRNA target sequence
atatgcagaatttggtgttatgcctaa

SEQ ID NO: 157406 - DNA, 27 bp, Artificial sequence
  SiRNA target sequence
tatgcagaatttggtgttatgcctaaa

SEQ ID NO: 157407 - DNA, 27 bp, Artificial sequence
  SiRNA target sequence
atgcagaatttggtgttatgcctaaag

SEQ ID NO: 157408 - DNA, 27 bp, Artificial sequence
  SiRNA target sequence
tgcagaatttggtgttatgcctaaaga

SEQ ID NO: 157409 - DNA, 27 bp, Artificial sequence
  SiRNA target sequence
gcagaatttggtgttatgcctaaagaa

SEQ ID NO: 157410 - DNA, 27 bp, Artificial sequence
  SiRNA target sequence
cagaatttggtgttatgcctaaagaac

SEQ ID NO: 157411 - DNA, 27 bp, Artificial sequence
  SiRNA target sequence
agaatttggtgttatgcctaaagaaca

SEQ ID NO: 157412 - DNA, 27 bp, Artificial sequence
  SiRNA target sequence
gaatttggtgttatgcctaaagaacag

SEQ ID NO: 157413 - DNA, 27 bp, Artificial sequence
  SiRNA target sequence
aatttggtgttatgcctaaagaacagg

SEQ ID NO: 157414 - DNA, 27 bp, Artificial sequence
  SiRNA target sequence
atttggtgttatgcctaaagaacagga

SEQ ID NO: 157415 - DNA, 27 bp, Artificial sequence
  SiRNA target sequence
tttggtgttatgcctaaagaacaggaa

SEQ ID NO: 157416 - DNA, 27 bp, Artificial sequence
  SiRNA target sequence
ttggtgttatgcctaaagaacaggaag

SEQ ID NO: 157417 - DNA, 27 bp, Artificial sequence
  SiRNA target sequence
tggtgttatgcctaaagaacaggaaga

SEQ ID NO: 157418 - DNA, 27 bp, Artificial sequence
  SiRNA target sequence
ggtgttatgcctaaagaacaggaagaa

SEQ ID NO: 157419 - DNA, 27 bp, Artificial sequence
  SiRNA target sequence
gtgttatgcctaaagaacaggaagaac

SEQ ID NO: 157420 - DNA, 27 bp, Artificial sequence
  SiRNA target sequence
tgttatgcctaaagaacaggaagaaca

SEQ ID NO: 157421 - DNA, 27 bp, Artificial sequence
  SiRNA target sequence
gttatgcctaaagaacaggaagaacaa

SEQ ID NO: 157422 - DNA, 27 bp, Artificial sequence
  SiRNA target sequence
ttatgcctaaagaacaggaagaacaaa

SEQ ID NO: 157423 - DNA, 27 bp, Artificial sequence
  SiRNA target sequence
tatgcctaaagaacaggaagaacaaaa

SEQ ID NO: 157424 - DNA, 27 bp, Artificial sequence
  SiRNA target sequence
atgcctaaagaacaggaagaacaaaac

SEQ ID NO: 157425 - DNA, 27 bp, Artificial sequence
  SiRNA target sequence
tgcctaaagaacaggaagaacaaaacg

SEQ ID NO: 157426 - DNA, 27 bp, Artificial sequence
  SiRNA target sequence
gcctaaagaacaggaagaacaaaacga

SEQ ID NO: 157427 - DNA, 27 bp, Artificial sequence
  SiRNA target sequence
cctaaagaacaggaagaacaaaacgaa

SEQ ID NO: 157428 - DNA, 27 bp, Artificial sequence
  SiRNA target sequence
ctaaagaacaggaagaacaaaacgaaa

SEQ ID NO: 157429 - DNA, 27 bp, Artificial sequence
  SiRNA target sequence
taaagaacaggaagaacaaaacgaaag

SEQ ID NO: 157430 - DNA, 27 bp, Artificial sequence
  SiRNA target sequence
aaagaacaggaagaacaaaacgaaaga

SEQ ID NO: 157431 - DNA, 27 bp, Artificial sequence
  SiRNA target sequence
aagaacaggaagaacaaaacgaaagag

SEQ ID NO: 157432 - DNA, 27 bp, Artificial sequence
  SiRNA target sequence
agaacaggaagaacaaaacgaaagaga

SEQ ID NO: 157433 - DNA, 27 bp, Artificial sequence
  SiRNA target sequence
gaacaggaagaacaaaacgaaagagaa

SEQ ID NO: 157434 - DNA, 27 bp, Artificial sequence
  SiRNA target sequence
aacaggaagaacaaaacgaaagagaaa

SEQ ID NO: 157435 - DNA, 27 bp, Artificial sequence
  SiRNA target sequence
acaggaagaacaaaacgaaagagaaag

SEQ ID NO: 157436 - DNA, 27 bp, Artificial sequence
  SiRNA target sequence
caggaagaacaaaacgaaagagaaaga

SEQ ID NO: 157437 - DNA, 27 bp, Artificial sequence
  SiRNA target sequence
aggaagaacaaaacgaaagagaaagat

SEQ ID NO: 157438 - DNA, 27 bp, Artificial sequence
  SiRNA target sequence
ggaagaacaaaacgaaagagaaagatt

SEQ ID NO: 157439 - DNA, 27 bp, Artificial sequence
  SiRNA target sequence
gaagaacaaaacgaaagagaaagattc

SEQ ID NO: 157440 - DNA, 27 bp, Artificial sequence
  SiRNA target sequence
aagaacaaaacgaaagagaaagattcg

SEQ ID NO: 157441 - DNA, 27 bp, Artificial sequence
  SiRNA target sequence
agaacaaaacgaaagagaaagattcga

SEQ ID NO: 157442 - DNA, 27 bp, Artificial sequence
  SiRNA target sequence
gaacaaaacgaaagagaaagattcgaa

SEQ ID NO: 157443 - DNA, 27 bp, Artificial sequence
  SiRNA target sequence
aacaaaacgaaagagaaagattcgaag

SEQ ID NO: 157444 - DNA, 27 bp, Artificial sequence
  SiRNA target sequence
acaaaacgaaagagaaagattcgaagg

SEQ ID NO: 157445 - DNA, 27 bp, Artificial sequence
  SiRNA target sequence
caaaacgaaagagaaagattcgaaggt

SEQ ID NO: 157446 - DNA, 27 bp, Artificial sequence
  SiRNA target sequence
aaaacgaaagagaaagattcgaaggtg

SEQ ID NO: 157447 - DNA, 27 bp, Artificial sequence
  SiRNA target sequence
aaacgaaagagaaagattcgaaggtgc

SEQ ID NO: 157448 - DNA, 27 bp, Artificial sequence
  SiRNA target sequence
aacgaaagagaaagattcgaaggtgca

SEQ ID NO: 157449 - DNA, 27 bp, Artificial sequence
  SiRNA target sequence
acgaaagagaaagattcgaaggtgcag

SEQ ID NO: 157450 - DNA, 27 bp, Artificial sequence
  SiRNA target sequence
cgaaagagaaagattcgaaggtgcaga

SEQ ID NO: 157451 - DNA, 27 bp, Artificial sequence
  SiRNA target sequence
gaaagagaaagattcgaaggtgcagaa

SEQ ID NO: 157452 - DNA, 27 bp, Artificial sequence
  SiRNA target sequence
aaagagaaagattcgaaggtgcagaag

SEQ ID NO: 157453 - DNA, 27 bp, Artificial sequence
  SiRNA target sequence
aagagaaagattcgaaggtgcagaaga

SEQ ID NO: 157454 - DNA, 27 bp, Artificial sequence
  SiRNA target sequence
agagaaagattcgaaggtgcagaagag

SEQ ID NO: 157455 - DNA, 27 bp, Artificial sequence
  SiRNA target sequence
gagaaagattcgaaggtgcagaagagt

SEQ ID NO: 157456 - DNA, 27 bp, Artificial sequence
  SiRNA target sequence
agaaagattcgaaggtgcagaagagtt

SEQ ID NO: 157457 - DNA, 27 bp, Artificial sequence
  SiRNA target sequence
gaaagattcgaaggtgcagaagagttt

SEQ ID NO: 157458 - DNA, 27 bp, Artificial sequence
  SiRNA target sequence
aaagattcgaaggtgcagaagagtttt

SEQ ID NO: 157459 - DNA, 27 bp, Artificial sequence
  SiRNA target sequence
aagattcgaaggtgcagaagagttttt

SEQ ID NO: 157460 - DNA, 27 bp, Artificial sequence
  SiRNA target sequence
agattcgaaggtgcagaagagtttttt

SEQ ID NO: 157461 - DNA, 27 bp, Artificial sequence
  SiRNA target sequence
gattcgaaggtgcagaagagttttttg

SEQ ID NO: 157462 - DNA, 27 bp, Artificial sequence
  SiRNA target sequence
attcgaaggtgcagaagagttttttgg

SEQ ID NO: 157463 - DNA, 27 bp, Artificial sequence
  SiRNA target sequence
ttcgaaggtgcagaagagttttttgga

SEQ ID NO: 157464 - DNA, 27 bp, Artificial sequence
  SiRNA target sequence
tcgaaggtgcagaagagttttttggag

SEQ ID NO: 157465 - DNA, 27 bp, Artificial sequence
  SiRNA target sequence
cgaaggtgcagaagagttttttggagg

SEQ ID NO: 157466 - DNA, 27 bp, Artificial sequence
  SiRNA target sequence
gaaggtgcagaagagttttttggagga

SEQ ID NO: 157467 - DNA, 27 bp, Artificial sequence
  SiRNA target sequence
aaggtgcagaagagttttttggaggaa

SEQ ID NO: 157468 - DNA, 27 bp, Artificial sequence
  SiRNA target sequence
aggtgcagaagagttttttggaggaaa

SEQ ID NO: 157469 - DNA, 27 bp, Artificial sequence
  SiRNA target sequence
ggtgcagaagagttttttggaggaaat

SEQ ID NO: 157470 - DNA, 27 bp, Artificial sequence
  SiRNA target sequence
gtgcagaagagttttttggaggaaatg

SEQ ID NO: 157471 - DNA, 27 bp, Artificial sequence
  SiRNA target sequence
tgcagaagagttttttggaggaaatgg

SEQ ID NO: 157472 - DNA, 27 bp, Artificial sequence
  SiRNA target sequence
gcagaagagttttttggaggaaatggt

SEQ ID NO: 157473 - DNA, 27 bp, Artificial sequence
  SiRNA target sequence
cagaagagttttttggaggaaatggta

SEQ ID NO: 157474 - DNA, 27 bp, Artificial sequence
  SiRNA target sequence
agaagagttttttggaggaaatggtag

SEQ ID NO: 157475 - DNA, 27 bp, Artificial sequence
  SiRNA target sequence
gaagagttttttggaggaaatggtaga

SEQ ID NO: 157476 - DNA, 27 bp, Artificial sequence
  SiRNA target sequence
aagagttttttggaggaaatggtagag

SEQ ID NO: 157477 - DNA, 27 bp, Artificial sequence
  SiRNA target sequence
agagttttttggaggaaatggtagaga

SEQ ID NO: 157478 - DNA, 27 bp, Artificial sequence
  SiRNA target sequence
gagttttttggaggaaatggtagagat

SEQ ID NO: 157479 - DNA, 27 bp, Artificial sequence
  SiRNA target sequence
agttttttggaggaaatggtagagatt

SEQ ID NO: 157480 - DNA, 27 bp, Artificial sequence
  SiRNA target sequence
gttttttggaggaaatggtagagattt

SEQ ID NO: 157481 - DNA, 27 bp, Artificial sequence
  SiRNA target sequence
ttttttggaggaaatggtagagatttt

SEQ ID NO: 157482 - DNA, 27 bp, Artificial sequence
  SiRNA target sequence
tttttggaggaaatggtagagattttt

SEQ ID NO: 157483 - DNA, 27 bp, Artificial sequence
  SiRNA target sequence
ttttggaggaaatggtagagatttttt

SEQ ID NO: 157484 - DNA, 27 bp, Artificial sequence
  SiRNA target sequence
tttggaggaaatggtagagattttttt

SEQ ID NO: 157485 - DNA, 27 bp, Artificial sequence
  SiRNA target sequence
ttggaggaaatggtagagattttttta

SEQ ID NO: 157486 - DNA, 27 bp, Artificial sequence
  SiRNA target sequence
tggaggaaatggtagagatttttttag

SEQ ID NO: 157487 - DNA, 27 bp, Artificial sequence
  SiRNA target sequence
ggaggaaatggtagagatttttttagc

SEQ ID NO: 157488 - DNA, 27 bp, Artificial sequence
  SiRNA target sequence
gaggaaatggtagagatttttttagca

SEQ ID NO: 157489 - DNA, 27 bp, Artificial sequence
  SiRNA target sequence
aggaaatggtagagatttttttagcaa

SEQ ID NO: 157490 - DNA, 27 bp, Artificial sequence
  SiRNA target sequence
ggaaatggtagagatttttttagcaag

SEQ ID NO: 157491 - DNA, 27 bp, Artificial sequence
  SiRNA target sequence
gaaatggtagagatttttttagcaagt

SEQ ID NO: 157492 - DNA, 27 bp, Artificial sequence
  SiRNA target sequence
aaatggtagagatttttttagcaagtt

SEQ ID NO: 157493 - DNA, 27 bp, Artificial sequence
  SiRNA target sequence
aatggtagagatttttttagcaagttt

SEQ ID NO: 157494 - DNA, 27 bp, Artificial sequence
  SiRNA target sequence
atggtagagatttttttagcaagtttg

SEQ ID NO: 157495 - DNA, 27 bp, Artificial sequence
  SiRNA target sequence
tggtagagatttttttagcaagtttgg

SEQ ID NO: 157496 - DNA, 27 bp, Artificial sequence
  SiRNA target sequence
ggtagagatttttttagcaagtttgga

SEQ ID NO: 157497 - DNA, 27 bp, Artificial sequence
  SiRNA target sequence
gtagagatttttttagcaagtttggat

SEQ ID NO: 157498 - DNA, 27 bp, Artificial sequence
  SiRNA target sequence
tagagatttttttagcaagtttggatt

SEQ ID NO: 157499 - DNA, 27 bp, Artificial sequence
  SiRNA target sequence
agagatttttttagcaagtttggattt

SEQ ID NO: 157500 - DNA, 27 bp, Artificial sequence
  SiRNA target sequence
gagatttttttagcaagtttggatttt

SEQ ID NO: 157501 - DNA, 27 bp, Artificial sequence
  SiRNA target sequence
agatttttttagcaagtttggattttt

SEQ ID NO: 157502 - DNA, 27 bp, Artificial sequence
  SiRNA target sequence
gatttttttagcaagtttggatttttc

SEQ ID NO: 157503 - DNA, 27 bp, Artificial sequence
  SiRNA target sequence
atttttttagcaagtttggatttttct

SEQ ID NO: 157504 - DNA, 27 bp, Artificial sequence
  SiRNA target sequence
tttttttagcaagtttggatttttcta

SEQ ID NO: 157505 - DNA, 27 bp, Artificial sequence
  SiRNA target sequence
ttttttagcaagtttggatttttctaa

SEQ ID NO: 157506 - DNA, 19 bp, Artificial sequence
  SiRNA target sequence
atgttatttttttatagcc

SEQ ID NO: 157507 - DNA, 19 bp, Artificial sequence
  SiRNA target sequence
tgttatttttttatagccc

SEQ ID NO: 157508 - DNA, 19 bp, Artificial sequence
  SiRNA target sequence
gttatttttttatagcccc

SEQ ID NO: 157509 - DNA, 19 bp, Artificial sequence
  SiRNA target sequence
ttatttttttatagcccca

SEQ ID NO: 157510 - DNA, 19 bp, Artificial sequence
  SiRNA target sequence
tatttttttatagccccat

SEQ ID NO: 157511 - DNA, 19 bp, Artificial sequence
  SiRNA target sequence
atttttttatagccccatt

SEQ ID NO: 157512 - DNA, 19 bp, Artificial sequence
  SiRNA target sequence
tttttttatagccccattt

SEQ ID NO: 157513 - DNA, 19 bp, Artificial sequence
  SiRNA target sequence
ttttttatagccccatttt

SEQ ID NO: 157514 - DNA, 19 bp, Artificial sequence
  SiRNA target sequence
tttttatagccccattttt

SEQ ID NO: 157515 - DNA, 19 bp, Artificial sequence
  SiRNA target sequence
ttttatagccccattttta

SEQ ID NO: 157516 - DNA, 19 bp, Artificial sequence
  SiRNA target sequence
tttatagccccatttttat

SEQ ID NO: 157517 - DNA, 19 bp, Artificial sequence
  SiRNA target sequence
ttatagccccatttttatg

SEQ ID NO: 157518 - DNA, 19 bp, Artificial sequence
  SiRNA target sequence
tatagccccatttttatga

SEQ ID NO: 157519 - DNA, 19 bp, Artificial sequence
  SiRNA target sequence
atagccccatttttatgac

SEQ ID NO: 157520 - DNA, 19 bp, Artificial sequence
  SiRNA target sequence
tagccccatttttatgact

SEQ ID NO: 157521 - DNA, 19 bp, Artificial sequence
  SiRNA target sequence
agccccatttttatgacta

SEQ ID NO: 157522 - DNA, 19 bp, Artificial sequence
  SiRNA target sequence
gccccatttttatgactaa

SEQ ID NO: 157523 - DNA, 19 bp, Artificial sequence
  SiRNA target sequence
ccccatttttatgactaaa

SEQ ID NO: 157524 - DNA, 19 bp, Artificial sequence
  SiRNA target sequence
cccatttttatgactaaaa

SEQ ID NO: 157525 - DNA, 19 bp, Artificial sequence
  SiRNA target sequence
ccatttttatgactaaaag

SEQ ID NO: 157526 - DNA, 19 bp, Artificial sequence
  SiRNA target sequence
catttttatgactaaaagt

SEQ ID NO: 157527 - DNA, 19 bp, Artificial sequence
  SiRNA target sequence
atttttatgactaaaagtt

SEQ ID NO: 157528 - DNA, 19 bp, Artificial sequence
  SiRNA target sequence
tttttatgactaaaagttt

SEQ ID NO: 157529 - DNA, 19 bp, Artificial sequence
  SiRNA target sequence
ttttatgactaaaagttta

SEQ ID NO: 157530 - DNA, 19 bp, Artificial sequence
  SiRNA target sequence
tttatgactaaaagtttaa

SEQ ID NO: 157531 - DNA, 19 bp, Artificial sequence
  SiRNA target sequence
ttatgactaaaagtttaac

SEQ ID NO: 157532 - DNA, 19 bp, Artificial sequence
  SiRNA target sequence
tatgactaaaagtttaacg

SEQ ID NO: 157533 - DNA, 19 bp, Artificial sequence
  SiRNA target sequence
atgactaaaagtttaacga

SEQ ID NO: 157534 - DNA, 19 bp, Artificial sequence
  SiRNA target sequence
tgactaaaagtttaacgaa

SEQ ID NO: 157535 - DNA, 19 bp, Artificial sequence
  SiRNA target sequence
gactaaaagtttaacgaat

SEQ ID NO: 157536 - DNA, 19 bp, Artificial sequence
  SiRNA target sequence
actaaaagtttaacgaatt

SEQ ID NO: 157537 - DNA, 19 bp, Artificial sequence
  SiRNA target sequence
ctaaaagtttaacgaattc

SEQ ID NO: 157538 - DNA, 19 bp, Artificial sequence
  SiRNA target sequence
taaaagtttaacgaattct

SEQ ID NO: 157539 - DNA, 19 bp, Artificial sequence
  SiRNA target sequence
aaaagtttaacgaattcta

SEQ ID NO: 157540 - DNA, 19 bp, Artificial sequence
  SiRNA target sequence
aaagtttaacgaattctaa

SEQ ID NO: 157541 - DNA, 19 bp, Artificial sequence
  SiRNA target sequence
aagtttaacgaattctaaa

SEQ ID NO: 157542 - DNA, 19 bp, Artificial sequence
  SiRNA target sequence
agtttaacgaattctaaaa

SEQ ID NO: 157543 - DNA, 19 bp, Artificial sequence
  SiRNA target sequence
gtttaacgaattctaaaac

SEQ ID NO: 157544 - DNA, 19 bp, Artificial sequence
  SiRNA target sequence
tttaacgaattctaaaact

SEQ ID NO: 157545 - DNA, 19 bp, Artificial sequence
  SiRNA target sequence
ttaacgaattctaaaactt

SEQ ID NO: 157546 - DNA, 19 bp, Artificial sequence
  SiRNA target sequence
taacgaattctaaaacttt

SEQ ID NO: 157547 - DNA, 19 bp, Artificial sequence
  SiRNA target sequence
aacgaattctaaaacttta

SEQ ID NO: 157548 - DNA, 19 bp, Artificial sequence
  SiRNA target sequence
acgaattctaaaactttaa

SEQ ID NO: 157549 - DNA, 19 bp, Artificial sequence
  SiRNA target sequence
cgaattctaaaactttaaa

SEQ ID NO: 157550 - DNA, 19 bp, Artificial sequence
  SiRNA target sequence
gaattctaaaactttaaat

SEQ ID NO: 157551 - DNA, 19 bp, Artificial sequence
  SiRNA target sequence
aattctaaaactttaaatt

SEQ ID NO: 157552 - DNA, 19 bp, Artificial sequence
  SiRNA target sequence
attctaaaactttaaattt

SEQ ID NO: 157553 - DNA, 19 bp, Artificial sequence
  SiRNA target sequence
ttctaaaactttaaattta

SEQ ID NO: 157554 - DNA, 19 bp, Artificial sequence
  SiRNA target sequence
tctaaaactttaaatttaa

SEQ ID NO: 157555 - DNA, 19 bp, Artificial sequence
  SiRNA target sequence
ctaaaactttaaatttaat

SEQ ID NO: 157556 - DNA, 19 bp, Artificial sequence
  SiRNA target sequence
taaaactttaaatttaatg

SEQ ID NO: 157557 - DNA, 19 bp, Artificial sequence
  SiRNA target sequence
aaaactttaaatttaatgt

SEQ ID NO: 157558 - DNA, 19 bp, Artificial sequence
  SiRNA target sequence
aaactttaaatttaatgtc

SEQ ID NO: 157559 - DNA, 19 bp, Artificial sequence
  SiRNA target sequence
aactttaaatttaatgtca

SEQ ID NO: 157560 - DNA, 19 bp, Artificial sequence
  SiRNA target sequence
actttaaatttaatgtcaa

SEQ ID NO: 157561 - DNA, 19 bp, Artificial sequence
  SiRNA target sequence
ctttaaatttaatgtcaag

SEQ ID NO: 157562 - DNA, 19 bp, Artificial sequence
  SiRNA target sequence
tttaaatttaatgtcaagt

SEQ ID NO: 157563 - DNA, 19 bp, Artificial sequence
  SiRNA target sequence
ttaaatttaatgtcaagtg

SEQ ID NO: 157564 - DNA, 19 bp, Artificial sequence
  SiRNA target sequence
taaatttaatgtcaagtgt

SEQ ID NO: 157565 - DNA, 19 bp, Artificial sequence
  SiRNA target sequence
aaatttaatgtcaagtgta

SEQ ID NO: 157566 - DNA, 19 bp, Artificial sequence
  SiRNA target sequence
aatttaatgtcaagtgtac

SEQ ID NO: 157567 - DNA, 19 bp, Artificial sequence
  SiRNA target sequence
atttaatgtcaagtgtaca

SEQ ID NO: 157568 - DNA, 19 bp, Artificial sequence
  SiRNA target sequence
tttaatgtcaagtgtacaa

SEQ ID NO: 157569 - DNA, 19 bp, Artificial sequence
  SiRNA target sequence
ttaatgtcaagtgtacaat

SEQ ID NO: 157570 - DNA, 19 bp, Artificial sequence
  SiRNA target sequence
taatgtcaagtgtacaatc

SEQ ID NO: 157571 - DNA, 19 bp, Artificial sequence
  SiRNA target sequence
aatgtcaagtgtacaatca

SEQ ID NO: 157572 - DNA, 19 bp, Artificial sequence
  SiRNA target sequence
atgtcaagtgtacaatcac

SEQ ID NO: 157573 - DNA, 19 bp, Artificial sequence
  SiRNA target sequence
tgtcaagtgtacaatcacc

SEQ ID NO: 157574 - DNA, 19 bp, Artificial sequence
  SiRNA target sequence
gtcaagtgtacaatcacca

SEQ ID NO: 157575 - DNA, 19 bp, Artificial sequence
  SiRNA target sequence
tcaagtgtacaatcaccag

SEQ ID NO: 157576 - DNA, 19 bp, Artificial sequence
  SiRNA target sequence
caagtgtacaatcaccagt

SEQ ID NO: 157577 - DNA, 19 bp, Artificial sequence
  SiRNA target sequence
aagtgtacaatcaccagtt

SEQ ID NO: 157578 - DNA, 19 bp, Artificial sequence
  SiRNA target sequence
agtgtacaatcaccagtta

SEQ ID NO: 157579 - DNA, 19 bp, Artificial sequence
  SiRNA target sequence
gtgtacaatcaccagttat

SEQ ID NO: 157580 - DNA, 19 bp, Artificial sequence
  SiRNA target sequence
tgtacaatcaccagttata

SEQ ID NO: 157581 - DNA, 19 bp, Artificial sequence
  SiRNA target sequence
gtacaatcaccagttataa

SEQ ID NO: 157582 - DNA, 19 bp, Artificial sequence
  SiRNA target sequence
tacaatcaccagttataaa

SEQ ID NO: 157583 - DNA, 19 bp, Artificial sequence
  SiRNA target sequence
acaatcaccagttataaat

SEQ ID NO: 157584 - DNA, 19 bp, Artificial sequence
  SiRNA target sequence
caatcaccagttataaata

SEQ ID NO: 157585 - DNA, 19 bp, Artificial sequence
  SiRNA target sequence
aatcaccagttataaatac

SEQ ID NO: 157586 - DNA, 19 bp, Artificial sequence
  SiRNA target sequence
atcaccagttataaataca

SEQ ID NO: 157587 - DNA, 19 bp, Artificial sequence
  SiRNA target sequence
tcaccagttataaatacaa

SEQ ID NO: 157588 - DNA, 19 bp, Artificial sequence
  SiRNA target sequence
caccagttataaatacaaa

SEQ ID NO: 157589 - DNA, 19 bp, Artificial sequence
  SiRNA target sequence
accagttataaatacaaaa

SEQ ID NO: 157590 - DNA, 19 bp, Artificial sequence
  SiRNA target sequence
ccagttataaatacaaaaa

SEQ ID NO: 157591 - DNA, 19 bp, Artificial sequence
  SiRNA target sequence
cagttataaatacaaaaaa

SEQ ID NO: 157592 - DNA, 19 bp, Artificial sequence
  SiRNA target sequence
agttataaatacaaaaaaa

SEQ ID NO: 157593 - DNA, 19 bp, Artificial sequence
  SiRNA target sequence
gttataaatacaaaaaaaa

SEQ ID NO: 157594 - DNA, 19 bp, Artificial sequence
  SiRNA target sequence
ttataaatacaaaaaaaat

SEQ ID NO: 157595 - DNA, 19 bp, Artificial sequence
  SiRNA target sequence
tataaatacaaaaaaaata

SEQ ID NO: 157596 - DNA, 19 bp, Artificial sequence
  SiRNA target sequence
ataaatacaaaaaaaatat

SEQ ID NO: 157597 - DNA, 19 bp, Artificial sequence
  SiRNA target sequence
taaatacaaaaaaaatata

SEQ ID NO: 157598 - DNA, 19 bp, Artificial sequence
  SiRNA target sequence
aaatacaaaaaaaatatat

SEQ ID NO: 157599 - DNA, 19 bp, Artificial sequence
  SiRNA target sequence
aatacaaaaaaaatatatc

SEQ ID NO: 157600 - DNA, 19 bp, Artificial sequence
  SiRNA target sequence
atacaaaaaaaatatatct

SEQ ID NO: 157601 - DNA, 19 bp, Artificial sequence
  SiRNA target sequence
tacaaaaaaaatatatctt

SEQ ID NO: 157602 - DNA, 19 bp, Artificial sequence
  SiRNA target sequence
acaaaaaaaatatatcttg

SEQ ID NO: 157603 - DNA, 19 bp, Artificial sequence
  SiRNA target sequence
caaaaaaaatatatcttga

SEQ ID NO: 157604 - DNA, 19 bp, Artificial sequence
  SiRNA target sequence
aaaaaaaatatatcttgat

SEQ ID NO: 157605 - DNA, 19 bp, Artificial sequence
  SiRNA target sequence
aaaaaaatatatcttgatg

SEQ ID NO: 157606 - DNA, 19 bp, Artificial sequence
  SiRNA target sequence
aaaaaatatatcttgatgc

SEQ ID NO: 157607 - DNA, 19 bp, Artificial sequence
  SiRNA target sequence
aaaaatatatcttgatgca

SEQ ID NO: 157608 - DNA, 19 bp, Artificial sequence
  SiRNA target sequence
aaaatatatcttgatgcac

SEQ ID NO: 157609 - DNA, 19 bp, Artificial sequence
  SiRNA target sequence
aaatatatcttgatgcaca

SEQ ID NO: 157610 - DNA, 19 bp, Artificial sequence
  SiRNA target sequence
aatatatcttgatgcacaa

SEQ ID NO: 157611 - DNA, 19 bp, Artificial sequence
  SiRNA target sequence
atatatcttgatgcacaag

SEQ ID NO: 157612 - DNA, 19 bp, Artificial sequence
  SiRNA target sequence
tatatcttgatgcacaagc

SEQ ID NO: 157613 - DNA, 19 bp, Artificial sequence
  SiRNA target sequence
atatcttgatgcacaagcg

SEQ ID NO: 157614 - DNA, 19 bp, Artificial sequence
  SiRNA target sequence
tatcttgatgcacaagcga

SEQ ID NO: 157615 - DNA, 19 bp, Artificial sequence
  SiRNA target sequence
atcttgatgcacaagcgac

SEQ ID NO: 157616 - DNA, 19 bp, Artificial sequence
  SiRNA target sequence
tcttgatgcacaagcgacc

SEQ ID NO: 157617 - DNA, 19 bp, Artificial sequence
  SiRNA target sequence
cttgatgcacaagcgacca

SEQ ID NO: 157618 - DNA, 19 bp, Artificial sequence
  SiRNA target sequence
ttgatgcacaagcgaccaa

SEQ ID NO: 157619 - DNA, 19 bp, Artificial sequence
  SiRNA target sequence
tgatgcacaagcgaccaag

SEQ ID NO: 157620 - DNA, 19 bp, Artificial sequence
  SiRNA target sequence
gatgcacaagcgaccaagc

SEQ ID NO: 157621 - DNA, 19 bp, Artificial sequence
  SiRNA target sequence
atgcacaagcgaccaagcc

SEQ ID NO: 157622 - DNA, 19 bp, Artificial sequence
  SiRNA target sequence
tgcacaagcgaccaagcct

SEQ ID NO: 157623 - DNA, 19 bp, Artificial sequence
  SiRNA target sequence
gcacaagcgaccaagcctt

SEQ ID NO: 157624 - DNA, 19 bp, Artificial sequence
  SiRNA target sequence
cacaagcgaccaagccttt

SEQ ID NO: 157625 - DNA, 19 bp, Artificial sequence
  SiRNA target sequence
acaagcgaccaagccttta

SEQ ID NO: 157626 - DNA, 19 bp, Artificial sequence
  SiRNA target sequence
caagcgaccaagcctttag

SEQ ID NO: 157627 - DNA, 19 bp, Artificial sequence
  SiRNA target sequence
aagcgaccaagcctttaga

SEQ ID NO: 157628 - DNA, 19 bp, Artificial sequence
  SiRNA target sequence
agcgaccaagcctttagac

SEQ ID NO: 157629 - DNA, 19 bp, Artificial sequence
  SiRNA target sequence
gcgaccaagcctttagacc

SEQ ID NO: 157630 - DNA, 19 bp, Artificial sequence
  SiRNA target sequence
cgaccaagcctttagaccc

SEQ ID NO: 157631 - DNA, 19 bp, Artificial sequence
  SiRNA target sequence
gaccaagcctttagacccg

SEQ ID NO: 157632 - DNA, 19 bp, Artificial sequence
  SiRNA target sequence
accaagcctttagacccgc

SEQ ID NO: 157633 - DNA, 19 bp, Artificial sequence
  SiRNA target sequence
ccaagcctttagacccgcg

SEQ ID NO: 157634 - DNA, 19 bp, Artificial sequence
  SiRNA target sequence
caagcctttagacccgcgt

SEQ ID NO: 157635 - DNA, 19 bp, Artificial sequence
  SiRNA target sequence
aagcctttagacccgcgtg

SEQ ID NO: 157636 - DNA, 19 bp, Artificial sequence
  SiRNA target sequence
agcctttagacccgcgtgt

SEQ ID NO: 157637 - DNA, 19 bp, Artificial sequence
  SiRNA target sequence
gcctttagacccgcgtgtg

SEQ ID NO: 157638 - DNA, 19 bp, Artificial sequence
  SiRNA target sequence
cctttagacccgcgtgtgc

SEQ ID NO: 157639 - DNA, 19 bp, Artificial sequence
  SiRNA target sequence
ctttagacccgcgtgtgct

SEQ ID NO: 157640 - DNA, 19 bp, Artificial sequence
  SiRNA target sequence
tttagacccgcgtgtgctt

SEQ ID NO: 157641 - DNA, 19 bp, Artificial sequence
  SiRNA target sequence
ttagacccgcgtgtgcttg

SEQ ID NO: 157642 - DNA, 19 bp, Artificial sequence
  SiRNA target sequence
tagacccgcgtgtgcttga

SEQ ID NO: 157643 - DNA, 19 bp, Artificial sequence
  SiRNA target sequence
agacccgcgtgtgcttgat

SEQ ID NO: 157644 - DNA, 19 bp, Artificial sequence
  SiRNA target sequence
gacccgcgtgtgcttgatg

SEQ ID NO: 157645 - DNA, 19 bp, Artificial sequence
  SiRNA target sequence
acccgcgtgtgcttgatgc

SEQ ID NO: 157646 - DNA, 19 bp, Artificial sequence
  SiRNA target sequence
cccgcgtgtgcttgatgca

SEQ ID NO: 157647 - DNA, 19 bp, Artificial sequence
  SiRNA target sequence
ccgcgtgtgcttgatgcaa

SEQ ID NO: 157648 - DNA, 19 bp, Artificial sequence
  SiRNA target sequence
cgcgtgtgcttgatgcaat

SEQ ID NO: 157649 - DNA, 19 bp, Artificial sequence
  SiRNA target sequence
gcgtgtgcttgatgcaatg

SEQ ID NO: 157650 - DNA, 19 bp, Artificial sequence
  SiRNA target sequence
cgtgtgcttgatgcaatgc

SEQ ID NO: 157651 - DNA, 19 bp, Artificial sequence
  SiRNA target sequence
gtgtgcttgatgcaatgct

SEQ ID NO: 157652 - DNA, 19 bp, Artificial sequence
  SiRNA target sequence
tgtgcttgatgcaatgctt

SEQ ID NO: 157653 - DNA, 19 bp, Artificial sequence
  SiRNA target sequence
gtgcttgatgcaatgcttc

SEQ ID NO: 157654 - DNA, 19 bp, Artificial sequence
  SiRNA target sequence
tgcttgatgcaatgcttcc

SEQ ID NO: 157655 - DNA, 19 bp, Artificial sequence
  SiRNA target sequence
gcttgatgcaatgcttcca

SEQ ID NO: 157656 - DNA, 19 bp, Artificial sequence
  SiRNA target sequence
cttgatgcaatgcttccat

SEQ ID NO: 157657 - DNA, 19 bp, Artificial sequence
  SiRNA target sequence
ttgatgcaatgcttccata

SEQ ID NO: 157658 - DNA, 19 bp, Artificial sequence
  SiRNA target sequence
tgatgcaatgcttccatac

SEQ ID NO: 157659 - DNA, 19 bp, Artificial sequence
  SiRNA target sequence
gatgcaatgcttccatact

SEQ ID NO: 157660 - DNA, 19 bp, Artificial sequence
  SiRNA target sequence
atgcaatgcttccatacta

SEQ ID NO: 157661 - DNA, 19 bp, Artificial sequence
  SiRNA target sequence
tgcaatgcttccatactat

SEQ ID NO: 157662 - DNA, 19 bp, Artificial sequence
  SiRNA target sequence
gcaatgcttccatactata

SEQ ID NO: 157663 - DNA, 19 bp, Artificial sequence
  SiRNA target sequence
caatgcttccatactatac

SEQ ID NO: 157664 - DNA, 19 bp, Artificial sequence
  SiRNA target sequence
aatgcttccatactataca

SEQ ID NO: 157665 - DNA, 19 bp, Artificial sequence
  SiRNA target sequence
atgcttccatactatacat

SEQ ID NO: 157666 - DNA, 19 bp, Artificial sequence
  SiRNA target sequence
tgcttccatactatacatc

SEQ ID NO: 157667 - DNA, 19 bp, Artificial sequence
  SiRNA target sequence
gcttccatactatacatcc

SEQ ID NO: 157668 - DNA, 19 bp, Artificial sequence
  SiRNA target sequence
cttccatactatacatcca

SEQ ID NO: 157669 - DNA, 19 bp, Artificial sequence
  SiRNA target sequence
ttccatactatacatccat

SEQ ID NO: 157670 - DNA, 19 bp, Artificial sequence
  SiRNA target sequence
tccatactatacatccatt

SEQ ID NO: 157671 - DNA, 19 bp, Artificial sequence
  SiRNA target sequence
ccatactatacatccattt

SEQ ID NO: 157672 - DNA, 19 bp, Artificial sequence
  SiRNA target sequence
catactatacatccatttt

SEQ ID NO: 157673 - DNA, 19 bp, Artificial sequence
  SiRNA target sequence
atactatacatccattttt

SEQ ID NO: 157674 - DNA, 19 bp, Artificial sequence
  SiRNA target sequence
tactatacatccatttttg

SEQ ID NO: 157675 - DNA, 19 bp, Artificial sequence
  SiRNA target sequence
actatacatccatttttgg

SEQ ID NO: 157676 - DNA, 19 bp, Artificial sequence
  SiRNA target sequence
ctatacatccatttttgga

SEQ ID NO: 157677 - DNA, 19 bp, Artificial sequence
  SiRNA target sequence
tatacatccatttttggaa

SEQ ID NO: 157678 - DNA, 19 bp, Artificial sequence
  SiRNA target sequence
atacatccatttttggaaa

SEQ ID NO: 157679 - DNA, 19 bp, Artificial sequence
  SiRNA target sequence
tacatccatttttggaaat

SEQ ID NO: 157680 - DNA, 19 bp, Artificial sequence
  SiRNA target sequence
acatccatttttggaaatc

SEQ ID NO: 157681 - DNA, 19 bp, Artificial sequence
  SiRNA target sequence
catccatttttggaaatcc

SEQ ID NO: 157682 - DNA, 19 bp, Artificial sequence
  SiRNA target sequence
atccatttttggaaatcca

SEQ ID NO: 157683 - DNA, 19 bp, Artificial sequence
  SiRNA target sequence
tccatttttggaaatccac

SEQ ID NO: 157684 - DNA, 19 bp, Artificial sequence
  SiRNA target sequence
ccatttttggaaatccaca

SEQ ID NO: 157685 - DNA, 19 bp, Artificial sequence
  SiRNA target sequence
catttttggaaatccacat

SEQ ID NO: 157686 - DNA, 19 bp, Artificial sequence
  SiRNA target sequence
atttttggaaatccacatt

SEQ ID NO: 157687 - DNA, 19 bp, Artificial sequence
  SiRNA target sequence
tttttggaaatccacattc

SEQ ID NO: 157688 - DNA, 19 bp, Artificial sequence
  SiRNA target sequence
ttttggaaatccacattct

SEQ ID NO: 157689 - DNA, 19 bp, Artificial sequence
  SiRNA target sequence
tttggaaatccacattctc

SEQ ID NO: 157690 - DNA, 19 bp, Artificial sequence
  SiRNA target sequence
ttggaaatccacattctcg

SEQ ID NO: 157691 - DNA, 19 bp, Artificial sequence
  SiRNA target sequence
tggaaatccacattctcgc

SEQ ID NO: 157692 - DNA, 19 bp, Artificial sequence
  SiRNA target sequence
ggaaatccacattctcgca

SEQ ID NO: 157693 - DNA, 19 bp, Artificial sequence
  SiRNA target sequence
gaaatccacattctcgcac

SEQ ID NO: 157694 - DNA, 19 bp, Artificial sequence
  SiRNA target sequence
aaatccacattctcgcacg

SEQ ID NO: 157695 - DNA, 19 bp, Artificial sequence
  SiRNA target sequence
aatccacattctcgcacgc

SEQ ID NO: 157696 - DNA, 19 bp, Artificial sequence
  SiRNA target sequence
atccacattctcgcacgca

SEQ ID NO: 157697 - DNA, 19 bp, Artificial sequence
  SiRNA target sequence
tccacattctcgcacgcat

SEQ ID NO: 157698 - DNA, 19 bp, Artificial sequence
  SiRNA target sequence
ccacattctcgcacgcata

SEQ ID NO: 157699 - DNA, 19 bp, Artificial sequence
  SiRNA target sequence
cacattctcgcacgcatac

SEQ ID NO: 157700 - DNA, 19 bp, Artificial sequence
  SiRNA target sequence
acattctcgcacgcatacg

SEQ ID NO: 157701 - DNA, 19 bp, Artificial sequence
  SiRNA target sequence
cattctcgcacgcatacgt

SEQ ID NO: 157702 - DNA, 19 bp, Artificial sequence
  SiRNA target sequence
attctcgcacgcatacgtt

SEQ ID NO: 157703 - DNA, 19 bp, Artificial sequence
  SiRNA target sequence
ttctcgcacgcatacgttt

SEQ ID NO: 157704 - DNA, 19 bp, Artificial sequence
  SiRNA target sequence
tctcgcacgcatacgtttg

SEQ ID NO: 157705 - DNA, 19 bp, Artificial sequence
  SiRNA target sequence
ctcgcacgcatacgtttgg

SEQ ID NO: 157706 - DNA, 19 bp, Artificial sequence
  SiRNA target sequence
tcgcacgcatacgtttgga

SEQ ID NO: 157707 - DNA, 19 bp, Artificial sequence
  SiRNA target sequence
cgcacgcatacgtttggat

SEQ ID NO: 157708 - DNA, 19 bp, Artificial sequence
  SiRNA target sequence
gcacgcatacgtttggatg

SEQ ID NO: 157709 - DNA, 19 bp, Artificial sequence
  SiRNA target sequence
cacgcatacgtttggatgg

SEQ ID NO: 157710 - DNA, 19 bp, Artificial sequence
  SiRNA target sequence
acgcatacgtttggatgga

SEQ ID NO: 157711 - DNA, 19 bp, Artificial sequence
  SiRNA target sequence
cgcatacgtttggatggaa

SEQ ID NO: 157712 - DNA, 19 bp, Artificial sequence
  SiRNA target sequence
gcatacgtttggatggaat

SEQ ID NO: 157713 - DNA, 19 bp, Artificial sequence
  SiRNA target sequence
catacgtttggatggaatg

SEQ ID NO: 157714 - DNA, 19 bp, Artificial sequence
  SiRNA target sequence
atacgtttggatggaatgc

SEQ ID NO: 157715 - DNA, 19 bp, Artificial sequence
  SiRNA target sequence
tacgtttggatggaatgca

SEQ ID NO: 157716 - DNA, 19 bp, Artificial sequence
  SiRNA target sequence
acgtttggatggaatgcag

SEQ ID NO: 157717 - DNA, 19 bp, Artificial sequence
  SiRNA target sequence
cgtttggatggaatgcaga

SEQ ID NO: 157718 - DNA, 19 bp, Artificial sequence
  SiRNA target sequence
gtttggatggaatgcagaa

SEQ ID NO: 157719 - DNA, 19 bp, Artificial sequence
  SiRNA target sequence
tttggatggaatgcagaaa

SEQ ID NO: 157720 - DNA, 19 bp, Artificial sequence
  SiRNA target sequence
ttggatggaatgcagaaaa

SEQ ID NO: 157721 - DNA, 19 bp, Artificial sequence
  SiRNA target sequence
tggatggaatgcagaaaaa

SEQ ID NO: 157722 - DNA, 19 bp, Artificial sequence
  SiRNA target sequence
ggatggaatgcagaaaaag

SEQ ID NO: 157723 - DNA, 19 bp, Artificial sequence
  SiRNA target sequence
gatggaatgcagaaaaagg

SEQ ID NO: 157724 - DNA, 19 bp, Artificial sequence
  SiRNA target sequence
atggaatgcagaaaaaggc

SEQ ID NO: 157725 - DNA, 19 bp, Artificial sequence
  SiRNA target sequence
tggaatgcagaaaaaggcg

SEQ ID NO: 157726 - DNA, 19 bp, Artificial sequence
  SiRNA target sequence
ggaatgcagaaaaaggcgt

SEQ ID NO: 157727 - DNA, 19 bp, Artificial sequence
  SiRNA target sequence
gaatgcagaaaaaggcgta

SEQ ID NO: 157728 - DNA, 19 bp, Artificial sequence
  SiRNA target sequence
aatgcagaaaaaggcgtag

SEQ ID NO: 157729 - DNA, 19 bp, Artificial sequence
  SiRNA target sequence
atgcagaaaaaggcgtaga

SEQ ID NO: 157730 - DNA, 19 bp, Artificial sequence
  SiRNA target sequence
tgcagaaaaaggcgtagaa

SEQ ID NO: 157731 - DNA, 19 bp, Artificial sequence
  SiRNA target sequence
gcagaaaaaggcgtagaaa

SEQ ID NO: 157732 - DNA, 19 bp, Artificial sequence
  SiRNA target sequence
cagaaaaaggcgtagaaat

SEQ ID NO: 157733 - DNA, 19 bp, Artificial sequence
  SiRNA target sequence
agaaaaaggcgtagaaatg

SEQ ID NO: 157734 - DNA, 19 bp, Artificial sequence
  SiRNA target sequence
gaaaaaggcgtagaaatgg

SEQ ID NO: 157735 - DNA, 19 bp, Artificial sequence
  SiRNA target sequence
aaaaaggcgtagaaatggc

SEQ ID NO: 157736 - DNA, 19 bp, Artificial sequence
  SiRNA target sequence
aaaaggcgtagaaatggct

SEQ ID NO: 157737 - DNA, 19 bp, Artificial sequence
  SiRNA target sequence
aaaggcgtagaaatggctc

SEQ ID NO: 157738 - DNA, 19 bp, Artificial sequence
  SiRNA target sequence
aaggcgtagaaatggctcg

SEQ ID NO: 157739 - DNA, 19 bp, Artificial sequence
  SiRNA target sequence
aggcgtagaaatggctcga

SEQ ID NO: 157740 - DNA, 19 bp, Artificial sequence
  SiRNA target sequence
ggcgtagaaatggctcgaa

SEQ ID NO: 157741 - DNA, 19 bp, Artificial sequence
  SiRNA target sequence
gcgtagaaatggctcgaaa

SEQ ID NO: 157742 - DNA, 19 bp, Artificial sequence
  SiRNA target sequence
cgtagaaatggctcgaaag

SEQ ID NO: 157743 - DNA, 19 bp, Artificial sequence
  SiRNA target sequence
gtagaaatggctcgaaagc

SEQ ID NO: 157744 - DNA, 19 bp, Artificial sequence
  SiRNA target sequence
tagaaatggctcgaaagca

SEQ ID NO: 157745 - DNA, 19 bp, Artificial sequence
  SiRNA target sequence
agaaatggctcgaaagcaa

SEQ ID NO: 157746 - DNA, 19 bp, Artificial sequence
  SiRNA target sequence
gaaatggctcgaaagcaag

SEQ ID NO: 157747 - DNA, 19 bp, Artificial sequence
  SiRNA target sequence
aaatggctcgaaagcaagt

SEQ ID NO: 157748 - DNA, 19 bp, Artificial sequence
  SiRNA target sequence
aatggctcgaaagcaagta

SEQ ID NO: 157749 - DNA, 19 bp, Artificial sequence
  SiRNA target sequence
atggctcgaaagcaagtag

SEQ ID NO: 157750 - DNA, 19 bp, Artificial sequence
  SiRNA target sequence
tggctcgaaagcaagtagc

SEQ ID NO: 157751 - DNA, 19 bp, Artificial sequence
  SiRNA target sequence
ggctcgaaagcaagtagca

SEQ ID NO: 157752 - DNA, 19 bp, Artificial sequence
  SiRNA target sequence
gctcgaaagcaagtagcag

SEQ ID NO: 157753 - DNA, 19 bp, Artificial sequence
  SiRNA target sequence
ctcgaaagcaagtagcaga

SEQ ID NO: 157754 - DNA, 19 bp, Artificial sequence
  SiRNA target sequence
tcgaaagcaagtagcagat

SEQ ID NO: 157755 - DNA, 19 bp, Artificial sequence
  SiRNA target sequence
cgaaagcaagtagcagatt

SEQ ID NO: 157756 - DNA, 19 bp, Artificial sequence
  SiRNA target sequence
gaaagcaagtagcagattt

SEQ ID NO: 157757 - DNA, 19 bp, Artificial sequence
  SiRNA target sequence
aaagcaagtagcagattta

SEQ ID NO: 157758 - DNA, 19 bp, Artificial sequence
  SiRNA target sequence
aagcaagtagcagatttac

SEQ ID NO: 157759 - DNA, 19 bp, Artificial sequence
  SiRNA target sequence
agcaagtagcagatttact

SEQ ID NO: 157760 - DNA, 19 bp, Artificial sequence
  SiRNA target sequence
gcaagtagcagatttactg

SEQ ID NO: 157761 - DNA, 19 bp, Artificial sequence
  SiRNA target sequence
caagtagcagatttactga

SEQ ID NO: 157762 - DNA, 19 bp, Artificial sequence
  SiRNA target sequence
aagtagcagatttactgaa

SEQ ID NO: 157763 - DNA, 19 bp, Artificial sequence
  SiRNA target sequence
agtagcagatttactgaat

SEQ ID NO: 157764 - DNA, 19 bp, Artificial sequence
  SiRNA target sequence
gtagcagatttactgaatg

SEQ ID NO: 157765 - DNA, 19 bp, Artificial sequence
  SiRNA target sequence
tagcagatttactgaatgc

SEQ ID NO: 157766 - DNA, 19 bp, Artificial sequence
  SiRNA target sequence
agcagatttactgaatgcc

SEQ ID NO: 157767 - DNA, 19 bp, Artificial sequence
  SiRNA target sequence
gcagatttactgaatgcca

SEQ ID NO: 157768 - DNA, 19 bp, Artificial sequence
  SiRNA target sequence
cagatttactgaatgccaa

SEQ ID NO: 157769 - DNA, 19 bp, Artificial sequence
  SiRNA target sequence
agatttactgaatgccaat

SEQ ID NO: 157770 - DNA, 19 bp, Artificial sequence
  SiRNA target sequence
gatttactgaatgccaatg

SEQ ID NO: 157771 - DNA, 19 bp, Artificial sequence
  SiRNA target sequence
atttactgaatgccaatga

SEQ ID NO: 157772 - DNA, 19 bp, Artificial sequence
  SiRNA target sequence
tttactgaatgccaatgaa

SEQ ID NO: 157773 - DNA, 19 bp, Artificial sequence
  SiRNA target sequence
ttactgaatgccaatgaaa

SEQ ID NO: 157774 - DNA, 19 bp, Artificial sequence
  SiRNA target sequence
tactgaatgccaatgaaaa

SEQ ID NO: 157775 - DNA, 19 bp, Artificial sequence
  SiRNA target sequence
actgaatgccaatgaaaaa

SEQ ID NO: 157776 - DNA, 19 bp, Artificial sequence
  SiRNA target sequence
ctgaatgccaatgaaaaag

SEQ ID NO: 157777 - DNA, 19 bp, Artificial sequence
  SiRNA target sequence
tgaatgccaatgaaaaaga

SEQ ID NO: 157778 - DNA, 19 bp, Artificial sequence
  SiRNA target sequence
gaatgccaatgaaaaagaa

SEQ ID NO: 157779 - DNA, 19 bp, Artificial sequence
  SiRNA target sequence
aatgccaatgaaaaagaaa

SEQ ID NO: 157780 - DNA, 19 bp, Artificial sequence
  SiRNA target sequence
atgccaatgaaaaagaaat

SEQ ID NO: 157781 - DNA, 19 bp, Artificial sequence
  SiRNA target sequence
tgccaatgaaaaagaaatt

SEQ ID NO: 157782 - DNA, 19 bp, Artificial sequence
  SiRNA target sequence
gccaatgaaaaagaaatta

SEQ ID NO: 157783 - DNA, 19 bp, Artificial sequence
  SiRNA target sequence
ccaatgaaaaagaaattat

SEQ ID NO: 157784 - DNA, 19 bp, Artificial sequence
  SiRNA target sequence
caatgaaaaagaaattatt

SEQ ID NO: 157785 - DNA, 19 bp, Artificial sequence
  SiRNA target sequence
aatgaaaaagaaattattt

SEQ ID NO: 157786 - DNA, 19 bp, Artificial sequence
  SiRNA target sequence
atgaaaaagaaattatttt

SEQ ID NO: 157787 - DNA, 19 bp, Artificial sequence
  SiRNA target sequence
tgaaaaagaaattattttt

SEQ ID NO: 157788 - DNA, 19 bp, Artificial sequence
  SiRNA target sequence
gaaaaagaaattattttta

SEQ ID NO: 157789 - DNA, 19 bp, Artificial sequence
  SiRNA target sequence
aaaaagaaattatttttac

SEQ ID NO: 157790 - DNA, 19 bp, Artificial sequence
  SiRNA target sequence
aaaagaaattatttttact

SEQ ID NO: 157791 - DNA, 19 bp, Artificial sequence
  SiRNA target sequence
aaagaaattatttttacta

SEQ ID NO: 157792 - DNA, 19 bp, Artificial sequence
  SiRNA target sequence
aagaaattatttttactag

SEQ ID NO: 157793 - DNA, 19 bp, Artificial sequence
  SiRNA target sequence
agaaattatttttactagc

SEQ ID NO: 157794 - DNA, 19 bp, Artificial sequence
  SiRNA target sequence
gaaattatttttactagcg

SEQ ID NO: 157795 - DNA, 19 bp, Artificial sequence
  SiRNA target sequence
aaattatttttactagcgg

SEQ ID NO: 157796 - DNA, 19 bp, Artificial sequence
  SiRNA target sequence
aattatttttactagcggt

SEQ ID NO: 157797 - DNA, 19 bp, Artificial sequence
  SiRNA target sequence
attatttttactagcggtg

SEQ ID NO: 157798 - DNA, 19 bp, Artificial sequence
  SiRNA target sequence
ttatttttactagcggtgc

SEQ ID NO: 157799 - DNA, 19 bp, Artificial sequence
  SiRNA target sequence
tatttttactagcggtgct

SEQ ID NO: 157800 - DNA, 19 bp, Artificial sequence
  SiRNA target sequence
atttttactagcggtgcta

SEQ ID NO: 157801 - DNA, 19 bp, Artificial sequence
  SiRNA target sequence
tttttactagcggtgctac

SEQ ID NO: 157802 - DNA, 19 bp, Artificial sequence
  SiRNA target sequence
ttttactagcggtgctact

SEQ ID NO: 157803 - DNA, 19 bp, Artificial sequence
  SiRNA target sequence
tttactagcggtgctactg

SEQ ID NO: 157804 - DNA, 19 bp, Artificial sequence
  SiRNA target sequence
ttactagcggtgctactga

SEQ ID NO: 157805 - DNA, 19 bp, Artificial sequence
  SiRNA target sequence
tactagcggtgctactgag

SEQ ID NO: 157806 - DNA, 19 bp, Artificial sequence
  SiRNA target sequence
actagcggtgctactgaga

SEQ ID NO: 157807 - DNA, 19 bp, Artificial sequence
  SiRNA target sequence
ctagcggtgctactgagag

SEQ ID NO: 157808 - DNA, 19 bp, Artificial sequence
  SiRNA target sequence
tagcggtgctactgagagt

SEQ ID NO: 157809 - DNA, 19 bp, Artificial sequence
  SiRNA target sequence
agcggtgctactgagagta

SEQ ID NO: 157810 - DNA, 19 bp, Artificial sequence
  SiRNA target sequence
gcggtgctactgagagtaa

SEQ ID NO: 157811 - DNA, 19 bp, Artificial sequence
  SiRNA target sequence
cggtgctactgagagtaac

SEQ ID NO: 157812 - DNA, 19 bp, Artificial sequence
  SiRNA target sequence
ggtgctactgagagtaaca

SEQ ID NO: 157813 - DNA, 19 bp, Artificial sequence
  SiRNA target sequence
gtgctactgagagtaacaa

SEQ ID NO: 157814 - DNA, 19 bp, Artificial sequence
  SiRNA target sequence
tgctactgagagtaacaac

SEQ ID NO: 157815 - DNA, 19 bp, Artificial sequence
  SiRNA target sequence
gctactgagagtaacaacc

SEQ ID NO: 157816 - DNA, 19 bp, Artificial sequence
  SiRNA target sequence
ctactgagagtaacaacct

SEQ ID NO: 157817 - DNA, 19 bp, Artificial sequence
  SiRNA target sequence
tactgagagtaacaacctt

SEQ ID NO: 157818 - DNA, 19 bp, Artificial sequence
  SiRNA target sequence
actgagagtaacaaccttg

SEQ ID NO: 157819 - DNA, 19 bp, Artificial sequence
  SiRNA target sequence
ctgagagtaacaaccttgc

SEQ ID NO: 157820 - DNA, 19 bp, Artificial sequence
  SiRNA target sequence
tgagagtaacaaccttgca

SEQ ID NO: 157821 - DNA, 19 bp, Artificial sequence
  SiRNA target sequence
gagagtaacaaccttgcac

SEQ ID NO: 157822 - DNA, 19 bp, Artificial sequence
  SiRNA target sequence
agagtaacaaccttgcact

SEQ ID NO: 157823 - DNA, 19 bp, Artificial sequence
  SiRNA target sequence
gagtaacaaccttgcacta

SEQ ID NO: 157824 - DNA, 19 bp, Artificial sequence
  SiRNA target sequence
agtaacaaccttgcactaa

SEQ ID NO: 157825 - DNA, 19 bp, Artificial sequence
  SiRNA target sequence
gtaacaaccttgcactaaa

SEQ ID NO: 157826 - DNA, 19 bp, Artificial sequence
  SiRNA target sequence
taacaaccttgcactaaag

SEQ ID NO: 157827 - DNA, 19 bp, Artificial sequence
  SiRNA target sequence
aacaaccttgcactaaagg

SEQ ID NO: 157828 - DNA, 19 bp, Artificial sequence
  SiRNA target sequence
acaaccttgcactaaaggg

SEQ ID NO: 157829 - DNA, 19 bp, Artificial sequence
  SiRNA target sequence
caaccttgcactaaagggt

SEQ ID NO: 157830 - DNA, 19 bp, Artificial sequence
  SiRNA target sequence
aaccttgcactaaagggtg

SEQ ID NO: 157831 - DNA, 19 bp, Artificial sequence
  SiRNA target sequence
accttgcactaaagggtgt

SEQ ID NO: 157832 - DNA, 19 bp, Artificial sequence
  SiRNA target sequence
ccttgcactaaagggtgtc

SEQ ID NO: 157833 - DNA, 19 bp, Artificial sequence
  SiRNA target sequence
cttgcactaaagggtgtct

SEQ ID NO: 157834 - DNA, 19 bp, Artificial sequence
  SiRNA target sequence
ttgcactaaagggtgtctt

SEQ ID NO: 157835 - DNA, 19 bp, Artificial sequence
  SiRNA target sequence
tgcactaaagggtgtcttt

SEQ ID NO: 157836 - DNA, 19 bp, Artificial sequence
  SiRNA target sequence
gcactaaagggtgtctttg

SEQ ID NO: 157837 - DNA, 19 bp, Artificial sequence
  SiRNA target sequence
cactaaagggtgtctttgc

SEQ ID NO: 157838 - DNA, 19 bp, Artificial sequence
  SiRNA target sequence
actaaagggtgtctttgca

SEQ ID NO: 157839 - DNA, 19 bp, Artificial sequence
  SiRNA target sequence
ctaaagggtgtctttgcat

SEQ ID NO: 157840 - DNA, 19 bp, Artificial sequence
  SiRNA target sequence
taaagggtgtctttgcatt

SEQ ID NO: 157841 - DNA, 19 bp, Artificial sequence
  SiRNA target sequence
aaagggtgtctttgcattt

SEQ ID NO: 157842 - DNA, 19 bp, Artificial sequence
  SiRNA target sequence
aagggtgtctttgcatttt

SEQ ID NO: 157843 - DNA, 19 bp, Artificial sequence
  SiRNA target sequence
agggtgtctttgcattttt

SEQ ID NO: 157844 - DNA, 19 bp, Artificial sequence
  SiRNA target sequence
gggtgtctttgcattttta

SEQ ID NO: 157845 - DNA, 19 bp, Artificial sequence
  SiRNA target sequence
ggtgtctttgcatttttaa

SEQ ID NO: 157846 - DNA, 19 bp, Artificial sequence
  SiRNA target sequence
gtgtctttgcatttttaaa

SEQ ID NO: 157847 - DNA, 19 bp, Artificial sequence
  SiRNA target sequence
tgtctttgcatttttaaaa

SEQ ID NO: 157848 - DNA, 19 bp, Artificial sequence
  SiRNA target sequence
gtctttgcatttttaaaaa

SEQ ID NO: 157849 - DNA, 19 bp, Artificial sequence
  SiRNA target sequence
tctttgcatttttaaaaaa

SEQ ID NO: 157850 - DNA, 19 bp, Artificial sequence
  SiRNA target sequence
ctttgcatttttaaaaaaa

SEQ ID NO: 157851 - DNA, 19 bp, Artificial sequence
  SiRNA target sequence
tttgcatttttaaaaaaag

SEQ ID NO: 157852 - DNA, 19 bp, Artificial sequence
  SiRNA target sequence
ttgcatttttaaaaaaaga

SEQ ID NO: 157853 - DNA, 19 bp, Artificial sequence
  SiRNA target sequence
tgcatttttaaaaaaagac

SEQ ID NO: 157854 - DNA, 19 bp, Artificial sequence
  SiRNA target sequence
gcatttttaaaaaaagaca

SEQ ID NO: 157855 - DNA, 19 bp, Artificial sequence
  SiRNA target sequence
catttttaaaaaaagacaa

SEQ ID NO: 157856 - DNA, 19 bp, Artificial sequence
  SiRNA target sequence
atttttaaaaaaagacaat

SEQ ID NO: 157857 - DNA, 19 bp, Artificial sequence
  SiRNA target sequence
tttttaaaaaaagacaata

SEQ ID NO: 157858 - DNA, 19 bp, Artificial sequence
  SiRNA target sequence
ttttaaaaaaagacaatag

SEQ ID NO: 157859 - DNA, 19 bp, Artificial sequence
  SiRNA target sequence
tttaaaaaaagacaatagg

SEQ ID NO: 157860 - DNA, 19 bp, Artificial sequence
  SiRNA target sequence
ttaaaaaaagacaataggc

SEQ ID NO: 157861 - DNA, 19 bp, Artificial sequence
  SiRNA target sequence
taaaaaaagacaataggcc

SEQ ID NO: 157862 - DNA, 19 bp, Artificial sequence
  SiRNA target sequence
aaaaaaagacaataggcct

SEQ ID NO: 157863 - DNA, 19 bp, Artificial sequence
  SiRNA target sequence
aaaaaagacaataggcctg

SEQ ID NO: 157864 - DNA, 19 bp, Artificial sequence
  SiRNA target sequence
aaaaagacaataggcctgt

SEQ ID NO: 157865 - DNA, 19 bp, Artificial sequence
  SiRNA target sequence
aaaagacaataggcctgtt

SEQ ID NO: 157866 - DNA, 19 bp, Artificial sequence
  SiRNA target sequence
aaagacaataggcctgttc

SEQ ID NO: 157867 - DNA, 19 bp, Artificial sequence
  SiRNA target sequence
aagacaataggcctgttca

SEQ ID NO: 157868 - DNA, 19 bp, Artificial sequence
  SiRNA target sequence
agacaataggcctgttcat

SEQ ID NO: 157869 - DNA, 19 bp, Artificial sequence
  SiRNA target sequence
gacaataggcctgttcata

SEQ ID NO: 157870 - DNA, 19 bp, Artificial sequence
  SiRNA target sequence
acaataggcctgttcatat

SEQ ID NO: 157871 - DNA, 19 bp, Artificial sequence
  SiRNA target sequence
caataggcctgttcatatc

SEQ ID NO: 157872 - DNA, 19 bp, Artificial sequence
  SiRNA target sequence
aataggcctgttcatatca

SEQ ID NO: 157873 - DNA, 19 bp, Artificial sequence
  SiRNA target sequence
ataggcctgttcatatcat

SEQ ID NO: 157874 - DNA, 19 bp, Artificial sequence
  SiRNA target sequence
taggcctgttcatatcatt

SEQ ID NO: 157875 - DNA, 19 bp, Artificial sequence
  SiRNA target sequence
aggcctgttcatatcatta

SEQ ID NO: 157876 - DNA, 19 bp, Artificial sequence
  SiRNA target sequence
ggcctgttcatatcattac

SEQ ID NO: 157877 - DNA, 19 bp, Artificial sequence
  SiRNA target sequence
gcctgttcatatcattacc

SEQ ID NO: 157878 - DNA, 19 bp, Artificial sequence
  SiRNA target sequence
cctgttcatatcattacca

SEQ ID NO: 157879 - DNA, 19 bp, Artificial sequence
  SiRNA target sequence
ctgttcatatcattaccac

SEQ ID NO: 157880 - DNA, 19 bp, Artificial sequence
  SiRNA target sequence
tgttcatatcattaccaca

SEQ ID NO: 157881 - DNA, 19 bp, Artificial sequence
  SiRNA target sequence
gttcatatcattaccacac

SEQ ID NO: 157882 - DNA, 19 bp, Artificial sequence
  SiRNA target sequence
ttcatatcattaccacaca

SEQ ID NO: 157883 - DNA, 19 bp, Artificial sequence
  SiRNA target sequence
tcatatcattaccacacaa

SEQ ID NO: 157884 - DNA, 19 bp, Artificial sequence
  SiRNA target sequence
catatcattaccacacaaa

SEQ ID NO: 157885 - DNA, 19 bp, Artificial sequence
  SiRNA target sequence
atatcattaccacacaaat

SEQ ID NO: 157886 - DNA, 19 bp, Artificial sequence
  SiRNA target sequence
tatcattaccacacaaatt

SEQ ID NO: 157887 - DNA, 19 bp, Artificial sequence
  SiRNA target sequence
atcattaccacacaaattg

SEQ ID NO: 157888 - DNA, 19 bp, Artificial sequence
  SiRNA target sequence
tcattaccacacaaattga

SEQ ID NO: 157889 - DNA, 19 bp, Artificial sequence
  SiRNA target sequence
cattaccacacaaattgaa

SEQ ID NO: 157890 - DNA, 19 bp, Artificial sequence
  SiRNA target sequence
attaccacacaaattgaac

SEQ ID NO: 157891 - DNA, 19 bp, Artificial sequence
  SiRNA target sequence
ttaccacacaaattgaaca

SEQ ID NO: 157892 - DNA, 19 bp, Artificial sequence
  SiRNA target sequence
taccacacaaattgaacat

SEQ ID NO: 157893 - DNA, 19 bp, Artificial sequence
  SiRNA target sequence
accacacaaattgaacata

SEQ ID NO: 157894 - DNA, 19 bp, Artificial sequence
  SiRNA target sequence
ccacacaaattgaacataa

SEQ ID NO: 157895 - DNA, 19 bp, Artificial sequence
  SiRNA target sequence
cacacaaattgaacataaa

SEQ ID NO: 157896 - DNA, 19 bp, Artificial sequence
  SiRNA target sequence
acacaaattgaacataaat

SEQ ID NO: 157897 - DNA, 19 bp, Artificial sequence
  SiRNA target sequence
cacaaattgaacataaatg

SEQ ID NO: 157898 - DNA, 19 bp, Artificial sequence
  SiRNA target sequence
acaaattgaacataaatgt

SEQ ID NO: 157899 - DNA, 19 bp, Artificial sequence
  SiRNA target sequence
caaattgaacataaatgtg

SEQ ID NO: 157900 - DNA, 19 bp, Artificial sequence
  SiRNA target sequence
aaattgaacataaatgtgt

SEQ ID NO: 157901 - DNA, 19 bp, Artificial sequence
  SiRNA target sequence
aattgaacataaatgtgta

SEQ ID NO: 157902 - DNA, 19 bp, Artificial sequence
  SiRNA target sequence
attgaacataaatgtgtat

SEQ ID NO: 157903 - DNA, 19 bp, Artificial sequence
  SiRNA target sequence
ttgaacataaatgtgtatt

SEQ ID NO: 157904 - DNA, 19 bp, Artificial sequence
  SiRNA target sequence
tgaacataaatgtgtattg

SEQ ID NO: 157905 - DNA, 19 bp, Artificial sequence
  SiRNA target sequence
gaacataaatgtgtattgg

SEQ ID NO: 157906 - DNA, 19 bp, Artificial sequence
  SiRNA target sequence
aacataaatgtgtattgga

SEQ ID NO: 157907 - DNA, 19 bp, Artificial sequence
  SiRNA target sequence
acataaatgtgtattggac

SEQ ID NO: 157908 - DNA, 19 bp, Artificial sequence
  SiRNA target sequence
cataaatgtgtattggaca

SEQ ID NO: 157909 - DNA, 19 bp, Artificial sequence
  SiRNA target sequence
ataaatgtgtattggacac

SEQ ID NO: 157910 - DNA, 19 bp, Artificial sequence
  SiRNA target sequence
taaatgtgtattggacaca

SEQ ID NO: 157911 - DNA, 19 bp, Artificial sequence
  SiRNA target sequence
aaatgtgtattggacacat

SEQ ID NO: 157912 - DNA, 19 bp, Artificial sequence
  SiRNA target sequence
aatgtgtattggacacatg

SEQ ID NO: 157913 - DNA, 19 bp, Artificial sequence
  SiRNA target sequence
atgtgtattggacacatgt

SEQ ID NO: 157914 - DNA, 19 bp, Artificial sequence
  SiRNA target sequence
tgtgtattggacacatgta

SEQ ID NO: 157915 - DNA, 19 bp, Artificial sequence
  SiRNA target sequence
gtgtattggacacatgtag

SEQ ID NO: 157916 - DNA, 19 bp, Artificial sequence
  SiRNA target sequence
tgtattggacacatgtaga

SEQ ID NO: 157917 - DNA, 19 bp, Artificial sequence
  SiRNA target sequence
gtattggacacatgtagaa

SEQ ID NO: 157918 - DNA, 19 bp, Artificial sequence
  SiRNA target sequence
tattggacacatgtagaag

SEQ ID NO: 157919 - DNA, 19 bp, Artificial sequence
  SiRNA target sequence
attggacacatgtagaaga

SEQ ID NO: 157920 - DNA, 19 bp, Artificial sequence
  SiRNA target sequence
ttggacacatgtagaagat

SEQ ID NO: 157921 - DNA, 19 bp, Artificial sequence
  SiRNA target sequence
tggacacatgtagaagatt

SEQ ID NO: 157922 - DNA, 19 bp, Artificial sequence
  SiRNA target sequence
ggacacatgtagaagatta

SEQ ID NO: 157923 - DNA, 19 bp, Artificial sequence
  SiRNA target sequence
gacacatgtagaagattag

SEQ ID NO: 157924 - DNA, 19 bp, Artificial sequence
  SiRNA target sequence
acacatgtagaagattaga

SEQ ID NO: 157925 - DNA, 19 bp, Artificial sequence
  SiRNA target sequence
cacatgtagaagattagaa

SEQ ID NO: 157926 - DNA, 19 bp, Artificial sequence
  SiRNA target sequence
acatgtagaagattagaag

SEQ ID NO: 157927 - DNA, 19 bp, Artificial sequence
  SiRNA target sequence
catgtagaagattagaaga

SEQ ID NO: 157928 - DNA, 19 bp, Artificial sequence
  SiRNA target sequence
atgtagaagattagaagaa

SEQ ID NO: 157929 - DNA, 19 bp, Artificial sequence
  SiRNA target sequence
tgtagaagattagaagaag

SEQ ID NO: 157930 - DNA, 19 bp, Artificial sequence
  SiRNA target sequence
gtagaagattagaagaaga

SEQ ID NO: 157931 - DNA, 19 bp, Artificial sequence
  SiRNA target sequence
tagaagattagaagaagaa

SEQ ID NO: 157932 - DNA, 19 bp, Artificial sequence
  SiRNA target sequence
agaagattagaagaagaag

SEQ ID NO: 157933 - DNA, 19 bp, Artificial sequence
  SiRNA target sequence
gaagattagaagaagaagg

SEQ ID NO: 157934 - DNA, 19 bp, Artificial sequence
  SiRNA target sequence
aagattagaagaagaagga

SEQ ID NO: 157935 - DNA, 19 bp, Artificial sequence
  SiRNA target sequence
agattagaagaagaaggag

SEQ ID NO: 157936 - DNA, 19 bp, Artificial sequence
  SiRNA target sequence
gattagaagaagaaggagc

SEQ ID NO: 157937 - DNA, 19 bp, Artificial sequence
  SiRNA target sequence
attagaagaagaaggagct

SEQ ID NO: 157938 - DNA, 19 bp, Artificial sequence
  SiRNA target sequence
ttagaagaagaaggagcta

SEQ ID NO: 157939 - DNA, 19 bp, Artificial sequence
  SiRNA target sequence
tagaagaagaaggagctac

SEQ ID NO: 157940 - DNA, 19 bp, Artificial sequence
  SiRNA target sequence
agaagaagaaggagctaca

SEQ ID NO: 157941 - DNA, 19 bp, Artificial sequence
  SiRNA target sequence
gaagaagaaggagctacag

SEQ ID NO: 157942 - DNA, 19 bp, Artificial sequence
  SiRNA target sequence
aagaagaaggagctacagt

SEQ ID NO: 157943 - DNA, 19 bp, Artificial sequence
  SiRNA target sequence
agaagaaggagctacagtg

SEQ ID NO: 157944 - DNA, 19 bp, Artificial sequence
  SiRNA target sequence
gaagaaggagctacagtga

SEQ ID NO: 157945 - DNA, 19 bp, Artificial sequence
  SiRNA target sequence
aagaaggagctacagtgac

SEQ ID NO: 157946 - DNA, 19 bp, Artificial sequence
  SiRNA target sequence
agaaggagctacagtgact

SEQ ID NO: 157947 - DNA, 19 bp, Artificial sequence
  SiRNA target sequence
gaaggagctacagtgactt

SEQ ID NO: 157948 - DNA, 19 bp, Artificial sequence
  SiRNA target sequence
aaggagctacagtgactta

SEQ ID NO: 157949 - DNA, 19 bp, Artificial sequence
  SiRNA target sequence
aggagctacagtgacttat

SEQ ID NO: 157950 - DNA, 19 bp, Artificial sequence
  SiRNA target sequence
ggagctacagtgacttatt

SEQ ID NO: 157951 - DNA, 19 bp, Artificial sequence
  SiRNA target sequence
gagctacagtgacttattt

SEQ ID NO: 157952 - DNA, 19 bp, Artificial sequence
  SiRNA target sequence
agctacagtgacttatttg

SEQ ID NO: 157953 - DNA, 19 bp, Artificial sequence
  SiRNA target sequence
gctacagtgacttatttgc

SEQ ID NO: 157954 - DNA, 19 bp, Artificial sequence
  SiRNA target sequence
ctacagtgacttatttgcc

SEQ ID NO: 157955 - DNA, 19 bp, Artificial sequence
  SiRNA target sequence
tacagtgacttatttgcct

SEQ ID NO: 157956 - DNA, 19 bp, Artificial sequence
  SiRNA target sequence
acagtgacttatttgcctg

SEQ ID NO: 157957 - DNA, 19 bp, Artificial sequence
  SiRNA target sequence
cagtgacttatttgcctgt

SEQ ID NO: 157958 - DNA, 19 bp, Artificial sequence
  SiRNA target sequence
agtgacttatttgcctgta

SEQ ID NO: 157959 - DNA, 19 bp, Artificial sequence
  SiRNA target sequence
gtgacttatttgcctgtag

SEQ ID NO: 157960 - DNA, 19 bp, Artificial sequence
  SiRNA target sequence
tgacttatttgcctgtaga

SEQ ID NO: 157961 - DNA, 19 bp, Artificial sequence
  SiRNA target sequence
gacttatttgcctgtagat

SEQ ID NO: 157962 - DNA, 19 bp, Artificial sequence
  SiRNA target sequence
acttatttgcctgtagata

SEQ ID NO: 157963 - DNA, 19 bp, Artificial sequence
  SiRNA target sequence
cttatttgcctgtagataa

SEQ ID NO: 157964 - DNA, 19 bp, Artificial sequence
  SiRNA target sequence
ttatttgcctgtagataaa

SEQ ID NO: 157965 - DNA, 19 bp, Artificial sequence
  SiRNA target sequence
tatttgcctgtagataaaa

SEQ ID NO: 157966 - DNA, 19 bp, Artificial sequence
  SiRNA target sequence
atttgcctgtagataaaaa

SEQ ID NO: 157967 - DNA, 19 bp, Artificial sequence
  SiRNA target sequence
tttgcctgtagataaaaat

SEQ ID NO: 157968 - DNA, 19 bp, Artificial sequence
  SiRNA target sequence
ttgcctgtagataaaaatg

SEQ ID NO: 157969 - DNA, 19 bp, Artificial sequence
  SiRNA target sequence
tgcctgtagataaaaatgg

SEQ ID NO: 157970 - DNA, 19 bp, Artificial sequence
  SiRNA target sequence
gcctgtagataaaaatgga

SEQ ID NO: 157971 - DNA, 19 bp, Artificial sequence
  SiRNA target sequence
cctgtagataaaaatggaa

SEQ ID NO: 157972 - DNA, 19 bp, Artificial sequence
  SiRNA target sequence
ctgtagataaaaatggaat

SEQ ID NO: 157973 - DNA, 19 bp, Artificial sequence
  SiRNA target sequence
tgtagataaaaatggaata

SEQ ID NO: 157974 - DNA, 19 bp, Artificial sequence
  SiRNA target sequence
gtagataaaaatggaatag

SEQ ID NO: 157975 - DNA, 19 bp, Artificial sequence
  SiRNA target sequence
tagataaaaatggaatagt

SEQ ID NO: 157976 - DNA, 19 bp, Artificial sequence
  SiRNA target sequence
agataaaaatggaatagta

SEQ ID NO: 157977 - DNA, 19 bp, Artificial sequence
  SiRNA target sequence
gataaaaatggaatagtag

SEQ ID NO: 157978 - DNA, 19 bp, Artificial sequence
  SiRNA target sequence
ataaaaatggaatagtaga

SEQ ID NO: 157979 - DNA, 19 bp, Artificial sequence
  SiRNA target sequence
taaaaatggaatagtagat

SEQ ID NO: 157980 - DNA, 19 bp, Artificial sequence
  SiRNA target sequence
aaaaatggaatagtagatc

SEQ ID NO: 157981 - DNA, 19 bp, Artificial sequence
  SiRNA target sequence
aaaatggaatagtagatcc

SEQ ID NO: 157982 - DNA, 19 bp, Artificial sequence
  SiRNA target sequence
aaatggaatagtagatccg

SEQ ID NO: 157983 - DNA, 19 bp, Artificial sequence
  SiRNA target sequence
aatggaatagtagatccgc

SEQ ID NO: 157984 - DNA, 19 bp, Artificial sequence
  SiRNA target sequence
atggaatagtagatccgca

SEQ ID NO: 157985 - DNA, 19 bp, Artificial sequence
  SiRNA target sequence
tggaatagtagatccgcaa

SEQ ID NO: 157986 - DNA, 19 bp, Artificial sequence
  SiRNA target sequence
ggaatagtagatccgcaat

SEQ ID NO: 157987 - DNA, 19 bp, Artificial sequence
  SiRNA target sequence
gaatagtagatccgcaatt

SEQ ID NO: 157988 - DNA, 19 bp, Artificial sequence
  SiRNA target sequence
aatagtagatccgcaatta

SEQ ID NO: 157989 - DNA, 19 bp, Artificial sequence
  SiRNA target sequence
atagtagatccgcaattaa

SEQ ID NO: 157990 - DNA, 19 bp, Artificial sequence
  SiRNA target sequence
tagtagatccgcaattaat

SEQ ID NO: 157991 - DNA, 19 bp, Artificial sequence
  SiRNA target sequence
agtagatccgcaattaata

SEQ ID NO: 157992 - DNA, 19 bp, Artificial sequence
  SiRNA target sequence
gtagatccgcaattaataa

SEQ ID NO: 157993 - DNA, 19 bp, Artificial sequence
  SiRNA target sequence
tagatccgcaattaataaa

SEQ ID NO: 157994 - DNA, 19 bp, Artificial sequence
  SiRNA target sequence
agatccgcaattaataaaa

SEQ ID NO: 157995 - DNA, 19 bp, Artificial sequence
  SiRNA target sequence
gatccgcaattaataaaaa

SEQ ID NO: 157996 - DNA, 19 bp, Artificial sequence
  SiRNA target sequence
atccgcaattaataaaaaa

SEQ ID NO: 157997 - DNA, 19 bp, Artificial sequence
  SiRNA target sequence
tccgcaattaataaaaaac

SEQ ID NO: 157998 - DNA, 19 bp, Artificial sequence
  SiRNA target sequence
ccgcaattaataaaaaaca

SEQ ID NO: 157999 - DNA, 19 bp, Artificial sequence
  SiRNA target sequence
cgcaattaataaaaaacag

SEQ ID NO: 158000 - DNA, 19 bp, Artificial sequence
  SiRNA target sequence
gcaattaataaaaaacagt

SEQ ID NO: 158001 - DNA, 19 bp, Artificial sequence
  SiRNA target sequence
caattaataaaaaacagta

SEQ ID NO: 158002 - DNA, 19 bp, Artificial sequence
  SiRNA target sequence
aattaataaaaaacagtat

SEQ ID NO: 158003 - DNA, 19 bp, Artificial sequence
  SiRNA target sequence
attaataaaaaacagtatt

SEQ ID NO: 158004 - DNA, 19 bp, Artificial sequence
  SiRNA target sequence
ttaataaaaaacagtatta

SEQ ID NO: 158005 - DNA, 19 bp, Artificial sequence
  SiRNA target sequence
taataaaaaacagtattac

SEQ ID NO: 158006 - DNA, 19 bp, Artificial sequence
  SiRNA target sequence
aataaaaaacagtattact

SEQ ID NO: 158007 - DNA, 19 bp, Artificial sequence
  SiRNA target sequence
ataaaaaacagtattacta

SEQ ID NO: 158008 - DNA, 19 bp, Artificial sequence
  SiRNA target sequence
taaaaaacagtattactaa

SEQ ID NO: 158009 - DNA, 19 bp, Artificial sequence
  SiRNA target sequence
aaaaaacagtattactaaa

SEQ ID NO: 158010 - DNA, 19 bp, Artificial sequence
  SiRNA target sequence
aaaaacagtattactaaag

SEQ ID NO: 158011 - DNA, 19 bp, Artificial sequence
  SiRNA target sequence
aaaacagtattactaaaga

SEQ ID NO: 158012 - DNA, 19 bp, Artificial sequence
  SiRNA target sequence
aaacagtattactaaagat

SEQ ID NO: 158013 - DNA, 19 bp, Artificial sequence
  SiRNA target sequence
aacagtattactaaagata

SEQ ID NO: 158014 - DNA, 19 bp, Artificial sequence
  SiRNA target sequence
acagtattactaaagatac

SEQ ID NO: 158015 - DNA, 19 bp, Artificial sequence
  SiRNA target sequence
cagtattactaaagatacc

SEQ ID NO: 158016 - DNA, 19 bp, Artificial sequence
  SiRNA target sequence
agtattactaaagataccg

SEQ ID NO: 158017 - DNA, 19 bp, Artificial sequence
  SiRNA target sequence
gtattactaaagataccgc

SEQ ID NO: 158018 - DNA, 19 bp, Artificial sequence
  SiRNA target sequence
tattactaaagataccgct

SEQ ID NO: 158019 - DNA, 19 bp, Artificial sequence
  SiRNA target sequence
attactaaagataccgctt

SEQ ID NO: 158020 - DNA, 19 bp, Artificial sequence
  SiRNA target sequence
ttactaaagataccgcttt

SEQ ID NO: 158021 - DNA, 19 bp, Artificial sequence
  SiRNA target sequence
tactaaagataccgctttg

SEQ ID NO: 158022 - DNA, 19 bp, Artificial sequence
  SiRNA target sequence
actaaagataccgctttgg

SEQ ID NO: 158023 - DNA, 19 bp, Artificial sequence
  SiRNA target sequence
ctaaagataccgctttggt

SEQ ID NO: 158024 - DNA, 19 bp, Artificial sequence
  SiRNA target sequence
taaagataccgctttggtg

SEQ ID NO: 158025 - DNA, 19 bp, Artificial sequence
  SiRNA target sequence
aaagataccgctttggtgt

SEQ ID NO: 158026 - DNA, 19 bp, Artificial sequence
  SiRNA target sequence
aagataccgctttggtgtc

SEQ ID NO: 158027 - DNA, 19 bp, Artificial sequence
  SiRNA target sequence
agataccgctttggtgtct

SEQ ID NO: 158028 - DNA, 19 bp, Artificial sequence
  SiRNA target sequence
gataccgctttggtgtctg

SEQ ID NO: 158029 - DNA, 19 bp, Artificial sequence
  SiRNA target sequence
ataccgctttggtgtctgt

SEQ ID NO: 158030 - DNA, 19 bp, Artificial sequence
  SiRNA target sequence
taccgctttggtgtctgtt

SEQ ID NO: 158031 - DNA, 19 bp, Artificial sequence
  SiRNA target sequence
accgctttggtgtctgtta

SEQ ID NO: 158032 - DNA, 19 bp, Artificial sequence
  SiRNA target sequence
ccgctttggtgtctgttat

SEQ ID NO: 158033 - DNA, 19 bp, Artificial sequence
  SiRNA target sequence
cgctttggtgtctgttatg

SEQ ID NO: 158034 - DNA, 19 bp, Artificial sequence
  SiRNA target sequence
gctttggtgtctgttatgg

SEQ ID NO: 158035 - DNA, 19 bp, Artificial sequence
  SiRNA target sequence
ctttggtgtctgttatggc

SEQ ID NO: 158036 - DNA, 19 bp, Artificial sequence
  SiRNA target sequence
tttggtgtctgttatggct

SEQ ID NO: 158037 - DNA, 19 bp, Artificial sequence
  SiRNA target sequence
ttggtgtctgttatggctg

SEQ ID NO: 158038 - DNA, 19 bp, Artificial sequence
  SiRNA target sequence
tggtgtctgttatggctgt

SEQ ID NO: 158039 - DNA, 19 bp, Artificial sequence
  SiRNA target sequence
ggtgtctgttatggctgtt

SEQ ID NO: 158040 - DNA, 19 bp, Artificial sequence
  SiRNA target sequence
gtgtctgttatggctgtta

SEQ ID NO: 158041 - DNA, 19 bp, Artificial sequence
  SiRNA target sequence
tgtctgttatggctgttaa

SEQ ID NO: 158042 - DNA, 19 bp, Artificial sequence
  SiRNA target sequence
gtctgttatggctgttaac

SEQ ID NO: 158043 - DNA, 19 bp, Artificial sequence
  SiRNA target sequence
tctgttatggctgttaaca

SEQ ID NO: 158044 - DNA, 19 bp, Artificial sequence
  SiRNA target sequence
ctgttatggctgttaacaa

SEQ ID NO: 158045 - DNA, 19 bp, Artificial sequence
  SiRNA target sequence
tgttatggctgttaacaac

SEQ ID NO: 158046 - DNA, 19 bp, Artificial sequence
  SiRNA target sequence
gttatggctgttaacaacg

SEQ ID NO: 158047 - DNA, 19 bp, Artificial sequence
  SiRNA target sequence
ttatggctgttaacaacga

SEQ ID NO: 158048 - DNA, 19 bp, Artificial sequence
  SiRNA target sequence
tatggctgttaacaacgaa

SEQ ID NO: 158049 - DNA, 19 bp, Artificial sequence
  SiRNA target sequence
atggctgttaacaacgaaa

SEQ ID NO: 158050 - DNA, 19 bp, Artificial sequence
  SiRNA target sequence
tggctgttaacaacgaaat

SEQ ID NO: 158051 - DNA, 19 bp, Artificial sequence
  SiRNA target sequence
ggctgttaacaacgaaatg

SEQ ID NO: 158052 - DNA, 19 bp, Artificial sequence
  SiRNA target sequence
gctgttaacaacgaaatgg

SEQ ID NO: 158053 - DNA, 19 bp, Artificial sequence
  SiRNA target sequence
ctgttaacaacgaaatggg

SEQ ID NO: 158054 - DNA, 19 bp, Artificial sequence
  SiRNA target sequence
tgttaacaacgaaatggga

SEQ ID NO: 158055 - DNA, 19 bp, Artificial sequence
  SiRNA target sequence
gttaacaacgaaatgggag

SEQ ID NO: 158056 - DNA, 19 bp, Artificial sequence
  SiRNA target sequence
ttaacaacgaaatgggagc

SEQ ID NO: 158057 - DNA, 19 bp, Artificial sequence
  SiRNA target sequence
taacaacgaaatgggagca

SEQ ID NO: 158058 - DNA, 19 bp, Artificial sequence
  SiRNA target sequence
aacaacgaaatgggagcaa

SEQ ID NO: 158059 - DNA, 19 bp, Artificial sequence
  SiRNA target sequence
acaacgaaatgggagcaat

SEQ ID NO: 158060 - DNA, 19 bp, Artificial sequence
  SiRNA target sequence
caacgaaatgggagcaata

SEQ ID NO: 158061 - DNA, 19 bp, Artificial sequence
  SiRNA target sequence
aacgaaatgggagcaatac

SEQ ID NO: 158062 - DNA, 19 bp, Artificial sequence
  SiRNA target sequence
acgaaatgggagcaataca

SEQ ID NO: 158063 - DNA, 19 bp, Artificial sequence
  SiRNA target sequence
cgaaatgggagcaatacaa

SEQ ID NO: 158064 - DNA, 19 bp, Artificial sequence
  SiRNA target sequence
gaaatgggagcaatacaac

SEQ ID NO: 158065 - DNA, 19 bp, Artificial sequence
  SiRNA target sequence
aaatgggagcaatacaacc

SEQ ID NO: 158066 - DNA, 19 bp, Artificial sequence
  SiRNA target sequence
aatgggagcaatacaaccg

SEQ ID NO: 158067 - DNA, 19 bp, Artificial sequence
  SiRNA target sequence
atgggagcaatacaaccgc

SEQ ID NO: 158068 - DNA, 19 bp, Artificial sequence
  SiRNA target sequence
tgggagcaatacaaccgct

SEQ ID NO: 158069 - DNA, 19 bp, Artificial sequence
  SiRNA target sequence
gggagcaatacaaccgctt

SEQ ID NO: 158070 - DNA, 19 bp, Artificial sequence
  SiRNA target sequence
ggagcaatacaaccgctta

SEQ ID NO: 158071 - DNA, 19 bp, Artificial sequence
  SiRNA target sequence
gagcaatacaaccgcttaa

SEQ ID NO: 158072 - DNA, 19 bp, Artificial sequence
  SiRNA target sequence
agcaatacaaccgcttaaa

SEQ ID NO: 158073 - DNA, 19 bp, Artificial sequence
  SiRNA target sequence
gcaatacaaccgcttaaag

SEQ ID NO: 158074 - DNA, 19 bp, Artificial sequence
  SiRNA target sequence
caatacaaccgcttaaaga

SEQ ID NO: 158075 - DNA, 19 bp, Artificial sequence
  SiRNA target sequence
aatacaaccgcttaaagaa

SEQ ID NO: 158076 - DNA, 19 bp, Artificial sequence
  SiRNA target sequence
atacaaccgcttaaagaaa

SEQ ID NO: 158077 - DNA, 19 bp, Artificial sequence
  SiRNA target sequence
tacaaccgcttaaagaaat

SEQ ID NO: 158078 - DNA, 19 bp, Artificial sequence
  SiRNA target sequence
acaaccgcttaaagaaata

SEQ ID NO: 158079 - DNA, 19 bp, Artificial sequence
  SiRNA target sequence
caaccgcttaaagaaatag

SEQ ID NO: 158080 - DNA, 19 bp, Artificial sequence
  SiRNA target sequence
aaccgcttaaagaaatagg

SEQ ID NO: 158081 - DNA, 19 bp, Artificial sequence
  SiRNA target sequence
accgcttaaagaaatagga

SEQ ID NO: 158082 - DNA, 19 bp, Artificial sequence
  SiRNA target sequence
ccgcttaaagaaataggaa

SEQ ID NO: 158083 - DNA, 19 bp, Artificial sequence
  SiRNA target sequence
cgcttaaagaaataggaag

SEQ ID NO: 158084 - DNA, 19 bp, Artificial sequence
  SiRNA target sequence
gcttaaagaaataggaaga

SEQ ID NO: 158085 - DNA, 19 bp, Artificial sequence
  SiRNA target sequence
cttaaagaaataggaagaa

SEQ ID NO: 158086 - DNA, 19 bp, Artificial sequence
  SiRNA target sequence
ttaaagaaataggaagaat

SEQ ID NO: 158087 - DNA, 19 bp, Artificial sequence
  SiRNA target sequence
taaagaaataggaagaata

SEQ ID NO: 158088 - DNA, 19 bp, Artificial sequence
  SiRNA target sequence
aaagaaataggaagaatat

SEQ ID NO: 158089 - DNA, 19 bp, Artificial sequence
  SiRNA target sequence
aagaaataggaagaatatg

SEQ ID NO: 158090 - DNA, 19 bp, Artificial sequence
  SiRNA target sequence
agaaataggaagaatatgt

SEQ ID NO: 158091 - DNA, 19 bp, Artificial sequence
  SiRNA target sequence
gaaataggaagaatatgta

SEQ ID NO: 158092 - DNA, 19 bp, Artificial sequence
  SiRNA target sequence
aaataggaagaatatgtaa

SEQ ID NO: 158093 - DNA, 19 bp, Artificial sequence
  SiRNA target sequence
aataggaagaatatgtaaa

SEQ ID NO: 158094 - DNA, 19 bp, Artificial sequence
  SiRNA target sequence
ataggaagaatatgtaaag

SEQ ID NO: 158095 - DNA, 19 bp, Artificial sequence
  SiRNA target sequence
taggaagaatatgtaaaga

SEQ ID NO: 158096 - DNA, 19 bp, Artificial sequence
  SiRNA target sequence
aggaagaatatgtaaagaa

SEQ ID NO: 158097 - DNA, 19 bp, Artificial sequence
  SiRNA target sequence
ggaagaatatgtaaagaaa

SEQ ID NO: 158098 - DNA, 19 bp, Artificial sequence
  SiRNA target sequence
gaagaatatgtaaagaaaa

SEQ ID NO: 158099 - DNA, 19 bp, Artificial sequence
  SiRNA target sequence
aagaatatgtaaagaaaat

SEQ ID NO: 158100 - DNA, 19 bp, Artificial sequence
  SiRNA target sequence
agaatatgtaaagaaaata

SEQ ID NO: 158101 - DNA, 19 bp, Artificial sequence
  SiRNA target sequence
gaatatgtaaagaaaataa

SEQ ID NO: 158102 - DNA, 19 bp, Artificial sequence
  SiRNA target sequence
aatatgtaaagaaaataat

SEQ ID NO: 158103 - DNA, 19 bp, Artificial sequence
  SiRNA target sequence
atatgtaaagaaaataata

SEQ ID NO: 158104 - DNA, 19 bp, Artificial sequence
  SiRNA target sequence
tatgtaaagaaaataatat

SEQ ID NO: 158105 - DNA, 19 bp, Artificial sequence
  SiRNA target sequence
atgtaaagaaaataatatt

SEQ ID NO: 158106 - DNA, 19 bp, Artificial sequence
  SiRNA target sequence
tgtaaagaaaataatattt

SEQ ID NO: 158107 - DNA, 19 bp, Artificial sequence
  SiRNA target sequence
gtaaagaaaataatatttt

SEQ ID NO: 158108 - DNA, 19 bp, Artificial sequence
  SiRNA target sequence
taaagaaaataatatttta

SEQ ID NO: 158109 - DNA, 19 bp, Artificial sequence
  SiRNA target sequence
aaagaaaataatattttat

SEQ ID NO: 158110 - DNA, 19 bp, Artificial sequence
  SiRNA target sequence
aagaaaataatattttatt

SEQ ID NO: 158111 - DNA, 19 bp, Artificial sequence
  SiRNA target sequence
agaaaataatattttattt

SEQ ID NO: 158112 - DNA, 19 bp, Artificial sequence
  SiRNA target sequence
gaaaataatattttatttc

SEQ ID NO: 158113 - DNA, 19 bp, Artificial sequence
  SiRNA target sequence
aaaataatattttatttca

SEQ ID NO: 158114 - DNA, 19 bp, Artificial sequence
  SiRNA target sequence
aaataatattttatttcac

SEQ ID NO: 158115 - DNA, 19 bp, Artificial sequence
  SiRNA target sequence
aataatattttatttcaca

SEQ ID NO: 158116 - DNA, 19 bp, Artificial sequence
  SiRNA target sequence
ataatattttatttcacac

SEQ ID NO: 158117 - DNA, 19 bp, Artificial sequence
  SiRNA target sequence
taatattttatttcacact

SEQ ID NO: 158118 - DNA, 19 bp, Artificial sequence
  SiRNA target sequence
aatattttatttcacactg

SEQ ID NO: 158119 - DNA, 19 bp, Artificial sequence
  SiRNA target sequence
atattttatttcacactga

SEQ ID NO: 158120 - DNA, 19 bp, Artificial sequence
  SiRNA target sequence
tattttatttcacactgat

SEQ ID NO: 158121 - DNA, 19 bp, Artificial sequence
  SiRNA target sequence
attttatttcacactgatg

SEQ ID NO: 158122 - DNA, 19 bp, Artificial sequence
  SiRNA target sequence
ttttatttcacactgatgc

SEQ ID NO: 158123 - DNA, 19 bp, Artificial sequence
  SiRNA target sequence
tttatttcacactgatgca

SEQ ID NO: 158124 - DNA, 19 bp, Artificial sequence
  SiRNA target sequence
ttatttcacactgatgcag

SEQ ID NO: 158125 - DNA, 19 bp, Artificial sequence
  SiRNA target sequence
tatttcacactgatgcagc

SEQ ID NO: 158126 - DNA, 19 bp, Artificial sequence
  SiRNA target sequence
atttcacactgatgcagca

SEQ ID NO: 158127 - DNA, 19 bp, Artificial sequence
  SiRNA target sequence
tttcacactgatgcagcac

SEQ ID NO: 158128 - DNA, 19 bp, Artificial sequence
  SiRNA target sequence
ttcacactgatgcagcaca

SEQ ID NO: 158129 - DNA, 19 bp, Artificial sequence
  SiRNA target sequence
tcacactgatgcagcacaa

SEQ ID NO: 158130 - DNA, 19 bp, Artificial sequence
  SiRNA target sequence
cacactgatgcagcacaag

SEQ ID NO: 158131 - DNA, 19 bp, Artificial sequence
  SiRNA target sequence
acactgatgcagcacaagc

SEQ ID NO: 158132 - DNA, 19 bp, Artificial sequence
  SiRNA target sequence
cactgatgcagcacaagca

SEQ ID NO: 158133 - DNA, 19 bp, Artificial sequence
  SiRNA target sequence
actgatgcagcacaagcag

SEQ ID NO: 158134 - DNA, 19 bp, Artificial sequence
  SiRNA target sequence
ctgatgcagcacaagcagt

SEQ ID NO: 158135 - DNA, 19 bp, Artificial sequence
  SiRNA target sequence
tgatgcagcacaagcagtt

SEQ ID NO: 158136 - DNA, 19 bp, Artificial sequence
  SiRNA target sequence
gatgcagcacaagcagttg

SEQ ID NO: 158137 - DNA, 19 bp, Artificial sequence
  SiRNA target sequence
atgcagcacaagcagttgg

SEQ ID NO: 158138 - DNA, 19 bp, Artificial sequence
  SiRNA target sequence
tgcagcacaagcagttggt

SEQ ID NO: 158139 - DNA, 19 bp, Artificial sequence
  SiRNA target sequence
gcagcacaagcagttggta

SEQ ID NO: 158140 - DNA, 19 bp, Artificial sequence
  SiRNA target sequence
cagcacaagcagttggtaa

SEQ ID NO: 158141 - DNA, 19 bp, Artificial sequence
  SiRNA target sequence
agcacaagcagttggtaat

SEQ ID NO: 158142 - DNA, 19 bp, Artificial sequence
  SiRNA target sequence
gcacaagcagttggtaata

SEQ ID NO: 158143 - DNA, 19 bp, Artificial sequence
  SiRNA target sequence
cacaagcagttggtaatat

SEQ ID NO: 158144 - DNA, 19 bp, Artificial sequence
  SiRNA target sequence
acaagcagttggtaatata

SEQ ID NO: 158145 - DNA, 19 bp, Artificial sequence
  SiRNA target sequence
caagcagttggtaatatag

SEQ ID NO: 158146 - DNA, 19 bp, Artificial sequence
  SiRNA target sequence
aagcagttggtaatataga

SEQ ID NO: 158147 - DNA, 19 bp, Artificial sequence
  SiRNA target sequence
agcagttggtaatatagat

SEQ ID NO: 158148 - DNA, 19 bp, Artificial sequence
  SiRNA target sequence
gcagttggtaatatagata

SEQ ID NO: 158149 - DNA, 19 bp, Artificial sequence
  SiRNA target sequence
cagttggtaatatagatat

SEQ ID NO: 158150 - DNA, 19 bp, Artificial sequence
  SiRNA target sequence
agttggtaatatagatatt

SEQ ID NO: 158151 - DNA, 19 bp, Artificial sequence
  SiRNA target sequence
gttggtaatatagatattg

SEQ ID NO: 158152 - DNA, 19 bp, Artificial sequence
  SiRNA target sequence
ttggtaatatagatattga

SEQ ID NO: 158153 - DNA, 19 bp, Artificial sequence
  SiRNA target sequence
tggtaatatagatattgat

SEQ ID NO: 158154 - DNA, 19 bp, Artificial sequence
  SiRNA target sequence
ggtaatatagatattgatg

SEQ ID NO: 158155 - DNA, 19 bp, Artificial sequence
  SiRNA target sequence
gtaatatagatattgatgt

SEQ ID NO: 158156 - DNA, 19 bp, Artificial sequence
  SiRNA target sequence
taatatagatattgatgtc

SEQ ID NO: 158157 - DNA, 19 bp, Artificial sequence
  SiRNA target sequence
aatatagatattgatgtca

SEQ ID NO: 158158 - DNA, 19 bp, Artificial sequence
  SiRNA target sequence
atatagatattgatgtcaa

SEQ ID NO: 158159 - DNA, 19 bp, Artificial sequence
  SiRNA target sequence
tatagatattgatgtcaat

SEQ ID NO: 158160 - DNA, 19 bp, Artificial sequence
  SiRNA target sequence
atagatattgatgtcaatg

SEQ ID NO: 158161 - DNA, 19 bp, Artificial sequence
  SiRNA target sequence
tagatattgatgtcaatga

SEQ ID NO: 158162 - DNA, 19 bp, Artificial sequence
  SiRNA target sequence
agatattgatgtcaatgat

SEQ ID NO: 158163 - DNA, 19 bp, Artificial sequence
  SiRNA target sequence
gatattgatgtcaatgata

SEQ ID NO: 158164 - DNA, 19 bp, Artificial sequence
  SiRNA target sequence
atattgatgtcaatgatat

SEQ ID NO: 158165 - DNA, 19 bp, Artificial sequence
  SiRNA target sequence
tattgatgtcaatgatatg

SEQ ID NO: 158166 - DNA, 19 bp, Artificial sequence
  SiRNA target sequence
attgatgtcaatgatatga

SEQ ID NO: 158167 - DNA, 19 bp, Artificial sequence
  SiRNA target sequence
ttgatgtcaatgatatgaa

SEQ ID NO: 158168 - DNA, 19 bp, Artificial sequence
  SiRNA target sequence
tgatgtcaatgatatgaat

SEQ ID NO: 158169 - DNA, 19 bp, Artificial sequence
  SiRNA target sequence
gatgtcaatgatatgaata

SEQ ID NO: 158170 - DNA, 19 bp, Artificial sequence
  SiRNA target sequence
atgtcaatgatatgaatat

SEQ ID NO: 158171 - DNA, 19 bp, Artificial sequence
  SiRNA target sequence
tgtcaatgatatgaatatt

SEQ ID NO: 158172 - DNA, 19 bp, Artificial sequence
  SiRNA target sequence
gtcaatgatatgaatattg

SEQ ID NO: 158173 - DNA, 19 bp, Artificial sequence
  SiRNA target sequence
tcaatgatatgaatattga

SEQ ID NO: 158174 - DNA, 19 bp, Artificial sequence
  SiRNA target sequence
caatgatatgaatattgat

SEQ ID NO: 158175 - DNA, 19 bp, Artificial sequence
  SiRNA target sequence
aatgatatgaatattgatt

SEQ ID NO: 158176 - DNA, 19 bp, Artificial sequence
  SiRNA target sequence
atgatatgaatattgattt

SEQ ID NO: 158177 - DNA, 19 bp, Artificial sequence
  SiRNA target sequence
tgatatgaatattgattta

SEQ ID NO: 158178 - DNA, 19 bp, Artificial sequence
  SiRNA target sequence
gatatgaatattgatttac

SEQ ID NO: 158179 - DNA, 19 bp, Artificial sequence
  SiRNA target sequence
atatgaatattgatttact

SEQ ID NO: 158180 - DNA, 19 bp, Artificial sequence
  SiRNA target sequence
tatgaatattgatttacta

SEQ ID NO: 158181 - DNA, 19 bp, Artificial sequence
  SiRNA target sequence
atgaatattgatttactaa

SEQ ID NO: 158182 - DNA, 19 bp, Artificial sequence
  SiRNA target sequence
tgaatattgatttactaag

SEQ ID NO: 158183 - DNA, 19 bp, Artificial sequence
  SiRNA target sequence
gaatattgatttactaagt

SEQ ID NO: 158184 - DNA, 19 bp, Artificial sequence
  SiRNA target sequence
aatattgatttactaagtt

SEQ ID NO: 158185 - DNA, 19 bp, Artificial sequence
  SiRNA target sequence
atattgatttactaagttt

SEQ ID NO: 158186 - DNA, 19 bp, Artificial sequence
  SiRNA target sequence
tattgatttactaagttta

SEQ ID NO: 158187 - DNA, 19 bp, Artificial sequence
  SiRNA target sequence
attgatttactaagtttat

SEQ ID NO: 158188 - DNA, 19 bp, Artificial sequence
  SiRNA target sequence
ttgatttactaagtttatc

SEQ ID NO: 158189 - DNA, 19 bp, Artificial sequence
  SiRNA target sequence
tgatttactaagtttatca

SEQ ID NO: 158190 - DNA, 19 bp, Artificial sequence
  SiRNA target sequence
gatttactaagtttatcaa

SEQ ID NO: 158191 - DNA, 19 bp, Artificial sequence
  SiRNA target sequence
atttactaagtttatcaag

SEQ ID NO: 158192 - DNA, 19 bp, Artificial sequence
  SiRNA target sequence
tttactaagtttatcaagt

SEQ ID NO: 158193 - DNA, 19 bp, Artificial sequence
  SiRNA target sequence
ttactaagtttatcaagtc

SEQ ID NO: 158194 - DNA, 19 bp, Artificial sequence
  SiRNA target sequence
tactaagtttatcaagtca

SEQ ID NO: 158195 - DNA, 19 bp, Artificial sequence
  SiRNA target sequence
actaagtttatcaagtcat

SEQ ID NO: 158196 - DNA, 19 bp, Artificial sequence
  SiRNA target sequence
ctaagtttatcaagtcata

SEQ ID NO: 158197 - DNA, 19 bp, Artificial sequence
  SiRNA target sequence
taagtttatcaagtcataa

SEQ ID NO: 158198 - DNA, 19 bp, Artificial sequence
  SiRNA target sequence
aagtttatcaagtcataaa

SEQ ID NO: 158199 - DNA, 19 bp, Artificial sequence
  SiRNA target sequence
agtttatcaagtcataaaa

SEQ ID NO: 158200 - DNA, 19 bp, Artificial sequence
  SiRNA target sequence
gtttatcaagtcataaaat

SEQ ID NO: 158201 - DNA, 19 bp, Artificial sequence
  SiRNA target sequence
tttatcaagtcataaaatt

SEQ ID NO: 158202 - DNA, 19 bp, Artificial sequence
  SiRNA target sequence
ttatcaagtcataaaattt

SEQ ID NO: 158203 - DNA, 19 bp, Artificial sequence
  SiRNA target sequence
tatcaagtcataaaattta

SEQ ID NO: 158204 - DNA, 19 bp, Artificial sequence
  SiRNA target sequence
atcaagtcataaaatttat

SEQ ID NO: 158205 - DNA, 19 bp, Artificial sequence
  SiRNA target sequence
tcaagtcataaaatttatg

SEQ ID NO: 158206 - DNA, 19 bp, Artificial sequence
  SiRNA target sequence
caagtcataaaatttatgg

SEQ ID NO: 158207 - DNA, 19 bp, Artificial sequence
  SiRNA target sequence
aagtcataaaatttatggt

SEQ ID NO: 158208 - DNA, 19 bp, Artificial sequence
  SiRNA target sequence
agtcataaaatttatggtc

SEQ ID NO: 158209 - DNA, 19 bp, Artificial sequence
  SiRNA target sequence
gtcataaaatttatggtcc

SEQ ID NO: 158210 - DNA, 19 bp, Artificial sequence
  SiRNA target sequence
tcataaaatttatggtcca

SEQ ID NO: 158211 - DNA, 19 bp, Artificial sequence
  SiRNA target sequence
cataaaatttatggtccaa

SEQ ID NO: 158212 - DNA, 19 bp, Artificial sequence
  SiRNA target sequence
ataaaatttatggtccaaa

SEQ ID NO: 158213 - DNA, 19 bp, Artificial sequence
  SiRNA target sequence
taaaatttatggtccaaaa

SEQ ID NO: 158214 - DNA, 19 bp, Artificial sequence
  SiRNA target sequence
aaaatttatggtccaaaag

SEQ ID NO: 158215 - DNA, 19 bp, Artificial sequence
  SiRNA target sequence
aaatttatggtccaaaagg

SEQ ID NO: 158216 - DNA, 19 bp, Artificial sequence
  SiRNA target sequence
aatttatggtccaaaaggt

SEQ ID NO: 158217 - DNA, 19 bp, Artificial sequence
  SiRNA target sequence
atttatggtccaaaaggtg

SEQ ID NO: 158218 - DNA, 19 bp, Artificial sequence
  SiRNA target sequence
tttatggtccaaaaggtgt

SEQ ID NO: 158219 - DNA, 19 bp, Artificial sequence
  SiRNA target sequence
ttatggtccaaaaggtgtt

SEQ ID NO: 158220 - DNA, 19 bp, Artificial sequence
  SiRNA target sequence
tatggtccaaaaggtgttg

SEQ ID NO: 158221 - DNA, 19 bp, Artificial sequence
  SiRNA target sequence
atggtccaaaaggtgttgg

SEQ ID NO: 158222 - DNA, 19 bp, Artificial sequence
  SiRNA target sequence
tggtccaaaaggtgttggt

SEQ ID NO: 158223 - DNA, 19 bp, Artificial sequence
  SiRNA target sequence
ggtccaaaaggtgttggtg

SEQ ID NO: 158224 - DNA, 19 bp, Artificial sequence
  SiRNA target sequence
gtccaaaaggtgttggtgc

SEQ ID NO: 158225 - DNA, 19 bp, Artificial sequence
  SiRNA target sequence
tccaaaaggtgttggtgcc

SEQ ID NO: 158226 - DNA, 19 bp, Artificial sequence
  SiRNA target sequence
ccaaaaggtgttggtgcct

SEQ ID NO: 158227 - DNA, 19 bp, Artificial sequence
  SiRNA target sequence
caaaaggtgttggtgcctt

SEQ ID NO: 158228 - DNA, 19 bp, Artificial sequence
  SiRNA target sequence
aaaaggtgttggtgcctta

SEQ ID NO: 158229 - DNA, 19 bp, Artificial sequence
  SiRNA target sequence
aaaggtgttggtgccttat

SEQ ID NO: 158230 - DNA, 19 bp, Artificial sequence
  SiRNA target sequence
aaggtgttggtgccttata

SEQ ID NO: 158231 - DNA, 19 bp, Artificial sequence
  SiRNA target sequence
aggtgttggtgccttatac

SEQ ID NO: 158232 - DNA, 19 bp, Artificial sequence
  SiRNA target sequence
ggtgttggtgccttatacg

SEQ ID NO: 158233 - DNA, 19 bp, Artificial sequence
  SiRNA target sequence
gtgttggtgccttatacgt

SEQ ID NO: 158234 - DNA, 19 bp, Artificial sequence
  SiRNA target sequence
tgttggtgccttatacgtc

SEQ ID NO: 158235 - DNA, 19 bp, Artificial sequence
  SiRNA target sequence
gttggtgccttatacgtca

SEQ ID NO: 158236 - DNA, 19 bp, Artificial sequence
  SiRNA target sequence
ttggtgccttatacgtcag

SEQ ID NO: 158237 - DNA, 19 bp, Artificial sequence
  SiRNA target sequence
tggtgccttatacgtcaga

SEQ ID NO: 158238 - DNA, 19 bp, Artificial sequence
  SiRNA target sequence
ggtgccttatacgtcagaa

SEQ ID NO: 158239 - DNA, 19 bp, Artificial sequence
  SiRNA target sequence
gtgccttatacgtcagaag

SEQ ID NO: 158240 - DNA, 19 bp, Artificial sequence
  SiRNA target sequence
tgccttatacgtcagaaga

SEQ ID NO: 158241 - DNA, 19 bp, Artificial sequence
  SiRNA target sequence
gccttatacgtcagaagaa

SEQ ID NO: 158242 - DNA, 19 bp, Artificial sequence
  SiRNA target sequence
ccttatacgtcagaagaag

SEQ ID NO: 158243 - DNA, 19 bp, Artificial sequence
  SiRNA target sequence
cttatacgtcagaagaagg

SEQ ID NO: 158244 - DNA, 19 bp, Artificial sequence
  SiRNA target sequence
ttatacgtcagaagaaggc

SEQ ID NO: 158245 - DNA, 19 bp, Artificial sequence
  SiRNA target sequence
tatacgtcagaagaaggcc

SEQ ID NO: 158246 - DNA, 19 bp, Artificial sequence
  SiRNA target sequence
atacgtcagaagaaggcct

SEQ ID NO: 158247 - DNA, 19 bp, Artificial sequence
  SiRNA target sequence
tacgtcagaagaaggccta

SEQ ID NO: 158248 - DNA, 19 bp, Artificial sequence
  SiRNA target sequence
acgtcagaagaaggcctag

SEQ ID NO: 158249 - DNA, 19 bp, Artificial sequence
  SiRNA target sequence
cgtcagaagaaggcctagg

SEQ ID NO: 158250 - DNA, 19 bp, Artificial sequence
  SiRNA target sequence
gtcagaagaaggcctaggg

SEQ ID NO: 158251 - DNA, 19 bp, Artificial sequence
  SiRNA target sequence
tcagaagaaggcctagggt

SEQ ID NO: 158252 - DNA, 19 bp, Artificial sequence
  SiRNA target sequence
cagaagaaggcctagggtg

SEQ ID NO: 158253 - DNA, 19 bp, Artificial sequence
  SiRNA target sequence
agaagaaggcctagggtga

SEQ ID NO: 158254 - DNA, 19 bp, Artificial sequence
  SiRNA target sequence
gaagaaggcctagggtgag

SEQ ID NO: 158255 - DNA, 19 bp, Artificial sequence
  SiRNA target sequence
aagaaggcctagggtgaga

SEQ ID NO: 158256 - DNA, 19 bp, Artificial sequence
  SiRNA target sequence
agaaggcctagggtgagaa

SEQ ID NO: 158257 - DNA, 19 bp, Artificial sequence
  SiRNA target sequence
gaaggcctagggtgagaat

SEQ ID NO: 158258 - DNA, 19 bp, Artificial sequence
  SiRNA target sequence
aaggcctagggtgagaatg

SEQ ID NO: 158259 - DNA, 19 bp, Artificial sequence
  SiRNA target sequence
aggcctagggtgagaatgt

SEQ ID NO: 158260 - DNA, 19 bp, Artificial sequence
  SiRNA target sequence
ggcctagggtgagaatgtt

SEQ ID NO: 158261 - DNA, 19 bp, Artificial sequence
  SiRNA target sequence
gcctagggtgagaatgtta

SEQ ID NO: 158262 - DNA, 19 bp, Artificial sequence
  SiRNA target sequence
cctagggtgagaatgttac

SEQ ID NO: 158263 - DNA, 19 bp, Artificial sequence
  SiRNA target sequence
ctagggtgagaatgttacc

SEQ ID NO: 158264 - DNA, 19 bp, Artificial sequence
  SiRNA target sequence
tagggtgagaatgttacca

SEQ ID NO: 158265 - DNA, 19 bp, Artificial sequence
  SiRNA target sequence
agggtgagaatgttaccac

SEQ ID NO: 158266 - DNA, 19 bp, Artificial sequence
  SiRNA target sequence
gggtgagaatgttaccact

SEQ ID NO: 158267 - DNA, 19 bp, Artificial sequence
  SiRNA target sequence
ggtgagaatgttaccactt

SEQ ID NO: 158268 - DNA, 19 bp, Artificial sequence
  SiRNA target sequence
gtgagaatgttaccacttt

SEQ ID NO: 158269 - DNA, 19 bp, Artificial sequence
  SiRNA target sequence
tgagaatgttaccactttt

SEQ ID NO: 158270 - DNA, 19 bp, Artificial sequence
  SiRNA target sequence
gagaatgttaccacttttt

SEQ ID NO: 158271 - DNA, 19 bp, Artificial sequence
  SiRNA target sequence
agaatgttaccacttttta

SEQ ID NO: 158272 - DNA, 19 bp, Artificial sequence
  SiRNA target sequence
gaatgttaccactttttaa

SEQ ID NO: 158273 - DNA, 19 bp, Artificial sequence
  SiRNA target sequence
aatgttaccactttttaat

SEQ ID NO: 158274 - DNA, 19 bp, Artificial sequence
  SiRNA target sequence
atgttaccactttttaatg

SEQ ID NO: 158275 - DNA, 19 bp, Artificial sequence
  SiRNA target sequence
tgttaccactttttaatgg

SEQ ID NO: 158276 - DNA, 19 bp, Artificial sequence
  SiRNA target sequence
gttaccactttttaatggt

SEQ ID NO: 158277 - DNA, 19 bp, Artificial sequence
  SiRNA target sequence
ttaccactttttaatggtg

SEQ ID NO: 158278 - DNA, 19 bp, Artificial sequence
  SiRNA target sequence
taccactttttaatggtgg

SEQ ID NO: 158279 - DNA, 19 bp, Artificial sequence
  SiRNA target sequence
accactttttaatggtggt

SEQ ID NO: 158280 - DNA, 19 bp, Artificial sequence
  SiRNA target sequence
ccactttttaatggtggtg

SEQ ID NO: 158281 - DNA, 19 bp, Artificial sequence
  SiRNA target sequence
cactttttaatggtggtgg

SEQ ID NO: 158282 - DNA, 19 bp, Artificial sequence
  SiRNA target sequence
actttttaatggtggtgga

SEQ ID NO: 158283 - DNA, 19 bp, Artificial sequence
  SiRNA target sequence
ctttttaatggtggtggac

SEQ ID NO: 158284 - DNA, 19 bp, Artificial sequence
  SiRNA target sequence
tttttaatggtggtggaca

SEQ ID NO: 158285 - DNA, 19 bp, Artificial sequence
  SiRNA target sequence
ttttaatggtggtggacaa

SEQ ID NO: 158286 - DNA, 19 bp, Artificial sequence
  SiRNA target sequence
tttaatggtggtggacaag

SEQ ID NO: 158287 - DNA, 19 bp, Artificial sequence
  SiRNA target sequence
ttaatggtggtggacaaga

SEQ ID NO: 158288 - DNA, 19 bp, Artificial sequence
  SiRNA target sequence
taatggtggtggacaagaa

SEQ ID NO: 158289 - DNA, 19 bp, Artificial sequence
  SiRNA target sequence
aatggtggtggacaagaaa

SEQ ID NO: 158290 - DNA, 19 bp, Artificial sequence
  SiRNA target sequence
atggtggtggacaagaaag

SEQ ID NO: 158291 - DNA, 19 bp, Artificial sequence
  SiRNA target sequence
tggtggtggacaagaaaga

SEQ ID NO: 158292 - DNA, 19 bp, Artificial sequence
  SiRNA target sequence
ggtggtggacaagaaagag

SEQ ID NO: 158293 - DNA, 19 bp, Artificial sequence
  SiRNA target sequence
gtggtggacaagaaagagg

SEQ ID NO: 158294 - DNA, 19 bp, Artificial sequence
  SiRNA target sequence
tggtggacaagaaagagga

SEQ ID NO: 158295 - DNA, 19 bp, Artificial sequence
  SiRNA target sequence
ggtggacaagaaagaggat

SEQ ID NO: 158296 - DNA, 19 bp, Artificial sequence
  SiRNA target sequence
gtggacaagaaagaggatt

SEQ ID NO: 158297 - DNA, 19 bp, Artificial sequence
  SiRNA target sequence
tggacaagaaagaggatta

SEQ ID NO: 158298 - DNA, 19 bp, Artificial sequence
  SiRNA target sequence
ggacaagaaagaggattaa

SEQ ID NO: 158299 - DNA, 19 bp, Artificial sequence
  SiRNA target sequence
gacaagaaagaggattaag

SEQ ID NO: 158300 - DNA, 19 bp, Artificial sequence
  SiRNA target sequence
acaagaaagaggattaaga

SEQ ID NO: 158301 - DNA, 19 bp, Artificial sequence
  SiRNA target sequence
caagaaagaggattaagaa

SEQ ID NO: 158302 - DNA, 19 bp, Artificial sequence
  SiRNA target sequence
aagaaagaggattaagaag

SEQ ID NO: 158303 - DNA, 19 bp, Artificial sequence
  SiRNA target sequence
agaaagaggattaagaagt

SEQ ID NO: 158304 - DNA, 19 bp, Artificial sequence
  SiRNA target sequence
gaaagaggattaagaagtg

SEQ ID NO: 158305 - DNA, 19 bp, Artificial sequence
  SiRNA target sequence
aaagaggattaagaagtgg

SEQ ID NO: 158306 - DNA, 19 bp, Artificial sequence
  SiRNA target sequence
aagaggattaagaagtggg

SEQ ID NO: 158307 - DNA, 19 bp, Artificial sequence
  SiRNA target sequence
agaggattaagaagtggga

SEQ ID NO: 158308 - DNA, 19 bp, Artificial sequence
  SiRNA target sequence
gaggattaagaagtgggac

SEQ ID NO: 158309 - DNA, 19 bp, Artificial sequence
  SiRNA target sequence
aggattaagaagtgggaca

SEQ ID NO: 158310 - DNA, 19 bp, Artificial sequence
  SiRNA target sequence
ggattaagaagtgggacaa

SEQ ID NO: 158311 - DNA, 19 bp, Artificial sequence
  SiRNA target sequence
gattaagaagtgggacaac

SEQ ID NO: 158312 - DNA, 19 bp, Artificial sequence
  SiRNA target sequence
attaagaagtgggacaact

SEQ ID NO: 158313 - DNA, 19 bp, Artificial sequence
  SiRNA target sequence
ttaagaagtgggacaactt

SEQ ID NO: 158314 - DNA, 19 bp, Artificial sequence
  SiRNA target sequence
taagaagtgggacaacttc

SEQ ID NO: 158315 - DNA, 19 bp, Artificial sequence
  SiRNA target sequence
aagaagtgggacaacttct

SEQ ID NO: 158316 - DNA, 19 bp, Artificial sequence
  SiRNA target sequence
agaagtgggacaacttctc

SEQ ID NO: 158317 - DNA, 19 bp, Artificial sequence
  SiRNA target sequence
gaagtgggacaacttctcc

SEQ ID NO: 158318 - DNA, 19 bp, Artificial sequence
  SiRNA target sequence
aagtgggacaacttctcca

SEQ ID NO: 158319 - DNA, 19 bp, Artificial sequence
  SiRNA target sequence
agtgggacaacttctccac

SEQ ID NO: 158320 - DNA, 19 bp, Artificial sequence
  SiRNA target sequence
gtgggacaacttctccacc

SEQ ID NO: 158321 - DNA, 19 bp, Artificial sequence
  SiRNA target sequence
tgggacaacttctccacct

SEQ ID NO: 158322 - DNA, 19 bp, Artificial sequence
  SiRNA target sequence
gggacaacttctccacctt

SEQ ID NO: 158323 - DNA, 19 bp, Artificial sequence
  SiRNA target sequence
ggacaacttctccaccttt

SEQ ID NO: 158324 - DNA, 19 bp, Artificial sequence
  SiRNA target sequence
gacaacttctccaccttta

SEQ ID NO: 158325 - DNA, 19 bp, Artificial sequence
  SiRNA target sequence
acaacttctccacctttag

SEQ ID NO: 158326 - DNA, 19 bp, Artificial sequence
  SiRNA target sequence
caacttctccacctttagt

SEQ ID NO: 158327 - DNA, 19 bp, Artificial sequence
  SiRNA target sequence
aacttctccacctttagtt

SEQ ID NO: 158328 - DNA, 19 bp, Artificial sequence
  SiRNA target sequence
acttctccacctttagttg

SEQ ID NO: 158329 - DNA, 19 bp, Artificial sequence
  SiRNA target sequence
cttctccacctttagttgt

SEQ ID NO: 158330 - DNA, 19 bp, Artificial sequence
  SiRNA target sequence
ttctccacctttagttgtt

SEQ ID NO: 158331 - DNA, 19 bp, Artificial sequence
  SiRNA target sequence
tctccacctttagttgttg

SEQ ID NO: 158332 - DNA, 19 bp, Artificial sequence
  SiRNA target sequence
ctccacctttagttgttgg

SEQ ID NO: 158333 - DNA, 19 bp, Artificial sequence
  SiRNA target sequence
tccacctttagttgttgga

SEQ ID NO: 158334 - DNA, 19 bp, Artificial sequence
  SiRNA target sequence
ccacctttagttgttggat

SEQ ID NO: 158335 - DNA, 19 bp, Artificial sequence
  SiRNA target sequence
cacctttagttgttggatt

SEQ ID NO: 158336 - DNA, 19 bp, Artificial sequence
  SiRNA target sequence
acctttagttgttggatta

SEQ ID NO: 158337 - DNA, 19 bp, Artificial sequence
  SiRNA target sequence
cctttagttgttggattag

SEQ ID NO: 158338 - DNA, 19 bp, Artificial sequence
  SiRNA target sequence
ctttagttgttggattagg

SEQ ID NO: 158339 - DNA, 19 bp, Artificial sequence
  SiRNA target sequence
tttagttgttggattaggc

SEQ ID NO: 158340 - DNA, 19 bp, Artificial sequence
  SiRNA target sequence
ttagttgttggattaggca

SEQ ID NO: 158341 - DNA, 19 bp, Artificial sequence
  SiRNA target sequence
tagttgttggattaggcaa

SEQ ID NO: 158342 - DNA, 19 bp, Artificial sequence
  SiRNA target sequence
agttgttggattaggcaaa

SEQ ID NO: 158343 - DNA, 19 bp, Artificial sequence
  SiRNA target sequence
gttgttggattaggcaaag

SEQ ID NO: 158344 - DNA, 19 bp, Artificial sequence
  SiRNA target sequence
ttgttggattaggcaaagc

SEQ ID NO: 158345 - DNA, 19 bp, Artificial sequence
  SiRNA target sequence
tgttggattaggcaaagct

SEQ ID NO: 158346 - DNA, 19 bp, Artificial sequence
  SiRNA target sequence
gttggattaggcaaagctg

SEQ ID NO: 158347 - DNA, 19 bp, Artificial sequence
  SiRNA target sequence
ttggattaggcaaagctgc

SEQ ID NO: 158348 - DNA, 19 bp, Artificial sequence
  SiRNA target sequence
tggattaggcaaagctgct

SEQ ID NO: 158349 - DNA, 19 bp, Artificial sequence
  SiRNA target sequence
ggattaggcaaagctgctg

SEQ ID NO: 158350 - DNA, 19 bp, Artificial sequence
  SiRNA target sequence
gattaggcaaagctgctga

SEQ ID NO: 158351 - DNA, 19 bp, Artificial sequence
  SiRNA target sequence
attaggcaaagctgctgag

SEQ ID NO: 158352 - DNA, 19 bp, Artificial sequence
  SiRNA target sequence
ttaggcaaagctgctgaga

SEQ ID NO: 158353 - DNA, 19 bp, Artificial sequence
  SiRNA target sequence
taggcaaagctgctgagat

SEQ ID NO: 158354 - DNA, 19 bp, Artificial sequence
  SiRNA target sequence
aggcaaagctgctgagata

SEQ ID NO: 158355 - DNA, 19 bp, Artificial sequence
  SiRNA target sequence
ggcaaagctgctgagatat

SEQ ID NO: 158356 - DNA, 19 bp, Artificial sequence
  SiRNA target sequence
gcaaagctgctgagatatg

SEQ ID NO: 158357 - DNA, 19 bp, Artificial sequence
  SiRNA target sequence
caaagctgctgagatatgc

SEQ ID NO: 158358 - DNA, 19 bp, Artificial sequence
  SiRNA target sequence
aaagctgctgagatatgct

SEQ ID NO: 158359 - DNA, 19 bp, Artificial sequence
  SiRNA target sequence
aagctgctgagatatgctc

SEQ ID NO: 158360 - DNA, 19 bp, Artificial sequence
  SiRNA target sequence
agctgctgagatatgctct

SEQ ID NO: 158361 - DNA, 19 bp, Artificial sequence
  SiRNA target sequence
gctgctgagatatgctctc

SEQ ID NO: 158362 - DNA, 19 bp, Artificial sequence
  SiRNA target sequence
ctgctgagatatgctctca

SEQ ID NO: 158363 - DNA, 19 bp, Artificial sequence
  SiRNA target sequence
tgctgagatatgctctcag

SEQ ID NO: 158364 - DNA, 19 bp, Artificial sequence
  SiRNA target sequence
gctgagatatgctctcagg

SEQ ID NO: 158365 - DNA, 19 bp, Artificial sequence
  SiRNA target sequence
ctgagatatgctctcagga

SEQ ID NO: 158366 - DNA, 19 bp, Artificial sequence
  SiRNA target sequence
tgagatatgctctcaggag

SEQ ID NO: 158367 - DNA, 19 bp, Artificial sequence
  SiRNA target sequence
gagatatgctctcaggaga

SEQ ID NO: 158368 - DNA, 19 bp, Artificial sequence
  SiRNA target sequence
agatatgctctcaggagat

SEQ ID NO: 158369 - DNA, 19 bp, Artificial sequence
  SiRNA target sequence
gatatgctctcaggagatg

SEQ ID NO: 158370 - DNA, 19 bp, Artificial sequence
  SiRNA target sequence
atatgctctcaggagatgc

SEQ ID NO: 158371 - DNA, 19 bp, Artificial sequence
  SiRNA target sequence
tatgctctcaggagatgcg

SEQ ID NO: 158372 - DNA, 19 bp, Artificial sequence
  SiRNA target sequence
atgctctcaggagatgcgt

SEQ ID NO: 158373 - DNA, 19 bp, Artificial sequence
  SiRNA target sequence
tgctctcaggagatgcgta

SEQ ID NO: 158374 - DNA, 19 bp, Artificial sequence
  SiRNA target sequence
gctctcaggagatgcgtaa

SEQ ID NO: 158375 - DNA, 19 bp, Artificial sequence
  SiRNA target sequence
ctctcaggagatgcgtaag

SEQ ID NO: 158376 - DNA, 19 bp, Artificial sequence
  SiRNA target sequence
tctcaggagatgcgtaagg

SEQ ID NO: 158377 - DNA, 19 bp, Artificial sequence
  SiRNA target sequence
ctcaggagatgcgtaagga

SEQ ID NO: 158378 - DNA, 19 bp, Artificial sequence
  SiRNA target sequence
tcaggagatgcgtaaggac

SEQ ID NO: 158379 - DNA, 19 bp, Artificial sequence
  SiRNA target sequence
caggagatgcgtaaggact

SEQ ID NO: 158380 - DNA, 19 bp, Artificial sequence
  SiRNA target sequence
aggagatgcgtaaggacta

SEQ ID NO: 158381 - DNA, 19 bp, Artificial sequence
  SiRNA target sequence
ggagatgcgtaaggactat

SEQ ID NO: 158382 - DNA, 19 bp, Artificial sequence
  SiRNA target sequence
gagatgcgtaaggactatg

SEQ ID NO: 158383 - DNA, 19 bp, Artificial sequence
  SiRNA target sequence
agatgcgtaaggactatga

SEQ ID NO: 158384 - DNA, 19 bp, Artificial sequence
  SiRNA target sequence
gatgcgtaaggactatgaa

SEQ ID NO: 158385 - DNA, 19 bp, Artificial sequence
  SiRNA target sequence
atgcgtaaggactatgaat

SEQ ID NO: 158386 - DNA, 19 bp, Artificial sequence
  SiRNA target sequence
tgcgtaaggactatgaata

SEQ ID NO: 158387 - DNA, 19 bp, Artificial sequence
  SiRNA target sequence
gcgtaaggactatgaatat

SEQ ID NO: 158388 - DNA, 19 bp, Artificial sequence
  SiRNA target sequence
cgtaaggactatgaatata

SEQ ID NO: 158389 - DNA, 19 bp, Artificial sequence
  SiRNA target sequence
gtaaggactatgaatatat

SEQ ID NO: 158390 - DNA, 19 bp, Artificial sequence
  SiRNA target sequence
taaggactatgaatatata

SEQ ID NO: 158391 - DNA, 19 bp, Artificial sequence
  SiRNA target sequence
aaggactatgaatatatac

SEQ ID NO: 158392 - DNA, 19 bp, Artificial sequence
  SiRNA target sequence
aggactatgaatatataca

SEQ ID NO: 158393 - DNA, 19 bp, Artificial sequence
  SiRNA target sequence
ggactatgaatatatacaa

SEQ ID NO: 158394 - DNA, 19 bp, Artificial sequence
  SiRNA target sequence
gactatgaatatatacaaa

SEQ ID NO: 158395 - DNA, 19 bp, Artificial sequence
  SiRNA target sequence
actatgaatatatacaaaa

SEQ ID NO: 158396 - DNA, 19 bp, Artificial sequence
  SiRNA target sequence
ctatgaatatatacaaaaa

SEQ ID NO: 158397 - DNA, 19 bp, Artificial sequence
  SiRNA target sequence
tatgaatatatacaaaaat

SEQ ID NO: 158398 - DNA, 19 bp, Artificial sequence
  SiRNA target sequence
atgaatatatacaaaaatt

SEQ ID NO: 158399 - DNA, 19 bp, Artificial sequence
  SiRNA target sequence
tgaatatatacaaaaatta

SEQ ID NO: 158400 - DNA, 19 bp, Artificial sequence
  SiRNA target sequence
gaatatatacaaaaattat

SEQ ID NO: 158401 - DNA, 19 bp, Artificial sequence
  SiRNA target sequence
aatatatacaaaaattatc

SEQ ID NO: 158402 - DNA, 19 bp, Artificial sequence
  SiRNA target sequence
atatatacaaaaattatcg

SEQ ID NO: 158403 - DNA, 19 bp, Artificial sequence
  SiRNA target sequence
tatatacaaaaattatcgg

SEQ ID NO: 158404 - DNA, 19 bp, Artificial sequence
  SiRNA target sequence
atatacaaaaattatcgga

SEQ ID NO: 158405 - DNA, 19 bp, Artificial sequence
  SiRNA target sequence
tatacaaaaattatcggat

SEQ ID NO: 158406 - DNA, 19 bp, Artificial sequence
  SiRNA target sequence
atacaaaaattatcggata

SEQ ID NO: 158407 - DNA, 19 bp, Artificial sequence
  SiRNA target sequence
tacaaaaattatcggataa

SEQ ID NO: 158408 - DNA, 19 bp, Artificial sequence
  SiRNA target sequence
acaaaaattatcggataaa

SEQ ID NO: 158409 - DNA, 19 bp, Artificial sequence
  SiRNA target sequence
caaaaattatcggataaac

SEQ ID NO: 158410 - DNA, 19 bp, Artificial sequence
  SiRNA target sequence
aaaaattatcggataaact

SEQ ID NO: 158411 - DNA, 19 bp, Artificial sequence
  SiRNA target sequence
aaaattatcggataaacta

SEQ ID NO: 158412 - DNA, 19 bp, Artificial sequence
  SiRNA target sequence
aaattatcggataaactaa

SEQ ID NO: 158413 - DNA, 19 bp, Artificial sequence
  SiRNA target sequence
aattatcggataaactaaa

SEQ ID NO: 158414 - DNA, 19 bp, Artificial sequence
  SiRNA target sequence
attatcggataaactaaaa

SEQ ID NO: 158415 - DNA, 19 bp, Artificial sequence
  SiRNA target sequence
ttatcggataaactaaaaa

SEQ ID NO: 158416 - DNA, 19 bp, Artificial sequence
  SiRNA target sequence
tatcggataaactaaaaaa

SEQ ID NO: 158417 - DNA, 19 bp, Artificial sequence
  SiRNA target sequence
atcggataaactaaaaaat

SEQ ID NO: 158418 - DNA, 19 bp, Artificial sequence
  SiRNA target sequence
tcggataaactaaaaaatc

SEQ ID NO: 158419 - DNA, 19 bp, Artificial sequence
  SiRNA target sequence
cggataaactaaaaaatcg

SEQ ID NO: 158420 - DNA, 19 bp, Artificial sequence
  SiRNA target sequence
ggataaactaaaaaatcgc

SEQ ID NO: 158421 - DNA, 19 bp, Artificial sequence
  SiRNA target sequence
gataaactaaaaaatcgca

SEQ ID NO: 158422 - DNA, 19 bp, Artificial sequence
  SiRNA target sequence
ataaactaaaaaatcgcat

SEQ ID NO: 158423 - DNA, 19 bp, Artificial sequence
  SiRNA target sequence
taaactaaaaaatcgcatc

SEQ ID NO: 158424 - DNA, 19 bp, Artificial sequence
  SiRNA target sequence
aaactaaaaaatcgcatca

SEQ ID NO: 158425 - DNA, 19 bp, Artificial sequence
  SiRNA target sequence
aactaaaaaatcgcatcaa

SEQ ID NO: 158426 - DNA, 19 bp, Artificial sequence
  SiRNA target sequence
actaaaaaatcgcatcaaa

SEQ ID NO: 158427 - DNA, 19 bp, Artificial sequence
  SiRNA target sequence
ctaaaaaatcgcatcaaaa

SEQ ID NO: 158428 - DNA, 19 bp, Artificial sequence
  SiRNA target sequence
taaaaaatcgcatcaaaac

SEQ ID NO: 158429 - DNA, 19 bp, Artificial sequence
  SiRNA target sequence
aaaaaatcgcatcaaaacg

SEQ ID NO: 158430 - DNA, 19 bp, Artificial sequence
  SiRNA target sequence
aaaaatcgcatcaaaacga

SEQ ID NO: 158431 - DNA, 19 bp, Artificial sequence
  SiRNA target sequence
aaaatcgcatcaaaacgaa

SEQ ID NO: 158432 - DNA, 19 bp, Artificial sequence
  SiRNA target sequence
aaatcgcatcaaaacgaat

SEQ ID NO: 158433 - DNA, 19 bp, Artificial sequence
  SiRNA target sequence
aatcgcatcaaaacgaatg

SEQ ID NO: 158434 - DNA, 19 bp, Artificial sequence
  SiRNA target sequence
atcgcatcaaaacgaatgt

SEQ ID NO: 158435 - DNA, 19 bp, Artificial sequence
  SiRNA target sequence
tcgcatcaaaacgaatgta

SEQ ID NO: 158436 - DNA, 19 bp, Artificial sequence
  SiRNA target sequence
cgcatcaaaacgaatgtag

SEQ ID NO: 158437 - DNA, 19 bp, Artificial sequence
  SiRNA target sequence
gcatcaaaacgaatgtaga

SEQ ID NO: 158438 - DNA, 19 bp, Artificial sequence
  SiRNA target sequence
catcaaaacgaatgtagaa

SEQ ID NO: 158439 - DNA, 19 bp, Artificial sequence
  SiRNA target sequence
atcaaaacgaatgtagaaa

SEQ ID NO: 158440 - DNA, 19 bp, Artificial sequence
  SiRNA target sequence
tcaaaacgaatgtagaaaa

SEQ ID NO: 158441 - DNA, 19 bp, Artificial sequence
  SiRNA target sequence
caaaacgaatgtagaaaat

SEQ ID NO: 158442 - DNA, 19 bp, Artificial sequence
  SiRNA target sequence
aaaacgaatgtagaaaatg

SEQ ID NO: 158443 - DNA, 19 bp, Artificial sequence
  SiRNA target sequence
aaacgaatgtagaaaatgt

SEQ ID NO: 158444 - DNA, 19 bp, Artificial sequence
  SiRNA target sequence
aacgaatgtagaaaatgtt

SEQ ID NO: 158445 - DNA, 19 bp, Artificial sequence
  SiRNA target sequence
acgaatgtagaaaatgttg

SEQ ID NO: 158446 - DNA, 19 bp, Artificial sequence
  SiRNA target sequence
cgaatgtagaaaatgttgt

SEQ ID NO: 158447 - DNA, 19 bp, Artificial sequence
  SiRNA target sequence
gaatgtagaaaatgttgtt

SEQ ID NO: 158448 - DNA, 19 bp, Artificial sequence
  SiRNA target sequence
aatgtagaaaatgttgtta

SEQ ID NO: 158449 - DNA, 19 bp, Artificial sequence
  SiRNA target sequence
atgtagaaaatgttgttat

SEQ ID NO: 158450 - DNA, 19 bp, Artificial sequence
  SiRNA target sequence
tgtagaaaatgttgttatt

SEQ ID NO: 158451 - DNA, 19 bp, Artificial sequence
  SiRNA target sequence
gtagaaaatgttgttatta

SEQ ID NO: 158452 - DNA, 19 bp, Artificial sequence
  SiRNA target sequence
tagaaaatgttgttattaa

SEQ ID NO: 158453 - DNA, 19 bp, Artificial sequence
  SiRNA target sequence
agaaaatgttgttattaac

SEQ ID NO: 158454 - DNA, 19 bp, Artificial sequence
  SiRNA target sequence
gaaaatgttgttattaacg

SEQ ID NO: 158455 - DNA, 19 bp, Artificial sequence
  SiRNA target sequence
aaaatgttgttattaacgg

SEQ ID NO: 158456 - DNA, 19 bp, Artificial sequence
  SiRNA target sequence
aaatgttgttattaacggc

SEQ ID NO: 158457 - DNA, 19 bp, Artificial sequence
  SiRNA target sequence
aatgttgttattaacggcg

SEQ ID NO: 158458 - DNA, 19 bp, Artificial sequence
  SiRNA target sequence
atgttgttattaacggcga

SEQ ID NO: 158459 - DNA, 19 bp, Artificial sequence
  SiRNA target sequence
tgttgttattaacggcgat

SEQ ID NO: 158460 - DNA, 19 bp, Artificial sequence
  SiRNA target sequence
gttgttattaacggcgatg

SEQ ID NO: 158461 - DNA, 19 bp, Artificial sequence
  SiRNA target sequence
ttgttattaacggcgatga

SEQ ID NO: 158462 - DNA, 19 bp, Artificial sequence
  SiRNA target sequence
tgttattaacggcgatgat

SEQ ID NO: 158463 - DNA, 19 bp, Artificial sequence
  SiRNA target sequence
gttattaacggcgatgatt

SEQ ID NO: 158464 - DNA, 19 bp, Artificial sequence
  SiRNA target sequence
ttattaacggcgatgattc

SEQ ID NO: 158465 - DNA, 19 bp, Artificial sequence
  SiRNA target sequence
tattaacggcgatgattct

SEQ ID NO: 158466 - DNA, 19 bp, Artificial sequence
  SiRNA target sequence
attaacggcgatgattcta

SEQ ID NO: 158467 - DNA, 19 bp, Artificial sequence
  SiRNA target sequence
ttaacggcgatgattctaa

SEQ ID NO: 158468 - DNA, 19 bp, Artificial sequence
  SiRNA target sequence
taacggcgatgattctaag

SEQ ID NO: 158469 - DNA, 19 bp, Artificial sequence
  SiRNA target sequence
aacggcgatgattctaaga

SEQ ID NO: 158470 - DNA, 19 bp, Artificial sequence
  SiRNA target sequence
acggcgatgattctaagac

SEQ ID NO: 158471 - DNA, 19 bp, Artificial sequence
  SiRNA target sequence
cggcgatgattctaagact

SEQ ID NO: 158472 - DNA, 19 bp, Artificial sequence
  SiRNA target sequence
ggcgatgattctaagactt

SEQ ID NO: 158473 - DNA, 19 bp, Artificial sequence
  SiRNA target sequence
gcgatgattctaagacttt

SEQ ID NO: 158474 - DNA, 19 bp, Artificial sequence
  SiRNA target sequence
cgatgattctaagactttt

SEQ ID NO: 158475 - DNA, 19 bp, Artificial sequence
  SiRNA target sequence
gatgattctaagacttttc

SEQ ID NO: 158476 - DNA, 19 bp, Artificial sequence
  SiRNA target sequence
atgattctaagacttttcc

SEQ ID NO: 158477 - DNA, 19 bp, Artificial sequence
  SiRNA target sequence
tgattctaagacttttcct

SEQ ID NO: 158478 - DNA, 19 bp, Artificial sequence
  SiRNA target sequence
gattctaagacttttcctg

SEQ ID NO: 158479 - DNA, 19 bp, Artificial sequence
  SiRNA target sequence
attctaagacttttcctgg

SEQ ID NO: 158480 - DNA, 19 bp, Artificial sequence
  SiRNA target sequence
ttctaagacttttcctggc

SEQ ID NO: 158481 - DNA, 19 bp, Artificial sequence
  SiRNA target sequence
tctaagacttttcctggct

SEQ ID NO: 158482 - DNA, 19 bp, Artificial sequence
  SiRNA target sequence
ctaagacttttcctggctg

SEQ ID NO: 158483 - DNA, 19 bp, Artificial sequence
  SiRNA target sequence
taagacttttcctggctgt

SEQ ID NO: 158484 - DNA, 19 bp, Artificial sequence
  SiRNA target sequence
aagacttttcctggctgtc

SEQ ID NO: 158485 - DNA, 19 bp, Artificial sequence
  SiRNA target sequence
agacttttcctggctgtct

SEQ ID NO: 158486 - DNA, 19 bp, Artificial sequence
  SiRNA target sequence
gacttttcctggctgtctc

SEQ ID NO: 158487 - DNA, 19 bp, Artificial sequence
  SiRNA target sequence
acttttcctggctgtctca

SEQ ID NO: 158488 - DNA, 19 bp, Artificial sequence
  SiRNA target sequence
cttttcctggctgtctcaa

SEQ ID NO: 158489 - DNA, 19 bp, Artificial sequence
  SiRNA target sequence
ttttcctggctgtctcaat

SEQ ID NO: 158490 - DNA, 19 bp, Artificial sequence
  SiRNA target sequence
tttcctggctgtctcaata

SEQ ID NO: 158491 - DNA, 19 bp, Artificial sequence
  SiRNA target sequence
ttcctggctgtctcaatat

SEQ ID NO: 158492 - DNA, 19 bp, Artificial sequence
  SiRNA target sequence
tcctggctgtctcaatatt

SEQ ID NO: 158493 - DNA, 19 bp, Artificial sequence
  SiRNA target sequence
cctggctgtctcaatattt

SEQ ID NO: 158494 - DNA, 19 bp, Artificial sequence
  SiRNA target sequence
ctggctgtctcaatatttc

SEQ ID NO: 158495 - DNA, 19 bp, Artificial sequence
  SiRNA target sequence
tggctgtctcaatatttct

SEQ ID NO: 158496 - DNA, 19 bp, Artificial sequence
  SiRNA target sequence
ggctgtctcaatatttctt

SEQ ID NO: 158497 - DNA, 19 bp, Artificial sequence
  SiRNA target sequence
gctgtctcaatatttcttt

SEQ ID NO: 158498 - DNA, 19 bp, Artificial sequence
  SiRNA target sequence
ctgtctcaatatttctttt

SEQ ID NO: 158499 - DNA, 19 bp, Artificial sequence
  SiRNA target sequence
tgtctcaatatttcttttc

SEQ ID NO: 158500 - DNA, 19 bp, Artificial sequence
  SiRNA target sequence
gtctcaatatttcttttcc

SEQ ID NO: 158501 - DNA, 19 bp, Artificial sequence
  SiRNA target sequence
tctcaatatttcttttcca

SEQ ID NO: 158502 - DNA, 19 bp, Artificial sequence
  SiRNA target sequence
ctcaatatttcttttccat

SEQ ID NO: 158503 - DNA, 19 bp, Artificial sequence
  SiRNA target sequence
tcaatatttcttttccata

SEQ ID NO: 158504 - DNA, 19 bp, Artificial sequence
  SiRNA target sequence
caatatttcttttccatat

SEQ ID NO: 158505 - DNA, 19 bp, Artificial sequence
  SiRNA target sequence
aatatttcttttccatatg

SEQ ID NO: 158506 - DNA, 19 bp, Artificial sequence
  SiRNA target sequence
atatttcttttccatatgt

SEQ ID NO: 158507 - DNA, 19 bp, Artificial sequence
  SiRNA target sequence
tatttcttttccatatgta

SEQ ID NO: 158508 - DNA, 19 bp, Artificial sequence
  SiRNA target sequence
atttcttttccatatgtag

SEQ ID NO: 158509 - DNA, 19 bp, Artificial sequence
  SiRNA target sequence
tttcttttccatatgtaga

SEQ ID NO: 158510 - DNA, 19 bp, Artificial sequence
  SiRNA target sequence
ttcttttccatatgtagaa

SEQ ID NO: 158511 - DNA, 19 bp, Artificial sequence
  SiRNA target sequence
tcttttccatatgtagaag

SEQ ID NO: 158512 - DNA, 19 bp, Artificial sequence
  SiRNA target sequence
cttttccatatgtagaagg

SEQ ID NO: 158513 - DNA, 19 bp, Artificial sequence
  SiRNA target sequence
ttttccatatgtagaaggt

SEQ ID NO: 158514 - DNA, 19 bp, Artificial sequence
  SiRNA target sequence
tttccatatgtagaaggtg

SEQ ID NO: 158515 - DNA, 19 bp, Artificial sequence
  SiRNA target sequence
ttccatatgtagaaggtga

SEQ ID NO: 158516 - DNA, 19 bp, Artificial sequence
  SiRNA target sequence
tccatatgtagaaggtgaa

SEQ ID NO: 158517 - DNA, 19 bp, Artificial sequence
  SiRNA target sequence
ccatatgtagaaggtgaag

SEQ ID NO: 158518 - DNA, 19 bp, Artificial sequence
  SiRNA target sequence
catatgtagaaggtgaagg

SEQ ID NO: 158519 - DNA, 19 bp, Artificial sequence
  SiRNA target sequence
atatgtagaaggtgaaggg

SEQ ID NO: 158520 - DNA, 19 bp, Artificial sequence
  SiRNA target sequence
tatgtagaaggtgaagggc

SEQ ID NO: 158521 - DNA, 19 bp, Artificial sequence
  SiRNA target sequence
atgtagaaggtgaagggct

SEQ ID NO: 158522 - DNA, 19 bp, Artificial sequence
  SiRNA target sequence
tgtagaaggtgaagggctt

SEQ ID NO: 158523 - DNA, 19 bp, Artificial sequence
  SiRNA target sequence
gtagaaggtgaagggctta

SEQ ID NO: 158524 - DNA, 19 bp, Artificial sequence
  SiRNA target sequence
tagaaggtgaagggcttat

SEQ ID NO: 158525 - DNA, 19 bp, Artificial sequence
  SiRNA target sequence
agaaggtgaagggcttatg

SEQ ID NO: 158526 - DNA, 19 bp, Artificial sequence
  SiRNA target sequence
gaaggtgaagggcttatga

SEQ ID NO: 158527 - DNA, 19 bp, Artificial sequence
  SiRNA target sequence
aaggtgaagggcttatgat

SEQ ID NO: 158528 - DNA, 19 bp, Artificial sequence
  SiRNA target sequence
aggtgaagggcttatgatg

SEQ ID NO: 158529 - DNA, 19 bp, Artificial sequence
  SiRNA target sequence
ggtgaagggcttatgatga

SEQ ID NO: 158530 - DNA, 19 bp, Artificial sequence
  SiRNA target sequence
gtgaagggcttatgatgaa

SEQ ID NO: 158531 - DNA, 19 bp, Artificial sequence
  SiRNA target sequence
tgaagggcttatgatgaat

SEQ ID NO: 158532 - DNA, 19 bp, Artificial sequence
  SiRNA target sequence
gaagggcttatgatgaata

SEQ ID NO: 158533 - DNA, 19 bp, Artificial sequence
  SiRNA target sequence
aagggcttatgatgaatat

SEQ ID NO: 158534 - DNA, 19 bp, Artificial sequence
  SiRNA target sequence
agggcttatgatgaatatt

SEQ ID NO: 158535 - DNA, 19 bp, Artificial sequence
  SiRNA target sequence
gggcttatgatgaatatta

SEQ ID NO: 158536 - DNA, 19 bp, Artificial sequence
  SiRNA target sequence
ggcttatgatgaatattaa

SEQ ID NO: 158537 - DNA, 19 bp, Artificial sequence
  SiRNA target sequence
gcttatgatgaatattaag

SEQ ID NO: 158538 - DNA, 19 bp, Artificial sequence
  SiRNA target sequence
cttatgatgaatattaagg

SEQ ID NO: 158539 - DNA, 19 bp, Artificial sequence
  SiRNA target sequence
ttatgatgaatattaagga

SEQ ID NO: 158540 - DNA, 19 bp, Artificial sequence
  SiRNA target sequence
tatgatgaatattaaggat

SEQ ID NO: 158541 - DNA, 19 bp, Artificial sequence
  SiRNA target sequence
atgatgaatattaaggata

SEQ ID NO: 158542 - DNA, 19 bp, Artificial sequence
  SiRNA target sequence
tgatgaatattaaggatat

SEQ ID NO: 158543 - DNA, 19 bp, Artificial sequence
  SiRNA target sequence
gatgaatattaaggatatt

SEQ ID NO: 158544 - DNA, 19 bp, Artificial sequence
  SiRNA target sequence
atgaatattaaggatattg

SEQ ID NO: 158545 - DNA, 19 bp, Artificial sequence
  SiRNA target sequence
tgaatattaaggatattgc

SEQ ID NO: 158546 - DNA, 19 bp, Artificial sequence
  SiRNA target sequence
gaatattaaggatattgct

SEQ ID NO: 158547 - DNA, 19 bp, Artificial sequence
  SiRNA target sequence
aatattaaggatattgctg

SEQ ID NO: 158548 - DNA, 19 bp, Artificial sequence
  SiRNA target sequence
atattaaggatattgctgt

SEQ ID NO: 158549 - DNA, 19 bp, Artificial sequence
  SiRNA target sequence
tattaaggatattgctgtt

SEQ ID NO: 158550 - DNA, 19 bp, Artificial sequence
  SiRNA target sequence
attaaggatattgctgtta

SEQ ID NO: 158551 - DNA, 19 bp, Artificial sequence
  SiRNA target sequence
ttaaggatattgctgttag

SEQ ID NO: 158552 - DNA, 19 bp, Artificial sequence
  SiRNA target sequence
taaggatattgctgttagt

SEQ ID NO: 158553 - DNA, 19 bp, Artificial sequence
  SiRNA target sequence
aaggatattgctgttagta

SEQ ID NO: 158554 - DNA, 19 bp, Artificial sequence
  SiRNA target sequence
aggatattgctgttagtag

SEQ ID NO: 158555 - DNA, 19 bp, Artificial sequence
  SiRNA target sequence
ggatattgctgttagtagt

SEQ ID NO: 158556 - DNA, 19 bp, Artificial sequence
  SiRNA target sequence
gatattgctgttagtagtg

SEQ ID NO: 158557 - DNA, 19 bp, Artificial sequence
  SiRNA target sequence
atattgctgttagtagtgg

SEQ ID NO: 158558 - DNA, 19 bp, Artificial sequence
  SiRNA target sequence
tattgctgttagtagtgga

SEQ ID NO: 158559 - DNA, 19 bp, Artificial sequence
  SiRNA target sequence
attgctgttagtagtggaa

SEQ ID NO: 158560 - DNA, 19 bp, Artificial sequence
  SiRNA target sequence
ttgctgttagtagtggaag

SEQ ID NO: 158561 - DNA, 19 bp, Artificial sequence
  SiRNA target sequence
tgctgttagtagtggaagt

SEQ ID NO: 158562 - DNA, 19 bp, Artificial sequence
  SiRNA target sequence
gctgttagtagtggaagtg

SEQ ID NO: 158563 - DNA, 19 bp, Artificial sequence
  SiRNA target sequence
ctgttagtagtggaagtgc

SEQ ID NO: 158564 - DNA, 19 bp, Artificial sequence
  SiRNA target sequence
tgttagtagtggaagtgct

SEQ ID NO: 158565 - DNA, 19 bp, Artificial sequence
  SiRNA target sequence
gttagtagtggaagtgctt

SEQ ID NO: 158566 - DNA, 19 bp, Artificial sequence
  SiRNA target sequence
ttagtagtggaagtgcttg

SEQ ID NO: 158567 - DNA, 19 bp, Artificial sequence
  SiRNA target sequence
tagtagtggaagtgcttgc

SEQ ID NO: 158568 - DNA, 19 bp, Artificial sequence
  SiRNA target sequence
agtagtggaagtgcttgca

SEQ ID NO: 158569 - DNA, 19 bp, Artificial sequence
  SiRNA target sequence
gtagtggaagtgcttgcac

SEQ ID NO: 158570 - DNA, 19 bp, Artificial sequence
  SiRNA target sequence
tagtggaagtgcttgcact

SEQ ID NO: 158571 - DNA, 19 bp, Artificial sequence
  SiRNA target sequence
agtggaagtgcttgcactt

SEQ ID NO: 158572 - DNA, 19 bp, Artificial sequence
  SiRNA target sequence
gtggaagtgcttgcacttc

SEQ ID NO: 158573 - DNA, 19 bp, Artificial sequence
  SiRNA target sequence
tggaagtgcttgcacttca

SEQ ID NO: 158574 - DNA, 19 bp, Artificial sequence
  SiRNA target sequence
ggaagtgcttgcacttcat

SEQ ID NO: 158575 - DNA, 19 bp, Artificial sequence
  SiRNA target sequence
gaagtgcttgcacttcatc

SEQ ID NO: 158576 - DNA, 19 bp, Artificial sequence
  SiRNA target sequence
aagtgcttgcacttcatca

SEQ ID NO: 158577 - DNA, 19 bp, Artificial sequence
  SiRNA target sequence
agtgcttgcacttcatcat

SEQ ID NO: 158578 - DNA, 19 bp, Artificial sequence
  SiRNA target sequence
gtgcttgcacttcatcatc

SEQ ID NO: 158579 - DNA, 19 bp, Artificial sequence
  SiRNA target sequence
tgcttgcacttcatcatct

SEQ ID NO: 158580 - DNA, 19 bp, Artificial sequence
  SiRNA target sequence
gcttgcacttcatcatctt

SEQ ID NO: 158581 - DNA, 19 bp, Artificial sequence
  SiRNA target sequence
cttgcacttcatcatcttt

SEQ ID NO: 158582 - DNA, 19 bp, Artificial sequence
  SiRNA target sequence
ttgcacttcatcatcttta

SEQ ID NO: 158583 - DNA, 19 bp, Artificial sequence
  SiRNA target sequence
tgcacttcatcatctttag

SEQ ID NO: 158584 - DNA, 19 bp, Artificial sequence
  SiRNA target sequence
gcacttcatcatctttaga

SEQ ID NO: 158585 - DNA, 19 bp, Artificial sequence
  SiRNA target sequence
cacttcatcatctttagaa

SEQ ID NO: 158586 - DNA, 19 bp, Artificial sequence
  SiRNA target sequence
acttcatcatctttagaac

SEQ ID NO: 158587 - DNA, 19 bp, Artificial sequence
  SiRNA target sequence
cttcatcatctttagaacc

SEQ ID NO: 158588 - DNA, 19 bp, Artificial sequence
  SiRNA target sequence
ttcatcatctttagaaccc

SEQ ID NO: 158589 - DNA, 19 bp, Artificial sequence
  SiRNA target sequence
tcatcatctttagaaccct

SEQ ID NO: 158590 - DNA, 19 bp, Artificial sequence
  SiRNA target sequence
catcatctttagaaccctc

SEQ ID NO: 158591 - DNA, 19 bp, Artificial sequence
  SiRNA target sequence
atcatctttagaaccctct

SEQ ID NO: 158592 - DNA, 19 bp, Artificial sequence
  SiRNA target sequence
tcatctttagaaccctctt

SEQ ID NO: 158593 - DNA, 19 bp, Artificial sequence
  SiRNA target sequence
catctttagaaccctctta

SEQ ID NO: 158594 - DNA, 19 bp, Artificial sequence
  SiRNA target sequence
atctttagaaccctcttat

SEQ ID NO: 158595 - DNA, 19 bp, Artificial sequence
  SiRNA target sequence
tctttagaaccctcttatg

SEQ ID NO: 158596 - DNA, 19 bp, Artificial sequence
  SiRNA target sequence
ctttagaaccctcttatgt

SEQ ID NO: 158597 - DNA, 19 bp, Artificial sequence
  SiRNA target sequence
tttagaaccctcttatgtt

SEQ ID NO: 158598 - DNA, 19 bp, Artificial sequence
  SiRNA target sequence
ttagaaccctcttatgttt

SEQ ID NO: 158599 - DNA, 19 bp, Artificial sequence
  SiRNA target sequence
tagaaccctcttatgtttt

SEQ ID NO: 158600 - DNA, 19 bp, Artificial sequence
  SiRNA target sequence
agaaccctcttatgttttg

SEQ ID NO: 158601 - DNA, 19 bp, Artificial sequence
  SiRNA target sequence
gaaccctcttatgttttgc

SEQ ID NO: 158602 - DNA, 19 bp, Artificial sequence
  SiRNA target sequence
aaccctcttatgttttgcg

SEQ ID NO: 158603 - DNA, 19 bp, Artificial sequence
  SiRNA target sequence
accctcttatgttttgcga

SEQ ID NO: 158604 - DNA, 19 bp, Artificial sequence
  SiRNA target sequence
ccctcttatgttttgcgag

SEQ ID NO: 158605 - DNA, 19 bp, Artificial sequence
  SiRNA target sequence
cctcttatgttttgcgagc

SEQ ID NO: 158606 - DNA, 19 bp, Artificial sequence
  SiRNA target sequence
ctcttatgttttgcgagct

SEQ ID NO: 158607 - DNA, 19 bp, Artificial sequence
  SiRNA target sequence
tcttatgttttgcgagctt

SEQ ID NO: 158608 - DNA, 19 bp, Artificial sequence
  SiRNA target sequence
cttatgttttgcgagcttt

SEQ ID NO: 158609 - DNA, 19 bp, Artificial sequence
  SiRNA target sequence
ttatgttttgcgagcttta

SEQ ID NO: 158610 - DNA, 19 bp, Artificial sequence
  SiRNA target sequence
tatgttttgcgagctttag

SEQ ID NO: 158611 - DNA, 19 bp, Artificial sequence
  SiRNA target sequence
atgttttgcgagctttagg

SEQ ID NO: 158612 - DNA, 19 bp, Artificial sequence
  SiRNA target sequence
tgttttgcgagctttaggc

SEQ ID NO: 158613 - DNA, 19 bp, Artificial sequence
  SiRNA target sequence
gttttgcgagctttaggca

SEQ ID NO: 158614 - DNA, 19 bp, Artificial sequence
  SiRNA target sequence
ttttgcgagctttaggcaa

SEQ ID NO: 158615 - DNA, 19 bp, Artificial sequence
  SiRNA target sequence
tttgcgagctttaggcaaa

SEQ ID NO: 158616 - DNA, 19 bp, Artificial sequence
  SiRNA target sequence
ttgcgagctttaggcaaaa

SEQ ID NO: 158617 - DNA, 19 bp, Artificial sequence
  SiRNA target sequence
tgcgagctttaggcaaaaa

SEQ ID NO: 158618 - DNA, 19 bp, Artificial sequence
  SiRNA target sequence
gcgagctttaggcaaaaat

SEQ ID NO: 158619 - DNA, 19 bp, Artificial sequence
  SiRNA target sequence
cgagctttaggcaaaaatg

SEQ ID NO: 158620 - DNA, 19 bp, Artificial sequence
  SiRNA target sequence
gagctttaggcaaaaatga

SEQ ID NO: 158621 - DNA, 19 bp, Artificial sequence
  SiRNA target sequence
agctttaggcaaaaatgat

SEQ ID NO: 158622 - DNA, 19 bp, Artificial sequence
  SiRNA target sequence
gctttaggcaaaaatgatg

SEQ ID NO: 158623 - DNA, 19 bp, Artificial sequence
  SiRNA target sequence
ctttaggcaaaaatgatga

SEQ ID NO: 158624 - DNA, 19 bp, Artificial sequence
  SiRNA target sequence
tttaggcaaaaatgatgat

SEQ ID NO: 158625 - DNA, 19 bp, Artificial sequence
  SiRNA target sequence
ttaggcaaaaatgatgatc

SEQ ID NO: 158626 - DNA, 19 bp, Artificial sequence
  SiRNA target sequence
taggcaaaaatgatgatct

SEQ ID NO: 158627 - DNA, 19 bp, Artificial sequence
  SiRNA target sequence
aggcaaaaatgatgatctt

SEQ ID NO: 158628 - DNA, 19 bp, Artificial sequence
  SiRNA target sequence
ggcaaaaatgatgatcttg

SEQ ID NO: 158629 - DNA, 19 bp, Artificial sequence
  SiRNA target sequence
gcaaaaatgatgatcttgc

SEQ ID NO: 158630 - DNA, 19 bp, Artificial sequence
  SiRNA target sequence
caaaaatgatgatcttgcg

SEQ ID NO: 158631 - DNA, 19 bp, Artificial sequence
  SiRNA target sequence
aaaaatgatgatcttgcgc

SEQ ID NO: 158632 - DNA, 19 bp, Artificial sequence
  SiRNA target sequence
aaaatgatgatcttgcgca

SEQ ID NO: 158633 - DNA, 19 bp, Artificial sequence
  SiRNA target sequence
aaatgatgatcttgcgcat

SEQ ID NO: 158634 - DNA, 19 bp, Artificial sequence
  SiRNA target sequence
aatgatgatcttgcgcatt

SEQ ID NO: 158635 - DNA, 19 bp, Artificial sequence
  SiRNA target sequence
atgatgatcttgcgcattc

SEQ ID NO: 158636 - DNA, 19 bp, Artificial sequence
  SiRNA target sequence
tgatgatcttgcgcattct

SEQ ID NO: 158637 - DNA, 19 bp, Artificial sequence
  SiRNA target sequence
gatgatcttgcgcattctt

SEQ ID NO: 158638 - DNA, 19 bp, Artificial sequence
  SiRNA target sequence
atgatcttgcgcattcttc

SEQ ID NO: 158639 - DNA, 19 bp, Artificial sequence
  SiRNA target sequence
tgatcttgcgcattcttct

SEQ ID NO: 158640 - DNA, 19 bp, Artificial sequence
  SiRNA target sequence
gatcttgcgcattcttcta

SEQ ID NO: 158641 - DNA, 19 bp, Artificial sequence
  SiRNA target sequence
atcttgcgcattcttctat

SEQ ID NO: 158642 - DNA, 19 bp, Artificial sequence
  SiRNA target sequence
tcttgcgcattcttctata

SEQ ID NO: 158643 - DNA, 19 bp, Artificial sequence
  SiRNA target sequence
cttgcgcattcttctataa

SEQ ID NO: 158644 - DNA, 19 bp, Artificial sequence
  SiRNA target sequence
ttgcgcattcttctataag

SEQ ID NO: 158645 - DNA, 19 bp, Artificial sequence
  SiRNA target sequence
tgcgcattcttctataaga

SEQ ID NO: 158646 - DNA, 19 bp, Artificial sequence
  SiRNA target sequence
gcgcattcttctataagat

SEQ ID NO: 158647 - DNA, 19 bp, Artificial sequence
  SiRNA target sequence
cgcattcttctataagatt

SEQ ID NO: 158648 - DNA, 19 bp, Artificial sequence
  SiRNA target sequence
gcattcttctataagattt

SEQ ID NO: 158649 - DNA, 19 bp, Artificial sequence
  SiRNA target sequence
cattcttctataagatttg

SEQ ID NO: 158650 - DNA, 19 bp, Artificial sequence
  SiRNA target sequence
attcttctataagatttgg

SEQ ID NO: 158651 - DNA, 19 bp, Artificial sequence
  SiRNA target sequence
ttcttctataagatttgga

SEQ ID NO: 158652 - DNA, 19 bp, Artificial sequence
  SiRNA target sequence
tcttctataagatttggaa

SEQ ID NO: 158653 - DNA, 19 bp, Artificial sequence
  SiRNA target sequence
cttctataagatttggaat

SEQ ID NO: 158654 - DNA, 19 bp, Artificial sequence
  SiRNA target sequence
ttctataagatttggaata

SEQ ID NO: 158655 - DNA, 19 bp, Artificial sequence
  SiRNA target sequence
tctataagatttggaataa

SEQ ID NO: 158656 - DNA, 19 bp, Artificial sequence
  SiRNA target sequence
ctataagatttggaataaa

SEQ ID NO: 158657 - DNA, 19 bp, Artificial sequence
  SiRNA target sequence
tataagatttggaataaat

SEQ ID NO: 158658 - DNA, 19 bp, Artificial sequence
  SiRNA target sequence
ataagatttggaataaata

SEQ ID NO: 158659 - DNA, 19 bp, Artificial sequence
  SiRNA target sequence
taagatttggaataaataa

SEQ ID NO: 158660 - DNA, 19 bp, Artificial sequence
  SiRNA target sequence
aagatttggaataaataag

SEQ ID NO: 158661 - DNA, 19 bp, Artificial sequence
  SiRNA target sequence
agatttggaataaataagt

SEQ ID NO: 158662 - DNA, 19 bp, Artificial sequence
  SiRNA target sequence
gatttggaataaataagtt

SEQ ID NO: 158663 - DNA, 19 bp, Artificial sequence
  SiRNA target sequence
atttggaataaataagttt

SEQ ID NO: 158664 - DNA, 19 bp, Artificial sequence
  SiRNA target sequence
tttggaataaataagttta

SEQ ID NO: 158665 - DNA, 19 bp, Artificial sequence
  SiRNA target sequence
ttggaataaataagtttac

SEQ ID NO: 158666 - DNA, 19 bp, Artificial sequence
  SiRNA target sequence
tggaataaataagtttaca

SEQ ID NO: 158667 - DNA, 19 bp, Artificial sequence
  SiRNA target sequence
ggaataaataagtttacaa

SEQ ID NO: 158668 - DNA, 19 bp, Artificial sequence
  SiRNA target sequence
gaataaataagtttacaac

SEQ ID NO: 158669 - DNA, 19 bp, Artificial sequence
  SiRNA target sequence
aataaataagtttacaact

SEQ ID NO: 158670 - DNA, 19 bp, Artificial sequence
  SiRNA target sequence
ataaataagtttacaactg

SEQ ID NO: 158671 - DNA, 19 bp, Artificial sequence
  SiRNA target sequence
taaataagtttacaactga

SEQ ID NO: 158672 - DNA, 19 bp, Artificial sequence
  SiRNA target sequence
aaataagtttacaactgaa

SEQ ID NO: 158673 - DNA, 19 bp, Artificial sequence
  SiRNA target sequence
aataagtttacaactgaag

SEQ ID NO: 158674 - DNA, 19 bp, Artificial sequence
  SiRNA target sequence
ataagtttacaactgaaga

SEQ ID NO: 158675 - DNA, 19 bp, Artificial sequence
  SiRNA target sequence
taagtttacaactgaagaa

SEQ ID NO: 158676 - DNA, 19 bp, Artificial sequence
  SiRNA target sequence
aagtttacaactgaagaag

SEQ ID NO: 158677 - DNA, 19 bp, Artificial sequence
  SiRNA target sequence
agtttacaactgaagaaga

SEQ ID NO: 158678 - DNA, 19 bp, Artificial sequence
  SiRNA target sequence
gtttacaactgaagaagaa

SEQ ID NO: 158679 - DNA, 19 bp, Artificial sequence
  SiRNA target sequence
tttacaactgaagaagaaa

SEQ ID NO: 158680 - DNA, 19 bp, Artificial sequence
  SiRNA target sequence
ttacaactgaagaagaaat

SEQ ID NO: 158681 - DNA, 19 bp, Artificial sequence
  SiRNA target sequence
tacaactgaagaagaaatc

SEQ ID NO: 158682 - DNA, 19 bp, Artificial sequence
  SiRNA target sequence
acaactgaagaagaaatca

SEQ ID NO: 158683 - DNA, 19 bp, Artificial sequence
  SiRNA target sequence
caactgaagaagaaatcaa

SEQ ID NO: 158684 - DNA, 19 bp, Artificial sequence
  SiRNA target sequence
aactgaagaagaaatcaat

SEQ ID NO: 158685 - DNA, 19 bp, Artificial sequence
  SiRNA target sequence
actgaagaagaaatcaata

SEQ ID NO: 158686 - DNA, 19 bp, Artificial sequence
  SiRNA target sequence
ctgaagaagaaatcaataa

SEQ ID NO: 158687 - DNA, 19 bp, Artificial sequence
  SiRNA target sequence
tgaagaagaaatcaataaa

SEQ ID NO: 158688 - DNA, 19 bp, Artificial sequence
  SiRNA target sequence
gaagaagaaatcaataaag

SEQ ID NO: 158689 - DNA, 19 bp, Artificial sequence
  SiRNA target sequence
aagaagaaatcaataaagt

SEQ ID NO: 158690 - DNA, 19 bp, Artificial sequence
  SiRNA target sequence
agaagaaatcaataaagta

SEQ ID NO: 158691 - DNA, 19 bp, Artificial sequence
  SiRNA target sequence
gaagaaatcaataaagtat

SEQ ID NO: 158692 - DNA, 19 bp, Artificial sequence
  SiRNA target sequence
aagaaatcaataaagtatc

SEQ ID NO: 158693 - DNA, 19 bp, Artificial sequence
  SiRNA target sequence
agaaatcaataaagtatct

SEQ ID NO: 158694 - DNA, 19 bp, Artificial sequence
  SiRNA target sequence
gaaatcaataaagtatcta

SEQ ID NO: 158695 - DNA, 19 bp, Artificial sequence
  SiRNA target sequence
aaatcaataaagtatctag

SEQ ID NO: 158696 - DNA, 19 bp, Artificial sequence
  SiRNA target sequence
aatcaataaagtatctagt

SEQ ID NO: 158697 - DNA, 19 bp, Artificial sequence
  SiRNA target sequence
atcaataaagtatctagtg

SEQ ID NO: 158698 - DNA, 19 bp, Artificial sequence
  SiRNA target sequence
tcaataaagtatctagtga

SEQ ID NO: 158699 - DNA, 19 bp, Artificial sequence
  SiRNA target sequence
caataaagtatctagtgat

SEQ ID NO: 158700 - DNA, 19 bp, Artificial sequence
  SiRNA target sequence
aataaagtatctagtgata

SEQ ID NO: 158701 - DNA, 19 bp, Artificial sequence
  SiRNA target sequence
ataaagtatctagtgatac

SEQ ID NO: 158702 - DNA, 19 bp, Artificial sequence
  SiRNA target sequence
taaagtatctagtgataca

SEQ ID NO: 158703 - DNA, 19 bp, Artificial sequence
  SiRNA target sequence
aaagtatctagtgatacaa

SEQ ID NO: 158704 - DNA, 19 bp, Artificial sequence
  SiRNA target sequence
aagtatctagtgatacaat

SEQ ID NO: 158705 - DNA, 19 bp, Artificial sequence
  SiRNA target sequence
agtatctagtgatacaatt

SEQ ID NO: 158706 - DNA, 19 bp, Artificial sequence
  SiRNA target sequence
gtatctagtgatacaatta

SEQ ID NO: 158707 - DNA, 19 bp, Artificial sequence
  SiRNA target sequence
tatctagtgatacaattaa

SEQ ID NO: 158708 - DNA, 19 bp, Artificial sequence
  SiRNA target sequence
atctagtgatacaattaaa

SEQ ID NO: 158709 - DNA, 19 bp, Artificial sequence
  SiRNA target sequence
tctagtgatacaattaaag

SEQ ID NO: 158710 - DNA, 19 bp, Artificial sequence
  SiRNA target sequence
ctagtgatacaattaaagc

SEQ ID NO: 158711 - DNA, 19 bp, Artificial sequence
  SiRNA target sequence
tagtgatacaattaaagct

SEQ ID NO: 158712 - DNA, 19 bp, Artificial sequence
  SiRNA target sequence
agtgatacaattaaagctg

SEQ ID NO: 158713 - DNA, 19 bp, Artificial sequence
  SiRNA target sequence
gtgatacaattaaagctgt

SEQ ID NO: 158714 - DNA, 19 bp, Artificial sequence
  SiRNA target sequence
tgatacaattaaagctgtt

SEQ ID NO: 158715 - DNA, 19 bp, Artificial sequence
  SiRNA target sequence
gatacaattaaagctgtta

SEQ ID NO: 158716 - DNA, 19 bp, Artificial sequence
  SiRNA target sequence
atacaattaaagctgttaa

SEQ ID NO: 158717 - DNA, 19 bp, Artificial sequence
  SiRNA target sequence
tacaattaaagctgttaat

SEQ ID NO: 158718 - DNA, 19 bp, Artificial sequence
  SiRNA target sequence
acaattaaagctgttaata

SEQ ID NO: 158719 - DNA, 19 bp, Artificial sequence
  SiRNA target sequence
caattaaagctgttaataa

SEQ ID NO: 158720 - DNA, 19 bp, Artificial sequence
  SiRNA target sequence
aattaaagctgttaataag

SEQ ID NO: 158721 - DNA, 19 bp, Artificial sequence
  SiRNA target sequence
attaaagctgttaataagt

SEQ ID NO: 158722 - DNA, 19 bp, Artificial sequence
  SiRNA target sequence
ttaaagctgttaataagtt

SEQ ID NO: 158723 - DNA, 19 bp, Artificial sequence
  SiRNA target sequence
taaagctgttaataagtta

SEQ ID NO: 158724 - DNA, 19 bp, Artificial sequence
  SiRNA target sequence
aaagctgttaataagttaa

SEQ ID NO: 158725 - DNA, 19 bp, Artificial sequence
  SiRNA target sequence
aagctgttaataagttaag

SEQ ID NO: 158726 - DNA, 19 bp, Artificial sequence
  SiRNA target sequence
agctgttaataagttaaga

SEQ ID NO: 158727 - DNA, 19 bp, Artificial sequence
  SiRNA target sequence
gctgttaataagttaagag

SEQ ID NO: 158728 - DNA, 19 bp, Artificial sequence
  SiRNA target sequence
ctgttaataagttaagaga

SEQ ID NO: 158729 - DNA, 19 bp, Artificial sequence
  SiRNA target sequence
tgttaataagttaagagat

SEQ ID NO: 158730 - DNA, 19 bp, Artificial sequence
  SiRNA target sequence
gttaataagttaagagata

SEQ ID NO: 158731 - DNA, 19 bp, Artificial sequence
  SiRNA target sequence
ttaataagttaagagatat

SEQ ID NO: 158732 - DNA, 19 bp, Artificial sequence
  SiRNA target sequence
taataagttaagagatatg

SEQ ID NO: 158733 - DNA, 19 bp, Artificial sequence
  SiRNA target sequence
aataagttaagagatatgt

SEQ ID NO: 158734 - DNA, 19 bp, Artificial sequence
  SiRNA target sequence
ataagttaagagatatgtc

SEQ ID NO: 158735 - DNA, 19 bp, Artificial sequence
  SiRNA target sequence
taagttaagagatatgtct

SEQ ID NO: 158736 - DNA, 19 bp, Artificial sequence
  SiRNA target sequence
aagttaagagatatgtctc

SEQ ID NO: 158737 - DNA, 19 bp, Artificial sequence
  SiRNA target sequence
agttaagagatatgtctcc

SEQ ID NO: 158738 - DNA, 19 bp, Artificial sequence
  SiRNA target sequence
gttaagagatatgtctcct

SEQ ID NO: 158739 - DNA, 19 bp, Artificial sequence
  SiRNA target sequence
ttaagagatatgtctcctt

SEQ ID NO: 158740 - DNA, 19 bp, Artificial sequence
  SiRNA target sequence
taagagatatgtctccttt

SEQ ID NO: 158741 - DNA, 19 bp, Artificial sequence
  SiRNA target sequence
aagagatatgtctccttta

SEQ ID NO: 158742 - DNA, 19 bp, Artificial sequence
  SiRNA target sequence
agagatatgtctcctttat

SEQ ID NO: 158743 - DNA, 19 bp, Artificial sequence
  SiRNA target sequence
gagatatgtctcctttata

SEQ ID NO: 158744 - DNA, 19 bp, Artificial sequence
  SiRNA target sequence
agatatgtctcctttatat

SEQ ID NO: 158745 - DNA, 19 bp, Artificial sequence
  SiRNA target sequence
gatatgtctcctttatatg

SEQ ID NO: 158746 - DNA, 19 bp, Artificial sequence
  SiRNA target sequence
atatgtctcctttatatga

SEQ ID NO: 158747 - DNA, 19 bp, Artificial sequence
  SiRNA target sequence
tatgtctcctttatatgaa

SEQ ID NO: 158748 - DNA, 19 bp, Artificial sequence
  SiRNA target sequence
atgtctcctttatatgaaa

SEQ ID NO: 158749 - DNA, 19 bp, Artificial sequence
  SiRNA target sequence
tgtctcctttatatgaaat

SEQ ID NO: 158750 - DNA, 19 bp, Artificial sequence
  SiRNA target sequence
gtctcctttatatgaaatg

SEQ ID NO: 158751 - DNA, 19 bp, Artificial sequence
  SiRNA target sequence
tctcctttatatgaaatgg

SEQ ID NO: 158752 - DNA, 19 bp, Artificial sequence
  SiRNA target sequence
ctcctttatatgaaatggt

SEQ ID NO: 158753 - DNA, 19 bp, Artificial sequence
  SiRNA target sequence
tcctttatatgaaatggtc

SEQ ID NO: 158754 - DNA, 19 bp, Artificial sequence
  SiRNA target sequence
cctttatatgaaatggtca

SEQ ID NO: 158755 - DNA, 19 bp, Artificial sequence
  SiRNA target sequence
ctttatatgaaatggtcaa

SEQ ID NO: 158756 - DNA, 19 bp, Artificial sequence
  SiRNA target sequence
tttatatgaaatggtcaaa

SEQ ID NO: 158757 - DNA, 19 bp, Artificial sequence
  SiRNA target sequence
ttatatgaaatggtcaaag

SEQ ID NO: 158758 - DNA, 19 bp, Artificial sequence
  SiRNA target sequence
tatatgaaatggtcaaaga

SEQ ID NO: 158759 - DNA, 19 bp, Artificial sequence
  SiRNA target sequence
atatgaaatggtcaaagaa

SEQ ID NO: 158760 - DNA, 19 bp, Artificial sequence
  SiRNA target sequence
tatgaaatggtcaaagaag

SEQ ID NO: 158761 - DNA, 19 bp, Artificial sequence
  SiRNA target sequence
atgaaatggtcaaagaagg

SEQ ID NO: 158762 - DNA, 19 bp, Artificial sequence
  SiRNA target sequence
tgaaatggtcaaagaaggg

SEQ ID NO: 158763 - DNA, 19 bp, Artificial sequence
  SiRNA target sequence
gaaatggtcaaagaaggga

SEQ ID NO: 158764 - DNA, 19 bp, Artificial sequence
  SiRNA target sequence
aaatggtcaaagaagggat

SEQ ID NO: 158765 - DNA, 19 bp, Artificial sequence
  SiRNA target sequence
aatggtcaaagaagggata

SEQ ID NO: 158766 - DNA, 19 bp, Artificial sequence
  SiRNA target sequence
atggtcaaagaagggatag

SEQ ID NO: 158767 - DNA, 19 bp, Artificial sequence
  SiRNA target sequence
tggtcaaagaagggataga

SEQ ID NO: 158768 - DNA, 19 bp, Artificial sequence
  SiRNA target sequence
ggtcaaagaagggatagat

SEQ ID NO: 158769 - DNA, 19 bp, Artificial sequence
  SiRNA target sequence
gtcaaagaagggatagatt

SEQ ID NO: 158770 - DNA, 19 bp, Artificial sequence
  SiRNA target sequence
tcaaagaagggatagattt

SEQ ID NO: 158771 - DNA, 19 bp, Artificial sequence
  SiRNA target sequence
caaagaagggatagattta

SEQ ID NO: 158772 - DNA, 19 bp, Artificial sequence
  SiRNA target sequence
aaagaagggatagatttag

SEQ ID NO: 158773 - DNA, 19 bp, Artificial sequence
  SiRNA target sequence
aagaagggatagatttaga

SEQ ID NO: 158774 - DNA, 19 bp, Artificial sequence
  SiRNA target sequence
agaagggatagatttagat

SEQ ID NO: 158775 - DNA, 19 bp, Artificial sequence
  SiRNA target sequence
gaagggatagatttagata

SEQ ID NO: 158776 - DNA, 19 bp, Artificial sequence
  SiRNA target sequence
aagggatagatttagataa

SEQ ID NO: 158777 - DNA, 19 bp, Artificial sequence
  SiRNA target sequence
agggatagatttagataaa

SEQ ID NO: 158778 - DNA, 19 bp, Artificial sequence
  SiRNA target sequence
gggatagatttagataaaa

SEQ ID NO: 158779 - DNA, 19 bp, Artificial sequence
  SiRNA target sequence
ggatagatttagataaaat

SEQ ID NO: 158780 - DNA, 19 bp, Artificial sequence
  SiRNA target sequence
gatagatttagataaaatt

SEQ ID NO: 158781 - DNA, 19 bp, Artificial sequence
  SiRNA target sequence
atagatttagataaaatta

SEQ ID NO: 158782 - DNA, 19 bp, Artificial sequence
  SiRNA target sequence
tagatttagataaaattaa

SEQ ID NO: 158783 - DNA, 19 bp, Artificial sequence
  SiRNA target sequence
agatttagataaaattaat

SEQ ID NO: 158784 - DNA, 19 bp, Artificial sequence
  SiRNA target sequence
gatttagataaaattaatt

SEQ ID NO: 158785 - DNA, 19 bp, Artificial sequence
  SiRNA target sequence
atttagataaaattaattg

SEQ ID NO: 158786 - DNA, 19 bp, Artificial sequence
  SiRNA target sequence
tttagataaaattaattgg

SEQ ID NO: 158787 - DNA, 19 bp, Artificial sequence
  SiRNA target sequence
ttagataaaattaattggt

SEQ ID NO: 158788 - DNA, 19 bp, Artificial sequence
  SiRNA target sequence
tagataaaattaattggtc

SEQ ID NO: 158789 - DNA, 19 bp, Artificial sequence
  SiRNA target sequence
agataaaattaattggtct

SEQ ID NO: 158790 - DNA, 19 bp, Artificial sequence
  SiRNA target sequence
gataaaattaattggtctg

SEQ ID NO: 158791 - DNA, 19 bp, Artificial sequence
  SiRNA target sequence
ataaaattaattggtctgc

SEQ ID NO: 158792 - DNA, 19 bp, Artificial sequence
  SiRNA target sequence
taaaattaattggtctgct

SEQ ID NO: 158793 - DNA, 19 bp, Artificial sequence
  SiRNA target sequence
aaaattaattggtctgctt

SEQ ID NO: 158794 - DNA, 19 bp, Artificial sequence
  SiRNA target sequence
aaattaattggtctgctta

SEQ ID NO: 158795 - DNA, 19 bp, Artificial sequence
  SiRNA target sequence
aattaattggtctgcttaa

SEQ ID NO: 158796 - DNA, 20 bp, Artificial sequence
  SiRNA target sequence
atgttatttttttatagccc

SEQ ID NO: 158797 - DNA, 20 bp, Artificial sequence
  SiRNA target sequence
tgttatttttttatagcccc

SEQ ID NO: 158798 - DNA, 20 bp, Artificial sequence
  SiRNA target sequence
gttatttttttatagcccca

SEQ ID NO: 158799 - DNA, 20 bp, Artificial sequence
  SiRNA target sequence
ttatttttttatagccccat

SEQ ID NO: 158800 - DNA, 20 bp, Artificial sequence
  SiRNA target sequence
tatttttttatagccccatt

SEQ ID NO: 158801 - DNA, 20 bp, Artificial sequence
  SiRNA target sequence
atttttttatagccccattt

SEQ ID NO: 158802 - DNA, 20 bp, Artificial sequence
  SiRNA target sequence
tttttttatagccccatttt

SEQ ID NO: 158803 - DNA, 20 bp, Artificial sequence
  SiRNA target sequence
ttttttatagccccattttt

SEQ ID NO: 158804 - DNA, 20 bp, Artificial sequence
  SiRNA target sequence
tttttatagccccattttta

SEQ ID NO: 158805 - DNA, 20 bp, Artificial sequence
  SiRNA target sequence
ttttatagccccatttttat

SEQ ID NO: 158806 - DNA, 20 bp, Artificial sequence
  SiRNA target sequence
tttatagccccatttttatg

SEQ ID NO: 158807 - DNA, 20 bp, Artificial sequence
  SiRNA target sequence
ttatagccccatttttatga

SEQ ID NO: 158808 - DNA, 20 bp, Artificial sequence
  SiRNA target sequence
tatagccccatttttatgac

SEQ ID NO: 158809 - DNA, 20 bp, Artificial sequence
  SiRNA target sequence
atagccccatttttatgact

SEQ ID NO: 158810 - DNA, 20 bp, Artificial sequence
  SiRNA target sequence
tagccccatttttatgacta

SEQ ID NO: 158811 - DNA, 20 bp, Artificial sequence
  SiRNA target sequence
agccccatttttatgactaa

SEQ ID NO: 158812 - DNA, 20 bp, Artificial sequence
  SiRNA target sequence
gccccatttttatgactaaa

SEQ ID NO: 158813 - DNA, 20 bp, Artificial sequence
  SiRNA target sequence
ccccatttttatgactaaaa

SEQ ID NO: 158814 - DNA, 20 bp, Artificial sequence
  SiRNA target sequence
cccatttttatgactaaaag

SEQ ID NO: 158815 - DNA, 20 bp, Artificial sequence
  SiRNA target sequence
ccatttttatgactaaaagt

SEQ ID NO: 158816 - DNA, 20 bp, Artificial sequence
  SiRNA target sequence
catttttatgactaaaagtt

SEQ ID NO: 158817 - DNA, 20 bp, Artificial sequence
  SiRNA target sequence
atttttatgactaaaagttt

SEQ ID NO: 158818 - DNA, 20 bp, Artificial sequence
  SiRNA target sequence
tttttatgactaaaagttta

SEQ ID NO: 158819 - DNA, 20 bp, Artificial sequence
  SiRNA target sequence
ttttatgactaaaagtttaa

SEQ ID NO: 158820 - DNA, 20 bp, Artificial sequence
  SiRNA target sequence
tttatgactaaaagtttaac

SEQ ID NO: 158821 - DNA, 20 bp, Artificial sequence
  SiRNA target sequence
ttatgactaaaagtttaacg

SEQ ID NO: 158822 - DNA, 20 bp, Artificial sequence
  SiRNA target sequence
tatgactaaaagtttaacga

SEQ ID NO: 158823 - DNA, 20 bp, Artificial sequence
  SiRNA target sequence
atgactaaaagtttaacgaa

SEQ ID NO: 158824 - DNA, 20 bp, Artificial sequence
  SiRNA target sequence
tgactaaaagtttaacgaat

SEQ ID NO: 158825 - DNA, 20 bp, Artificial sequence
  SiRNA target sequence
gactaaaagtttaacgaatt

SEQ ID NO: 158826 - DNA, 20 bp, Artificial sequence
  SiRNA target sequence
actaaaagtttaacgaattc

SEQ ID NO: 158827 - DNA, 20 bp, Artificial sequence
  SiRNA target sequence
ctaaaagtttaacgaattct

SEQ ID NO: 158828 - DNA, 20 bp, Artificial sequence
  SiRNA target sequence
taaaagtttaacgaattcta

SEQ ID NO: 158829 - DNA, 20 bp, Artificial sequence
  SiRNA target sequence
aaaagtttaacgaattctaa

SEQ ID NO: 158830 - DNA, 20 bp, Artificial sequence
  SiRNA target sequence
aaagtttaacgaattctaaa

SEQ ID NO: 158831 - DNA, 20 bp, Artificial sequence
  SiRNA target sequence
aagtttaacgaattctaaaa

SEQ ID NO: 158832 - DNA, 20 bp, Artificial sequence
  SiRNA target sequence
agtttaacgaattctaaaac

SEQ ID NO: 158833 - DNA, 20 bp, Artificial sequence
  SiRNA target sequence
gtttaacgaattctaaaact

SEQ ID NO: 158834 - DNA, 20 bp, Artificial sequence
  SiRNA target sequence
tttaacgaattctaaaactt

SEQ ID NO: 158835 - DNA, 20 bp, Artificial sequence
  SiRNA target sequence
ttaacgaattctaaaacttt

SEQ ID NO: 158836 - DNA, 20 bp, Artificial sequence
  SiRNA target sequence
taacgaattctaaaacttta

SEQ ID NO: 158837 - DNA, 20 bp, Artificial sequence
  SiRNA target sequence
aacgaattctaaaactttaa

SEQ ID NO: 158838 - DNA, 20 bp, Artificial sequence
  SiRNA target sequence
acgaattctaaaactttaaa

SEQ ID NO: 158839 - DNA, 20 bp, Artificial sequence
  SiRNA target sequence
cgaattctaaaactttaaat

SEQ ID NO: 158840 - DNA, 20 bp, Artificial sequence
  SiRNA target sequence
gaattctaaaactttaaatt

SEQ ID NO: 158841 - DNA, 20 bp, Artificial sequence
  SiRNA target sequence
aattctaaaactttaaattt

SEQ ID NO: 158842 - DNA, 20 bp, Artificial sequence
  SiRNA target sequence
attctaaaactttaaattta

SEQ ID NO: 158843 - DNA, 20 bp, Artificial sequence
  SiRNA target sequence
ttctaaaactttaaatttaa

SEQ ID NO: 158844 - DNA, 20 bp, Artificial sequence
  SiRNA target sequence
tctaaaactttaaatttaat

SEQ ID NO: 158845 - DNA, 20 bp, Artificial sequence
  SiRNA target sequence
ctaaaactttaaatttaatg

SEQ ID NO: 158846 - DNA, 20 bp, Artificial sequence
  SiRNA target sequence
taaaactttaaatttaatgt

SEQ ID NO: 158847 - DNA, 20 bp, Artificial sequence
  SiRNA target sequence
aaaactttaaatttaatgtc

SEQ ID NO: 158848 - DNA, 20 bp, Artificial sequence
  SiRNA target sequence
aaactttaaatttaatgtca

SEQ ID NO: 158849 - DNA, 20 bp, Artificial sequence
  SiRNA target sequence
aactttaaatttaatgtcaa

SEQ ID NO: 158850 - DNA, 20 bp, Artificial sequence
  SiRNA target sequence
actttaaatttaatgtcaag

SEQ ID NO: 158851 - DNA, 20 bp, Artificial sequence
  SiRNA target sequence
ctttaaatttaatgtcaagt

SEQ ID NO: 158852 - DNA, 20 bp, Artificial sequence
  SiRNA target sequence
tttaaatttaatgtcaagtg

SEQ ID NO: 158853 - DNA, 20 bp, Artificial sequence
  SiRNA target sequence
ttaaatttaatgtcaagtgt

SEQ ID NO: 158854 - DNA, 20 bp, Artificial sequence
  SiRNA target sequence
taaatttaatgtcaagtgta

SEQ ID NO: 158855 - DNA, 20 bp, Artificial sequence
  SiRNA target sequence
aaatttaatgtcaagtgtac

SEQ ID NO: 158856 - DNA, 20 bp, Artificial sequence
  SiRNA target sequence
aatttaatgtcaagtgtaca

SEQ ID NO: 158857 - DNA, 20 bp, Artificial sequence
  SiRNA target sequence
atttaatgtcaagtgtacaa

SEQ ID NO: 158858 - DNA, 20 bp, Artificial sequence
  SiRNA target sequence
tttaatgtcaagtgtacaat

SEQ ID NO: 158859 - DNA, 20 bp, Artificial sequence
  SiRNA target sequence
ttaatgtcaagtgtacaatc

SEQ ID NO: 158860 - DNA, 20 bp, Artificial sequence
  SiRNA target sequence
taatgtcaagtgtacaatca

SEQ ID NO: 158861 - DNA, 20 bp, Artificial sequence
  SiRNA target sequence
aatgtcaagtgtacaatcac

SEQ ID NO: 158862 - DNA, 20 bp, Artificial sequence
  SiRNA target sequence
atgtcaagtgtacaatcacc

SEQ ID NO: 158863 - DNA, 20 bp, Artificial sequence
  SiRNA target sequence
tgtcaagtgtacaatcacca

SEQ ID NO: 158864 - DNA, 20 bp, Artificial sequence
  SiRNA target sequence
gtcaagtgtacaatcaccag

SEQ ID NO: 158865 - DNA, 20 bp, Artificial sequence
  SiRNA target sequence
tcaagtgtacaatcaccagt

SEQ ID NO: 158866 - DNA, 20 bp, Artificial sequence
  SiRNA target sequence
caagtgtacaatcaccagtt

SEQ ID NO: 158867 - DNA, 20 bp, Artificial sequence
  SiRNA target sequence
aagtgtacaatcaccagtta

SEQ ID NO: 158868 - DNA, 20 bp, Artificial sequence
  SiRNA target sequence
agtgtacaatcaccagttat

SEQ ID NO: 158869 - DNA, 20 bp, Artificial sequence
  SiRNA target sequence
gtgtacaatcaccagttata

SEQ ID NO: 158870 - DNA, 20 bp, Artificial sequence
  SiRNA target sequence
tgtacaatcaccagttataa

SEQ ID NO: 158871 - DNA, 20 bp, Artificial sequence
  SiRNA target sequence
gtacaatcaccagttataaa

SEQ ID NO: 158872 - DNA, 20 bp, Artificial sequence
  SiRNA target sequence
tacaatcaccagttataaat

SEQ ID NO: 158873 - DNA, 20 bp, Artificial sequence
  SiRNA target sequence
acaatcaccagttataaata

SEQ ID NO: 158874 - DNA, 20 bp, Artificial sequence
  SiRNA target sequence
caatcaccagttataaatac

SEQ ID NO: 158875 - DNA, 20 bp, Artificial sequence
  SiRNA target sequence
aatcaccagttataaataca

SEQ ID NO: 158876 - DNA, 20 bp, Artificial sequence
  SiRNA target sequence
atcaccagttataaatacaa

SEQ ID NO: 158877 - DNA, 20 bp, Artificial sequence
  SiRNA target sequence
tcaccagttataaatacaaa

SEQ ID NO: 158878 - DNA, 20 bp, Artificial sequence
  SiRNA target sequence
caccagttataaatacaaaa

SEQ ID NO: 158879 - DNA, 20 bp, Artificial sequence
  SiRNA target sequence
accagttataaatacaaaaa

SEQ ID NO: 158880 - DNA, 20 bp, Artificial sequence
  SiRNA target sequence
ccagttataaatacaaaaaa

SEQ ID NO: 158881 - DNA, 20 bp, Artificial sequence
  SiRNA target sequence
cagttataaatacaaaaaaa

SEQ ID NO: 158882 - DNA, 20 bp, Artificial sequence
  SiRNA target sequence
agttataaatacaaaaaaaa

SEQ ID NO: 158883 - DNA, 20 bp, Artificial sequence
  SiRNA target sequence
gttataaatacaaaaaaaat

SEQ ID NO: 158884 - DNA, 20 bp, Artificial sequence
  SiRNA target sequence
ttataaatacaaaaaaaata

SEQ ID NO: 158885 - DNA, 20 bp, Artificial sequence
  SiRNA target sequence
tataaatacaaaaaaaatat

SEQ ID NO: 158886 - DNA, 20 bp, Artificial sequence
  SiRNA target sequence
ataaatacaaaaaaaatata

SEQ ID NO: 158887 - DNA, 20 bp, Artificial sequence
  SiRNA target sequence
taaatacaaaaaaaatatat

SEQ ID NO: 158888 - DNA, 20 bp, Artificial sequence
  SiRNA target sequence
aaatacaaaaaaaatatatc

SEQ ID NO: 158889 - DNA, 20 bp, Artificial sequence
  SiRNA target sequence
aatacaaaaaaaatatatct

SEQ ID NO: 158890 - DNA, 20 bp, Artificial sequence
  SiRNA target sequence
atacaaaaaaaatatatctt

SEQ ID NO: 158891 - DNA, 20 bp, Artificial sequence
  SiRNA target sequence
tacaaaaaaaatatatcttg

SEQ ID NO: 158892 - DNA, 20 bp, Artificial sequence
  SiRNA target sequence
acaaaaaaaatatatcttga

SEQ ID NO: 158893 - DNA, 20 bp, Artificial sequence
  SiRNA target sequence
caaaaaaaatatatcttgat

SEQ ID NO: 158894 - DNA, 20 bp, Artificial sequence
  SiRNA target sequence
aaaaaaaatatatcttgatg

SEQ ID NO: 158895 - DNA, 20 bp, Artificial sequence
  SiRNA target sequence
aaaaaaatatatcttgatgc

SEQ ID NO: 158896 - DNA, 20 bp, Artificial sequence
  SiRNA target sequence
aaaaaatatatcttgatgca

SEQ ID NO: 158897 - DNA, 20 bp, Artificial sequence
  SiRNA target sequence
aaaaatatatcttgatgcac

SEQ ID NO: 158898 - DNA, 20 bp, Artificial sequence
  SiRNA target sequence
aaaatatatcttgatgcaca

SEQ ID NO: 158899 - DNA, 20 bp, Artificial sequence
  SiRNA target sequence
aaatatatcttgatgcacaa

SEQ ID NO: 158900 - DNA, 20 bp, Artificial sequence
  SiRNA target sequence
aatatatcttgatgcacaag

SEQ ID NO: 158901 - DNA, 20 bp, Artificial sequence
  SiRNA target sequence
atatatcttgatgcacaagc

SEQ ID NO: 158902 - DNA, 20 bp, Artificial sequence
  SiRNA target sequence
tatatcttgatgcacaagcg

SEQ ID NO: 158903 - DNA, 20 bp, Artificial sequence
  SiRNA target sequence
atatcttgatgcacaagcga

SEQ ID NO: 158904 - DNA, 20 bp, Artificial sequence
  SiRNA target sequence
tatcttgatgcacaagcgac

SEQ ID NO: 158905 - DNA, 20 bp, Artificial sequence
  SiRNA target sequence
atcttgatgcacaagcgacc

SEQ ID NO: 158906 - DNA, 20 bp, Artificial sequence
  SiRNA target sequence
tcttgatgcacaagcgacca

SEQ ID NO: 158907 - DNA, 20 bp, Artificial sequence
  SiRNA target sequence
cttgatgcacaagcgaccaa

SEQ ID NO: 158908 - DNA, 20 bp, Artificial sequence
  SiRNA target sequence
ttgatgcacaagcgaccaag

SEQ ID NO: 158909 - DNA, 20 bp, Artificial sequence
  SiRNA target sequence
tgatgcacaagcgaccaagc

SEQ ID NO: 158910 - DNA, 20 bp, Artificial sequence
  SiRNA target sequence
gatgcacaagcgaccaagcc

SEQ ID NO: 158911 - DNA, 20 bp, Artificial sequence
  SiRNA target sequence
atgcacaagcgaccaagcct

SEQ ID NO: 158912 - DNA, 20 bp, Artificial sequence
  SiRNA target sequence
tgcacaagcgaccaagcctt

SEQ ID NO: 158913 - DNA, 20 bp, Artificial sequence
  SiRNA target sequence
gcacaagcgaccaagccttt

SEQ ID NO: 158914 - DNA, 20 bp, Artificial sequence
  SiRNA target sequence
cacaagcgaccaagccttta

SEQ ID NO: 158915 - DNA, 20 bp, Artificial sequence
  SiRNA target sequence
acaagcgaccaagcctttag

SEQ ID NO: 158916 - DNA, 20 bp, Artificial sequence
  SiRNA target sequence
caagcgaccaagcctttaga

SEQ ID NO: 158917 - DNA, 20 bp, Artificial sequence
  SiRNA target sequence
aagcgaccaagcctttagac

SEQ ID NO: 158918 - DNA, 20 bp, Artificial sequence
  SiRNA target sequence
agcgaccaagcctttagacc

SEQ ID NO: 158919 - DNA, 20 bp, Artificial sequence
  SiRNA target sequence
gcgaccaagcctttagaccc

SEQ ID NO: 158920 - DNA, 20 bp, Artificial sequence
  SiRNA target sequence
cgaccaagcctttagacccg

SEQ ID NO: 158921 - DNA, 20 bp, Artificial sequence
  SiRNA target sequence
gaccaagcctttagacccgc

SEQ ID NO: 158922 - DNA, 20 bp, Artificial sequence
  SiRNA target sequence
accaagcctttagacccgcg

SEQ ID NO: 158923 - DNA, 20 bp, Artificial sequence
  SiRNA target sequence
ccaagcctttagacccgcgt

SEQ ID NO: 158924 - DNA, 20 bp, Artificial sequence
  SiRNA target sequence
caagcctttagacccgcgtg

SEQ ID NO: 158925 - DNA, 20 bp, Artificial sequence
  SiRNA target sequence
aagcctttagacccgcgtgt

SEQ ID NO: 158926 - DNA, 20 bp, Artificial sequence
  SiRNA target sequence
agcctttagacccgcgtgtg

SEQ ID NO: 158927 - DNA, 20 bp, Artificial sequence
  SiRNA target sequence
gcctttagacccgcgtgtgc

SEQ ID NO: 158928 - DNA, 20 bp, Artificial sequence
  SiRNA target sequence
cctttagacccgcgtgtgct

SEQ ID NO: 158929 - DNA, 20 bp, Artificial sequence
  SiRNA target sequence
ctttagacccgcgtgtgctt

SEQ ID NO: 158930 - DNA, 20 bp, Artificial sequence
  SiRNA target sequence
tttagacccgcgtgtgcttg

SEQ ID NO: 158931 - DNA, 20 bp, Artificial sequence
  SiRNA target sequence
ttagacccgcgtgtgcttga

SEQ ID NO: 158932 - DNA, 20 bp, Artificial sequence
  SiRNA target sequence
tagacccgcgtgtgcttgat

SEQ ID NO: 158933 - DNA, 20 bp, Artificial sequence
  SiRNA target sequence
agacccgcgtgtgcttgatg

SEQ ID NO: 158934 - DNA, 20 bp, Artificial sequence
  SiRNA target sequence
gacccgcgtgtgcttgatgc

SEQ ID NO: 158935 - DNA, 20 bp, Artificial sequence
  SiRNA target sequence
acccgcgtgtgcttgatgca

SEQ ID NO: 158936 - DNA, 20 bp, Artificial sequence
  SiRNA target sequence
cccgcgtgtgcttgatgcaa

SEQ ID NO: 158937 - DNA, 20 bp, Artificial sequence
  SiRNA target sequence
ccgcgtgtgcttgatgcaat

SEQ ID NO: 158938 - DNA, 20 bp, Artificial sequence
  SiRNA target sequence
cgcgtgtgcttgatgcaatg

SEQ ID NO: 158939 - DNA, 20 bp, Artificial sequence
  SiRNA target sequence
gcgtgtgcttgatgcaatgc

SEQ ID NO: 158940 - DNA, 20 bp, Artificial sequence
  SiRNA target sequence
cgtgtgcttgatgcaatgct

SEQ ID NO: 158941 - DNA, 20 bp, Artificial sequence
  SiRNA target sequence
gtgtgcttgatgcaatgctt

SEQ ID NO: 158942 - DNA, 20 bp, Artificial sequence
  SiRNA target sequence
tgtgcttgatgcaatgcttc

SEQ ID NO: 158943 - DNA, 20 bp, Artificial sequence
  SiRNA target sequence
gtgcttgatgcaatgcttcc

SEQ ID NO: 158944 - DNA, 20 bp, Artificial sequence
  SiRNA target sequence
tgcttgatgcaatgcttcca

SEQ ID NO: 158945 - DNA, 20 bp, Artificial sequence
  SiRNA target sequence
gcttgatgcaatgcttccat

SEQ ID NO: 158946 - DNA, 20 bp, Artificial sequence
  SiRNA target sequence
cttgatgcaatgcttccata

SEQ ID NO: 158947 - DNA, 20 bp, Artificial sequence
  SiRNA target sequence
ttgatgcaatgcttccatac

SEQ ID NO: 158948 - DNA, 20 bp, Artificial sequence
  SiRNA target sequence
tgatgcaatgcttccatact

SEQ ID NO: 158949 - DNA, 20 bp, Artificial sequence
  SiRNA target sequence
gatgcaatgcttccatacta

SEQ ID NO: 158950 - DNA, 20 bp, Artificial sequence
  SiRNA target sequence
atgcaatgcttccatactat

SEQ ID NO: 158951 - DNA, 20 bp, Artificial sequence
  SiRNA target sequence
tgcaatgcttccatactata

SEQ ID NO: 158952 - DNA, 20 bp, Artificial sequence
  SiRNA target sequence
gcaatgcttccatactatac

SEQ ID NO: 158953 - DNA, 20 bp, Artificial sequence
  SiRNA target sequence
caatgcttccatactataca

SEQ ID NO: 158954 - DNA, 20 bp, Artificial sequence
  SiRNA target sequence
aatgcttccatactatacat

SEQ ID NO: 158955 - DNA, 20 bp, Artificial sequence
  SiRNA target sequence
atgcttccatactatacatc

SEQ ID NO: 158956 - DNA, 20 bp, Artificial sequence
  SiRNA target sequence
tgcttccatactatacatcc

SEQ ID NO: 158957 - DNA, 20 bp, Artificial sequence
  SiRNA target sequence
gcttccatactatacatcca

SEQ ID NO: 158958 - DNA, 20 bp, Artificial sequence
  SiRNA target sequence
cttccatactatacatccat

SEQ ID NO: 158959 - DNA, 20 bp, Artificial sequence
  SiRNA target sequence
ttccatactatacatccatt

SEQ ID NO: 158960 - DNA, 20 bp, Artificial sequence
  SiRNA target sequence
tccatactatacatccattt

SEQ ID NO: 158961 - DNA, 20 bp, Artificial sequence
  SiRNA target sequence
ccatactatacatccatttt

SEQ ID NO: 158962 - DNA, 20 bp, Artificial sequence
  SiRNA target sequence
catactatacatccattttt

SEQ ID NO: 158963 - DNA, 20 bp, Artificial sequence
  SiRNA target sequence
atactatacatccatttttg

SEQ ID NO: 158964 - DNA, 20 bp, Artificial sequence
  SiRNA target sequence
tactatacatccatttttgg

SEQ ID NO: 158965 - DNA, 20 bp, Artificial sequence
  SiRNA target sequence
actatacatccatttttgga

SEQ ID NO: 158966 - DNA, 20 bp, Artificial sequence
  SiRNA target sequence
ctatacatccatttttggaa

SEQ ID NO: 158967 - DNA, 20 bp, Artificial sequence
  SiRNA target sequence
tatacatccatttttggaaa

SEQ ID NO: 158968 - DNA, 20 bp, Artificial sequence
  SiRNA target sequence
atacatccatttttggaaat

SEQ ID NO: 158969 - DNA, 20 bp, Artificial sequence
  SiRNA target sequence
tacatccatttttggaaatc

SEQ ID NO: 158970 - DNA, 20 bp, Artificial sequence
  SiRNA target sequence
acatccatttttggaaatcc

SEQ ID NO: 158971 - DNA, 20 bp, Artificial sequence
  SiRNA target sequence
catccatttttggaaatcca

SEQ ID NO: 158972 - DNA, 20 bp, Artificial sequence
  SiRNA target sequence
atccatttttggaaatccac

SEQ ID NO: 158973 - DNA, 20 bp, Artificial sequence
  SiRNA target sequence
tccatttttggaaatccaca

SEQ ID NO: 158974 - DNA, 20 bp, Artificial sequence
  SiRNA target sequence
ccatttttggaaatccacat

SEQ ID NO: 158975 - DNA, 20 bp, Artificial sequence
  SiRNA target sequence
catttttggaaatccacatt

SEQ ID NO: 158976 - DNA, 20 bp, Artificial sequence
  SiRNA target sequence
atttttggaaatccacattc

SEQ ID NO: 158977 - DNA, 20 bp, Artificial sequence
  SiRNA target sequence
tttttggaaatccacattct

SEQ ID NO: 158978 - DNA, 20 bp, Artificial sequence
  SiRNA target sequence
ttttggaaatccacattctc

SEQ ID NO: 158979 - DNA, 20 bp, Artificial sequence
  SiRNA target sequence
tttggaaatccacattctcg

SEQ ID NO: 158980 - DNA, 20 bp, Artificial sequence
  SiRNA target sequence
ttggaaatccacattctcgc

SEQ ID NO: 158981 - DNA, 20 bp, Artificial sequence
  SiRNA target sequence
tggaaatccacattctcgca

SEQ ID NO: 158982 - DNA, 20 bp, Artificial sequence
  SiRNA target sequence
ggaaatccacattctcgcac

SEQ ID NO: 158983 - DNA, 20 bp, Artificial sequence
  SiRNA target sequence
gaaatccacattctcgcacg

SEQ ID NO: 158984 - DNA, 20 bp, Artificial sequence
  SiRNA target sequence
aaatccacattctcgcacgc

SEQ ID NO: 158985 - DNA, 20 bp, Artificial sequence
  SiRNA target sequence
aatccacattctcgcacgca

SEQ ID NO: 158986 - DNA, 20 bp, Artificial sequence
  SiRNA target sequence
atccacattctcgcacgcat

SEQ ID NO: 158987 - DNA, 20 bp, Artificial sequence
  SiRNA target sequence
tccacattctcgcacgcata

SEQ ID NO: 158988 - DNA, 20 bp, Artificial sequence
  SiRNA target sequence
ccacattctcgcacgcatac

SEQ ID NO: 158989 - DNA, 20 bp, Artificial sequence
  SiRNA target sequence
cacattctcgcacgcatacg

SEQ ID NO: 158990 - DNA, 20 bp, Artificial sequence
  SiRNA target sequence
acattctcgcacgcatacgt

SEQ ID NO: 158991 - DNA, 20 bp, Artificial sequence
  SiRNA target sequence
cattctcgcacgcatacgtt

SEQ ID NO: 158992 - DNA, 20 bp, Artificial sequence
  SiRNA target sequence
attctcgcacgcatacgttt

SEQ ID NO: 158993 - DNA, 20 bp, Artificial sequence
  SiRNA target sequence
ttctcgcacgcatacgtttg

SEQ ID NO: 158994 - DNA, 20 bp, Artificial sequence
  SiRNA target sequence
tctcgcacgcatacgtttgg

SEQ ID NO: 158995 - DNA, 20 bp, Artificial sequence
  SiRNA target sequence
ctcgcacgcatacgtttgga

SEQ ID NO: 158996 - DNA, 20 bp, Artificial sequence
  SiRNA target sequence
tcgcacgcatacgtttggat

SEQ ID NO: 158997 - DNA, 20 bp, Artificial sequence
  SiRNA target sequence
cgcacgcatacgtttggatg

SEQ ID NO: 158998 - DNA, 20 bp, Artificial sequence
  SiRNA target sequence
gcacgcatacgtttggatgg

SEQ ID NO: 158999 - DNA, 20 bp, Artificial sequence
  SiRNA target sequence
cacgcatacgtttggatgga

SEQ ID NO: 159000 - DNA, 20 bp, Artificial sequence
  SiRNA target sequence
acgcatacgtttggatggaa

SEQ ID NO: 159001 - DNA, 20 bp, Artificial sequence
  SiRNA target sequence
cgcatacgtttggatggaat

SEQ ID NO: 159002 - DNA, 20 bp, Artificial sequence
  SiRNA target sequence
gcatacgtttggatggaatg

SEQ ID NO: 159003 - DNA, 20 bp, Artificial sequence
  SiRNA target sequence
catacgtttggatggaatgc

SEQ ID NO: 159004 - DNA, 20 bp, Artificial sequence
  SiRNA target sequence
atacgtttggatggaatgca

SEQ ID NO: 159005 - DNA, 20 bp, Artificial sequence
  SiRNA target sequence
tacgtttggatggaatgcag

SEQ ID NO: 159006 - DNA, 20 bp, Artificial sequence
  SiRNA target sequence
acgtttggatggaatgcaga

SEQ ID NO: 159007 - DNA, 20 bp, Artificial sequence
  SiRNA target sequence
cgtttggatggaatgcagaa

SEQ ID NO: 159008 - DNA, 20 bp, Artificial sequence
  SiRNA target sequence
gtttggatggaatgcagaaa

SEQ ID NO: 159009 - DNA, 20 bp, Artificial sequence
  SiRNA target sequence
tttggatggaatgcagaaaa

SEQ ID NO: 159010 - DNA, 20 bp, Artificial sequence
  SiRNA target sequence
ttggatggaatgcagaaaaa

SEQ ID NO: 159011 - DNA, 20 bp, Artificial sequence
  SiRNA target sequence
tggatggaatgcagaaaaag

SEQ ID NO: 159012 - DNA, 20 bp, Artificial sequence
  SiRNA target sequence
ggatggaatgcagaaaaagg

SEQ ID NO: 159013 - DNA, 20 bp, Artificial sequence
  SiRNA target sequence
gatggaatgcagaaaaaggc

SEQ ID NO: 159014 - DNA, 20 bp, Artificial sequence
  SiRNA target sequence
atggaatgcagaaaaaggcg

SEQ ID NO: 159015 - DNA, 20 bp, Artificial sequence
  SiRNA target sequence
tggaatgcagaaaaaggcgt

SEQ ID NO: 159016 - DNA, 20 bp, Artificial sequence
  SiRNA target sequence
ggaatgcagaaaaaggcgta

SEQ ID NO: 159017 - DNA, 20 bp, Artificial sequence
  SiRNA target sequence
gaatgcagaaaaaggcgtag

SEQ ID NO: 159018 - DNA, 20 bp, Artificial sequence
  SiRNA target sequence
aatgcagaaaaaggcgtaga

SEQ ID NO: 159019 - DNA, 20 bp, Artificial sequence
  SiRNA target sequence
atgcagaaaaaggcgtagaa

SEQ ID NO: 159020 - DNA, 20 bp, Artificial sequence
  SiRNA target sequence
tgcagaaaaaggcgtagaaa

SEQ ID NO: 159021 - DNA, 20 bp, Artificial sequence
  SiRNA target sequence
gcagaaaaaggcgtagaaat

SEQ ID NO: 159022 - DNA, 20 bp, Artificial sequence
  SiRNA target sequence
cagaaaaaggcgtagaaatg

SEQ ID NO: 159023 - DNA, 20 bp, Artificial sequence
  SiRNA target sequence
agaaaaaggcgtagaaatgg

SEQ ID NO: 159024 - DNA, 20 bp, Artificial sequence
  SiRNA target sequence
gaaaaaggcgtagaaatggc

SEQ ID NO: 159025 - DNA, 20 bp, Artificial sequence
  SiRNA target sequence
aaaaaggcgtagaaatggct

SEQ ID NO: 159026 - DNA, 20 bp, Artificial sequence
  SiRNA target sequence
aaaaggcgtagaaatggctc

SEQ ID NO: 159027 - DNA, 20 bp, Artificial sequence
  SiRNA target sequence
aaaggcgtagaaatggctcg

SEQ ID NO: 159028 - DNA, 20 bp, Artificial sequence
  SiRNA target sequence
aaggcgtagaaatggctcga

SEQ ID NO: 159029 - DNA, 20 bp, Artificial sequence
  SiRNA target sequence
aggcgtagaaatggctcgaa

SEQ ID NO: 159030 - DNA, 20 bp, Artificial sequence
  SiRNA target sequence
ggcgtagaaatggctcgaaa

SEQ ID NO: 159031 - DNA, 20 bp, Artificial sequence
  SiRNA target sequence
gcgtagaaatggctcgaaag

SEQ ID NO: 159032 - DNA, 20 bp, Artificial sequence
  SiRNA target sequence
cgtagaaatggctcgaaagc

SEQ ID NO: 159033 - DNA, 20 bp, Artificial sequence
  SiRNA target sequence
gtagaaatggctcgaaagca

SEQ ID NO: 159034 - DNA, 20 bp, Artificial sequence
  SiRNA target sequence
tagaaatggctcgaaagcaa

SEQ ID NO: 159035 - DNA, 20 bp, Artificial sequence
  SiRNA target sequence
agaaatggctcgaaagcaag

SEQ ID NO: 159036 - DNA, 20 bp, Artificial sequence
  SiRNA target sequence
gaaatggctcgaaagcaagt

SEQ ID NO: 159037 - DNA, 20 bp, Artificial sequence
  SiRNA target sequence
aaatggctcgaaagcaagta

SEQ ID NO: 159038 - DNA, 20 bp, Artificial sequence
  SiRNA target sequence
aatggctcgaaagcaagtag

SEQ ID NO: 159039 - DNA, 20 bp, Artificial sequence
  SiRNA target sequence
atggctcgaaagcaagtagc

SEQ ID NO: 159040 - DNA, 20 bp, Artificial sequence
  SiRNA target sequence
tggctcgaaagcaagtagca

SEQ ID NO: 159041 - DNA, 20 bp, Artificial sequence
  SiRNA target sequence
ggctcgaaagcaagtagcag

SEQ ID NO: 159042 - DNA, 20 bp, Artificial sequence
  SiRNA target sequence
gctcgaaagcaagtagcaga

SEQ ID NO: 159043 - DNA, 20 bp, Artificial sequence
  SiRNA target sequence
ctcgaaagcaagtagcagat

SEQ ID NO: 159044 - DNA, 20 bp, Artificial sequence
  SiRNA target sequence
tcgaaagcaagtagcagatt

SEQ ID NO: 159045 - DNA, 20 bp, Artificial sequence
  SiRNA target sequence
cgaaagcaagtagcagattt

SEQ ID NO: 159046 - DNA, 20 bp, Artificial sequence
  SiRNA target sequence
gaaagcaagtagcagattta

SEQ ID NO: 159047 - DNA, 20 bp, Artificial sequence
  SiRNA target sequence
aaagcaagtagcagatttac

SEQ ID NO: 159048 - DNA, 20 bp, Artificial sequence
  SiRNA target sequence
aagcaagtagcagatttact

SEQ ID NO: 159049 - DNA, 20 bp, Artificial sequence
  SiRNA target sequence
agcaagtagcagatttactg

SEQ ID NO: 159050 - DNA, 20 bp, Artificial sequence
  SiRNA target sequence
gcaagtagcagatttactga

SEQ ID NO: 159051 - DNA, 20 bp, Artificial sequence
  SiRNA target sequence
caagtagcagatttactgaa

SEQ ID NO: 159052 - DNA, 20 bp, Artificial sequence
  SiRNA target sequence
aagtagcagatttactgaat

SEQ ID NO: 159053 - DNA, 20 bp, Artificial sequence
  SiRNA target sequence
agtagcagatttactgaatg

SEQ ID NO: 159054 - DNA, 20 bp, Artificial sequence
  SiRNA target sequence
gtagcagatttactgaatgc

SEQ ID NO: 159055 - DNA, 20 bp, Artificial sequence
  SiRNA target sequence
tagcagatttactgaatgcc

SEQ ID NO: 159056 - DNA, 20 bp, Artificial sequence
  SiRNA target sequence
agcagatttactgaatgcca

SEQ ID NO: 159057 - DNA, 20 bp, Artificial sequence
  SiRNA target sequence
gcagatttactgaatgccaa

SEQ ID NO: 159058 - DNA, 20 bp, Artificial sequence
  SiRNA target sequence
cagatttactgaatgccaat

SEQ ID NO: 159059 - DNA, 20 bp, Artificial sequence
  SiRNA target sequence
agatttactgaatgccaatg

SEQ ID NO: 159060 - DNA, 20 bp, Artificial sequence
  SiRNA target sequence
gatttactgaatgccaatga

SEQ ID NO: 159061 - DNA, 20 bp, Artificial sequence
  SiRNA target sequence
atttactgaatgccaatgaa

SEQ ID NO: 159062 - DNA, 20 bp, Artificial sequence
  SiRNA target sequence
tttactgaatgccaatgaaa

SEQ ID NO: 159063 - DNA, 20 bp, Artificial sequence
  SiRNA target sequence
ttactgaatgccaatgaaaa

SEQ ID NO: 159064 - DNA, 20 bp, Artificial sequence
  SiRNA target sequence
tactgaatgccaatgaaaaa

SEQ ID NO: 159065 - DNA, 20 bp, Artificial sequence
  SiRNA target sequence
actgaatgccaatgaaaaag

SEQ ID NO: 159066 - DNA, 20 bp, Artificial sequence
  SiRNA target sequence
ctgaatgccaatgaaaaaga

SEQ ID NO: 159067 - DNA, 20 bp, Artificial sequence
  SiRNA target sequence
tgaatgccaatgaaaaagaa

SEQ ID NO: 159068 - DNA, 20 bp, Artificial sequence
  SiRNA target sequence
gaatgccaatgaaaaagaaa

SEQ ID NO: 159069 - DNA, 20 bp, Artificial sequence
  SiRNA target sequence
aatgccaatgaaaaagaaat

SEQ ID NO: 159070 - DNA, 20 bp, Artificial sequence
  SiRNA target sequence
atgccaatgaaaaagaaatt

SEQ ID NO: 159071 - DNA, 20 bp, Artificial sequence
  SiRNA target sequence
tgccaatgaaaaagaaatta

SEQ ID NO: 159072 - DNA, 20 bp, Artificial sequence
  SiRNA target sequence
gccaatgaaaaagaaattat

SEQ ID NO: 159073 - DNA, 20 bp, Artificial sequence
  SiRNA target sequence
ccaatgaaaaagaaattatt

SEQ ID NO: 159074 - DNA, 20 bp, Artificial sequence
  SiRNA target sequence
caatgaaaaagaaattattt

SEQ ID NO: 159075 - DNA, 20 bp, Artificial sequence
  SiRNA target sequence
aatgaaaaagaaattatttt

SEQ ID NO: 159076 - DNA, 20 bp, Artificial sequence
  SiRNA target sequence
atgaaaaagaaattattttt

SEQ ID NO: 159077 - DNA, 20 bp, Artificial sequence
  SiRNA target sequence
tgaaaaagaaattattttta

SEQ ID NO: 159078 - DNA, 20 bp, Artificial sequence
  SiRNA target sequence
gaaaaagaaattatttttac

SEQ ID NO: 159079 - DNA, 20 bp, Artificial sequence
  SiRNA target sequence
aaaaagaaattatttttact

SEQ ID NO: 159080 - DNA, 20 bp, Artificial sequence
  SiRNA target sequence
aaaagaaattatttttacta

SEQ ID NO: 159081 - DNA, 20 bp, Artificial sequence
  SiRNA target sequence
aaagaaattatttttactag

SEQ ID NO: 159082 - DNA, 20 bp, Artificial sequence
  SiRNA target sequence
aagaaattatttttactagc

SEQ ID NO: 159083 - DNA, 20 bp, Artificial sequence
  SiRNA target sequence
agaaattatttttactagcg

SEQ ID NO: 159084 - DNA, 20 bp, Artificial sequence
  SiRNA target sequence
gaaattatttttactagcgg

SEQ ID NO: 159085 - DNA, 20 bp, Artificial sequence
  SiRNA target sequence
aaattatttttactagcggt

SEQ ID NO: 159086 - DNA, 20 bp, Artificial sequence
  SiRNA target sequence
aattatttttactagcggtg

SEQ ID NO: 159087 - DNA, 20 bp, Artificial sequence
  SiRNA target sequence
attatttttactagcggtgc

SEQ ID NO: 159088 - DNA, 20 bp, Artificial sequence
  SiRNA target sequence
ttatttttactagcggtgct

SEQ ID NO: 159089 - DNA, 20 bp, Artificial sequence
  SiRNA target sequence
tatttttactagcggtgcta

SEQ ID NO: 159090 - DNA, 20 bp, Artificial sequence
  SiRNA target sequence
atttttactagcggtgctac

SEQ ID NO: 159091 - DNA, 20 bp, Artificial sequence
  SiRNA target sequence
tttttactagcggtgctact

SEQ ID NO: 159092 - DNA, 20 bp, Artificial sequence
  SiRNA target sequence
ttttactagcggtgctactg

SEQ ID NO: 159093 - DNA, 20 bp, Artificial sequence
  SiRNA target sequence
tttactagcggtgctactga

SEQ ID NO: 159094 - DNA, 20 bp, Artificial sequence
  SiRNA target sequence
ttactagcggtgctactgag

SEQ ID NO: 159095 - DNA, 20 bp, Artificial sequence
  SiRNA target sequence
tactagcggtgctactgaga

SEQ ID NO: 159096 - DNA, 20 bp, Artificial sequence
  SiRNA target sequence
actagcggtgctactgagag

SEQ ID NO: 159097 - DNA, 20 bp, Artificial sequence
  SiRNA target sequence
ctagcggtgctactgagagt

SEQ ID NO: 159098 - DNA, 20 bp, Artificial sequence
  SiRNA target sequence
tagcggtgctactgagagta

SEQ ID NO: 159099 - DNA, 20 bp, Artificial sequence
  SiRNA target sequence
agcggtgctactgagagtaa

SEQ ID NO: 159100 - DNA, 20 bp, Artificial sequence
  SiRNA target sequence
gcggtgctactgagagtaac

SEQ ID NO: 159101 - DNA, 20 bp, Artificial sequence
  SiRNA target sequence
cggtgctactgagagtaaca

SEQ ID NO: 159102 - DNA, 20 bp, Artificial sequence
  SiRNA target sequence
ggtgctactgagagtaacaa

SEQ ID NO: 159103 - DNA, 20 bp, Artificial sequence
  SiRNA target sequence
gtgctactgagagtaacaac

SEQ ID NO: 159104 - DNA, 20 bp, Artificial sequence
  SiRNA target sequence
tgctactgagagtaacaacc

SEQ ID NO: 159105 - DNA, 20 bp, Artificial sequence
  SiRNA target sequence
gctactgagagtaacaacct

SEQ ID NO: 159106 - DNA, 20 bp, Artificial sequence
  SiRNA target sequence
ctactgagagtaacaacctt

SEQ ID NO: 159107 - DNA, 20 bp, Artificial sequence
  SiRNA target sequence
tactgagagtaacaaccttg

SEQ ID NO: 159108 - DNA, 20 bp, Artificial sequence
  SiRNA target sequence
actgagagtaacaaccttgc

SEQ ID NO: 159109 - DNA, 20 bp, Artificial sequence
  SiRNA target sequence
ctgagagtaacaaccttgca

SEQ ID NO: 159110 - DNA, 20 bp, Artificial sequence
  SiRNA target sequence
tgagagtaacaaccttgcac

SEQ ID NO: 159111 - DNA, 20 bp, Artificial sequence
  SiRNA target sequence
gagagtaacaaccttgcact

SEQ ID NO: 159112 - DNA, 20 bp, Artificial sequence
  SiRNA target sequence
agagtaacaaccttgcacta

SEQ ID NO: 159113 - DNA, 20 bp, Artificial sequence
  SiRNA target sequence
gagtaacaaccttgcactaa

SEQ ID NO: 159114 - DNA, 20 bp, Artificial sequence
  SiRNA target sequence
agtaacaaccttgcactaaa

SEQ ID NO: 159115 - DNA, 20 bp, Artificial sequence
  SiRNA target sequence
gtaacaaccttgcactaaag

SEQ ID NO: 159116 - DNA, 20 bp, Artificial sequence
  SiRNA target sequence
taacaaccttgcactaaagg

SEQ ID NO: 159117 - DNA, 20 bp, Artificial sequence
  SiRNA target sequence
aacaaccttgcactaaaggg

SEQ ID NO: 159118 - DNA, 20 bp, Artificial sequence
  SiRNA target sequence
acaaccttgcactaaagggt

SEQ ID NO: 159119 - DNA, 20 bp, Artificial sequence
  SiRNA target sequence
caaccttgcactaaagggtg

SEQ ID NO: 159120 - DNA, 20 bp, Artificial sequence
  SiRNA target sequence
aaccttgcactaaagggtgt

SEQ ID NO: 159121 - DNA, 20 bp, Artificial sequence
  SiRNA target sequence
accttgcactaaagggtgtc

SEQ ID NO: 159122 - DNA, 20 bp, Artificial sequence
  SiRNA target sequence
ccttgcactaaagggtgtct

SEQ ID NO: 159123 - DNA, 20 bp, Artificial sequence
  SiRNA target sequence
cttgcactaaagggtgtctt

SEQ ID NO: 159124 - DNA, 20 bp, Artificial sequence
  SiRNA target sequence
ttgcactaaagggtgtcttt

SEQ ID NO: 159125 - DNA, 20 bp, Artificial sequence
  SiRNA target sequence
tgcactaaagggtgtctttg

SEQ ID NO: 159126 - DNA, 20 bp, Artificial sequence
  SiRNA target sequence
gcactaaagggtgtctttgc

SEQ ID NO: 159127 - DNA, 20 bp, Artificial sequence
  SiRNA target sequence
cactaaagggtgtctttgca

SEQ ID NO: 159128 - DNA, 20 bp, Artificial sequence
  SiRNA target sequence
actaaagggtgtctttgcat

SEQ ID NO: 159129 - DNA, 20 bp, Artificial sequence
  SiRNA target sequence
ctaaagggtgtctttgcatt

SEQ ID NO: 159130 - DNA, 20 bp, Artificial sequence
  SiRNA target sequence
taaagggtgtctttgcattt

SEQ ID NO: 159131 - DNA, 20 bp, Artificial sequence
  SiRNA target sequence
aaagggtgtctttgcatttt

SEQ ID NO: 159132 - DNA, 20 bp, Artificial sequence
  SiRNA target sequence
aagggtgtctttgcattttt

SEQ ID NO: 159133 - DNA, 20 bp, Artificial sequence
  SiRNA target sequence
agggtgtctttgcattttta

SEQ ID NO: 159134 - DNA, 20 bp, Artificial sequence
  SiRNA target sequence
gggtgtctttgcatttttaa

SEQ ID NO: 159135 - DNA, 20 bp, Artificial sequence
  SiRNA target sequence
ggtgtctttgcatttttaaa

SEQ ID NO: 159136 - DNA, 20 bp, Artificial sequence
  SiRNA target sequence
gtgtctttgcatttttaaaa

SEQ ID NO: 159137 - DNA, 20 bp, Artificial sequence
  SiRNA target sequence
tgtctttgcatttttaaaaa

SEQ ID NO: 159138 - DNA, 20 bp, Artificial sequence
  SiRNA target sequence
gtctttgcatttttaaaaaa

SEQ ID NO: 159139 - DNA, 20 bp, Artificial sequence
  SiRNA target sequence
tctttgcatttttaaaaaaa

SEQ ID NO: 159140 - DNA, 20 bp, Artificial sequence
  SiRNA target sequence
ctttgcatttttaaaaaaag

SEQ ID NO: 159141 - DNA, 20 bp, Artificial sequence
  SiRNA target sequence
tttgcatttttaaaaaaaga

SEQ ID NO: 159142 - DNA, 20 bp, Artificial sequence
  SiRNA target sequence
ttgcatttttaaaaaaagac

SEQ ID NO: 159143 - DNA, 20 bp, Artificial sequence
  SiRNA target sequence
tgcatttttaaaaaaagaca

SEQ ID NO: 159144 - DNA, 20 bp, Artificial sequence
  SiRNA target sequence
gcatttttaaaaaaagacaa

SEQ ID NO: 159145 - DNA, 20 bp, Artificial sequence
  SiRNA target sequence
catttttaaaaaaagacaat

SEQ ID NO: 159146 - DNA, 20 bp, Artificial sequence
  SiRNA target sequence
atttttaaaaaaagacaata

SEQ ID NO: 159147 - DNA, 20 bp, Artificial sequence
  SiRNA target sequence
tttttaaaaaaagacaatag

SEQ ID NO: 159148 - DNA, 20 bp, Artificial sequence
  SiRNA target sequence
ttttaaaaaaagacaatagg

SEQ ID NO: 159149 - DNA, 20 bp, Artificial sequence
  SiRNA target sequence
tttaaaaaaagacaataggc

SEQ ID NO: 159150 - DNA, 20 bp, Artificial sequence
  SiRNA target sequence
ttaaaaaaagacaataggcc

SEQ ID NO: 159151 - DNA, 20 bp, Artificial sequence
  SiRNA target sequence
taaaaaaagacaataggcct

SEQ ID NO: 159152 - DNA, 20 bp, Artificial sequence
  SiRNA target sequence
aaaaaaagacaataggcctg

SEQ ID NO: 159153 - DNA, 20 bp, Artificial sequence
  SiRNA target sequence
aaaaaagacaataggcctgt

SEQ ID NO: 159154 - DNA, 20 bp, Artificial sequence
  SiRNA target sequence
aaaaagacaataggcctgtt

SEQ ID NO: 159155 - DNA, 20 bp, Artificial sequence
  SiRNA target sequence
aaaagacaataggcctgttc

SEQ ID NO: 159156 - DNA, 20 bp, Artificial sequence
  SiRNA target sequence
aaagacaataggcctgttca

SEQ ID NO: 159157 - DNA, 20 bp, Artificial sequence
  SiRNA target sequence
aagacaataggcctgttcat

SEQ ID NO: 159158 - DNA, 20 bp, Artificial sequence
  SiRNA target sequence
agacaataggcctgttcata

SEQ ID NO: 159159 - DNA, 20 bp, Artificial sequence
  SiRNA target sequence
gacaataggcctgttcatat

SEQ ID NO: 159160 - DNA, 20 bp, Artificial sequence
  SiRNA target sequence
acaataggcctgttcatatc

SEQ ID NO: 159161 - DNA, 20 bp, Artificial sequence
  SiRNA target sequence
caataggcctgttcatatca

SEQ ID NO: 159162 - DNA, 20 bp, Artificial sequence
  SiRNA target sequence
aataggcctgttcatatcat

SEQ ID NO: 159163 - DNA, 20 bp, Artificial sequence
  SiRNA target sequence
ataggcctgttcatatcatt

SEQ ID NO: 159164 - DNA, 20 bp, Artificial sequence
  SiRNA target sequence
taggcctgttcatatcatta

SEQ ID NO: 159165 - DNA, 20 bp, Artificial sequence
  SiRNA target sequence
aggcctgttcatatcattac

SEQ ID NO: 159166 - DNA, 20 bp, Artificial sequence
  SiRNA target sequence
ggcctgttcatatcattacc

SEQ ID NO: 159167 - DNA, 20 bp, Artificial sequence
  SiRNA target sequence
gcctgttcatatcattacca

SEQ ID NO: 159168 - DNA, 20 bp, Artificial sequence
  SiRNA target sequence
cctgttcatatcattaccac

SEQ ID NO: 159169 - DNA, 20 bp, Artificial sequence
  SiRNA target sequence
ctgttcatatcattaccaca

SEQ ID NO: 159170 - DNA, 20 bp, Artificial sequence
  SiRNA target sequence
tgttcatatcattaccacac

SEQ ID NO: 159171 - DNA, 20 bp, Artificial sequence
  SiRNA target sequence
gttcatatcattaccacaca

SEQ ID NO: 159172 - DNA, 20 bp, Artificial sequence
  SiRNA target sequence
ttcatatcattaccacacaa

SEQ ID NO: 159173 - DNA, 20 bp, Artificial sequence
  SiRNA target sequence
tcatatcattaccacacaaa

SEQ ID NO: 159174 - DNA, 20 bp, Artificial sequence
  SiRNA target sequence
catatcattaccacacaaat

SEQ ID NO: 159175 - DNA, 20 bp, Artificial sequence
  SiRNA target sequence
atatcattaccacacaaatt

SEQ ID NO: 159176 - DNA, 20 bp, Artificial sequence
  SiRNA target sequence
tatcattaccacacaaattg

SEQ ID NO: 159177 - DNA, 20 bp, Artificial sequence
  SiRNA target sequence
atcattaccacacaaattga

SEQ ID NO: 159178 - DNA, 20 bp, Artificial sequence
  SiRNA target sequence
tcattaccacacaaattgaa

SEQ ID NO: 159179 - DNA, 20 bp, Artificial sequence
  SiRNA target sequence
cattaccacacaaattgaac

SEQ ID NO: 159180 - DNA, 20 bp, Artificial sequence
  SiRNA target sequence
attaccacacaaattgaaca

SEQ ID NO: 159181 - DNA, 20 bp, Artificial sequence
  SiRNA target sequence
ttaccacacaaattgaacat

SEQ ID NO: 159182 - DNA, 20 bp, Artificial sequence
  SiRNA target sequence
taccacacaaattgaacata

SEQ ID NO: 159183 - DNA, 20 bp, Artificial sequence
  SiRNA target sequence
accacacaaattgaacataa

SEQ ID NO: 159184 - DNA, 20 bp, Artificial sequence
  SiRNA target sequence
ccacacaaattgaacataaa

SEQ ID NO: 159185 - DNA, 20 bp, Artificial sequence
  SiRNA target sequence
cacacaaattgaacataaat

SEQ ID NO: 159186 - DNA, 20 bp, Artificial sequence
  SiRNA target sequence
acacaaattgaacataaatg

SEQ ID NO: 159187 - DNA, 20 bp, Artificial sequence
  SiRNA target sequence
cacaaattgaacataaatgt

SEQ ID NO: 159188 - DNA, 20 bp, Artificial sequence
  SiRNA target sequence
acaaattgaacataaatgtg

SEQ ID NO: 159189 - DNA, 20 bp, Artificial sequence
  SiRNA target sequence
caaattgaacataaatgtgt

SEQ ID NO: 159190 - DNA, 20 bp, Artificial sequence
  SiRNA target sequence
aaattgaacataaatgtgta

SEQ ID NO: 159191 - DNA, 20 bp, Artificial sequence
  SiRNA target sequence
aattgaacataaatgtgtat

SEQ ID NO: 159192 - DNA, 20 bp, Artificial sequence
  SiRNA target sequence
attgaacataaatgtgtatt

SEQ ID NO: 159193 - DNA, 20 bp, Artificial sequence
  SiRNA target sequence
ttgaacataaatgtgtattg

SEQ ID NO: 159194 - DNA, 20 bp, Artificial sequence
  SiRNA target sequence
tgaacataaatgtgtattgg

SEQ ID NO: 159195 - DNA, 20 bp, Artificial sequence
  SiRNA target sequence
gaacataaatgtgtattgga

SEQ ID NO: 159196 - DNA, 20 bp, Artificial sequence
  SiRNA target sequence
aacataaatgtgtattggac

SEQ ID NO: 159197 - DNA, 20 bp, Artificial sequence
  SiRNA target sequence
acataaatgtgtattggaca

SEQ ID NO: 159198 - DNA, 20 bp, Artificial sequence
  SiRNA target sequence
cataaatgtgtattggacac

SEQ ID NO: 159199 - DNA, 20 bp, Artificial sequence
  SiRNA target sequence
ataaatgtgtattggacaca

SEQ ID NO: 159200 - DNA, 20 bp, Artificial sequence
  SiRNA target sequence
taaatgtgtattggacacat

SEQ ID NO: 159201 - DNA, 20 bp, Artificial sequence
  SiRNA target sequence
aaatgtgtattggacacatg

SEQ ID NO: 159202 - DNA, 20 bp, Artificial sequence
  SiRNA target sequence
aatgtgtattggacacatgt

SEQ ID NO: 159203 - DNA, 20 bp, Artificial sequence
  SiRNA target sequence
atgtgtattggacacatgta

SEQ ID NO: 159204 - DNA, 20 bp, Artificial sequence
  SiRNA target sequence
tgtgtattggacacatgtag

SEQ ID NO: 159205 - DNA, 20 bp, Artificial sequence
  SiRNA target sequence
gtgtattggacacatgtaga

SEQ ID NO: 159206 - DNA, 20 bp, Artificial sequence
  SiRNA target sequence
tgtattggacacatgtagaa

SEQ ID NO: 159207 - DNA, 20 bp, Artificial sequence
  SiRNA target sequence
gtattggacacatgtagaag

SEQ ID NO: 159208 - DNA, 20 bp, Artificial sequence
  SiRNA target sequence
tattggacacatgtagaaga

SEQ ID NO: 159209 - DNA, 20 bp, Artificial sequence
  SiRNA target sequence
attggacacatgtagaagat

SEQ ID NO: 159210 - DNA, 20 bp, Artificial sequence
  SiRNA target sequence
ttggacacatgtagaagatt

SEQ ID NO: 159211 - DNA, 20 bp, Artificial sequence
  SiRNA target sequence
tggacacatgtagaagatta

SEQ ID NO: 159212 - DNA, 20 bp, Artificial sequence
  SiRNA target sequence
ggacacatgtagaagattag

SEQ ID NO: 159213 - DNA, 20 bp, Artificial sequence
  SiRNA target sequence
gacacatgtagaagattaga

SEQ ID NO: 159214 - DNA, 20 bp, Artificial sequence
  SiRNA target sequence
acacatgtagaagattagaa

SEQ ID NO: 159215 - DNA, 20 bp, Artificial sequence
  SiRNA target sequence
cacatgtagaagattagaag

SEQ ID NO: 159216 - DNA, 20 bp, Artificial sequence
  SiRNA target sequence
acatgtagaagattagaaga

SEQ ID NO: 159217 - DNA, 20 bp, Artificial sequence
  SiRNA target sequence
catgtagaagattagaagaa

SEQ ID NO: 159218 - DNA, 20 bp, Artificial sequence
  SiRNA target sequence
atgtagaagattagaagaag

SEQ ID NO: 159219 - DNA, 20 bp, Artificial sequence
  SiRNA target sequence
tgtagaagattagaagaaga

SEQ ID NO: 159220 - DNA, 20 bp, Artificial sequence
  SiRNA target sequence
gtagaagattagaagaagaa

SEQ ID NO: 159221 - DNA, 20 bp, Artificial sequence
  SiRNA target sequence
tagaagattagaagaagaag

SEQ ID NO: 159222 - DNA, 20 bp, Artificial sequence
  SiRNA target sequence
agaagattagaagaagaagg

SEQ ID NO: 159223 - DNA, 20 bp, Artificial sequence
  SiRNA target sequence
gaagattagaagaagaagga

SEQ ID NO: 159224 - DNA, 20 bp, Artificial sequence
  SiRNA target sequence
aagattagaagaagaaggag

SEQ ID NO: 159225 - DNA, 20 bp, Artificial sequence
  SiRNA target sequence
agattagaagaagaaggagc

SEQ ID NO: 159226 - DNA, 20 bp, Artificial sequence
  SiRNA target sequence
gattagaagaagaaggagct

SEQ ID NO: 159227 - DNA, 20 bp, Artificial sequence
  SiRNA target sequence
attagaagaagaaggagcta

SEQ ID NO: 159228 - DNA, 20 bp, Artificial sequence
  SiRNA target sequence
ttagaagaagaaggagctac

SEQ ID NO: 159229 - DNA, 20 bp, Artificial sequence
  SiRNA target sequence
tagaagaagaaggagctaca

SEQ ID NO: 159230 - DNA, 20 bp, Artificial sequence
  SiRNA target sequence
agaagaagaaggagctacag

SEQ ID NO: 159231 - DNA, 20 bp, Artificial sequence
  SiRNA target sequence
gaagaagaaggagctacagt

SEQ ID NO: 159232 - DNA, 20 bp, Artificial sequence
  SiRNA target sequence
aagaagaaggagctacagtg

SEQ ID NO: 159233 - DNA, 20 bp, Artificial sequence
  SiRNA target sequence
agaagaaggagctacagtga

SEQ ID NO: 159234 - DNA, 20 bp, Artificial sequence
  SiRNA target sequence
gaagaaggagctacagtgac

SEQ ID NO: 159235 - DNA, 20 bp, Artificial sequence
  SiRNA target sequence
aagaaggagctacagtgact

SEQ ID NO: 159236 - DNA, 20 bp, Artificial sequence
  SiRNA target sequence
agaaggagctacagtgactt

SEQ ID NO: 159237 - DNA, 20 bp, Artificial sequence
  SiRNA target sequence
gaaggagctacagtgactta

SEQ ID NO: 159238 - DNA, 20 bp, Artificial sequence
  SiRNA target sequence
aaggagctacagtgacttat

SEQ ID NO: 159239 - DNA, 20 bp, Artificial sequence
  SiRNA target sequence
aggagctacagtgacttatt

SEQ ID NO: 159240 - DNA, 20 bp, Artificial sequence
  SiRNA target sequence
ggagctacagtgacttattt

SEQ ID NO: 159241 - DNA, 20 bp, Artificial sequence
  SiRNA target sequence
gagctacagtgacttatttg

SEQ ID NO: 159242 - DNA, 20 bp, Artificial sequence
  SiRNA target sequence
agctacagtgacttatttgc

SEQ ID NO: 159243 - DNA, 20 bp, Artificial sequence
  SiRNA target sequence
gctacagtgacttatttgcc

SEQ ID NO: 159244 - DNA, 20 bp, Artificial sequence
  SiRNA target sequence
ctacagtgacttatttgcct

SEQ ID NO: 159245 - DNA, 20 bp, Artificial sequence
  SiRNA target sequence
tacagtgacttatttgcctg

SEQ ID NO: 159246 - DNA, 20 bp, Artificial sequence
  SiRNA target sequence
acagtgacttatttgcctgt

SEQ ID NO: 159247 - DNA, 20 bp, Artificial sequence
  SiRNA target sequence
cagtgacttatttgcctgta

SEQ ID NO: 159248 - DNA, 20 bp, Artificial sequence
  SiRNA target sequence
agtgacttatttgcctgtag

SEQ ID NO: 159249 - DNA, 20 bp, Artificial sequence
  SiRNA target sequence
gtgacttatttgcctgtaga

SEQ ID NO: 159250 - DNA, 20 bp, Artificial sequence
  SiRNA target sequence
tgacttatttgcctgtagat

SEQ ID NO: 159251 - DNA, 20 bp, Artificial sequence
  SiRNA target sequence
gacttatttgcctgtagata

SEQ ID NO: 159252 - DNA, 20 bp, Artificial sequence
  SiRNA target sequence
acttatttgcctgtagataa

SEQ ID NO: 159253 - DNA, 20 bp, Artificial sequence
  SiRNA target sequence
cttatttgcctgtagataaa

SEQ ID NO: 159254 - DNA, 20 bp, Artificial sequence
  SiRNA target sequence
ttatttgcctgtagataaaa

SEQ ID NO: 159255 - DNA, 20 bp, Artificial sequence
  SiRNA target sequence
tatttgcctgtagataaaaa

SEQ ID NO: 159256 - DNA, 20 bp, Artificial sequence
  SiRNA target sequence
atttgcctgtagataaaaat

SEQ ID NO: 159257 - DNA, 20 bp, Artificial sequence
  SiRNA target sequence
tttgcctgtagataaaaatg

SEQ ID NO: 159258 - DNA, 20 bp, Artificial sequence
  SiRNA target sequence
ttgcctgtagataaaaatgg

SEQ ID NO: 159259 - DNA, 20 bp, Artificial sequence
  SiRNA target sequence
tgcctgtagataaaaatgga

SEQ ID NO: 159260 - DNA, 20 bp, Artificial sequence
  SiRNA target sequence
gcctgtagataaaaatggaa

SEQ ID NO: 159261 - DNA, 20 bp, Artificial sequence
  SiRNA target sequence
cctgtagataaaaatggaat

SEQ ID NO: 159262 - DNA, 20 bp, Artificial sequence
  SiRNA target sequence
ctgtagataaaaatggaata

SEQ ID NO: 159263 - DNA, 20 bp, Artificial sequence
  SiRNA target sequence
tgtagataaaaatggaatag

SEQ ID NO: 159264 - DNA, 20 bp, Artificial sequence
  SiRNA target sequence
gtagataaaaatggaatagt

SEQ ID NO: 159265 - DNA, 20 bp, Artificial sequence
  SiRNA target sequence
tagataaaaatggaatagta

SEQ ID NO: 159266 - DNA, 20 bp, Artificial sequence
  SiRNA target sequence
agataaaaatggaatagtag

SEQ ID NO: 159267 - DNA, 20 bp, Artificial sequence
  SiRNA target sequence
gataaaaatggaatagtaga

SEQ ID NO: 159268 - DNA, 20 bp, Artificial sequence
  SiRNA target sequence
ataaaaatggaatagtagat

SEQ ID NO: 159269 - DNA, 20 bp, Artificial sequence
  SiRNA target sequence
taaaaatggaatagtagatc

SEQ ID NO: 159270 - DNA, 20 bp, Artificial sequence
  SiRNA target sequence
aaaaatggaatagtagatcc

SEQ ID NO: 159271 - DNA, 20 bp, Artificial sequence
  SiRNA target sequence
aaaatggaatagtagatccg

SEQ ID NO: 159272 - DNA, 20 bp, Artificial sequence
  SiRNA target sequence
aaatggaatagtagatccgc

SEQ ID NO: 159273 - DNA, 20 bp, Artificial sequence
  SiRNA target sequence
aatggaatagtagatccgca

SEQ ID NO: 159274 - DNA, 20 bp, Artificial sequence
  SiRNA target sequence
atggaatagtagatccgcaa

SEQ ID NO: 159275 - DNA, 20 bp, Artificial sequence
  SiRNA target sequence
tggaatagtagatccgcaat

SEQ ID NO: 159276 - DNA, 20 bp, Artificial sequence
  SiRNA target sequence
ggaatagtagatccgcaatt

SEQ ID NO: 159277 - DNA, 20 bp, Artificial sequence
  SiRNA target sequence
gaatagtagatccgcaatta

SEQ ID NO: 159278 - DNA, 20 bp, Artificial sequence
  SiRNA target sequence
aatagtagatccgcaattaa

SEQ ID NO: 159279 - DNA, 20 bp, Artificial sequence
  SiRNA target sequence
atagtagatccgcaattaat

SEQ ID NO: 159280 - DNA, 20 bp, Artificial sequence
  SiRNA target sequence
tagtagatccgcaattaata

SEQ ID NO: 159281 - DNA, 20 bp, Artificial sequence
  SiRNA target sequence
agtagatccgcaattaataa

SEQ ID NO: 159282 - DNA, 20 bp, Artificial sequence
  SiRNA target sequence
gtagatccgcaattaataaa

SEQ ID NO: 159283 - DNA, 20 bp, Artificial sequence
  SiRNA target sequence
tagatccgcaattaataaaa

SEQ ID NO: 159284 - DNA, 20 bp, Artificial sequence
  SiRNA target sequence
agatccgcaattaataaaaa

SEQ ID NO: 159285 - DNA, 20 bp, Artificial sequence
  SiRNA target sequence
gatccgcaattaataaaaaa

SEQ ID NO: 159286 - DNA, 20 bp, Artificial sequence
  SiRNA target sequence
atccgcaattaataaaaaac

SEQ ID NO: 159287 - DNA, 20 bp, Artificial sequence
  SiRNA target sequence
tccgcaattaataaaaaaca

SEQ ID NO: 159288 - DNA, 20 bp, Artificial sequence
  SiRNA target sequence
ccgcaattaataaaaaacag

SEQ ID NO: 159289 - DNA, 20 bp, Artificial sequence
  SiRNA target sequence
cgcaattaataaaaaacagt

SEQ ID NO: 159290 - DNA, 20 bp, Artificial sequence
  SiRNA target sequence
gcaattaataaaaaacagta

SEQ ID NO: 159291 - DNA, 20 bp, Artificial sequence
  SiRNA target sequence
caattaataaaaaacagtat

SEQ ID NO: 159292 - DNA, 20 bp, Artificial sequence
  SiRNA target sequence
aattaataaaaaacagtatt

SEQ ID NO: 159293 - DNA, 20 bp, Artificial sequence
  SiRNA target sequence
attaataaaaaacagtatta

SEQ ID NO: 159294 - DNA, 20 bp, Artificial sequence
  SiRNA target sequence
ttaataaaaaacagtattac

SEQ ID NO: 159295 - DNA, 20 bp, Artificial sequence
  SiRNA target sequence
taataaaaaacagtattact

SEQ ID NO: 159296 - DNA, 20 bp, Artificial sequence
  SiRNA target sequence
aataaaaaacagtattacta

SEQ ID NO: 159297 - DNA, 20 bp, Artificial sequence
  SiRNA target sequence
ataaaaaacagtattactaa

SEQ ID NO: 159298 - DNA, 20 bp, Artificial sequence
  SiRNA target sequence
taaaaaacagtattactaaa

SEQ ID NO: 159299 - DNA, 20 bp, Artificial sequence
  SiRNA target sequence
aaaaaacagtattactaaag

SEQ ID NO: 159300 - DNA, 20 bp, Artificial sequence
  SiRNA target sequence
aaaaacagtattactaaaga

SEQ ID NO: 159301 - DNA, 20 bp, Artificial sequence
  SiRNA target sequence
aaaacagtattactaaagat

SEQ ID NO: 159302 - DNA, 20 bp, Artificial sequence
  SiRNA target sequence
aaacagtattactaaagata

SEQ ID NO: 159303 - DNA, 20 bp, Artificial sequence
  SiRNA target sequence
aacagtattactaaagatac

SEQ ID NO: 159304 - DNA, 20 bp, Artificial sequence
  SiRNA target sequence
acagtattactaaagatacc

SEQ ID NO: 159305 - DNA, 20 bp, Artificial sequence
  SiRNA target sequence
cagtattactaaagataccg

SEQ ID NO: 159306 - DNA, 20 bp, Artificial sequence
  SiRNA target sequence
agtattactaaagataccgc

SEQ ID NO: 159307 - DNA, 20 bp, Artificial sequence
  SiRNA target sequence
gtattactaaagataccgct

SEQ ID NO: 159308 - DNA, 20 bp, Artificial sequence
  SiRNA target sequence
tattactaaagataccgctt

SEQ ID NO: 159309 - DNA, 20 bp, Artificial sequence
  SiRNA target sequence
attactaaagataccgcttt

SEQ ID NO: 159310 - DNA, 20 bp, Artificial sequence
  SiRNA target sequence
ttactaaagataccgctttg

SEQ ID NO: 159311 - DNA, 20 bp, Artificial sequence
  SiRNA target sequence
tactaaagataccgctttgg

SEQ ID NO: 159312 - DNA, 20 bp, Artificial sequence
  SiRNA target sequence
actaaagataccgctttggt

SEQ ID NO: 159313 - DNA, 20 bp, Artificial sequence
  SiRNA target sequence
ctaaagataccgctttggtg

SEQ ID NO: 159314 - DNA, 20 bp, Artificial sequence
  SiRNA target sequence
taaagataccgctttggtgt

SEQ ID NO: 159315 - DNA, 20 bp, Artificial sequence
  SiRNA target sequence
aaagataccgctttggtgtc

SEQ ID NO: 159316 - DNA, 20 bp, Artificial sequence
  SiRNA target sequence
aagataccgctttggtgtct

SEQ ID NO: 159317 - DNA, 20 bp, Artificial sequence
  SiRNA target sequence
agataccgctttggtgtctg

SEQ ID NO: 159318 - DNA, 20 bp, Artificial sequence
  SiRNA target sequence
gataccgctttggtgtctgt

SEQ ID NO: 159319 - DNA, 20 bp, Artificial sequence
  SiRNA target sequence
ataccgctttggtgtctgtt

SEQ ID NO: 159320 - DNA, 20 bp, Artificial sequence
  SiRNA target sequence
taccgctttggtgtctgtta

SEQ ID NO: 159321 - DNA, 20 bp, Artificial sequence
  SiRNA target sequence
accgctttggtgtctgttat

SEQ ID NO: 159322 - DNA, 20 bp, Artificial sequence
  SiRNA target sequence
ccgctttggtgtctgttatg

SEQ ID NO: 159323 - DNA, 20 bp, Artificial sequence
  SiRNA target sequence
cgctttggtgtctgttatgg

SEQ ID NO: 159324 - DNA, 20 bp, Artificial sequence
  SiRNA target sequence
gctttggtgtctgttatggc

SEQ ID NO: 159325 - DNA, 20 bp, Artificial sequence
  SiRNA target sequence
ctttggtgtctgttatggct

SEQ ID NO: 159326 - DNA, 20 bp, Artificial sequence
  SiRNA target sequence
tttggtgtctgttatggctg

SEQ ID NO: 159327 - DNA, 20 bp, Artificial sequence
  SiRNA target sequence
ttggtgtctgttatggctgt

SEQ ID NO: 159328 - DNA, 20 bp, Artificial sequence
  SiRNA target sequence
tggtgtctgttatggctgtt

SEQ ID NO: 159329 - DNA, 20 bp, Artificial sequence
  SiRNA target sequence
ggtgtctgttatggctgtta

SEQ ID NO: 159330 - DNA, 20 bp, Artificial sequence
  SiRNA target sequence
gtgtctgttatggctgttaa

SEQ ID NO: 159331 - DNA, 20 bp, Artificial sequence
  SiRNA target sequence
tgtctgttatggctgttaac

SEQ ID NO: 159332 - DNA, 20 bp, Artificial sequence
  SiRNA target sequence
gtctgttatggctgttaaca

SEQ ID NO: 159333 - DNA, 20 bp, Artificial sequence
  SiRNA target sequence
tctgttatggctgttaacaa

SEQ ID NO: 159334 - DNA, 20 bp, Artificial sequence
  SiRNA target sequence
ctgttatggctgttaacaac

SEQ ID NO: 159335 - DNA, 20 bp, Artificial sequence
  SiRNA target sequence
tgttatggctgttaacaacg

SEQ ID NO: 159336 - DNA, 20 bp, Artificial sequence
  SiRNA target sequence
gttatggctgttaacaacga

SEQ ID NO: 159337 - DNA, 20 bp, Artificial sequence
  SiRNA target sequence
ttatggctgttaacaacgaa

SEQ ID NO: 159338 - DNA, 20 bp, Artificial sequence
  SiRNA target sequence
tatggctgttaacaacgaaa

SEQ ID NO: 159339 - DNA, 20 bp, Artificial sequence
  SiRNA target sequence
atggctgttaacaacgaaat

SEQ ID NO: 159340 - DNA, 20 bp, Artificial sequence
  SiRNA target sequence
tggctgttaacaacgaaatg

SEQ ID NO: 159341 - DNA, 20 bp, Artificial sequence
  SiRNA target sequence
ggctgttaacaacgaaatgg

SEQ ID NO: 159342 - DNA, 20 bp, Artificial sequence
  SiRNA target sequence
gctgttaacaacgaaatggg

SEQ ID NO: 159343 - DNA, 20 bp, Artificial sequence
  SiRNA target sequence
ctgttaacaacgaaatggga

SEQ ID NO: 159344 - DNA, 20 bp, Artificial sequence
  SiRNA target sequence
tgttaacaacgaaatgggag

SEQ ID NO: 159345 - DNA, 20 bp, Artificial sequence
  SiRNA target sequence
gttaacaacgaaatgggagc

SEQ ID NO: 159346 - DNA, 20 bp, Artificial sequence
  SiRNA target sequence
ttaacaacgaaatgggagca

SEQ ID NO: 159347 - DNA, 20 bp, Artificial sequence
  SiRNA target sequence
taacaacgaaatgggagcaa

SEQ ID NO: 159348 - DNA, 20 bp, Artificial sequence
  SiRNA target sequence
aacaacgaaatgggagcaat

SEQ ID NO: 159349 - DNA, 20 bp, Artificial sequence
  SiRNA target sequence
acaacgaaatgggagcaata

SEQ ID NO: 159350 - DNA, 20 bp, Artificial sequence
  SiRNA target sequence
caacgaaatgggagcaatac

SEQ ID NO: 159351 - DNA, 20 bp, Artificial sequence
  SiRNA target sequence
aacgaaatgggagcaataca

SEQ ID NO: 159352 - DNA, 20 bp, Artificial sequence
  SiRNA target sequence
acgaaatgggagcaatacaa

SEQ ID NO: 159353 - DNA, 20 bp, Artificial sequence
  SiRNA target sequence
cgaaatgggagcaatacaac

SEQ ID NO: 159354 - DNA, 20 bp, Artificial sequence
  SiRNA target sequence
gaaatgggagcaatacaacc

SEQ ID NO: 159355 - DNA, 20 bp, Artificial sequence
  SiRNA target sequence
aaatgggagcaatacaaccg

SEQ ID NO: 159356 - DNA, 20 bp, Artificial sequence
  SiRNA target sequence
aatgggagcaatacaaccgc

SEQ ID NO: 159357 - DNA, 20 bp, Artificial sequence
  SiRNA target sequence
atgggagcaatacaaccgct

SEQ ID NO: 159358 - DNA, 20 bp, Artificial sequence
  SiRNA target sequence
tgggagcaatacaaccgctt

SEQ ID NO: 159359 - DNA, 20 bp, Artificial sequence
  SiRNA target sequence
gggagcaatacaaccgctta

SEQ ID NO: 159360 - DNA, 20 bp, Artificial sequence
  SiRNA target sequence
ggagcaatacaaccgcttaa

SEQ ID NO: 159361 - DNA, 20 bp, Artificial sequence
  SiRNA target sequence
gagcaatacaaccgcttaaa

SEQ ID NO: 159362 - DNA, 20 bp, Artificial sequence
  SiRNA target sequence
agcaatacaaccgcttaaag

SEQ ID NO: 159363 - DNA, 20 bp, Artificial sequence
  SiRNA target sequence
gcaatacaaccgcttaaaga

SEQ ID NO: 159364 - DNA, 20 bp, Artificial sequence
  SiRNA target sequence
caatacaaccgcttaaagaa

SEQ ID NO: 159365 - DNA, 20 bp, Artificial sequence
  SiRNA target sequence
aatacaaccgcttaaagaaa

SEQ ID NO: 159366 - DNA, 20 bp, Artificial sequence
  SiRNA target sequence
atacaaccgcttaaagaaat

SEQ ID NO: 159367 - DNA, 20 bp, Artificial sequence
  SiRNA target sequence
tacaaccgcttaaagaaata

SEQ ID NO: 159368 - DNA, 20 bp, Artificial sequence
  SiRNA target sequence
acaaccgcttaaagaaatag

SEQ ID NO: 159369 - DNA, 20 bp, Artificial sequence
  SiRNA target sequence
caaccgcttaaagaaatagg

SEQ ID NO: 159370 - DNA, 20 bp, Artificial sequence
  SiRNA target sequence
aaccgcttaaagaaatagga

SEQ ID NO: 159371 - DNA, 20 bp, Artificial sequence
  SiRNA target sequence
accgcttaaagaaataggaa

SEQ ID NO: 159372 - DNA, 20 bp, Artificial sequence
  SiRNA target sequence
ccgcttaaagaaataggaag

SEQ ID NO: 159373 - DNA, 20 bp, Artificial sequence
  SiRNA target sequence
cgcttaaagaaataggaaga

SEQ ID NO: 159374 - DNA, 20 bp, Artificial sequence
  SiRNA target sequence
gcttaaagaaataggaagaa

SEQ ID NO: 159375 - DNA, 20 bp, Artificial sequence
  SiRNA target sequence
cttaaagaaataggaagaat

SEQ ID NO: 159376 - DNA, 20 bp, Artificial sequence
  SiRNA target sequence
ttaaagaaataggaagaata

SEQ ID NO: 159377 - DNA, 20 bp, Artificial sequence
  SiRNA target sequence
taaagaaataggaagaatat

SEQ ID NO: 159378 - DNA, 20 bp, Artificial sequence
  SiRNA target sequence
aaagaaataggaagaatatg

SEQ ID NO: 159379 - DNA, 20 bp, Artificial sequence
  SiRNA target sequence
aagaaataggaagaatatgt

SEQ ID NO: 159380 - DNA, 20 bp, Artificial sequence
  SiRNA target sequence
agaaataggaagaatatgta

SEQ ID NO: 159381 - DNA, 20 bp, Artificial sequence
  SiRNA target sequence
gaaataggaagaatatgtaa

SEQ ID NO: 159382 - DNA, 20 bp, Artificial sequence
  SiRNA target sequence
aaataggaagaatatgtaaa

SEQ ID NO: 159383 - DNA, 20 bp, Artificial sequence
  SiRNA target sequence
aataggaagaatatgtaaag

SEQ ID NO: 159384 - DNA, 20 bp, Artificial sequence
  SiRNA target sequence
ataggaagaatatgtaaaga

SEQ ID NO: 159385 - DNA, 20 bp, Artificial sequence
  SiRNA target sequence
taggaagaatatgtaaagaa

SEQ ID NO: 159386 - DNA, 20 bp, Artificial sequence
  SiRNA target sequence
aggaagaatatgtaaagaaa

SEQ ID NO: 159387 - DNA, 20 bp, Artificial sequence
  SiRNA target sequence
ggaagaatatgtaaagaaaa

SEQ ID NO: 159388 - DNA, 20 bp, Artificial sequence
  SiRNA target sequence
gaagaatatgtaaagaaaat

SEQ ID NO: 159389 - DNA, 20 bp, Artificial sequence
  SiRNA target sequence
aagaatatgtaaagaaaata

SEQ ID NO: 159390 - DNA, 20 bp, Artificial sequence
  SiRNA target sequence
agaatatgtaaagaaaataa

SEQ ID NO: 159391 - DNA, 20 bp, Artificial sequence
  SiRNA target sequence
gaatatgtaaagaaaataat

SEQ ID NO: 159392 - DNA, 20 bp, Artificial sequence
  SiRNA target sequence
aatatgtaaagaaaataata

SEQ ID NO: 159393 - DNA, 20 bp, Artificial sequence
  SiRNA target sequence
atatgtaaagaaaataatat

SEQ ID NO: 159394 - DNA, 20 bp, Artificial sequence
  SiRNA target sequence
tatgtaaagaaaataatatt

SEQ ID NO: 159395 - DNA, 20 bp, Artificial sequence
  SiRNA target sequence
atgtaaagaaaataatattt

SEQ ID NO: 159396 - DNA, 20 bp, Artificial sequence
  SiRNA target sequence
tgtaaagaaaataatatttt

SEQ ID NO: 159397 - DNA, 20 bp, Artificial sequence
  SiRNA target sequence
gtaaagaaaataatatttta

SEQ ID NO: 159398 - DNA, 20 bp, Artificial sequence
  SiRNA target sequence
taaagaaaataatattttat

SEQ ID NO: 159399 - DNA, 20 bp, Artificial sequence
  SiRNA target sequence
aaagaaaataatattttatt

SEQ ID NO: 159400 - DNA, 20 bp, Artificial sequence
  SiRNA target sequence
aagaaaataatattttattt

SEQ ID NO: 159401 - DNA, 20 bp, Artificial sequence
  SiRNA target sequence
agaaaataatattttatttc

SEQ ID NO: 159402 - DNA, 20 bp, Artificial sequence
  SiRNA target sequence
gaaaataatattttatttca

SEQ ID NO: 159403 - DNA, 20 bp, Artificial sequence
  SiRNA target sequence
aaaataatattttatttcac

SEQ ID NO: 159404 - DNA, 20 bp, Artificial sequence
  SiRNA target sequence
aaataatattttatttcaca

SEQ ID NO: 159405 - DNA, 20 bp, Artificial sequence
  SiRNA target sequence
aataatattttatttcacac

SEQ ID NO: 159406 - DNA, 20 bp, Artificial sequence
  SiRNA target sequence
ataatattttatttcacact

SEQ ID NO: 159407 - DNA, 20 bp, Artificial sequence
  SiRNA target sequence
taatattttatttcacactg

SEQ ID NO: 159408 - DNA, 20 bp, Artificial sequence
  SiRNA target sequence
aatattttatttcacactga

SEQ ID NO: 159409 - DNA, 20 bp, Artificial sequence
  SiRNA target sequence
atattttatttcacactgat

SEQ ID NO: 159410 - DNA, 20 bp, Artificial sequence
  SiRNA target sequence
tattttatttcacactgatg

SEQ ID NO: 159411 - DNA, 20 bp, Artificial sequence
  SiRNA target sequence
attttatttcacactgatgc

SEQ ID NO: 159412 - DNA, 20 bp, Artificial sequence
  SiRNA target sequence
ttttatttcacactgatgca

SEQ ID NO: 159413 - DNA, 20 bp, Artificial sequence
  SiRNA target sequence
tttatttcacactgatgcag

SEQ ID NO: 159414 - DNA, 20 bp, Artificial sequence
  SiRNA target sequence
ttatttcacactgatgcagc

SEQ ID NO: 159415 - DNA, 20 bp, Artificial sequence
  SiRNA target sequence
tatttcacactgatgcagca

SEQ ID NO: 159416 - DNA, 20 bp, Artificial sequence
  SiRNA target sequence
atttcacactgatgcagcac

SEQ ID NO: 159417 - DNA, 20 bp, Artificial sequence
  SiRNA target sequence
tttcacactgatgcagcaca

SEQ ID NO: 159418 - DNA, 20 bp, Artificial sequence
  SiRNA target sequence
ttcacactgatgcagcacaa

SEQ ID NO: 159419 - DNA, 20 bp, Artificial sequence
  SiRNA target sequence
tcacactgatgcagcacaag

SEQ ID NO: 159420 - DNA, 20 bp, Artificial sequence
  SiRNA target sequence
cacactgatgcagcacaagc

SEQ ID NO: 159421 - DNA, 20 bp, Artificial sequence
  SiRNA target sequence
acactgatgcagcacaagca

SEQ ID NO: 159422 - DNA, 20 bp, Artificial sequence
  SiRNA target sequence
cactgatgcagcacaagcag

SEQ ID NO: 159423 - DNA, 20 bp, Artificial sequence
  SiRNA target sequence
actgatgcagcacaagcagt

SEQ ID NO: 159424 - DNA, 20 bp, Artificial sequence
  SiRNA target sequence
ctgatgcagcacaagcagtt

SEQ ID NO: 159425 - DNA, 20 bp, Artificial sequence
  SiRNA target sequence
tgatgcagcacaagcagttg

SEQ ID NO: 159426 - DNA, 20 bp, Artificial sequence
  SiRNA target sequence
gatgcagcacaagcagttgg

SEQ ID NO: 159427 - DNA, 20 bp, Artificial sequence
  SiRNA target sequence
atgcagcacaagcagttggt

SEQ ID NO: 159428 - DNA, 20 bp, Artificial sequence
  SiRNA target sequence
tgcagcacaagcagttggta

SEQ ID NO: 159429 - DNA, 20 bp, Artificial sequence
  SiRNA target sequence
gcagcacaagcagttggtaa

SEQ ID NO: 159430 - DNA, 20 bp, Artificial sequence
  SiRNA target sequence
cagcacaagcagttggtaat

SEQ ID NO: 159431 - DNA, 20 bp, Artificial sequence
  SiRNA target sequence
agcacaagcagttggtaata

SEQ ID NO: 159432 - DNA, 20 bp, Artificial sequence
  SiRNA target sequence
gcacaagcagttggtaatat

SEQ ID NO: 159433 - DNA, 20 bp, Artificial sequence
  SiRNA target sequence
cacaagcagttggtaatata

SEQ ID NO: 159434 - DNA, 20 bp, Artificial sequence
  SiRNA target sequence
acaagcagttggtaatatag

SEQ ID NO: 159435 - DNA, 20 bp, Artificial sequence
  SiRNA target sequence
caagcagttggtaatataga

SEQ ID NO: 159436 - DNA, 20 bp, Artificial sequence
  SiRNA target sequence
aagcagttggtaatatagat

SEQ ID NO: 159437 - DNA, 20 bp, Artificial sequence
  SiRNA target sequence
agcagttggtaatatagata

SEQ ID NO: 159438 - DNA, 20 bp, Artificial sequence
  SiRNA target sequence
gcagttggtaatatagatat

SEQ ID NO: 159439 - DNA, 20 bp, Artificial sequence
  SiRNA target sequence
cagttggtaatatagatatt

SEQ ID NO: 159440 - DNA, 20 bp, Artificial sequence
  SiRNA target sequence
agttggtaatatagatattg

SEQ ID NO: 159441 - DNA, 20 bp, Artificial sequence
  SiRNA target sequence
gttggtaatatagatattga

SEQ ID NO: 159442 - DNA, 20 bp, Artificial sequence
  SiRNA target sequence
ttggtaatatagatattgat

SEQ ID NO: 159443 - DNA, 20 bp, Artificial sequence
  SiRNA target sequence
tggtaatatagatattgatg

SEQ ID NO: 159444 - DNA, 20 bp, Artificial sequence
  SiRNA target sequence
ggtaatatagatattgatgt

SEQ ID NO: 159445 - DNA, 20 bp, Artificial sequence
  SiRNA target sequence
gtaatatagatattgatgtc

SEQ ID NO: 159446 - DNA, 20 bp, Artificial sequence
  SiRNA target sequence
taatatagatattgatgtca

SEQ ID NO: 159447 - DNA, 20 bp, Artificial sequence
  SiRNA target sequence
aatatagatattgatgtcaa

SEQ ID NO: 159448 - DNA, 20 bp, Artificial sequence
  SiRNA target sequence
atatagatattgatgtcaat

SEQ ID NO: 159449 - DNA, 20 bp, Artificial sequence
  SiRNA target sequence
tatagatattgatgtcaatg

SEQ ID NO: 159450 - DNA, 20 bp, Artificial sequence
  SiRNA target sequence
atagatattgatgtcaatga

SEQ ID NO: 159451 - DNA, 20 bp, Artificial sequence
  SiRNA target sequence
tagatattgatgtcaatgat

SEQ ID NO: 159452 - DNA, 20 bp, Artificial sequence
  SiRNA target sequence
agatattgatgtcaatgata

SEQ ID NO: 159453 - DNA, 20 bp, Artificial sequence
  SiRNA target sequence
gatattgatgtcaatgatat

SEQ ID NO: 159454 - DNA, 20 bp, Artificial sequence
  SiRNA target sequence
atattgatgtcaatgatatg

SEQ ID NO: 159455 - DNA, 20 bp, Artificial sequence
  SiRNA target sequence
tattgatgtcaatgatatga

SEQ ID NO: 159456 - DNA, 20 bp, Artificial sequence
  SiRNA target sequence
attgatgtcaatgatatgaa

SEQ ID NO: 159457 - DNA, 20 bp, Artificial sequence
  SiRNA target sequence
ttgatgtcaatgatatgaat

SEQ ID NO: 159458 - DNA, 20 bp, Artificial sequence
  SiRNA target sequence
tgatgtcaatgatatgaata

SEQ ID NO: 159459 - DNA, 20 bp, Artificial sequence
  SiRNA target sequence
gatgtcaatgatatgaatat

SEQ ID NO: 159460 - DNA, 20 bp, Artificial sequence
  SiRNA target sequence
atgtcaatgatatgaatatt

SEQ ID NO: 159461 - DNA, 20 bp, Artificial sequence
  SiRNA target sequence
tgtcaatgatatgaatattg

SEQ ID NO: 159462 - DNA, 20 bp, Artificial sequence
  SiRNA target sequence
gtcaatgatatgaatattga

SEQ ID NO: 159463 - DNA, 20 bp, Artificial sequence
  SiRNA target sequence
tcaatgatatgaatattgat

SEQ ID NO: 159464 - DNA, 20 bp, Artificial sequence
  SiRNA target sequence
caatgatatgaatattgatt

SEQ ID NO: 159465 - DNA, 20 bp, Artificial sequence
  SiRNA target sequence
aatgatatgaatattgattt

SEQ ID NO: 159466 - DNA, 20 bp, Artificial sequence
  SiRNA target sequence
atgatatgaatattgattta

SEQ ID NO: 159467 - DNA, 20 bp, Artificial sequence
  SiRNA target sequence
tgatatgaatattgatttac

SEQ ID NO: 159468 - DNA, 20 bp, Artificial sequence
  SiRNA target sequence
gatatgaatattgatttact

SEQ ID NO: 159469 - DNA, 20 bp, Artificial sequence
  SiRNA target sequence
atatgaatattgatttacta

SEQ ID NO: 159470 - DNA, 20 bp, Artificial sequence
  SiRNA target sequence
tatgaatattgatttactaa

SEQ ID NO: 159471 - DNA, 20 bp, Artificial sequence
  SiRNA target sequence
atgaatattgatttactaag

SEQ ID NO: 159472 - DNA, 20 bp, Artificial sequence
  SiRNA target sequence
tgaatattgatttactaagt

SEQ ID NO: 159473 - DNA, 20 bp, Artificial sequence
  SiRNA target sequence
gaatattgatttactaagtt

SEQ ID NO: 159474 - DNA, 20 bp, Artificial sequence
  SiRNA target sequence
aatattgatttactaagttt

SEQ ID NO: 159475 - DNA, 20 bp, Artificial sequence
  SiRNA target sequence
atattgatttactaagttta

SEQ ID NO: 159476 - DNA, 20 bp, Artificial sequence
  SiRNA target sequence
tattgatttactaagtttat

SEQ ID NO: 159477 - DNA, 20 bp, Artificial sequence
  SiRNA target sequence
attgatttactaagtttatc

SEQ ID NO: 159478 - DNA, 20 bp, Artificial sequence
  SiRNA target sequence
ttgatttactaagtttatca

SEQ ID NO: 159479 - DNA, 20 bp, Artificial sequence
  SiRNA target sequence
tgatttactaagtttatcaa

SEQ ID NO: 159480 - DNA, 20 bp, Artificial sequence
  SiRNA target sequence
gatttactaagtttatcaag

SEQ ID NO: 159481 - DNA, 20 bp, Artificial sequence
  SiRNA target sequence
atttactaagtttatcaagt

SEQ ID NO: 159482 - DNA, 20 bp, Artificial sequence
  SiRNA target sequence
tttactaagtttatcaagtc

SEQ ID NO: 159483 - DNA, 20 bp, Artificial sequence
  SiRNA target sequence
ttactaagtttatcaagtca

SEQ ID NO: 159484 - DNA, 20 bp, Artificial sequence
  SiRNA target sequence
tactaagtttatcaagtcat

SEQ ID NO: 159485 - DNA, 20 bp, Artificial sequence
  SiRNA target sequence
actaagtttatcaagtcata

SEQ ID NO: 159486 - DNA, 20 bp, Artificial sequence
  SiRNA target sequence
ctaagtttatcaagtcataa

SEQ ID NO: 159487 - DNA, 20 bp, Artificial sequence
  SiRNA target sequence
taagtttatcaagtcataaa

SEQ ID NO: 159488 - DNA, 20 bp, Artificial sequence
  SiRNA target sequence
aagtttatcaagtcataaaa

SEQ ID NO: 159489 - DNA, 20 bp, Artificial sequence
  SiRNA target sequence
agtttatcaagtcataaaat

SEQ ID NO: 159490 - DNA, 20 bp, Artificial sequence
  SiRNA target sequence
gtttatcaagtcataaaatt

SEQ ID NO: 159491 - DNA, 20 bp, Artificial sequence
  SiRNA target sequence
tttatcaagtcataaaattt

SEQ ID NO: 159492 - DNA, 20 bp, Artificial sequence
  SiRNA target sequence
ttatcaagtcataaaattta

SEQ ID NO: 159493 - DNA, 20 bp, Artificial sequence
  SiRNA target sequence
tatcaagtcataaaatttat

SEQ ID NO: 159494 - DNA, 20 bp, Artificial sequence
  SiRNA target sequence
atcaagtcataaaatttatg

SEQ ID NO: 159495 - DNA, 20 bp, Artificial sequence
  SiRNA target sequence
tcaagtcataaaatttatgg

SEQ ID NO: 159496 - DNA, 20 bp, Artificial sequence
  SiRNA target sequence
caagtcataaaatttatggt

SEQ ID NO: 159497 - DNA, 20 bp, Artificial sequence
  SiRNA target sequence
aagtcataaaatttatggtc

SEQ ID NO: 159498 - DNA, 20 bp, Artificial sequence
  SiRNA target sequence
agtcataaaatttatggtcc

SEQ ID NO: 159499 - DNA, 20 bp, Artificial sequence
  SiRNA target sequence
gtcataaaatttatggtcca

SEQ ID NO: 159500 - DNA, 20 bp, Artificial sequence
  SiRNA target sequence
tcataaaatttatggtccaa

SEQ ID NO: 159501 - DNA, 20 bp, Artificial sequence
  SiRNA target sequence
cataaaatttatggtccaaa

SEQ ID NO: 159502 - DNA, 20 bp, Artificial sequence
  SiRNA target sequence
ataaaatttatggtccaaaa

SEQ ID NO: 159503 - DNA, 20 bp, Artificial sequence
  SiRNA target sequence
taaaatttatggtccaaaag

SEQ ID NO: 159504 - DNA, 20 bp, Artificial sequence
  SiRNA target sequence
aaaatttatggtccaaaagg

SEQ ID NO: 159505 - DNA, 20 bp, Artificial sequence
  SiRNA target sequence
aaatttatggtccaaaaggt

SEQ ID NO: 159506 - DNA, 20 bp, Artificial sequence
  SiRNA target sequence
aatttatggtccaaaaggtg

SEQ ID NO: 159507 - DNA, 20 bp, Artificial sequence
  SiRNA target sequence
atttatggtccaaaaggtgt

SEQ ID NO: 159508 - DNA, 20 bp, Artificial sequence
  SiRNA target sequence
tttatggtccaaaaggtgtt

SEQ ID NO: 159509 - DNA, 20 bp, Artificial sequence
  SiRNA target sequence
ttatggtccaaaaggtgttg

SEQ ID NO: 159510 - DNA, 20 bp, Artificial sequence
  SiRNA target sequence
tatggtccaaaaggtgttgg

SEQ ID NO: 159511 - DNA, 20 bp, Artificial sequence
  SiRNA target sequence
atggtccaaaaggtgttggt

SEQ ID NO: 159512 - DNA, 20 bp, Artificial sequence
  SiRNA target sequence
tggtccaaaaggtgttggtg

SEQ ID NO: 159513 - DNA, 20 bp, Artificial sequence
  SiRNA target sequence
ggtccaaaaggtgttggtgc

SEQ ID NO: 159514 - DNA, 20 bp, Artificial sequence
  SiRNA target sequence
gtccaaaaggtgttggtgcc

SEQ ID NO: 159515 - DNA, 20 bp, Artificial sequence
  SiRNA target sequence
tccaaaaggtgttggtgcct

SEQ ID NO: 159516 - DNA, 20 bp, Artificial sequence
  SiRNA target sequence
ccaaaaggtgttggtgcctt

SEQ ID NO: 159517 - DNA, 20 bp, Artificial sequence
  SiRNA target sequence
caaaaggtgttggtgcctta

SEQ ID NO: 159518 - DNA, 20 bp, Artificial sequence
  SiRNA target sequence
aaaaggtgttggtgccttat

SEQ ID NO: 159519 - DNA, 20 bp, Artificial sequence
  SiRNA target sequence
aaaggtgttggtgccttata

SEQ ID NO: 159520 - DNA, 20 bp, Artificial sequence
  SiRNA target sequence
aaggtgttggtgccttatac

SEQ ID NO: 159521 - DNA, 20 bp, Artificial sequence
  SiRNA target sequence
aggtgttggtgccttatacg

SEQ ID NO: 159522 - DNA, 20 bp, Artificial sequence
  SiRNA target sequence
ggtgttggtgccttatacgt

SEQ ID NO: 159523 - DNA, 20 bp, Artificial sequence
  SiRNA target sequence
gtgttggtgccttatacgtc

SEQ ID NO: 159524 - DNA, 20 bp, Artificial sequence
  SiRNA target sequence
tgttggtgccttatacgtca

SEQ ID NO: 159525 - DNA, 20 bp, Artificial sequence
  SiRNA target sequence
gttggtgccttatacgtcag

SEQ ID NO: 159526 - DNA, 20 bp, Artificial sequence
  SiRNA target sequence
ttggtgccttatacgtcaga

SEQ ID NO: 159527 - DNA, 20 bp, Artificial sequence
  SiRNA target sequence
tggtgccttatacgtcagaa

SEQ ID NO: 159528 - DNA, 20 bp, Artificial sequence
  SiRNA target sequence
ggtgccttatacgtcagaag

SEQ ID NO: 159529 - DNA, 20 bp, Artificial sequence
  SiRNA target sequence
gtgccttatacgtcagaaga

SEQ ID NO: 159530 - DNA, 20 bp, Artificial sequence
  SiRNA target sequence
tgccttatacgtcagaagaa

SEQ ID NO: 159531 - DNA, 20 bp, Artificial sequence
  SiRNA target sequence
gccttatacgtcagaagaag

SEQ ID NO: 159532 - DNA, 20 bp, Artificial sequence
  SiRNA target sequence
ccttatacgtcagaagaagg

SEQ ID NO: 159533 - DNA, 20 bp, Artificial sequence
  SiRNA target sequence
cttatacgtcagaagaaggc

SEQ ID NO: 159534 - DNA, 20 bp, Artificial sequence
  SiRNA target sequence
ttatacgtcagaagaaggcc

SEQ ID NO: 159535 - DNA, 20 bp, Artificial sequence
  SiRNA target sequence
tatacgtcagaagaaggcct

SEQ ID NO: 159536 - DNA, 20 bp, Artificial sequence
  SiRNA target sequence
atacgtcagaagaaggccta

SEQ ID NO: 159537 - DNA, 20 bp, Artificial sequence
  SiRNA target sequence
tacgtcagaagaaggcctag

SEQ ID NO: 159538 - DNA, 20 bp, Artificial sequence
  SiRNA target sequence
acgtcagaagaaggcctagg

SEQ ID NO: 159539 - DNA, 20 bp, Artificial sequence
  SiRNA target sequence
cgtcagaagaaggcctaggg

SEQ ID NO: 159540 - DNA, 20 bp, Artificial sequence
  SiRNA target sequence
gtcagaagaaggcctagggt

SEQ ID NO: 159541 - DNA, 20 bp, Artificial sequence
  SiRNA target sequence
tcagaagaaggcctagggtg

SEQ ID NO: 159542 - DNA, 20 bp, Artificial sequence
  SiRNA target sequence
cagaagaaggcctagggtga

SEQ ID NO: 159543 - DNA, 20 bp, Artificial sequence
  SiRNA target sequence
agaagaaggcctagggtgag

SEQ ID NO: 159544 - DNA, 20 bp, Artificial sequence
  SiRNA target sequence
gaagaaggcctagggtgaga

SEQ ID NO: 159545 - DNA, 20 bp, Artificial sequence
  SiRNA target sequence
aagaaggcctagggtgagaa

SEQ ID NO: 159546 - DNA, 20 bp, Artificial sequence
  SiRNA target sequence
agaaggcctagggtgagaat

SEQ ID NO: 159547 - DNA, 20 bp, Artificial sequence
  SiRNA target sequence
gaaggcctagggtgagaatg

SEQ ID NO: 159548 - DNA, 20 bp, Artificial sequence
  SiRNA target sequence
aaggcctagggtgagaatgt

SEQ ID NO: 159549 - DNA, 20 bp, Artificial sequence
  SiRNA target sequence
aggcctagggtgagaatgtt

SEQ ID NO: 159550 - DNA, 20 bp, Artificial sequence
  SiRNA target sequence
ggcctagggtgagaatgtta

SEQ ID NO: 159551 - DNA, 20 bp, Artificial sequence
  SiRNA target sequence
gcctagggtgagaatgttac

SEQ ID NO: 159552 - DNA, 20 bp, Artificial sequence
  SiRNA target sequence
cctagggtgagaatgttacc

SEQ ID NO: 159553 - DNA, 20 bp, Artificial sequence
  SiRNA target sequence
ctagggtgagaatgttacca

SEQ ID NO: 159554 - DNA, 20 bp, Artificial sequence
  SiRNA target sequence
tagggtgagaatgttaccac

SEQ ID NO: 159555 - DNA, 20 bp, Artificial sequence
  SiRNA target sequence
agggtgagaatgttaccact

SEQ ID NO: 159556 - DNA, 20 bp, Artificial sequence
  SiRNA target sequence
gggtgagaatgttaccactt

SEQ ID NO: 159557 - DNA, 20 bp, Artificial sequence
  SiRNA target sequence
ggtgagaatgttaccacttt

SEQ ID NO: 159558 - DNA, 20 bp, Artificial sequence
  SiRNA target sequence
gtgagaatgttaccactttt

SEQ ID NO: 159559 - DNA, 20 bp, Artificial sequence
  SiRNA target sequence
tgagaatgttaccacttttt

SEQ ID NO: 159560 - DNA, 20 bp, Artificial sequence
  SiRNA target sequence
gagaatgttaccacttttta

SEQ ID NO: 159561 - DNA, 20 bp, Artificial sequence
  SiRNA target sequence
agaatgttaccactttttaa

SEQ ID NO: 159562 - DNA, 20 bp, Artificial sequence
  SiRNA target sequence
gaatgttaccactttttaat

SEQ ID NO: 159563 - DNA, 20 bp, Artificial sequence
  SiRNA target sequence
aatgttaccactttttaatg

SEQ ID NO: 159564 - DNA, 20 bp, Artificial sequence
  SiRNA target sequence
atgttaccactttttaatgg

SEQ ID NO: 159565 - DNA, 20 bp, Artificial sequence
  SiRNA target sequence
tgttaccactttttaatggt

SEQ ID NO: 159566 - DNA, 20 bp, Artificial sequence
  SiRNA target sequence
gttaccactttttaatggtg

SEQ ID NO: 159567 - DNA, 20 bp, Artificial sequence
  SiRNA target sequence
ttaccactttttaatggtgg

SEQ ID NO: 159568 - DNA, 20 bp, Artificial sequence
  SiRNA target sequence
taccactttttaatggtggt

SEQ ID NO: 159569 - DNA, 20 bp, Artificial sequence
  SiRNA target sequence
accactttttaatggtggtg

SEQ ID NO: 159570 - DNA, 20 bp, Artificial sequence
  SiRNA target sequence
ccactttttaatggtggtgg

SEQ ID NO: 159571 - DNA, 20 bp, Artificial sequence
  SiRNA target sequence
cactttttaatggtggtgga

SEQ ID NO: 159572 - DNA, 20 bp, Artificial sequence
  SiRNA target sequence
actttttaatggtggtggac

SEQ ID NO: 159573 - DNA, 20 bp, Artificial sequence
  SiRNA target sequence
ctttttaatggtggtggaca

SEQ ID NO: 159574 - DNA, 20 bp, Artificial sequence
  SiRNA target sequence
tttttaatggtggtggacaa

SEQ ID NO: 159575 - DNA, 20 bp, Artificial sequence
  SiRNA target sequence
ttttaatggtggtggacaag

SEQ ID NO: 159576 - DNA, 20 bp, Artificial sequence
  SiRNA target sequence
tttaatggtggtggacaaga

SEQ ID NO: 159577 - DNA, 20 bp, Artificial sequence
  SiRNA target sequence
ttaatggtggtggacaagaa

SEQ ID NO: 159578 - DNA, 20 bp, Artificial sequence
  SiRNA target sequence
taatggtggtggacaagaaa

SEQ ID NO: 159579 - DNA, 20 bp, Artificial sequence
  SiRNA target sequence
aatggtggtggacaagaaag

SEQ ID NO: 159580 - DNA, 20 bp, Artificial sequence
  SiRNA target sequence
atggtggtggacaagaaaga

SEQ ID NO: 159581 - DNA, 20 bp, Artificial sequence
  SiRNA target sequence
tggtggtggacaagaaagag

SEQ ID NO: 159582 - DNA, 20 bp, Artificial sequence
  SiRNA target sequence
ggtggtggacaagaaagagg

SEQ ID NO: 159583 - DNA, 20 bp, Artificial sequence
  SiRNA target sequence
gtggtggacaagaaagagga

SEQ ID NO: 159584 - DNA, 20 bp, Artificial sequence
  SiRNA target sequence
tggtggacaagaaagaggat

SEQ ID NO: 159585 - DNA, 20 bp, Artificial sequence
  SiRNA target sequence
ggtggacaagaaagaggatt

SEQ ID NO: 159586 - DNA, 20 bp, Artificial sequence
  SiRNA target sequence
gtggacaagaaagaggatta

SEQ ID NO: 159587 - DNA, 20 bp, Artificial sequence
  SiRNA target sequence
tggacaagaaagaggattaa

SEQ ID NO: 159588 - DNA, 20 bp, Artificial sequence
  SiRNA target sequence
ggacaagaaagaggattaag

SEQ ID NO: 159589 - DNA, 20 bp, Artificial sequence
  SiRNA target sequence
gacaagaaagaggattaaga

SEQ ID NO: 159590 - DNA, 20 bp, Artificial sequence
  SiRNA target sequence
acaagaaagaggattaagaa

SEQ ID NO: 159591 - DNA, 20 bp, Artificial sequence
  SiRNA target sequence
caagaaagaggattaagaag

SEQ ID NO: 159592 - DNA, 20 bp, Artificial sequence
  SiRNA target sequence
aagaaagaggattaagaagt

SEQ ID NO: 159593 - DNA, 20 bp, Artificial sequence
  SiRNA target sequence
agaaagaggattaagaagtg

SEQ ID NO: 159594 - DNA, 20 bp, Artificial sequence
  SiRNA target sequence
gaaagaggattaagaagtgg

SEQ ID NO: 159595 - DNA, 20 bp, Artificial sequence
  SiRNA target sequence
aaagaggattaagaagtggg

SEQ ID NO: 159596 - DNA, 20 bp, Artificial sequence
  SiRNA target sequence
aagaggattaagaagtggga

SEQ ID NO: 159597 - DNA, 20 bp, Artificial sequence
  SiRNA target sequence
agaggattaagaagtgggac

SEQ ID NO: 159598 - DNA, 20 bp, Artificial sequence
  SiRNA target sequence
gaggattaagaagtgggaca

SEQ ID NO: 159599 - DNA, 20 bp, Artificial sequence
  SiRNA target sequence
aggattaagaagtgggacaa

SEQ ID NO: 159600 - DNA, 20 bp, Artificial sequence
  SiRNA target sequence
ggattaagaagtgggacaac

SEQ ID NO: 159601 - DNA, 20 bp, Artificial sequence
  SiRNA target sequence
gattaagaagtgggacaact

SEQ ID NO: 159602 - DNA, 20 bp, Artificial sequence
  SiRNA target sequence
attaagaagtgggacaactt

SEQ ID NO: 159603 - DNA, 20 bp, Artificial sequence
  SiRNA target sequence
ttaagaagtgggacaacttc

SEQ ID NO: 159604 - DNA, 20 bp, Artificial sequence
  SiRNA target sequence
taagaagtgggacaacttct

SEQ ID NO: 159605 - DNA, 20 bp, Artificial sequence
  SiRNA target sequence
aagaagtgggacaacttctc

SEQ ID NO: 159606 - DNA, 20 bp, Artificial sequence
  SiRNA target sequence
agaagtgggacaacttctcc

SEQ ID NO: 159607 - DNA, 20 bp, Artificial sequence
  SiRNA target sequence
gaagtgggacaacttctcca

SEQ ID NO: 159608 - DNA, 20 bp, Artificial sequence
  SiRNA target sequence
aagtgggacaacttctccac

SEQ ID NO: 159609 - DNA, 20 bp, Artificial sequence
  SiRNA target sequence
agtgggacaacttctccacc

SEQ ID NO: 159610 - DNA, 20 bp, Artificial sequence
  SiRNA target sequence
gtgggacaacttctccacct

SEQ ID NO: 159611 - DNA, 20 bp, Artificial sequence
  SiRNA target sequence
tgggacaacttctccacctt

SEQ ID NO: 159612 - DNA, 20 bp, Artificial sequence
  SiRNA target sequence
gggacaacttctccaccttt

SEQ ID NO: 159613 - DNA, 20 bp, Artificial sequence
  SiRNA target sequence
ggacaacttctccaccttta

SEQ ID NO: 159614 - DNA, 20 bp, Artificial sequence
  SiRNA target sequence
gacaacttctccacctttag

SEQ ID NO: 159615 - DNA, 20 bp, Artificial sequence
  SiRNA target sequence
acaacttctccacctttagt

SEQ ID NO: 159616 - DNA, 20 bp, Artificial sequence
  SiRNA target sequence
caacttctccacctttagtt

SEQ ID NO: 159617 - DNA, 20 bp, Artificial sequence
  SiRNA target sequence
aacttctccacctttagttg

SEQ ID NO: 159618 - DNA, 20 bp, Artificial sequence
  SiRNA target sequence
acttctccacctttagttgt

SEQ ID NO: 159619 - DNA, 20 bp, Artificial sequence
  SiRNA target sequence
cttctccacctttagttgtt

SEQ ID NO: 159620 - DNA, 20 bp, Artificial sequence
  SiRNA target sequence
ttctccacctttagttgttg

SEQ ID NO: 159621 - DNA, 20 bp, Artificial sequence
  SiRNA target sequence
tctccacctttagttgttgg

SEQ ID NO: 159622 - DNA, 20 bp, Artificial sequence
  SiRNA target sequence
ctccacctttagttgttgga

SEQ ID NO: 159623 - DNA, 20 bp, Artificial sequence
  SiRNA target sequence
tccacctttagttgttggat

SEQ ID NO: 159624 - DNA, 20 bp, Artificial sequence
  SiRNA target sequence
ccacctttagttgttggatt

SEQ ID NO: 159625 - DNA, 20 bp, Artificial sequence
  SiRNA target sequence
cacctttagttgttggatta

SEQ ID NO: 159626 - DNA, 20 bp, Artificial sequence
  SiRNA target sequence
acctttagttgttggattag

SEQ ID NO: 159627 - DNA, 20 bp, Artificial sequence
  SiRNA target sequence
cctttagttgttggattagg

SEQ ID NO: 159628 - DNA, 20 bp, Artificial sequence
  SiRNA target sequence
ctttagttgttggattaggc

SEQ ID NO: 159629 - DNA, 20 bp, Artificial sequence
  SiRNA target sequence
tttagttgttggattaggca

SEQ ID NO: 159630 - DNA, 20 bp, Artificial sequence
  SiRNA target sequence
ttagttgttggattaggcaa

SEQ ID NO: 159631 - DNA, 20 bp, Artificial sequence
  SiRNA target sequence
tagttgttggattaggcaaa

SEQ ID NO: 159632 - DNA, 20 bp, Artificial sequence
  SiRNA target sequence
agttgttggattaggcaaag

SEQ ID NO: 159633 - DNA, 20 bp, Artificial sequence
  SiRNA target sequence
gttgttggattaggcaaagc

SEQ ID NO: 159634 - DNA, 20 bp, Artificial sequence
  SiRNA target sequence
ttgttggattaggcaaagct

SEQ ID NO: 159635 - DNA, 20 bp, Artificial sequence
  SiRNA target sequence
tgttggattaggcaaagctg

SEQ ID NO: 159636 - DNA, 20 bp, Artificial sequence
  SiRNA target sequence
gttggattaggcaaagctgc

SEQ ID NO: 159637 - DNA, 20 bp, Artificial sequence
  SiRNA target sequence
ttggattaggcaaagctgct

SEQ ID NO: 159638 - DNA, 20 bp, Artificial sequence
  SiRNA target sequence
tggattaggcaaagctgctg

SEQ ID NO: 159639 - DNA, 20 bp, Artificial sequence
  SiRNA target sequence
ggattaggcaaagctgctga

SEQ ID NO: 159640 - DNA, 20 bp, Artificial sequence
  SiRNA target sequence
gattaggcaaagctgctgag

SEQ ID NO: 159641 - DNA, 20 bp, Artificial sequence
  SiRNA target sequence
attaggcaaagctgctgaga

SEQ ID NO: 159642 - DNA, 20 bp, Artificial sequence
  SiRNA target sequence
ttaggcaaagctgctgagat

SEQ ID NO: 159643 - DNA, 20 bp, Artificial sequence
  SiRNA target sequence
taggcaaagctgctgagata

SEQ ID NO: 159644 - DNA, 20 bp, Artificial sequence
  SiRNA target sequence
aggcaaagctgctgagatat

SEQ ID NO: 159645 - DNA, 20 bp, Artificial sequence
  SiRNA target sequence
ggcaaagctgctgagatatg

SEQ ID NO: 159646 - DNA, 20 bp, Artificial sequence
  SiRNA target sequence
gcaaagctgctgagatatgc

SEQ ID NO: 159647 - DNA, 20 bp, Artificial sequence
  SiRNA target sequence
caaagctgctgagatatgct

SEQ ID NO: 159648 - DNA, 20 bp, Artificial sequence
  SiRNA target sequence
aaagctgctgagatatgctc

SEQ ID NO: 159649 - DNA, 20 bp, Artificial sequence
  SiRNA target sequence
aagctgctgagatatgctct

SEQ ID NO: 159650 - DNA, 20 bp, Artificial sequence
  SiRNA target sequence
agctgctgagatatgctctc

SEQ ID NO: 159651 - DNA, 20 bp, Artificial sequence
  SiRNA target sequence
gctgctgagatatgctctca

SEQ ID NO: 159652 - DNA, 20 bp, Artificial sequence
  SiRNA target sequence
ctgctgagatatgctctcag

SEQ ID NO: 159653 - DNA, 20 bp, Artificial sequence
  SiRNA target sequence
tgctgagatatgctctcagg

SEQ ID NO: 159654 - DNA, 20 bp, Artificial sequence
  SiRNA target sequence
gctgagatatgctctcagga

SEQ ID NO: 159655 - DNA, 20 bp, Artificial sequence
  SiRNA target sequence
ctgagatatgctctcaggag

SEQ ID NO: 159656 - DNA, 20 bp, Artificial sequence
  SiRNA target sequence
tgagatatgctctcaggaga

SEQ ID NO: 159657 - DNA, 20 bp, Artificial sequence
  SiRNA target sequence
gagatatgctctcaggagat

SEQ ID NO: 159658 - DNA, 20 bp, Artificial sequence
  SiRNA target sequence
agatatgctctcaggagatg

SEQ ID NO: 159659 - DNA, 20 bp, Artificial sequence
  SiRNA target sequence
gatatgctctcaggagatgc

SEQ ID NO: 159660 - DNA, 20 bp, Artificial sequence
  SiRNA target sequence
atatgctctcaggagatgcg

SEQ ID NO: 159661 - DNA, 20 bp, Artificial sequence
  SiRNA target sequence
tatgctctcaggagatgcgt

SEQ ID NO: 159662 - DNA, 20 bp, Artificial sequence
  SiRNA target sequence
atgctctcaggagatgcgta

SEQ ID NO: 159663 - DNA, 20 bp, Artificial sequence
  SiRNA target sequence
tgctctcaggagatgcgtaa

SEQ ID NO: 159664 - DNA, 20 bp, Artificial sequence
  SiRNA target sequence
gctctcaggagatgcgtaag

SEQ ID NO: 159665 - DNA, 20 bp, Artificial sequence
  SiRNA target sequence
ctctcaggagatgcgtaagg

SEQ ID NO: 159666 - DNA, 20 bp, Artificial sequence
  SiRNA target sequence
tctcaggagatgcgtaagga

SEQ ID NO: 159667 - DNA, 20 bp, Artificial sequence
  SiRNA target sequence
ctcaggagatgcgtaaggac

SEQ ID NO: 159668 - DNA, 20 bp, Artificial sequence
  SiRNA target sequence
tcaggagatgcgtaaggact

SEQ ID NO: 159669 - DNA, 20 bp, Artificial sequence
  SiRNA target sequence
caggagatgcgtaaggacta

SEQ ID NO: 159670 - DNA, 20 bp, Artificial sequence
  SiRNA target sequence
aggagatgcgtaaggactat

SEQ ID NO: 159671 - DNA, 20 bp, Artificial sequence
  SiRNA target sequence
ggagatgcgtaaggactatg

SEQ ID NO: 159672 - DNA, 20 bp, Artificial sequence
  SiRNA target sequence
gagatgcgtaaggactatga

SEQ ID NO: 159673 - DNA, 20 bp, Artificial sequence
  SiRNA target sequence
agatgcgtaaggactatgaa

SEQ ID NO: 159674 - DNA, 20 bp, Artificial sequence
  SiRNA target sequence
gatgcgtaaggactatgaat

SEQ ID NO: 159675 - DNA, 20 bp, Artificial sequence
  SiRNA target sequence
atgcgtaaggactatgaata

SEQ ID NO: 159676 - DNA, 20 bp, Artificial sequence
  SiRNA target sequence
tgcgtaaggactatgaatat

SEQ ID NO: 159677 - DNA, 20 bp, Artificial sequence
  SiRNA target sequence
gcgtaaggactatgaatata

SEQ ID NO: 159678 - DNA, 20 bp, Artificial sequence
  SiRNA target sequence
cgtaaggactatgaatatat

SEQ ID NO: 159679 - DNA, 20 bp, Artificial sequence
  SiRNA target sequence
gtaaggactatgaatatata

SEQ ID NO: 159680 - DNA, 20 bp, Artificial sequence
  SiRNA target sequence
taaggactatgaatatatac

SEQ ID NO: 159681 - DNA, 20 bp, Artificial sequence
  SiRNA target sequence
aaggactatgaatatataca

SEQ ID NO: 159682 - DNA, 20 bp, Artificial sequence
  SiRNA target sequence
aggactatgaatatatacaa

SEQ ID NO: 159683 - DNA, 20 bp, Artificial sequence
  SiRNA target sequence
ggactatgaatatatacaaa

SEQ ID NO: 159684 - DNA, 20 bp, Artificial sequence
  SiRNA target sequence
gactatgaatatatacaaaa

SEQ ID NO: 159685 - DNA, 20 bp, Artificial sequence
  SiRNA target sequence
actatgaatatatacaaaaa

SEQ ID NO: 159686 - DNA, 20 bp, Artificial sequence
  SiRNA target sequence
ctatgaatatatacaaaaat

SEQ ID NO: 159687 - DNA, 20 bp, Artificial sequence
  SiRNA target sequence
tatgaatatatacaaaaatt

SEQ ID NO: 159688 - DNA, 20 bp, Artificial sequence
  SiRNA target sequence
atgaatatatacaaaaatta

SEQ ID NO: 159689 - DNA, 20 bp, Artificial sequence
  SiRNA target sequence
tgaatatatacaaaaattat

SEQ ID NO: 159690 - DNA, 20 bp, Artificial sequence
  SiRNA target sequence
gaatatatacaaaaattatc

SEQ ID NO: 159691 - DNA, 20 bp, Artificial sequence
  SiRNA target sequence
aatatatacaaaaattatcg

SEQ ID NO: 159692 - DNA, 20 bp, Artificial sequence
  SiRNA target sequence
atatatacaaaaattatcgg

SEQ ID NO: 159693 - DNA, 20 bp, Artificial sequence
  SiRNA target sequence
tatatacaaaaattatcgga

SEQ ID NO: 159694 - DNA, 20 bp, Artificial sequence
  SiRNA target sequence
atatacaaaaattatcggat

SEQ ID NO: 159695 - DNA, 20 bp, Artificial sequence
  SiRNA target sequence
tatacaaaaattatcggata

SEQ ID NO: 159696 - DNA, 20 bp, Artificial sequence
  SiRNA target sequence
atacaaaaattatcggataa

SEQ ID NO: 159697 - DNA, 20 bp, Artificial sequence
  SiRNA target sequence
tacaaaaattatcggataaa

SEQ ID NO: 159698 - DNA, 20 bp, Artificial sequence
  SiRNA target sequence
acaaaaattatcggataaac

SEQ ID NO: 159699 - DNA, 20 bp, Artificial sequence
  SiRNA target sequence
caaaaattatcggataaact

SEQ ID NO: 159700 - DNA, 20 bp, Artificial sequence
  SiRNA target sequence
aaaaattatcggataaacta

SEQ ID NO: 159701 - DNA, 20 bp, Artificial sequence
  SiRNA target sequence
aaaattatcggataaactaa

SEQ ID NO: 159702 - DNA, 20 bp, Artificial sequence
  SiRNA target sequence
aaattatcggataaactaaa

SEQ ID NO: 159703 - DNA, 20 bp, Artificial sequence
  SiRNA target sequence
aattatcggataaactaaaa

SEQ ID NO: 159704 - DNA, 20 bp, Artificial sequence
  SiRNA target sequence
attatcggataaactaaaaa

SEQ ID NO: 159705 - DNA, 20 bp, Artificial sequence
  SiRNA target sequence
ttatcggataaactaaaaaa

SEQ ID NO: 159706 - DNA, 20 bp, Artificial sequence
  SiRNA target sequence
tatcggataaactaaaaaat

SEQ ID NO: 159707 - DNA, 20 bp, Artificial sequence
  SiRNA target sequence
atcggataaactaaaaaatc

SEQ ID NO: 159708 - DNA, 20 bp, Artificial sequence
  SiRNA target sequence
tcggataaactaaaaaatcg

SEQ ID NO: 159709 - DNA, 20 bp, Artificial sequence
  SiRNA target sequence
cggataaactaaaaaatcgc

SEQ ID NO: 159710 - DNA, 20 bp, Artificial sequence
  SiRNA target sequence
ggataaactaaaaaatcgca

SEQ ID NO: 159711 - DNA, 20 bp, Artificial sequence
  SiRNA target sequence
gataaactaaaaaatcgcat

SEQ ID NO: 159712 - DNA, 20 bp, Artificial sequence
  SiRNA target sequence
ataaactaaaaaatcgcatc

SEQ ID NO: 159713 - DNA, 20 bp, Artificial sequence
  SiRNA target sequence
taaactaaaaaatcgcatca

SEQ ID NO: 159714 - DNA, 20 bp, Artificial sequence
  SiRNA target sequence
aaactaaaaaatcgcatcaa

SEQ ID NO: 159715 - DNA, 20 bp, Artificial sequence
  SiRNA target sequence
aactaaaaaatcgcatcaaa

SEQ ID NO: 159716 - DNA, 20 bp, Artificial sequence
  SiRNA target sequence
actaaaaaatcgcatcaaaa

SEQ ID NO: 159717 - DNA, 20 bp, Artificial sequence
  SiRNA target sequence
ctaaaaaatcgcatcaaaac

SEQ ID NO: 159718 - DNA, 20 bp, Artificial sequence
  SiRNA target sequence
taaaaaatcgcatcaaaacg

SEQ ID NO: 159719 - DNA, 20 bp, Artificial sequence
  SiRNA target sequence
aaaaaatcgcatcaaaacga

SEQ ID NO: 159720 - DNA, 20 bp, Artificial sequence
  SiRNA target sequence
aaaaatcgcatcaaaacgaa

SEQ ID NO: 159721 - DNA, 20 bp, Artificial sequence
  SiRNA target sequence
aaaatcgcatcaaaacgaat

SEQ ID NO: 159722 - DNA, 20 bp, Artificial sequence
  SiRNA target sequence
aaatcgcatcaaaacgaatg

SEQ ID NO: 159723 - DNA, 20 bp, Artificial sequence
  SiRNA target sequence
aatcgcatcaaaacgaatgt

SEQ ID NO: 159724 - DNA, 20 bp, Artificial sequence
  SiRNA target sequence
atcgcatcaaaacgaatgta

SEQ ID NO: 159725 - DNA, 20 bp, Artificial sequence
  SiRNA target sequence
tcgcatcaaaacgaatgtag

SEQ ID NO: 159726 - DNA, 20 bp, Artificial sequence
  SiRNA target sequence
cgcatcaaaacgaatgtaga

SEQ ID NO: 159727 - DNA, 20 bp, Artificial sequence
  SiRNA target sequence
gcatcaaaacgaatgtagaa

SEQ ID NO: 159728 - DNA, 20 bp, Artificial sequence
  SiRNA target sequence
catcaaaacgaatgtagaaa

SEQ ID NO: 159729 - DNA, 20 bp, Artificial sequence
  SiRNA target sequence
atcaaaacgaatgtagaaaa

SEQ ID NO: 159730 - DNA, 20 bp, Artificial sequence
  SiRNA target sequence
tcaaaacgaatgtagaaaat

SEQ ID NO: 159731 - DNA, 20 bp, Artificial sequence
  SiRNA target sequence
caaaacgaatgtagaaaatg

SEQ ID NO: 159732 - DNA, 20 bp, Artificial sequence
  SiRNA target sequence
aaaacgaatgtagaaaatgt

SEQ ID NO: 159733 - DNA, 20 bp, Artificial sequence
  SiRNA target sequence
aaacgaatgtagaaaatgtt

SEQ ID NO: 159734 - DNA, 20 bp, Artificial sequence
  SiRNA target sequence
aacgaatgtagaaaatgttg

SEQ ID NO: 159735 - DNA, 20 bp, Artificial sequence
  SiRNA target sequence
acgaatgtagaaaatgttgt

SEQ ID NO: 159736 - DNA, 20 bp, Artificial sequence
  SiRNA target sequence
cgaatgtagaaaatgttgtt

SEQ ID NO: 159737 - DNA, 20 bp, Artificial sequence
  SiRNA target sequence
gaatgtagaaaatgttgtta

SEQ ID NO: 159738 - DNA, 20 bp, Artificial sequence
  SiRNA target sequence
aatgtagaaaatgttgttat

SEQ ID NO: 159739 - DNA, 20 bp, Artificial sequence
  SiRNA target sequence
atgtagaaaatgttgttatt

SEQ ID NO: 159740 - DNA, 20 bp, Artificial sequence
  SiRNA target sequence
tgtagaaaatgttgttatta

SEQ ID NO: 159741 - DNA, 20 bp, Artificial sequence
  SiRNA target sequence
gtagaaaatgttgttattaa

SEQ ID NO: 159742 - DNA, 20 bp, Artificial sequence
  SiRNA target sequence
tagaaaatgttgttattaac

SEQ ID NO: 159743 - DNA, 20 bp, Artificial sequence
  SiRNA target sequence
agaaaatgttgttattaacg

SEQ ID NO: 159744 - DNA, 20 bp, Artificial sequence
  SiRNA target sequence
gaaaatgttgttattaacgg

SEQ ID NO: 159745 - DNA, 20 bp, Artificial sequence
  SiRNA target sequence
aaaatgttgttattaacggc

SEQ ID NO: 159746 - DNA, 20 bp, Artificial sequence
  SiRNA target sequence
aaatgttgttattaacggcg

SEQ ID NO: 159747 - DNA, 20 bp, Artificial sequence
  SiRNA target sequence
aatgttgttattaacggcga

SEQ ID NO: 159748 - DNA, 20 bp, Artificial sequence
  SiRNA target sequence
atgttgttattaacggcgat

SEQ ID NO: 159749 - DNA, 20 bp, Artificial sequence
  SiRNA target sequence
tgttgttattaacggcgatg

SEQ ID NO: 159750 - DNA, 20 bp, Artificial sequence
  SiRNA target sequence
gttgttattaacggcgatga

SEQ ID NO: 159751 - DNA, 20 bp, Artificial sequence
  SiRNA target sequence
ttgttattaacggcgatgat

SEQ ID NO: 159752 - DNA, 20 bp, Artificial sequence
  SiRNA target sequence
tgttattaacggcgatgatt

SEQ ID NO: 159753 - DNA, 20 bp, Artificial sequence
  SiRNA target sequence
gttattaacggcgatgattc

SEQ ID NO: 159754 - DNA, 20 bp, Artificial sequence
  SiRNA target sequence
ttattaacggcgatgattct

SEQ ID NO: 159755 - DNA, 20 bp, Artificial sequence
  SiRNA target sequence
tattaacggcgatgattcta

SEQ ID NO: 159756 - DNA, 20 bp, Artificial sequence
  SiRNA target sequence
attaacggcgatgattctaa

SEQ ID NO: 159757 - DNA, 20 bp, Artificial sequence
  SiRNA target sequence
ttaacggcgatgattctaag

SEQ ID NO: 159758 - DNA, 20 bp, Artificial sequence
  SiRNA target sequence
taacggcgatgattctaaga

SEQ ID NO: 159759 - DNA, 20 bp, Artificial sequence
  SiRNA target sequence
aacggcgatgattctaagac

SEQ ID NO: 159760 - DNA, 20 bp, Artificial sequence
  SiRNA target sequence
acggcgatgattctaagact

SEQ ID NO: 159761 - DNA, 20 bp, Artificial sequence
  SiRNA target sequence
cggcgatgattctaagactt

SEQ ID NO: 159762 - DNA, 20 bp, Artificial sequence
  SiRNA target sequence
ggcgatgattctaagacttt

SEQ ID NO: 159763 - DNA, 20 bp, Artificial sequence
  SiRNA target sequence
gcgatgattctaagactttt

SEQ ID NO: 159764 - DNA, 20 bp, Artificial sequence
  SiRNA target sequence
cgatgattctaagacttttc

SEQ ID NO: 159765 - DNA, 20 bp, Artificial sequence
  SiRNA target sequence
gatgattctaagacttttcc

SEQ ID NO: 159766 - DNA, 20 bp, Artificial sequence
  SiRNA target sequence
atgattctaagacttttcct

SEQ ID NO: 159767 - DNA, 20 bp, Artificial sequence
  SiRNA target sequence
tgattctaagacttttcctg

SEQ ID NO: 159768 - DNA, 20 bp, Artificial sequence
  SiRNA target sequence
gattctaagacttttcctgg

SEQ ID NO: 159769 - DNA, 20 bp, Artificial sequence
  SiRNA target sequence
attctaagacttttcctggc

SEQ ID NO: 159770 - DNA, 20 bp, Artificial sequence
  SiRNA target sequence
ttctaagacttttcctggct

SEQ ID NO: 159771 - DNA, 20 bp, Artificial sequence
  SiRNA target sequence
tctaagacttttcctggctg

SEQ ID NO: 159772 - DNA, 20 bp, Artificial sequence
  SiRNA target sequence
ctaagacttttcctggctgt

SEQ ID NO: 159773 - DNA, 20 bp, Artificial sequence
  SiRNA target sequence
taagacttttcctggctgtc

SEQ ID NO: 159774 - DNA, 20 bp, Artificial sequence
  SiRNA target sequence
aagacttttcctggctgtct

SEQ ID NO: 159775 - DNA, 20 bp, Artificial sequence
  SiRNA target sequence
agacttttcctggctgtctc

SEQ ID NO: 159776 - DNA, 20 bp, Artificial sequence
  SiRNA target sequence
gacttttcctggctgtctca

SEQ ID NO: 159777 - DNA, 20 bp, Artificial sequence
  SiRNA target sequence
acttttcctggctgtctcaa

SEQ ID NO: 159778 - DNA, 20 bp, Artificial sequence
  SiRNA target sequence
cttttcctggctgtctcaat

SEQ ID NO: 159779 - DNA, 20 bp, Artificial sequence
  SiRNA target sequence
ttttcctggctgtctcaata

SEQ ID NO: 159780 - DNA, 20 bp, Artificial sequence
  SiRNA target sequence
tttcctggctgtctcaatat

SEQ ID NO: 159781 - DNA, 20 bp, Artificial sequence
  SiRNA target sequence
ttcctggctgtctcaatatt

SEQ ID NO: 159782 - DNA, 20 bp, Artificial sequence
  SiRNA target sequence
tcctggctgtctcaatattt

SEQ ID NO: 159783 - DNA, 20 bp, Artificial sequence
  SiRNA target sequence
cctggctgtctcaatatttc

SEQ ID NO: 159784 - DNA, 20 bp, Artificial sequence
  SiRNA target sequence
ctggctgtctcaatatttct

SEQ ID NO: 159785 - DNA, 20 bp, Artificial sequence
  SiRNA target sequence
tggctgtctcaatatttctt

SEQ ID NO: 159786 - DNA, 20 bp, Artificial sequence
  SiRNA target sequence
ggctgtctcaatatttcttt

SEQ ID NO: 159787 - DNA, 20 bp, Artificial sequence
  SiRNA target sequence
gctgtctcaatatttctttt

SEQ ID NO: 159788 - DNA, 20 bp, Artificial sequence
  SiRNA target sequence
ctgtctcaatatttcttttc

SEQ ID NO: 159789 - DNA, 20 bp, Artificial sequence
  SiRNA target sequence
tgtctcaatatttcttttcc

SEQ ID NO: 159790 - DNA, 20 bp, Artificial sequence
  SiRNA target sequence
gtctcaatatttcttttcca

SEQ ID NO: 159791 - DNA, 20 bp, Artificial sequence
  SiRNA target sequence
tctcaatatttcttttccat

SEQ ID NO: 159792 - DNA, 20 bp, Artificial sequence
  SiRNA target sequence
ctcaatatttcttttccata

SEQ ID NO: 159793 - DNA, 20 bp, Artificial sequence
  SiRNA target sequence
tcaatatttcttttccatat

SEQ ID NO: 159794 - DNA, 20 bp, Artificial sequence
  SiRNA target sequence
caatatttcttttccatatg

SEQ ID NO: 159795 - DNA, 20 bp, Artificial sequence
  SiRNA target sequence
aatatttcttttccatatgt

SEQ ID NO: 159796 - DNA, 20 bp, Artificial sequence
  SiRNA target sequence
atatttcttttccatatgta

SEQ ID NO: 159797 - DNA, 20 bp, Artificial sequence
  SiRNA target sequence
tatttcttttccatatgtag

SEQ ID NO: 159798 - DNA, 20 bp, Artificial sequence
  SiRNA target sequence
atttcttttccatatgtaga

SEQ ID NO: 159799 - DNA, 20 bp, Artificial sequence
  SiRNA target sequence
tttcttttccatatgtagaa

SEQ ID NO: 159800 - DNA, 20 bp, Artificial sequence
  SiRNA target sequence
ttcttttccatatgtagaag

SEQ ID NO: 159801 - DNA, 20 bp, Artificial sequence
  SiRNA target sequence
tcttttccatatgtagaagg

SEQ ID NO: 159802 - DNA, 20 bp, Artificial sequence
  SiRNA target sequence
cttttccatatgtagaaggt

SEQ ID NO: 159803 - DNA, 20 bp, Artificial sequence
  SiRNA target sequence
ttttccatatgtagaaggtg

SEQ ID NO: 159804 - DNA, 20 bp, Artificial sequence
  SiRNA target sequence
tttccatatgtagaaggtga

SEQ ID NO: 159805 - DNA, 20 bp, Artificial sequence
  SiRNA target sequence
ttccatatgtagaaggtgaa

SEQ ID NO: 159806 - DNA, 20 bp, Artificial sequence
  SiRNA target sequence
tccatatgtagaaggtgaag

SEQ ID NO: 159807 - DNA, 20 bp, Artificial sequence
  SiRNA target sequence
ccatatgtagaaggtgaagg

SEQ ID NO: 159808 - DNA, 20 bp, Artificial sequence
  SiRNA target sequence
catatgtagaaggtgaaggg

SEQ ID NO: 159809 - DNA, 20 bp, Artificial sequence
  SiRNA target sequence
atatgtagaaggtgaagggc

SEQ ID NO: 159810 - DNA, 20 bp, Artificial sequence
  SiRNA target sequence
tatgtagaaggtgaagggct

SEQ ID NO: 159811 - DNA, 20 bp, Artificial sequence
  SiRNA target sequence
atgtagaaggtgaagggctt

SEQ ID NO: 159812 - DNA, 20 bp, Artificial sequence
  SiRNA target sequence
tgtagaaggtgaagggctta

SEQ ID NO: 159813 - DNA, 20 bp, Artificial sequence
  SiRNA target sequence
gtagaaggtgaagggcttat

SEQ ID NO: 159814 - DNA, 20 bp, Artificial sequence
  SiRNA target sequence
tagaaggtgaagggcttatg

SEQ ID NO: 159815 - DNA, 20 bp, Artificial sequence
  SiRNA target sequence
agaaggtgaagggcttatga

SEQ ID NO: 159816 - DNA, 20 bp, Artificial sequence
  SiRNA target sequence
gaaggtgaagggcttatgat

SEQ ID NO: 159817 - DNA, 20 bp, Artificial sequence
  SiRNA target sequence
aaggtgaagggcttatgatg

SEQ ID NO: 159818 - DNA, 20 bp, Artificial sequence
  SiRNA target sequence
aggtgaagggcttatgatga

SEQ ID NO: 159819 - DNA, 20 bp, Artificial sequence
  SiRNA target sequence
ggtgaagggcttatgatgaa

SEQ ID NO: 159820 - DNA, 20 bp, Artificial sequence
  SiRNA target sequence
gtgaagggcttatgatgaat

SEQ ID NO: 159821 - DNA, 20 bp, Artificial sequence
  SiRNA target sequence
tgaagggcttatgatgaata

SEQ ID NO: 159822 - DNA, 20 bp, Artificial sequence
  SiRNA target sequence
gaagggcttatgatgaatat

SEQ ID NO: 159823 - DNA, 20 bp, Artificial sequence
  SiRNA target sequence
aagggcttatgatgaatatt

SEQ ID NO: 159824 - DNA, 20 bp, Artificial sequence
  SiRNA target sequence
agggcttatgatgaatatta

SEQ ID NO: 159825 - DNA, 20 bp, Artificial sequence
  SiRNA target sequence
gggcttatgatgaatattaa

SEQ ID NO: 159826 - DNA, 20 bp, Artificial sequence
  SiRNA target sequence
ggcttatgatgaatattaag

SEQ ID NO: 159827 - DNA, 20 bp, Artificial sequence
  SiRNA target sequence
gcttatgatgaatattaagg

SEQ ID NO: 159828 - DNA, 20 bp, Artificial sequence
  SiRNA target sequence
cttatgatgaatattaagga

SEQ ID NO: 159829 - DNA, 20 bp, Artificial sequence
  SiRNA target sequence
ttatgatgaatattaaggat

SEQ ID NO: 159830 - DNA, 20 bp, Artificial sequence
  SiRNA target sequence
tatgatgaatattaaggata

SEQ ID NO: 159831 - DNA, 20 bp, Artificial sequence
  SiRNA target sequence
atgatgaatattaaggatat

SEQ ID NO: 159832 - DNA, 20 bp, Artificial sequence
  SiRNA target sequence
tgatgaatattaaggatatt

SEQ ID NO: 159833 - DNA, 20 bp, Artificial sequence
  SiRNA target sequence
gatgaatattaaggatattg

SEQ ID NO: 159834 - DNA, 20 bp, Artificial sequence
  SiRNA target sequence
atgaatattaaggatattgc

SEQ ID NO: 159835 - DNA, 20 bp, Artificial sequence
  SiRNA target sequence
tgaatattaaggatattgct

SEQ ID NO: 159836 - DNA, 20 bp, Artificial sequence
  SiRNA target sequence
gaatattaaggatattgctg

SEQ ID NO: 159837 - DNA, 20 bp, Artificial sequence
  SiRNA target sequence
aatattaaggatattgctgt

SEQ ID NO: 159838 - DNA, 20 bp, Artificial sequence
  SiRNA target sequence
atattaaggatattgctgtt

SEQ ID NO: 159839 - DNA, 20 bp, Artificial sequence
  SiRNA target sequence
tattaaggatattgctgtta

SEQ ID NO: 159840 - DNA, 20 bp, Artificial sequence
  SiRNA target sequence
attaaggatattgctgttag

SEQ ID NO: 159841 - DNA, 20 bp, Artificial sequence
  SiRNA target sequence
ttaaggatattgctgttagt

SEQ ID NO: 159842 - DNA, 20 bp, Artificial sequence
  SiRNA target sequence
taaggatattgctgttagta

SEQ ID NO: 159843 - DNA, 20 bp, Artificial sequence
  SiRNA target sequence
aaggatattgctgttagtag

SEQ ID NO: 159844 - DNA, 20 bp, Artificial sequence
  SiRNA target sequence
aggatattgctgttagtagt

SEQ ID NO: 159845 - DNA, 20 bp, Artificial sequence
  SiRNA target sequence
ggatattgctgttagtagtg

SEQ ID NO: 159846 - DNA, 20 bp, Artificial sequence
  SiRNA target sequence
gatattgctgttagtagtgg

SEQ ID NO: 159847 - DNA, 20 bp, Artificial sequence
  SiRNA target sequence
atattgctgttagtagtgga

SEQ ID NO: 159848 - DNA, 20 bp, Artificial sequence
  SiRNA target sequence
tattgctgttagtagtggaa

SEQ ID NO: 159849 - DNA, 20 bp, Artificial sequence
  SiRNA target sequence
attgctgttagtagtggaag

SEQ ID NO: 159850 - DNA, 20 bp, Artificial sequence
  SiRNA target sequence
ttgctgttagtagtggaagt

SEQ ID NO: 159851 - DNA, 20 bp, Artificial sequence
  SiRNA target sequence
tgctgttagtagtggaagtg

SEQ ID NO: 159852 - DNA, 20 bp, Artificial sequence
  SiRNA target sequence
gctgttagtagtggaagtgc

SEQ ID NO: 159853 - DNA, 20 bp, Artificial sequence
  SiRNA target sequence
ctgttagtagtggaagtgct

SEQ ID NO: 159854 - DNA, 20 bp, Artificial sequence
  SiRNA target sequence
tgttagtagtggaagtgctt

SEQ ID NO: 159855 - DNA, 20 bp, Artificial sequence
  SiRNA target sequence
gttagtagtggaagtgcttg

SEQ ID NO: 159856 - DNA, 20 bp, Artificial sequence
  SiRNA target sequence
ttagtagtggaagtgcttgc

SEQ ID NO: 159857 - DNA, 20 bp, Artificial sequence
  SiRNA target sequence
tagtagtggaagtgcttgca

SEQ ID NO: 159858 - DNA, 20 bp, Artificial sequence
  SiRNA target sequence
agtagtggaagtgcttgcac

SEQ ID NO: 159859 - DNA, 20 bp, Artificial sequence
  SiRNA target sequence
gtagtggaagtgcttgcact

SEQ ID NO: 159860 - DNA, 20 bp, Artificial sequence
  SiRNA target sequence
tagtggaagtgcttgcactt

SEQ ID NO: 159861 - DNA, 20 bp, Artificial sequence
  SiRNA target sequence
agtggaagtgcttgcacttc

SEQ ID NO: 159862 - DNA, 20 bp, Artificial sequence
  SiRNA target sequence
gtggaagtgcttgcacttca

SEQ ID NO: 159863 - DNA, 20 bp, Artificial sequence
  SiRNA target sequence
tggaagtgcttgcacttcat

SEQ ID NO: 159864 - DNA, 20 bp, Artificial sequence
  SiRNA target sequence
ggaagtgcttgcacttcatc

SEQ ID NO: 159865 - DNA, 20 bp, Artificial sequence
  SiRNA target sequence
gaagtgcttgcacttcatca

SEQ ID NO: 159866 - DNA, 20 bp, Artificial sequence
  SiRNA target sequence
aagtgcttgcacttcatcat

SEQ ID NO: 159867 - DNA, 20 bp, Artificial sequence
  SiRNA target sequence
agtgcttgcacttcatcatc

SEQ ID NO: 159868 - DNA, 20 bp, Artificial sequence
  SiRNA target sequence
gtgcttgcacttcatcatct

SEQ ID NO: 159869 - DNA, 20 bp, Artificial sequence
  SiRNA target sequence
tgcttgcacttcatcatctt

SEQ ID NO: 159870 - DNA, 20 bp, Artificial sequence
  SiRNA target sequence
gcttgcacttcatcatcttt

SEQ ID NO: 159871 - DNA, 20 bp, Artificial sequence
  SiRNA target sequence
cttgcacttcatcatcttta

SEQ ID NO: 159872 - DNA, 20 bp, Artificial sequence
  SiRNA target sequence
ttgcacttcatcatctttag

SEQ ID NO: 159873 - DNA, 20 bp, Artificial sequence
  SiRNA target sequence
tgcacttcatcatctttaga

SEQ ID NO: 159874 - DNA, 20 bp, Artificial sequence
  SiRNA target sequence
gcacttcatcatctttagaa

SEQ ID NO: 159875 - DNA, 20 bp, Artificial sequence
  SiRNA target sequence
cacttcatcatctttagaac

SEQ ID NO: 159876 - DNA, 20 bp, Artificial sequence
  SiRNA target sequence
acttcatcatctttagaacc

SEQ ID NO: 159877 - DNA, 20 bp, Artificial sequence
  SiRNA target sequence
cttcatcatctttagaaccc

SEQ ID NO: 159878 - DNA, 20 bp, Artificial sequence
  SiRNA target sequence
ttcatcatctttagaaccct

SEQ ID NO: 159879 - DNA, 20 bp, Artificial sequence
  SiRNA target sequence
tcatcatctttagaaccctc

SEQ ID NO: 159880 - DNA, 20 bp, Artificial sequence
  SiRNA target sequence
catcatctttagaaccctct

SEQ ID NO: 159881 - DNA, 20 bp, Artificial sequence
  SiRNA target sequence
atcatctttagaaccctctt

SEQ ID NO: 159882 - DNA, 20 bp, Artificial sequence
  SiRNA target sequence
tcatctttagaaccctctta

SEQ ID NO: 159883 - DNA, 20 bp, Artificial sequence
  SiRNA target sequence
catctttagaaccctcttat

SEQ ID NO: 159884 - DNA, 20 bp, Artificial sequence
  SiRNA target sequence
atctttagaaccctcttatg

SEQ ID NO: 159885 - DNA, 20 bp, Artificial sequence
  SiRNA target sequence
tctttagaaccctcttatgt

SEQ ID NO: 159886 - DNA, 20 bp, Artificial sequence
  SiRNA target sequence
ctttagaaccctcttatgtt

SEQ ID NO: 159887 - DNA, 20 bp, Artificial sequence
  SiRNA target sequence
tttagaaccctcttatgttt

SEQ ID NO: 159888 - DNA, 20 bp, Artificial sequence
  SiRNA target sequence
ttagaaccctcttatgtttt

SEQ ID NO: 159889 - DNA, 20 bp, Artificial sequence
  SiRNA target sequence
tagaaccctcttatgttttg

SEQ ID NO: 159890 - DNA, 20 bp, Artificial sequence
  SiRNA target sequence
agaaccctcttatgttttgc

SEQ ID NO: 159891 - DNA, 20 bp, Artificial sequence
  SiRNA target sequence
gaaccctcttatgttttgcg

SEQ ID NO: 159892 - DNA, 20 bp, Artificial sequence
  SiRNA target sequence
aaccctcttatgttttgcga

SEQ ID NO: 159893 - DNA, 20 bp, Artificial sequence
  SiRNA target sequence
accctcttatgttttgcgag

SEQ ID NO: 159894 - DNA, 20 bp, Artificial sequence
  SiRNA target sequence
ccctcttatgttttgcgagc

SEQ ID NO: 159895 - DNA, 20 bp, Artificial sequence
  SiRNA target sequence
cctcttatgttttgcgagct

SEQ ID NO: 159896 - DNA, 20 bp, Artificial sequence
  SiRNA target sequence
ctcttatgttttgcgagctt

SEQ ID NO: 159897 - DNA, 20 bp, Artificial sequence
  SiRNA target sequence
tcttatgttttgcgagcttt

SEQ ID NO: 159898 - DNA, 20 bp, Artificial sequence
  SiRNA target sequence
cttatgttttgcgagcttta

SEQ ID NO: 159899 - DNA, 20 bp, Artificial sequence
  SiRNA target sequence
ttatgttttgcgagctttag

SEQ ID NO: 159900 - DNA, 20 bp, Artificial sequence
  SiRNA target sequence
tatgttttgcgagctttagg

SEQ ID NO: 159901 - DNA, 20 bp, Artificial sequence
  SiRNA target sequence
atgttttgcgagctttaggc

SEQ ID NO: 159902 - DNA, 20 bp, Artificial sequence
  SiRNA target sequence
tgttttgcgagctttaggca

SEQ ID NO: 159903 - DNA, 20 bp, Artificial sequence
  SiRNA target sequence
gttttgcgagctttaggcaa

SEQ ID NO: 159904 - DNA, 20 bp, Artificial sequence
  SiRNA target sequence
ttttgcgagctttaggcaaa

SEQ ID NO: 159905 - DNA, 20 bp, Artificial sequence
  SiRNA target sequence
tttgcgagctttaggcaaaa

SEQ ID NO: 159906 - DNA, 20 bp, Artificial sequence
  SiRNA target sequence
ttgcgagctttaggcaaaaa

SEQ ID NO: 159907 - DNA, 20 bp, Artificial sequence
  SiRNA target sequence
tgcgagctttaggcaaaaat

SEQ ID NO: 159908 - DNA, 20 bp, Artificial sequence
  SiRNA target sequence
gcgagctttaggcaaaaatg

SEQ ID NO: 159909 - DNA, 20 bp, Artificial sequence
  SiRNA target sequence
cgagctttaggcaaaaatga

SEQ ID NO: 159910 - DNA, 20 bp, Artificial sequence
  SiRNA target sequence
gagctttaggcaaaaatgat

SEQ ID NO: 159911 - DNA, 20 bp, Artificial sequence
  SiRNA target sequence
agctttaggcaaaaatgatg

SEQ ID NO: 159912 - DNA, 20 bp, Artificial sequence
  SiRNA target sequence
gctttaggcaaaaatgatga

SEQ ID NO: 159913 - DNA, 20 bp, Artificial sequence
  SiRNA target sequence
ctttaggcaaaaatgatgat

SEQ ID NO: 159914 - DNA, 20 bp, Artificial sequence
  SiRNA target sequence
tttaggcaaaaatgatgatc

SEQ ID NO: 159915 - DNA, 20 bp, Artificial sequence
  SiRNA target sequence
ttaggcaaaaatgatgatct

SEQ ID NO: 159916 - DNA, 20 bp, Artificial sequence
  SiRNA target sequence
taggcaaaaatgatgatctt

SEQ ID NO: 159917 - DNA, 20 bp, Artificial sequence
  SiRNA target sequence
aggcaaaaatgatgatcttg

SEQ ID NO: 159918 - DNA, 20 bp, Artificial sequence
  SiRNA target sequence
ggcaaaaatgatgatcttgc

SEQ ID NO: 159919 - DNA, 20 bp, Artificial sequence
  SiRNA target sequence
gcaaaaatgatgatcttgcg

SEQ ID NO: 159920 - DNA, 20 bp, Artificial sequence
  SiRNA target sequence
caaaaatgatgatcttgcgc

SEQ ID NO: 159921 - DNA, 20 bp, Artificial sequence
  SiRNA target sequence
aaaaatgatgatcttgcgca

SEQ ID NO: 159922 - DNA, 20 bp, Artificial sequence
  SiRNA target sequence
aaaatgatgatcttgcgcat

SEQ ID NO: 159923 - DNA, 20 bp, Artificial sequence
  SiRNA target sequence
aaatgatgatcttgcgcatt

SEQ ID NO: 159924 - DNA, 20 bp, Artificial sequence
  SiRNA target sequence
aatgatgatcttgcgcattc

SEQ ID NO: 159925 - DNA, 20 bp, Artificial sequence
  SiRNA target sequence
atgatgatcttgcgcattct

SEQ ID NO: 159926 - DNA, 20 bp, Artificial sequence
  SiRNA target sequence
tgatgatcttgcgcattctt

SEQ ID NO: 159927 - DNA, 20 bp, Artificial sequence
  SiRNA target sequence
gatgatcttgcgcattcttc

SEQ ID NO: 159928 - DNA, 20 bp, Artificial sequence
  SiRNA target sequence
atgatcttgcgcattcttct

SEQ ID NO: 159929 - DNA, 20 bp, Artificial sequence
  SiRNA target sequence
tgatcttgcgcattcttcta

SEQ ID NO: 159930 - DNA, 20 bp, Artificial sequence
  SiRNA target sequence
gatcttgcgcattcttctat

SEQ ID NO: 159931 - DNA, 20 bp, Artificial sequence
  SiRNA target sequence
atcttgcgcattcttctata

SEQ ID NO: 159932 - DNA, 20 bp, Artificial sequence
  SiRNA target sequence
tcttgcgcattcttctataa

SEQ ID NO: 159933 - DNA, 20 bp, Artificial sequence
  SiRNA target sequence
cttgcgcattcttctataag

SEQ ID NO: 159934 - DNA, 20 bp, Artificial sequence
  SiRNA target sequence
ttgcgcattcttctataaga

SEQ ID NO: 159935 - DNA, 20 bp, Artificial sequence
  SiRNA target sequence
tgcgcattcttctataagat

SEQ ID NO: 159936 - DNA, 20 bp, Artificial sequence
  SiRNA target sequence
gcgcattcttctataagatt

SEQ ID NO: 159937 - DNA, 20 bp, Artificial sequence
  SiRNA target sequence
cgcattcttctataagattt

SEQ ID NO: 159938 - DNA, 20 bp, Artificial sequence
  SiRNA target sequence
gcattcttctataagatttg

SEQ ID NO: 159939 - DNA, 20 bp, Artificial sequence
  SiRNA target sequence
cattcttctataagatttgg

SEQ ID NO: 159940 - DNA, 20 bp, Artificial sequence
  SiRNA target sequence
attcttctataagatttgga

SEQ ID NO: 159941 - DNA, 20 bp, Artificial sequence
  SiRNA target sequence
ttcttctataagatttggaa

SEQ ID NO: 159942 - DNA, 20 bp, Artificial sequence
  SiRNA target sequence
tcttctataagatttggaat

SEQ ID NO: 159943 - DNA, 20 bp, Artificial sequence
  SiRNA target sequence
cttctataagatttggaata

SEQ ID NO: 159944 - DNA, 20 bp, Artificial sequence
  SiRNA target sequence
ttctataagatttggaataa

SEQ ID NO: 159945 - DNA, 20 bp, Artificial sequence
  SiRNA target sequence
tctataagatttggaataaa

SEQ ID NO: 159946 - DNA, 20 bp, Artificial sequence
  SiRNA target sequence
ctataagatttggaataaat

SEQ ID NO: 159947 - DNA, 20 bp, Artificial sequence
  SiRNA target sequence
tataagatttggaataaata

SEQ ID NO: 159948 - DNA, 20 bp, Artificial sequence
  SiRNA target sequence
ataagatttggaataaataa

SEQ ID NO: 159949 - DNA, 20 bp, Artificial sequence
  SiRNA target sequence
taagatttggaataaataag

SEQ ID NO: 159950 - DNA, 20 bp, Artificial sequence
  SiRNA target sequence
aagatttggaataaataagt

SEQ ID NO: 159951 - DNA, 20 bp, Artificial sequence
  SiRNA target sequence
agatttggaataaataagtt

SEQ ID NO: 159952 - DNA, 20 bp, Artificial sequence
  SiRNA target sequence
gatttggaataaataagttt

SEQ ID NO: 159953 - DNA, 20 bp, Artificial sequence
  SiRNA target sequence
atttggaataaataagttta

SEQ ID NO: 159954 - DNA, 20 bp, Artificial sequence
  SiRNA target sequence
tttggaataaataagtttac

SEQ ID NO: 159955 - DNA, 20 bp, Artificial sequence
  SiRNA target sequence
ttggaataaataagtttaca

SEQ ID NO: 159956 - DNA, 20 bp, Artificial sequence
  SiRNA target sequence
tggaataaataagtttacaa

SEQ ID NO: 159957 - DNA, 20 bp, Artificial sequence
  SiRNA target sequence
ggaataaataagtttacaac

SEQ ID NO: 159958 - DNA, 20 bp, Artificial sequence
  SiRNA target sequence
gaataaataagtttacaact

SEQ ID NO: 159959 - DNA, 20 bp, Artificial sequence
  SiRNA target sequence
aataaataagtttacaactg

SEQ ID NO: 159960 - DNA, 20 bp, Artificial sequence
  SiRNA target sequence
ataaataagtttacaactga

SEQ ID NO: 159961 - DNA, 20 bp, Artificial sequence
  SiRNA target sequence
taaataagtttacaactgaa

SEQ ID NO: 159962 - DNA, 20 bp, Artificial sequence
  SiRNA target sequence
aaataagtttacaactgaag

SEQ ID NO: 159963 - DNA, 20 bp, Artificial sequence
  SiRNA target sequence
aataagtttacaactgaaga

SEQ ID NO: 159964 - DNA, 20 bp, Artificial sequence
  SiRNA target sequence
ataagtttacaactgaagaa

SEQ ID NO: 159965 - DNA, 20 bp, Artificial sequence
  SiRNA target sequence
taagtttacaactgaagaag

SEQ ID NO: 159966 - DNA, 20 bp, Artificial sequence
  SiRNA target sequence
aagtttacaactgaagaaga

SEQ ID NO: 159967 - DNA, 20 bp, Artificial sequence
  SiRNA target sequence
agtttacaactgaagaagaa

SEQ ID NO: 159968 - DNA, 20 bp, Artificial sequence
  SiRNA target sequence
gtttacaactgaagaagaaa

SEQ ID NO: 159969 - DNA, 20 bp, Artificial sequence
  SiRNA target sequence
tttacaactgaagaagaaat

SEQ ID NO: 159970 - DNA, 20 bp, Artificial sequence
  SiRNA target sequence
ttacaactgaagaagaaatc

SEQ ID NO: 159971 - DNA, 20 bp, Artificial sequence
  SiRNA target sequence
tacaactgaagaagaaatca

SEQ ID NO: 159972 - DNA, 20 bp, Artificial sequence
  SiRNA target sequence
acaactgaagaagaaatcaa

SEQ ID NO: 159973 - DNA, 20 bp, Artificial sequence
  SiRNA target sequence
caactgaagaagaaatcaat

SEQ ID NO: 159974 - DNA, 20 bp, Artificial sequence
  SiRNA target sequence
aactgaagaagaaatcaata

SEQ ID NO: 159975 - DNA, 20 bp, Artificial sequence
  SiRNA target sequence
actgaagaagaaatcaataa

SEQ ID NO: 159976 - DNA, 20 bp, Artificial sequence
  SiRNA target sequence
ctgaagaagaaatcaataaa

SEQ ID NO: 159977 - DNA, 20 bp, Artificial sequence
  SiRNA target sequence
tgaagaagaaatcaataaag

SEQ ID NO: 159978 - DNA, 20 bp, Artificial sequence
  SiRNA target sequence
gaagaagaaatcaataaagt

SEQ ID NO: 159979 - DNA, 20 bp, Artificial sequence
  SiRNA target sequence
aagaagaaatcaataaagta

SEQ ID NO: 159980 - DNA, 20 bp, Artificial sequence
  SiRNA target sequence
agaagaaatcaataaagtat

SEQ ID NO: 159981 - DNA, 20 bp, Artificial sequence
  SiRNA target sequence
gaagaaatcaataaagtatc

SEQ ID NO: 159982 - DNA, 20 bp, Artificial sequence
  SiRNA target sequence
aagaaatcaataaagtatct

SEQ ID NO: 159983 - DNA, 20 bp, Artificial sequence
  SiRNA target sequence
agaaatcaataaagtatcta

SEQ ID NO: 159984 - DNA, 20 bp, Artificial sequence
  SiRNA target sequence
gaaatcaataaagtatctag

SEQ ID NO: 159985 - DNA, 20 bp, Artificial sequence
  SiRNA target sequence
aaatcaataaagtatctagt

SEQ ID NO: 159986 - DNA, 20 bp, Artificial sequence
  SiRNA target sequence
aatcaataaagtatctagtg

SEQ ID NO: 159987 - DNA, 20 bp, Artificial sequence
  SiRNA target sequence
atcaataaagtatctagtga

SEQ ID NO: 159988 - DNA, 20 bp, Artificial sequence
  SiRNA target sequence
tcaataaagtatctagtgat

SEQ ID NO: 159989 - DNA, 20 bp, Artificial sequence
  SiRNA target sequence
caataaagtatctagtgata

SEQ ID NO: 159990 - DNA, 20 bp, Artificial sequence
  SiRNA target sequence
aataaagtatctagtgatac

SEQ ID NO: 159991 - DNA, 20 bp, Artificial sequence
  SiRNA target sequence
ataaagtatctagtgataca

SEQ ID NO: 159992 - DNA, 20 bp, Artificial sequence
  SiRNA target sequence
taaagtatctagtgatacaa

SEQ ID NO: 159993 - DNA, 20 bp, Artificial sequence
  SiRNA target sequence
aaagtatctagtgatacaat

SEQ ID NO: 159994 - DNA, 20 bp, Artificial sequence
  SiRNA target sequence
aagtatctagtgatacaatt

SEQ ID NO: 159995 - DNA, 20 bp, Artificial sequence
  SiRNA target sequence
agtatctagtgatacaatta

SEQ ID NO: 159996 - DNA, 20 bp, Artificial sequence
  SiRNA target sequence
gtatctagtgatacaattaa

SEQ ID NO: 159997 - DNA, 20 bp, Artificial sequence
  SiRNA target sequence
tatctagtgatacaattaaa

SEQ ID NO: 159998 - DNA, 20 bp, Artificial sequence
  SiRNA target sequence
atctagtgatacaattaaag

SEQ ID NO: 159999 - DNA, 20 bp, Artificial sequence
  SiRNA target sequence
tctagtgatacaattaaagc

SEQ ID NO: 160000 - DNA, 20 bp, Artificial sequence
  SiRNA target sequence
ctagtgatacaattaaagct

SEQ ID NO: 160001 - DNA, 20 bp, Artificial sequence
  SiRNA target sequence
tagtgatacaattaaagctg

SEQ ID NO: 160002 - DNA, 20 bp, Artificial sequence
  SiRNA target sequence
agtgatacaattaaagctgt

SEQ ID NO: 160003 - DNA, 20 bp, Artificial sequence
  SiRNA target sequence
gtgatacaattaaagctgtt

SEQ ID NO: 160004 - DNA, 20 bp, Artificial sequence
  SiRNA target sequence
tgatacaattaaagctgtta

SEQ ID NO: 160005 - DNA, 20 bp, Artificial sequence
  SiRNA target sequence
gatacaattaaagctgttaa

SEQ ID NO: 160006 - DNA, 20 bp, Artificial sequence
  SiRNA target sequence
atacaattaaagctgttaat

SEQ ID NO: 160007 - DNA, 20 bp, Artificial sequence
  SiRNA target sequence
tacaattaaagctgttaata

SEQ ID NO: 160008 - DNA, 20 bp, Artificial sequence
  SiRNA target sequence
acaattaaagctgttaataa

SEQ ID NO: 160009 - DNA, 20 bp, Artificial sequence
  SiRNA target sequence
caattaaagctgttaataag

SEQ ID NO: 160010 - DNA, 20 bp, Artificial sequence
  SiRNA target sequence
aattaaagctgttaataagt

SEQ ID NO: 160011 - DNA, 20 bp, Artificial sequence
  SiRNA target sequence
attaaagctgttaataagtt

SEQ ID NO: 160012 - DNA, 20 bp, Artificial sequence
  SiRNA target sequence
ttaaagctgttaataagtta

SEQ ID NO: 160013 - DNA, 20 bp, Artificial sequence
  SiRNA target sequence
taaagctgttaataagttaa

SEQ ID NO: 160014 - DNA, 20 bp, Artificial sequence
  SiRNA target sequence
aaagctgttaataagttaag

SEQ ID NO: 160015 - DNA, 20 bp, Artificial sequence
  SiRNA target sequence
aagctgttaataagttaaga

SEQ ID NO: 160016 - DNA, 20 bp, Artificial sequence
  SiRNA target sequence
agctgttaataagttaagag

SEQ ID NO: 160017 - DNA, 20 bp, Artificial sequence
  SiRNA target sequence
gctgttaataagttaagaga

SEQ ID NO: 160018 - DNA, 20 bp, Artificial sequence
  SiRNA target sequence
ctgttaataagttaagagat

SEQ ID NO: 160019 - DNA, 20 bp, Artificial sequence
  SiRNA target sequence
tgttaataagttaagagata

SEQ ID NO: 160020 - DNA, 20 bp, Artificial sequence
  SiRNA target sequence
gttaataagttaagagatat

SEQ ID NO: 160021 - DNA, 20 bp, Artificial sequence
  SiRNA target sequence
ttaataagttaagagatatg

SEQ ID NO: 160022 - DNA, 20 bp, Artificial sequence
  SiRNA target sequence
taataagttaagagatatgt

SEQ ID NO: 160023 - DNA, 20 bp, Artificial sequence
  SiRNA target sequence
aataagttaagagatatgtc

SEQ ID NO: 160024 - DNA, 20 bp, Artificial sequence
  SiRNA target sequence
ataagttaagagatatgtct

SEQ ID NO: 160025 - DNA, 20 bp, Artificial sequence
  SiRNA target sequence
taagttaagagatatgtctc

SEQ ID NO: 160026 - DNA, 20 bp, Artificial sequence
  SiRNA target sequence
aagttaagagatatgtctcc

SEQ ID NO: 160027 - DNA, 20 bp, Artificial sequence
  SiRNA target sequence
agttaagagatatgtctcct

SEQ ID NO: 160028 - DNA, 20 bp, Artificial sequence
  SiRNA target sequence
gttaagagatatgtctcctt

SEQ ID NO: 160029 - DNA, 20 bp, Artificial sequence
  SiRNA target sequence
ttaagagatatgtctccttt

SEQ ID NO: 160030 - DNA, 20 bp, Artificial sequence
  SiRNA target sequence
taagagatatgtctccttta

SEQ ID NO: 160031 - DNA, 20 bp, Artificial sequence
  SiRNA target sequence
aagagatatgtctcctttat

SEQ ID NO: 160032 - DNA, 20 bp, Artificial sequence
  SiRNA target sequence
agagatatgtctcctttata

SEQ ID NO: 160033 - DNA, 20 bp, Artificial sequence
  SiRNA target sequence
gagatatgtctcctttatat

SEQ ID NO: 160034 - DNA, 20 bp, Artificial sequence
  SiRNA target sequence
agatatgtctcctttatatg

SEQ ID NO: 160035 - DNA, 20 bp, Artificial sequence
  SiRNA target sequence
gatatgtctcctttatatga

SEQ ID NO: 160036 - DNA, 20 bp, Artificial sequence
  SiRNA target sequence
atatgtctcctttatatgaa

SEQ ID NO: 160037 - DNA, 20 bp, Artificial sequence
  SiRNA target sequence
tatgtctcctttatatgaaa

SEQ ID NO: 160038 - DNA, 20 bp, Artificial sequence
  SiRNA target sequence
atgtctcctttatatgaaat

SEQ ID NO: 160039 - DNA, 20 bp, Artificial sequence
  SiRNA target sequence
tgtctcctttatatgaaatg

SEQ ID NO: 160040 - DNA, 20 bp, Artificial sequence
  SiRNA target sequence
gtctcctttatatgaaatgg

SEQ ID NO: 160041 - DNA, 20 bp, Artificial sequence
  SiRNA target sequence
tctcctttatatgaaatggt

SEQ ID NO: 160042 - DNA, 20 bp, Artificial sequence
  SiRNA target sequence
ctcctttatatgaaatggtc

SEQ ID NO: 160043 - DNA, 20 bp, Artificial sequence
  SiRNA target sequence
tcctttatatgaaatggtca

SEQ ID NO: 160044 - DNA, 20 bp, Artificial sequence
  SiRNA target sequence
cctttatatgaaatggtcaa

SEQ ID NO: 160045 - DNA, 20 bp, Artificial sequence
  SiRNA target sequence
ctttatatgaaatggtcaaa

SEQ ID NO: 160046 - DNA, 20 bp, Artificial sequence
  SiRNA target sequence
tttatatgaaatggtcaaag

SEQ ID NO: 160047 - DNA, 20 bp, Artificial sequence
  SiRNA target sequence
ttatatgaaatggtcaaaga

SEQ ID NO: 160048 - DNA, 20 bp, Artificial sequence
  SiRNA target sequence
tatatgaaatggtcaaagaa

SEQ ID NO: 160049 - DNA, 20 bp, Artificial sequence
  SiRNA target sequence
atatgaaatggtcaaagaag

SEQ ID NO: 160050 - DNA, 20 bp, Artificial sequence
  SiRNA target sequence
tatgaaatggtcaaagaagg

SEQ ID NO: 160051 - DNA, 20 bp, Artificial sequence
  SiRNA target sequence
atgaaatggtcaaagaaggg

SEQ ID NO: 160052 - DNA, 20 bp, Artificial sequence
  SiRNA target sequence
tgaaatggtcaaagaaggga

SEQ ID NO: 160053 - DNA, 20 bp, Artificial sequence
  SiRNA target sequence
gaaatggtcaaagaagggat

SEQ ID NO: 160054 - DNA, 20 bp, Artificial sequence
  SiRNA target sequence
aaatggtcaaagaagggata

SEQ ID NO: 160055 - DNA, 20 bp, Artificial sequence
  SiRNA target sequence
aatggtcaaagaagggatag

SEQ ID NO: 160056 - DNA, 20 bp, Artificial sequence
  SiRNA target sequence
atggtcaaagaagggataga

SEQ ID NO: 160057 - DNA, 20 bp, Artificial sequence
  SiRNA target sequence
tggtcaaagaagggatagat

SEQ ID NO: 160058 - DNA, 20 bp, Artificial sequence
  SiRNA target sequence
ggtcaaagaagggatagatt

SEQ ID NO: 160059 - DNA, 20 bp, Artificial sequence
  SiRNA target sequence
gtcaaagaagggatagattt

SEQ ID NO: 160060 - DNA, 20 bp, Artificial sequence
  SiRNA target sequence
tcaaagaagggatagattta

SEQ ID NO: 160061 - DNA, 20 bp, Artificial sequence
  SiRNA target sequence
caaagaagggatagatttag

SEQ ID NO: 160062 - DNA, 20 bp, Artificial sequence
  SiRNA target sequence
aaagaagggatagatttaga

SEQ ID NO: 160063 - DNA, 20 bp, Artificial sequence
  SiRNA target sequence
aagaagggatagatttagat

SEQ ID NO: 160064 - DNA, 20 bp, Artificial sequence
  SiRNA target sequence
agaagggatagatttagata

SEQ ID NO: 160065 - DNA, 20 bp, Artificial sequence
  SiRNA target sequence
gaagggatagatttagataa

SEQ ID NO: 160066 - DNA, 20 bp, Artificial sequence
  SiRNA target sequence
aagggatagatttagataaa

SEQ ID NO: 160067 - DNA, 20 bp, Artificial sequence
  SiRNA target sequence
agggatagatttagataaaa

SEQ ID NO: 160068 - DNA, 20 bp, Artificial sequence
  SiRNA target sequence
gggatagatttagataaaat

SEQ ID NO: 160069 - DNA, 20 bp, Artificial sequence
  SiRNA target sequence
ggatagatttagataaaatt

SEQ ID NO: 160070 - DNA, 20 bp, Artificial sequence
  SiRNA target sequence
gatagatttagataaaatta

SEQ ID NO: 160071 - DNA, 20 bp, Artificial sequence
  SiRNA target sequence
atagatttagataaaattaa

SEQ ID NO: 160072 - DNA, 20 bp, Artificial sequence
  SiRNA target sequence
tagatttagataaaattaat

SEQ ID NO: 160073 - DNA, 20 bp, Artificial sequence
  SiRNA target sequence
agatttagataaaattaatt

SEQ ID NO: 160074 - DNA, 20 bp, Artificial sequence
  SiRNA target sequence
gatttagataaaattaattg

SEQ ID NO: 160075 - DNA, 20 bp, Artificial sequence
  SiRNA target sequence
atttagataaaattaattgg

SEQ ID NO: 160076 - DNA, 20 bp, Artificial sequence
  SiRNA target sequence
tttagataaaattaattggt

SEQ ID NO: 160077 - DNA, 20 bp, Artificial sequence
  SiRNA target sequence
ttagataaaattaattggtc

SEQ ID NO: 160078 - DNA, 20 bp, Artificial sequence
  SiRNA target sequence
tagataaaattaattggtct

SEQ ID NO: 160079 - DNA, 20 bp, Artificial sequence
  SiRNA target sequence
agataaaattaattggtctg

SEQ ID NO: 160080 - DNA, 20 bp, Artificial sequence
  SiRNA target sequence
gataaaattaattggtctgc

SEQ ID NO: 160081 - DNA, 20 bp, Artificial sequence
  SiRNA target sequence
ataaaattaattggtctgct

SEQ ID NO: 160082 - DNA, 20 bp, Artificial sequence
  SiRNA target sequence
taaaattaattggtctgctt

SEQ ID NO: 160083 - DNA, 20 bp, Artificial sequence
  SiRNA target sequence
aaaattaattggtctgctta

SEQ ID NO: 160084 - DNA, 20 bp, Artificial sequence
  SiRNA target sequence
aaattaattggtctgcttaa

SEQ ID NO: 160085 - DNA, 21 bp, Artificial sequence
  SiRNA target sequence
atgttatttttttatagcccc

SEQ ID NO: 160086 - DNA, 21 bp, Artificial sequence
  SiRNA target sequence
tgttatttttttatagcccca

SEQ ID NO: 160087 - DNA, 21 bp, Artificial sequence
  SiRNA target sequence
gttatttttttatagccccat

SEQ ID NO: 160088 - DNA, 21 bp, Artificial sequence
  SiRNA target sequence
ttatttttttatagccccatt

SEQ ID NO: 160089 - DNA, 21 bp, Artificial sequence
  SiRNA target sequence
tatttttttatagccccattt

SEQ ID NO: 160090 - DNA, 21 bp, Artificial sequence
  SiRNA target sequence
atttttttatagccccatttt

SEQ ID NO: 160091 - DNA, 21 bp, Artificial sequence
  SiRNA target sequence
tttttttatagccccattttt

SEQ ID NO: 160092 - DNA, 21 bp, Artificial sequence
  SiRNA target sequence
ttttttatagccccattttta

SEQ ID NO: 160093 - DNA, 21 bp, Artificial sequence
  SiRNA target sequence
tttttatagccccatttttat

SEQ ID NO: 160094 - DNA, 21 bp, Artificial sequence
  SiRNA target sequence
ttttatagccccatttttatg

SEQ ID NO: 160095 - DNA, 21 bp, Artificial sequence
  SiRNA target sequence
tttatagccccatttttatga

SEQ ID NO: 160096 - DNA, 21 bp, Artificial sequence
  SiRNA target sequence
ttatagccccatttttatgac

SEQ ID NO: 160097 - DNA, 21 bp, Artificial sequence
  SiRNA target sequence
tatagccccatttttatgact

SEQ ID NO: 160098 - DNA, 21 bp, Artificial sequence
  SiRNA target sequence
atagccccatttttatgacta

SEQ ID NO: 160099 - DNA, 21 bp, Artificial sequence
  SiRNA target sequence
tagccccatttttatgactaa

SEQ ID NO: 160100 - DNA, 21 bp, Artificial sequence
  SiRNA target sequence
agccccatttttatgactaaa

SEQ ID NO: 160101 - DNA, 21 bp, Artificial sequence
  SiRNA target sequence
gccccatttttatgactaaaa

SEQ ID NO: 160102 - DNA, 21 bp, Artificial sequence
  SiRNA target sequence
ccccatttttatgactaaaag

SEQ ID NO: 160103 - DNA, 21 bp, Artificial sequence
  SiRNA target sequence
cccatttttatgactaaaagt

SEQ ID NO: 160104 - DNA, 21 bp, Artificial sequence
  SiRNA target sequence
ccatttttatgactaaaagtt

SEQ ID NO: 160105 - DNA, 21 bp, Artificial sequence
  SiRNA target sequence
catttttatgactaaaagttt

SEQ ID NO: 160106 - DNA, 21 bp, Artificial sequence
  SiRNA target sequence
atttttatgactaaaagttta

SEQ ID NO: 160107 - DNA, 21 bp, Artificial sequence
  SiRNA target sequence
tttttatgactaaaagtttaa

SEQ ID NO: 160108 - DNA, 21 bp, Artificial sequence
  SiRNA target sequence
ttttatgactaaaagtttaac

SEQ ID NO: 160109 - DNA, 21 bp, Artificial sequence
  SiRNA target sequence
tttatgactaaaagtttaacg

SEQ ID NO: 160110 - DNA, 21 bp, Artificial sequence
  SiRNA target sequence
ttatgactaaaagtttaacga

SEQ ID NO: 160111 - DNA, 21 bp, Artificial sequence
  SiRNA target sequence
tatgactaaaagtttaacgaa

SEQ ID NO: 160112 - DNA, 21 bp, Artificial sequence
  SiRNA target sequence
atgactaaaagtttaacgaat

SEQ ID NO: 160113 - DNA, 21 bp, Artificial sequence
  SiRNA target sequence
tgactaaaagtttaacgaatt

SEQ ID NO: 160114 - DNA, 21 bp, Artificial sequence
  SiRNA target sequence
gactaaaagtttaacgaattc

SEQ ID NO: 160115 - DNA, 21 bp, Artificial sequence
  SiRNA target sequence
actaaaagtttaacgaattct

SEQ ID NO: 160116 - DNA, 21 bp, Artificial sequence
  SiRNA target sequence
ctaaaagtttaacgaattcta

SEQ ID NO: 160117 - DNA, 21 bp, Artificial sequence
  SiRNA target sequence
taaaagtttaacgaattctaa

SEQ ID NO: 160118 - DNA, 21 bp, Artificial sequence
  SiRNA target sequence
aaaagtttaacgaattctaaa

SEQ ID NO: 160119 - DNA, 21 bp, Artificial sequence
  SiRNA target sequence
aaagtttaacgaattctaaaa

SEQ ID NO: 160120 - DNA, 21 bp, Artificial sequence
  SiRNA target sequence
aagtttaacgaattctaaaac

SEQ ID NO: 160121 - DNA, 21 bp, Artificial sequence
  SiRNA target sequence
agtttaacgaattctaaaact

SEQ ID NO: 160122 - DNA, 21 bp, Artificial sequence
  SiRNA target sequence
gtttaacgaattctaaaactt

SEQ ID NO: 160123 - DNA, 21 bp, Artificial sequence
  SiRNA target sequence
tttaacgaattctaaaacttt

SEQ ID NO: 160124 - DNA, 21 bp, Artificial sequence
  SiRNA target sequence
ttaacgaattctaaaacttta

SEQ ID NO: 160125 - DNA, 21 bp, Artificial sequence
  SiRNA target sequence
taacgaattctaaaactttaa

SEQ ID NO: 160126 - DNA, 21 bp, Artificial sequence
  SiRNA target sequence
aacgaattctaaaactttaaa

SEQ ID NO: 160127 - DNA, 21 bp, Artificial sequence
  SiRNA target sequence
acgaattctaaaactttaaat

SEQ ID NO: 160128 - DNA, 21 bp, Artificial sequence
  SiRNA target sequence
cgaattctaaaactttaaatt

SEQ ID NO: 160129 - DNA, 21 bp, Artificial sequence
  SiRNA target sequence
gaattctaaaactttaaattt

SEQ ID NO: 160130 - DNA, 21 bp, Artificial sequence
  SiRNA target sequence
aattctaaaactttaaattta

SEQ ID NO: 160131 - DNA, 21 bp, Artificial sequence
  SiRNA target sequence
attctaaaactttaaatttaa

SEQ ID NO: 160132 - DNA, 21 bp, Artificial sequence
  SiRNA target sequence
ttctaaaactttaaatttaat

SEQ ID NO: 160133 - DNA, 21 bp, Artificial sequence
  SiRNA target sequence
tctaaaactttaaatttaatg

SEQ ID NO: 160134 - DNA, 21 bp, Artificial sequence
  SiRNA target sequence
ctaaaactttaaatttaatgt

SEQ ID NO: 160135 - DNA, 21 bp, Artificial sequence
  SiRNA target sequence
taaaactttaaatttaatgtc

SEQ ID NO: 160136 - DNA, 21 bp, Artificial sequence
  SiRNA target sequence
aaaactttaaatttaatgtca

SEQ ID NO: 160137 - DNA, 21 bp, Artificial sequence
  SiRNA target sequence
aaactttaaatttaatgtcaa

SEQ ID NO: 160138 - DNA, 21 bp, Artificial sequence
  SiRNA target sequence
aactttaaatttaatgtcaag

SEQ ID NO: 160139 - DNA, 21 bp, Artificial sequence
  SiRNA target sequence
actttaaatttaatgtcaagt

SEQ ID NO: 160140 - DNA, 21 bp, Artificial sequence
  SiRNA target sequence
ctttaaatttaatgtcaagtg

SEQ ID NO: 160141 - DNA, 21 bp, Artificial sequence
  SiRNA target sequence
tttaaatttaatgtcaagtgt

SEQ ID NO: 160142 - DNA, 21 bp, Artificial sequence
  SiRNA target sequence
ttaaatttaatgtcaagtgta

SEQ ID NO: 160143 - DNA, 21 bp, Artificial sequence
  SiRNA target sequence
taaatttaatgtcaagtgtac

SEQ ID NO: 160144 - DNA, 21 bp, Artificial sequence
  SiRNA target sequence
aaatttaatgtcaagtgtaca

SEQ ID NO: 160145 - DNA, 21 bp, Artificial sequence
  SiRNA target sequence
aatttaatgtcaagtgtacaa

SEQ ID NO: 160146 - DNA, 21 bp, Artificial sequence
  SiRNA target sequence
atttaatgtcaagtgtacaat

SEQ ID NO: 160147 - DNA, 21 bp, Artificial sequence
  SiRNA target sequence
tttaatgtcaagtgtacaatc

SEQ ID NO: 160148 - DNA, 21 bp, Artificial sequence
  SiRNA target sequence
ttaatgtcaagtgtacaatca

SEQ ID NO: 160149 - DNA, 21 bp, Artificial sequence
  SiRNA target sequence
taatgtcaagtgtacaatcac

SEQ ID NO: 160150 - DNA, 21 bp, Artificial sequence
  SiRNA target sequence
aatgtcaagtgtacaatcacc

SEQ ID NO: 160151 - DNA, 21 bp, Artificial sequence
  SiRNA target sequence
atgtcaagtgtacaatcacca

SEQ ID NO: 160152 - DNA, 21 bp, Artificial sequence
  SiRNA target sequence
tgtcaagtgtacaatcaccag

SEQ ID NO: 160153 - DNA, 21 bp, Artificial sequence
  SiRNA target sequence
gtcaagtgtacaatcaccagt

SEQ ID NO: 160154 - DNA, 21 bp, Artificial sequence
  SiRNA target sequence
tcaagtgtacaatcaccagtt

SEQ ID NO: 160155 - DNA, 21 bp, Artificial sequence
  SiRNA target sequence
caagtgtacaatcaccagtta

SEQ ID NO: 160156 - DNA, 21 bp, Artificial sequence
  SiRNA target sequence
aagtgtacaatcaccagttat

SEQ ID NO: 160157 - DNA, 21 bp, Artificial sequence
  SiRNA target sequence
agtgtacaatcaccagttata

SEQ ID NO: 160158 - DNA, 21 bp, Artificial sequence
  SiRNA target sequence
gtgtacaatcaccagttataa

SEQ ID NO: 160159 - DNA, 21 bp, Artificial sequence
  SiRNA target sequence
tgtacaatcaccagttataaa

SEQ ID NO: 160160 - DNA, 21 bp, Artificial sequence
  SiRNA target sequence
gtacaatcaccagttataaat

SEQ ID NO: 160161 - DNA, 21 bp, Artificial sequence
  SiRNA target sequence
tacaatcaccagttataaata

SEQ ID NO: 160162 - DNA, 21 bp, Artificial sequence
  SiRNA target sequence
acaatcaccagttataaatac

SEQ ID NO: 160163 - DNA, 21 bp, Artificial sequence
  SiRNA target sequence
caatcaccagttataaataca

SEQ ID NO: 160164 - DNA, 21 bp, Artificial sequence
  SiRNA target sequence
aatcaccagttataaatacaa

SEQ ID NO: 160165 - DNA, 21 bp, Artificial sequence
  SiRNA target sequence
atcaccagttataaatacaaa

SEQ ID NO: 160166 - DNA, 21 bp, Artificial sequence
  SiRNA target sequence
tcaccagttataaatacaaaa

SEQ ID NO: 160167 - DNA, 21 bp, Artificial sequence
  SiRNA target sequence
caccagttataaatacaaaaa

SEQ ID NO: 160168 - DNA, 21 bp, Artificial sequence
  SiRNA target sequence
accagttataaatacaaaaaa

SEQ ID NO: 160169 - DNA, 21 bp, Artificial sequence
  SiRNA target sequence
ccagttataaatacaaaaaaa

SEQ ID NO: 160170 - DNA, 21 bp, Artificial sequence
  SiRNA target sequence
cagttataaatacaaaaaaaa

SEQ ID NO: 160171 - DNA, 21 bp, Artificial sequence
  SiRNA target sequence
agttataaatacaaaaaaaat

SEQ ID NO: 160172 - DNA, 21 bp, Artificial sequence
  SiRNA target sequence
gttataaatacaaaaaaaata

SEQ ID NO: 160173 - DNA, 21 bp, Artificial sequence
  SiRNA target sequence
ttataaatacaaaaaaaatat

SEQ ID NO: 160174 - DNA, 21 bp, Artificial sequence
  SiRNA target sequence
tataaatacaaaaaaaatata

SEQ ID NO: 160175 - DNA, 21 bp, Artificial sequence
  SiRNA target sequence
ataaatacaaaaaaaatatat

SEQ ID NO: 160176 - DNA, 21 bp, Artificial sequence
  SiRNA target sequence
taaatacaaaaaaaatatatc

SEQ ID NO: 160177 - DNA, 21 bp, Artificial sequence
  SiRNA target sequence
aaatacaaaaaaaatatatct

SEQ ID NO: 160178 - DNA, 21 bp, Artificial sequence
  SiRNA target sequence
aatacaaaaaaaatatatctt

SEQ ID NO: 160179 - DNA, 21 bp, Artificial sequence
  SiRNA target sequence
atacaaaaaaaatatatcttg

SEQ ID NO: 160180 - DNA, 21 bp, Artificial sequence
  SiRNA target sequence
tacaaaaaaaatatatcttga

SEQ ID NO: 160181 - DNA, 21 bp, Artificial sequence
  SiRNA target sequence
acaaaaaaaatatatcttgat

SEQ ID NO: 160182 - DNA, 21 bp, Artificial sequence
  SiRNA target sequence
caaaaaaaatatatcttgatg

SEQ ID NO: 160183 - DNA, 21 bp, Artificial sequence
  SiRNA target sequence
aaaaaaaatatatcttgatgc

SEQ ID NO: 160184 - DNA, 21 bp, Artificial sequence
  SiRNA target sequence
aaaaaaatatatcttgatgca

SEQ ID NO: 160185 - DNA, 21 bp, Artificial sequence
  SiRNA target sequence
aaaaaatatatcttgatgcac

SEQ ID NO: 160186 - DNA, 21 bp, Artificial sequence
  SiRNA target sequence
aaaaatatatcttgatgcaca

SEQ ID NO: 160187 - DNA, 21 bp, Artificial sequence
  SiRNA target sequence
aaaatatatcttgatgcacaa

SEQ ID NO: 160188 - DNA, 21 bp, Artificial sequence
  SiRNA target sequence
aaatatatcttgatgcacaag

SEQ ID NO: 160189 - DNA, 21 bp, Artificial sequence
  SiRNA target sequence
aatatatcttgatgcacaagc

SEQ ID NO: 160190 - DNA, 21 bp, Artificial sequence
  SiRNA target sequence
atatatcttgatgcacaagcg

SEQ ID NO: 160191 - DNA, 21 bp, Artificial sequence
  SiRNA target sequence
tatatcttgatgcacaagcga

SEQ ID NO: 160192 - DNA, 21 bp, Artificial sequence
  SiRNA target sequence
atatcttgatgcacaagcgac

SEQ ID NO: 160193 - DNA, 21 bp, Artificial sequence
  SiRNA target sequence
tatcttgatgcacaagcgacc

SEQ ID NO: 160194 - DNA, 21 bp, Artificial sequence
  SiRNA target sequence
atcttgatgcacaagcgacca

SEQ ID NO: 160195 - DNA, 21 bp, Artificial sequence
  SiRNA target sequence
tcttgatgcacaagcgaccaa

SEQ ID NO: 160196 - DNA, 21 bp, Artificial sequence
  SiRNA target sequence
cttgatgcacaagcgaccaag

SEQ ID NO: 160197 - DNA, 21 bp, Artificial sequence
  SiRNA target sequence
ttgatgcacaagcgaccaagc

SEQ ID NO: 160198 - DNA, 21 bp, Artificial sequence
  SiRNA target sequence
tgatgcacaagcgaccaagcc

SEQ ID NO: 160199 - DNA, 21 bp, Artificial sequence
  SiRNA target sequence
gatgcacaagcgaccaagcct

SEQ ID NO: 160200 - DNA, 21 bp, Artificial sequence
  SiRNA target sequence
atgcacaagcgaccaagcctt

SEQ ID NO: 160201 - DNA, 21 bp, Artificial sequence
  SiRNA target sequence
tgcacaagcgaccaagccttt

SEQ ID NO: 160202 - DNA, 21 bp, Artificial sequence
  SiRNA target sequence
gcacaagcgaccaagccttta

SEQ ID NO: 160203 - DNA, 21 bp, Artificial sequence
  SiRNA target sequence
cacaagcgaccaagcctttag

SEQ ID NO: 160204 - DNA, 21 bp, Artificial sequence
  SiRNA target sequence
acaagcgaccaagcctttaga

SEQ ID NO: 160205 - DNA, 21 bp, Artificial sequence
  SiRNA target sequence
caagcgaccaagcctttagac

SEQ ID NO: 160206 - DNA, 21 bp, Artificial sequence
  SiRNA target sequence
aagcgaccaagcctttagacc

SEQ ID NO: 160207 - DNA, 21 bp, Artificial sequence
  SiRNA target sequence
agcgaccaagcctttagaccc

SEQ ID NO: 160208 - DNA, 21 bp, Artificial sequence
  SiRNA target sequence
gcgaccaagcctttagacccg

SEQ ID NO: 160209 - DNA, 21 bp, Artificial sequence
  SiRNA target sequence
cgaccaagcctttagacccgc

SEQ ID NO: 160210 - DNA, 21 bp, Artificial sequence
  SiRNA target sequence
gaccaagcctttagacccgcg

SEQ ID NO: 160211 - DNA, 21 bp, Artificial sequence
  SiRNA target sequence
accaagcctttagacccgcgt

SEQ ID NO: 160212 - DNA, 21 bp, Artificial sequence
  SiRNA target sequence
ccaagcctttagacccgcgtg

SEQ ID NO: 160213 - DNA, 21 bp, Artificial sequence
  SiRNA target sequence
caagcctttagacccgcgtgt

SEQ ID NO: 160214 - DNA, 21 bp, Artificial sequence
  SiRNA target sequence
aagcctttagacccgcgtgtg

SEQ ID NO: 160215 - DNA, 21 bp, Artificial sequence
  SiRNA target sequence
agcctttagacccgcgtgtgc

SEQ ID NO: 160216 - DNA, 21 bp, Artificial sequence
  SiRNA target sequence
gcctttagacccgcgtgtgct

SEQ ID NO: 160217 - DNA, 21 bp, Artificial sequence
  SiRNA target sequence
cctttagacccgcgtgtgctt

SEQ ID NO: 160218 - DNA, 21 bp, Artificial sequence
  SiRNA target sequence
ctttagacccgcgtgtgcttg

SEQ ID NO: 160219 - DNA, 21 bp, Artificial sequence
  SiRNA target sequence
tttagacccgcgtgtgcttga

SEQ ID NO: 160220 - DNA, 21 bp, Artificial sequence
  SiRNA target sequence
ttagacccgcgtgtgcttgat

SEQ ID NO: 160221 - DNA, 21 bp, Artificial sequence
  SiRNA target sequence
tagacccgcgtgtgcttgatg

SEQ ID NO: 160222 - DNA, 21 bp, Artificial sequence
  SiRNA target sequence
agacccgcgtgtgcttgatgc

SEQ ID NO: 160223 - DNA, 21 bp, Artificial sequence
  SiRNA target sequence
gacccgcgtgtgcttgatgca

SEQ ID NO: 160224 - DNA, 21 bp, Artificial sequence
  SiRNA target sequence
acccgcgtgtgcttgatgcaa

SEQ ID NO: 160225 - DNA, 21 bp, Artificial sequence
  SiRNA target sequence
cccgcgtgtgcttgatgcaat

SEQ ID NO: 160226 - DNA, 21 bp, Artificial sequence
  SiRNA target sequence
ccgcgtgtgcttgatgcaatg

SEQ ID NO: 160227 - DNA, 21 bp, Artificial sequence
  SiRNA target sequence
cgcgtgtgcttgatgcaatgc

SEQ ID NO: 160228 - DNA, 21 bp, Artificial sequence
  SiRNA target sequence
gcgtgtgcttgatgcaatgct

SEQ ID NO: 160229 - DNA, 21 bp, Artificial sequence
  SiRNA target sequence
cgtgtgcttgatgcaatgctt

SEQ ID NO: 160230 - DNA, 21 bp, Artificial sequence
  SiRNA target sequence
gtgtgcttgatgcaatgcttc

SEQ ID NO: 160231 - DNA, 21 bp, Artificial sequence
  SiRNA target sequence
tgtgcttgatgcaatgcttcc

SEQ ID NO: 160232 - DNA, 21 bp, Artificial sequence
  SiRNA target sequence
gtgcttgatgcaatgcttcca

SEQ ID NO: 160233 - DNA, 21 bp, Artificial sequence
  SiRNA target sequence
tgcttgatgcaatgcttccat

SEQ ID NO: 160234 - DNA, 21 bp, Artificial sequence
  SiRNA target sequence
gcttgatgcaatgcttccata

SEQ ID NO: 160235 - DNA, 21 bp, Artificial sequence
  SiRNA target sequence
cttgatgcaatgcttccatac

SEQ ID NO: 160236 - DNA, 21 bp, Artificial sequence
  SiRNA target sequence
ttgatgcaatgcttccatact

SEQ ID NO: 160237 - DNA, 21 bp, Artificial sequence
  SiRNA target sequence
tgatgcaatgcttccatacta

SEQ ID NO: 160238 - DNA, 21 bp, Artificial sequence
  SiRNA target sequence
gatgcaatgcttccatactat

SEQ ID NO: 160239 - DNA, 21 bp, Artificial sequence
  SiRNA target sequence
atgcaatgcttccatactata

SEQ ID NO: 160240 - DNA, 21 bp, Artificial sequence
  SiRNA target sequence
tgcaatgcttccatactatac

SEQ ID NO: 160241 - DNA, 21 bp, Artificial sequence
  SiRNA target sequence
gcaatgcttccatactataca

SEQ ID NO: 160242 - DNA, 21 bp, Artificial sequence
  SiRNA target sequence
caatgcttccatactatacat

SEQ ID NO: 160243 - DNA, 21 bp, Artificial sequence
  SiRNA target sequence
aatgcttccatactatacatc

SEQ ID NO: 160244 - DNA, 21 bp, Artificial sequence
  SiRNA target sequence
atgcttccatactatacatcc

SEQ ID NO: 160245 - DNA, 21 bp, Artificial sequence
  SiRNA target sequence
tgcttccatactatacatcca

SEQ ID NO: 160246 - DNA, 21 bp, Artificial sequence
  SiRNA target sequence
gcttccatactatacatccat

SEQ ID NO: 160247 - DNA, 21 bp, Artificial sequence
  SiRNA target sequence
cttccatactatacatccatt

SEQ ID NO: 160248 - DNA, 21 bp, Artificial sequence
  SiRNA target sequence
ttccatactatacatccattt

SEQ ID NO: 160249 - DNA, 21 bp, Artificial sequence
  SiRNA target sequence
tccatactatacatccatttt

SEQ ID NO: 160250 - DNA, 21 bp, Artificial sequence
  SiRNA target sequence
ccatactatacatccattttt

SEQ ID NO: 160251 - DNA, 21 bp, Artificial sequence
  SiRNA target sequence
catactatacatccatttttg

SEQ ID NO: 160252 - DNA, 21 bp, Artificial sequence
  SiRNA target sequence
atactatacatccatttttgg

SEQ ID NO: 160253 - DNA, 21 bp, Artificial sequence
  SiRNA target sequence
tactatacatccatttttgga

SEQ ID NO: 160254 - DNA, 21 bp, Artificial sequence
  SiRNA target sequence
actatacatccatttttggaa

SEQ ID NO: 160255 - DNA, 21 bp, Artificial sequence
  SiRNA target sequence
ctatacatccatttttggaaa

SEQ ID NO: 160256 - DNA, 21 bp, Artificial sequence
  SiRNA target sequence
tatacatccatttttggaaat

SEQ ID NO: 160257 - DNA, 21 bp, Artificial sequence
  SiRNA target sequence
atacatccatttttggaaatc

SEQ ID NO: 160258 - DNA, 21 bp, Artificial sequence
  SiRNA target sequence
tacatccatttttggaaatcc

SEQ ID NO: 160259 - DNA, 21 bp, Artificial sequence
  SiRNA target sequence
acatccatttttggaaatcca

SEQ ID NO: 160260 - DNA, 21 bp, Artificial sequence
  SiRNA target sequence
catccatttttggaaatccac

SEQ ID NO: 160261 - DNA, 21 bp, Artificial sequence
  SiRNA target sequence
atccatttttggaaatccaca

SEQ ID NO: 160262 - DNA, 21 bp, Artificial sequence
  SiRNA target sequence
tccatttttggaaatccacat

SEQ ID NO: 160263 - DNA, 21 bp, Artificial sequence
  SiRNA target sequence
ccatttttggaaatccacatt

SEQ ID NO: 160264 - DNA, 21 bp, Artificial sequence
  SiRNA target sequence
catttttggaaatccacattc

SEQ ID NO: 160265 - DNA, 21 bp, Artificial sequence
  SiRNA target sequence
atttttggaaatccacattct

SEQ ID NO: 160266 - DNA, 21 bp, Artificial sequence
  SiRNA target sequence
tttttggaaatccacattctc

SEQ ID NO: 160267 - DNA, 21 bp, Artificial sequence
  SiRNA target sequence
ttttggaaatccacattctcg

SEQ ID NO: 160268 - DNA, 21 bp, Artificial sequence
  SiRNA target sequence
tttggaaatccacattctcgc

SEQ ID NO: 160269 - DNA, 21 bp, Artificial sequence
  SiRNA target sequence
ttggaaatccacattctcgca

SEQ ID NO: 160270 - DNA, 21 bp, Artificial sequence
  SiRNA target sequence
tggaaatccacattctcgcac

SEQ ID NO: 160271 - DNA, 21 bp, Artificial sequence
  SiRNA target sequence
ggaaatccacattctcgcacg

SEQ ID NO: 160272 - DNA, 21 bp, Artificial sequence
  SiRNA target sequence
gaaatccacattctcgcacgc

SEQ ID NO: 160273 - DNA, 21 bp, Artificial sequence
  SiRNA target sequence
aaatccacattctcgcacgca

SEQ ID NO: 160274 - DNA, 21 bp, Artificial sequence
  SiRNA target sequence
aatccacattctcgcacgcat

SEQ ID NO: 160275 - DNA, 21 bp, Artificial sequence
  SiRNA target sequence
atccacattctcgcacgcata

SEQ ID NO: 160276 - DNA, 21 bp, Artificial sequence
  SiRNA target sequence
tccacattctcgcacgcatac

SEQ ID NO: 160277 - DNA, 21 bp, Artificial sequence
  SiRNA target sequence
ccacattctcgcacgcatacg

SEQ ID NO: 160278 - DNA, 21 bp, Artificial sequence
  SiRNA target sequence
cacattctcgcacgcatacgt

SEQ ID NO: 160279 - DNA, 21 bp, Artificial sequence
  SiRNA target sequence
acattctcgcacgcatacgtt

SEQ ID NO: 160280 - DNA, 21 bp, Artificial sequence
  SiRNA target sequence
cattctcgcacgcatacgttt

SEQ ID NO: 160281 - DNA, 21 bp, Artificial sequence
  SiRNA target sequence
attctcgcacgcatacgtttg

SEQ ID NO: 160282 - DNA, 21 bp, Artificial sequence
  SiRNA target sequence
ttctcgcacgcatacgtttgg

SEQ ID NO: 160283 - DNA, 21 bp, Artificial sequence
  SiRNA target sequence
tctcgcacgcatacgtttgga

SEQ ID NO: 160284 - DNA, 21 bp, Artificial sequence
  SiRNA target sequence
ctcgcacgcatacgtttggat

SEQ ID NO: 160285 - DNA, 21 bp, Artificial sequence
  SiRNA target sequence
tcgcacgcatacgtttggatg

SEQ ID NO: 160286 - DNA, 21 bp, Artificial sequence
  SiRNA target sequence
cgcacgcatacgtttggatgg

SEQ ID NO: 160287 - DNA, 21 bp, Artificial sequence
  SiRNA target sequence
gcacgcatacgtttggatgga

SEQ ID NO: 160288 - DNA, 21 bp, Artificial sequence
  SiRNA target sequence
cacgcatacgtttggatggaa

SEQ ID NO: 160289 - DNA, 21 bp, Artificial sequence
  SiRNA target sequence
acgcatacgtttggatggaat

SEQ ID NO: 160290 - DNA, 21 bp, Artificial sequence
  SiRNA target sequence
cgcatacgtttggatggaatg

SEQ ID NO: 160291 - DNA, 21 bp, Artificial sequence
  SiRNA target sequence
gcatacgtttggatggaatgc

SEQ ID NO: 160292 - DNA, 21 bp, Artificial sequence
  SiRNA target sequence
catacgtttggatggaatgca

SEQ ID NO: 160293 - DNA, 21 bp, Artificial sequence
  SiRNA target sequence
atacgtttggatggaatgcag

SEQ ID NO: 160294 - DNA, 21 bp, Artificial sequence
  SiRNA target sequence
tacgtttggatggaatgcaga

SEQ ID NO: 160295 - DNA, 21 bp, Artificial sequence
  SiRNA target sequence
acgtttggatggaatgcagaa

SEQ ID NO: 160296 - DNA, 21 bp, Artificial sequence
  SiRNA target sequence
cgtttggatggaatgcagaaa

SEQ ID NO: 160297 - DNA, 21 bp, Artificial sequence
  SiRNA target sequence
gtttggatggaatgcagaaaa

SEQ ID NO: 160298 - DNA, 21 bp, Artificial sequence
  SiRNA target sequence
tttggatggaatgcagaaaaa

SEQ ID NO: 160299 - DNA, 21 bp, Artificial sequence
  SiRNA target sequence
ttggatggaatgcagaaaaag

SEQ ID NO: 160300 - DNA, 21 bp, Artificial sequence
  SiRNA target sequence
tggatggaatgcagaaaaagg

SEQ ID NO: 160301 - DNA, 21 bp, Artificial sequence
  SiRNA target sequence
ggatggaatgcagaaaaaggc

SEQ ID NO: 160302 - DNA, 21 bp, Artificial sequence
  SiRNA target sequence
gatggaatgcagaaaaaggcg

SEQ ID NO: 160303 - DNA, 21 bp, Artificial sequence
  SiRNA target sequence
atggaatgcagaaaaaggcgt

SEQ ID NO: 160304 - DNA, 21 bp, Artificial sequence
  SiRNA target sequence
tggaatgcagaaaaaggcgta

SEQ ID NO: 160305 - DNA, 21 bp, Artificial sequence
  SiRNA target sequence
ggaatgcagaaaaaggcgtag

SEQ ID NO: 160306 - DNA, 21 bp, Artificial sequence
  SiRNA target sequence
gaatgcagaaaaaggcgtaga

SEQ ID NO: 160307 - DNA, 21 bp, Artificial sequence
  SiRNA target sequence
aatgcagaaaaaggcgtagaa

SEQ ID NO: 160308 - DNA, 21 bp, Artificial sequence
  SiRNA target sequence
atgcagaaaaaggcgtagaaa

SEQ ID NO: 160309 - DNA, 21 bp, Artificial sequence
  SiRNA target sequence
tgcagaaaaaggcgtagaaat

SEQ ID NO: 160310 - DNA, 21 bp, Artificial sequence
  SiRNA target sequence
gcagaaaaaggcgtagaaatg

SEQ ID NO: 160311 - DNA, 21 bp, Artificial sequence
  SiRNA target sequence
cagaaaaaggcgtagaaatgg

SEQ ID NO: 160312 - DNA, 21 bp, Artificial sequence
  SiRNA target sequence
agaaaaaggcgtagaaatggc

SEQ ID NO: 160313 - DNA, 21 bp, Artificial sequence
  SiRNA target sequence
gaaaaaggcgtagaaatggct

SEQ ID NO: 160314 - DNA, 21 bp, Artificial sequence
  SiRNA target sequence
aaaaaggcgtagaaatggctc

SEQ ID NO: 160315 - DNA, 21 bp, Artificial sequence
  SiRNA target sequence
aaaaggcgtagaaatggctcg

SEQ ID NO: 160316 - DNA, 21 bp, Artificial sequence
  SiRNA target sequence
aaaggcgtagaaatggctcga

SEQ ID NO: 160317 - DNA, 21 bp, Artificial sequence
  SiRNA target sequence
aaggcgtagaaatggctcgaa

SEQ ID NO: 160318 - DNA, 21 bp, Artificial sequence
  SiRNA target sequence
aggcgtagaaatggctcgaaa

SEQ ID NO: 160319 - DNA, 21 bp, Artificial sequence
  SiRNA target sequence
ggcgtagaaatggctcgaaag

SEQ ID NO: 160320 - DNA, 21 bp, Artificial sequence
  SiRNA target sequence
gcgtagaaatggctcgaaagc

SEQ ID NO: 160321 - DNA, 21 bp, Artificial sequence
  SiRNA target sequence
cgtagaaatggctcgaaagca

SEQ ID NO: 160322 - DNA, 21 bp, Artificial sequence
  SiRNA target sequence
gtagaaatggctcgaaagcaa

SEQ ID NO: 160323 - DNA, 21 bp, Artificial sequence
  SiRNA target sequence
tagaaatggctcgaaagcaag

SEQ ID NO: 160324 - DNA, 21 bp, Artificial sequence
  SiRNA target sequence
agaaatggctcgaaagcaagt

SEQ ID NO: 160325 - DNA, 21 bp, Artificial sequence
  SiRNA target sequence
gaaatggctcgaaagcaagta

SEQ ID NO: 160326 - DNA, 21 bp, Artificial sequence
  SiRNA target sequence
aaatggctcgaaagcaagtag

SEQ ID NO: 160327 - DNA, 21 bp, Artificial sequence
  SiRNA target sequence
aatggctcgaaagcaagtagc

SEQ ID NO: 160328 - DNA, 21 bp, Artificial sequence
  SiRNA target sequence
atggctcgaaagcaagtagca

SEQ ID NO: 160329 - DNA, 21 bp, Artificial sequence
  SiRNA target sequence
tggctcgaaagcaagtagcag

SEQ ID NO: 160330 - DNA, 21 bp, Artificial sequence
  SiRNA target sequence
ggctcgaaagcaagtagcaga

SEQ ID NO: 160331 - DNA, 21 bp, Artificial sequence
  SiRNA target sequence
gctcgaaagcaagtagcagat

SEQ ID NO: 160332 - DNA, 21 bp, Artificial sequence
  SiRNA target sequence
ctcgaaagcaagtagcagatt

SEQ ID NO: 160333 - DNA, 21 bp, Artificial sequence
  SiRNA target sequence
tcgaaagcaagtagcagattt

SEQ ID NO: 160334 - DNA, 21 bp, Artificial sequence
  SiRNA target sequence
cgaaagcaagtagcagattta

SEQ ID NO: 160335 - DNA, 21 bp, Artificial sequence
  SiRNA target sequence
gaaagcaagtagcagatttac

SEQ ID NO: 160336 - DNA, 21 bp, Artificial sequence
  SiRNA target sequence
aaagcaagtagcagatttact

SEQ ID NO: 160337 - DNA, 21 bp, Artificial sequence
  SiRNA target sequence
aagcaagtagcagatttactg

SEQ ID NO: 160338 - DNA, 21 bp, Artificial sequence
  SiRNA target sequence
agcaagtagcagatttactga

SEQ ID NO: 160339 - DNA, 21 bp, Artificial sequence
  SiRNA target sequence
gcaagtagcagatttactgaa

SEQ ID NO: 160340 - DNA, 21 bp, Artificial sequence
  SiRNA target sequence
caagtagcagatttactgaat

SEQ ID NO: 160341 - DNA, 21 bp, Artificial sequence
  SiRNA target sequence
aagtagcagatttactgaatg

SEQ ID NO: 160342 - DNA, 21 bp, Artificial sequence
  SiRNA target sequence
agtagcagatttactgaatgc

SEQ ID NO: 160343 - DNA, 21 bp, Artificial sequence
  SiRNA target sequence
gtagcagatttactgaatgcc

SEQ ID NO: 160344 - DNA, 21 bp, Artificial sequence
  SiRNA target sequence
tagcagatttactgaatgcca

SEQ ID NO: 160345 - DNA, 21 bp, Artificial sequence
  SiRNA target sequence
agcagatttactgaatgccaa

SEQ ID NO: 160346 - DNA, 21 bp, Artificial sequence
  SiRNA target sequence
gcagatttactgaatgccaat

SEQ ID NO: 160347 - DNA, 21 bp, Artificial sequence
  SiRNA target sequence
cagatttactgaatgccaatg

SEQ ID NO: 160348 - DNA, 21 bp, Artificial sequence
  SiRNA target sequence
agatttactgaatgccaatga

SEQ ID NO: 160349 - DNA, 21 bp, Artificial sequence
  SiRNA target sequence
gatttactgaatgccaatgaa

SEQ ID NO: 160350 - DNA, 21 bp, Artificial sequence
  SiRNA target sequence
atttactgaatgccaatgaaa

SEQ ID NO: 160351 - DNA, 21 bp, Artificial sequence
  SiRNA target sequence
tttactgaatgccaatgaaaa

SEQ ID NO: 160352 - DNA, 21 bp, Artificial sequence
  SiRNA target sequence
ttactgaatgccaatgaaaaa

SEQ ID NO: 160353 - DNA, 21 bp, Artificial sequence
  SiRNA target sequence
tactgaatgccaatgaaaaag

SEQ ID NO: 160354 - DNA, 21 bp, Artificial sequence
  SiRNA target sequence
actgaatgccaatgaaaaaga

SEQ ID NO: 160355 - DNA, 21 bp, Artificial sequence
  SiRNA target sequence
ctgaatgccaatgaaaaagaa

SEQ ID NO: 160356 - DNA, 21 bp, Artificial sequence
  SiRNA target sequence
tgaatgccaatgaaaaagaaa

SEQ ID NO: 160357 - DNA, 21 bp, Artificial sequence
  SiRNA target sequence
gaatgccaatgaaaaagaaat

SEQ ID NO: 160358 - DNA, 21 bp, Artificial sequence
  SiRNA target sequence
aatgccaatgaaaaagaaatt

SEQ ID NO: 160359 - DNA, 21 bp, Artificial sequence
  SiRNA target sequence
atgccaatgaaaaagaaatta

SEQ ID NO: 160360 - DNA, 21 bp, Artificial sequence
  SiRNA target sequence
tgccaatgaaaaagaaattat

SEQ ID NO: 160361 - DNA, 21 bp, Artificial sequence
  SiRNA target sequence
gccaatgaaaaagaaattatt

SEQ ID NO: 160362 - DNA, 21 bp, Artificial sequence
  SiRNA target sequence
ccaatgaaaaagaaattattt

SEQ ID NO: 160363 - DNA, 21 bp, Artificial sequence
  SiRNA target sequence
caatgaaaaagaaattatttt

SEQ ID NO: 160364 - DNA, 21 bp, Artificial sequence
  SiRNA target sequence
aatgaaaaagaaattattttt

SEQ ID NO: 160365 - DNA, 21 bp, Artificial sequence
  SiRNA target sequence
atgaaaaagaaattattttta

SEQ ID NO: 160366 - DNA, 21 bp, Artificial sequence
  SiRNA target sequence
tgaaaaagaaattatttttac

SEQ ID NO: 160367 - DNA, 21 bp, Artificial sequence
  SiRNA target sequence
gaaaaagaaattatttttact

SEQ ID NO: 160368 - DNA, 21 bp, Artificial sequence
  SiRNA target sequence
aaaaagaaattatttttacta

SEQ ID NO: 160369 - DNA, 21 bp, Artificial sequence
  SiRNA target sequence
aaaagaaattatttttactag

SEQ ID NO: 160370 - DNA, 21 bp, Artificial sequence
  SiRNA target sequence
aaagaaattatttttactagc

SEQ ID NO: 160371 - DNA, 21 bp, Artificial sequence
  SiRNA target sequence
aagaaattatttttactagcg

SEQ ID NO: 160372 - DNA, 21 bp, Artificial sequence
  SiRNA target sequence
agaaattatttttactagcgg

SEQ ID NO: 160373 - DNA, 21 bp, Artificial sequence
  SiRNA target sequence
gaaattatttttactagcggt

SEQ ID NO: 160374 - DNA, 21 bp, Artificial sequence
  SiRNA target sequence
aaattatttttactagcggtg

SEQ ID NO: 160375 - DNA, 21 bp, Artificial sequence
  SiRNA target sequence
aattatttttactagcggtgc

SEQ ID NO: 160376 - DNA, 21 bp, Artificial sequence
  SiRNA target sequence
attatttttactagcggtgct

SEQ ID NO: 160377 - DNA, 21 bp, Artificial sequence
  SiRNA target sequence
ttatttttactagcggtgcta

SEQ ID NO: 160378 - DNA, 21 bp, Artificial sequence
  SiRNA target sequence
tatttttactagcggtgctac

SEQ ID NO: 160379 - DNA, 21 bp, Artificial sequence
  SiRNA target sequence
atttttactagcggtgctact

SEQ ID NO: 160380 - DNA, 21 bp, Artificial sequence
  SiRNA target sequence
tttttactagcggtgctactg

SEQ ID NO: 160381 - DNA, 21 bp, Artificial sequence
  SiRNA target sequence
ttttactagcggtgctactga

SEQ ID NO: 160382 - DNA, 21 bp, Artificial sequence
  SiRNA target sequence
tttactagcggtgctactgag

SEQ ID NO: 160383 - DNA, 21 bp, Artificial sequence
  SiRNA target sequence
ttactagcggtgctactgaga

SEQ ID NO: 160384 - DNA, 21 bp, Artificial sequence
  SiRNA target sequence
tactagcggtgctactgagag

SEQ ID NO: 160385 - DNA, 21 bp, Artificial sequence
  SiRNA target sequence
actagcggtgctactgagagt

SEQ ID NO: 160386 - DNA, 21 bp, Artificial sequence
  SiRNA target sequence
ctagcggtgctactgagagta

SEQ ID NO: 160387 - DNA, 21 bp, Artificial sequence
  SiRNA target sequence
tagcggtgctactgagagtaa

SEQ ID NO: 160388 - DNA, 21 bp, Artificial sequence
  SiRNA target sequence
agcggtgctactgagagtaac

SEQ ID NO: 160389 - DNA, 21 bp, Artificial sequence
  SiRNA target sequence
gcggtgctactgagagtaaca

SEQ ID NO: 160390 - DNA, 21 bp, Artificial sequence
  SiRNA target sequence
cggtgctactgagagtaacaa

SEQ ID NO: 160391 - DNA, 21 bp, Artificial sequence
  SiRNA target sequence
ggtgctactgagagtaacaac

SEQ ID NO: 160392 - DNA, 21 bp, Artificial sequence
  SiRNA target sequence
gtgctactgagagtaacaacc

SEQ ID NO: 160393 - DNA, 21 bp, Artificial sequence
  SiRNA target sequence
tgctactgagagtaacaacct

SEQ ID NO: 160394 - DNA, 21 bp, Artificial sequence
  SiRNA target sequence
gctactgagagtaacaacctt

SEQ ID NO: 160395 - DNA, 21 bp, Artificial sequence
  SiRNA target sequence
ctactgagagtaacaaccttg

SEQ ID NO: 160396 - DNA, 21 bp, Artificial sequence
  SiRNA target sequence
tactgagagtaacaaccttgc

SEQ ID NO: 160397 - DNA, 21 bp, Artificial sequence
  SiRNA target sequence
actgagagtaacaaccttgca

SEQ ID NO: 160398 - DNA, 21 bp, Artificial sequence
  SiRNA target sequence
ctgagagtaacaaccttgcac

SEQ ID NO: 160399 - DNA, 21 bp, Artificial sequence
  SiRNA target sequence
tgagagtaacaaccttgcact

SEQ ID NO: 160400 - DNA, 21 bp, Artificial sequence
  SiRNA target sequence
gagagtaacaaccttgcacta

SEQ ID NO: 160401 - DNA, 21 bp, Artificial sequence
  SiRNA target sequence
agagtaacaaccttgcactaa

SEQ ID NO: 160402 - DNA, 21 bp, Artificial sequence
  SiRNA target sequence
gagtaacaaccttgcactaaa

SEQ ID NO: 160403 - DNA, 21 bp, Artificial sequence
  SiRNA target sequence
agtaacaaccttgcactaaag

SEQ ID NO: 160404 - DNA, 21 bp, Artificial sequence
  SiRNA target sequence
gtaacaaccttgcactaaagg

SEQ ID NO: 160405 - DNA, 21 bp, Artificial sequence
  SiRNA target sequence
taacaaccttgcactaaaggg

SEQ ID NO: 160406 - DNA, 21 bp, Artificial sequence
  SiRNA target sequence
aacaaccttgcactaaagggt

SEQ ID NO: 160407 - DNA, 21 bp, Artificial sequence
  SiRNA target sequence
acaaccttgcactaaagggtg

SEQ ID NO: 160408 - DNA, 21 bp, Artificial sequence
  SiRNA target sequence
caaccttgcactaaagggtgt

SEQ ID NO: 160409 - DNA, 21 bp, Artificial sequence
  SiRNA target sequence
aaccttgcactaaagggtgtc

SEQ ID NO: 160410 - DNA, 21 bp, Artificial sequence
  SiRNA target sequence
accttgcactaaagggtgtct

SEQ ID NO: 160411 - DNA, 21 bp, Artificial sequence
  SiRNA target sequence
ccttgcactaaagggtgtctt

SEQ ID NO: 160412 - DNA, 21 bp, Artificial sequence
  SiRNA target sequence
cttgcactaaagggtgtcttt

SEQ ID NO: 160413 - DNA, 21 bp, Artificial sequence
  SiRNA target sequence
ttgcactaaagggtgtctttg

SEQ ID NO: 160414 - DNA, 21 bp, Artificial sequence
  SiRNA target sequence
tgcactaaagggtgtctttgc

SEQ ID NO: 160415 - DNA, 21 bp, Artificial sequence
  SiRNA target sequence
gcactaaagggtgtctttgca

SEQ ID NO: 160416 - DNA, 21 bp, Artificial sequence
  SiRNA target sequence
cactaaagggtgtctttgcat

SEQ ID NO: 160417 - DNA, 21 bp, Artificial sequence
  SiRNA target sequence
actaaagggtgtctttgcatt

SEQ ID NO: 160418 - DNA, 21 bp, Artificial sequence
  SiRNA target sequence
ctaaagggtgtctttgcattt

SEQ ID NO: 160419 - DNA, 21 bp, Artificial sequence
  SiRNA target sequence
taaagggtgtctttgcatttt

SEQ ID NO: 160420 - DNA, 21 bp, Artificial sequence
  SiRNA target sequence
aaagggtgtctttgcattttt

SEQ ID NO: 160421 - DNA, 21 bp, Artificial sequence
  SiRNA target sequence
aagggtgtctttgcattttta

SEQ ID NO: 160422 - DNA, 21 bp, Artificial sequence
  SiRNA target sequence
agggtgtctttgcatttttaa

SEQ ID NO: 160423 - DNA, 21 bp, Artificial sequence
  SiRNA target sequence
gggtgtctttgcatttttaaa

SEQ ID NO: 160424 - DNA, 21 bp, Artificial sequence
  SiRNA target sequence
ggtgtctttgcatttttaaaa

SEQ ID NO: 160425 - DNA, 21 bp, Artificial sequence
  SiRNA target sequence
gtgtctttgcatttttaaaaa

SEQ ID NO: 160426 - DNA, 21 bp, Artificial sequence
  SiRNA target sequence
tgtctttgcatttttaaaaaa

SEQ ID NO: 160427 - DNA, 21 bp, Artificial sequence
  SiRNA target sequence
gtctttgcatttttaaaaaaa

SEQ ID NO: 160428 - DNA, 21 bp, Artificial sequence
  SiRNA target sequence
tctttgcatttttaaaaaaag

SEQ ID NO: 160429 - DNA, 21 bp, Artificial sequence
  SiRNA target sequence
ctttgcatttttaaaaaaaga

SEQ ID NO: 160430 - DNA, 21 bp, Artificial sequence
  SiRNA target sequence
tttgcatttttaaaaaaagac

SEQ ID NO: 160431 - DNA, 21 bp, Artificial sequence
  SiRNA target sequence
ttgcatttttaaaaaaagaca

SEQ ID NO: 160432 - DNA, 21 bp, Artificial sequence
  SiRNA target sequence
tgcatttttaaaaaaagacaa

SEQ ID NO: 160433 - DNA, 21 bp, Artificial sequence
  SiRNA target sequence
gcatttttaaaaaaagacaat

SEQ ID NO: 160434 - DNA, 21 bp, Artificial sequence
  SiRNA target sequence
catttttaaaaaaagacaata

SEQ ID NO: 160435 - DNA, 21 bp, Artificial sequence
  SiRNA target sequence
atttttaaaaaaagacaatag

SEQ ID NO: 160436 - DNA, 21 bp, Artificial sequence
  SiRNA target sequence
tttttaaaaaaagacaatagg

SEQ ID NO: 160437 - DNA, 21 bp, Artificial sequence
  SiRNA target sequence
ttttaaaaaaagacaataggc

SEQ ID NO: 160438 - DNA, 21 bp, Artificial sequence
  SiRNA target sequence
tttaaaaaaagacaataggcc

SEQ ID NO: 160439 - DNA, 21 bp, Artificial sequence
  SiRNA target sequence
ttaaaaaaagacaataggcct

SEQ ID NO: 160440 - DNA, 21 bp, Artificial sequence
  SiRNA target sequence
taaaaaaagacaataggcctg

SEQ ID NO: 160441 - DNA, 21 bp, Artificial sequence
  SiRNA target sequence
aaaaaaagacaataggcctgt

SEQ ID NO: 160442 - DNA, 21 bp, Artificial sequence
  SiRNA target sequence
aaaaaagacaataggcctgtt

SEQ ID NO: 160443 - DNA, 21 bp, Artificial sequence
  SiRNA target sequence
aaaaagacaataggcctgttc

SEQ ID NO: 160444 - DNA, 21 bp, Artificial sequence
  SiRNA target sequence
aaaagacaataggcctgttca

SEQ ID NO: 160445 - DNA, 21 bp, Artificial sequence
  SiRNA target sequence
aaagacaataggcctgttcat

SEQ ID NO: 160446 - DNA, 21 bp, Artificial sequence
  SiRNA target sequence
aagacaataggcctgttcata

SEQ ID NO: 160447 - DNA, 21 bp, Artificial sequence
  SiRNA target sequence
agacaataggcctgttcatat

SEQ ID NO: 160448 - DNA, 21 bp, Artificial sequence
  SiRNA target sequence
gacaataggcctgttcatatc

SEQ ID NO: 160449 - DNA, 21 bp, Artificial sequence
  SiRNA target sequence
acaataggcctgttcatatca

SEQ ID NO: 160450 - DNA, 21 bp, Artificial sequence
  SiRNA target sequence
caataggcctgttcatatcat

SEQ ID NO: 160451 - DNA, 21 bp, Artificial sequence
  SiRNA target sequence
aataggcctgttcatatcatt

SEQ ID NO: 160452 - DNA, 21 bp, Artificial sequence
  SiRNA target sequence
ataggcctgttcatatcatta

SEQ ID NO: 160453 - DNA, 21 bp, Artificial sequence
  SiRNA target sequence
taggcctgttcatatcattac

SEQ ID NO: 160454 - DNA, 21 bp, Artificial sequence
  SiRNA target sequence
aggcctgttcatatcattacc

SEQ ID NO: 160455 - DNA, 21 bp, Artificial sequence
  SiRNA target sequence
ggcctgttcatatcattacca

SEQ ID NO: 160456 - DNA, 21 bp, Artificial sequence
  SiRNA target sequence
gcctgttcatatcattaccac

SEQ ID NO: 160457 - DNA, 21 bp, Artificial sequence
  SiRNA target sequence
cctgttcatatcattaccaca

SEQ ID NO: 160458 - DNA, 21 bp, Artificial sequence
  SiRNA target sequence
ctgttcatatcattaccacac

SEQ ID NO: 160459 - DNA, 21 bp, Artificial sequence
  SiRNA target sequence
tgttcatatcattaccacaca

SEQ ID NO: 160460 - DNA, 21 bp, Artificial sequence
  SiRNA target sequence
gttcatatcattaccacacaa

SEQ ID NO: 160461 - DNA, 21 bp, Artificial sequence
  SiRNA target sequence
ttcatatcattaccacacaaa

SEQ ID NO: 160462 - DNA, 21 bp, Artificial sequence
  SiRNA target sequence
tcatatcattaccacacaaat

SEQ ID NO: 160463 - DNA, 21 bp, Artificial sequence
  SiRNA target sequence
catatcattaccacacaaatt

SEQ ID NO: 160464 - DNA, 21 bp, Artificial sequence
  SiRNA target sequence
atatcattaccacacaaattg

SEQ ID NO: 160465 - DNA, 21 bp, Artificial sequence
  SiRNA target sequence
tatcattaccacacaaattga

SEQ ID NO: 160466 - DNA, 21 bp, Artificial sequence
  SiRNA target sequence
atcattaccacacaaattgaa

SEQ ID NO: 160467 - DNA, 21 bp, Artificial sequence
  SiRNA target sequence
tcattaccacacaaattgaac

SEQ ID NO: 160468 - DNA, 21 bp, Artificial sequence
  SiRNA target sequence
cattaccacacaaattgaaca

SEQ ID NO: 160469 - DNA, 21 bp, Artificial sequence
  SiRNA target sequence
attaccacacaaattgaacat

SEQ ID NO: 160470 - DNA, 21 bp, Artificial sequence
  SiRNA target sequence
ttaccacacaaattgaacata

SEQ ID NO: 160471 - DNA, 21 bp, Artificial sequence
  SiRNA target sequence
taccacacaaattgaacataa

SEQ ID NO: 160472 - DNA, 21 bp, Artificial sequence
  SiRNA target sequence
accacacaaattgaacataaa

SEQ ID NO: 160473 - DNA, 21 bp, Artificial sequence
  SiRNA target sequence
ccacacaaattgaacataaat

SEQ ID NO: 160474 - DNA, 21 bp, Artificial sequence
  SiRNA target sequence
cacacaaattgaacataaatg

SEQ ID NO: 160475 - DNA, 21 bp, Artificial sequence
  SiRNA target sequence
acacaaattgaacataaatgt

SEQ ID NO: 160476 - DNA, 21 bp, Artificial sequence
  SiRNA target sequence
cacaaattgaacataaatgtg

SEQ ID NO: 160477 - DNA, 21 bp, Artificial sequence
  SiRNA target sequence
acaaattgaacataaatgtgt

SEQ ID NO: 160478 - DNA, 21 bp, Artificial sequence
  SiRNA target sequence
caaattgaacataaatgtgta

SEQ ID NO: 160479 - DNA, 21 bp, Artificial sequence
  SiRNA target sequence
aaattgaacataaatgtgtat

SEQ ID NO: 160480 - DNA, 21 bp, Artificial sequence
  SiRNA target sequence
aattgaacataaatgtgtatt

SEQ ID NO: 160481 - DNA, 21 bp, Artificial sequence
  SiRNA target sequence
attgaacataaatgtgtattg

SEQ ID NO: 160482 - DNA, 21 bp, Artificial sequence
  SiRNA target sequence
ttgaacataaatgtgtattgg

SEQ ID NO: 160483 - DNA, 21 bp, Artificial sequence
  SiRNA target sequence
tgaacataaatgtgtattgga

SEQ ID NO: 160484 - DNA, 21 bp, Artificial sequence
  SiRNA target sequence
gaacataaatgtgtattggac

SEQ ID NO: 160485 - DNA, 21 bp, Artificial sequence
  SiRNA target sequence
aacataaatgtgtattggaca

SEQ ID NO: 160486 - DNA, 21 bp, Artificial sequence
  SiRNA target sequence
acataaatgtgtattggacac

SEQ ID NO: 160487 - DNA, 21 bp, Artificial sequence
  SiRNA target sequence
cataaatgtgtattggacaca

SEQ ID NO: 160488 - DNA, 21 bp, Artificial sequence
  SiRNA target sequence
ataaatgtgtattggacacat

SEQ ID NO: 160489 - DNA, 21 bp, Artificial sequence
  SiRNA target sequence
taaatgtgtattggacacatg

SEQ ID NO: 160490 - DNA, 21 bp, Artificial sequence
  SiRNA target sequence
aaatgtgtattggacacatgt

SEQ ID NO: 160491 - DNA, 21 bp, Artificial sequence
  SiRNA target sequence
aatgtgtattggacacatgta

SEQ ID NO: 160492 - DNA, 21 bp, Artificial sequence
  SiRNA target sequence
atgtgtattggacacatgtag

SEQ ID NO: 160493 - DNA, 21 bp, Artificial sequence
  SiRNA target sequence
tgtgtattggacacatgtaga

SEQ ID NO: 160494 - DNA, 21 bp, Artificial sequence
  SiRNA target sequence
gtgtattggacacatgtagaa

SEQ ID NO: 160495 - DNA, 21 bp, Artificial sequence
  SiRNA target sequence
tgtattggacacatgtagaag

SEQ ID NO: 160496 - DNA, 21 bp, Artificial sequence
  SiRNA target sequence
gtattggacacatgtagaaga

SEQ ID NO: 160497 - DNA, 21 bp, Artificial sequence
  SiRNA target sequence
tattggacacatgtagaagat

SEQ ID NO: 160498 - DNA, 21 bp, Artificial sequence
  SiRNA target sequence
attggacacatgtagaagatt

SEQ ID NO: 160499 - DNA, 21 bp, Artificial sequence
  SiRNA target sequence
ttggacacatgtagaagatta

SEQ ID NO: 160500 - DNA, 21 bp, Artificial sequence
  SiRNA target sequence
tggacacatgtagaagattag

SEQ ID NO: 160501 - DNA, 21 bp, Artificial sequence
  SiRNA target sequence
ggacacatgtagaagattaga

SEQ ID NO: 160502 - DNA, 21 bp, Artificial sequence
  SiRNA target sequence
gacacatgtagaagattagaa

SEQ ID NO: 160503 - DNA, 21 bp, Artificial sequence
  SiRNA target sequence
acacatgtagaagattagaag

SEQ ID NO: 160504 - DNA, 21 bp, Artificial sequence
  SiRNA target sequence
cacatgtagaagattagaaga

SEQ ID NO: 160505 - DNA, 21 bp, Artificial sequence
  SiRNA target sequence
acatgtagaagattagaagaa

SEQ ID NO: 160506 - DNA, 21 bp, Artificial sequence
  SiRNA target sequence
catgtagaagattagaagaag

SEQ ID NO: 160507 - DNA, 21 bp, Artificial sequence
  SiRNA target sequence
atgtagaagattagaagaaga

SEQ ID NO: 160508 - DNA, 21 bp, Artificial sequence
  SiRNA target sequence
tgtagaagattagaagaagaa

SEQ ID NO: 160509 - DNA, 21 bp, Artificial sequence
  SiRNA target sequence
gtagaagattagaagaagaag

SEQ ID NO: 160510 - DNA, 21 bp, Artificial sequence
  SiRNA target sequence
tagaagattagaagaagaagg

SEQ ID NO: 160511 - DNA, 21 bp, Artificial sequence
  SiRNA target sequence
agaagattagaagaagaagga

SEQ ID NO: 160512 - DNA, 21 bp, Artificial sequence
  SiRNA target sequence
gaagattagaagaagaaggag

SEQ ID NO: 160513 - DNA, 21 bp, Artificial sequence
  SiRNA target sequence
aagattagaagaagaaggagc

SEQ ID NO: 160514 - DNA, 21 bp, Artificial sequence
  SiRNA target sequence
agattagaagaagaaggagct

SEQ ID NO: 160515 - DNA, 21 bp, Artificial sequence
  SiRNA target sequence
gattagaagaagaaggagcta

SEQ ID NO: 160516 - DNA, 21 bp, Artificial sequence
  SiRNA target sequence
attagaagaagaaggagctac

SEQ ID NO: 160517 - DNA, 21 bp, Artificial sequence
  SiRNA target sequence
ttagaagaagaaggagctaca

SEQ ID NO: 160518 - DNA, 21 bp, Artificial sequence
  SiRNA target sequence
tagaagaagaaggagctacag

SEQ ID NO: 160519 - DNA, 21 bp, Artificial sequence
  SiRNA target sequence
agaagaagaaggagctacagt

SEQ ID NO: 160520 - DNA, 21 bp, Artificial sequence
  SiRNA target sequence
gaagaagaaggagctacagtg

SEQ ID NO: 160521 - DNA, 21 bp, Artificial sequence
  SiRNA target sequence
aagaagaaggagctacagtga

SEQ ID NO: 160522 - DNA, 21 bp, Artificial sequence
  SiRNA target sequence
agaagaaggagctacagtgac

SEQ ID NO: 160523 - DNA, 21 bp, Artificial sequence
  SiRNA target sequence
gaagaaggagctacagtgact

SEQ ID NO: 160524 - DNA, 21 bp, Artificial sequence
  SiRNA target sequence
aagaaggagctacagtgactt

SEQ ID NO: 160525 - DNA, 21 bp, Artificial sequence
  SiRNA target sequence
agaaggagctacagtgactta

SEQ ID NO: 160526 - DNA, 21 bp, Artificial sequence
  SiRNA target sequence
gaaggagctacagtgacttat

SEQ ID NO: 160527 - DNA, 21 bp, Artificial sequence
  SiRNA target sequence
aaggagctacagtgacttatt

SEQ ID NO: 160528 - DNA, 21 bp, Artificial sequence
  SiRNA target sequence
aggagctacagtgacttattt

SEQ ID NO: 160529 - DNA, 21 bp, Artificial sequence
  SiRNA target sequence
ggagctacagtgacttatttg

SEQ ID NO: 160530 - DNA, 21 bp, Artificial sequence
  SiRNA target sequence
gagctacagtgacttatttgc

SEQ ID NO: 160531 - DNA, 21 bp, Artificial sequence
  SiRNA target sequence
agctacagtgacttatttgcc

SEQ ID NO: 160532 - DNA, 21 bp, Artificial sequence
  SiRNA target sequence
gctacagtgacttatttgcct

SEQ ID NO: 160533 - DNA, 21 bp, Artificial sequence
  SiRNA target sequence
ctacagtgacttatttgcctg

SEQ ID NO: 160534 - DNA, 21 bp, Artificial sequence
  SiRNA target sequence
tacagtgacttatttgcctgt

SEQ ID NO: 160535 - DNA, 21 bp, Artificial sequence
  SiRNA target sequence
acagtgacttatttgcctgta

SEQ ID NO: 160536 - DNA, 21 bp, Artificial sequence
  SiRNA target sequence
cagtgacttatttgcctgtag

SEQ ID NO: 160537 - DNA, 21 bp, Artificial sequence
  SiRNA target sequence
agtgacttatttgcctgtaga

SEQ ID NO: 160538 - DNA, 21 bp, Artificial sequence
  SiRNA target sequence
gtgacttatttgcctgtagat

SEQ ID NO: 160539 - DNA, 21 bp, Artificial sequence
  SiRNA target sequence
tgacttatttgcctgtagata

SEQ ID NO: 160540 - DNA, 21 bp, Artificial sequence
  SiRNA target sequence
gacttatttgcctgtagataa

SEQ ID NO: 160541 - DNA, 21 bp, Artificial sequence
  SiRNA target sequence
acttatttgcctgtagataaa

SEQ ID NO: 160542 - DNA, 21 bp, Artificial sequence
  SiRNA target sequence
cttatttgcctgtagataaaa

SEQ ID NO: 160543 - DNA, 21 bp, Artificial sequence
  SiRNA target sequence
ttatttgcctgtagataaaaa

SEQ ID NO: 160544 - DNA, 21 bp, Artificial sequence
  SiRNA target sequence
tatttgcctgtagataaaaat

SEQ ID NO: 160545 - DNA, 21 bp, Artificial sequence
  SiRNA target sequence
atttgcctgtagataaaaatg

SEQ ID NO: 160546 - DNA, 21 bp, Artificial sequence
  SiRNA target sequence
tttgcctgtagataaaaatgg

SEQ ID NO: 160547 - DNA, 21 bp, Artificial sequence
  SiRNA target sequence
ttgcctgtagataaaaatgga

SEQ ID NO: 160548 - DNA, 21 bp, Artificial sequence
  SiRNA target sequence
tgcctgtagataaaaatggaa

SEQ ID NO: 160549 - DNA, 21 bp, Artificial sequence
  SiRNA target sequence
gcctgtagataaaaatggaat

SEQ ID NO: 160550 - DNA, 21 bp, Artificial sequence
  SiRNA target sequence
cctgtagataaaaatggaata

SEQ ID NO: 160551 - DNA, 21 bp, Artificial sequence
  SiRNA target sequence
ctgtagataaaaatggaatag

SEQ ID NO: 160552 - DNA, 21 bp, Artificial sequence
  SiRNA target sequence
tgtagataaaaatggaatagt

SEQ ID NO: 160553 - DNA, 21 bp, Artificial sequence
  SiRNA target sequence
gtagataaaaatggaatagta

SEQ ID NO: 160554 - DNA, 21 bp, Artificial sequence
  SiRNA target sequence
tagataaaaatggaatagtag

SEQ ID NO: 160555 - DNA, 21 bp, Artificial sequence
  SiRNA target sequence
agataaaaatggaatagtaga

SEQ ID NO: 160556 - DNA, 21 bp, Artificial sequence
  SiRNA target sequence
gataaaaatggaatagtagat

SEQ ID NO: 160557 - DNA, 21 bp, Artificial sequence
  SiRNA target sequence
ataaaaatggaatagtagatc

SEQ ID NO: 160558 - DNA, 21 bp, Artificial sequence
  SiRNA target sequence
taaaaatggaatagtagatcc

SEQ ID NO: 160559 - DNA, 21 bp, Artificial sequence
  SiRNA target sequence
aaaaatggaatagtagatccg

SEQ ID NO: 160560 - DNA, 21 bp, Artificial sequence
  SiRNA target sequence
aaaatggaatagtagatccgc

SEQ ID NO: 160561 - DNA, 21 bp, Artificial sequence
  SiRNA target sequence
aaatggaatagtagatccgca

SEQ ID NO: 160562 - DNA, 21 bp, Artificial sequence
  SiRNA target sequence
aatggaatagtagatccgcaa

SEQ ID NO: 160563 - DNA, 21 bp, Artificial sequence
  SiRNA target sequence
atggaatagtagatccgcaat

SEQ ID NO: 160564 - DNA, 21 bp, Artificial sequence
  SiRNA target sequence
tggaatagtagatccgcaatt

SEQ ID NO: 160565 - DNA, 21 bp, Artificial sequence
  SiRNA target sequence
ggaatagtagatccgcaatta

SEQ ID NO: 160566 - DNA, 21 bp, Artificial sequence
  SiRNA target sequence
gaatagtagatccgcaattaa

SEQ ID NO: 160567 - DNA, 21 bp, Artificial sequence
  SiRNA target sequence
aatagtagatccgcaattaat

SEQ ID NO: 160568 - DNA, 21 bp, Artificial sequence
  SiRNA target sequence
atagtagatccgcaattaata

SEQ ID NO: 160569 - DNA, 21 bp, Artificial sequence
  SiRNA target sequence
tagtagatccgcaattaataa

SEQ ID NO: 160570 - DNA, 21 bp, Artificial sequence
  SiRNA target sequence
agtagatccgcaattaataaa

SEQ ID NO: 160571 - DNA, 21 bp, Artificial sequence
  SiRNA target sequence
gtagatccgcaattaataaaa

SEQ ID NO: 160572 - DNA, 21 bp, Artificial sequence
  SiRNA target sequence
tagatccgcaattaataaaaa

SEQ ID NO: 160573 - DNA, 21 bp, Artificial sequence
  SiRNA target sequence
agatccgcaattaataaaaaa

SEQ ID NO: 160574 - DNA, 21 bp, Artificial sequence
  SiRNA target sequence
gatccgcaattaataaaaaac

SEQ ID NO: 160575 - DNA, 21 bp, Artificial sequence
  SiRNA target sequence
atccgcaattaataaaaaaca

SEQ ID NO: 160576 - DNA, 21 bp, Artificial sequence
  SiRNA target sequence
tccgcaattaataaaaaacag

SEQ ID NO: 160577 - DNA, 21 bp, Artificial sequence
  SiRNA target sequence
ccgcaattaataaaaaacagt

SEQ ID NO: 160578 - DNA, 21 bp, Artificial sequence
  SiRNA target sequence
cgcaattaataaaaaacagta

SEQ ID NO: 160579 - DNA, 21 bp, Artificial sequence
  SiRNA target sequence
gcaattaataaaaaacagtat

SEQ ID NO: 160580 - DNA, 21 bp, Artificial sequence
  SiRNA target sequence
caattaataaaaaacagtatt

SEQ ID NO: 160581 - DNA, 21 bp, Artificial sequence
  SiRNA target sequence
aattaataaaaaacagtatta

SEQ ID NO: 160582 - DNA, 21 bp, Artificial sequence
  SiRNA target sequence
attaataaaaaacagtattac

SEQ ID NO: 160583 - DNA, 21 bp, Artificial sequence
  SiRNA target sequence
ttaataaaaaacagtattact

SEQ ID NO: 160584 - DNA, 21 bp, Artificial sequence
  SiRNA target sequence
taataaaaaacagtattacta

SEQ ID NO: 160585 - DNA, 21 bp, Artificial sequence
  SiRNA target sequence
aataaaaaacagtattactaa

SEQ ID NO: 160586 - DNA, 21 bp, Artificial sequence
  SiRNA target sequence
ataaaaaacagtattactaaa

SEQ ID NO: 160587 - DNA, 21 bp, Artificial sequence
  SiRNA target sequence
taaaaaacagtattactaaag

SEQ ID NO: 160588 - DNA, 21 bp, Artificial sequence
  SiRNA target sequence
aaaaaacagtattactaaaga

SEQ ID NO: 160589 - DNA, 21 bp, Artificial sequence
  SiRNA target sequence
aaaaacagtattactaaagat

SEQ ID NO: 160590 - DNA, 21 bp, Artificial sequence
  SiRNA target sequence
aaaacagtattactaaagata

SEQ ID NO: 160591 - DNA, 21 bp, Artificial sequence
  SiRNA target sequence
aaacagtattactaaagatac

SEQ ID NO: 160592 - DNA, 21 bp, Artificial sequence
  SiRNA target sequence
aacagtattactaaagatacc

SEQ ID NO: 160593 - DNA, 21 bp, Artificial sequence
  SiRNA target sequence
acagtattactaaagataccg

SEQ ID NO: 160594 - DNA, 21 bp, Artificial sequence
  SiRNA target sequence
cagtattactaaagataccgc

SEQ ID NO: 160595 - DNA, 21 bp, Artificial sequence
  SiRNA target sequence
agtattactaaagataccgct

SEQ ID NO: 160596 - DNA, 21 bp, Artificial sequence
  SiRNA target sequence
gtattactaaagataccgctt

SEQ ID NO: 160597 - DNA, 21 bp, Artificial sequence
  SiRNA target sequence
tattactaaagataccgcttt

SEQ ID NO: 160598 - DNA, 21 bp, Artificial sequence
  SiRNA target sequence
attactaaagataccgctttg

SEQ ID NO: 160599 - DNA, 21 bp, Artificial sequence
  SiRNA target sequence
ttactaaagataccgctttgg

SEQ ID NO: 160600 - DNA, 21 bp, Artificial sequence
  SiRNA target sequence
tactaaagataccgctttggt

SEQ ID NO: 160601 - DNA, 21 bp, Artificial sequence
  SiRNA target sequence
actaaagataccgctttggtg

SEQ ID NO: 160602 - DNA, 21 bp, Artificial sequence
  SiRNA target sequence
ctaaagataccgctttggtgt

SEQ ID NO: 160603 - DNA, 21 bp, Artificial sequence
  SiRNA target sequence
taaagataccgctttggtgtc

SEQ ID NO: 160604 - DNA, 21 bp, Artificial sequence
  SiRNA target sequence
aaagataccgctttggtgtct

SEQ ID NO: 160605 - DNA, 21 bp, Artificial sequence
  SiRNA target sequence
aagataccgctttggtgtctg

SEQ ID NO: 160606 - DNA, 21 bp, Artificial sequence
  SiRNA target sequence
agataccgctttggtgtctgt

SEQ ID NO: 160607 - DNA, 21 bp, Artificial sequence
  SiRNA target sequence
gataccgctttggtgtctgtt

SEQ ID NO: 160608 - DNA, 21 bp, Artificial sequence
  SiRNA target sequence
ataccgctttggtgtctgtta

SEQ ID NO: 160609 - DNA, 21 bp, Artificial sequence
  SiRNA target sequence
taccgctttggtgtctgttat

SEQ ID NO: 160610 - DNA, 21 bp, Artificial sequence
  SiRNA target sequence
accgctttggtgtctgttatg

SEQ ID NO: 160611 - DNA, 21 bp, Artificial sequence
  SiRNA target sequence
ccgctttggtgtctgttatgg

SEQ ID NO: 160612 - DNA, 21 bp, Artificial sequence
  SiRNA target sequence
cgctttggtgtctgttatggc

SEQ ID NO: 160613 - DNA, 21 bp, Artificial sequence
  SiRNA target sequence
gctttggtgtctgttatggct

SEQ ID NO: 160614 - DNA, 21 bp, Artificial sequence
  SiRNA target sequence
ctttggtgtctgttatggctg

SEQ ID NO: 160615 - DNA, 21 bp, Artificial sequence
  SiRNA target sequence
tttggtgtctgttatggctgt

SEQ ID NO: 160616 - DNA, 21 bp, Artificial sequence
  SiRNA target sequence
ttggtgtctgttatggctgtt

SEQ ID NO: 160617 - DNA, 21 bp, Artificial sequence
  SiRNA target sequence
tggtgtctgttatggctgtta

SEQ ID NO: 160618 - DNA, 21 bp, Artificial sequence
  SiRNA target sequence
ggtgtctgttatggctgttaa

SEQ ID NO: 160619 - DNA, 21 bp, Artificial sequence
  SiRNA target sequence
gtgtctgttatggctgttaac

SEQ ID NO: 160620 - DNA, 21 bp, Artificial sequence
  SiRNA target sequence
tgtctgttatggctgttaaca

SEQ ID NO: 160621 - DNA, 21 bp, Artificial sequence
  SiRNA target sequence
gtctgttatggctgttaacaa

SEQ ID NO: 160622 - DNA, 21 bp, Artificial sequence
  SiRNA target sequence
tctgttatggctgttaacaac

SEQ ID NO: 160623 - DNA, 21 bp, Artificial sequence
  SiRNA target sequence
ctgttatggctgttaacaacg

SEQ ID NO: 160624 - DNA, 21 bp, Artificial sequence
  SiRNA target sequence
tgttatggctgttaacaacga

SEQ ID NO: 160625 - DNA, 21 bp, Artificial sequence
  SiRNA target sequence
gttatggctgttaacaacgaa

SEQ ID NO: 160626 - DNA, 21 bp, Artificial sequence
  SiRNA target sequence
ttatggctgttaacaacgaaa

SEQ ID NO: 160627 - DNA, 21 bp, Artificial sequence
  SiRNA target sequence
tatggctgttaacaacgaaat

SEQ ID NO: 160628 - DNA, 21 bp, Artificial sequence
  SiRNA target sequence
atggctgttaacaacgaaatg

SEQ ID NO: 160629 - DNA, 21 bp, Artificial sequence
  SiRNA target sequence
tggctgttaacaacgaaatgg

SEQ ID NO: 160630 - DNA, 21 bp, Artificial sequence
  SiRNA target sequence
ggctgttaacaacgaaatggg

SEQ ID NO: 160631 - DNA, 21 bp, Artificial sequence
  SiRNA target sequence
gctgttaacaacgaaatggga

SEQ ID NO: 160632 - DNA, 21 bp, Artificial sequence
  SiRNA target sequence
ctgttaacaacgaaatgggag

SEQ ID NO: 160633 - DNA, 21 bp, Artificial sequence
  SiRNA target sequence
tgttaacaacgaaatgggagc

SEQ ID NO: 160634 - DNA, 21 bp, Artificial sequence
  SiRNA target sequence
gttaacaacgaaatgggagca

SEQ ID NO: 160635 - DNA, 21 bp, Artificial sequence
  SiRNA target sequence
ttaacaacgaaatgggagcaa

SEQ ID NO: 160636 - DNA, 21 bp, Artificial sequence
  SiRNA target sequence
taacaacgaaatgggagcaat

SEQ ID NO: 160637 - DNA, 21 bp, Artificial sequence
  SiRNA target sequence
aacaacgaaatgggagcaata

SEQ ID NO: 160638 - DNA, 21 bp, Artificial sequence
  SiRNA target sequence
acaacgaaatgggagcaatac

SEQ ID NO: 160639 - DNA, 21 bp, Artificial sequence
  SiRNA target sequence
caacgaaatgggagcaataca

SEQ ID NO: 160640 - DNA, 21 bp, Artificial sequence
  SiRNA target sequence
aacgaaatgggagcaatacaa

SEQ ID NO: 160641 - DNA, 21 bp, Artificial sequence
  SiRNA target sequence
acgaaatgggagcaatacaac

SEQ ID NO: 160642 - DNA, 21 bp, Artificial sequence
  SiRNA target sequence
cgaaatgggagcaatacaacc

SEQ ID NO: 160643 - DNA, 21 bp, Artificial sequence
  SiRNA target sequence
gaaatgggagcaatacaaccg

SEQ ID NO: 160644 - DNA, 21 bp, Artificial sequence
  SiRNA target sequence
aaatgggagcaatacaaccgc

SEQ ID NO: 160645 - DNA, 21 bp, Artificial sequence
  SiRNA target sequence
aatgggagcaatacaaccgct

SEQ ID NO: 160646 - DNA, 21 bp, Artificial sequence
  SiRNA target sequence
atgggagcaatacaaccgctt

SEQ ID NO: 160647 - DNA, 21 bp, Artificial sequence
  SiRNA target sequence
tgggagcaatacaaccgctta

SEQ ID NO: 160648 - DNA, 21 bp, Artificial sequence
  SiRNA target sequence
gggagcaatacaaccgcttaa

SEQ ID NO: 160649 - DNA, 21 bp, Artificial sequence
  SiRNA target sequence
ggagcaatacaaccgcttaaa

SEQ ID NO: 160650 - DNA, 21 bp, Artificial sequence
  SiRNA target sequence
gagcaatacaaccgcttaaag

SEQ ID NO: 160651 - DNA, 21 bp, Artificial sequence
  SiRNA target sequence
agcaatacaaccgcttaaaga

SEQ ID NO: 160652 - DNA, 21 bp, Artificial sequence
  SiRNA target sequence
gcaatacaaccgcttaaagaa

SEQ ID NO: 160653 - DNA, 21 bp, Artificial sequence
  SiRNA target sequence
caatacaaccgcttaaagaaa

SEQ ID NO: 160654 - DNA, 21 bp, Artificial sequence
  SiRNA target sequence
aatacaaccgcttaaagaaat

SEQ ID NO: 160655 - DNA, 21 bp, Artificial sequence
  SiRNA target sequence
atacaaccgcttaaagaaata

SEQ ID NO: 160656 - DNA, 21 bp, Artificial sequence
  SiRNA target sequence
tacaaccgcttaaagaaatag

SEQ ID NO: 160657 - DNA, 21 bp, Artificial sequence
  SiRNA target sequence
acaaccgcttaaagaaatagg

SEQ ID NO: 160658 - DNA, 21 bp, Artificial sequence
  SiRNA target sequence
caaccgcttaaagaaatagga

SEQ ID NO: 160659 - DNA, 21 bp, Artificial sequence
  SiRNA target sequence
aaccgcttaaagaaataggaa

SEQ ID NO: 160660 - DNA, 21 bp, Artificial sequence
  SiRNA target sequence
accgcttaaagaaataggaag

SEQ ID NO: 160661 - DNA, 21 bp, Artificial sequence
  SiRNA target sequence
ccgcttaaagaaataggaaga

SEQ ID NO: 160662 - DNA, 21 bp, Artificial sequence
  SiRNA target sequence
cgcttaaagaaataggaagaa

SEQ ID NO: 160663 - DNA, 21 bp, Artificial sequence
  SiRNA target sequence
gcttaaagaaataggaagaat

SEQ ID NO: 160664 - DNA, 21 bp, Artificial sequence
  SiRNA target sequence
cttaaagaaataggaagaata

SEQ ID NO: 160665 - DNA, 21 bp, Artificial sequence
  SiRNA target sequence
ttaaagaaataggaagaatat

SEQ ID NO: 160666 - DNA, 21 bp, Artificial sequence
  SiRNA target sequence
taaagaaataggaagaatatg

SEQ ID NO: 160667 - DNA, 21 bp, Artificial sequence
  SiRNA target sequence
aaagaaataggaagaatatgt

SEQ ID NO: 160668 - DNA, 21 bp, Artificial sequence
  SiRNA target sequence
aagaaataggaagaatatgta

SEQ ID NO: 160669 - DNA, 21 bp, Artificial sequence
  SiRNA target sequence
agaaataggaagaatatgtaa

SEQ ID NO: 160670 - DNA, 21 bp, Artificial sequence
  SiRNA target sequence
gaaataggaagaatatgtaaa

SEQ ID NO: 160671 - DNA, 21 bp, Artificial sequence
  SiRNA target sequence
aaataggaagaatatgtaaag

SEQ ID NO: 160672 - DNA, 21 bp, Artificial sequence
  SiRNA target sequence
aataggaagaatatgtaaaga

SEQ ID NO: 160673 - DNA, 21 bp, Artificial sequence
  SiRNA target sequence
ataggaagaatatgtaaagaa

SEQ ID NO: 160674 - DNA, 21 bp, Artificial sequence
  SiRNA target sequence
taggaagaatatgtaaagaaa

SEQ ID NO: 160675 - DNA, 21 bp, Artificial sequence
  SiRNA target sequence
aggaagaatatgtaaagaaaa

SEQ ID NO: 160676 - DNA, 21 bp, Artificial sequence
  SiRNA target sequence
ggaagaatatgtaaagaaaat

SEQ ID NO: 160677 - DNA, 21 bp, Artificial sequence
  SiRNA target sequence
gaagaatatgtaaagaaaata

SEQ ID NO: 160678 - DNA, 21 bp, Artificial sequence
  SiRNA target sequence
aagaatatgtaaagaaaataa

SEQ ID NO: 160679 - DNA, 21 bp, Artificial sequence
  SiRNA target sequence
agaatatgtaaagaaaataat

SEQ ID NO: 160680 - DNA, 21 bp, Artificial sequence
  SiRNA target sequence
gaatatgtaaagaaaataata

SEQ ID NO: 160681 - DNA, 21 bp, Artificial sequence
  SiRNA target sequence
aatatgtaaagaaaataatat

SEQ ID NO: 160682 - DNA, 21 bp, Artificial sequence
  SiRNA target sequence
atatgtaaagaaaataatatt

SEQ ID NO: 160683 - DNA, 21 bp, Artificial sequence
  SiRNA target sequence
tatgtaaagaaaataatattt

SEQ ID NO: 160684 - DNA, 21 bp, Artificial sequence
  SiRNA target sequence
atgtaaagaaaataatatttt

SEQ ID NO: 160685 - DNA, 21 bp, Artificial sequence
  SiRNA target sequence
tgtaaagaaaataatatttta

SEQ ID NO: 160686 - DNA, 21 bp, Artificial sequence
  SiRNA target sequence
gtaaagaaaataatattttat

SEQ ID NO: 160687 - DNA, 21 bp, Artificial sequence
  SiRNA target sequence
taaagaaaataatattttatt

SEQ ID NO: 160688 - DNA, 21 bp, Artificial sequence
  SiRNA target sequence
aaagaaaataatattttattt

SEQ ID NO: 160689 - DNA, 21 bp, Artificial sequence
  SiRNA target sequence
aagaaaataatattttatttc

SEQ ID NO: 160690 - DNA, 21 bp, Artificial sequence
  SiRNA target sequence
agaaaataatattttatttca

SEQ ID NO: 160691 - DNA, 21 bp, Artificial sequence
  SiRNA target sequence
gaaaataatattttatttcac

SEQ ID NO: 160692 - DNA, 21 bp, Artificial sequence
  SiRNA target sequence
aaaataatattttatttcaca

SEQ ID NO: 160693 - DNA, 21 bp, Artificial sequence
  SiRNA target sequence
aaataatattttatttcacac

SEQ ID NO: 160694 - DNA, 21 bp, Artificial sequence
  SiRNA target sequence
aataatattttatttcacact

SEQ ID NO: 160695 - DNA, 21 bp, Artificial sequence
  SiRNA target sequence
ataatattttatttcacactg

SEQ ID NO: 160696 - DNA, 21 bp, Artificial sequence
  SiRNA target sequence
taatattttatttcacactga

SEQ ID NO: 160697 - DNA, 21 bp, Artificial sequence
  SiRNA target sequence
aatattttatttcacactgat

SEQ ID NO: 160698 - DNA, 21 bp, Artificial sequence
  SiRNA target sequence
atattttatttcacactgatg

SEQ ID NO: 160699 - DNA, 21 bp, Artificial sequence
  SiRNA target sequence
tattttatttcacactgatgc

SEQ ID NO: 160700 - DNA, 21 bp, Artificial sequence
  SiRNA target sequence
attttatttcacactgatgca

SEQ ID NO: 160701 - DNA, 21 bp, Artificial sequence
  SiRNA target sequence
ttttatttcacactgatgcag

SEQ ID NO: 160702 - DNA, 21 bp, Artificial sequence
  SiRNA target sequence
tttatttcacactgatgcagc

SEQ ID NO: 160703 - DNA, 21 bp, Artificial sequence
  SiRNA target sequence
ttatttcacactgatgcagca

SEQ ID NO: 160704 - DNA, 21 bp, Artificial sequence
  SiRNA target sequence
tatttcacactgatgcagcac

SEQ ID NO: 160705 - DNA, 21 bp, Artificial sequence
  SiRNA target sequence
atttcacactgatgcagcaca

SEQ ID NO: 160706 - DNA, 21 bp, Artificial sequence
  SiRNA target sequence
tttcacactgatgcagcacaa

SEQ ID NO: 160707 - DNA, 21 bp, Artificial sequence
  SiRNA target sequence
ttcacactgatgcagcacaag

SEQ ID NO: 160708 - DNA, 21 bp, Artificial sequence
  SiRNA target sequence
tcacactgatgcagcacaagc

SEQ ID NO: 160709 - DNA, 21 bp, Artificial sequence
  SiRNA target sequence
cacactgatgcagcacaagca

SEQ ID NO: 160710 - DNA, 21 bp, Artificial sequence
  SiRNA target sequence
acactgatgcagcacaagcag

SEQ ID NO: 160711 - DNA, 21 bp, Artificial sequence
  SiRNA target sequence
cactgatgcagcacaagcagt

SEQ ID NO: 160712 - DNA, 21 bp, Artificial sequence
  SiRNA target sequence
actgatgcagcacaagcagtt

SEQ ID NO: 160713 - DNA, 21 bp, Artificial sequence
  SiRNA target sequence
ctgatgcagcacaagcagttg

SEQ ID NO: 160714 - DNA, 21 bp, Artificial sequence
  SiRNA target sequence
tgatgcagcacaagcagttgg

SEQ ID NO: 160715 - DNA, 21 bp, Artificial sequence
  SiRNA target sequence
gatgcagcacaagcagttggt

SEQ ID NO: 160716 - DNA, 21 bp, Artificial sequence
  SiRNA target sequence
atgcagcacaagcagttggta

SEQ ID NO: 160717 - DNA, 21 bp, Artificial sequence
  SiRNA target sequence
tgcagcacaagcagttggtaa

SEQ ID NO: 160718 - DNA, 21 bp, Artificial sequence
  SiRNA target sequence
gcagcacaagcagttggtaat

SEQ ID NO: 160719 - DNA, 21 bp, Artificial sequence
  SiRNA target sequence
cagcacaagcagttggtaata

SEQ ID NO: 160720 - DNA, 21 bp, Artificial sequence
  SiRNA target sequence
agcacaagcagttggtaatat

SEQ ID NO: 160721 - DNA, 21 bp, Artificial sequence
  SiRNA target sequence
gcacaagcagttggtaatata

SEQ ID NO: 160722 - DNA, 21 bp, Artificial sequence
  SiRNA target sequence
cacaagcagttggtaatatag

SEQ ID NO: 160723 - DNA, 21 bp, Artificial sequence
  SiRNA target sequence
acaagcagttggtaatataga

SEQ ID NO: 160724 - DNA, 21 bp, Artificial sequence
  SiRNA target sequence
caagcagttggtaatatagat

SEQ ID NO: 160725 - DNA, 21 bp, Artificial sequence
  SiRNA target sequence
aagcagttggtaatatagata

SEQ ID NO: 160726 - DNA, 21 bp, Artificial sequence
  SiRNA target sequence
agcagttggtaatatagatat

SEQ ID NO: 160727 - DNA, 21 bp, Artificial sequence
  SiRNA target sequence
gcagttggtaatatagatatt

SEQ ID NO: 160728 - DNA, 21 bp, Artificial sequence
  SiRNA target sequence
cagttggtaatatagatattg

SEQ ID NO: 160729 - DNA, 21 bp, Artificial sequence
  SiRNA target sequence
agttggtaatatagatattga

SEQ ID NO: 160730 - DNA, 21 bp, Artificial sequence
  SiRNA target sequence
gttggtaatatagatattgat

SEQ ID NO: 160731 - DNA, 21 bp, Artificial sequence
  SiRNA target sequence
ttggtaatatagatattgatg

SEQ ID NO: 160732 - DNA, 21 bp, Artificial sequence
  SiRNA target sequence
tggtaatatagatattgatgt

SEQ ID NO: 160733 - DNA, 21 bp, Artificial sequence
  SiRNA target sequence
ggtaatatagatattgatgtc

SEQ ID NO: 160734 - DNA, 21 bp, Artificial sequence
  SiRNA target sequence
gtaatatagatattgatgtca

SEQ ID NO: 160735 - DNA, 21 bp, Artificial sequence
  SiRNA target sequence
taatatagatattgatgtcaa

SEQ ID NO: 160736 - DNA, 21 bp, Artificial sequence
  SiRNA target sequence
aatatagatattgatgtcaat

SEQ ID NO: 160737 - DNA, 21 bp, Artificial sequence
  SiRNA target sequence
atatagatattgatgtcaatg

SEQ ID NO: 160738 - DNA, 21 bp, Artificial sequence
  SiRNA target sequence
tatagatattgatgtcaatga

SEQ ID NO: 160739 - DNA, 21 bp, Artificial sequence
  SiRNA target sequence
atagatattgatgtcaatgat

SEQ ID NO: 160740 - DNA, 21 bp, Artificial sequence
  SiRNA target sequence
tagatattgatgtcaatgata

SEQ ID NO: 160741 - DNA, 21 bp, Artificial sequence
  SiRNA target sequence
agatattgatgtcaatgatat

SEQ ID NO: 160742 - DNA, 21 bp, Artificial sequence
  SiRNA target sequence
gatattgatgtcaatgatatg

SEQ ID NO: 160743 - DNA, 21 bp, Artificial sequence
  SiRNA target sequence
atattgatgtcaatgatatga

SEQ ID NO: 160744 - DNA, 21 bp, Artificial sequence
  SiRNA target sequence
tattgatgtcaatgatatgaa

SEQ ID NO: 160745 - DNA, 21 bp, Artificial sequence
  SiRNA target sequence
attgatgtcaatgatatgaat

SEQ ID NO: 160746 - DNA, 21 bp, Artificial sequence
  SiRNA target sequence
ttgatgtcaatgatatgaata

SEQ ID NO: 160747 - DNA, 21 bp, Artificial sequence
  SiRNA target sequence
tgatgtcaatgatatgaatat

SEQ ID NO: 160748 - DNA, 21 bp, Artificial sequence
  SiRNA target sequence
gatgtcaatgatatgaatatt

SEQ ID NO: 160749 - DNA, 21 bp, Artificial sequence
  SiRNA target sequence
atgtcaatgatatgaatattg

SEQ ID NO: 160750 - DNA, 21 bp, Artificial sequence
  SiRNA target sequence
tgtcaatgatatgaatattga

SEQ ID NO: 160751 - DNA, 21 bp, Artificial sequence
  SiRNA target sequence
gtcaatgatatgaatattgat

SEQ ID NO: 160752 - DNA, 21 bp, Artificial sequence
  SiRNA target sequence
tcaatgatatgaatattgatt

SEQ ID NO: 160753 - DNA, 21 bp, Artificial sequence
  SiRNA target sequence
caatgatatgaatattgattt

SEQ ID NO: 160754 - DNA, 21 bp, Artificial sequence
  SiRNA target sequence
aatgatatgaatattgattta

SEQ ID NO: 160755 - DNA, 21 bp, Artificial sequence
  SiRNA target sequence
atgatatgaatattgatttac

SEQ ID NO: 160756 - DNA, 21 bp, Artificial sequence
  SiRNA target sequence
tgatatgaatattgatttact

SEQ ID NO: 160757 - DNA, 21 bp, Artificial sequence
  SiRNA target sequence
gatatgaatattgatttacta

SEQ ID NO: 160758 - DNA, 21 bp, Artificial sequence
  SiRNA target sequence
atatgaatattgatttactaa

SEQ ID NO: 160759 - DNA, 21 bp, Artificial sequence
  SiRNA target sequence
tatgaatattgatttactaag

SEQ ID NO: 160760 - DNA, 21 bp, Artificial sequence
  SiRNA target sequence
atgaatattgatttactaagt

SEQ ID NO: 160761 - DNA, 21 bp, Artificial sequence
  SiRNA target sequence
tgaatattgatttactaagtt

SEQ ID NO: 160762 - DNA, 21 bp, Artificial sequence
  SiRNA target sequence
gaatattgatttactaagttt

SEQ ID NO: 160763 - DNA, 21 bp, Artificial sequence
  SiRNA target sequence
aatattgatttactaagttta

SEQ ID NO: 160764 - DNA, 21 bp, Artificial sequence
  SiRNA target sequence
atattgatttactaagtttat

SEQ ID NO: 160765 - DNA, 21 bp, Artificial sequence
  SiRNA target sequence
tattgatttactaagtttatc

SEQ ID NO: 160766 - DNA, 21 bp, Artificial sequence
  SiRNA target sequence
attgatttactaagtttatca

SEQ ID NO: 160767 - DNA, 21 bp, Artificial sequence
  SiRNA target sequence
ttgatttactaagtttatcaa

SEQ ID NO: 160768 - DNA, 21 bp, Artificial sequence
  SiRNA target sequence
tgatttactaagtttatcaag

SEQ ID NO: 160769 - DNA, 21 bp, Artificial sequence
  SiRNA target sequence
gatttactaagtttatcaagt

SEQ ID NO: 160770 - DNA, 21 bp, Artificial sequence
  SiRNA target sequence
atttactaagtttatcaagtc

SEQ ID NO: 160771 - DNA, 21 bp, Artificial sequence
  SiRNA target sequence
tttactaagtttatcaagtca

SEQ ID NO: 160772 - DNA, 21 bp, Artificial sequence
  SiRNA target sequence
ttactaagtttatcaagtcat

SEQ ID NO: 160773 - DNA, 21 bp, Artificial sequence
  SiRNA target sequence
tactaagtttatcaagtcata

SEQ ID NO: 160774 - DNA, 21 bp, Artificial sequence
  SiRNA target sequence
actaagtttatcaagtcataa

SEQ ID NO: 160775 - DNA, 21 bp, Artificial sequence
  SiRNA target sequence
ctaagtttatcaagtcataaa

SEQ ID NO: 160776 - DNA, 21 bp, Artificial sequence
  SiRNA target sequence
taagtttatcaagtcataaaa

SEQ ID NO: 160777 - DNA, 21 bp, Artificial sequence
  SiRNA target sequence
aagtttatcaagtcataaaat

SEQ ID NO: 160778 - DNA, 21 bp, Artificial sequence
  SiRNA target sequence
agtttatcaagtcataaaatt

SEQ ID NO: 160779 - DNA, 21 bp, Artificial sequence
  SiRNA target sequence
gtttatcaagtcataaaattt

SEQ ID NO: 160780 - DNA, 21 bp, Artificial sequence
  SiRNA target sequence
tttatcaagtcataaaattta

SEQ ID NO: 160781 - DNA, 21 bp, Artificial sequence
  SiRNA target sequence
ttatcaagtcataaaatttat

SEQ ID NO: 160782 - DNA, 21 bp, Artificial sequence
  SiRNA target sequence
tatcaagtcataaaatttatg

SEQ ID NO: 160783 - DNA, 21 bp, Artificial sequence
  SiRNA target sequence
atcaagtcataaaatttatgg

SEQ ID NO: 160784 - DNA, 21 bp, Artificial sequence
  SiRNA target sequence
tcaagtcataaaatttatggt

SEQ ID NO: 160785 - DNA, 21 bp, Artificial sequence
  SiRNA target sequence
caagtcataaaatttatggtc

SEQ ID NO: 160786 - DNA, 21 bp, Artificial sequence
  SiRNA target sequence
aagtcataaaatttatggtcc

SEQ ID NO: 160787 - DNA, 21 bp, Artificial sequence
  SiRNA target sequence
agtcataaaatttatggtcca

SEQ ID NO: 160788 - DNA, 21 bp, Artificial sequence
  SiRNA target sequence
gtcataaaatttatggtccaa

SEQ ID NO: 160789 - DNA, 21 bp, Artificial sequence
  SiRNA target sequence
tcataaaatttatggtccaaa

SEQ ID NO: 160790 - DNA, 21 bp, Artificial sequence
  SiRNA target sequence
cataaaatttatggtccaaaa

SEQ ID NO: 160791 - DNA, 21 bp, Artificial sequence
  SiRNA target sequence
ataaaatttatggtccaaaag

SEQ ID NO: 160792 - DNA, 21 bp, Artificial sequence
  SiRNA target sequence
taaaatttatggtccaaaagg

SEQ ID NO: 160793 - DNA, 21 bp, Artificial sequence
  SiRNA target sequence
aaaatttatggtccaaaaggt

SEQ ID NO: 160794 - DNA, 21 bp, Artificial sequence
  SiRNA target sequence
aaatttatggtccaaaaggtg

SEQ ID NO: 160795 - DNA, 21 bp, Artificial sequence
  SiRNA target sequence
aatttatggtccaaaaggtgt

SEQ ID NO: 160796 - DNA, 21 bp, Artificial sequence
  SiRNA target sequence
atttatggtccaaaaggtgtt

SEQ ID NO: 160797 - DNA, 21 bp, Artificial sequence
  SiRNA target sequence
tttatggtccaaaaggtgttg

SEQ ID NO: 160798 - DNA, 21 bp, Artificial sequence
  SiRNA target sequence
ttatggtccaaaaggtgttgg

SEQ ID NO: 160799 - DNA, 21 bp, Artificial sequence
  SiRNA target sequence
tatggtccaaaaggtgttggt

SEQ ID NO: 160800 - DNA, 21 bp, Artificial sequence
  SiRNA target sequence
atggtccaaaaggtgttggtg

SEQ ID NO: 160801 - DNA, 21 bp, Artificial sequence
  SiRNA target sequence
tggtccaaaaggtgttggtgc

SEQ ID NO: 160802 - DNA, 21 bp, Artificial sequence
  SiRNA target sequence
ggtccaaaaggtgttggtgcc

SEQ ID NO: 160803 - DNA, 21 bp, Artificial sequence
  SiRNA target sequence
gtccaaaaggtgttggtgcct

SEQ ID NO: 160804 - DNA, 21 bp, Artificial sequence
  SiRNA target sequence
tccaaaaggtgttggtgcctt

SEQ ID NO: 160805 - DNA, 21 bp, Artificial sequence
  SiRNA target sequence
ccaaaaggtgttggtgcctta

SEQ ID NO: 160806 - DNA, 21 bp, Artificial sequence
  SiRNA target sequence
caaaaggtgttggtgccttat

SEQ ID NO: 160807 - DNA, 21 bp, Artificial sequence
  SiRNA target sequence
aaaaggtgttggtgccttata

SEQ ID NO: 160808 - DNA, 21 bp, Artificial sequence
  SiRNA target sequence
aaaggtgttggtgccttatac

SEQ ID NO: 160809 - DNA, 21 bp, Artificial sequence
  SiRNA target sequence
aaggtgttggtgccttatacg

SEQ ID NO: 160810 - DNA, 21 bp, Artificial sequence
  SiRNA target sequence
aggtgttggtgccttatacgt

SEQ ID NO: 160811 - DNA, 21 bp, Artificial sequence
  SiRNA target sequence
ggtgttggtgccttatacgtc

SEQ ID NO: 160812 - DNA, 21 bp, Artificial sequence
  SiRNA target sequence
gtgttggtgccttatacgtca

SEQ ID NO: 160813 - DNA, 21 bp, Artificial sequence
  SiRNA target sequence
tgttggtgccttatacgtcag

SEQ ID NO: 160814 - DNA, 21 bp, Artificial sequence
  SiRNA target sequence
gttggtgccttatacgtcaga

SEQ ID NO: 160815 - DNA, 21 bp, Artificial sequence
  SiRNA target sequence
ttggtgccttatacgtcagaa

SEQ ID NO: 160816 - DNA, 21 bp, Artificial sequence
  SiRNA target sequence
tggtgccttatacgtcagaag

SEQ ID NO: 160817 - DNA, 21 bp, Artificial sequence
  SiRNA target sequence
ggtgccttatacgtcagaaga

SEQ ID NO: 160818 - DNA, 21 bp, Artificial sequence
  SiRNA target sequence
gtgccttatacgtcagaagaa

SEQ ID NO: 160819 - DNA, 21 bp, Artificial sequence
  SiRNA target sequence
tgccttatacgtcagaagaag

SEQ ID NO: 160820 - DNA, 21 bp, Artificial sequence
  SiRNA target sequence
gccttatacgtcagaagaagg

SEQ ID NO: 160821 - DNA, 21 bp, Artificial sequence
  SiRNA target sequence
ccttatacgtcagaagaaggc

SEQ ID NO: 160822 - DNA, 21 bp, Artificial sequence
  SiRNA target sequence
cttatacgtcagaagaaggcc

SEQ ID NO: 160823 - DNA, 21 bp, Artificial sequence
  SiRNA target sequence
ttatacgtcagaagaaggcct

SEQ ID NO: 160824 - DNA, 21 bp, Artificial sequence
  SiRNA target sequence
tatacgtcagaagaaggccta

SEQ ID NO: 160825 - DNA, 21 bp, Artificial sequence
  SiRNA target sequence
atacgtcagaagaaggcctag

SEQ ID NO: 160826 - DNA, 21 bp, Artificial sequence
  SiRNA target sequence
tacgtcagaagaaggcctagg

SEQ ID NO: 160827 - DNA, 21 bp, Artificial sequence
  SiRNA target sequence
acgtcagaagaaggcctaggg

SEQ ID NO: 160828 - DNA, 21 bp, Artificial sequence
  SiRNA target sequence
cgtcagaagaaggcctagggt

SEQ ID NO: 160829 - DNA, 21 bp, Artificial sequence
  SiRNA target sequence
gtcagaagaaggcctagggtg

SEQ ID NO: 160830 - DNA, 21 bp, Artificial sequence
  SiRNA target sequence
tcagaagaaggcctagggtga

SEQ ID NO: 160831 - DNA, 21 bp, Artificial sequence
  SiRNA target sequence
cagaagaaggcctagggtgag

SEQ ID NO: 160832 - DNA, 21 bp, Artificial sequence
  SiRNA target sequence
agaagaaggcctagggtgaga

SEQ ID NO: 160833 - DNA, 21 bp, Artificial sequence
  SiRNA target sequence
gaagaaggcctagggtgagaa

SEQ ID NO: 160834 - DNA, 21 bp, Artificial sequence
  SiRNA target sequence
aagaaggcctagggtgagaat

SEQ ID NO: 160835 - DNA, 21 bp, Artificial sequence
  SiRNA target sequence
agaaggcctagggtgagaatg

SEQ ID NO: 160836 - DNA, 21 bp, Artificial sequence
  SiRNA target sequence
gaaggcctagggtgagaatgt

SEQ ID NO: 160837 - DNA, 21 bp, Artificial sequence
  SiRNA target sequence
aaggcctagggtgagaatgtt

SEQ ID NO: 160838 - DNA, 21 bp, Artificial sequence
  SiRNA target sequence
aggcctagggtgagaatgtta

SEQ ID NO: 160839 - DNA, 21 bp, Artificial sequence
  SiRNA target sequence
ggcctagggtgagaatgttac

SEQ ID NO: 160840 - DNA, 21 bp, Artificial sequence
  SiRNA target sequence
gcctagggtgagaatgttacc

SEQ ID NO: 160841 - DNA, 21 bp, Artificial sequence
  SiRNA target sequence
cctagggtgagaatgttacca

SEQ ID NO: 160842 - DNA, 21 bp, Artificial sequence
  SiRNA target sequence
ctagggtgagaatgttaccac

SEQ ID NO: 160843 - DNA, 21 bp, Artificial sequence
  SiRNA target sequence
tagggtgagaatgttaccact

SEQ ID NO: 160844 - DNA, 21 bp, Artificial sequence
  SiRNA target sequence
agggtgagaatgttaccactt

SEQ ID NO: 160845 - DNA, 21 bp, Artificial sequence
  SiRNA target sequence
gggtgagaatgttaccacttt

SEQ ID NO: 160846 - DNA, 21 bp, Artificial sequence
  SiRNA target sequence
ggtgagaatgttaccactttt

SEQ ID NO: 160847 - DNA, 21 bp, Artificial sequence
  SiRNA target sequence
gtgagaatgttaccacttttt

SEQ ID NO: 160848 - DNA, 21 bp, Artificial sequence
  SiRNA target sequence
tgagaatgttaccacttttta

SEQ ID NO: 160849 - DNA, 21 bp, Artificial sequence
  SiRNA target sequence
gagaatgttaccactttttaa

SEQ ID NO: 160850 - DNA, 21 bp, Artificial sequence
  SiRNA target sequence
agaatgttaccactttttaat

SEQ ID NO: 160851 - DNA, 21 bp, Artificial sequence
  SiRNA target sequence
gaatgttaccactttttaatg

SEQ ID NO: 160852 - DNA, 21 bp, Artificial sequence
  SiRNA target sequence
aatgttaccactttttaatgg

SEQ ID NO: 160853 - DNA, 21 bp, Artificial sequence
  SiRNA target sequence
atgttaccactttttaatggt

SEQ ID NO: 160854 - DNA, 21 bp, Artificial sequence
  SiRNA target sequence
tgttaccactttttaatggtg

SEQ ID NO: 160855 - DNA, 21 bp, Artificial sequence
  SiRNA target sequence
gttaccactttttaatggtgg

SEQ ID NO: 160856 - DNA, 21 bp, Artificial sequence
  SiRNA target sequence
ttaccactttttaatggtggt

SEQ ID NO: 160857 - DNA, 21 bp, Artificial sequence
  SiRNA target sequence
taccactttttaatggtggtg

SEQ ID NO: 160858 - DNA, 21 bp, Artificial sequence
  SiRNA target sequence
accactttttaatggtggtgg

SEQ ID NO: 160859 - DNA, 21 bp, Artificial sequence
  SiRNA target sequence
ccactttttaatggtggtgga

SEQ ID NO: 160860 - DNA, 21 bp, Artificial sequence
  SiRNA target sequence
cactttttaatggtggtggac

SEQ ID NO: 160861 - DNA, 21 bp, Artificial sequence
  SiRNA target sequence
actttttaatggtggtggaca

SEQ ID NO: 160862 - DNA, 21 bp, Artificial sequence
  SiRNA target sequence
ctttttaatggtggtggacaa

SEQ ID NO: 160863 - DNA, 21 bp, Artificial sequence
  SiRNA target sequence
tttttaatggtggtggacaag

SEQ ID NO: 160864 - DNA, 21 bp, Artificial sequence
  SiRNA target sequence
ttttaatggtggtggacaaga

SEQ ID NO: 160865 - DNA, 21 bp, Artificial sequence
  SiRNA target sequence
tttaatggtggtggacaagaa

SEQ ID NO: 160866 - DNA, 21 bp, Artificial sequence
  SiRNA target sequence
ttaatggtggtggacaagaaa

SEQ ID NO: 160867 - DNA, 21 bp, Artificial sequence
  SiRNA target sequence
taatggtggtggacaagaaag

SEQ ID NO: 160868 - DNA, 21 bp, Artificial sequence
  SiRNA target sequence
aatggtggtggacaagaaaga

SEQ ID NO: 160869 - DNA, 21 bp, Artificial sequence
  SiRNA target sequence
atggtggtggacaagaaagag

SEQ ID NO: 160870 - DNA, 21 bp, Artificial sequence
  SiRNA target sequence
tggtggtggacaagaaagagg

SEQ ID NO: 160871 - DNA, 21 bp, Artificial sequence
  SiRNA target sequence
ggtggtggacaagaaagagga

SEQ ID NO: 160872 - DNA, 21 bp, Artificial sequence
  SiRNA target sequence
gtggtggacaagaaagaggat

SEQ ID NO: 160873 - DNA, 21 bp, Artificial sequence
  SiRNA target sequence
tggtggacaagaaagaggatt

SEQ ID NO: 160874 - DNA, 21 bp, Artificial sequence
  SiRNA target sequence
ggtggacaagaaagaggatta

SEQ ID NO: 160875 - DNA, 21 bp, Artificial sequence
  SiRNA target sequence
gtggacaagaaagaggattaa

SEQ ID NO: 160876 - DNA, 21 bp, Artificial sequence
  SiRNA target sequence
tggacaagaaagaggattaag

SEQ ID NO: 160877 - DNA, 21 bp, Artificial sequence
  SiRNA target sequence
ggacaagaaagaggattaaga

SEQ ID NO: 160878 - DNA, 21 bp, Artificial sequence
  SiRNA target sequence
gacaagaaagaggattaagaa

SEQ ID NO: 160879 - DNA, 21 bp, Artificial sequence
  SiRNA target sequence
acaagaaagaggattaagaag

SEQ ID NO: 160880 - DNA, 21 bp, Artificial sequence
  SiRNA target sequence
caagaaagaggattaagaagt

SEQ ID NO: 160881 - DNA, 21 bp, Artificial sequence
  SiRNA target sequence
aagaaagaggattaagaagtg

SEQ ID NO: 160882 - DNA, 21 bp, Artificial sequence
  SiRNA target sequence
agaaagaggattaagaagtgg

SEQ ID NO: 160883 - DNA, 21 bp, Artificial sequence
  SiRNA target sequence
gaaagaggattaagaagtggg

SEQ ID NO: 160884 - DNA, 21 bp, Artificial sequence
  SiRNA target sequence
aaagaggattaagaagtggga

SEQ ID NO: 160885 - DNA, 21 bp, Artificial sequence
  SiRNA target sequence
aagaggattaagaagtgggac

SEQ ID NO: 160886 - DNA, 21 bp, Artificial sequence
  SiRNA target sequence
agaggattaagaagtgggaca

SEQ ID NO: 160887 - DNA, 21 bp, Artificial sequence
  SiRNA target sequence
gaggattaagaagtgggacaa

SEQ ID NO: 160888 - DNA, 21 bp, Artificial sequence
  SiRNA target sequence
aggattaagaagtgggacaac

SEQ ID NO: 160889 - DNA, 21 bp, Artificial sequence
  SiRNA target sequence
ggattaagaagtgggacaact

SEQ ID NO: 160890 - DNA, 21 bp, Artificial sequence
  SiRNA target sequence
gattaagaagtgggacaactt

SEQ ID NO: 160891 - DNA, 21 bp, Artificial sequence
  SiRNA target sequence
attaagaagtgggacaacttc

SEQ ID NO: 160892 - DNA, 21 bp, Artificial sequence
  SiRNA target sequence
ttaagaagtgggacaacttct

SEQ ID NO: 160893 - DNA, 21 bp, Artificial sequence
  SiRNA target sequence
taagaagtgggacaacttctc

SEQ ID NO: 160894 - DNA, 21 bp, Artificial sequence
  SiRNA target sequence
aagaagtgggacaacttctcc

SEQ ID NO: 160895 - DNA, 21 bp, Artificial sequence
  SiRNA target sequence
agaagtgggacaacttctcca

SEQ ID NO: 160896 - DNA, 21 bp, Artificial sequence
  SiRNA target sequence
gaagtgggacaacttctccac

SEQ ID NO: 160897 - DNA, 21 bp, Artificial sequence
  SiRNA target sequence
aagtgggacaacttctccacc

SEQ ID NO: 160898 - DNA, 21 bp, Artificial sequence
  SiRNA target sequence
agtgggacaacttctccacct

SEQ ID NO: 160899 - DNA, 21 bp, Artificial sequence
  SiRNA target sequence
gtgggacaacttctccacctt

SEQ ID NO: 160900 - DNA, 21 bp, Artificial sequence
  SiRNA target sequence
tgggacaacttctccaccttt

SEQ ID NO: 160901 - DNA, 21 bp, Artificial sequence
  SiRNA target sequence
gggacaacttctccaccttta

SEQ ID NO: 160902 - DNA, 21 bp, Artificial sequence
  SiRNA target sequence
ggacaacttctccacctttag

SEQ ID NO: 160903 - DNA, 21 bp, Artificial sequence
  SiRNA target sequence
gacaacttctccacctttagt

SEQ ID NO: 160904 - DNA, 21 bp, Artificial sequence
  SiRNA target sequence
acaacttctccacctttagtt

SEQ ID NO: 160905 - DNA, 21 bp, Artificial sequence
  SiRNA target sequence
caacttctccacctttagttg

SEQ ID NO: 160906 - DNA, 21 bp, Artificial sequence
  SiRNA target sequence
aacttctccacctttagttgt

SEQ ID NO: 160907 - DNA, 21 bp, Artificial sequence
  SiRNA target sequence
acttctccacctttagttgtt

SEQ ID NO: 160908 - DNA, 21 bp, Artificial sequence
  SiRNA target sequence
cttctccacctttagttgttg

SEQ ID NO: 160909 - DNA, 21 bp, Artificial sequence
  SiRNA target sequence
ttctccacctttagttgttgg

SEQ ID NO: 160910 - DNA, 21 bp, Artificial sequence
  SiRNA target sequence
tctccacctttagttgttgga

SEQ ID NO: 160911 - DNA, 21 bp, Artificial sequence
  SiRNA target sequence
ctccacctttagttgttggat

SEQ ID NO: 160912 - DNA, 21 bp, Artificial sequence
  SiRNA target sequence
tccacctttagttgttggatt

SEQ ID NO: 160913 - DNA, 21 bp, Artificial sequence
  SiRNA target sequence
ccacctttagttgttggatta

SEQ ID NO: 160914 - DNA, 21 bp, Artificial sequence
  SiRNA target sequence
cacctttagttgttggattag

SEQ ID NO: 160915 - DNA, 21 bp, Artificial sequence
  SiRNA target sequence
acctttagttgttggattagg

SEQ ID NO: 160916 - DNA, 21 bp, Artificial sequence
  SiRNA target sequence
cctttagttgttggattaggc

SEQ ID NO: 160917 - DNA, 21 bp, Artificial sequence
  SiRNA target sequence
ctttagttgttggattaggca

SEQ ID NO: 160918 - DNA, 21 bp, Artificial sequence
  SiRNA target sequence
tttagttgttggattaggcaa

SEQ ID NO: 160919 - DNA, 21 bp, Artificial sequence
  SiRNA target sequence
ttagttgttggattaggcaaa

SEQ ID NO: 160920 - DNA, 21 bp, Artificial sequence
  SiRNA target sequence
tagttgttggattaggcaaag

SEQ ID NO: 160921 - DNA, 21 bp, Artificial sequence
  SiRNA target sequence
agttgttggattaggcaaagc

SEQ ID NO: 160922 - DNA, 21 bp, Artificial sequence
  SiRNA target sequence
gttgttggattaggcaaagct

SEQ ID NO: 160923 - DNA, 21 bp, Artificial sequence
  SiRNA target sequence
ttgttggattaggcaaagctg

SEQ ID NO: 160924 - DNA, 21 bp, Artificial sequence
  SiRNA target sequence
tgttggattaggcaaagctgc

SEQ ID NO: 160925 - DNA, 21 bp, Artificial sequence
  SiRNA target sequence
gttggattaggcaaagctgct

SEQ ID NO: 160926 - DNA, 21 bp, Artificial sequence
  SiRNA target sequence
ttggattaggcaaagctgctg

SEQ ID NO: 160927 - DNA, 21 bp, Artificial sequence
  SiRNA target sequence
tggattaggcaaagctgctga

SEQ ID NO: 160928 - DNA, 21 bp, Artificial sequence
  SiRNA target sequence
ggattaggcaaagctgctgag

SEQ ID NO: 160929 - DNA, 21 bp, Artificial sequence
  SiRNA target sequence
gattaggcaaagctgctgaga

SEQ ID NO: 160930 - DNA, 21 bp, Artificial sequence
  SiRNA target sequence
attaggcaaagctgctgagat

SEQ ID NO: 160931 - DNA, 21 bp, Artificial sequence
  SiRNA target sequence
ttaggcaaagctgctgagata

SEQ ID NO: 160932 - DNA, 21 bp, Artificial sequence
  SiRNA target sequence
taggcaaagctgctgagatat

SEQ ID NO: 160933 - DNA, 21 bp, Artificial sequence
  SiRNA target sequence
aggcaaagctgctgagatatg

SEQ ID NO: 160934 - DNA, 21 bp, Artificial sequence
  SiRNA target sequence
ggcaaagctgctgagatatgc

SEQ ID NO: 160935 - DNA, 21 bp, Artificial sequence
  SiRNA target sequence
gcaaagctgctgagatatgct

SEQ ID NO: 160936 - DNA, 21 bp, Artificial sequence
  SiRNA target sequence
caaagctgctgagatatgctc

SEQ ID NO: 160937 - DNA, 21 bp, Artificial sequence
  SiRNA target sequence
aaagctgctgagatatgctct

SEQ ID NO: 160938 - DNA, 21 bp, Artificial sequence
  SiRNA target sequence
aagctgctgagatatgctctc

SEQ ID NO: 160939 - DNA, 21 bp, Artificial sequence
  SiRNA target sequence
agctgctgagatatgctctca

SEQ ID NO: 160940 - DNA, 21 bp, Artificial sequence
  SiRNA target sequence
gctgctgagatatgctctcag

SEQ ID NO: 160941 - DNA, 21 bp, Artificial sequence
  SiRNA target sequence
ctgctgagatatgctctcagg

SEQ ID NO: 160942 - DNA, 21 bp, Artificial sequence
  SiRNA target sequence
tgctgagatatgctctcagga

SEQ ID NO: 160943 - DNA, 21 bp, Artificial sequence
  SiRNA target sequence
gctgagatatgctctcaggag

SEQ ID NO: 160944 - DNA, 21 bp, Artificial sequence
  SiRNA target sequence
ctgagatatgctctcaggaga

SEQ ID NO: 160945 - DNA, 21 bp, Artificial sequence
  SiRNA target sequence
tgagatatgctctcaggagat

SEQ ID NO: 160946 - DNA, 21 bp, Artificial sequence
  SiRNA target sequence
gagatatgctctcaggagatg

SEQ ID NO: 160947 - DNA, 21 bp, Artificial sequence
  SiRNA target sequence
agatatgctctcaggagatgc

SEQ ID NO: 160948 - DNA, 21 bp, Artificial sequence
  SiRNA target sequence
gatatgctctcaggagatgcg

SEQ ID NO: 160949 - DNA, 21 bp, Artificial sequence
  SiRNA target sequence
atatgctctcaggagatgcgt

SEQ ID NO: 160950 - DNA, 21 bp, Artificial sequence
  SiRNA target sequence
tatgctctcaggagatgcgta

SEQ ID NO: 160951 - DNA, 21 bp, Artificial sequence
  SiRNA target sequence
atgctctcaggagatgcgtaa

SEQ ID NO: 160952 - DNA, 21 bp, Artificial sequence
  SiRNA target sequence
tgctctcaggagatgcgtaag

SEQ ID NO: 160953 - DNA, 21 bp, Artificial sequence
  SiRNA target sequence
gctctcaggagatgcgtaagg

SEQ ID NO: 160954 - DNA, 21 bp, Artificial sequence
  SiRNA target sequence
ctctcaggagatgcgtaagga

SEQ ID NO: 160955 - DNA, 21 bp, Artificial sequence
  SiRNA target sequence
tctcaggagatgcgtaaggac

SEQ ID NO: 160956 - DNA, 21 bp, Artificial sequence
  SiRNA target sequence
ctcaggagatgcgtaaggact

SEQ ID NO: 160957 - DNA, 21 bp, Artificial sequence
  SiRNA target sequence
tcaggagatgcgtaaggacta

SEQ ID NO: 160958 - DNA, 21 bp, Artificial sequence
  SiRNA target sequence
caggagatgcgtaaggactat

SEQ ID NO: 160959 - DNA, 21 bp, Artificial sequence
  SiRNA target sequence
aggagatgcgtaaggactatg

SEQ ID NO: 160960 - DNA, 21 bp, Artificial sequence
  SiRNA target sequence
ggagatgcgtaaggactatga

SEQ ID NO: 160961 - DNA, 21 bp, Artificial sequence
  SiRNA target sequence
gagatgcgtaaggactatgaa

SEQ ID NO: 160962 - DNA, 21 bp, Artificial sequence
  SiRNA target sequence
agatgcgtaaggactatgaat

SEQ ID NO: 160963 - DNA, 21 bp, Artificial sequence
  SiRNA target sequence
gatgcgtaaggactatgaata

SEQ ID NO: 160964 - DNA, 21 bp, Artificial sequence
  SiRNA target sequence
atgcgtaaggactatgaatat

SEQ ID NO: 160965 - DNA, 21 bp, Artificial sequence
  SiRNA target sequence
tgcgtaaggactatgaatata

SEQ ID NO: 160966 - DNA, 21 bp, Artificial sequence
  SiRNA target sequence
gcgtaaggactatgaatatat

SEQ ID NO: 160967 - DNA, 21 bp, Artificial sequence
  SiRNA target sequence
cgtaaggactatgaatatata

SEQ ID NO: 160968 - DNA, 21 bp, Artificial sequence
  SiRNA target sequence
gtaaggactatgaatatatac

SEQ ID NO: 160969 - DNA, 21 bp, Artificial sequence
  SiRNA target sequence
taaggactatgaatatataca

SEQ ID NO: 160970 - DNA, 21 bp, Artificial sequence
  SiRNA target sequence
aaggactatgaatatatacaa

SEQ ID NO: 160971 - DNA, 21 bp, Artificial sequence
  SiRNA target sequence
aggactatgaatatatacaaa

SEQ ID NO: 160972 - DNA, 21 bp, Artificial sequence
  SiRNA target sequence
ggactatgaatatatacaaaa

SEQ ID NO: 160973 - DNA, 21 bp, Artificial sequence
  SiRNA target sequence
gactatgaatatatacaaaaa

SEQ ID NO: 160974 - DNA, 21 bp, Artificial sequence
  SiRNA target sequence
actatgaatatatacaaaaat

SEQ ID NO: 160975 - DNA, 21 bp, Artificial sequence
  SiRNA target sequence
ctatgaatatatacaaaaatt

SEQ ID NO: 160976 - DNA, 21 bp, Artificial sequence
  SiRNA target sequence
tatgaatatatacaaaaatta

SEQ ID NO: 160977 - DNA, 21 bp, Artificial sequence
  SiRNA target sequence
atgaatatatacaaaaattat

SEQ ID NO: 160978 - DNA, 21 bp, Artificial sequence
  SiRNA target sequence
tgaatatatacaaaaattatc

SEQ ID NO: 160979 - DNA, 21 bp, Artificial sequence
  SiRNA target sequence
gaatatatacaaaaattatcg

SEQ ID NO: 160980 - DNA, 21 bp, Artificial sequence
  SiRNA target sequence
aatatatacaaaaattatcgg

SEQ ID NO: 160981 - DNA, 21 bp, Artificial sequence
  SiRNA target sequence
atatatacaaaaattatcgga

SEQ ID NO: 160982 - DNA, 21 bp, Artificial sequence
  SiRNA target sequence
tatatacaaaaattatcggat

SEQ ID NO: 160983 - DNA, 21 bp, Artificial sequence
  SiRNA target sequence
atatacaaaaattatcggata

SEQ ID NO: 160984 - DNA, 21 bp, Artificial sequence
  SiRNA target sequence
tatacaaaaattatcggataa

SEQ ID NO: 160985 - DNA, 21 bp, Artificial sequence
  SiRNA target sequence
atacaaaaattatcggataaa

SEQ ID NO: 160986 - DNA, 21 bp, Artificial sequence
  SiRNA target sequence
tacaaaaattatcggataaac

SEQ ID NO: 160987 - DNA, 21 bp, Artificial sequence
  SiRNA target sequence
acaaaaattatcggataaact

SEQ ID NO: 160988 - DNA, 21 bp, Artificial sequence
  SiRNA target sequence
caaaaattatcggataaacta

SEQ ID NO: 160989 - DNA, 21 bp, Artificial sequence
  SiRNA target sequence
aaaaattatcggataaactaa

SEQ ID NO: 160990 - DNA, 21 bp, Artificial sequence
  SiRNA target sequence
aaaattatcggataaactaaa

SEQ ID NO: 160991 - DNA, 21 bp, Artificial sequence
  SiRNA target sequence
aaattatcggataaactaaaa

SEQ ID NO: 160992 - DNA, 21 bp, Artificial sequence
  SiRNA target sequence
aattatcggataaactaaaaa

SEQ ID NO: 160993 - DNA, 21 bp, Artificial sequence
  SiRNA target sequence
attatcggataaactaaaaaa

SEQ ID NO: 160994 - DNA, 21 bp, Artificial sequence
  SiRNA target sequence
ttatcggataaactaaaaaat

SEQ ID NO: 160995 - DNA, 21 bp, Artificial sequence
  SiRNA target sequence
tatcggataaactaaaaaatc

SEQ ID NO: 160996 - DNA, 21 bp, Artificial sequence
  SiRNA target sequence
atcggataaactaaaaaatcg

SEQ ID NO: 160997 - DNA, 21 bp, Artificial sequence
  SiRNA target sequence
tcggataaactaaaaaatcgc

SEQ ID NO: 160998 - DNA, 21 bp, Artificial sequence
  SiRNA target sequence
cggataaactaaaaaatcgca

SEQ ID NO: 160999 - DNA, 21 bp, Artificial sequence
  SiRNA target sequence
ggataaactaaaaaatcgcat

SEQ ID NO: 161000 - DNA, 21 bp, Artificial sequence
  SiRNA target sequence
gataaactaaaaaatcgcatc

SEQ ID NO: 161001 - DNA, 21 bp, Artificial sequence
  SiRNA target sequence
ataaactaaaaaatcgcatca

SEQ ID NO: 161002 - DNA, 21 bp, Artificial sequence
  SiRNA target sequence
taaactaaaaaatcgcatcaa

SEQ ID NO: 161003 - DNA, 21 bp, Artificial sequence
  SiRNA target sequence
aaactaaaaaatcgcatcaaa

SEQ ID NO: 161004 - DNA, 21 bp, Artificial sequence
  SiRNA target sequence
aactaaaaaatcgcatcaaaa

SEQ ID NO: 161005 - DNA, 21 bp, Artificial sequence
  SiRNA target sequence
actaaaaaatcgcatcaaaac

SEQ ID NO: 161006 - DNA, 21 bp, Artificial sequence
  SiRNA target sequence
ctaaaaaatcgcatcaaaacg

SEQ ID NO: 161007 - DNA, 21 bp, Artificial sequence
  SiRNA target sequence
taaaaaatcgcatcaaaacga

SEQ ID NO: 161008 - DNA, 21 bp, Artificial sequence
  SiRNA target sequence
aaaaaatcgcatcaaaacgaa

SEQ ID NO: 161009 - DNA, 21 bp, Artificial sequence
  SiRNA target sequence
aaaaatcgcatcaaaacgaat

SEQ ID NO: 161010 - DNA, 21 bp, Artificial sequence
  SiRNA target sequence
aaaatcgcatcaaaacgaatg

SEQ ID NO: 161011 - DNA, 21 bp, Artificial sequence
  SiRNA target sequence
aaatcgcatcaaaacgaatgt

SEQ ID NO: 161012 - DNA, 21 bp, Artificial sequence
  SiRNA target sequence
aatcgcatcaaaacgaatgta

SEQ ID NO: 161013 - DNA, 21 bp, Artificial sequence
  SiRNA target sequence
atcgcatcaaaacgaatgtag

SEQ ID NO: 161014 - DNA, 21 bp, Artificial sequence
  SiRNA target sequence
tcgcatcaaaacgaatgtaga

SEQ ID NO: 161015 - DNA, 21 bp, Artificial sequence
  SiRNA target sequence
cgcatcaaaacgaatgtagaa

SEQ ID NO: 161016 - DNA, 21 bp, Artificial sequence
  SiRNA target sequence
gcatcaaaacgaatgtagaaa

SEQ ID NO: 161017 - DNA, 21 bp, Artificial sequence
  SiRNA target sequence
catcaaaacgaatgtagaaaa

SEQ ID NO: 161018 - DNA, 21 bp, Artificial sequence
  SiRNA target sequence
atcaaaacgaatgtagaaaat

SEQ ID NO: 161019 - DNA, 21 bp, Artificial sequence
  SiRNA target sequence
tcaaaacgaatgtagaaaatg

SEQ ID NO: 161020 - DNA, 21 bp, Artificial sequence
  SiRNA target sequence
caaaacgaatgtagaaaatgt

SEQ ID NO: 161021 - DNA, 21 bp, Artificial sequence
  SiRNA target sequence
aaaacgaatgtagaaaatgtt

SEQ ID NO: 161022 - DNA, 21 bp, Artificial sequence
  SiRNA target sequence
aaacgaatgtagaaaatgttg

SEQ ID NO: 161023 - DNA, 21 bp, Artificial sequence
  SiRNA target sequence
aacgaatgtagaaaatgttgt

SEQ ID NO: 161024 - DNA, 21 bp, Artificial sequence
  SiRNA target sequence
acgaatgtagaaaatgttgtt

SEQ ID NO: 161025 - DNA, 21 bp, Artificial sequence
  SiRNA target sequence
cgaatgtagaaaatgttgtta

SEQ ID NO: 161026 - DNA, 21 bp, Artificial sequence
  SiRNA target sequence
gaatgtagaaaatgttgttat

SEQ ID NO: 161027 - DNA, 21 bp, Artificial sequence
  SiRNA target sequence
aatgtagaaaatgttgttatt

SEQ ID NO: 161028 - DNA, 21 bp, Artificial sequence
  SiRNA target sequence
atgtagaaaatgttgttatta

SEQ ID NO: 161029 - DNA, 21 bp, Artificial sequence
  SiRNA target sequence
tgtagaaaatgttgttattaa

SEQ ID NO: 161030 - DNA, 21 bp, Artificial sequence
  SiRNA target sequence
gtagaaaatgttgttattaac

SEQ ID NO: 161031 - DNA, 21 bp, Artificial sequence
  SiRNA target sequence
tagaaaatgttgttattaacg

SEQ ID NO: 161032 - DNA, 21 bp, Artificial sequence
  SiRNA target sequence
agaaaatgttgttattaacgg

SEQ ID NO: 161033 - DNA, 21 bp, Artificial sequence
  SiRNA target sequence
gaaaatgttgttattaacggc

SEQ ID NO: 161034 - DNA, 21 bp, Artificial sequence
  SiRNA target sequence
aaaatgttgttattaacggcg

SEQ ID NO: 161035 - DNA, 21 bp, Artificial sequence
  SiRNA target sequence
aaatgttgttattaacggcga

SEQ ID NO: 161036 - DNA, 21 bp, Artificial sequence
  SiRNA target sequence
aatgttgttattaacggcgat

SEQ ID NO: 161037 - DNA, 21 bp, Artificial sequence
  SiRNA target sequence
atgttgttattaacggcgatg

SEQ ID NO: 161038 - DNA, 21 bp, Artificial sequence
  SiRNA target sequence
tgttgttattaacggcgatga

SEQ ID NO: 161039 - DNA, 21 bp, Artificial sequence
  SiRNA target sequence
gttgttattaacggcgatgat

SEQ ID NO: 161040 - DNA, 21 bp, Artificial sequence
  SiRNA target sequence
ttgttattaacggcgatgatt

SEQ ID NO: 161041 - DNA, 21 bp, Artificial sequence
  SiRNA target sequence
tgttattaacggcgatgattc

SEQ ID NO: 161042 - DNA, 21 bp, Artificial sequence
  SiRNA target sequence
gttattaacggcgatgattct

SEQ ID NO: 161043 - DNA, 21 bp, Artificial sequence
  SiRNA target sequence
ttattaacggcgatgattcta

SEQ ID NO: 161044 - DNA, 21 bp, Artificial sequence
  SiRNA target sequence
tattaacggcgatgattctaa

SEQ ID NO: 161045 - DNA, 21 bp, Artificial sequence
  SiRNA target sequence
attaacggcgatgattctaag

SEQ ID NO: 161046 - DNA, 21 bp, Artificial sequence
  SiRNA target sequence
ttaacggcgatgattctaaga

SEQ ID NO: 161047 - DNA, 21 bp, Artificial sequence
  SiRNA target sequence
taacggcgatgattctaagac

SEQ ID NO: 161048 - DNA, 21 bp, Artificial sequence
  SiRNA target sequence
aacggcgatgattctaagact

SEQ ID NO: 161049 - DNA, 21 bp, Artificial sequence
  SiRNA target sequence
acggcgatgattctaagactt

SEQ ID NO: 161050 - DNA, 21 bp, Artificial sequence
  SiRNA target sequence
cggcgatgattctaagacttt

SEQ ID NO: 161051 - DNA, 21 bp, Artificial sequence
  SiRNA target sequence
ggcgatgattctaagactttt

SEQ ID NO: 161052 - DNA, 21 bp, Artificial sequence
  SiRNA target sequence
gcgatgattctaagacttttc

SEQ ID NO: 161053 - DNA, 21 bp, Artificial sequence
  SiRNA target sequence
cgatgattctaagacttttcc

SEQ ID NO: 161054 - DNA, 21 bp, Artificial sequence
  SiRNA target sequence
gatgattctaagacttttcct

SEQ ID NO: 161055 - DNA, 21 bp, Artificial sequence
  SiRNA target sequence
atgattctaagacttttcctg

SEQ ID NO: 161056 - DNA, 21 bp, Artificial sequence
  SiRNA target sequence
tgattctaagacttttcctgg

SEQ ID NO: 161057 - DNA, 21 bp, Artificial sequence
  SiRNA target sequence
gattctaagacttttcctggc

SEQ ID NO: 161058 - DNA, 21 bp, Artificial sequence
  SiRNA target sequence
attctaagacttttcctggct

SEQ ID NO: 161059 - DNA, 21 bp, Artificial sequence
  SiRNA target sequence
ttctaagacttttcctggctg

SEQ ID NO: 161060 - DNA, 21 bp, Artificial sequence
  SiRNA target sequence
tctaagacttttcctggctgt

SEQ ID NO: 161061 - DNA, 21 bp, Artificial sequence
  SiRNA target sequence
ctaagacttttcctggctgtc

SEQ ID NO: 161062 - DNA, 21 bp, Artificial sequence
  SiRNA target sequence
taagacttttcctggctgtct

SEQ ID NO: 161063 - DNA, 21 bp, Artificial sequence
  SiRNA target sequence
aagacttttcctggctgtctc

SEQ ID NO: 161064 - DNA, 21 bp, Artificial sequence
  SiRNA target sequence
agacttttcctggctgtctca

SEQ ID NO: 161065 - DNA, 21 bp, Artificial sequence
  SiRNA target sequence
gacttttcctggctgtctcaa

SEQ ID NO: 161066 - DNA, 21 bp, Artificial sequence
  SiRNA target sequence
acttttcctggctgtctcaat

SEQ ID NO: 161067 - DNA, 21 bp, Artificial sequence
  SiRNA target sequence
cttttcctggctgtctcaata

SEQ ID NO: 161068 - DNA, 21 bp, Artificial sequence
  SiRNA target sequence
ttttcctggctgtctcaatat

SEQ ID NO: 161069 - DNA, 21 bp, Artificial sequence
  SiRNA target sequence
tttcctggctgtctcaatatt

SEQ ID NO: 161070 - DNA, 21 bp, Artificial sequence
  SiRNA target sequence
ttcctggctgtctcaatattt

SEQ ID NO: 161071 - DNA, 21 bp, Artificial sequence
  SiRNA target sequence
tcctggctgtctcaatatttc

SEQ ID NO: 161072 - DNA, 21 bp, Artificial sequence
  SiRNA target sequence
cctggctgtctcaatatttct

SEQ ID NO: 161073 - DNA, 21 bp, Artificial sequence
  SiRNA target sequence
ctggctgtctcaatatttctt

SEQ ID NO: 161074 - DNA, 21 bp, Artificial sequence
  SiRNA target sequence
tggctgtctcaatatttcttt

SEQ ID NO: 161075 - DNA, 21 bp, Artificial sequence
  SiRNA target sequence
ggctgtctcaatatttctttt

SEQ ID NO: 161076 - DNA, 21 bp, Artificial sequence
  SiRNA target sequence
gctgtctcaatatttcttttc

SEQ ID NO: 161077 - DNA, 21 bp, Artificial sequence
  SiRNA target sequence
ctgtctcaatatttcttttcc

SEQ ID NO: 161078 - DNA, 21 bp, Artificial sequence
  SiRNA target sequence
tgtctcaatatttcttttcca

SEQ ID NO: 161079 - DNA, 21 bp, Artificial sequence
  SiRNA target sequence
gtctcaatatttcttttccat

SEQ ID NO: 161080 - DNA, 21 bp, Artificial sequence
  SiRNA target sequence
tctcaatatttcttttccata

SEQ ID NO: 161081 - DNA, 21 bp, Artificial sequence
  SiRNA target sequence
ctcaatatttcttttccatat

SEQ ID NO: 161082 - DNA, 21 bp, Artificial sequence
  SiRNA target sequence
tcaatatttcttttccatatg

SEQ ID NO: 161083 - DNA, 21 bp, Artificial sequence
  SiRNA target sequence
caatatttcttttccatatgt

SEQ ID NO: 161084 - DNA, 21 bp, Artificial sequence
  SiRNA target sequence
aatatttcttttccatatgta

SEQ ID NO: 161085 - DNA, 21 bp, Artificial sequence
  SiRNA target sequence
atatttcttttccatatgtag

SEQ ID NO: 161086 - DNA, 21 bp, Artificial sequence
  SiRNA target sequence
tatttcttttccatatgtaga

SEQ ID NO: 161087 - DNA, 21 bp, Artificial sequence
  SiRNA target sequence
atttcttttccatatgtagaa

SEQ ID NO: 161088 - DNA, 21 bp, Artificial sequence
  SiRNA target sequence
tttcttttccatatgtagaag

SEQ ID NO: 161089 - DNA, 21 bp, Artificial sequence
  SiRNA target sequence
ttcttttccatatgtagaagg

SEQ ID NO: 161090 - DNA, 21 bp, Artificial sequence
  SiRNA target sequence
tcttttccatatgtagaaggt

SEQ ID NO: 161091 - DNA, 21 bp, Artificial sequence
  SiRNA target sequence
cttttccatatgtagaaggtg

SEQ ID NO: 161092 - DNA, 21 bp, Artificial sequence
  SiRNA target sequence
ttttccatatgtagaaggtga

SEQ ID NO: 161093 - DNA, 21 bp, Artificial sequence
  SiRNA target sequence
tttccatatgtagaaggtgaa

SEQ ID NO: 161094 - DNA, 21 bp, Artificial sequence
  SiRNA target sequence
ttccatatgtagaaggtgaag

SEQ ID NO: 161095 - DNA, 21 bp, Artificial sequence
  SiRNA target sequence
tccatatgtagaaggtgaagg

SEQ ID NO: 161096 - DNA, 21 bp, Artificial sequence
  SiRNA target sequence
ccatatgtagaaggtgaaggg

SEQ ID NO: 161097 - DNA, 21 bp, Artificial sequence
  SiRNA target sequence
catatgtagaaggtgaagggc

SEQ ID NO: 161098 - DNA, 21 bp, Artificial sequence
  SiRNA target sequence
atatgtagaaggtgaagggct

SEQ ID NO: 161099 - DNA, 21 bp, Artificial sequence
  SiRNA target sequence
tatgtagaaggtgaagggctt

SEQ ID NO: 161100 - DNA, 21 bp, Artificial sequence
  SiRNA target sequence
atgtagaaggtgaagggctta

SEQ ID NO: 161101 - DNA, 21 bp, Artificial sequence
  SiRNA target sequence
tgtagaaggtgaagggcttat

SEQ ID NO: 161102 - DNA, 21 bp, Artificial sequence
  SiRNA target sequence
gtagaaggtgaagggcttatg

SEQ ID NO: 161103 - DNA, 21 bp, Artificial sequence
  SiRNA target sequence
tagaaggtgaagggcttatga

SEQ ID NO: 161104 - DNA, 21 bp, Artificial sequence
  SiRNA target sequence
agaaggtgaagggcttatgat

SEQ ID NO: 161105 - DNA, 21 bp, Artificial sequence
  SiRNA target sequence
gaaggtgaagggcttatgatg

SEQ ID NO: 161106 - DNA, 21 bp, Artificial sequence
  SiRNA target sequence
aaggtgaagggcttatgatga

SEQ ID NO: 161107 - DNA, 21 bp, Artificial sequence
  SiRNA target sequence
aggtgaagggcttatgatgaa

SEQ ID NO: 161108 - DNA, 21 bp, Artificial sequence
  SiRNA target sequence
ggtgaagggcttatgatgaat

SEQ ID NO: 161109 - DNA, 21 bp, Artificial sequence
  SiRNA target sequence
gtgaagggcttatgatgaata

SEQ ID NO: 161110 - DNA, 21 bp, Artificial sequence
  SiRNA target sequence
tgaagggcttatgatgaatat

SEQ ID NO: 161111 - DNA, 21 bp, Artificial sequence
  SiRNA target sequence
gaagggcttatgatgaatatt

SEQ ID NO: 161112 - DNA, 21 bp, Artificial sequence
  SiRNA target sequence
aagggcttatgatgaatatta

SEQ ID NO: 161113 - DNA, 21 bp, Artificial sequence
  SiRNA target sequence
agggcttatgatgaatattaa

SEQ ID NO: 161114 - DNA, 21 bp, Artificial sequence
  SiRNA target sequence
gggcttatgatgaatattaag

SEQ ID NO: 161115 - DNA, 21 bp, Artificial sequence
  SiRNA target sequence
ggcttatgatgaatattaagg

SEQ ID NO: 161116 - DNA, 21 bp, Artificial sequence
  SiRNA target sequence
gcttatgatgaatattaagga

SEQ ID NO: 161117 - DNA, 21 bp, Artificial sequence
  SiRNA target sequence
cttatgatgaatattaaggat

SEQ ID NO: 161118 - DNA, 21 bp, Artificial sequence
  SiRNA target sequence
ttatgatgaatattaaggata

SEQ ID NO: 161119 - DNA, 21 bp, Artificial sequence
  SiRNA target sequence
tatgatgaatattaaggatat

SEQ ID NO: 161120 - DNA, 21 bp, Artificial sequence
  SiRNA target sequence
atgatgaatattaaggatatt

SEQ ID NO: 161121 - DNA, 21 bp, Artificial sequence
  SiRNA target sequence
tgatgaatattaaggatattg

SEQ ID NO: 161122 - DNA, 21 bp, Artificial sequence
  SiRNA target sequence
gatgaatattaaggatattgc

SEQ ID NO: 161123 - DNA, 21 bp, Artificial sequence
  SiRNA target sequence
atgaatattaaggatattgct

SEQ ID NO: 161124 - DNA, 21 bp, Artificial sequence
  SiRNA target sequence
tgaatattaaggatattgctg

SEQ ID NO: 161125 - DNA, 21 bp, Artificial sequence
  SiRNA target sequence
gaatattaaggatattgctgt

SEQ ID NO: 161126 - DNA, 21 bp, Artificial sequence
  SiRNA target sequence
aatattaaggatattgctgtt

SEQ ID NO: 161127 - DNA, 21 bp, Artificial sequence
  SiRNA target sequence
atattaaggatattgctgtta

SEQ ID NO: 161128 - DNA, 21 bp, Artificial sequence
  SiRNA target sequence
tattaaggatattgctgttag

SEQ ID NO: 161129 - DNA, 21 bp, Artificial sequence
  SiRNA target sequence
attaaggatattgctgttagt

SEQ ID NO: 161130 - DNA, 21 bp, Artificial sequence
  SiRNA target sequence
ttaaggatattgctgttagta

SEQ ID NO: 161131 - DNA, 21 bp, Artificial sequence
  SiRNA target sequence
taaggatattgctgttagtag

SEQ ID NO: 161132 - DNA, 21 bp, Artificial sequence
  SiRNA target sequence
aaggatattgctgttagtagt

SEQ ID NO: 161133 - DNA, 21 bp, Artificial sequence
  SiRNA target sequence
aggatattgctgttagtagtg

SEQ ID NO: 161134 - DNA, 21 bp, Artificial sequence
  SiRNA target sequence
ggatattgctgttagtagtgg

SEQ ID NO: 161135 - DNA, 21 bp, Artificial sequence
  SiRNA target sequence
gatattgctgttagtagtgga

SEQ ID NO: 161136 - DNA, 21 bp, Artificial sequence
  SiRNA target sequence
atattgctgttagtagtggaa

SEQ ID NO: 161137 - DNA, 21 bp, Artificial sequence
  SiRNA target sequence
tattgctgttagtagtggaag

SEQ ID NO: 161138 - DNA, 21 bp, Artificial sequence
  SiRNA target sequence
attgctgttagtagtggaagt

SEQ ID NO: 161139 - DNA, 21 bp, Artificial sequence
  SiRNA target sequence
ttgctgttagtagtggaagtg

SEQ ID NO: 161140 - DNA, 21 bp, Artificial sequence
  SiRNA target sequence
tgctgttagtagtggaagtgc

SEQ ID NO: 161141 - DNA, 21 bp, Artificial sequence
  SiRNA target sequence
gctgttagtagtggaagtgct

SEQ ID NO: 161142 - DNA, 21 bp, Artificial sequence
  SiRNA target sequence
ctgttagtagtggaagtgctt

SEQ ID NO: 161143 - DNA, 21 bp, Artificial sequence
  SiRNA target sequence
tgttagtagtggaagtgcttg

SEQ ID NO: 161144 - DNA, 21 bp, Artificial sequence
  SiRNA target sequence
gttagtagtggaagtgcttgc

SEQ ID NO: 161145 - DNA, 21 bp, Artificial sequence
  SiRNA target sequence
ttagtagtggaagtgcttgca

SEQ ID NO: 161146 - DNA, 21 bp, Artificial sequence
  SiRNA target sequence
tagtagtggaagtgcttgcac

SEQ ID NO: 161147 - DNA, 21 bp, Artificial sequence
  SiRNA target sequence
agtagtggaagtgcttgcact

SEQ ID NO: 161148 - DNA, 21 bp, Artificial sequence
  SiRNA target sequence
gtagtggaagtgcttgcactt

SEQ ID NO: 161149 - DNA, 21 bp, Artificial sequence
  SiRNA target sequence
tagtggaagtgcttgcacttc

SEQ ID NO: 161150 - DNA, 21 bp, Artificial sequence
  SiRNA target sequence
agtggaagtgcttgcacttca

SEQ ID NO: 161151 - DNA, 21 bp, Artificial sequence
  SiRNA target sequence
gtggaagtgcttgcacttcat

SEQ ID NO: 161152 - DNA, 21 bp, Artificial sequence
  SiRNA target sequence
tggaagtgcttgcacttcatc

SEQ ID NO: 161153 - DNA, 21 bp, Artificial sequence
  SiRNA target sequence
ggaagtgcttgcacttcatca

SEQ ID NO: 161154 - DNA, 21 bp, Artificial sequence
  SiRNA target sequence
gaagtgcttgcacttcatcat

SEQ ID NO: 161155 - DNA, 21 bp, Artificial sequence
  SiRNA target sequence
aagtgcttgcacttcatcatc

SEQ ID NO: 161156 - DNA, 21 bp, Artificial sequence
  SiRNA target sequence
agtgcttgcacttcatcatct

SEQ ID NO: 161157 - DNA, 21 bp, Artificial sequence
  SiRNA target sequence
gtgcttgcacttcatcatctt

SEQ ID NO: 161158 - DNA, 21 bp, Artificial sequence
  SiRNA target sequence
tgcttgcacttcatcatcttt

SEQ ID NO: 161159 - DNA, 21 bp, Artificial sequence
  SiRNA target sequence
gcttgcacttcatcatcttta

SEQ ID NO: 161160 - DNA, 21 bp, Artificial sequence
  SiRNA target sequence
cttgcacttcatcatctttag

SEQ ID NO: 161161 - DNA, 21 bp, Artificial sequence
  SiRNA target sequence
ttgcacttcatcatctttaga

SEQ ID NO: 161162 - DNA, 21 bp, Artificial sequence
  SiRNA target sequence
tgcacttcatcatctttagaa

SEQ ID NO: 161163 - DNA, 21 bp, Artificial sequence
  SiRNA target sequence
gcacttcatcatctttagaac

SEQ ID NO: 161164 - DNA, 21 bp, Artificial sequence
  SiRNA target sequence
cacttcatcatctttagaacc

SEQ ID NO: 161165 - DNA, 21 bp, Artificial sequence
  SiRNA target sequence
acttcatcatctttagaaccc

SEQ ID NO: 161166 - DNA, 21 bp, Artificial sequence
  SiRNA target sequence
cttcatcatctttagaaccct

SEQ ID NO: 161167 - DNA, 21 bp, Artificial sequence
  SiRNA target sequence
ttcatcatctttagaaccctc

SEQ ID NO: 161168 - DNA, 21 bp, Artificial sequence
  SiRNA target sequence
tcatcatctttagaaccctct

SEQ ID NO: 161169 - DNA, 21 bp, Artificial sequence
  SiRNA target sequence
catcatctttagaaccctctt

SEQ ID NO: 161170 - DNA, 21 bp, Artificial sequence
  SiRNA target sequence
atcatctttagaaccctctta

SEQ ID NO: 161171 - DNA, 21 bp, Artificial sequence
  SiRNA target sequence
tcatctttagaaccctcttat

SEQ ID NO: 161172 - DNA, 21 bp, Artificial sequence
  SiRNA target sequence
catctttagaaccctcttatg

SEQ ID NO: 161173 - DNA, 21 bp, Artificial sequence
  SiRNA target sequence
atctttagaaccctcttatgt

SEQ ID NO: 161174 - DNA, 21 bp, Artificial sequence
  SiRNA target sequence
tctttagaaccctcttatgtt

SEQ ID NO: 161175 - DNA, 21 bp, Artificial sequence
  SiRNA target sequence
ctttagaaccctcttatgttt

SEQ ID NO: 161176 - DNA, 21 bp, Artificial sequence
  SiRNA target sequence
tttagaaccctcttatgtttt

SEQ ID NO: 161177 - DNA, 21 bp, Artificial sequence
  SiRNA target sequence
ttagaaccctcttatgttttg

SEQ ID NO: 161178 - DNA, 21 bp, Artificial sequence
  SiRNA target sequence
tagaaccctcttatgttttgc

SEQ ID NO: 161179 - DNA, 21 bp, Artificial sequence
  SiRNA target sequence
agaaccctcttatgttttgcg

SEQ ID NO: 161180 - DNA, 21 bp, Artificial sequence
  SiRNA target sequence
gaaccctcttatgttttgcga

SEQ ID NO: 161181 - DNA, 21 bp, Artificial sequence
  SiRNA target sequence
aaccctcttatgttttgcgag

SEQ ID NO: 161182 - DNA, 21 bp, Artificial sequence
  SiRNA target sequence
accctcttatgttttgcgagc

SEQ ID NO: 161183 - DNA, 21 bp, Artificial sequence
  SiRNA target sequence
ccctcttatgttttgcgagct

SEQ ID NO: 161184 - DNA, 21 bp, Artificial sequence
  SiRNA target sequence
cctcttatgttttgcgagctt

SEQ ID NO: 161185 - DNA, 21 bp, Artificial sequence
  SiRNA target sequence
ctcttatgttttgcgagcttt

SEQ ID NO: 161186 - DNA, 21 bp, Artificial sequence
  SiRNA target sequence
tcttatgttttgcgagcttta

SEQ ID NO: 161187 - DNA, 21 bp, Artificial sequence
  SiRNA target sequence
cttatgttttgcgagctttag

SEQ ID NO: 161188 - DNA, 21 bp, Artificial sequence
  SiRNA target sequence
ttatgttttgcgagctttagg

SEQ ID NO: 161189 - DNA, 21 bp, Artificial sequence
  SiRNA target sequence
tatgttttgcgagctttaggc

SEQ ID NO: 161190 - DNA, 21 bp, Artificial sequence
  SiRNA target sequence
atgttttgcgagctttaggca

SEQ ID NO: 161191 - DNA, 21 bp, Artificial sequence
  SiRNA target sequence
tgttttgcgagctttaggcaa

SEQ ID NO: 161192 - DNA, 21 bp, Artificial sequence
  SiRNA target sequence
gttttgcgagctttaggcaaa

SEQ ID NO: 161193 - DNA, 21 bp, Artificial sequence
  SiRNA target sequence
ttttgcgagctttaggcaaaa

SEQ ID NO: 161194 - DNA, 21 bp, Artificial sequence
  SiRNA target sequence
tttgcgagctttaggcaaaaa

SEQ ID NO: 161195 - DNA, 21 bp, Artificial sequence
  SiRNA target sequence
ttgcgagctttaggcaaaaat

SEQ ID NO: 161196 - DNA, 21 bp, Artificial sequence
  SiRNA target sequence
tgcgagctttaggcaaaaatg

SEQ ID NO: 161197 - DNA, 21 bp, Artificial sequence
  SiRNA target sequence
gcgagctttaggcaaaaatga

SEQ ID NO: 161198 - DNA, 21 bp, Artificial sequence
  SiRNA target sequence
cgagctttaggcaaaaatgat

SEQ ID NO: 161199 - DNA, 21 bp, Artificial sequence
  SiRNA target sequence
gagctttaggcaaaaatgatg

SEQ ID NO: 161200 - DNA, 21 bp, Artificial sequence
  SiRNA target sequence
agctttaggcaaaaatgatga

SEQ ID NO: 161201 - DNA, 21 bp, Artificial sequence
  SiRNA target sequence
gctttaggcaaaaatgatgat

SEQ ID NO: 161202 - DNA, 21 bp, Artificial sequence
  SiRNA target sequence
ctttaggcaaaaatgatgatc

SEQ ID NO: 161203 - DNA, 21 bp, Artificial sequence
  SiRNA target sequence
tttaggcaaaaatgatgatct

SEQ ID NO: 161204 - DNA, 21 bp, Artificial sequence
  SiRNA target sequence
ttaggcaaaaatgatgatctt

SEQ ID NO: 161205 - DNA, 21 bp, Artificial sequence
  SiRNA target sequence
taggcaaaaatgatgatcttg

SEQ ID NO: 161206 - DNA, 21 bp, Artificial sequence
  SiRNA target sequence
aggcaaaaatgatgatcttgc

SEQ ID NO: 161207 - DNA, 21 bp, Artificial sequence
  SiRNA target sequence
ggcaaaaatgatgatcttgcg

SEQ ID NO: 161208 - DNA, 21 bp, Artificial sequence
  SiRNA target sequence
gcaaaaatgatgatcttgcgc

SEQ ID NO: 161209 - DNA, 21 bp, Artificial sequence
  SiRNA target sequence
caaaaatgatgatcttgcgca

SEQ ID NO: 161210 - DNA, 21 bp, Artificial sequence
  SiRNA target sequence
aaaaatgatgatcttgcgcat

SEQ ID NO: 161211 - DNA, 21 bp, Artificial sequence
  SiRNA target sequence
aaaatgatgatcttgcgcatt

SEQ ID NO: 161212 - DNA, 21 bp, Artificial sequence
  SiRNA target sequence
aaatgatgatcttgcgcattc

SEQ ID NO: 161213 - DNA, 21 bp, Artificial sequence
  SiRNA target sequence
aatgatgatcttgcgcattct

SEQ ID NO: 161214 - DNA, 21 bp, Artificial sequence
  SiRNA target sequence
atgatgatcttgcgcattctt

SEQ ID NO: 161215 - DNA, 21 bp, Artificial sequence
  SiRNA target sequence
tgatgatcttgcgcattcttc

SEQ ID NO: 161216 - DNA, 21 bp, Artificial sequence
  SiRNA target sequence
gatgatcttgcgcattcttct

SEQ ID NO: 161217 - DNA, 21 bp, Artificial sequence
  SiRNA target sequence
atgatcttgcgcattcttcta

SEQ ID NO: 161218 - DNA, 21 bp, Artificial sequence
  SiRNA target sequence
tgatcttgcgcattcttctat

SEQ ID NO: 161219 - DNA, 21 bp, Artificial sequence
  SiRNA target sequence
gatcttgcgcattcttctata

SEQ ID NO: 161220 - DNA, 21 bp, Artificial sequence
  SiRNA target sequence
atcttgcgcattcttctataa

SEQ ID NO: 161221 - DNA, 21 bp, Artificial sequence
  SiRNA target sequence
tcttgcgcattcttctataag

SEQ ID NO: 161222 - DNA, 21 bp, Artificial sequence
  SiRNA target sequence
cttgcgcattcttctataaga

SEQ ID NO: 161223 - DNA, 21 bp, Artificial sequence
  SiRNA target sequence
ttgcgcattcttctataagat

SEQ ID NO: 161224 - DNA, 21 bp, Artificial sequence
  SiRNA target sequence
tgcgcattcttctataagatt

SEQ ID NO: 161225 - DNA, 21 bp, Artificial sequence
  SiRNA target sequence
gcgcattcttctataagattt

SEQ ID NO: 161226 - DNA, 21 bp, Artificial sequence
  SiRNA target sequence
cgcattcttctataagatttg

SEQ ID NO: 161227 - DNA, 21 bp, Artificial sequence
  SiRNA target sequence
gcattcttctataagatttgg

SEQ ID NO: 161228 - DNA, 21 bp, Artificial sequence
  SiRNA target sequence
cattcttctataagatttgga

SEQ ID NO: 161229 - DNA, 21 bp, Artificial sequence
  SiRNA target sequence
attcttctataagatttggaa

SEQ ID NO: 161230 - DNA, 21 bp, Artificial sequence
  SiRNA target sequence
ttcttctataagatttggaat

SEQ ID NO: 161231 - DNA, 21 bp, Artificial sequence
  SiRNA target sequence
tcttctataagatttggaata

SEQ ID NO: 161232 - DNA, 21 bp, Artificial sequence
  SiRNA target sequence
cttctataagatttggaataa

SEQ ID NO: 161233 - DNA, 21 bp, Artificial sequence
  SiRNA target sequence
ttctataagatttggaataaa

SEQ ID NO: 161234 - DNA, 21 bp, Artificial sequence
  SiRNA target sequence
tctataagatttggaataaat

SEQ ID NO: 161235 - DNA, 21 bp, Artificial sequence
  SiRNA target sequence
ctataagatttggaataaata

SEQ ID NO: 161236 - DNA, 21 bp, Artificial sequence
  SiRNA target sequence
tataagatttggaataaataa

SEQ ID NO: 161237 - DNA, 21 bp, Artificial sequence
  SiRNA target sequence
ataagatttggaataaataag

SEQ ID NO: 161238 - DNA, 21 bp, Artificial sequence
  SiRNA target sequence
taagatttggaataaataagt

SEQ ID NO: 161239 - DNA, 21 bp, Artificial sequence
  SiRNA target sequence
aagatttggaataaataagtt

SEQ ID NO: 161240 - DNA, 21 bp, Artificial sequence
  SiRNA target sequence
agatttggaataaataagttt

SEQ ID NO: 161241 - DNA, 21 bp, Artificial sequence
  SiRNA target sequence
gatttggaataaataagttta

SEQ ID NO: 161242 - DNA, 21 bp, Artificial sequence
  SiRNA target sequence
atttggaataaataagtttac

SEQ ID NO: 161243 - DNA, 21 bp, Artificial sequence
  SiRNA target sequence
tttggaataaataagtttaca

SEQ ID NO: 161244 - DNA, 21 bp, Artificial sequence
  SiRNA target sequence
ttggaataaataagtttacaa

SEQ ID NO: 161245 - DNA, 21 bp, Artificial sequence
  SiRNA target sequence
tggaataaataagtttacaac

SEQ ID NO: 161246 - DNA, 21 bp, Artificial sequence
  SiRNA target sequence
ggaataaataagtttacaact

SEQ ID NO: 161247 - DNA, 21 bp, Artificial sequence
  SiRNA target sequence
gaataaataagtttacaactg

SEQ ID NO: 161248 - DNA, 21 bp, Artificial sequence
  SiRNA target sequence
aataaataagtttacaactga

SEQ ID NO: 161249 - DNA, 21 bp, Artificial sequence
  SiRNA target sequence
ataaataagtttacaactgaa

SEQ ID NO: 161250 - DNA, 21 bp, Artificial sequence
  SiRNA target sequence
taaataagtttacaactgaag

SEQ ID NO: 161251 - DNA, 21 bp, Artificial sequence
  SiRNA target sequence
aaataagtttacaactgaaga

SEQ ID NO: 161252 - DNA, 21 bp, Artificial sequence
  SiRNA target sequence
aataagtttacaactgaagaa

SEQ ID NO: 161253 - DNA, 21 bp, Artificial sequence
  SiRNA target sequence
ataagtttacaactgaagaag

SEQ ID NO: 161254 - DNA, 21 bp, Artificial sequence
  SiRNA target sequence
taagtttacaactgaagaaga

SEQ ID NO: 161255 - DNA, 21 bp, Artificial sequence
  SiRNA target sequence
aagtttacaactgaagaagaa

SEQ ID NO: 161256 - DNA, 21 bp, Artificial sequence
  SiRNA target sequence
agtttacaactgaagaagaaa

SEQ ID NO: 161257 - DNA, 21 bp, Artificial sequence
  SiRNA target sequence
gtttacaactgaagaagaaat

SEQ ID NO: 161258 - DNA, 21 bp, Artificial sequence
  SiRNA target sequence
tttacaactgaagaagaaatc

SEQ ID NO: 161259 - DNA, 21 bp, Artificial sequence
  SiRNA target sequence
ttacaactgaagaagaaatca

SEQ ID NO: 161260 - DNA, 21 bp, Artificial sequence
  SiRNA target sequence
tacaactgaagaagaaatcaa

SEQ ID NO: 161261 - DNA, 21 bp, Artificial sequence
  SiRNA target sequence
acaactgaagaagaaatcaat

SEQ ID NO: 161262 - DNA, 21 bp, Artificial sequence
  SiRNA target sequence
caactgaagaagaaatcaata

SEQ ID NO: 161263 - DNA, 21 bp, Artificial sequence
  SiRNA target sequence
aactgaagaagaaatcaataa

SEQ ID NO: 161264 - DNA, 21 bp, Artificial sequence
  SiRNA target sequence
actgaagaagaaatcaataaa

SEQ ID NO: 161265 - DNA, 21 bp, Artificial sequence
  SiRNA target sequence
ctgaagaagaaatcaataaag

SEQ ID NO: 161266 - DNA, 21 bp, Artificial sequence
  SiRNA target sequence
tgaagaagaaatcaataaagt

SEQ ID NO: 161267 - DNA, 21 bp, Artificial sequence
  SiRNA target sequence
gaagaagaaatcaataaagta

SEQ ID NO: 161268 - DNA, 21 bp, Artificial sequence
  SiRNA target sequence
aagaagaaatcaataaagtat

SEQ ID NO: 161269 - DNA, 21 bp, Artificial sequence
  SiRNA target sequence
agaagaaatcaataaagtatc

SEQ ID NO: 161270 - DNA, 21 bp, Artificial sequence
  SiRNA target sequence
gaagaaatcaataaagtatct

SEQ ID NO: 161271 - DNA, 21 bp, Artificial sequence
  SiRNA target sequence
aagaaatcaataaagtatcta

SEQ ID NO: 161272 - DNA, 21 bp, Artificial sequence
  SiRNA target sequence
agaaatcaataaagtatctag

SEQ ID NO: 161273 - DNA, 21 bp, Artificial sequence
  SiRNA target sequence
gaaatcaataaagtatctagt

SEQ ID NO: 161274 - DNA, 21 bp, Artificial sequence
  SiRNA target sequence
aaatcaataaagtatctagtg

SEQ ID NO: 161275 - DNA, 21 bp, Artificial sequence
  SiRNA target sequence
aatcaataaagtatctagtga

SEQ ID NO: 161276 - DNA, 21 bp, Artificial sequence
  SiRNA target sequence
atcaataaagtatctagtgat

SEQ ID NO: 161277 - DNA, 21 bp, Artificial sequence
  SiRNA target sequence
tcaataaagtatctagtgata

SEQ ID NO: 161278 - DNA, 21 bp, Artificial sequence
  SiRNA target sequence
caataaagtatctagtgatac

SEQ ID NO: 161279 - DNA, 21 bp, Artificial sequence
  SiRNA target sequence
aataaagtatctagtgataca

SEQ ID NO: 161280 - DNA, 21 bp, Artificial sequence
  SiRNA target sequence
ataaagtatctagtgatacaa

SEQ ID NO: 161281 - DNA, 21 bp, Artificial sequence
  SiRNA target sequence
taaagtatctagtgatacaat

SEQ ID NO: 161282 - DNA, 21 bp, Artificial sequence
  SiRNA target sequence
aaagtatctagtgatacaatt

SEQ ID NO: 161283 - DNA, 21 bp, Artificial sequence
  SiRNA target sequence
aagtatctagtgatacaatta

SEQ ID NO: 161284 - DNA, 21 bp, Artificial sequence
  SiRNA target sequence
agtatctagtgatacaattaa

SEQ ID NO: 161285 - DNA, 21 bp, Artificial sequence
  SiRNA target sequence
gtatctagtgatacaattaaa

SEQ ID NO: 161286 - DNA, 21 bp, Artificial sequence
  SiRNA target sequence
tatctagtgatacaattaaag

SEQ ID NO: 161287 - DNA, 21 bp, Artificial sequence
  SiRNA target sequence
atctagtgatacaattaaagc

SEQ ID NO: 161288 - DNA, 21 bp, Artificial sequence
  SiRNA target sequence
tctagtgatacaattaaagct

SEQ ID NO: 161289 - DNA, 21 bp, Artificial sequence
  SiRNA target sequence
ctagtgatacaattaaagctg

SEQ ID NO: 161290 - DNA, 21 bp, Artificial sequence
  SiRNA target sequence
tagtgatacaattaaagctgt

SEQ ID NO: 161291 - DNA, 21 bp, Artificial sequence
  SiRNA target sequence
agtgatacaattaaagctgtt

SEQ ID NO: 161292 - DNA, 21 bp, Artificial sequence
  SiRNA target sequence
gtgatacaattaaagctgtta

SEQ ID NO: 161293 - DNA, 21 bp, Artificial sequence
  SiRNA target sequence
tgatacaattaaagctgttaa

SEQ ID NO: 161294 - DNA, 21 bp, Artificial sequence
  SiRNA target sequence
gatacaattaaagctgttaat

SEQ ID NO: 161295 - DNA, 21 bp, Artificial sequence
  SiRNA target sequence
atacaattaaagctgttaata

SEQ ID NO: 161296 - DNA, 21 bp, Artificial sequence
  SiRNA target sequence
tacaattaaagctgttaataa

SEQ ID NO: 161297 - DNA, 21 bp, Artificial sequence
  SiRNA target sequence
acaattaaagctgttaataag

SEQ ID NO: 161298 - DNA, 21 bp, Artificial sequence
  SiRNA target sequence
caattaaagctgttaataagt

SEQ ID NO: 161299 - DNA, 21 bp, Artificial sequence
  SiRNA target sequence
aattaaagctgttaataagtt

SEQ ID NO: 161300 - DNA, 21 bp, Artificial sequence
  SiRNA target sequence
attaaagctgttaataagtta

SEQ ID NO: 161301 - DNA, 21 bp, Artificial sequence
  SiRNA target sequence
ttaaagctgttaataagttaa

SEQ ID NO: 161302 - DNA, 21 bp, Artificial sequence
  SiRNA target sequence
taaagctgttaataagttaag

SEQ ID NO: 161303 - DNA, 21 bp, Artificial sequence
  SiRNA target sequence
aaagctgttaataagttaaga

SEQ ID NO: 161304 - DNA, 21 bp, Artificial sequence
  SiRNA target sequence
aagctgttaataagttaagag

SEQ ID NO: 161305 - DNA, 21 bp, Artificial sequence
  SiRNA target sequence
agctgttaataagttaagaga

SEQ ID NO: 161306 - DNA, 21 bp, Artificial sequence
  SiRNA target sequence
gctgttaataagttaagagat

SEQ ID NO: 161307 - DNA, 21 bp, Artificial sequence
  SiRNA target sequence
ctgttaataagttaagagata

SEQ ID NO: 161308 - DNA, 21 bp, Artificial sequence
  SiRNA target sequence
tgttaataagttaagagatat

SEQ ID NO: 161309 - DNA, 21 bp, Artificial sequence
  SiRNA target sequence
gttaataagttaagagatatg

SEQ ID NO: 161310 - DNA, 21 bp, Artificial sequence
  SiRNA target sequence
ttaataagttaagagatatgt

SEQ ID NO: 161311 - DNA, 21 bp, Artificial sequence
  SiRNA target sequence
taataagttaagagatatgtc

SEQ ID NO: 161312 - DNA, 21 bp, Artificial sequence
  SiRNA target sequence
aataagttaagagatatgtct

SEQ ID NO: 161313 - DNA, 21 bp, Artificial sequence
  SiRNA target sequence
ataagttaagagatatgtctc

SEQ ID NO: 161314 - DNA, 21 bp, Artificial sequence
  SiRNA target sequence
taagttaagagatatgtctcc

SEQ ID NO: 161315 - DNA, 21 bp, Artificial sequence
  SiRNA target sequence
aagttaagagatatgtctcct

SEQ ID NO: 161316 - DNA, 21 bp, Artificial sequence
  SiRNA target sequence
agttaagagatatgtctcctt

SEQ ID NO: 161317 - DNA, 21 bp, Artificial sequence
  SiRNA target sequence
gttaagagatatgtctccttt

SEQ ID NO: 161318 - DNA, 21 bp, Artificial sequence
  SiRNA target sequence
ttaagagatatgtctccttta

SEQ ID NO: 161319 - DNA, 21 bp, Artificial sequence
  SiRNA target sequence
taagagatatgtctcctttat

SEQ ID NO: 161320 - DNA, 21 bp, Artificial sequence
  SiRNA target sequence
aagagatatgtctcctttata

SEQ ID NO: 161321 - DNA, 21 bp, Artificial sequence
  SiRNA target sequence
agagatatgtctcctttatat

SEQ ID NO: 161322 - DNA, 21 bp, Artificial sequence
  SiRNA target sequence
gagatatgtctcctttatatg

SEQ ID NO: 161323 - DNA, 21 bp, Artificial sequence
  SiRNA target sequence
agatatgtctcctttatatga

SEQ ID NO: 161324 - DNA, 21 bp, Artificial sequence
  SiRNA target sequence
gatatgtctcctttatatgaa

SEQ ID NO: 161325 - DNA, 21 bp, Artificial sequence
  SiRNA target sequence
atatgtctcctttatatgaaa

SEQ ID NO: 161326 - DNA, 21 bp, Artificial sequence
  SiRNA target sequence
tatgtctcctttatatgaaat

SEQ ID NO: 161327 - DNA, 21 bp, Artificial sequence
  SiRNA target sequence
atgtctcctttatatgaaatg

SEQ ID NO: 161328 - DNA, 21 bp, Artificial sequence
  SiRNA target sequence
tgtctcctttatatgaaatgg

SEQ ID NO: 161329 - DNA, 21 bp, Artificial sequence
  SiRNA target sequence
gtctcctttatatgaaatggt

SEQ ID NO: 161330 - DNA, 21 bp, Artificial sequence
  SiRNA target sequence
tctcctttatatgaaatggtc

SEQ ID NO: 161331 - DNA, 21 bp, Artificial sequence
  SiRNA target sequence
ctcctttatatgaaatggtca

SEQ ID NO: 161332 - DNA, 21 bp, Artificial sequence
  SiRNA target sequence
tcctttatatgaaatggtcaa

SEQ ID NO: 161333 - DNA, 21 bp, Artificial sequence
  SiRNA target sequence
cctttatatgaaatggtcaaa

SEQ ID NO: 161334 - DNA, 21 bp, Artificial sequence
  SiRNA target sequence
ctttatatgaaatggtcaaag

SEQ ID NO: 161335 - DNA, 21 bp, Artificial sequence
  SiRNA target sequence
tttatatgaaatggtcaaaga

SEQ ID NO: 161336 - DNA, 21 bp, Artificial sequence
  SiRNA target sequence
ttatatgaaatggtcaaagaa

SEQ ID NO: 161337 - DNA, 21 bp, Artificial sequence
  SiRNA target sequence
tatatgaaatggtcaaagaag

SEQ ID NO: 161338 - DNA, 21 bp, Artificial sequence
  SiRNA target sequence
atatgaaatggtcaaagaagg

SEQ ID NO: 161339 - DNA, 21 bp, Artificial sequence
  SiRNA target sequence
tatgaaatggtcaaagaaggg

SEQ ID NO: 161340 - DNA, 21 bp, Artificial sequence
  SiRNA target sequence
atgaaatggtcaaagaaggga

SEQ ID NO: 161341 - DNA, 21 bp, Artificial sequence
  SiRNA target sequence
tgaaatggtcaaagaagggat

SEQ ID NO: 161342 - DNA, 21 bp, Artificial sequence
  SiRNA target sequence
gaaatggtcaaagaagggata

SEQ ID NO: 161343 - DNA, 21 bp, Artificial sequence
  SiRNA target sequence
aaatggtcaaagaagggatag

SEQ ID NO: 161344 - DNA, 21 bp, Artificial sequence
  SiRNA target sequence
aatggtcaaagaagggataga

SEQ ID NO: 161345 - DNA, 21 bp, Artificial sequence
  SiRNA target sequence
atggtcaaagaagggatagat

SEQ ID NO: 161346 - DNA, 21 bp, Artificial sequence
  SiRNA target sequence
tggtcaaagaagggatagatt

SEQ ID NO: 161347 - DNA, 21 bp, Artificial sequence
  SiRNA target sequence
ggtcaaagaagggatagattt

SEQ ID NO: 161348 - DNA, 21 bp, Artificial sequence
  SiRNA target sequence
gtcaaagaagggatagattta

SEQ ID NO: 161349 - DNA, 21 bp, Artificial sequence
  SiRNA target sequence
tcaaagaagggatagatttag

SEQ ID NO: 161350 - DNA, 21 bp, Artificial sequence
  SiRNA target sequence
caaagaagggatagatttaga

SEQ ID NO: 161351 - DNA, 21 bp, Artificial sequence
  SiRNA target sequence
aaagaagggatagatttagat

SEQ ID NO: 161352 - DNA, 21 bp, Artificial sequence
  SiRNA target sequence
aagaagggatagatttagata

SEQ ID NO: 161353 - DNA, 21 bp, Artificial sequence
  SiRNA target sequence
agaagggatagatttagataa

SEQ ID NO: 161354 - DNA, 21 bp, Artificial sequence
  SiRNA target sequence
gaagggatagatttagataaa

SEQ ID NO: 161355 - DNA, 21 bp, Artificial sequence
  SiRNA target sequence
aagggatagatttagataaaa

SEQ ID NO: 161356 - DNA, 21 bp, Artificial sequence
  SiRNA target sequence
agggatagatttagataaaat

SEQ ID NO: 161357 - DNA, 21 bp, Artificial sequence
  SiRNA target sequence
gggatagatttagataaaatt

SEQ ID NO: 161358 - DNA, 21 bp, Artificial sequence
  SiRNA target sequence
ggatagatttagataaaatta

SEQ ID NO: 161359 - DNA, 21 bp, Artificial sequence
  SiRNA target sequence
gatagatttagataaaattaa

SEQ ID NO: 161360 - DNA, 21 bp, Artificial sequence
  SiRNA target sequence
atagatttagataaaattaat

SEQ ID NO: 161361 - DNA, 21 bp, Artificial sequence
  SiRNA target sequence
tagatttagataaaattaatt

SEQ ID NO: 161362 - DNA, 21 bp, Artificial sequence
  SiRNA target sequence
agatttagataaaattaattg

SEQ ID NO: 161363 - DNA, 21 bp, Artificial sequence
  SiRNA target sequence
gatttagataaaattaattgg

SEQ ID NO: 161364 - DNA, 21 bp, Artificial sequence
  SiRNA target sequence
atttagataaaattaattggt

SEQ ID NO: 161365 - DNA, 21 bp, Artificial sequence
  SiRNA target sequence
tttagataaaattaattggtc

SEQ ID NO: 161366 - DNA, 21 bp, Artificial sequence
  SiRNA target sequence
ttagataaaattaattggtct

SEQ ID NO: 161367 - DNA, 21 bp, Artificial sequence
  SiRNA target sequence
tagataaaattaattggtctg

SEQ ID NO: 161368 - DNA, 21 bp, Artificial sequence
  SiRNA target sequence
agataaaattaattggtctgc

SEQ ID NO: 161369 - DNA, 21 bp, Artificial sequence
  SiRNA target sequence
gataaaattaattggtctgct

SEQ ID NO: 161370 - DNA, 21 bp, Artificial sequence
  SiRNA target sequence
ataaaattaattggtctgctt

SEQ ID NO: 161371 - DNA, 21 bp, Artificial sequence
  SiRNA target sequence
taaaattaattggtctgctta

SEQ ID NO: 161372 - DNA, 21 bp, Artificial sequence
  SiRNA target sequence
aaaattaattggtctgcttaa

SEQ ID NO: 161373 - DNA, 22 bp, Artificial sequence
  SiRNA target sequence
atgttatttttttatagcccca

SEQ ID NO: 161374 - DNA, 22 bp, Artificial sequence
  SiRNA target sequence
tgttatttttttatagccccat

SEQ ID NO: 161375 - DNA, 22 bp, Artificial sequence
  SiRNA target sequence
gttatttttttatagccccatt

SEQ ID NO: 161376 - DNA, 22 bp, Artificial sequence
  SiRNA target sequence
ttatttttttatagccccattt

SEQ ID NO: 161377 - DNA, 22 bp, Artificial sequence
  SiRNA target sequence
tatttttttatagccccatttt

SEQ ID NO: 161378 - DNA, 22 bp, Artificial sequence
  SiRNA target sequence
atttttttatagccccattttt

SEQ ID NO: 161379 - DNA, 22 bp, Artificial sequence
  SiRNA target sequence
tttttttatagccccattttta

SEQ ID NO: 161380 - DNA, 22 bp, Artificial sequence
  SiRNA target sequence
ttttttatagccccatttttat

SEQ ID NO: 161381 - DNA, 22 bp, Artificial sequence
  SiRNA target sequence
tttttatagccccatttttatg

SEQ ID NO: 161382 - DNA, 22 bp, Artificial sequence
  SiRNA target sequence
ttttatagccccatttttatga

SEQ ID NO: 161383 - DNA, 22 bp, Artificial sequence
  SiRNA target sequence
tttatagccccatttttatgac

SEQ ID NO: 161384 - DNA, 22 bp, Artificial sequence
  SiRNA target sequence
ttatagccccatttttatgact

SEQ ID NO: 161385 - DNA, 22 bp, Artificial sequence
  SiRNA target sequence
tatagccccatttttatgacta

SEQ ID NO: 161386 - DNA, 22 bp, Artificial sequence
  SiRNA target sequence
atagccccatttttatgactaa

SEQ ID NO: 161387 - DNA, 22 bp, Artificial sequence
  SiRNA target sequence
tagccccatttttatgactaaa

SEQ ID NO: 161388 - DNA, 22 bp, Artificial sequence
  SiRNA target sequence
agccccatttttatgactaaaa

SEQ ID NO: 161389 - DNA, 22 bp, Artificial sequence
  SiRNA target sequence
gccccatttttatgactaaaag

SEQ ID NO: 161390 - DNA, 22 bp, Artificial sequence
  SiRNA target sequence
ccccatttttatgactaaaagt

SEQ ID NO: 161391 - DNA, 22 bp, Artificial sequence
  SiRNA target sequence
cccatttttatgactaaaagtt

SEQ ID NO: 161392 - DNA, 22 bp, Artificial sequence
  SiRNA target sequence
ccatttttatgactaaaagttt

SEQ ID NO: 161393 - DNA, 22 bp, Artificial sequence
  SiRNA target sequence
catttttatgactaaaagttta

SEQ ID NO: 161394 - DNA, 22 bp, Artificial sequence
  SiRNA target sequence
atttttatgactaaaagtttaa

SEQ ID NO: 161395 - DNA, 22 bp, Artificial sequence
  SiRNA target sequence
tttttatgactaaaagtttaac

SEQ ID NO: 161396 - DNA, 22 bp, Artificial sequence
  SiRNA target sequence
ttttatgactaaaagtttaacg

SEQ ID NO: 161397 - DNA, 22 bp, Artificial sequence
  SiRNA target sequence
tttatgactaaaagtttaacga

SEQ ID NO: 161398 - DNA, 22 bp, Artificial sequence
  SiRNA target sequence
ttatgactaaaagtttaacgaa

SEQ ID NO: 161399 - DNA, 22 bp, Artificial sequence
  SiRNA target sequence
tatgactaaaagtttaacgaat

SEQ ID NO: 161400 - DNA, 22 bp, Artificial sequence
  SiRNA target sequence
atgactaaaagtttaacgaatt

SEQ ID NO: 161401 - DNA, 22 bp, Artificial sequence
  SiRNA target sequence
tgactaaaagtttaacgaattc

SEQ ID NO: 161402 - DNA, 22 bp, Artificial sequence
  SiRNA target sequence
gactaaaagtttaacgaattct

SEQ ID NO: 161403 - DNA, 22 bp, Artificial sequence
  SiRNA target sequence
actaaaagtttaacgaattcta

SEQ ID NO: 161404 - DNA, 22 bp, Artificial sequence
  SiRNA target sequence
ctaaaagtttaacgaattctaa

SEQ ID NO: 161405 - DNA, 22 bp, Artificial sequence
  SiRNA target sequence
taaaagtttaacgaattctaaa

SEQ ID NO: 161406 - DNA, 22 bp, Artificial sequence
  SiRNA target sequence
aaaagtttaacgaattctaaaa

SEQ ID NO: 161407 - DNA, 22 bp, Artificial sequence
  SiRNA target sequence
aaagtttaacgaattctaaaac

SEQ ID NO: 161408 - DNA, 22 bp, Artificial sequence
  SiRNA target sequence
aagtttaacgaattctaaaact

SEQ ID NO: 161409 - DNA, 22 bp, Artificial sequence
  SiRNA target sequence
agtttaacgaattctaaaactt

SEQ ID NO: 161410 - DNA, 22 bp, Artificial sequence
  SiRNA target sequence
gtttaacgaattctaaaacttt

SEQ ID NO: 161411 - DNA, 22 bp, Artificial sequence
  SiRNA target sequence
tttaacgaattctaaaacttta

SEQ ID NO: 161412 - DNA, 22 bp, Artificial sequence
  SiRNA target sequence
ttaacgaattctaaaactttaa

SEQ ID NO: 161413 - DNA, 22 bp, Artificial sequence
  SiRNA target sequence
taacgaattctaaaactttaaa

SEQ ID NO: 161414 - DNA, 22 bp, Artificial sequence
  SiRNA target sequence
aacgaattctaaaactttaaat

SEQ ID NO: 161415 - DNA, 22 bp, Artificial sequence
  SiRNA target sequence
acgaattctaaaactttaaatt

SEQ ID NO: 161416 - DNA, 22 bp, Artificial sequence
  SiRNA target sequence
cgaattctaaaactttaaattt

SEQ ID NO: 161417 - DNA, 22 bp, Artificial sequence
  SiRNA target sequence
gaattctaaaactttaaattta

SEQ ID NO: 161418 - DNA, 22 bp, Artificial sequence
  SiRNA target sequence
aattctaaaactttaaatttaa

SEQ ID NO: 161419 - DNA, 22 bp, Artificial sequence
  SiRNA target sequence
attctaaaactttaaatttaat

SEQ ID NO: 161420 - DNA, 22 bp, Artificial sequence
  SiRNA target sequence
ttctaaaactttaaatttaatg

SEQ ID NO: 161421 - DNA, 22 bp, Artificial sequence
  SiRNA target sequence
tctaaaactttaaatttaatgt

SEQ ID NO: 161422 - DNA, 22 bp, Artificial sequence
  SiRNA target sequence
ctaaaactttaaatttaatgtc

SEQ ID NO: 161423 - DNA, 22 bp, Artificial sequence
  SiRNA target sequence
taaaactttaaatttaatgtca

SEQ ID NO: 161424 - DNA, 22 bp, Artificial sequence
  SiRNA target sequence
aaaactttaaatttaatgtcaa

SEQ ID NO: 161425 - DNA, 22 bp, Artificial sequence
  SiRNA target sequence
aaactttaaatttaatgtcaag

SEQ ID NO: 161426 - DNA, 22 bp, Artificial sequence
  SiRNA target sequence
aactttaaatttaatgtcaagt

SEQ ID NO: 161427 - DNA, 22 bp, Artificial sequence
  SiRNA target sequence
actttaaatttaatgtcaagtg

SEQ ID NO: 161428 - DNA, 22 bp, Artificial sequence
  SiRNA target sequence
ctttaaatttaatgtcaagtgt

SEQ ID NO: 161429 - DNA, 22 bp, Artificial sequence
  SiRNA target sequence
tttaaatttaatgtcaagtgta

SEQ ID NO: 161430 - DNA, 22 bp, Artificial sequence
  SiRNA target sequence
ttaaatttaatgtcaagtgtac

SEQ ID NO: 161431 - DNA, 22 bp, Artificial sequence
  SiRNA target sequence
taaatttaatgtcaagtgtaca

SEQ ID NO: 161432 - DNA, 22 bp, Artificial sequence
  SiRNA target sequence
aaatttaatgtcaagtgtacaa

SEQ ID NO: 161433 - DNA, 22 bp, Artificial sequence
  SiRNA target sequence
aatttaatgtcaagtgtacaat

SEQ ID NO: 161434 - DNA, 22 bp, Artificial sequence
  SiRNA target sequence
atttaatgtcaagtgtacaatc

SEQ ID NO: 161435 - DNA, 22 bp, Artificial sequence
  SiRNA target sequence
tttaatgtcaagtgtacaatca

SEQ ID NO: 161436 - DNA, 22 bp, Artificial sequence
  SiRNA target sequence
ttaatgtcaagtgtacaatcac

SEQ ID NO: 161437 - DNA, 22 bp, Artificial sequence
  SiRNA target sequence
taatgtcaagtgtacaatcacc

SEQ ID NO: 161438 - DNA, 22 bp, Artificial sequence
  SiRNA target sequence
aatgtcaagtgtacaatcacca

SEQ ID NO: 161439 - DNA, 22 bp, Artificial sequence
  SiRNA target sequence
atgtcaagtgtacaatcaccag

SEQ ID NO: 161440 - DNA, 22 bp, Artificial sequence
  SiRNA target sequence
tgtcaagtgtacaatcaccagt

SEQ ID NO: 161441 - DNA, 22 bp, Artificial sequence
  SiRNA target sequence
gtcaagtgtacaatcaccagtt

SEQ ID NO: 161442 - DNA, 22 bp, Artificial sequence
  SiRNA target sequence
tcaagtgtacaatcaccagtta

SEQ ID NO: 161443 - DNA, 22 bp, Artificial sequence
  SiRNA target sequence
caagtgtacaatcaccagttat

SEQ ID NO: 161444 - DNA, 22 bp, Artificial sequence
  SiRNA target sequence
aagtgtacaatcaccagttata

SEQ ID NO: 161445 - DNA, 22 bp, Artificial sequence
  SiRNA target sequence
agtgtacaatcaccagttataa

SEQ ID NO: 161446 - DNA, 22 bp, Artificial sequence
  SiRNA target sequence
gtgtacaatcaccagttataaa

SEQ ID NO: 161447 - DNA, 22 bp, Artificial sequence
  SiRNA target sequence
tgtacaatcaccagttataaat

SEQ ID NO: 161448 - DNA, 22 bp, Artificial sequence
  SiRNA target sequence
gtacaatcaccagttataaata

SEQ ID NO: 161449 - DNA, 22 bp, Artificial sequence
  SiRNA target sequence
tacaatcaccagttataaatac

SEQ ID NO: 161450 - DNA, 22 bp, Artificial sequence
  SiRNA target sequence
acaatcaccagttataaataca

SEQ ID NO: 161451 - DNA, 22 bp, Artificial sequence
  SiRNA target sequence
caatcaccagttataaatacaa

SEQ ID NO: 161452 - DNA, 22 bp, Artificial sequence
  SiRNA target sequence
aatcaccagttataaatacaaa

SEQ ID NO: 161453 - DNA, 22 bp, Artificial sequence
  SiRNA target sequence
atcaccagttataaatacaaaa

SEQ ID NO: 161454 - DNA, 22 bp, Artificial sequence
  SiRNA target sequence
tcaccagttataaatacaaaaa

SEQ ID NO: 161455 - DNA, 22 bp, Artificial sequence
  SiRNA target sequence
caccagttataaatacaaaaaa

SEQ ID NO: 161456 - DNA, 22 bp, Artificial sequence
  SiRNA target sequence
accagttataaatacaaaaaaa

SEQ ID NO: 161457 - DNA, 22 bp, Artificial sequence
  SiRNA target sequence
ccagttataaatacaaaaaaaa

SEQ ID NO: 161458 - DNA, 22 bp, Artificial sequence
  SiRNA target sequence
cagttataaatacaaaaaaaat

SEQ ID NO: 161459 - DNA, 22 bp, Artificial sequence
  SiRNA target sequence
agttataaatacaaaaaaaata

SEQ ID NO: 161460 - DNA, 22 bp, Artificial sequence
  SiRNA target sequence
gttataaatacaaaaaaaatat

SEQ ID NO: 161461 - DNA, 22 bp, Artificial sequence
  SiRNA target sequence
ttataaatacaaaaaaaatata

SEQ ID NO: 161462 - DNA, 22 bp, Artificial sequence
  SiRNA target sequence
tataaatacaaaaaaaatatat

SEQ ID NO: 161463 - DNA, 22 bp, Artificial sequence
  SiRNA target sequence
ataaatacaaaaaaaatatatc

SEQ ID NO: 161464 - DNA, 22 bp, Artificial sequence
  SiRNA target sequence
taaatacaaaaaaaatatatct

SEQ ID NO: 161465 - DNA, 22 bp, Artificial sequence
  SiRNA target sequence
aaatacaaaaaaaatatatctt

SEQ ID NO: 161466 - DNA, 22 bp, Artificial sequence
  SiRNA target sequence
aatacaaaaaaaatatatcttg

SEQ ID NO: 161467 - DNA, 22 bp, Artificial sequence
  SiRNA target sequence
atacaaaaaaaatatatcttga

SEQ ID NO: 161468 - DNA, 22 bp, Artificial sequence
  SiRNA target sequence
tacaaaaaaaatatatcttgat

SEQ ID NO: 161469 - DNA, 22 bp, Artificial sequence
  SiRNA target sequence
acaaaaaaaatatatcttgatg

SEQ ID NO: 161470 - DNA, 22 bp, Artificial sequence
  SiRNA target sequence
caaaaaaaatatatcttgatgc

SEQ ID NO: 161471 - DNA, 22 bp, Artificial sequence
  SiRNA target sequence
aaaaaaaatatatcttgatgca

SEQ ID NO: 161472 - DNA, 22 bp, Artificial sequence
  SiRNA target sequence
aaaaaaatatatcttgatgcac

SEQ ID NO: 161473 - DNA, 22 bp, Artificial sequence
  SiRNA target sequence
aaaaaatatatcttgatgcaca

SEQ ID NO: 161474 - DNA, 22 bp, Artificial sequence
  SiRNA target sequence
aaaaatatatcttgatgcacaa

SEQ ID NO: 161475 - DNA, 22 bp, Artificial sequence
  SiRNA target sequence
aaaatatatcttgatgcacaag

SEQ ID NO: 161476 - DNA, 22 bp, Artificial sequence
  SiRNA target sequence
aaatatatcttgatgcacaagc

SEQ ID NO: 161477 - DNA, 22 bp, Artificial sequence
  SiRNA target sequence
aatatatcttgatgcacaagcg

SEQ ID NO: 161478 - DNA, 22 bp, Artificial sequence
  SiRNA target sequence
atatatcttgatgcacaagcga

SEQ ID NO: 161479 - DNA, 22 bp, Artificial sequence
  SiRNA target sequence
tatatcttgatgcacaagcgac

SEQ ID NO: 161480 - DNA, 22 bp, Artificial sequence
  SiRNA target sequence
atatcttgatgcacaagcgacc

SEQ ID NO: 161481 - DNA, 22 bp, Artificial sequence
  SiRNA target sequence
tatcttgatgcacaagcgacca

SEQ ID NO: 161482 - DNA, 22 bp, Artificial sequence
  SiRNA target sequence
atcttgatgcacaagcgaccaa

SEQ ID NO: 161483 - DNA, 22 bp, Artificial sequence
  SiRNA target sequence
tcttgatgcacaagcgaccaag

SEQ ID NO: 161484 - DNA, 22 bp, Artificial sequence
  SiRNA target sequence
cttgatgcacaagcgaccaagc

SEQ ID NO: 161485 - DNA, 22 bp, Artificial sequence
  SiRNA target sequence
ttgatgcacaagcgaccaagcc

SEQ ID NO: 161486 - DNA, 22 bp, Artificial sequence
  SiRNA target sequence
tgatgcacaagcgaccaagcct

SEQ ID NO: 161487 - DNA, 22 bp, Artificial sequence
  SiRNA target sequence
gatgcacaagcgaccaagcctt

SEQ ID NO: 161488 - DNA, 22 bp, Artificial sequence
  SiRNA target sequence
atgcacaagcgaccaagccttt

SEQ ID NO: 161489 - DNA, 22 bp, Artificial sequence
  SiRNA target sequence
tgcacaagcgaccaagccttta

SEQ ID NO: 161490 - DNA, 22 bp, Artificial sequence
  SiRNA target sequence
gcacaagcgaccaagcctttag

SEQ ID NO: 161491 - DNA, 22 bp, Artificial sequence
  SiRNA target sequence
cacaagcgaccaagcctttaga

SEQ ID NO: 161492 - DNA, 22 bp, Artificial sequence
  SiRNA target sequence
acaagcgaccaagcctttagac

SEQ ID NO: 161493 - DNA, 22 bp, Artificial sequence
  SiRNA target sequence
caagcgaccaagcctttagacc

SEQ ID NO: 161494 - DNA, 22 bp, Artificial sequence
  SiRNA target sequence
aagcgaccaagcctttagaccc

SEQ ID NO: 161495 - DNA, 22 bp, Artificial sequence
  SiRNA target sequence
agcgaccaagcctttagacccg

SEQ ID NO: 161496 - DNA, 22 bp, Artificial sequence
  SiRNA target sequence
gcgaccaagcctttagacccgc

SEQ ID NO: 161497 - DNA, 22 bp, Artificial sequence
  SiRNA target sequence
cgaccaagcctttagacccgcg

SEQ ID NO: 161498 - DNA, 22 bp, Artificial sequence
  SiRNA target sequence
gaccaagcctttagacccgcgt

SEQ ID NO: 161499 - DNA, 22 bp, Artificial sequence
  SiRNA target sequence
accaagcctttagacccgcgtg

SEQ ID NO: 161500 - DNA, 22 bp, Artificial sequence
  SiRNA target sequence
ccaagcctttagacccgcgtgt

SEQ ID NO: 161501 - DNA, 22 bp, Artificial sequence
  SiRNA target sequence
caagcctttagacccgcgtgtg

SEQ ID NO: 161502 - DNA, 22 bp, Artificial sequence
  SiRNA target sequence
aagcctttagacccgcgtgtgc

SEQ ID NO: 161503 - DNA, 22 bp, Artificial sequence
  SiRNA target sequence
agcctttagacccgcgtgtgct

SEQ ID NO: 161504 - DNA, 22 bp, Artificial sequence
  SiRNA target sequence
gcctttagacccgcgtgtgctt

SEQ ID NO: 161505 - DNA, 22 bp, Artificial sequence
  SiRNA target sequence
cctttagacccgcgtgtgcttg

SEQ ID NO: 161506 - DNA, 22 bp, Artificial sequence
  SiRNA target sequence
ctttagacccgcgtgtgcttga

SEQ ID NO: 161507 - DNA, 22 bp, Artificial sequence
  SiRNA target sequence
tttagacccgcgtgtgcttgat

SEQ ID NO: 161508 - DNA, 22 bp, Artificial sequence
  SiRNA target sequence
ttagacccgcgtgtgcttgatg

SEQ ID NO: 161509 - DNA, 22 bp, Artificial sequence
  SiRNA target sequence
tagacccgcgtgtgcttgatgc

SEQ ID NO: 161510 - DNA, 22 bp, Artificial sequence
  SiRNA target sequence
agacccgcgtgtgcttgatgca

SEQ ID NO: 161511 - DNA, 22 bp, Artificial sequence
  SiRNA target sequence
gacccgcgtgtgcttgatgcaa

SEQ ID NO: 161512 - DNA, 22 bp, Artificial sequence
  SiRNA target sequence
acccgcgtgtgcttgatgcaat

SEQ ID NO: 161513 - DNA, 22 bp, Artificial sequence
  SiRNA target sequence
cccgcgtgtgcttgatgcaatg

SEQ ID NO: 161514 - DNA, 22 bp, Artificial sequence
  SiRNA target sequence
ccgcgtgtgcttgatgcaatgc

SEQ ID NO: 161515 - DNA, 22 bp, Artificial sequence
  SiRNA target sequence
cgcgtgtgcttgatgcaatgct

SEQ ID NO: 161516 - DNA, 22 bp, Artificial sequence
  SiRNA target sequence
gcgtgtgcttgatgcaatgctt

SEQ ID NO: 161517 - DNA, 22 bp, Artificial sequence
  SiRNA target sequence
cgtgtgcttgatgcaatgcttc

SEQ ID NO: 161518 - DNA, 22 bp, Artificial sequence
  SiRNA target sequence
gtgtgcttgatgcaatgcttcc

SEQ ID NO: 161519 - DNA, 22 bp, Artificial sequence
  SiRNA target sequence
tgtgcttgatgcaatgcttcca

SEQ ID NO: 161520 - DNA, 22 bp, Artificial sequence
  SiRNA target sequence
gtgcttgatgcaatgcttccat

SEQ ID NO: 161521 - DNA, 22 bp, Artificial sequence
  SiRNA target sequence
tgcttgatgcaatgcttccata

SEQ ID NO: 161522 - DNA, 22 bp, Artificial sequence
  SiRNA target sequence
gcttgatgcaatgcttccatac

SEQ ID NO: 161523 - DNA, 22 bp, Artificial sequence
  SiRNA target sequence
cttgatgcaatgcttccatact

SEQ ID NO: 161524 - DNA, 22 bp, Artificial sequence
  SiRNA target sequence
ttgatgcaatgcttccatacta

SEQ ID NO: 161525 - DNA, 22 bp, Artificial sequence
  SiRNA target sequence
tgatgcaatgcttccatactat

SEQ ID NO: 161526 - DNA, 22 bp, Artificial sequence
  SiRNA target sequence
gatgcaatgcttccatactata

SEQ ID NO: 161527 - DNA, 22 bp, Artificial sequence
  SiRNA target sequence
atgcaatgcttccatactatac

SEQ ID NO: 161528 - DNA, 22 bp, Artificial sequence
  SiRNA target sequence
tgcaatgcttccatactataca

SEQ ID NO: 161529 - DNA, 22 bp, Artificial sequence
  SiRNA target sequence
gcaatgcttccatactatacat

SEQ ID NO: 161530 - DNA, 22 bp, Artificial sequence
  SiRNA target sequence
caatgcttccatactatacatc

SEQ ID NO: 161531 - DNA, 22 bp, Artificial sequence
  SiRNA target sequence
aatgcttccatactatacatcc

SEQ ID NO: 161532 - DNA, 22 bp, Artificial sequence
  SiRNA target sequence
atgcttccatactatacatcca

SEQ ID NO: 161533 - DNA, 22 bp, Artificial sequence
  SiRNA target sequence
tgcttccatactatacatccat

SEQ ID NO: 161534 - DNA, 22 bp, Artificial sequence
  SiRNA target sequence
gcttccatactatacatccatt

SEQ ID NO: 161535 - DNA, 22 bp, Artificial sequence
  SiRNA target sequence
cttccatactatacatccattt

SEQ ID NO: 161536 - DNA, 22 bp, Artificial sequence
  SiRNA target sequence
ttccatactatacatccatttt

SEQ ID NO: 161537 - DNA, 22 bp, Artificial sequence
  SiRNA target sequence
tccatactatacatccattttt

SEQ ID NO: 161538 - DNA, 22 bp, Artificial sequence
  SiRNA target sequence
ccatactatacatccatttttg

SEQ ID NO: 161539 - DNA, 22 bp, Artificial sequence
  SiRNA target sequence
catactatacatccatttttgg

SEQ ID NO: 161540 - DNA, 22 bp, Artificial sequence
  SiRNA target sequence
atactatacatccatttttgga

SEQ ID NO: 161541 - DNA, 22 bp, Artificial sequence
  SiRNA target sequence
tactatacatccatttttggaa

SEQ ID NO: 161542 - DNA, 22 bp, Artificial sequence
  SiRNA target sequence
actatacatccatttttggaaa

SEQ ID NO: 161543 - DNA, 22 bp, Artificial sequence
  SiRNA target sequence
ctatacatccatttttggaaat

SEQ ID NO: 161544 - DNA, 22 bp, Artificial sequence
  SiRNA target sequence
tatacatccatttttggaaatc

SEQ ID NO: 161545 - DNA, 22 bp, Artificial sequence
  SiRNA target sequence
atacatccatttttggaaatcc

SEQ ID NO: 161546 - DNA, 22 bp, Artificial sequence
  SiRNA target sequence
tacatccatttttggaaatcca

SEQ ID NO: 161547 - DNA, 22 bp, Artificial sequence
  SiRNA target sequence
acatccatttttggaaatccac

SEQ ID NO: 161548 - DNA, 22 bp, Artificial sequence
  SiRNA target sequence
catccatttttggaaatccaca

SEQ ID NO: 161549 - DNA, 22 bp, Artificial sequence
  SiRNA target sequence
atccatttttggaaatccacat

SEQ ID NO: 161550 - DNA, 22 bp, Artificial sequence
  SiRNA target sequence
tccatttttggaaatccacatt

SEQ ID NO: 161551 - DNA, 22 bp, Artificial sequence
  SiRNA target sequence
ccatttttggaaatccacattc

SEQ ID NO: 161552 - DNA, 22 bp, Artificial sequence
  SiRNA target sequence
catttttggaaatccacattct

SEQ ID NO: 161553 - DNA, 22 bp, Artificial sequence
  SiRNA target sequence
atttttggaaatccacattctc

SEQ ID NO: 161554 - DNA, 22 bp, Artificial sequence
  SiRNA target sequence
tttttggaaatccacattctcg

SEQ ID NO: 161555 - DNA, 22 bp, Artificial sequence
  SiRNA target sequence
ttttggaaatccacattctcgc

SEQ ID NO: 161556 - DNA, 22 bp, Artificial sequence
  SiRNA target sequence
tttggaaatccacattctcgca

SEQ ID NO: 161557 - DNA, 22 bp, Artificial sequence
  SiRNA target sequence
ttggaaatccacattctcgcac

SEQ ID NO: 161558 - DNA, 22 bp, Artificial sequence
  SiRNA target sequence
tggaaatccacattctcgcacg

SEQ ID NO: 161559 - DNA, 22 bp, Artificial sequence
  SiRNA target sequence
ggaaatccacattctcgcacgc

SEQ ID NO: 161560 - DNA, 22 bp, Artificial sequence
  SiRNA target sequence
gaaatccacattctcgcacgca

SEQ ID NO: 161561 - DNA, 22 bp, Artificial sequence
  SiRNA target sequence
aaatccacattctcgcacgcat

SEQ ID NO: 161562 - DNA, 22 bp, Artificial sequence
  SiRNA target sequence
aatccacattctcgcacgcata

SEQ ID NO: 161563 - DNA, 22 bp, Artificial sequence
  SiRNA target sequence
atccacattctcgcacgcatac

SEQ ID NO: 161564 - DNA, 22 bp, Artificial sequence
  SiRNA target sequence
tccacattctcgcacgcatacg

SEQ ID NO: 161565 - DNA, 22 bp, Artificial sequence
  SiRNA target sequence
ccacattctcgcacgcatacgt

SEQ ID NO: 161566 - DNA, 22 bp, Artificial sequence
  SiRNA target sequence
cacattctcgcacgcatacgtt

SEQ ID NO: 161567 - DNA, 22 bp, Artificial sequence
  SiRNA target sequence
acattctcgcacgcatacgttt

SEQ ID NO: 161568 - DNA, 22 bp, Artificial sequence
  SiRNA target sequence
cattctcgcacgcatacgtttg

SEQ ID NO: 161569 - DNA, 22 bp, Artificial sequence
  SiRNA target sequence
attctcgcacgcatacgtttgg

SEQ ID NO: 161570 - DNA, 22 bp, Artificial sequence
  SiRNA target sequence
ttctcgcacgcatacgtttgga

SEQ ID NO: 161571 - DNA, 22 bp, Artificial sequence
  SiRNA target sequence
tctcgcacgcatacgtttggat

SEQ ID NO: 161572 - DNA, 22 bp, Artificial sequence
  SiRNA target sequence
ctcgcacgcatacgtttggatg

SEQ ID NO: 161573 - DNA, 22 bp, Artificial sequence
  SiRNA target sequence
tcgcacgcatacgtttggatgg

SEQ ID NO: 161574 - DNA, 22 bp, Artificial sequence
  SiRNA target sequence
cgcacgcatacgtttggatgga

SEQ ID NO: 161575 - DNA, 22 bp, Artificial sequence
  SiRNA target sequence
gcacgcatacgtttggatggaa

SEQ ID NO: 161576 - DNA, 22 bp, Artificial sequence
  SiRNA target sequence
cacgcatacgtttggatggaat

SEQ ID NO: 161577 - DNA, 22 bp, Artificial sequence
  SiRNA target sequence
acgcatacgtttggatggaatg

SEQ ID NO: 161578 - DNA, 22 bp, Artificial sequence
  SiRNA target sequence
cgcatacgtttggatggaatgc

SEQ ID NO: 161579 - DNA, 22 bp, Artificial sequence
  SiRNA target sequence
gcatacgtttggatggaatgca

SEQ ID NO: 161580 - DNA, 22 bp, Artificial sequence
  SiRNA target sequence
catacgtttggatggaatgcag

SEQ ID NO: 161581 - DNA, 22 bp, Artificial sequence
  SiRNA target sequence
atacgtttggatggaatgcaga

SEQ ID NO: 161582 - DNA, 22 bp, Artificial sequence
  SiRNA target sequence
tacgtttggatggaatgcagaa

SEQ ID NO: 161583 - DNA, 22 bp, Artificial sequence
  SiRNA target sequence
acgtttggatggaatgcagaaa

SEQ ID NO: 161584 - DNA, 22 bp, Artificial sequence
  SiRNA target sequence
cgtttggatggaatgcagaaaa

SEQ ID NO: 161585 - DNA, 22 bp, Artificial sequence
  SiRNA target sequence
gtttggatggaatgcagaaaaa

SEQ ID NO: 161586 - DNA, 22 bp, Artificial sequence
  SiRNA target sequence
tttggatggaatgcagaaaaag

SEQ ID NO: 161587 - DNA, 22 bp, Artificial sequence
  SiRNA target sequence
ttggatggaatgcagaaaaagg

SEQ ID NO: 161588 - DNA, 22 bp, Artificial sequence
  SiRNA target sequence
tggatggaatgcagaaaaaggc

SEQ ID NO: 161589 - DNA, 22 bp, Artificial sequence
  SiRNA target sequence
ggatggaatgcagaaaaaggcg

SEQ ID NO: 161590 - DNA, 22 bp, Artificial sequence
  SiRNA target sequence
gatggaatgcagaaaaaggcgt

SEQ ID NO: 161591 - DNA, 22 bp, Artificial sequence
  SiRNA target sequence
atggaatgcagaaaaaggcgta

SEQ ID NO: 161592 - DNA, 22 bp, Artificial sequence
  SiRNA target sequence
tggaatgcagaaaaaggcgtag

SEQ ID NO: 161593 - DNA, 22 bp, Artificial sequence
  SiRNA target sequence
ggaatgcagaaaaaggcgtaga

SEQ ID NO: 161594 - DNA, 22 bp, Artificial sequence
  SiRNA target sequence
gaatgcagaaaaaggcgtagaa

SEQ ID NO: 161595 - DNA, 22 bp, Artificial sequence
  SiRNA target sequence
aatgcagaaaaaggcgtagaaa

SEQ ID NO: 161596 - DNA, 22 bp, Artificial sequence
  SiRNA target sequence
atgcagaaaaaggcgtagaaat

SEQ ID NO: 161597 - DNA, 22 bp, Artificial sequence
  SiRNA target sequence
tgcagaaaaaggcgtagaaatg

SEQ ID NO: 161598 - DNA, 22 bp, Artificial sequence
  SiRNA target sequence
gcagaaaaaggcgtagaaatgg

SEQ ID NO: 161599 - DNA, 22 bp, Artificial sequence
  SiRNA target sequence
cagaaaaaggcgtagaaatggc

SEQ ID NO: 161600 - DNA, 22 bp, Artificial sequence
  SiRNA target sequence
agaaaaaggcgtagaaatggct

SEQ ID NO: 161601 - DNA, 22 bp, Artificial sequence
  SiRNA target sequence
gaaaaaggcgtagaaatggctc

SEQ ID NO: 161602 - DNA, 22 bp, Artificial sequence
  SiRNA target sequence
aaaaaggcgtagaaatggctcg

SEQ ID NO: 161603 - DNA, 22 bp, Artificial sequence
  SiRNA target sequence
aaaaggcgtagaaatggctcga

SEQ ID NO: 161604 - DNA, 22 bp, Artificial sequence
  SiRNA target sequence
aaaggcgtagaaatggctcgaa

SEQ ID NO: 161605 - DNA, 22 bp, Artificial sequence
  SiRNA target sequence
aaggcgtagaaatggctcgaaa

SEQ ID NO: 161606 - DNA, 22 bp, Artificial sequence
  SiRNA target sequence
aggcgtagaaatggctcgaaag

SEQ ID NO: 161607 - DNA, 22 bp, Artificial sequence
  SiRNA target sequence
ggcgtagaaatggctcgaaagc

SEQ ID NO: 161608 - DNA, 22 bp, Artificial sequence
  SiRNA target sequence
gcgtagaaatggctcgaaagca

SEQ ID NO: 161609 - DNA, 22 bp, Artificial sequence
  SiRNA target sequence
cgtagaaatggctcgaaagcaa

SEQ ID NO: 161610 - DNA, 22 bp, Artificial sequence
  SiRNA target sequence
gtagaaatggctcgaaagcaag

SEQ ID NO: 161611 - DNA, 22 bp, Artificial sequence
  SiRNA target sequence
tagaaatggctcgaaagcaagt

SEQ ID NO: 161612 - DNA, 22 bp, Artificial sequence
  SiRNA target sequence
agaaatggctcgaaagcaagta

SEQ ID NO: 161613 - DNA, 22 bp, Artificial sequence
  SiRNA target sequence
gaaatggctcgaaagcaagtag

SEQ ID NO: 161614 - DNA, 22 bp, Artificial sequence
  SiRNA target sequence
aaatggctcgaaagcaagtagc

SEQ ID NO: 161615 - DNA, 22 bp, Artificial sequence
  SiRNA target sequence
aatggctcgaaagcaagtagca

SEQ ID NO: 161616 - DNA, 22 bp, Artificial sequence
  SiRNA target sequence
atggctcgaaagcaagtagcag

SEQ ID NO: 161617 - DNA, 22 bp, Artificial sequence
  SiRNA target sequence
tggctcgaaagcaagtagcaga

SEQ ID NO: 161618 - DNA, 22 bp, Artificial sequence
  SiRNA target sequence
ggctcgaaagcaagtagcagat

SEQ ID NO: 161619 - DNA, 22 bp, Artificial sequence
  SiRNA target sequence
gctcgaaagcaagtagcagatt

SEQ ID NO: 161620 - DNA, 22 bp, Artificial sequence
  SiRNA target sequence
ctcgaaagcaagtagcagattt

SEQ ID NO: 161621 - DNA, 22 bp, Artificial sequence
  SiRNA target sequence
tcgaaagcaagtagcagattta

SEQ ID NO: 161622 - DNA, 22 bp, Artificial sequence
  SiRNA target sequence
cgaaagcaagtagcagatttac

SEQ ID NO: 161623 - DNA, 22 bp, Artificial sequence
  SiRNA target sequence
gaaagcaagtagcagatttact

SEQ ID NO: 161624 - DNA, 22 bp, Artificial sequence
  SiRNA target sequence
aaagcaagtagcagatttactg

SEQ ID NO: 161625 - DNA, 22 bp, Artificial sequence
  SiRNA target sequence
aagcaagtagcagatttactga

SEQ ID NO: 161626 - DNA, 22 bp, Artificial sequence
  SiRNA target sequence
agcaagtagcagatttactgaa

SEQ ID NO: 161627 - DNA, 22 bp, Artificial sequence
  SiRNA target sequence
gcaagtagcagatttactgaat

SEQ ID NO: 161628 - DNA, 22 bp, Artificial sequence
  SiRNA target sequence
caagtagcagatttactgaatg

SEQ ID NO: 161629 - DNA, 22 bp, Artificial sequence
  SiRNA target sequence
aagtagcagatttactgaatgc

SEQ ID NO: 161630 - DNA, 22 bp, Artificial sequence
  SiRNA target sequence
agtagcagatttactgaatgcc

SEQ ID NO: 161631 - DNA, 22 bp, Artificial sequence
  SiRNA target sequence
gtagcagatttactgaatgcca

SEQ ID NO: 161632 - DNA, 22 bp, Artificial sequence
  SiRNA target sequence
tagcagatttactgaatgccaa

SEQ ID NO: 161633 - DNA, 22 bp, Artificial sequence
  SiRNA target sequence
agcagatttactgaatgccaat

SEQ ID NO: 161634 - DNA, 22 bp, Artificial sequence
  SiRNA target sequence
gcagatttactgaatgccaatg

SEQ ID NO: 161635 - DNA, 22 bp, Artificial sequence
  SiRNA target sequence
cagatttactgaatgccaatga

SEQ ID NO: 161636 - DNA, 22 bp, Artificial sequence
  SiRNA target sequence
agatttactgaatgccaatgaa

SEQ ID NO: 161637 - DNA, 22 bp, Artificial sequence
  SiRNA target sequence
gatttactgaatgccaatgaaa

SEQ ID NO: 161638 - DNA, 22 bp, Artificial sequence
  SiRNA target sequence
atttactgaatgccaatgaaaa

SEQ ID NO: 161639 - DNA, 22 bp, Artificial sequence
  SiRNA target sequence
tttactgaatgccaatgaaaaa

SEQ ID NO: 161640 - DNA, 22 bp, Artificial sequence
  SiRNA target sequence
ttactgaatgccaatgaaaaag

SEQ ID NO: 161641 - DNA, 22 bp, Artificial sequence
  SiRNA target sequence
tactgaatgccaatgaaaaaga

SEQ ID NO: 161642 - DNA, 22 bp, Artificial sequence
  SiRNA target sequence
actgaatgccaatgaaaaagaa

SEQ ID NO: 161643 - DNA, 22 bp, Artificial sequence
  SiRNA target sequence
ctgaatgccaatgaaaaagaaa

SEQ ID NO: 161644 - DNA, 22 bp, Artificial sequence
  SiRNA target sequence
tgaatgccaatgaaaaagaaat

SEQ ID NO: 161645 - DNA, 22 bp, Artificial sequence
  SiRNA target sequence
gaatgccaatgaaaaagaaatt

SEQ ID NO: 161646 - DNA, 22 bp, Artificial sequence
  SiRNA target sequence
aatgccaatgaaaaagaaatta

SEQ ID NO: 161647 - DNA, 22 bp, Artificial sequence
  SiRNA target sequence
atgccaatgaaaaagaaattat

SEQ ID NO: 161648 - DNA, 22 bp, Artificial sequence
  SiRNA target sequence
tgccaatgaaaaagaaattatt

SEQ ID NO: 161649 - DNA, 22 bp, Artificial sequence
  SiRNA target sequence
gccaatgaaaaagaaattattt

SEQ ID NO: 161650 - DNA, 22 bp, Artificial sequence
  SiRNA target sequence
ccaatgaaaaagaaattatttt

SEQ ID NO: 161651 - DNA, 22 bp, Artificial sequence
  SiRNA target sequence
caatgaaaaagaaattattttt

SEQ ID NO: 161652 - DNA, 22 bp, Artificial sequence
  SiRNA target sequence
aatgaaaaagaaattattttta

SEQ ID NO: 161653 - DNA, 22 bp, Artificial sequence
  SiRNA target sequence
atgaaaaagaaattatttttac

SEQ ID NO: 161654 - DNA, 22 bp, Artificial sequence
  SiRNA target sequence
tgaaaaagaaattatttttact

SEQ ID NO: 161655 - DNA, 22 bp, Artificial sequence
  SiRNA target sequence
gaaaaagaaattatttttacta

SEQ ID NO: 161656 - DNA, 22 bp, Artificial sequence
  SiRNA target sequence
aaaaagaaattatttttactag

SEQ ID NO: 161657 - DNA, 22 bp, Artificial sequence
  SiRNA target sequence
aaaagaaattatttttactagc

SEQ ID NO: 161658 - DNA, 22 bp, Artificial sequence
  SiRNA target sequence
aaagaaattatttttactagcg

SEQ ID NO: 161659 - DNA, 22 bp, Artificial sequence
  SiRNA target sequence
aagaaattatttttactagcgg

SEQ ID NO: 161660 - DNA, 22 bp, Artificial sequence
  SiRNA target sequence
agaaattatttttactagcggt

SEQ ID NO: 161661 - DNA, 22 bp, Artificial sequence
  SiRNA target sequence
gaaattatttttactagcggtg

SEQ ID NO: 161662 - DNA, 22 bp, Artificial sequence
  SiRNA target sequence
aaattatttttactagcggtgc

SEQ ID NO: 161663 - DNA, 22 bp, Artificial sequence
  SiRNA target sequence
aattatttttactagcggtgct

SEQ ID NO: 161664 - DNA, 22 bp, Artificial sequence
  SiRNA target sequence
attatttttactagcggtgcta

SEQ ID NO: 161665 - DNA, 22 bp, Artificial sequence
  SiRNA target sequence
ttatttttactagcggtgctac

SEQ ID NO: 161666 - DNA, 22 bp, Artificial sequence
  SiRNA target sequence
tatttttactagcggtgctact

SEQ ID NO: 161667 - DNA, 22 bp, Artificial sequence
  SiRNA target sequence
atttttactagcggtgctactg

SEQ ID NO: 161668 - DNA, 22 bp, Artificial sequence
  SiRNA target sequence
tttttactagcggtgctactga

SEQ ID NO: 161669 - DNA, 22 bp, Artificial sequence
  SiRNA target sequence
ttttactagcggtgctactgag

SEQ ID NO: 161670 - DNA, 22 bp, Artificial sequence
  SiRNA target sequence
tttactagcggtgctactgaga

SEQ ID NO: 161671 - DNA, 22 bp, Artificial sequence
  SiRNA target sequence
ttactagcggtgctactgagag

SEQ ID NO: 161672 - DNA, 22 bp, Artificial sequence
  SiRNA target sequence
tactagcggtgctactgagagt

SEQ ID NO: 161673 - DNA, 22 bp, Artificial sequence
  SiRNA target sequence
actagcggtgctactgagagta

SEQ ID NO: 161674 - DNA, 22 bp, Artificial sequence
  SiRNA target sequence
ctagcggtgctactgagagtaa

SEQ ID NO: 161675 - DNA, 22 bp, Artificial sequence
  SiRNA target sequence
tagcggtgctactgagagtaac

SEQ ID NO: 161676 - DNA, 22 bp, Artificial sequence
  SiRNA target sequence
agcggtgctactgagagtaaca

SEQ ID NO: 161677 - DNA, 22 bp, Artificial sequence
  SiRNA target sequence
gcggtgctactgagagtaacaa

SEQ ID NO: 161678 - DNA, 22 bp, Artificial sequence
  SiRNA target sequence
cggtgctactgagagtaacaac

SEQ ID NO: 161679 - DNA, 22 bp, Artificial sequence
  SiRNA target sequence
ggtgctactgagagtaacaacc

SEQ ID NO: 161680 - DNA, 22 bp, Artificial sequence
  SiRNA target sequence
gtgctactgagagtaacaacct

SEQ ID NO: 161681 - DNA, 22 bp, Artificial sequence
  SiRNA target sequence
tgctactgagagtaacaacctt

SEQ ID NO: 161682 - DNA, 22 bp, Artificial sequence
  SiRNA target sequence
gctactgagagtaacaaccttg

SEQ ID NO: 161683 - DNA, 22 bp, Artificial sequence
  SiRNA target sequence
ctactgagagtaacaaccttgc

SEQ ID NO: 161684 - DNA, 22 bp, Artificial sequence
  SiRNA target sequence
tactgagagtaacaaccttgca

SEQ ID NO: 161685 - DNA, 22 bp, Artificial sequence
  SiRNA target sequence
actgagagtaacaaccttgcac

SEQ ID NO: 161686 - DNA, 22 bp, Artificial sequence
  SiRNA target sequence
ctgagagtaacaaccttgcact

SEQ ID NO: 161687 - DNA, 22 bp, Artificial sequence
  SiRNA target sequence
tgagagtaacaaccttgcacta

SEQ ID NO: 161688 - DNA, 22 bp, Artificial sequence
  SiRNA target sequence
gagagtaacaaccttgcactaa

SEQ ID NO: 161689 - DNA, 22 bp, Artificial sequence
  SiRNA target sequence
agagtaacaaccttgcactaaa

SEQ ID NO: 161690 - DNA, 22 bp, Artificial sequence
  SiRNA target sequence
gagtaacaaccttgcactaaag

SEQ ID NO: 161691 - DNA, 22 bp, Artificial sequence
  SiRNA target sequence
agtaacaaccttgcactaaagg

SEQ ID NO: 161692 - DNA, 22 bp, Artificial sequence
  SiRNA target sequence
gtaacaaccttgcactaaaggg

SEQ ID NO: 161693 - DNA, 22 bp, Artificial sequence
  SiRNA target sequence
taacaaccttgcactaaagggt

SEQ ID NO: 161694 - DNA, 22 bp, Artificial sequence
  SiRNA target sequence
aacaaccttgcactaaagggtg

SEQ ID NO: 161695 - DNA, 22 bp, Artificial sequence
  SiRNA target sequence
acaaccttgcactaaagggtgt

SEQ ID NO: 161696 - DNA, 22 bp, Artificial sequence
  SiRNA target sequence
caaccttgcactaaagggtgtc

SEQ ID NO: 161697 - DNA, 22 bp, Artificial sequence
  SiRNA target sequence
aaccttgcactaaagggtgtct

SEQ ID NO: 161698 - DNA, 22 bp, Artificial sequence
  SiRNA target sequence
accttgcactaaagggtgtctt

SEQ ID NO: 161699 - DNA, 22 bp, Artificial sequence
  SiRNA target sequence
ccttgcactaaagggtgtcttt

SEQ ID NO: 161700 - DNA, 22 bp, Artificial sequence
  SiRNA target sequence
cttgcactaaagggtgtctttg

SEQ ID NO: 161701 - DNA, 22 bp, Artificial sequence
  SiRNA target sequence
ttgcactaaagggtgtctttgc

SEQ ID NO: 161702 - DNA, 22 bp, Artificial sequence
  SiRNA target sequence
tgcactaaagggtgtctttgca

SEQ ID NO: 161703 - DNA, 22 bp, Artificial sequence
  SiRNA target sequence
gcactaaagggtgtctttgcat

SEQ ID NO: 161704 - DNA, 22 bp, Artificial sequence
  SiRNA target sequence
cactaaagggtgtctttgcatt

SEQ ID NO: 161705 - DNA, 22 bp, Artificial sequence
  SiRNA target sequence
actaaagggtgtctttgcattt

SEQ ID NO: 161706 - DNA, 22 bp, Artificial sequence
  SiRNA target sequence
ctaaagggtgtctttgcatttt

SEQ ID NO: 161707 - DNA, 22 bp, Artificial sequence
  SiRNA target sequence
taaagggtgtctttgcattttt

SEQ ID NO: 161708 - DNA, 22 bp, Artificial sequence
  SiRNA target sequence
aaagggtgtctttgcattttta

SEQ ID NO: 161709 - DNA, 22 bp, Artificial sequence
  SiRNA target sequence
aagggtgtctttgcatttttaa

SEQ ID NO: 161710 - DNA, 22 bp, Artificial sequence
  SiRNA target sequence
agggtgtctttgcatttttaaa

SEQ ID NO: 161711 - DNA, 22 bp, Artificial sequence
  SiRNA target sequence
gggtgtctttgcatttttaaaa

SEQ ID NO: 161712 - DNA, 22 bp, Artificial sequence
  SiRNA target sequence
ggtgtctttgcatttttaaaaa

SEQ ID NO: 161713 - DNA, 22 bp, Artificial sequence
  SiRNA target sequence
gtgtctttgcatttttaaaaaa

SEQ ID NO: 161714 - DNA, 22 bp, Artificial sequence
  SiRNA target sequence
tgtctttgcatttttaaaaaaa

SEQ ID NO: 161715 - DNA, 22 bp, Artificial sequence
  SiRNA target sequence
gtctttgcatttttaaaaaaag

SEQ ID NO: 161716 - DNA, 22 bp, Artificial sequence
  SiRNA target sequence
tctttgcatttttaaaaaaaga

SEQ ID NO: 161717 - DNA, 22 bp, Artificial sequence
  SiRNA target sequence
ctttgcatttttaaaaaaagac

SEQ ID NO: 161718 - DNA, 22 bp, Artificial sequence
  SiRNA target sequence
tttgcatttttaaaaaaagaca

SEQ ID NO: 161719 - DNA, 22 bp, Artificial sequence
  SiRNA target sequence
ttgcatttttaaaaaaagacaa

SEQ ID NO: 161720 - DNA, 22 bp, Artificial sequence
  SiRNA target sequence
tgcatttttaaaaaaagacaat

SEQ ID NO: 161721 - DNA, 22 bp, Artificial sequence
  SiRNA target sequence
gcatttttaaaaaaagacaata

SEQ ID NO: 161722 - DNA, 22 bp, Artificial sequence
  SiRNA target sequence
catttttaaaaaaagacaatag

SEQ ID NO: 161723 - DNA, 22 bp, Artificial sequence
  SiRNA target sequence
atttttaaaaaaagacaatagg

SEQ ID NO: 161724 - DNA, 22 bp, Artificial sequence
  SiRNA target sequence
tttttaaaaaaagacaataggc

SEQ ID NO: 161725 - DNA, 22 bp, Artificial sequence
  SiRNA target sequence
ttttaaaaaaagacaataggcc

SEQ ID NO: 161726 - DNA, 22 bp, Artificial sequence
  SiRNA target sequence
tttaaaaaaagacaataggcct

SEQ ID NO: 161727 - DNA, 22 bp, Artificial sequence
  SiRNA target sequence
ttaaaaaaagacaataggcctg

SEQ ID NO: 161728 - DNA, 22 bp, Artificial sequence
  SiRNA target sequence
taaaaaaagacaataggcctgt

SEQ ID NO: 161729 - DNA, 22 bp, Artificial sequence
  SiRNA target sequence
aaaaaaagacaataggcctgtt

SEQ ID NO: 161730 - DNA, 22 bp, Artificial sequence
  SiRNA target sequence
aaaaaagacaataggcctgttc

SEQ ID NO: 161731 - DNA, 22 bp, Artificial sequence
  SiRNA target sequence
aaaaagacaataggcctgttca

SEQ ID NO: 161732 - DNA, 22 bp, Artificial sequence
  SiRNA target sequence
aaaagacaataggcctgttcat

SEQ ID NO: 161733 - DNA, 22 bp, Artificial sequence
  SiRNA target sequence
aaagacaataggcctgttcata

SEQ ID NO: 161734 - DNA, 22 bp, Artificial sequence
  SiRNA target sequence
aagacaataggcctgttcatat

SEQ ID NO: 161735 - DNA, 22 bp, Artificial sequence
  SiRNA target sequence
agacaataggcctgttcatatc

SEQ ID NO: 161736 - DNA, 22 bp, Artificial sequence
  SiRNA target sequence
gacaataggcctgttcatatca

SEQ ID NO: 161737 - DNA, 22 bp, Artificial sequence
  SiRNA target sequence
acaataggcctgttcatatcat

SEQ ID NO: 161738 - DNA, 22 bp, Artificial sequence
  SiRNA target sequence
caataggcctgttcatatcatt

SEQ ID NO: 161739 - DNA, 22 bp, Artificial sequence
  SiRNA target sequence
aataggcctgttcatatcatta

SEQ ID NO: 161740 - DNA, 22 bp, Artificial sequence
  SiRNA target sequence
ataggcctgttcatatcattac

SEQ ID NO: 161741 - DNA, 22 bp, Artificial sequence
  SiRNA target sequence
taggcctgttcatatcattacc

SEQ ID NO: 161742 - DNA, 22 bp, Artificial sequence
  SiRNA target sequence
aggcctgttcatatcattacca

SEQ ID NO: 161743 - DNA, 22 bp, Artificial sequence
  SiRNA target sequence
ggcctgttcatatcattaccac

SEQ ID NO: 161744 - DNA, 22 bp, Artificial sequence
  SiRNA target sequence
gcctgttcatatcattaccaca

SEQ ID NO: 161745 - DNA, 22 bp, Artificial sequence
  SiRNA target sequence
cctgttcatatcattaccacac

SEQ ID NO: 161746 - DNA, 22 bp, Artificial sequence
  SiRNA target sequence
ctgttcatatcattaccacaca

SEQ ID NO: 161747 - DNA, 22 bp, Artificial sequence
  SiRNA target sequence
tgttcatatcattaccacacaa

SEQ ID NO: 161748 - DNA, 22 bp, Artificial sequence
  SiRNA target sequence
gttcatatcattaccacacaaa

SEQ ID NO: 161749 - DNA, 22 bp, Artificial sequence
  SiRNA target sequence
ttcatatcattaccacacaaat

SEQ ID NO: 161750 - DNA, 22 bp, Artificial sequence
  SiRNA target sequence
tcatatcattaccacacaaatt

SEQ ID NO: 161751 - DNA, 22 bp, Artificial sequence
  SiRNA target sequence
catatcattaccacacaaattg

SEQ ID NO: 161752 - DNA, 22 bp, Artificial sequence
  SiRNA target sequence
atatcattaccacacaaattga

SEQ ID NO: 161753 - DNA, 22 bp, Artificial sequence
  SiRNA target sequence
tatcattaccacacaaattgaa

SEQ ID NO: 161754 - DNA, 22 bp, Artificial sequence
  SiRNA target sequence
atcattaccacacaaattgaac

SEQ ID NO: 161755 - DNA, 22 bp, Artificial sequence
  SiRNA target sequence
tcattaccacacaaattgaaca

SEQ ID NO: 161756 - DNA, 22 bp, Artificial sequence
  SiRNA target sequence
cattaccacacaaattgaacat

SEQ ID NO: 161757 - DNA, 22 bp, Artificial sequence
  SiRNA target sequence
attaccacacaaattgaacata

SEQ ID NO: 161758 - DNA, 22 bp, Artificial sequence
  SiRNA target sequence
ttaccacacaaattgaacataa

SEQ ID NO: 161759 - DNA, 22 bp, Artificial sequence
  SiRNA target sequence
taccacacaaattgaacataaa

SEQ ID NO: 161760 - DNA, 22 bp, Artificial sequence
  SiRNA target sequence
accacacaaattgaacataaat

SEQ ID NO: 161761 - DNA, 22 bp, Artificial sequence
  SiRNA target sequence
ccacacaaattgaacataaatg

SEQ ID NO: 161762 - DNA, 22 bp, Artificial sequence
  SiRNA target sequence
cacacaaattgaacataaatgt

SEQ ID NO: 161763 - DNA, 22 bp, Artificial sequence
  SiRNA target sequence
acacaaattgaacataaatgtg

SEQ ID NO: 161764 - DNA, 22 bp, Artificial sequence
  SiRNA target sequence
cacaaattgaacataaatgtgt

SEQ ID NO: 161765 - DNA, 22 bp, Artificial sequence
  SiRNA target sequence
acaaattgaacataaatgtgta

SEQ ID NO: 161766 - DNA, 22 bp, Artificial sequence
  SiRNA target sequence
caaattgaacataaatgtgtat

SEQ ID NO: 161767 - DNA, 22 bp, Artificial sequence
  SiRNA target sequence
aaattgaacataaatgtgtatt

SEQ ID NO: 161768 - DNA, 22 bp, Artificial sequence
  SiRNA target sequence
aattgaacataaatgtgtattg

SEQ ID NO: 161769 - DNA, 22 bp, Artificial sequence
  SiRNA target sequence
attgaacataaatgtgtattgg

SEQ ID NO: 161770 - DNA, 22 bp, Artificial sequence
  SiRNA target sequence
ttgaacataaatgtgtattgga

SEQ ID NO: 161771 - DNA, 22 bp, Artificial sequence
  SiRNA target sequence
tgaacataaatgtgtattggac

SEQ ID NO: 161772 - DNA, 22 bp, Artificial sequence
  SiRNA target sequence
gaacataaatgtgtattggaca

SEQ ID NO: 161773 - DNA, 22 bp, Artificial sequence
  SiRNA target sequence
aacataaatgtgtattggacac

SEQ ID NO: 161774 - DNA, 22 bp, Artificial sequence
  SiRNA target sequence
acataaatgtgtattggacaca

SEQ ID NO: 161775 - DNA, 22 bp, Artificial sequence
  SiRNA target sequence
cataaatgtgtattggacacat

SEQ ID NO: 161776 - DNA, 22 bp, Artificial sequence
  SiRNA target sequence
ataaatgtgtattggacacatg

SEQ ID NO: 161777 - DNA, 22 bp, Artificial sequence
  SiRNA target sequence
taaatgtgtattggacacatgt

SEQ ID NO: 161778 - DNA, 22 bp, Artificial sequence
  SiRNA target sequence
aaatgtgtattggacacatgta

SEQ ID NO: 161779 - DNA, 22 bp, Artificial sequence
  SiRNA target sequence
aatgtgtattggacacatgtag

SEQ ID NO: 161780 - DNA, 22 bp, Artificial sequence
  SiRNA target sequence
atgtgtattggacacatgtaga

SEQ ID NO: 161781 - DNA, 22 bp, Artificial sequence
  SiRNA target sequence
tgtgtattggacacatgtagaa

SEQ ID NO: 161782 - DNA, 22 bp, Artificial sequence
  SiRNA target sequence
gtgtattggacacatgtagaag

SEQ ID NO: 161783 - DNA, 22 bp, Artificial sequence
  SiRNA target sequence
tgtattggacacatgtagaaga

SEQ ID NO: 161784 - DNA, 22 bp, Artificial sequence
  SiRNA target sequence
gtattggacacatgtagaagat

SEQ ID NO: 161785 - DNA, 22 bp, Artificial sequence
  SiRNA target sequence
tattggacacatgtagaagatt

SEQ ID NO: 161786 - DNA, 22 bp, Artificial sequence
  SiRNA target sequence
attggacacatgtagaagatta

SEQ ID NO: 161787 - DNA, 22 bp, Artificial sequence
  SiRNA target sequence
ttggacacatgtagaagattag

SEQ ID NO: 161788 - DNA, 22 bp, Artificial sequence
  SiRNA target sequence
tggacacatgtagaagattaga

SEQ ID NO: 161789 - DNA, 22 bp, Artificial sequence
  SiRNA target sequence
ggacacatgtagaagattagaa

SEQ ID NO: 161790 - DNA, 22 bp, Artificial sequence
  SiRNA target sequence
gacacatgtagaagattagaag

SEQ ID NO: 161791 - DNA, 22 bp, Artificial sequence
  SiRNA target sequence
acacatgtagaagattagaaga

SEQ ID NO: 161792 - DNA, 22 bp, Artificial sequence
  SiRNA target sequence
cacatgtagaagattagaagaa

SEQ ID NO: 161793 - DNA, 22 bp, Artificial sequence
  SiRNA target sequence
acatgtagaagattagaagaag

SEQ ID NO: 161794 - DNA, 22 bp, Artificial sequence
  SiRNA target sequence
catgtagaagattagaagaaga

SEQ ID NO: 161795 - DNA, 22 bp, Artificial sequence
  SiRNA target sequence
atgtagaagattagaagaagaa

SEQ ID NO: 161796 - DNA, 22 bp, Artificial sequence
  SiRNA target sequence
tgtagaagattagaagaagaag

SEQ ID NO: 161797 - DNA, 22 bp, Artificial sequence
  SiRNA target sequence
gtagaagattagaagaagaagg

SEQ ID NO: 161798 - DNA, 22 bp, Artificial sequence
  SiRNA target sequence
tagaagattagaagaagaagga

SEQ ID NO: 161799 - DNA, 22 bp, Artificial sequence
  SiRNA target sequence
agaagattagaagaagaaggag

SEQ ID NO: 161800 - DNA, 22 bp, Artificial sequence
  SiRNA target sequence
gaagattagaagaagaaggagc

SEQ ID NO: 161801 - DNA, 22 bp, Artificial sequence
  SiRNA target sequence
aagattagaagaagaaggagct

SEQ ID NO: 161802 - DNA, 22 bp, Artificial sequence
  SiRNA target sequence
agattagaagaagaaggagcta

SEQ ID NO: 161803 - DNA, 22 bp, Artificial sequence
  SiRNA target sequence
gattagaagaagaaggagctac

SEQ ID NO: 161804 - DNA, 22 bp, Artificial sequence
  SiRNA target sequence
attagaagaagaaggagctaca

SEQ ID NO: 161805 - DNA, 22 bp, Artificial sequence
  SiRNA target sequence
ttagaagaagaaggagctacag

SEQ ID NO: 161806 - DNA, 22 bp, Artificial sequence
  SiRNA target sequence
tagaagaagaaggagctacagt

SEQ ID NO: 161807 - DNA, 22 bp, Artificial sequence
  SiRNA target sequence
agaagaagaaggagctacagtg

SEQ ID NO: 161808 - DNA, 22 bp, Artificial sequence
  SiRNA target sequence
gaagaagaaggagctacagtga

SEQ ID NO: 161809 - DNA, 22 bp, Artificial sequence
  SiRNA target sequence
aagaagaaggagctacagtgac

SEQ ID NO: 161810 - DNA, 22 bp, Artificial sequence
  SiRNA target sequence
agaagaaggagctacagtgact

SEQ ID NO: 161811 - DNA, 22 bp, Artificial sequence
  SiRNA target sequence
gaagaaggagctacagtgactt

SEQ ID NO: 161812 - DNA, 22 bp, Artificial sequence
  SiRNA target sequence
aagaaggagctacagtgactta

SEQ ID NO: 161813 - DNA, 22 bp, Artificial sequence
  SiRNA target sequence
agaaggagctacagtgacttat

SEQ ID NO: 161814 - DNA, 22 bp, Artificial sequence
  SiRNA target sequence
gaaggagctacagtgacttatt

SEQ ID NO: 161815 - DNA, 22 bp, Artificial sequence
  SiRNA target sequence
aaggagctacagtgacttattt

SEQ ID NO: 161816 - DNA, 22 bp, Artificial sequence
  SiRNA target sequence
aggagctacagtgacttatttg

SEQ ID NO: 161817 - DNA, 22 bp, Artificial sequence
  SiRNA target sequence
ggagctacagtgacttatttgc

SEQ ID NO: 161818 - DNA, 22 bp, Artificial sequence
  SiRNA target sequence
gagctacagtgacttatttgcc

SEQ ID NO: 161819 - DNA, 22 bp, Artificial sequence
  SiRNA target sequence
agctacagtgacttatttgcct

SEQ ID NO: 161820 - DNA, 22 bp, Artificial sequence
  SiRNA target sequence
gctacagtgacttatttgcctg

SEQ ID NO: 161821 - DNA, 22 bp, Artificial sequence
  SiRNA target sequence
ctacagtgacttatttgcctgt

SEQ ID NO: 161822 - DNA, 22 bp, Artificial sequence
  SiRNA target sequence
tacagtgacttatttgcctgta

SEQ ID NO: 161823 - DNA, 22 bp, Artificial sequence
  SiRNA target sequence
acagtgacttatttgcctgtag

SEQ ID NO: 161824 - DNA, 22 bp, Artificial sequence
  SiRNA target sequence
cagtgacttatttgcctgtaga

SEQ ID NO: 161825 - DNA, 22 bp, Artificial sequence
  SiRNA target sequence
agtgacttatttgcctgtagat

SEQ ID NO: 161826 - DNA, 22 bp, Artificial sequence
  SiRNA target sequence
gtgacttatttgcctgtagata

SEQ ID NO: 161827 - DNA, 22 bp, Artificial sequence
  SiRNA target sequence
tgacttatttgcctgtagataa

SEQ ID NO: 161828 - DNA, 22 bp, Artificial sequence
  SiRNA target sequence
gacttatttgcctgtagataaa

SEQ ID NO: 161829 - DNA, 22 bp, Artificial sequence
  SiRNA target sequence
acttatttgcctgtagataaaa

SEQ ID NO: 161830 - DNA, 22 bp, Artificial sequence
  SiRNA target sequence
cttatttgcctgtagataaaaa

SEQ ID NO: 161831 - DNA, 22 bp, Artificial sequence
  SiRNA target sequence
ttatttgcctgtagataaaaat

SEQ ID NO: 161832 - DNA, 22 bp, Artificial sequence
  SiRNA target sequence
tatttgcctgtagataaaaatg

SEQ ID NO: 161833 - DNA, 22 bp, Artificial sequence
  SiRNA target sequence
atttgcctgtagataaaaatgg

SEQ ID NO: 161834 - DNA, 22 bp, Artificial sequence
  SiRNA target sequence
tttgcctgtagataaaaatgga

SEQ ID NO: 161835 - DNA, 22 bp, Artificial sequence
  SiRNA target sequence
ttgcctgtagataaaaatggaa

SEQ ID NO: 161836 - DNA, 22 bp, Artificial sequence
  SiRNA target sequence
tgcctgtagataaaaatggaat

SEQ ID NO: 161837 - DNA, 22 bp, Artificial sequence
  SiRNA target sequence
gcctgtagataaaaatggaata

SEQ ID NO: 161838 - DNA, 22 bp, Artificial sequence
  SiRNA target sequence
cctgtagataaaaatggaatag

SEQ ID NO: 161839 - DNA, 22 bp, Artificial sequence
  SiRNA target sequence
ctgtagataaaaatggaatagt

SEQ ID NO: 161840 - DNA, 22 bp, Artificial sequence
  SiRNA target sequence
tgtagataaaaatggaatagta

SEQ ID NO: 161841 - DNA, 22 bp, Artificial sequence
  SiRNA target sequence
gtagataaaaatggaatagtag

SEQ ID NO: 161842 - DNA, 22 bp, Artificial sequence
  SiRNA target sequence
tagataaaaatggaatagtaga

SEQ ID NO: 161843 - DNA, 22 bp, Artificial sequence
  SiRNA target sequence
agataaaaatggaatagtagat

SEQ ID NO: 161844 - DNA, 22 bp, Artificial sequence
  SiRNA target sequence
gataaaaatggaatagtagatc

SEQ ID NO: 161845 - DNA, 22 bp, Artificial sequence
  SiRNA target sequence
ataaaaatggaatagtagatcc

SEQ ID NO: 161846 - DNA, 22 bp, Artificial sequence
  SiRNA target sequence
taaaaatggaatagtagatccg

SEQ ID NO: 161847 - DNA, 22 bp, Artificial sequence
  SiRNA target sequence
aaaaatggaatagtagatccgc

SEQ ID NO: 161848 - DNA, 22 bp, Artificial sequence
  SiRNA target sequence
aaaatggaatagtagatccgca

SEQ ID NO: 161849 - DNA, 22 bp, Artificial sequence
  SiRNA target sequence
aaatggaatagtagatccgcaa

SEQ ID NO: 161850 - DNA, 22 bp, Artificial sequence
  SiRNA target sequence
aatggaatagtagatccgcaat

SEQ ID NO: 161851 - DNA, 22 bp, Artificial sequence
  SiRNA target sequence
atggaatagtagatccgcaatt

SEQ ID NO: 161852 - DNA, 22 bp, Artificial sequence
  SiRNA target sequence
tggaatagtagatccgcaatta

SEQ ID NO: 161853 - DNA, 22 bp, Artificial sequence
  SiRNA target sequence
ggaatagtagatccgcaattaa

SEQ ID NO: 161854 - DNA, 22 bp, Artificial sequence
  SiRNA target sequence
gaatagtagatccgcaattaat

SEQ ID NO: 161855 - DNA, 22 bp, Artificial sequence
  SiRNA target sequence
aatagtagatccgcaattaata

SEQ ID NO: 161856 - DNA, 22 bp, Artificial sequence
  SiRNA target sequence
atagtagatccgcaattaataa

SEQ ID NO: 161857 - DNA, 22 bp, Artificial sequence
  SiRNA target sequence
tagtagatccgcaattaataaa

SEQ ID NO: 161858 - DNA, 22 bp, Artificial sequence
  SiRNA target sequence
agtagatccgcaattaataaaa

SEQ ID NO: 161859 - DNA, 22 bp, Artificial sequence
  SiRNA target sequence
gtagatccgcaattaataaaaa

SEQ ID NO: 161860 - DNA, 22 bp, Artificial sequence
  SiRNA target sequence
tagatccgcaattaataaaaaa

SEQ ID NO: 161861 - DNA, 22 bp, Artificial sequence
  SiRNA target sequence
agatccgcaattaataaaaaac

SEQ ID NO: 161862 - DNA, 22 bp, Artificial sequence
  SiRNA target sequence
gatccgcaattaataaaaaaca

SEQ ID NO: 161863 - DNA, 22 bp, Artificial sequence
  SiRNA target sequence
atccgcaattaataaaaaacag

SEQ ID NO: 161864 - DNA, 22 bp, Artificial sequence
  SiRNA target sequence
tccgcaattaataaaaaacagt

SEQ ID NO: 161865 - DNA, 22 bp, Artificial sequence
  SiRNA target sequence
ccgcaattaataaaaaacagta

SEQ ID NO: 161866 - DNA, 22 bp, Artificial sequence
  SiRNA target sequence
cgcaattaataaaaaacagtat

SEQ ID NO: 161867 - DNA, 22 bp, Artificial sequence
  SiRNA target sequence
gcaattaataaaaaacagtatt

SEQ ID NO: 161868 - DNA, 22 bp, Artificial sequence
  SiRNA target sequence
caattaataaaaaacagtatta

SEQ ID NO: 161869 - DNA, 22 bp, Artificial sequence
  SiRNA target sequence
aattaataaaaaacagtattac

SEQ ID NO: 161870 - DNA, 22 bp, Artificial sequence
  SiRNA target sequence
attaataaaaaacagtattact

SEQ ID NO: 161871 - DNA, 22 bp, Artificial sequence
  SiRNA target sequence
ttaataaaaaacagtattacta

SEQ ID NO: 161872 - DNA, 22 bp, Artificial sequence
  SiRNA target sequence
taataaaaaacagtattactaa

SEQ ID NO: 161873 - DNA, 22 bp, Artificial sequence
  SiRNA target sequence
aataaaaaacagtattactaaa

SEQ ID NO: 161874 - DNA, 22 bp, Artificial sequence
  SiRNA target sequence
ataaaaaacagtattactaaag

SEQ ID NO: 161875 - DNA, 22 bp, Artificial sequence
  SiRNA target sequence
taaaaaacagtattactaaaga

SEQ ID NO: 161876 - DNA, 22 bp, Artificial sequence
  SiRNA target sequence
aaaaaacagtattactaaagat

SEQ ID NO: 161877 - DNA, 22 bp, Artificial sequence
  SiRNA target sequence
aaaaacagtattactaaagata

SEQ ID NO: 161878 - DNA, 22 bp, Artificial sequence
  SiRNA target sequence
aaaacagtattactaaagatac

SEQ ID NO: 161879 - DNA, 22 bp, Artificial sequence
  SiRNA target sequence
aaacagtattactaaagatacc

SEQ ID NO: 161880 - DNA, 22 bp, Artificial sequence
  SiRNA target sequence
aacagtattactaaagataccg

SEQ ID NO: 161881 - DNA, 22 bp, Artificial sequence
  SiRNA target sequence
acagtattactaaagataccgc

SEQ ID NO: 161882 - DNA, 22 bp, Artificial sequence
  SiRNA target sequence
cagtattactaaagataccgct

SEQ ID NO: 161883 - DNA, 22 bp, Artificial sequence
  SiRNA target sequence
agtattactaaagataccgctt

SEQ ID NO: 161884 - DNA, 22 bp, Artificial sequence
  SiRNA target sequence
gtattactaaagataccgcttt

SEQ ID NO: 161885 - DNA, 22 bp, Artificial sequence
  SiRNA target sequence
tattactaaagataccgctttg

SEQ ID NO: 161886 - DNA, 22 bp, Artificial sequence
  SiRNA target sequence
attactaaagataccgctttgg

SEQ ID NO: 161887 - DNA, 22 bp, Artificial sequence
  SiRNA target sequence
ttactaaagataccgctttggt

SEQ ID NO: 161888 - DNA, 22 bp, Artificial sequence
  SiRNA target sequence
tactaaagataccgctttggtg

SEQ ID NO: 161889 - DNA, 22 bp, Artificial sequence
  SiRNA target sequence
actaaagataccgctttggtgt

SEQ ID NO: 161890 - DNA, 22 bp, Artificial sequence
  SiRNA target sequence
ctaaagataccgctttggtgtc

SEQ ID NO: 161891 - DNA, 22 bp, Artificial sequence
  SiRNA target sequence
taaagataccgctttggtgtct

SEQ ID NO: 161892 - DNA, 22 bp, Artificial sequence
  SiRNA target sequence
aaagataccgctttggtgtctg

SEQ ID NO: 161893 - DNA, 22 bp, Artificial sequence
  SiRNA target sequence
aagataccgctttggtgtctgt

SEQ ID NO: 161894 - DNA, 22 bp, Artificial sequence
  SiRNA target sequence
agataccgctttggtgtctgtt

SEQ ID NO: 161895 - DNA, 22 bp, Artificial sequence
  SiRNA target sequence
gataccgctttggtgtctgtta

SEQ ID NO: 161896 - DNA, 22 bp, Artificial sequence
  SiRNA target sequence
ataccgctttggtgtctgttat

SEQ ID NO: 161897 - DNA, 22 bp, Artificial sequence
  SiRNA target sequence
taccgctttggtgtctgttatg

SEQ ID NO: 161898 - DNA, 22 bp, Artificial sequence
  SiRNA target sequence
accgctttggtgtctgttatgg

SEQ ID NO: 161899 - DNA, 22 bp, Artificial sequence
  SiRNA target sequence
ccgctttggtgtctgttatggc

SEQ ID NO: 161900 - DNA, 22 bp, Artificial sequence
  SiRNA target sequence
cgctttggtgtctgttatggct

SEQ ID NO: 161901 - DNA, 22 bp, Artificial sequence
  SiRNA target sequence
gctttggtgtctgttatggctg

SEQ ID NO: 161902 - DNA, 22 bp, Artificial sequence
  SiRNA target sequence
ctttggtgtctgttatggctgt

SEQ ID NO: 161903 - DNA, 22 bp, Artificial sequence
  SiRNA target sequence
tttggtgtctgttatggctgtt

SEQ ID NO: 161904 - DNA, 22 bp, Artificial sequence
  SiRNA target sequence
ttggtgtctgttatggctgtta

SEQ ID NO: 161905 - DNA, 22 bp, Artificial sequence
  SiRNA target sequence
tggtgtctgttatggctgttaa

SEQ ID NO: 161906 - DNA, 22 bp, Artificial sequence
  SiRNA target sequence
ggtgtctgttatggctgttaac

SEQ ID NO: 161907 - DNA, 22 bp, Artificial sequence
  SiRNA target sequence
gtgtctgttatggctgttaaca

SEQ ID NO: 161908 - DNA, 22 bp, Artificial sequence
  SiRNA target sequence
tgtctgttatggctgttaacaa

SEQ ID NO: 161909 - DNA, 22 bp, Artificial sequence
  SiRNA target sequence
gtctgttatggctgttaacaac

SEQ ID NO: 161910 - DNA, 22 bp, Artificial sequence
  SiRNA target sequence
tctgttatggctgttaacaacg

SEQ ID NO: 161911 - DNA, 22 bp, Artificial sequence
  SiRNA target sequence
ctgttatggctgttaacaacga

SEQ ID NO: 161912 - DNA, 22 bp, Artificial sequence
  SiRNA target sequence
tgttatggctgttaacaacgaa

SEQ ID NO: 161913 - DNA, 22 bp, Artificial sequence
  SiRNA target sequence
gttatggctgttaacaacgaaa

SEQ ID NO: 161914 - DNA, 22 bp, Artificial sequence
  SiRNA target sequence
ttatggctgttaacaacgaaat

SEQ ID NO: 161915 - DNA, 22 bp, Artificial sequence
  SiRNA target sequence
tatggctgttaacaacgaaatg

SEQ ID NO: 161916 - DNA, 22 bp, Artificial sequence
  SiRNA target sequence
atggctgttaacaacgaaatgg

SEQ ID NO: 161917 - DNA, 22 bp, Artificial sequence
  SiRNA target sequence
tggctgttaacaacgaaatggg

SEQ ID NO: 161918 - DNA, 22 bp, Artificial sequence
  SiRNA target sequence
ggctgttaacaacgaaatggga

SEQ ID NO: 161919 - DNA, 22 bp, Artificial sequence
  SiRNA target sequence
gctgttaacaacgaaatgggag

SEQ ID NO: 161920 - DNA, 22 bp, Artificial sequence
  SiRNA target sequence
ctgttaacaacgaaatgggagc

SEQ ID NO: 161921 - DNA, 22 bp, Artificial sequence
  SiRNA target sequence
tgttaacaacgaaatgggagca

SEQ ID NO: 161922 - DNA, 22 bp, Artificial sequence
  SiRNA target sequence
gttaacaacgaaatgggagcaa

SEQ ID NO: 161923 - DNA, 22 bp, Artificial sequence
  SiRNA target sequence
ttaacaacgaaatgggagcaat

SEQ ID NO: 161924 - DNA, 22 bp, Artificial sequence
  SiRNA target sequence
taacaacgaaatgggagcaata

SEQ ID NO: 161925 - DNA, 22 bp, Artificial sequence
  SiRNA target sequence
aacaacgaaatgggagcaatac

SEQ ID NO: 161926 - DNA, 22 bp, Artificial sequence
  SiRNA target sequence
acaacgaaatgggagcaataca

SEQ ID NO: 161927 - DNA, 22 bp, Artificial sequence
  SiRNA target sequence
caacgaaatgggagcaatacaa

SEQ ID NO: 161928 - DNA, 22 bp, Artificial sequence
  SiRNA target sequence
aacgaaatgggagcaatacaac

SEQ ID NO: 161929 - DNA, 22 bp, Artificial sequence
  SiRNA target sequence
acgaaatgggagcaatacaacc

SEQ ID NO: 161930 - DNA, 22 bp, Artificial sequence
  SiRNA target sequence
cgaaatgggagcaatacaaccg

SEQ ID NO: 161931 - DNA, 22 bp, Artificial sequence
  SiRNA target sequence
gaaatgggagcaatacaaccgc

SEQ ID NO: 161932 - DNA, 22 bp, Artificial sequence
  SiRNA target sequence
aaatgggagcaatacaaccgct

SEQ ID NO: 161933 - DNA, 22 bp, Artificial sequence
  SiRNA target sequence
aatgggagcaatacaaccgctt

SEQ ID NO: 161934 - DNA, 22 bp, Artificial sequence
  SiRNA target sequence
atgggagcaatacaaccgctta

SEQ ID NO: 161935 - DNA, 22 bp, Artificial sequence
  SiRNA target sequence
tgggagcaatacaaccgcttaa

SEQ ID NO: 161936 - DNA, 22 bp, Artificial sequence
  SiRNA target sequence
gggagcaatacaaccgcttaaa

SEQ ID NO: 161937 - DNA, 22 bp, Artificial sequence
  SiRNA target sequence
ggagcaatacaaccgcttaaag

SEQ ID NO: 161938 - DNA, 22 bp, Artificial sequence
  SiRNA target sequence
gagcaatacaaccgcttaaaga

SEQ ID NO: 161939 - DNA, 22 bp, Artificial sequence
  SiRNA target sequence
agcaatacaaccgcttaaagaa

SEQ ID NO: 161940 - DNA, 22 bp, Artificial sequence
  SiRNA target sequence
gcaatacaaccgcttaaagaaa

SEQ ID NO: 161941 - DNA, 22 bp, Artificial sequence
  SiRNA target sequence
caatacaaccgcttaaagaaat

SEQ ID NO: 161942 - DNA, 22 bp, Artificial sequence
  SiRNA target sequence
aatacaaccgcttaaagaaata

SEQ ID NO: 161943 - DNA, 22 bp, Artificial sequence
  SiRNA target sequence
atacaaccgcttaaagaaatag

SEQ ID NO: 161944 - DNA, 22 bp, Artificial sequence
  SiRNA target sequence
tacaaccgcttaaagaaatagg

SEQ ID NO: 161945 - DNA, 22 bp, Artificial sequence
  SiRNA target sequence
acaaccgcttaaagaaatagga

SEQ ID NO: 161946 - DNA, 22 bp, Artificial sequence
  SiRNA target sequence
caaccgcttaaagaaataggaa

SEQ ID NO: 161947 - DNA, 22 bp, Artificial sequence
  SiRNA target sequence
aaccgcttaaagaaataggaag

SEQ ID NO: 161948 - DNA, 22 bp, Artificial sequence
  SiRNA target sequence
accgcttaaagaaataggaaga

SEQ ID NO: 161949 - DNA, 22 bp, Artificial sequence
  SiRNA target sequence
ccgcttaaagaaataggaagaa

SEQ ID NO: 161950 - DNA, 22 bp, Artificial sequence
  SiRNA target sequence
cgcttaaagaaataggaagaat

SEQ ID NO: 161951 - DNA, 22 bp, Artificial sequence
  SiRNA target sequence
gcttaaagaaataggaagaata

SEQ ID NO: 161952 - DNA, 22 bp, Artificial sequence
  SiRNA target sequence
cttaaagaaataggaagaatat

SEQ ID NO: 161953 - DNA, 22 bp, Artificial sequence
  SiRNA target sequence
ttaaagaaataggaagaatatg

SEQ ID NO: 161954 - DNA, 22 bp, Artificial sequence
  SiRNA target sequence
taaagaaataggaagaatatgt

SEQ ID NO: 161955 - DNA, 22 bp, Artificial sequence
  SiRNA target sequence
aaagaaataggaagaatatgta

SEQ ID NO: 161956 - DNA, 22 bp, Artificial sequence
  SiRNA target sequence
aagaaataggaagaatatgtaa

SEQ ID NO: 161957 - DNA, 22 bp, Artificial sequence
  SiRNA target sequence
agaaataggaagaatatgtaaa

SEQ ID NO: 161958 - DNA, 22 bp, Artificial sequence
  SiRNA target sequence
gaaataggaagaatatgtaaag

SEQ ID NO: 161959 - DNA, 22 bp, Artificial sequence
  SiRNA target sequence
aaataggaagaatatgtaaaga

SEQ ID NO: 161960 - DNA, 22 bp, Artificial sequence
  SiRNA target sequence
aataggaagaatatgtaaagaa

SEQ ID NO: 161961 - DNA, 22 bp, Artificial sequence
  SiRNA target sequence
ataggaagaatatgtaaagaaa

SEQ ID NO: 161962 - DNA, 22 bp, Artificial sequence
  SiRNA target sequence
taggaagaatatgtaaagaaaa

SEQ ID NO: 161963 - DNA, 22 bp, Artificial sequence
  SiRNA target sequence
aggaagaatatgtaaagaaaat

SEQ ID NO: 161964 - DNA, 22 bp, Artificial sequence
  SiRNA target sequence
ggaagaatatgtaaagaaaata

SEQ ID NO: 161965 - DNA, 22 bp, Artificial sequence
  SiRNA target sequence
gaagaatatgtaaagaaaataa

SEQ ID NO: 161966 - DNA, 22 bp, Artificial sequence
  SiRNA target sequence
aagaatatgtaaagaaaataat

SEQ ID NO: 161967 - DNA, 22 bp, Artificial sequence
  SiRNA target sequence
agaatatgtaaagaaaataata

SEQ ID NO: 161968 - DNA, 22 bp, Artificial sequence
  SiRNA target sequence
gaatatgtaaagaaaataatat

SEQ ID NO: 161969 - DNA, 22 bp, Artificial sequence
  SiRNA target sequence
aatatgtaaagaaaataatatt

SEQ ID NO: 161970 - DNA, 22 bp, Artificial sequence
  SiRNA target sequence
atatgtaaagaaaataatattt

SEQ ID NO: 161971 - DNA, 22 bp, Artificial sequence
  SiRNA target sequence
tatgtaaagaaaataatatttt

SEQ ID NO: 161972 - DNA, 22 bp, Artificial sequence
  SiRNA target sequence
atgtaaagaaaataatatttta

SEQ ID NO: 161973 - DNA, 22 bp, Artificial sequence
  SiRNA target sequence
tgtaaagaaaataatattttat

SEQ ID NO: 161974 - DNA, 22 bp, Artificial sequence
  SiRNA target sequence
gtaaagaaaataatattttatt

SEQ ID NO: 161975 - DNA, 22 bp, Artificial sequence
  SiRNA target sequence
taaagaaaataatattttattt

SEQ ID NO: 161976 - DNA, 22 bp, Artificial sequence
  SiRNA target sequence
aaagaaaataatattttatttc

SEQ ID NO: 161977 - DNA, 22 bp, Artificial sequence
  SiRNA target sequence
aagaaaataatattttatttca

SEQ ID NO: 161978 - DNA, 22 bp, Artificial sequence
  SiRNA target sequence
agaaaataatattttatttcac

SEQ ID NO: 161979 - DNA, 22 bp, Artificial sequence
  SiRNA target sequence
gaaaataatattttatttcaca

SEQ ID NO: 161980 - DNA, 22 bp, Artificial sequence
  SiRNA target sequence
aaaataatattttatttcacac

SEQ ID NO: 161981 - DNA, 22 bp, Artificial sequence
  SiRNA target sequence
aaataatattttatttcacact

SEQ ID NO: 161982 - DNA, 22 bp, Artificial sequence
  SiRNA target sequence
aataatattttatttcacactg

SEQ ID NO: 161983 - DNA, 22 bp, Artificial sequence
  SiRNA target sequence
ataatattttatttcacactga

SEQ ID NO: 161984 - DNA, 22 bp, Artificial sequence
  SiRNA target sequence
taatattttatttcacactgat

SEQ ID NO: 161985 - DNA, 22 bp, Artificial sequence
  SiRNA target sequence
aatattttatttcacactgatg

SEQ ID NO: 161986 - DNA, 22 bp, Artificial sequence
  SiRNA target sequence
atattttatttcacactgatgc

SEQ ID NO: 161987 - DNA, 22 bp, Artificial sequence
  SiRNA target sequence
tattttatttcacactgatgca

SEQ ID NO: 161988 - DNA, 22 bp, Artificial sequence
  SiRNA target sequence
attttatttcacactgatgcag

SEQ ID NO: 161989 - DNA, 22 bp, Artificial sequence
  SiRNA target sequence
ttttatttcacactgatgcagc

SEQ ID NO: 161990 - DNA, 22 bp, Artificial sequence
  SiRNA target sequence
tttatttcacactgatgcagca

SEQ ID NO: 161991 - DNA, 22 bp, Artificial sequence
  SiRNA target sequence
ttatttcacactgatgcagcac

SEQ ID NO: 161992 - DNA, 22 bp, Artificial sequence
  SiRNA target sequence
tatttcacactgatgcagcaca

SEQ ID NO: 161993 - DNA, 22 bp, Artificial sequence
  SiRNA target sequence
atttcacactgatgcagcacaa

SEQ ID NO: 161994 - DNA, 22 bp, Artificial sequence
  SiRNA target sequence
tttcacactgatgcagcacaag

SEQ ID NO: 161995 - DNA, 22 bp, Artificial sequence
  SiRNA target sequence
ttcacactgatgcagcacaagc

SEQ ID NO: 161996 - DNA, 22 bp, Artificial sequence
  SiRNA target sequence
tcacactgatgcagcacaagca

SEQ ID NO: 161997 - DNA, 22 bp, Artificial sequence
  SiRNA target sequence
cacactgatgcagcacaagcag

SEQ ID NO: 161998 - DNA, 22 bp, Artificial sequence
  SiRNA target sequence
acactgatgcagcacaagcagt

SEQ ID NO: 161999 - DNA, 22 bp, Artificial sequence
  SiRNA target sequence
cactgatgcagcacaagcagtt

SEQ ID NO: 162000 - DNA, 22 bp, Artificial sequence
  SiRNA target sequence
actgatgcagcacaagcagttg

SEQ ID NO: 162001 - DNA, 22 bp, Artificial sequence
  SiRNA target sequence
ctgatgcagcacaagcagttgg

SEQ ID NO: 162002 - DNA, 22 bp, Artificial sequence
  SiRNA target sequence
tgatgcagcacaagcagttggt

SEQ ID NO: 162003 - DNA, 22 bp, Artificial sequence
  SiRNA target sequence
gatgcagcacaagcagttggta

SEQ ID NO: 162004 - DNA, 22 bp, Artificial sequence
  SiRNA target sequence
atgcagcacaagcagttggtaa

SEQ ID NO: 162005 - DNA, 22 bp, Artificial sequence
  SiRNA target sequence
tgcagcacaagcagttggtaat

SEQ ID NO: 162006 - DNA, 22 bp, Artificial sequence
  SiRNA target sequence
gcagcacaagcagttggtaata

SEQ ID NO: 162007 - DNA, 22 bp, Artificial sequence
  SiRNA target sequence
cagcacaagcagttggtaatat

SEQ ID NO: 162008 - DNA, 22 bp, Artificial sequence
  SiRNA target sequence
agcacaagcagttggtaatata

SEQ ID NO: 162009 - DNA, 22 bp, Artificial sequence
  SiRNA target sequence
gcacaagcagttggtaatatag

SEQ ID NO: 162010 - DNA, 22 bp, Artificial sequence
  SiRNA target sequence
cacaagcagttggtaatataga

SEQ ID NO: 162011 - DNA, 22 bp, Artificial sequence
  SiRNA target sequence
acaagcagttggtaatatagat

SEQ ID NO: 162012 - DNA, 22 bp, Artificial sequence
  SiRNA target sequence
caagcagttggtaatatagata

SEQ ID NO: 162013 - DNA, 22 bp, Artificial sequence
  SiRNA target sequence
aagcagttggtaatatagatat

SEQ ID NO: 162014 - DNA, 22 bp, Artificial sequence
  SiRNA target sequence
agcagttggtaatatagatatt

SEQ ID NO: 162015 - DNA, 22 bp, Artificial sequence
  SiRNA target sequence
gcagttggtaatatagatattg

SEQ ID NO: 162016 - DNA, 22 bp, Artificial sequence
  SiRNA target sequence
cagttggtaatatagatattga

SEQ ID NO: 162017 - DNA, 22 bp, Artificial sequence
  SiRNA target sequence
agttggtaatatagatattgat

SEQ ID NO: 162018 - DNA, 22 bp, Artificial sequence
  SiRNA target sequence
gttggtaatatagatattgatg

SEQ ID NO: 162019 - DNA, 22 bp, Artificial sequence
  SiRNA target sequence
ttggtaatatagatattgatgt

SEQ ID NO: 162020 - DNA, 22 bp, Artificial sequence
  SiRNA target sequence
tggtaatatagatattgatgtc

SEQ ID NO: 162021 - DNA, 22 bp, Artificial sequence
  SiRNA target sequence
ggtaatatagatattgatgtca

SEQ ID NO: 162022 - DNA, 22 bp, Artificial sequence
  SiRNA target sequence
gtaatatagatattgatgtcaa

SEQ ID NO: 162023 - DNA, 22 bp, Artificial sequence
  SiRNA target sequence
taatatagatattgatgtcaat

SEQ ID NO: 162024 - DNA, 22 bp, Artificial sequence
  SiRNA target sequence
aatatagatattgatgtcaatg

SEQ ID NO: 162025 - DNA, 22 bp, Artificial sequence
  SiRNA target sequence
atatagatattgatgtcaatga

SEQ ID NO: 162026 - DNA, 22 bp, Artificial sequence
  SiRNA target sequence
tatagatattgatgtcaatgat

SEQ ID NO: 162027 - DNA, 22 bp, Artificial sequence
  SiRNA target sequence
atagatattgatgtcaatgata

SEQ ID NO: 162028 - DNA, 22 bp, Artificial sequence
  SiRNA target sequence
tagatattgatgtcaatgatat

SEQ ID NO: 162029 - DNA, 22 bp, Artificial sequence
  SiRNA target sequence
agatattgatgtcaatgatatg

SEQ ID NO: 162030 - DNA, 22 bp, Artificial sequence
  SiRNA target sequence
gatattgatgtcaatgatatga

SEQ ID NO: 162031 - DNA, 22 bp, Artificial sequence
  SiRNA target sequence
atattgatgtcaatgatatgaa

SEQ ID NO: 162032 - DNA, 22 bp, Artificial sequence
  SiRNA target sequence
tattgatgtcaatgatatgaat

SEQ ID NO: 162033 - DNA, 22 bp, Artificial sequence
  SiRNA target sequence
attgatgtcaatgatatgaata

SEQ ID NO: 162034 - DNA, 22 bp, Artificial sequence
  SiRNA target sequence
ttgatgtcaatgatatgaatat

SEQ ID NO: 162035 - DNA, 22 bp, Artificial sequence
  SiRNA target sequence
tgatgtcaatgatatgaatatt

SEQ ID NO: 162036 - DNA, 22 bp, Artificial sequence
  SiRNA target sequence
gatgtcaatgatatgaatattg

SEQ ID NO: 162037 - DNA, 22 bp, Artificial sequence
  SiRNA target sequence
atgtcaatgatatgaatattga

SEQ ID NO: 162038 - DNA, 22 bp, Artificial sequence
  SiRNA target sequence
tgtcaatgatatgaatattgat

SEQ ID NO: 162039 - DNA, 22 bp, Artificial sequence
  SiRNA target sequence
gtcaatgatatgaatattgatt

SEQ ID NO: 162040 - DNA, 22 bp, Artificial sequence
  SiRNA target sequence
tcaatgatatgaatattgattt

SEQ ID NO: 162041 - DNA, 22 bp, Artificial sequence
  SiRNA target sequence
caatgatatgaatattgattta

SEQ ID NO: 162042 - DNA, 22 bp, Artificial sequence
  SiRNA target sequence
aatgatatgaatattgatttac

SEQ ID NO: 162043 - DNA, 22 bp, Artificial sequence
  SiRNA target sequence
atgatatgaatattgatttact

SEQ ID NO: 162044 - DNA, 22 bp, Artificial sequence
  SiRNA target sequence
tgatatgaatattgatttacta

SEQ ID NO: 162045 - DNA, 22 bp, Artificial sequence
  SiRNA target sequence
gatatgaatattgatttactaa

SEQ ID NO: 162046 - DNA, 22 bp, Artificial sequence
  SiRNA target sequence
atatgaatattgatttactaag

SEQ ID NO: 162047 - DNA, 22 bp, Artificial sequence
  SiRNA target sequence
tatgaatattgatttactaagt

SEQ ID NO: 162048 - DNA, 22 bp, Artificial sequence
  SiRNA target sequence
atgaatattgatttactaagtt

SEQ ID NO: 162049 - DNA, 22 bp, Artificial sequence
  SiRNA target sequence
tgaatattgatttactaagttt

SEQ ID NO: 162050 - DNA, 22 bp, Artificial sequence
  SiRNA target sequence
gaatattgatttactaagttta

SEQ ID NO: 162051 - DNA, 22 bp, Artificial sequence
  SiRNA target sequence
aatattgatttactaagtttat

SEQ ID NO: 162052 - DNA, 22 bp, Artificial sequence
  SiRNA target sequence
atattgatttactaagtttatc

SEQ ID NO: 162053 - DNA, 22 bp, Artificial sequence
  SiRNA target sequence
tattgatttactaagtttatca

SEQ ID NO: 162054 - DNA, 22 bp, Artificial sequence
  SiRNA target sequence
attgatttactaagtttatcaa

SEQ ID NO: 162055 - DNA, 22 bp, Artificial sequence
  SiRNA target sequence
ttgatttactaagtttatcaag

SEQ ID NO: 162056 - DNA, 22 bp, Artificial sequence
  SiRNA target sequence
tgatttactaagtttatcaagt

SEQ ID NO: 162057 - DNA, 22 bp, Artificial sequence
  SiRNA target sequence
gatttactaagtttatcaagtc

SEQ ID NO: 162058 - DNA, 22 bp, Artificial sequence
  SiRNA target sequence
atttactaagtttatcaagtca

SEQ ID NO: 162059 - DNA, 22 bp, Artificial sequence
  SiRNA target sequence
tttactaagtttatcaagtcat

SEQ ID NO: 162060 - DNA, 22 bp, Artificial sequence
  SiRNA target sequence
ttactaagtttatcaagtcata

SEQ ID NO: 162061 - DNA, 22 bp, Artificial sequence
  SiRNA target sequence
tactaagtttatcaagtcataa

SEQ ID NO: 162062 - DNA, 22 bp, Artificial sequence
  SiRNA target sequence
actaagtttatcaagtcataaa

SEQ ID NO: 162063 - DNA, 22 bp, Artificial sequence
  SiRNA target sequence
ctaagtttatcaagtcataaaa

SEQ ID NO: 162064 - DNA, 22 bp, Artificial sequence
  SiRNA target sequence
taagtttatcaagtcataaaat

SEQ ID NO: 162065 - DNA, 22 bp, Artificial sequence
  SiRNA target sequence
aagtttatcaagtcataaaatt

SEQ ID NO: 162066 - DNA, 22 bp, Artificial sequence
  SiRNA target sequence
agtttatcaagtcataaaattt

SEQ ID NO: 162067 - DNA, 22 bp, Artificial sequence
  SiRNA target sequence
gtttatcaagtcataaaattta

SEQ ID NO: 162068 - DNA, 22 bp, Artificial sequence
  SiRNA target sequence
tttatcaagtcataaaatttat

SEQ ID NO: 162069 - DNA, 22 bp, Artificial sequence
  SiRNA target sequence
ttatcaagtcataaaatttatg

SEQ ID NO: 162070 - DNA, 22 bp, Artificial sequence
  SiRNA target sequence
tatcaagtcataaaatttatgg

SEQ ID NO: 162071 - DNA, 22 bp, Artificial sequence
  SiRNA target sequence
atcaagtcataaaatttatggt

SEQ ID NO: 162072 - DNA, 22 bp, Artificial sequence
  SiRNA target sequence
tcaagtcataaaatttatggtc

SEQ ID NO: 162073 - DNA, 22 bp, Artificial sequence
  SiRNA target sequence
caagtcataaaatttatggtcc

SEQ ID NO: 162074 - DNA, 22 bp, Artificial sequence
  SiRNA target sequence
aagtcataaaatttatggtcca

SEQ ID NO: 162075 - DNA, 22 bp, Artificial sequence
  SiRNA target sequence
agtcataaaatttatggtccaa

SEQ ID NO: 162076 - DNA, 22 bp, Artificial sequence
  SiRNA target sequence
gtcataaaatttatggtccaaa

SEQ ID NO: 162077 - DNA, 22 bp, Artificial sequence
  SiRNA target sequence
tcataaaatttatggtccaaaa

SEQ ID NO: 162078 - DNA, 22 bp, Artificial sequence
  SiRNA target sequence
cataaaatttatggtccaaaag

SEQ ID NO: 162079 - DNA, 22 bp, Artificial sequence
  SiRNA target sequence
ataaaatttatggtccaaaagg

SEQ ID NO: 162080 - DNA, 22 bp, Artificial sequence
  SiRNA target sequence
taaaatttatggtccaaaaggt

SEQ ID NO: 162081 - DNA, 22 bp, Artificial sequence
  SiRNA target sequence
aaaatttatggtccaaaaggtg

SEQ ID NO: 162082 - DNA, 22 bp, Artificial sequence
  SiRNA target sequence
aaatttatggtccaaaaggtgt

SEQ ID NO: 162083 - DNA, 22 bp, Artificial sequence
  SiRNA target sequence
aatttatggtccaaaaggtgtt

SEQ ID NO: 162084 - DNA, 22 bp, Artificial sequence
  SiRNA target sequence
atttatggtccaaaaggtgttg

SEQ ID NO: 162085 - DNA, 22 bp, Artificial sequence
  SiRNA target sequence
tttatggtccaaaaggtgttgg

SEQ ID NO: 162086 - DNA, 22 bp, Artificial sequence
  SiRNA target sequence
ttatggtccaaaaggtgttggt

SEQ ID NO: 162087 - DNA, 22 bp, Artificial sequence
  SiRNA target sequence
tatggtccaaaaggtgttggtg

SEQ ID NO: 162088 - DNA, 22 bp, Artificial sequence
  SiRNA target sequence
atggtccaaaaggtgttggtgc

SEQ ID NO: 162089 - DNA, 22 bp, Artificial sequence
  SiRNA target sequence
tggtccaaaaggtgttggtgcc

SEQ ID NO: 162090 - DNA, 22 bp, Artificial sequence
  SiRNA target sequence
ggtccaaaaggtgttggtgcct

SEQ ID NO: 162091 - DNA, 22 bp, Artificial sequence
  SiRNA target sequence
gtccaaaaggtgttggtgcctt

SEQ ID NO: 162092 - DNA, 22 bp, Artificial sequence
  SiRNA target sequence
tccaaaaggtgttggtgcctta

SEQ ID NO: 162093 - DNA, 22 bp, Artificial sequence
  SiRNA target sequence
ccaaaaggtgttggtgccttat

SEQ ID NO: 162094 - DNA, 22 bp, Artificial sequence
  SiRNA target sequence
caaaaggtgttggtgccttata

SEQ ID NO: 162095 - DNA, 22 bp, Artificial sequence
  SiRNA target sequence
aaaaggtgttggtgccttatac

SEQ ID NO: 162096 - DNA, 22 bp, Artificial sequence
  SiRNA target sequence
aaaggtgttggtgccttatacg

SEQ ID NO: 162097 - DNA, 22 bp, Artificial sequence
  SiRNA target sequence
aaggtgttggtgccttatacgt

SEQ ID NO: 162098 - DNA, 22 bp, Artificial sequence
  SiRNA target sequence
aggtgttggtgccttatacgtc

SEQ ID NO: 162099 - DNA, 22 bp, Artificial sequence
  SiRNA target sequence
ggtgttggtgccttatacgtca

SEQ ID NO: 162100 - DNA, 22 bp, Artificial sequence
  SiRNA target sequence
gtgttggtgccttatacgtcag

SEQ ID NO: 162101 - DNA, 22 bp, Artificial sequence
  SiRNA target sequence
tgttggtgccttatacgtcaga

SEQ ID NO: 162102 - DNA, 22 bp, Artificial sequence
  SiRNA target sequence
gttggtgccttatacgtcagaa

SEQ ID NO: 162103 - DNA, 22 bp, Artificial sequence
  SiRNA target sequence
ttggtgccttatacgtcagaag

SEQ ID NO: 162104 - DNA, 22 bp, Artificial sequence
  SiRNA target sequence
tggtgccttatacgtcagaaga

SEQ ID NO: 162105 - DNA, 22 bp, Artificial sequence
  SiRNA target sequence
ggtgccttatacgtcagaagaa

SEQ ID NO: 162106 - DNA, 22 bp, Artificial sequence
  SiRNA target sequence
gtgccttatacgtcagaagaag

SEQ ID NO: 162107 - DNA, 22 bp, Artificial sequence
  SiRNA target sequence
tgccttatacgtcagaagaagg

SEQ ID NO: 162108 - DNA, 22 bp, Artificial sequence
  SiRNA target sequence
gccttatacgtcagaagaaggc

SEQ ID NO: 162109 - DNA, 22 bp, Artificial sequence
  SiRNA target sequence
ccttatacgtcagaagaaggcc

SEQ ID NO: 162110 - DNA, 22 bp, Artificial sequence
  SiRNA target sequence
cttatacgtcagaagaaggcct

SEQ ID NO: 162111 - DNA, 22 bp, Artificial sequence
  SiRNA target sequence
ttatacgtcagaagaaggccta

SEQ ID NO: 162112 - DNA, 22 bp, Artificial sequence
  SiRNA target sequence
tatacgtcagaagaaggcctag

SEQ ID NO: 162113 - DNA, 22 bp, Artificial sequence
  SiRNA target sequence
atacgtcagaagaaggcctagg

SEQ ID NO: 162114 - DNA, 22 bp, Artificial sequence
  SiRNA target sequence
tacgtcagaagaaggcctaggg

SEQ ID NO: 162115 - DNA, 22 bp, Artificial sequence
  SiRNA target sequence
acgtcagaagaaggcctagggt

SEQ ID NO: 162116 - DNA, 22 bp, Artificial sequence
  SiRNA target sequence
cgtcagaagaaggcctagggtg

SEQ ID NO: 162117 - DNA, 22 bp, Artificial sequence
  SiRNA target sequence
gtcagaagaaggcctagggtga

SEQ ID NO: 162118 - DNA, 22 bp, Artificial sequence
  SiRNA target sequence
tcagaagaaggcctagggtgag

SEQ ID NO: 162119 - DNA, 22 bp, Artificial sequence
  SiRNA target sequence
cagaagaaggcctagggtgaga

SEQ ID NO: 162120 - DNA, 22 bp, Artificial sequence
  SiRNA target sequence
agaagaaggcctagggtgagaa

SEQ ID NO: 162121 - DNA, 22 bp, Artificial sequence
  SiRNA target sequence
gaagaaggcctagggtgagaat

SEQ ID NO: 162122 - DNA, 22 bp, Artificial sequence
  SiRNA target sequence
aagaaggcctagggtgagaatg

SEQ ID NO: 162123 - DNA, 22 bp, Artificial sequence
  SiRNA target sequence
agaaggcctagggtgagaatgt

SEQ ID NO: 162124 - DNA, 22 bp, Artificial sequence
  SiRNA target sequence
gaaggcctagggtgagaatgtt

SEQ ID NO: 162125 - DNA, 22 bp, Artificial sequence
  SiRNA target sequence
aaggcctagggtgagaatgtta

SEQ ID NO: 162126 - DNA, 22 bp, Artificial sequence
  SiRNA target sequence
aggcctagggtgagaatgttac

SEQ ID NO: 162127 - DNA, 22 bp, Artificial sequence
  SiRNA target sequence
ggcctagggtgagaatgttacc

SEQ ID NO: 162128 - DNA, 22 bp, Artificial sequence
  SiRNA target sequence
gcctagggtgagaatgttacca

SEQ ID NO: 162129 - DNA, 22 bp, Artificial sequence
  SiRNA target sequence
cctagggtgagaatgttaccac

SEQ ID NO: 162130 - DNA, 22 bp, Artificial sequence
  SiRNA target sequence
ctagggtgagaatgttaccact

SEQ ID NO: 162131 - DNA, 22 bp, Artificial sequence
  SiRNA target sequence
tagggtgagaatgttaccactt

SEQ ID NO: 162132 - DNA, 22 bp, Artificial sequence
  SiRNA target sequence
agggtgagaatgttaccacttt

SEQ ID NO: 162133 - DNA, 22 bp, Artificial sequence
  SiRNA target sequence
gggtgagaatgttaccactttt

SEQ ID NO: 162134 - DNA, 22 bp, Artificial sequence
  SiRNA target sequence
ggtgagaatgttaccacttttt

SEQ ID NO: 162135 - DNA, 22 bp, Artificial sequence
  SiRNA target sequence
gtgagaatgttaccacttttta

SEQ ID NO: 162136 - DNA, 22 bp, Artificial sequence
  SiRNA target sequence
tgagaatgttaccactttttaa

SEQ ID NO: 162137 - DNA, 22 bp, Artificial sequence
  SiRNA target sequence
gagaatgttaccactttttaat

SEQ ID NO: 162138 - DNA, 22 bp, Artificial sequence
  SiRNA target sequence
agaatgttaccactttttaatg

SEQ ID NO: 162139 - DNA, 22 bp, Artificial sequence
  SiRNA target sequence
gaatgttaccactttttaatgg

SEQ ID NO: 162140 - DNA, 22 bp, Artificial sequence
  SiRNA target sequence
aatgttaccactttttaatggt

SEQ ID NO: 162141 - DNA, 22 bp, Artificial sequence
  SiRNA target sequence
atgttaccactttttaatggtg

SEQ ID NO: 162142 - DNA, 22 bp, Artificial sequence
  SiRNA target sequence
tgttaccactttttaatggtgg

SEQ ID NO: 162143 - DNA, 22 bp, Artificial sequence
  SiRNA target sequence
gttaccactttttaatggtggt

SEQ ID NO: 162144 - DNA, 22 bp, Artificial sequence
  SiRNA target sequence
ttaccactttttaatggtggtg

SEQ ID NO: 162145 - DNA, 22 bp, Artificial sequence
  SiRNA target sequence
taccactttttaatggtggtgg

SEQ ID NO: 162146 - DNA, 22 bp, Artificial sequence
  SiRNA target sequence
accactttttaatggtggtgga

SEQ ID NO: 162147 - DNA, 22 bp, Artificial sequence
  SiRNA target sequence
ccactttttaatggtggtggac

SEQ ID NO: 162148 - DNA, 22 bp, Artificial sequence
  SiRNA target sequence
cactttttaatggtggtggaca

SEQ ID NO: 162149 - DNA, 22 bp, Artificial sequence
  SiRNA target sequence
actttttaatggtggtggacaa

SEQ ID NO: 162150 - DNA, 22 bp, Artificial sequence
  SiRNA target sequence
ctttttaatggtggtggacaag

SEQ ID NO: 162151 - DNA, 22 bp, Artificial sequence
  SiRNA target sequence
tttttaatggtggtggacaaga

SEQ ID NO: 162152 - DNA, 22 bp, Artificial sequence
  SiRNA target sequence
ttttaatggtggtggacaagaa

SEQ ID NO: 162153 - DNA, 22 bp, Artificial sequence
  SiRNA target sequence
tttaatggtggtggacaagaaa

SEQ ID NO: 162154 - DNA, 22 bp, Artificial sequence
  SiRNA target sequence
ttaatggtggtggacaagaaag

SEQ ID NO: 162155 - DNA, 22 bp, Artificial sequence
  SiRNA target sequence
taatggtggtggacaagaaaga

SEQ ID NO: 162156 - DNA, 22 bp, Artificial sequence
  SiRNA target sequence
aatggtggtggacaagaaagag

SEQ ID NO: 162157 - DNA, 22 bp, Artificial sequence
  SiRNA target sequence
atggtggtggacaagaaagagg

SEQ ID NO: 162158 - DNA, 22 bp, Artificial sequence
  SiRNA target sequence
tggtggtggacaagaaagagga

SEQ ID NO: 162159 - DNA, 22 bp, Artificial sequence
  SiRNA target sequence
ggtggtggacaagaaagaggat

SEQ ID NO: 162160 - DNA, 22 bp, Artificial sequence
  SiRNA target sequence
gtggtggacaagaaagaggatt

SEQ ID NO: 162161 - DNA, 22 bp, Artificial sequence
  SiRNA target sequence
tggtggacaagaaagaggatta

SEQ ID NO: 162162 - DNA, 22 bp, Artificial sequence
  SiRNA target sequence
ggtggacaagaaagaggattaa

SEQ ID NO: 162163 - DNA, 22 bp, Artificial sequence
  SiRNA target sequence
gtggacaagaaagaggattaag

SEQ ID NO: 162164 - DNA, 22 bp, Artificial sequence
  SiRNA target sequence
tggacaagaaagaggattaaga

SEQ ID NO: 162165 - DNA, 22 bp, Artificial sequence
  SiRNA target sequence
ggacaagaaagaggattaagaa

SEQ ID NO: 162166 - DNA, 22 bp, Artificial sequence
  SiRNA target sequence
gacaagaaagaggattaagaag

SEQ ID NO: 162167 - DNA, 22 bp, Artificial sequence
  SiRNA target sequence
acaagaaagaggattaagaagt

SEQ ID NO: 162168 - DNA, 22 bp, Artificial sequence
  SiRNA target sequence
caagaaagaggattaagaagtg

SEQ ID NO: 162169 - DNA, 22 bp, Artificial sequence
  SiRNA target sequence
aagaaagaggattaagaagtgg

SEQ ID NO: 162170 - DNA, 22 bp, Artificial sequence
  SiRNA target sequence
agaaagaggattaagaagtggg

SEQ ID NO: 162171 - DNA, 22 bp, Artificial sequence
  SiRNA target sequence
gaaagaggattaagaagtggga

SEQ ID NO: 162172 - DNA, 22 bp, Artificial sequence
  SiRNA target sequence
aaagaggattaagaagtgggac

SEQ ID NO: 162173 - DNA, 22 bp, Artificial sequence
  SiRNA target sequence
aagaggattaagaagtgggaca

SEQ ID NO: 162174 - DNA, 22 bp, Artificial sequence
  SiRNA target sequence
agaggattaagaagtgggacaa

SEQ ID NO: 162175 - DNA, 22 bp, Artificial sequence
  SiRNA target sequence
gaggattaagaagtgggacaac

SEQ ID NO: 162176 - DNA, 22 bp, Artificial sequence
  SiRNA target sequence
aggattaagaagtgggacaact

SEQ ID NO: 162177 - DNA, 22 bp, Artificial sequence
  SiRNA target sequence
ggattaagaagtgggacaactt

SEQ ID NO: 162178 - DNA, 22 bp, Artificial sequence
  SiRNA target sequence
gattaagaagtgggacaacttc

SEQ ID NO: 162179 - DNA, 22 bp, Artificial sequence
  SiRNA target sequence
attaagaagtgggacaacttct

SEQ ID NO: 162180 - DNA, 22 bp, Artificial sequence
  SiRNA target sequence
ttaagaagtgggacaacttctc

SEQ ID NO: 162181 - DNA, 22 bp, Artificial sequence
  SiRNA target sequence
taagaagtgggacaacttctcc

SEQ ID NO: 162182 - DNA, 22 bp, Artificial sequence
  SiRNA target sequence
aagaagtgggacaacttctcca

SEQ ID NO: 162183 - DNA, 22 bp, Artificial sequence
  SiRNA target sequence
agaagtgggacaacttctccac

SEQ ID NO: 162184 - DNA, 22 bp, Artificial sequence
  SiRNA target sequence
gaagtgggacaacttctccacc

SEQ ID NO: 162185 - DNA, 22 bp, Artificial sequence
  SiRNA target sequence
aagtgggacaacttctccacct

SEQ ID NO: 162186 - DNA, 22 bp, Artificial sequence
  SiRNA target sequence
agtgggacaacttctccacctt

SEQ ID NO: 162187 - DNA, 22 bp, Artificial sequence
  SiRNA target sequence
gtgggacaacttctccaccttt

SEQ ID NO: 162188 - DNA, 22 bp, Artificial sequence
  SiRNA target sequence
tgggacaacttctccaccttta

SEQ ID NO: 162189 - DNA, 22 bp, Artificial sequence
  SiRNA target sequence
gggacaacttctccacctttag

SEQ ID NO: 162190 - DNA, 22 bp, Artificial sequence
  SiRNA target sequence
ggacaacttctccacctttagt

SEQ ID NO: 162191 - DNA, 22 bp, Artificial sequence
  SiRNA target sequence
gacaacttctccacctttagtt

SEQ ID NO: 162192 - DNA, 22 bp, Artificial sequence
  SiRNA target sequence
acaacttctccacctttagttg

SEQ ID NO: 162193 - DNA, 22 bp, Artificial sequence
  SiRNA target sequence
caacttctccacctttagttgt

SEQ ID NO: 162194 - DNA, 22 bp, Artificial sequence
  SiRNA target sequence
aacttctccacctttagttgtt

SEQ ID NO: 162195 - DNA, 22 bp, Artificial sequence
  SiRNA target sequence
acttctccacctttagttgttg

SEQ ID NO: 162196 - DNA, 22 bp, Artificial sequence
  SiRNA target sequence
cttctccacctttagttgttgg

SEQ ID NO: 162197 - DNA, 22 bp, Artificial sequence
  SiRNA target sequence
ttctccacctttagttgttgga

SEQ ID NO: 162198 - DNA, 22 bp, Artificial sequence
  SiRNA target sequence
tctccacctttagttgttggat

SEQ ID NO: 162199 - DNA, 22 bp, Artificial sequence
  SiRNA target sequence
ctccacctttagttgttggatt

SEQ ID NO: 162200 - DNA, 22 bp, Artificial sequence
  SiRNA target sequence
tccacctttagttgttggatta

SEQ ID NO: 162201 - DNA, 22 bp, Artificial sequence
  SiRNA target sequence
ccacctttagttgttggattag

SEQ ID NO: 162202 - DNA, 22 bp, Artificial sequence
  SiRNA target sequence
cacctttagttgttggattagg

SEQ ID NO: 162203 - DNA, 22 bp, Artificial sequence
  SiRNA target sequence
acctttagttgttggattaggc

SEQ ID NO: 162204 - DNA, 22 bp, Artificial sequence
  SiRNA target sequence
cctttagttgttggattaggca

SEQ ID NO: 162205 - DNA, 22 bp, Artificial sequence
  SiRNA target sequence
ctttagttgttggattaggcaa

SEQ ID NO: 162206 - DNA, 22 bp, Artificial sequence
  SiRNA target sequence
tttagttgttggattaggcaaa

SEQ ID NO: 162207 - DNA, 22 bp, Artificial sequence
  SiRNA target sequence
ttagttgttggattaggcaaag

SEQ ID NO: 162208 - DNA, 22 bp, Artificial sequence
  SiRNA target sequence
tagttgttggattaggcaaagc

SEQ ID NO: 162209 - DNA, 22 bp, Artificial sequence
  SiRNA target sequence
agttgttggattaggcaaagct

SEQ ID NO: 162210 - DNA, 22 bp, Artificial sequence
  SiRNA target sequence
gttgttggattaggcaaagctg

SEQ ID NO: 162211 - DNA, 22 bp, Artificial sequence
  SiRNA target sequence
ttgttggattaggcaaagctgc

SEQ ID NO: 162212 - DNA, 22 bp, Artificial sequence
  SiRNA target sequence
tgttggattaggcaaagctgct

SEQ ID NO: 162213 - DNA, 22 bp, Artificial sequence
  SiRNA target sequence
gttggattaggcaaagctgctg

SEQ ID NO: 162214 - DNA, 22 bp, Artificial sequence
  SiRNA target sequence
ttggattaggcaaagctgctga

SEQ ID NO: 162215 - DNA, 22 bp, Artificial sequence
  SiRNA target sequence
tggattaggcaaagctgctgag

SEQ ID NO: 162216 - DNA, 22 bp, Artificial sequence
  SiRNA target sequence
ggattaggcaaagctgctgaga

SEQ ID NO: 162217 - DNA, 22 bp, Artificial sequence
  SiRNA target sequence
gattaggcaaagctgctgagat

SEQ ID NO: 162218 - DNA, 22 bp, Artificial sequence
  SiRNA target sequence
attaggcaaagctgctgagata

SEQ ID NO: 162219 - DNA, 22 bp, Artificial sequence
  SiRNA target sequence
ttaggcaaagctgctgagatat

SEQ ID NO: 162220 - DNA, 22 bp, Artificial sequence
  SiRNA target sequence
taggcaaagctgctgagatatg

SEQ ID NO: 162221 - DNA, 22 bp, Artificial sequence
  SiRNA target sequence
aggcaaagctgctgagatatgc

SEQ ID NO: 162222 - DNA, 22 bp, Artificial sequence
  SiRNA target sequence
ggcaaagctgctgagatatgct

SEQ ID NO: 162223 - DNA, 22 bp, Artificial sequence
  SiRNA target sequence
gcaaagctgctgagatatgctc

SEQ ID NO: 162224 - DNA, 22 bp, Artificial sequence
  SiRNA target sequence
caaagctgctgagatatgctct

SEQ ID NO: 162225 - DNA, 22 bp, Artificial sequence
  SiRNA target sequence
aaagctgctgagatatgctctc

SEQ ID NO: 162226 - DNA, 22 bp, Artificial sequence
  SiRNA target sequence
aagctgctgagatatgctctca

SEQ ID NO: 162227 - DNA, 22 bp, Artificial sequence
  SiRNA target sequence
agctgctgagatatgctctcag

SEQ ID NO: 162228 - DNA, 22 bp, Artificial sequence
  SiRNA target sequence
gctgctgagatatgctctcagg

SEQ ID NO: 162229 - DNA, 22 bp, Artificial sequence
  SiRNA target sequence
ctgctgagatatgctctcagga

SEQ ID NO: 162230 - DNA, 22 bp, Artificial sequence
  SiRNA target sequence
tgctgagatatgctctcaggag

SEQ ID NO: 162231 - DNA, 22 bp, Artificial sequence
  SiRNA target sequence
gctgagatatgctctcaggaga

SEQ ID NO: 162232 - DNA, 22 bp, Artificial sequence
  SiRNA target sequence
ctgagatatgctctcaggagat

SEQ ID NO: 162233 - DNA, 22 bp, Artificial sequence
  SiRNA target sequence
tgagatatgctctcaggagatg

SEQ ID NO: 162234 - DNA, 22 bp, Artificial sequence
  SiRNA target sequence
gagatatgctctcaggagatgc

SEQ ID NO: 162235 - DNA, 22 bp, Artificial sequence
  SiRNA target sequence
agatatgctctcaggagatgcg

SEQ ID NO: 162236 - DNA, 22 bp, Artificial sequence
  SiRNA target sequence
gatatgctctcaggagatgcgt

SEQ ID NO: 162237 - DNA, 22 bp, Artificial sequence
  SiRNA target sequence
atatgctctcaggagatgcgta

SEQ ID NO: 162238 - DNA, 22 bp, Artificial sequence
  SiRNA target sequence
tatgctctcaggagatgcgtaa

SEQ ID NO: 162239 - DNA, 22 bp, Artificial sequence
  SiRNA target sequence
atgctctcaggagatgcgtaag

SEQ ID NO: 162240 - DNA, 22 bp, Artificial sequence
  SiRNA target sequence
tgctctcaggagatgcgtaagg

SEQ ID NO: 162241 - DNA, 22 bp, Artificial sequence
  SiRNA target sequence
gctctcaggagatgcgtaagga

SEQ ID NO: 162242 - DNA, 22 bp, Artificial sequence
  SiRNA target sequence
ctctcaggagatgcgtaaggac

SEQ ID NO: 162243 - DNA, 22 bp, Artificial sequence
  SiRNA target sequence
tctcaggagatgcgtaaggact

SEQ ID NO: 162244 - DNA, 22 bp, Artificial sequence
  SiRNA target sequence
ctcaggagatgcgtaaggacta

SEQ ID NO: 162245 - DNA, 22 bp, Artificial sequence
  SiRNA target sequence
tcaggagatgcgtaaggactat

SEQ ID NO: 162246 - DNA, 22 bp, Artificial sequence
  SiRNA target sequence
caggagatgcgtaaggactatg

SEQ ID NO: 162247 - DNA, 22 bp, Artificial sequence
  SiRNA target sequence
aggagatgcgtaaggactatga

SEQ ID NO: 162248 - DNA, 22 bp, Artificial sequence
  SiRNA target sequence
ggagatgcgtaaggactatgaa

SEQ ID NO: 162249 - DNA, 22 bp, Artificial sequence
  SiRNA target sequence
gagatgcgtaaggactatgaat

SEQ ID NO: 162250 - DNA, 22 bp, Artificial sequence
  SiRNA target sequence
agatgcgtaaggactatgaata

SEQ ID NO: 162251 - DNA, 22 bp, Artificial sequence
  SiRNA target sequence
gatgcgtaaggactatgaatat

SEQ ID NO: 162252 - DNA, 22 bp, Artificial sequence
  SiRNA target sequence
atgcgtaaggactatgaatata

SEQ ID NO: 162253 - DNA, 22 bp, Artificial sequence
  SiRNA target sequence
tgcgtaaggactatgaatatat

SEQ ID NO: 162254 - DNA, 22 bp, Artificial sequence
  SiRNA target sequence
gcgtaaggactatgaatatata

SEQ ID NO: 162255 - DNA, 22 bp, Artificial sequence
  SiRNA target sequence
cgtaaggactatgaatatatac

SEQ ID NO: 162256 - DNA, 22 bp, Artificial sequence
  SiRNA target sequence
gtaaggactatgaatatataca

SEQ ID NO: 162257 - DNA, 22 bp, Artificial sequence
  SiRNA target sequence
taaggactatgaatatatacaa

SEQ ID NO: 162258 - DNA, 22 bp, Artificial sequence
  SiRNA target sequence
aaggactatgaatatatacaaa

SEQ ID NO: 162259 - DNA, 22 bp, Artificial sequence
  SiRNA target sequence
aggactatgaatatatacaaaa

SEQ ID NO: 162260 - DNA, 22 bp, Artificial sequence
  SiRNA target sequence
ggactatgaatatatacaaaaa

SEQ ID NO: 162261 - DNA, 22 bp, Artificial sequence
  SiRNA target sequence
gactatgaatatatacaaaaat

SEQ ID NO: 162262 - DNA, 22 bp, Artificial sequence
  SiRNA target sequence
actatgaatatatacaaaaatt

SEQ ID NO: 162263 - DNA, 22 bp, Artificial sequence
  SiRNA target sequence
ctatgaatatatacaaaaatta

SEQ ID NO: 162264 - DNA, 22 bp, Artificial sequence
  SiRNA target sequence
tatgaatatatacaaaaattat

SEQ ID NO: 162265 - DNA, 22 bp, Artificial sequence
  SiRNA target sequence
atgaatatatacaaaaattatc

SEQ ID NO: 162266 - DNA, 22 bp, Artificial sequence
  SiRNA target sequence
tgaatatatacaaaaattatcg

SEQ ID NO: 162267 - DNA, 22 bp, Artificial sequence
  SiRNA target sequence
gaatatatacaaaaattatcgg

SEQ ID NO: 162268 - DNA, 22 bp, Artificial sequence
  SiRNA target sequence
aatatatacaaaaattatcgga

SEQ ID NO: 162269 - DNA, 22 bp, Artificial sequence
  SiRNA target sequence
atatatacaaaaattatcggat

SEQ ID NO: 162270 - DNA, 22 bp, Artificial sequence
  SiRNA target sequence
tatatacaaaaattatcggata

SEQ ID NO: 162271 - DNA, 22 bp, Artificial sequence
  SiRNA target sequence
atatacaaaaattatcggataa

SEQ ID NO: 162272 - DNA, 22 bp, Artificial sequence
  SiRNA target sequence
tatacaaaaattatcggataaa

SEQ ID NO: 162273 - DNA, 22 bp, Artificial sequence
  SiRNA target sequence
atacaaaaattatcggataaac

SEQ ID NO: 162274 - DNA, 22 bp, Artificial sequence
  SiRNA target sequence
tacaaaaattatcggataaact

SEQ ID NO: 162275 - DNA, 22 bp, Artificial sequence
  SiRNA target sequence
acaaaaattatcggataaacta

SEQ ID NO: 162276 - DNA, 22 bp, Artificial sequence
  SiRNA target sequence
caaaaattatcggataaactaa

SEQ ID NO: 162277 - DNA, 22 bp, Artificial sequence
  SiRNA target sequence
aaaaattatcggataaactaaa

SEQ ID NO: 162278 - DNA, 22 bp, Artificial sequence
  SiRNA target sequence
aaaattatcggataaactaaaa

SEQ ID NO: 162279 - DNA, 22 bp, Artificial sequence
  SiRNA target sequence
aaattatcggataaactaaaaa

SEQ ID NO: 162280 - DNA, 22 bp, Artificial sequence
  SiRNA target sequence
aattatcggataaactaaaaaa

SEQ ID NO: 162281 - DNA, 22 bp, Artificial sequence
  SiRNA target sequence
attatcggataaactaaaaaat

SEQ ID NO: 162282 - DNA, 22 bp, Artificial sequence
  SiRNA target sequence
ttatcggataaactaaaaaatc

SEQ ID NO: 162283 - DNA, 22 bp, Artificial sequence
  SiRNA target sequence
tatcggataaactaaaaaatcg

SEQ ID NO: 162284 - DNA, 22 bp, Artificial sequence
  SiRNA target sequence
atcggataaactaaaaaatcgc

SEQ ID NO: 162285 - DNA, 22 bp, Artificial sequence
  SiRNA target sequence
tcggataaactaaaaaatcgca

SEQ ID NO: 162286 - DNA, 22 bp, Artificial sequence
  SiRNA target sequence
cggataaactaaaaaatcgcat

SEQ ID NO: 162287 - DNA, 22 bp, Artificial sequence
  SiRNA target sequence
ggataaactaaaaaatcgcatc

SEQ ID NO: 162288 - DNA, 22 bp, Artificial sequence
  SiRNA target sequence
gataaactaaaaaatcgcatca

SEQ ID NO: 162289 - DNA, 22 bp, Artificial sequence
  SiRNA target sequence
ataaactaaaaaatcgcatcaa

SEQ ID NO: 162290 - DNA, 22 bp, Artificial sequence
  SiRNA target sequence
taaactaaaaaatcgcatcaaa

SEQ ID NO: 162291 - DNA, 22 bp, Artificial sequence
  SiRNA target sequence
aaactaaaaaatcgcatcaaaa

SEQ ID NO: 162292 - DNA, 22 bp, Artificial sequence
  SiRNA target sequence
aactaaaaaatcgcatcaaaac

SEQ ID NO: 162293 - DNA, 22 bp, Artificial sequence
  SiRNA target sequence
actaaaaaatcgcatcaaaacg

SEQ ID NO: 162294 - DNA, 22 bp, Artificial sequence
  SiRNA target sequence
ctaaaaaatcgcatcaaaacga

SEQ ID NO: 162295 - DNA, 22 bp, Artificial sequence
  SiRNA target sequence
taaaaaatcgcatcaaaacgaa

SEQ ID NO: 162296 - DNA, 22 bp, Artificial sequence
  SiRNA target sequence
aaaaaatcgcatcaaaacgaat

SEQ ID NO: 162297 - DNA, 22 bp, Artificial sequence
  SiRNA target sequence
aaaaatcgcatcaaaacgaatg

SEQ ID NO: 162298 - DNA, 22 bp, Artificial sequence
  SiRNA target sequence
aaaatcgcatcaaaacgaatgt

SEQ ID NO: 162299 - DNA, 22 bp, Artificial sequence
  SiRNA target sequence
aaatcgcatcaaaacgaatgta

SEQ ID NO: 162300 - DNA, 22 bp, Artificial sequence
  SiRNA target sequence
aatcgcatcaaaacgaatgtag

SEQ ID NO: 162301 - DNA, 22 bp, Artificial sequence
  SiRNA target sequence
atcgcatcaaaacgaatgtaga

SEQ ID NO: 162302 - DNA, 22 bp, Artificial sequence
  SiRNA target sequence
tcgcatcaaaacgaatgtagaa

SEQ ID NO: 162303 - DNA, 22 bp, Artificial sequence
  SiRNA target sequence
cgcatcaaaacgaatgtagaaa

SEQ ID NO: 162304 - DNA, 22 bp, Artificial sequence
  SiRNA target sequence
gcatcaaaacgaatgtagaaaa

SEQ ID NO: 162305 - DNA, 22 bp, Artificial sequence
  SiRNA target sequence
catcaaaacgaatgtagaaaat

SEQ ID NO: 162306 - DNA, 22 bp, Artificial sequence
  SiRNA target sequence
atcaaaacgaatgtagaaaatg

SEQ ID NO: 162307 - DNA, 22 bp, Artificial sequence
  SiRNA target sequence
tcaaaacgaatgtagaaaatgt

SEQ ID NO: 162308 - DNA, 22 bp, Artificial sequence
  SiRNA target sequence
caaaacgaatgtagaaaatgtt

SEQ ID NO: 162309 - DNA, 22 bp, Artificial sequence
  SiRNA target sequence
aaaacgaatgtagaaaatgttg

SEQ ID NO: 162310 - DNA, 22 bp, Artificial sequence
  SiRNA target sequence
aaacgaatgtagaaaatgttgt

SEQ ID NO: 162311 - DNA, 22 bp, Artificial sequence
  SiRNA target sequence
aacgaatgtagaaaatgttgtt

SEQ ID NO: 162312 - DNA, 22 bp, Artificial sequence
  SiRNA target sequence
acgaatgtagaaaatgttgtta

SEQ ID NO: 162313 - DNA, 22 bp, Artificial sequence
  SiRNA target sequence
cgaatgtagaaaatgttgttat

SEQ ID NO: 162314 - DNA, 22 bp, Artificial sequence
  SiRNA target sequence
gaatgtagaaaatgttgttatt

SEQ ID NO: 162315 - DNA, 22 bp, Artificial sequence
  SiRNA target sequence
aatgtagaaaatgttgttatta

SEQ ID NO: 162316 - DNA, 22 bp, Artificial sequence
  SiRNA target sequence
atgtagaaaatgttgttattaa

SEQ ID NO: 162317 - DNA, 22 bp, Artificial sequence
  SiRNA target sequence
tgtagaaaatgttgttattaac

SEQ ID NO: 162318 - DNA, 22 bp, Artificial sequence
  SiRNA target sequence
gtagaaaatgttgttattaacg

SEQ ID NO: 162319 - DNA, 22 bp, Artificial sequence
  SiRNA target sequence
tagaaaatgttgttattaacgg

SEQ ID NO: 162320 - DNA, 22 bp, Artificial sequence
  SiRNA target sequence
agaaaatgttgttattaacggc

SEQ ID NO: 162321 - DNA, 22 bp, Artificial sequence
  SiRNA target sequence
gaaaatgttgttattaacggcg

SEQ ID NO: 162322 - DNA, 22 bp, Artificial sequence
  SiRNA target sequence
aaaatgttgttattaacggcga

SEQ ID NO: 162323 - DNA, 22 bp, Artificial sequence
  SiRNA target sequence
aaatgttgttattaacggcgat

SEQ ID NO: 162324 - DNA, 22 bp, Artificial sequence
  SiRNA target sequence
aatgttgttattaacggcgatg

SEQ ID NO: 162325 - DNA, 22 bp, Artificial sequence
  SiRNA target sequence
atgttgttattaacggcgatga

SEQ ID NO: 162326 - DNA, 22 bp, Artificial sequence
  SiRNA target sequence
tgttgttattaacggcgatgat

SEQ ID NO: 162327 - DNA, 22 bp, Artificial sequence
  SiRNA target sequence
gttgttattaacggcgatgatt

SEQ ID NO: 162328 - DNA, 22 bp, Artificial sequence
  SiRNA target sequence
ttgttattaacggcgatgattc

SEQ ID NO: 162329 - DNA, 22 bp, Artificial sequence
  SiRNA target sequence
tgttattaacggcgatgattct

SEQ ID NO: 162330 - DNA, 22 bp, Artificial sequence
  SiRNA target sequence
gttattaacggcgatgattcta

SEQ ID NO: 162331 - DNA, 22 bp, Artificial sequence
  SiRNA target sequence
ttattaacggcgatgattctaa

SEQ ID NO: 162332 - DNA, 22 bp, Artificial sequence
  SiRNA target sequence
tattaacggcgatgattctaag

SEQ ID NO: 162333 - DNA, 22 bp, Artificial sequence
  SiRNA target sequence
attaacggcgatgattctaaga

SEQ ID NO: 162334 - DNA, 22 bp, Artificial sequence
  SiRNA target sequence
ttaacggcgatgattctaagac

SEQ ID NO: 162335 - DNA, 22 bp, Artificial sequence
  SiRNA target sequence
taacggcgatgattctaagact

SEQ ID NO: 162336 - DNA, 22 bp, Artificial sequence
  SiRNA target sequence
aacggcgatgattctaagactt

SEQ ID NO: 162337 - DNA, 22 bp, Artificial sequence
  SiRNA target sequence
acggcgatgattctaagacttt

SEQ ID NO: 162338 - DNA, 22 bp, Artificial sequence
  SiRNA target sequence
cggcgatgattctaagactttt

SEQ ID NO: 162339 - DNA, 22 bp, Artificial sequence
  SiRNA target sequence
ggcgatgattctaagacttttc

SEQ ID NO: 162340 - DNA, 22 bp, Artificial sequence
  SiRNA target sequence
gcgatgattctaagacttttcc

SEQ ID NO: 162341 - DNA, 22 bp, Artificial sequence
  SiRNA target sequence
cgatgattctaagacttttcct

SEQ ID NO: 162342 - DNA, 22 bp, Artificial sequence
  SiRNA target sequence
gatgattctaagacttttcctg

SEQ ID NO: 162343 - DNA, 22 bp, Artificial sequence
  SiRNA target sequence
atgattctaagacttttcctgg

SEQ ID NO: 162344 - DNA, 22 bp, Artificial sequence
  SiRNA target sequence
tgattctaagacttttcctggc

SEQ ID NO: 162345 - DNA, 22 bp, Artificial sequence
  SiRNA target sequence
gattctaagacttttcctggct

SEQ ID NO: 162346 - DNA, 22 bp, Artificial sequence
  SiRNA target sequence
attctaagacttttcctggctg

SEQ ID NO: 162347 - DNA, 22 bp, Artificial sequence
  SiRNA target sequence
ttctaagacttttcctggctgt

SEQ ID NO: 162348 - DNA, 22 bp, Artificial sequence
  SiRNA target sequence
tctaagacttttcctggctgtc

SEQ ID NO: 162349 - DNA, 22 bp, Artificial sequence
  SiRNA target sequence
ctaagacttttcctggctgtct

SEQ ID NO: 162350 - DNA, 22 bp, Artificial sequence
  SiRNA target sequence
taagacttttcctggctgtctc

SEQ ID NO: 162351 - DNA, 22 bp, Artificial sequence
  SiRNA target sequence
aagacttttcctggctgtctca

SEQ ID NO: 162352 - DNA, 22 bp, Artificial sequence
  SiRNA target sequence
agacttttcctggctgtctcaa

SEQ ID NO: 162353 - DNA, 22 bp, Artificial sequence
  SiRNA target sequence
gacttttcctggctgtctcaat

SEQ ID NO: 162354 - DNA, 22 bp, Artificial sequence
  SiRNA target sequence
acttttcctggctgtctcaata

SEQ ID NO: 162355 - DNA, 22 bp, Artificial sequence
  SiRNA target sequence
cttttcctggctgtctcaatat

SEQ ID NO: 162356 - DNA, 22 bp, Artificial sequence
  SiRNA target sequence
ttttcctggctgtctcaatatt

SEQ ID NO: 162357 - DNA, 22 bp, Artificial sequence
  SiRNA target sequence
tttcctggctgtctcaatattt

SEQ ID NO: 162358 - DNA, 22 bp, Artificial sequence
  SiRNA target sequence
ttcctggctgtctcaatatttc

SEQ ID NO: 162359 - DNA, 22 bp, Artificial sequence
  SiRNA target sequence
tcctggctgtctcaatatttct

SEQ ID NO: 162360 - DNA, 22 bp, Artificial sequence
  SiRNA target sequence
cctggctgtctcaatatttctt

SEQ ID NO: 162361 - DNA, 22 bp, Artificial sequence
  SiRNA target sequence
ctggctgtctcaatatttcttt

SEQ ID NO: 162362 - DNA, 22 bp, Artificial sequence
  SiRNA target sequence
tggctgtctcaatatttctttt

SEQ ID NO: 162363 - DNA, 22 bp, Artificial sequence
  SiRNA target sequence
ggctgtctcaatatttcttttc

SEQ ID NO: 162364 - DNA, 22 bp, Artificial sequence
  SiRNA target sequence
gctgtctcaatatttcttttcc

SEQ ID NO: 162365 - DNA, 22 bp, Artificial sequence
  SiRNA target sequence
ctgtctcaatatttcttttcca

SEQ ID NO: 162366 - DNA, 22 bp, Artificial sequence
  SiRNA target sequence
tgtctcaatatttcttttccat

SEQ ID NO: 162367 - DNA, 22 bp, Artificial sequence
  SiRNA target sequence
gtctcaatatttcttttccata

SEQ ID NO: 162368 - DNA, 22 bp, Artificial sequence
  SiRNA target sequence
tctcaatatttcttttccatat

SEQ ID NO: 162369 - DNA, 22 bp, Artificial sequence
  SiRNA target sequence
ctcaatatttcttttccatatg

SEQ ID NO: 162370 - DNA, 22 bp, Artificial sequence
  SiRNA target sequence
tcaatatttcttttccatatgt

SEQ ID NO: 162371 - DNA, 22 bp, Artificial sequence
  SiRNA target sequence
caatatttcttttccatatgta

SEQ ID NO: 162372 - DNA, 22 bp, Artificial sequence
  SiRNA target sequence
aatatttcttttccatatgtag

SEQ ID NO: 162373 - DNA, 22 bp, Artificial sequence
  SiRNA target sequence
atatttcttttccatatgtaga

SEQ ID NO: 162374 - DNA, 22 bp, Artificial sequence
  SiRNA target sequence
tatttcttttccatatgtagaa

SEQ ID NO: 162375 - DNA, 22 bp, Artificial sequence
  SiRNA target sequence
atttcttttccatatgtagaag

SEQ ID NO: 162376 - DNA, 22 bp, Artificial sequence
  SiRNA target sequence
tttcttttccatatgtagaagg

SEQ ID NO: 162377 - DNA, 22 bp, Artificial sequence
  SiRNA target sequence
ttcttttccatatgtagaaggt

SEQ ID NO: 162378 - DNA, 22 bp, Artificial sequence
  SiRNA target sequence
tcttttccatatgtagaaggtg

SEQ ID NO: 162379 - DNA, 22 bp, Artificial sequence
  SiRNA target sequence
cttttccatatgtagaaggtga

SEQ ID NO: 162380 - DNA, 22 bp, Artificial sequence
  SiRNA target sequence
ttttccatatgtagaaggtgaa

SEQ ID NO: 162381 - DNA, 22 bp, Artificial sequence
  SiRNA target sequence
tttccatatgtagaaggtgaag

SEQ ID NO: 162382 - DNA, 22 bp, Artificial sequence
  SiRNA target sequence
ttccatatgtagaaggtgaagg

SEQ ID NO: 162383 - DNA, 22 bp, Artificial sequence
  SiRNA target sequence
tccatatgtagaaggtgaaggg

SEQ ID NO: 162384 - DNA, 22 bp, Artificial sequence
  SiRNA target sequence
ccatatgtagaaggtgaagggc

SEQ ID NO: 162385 - DNA, 22 bp, Artificial sequence
  SiRNA target sequence
catatgtagaaggtgaagggct

SEQ ID NO: 162386 - DNA, 22 bp, Artificial sequence
  SiRNA target sequence
atatgtagaaggtgaagggctt

SEQ ID NO: 162387 - DNA, 22 bp, Artificial sequence
  SiRNA target sequence
tatgtagaaggtgaagggctta

SEQ ID NO: 162388 - DNA, 22 bp, Artificial sequence
  SiRNA target sequence
atgtagaaggtgaagggcttat

SEQ ID NO: 162389 - DNA, 22 bp, Artificial sequence
  SiRNA target sequence
tgtagaaggtgaagggcttatg

SEQ ID NO: 162390 - DNA, 22 bp, Artificial sequence
  SiRNA target sequence
gtagaaggtgaagggcttatga

SEQ ID NO: 162391 - DNA, 22 bp, Artificial sequence
  SiRNA target sequence
tagaaggtgaagggcttatgat

SEQ ID NO: 162392 - DNA, 22 bp, Artificial sequence
  SiRNA target sequence
agaaggtgaagggcttatgatg

SEQ ID NO: 162393 - DNA, 22 bp, Artificial sequence
  SiRNA target sequence
gaaggtgaagggcttatgatga

SEQ ID NO: 162394 - DNA, 22 bp, Artificial sequence
  SiRNA target sequence
aaggtgaagggcttatgatgaa

SEQ ID NO: 162395 - DNA, 22 bp, Artificial sequence
  SiRNA target sequence
aggtgaagggcttatgatgaat

SEQ ID NO: 162396 - DNA, 22 bp, Artificial sequence
  SiRNA target sequence
ggtgaagggcttatgatgaata

SEQ ID NO: 162397 - DNA, 22 bp, Artificial sequence
  SiRNA target sequence
gtgaagggcttatgatgaatat

SEQ ID NO: 162398 - DNA, 22 bp, Artificial sequence
  SiRNA target sequence
tgaagggcttatgatgaatatt

SEQ ID NO: 162399 - DNA, 22 bp, Artificial sequence
  SiRNA target sequence
gaagggcttatgatgaatatta

SEQ ID NO: 162400 - DNA, 22 bp, Artificial sequence
  SiRNA target sequence
aagggcttatgatgaatattaa

SEQ ID NO: 162401 - DNA, 22 bp, Artificial sequence
  SiRNA target sequence
agggcttatgatgaatattaag

SEQ ID NO: 162402 - DNA, 22 bp, Artificial sequence
  SiRNA target sequence
gggcttatgatgaatattaagg

SEQ ID NO: 162403 - DNA, 22 bp, Artificial sequence
  SiRNA target sequence
ggcttatgatgaatattaagga

SEQ ID NO: 162404 - DNA, 22 bp, Artificial sequence
  SiRNA target sequence
gcttatgatgaatattaaggat

SEQ ID NO: 162405 - DNA, 22 bp, Artificial sequence
  SiRNA target sequence
cttatgatgaatattaaggata

SEQ ID NO: 162406 - DNA, 22 bp, Artificial sequence
  SiRNA target sequence
ttatgatgaatattaaggatat

SEQ ID NO: 162407 - DNA, 22 bp, Artificial sequence
  SiRNA target sequence
tatgatgaatattaaggatatt

SEQ ID NO: 162408 - DNA, 22 bp, Artificial sequence
  SiRNA target sequence
atgatgaatattaaggatattg

SEQ ID NO: 162409 - DNA, 22 bp, Artificial sequence
  SiRNA target sequence
tgatgaatattaaggatattgc

SEQ ID NO: 162410 - DNA, 22 bp, Artificial sequence
  SiRNA target sequence
gatgaatattaaggatattgct

SEQ ID NO: 162411 - DNA, 22 bp, Artificial sequence
  SiRNA target sequence
atgaatattaaggatattgctg

SEQ ID NO: 162412 - DNA, 22 bp, Artificial sequence
  SiRNA target sequence
tgaatattaaggatattgctgt

SEQ ID NO: 162413 - DNA, 22 bp, Artificial sequence
  SiRNA target sequence
gaatattaaggatattgctgtt

SEQ ID NO: 162414 - DNA, 22 bp, Artificial sequence
  SiRNA target sequence
aatattaaggatattgctgtta

SEQ ID NO: 162415 - DNA, 22 bp, Artificial sequence
  SiRNA target sequence
atattaaggatattgctgttag

SEQ ID NO: 162416 - DNA, 22 bp, Artificial sequence
  SiRNA target sequence
tattaaggatattgctgttagt

SEQ ID NO: 162417 - DNA, 22 bp, Artificial sequence
  SiRNA target sequence
attaaggatattgctgttagta

SEQ ID NO: 162418 - DNA, 22 bp, Artificial sequence
  SiRNA target sequence
ttaaggatattgctgttagtag

SEQ ID NO: 162419 - DNA, 22 bp, Artificial sequence
  SiRNA target sequence
taaggatattgctgttagtagt

SEQ ID NO: 162420 - DNA, 22 bp, Artificial sequence
  SiRNA target sequence
aaggatattgctgttagtagtg

SEQ ID NO: 162421 - DNA, 22 bp, Artificial sequence
  SiRNA target sequence
aggatattgctgttagtagtgg

SEQ ID NO: 162422 - DNA, 22 bp, Artificial sequence
  SiRNA target sequence
ggatattgctgttagtagtgga

SEQ ID NO: 162423 - DNA, 22 bp, Artificial sequence
  SiRNA target sequence
gatattgctgttagtagtggaa

SEQ ID NO: 162424 - DNA, 22 bp, Artificial sequence
  SiRNA target sequence
atattgctgttagtagtggaag

SEQ ID NO: 162425 - DNA, 22 bp, Artificial sequence
  SiRNA target sequence
tattgctgttagtagtggaagt

SEQ ID NO: 162426 - DNA, 22 bp, Artificial sequence
  SiRNA target sequence
attgctgttagtagtggaagtg

SEQ ID NO: 162427 - DNA, 22 bp, Artificial sequence
  SiRNA target sequence
ttgctgttagtagtggaagtgc

SEQ ID NO: 162428 - DNA, 22 bp, Artificial sequence
  SiRNA target sequence
tgctgttagtagtggaagtgct

SEQ ID NO: 162429 - DNA, 22 bp, Artificial sequence
  SiRNA target sequence
gctgttagtagtggaagtgctt

SEQ ID NO: 162430 - DNA, 22 bp, Artificial sequence
  SiRNA target sequence
ctgttagtagtggaagtgcttg

SEQ ID NO: 162431 - DNA, 22 bp, Artificial sequence
  SiRNA target sequence
tgttagtagtggaagtgcttgc

SEQ ID NO: 162432 - DNA, 22 bp, Artificial sequence
  SiRNA target sequence
gttagtagtggaagtgcttgca

SEQ ID NO: 162433 - DNA, 22 bp, Artificial sequence
  SiRNA target sequence
ttagtagtggaagtgcttgcac

SEQ ID NO: 162434 - DNA, 22 bp, Artificial sequence
  SiRNA target sequence
tagtagtggaagtgcttgcact

SEQ ID NO: 162435 - DNA, 22 bp, Artificial sequence
  SiRNA target sequence
agtagtggaagtgcttgcactt

SEQ ID NO: 162436 - DNA, 22 bp, Artificial sequence
  SiRNA target sequence
gtagtggaagtgcttgcacttc

SEQ ID NO: 162437 - DNA, 22 bp, Artificial sequence
  SiRNA target sequence
tagtggaagtgcttgcacttca

SEQ ID NO: 162438 - DNA, 22 bp, Artificial sequence
  SiRNA target sequence
agtggaagtgcttgcacttcat

SEQ ID NO: 162439 - DNA, 22 bp, Artificial sequence
  SiRNA target sequence
gtggaagtgcttgcacttcatc

SEQ ID NO: 162440 - DNA, 22 bp, Artificial sequence
  SiRNA target sequence
tggaagtgcttgcacttcatca

SEQ ID NO: 162441 - DNA, 22 bp, Artificial sequence
  SiRNA target sequence
ggaagtgcttgcacttcatcat

SEQ ID NO: 162442 - DNA, 22 bp, Artificial sequence
  SiRNA target sequence
gaagtgcttgcacttcatcatc

SEQ ID NO: 162443 - DNA, 22 bp, Artificial sequence
  SiRNA target sequence
aagtgcttgcacttcatcatct

SEQ ID NO: 162444 - DNA, 22 bp, Artificial sequence
  SiRNA target sequence
agtgcttgcacttcatcatctt

SEQ ID NO: 162445 - DNA, 22 bp, Artificial sequence
  SiRNA target sequence
gtgcttgcacttcatcatcttt

SEQ ID NO: 162446 - DNA, 22 bp, Artificial sequence
  SiRNA target sequence
tgcttgcacttcatcatcttta

SEQ ID NO: 162447 - DNA, 22 bp, Artificial sequence
  SiRNA target sequence
gcttgcacttcatcatctttag

SEQ ID NO: 162448 - DNA, 22 bp, Artificial sequence
  SiRNA target sequence
cttgcacttcatcatctttaga

SEQ ID NO: 162449 - DNA, 22 bp, Artificial sequence
  SiRNA target sequence
ttgcacttcatcatctttagaa

SEQ ID NO: 162450 - DNA, 22 bp, Artificial sequence
  SiRNA target sequence
tgcacttcatcatctttagaac

SEQ ID NO: 162451 - DNA, 22 bp, Artificial sequence
  SiRNA target sequence
gcacttcatcatctttagaacc

SEQ ID NO: 162452 - DNA, 22 bp, Artificial sequence
  SiRNA target sequence
cacttcatcatctttagaaccc

SEQ ID NO: 162453 - DNA, 22 bp, Artificial sequence
  SiRNA target sequence
acttcatcatctttagaaccct

SEQ ID NO: 162454 - DNA, 22 bp, Artificial sequence
  SiRNA target sequence
cttcatcatctttagaaccctc

SEQ ID NO: 162455 - DNA, 22 bp, Artificial sequence
  SiRNA target sequence
ttcatcatctttagaaccctct

SEQ ID NO: 162456 - DNA, 22 bp, Artificial sequence
  SiRNA target sequence
tcatcatctttagaaccctctt

SEQ ID NO: 162457 - DNA, 22 bp, Artificial sequence
  SiRNA target sequence
catcatctttagaaccctctta

SEQ ID NO: 162458 - DNA, 22 bp, Artificial sequence
  SiRNA target sequence
atcatctttagaaccctcttat

SEQ ID NO: 162459 - DNA, 22 bp, Artificial sequence
  SiRNA target sequence
tcatctttagaaccctcttatg

SEQ ID NO: 162460 - DNA, 22 bp, Artificial sequence
  SiRNA target sequence
catctttagaaccctcttatgt

SEQ ID NO: 162461 - DNA, 22 bp, Artificial sequence
  SiRNA target sequence
atctttagaaccctcttatgtt

SEQ ID NO: 162462 - DNA, 22 bp, Artificial sequence
  SiRNA target sequence
tctttagaaccctcttatgttt

SEQ ID NO: 162463 - DNA, 22 bp, Artificial sequence
  SiRNA target sequence
ctttagaaccctcttatgtttt

SEQ ID NO: 162464 - DNA, 22 bp, Artificial sequence
  SiRNA target sequence
tttagaaccctcttatgttttg

SEQ ID NO: 162465 - DNA, 22 bp, Artificial sequence
  SiRNA target sequence
ttagaaccctcttatgttttgc

SEQ ID NO: 162466 - DNA, 22 bp, Artificial sequence
  SiRNA target sequence
tagaaccctcttatgttttgcg

SEQ ID NO: 162467 - DNA, 22 bp, Artificial sequence
  SiRNA target sequence
agaaccctcttatgttttgcga

SEQ ID NO: 162468 - DNA, 22 bp, Artificial sequence
  SiRNA target sequence
gaaccctcttatgttttgcgag

SEQ ID NO: 162469 - DNA, 22 bp, Artificial sequence
  SiRNA target sequence
aaccctcttatgttttgcgagc

SEQ ID NO: 162470 - DNA, 22 bp, Artificial sequence
  SiRNA target sequence
accctcttatgttttgcgagct

SEQ ID NO: 162471 - DNA, 22 bp, Artificial sequence
  SiRNA target sequence
ccctcttatgttttgcgagctt

SEQ ID NO: 162472 - DNA, 22 bp, Artificial sequence
  SiRNA target sequence
cctcttatgttttgcgagcttt

SEQ ID NO: 162473 - DNA, 22 bp, Artificial sequence
  SiRNA target sequence
ctcttatgttttgcgagcttta

SEQ ID NO: 162474 - DNA, 22 bp, Artificial sequence
  SiRNA target sequence
tcttatgttttgcgagctttag

SEQ ID NO: 162475 - DNA, 22 bp, Artificial sequence
  SiRNA target sequence
cttatgttttgcgagctttagg

SEQ ID NO: 162476 - DNA, 22 bp, Artificial sequence
  SiRNA target sequence
ttatgttttgcgagctttaggc

SEQ ID NO: 162477 - DNA, 22 bp, Artificial sequence
  SiRNA target sequence
tatgttttgcgagctttaggca

SEQ ID NO: 162478 - DNA, 22 bp, Artificial sequence
  SiRNA target sequence
atgttttgcgagctttaggcaa

SEQ ID NO: 162479 - DNA, 22 bp, Artificial sequence
  SiRNA target sequence
tgttttgcgagctttaggcaaa

SEQ ID NO: 162480 - DNA, 22 bp, Artificial sequence
  SiRNA target sequence
gttttgcgagctttaggcaaaa

SEQ ID NO: 162481 - DNA, 22 bp, Artificial sequence
  SiRNA target sequence
ttttgcgagctttaggcaaaaa

SEQ ID NO: 162482 - DNA, 22 bp, Artificial sequence
  SiRNA target sequence
tttgcgagctttaggcaaaaat

SEQ ID NO: 162483 - DNA, 22 bp, Artificial sequence
  SiRNA target sequence
ttgcgagctttaggcaaaaatg

SEQ ID NO: 162484 - DNA, 22 bp, Artificial sequence
  SiRNA target sequence
tgcgagctttaggcaaaaatga

SEQ ID NO: 162485 - DNA, 22 bp, Artificial sequence
  SiRNA target sequence
gcgagctttaggcaaaaatgat

SEQ ID NO: 162486 - DNA, 22 bp, Artificial sequence
  SiRNA target sequence
cgagctttaggcaaaaatgatg

SEQ ID NO: 162487 - DNA, 22 bp, Artificial sequence
  SiRNA target sequence
gagctttaggcaaaaatgatga

SEQ ID NO: 162488 - DNA, 22 bp, Artificial sequence
  SiRNA target sequence
agctttaggcaaaaatgatgat

SEQ ID NO: 162489 - DNA, 22 bp, Artificial sequence
  SiRNA target sequence
gctttaggcaaaaatgatgatc

SEQ ID NO: 162490 - DNA, 22 bp, Artificial sequence
  SiRNA target sequence
ctttaggcaaaaatgatgatct

SEQ ID NO: 162491 - DNA, 22 bp, Artificial sequence
  SiRNA target sequence
tttaggcaaaaatgatgatctt

SEQ ID NO: 162492 - DNA, 22 bp, Artificial sequence
  SiRNA target sequence
ttaggcaaaaatgatgatcttg

SEQ ID NO: 162493 - DNA, 22 bp, Artificial sequence
  SiRNA target sequence
taggcaaaaatgatgatcttgc

SEQ ID NO: 162494 - DNA, 22 bp, Artificial sequence
  SiRNA target sequence
aggcaaaaatgatgatcttgcg

SEQ ID NO: 162495 - DNA, 22 bp, Artificial sequence
  SiRNA target sequence
ggcaaaaatgatgatcttgcgc

SEQ ID NO: 162496 - DNA, 22 bp, Artificial sequence
  SiRNA target sequence
gcaaaaatgatgatcttgcgca

SEQ ID NO: 162497 - DNA, 22 bp, Artificial sequence
  SiRNA target sequence
caaaaatgatgatcttgcgcat

SEQ ID NO: 162498 - DNA, 22 bp, Artificial sequence
  SiRNA target sequence
aaaaatgatgatcttgcgcatt

SEQ ID NO: 162499 - DNA, 22 bp, Artificial sequence
  SiRNA target sequence
aaaatgatgatcttgcgcattc

SEQ ID NO: 162500 - DNA, 22 bp, Artificial sequence
  SiRNA target sequence
aaatgatgatcttgcgcattct

SEQ ID NO: 162501 - DNA, 22 bp, Artificial sequence
  SiRNA target sequence
aatgatgatcttgcgcattctt

SEQ ID NO: 162502 - DNA, 22 bp, Artificial sequence
  SiRNA target sequence
atgatgatcttgcgcattcttc

SEQ ID NO: 162503 - DNA, 22 bp, Artificial sequence
  SiRNA target sequence
tgatgatcttgcgcattcttct

SEQ ID NO: 162504 - DNA, 22 bp, Artificial sequence
  SiRNA target sequence
gatgatcttgcgcattcttcta

SEQ ID NO: 162505 - DNA, 22 bp, Artificial sequence
  SiRNA target sequence
atgatcttgcgcattcttctat

SEQ ID NO: 162506 - DNA, 22 bp, Artificial sequence
  SiRNA target sequence
tgatcttgcgcattcttctata

SEQ ID NO: 162507 - DNA, 22 bp, Artificial sequence
  SiRNA target sequence
gatcttgcgcattcttctataa

SEQ ID NO: 162508 - DNA, 22 bp, Artificial sequence
  SiRNA target sequence
atcttgcgcattcttctataag

SEQ ID NO: 162509 - DNA, 22 bp, Artificial sequence
  SiRNA target sequence
tcttgcgcattcttctataaga

SEQ ID NO: 162510 - DNA, 22 bp, Artificial sequence
  SiRNA target sequence
cttgcgcattcttctataagat

SEQ ID NO: 162511 - DNA, 22 bp, Artificial sequence
  SiRNA target sequence
ttgcgcattcttctataagatt

SEQ ID NO: 162512 - DNA, 22 bp, Artificial sequence
  SiRNA target sequence
tgcgcattcttctataagattt

SEQ ID NO: 162513 - DNA, 22 bp, Artificial sequence
  SiRNA target sequence
gcgcattcttctataagatttg

SEQ ID NO: 162514 - DNA, 22 bp, Artificial sequence
  SiRNA target sequence
cgcattcttctataagatttgg

SEQ ID NO: 162515 - DNA, 22 bp, Artificial sequence
  SiRNA target sequence
gcattcttctataagatttgga

SEQ ID NO: 162516 - DNA, 22 bp, Artificial sequence
  SiRNA target sequence
cattcttctataagatttggaa

SEQ ID NO: 162517 - DNA, 22 bp, Artificial sequence
  SiRNA target sequence
attcttctataagatttggaat

SEQ ID NO: 162518 - DNA, 22 bp, Artificial sequence
  SiRNA target sequence
ttcttctataagatttggaata

SEQ ID NO: 162519 - DNA, 22 bp, Artificial sequence
  SiRNA target sequence
tcttctataagatttggaataa

SEQ ID NO: 162520 - DNA, 22 bp, Artificial sequence
  SiRNA target sequence
cttctataagatttggaataaa

SEQ ID NO: 162521 - DNA, 22 bp, Artificial sequence
  SiRNA target sequence
ttctataagatttggaataaat

SEQ ID NO: 162522 - DNA, 22 bp, Artificial sequence
  SiRNA target sequence
tctataagatttggaataaata

SEQ ID NO: 162523 - DNA, 22 bp, Artificial sequence
  SiRNA target sequence
ctataagatttggaataaataa

SEQ ID NO: 162524 - DNA, 22 bp, Artificial sequence
  SiRNA target sequence
tataagatttggaataaataag

SEQ ID NO: 162525 - DNA, 22 bp, Artificial sequence
  SiRNA target sequence
ataagatttggaataaataagt

SEQ ID NO: 162526 - DNA, 22 bp, Artificial sequence
  SiRNA target sequence
taagatttggaataaataagtt

SEQ ID NO: 162527 - DNA, 22 bp, Artificial sequence
  SiRNA target sequence
aagatttggaataaataagttt

SEQ ID NO: 162528 - DNA, 22 bp, Artificial sequence
  SiRNA target sequence
agatttggaataaataagttta

SEQ ID NO: 162529 - DNA, 22 bp, Artificial sequence
  SiRNA target sequence
gatttggaataaataagtttac

SEQ ID NO: 162530 - DNA, 22 bp, Artificial sequence
  SiRNA target sequence
atttggaataaataagtttaca

SEQ ID NO: 162531 - DNA, 22 bp, Artificial sequence
  SiRNA target sequence
tttggaataaataagtttacaa

SEQ ID NO: 162532 - DNA, 22 bp, Artificial sequence
  SiRNA target sequence
ttggaataaataagtttacaac

SEQ ID NO: 162533 - DNA, 22 bp, Artificial sequence
  SiRNA target sequence
tggaataaataagtttacaact

SEQ ID NO: 162534 - DNA, 22 bp, Artificial sequence
  SiRNA target sequence
ggaataaataagtttacaactg

SEQ ID NO: 162535 - DNA, 22 bp, Artificial sequence
  SiRNA target sequence
gaataaataagtttacaactga

SEQ ID NO: 162536 - DNA, 22 bp, Artificial sequence
  SiRNA target sequence
aataaataagtttacaactgaa

SEQ ID NO: 162537 - DNA, 22 bp, Artificial sequence
  SiRNA target sequence
ataaataagtttacaactgaag

SEQ ID NO: 162538 - DNA, 22 bp, Artificial sequence
  SiRNA target sequence
taaataagtttacaactgaaga

SEQ ID NO: 162539 - DNA, 22 bp, Artificial sequence
  SiRNA target sequence
aaataagtttacaactgaagaa

SEQ ID NO: 162540 - DNA, 22 bp, Artificial sequence
  SiRNA target sequence
aataagtttacaactgaagaag

SEQ ID NO: 162541 - DNA, 22 bp, Artificial sequence
  SiRNA target sequence
ataagtttacaactgaagaaga

SEQ ID NO: 162542 - DNA, 22 bp, Artificial sequence
  SiRNA target sequence
taagtttacaactgaagaagaa

SEQ ID NO: 162543 - DNA, 22 bp, Artificial sequence
  SiRNA target sequence
aagtttacaactgaagaagaaa

SEQ ID NO: 162544 - DNA, 22 bp, Artificial sequence
  SiRNA target sequence
agtttacaactgaagaagaaat

SEQ ID NO: 162545 - DNA, 22 bp, Artificial sequence
  SiRNA target sequence
gtttacaactgaagaagaaatc

SEQ ID NO: 162546 - DNA, 22 bp, Artificial sequence
  SiRNA target sequence
tttacaactgaagaagaaatca

SEQ ID NO: 162547 - DNA, 22 bp, Artificial sequence
  SiRNA target sequence
ttacaactgaagaagaaatcaa

SEQ ID NO: 162548 - DNA, 22 bp, Artificial sequence
  SiRNA target sequence
tacaactgaagaagaaatcaat

SEQ ID NO: 162549 - DNA, 22 bp, Artificial sequence
  SiRNA target sequence
acaactgaagaagaaatcaata

SEQ ID NO: 162550 - DNA, 22 bp, Artificial sequence
  SiRNA target sequence
caactgaagaagaaatcaataa

SEQ ID NO: 162551 - DNA, 22 bp, Artificial sequence
  SiRNA target sequence
aactgaagaagaaatcaataaa

SEQ ID NO: 162552 - DNA, 22 bp, Artificial sequence
  SiRNA target sequence
actgaagaagaaatcaataaag

SEQ ID NO: 162553 - DNA, 22 bp, Artificial sequence
  SiRNA target sequence
ctgaagaagaaatcaataaagt

SEQ ID NO: 162554 - DNA, 22 bp, Artificial sequence
  SiRNA target sequence
tgaagaagaaatcaataaagta

SEQ ID NO: 162555 - DNA, 22 bp, Artificial sequence
  SiRNA target sequence
gaagaagaaatcaataaagtat

SEQ ID NO: 162556 - DNA, 22 bp, Artificial sequence
  SiRNA target sequence
aagaagaaatcaataaagtatc

SEQ ID NO: 162557 - DNA, 22 bp, Artificial sequence
  SiRNA target sequence
agaagaaatcaataaagtatct

SEQ ID NO: 162558 - DNA, 22 bp, Artificial sequence
  SiRNA target sequence
gaagaaatcaataaagtatcta

SEQ ID NO: 162559 - DNA, 22 bp, Artificial sequence
  SiRNA target sequence
aagaaatcaataaagtatctag

SEQ ID NO: 162560 - DNA, 22 bp, Artificial sequence
  SiRNA target sequence
agaaatcaataaagtatctagt

SEQ ID NO: 162561 - DNA, 22 bp, Artificial sequence
  SiRNA target sequence
gaaatcaataaagtatctagtg

SEQ ID NO: 162562 - DNA, 22 bp, Artificial sequence
  SiRNA target sequence
aaatcaataaagtatctagtga

SEQ ID NO: 162563 - DNA, 22 bp, Artificial sequence
  SiRNA target sequence
aatcaataaagtatctagtgat

SEQ ID NO: 162564 - DNA, 22 bp, Artificial sequence
  SiRNA target sequence
atcaataaagtatctagtgata

SEQ ID NO: 162565 - DNA, 22 bp, Artificial sequence
  SiRNA target sequence
tcaataaagtatctagtgatac

SEQ ID NO: 162566 - DNA, 22 bp, Artificial sequence
  SiRNA target sequence
caataaagtatctagtgataca

SEQ ID NO: 162567 - DNA, 22 bp, Artificial sequence
  SiRNA target sequence
aataaagtatctagtgatacaa

SEQ ID NO: 162568 - DNA, 22 bp, Artificial sequence
  SiRNA target sequence
ataaagtatctagtgatacaat

SEQ ID NO: 162569 - DNA, 22 bp, Artificial sequence
  SiRNA target sequence
taaagtatctagtgatacaatt

SEQ ID NO: 162570 - DNA, 22 bp, Artificial sequence
  SiRNA target sequence
aaagtatctagtgatacaatta

SEQ ID NO: 162571 - DNA, 22 bp, Artificial sequence
  SiRNA target sequence
aagtatctagtgatacaattaa

SEQ ID NO: 162572 - DNA, 22 bp, Artificial sequence
  SiRNA target sequence
agtatctagtgatacaattaaa

SEQ ID NO: 162573 - DNA, 22 bp, Artificial sequence
  SiRNA target sequence
gtatctagtgatacaattaaag

SEQ ID NO: 162574 - DNA, 22 bp, Artificial sequence
  SiRNA target sequence
tatctagtgatacaattaaagc

SEQ ID NO: 162575 - DNA, 22 bp, Artificial sequence
  SiRNA target sequence
atctagtgatacaattaaagct

SEQ ID NO: 162576 - DNA, 22 bp, Artificial sequence
  SiRNA target sequence
tctagtgatacaattaaagctg

SEQ ID NO: 162577 - DNA, 22 bp, Artificial sequence
  SiRNA target sequence
ctagtgatacaattaaagctgt

SEQ ID NO: 162578 - DNA, 22 bp, Artificial sequence
  SiRNA target sequence
tagtgatacaattaaagctgtt

SEQ ID NO: 162579 - DNA, 22 bp, Artificial sequence
  SiRNA target sequence
agtgatacaattaaagctgtta

SEQ ID NO: 162580 - DNA, 22 bp, Artificial sequence
  SiRNA target sequence
gtgatacaattaaagctgttaa

SEQ ID NO: 162581 - DNA, 22 bp, Artificial sequence
  SiRNA target sequence
tgatacaattaaagctgttaat

SEQ ID NO: 162582 - DNA, 22 bp, Artificial sequence
  SiRNA target sequence
gatacaattaaagctgttaata

SEQ ID NO: 162583 - DNA, 22 bp, Artificial sequence
  SiRNA target sequence
atacaattaaagctgttaataa

SEQ ID NO: 162584 - DNA, 22 bp, Artificial sequence
  SiRNA target sequence
tacaattaaagctgttaataag

SEQ ID NO: 162585 - DNA, 22 bp, Artificial sequence
  SiRNA target sequence
acaattaaagctgttaataagt

SEQ ID NO: 162586 - DNA, 22 bp, Artificial sequence
  SiRNA target sequence
caattaaagctgttaataagtt

SEQ ID NO: 162587 - DNA, 22 bp, Artificial sequence
  SiRNA target sequence
aattaaagctgttaataagtta

SEQ ID NO: 162588 - DNA, 22 bp, Artificial sequence
  SiRNA target sequence
attaaagctgttaataagttaa

SEQ ID NO: 162589 - DNA, 22 bp, Artificial sequence
  SiRNA target sequence
ttaaagctgttaataagttaag

SEQ ID NO: 162590 - DNA, 22 bp, Artificial sequence
  SiRNA target sequence
taaagctgttaataagttaaga

SEQ ID NO: 162591 - DNA, 22 bp, Artificial sequence
  SiRNA target sequence
aaagctgttaataagttaagag

SEQ ID NO: 162592 - DNA, 22 bp, Artificial sequence
  SiRNA target sequence
aagctgttaataagttaagaga

SEQ ID NO: 162593 - DNA, 22 bp, Artificial sequence
  SiRNA target sequence
agctgttaataagttaagagat

SEQ ID NO: 162594 - DNA, 22 bp, Artificial sequence
  SiRNA target sequence
gctgttaataagttaagagata

SEQ ID NO: 162595 - DNA, 22 bp, Artificial sequence
  SiRNA target sequence
ctgttaataagttaagagatat

SEQ ID NO: 162596 - DNA, 22 bp, Artificial sequence
  SiRNA target sequence
tgttaataagttaagagatatg

SEQ ID NO: 162597 - DNA, 22 bp, Artificial sequence
  SiRNA target sequence
gttaataagttaagagatatgt

SEQ ID NO: 162598 - DNA, 22 bp, Artificial sequence
  SiRNA target sequence
ttaataagttaagagatatgtc

SEQ ID NO: 162599 - DNA, 22 bp, Artificial sequence
  SiRNA target sequence
taataagttaagagatatgtct

SEQ ID NO: 162600 - DNA, 22 bp, Artificial sequence
  SiRNA target sequence
aataagttaagagatatgtctc

SEQ ID NO: 162601 - DNA, 22 bp, Artificial sequence
  SiRNA target sequence
ataagttaagagatatgtctcc

SEQ ID NO: 162602 - DNA, 22 bp, Artificial sequence
  SiRNA target sequence
taagttaagagatatgtctcct

SEQ ID NO: 162603 - DNA, 22 bp, Artificial sequence
  SiRNA target sequence
aagttaagagatatgtctcctt

SEQ ID NO: 162604 - DNA, 22 bp, Artificial sequence
  SiRNA target sequence
agttaagagatatgtctccttt

SEQ ID NO: 162605 - DNA, 22 bp, Artificial sequence
  SiRNA target sequence
gttaagagatatgtctccttta

SEQ ID NO: 162606 - DNA, 22 bp, Artificial sequence
  SiRNA target sequence
ttaagagatatgtctcctttat

SEQ ID NO: 162607 - DNA, 22 bp, Artificial sequence
  SiRNA target sequence
taagagatatgtctcctttata

SEQ ID NO: 162608 - DNA, 22 bp, Artificial sequence
  SiRNA target sequence
aagagatatgtctcctttatat

SEQ ID NO: 162609 - DNA, 22 bp, Artificial sequence
  SiRNA target sequence
agagatatgtctcctttatatg

SEQ ID NO: 162610 - DNA, 22 bp, Artificial sequence
  SiRNA target sequence
gagatatgtctcctttatatga

SEQ ID NO: 162611 - DNA, 22 bp, Artificial sequence
  SiRNA target sequence
agatatgtctcctttatatgaa

SEQ ID NO: 162612 - DNA, 22 bp, Artificial sequence
  SiRNA target sequence
gatatgtctcctttatatgaaa

SEQ ID NO: 162613 - DNA, 22 bp, Artificial sequence
  SiRNA target sequence
atatgtctcctttatatgaaat

SEQ ID NO: 162614 - DNA, 22 bp, Artificial sequence
  SiRNA target sequence
tatgtctcctttatatgaaatg

SEQ ID NO: 162615 - DNA, 22 bp, Artificial sequence
  SiRNA target sequence
atgtctcctttatatgaaatgg

SEQ ID NO: 162616 - DNA, 22 bp, Artificial sequence
  SiRNA target sequence
tgtctcctttatatgaaatggt

SEQ ID NO: 162617 - DNA, 22 bp, Artificial sequence
  SiRNA target sequence
gtctcctttatatgaaatggtc

SEQ ID NO: 162618 - DNA, 22 bp, Artificial sequence
  SiRNA target sequence
tctcctttatatgaaatggtca

SEQ ID NO: 162619 - DNA, 22 bp, Artificial sequence
  SiRNA target sequence
ctcctttatatgaaatggtcaa

SEQ ID NO: 162620 - DNA, 22 bp, Artificial sequence
  SiRNA target sequence
tcctttatatgaaatggtcaaa

SEQ ID NO: 162621 - DNA, 22 bp, Artificial sequence
  SiRNA target sequence
cctttatatgaaatggtcaaag

SEQ ID NO: 162622 - DNA, 22 bp, Artificial sequence
  SiRNA target sequence
ctttatatgaaatggtcaaaga

SEQ ID NO: 162623 - DNA, 22 bp, Artificial sequence
  SiRNA target sequence
tttatatgaaatggtcaaagaa

SEQ ID NO: 162624 - DNA, 22 bp, Artificial sequence
  SiRNA target sequence
ttatatgaaatggtcaaagaag

SEQ ID NO: 162625 - DNA, 22 bp, Artificial sequence
  SiRNA target sequence
tatatgaaatggtcaaagaagg

SEQ ID NO: 162626 - DNA, 22 bp, Artificial sequence
  SiRNA target sequence
atatgaaatggtcaaagaaggg

SEQ ID NO: 162627 - DNA, 22 bp, Artificial sequence
  SiRNA target sequence
tatgaaatggtcaaagaaggga

SEQ ID NO: 162628 - DNA, 22 bp, Artificial sequence
  SiRNA target sequence
atgaaatggtcaaagaagggat

SEQ ID NO: 162629 - DNA, 22 bp, Artificial sequence
  SiRNA target sequence
tgaaatggtcaaagaagggata

SEQ ID NO: 162630 - DNA, 22 bp, Artificial sequence
  SiRNA target sequence
gaaatggtcaaagaagggatag

SEQ ID NO: 162631 - DNA, 22 bp, Artificial sequence
  SiRNA target sequence
aaatggtcaaagaagggataga

SEQ ID NO: 162632 - DNA, 22 bp, Artificial sequence
  SiRNA target sequence
aatggtcaaagaagggatagat

SEQ ID NO: 162633 - DNA, 22 bp, Artificial sequence
  SiRNA target sequence
atggtcaaagaagggatagatt

SEQ ID NO: 162634 - DNA, 22 bp, Artificial sequence
  SiRNA target sequence
tggtcaaagaagggatagattt

SEQ ID NO: 162635 - DNA, 22 bp, Artificial sequence
  SiRNA target sequence
ggtcaaagaagggatagattta

SEQ ID NO: 162636 - DNA, 22 bp, Artificial sequence
  SiRNA target sequence
gtcaaagaagggatagatttag

SEQ ID NO: 162637 - DNA, 22 bp, Artificial sequence
  SiRNA target sequence
tcaaagaagggatagatttaga

SEQ ID NO: 162638 - DNA, 22 bp, Artificial sequence
  SiRNA target sequence
caaagaagggatagatttagat

SEQ ID NO: 162639 - DNA, 22 bp, Artificial sequence
  SiRNA target sequence
aaagaagggatagatttagata

SEQ ID NO: 162640 - DNA, 22 bp, Artificial sequence
  SiRNA target sequence
aagaagggatagatttagataa

SEQ ID NO: 162641 - DNA, 22 bp, Artificial sequence
  SiRNA target sequence
agaagggatagatttagataaa

SEQ ID NO: 162642 - DNA, 22 bp, Artificial sequence
  SiRNA target sequence
gaagggatagatttagataaaa

SEQ ID NO: 162643 - DNA, 22 bp, Artificial sequence
  SiRNA target sequence
aagggatagatttagataaaat

SEQ ID NO: 162644 - DNA, 22 bp, Artificial sequence
  SiRNA target sequence
agggatagatttagataaaatt

SEQ ID NO: 162645 - DNA, 22 bp, Artificial sequence
  SiRNA target sequence
gggatagatttagataaaatta

SEQ ID NO: 162646 - DNA, 22 bp, Artificial sequence
  SiRNA target sequence
ggatagatttagataaaattaa

SEQ ID NO: 162647 - DNA, 22 bp, Artificial sequence
  SiRNA target sequence
gatagatttagataaaattaat

SEQ ID NO: 162648 - DNA, 22 bp, Artificial sequence
  SiRNA target sequence
atagatttagataaaattaatt

SEQ ID NO: 162649 - DNA, 22 bp, Artificial sequence
  SiRNA target sequence
tagatttagataaaattaattg

SEQ ID NO: 162650 - DNA, 22 bp, Artificial sequence
  SiRNA target sequence
agatttagataaaattaattgg

SEQ ID NO: 162651 - DNA, 22 bp, Artificial sequence
  SiRNA target sequence
gatttagataaaattaattggt

SEQ ID NO: 162652 - DNA, 22 bp, Artificial sequence
  SiRNA target sequence
atttagataaaattaattggtc

SEQ ID NO: 162653 - DNA, 22 bp, Artificial sequence
  SiRNA target sequence
tttagataaaattaattggtct

SEQ ID NO: 162654 - DNA, 22 bp, Artificial sequence
  SiRNA target sequence
ttagataaaattaattggtctg

SEQ ID NO: 162655 - DNA, 22 bp, Artificial sequence
  SiRNA target sequence
tagataaaattaattggtctgc

SEQ ID NO: 162656 - DNA, 22 bp, Artificial sequence
  SiRNA target sequence
agataaaattaattggtctgct

SEQ ID NO: 162657 - DNA, 22 bp, Artificial sequence
  SiRNA target sequence
gataaaattaattggtctgctt

SEQ ID NO: 162658 - DNA, 22 bp, Artificial sequence
  SiRNA target sequence
ataaaattaattggtctgctta

SEQ ID NO: 162659 - DNA, 22 bp, Artificial sequence
  SiRNA target sequence
taaaattaattggtctgcttaa

SEQ ID NO: 162660 - DNA, 23 bp, Artificial sequence
  SiRNA target sequence
atgttatttttttatagccccat

SEQ ID NO: 162661 - DNA, 23 bp, Artificial sequence
  SiRNA target sequence
tgttatttttttatagccccatt

SEQ ID NO: 162662 - DNA, 23 bp, Artificial sequence
  SiRNA target sequence
gttatttttttatagccccattt

SEQ ID NO: 162663 - DNA, 23 bp, Artificial sequence
  SiRNA target sequence
ttatttttttatagccccatttt

SEQ ID NO: 162664 - DNA, 23 bp, Artificial sequence
  SiRNA target sequence
tatttttttatagccccattttt

SEQ ID NO: 162665 - DNA, 23 bp, Artificial sequence
  SiRNA target sequence
atttttttatagccccattttta

SEQ ID NO: 162666 - DNA, 23 bp, Artificial sequence
  SiRNA target sequence
tttttttatagccccatttttat

SEQ ID NO: 162667 - DNA, 23 bp, Artificial sequence
  SiRNA target sequence
ttttttatagccccatttttatg

SEQ ID NO: 162668 - DNA, 23 bp, Artificial sequence
  SiRNA target sequence
tttttatagccccatttttatga

SEQ ID NO: 162669 - DNA, 23 bp, Artificial sequence
  SiRNA target sequence
ttttatagccccatttttatgac

SEQ ID NO: 162670 - DNA, 23 bp, Artificial sequence
  SiRNA target sequence
tttatagccccatttttatgact

SEQ ID NO: 162671 - DNA, 23 bp, Artificial sequence
  SiRNA target sequence
ttatagccccatttttatgacta

SEQ ID NO: 162672 - DNA, 23 bp, Artificial sequence
  SiRNA target sequence
tatagccccatttttatgactaa

SEQ ID NO: 162673 - DNA, 23 bp, Artificial sequence
  SiRNA target sequence
atagccccatttttatgactaaa

SEQ ID NO: 162674 - DNA, 23 bp, Artificial sequence
  SiRNA target sequence
tagccccatttttatgactaaaa

SEQ ID NO: 162675 - DNA, 23 bp, Artificial sequence
  SiRNA target sequence
agccccatttttatgactaaaag

SEQ ID NO: 162676 - DNA, 23 bp, Artificial sequence
  SiRNA target sequence
gccccatttttatgactaaaagt

SEQ ID NO: 162677 - DNA, 23 bp, Artificial sequence
  SiRNA target sequence
ccccatttttatgactaaaagtt

SEQ ID NO: 162678 - DNA, 23 bp, Artificial sequence
  SiRNA target sequence
cccatttttatgactaaaagttt

SEQ ID NO: 162679 - DNA, 23 bp, Artificial sequence
  SiRNA target sequence
ccatttttatgactaaaagttta

SEQ ID NO: 162680 - DNA, 23 bp, Artificial sequence
  SiRNA target sequence
catttttatgactaaaagtttaa

SEQ ID NO: 162681 - DNA, 23 bp, Artificial sequence
  SiRNA target sequence
atttttatgactaaaagtttaac

SEQ ID NO: 162682 - DNA, 23 bp, Artificial sequence
  SiRNA target sequence
tttttatgactaaaagtttaacg

SEQ ID NO: 162683 - DNA, 23 bp, Artificial sequence
  SiRNA target sequence
ttttatgactaaaagtttaacga

SEQ ID NO: 162684 - DNA, 23 bp, Artificial sequence
  SiRNA target sequence
tttatgactaaaagtttaacgaa

SEQ ID NO: 162685 - DNA, 23 bp, Artificial sequence
  SiRNA target sequence
ttatgactaaaagtttaacgaat

SEQ ID NO: 162686 - DNA, 23 bp, Artificial sequence
  SiRNA target sequence
tatgactaaaagtttaacgaatt

SEQ ID NO: 162687 - DNA, 23 bp, Artificial sequence
  SiRNA target sequence
atgactaaaagtttaacgaattc

SEQ ID NO: 162688 - DNA, 23 bp, Artificial sequence
  SiRNA target sequence
tgactaaaagtttaacgaattct

SEQ ID NO: 162689 - DNA, 23 bp, Artificial sequence
  SiRNA target sequence
gactaaaagtttaacgaattcta

SEQ ID NO: 162690 - DNA, 23 bp, Artificial sequence
  SiRNA target sequence
actaaaagtttaacgaattctaa

SEQ ID NO: 162691 - DNA, 23 bp, Artificial sequence
  SiRNA target sequence
ctaaaagtttaacgaattctaaa

SEQ ID NO: 162692 - DNA, 23 bp, Artificial sequence
  SiRNA target sequence
taaaagtttaacgaattctaaaa

SEQ ID NO: 162693 - DNA, 23 bp, Artificial sequence
  SiRNA target sequence
aaaagtttaacgaattctaaaac

SEQ ID NO: 162694 - DNA, 23 bp, Artificial sequence
  SiRNA target sequence
aaagtttaacgaattctaaaact

SEQ ID NO: 162695 - DNA, 23 bp, Artificial sequence
  SiRNA target sequence
aagtttaacgaattctaaaactt

SEQ ID NO: 162696 - DNA, 23 bp, Artificial sequence
  SiRNA target sequence
agtttaacgaattctaaaacttt

SEQ ID NO: 162697 - DNA, 23 bp, Artificial sequence
  SiRNA target sequence
gtttaacgaattctaaaacttta

SEQ ID NO: 162698 - DNA, 23 bp, Artificial sequence
  SiRNA target sequence
tttaacgaattctaaaactttaa

SEQ ID NO: 162699 - DNA, 23 bp, Artificial sequence
  SiRNA target sequence
ttaacgaattctaaaactttaaa

SEQ ID NO: 162700 - DNA, 23 bp, Artificial sequence
  SiRNA target sequence
taacgaattctaaaactttaaat

SEQ ID NO: 162701 - DNA, 23 bp, Artificial sequence
  SiRNA target sequence
aacgaattctaaaactttaaatt

SEQ ID NO: 162702 - DNA, 23 bp, Artificial sequence
  SiRNA target sequence
acgaattctaaaactttaaattt

SEQ ID NO: 162703 - DNA, 23 bp, Artificial sequence
  SiRNA target sequence
cgaattctaaaactttaaattta

SEQ ID NO: 162704 - DNA, 23 bp, Artificial sequence
  SiRNA target sequence
gaattctaaaactttaaatttaa

SEQ ID NO: 162705 - DNA, 23 bp, Artificial sequence
  SiRNA target sequence
aattctaaaactttaaatttaat

SEQ ID NO: 162706 - DNA, 23 bp, Artificial sequence
  SiRNA target sequence
attctaaaactttaaatttaatg

SEQ ID NO: 162707 - DNA, 23 bp, Artificial sequence
  SiRNA target sequence
ttctaaaactttaaatttaatgt

SEQ ID NO: 162708 - DNA, 23 bp, Artificial sequence
  SiRNA target sequence
tctaaaactttaaatttaatgtc

SEQ ID NO: 162709 - DNA, 23 bp, Artificial sequence
  SiRNA target sequence
ctaaaactttaaatttaatgtca

SEQ ID NO: 162710 - DNA, 23 bp, Artificial sequence
  SiRNA target sequence
taaaactttaaatttaatgtcaa

SEQ ID NO: 162711 - DNA, 23 bp, Artificial sequence
  SiRNA target sequence
aaaactttaaatttaatgtcaag

SEQ ID NO: 162712 - DNA, 23 bp, Artificial sequence
  SiRNA target sequence
aaactttaaatttaatgtcaagt

SEQ ID NO: 162713 - DNA, 23 bp, Artificial sequence
  SiRNA target sequence
aactttaaatttaatgtcaagtg

SEQ ID NO: 162714 - DNA, 23 bp, Artificial sequence
  SiRNA target sequence
actttaaatttaatgtcaagtgt

SEQ ID NO: 162715 - DNA, 23 bp, Artificial sequence
  SiRNA target sequence
ctttaaatttaatgtcaagtgta

SEQ ID NO: 162716 - DNA, 23 bp, Artificial sequence
  SiRNA target sequence
tttaaatttaatgtcaagtgtac

SEQ ID NO: 162717 - DNA, 23 bp, Artificial sequence
  SiRNA target sequence
ttaaatttaatgtcaagtgtaca

SEQ ID NO: 162718 - DNA, 23 bp, Artificial sequence
  SiRNA target sequence
taaatttaatgtcaagtgtacaa

SEQ ID NO: 162719 - DNA, 23 bp, Artificial sequence
  SiRNA target sequence
aaatttaatgtcaagtgtacaat

SEQ ID NO: 162720 - DNA, 23 bp, Artificial sequence
  SiRNA target sequence
aatttaatgtcaagtgtacaatc

SEQ ID NO: 162721 - DNA, 23 bp, Artificial sequence
  SiRNA target sequence
atttaatgtcaagtgtacaatca

SEQ ID NO: 162722 - DNA, 23 bp, Artificial sequence
  SiRNA target sequence
tttaatgtcaagtgtacaatcac

SEQ ID NO: 162723 - DNA, 23 bp, Artificial sequence
  SiRNA target sequence
ttaatgtcaagtgtacaatcacc

SEQ ID NO: 162724 - DNA, 23 bp, Artificial sequence
  SiRNA target sequence
taatgtcaagtgtacaatcacca

SEQ ID NO: 162725 - DNA, 23 bp, Artificial sequence
  SiRNA target sequence
aatgtcaagtgtacaatcaccag

SEQ ID NO: 162726 - DNA, 23 bp, Artificial sequence
  SiRNA target sequence
atgtcaagtgtacaatcaccagt

SEQ ID NO: 162727 - DNA, 23 bp, Artificial sequence
  SiRNA target sequence
tgtcaagtgtacaatcaccagtt

SEQ ID NO: 162728 - DNA, 23 bp, Artificial sequence
  SiRNA target sequence
gtcaagtgtacaatcaccagtta

SEQ ID NO: 162729 - DNA, 23 bp, Artificial sequence
  SiRNA target sequence
tcaagtgtacaatcaccagttat

SEQ ID NO: 162730 - DNA, 23 bp, Artificial sequence
  SiRNA target sequence
caagtgtacaatcaccagttata

SEQ ID NO: 162731 - DNA, 23 bp, Artificial sequence
  SiRNA target sequence
aagtgtacaatcaccagttataa

SEQ ID NO: 162732 - DNA, 23 bp, Artificial sequence
  SiRNA target sequence
agtgtacaatcaccagttataaa

SEQ ID NO: 162733 - DNA, 23 bp, Artificial sequence
  SiRNA target sequence
gtgtacaatcaccagttataaat

SEQ ID NO: 162734 - DNA, 23 bp, Artificial sequence
  SiRNA target sequence
tgtacaatcaccagttataaata

SEQ ID NO: 162735 - DNA, 23 bp, Artificial sequence
  SiRNA target sequence
gtacaatcaccagttataaatac

SEQ ID NO: 162736 - DNA, 23 bp, Artificial sequence
  SiRNA target sequence
tacaatcaccagttataaataca

SEQ ID NO: 162737 - DNA, 23 bp, Artificial sequence
  SiRNA target sequence
acaatcaccagttataaatacaa

SEQ ID NO: 162738 - DNA, 23 bp, Artificial sequence
  SiRNA target sequence
caatcaccagttataaatacaaa

SEQ ID NO: 162739 - DNA, 23 bp, Artificial sequence
  SiRNA target sequence
aatcaccagttataaatacaaaa

SEQ ID NO: 162740 - DNA, 23 bp, Artificial sequence
  SiRNA target sequence
atcaccagttataaatacaaaaa

SEQ ID NO: 162741 - DNA, 23 bp, Artificial sequence
  SiRNA target sequence
tcaccagttataaatacaaaaaa

SEQ ID NO: 162742 - DNA, 23 bp, Artificial sequence
  SiRNA target sequence
caccagttataaatacaaaaaaa

SEQ ID NO: 162743 - DNA, 23 bp, Artificial sequence
  SiRNA target sequence
accagttataaatacaaaaaaaa

SEQ ID NO: 162744 - DNA, 23 bp, Artificial sequence
  SiRNA target sequence
ccagttataaatacaaaaaaaat

SEQ ID NO: 162745 - DNA, 23 bp, Artificial sequence
  SiRNA target sequence
cagttataaatacaaaaaaaata

SEQ ID NO: 162746 - DNA, 23 bp, Artificial sequence
  SiRNA target sequence
agttataaatacaaaaaaaatat

SEQ ID NO: 162747 - DNA, 23 bp, Artificial sequence
  SiRNA target sequence
gttataaatacaaaaaaaatata

SEQ ID NO: 162748 - DNA, 23 bp, Artificial sequence
  SiRNA target sequence
ttataaatacaaaaaaaatatat

SEQ ID NO: 162749 - DNA, 23 bp, Artificial sequence
  SiRNA target sequence
tataaatacaaaaaaaatatatc

SEQ ID NO: 162750 - DNA, 23 bp, Artificial sequence
  SiRNA target sequence
ataaatacaaaaaaaatatatct

SEQ ID NO: 162751 - DNA, 23 bp, Artificial sequence
  SiRNA target sequence
taaatacaaaaaaaatatatctt

SEQ ID NO: 162752 - DNA, 23 bp, Artificial sequence
  SiRNA target sequence
aaatacaaaaaaaatatatcttg

SEQ ID NO: 162753 - DNA, 23 bp, Artificial sequence
  SiRNA target sequence
aatacaaaaaaaatatatcttga

SEQ ID NO: 162754 - DNA, 23 bp, Artificial sequence
  SiRNA target sequence
atacaaaaaaaatatatcttgat

SEQ ID NO: 162755 - DNA, 23 bp, Artificial sequence
  SiRNA target sequence
tacaaaaaaaatatatcttgatg

SEQ ID NO: 162756 - DNA, 23 bp, Artificial sequence
  SiRNA target sequence
acaaaaaaaatatatcttgatgc

SEQ ID NO: 162757 - DNA, 23 bp, Artificial sequence
  SiRNA target sequence
caaaaaaaatatatcttgatgca

SEQ ID NO: 162758 - DNA, 23 bp, Artificial sequence
  SiRNA target sequence
aaaaaaaatatatcttgatgcac

SEQ ID NO: 162759 - DNA, 23 bp, Artificial sequence
  SiRNA target sequence
aaaaaaatatatcttgatgcaca

SEQ ID NO: 162760 - DNA, 23 bp, Artificial sequence
  SiRNA target sequence
aaaaaatatatcttgatgcacaa

SEQ ID NO: 162761 - DNA, 23 bp, Artificial sequence
  SiRNA target sequence
aaaaatatatcttgatgcacaag

SEQ ID NO: 162762 - DNA, 23 bp, Artificial sequence
  SiRNA target sequence
aaaatatatcttgatgcacaagc

SEQ ID NO: 162763 - DNA, 23 bp, Artificial sequence
  SiRNA target sequence
aaatatatcttgatgcacaagcg

SEQ ID NO: 162764 - DNA, 23 bp, Artificial sequence
  SiRNA target sequence
aatatatcttgatgcacaagcga

SEQ ID NO: 162765 - DNA, 23 bp, Artificial sequence
  SiRNA target sequence
atatatcttgatgcacaagcgac

SEQ ID NO: 162766 - DNA, 23 bp, Artificial sequence
  SiRNA target sequence
tatatcttgatgcacaagcgacc

SEQ ID NO: 162767 - DNA, 23 bp, Artificial sequence
  SiRNA target sequence
atatcttgatgcacaagcgacca

SEQ ID NO: 162768 - DNA, 23 bp, Artificial sequence
  SiRNA target sequence
tatcttgatgcacaagcgaccaa

SEQ ID NO: 162769 - DNA, 23 bp, Artificial sequence
  SiRNA target sequence
atcttgatgcacaagcgaccaag

SEQ ID NO: 162770 - DNA, 23 bp, Artificial sequence
  SiRNA target sequence
tcttgatgcacaagcgaccaagc

SEQ ID NO: 162771 - DNA, 23 bp, Artificial sequence
  SiRNA target sequence
cttgatgcacaagcgaccaagcc

SEQ ID NO: 162772 - DNA, 23 bp, Artificial sequence
  SiRNA target sequence
ttgatgcacaagcgaccaagcct

SEQ ID NO: 162773 - DNA, 23 bp, Artificial sequence
  SiRNA target sequence
tgatgcacaagcgaccaagcctt

SEQ ID NO: 162774 - DNA, 23 bp, Artificial sequence
  SiRNA target sequence
gatgcacaagcgaccaagccttt

SEQ ID NO: 162775 - DNA, 23 bp, Artificial sequence
  SiRNA target sequence
atgcacaagcgaccaagccttta

SEQ ID NO: 162776 - DNA, 23 bp, Artificial sequence
  SiRNA target sequence
tgcacaagcgaccaagcctttag

SEQ ID NO: 162777 - DNA, 23 bp, Artificial sequence
  SiRNA target sequence
gcacaagcgaccaagcctttaga

SEQ ID NO: 162778 - DNA, 23 bp, Artificial sequence
  SiRNA target sequence
cacaagcgaccaagcctttagac

SEQ ID NO: 162779 - DNA, 23 bp, Artificial sequence
  SiRNA target sequence
acaagcgaccaagcctttagacc

SEQ ID NO: 162780 - DNA, 23 bp, Artificial sequence
  SiRNA target sequence
caagcgaccaagcctttagaccc

SEQ ID NO: 162781 - DNA, 23 bp, Artificial sequence
  SiRNA target sequence
aagcgaccaagcctttagacccg

SEQ ID NO: 162782 - DNA, 23 bp, Artificial sequence
  SiRNA target sequence
agcgaccaagcctttagacccgc

SEQ ID NO: 162783 - DNA, 23 bp, Artificial sequence
  SiRNA target sequence
gcgaccaagcctttagacccgcg

SEQ ID NO: 162784 - DNA, 23 bp, Artificial sequence
  SiRNA target sequence
cgaccaagcctttagacccgcgt

SEQ ID NO: 162785 - DNA, 23 bp, Artificial sequence
  SiRNA target sequence
gaccaagcctttagacccgcgtg

SEQ ID NO: 162786 - DNA, 23 bp, Artificial sequence
  SiRNA target sequence
accaagcctttagacccgcgtgt

SEQ ID NO: 162787 - DNA, 23 bp, Artificial sequence
  SiRNA target sequence
ccaagcctttagacccgcgtgtg

SEQ ID NO: 162788 - DNA, 23 bp, Artificial sequence
  SiRNA target sequence
caagcctttagacccgcgtgtgc

SEQ ID NO: 162789 - DNA, 23 bp, Artificial sequence
  SiRNA target sequence
aagcctttagacccgcgtgtgct

SEQ ID NO: 162790 - DNA, 23 bp, Artificial sequence
  SiRNA target sequence
agcctttagacccgcgtgtgctt

SEQ ID NO: 162791 - DNA, 23 bp, Artificial sequence
  SiRNA target sequence
gcctttagacccgcgtgtgcttg

SEQ ID NO: 162792 - DNA, 23 bp, Artificial sequence
  SiRNA target sequence
cctttagacccgcgtgtgcttga

SEQ ID NO: 162793 - DNA, 23 bp, Artificial sequence
  SiRNA target sequence
ctttagacccgcgtgtgcttgat

SEQ ID NO: 162794 - DNA, 23 bp, Artificial sequence
  SiRNA target sequence
tttagacccgcgtgtgcttgatg

SEQ ID NO: 162795 - DNA, 23 bp, Artificial sequence
  SiRNA target sequence
ttagacccgcgtgtgcttgatgc

SEQ ID NO: 162796 - DNA, 23 bp, Artificial sequence
  SiRNA target sequence
tagacccgcgtgtgcttgatgca

SEQ ID NO: 162797 - DNA, 23 bp, Artificial sequence
  SiRNA target sequence
agacccgcgtgtgcttgatgcaa

SEQ ID NO: 162798 - DNA, 23 bp, Artificial sequence
  SiRNA target sequence
gacccgcgtgtgcttgatgcaat

SEQ ID NO: 162799 - DNA, 23 bp, Artificial sequence
  SiRNA target sequence
acccgcgtgtgcttgatgcaatg

SEQ ID NO: 162800 - DNA, 23 bp, Artificial sequence
  SiRNA target sequence
cccgcgtgtgcttgatgcaatgc

SEQ ID NO: 162801 - DNA, 23 bp, Artificial sequence
  SiRNA target sequence
ccgcgtgtgcttgatgcaatgct

SEQ ID NO: 162802 - DNA, 23 bp, Artificial sequence
  SiRNA target sequence
cgcgtgtgcttgatgcaatgctt

SEQ ID NO: 162803 - DNA, 23 bp, Artificial sequence
  SiRNA target sequence
gcgtgtgcttgatgcaatgcttc

SEQ ID NO: 162804 - DNA, 23 bp, Artificial sequence
  SiRNA target sequence
cgtgtgcttgatgcaatgcttcc

SEQ ID NO: 162805 - DNA, 23 bp, Artificial sequence
  SiRNA target sequence
gtgtgcttgatgcaatgcttcca

SEQ ID NO: 162806 - DNA, 23 bp, Artificial sequence
  SiRNA target sequence
tgtgcttgatgcaatgcttccat

SEQ ID NO: 162807 - DNA, 23 bp, Artificial sequence
  SiRNA target sequence
gtgcttgatgcaatgcttccata

SEQ ID NO: 162808 - DNA, 23 bp, Artificial sequence
  SiRNA target sequence
tgcttgatgcaatgcttccatac

SEQ ID NO: 162809 - DNA, 23 bp, Artificial sequence
  SiRNA target sequence
gcttgatgcaatgcttccatact

SEQ ID NO: 162810 - DNA, 23 bp, Artificial sequence
  SiRNA target sequence
cttgatgcaatgcttccatacta

SEQ ID NO: 162811 - DNA, 23 bp, Artificial sequence
  SiRNA target sequence
ttgatgcaatgcttccatactat

SEQ ID NO: 162812 - DNA, 23 bp, Artificial sequence
  SiRNA target sequence
tgatgcaatgcttccatactata

SEQ ID NO: 162813 - DNA, 23 bp, Artificial sequence
  SiRNA target sequence
gatgcaatgcttccatactatac

SEQ ID NO: 162814 - DNA, 23 bp, Artificial sequence
  SiRNA target sequence
atgcaatgcttccatactataca

SEQ ID NO: 162815 - DNA, 23 bp, Artificial sequence
  SiRNA target sequence
tgcaatgcttccatactatacat

SEQ ID NO: 162816 - DNA, 23 bp, Artificial sequence
  SiRNA target sequence
gcaatgcttccatactatacatc

SEQ ID NO: 162817 - DNA, 23 bp, Artificial sequence
  SiRNA target sequence
caatgcttccatactatacatcc

SEQ ID NO: 162818 - DNA, 23 bp, Artificial sequence
  SiRNA target sequence
aatgcttccatactatacatcca

SEQ ID NO: 162819 - DNA, 23 bp, Artificial sequence
  SiRNA target sequence
atgcttccatactatacatccat

SEQ ID NO: 162820 - DNA, 23 bp, Artificial sequence
  SiRNA target sequence
tgcttccatactatacatccatt

SEQ ID NO: 162821 - DNA, 23 bp, Artificial sequence
  SiRNA target sequence
gcttccatactatacatccattt

SEQ ID NO: 162822 - DNA, 23 bp, Artificial sequence
  SiRNA target sequence
cttccatactatacatccatttt

SEQ ID NO: 162823 - DNA, 23 bp, Artificial sequence
  SiRNA target sequence
ttccatactatacatccattttt

SEQ ID NO: 162824 - DNA, 23 bp, Artificial sequence
  SiRNA target sequence
tccatactatacatccatttttg

SEQ ID NO: 162825 - DNA, 23 bp, Artificial sequence
  SiRNA target sequence
ccatactatacatccatttttgg

SEQ ID NO: 162826 - DNA, 23 bp, Artificial sequence
  SiRNA target sequence
catactatacatccatttttgga

SEQ ID NO: 162827 - DNA, 23 bp, Artificial sequence
  SiRNA target sequence
atactatacatccatttttggaa

SEQ ID NO: 162828 - DNA, 23 bp, Artificial sequence
  SiRNA target sequence
tactatacatccatttttggaaa

SEQ ID NO: 162829 - DNA, 23 bp, Artificial sequence
  SiRNA target sequence
actatacatccatttttggaaat

SEQ ID NO: 162830 - DNA, 23 bp, Artificial sequence
  SiRNA target sequence
ctatacatccatttttggaaatc

SEQ ID NO: 162831 - DNA, 23 bp, Artificial sequence
  SiRNA target sequence
tatacatccatttttggaaatcc

SEQ ID NO: 162832 - DNA, 23 bp, Artificial sequence
  SiRNA target sequence
atacatccatttttggaaatcca

SEQ ID NO: 162833 - DNA, 23 bp, Artificial sequence
  SiRNA target sequence
tacatccatttttggaaatccac

SEQ ID NO: 162834 - DNA, 23 bp, Artificial sequence
  SiRNA target sequence
acatccatttttggaaatccaca

SEQ ID NO: 162835 - DNA, 23 bp, Artificial sequence
  SiRNA target sequence
catccatttttggaaatccacat

SEQ ID NO: 162836 - DNA, 23 bp, Artificial sequence
  SiRNA target sequence
atccatttttggaaatccacatt

SEQ ID NO: 162837 - DNA, 23 bp, Artificial sequence
  SiRNA target sequence
tccatttttggaaatccacattc

SEQ ID NO: 162838 - DNA, 23 bp, Artificial sequence
  SiRNA target sequence
ccatttttggaaatccacattct

SEQ ID NO: 162839 - DNA, 23 bp, Artificial sequence
  SiRNA target sequence
catttttggaaatccacattctc

SEQ ID NO: 162840 - DNA, 23 bp, Artificial sequence
  SiRNA target sequence
atttttggaaatccacattctcg

SEQ ID NO: 162841 - DNA, 23 bp, Artificial sequence
  SiRNA target sequence
tttttggaaatccacattctcgc

SEQ ID NO: 162842 - DNA, 23 bp, Artificial sequence
  SiRNA target sequence
ttttggaaatccacattctcgca

SEQ ID NO: 162843 - DNA, 23 bp, Artificial sequence
  SiRNA target sequence
tttggaaatccacattctcgcac

SEQ ID NO: 162844 - DNA, 23 bp, Artificial sequence
  SiRNA target sequence
ttggaaatccacattctcgcacg

SEQ ID NO: 162845 - DNA, 23 bp, Artificial sequence
  SiRNA target sequence
tggaaatccacattctcgcacgc

SEQ ID NO: 162846 - DNA, 23 bp, Artificial sequence
  SiRNA target sequence
ggaaatccacattctcgcacgca

SEQ ID NO: 162847 - DNA, 23 bp, Artificial sequence
  SiRNA target sequence
gaaatccacattctcgcacgcat

SEQ ID NO: 162848 - DNA, 23 bp, Artificial sequence
  SiRNA target sequence
aaatccacattctcgcacgcata

SEQ ID NO: 162849 - DNA, 23 bp, Artificial sequence
  SiRNA target sequence
aatccacattctcgcacgcatac

SEQ ID NO: 162850 - DNA, 23 bp, Artificial sequence
  SiRNA target sequence
atccacattctcgcacgcatacg

SEQ ID NO: 162851 - DNA, 23 bp, Artificial sequence
  SiRNA target sequence
tccacattctcgcacgcatacgt

SEQ ID NO: 162852 - DNA, 23 bp, Artificial sequence
  SiRNA target sequence
ccacattctcgcacgcatacgtt

SEQ ID NO: 162853 - DNA, 23 bp, Artificial sequence
  SiRNA target sequence
cacattctcgcacgcatacgttt

SEQ ID NO: 162854 - DNA, 23 bp, Artificial sequence
  SiRNA target sequence
acattctcgcacgcatacgtttg

SEQ ID NO: 162855 - DNA, 23 bp, Artificial sequence
  SiRNA target sequence
cattctcgcacgcatacgtttgg

SEQ ID NO: 162856 - DNA, 23 bp, Artificial sequence
  SiRNA target sequence
attctcgcacgcatacgtttgga

SEQ ID NO: 162857 - DNA, 23 bp, Artificial sequence
  SiRNA target sequence
ttctcgcacgcatacgtttggat

SEQ ID NO: 162858 - DNA, 23 bp, Artificial sequence
  SiRNA target sequence
tctcgcacgcatacgtttggatg

SEQ ID NO: 162859 - DNA, 23 bp, Artificial sequence
  SiRNA target sequence
ctcgcacgcatacgtttggatgg

SEQ ID NO: 162860 - DNA, 23 bp, Artificial sequence
  SiRNA target sequence
tcgcacgcatacgtttggatgga

SEQ ID NO: 162861 - DNA, 23 bp, Artificial sequence
  SiRNA target sequence
cgcacgcatacgtttggatggaa

SEQ ID NO: 162862 - DNA, 23 bp, Artificial sequence
  SiRNA target sequence
gcacgcatacgtttggatggaat

SEQ ID NO: 162863 - DNA, 23 bp, Artificial sequence
  SiRNA target sequence
cacgcatacgtttggatggaatg

SEQ ID NO: 162864 - DNA, 23 bp, Artificial sequence
  SiRNA target sequence
acgcatacgtttggatggaatgc

SEQ ID NO: 162865 - DNA, 23 bp, Artificial sequence
  SiRNA target sequence
cgcatacgtttggatggaatgca

SEQ ID NO: 162866 - DNA, 23 bp, Artificial sequence
  SiRNA target sequence
gcatacgtttggatggaatgcag

SEQ ID NO: 162867 - DNA, 23 bp, Artificial sequence
  SiRNA target sequence
catacgtttggatggaatgcaga

SEQ ID NO: 162868 - DNA, 23 bp, Artificial sequence
  SiRNA target sequence
atacgtttggatggaatgcagaa

SEQ ID NO: 162869 - DNA, 23 bp, Artificial sequence
  SiRNA target sequence
tacgtttggatggaatgcagaaa

SEQ ID NO: 162870 - DNA, 23 bp, Artificial sequence
  SiRNA target sequence
acgtttggatggaatgcagaaaa

SEQ ID NO: 162871 - DNA, 23 bp, Artificial sequence
  SiRNA target sequence
cgtttggatggaatgcagaaaaa

SEQ ID NO: 162872 - DNA, 23 bp, Artificial sequence
  SiRNA target sequence
gtttggatggaatgcagaaaaag

SEQ ID NO: 162873 - DNA, 23 bp, Artificial sequence
  SiRNA target sequence
tttggatggaatgcagaaaaagg

SEQ ID NO: 162874 - DNA, 23 bp, Artificial sequence
  SiRNA target sequence
ttggatggaatgcagaaaaaggc

SEQ ID NO: 162875 - DNA, 23 bp, Artificial sequence
  SiRNA target sequence
tggatggaatgcagaaaaaggcg

SEQ ID NO: 162876 - DNA, 23 bp, Artificial sequence
  SiRNA target sequence
ggatggaatgcagaaaaaggcgt

SEQ ID NO: 162877 - DNA, 23 bp, Artificial sequence
  SiRNA target sequence
gatggaatgcagaaaaaggcgta

SEQ ID NO: 162878 - DNA, 23 bp, Artificial sequence
  SiRNA target sequence
atggaatgcagaaaaaggcgtag

SEQ ID NO: 162879 - DNA, 23 bp, Artificial sequence
  SiRNA target sequence
tggaatgcagaaaaaggcgtaga

SEQ ID NO: 162880 - DNA, 23 bp, Artificial sequence
  SiRNA target sequence
ggaatgcagaaaaaggcgtagaa

SEQ ID NO: 162881 - DNA, 23 bp, Artificial sequence
  SiRNA target sequence
gaatgcagaaaaaggcgtagaaa

SEQ ID NO: 162882 - DNA, 23 bp, Artificial sequence
  SiRNA target sequence
aatgcagaaaaaggcgtagaaat

SEQ ID NO: 162883 - DNA, 23 bp, Artificial sequence
  SiRNA target sequence
atgcagaaaaaggcgtagaaatg

SEQ ID NO: 162884 - DNA, 23 bp, Artificial sequence
  SiRNA target sequence
tgcagaaaaaggcgtagaaatgg

SEQ ID NO: 162885 - DNA, 23 bp, Artificial sequence
  SiRNA target sequence
gcagaaaaaggcgtagaaatggc

SEQ ID NO: 162886 - DNA, 23 bp, Artificial sequence
  SiRNA target sequence
cagaaaaaggcgtagaaatggct

SEQ ID NO: 162887 - DNA, 23 bp, Artificial sequence
  SiRNA target sequence
agaaaaaggcgtagaaatggctc

SEQ ID NO: 162888 - DNA, 23 bp, Artificial sequence
  SiRNA target sequence
gaaaaaggcgtagaaatggctcg

SEQ ID NO: 162889 - DNA, 23 bp, Artificial sequence
  SiRNA target sequence
aaaaaggcgtagaaatggctcga

SEQ ID NO: 162890 - DNA, 23 bp, Artificial sequence
  SiRNA target sequence
aaaaggcgtagaaatggctcgaa

SEQ ID NO: 162891 - DNA, 23 bp, Artificial sequence
  SiRNA target sequence
aaaggcgtagaaatggctcgaaa

SEQ ID NO: 162892 - DNA, 23 bp, Artificial sequence
  SiRNA target sequence
aaggcgtagaaatggctcgaaag

SEQ ID NO: 162893 - DNA, 23 bp, Artificial sequence
  SiRNA target sequence
aggcgtagaaatggctcgaaagc

SEQ ID NO: 162894 - DNA, 23 bp, Artificial sequence
  SiRNA target sequence
ggcgtagaaatggctcgaaagca

SEQ ID NO: 162895 - DNA, 23 bp, Artificial sequence
  SiRNA target sequence
gcgtagaaatggctcgaaagcaa

SEQ ID NO: 162896 - DNA, 23 bp, Artificial sequence
  SiRNA target sequence
cgtagaaatggctcgaaagcaag

SEQ ID NO: 162897 - DNA, 23 bp, Artificial sequence
  SiRNA target sequence
gtagaaatggctcgaaagcaagt

SEQ ID NO: 162898 - DNA, 23 bp, Artificial sequence
  SiRNA target sequence
tagaaatggctcgaaagcaagta

SEQ ID NO: 162899 - DNA, 23 bp, Artificial sequence
  SiRNA target sequence
agaaatggctcgaaagcaagtag

SEQ ID NO: 162900 - DNA, 23 bp, Artificial sequence
  SiRNA target sequence
gaaatggctcgaaagcaagtagc

SEQ ID NO: 162901 - DNA, 23 bp, Artificial sequence
  SiRNA target sequence
aaatggctcgaaagcaagtagca

SEQ ID NO: 162902 - DNA, 23 bp, Artificial sequence
  SiRNA target sequence
aatggctcgaaagcaagtagcag

SEQ ID NO: 162903 - DNA, 23 bp, Artificial sequence
  SiRNA target sequence
atggctcgaaagcaagtagcaga

SEQ ID NO: 162904 - DNA, 23 bp, Artificial sequence
  SiRNA target sequence
tggctcgaaagcaagtagcagat

SEQ ID NO: 162905 - DNA, 23 bp, Artificial sequence
  SiRNA target sequence
ggctcgaaagcaagtagcagatt

SEQ ID NO: 162906 - DNA, 23 bp, Artificial sequence
  SiRNA target sequence
gctcgaaagcaagtagcagattt

SEQ ID NO: 162907 - DNA, 23 bp, Artificial sequence
  SiRNA target sequence
ctcgaaagcaagtagcagattta

SEQ ID NO: 162908 - DNA, 23 bp, Artificial sequence
  SiRNA target sequence
tcgaaagcaagtagcagatttac

SEQ ID NO: 162909 - DNA, 23 bp, Artificial sequence
  SiRNA target sequence
cgaaagcaagtagcagatttact

SEQ ID NO: 162910 - DNA, 23 bp, Artificial sequence
  SiRNA target sequence
gaaagcaagtagcagatttactg

SEQ ID NO: 162911 - DNA, 23 bp, Artificial sequence
  SiRNA target sequence
aaagcaagtagcagatttactga

SEQ ID NO: 162912 - DNA, 23 bp, Artificial sequence
  SiRNA target sequence
aagcaagtagcagatttactgaa

SEQ ID NO: 162913 - DNA, 23 bp, Artificial sequence
  SiRNA target sequence
agcaagtagcagatttactgaat

SEQ ID NO: 162914 - DNA, 23 bp, Artificial sequence
  SiRNA target sequence
gcaagtagcagatttactgaatg

SEQ ID NO: 162915 - DNA, 23 bp, Artificial sequence
  SiRNA target sequence
caagtagcagatttactgaatgc

SEQ ID NO: 162916 - DNA, 23 bp, Artificial sequence
  SiRNA target sequence
aagtagcagatttactgaatgcc

SEQ ID NO: 162917 - DNA, 23 bp, Artificial sequence
  SiRNA target sequence
agtagcagatttactgaatgcca

SEQ ID NO: 162918 - DNA, 23 bp, Artificial sequence
  SiRNA target sequence
gtagcagatttactgaatgccaa

SEQ ID NO: 162919 - DNA, 23 bp, Artificial sequence
  SiRNA target sequence
tagcagatttactgaatgccaat

SEQ ID NO: 162920 - DNA, 23 bp, Artificial sequence
  SiRNA target sequence
agcagatttactgaatgccaatg

SEQ ID NO: 162921 - DNA, 23 bp, Artificial sequence
  SiRNA target sequence
gcagatttactgaatgccaatga

SEQ ID NO: 162922 - DNA, 23 bp, Artificial sequence
  SiRNA target sequence
cagatttactgaatgccaatgaa

SEQ ID NO: 162923 - DNA, 23 bp, Artificial sequence
  SiRNA target sequence
agatttactgaatgccaatgaaa

SEQ ID NO: 162924 - DNA, 23 bp, Artificial sequence
  SiRNA target sequence
gatttactgaatgccaatgaaaa

SEQ ID NO: 162925 - DNA, 23 bp, Artificial sequence
  SiRNA target sequence
atttactgaatgccaatgaaaaa

SEQ ID NO: 162926 - DNA, 23 bp, Artificial sequence
  SiRNA target sequence
tttactgaatgccaatgaaaaag

SEQ ID NO: 162927 - DNA, 23 bp, Artificial sequence
  SiRNA target sequence
ttactgaatgccaatgaaaaaga

SEQ ID NO: 162928 - DNA, 23 bp, Artificial sequence
  SiRNA target sequence
tactgaatgccaatgaaaaagaa

SEQ ID NO: 162929 - DNA, 23 bp, Artificial sequence
  SiRNA target sequence
actgaatgccaatgaaaaagaaa

SEQ ID NO: 162930 - DNA, 23 bp, Artificial sequence
  SiRNA target sequence
ctgaatgccaatgaaaaagaaat

SEQ ID NO: 162931 - DNA, 23 bp, Artificial sequence
  SiRNA target sequence
tgaatgccaatgaaaaagaaatt

SEQ ID NO: 162932 - DNA, 23 bp, Artificial sequence
  SiRNA target sequence
gaatgccaatgaaaaagaaatta

SEQ ID NO: 162933 - DNA, 23 bp, Artificial sequence
  SiRNA target sequence
aatgccaatgaaaaagaaattat

SEQ ID NO: 162934 - DNA, 23 bp, Artificial sequence
  SiRNA target sequence
atgccaatgaaaaagaaattatt

SEQ ID NO: 162935 - DNA, 23 bp, Artificial sequence
  SiRNA target sequence
tgccaatgaaaaagaaattattt

SEQ ID NO: 162936 - DNA, 23 bp, Artificial sequence
  SiRNA target sequence
gccaatgaaaaagaaattatttt

SEQ ID NO: 162937 - DNA, 23 bp, Artificial sequence
  SiRNA target sequence
ccaatgaaaaagaaattattttt

SEQ ID NO: 162938 - DNA, 23 bp, Artificial sequence
  SiRNA target sequence
caatgaaaaagaaattattttta

SEQ ID NO: 162939 - DNA, 23 bp, Artificial sequence
  SiRNA target sequence
aatgaaaaagaaattatttttac

SEQ ID NO: 162940 - DNA, 23 bp, Artificial sequence
  SiRNA target sequence
atgaaaaagaaattatttttact

SEQ ID NO: 162941 - DNA, 23 bp, Artificial sequence
  SiRNA target sequence
tgaaaaagaaattatttttacta

SEQ ID NO: 162942 - DNA, 23 bp, Artificial sequence
  SiRNA target sequence
gaaaaagaaattatttttactag

SEQ ID NO: 162943 - DNA, 23 bp, Artificial sequence
  SiRNA target sequence
aaaaagaaattatttttactagc

SEQ ID NO: 162944 - DNA, 23 bp, Artificial sequence
  SiRNA target sequence
aaaagaaattatttttactagcg

SEQ ID NO: 162945 - DNA, 23 bp, Artificial sequence
  SiRNA target sequence
aaagaaattatttttactagcgg

SEQ ID NO: 162946 - DNA, 23 bp, Artificial sequence
  SiRNA target sequence
aagaaattatttttactagcggt

SEQ ID NO: 162947 - DNA, 23 bp, Artificial sequence
  SiRNA target sequence
agaaattatttttactagcggtg

SEQ ID NO: 162948 - DNA, 23 bp, Artificial sequence
  SiRNA target sequence
gaaattatttttactagcggtgc

SEQ ID NO: 162949 - DNA, 23 bp, Artificial sequence
  SiRNA target sequence
aaattatttttactagcggtgct

SEQ ID NO: 162950 - DNA, 23 bp, Artificial sequence
  SiRNA target sequence
aattatttttactagcggtgcta

SEQ ID NO: 162951 - DNA, 23 bp, Artificial sequence
  SiRNA target sequence
attatttttactagcggtgctac

SEQ ID NO: 162952 - DNA, 23 bp, Artificial sequence
  SiRNA target sequence
ttatttttactagcggtgctact

SEQ ID NO: 162953 - DNA, 23 bp, Artificial sequence
  SiRNA target sequence
tatttttactagcggtgctactg

SEQ ID NO: 162954 - DNA, 23 bp, Artificial sequence
  SiRNA target sequence
atttttactagcggtgctactga

SEQ ID NO: 162955 - DNA, 23 bp, Artificial sequence
  SiRNA target sequence
tttttactagcggtgctactgag

SEQ ID NO: 162956 - DNA, 23 bp, Artificial sequence
  SiRNA target sequence
ttttactagcggtgctactgaga

SEQ ID NO: 162957 - DNA, 23 bp, Artificial sequence
  SiRNA target sequence
tttactagcggtgctactgagag

SEQ ID NO: 162958 - DNA, 23 bp, Artificial sequence
  SiRNA target sequence
ttactagcggtgctactgagagt

SEQ ID NO: 162959 - DNA, 23 bp, Artificial sequence
  SiRNA target sequence
tactagcggtgctactgagagta

SEQ ID NO: 162960 - DNA, 23 bp, Artificial sequence
  SiRNA target sequence
actagcggtgctactgagagtaa

SEQ ID NO: 162961 - DNA, 23 bp, Artificial sequence
  SiRNA target sequence
ctagcggtgctactgagagtaac

SEQ ID NO: 162962 - DNA, 23 bp, Artificial sequence
  SiRNA target sequence
tagcggtgctactgagagtaaca

SEQ ID NO: 162963 - DNA, 23 bp, Artificial sequence
  SiRNA target sequence
agcggtgctactgagagtaacaa

SEQ ID NO: 162964 - DNA, 23 bp, Artificial sequence
  SiRNA target sequence
gcggtgctactgagagtaacaac

SEQ ID NO: 162965 - DNA, 23 bp, Artificial sequence
  SiRNA target sequence
cggtgctactgagagtaacaacc

SEQ ID NO: 162966 - DNA, 23 bp, Artificial sequence
  SiRNA target sequence
ggtgctactgagagtaacaacct

SEQ ID NO: 162967 - DNA, 23 bp, Artificial sequence
  SiRNA target sequence
gtgctactgagagtaacaacctt

SEQ ID NO: 162968 - DNA, 23 bp, Artificial sequence
  SiRNA target sequence
tgctactgagagtaacaaccttg

SEQ ID NO: 162969 - DNA, 23 bp, Artificial sequence
  SiRNA target sequence
gctactgagagtaacaaccttgc

SEQ ID NO: 162970 - DNA, 23 bp, Artificial sequence
  SiRNA target sequence
ctactgagagtaacaaccttgca

SEQ ID NO: 162971 - DNA, 23 bp, Artificial sequence
  SiRNA target sequence
tactgagagtaacaaccttgcac

SEQ ID NO: 162972 - DNA, 23 bp, Artificial sequence
  SiRNA target sequence
actgagagtaacaaccttgcact

SEQ ID NO: 162973 - DNA, 23 bp, Artificial sequence
  SiRNA target sequence
ctgagagtaacaaccttgcacta

SEQ ID NO: 162974 - DNA, 23 bp, Artificial sequence
  SiRNA target sequence
tgagagtaacaaccttgcactaa

SEQ ID NO: 162975 - DNA, 23 bp, Artificial sequence
  SiRNA target sequence
gagagtaacaaccttgcactaaa

SEQ ID NO: 162976 - DNA, 23 bp, Artificial sequence
  SiRNA target sequence
agagtaacaaccttgcactaaag

SEQ ID NO: 162977 - DNA, 23 bp, Artificial sequence
  SiRNA target sequence
gagtaacaaccttgcactaaagg

SEQ ID NO: 162978 - DNA, 23 bp, Artificial sequence
  SiRNA target sequence
agtaacaaccttgcactaaaggg

SEQ ID NO: 162979 - DNA, 23 bp, Artificial sequence
  SiRNA target sequence
gtaacaaccttgcactaaagggt

SEQ ID NO: 162980 - DNA, 23 bp, Artificial sequence
  SiRNA target sequence
taacaaccttgcactaaagggtg

SEQ ID NO: 162981 - DNA, 23 bp, Artificial sequence
  SiRNA target sequence
aacaaccttgcactaaagggtgt

SEQ ID NO: 162982 - DNA, 23 bp, Artificial sequence
  SiRNA target sequence
acaaccttgcactaaagggtgtc

SEQ ID NO: 162983 - DNA, 23 bp, Artificial sequence
  SiRNA target sequence
caaccttgcactaaagggtgtct

SEQ ID NO: 162984 - DNA, 23 bp, Artificial sequence
  SiRNA target sequence
aaccttgcactaaagggtgtctt

SEQ ID NO: 162985 - DNA, 23 bp, Artificial sequence
  SiRNA target sequence
accttgcactaaagggtgtcttt

SEQ ID NO: 162986 - DNA, 23 bp, Artificial sequence
  SiRNA target sequence
ccttgcactaaagggtgtctttg

SEQ ID NO: 162987 - DNA, 23 bp, Artificial sequence
  SiRNA target sequence
cttgcactaaagggtgtctttgc

SEQ ID NO: 162988 - DNA, 23 bp, Artificial sequence
  SiRNA target sequence
ttgcactaaagggtgtctttgca

SEQ ID NO: 162989 - DNA, 23 bp, Artificial sequence
  SiRNA target sequence
tgcactaaagggtgtctttgcat

SEQ ID NO: 162990 - DNA, 23 bp, Artificial sequence
  SiRNA target sequence
gcactaaagggtgtctttgcatt

SEQ ID NO: 162991 - DNA, 23 bp, Artificial sequence
  SiRNA target sequence
cactaaagggtgtctttgcattt

SEQ ID NO: 162992 - DNA, 23 bp, Artificial sequence
  SiRNA target sequence
actaaagggtgtctttgcatttt

SEQ ID NO: 162993 - DNA, 23 bp, Artificial sequence
  SiRNA target sequence
ctaaagggtgtctttgcattttt

SEQ ID NO: 162994 - DNA, 23 bp, Artificial sequence
  SiRNA target sequence
taaagggtgtctttgcattttta

SEQ ID NO: 162995 - DNA, 23 bp, Artificial sequence
  SiRNA target sequence
aaagggtgtctttgcatttttaa

SEQ ID NO: 162996 - DNA, 23 bp, Artificial sequence
  SiRNA target sequence
aagggtgtctttgcatttttaaa

SEQ ID NO: 162997 - DNA, 23 bp, Artificial sequence
  SiRNA target sequence
agggtgtctttgcatttttaaaa

SEQ ID NO: 162998 - DNA, 23 bp, Artificial sequence
  SiRNA target sequence
gggtgtctttgcatttttaaaaa

SEQ ID NO: 162999 - DNA, 23 bp, Artificial sequence
  SiRNA target sequence
ggtgtctttgcatttttaaaaaa

SEQ ID NO: 163000 - DNA, 23 bp, Artificial sequence
  SiRNA target sequence
gtgtctttgcatttttaaaaaaa

SEQ ID NO: 163001 - DNA, 23 bp, Artificial sequence
  SiRNA target sequence
tgtctttgcatttttaaaaaaag

SEQ ID NO: 163002 - DNA, 23 bp, Artificial sequence
  SiRNA target sequence
gtctttgcatttttaaaaaaaga

SEQ ID NO: 163003 - DNA, 23 bp, Artificial sequence
  SiRNA target sequence
tctttgcatttttaaaaaaagac

SEQ ID NO: 163004 - DNA, 23 bp, Artificial sequence
  SiRNA target sequence
ctttgcatttttaaaaaaagaca

SEQ ID NO: 163005 - DNA, 23 bp, Artificial sequence
  SiRNA target sequence
tttgcatttttaaaaaaagacaa

SEQ ID NO: 163006 - DNA, 23 bp, Artificial sequence
  SiRNA target sequence
ttgcatttttaaaaaaagacaat

SEQ ID NO: 163007 - DNA, 23 bp, Artificial sequence
  SiRNA target sequence
tgcatttttaaaaaaagacaata

SEQ ID NO: 163008 - DNA, 23 bp, Artificial sequence
  SiRNA target sequence
gcatttttaaaaaaagacaatag

SEQ ID NO: 163009 - DNA, 23 bp, Artificial sequence
  SiRNA target sequence
catttttaaaaaaagacaatagg

SEQ ID NO: 163010 - DNA, 23 bp, Artificial sequence
  SiRNA target sequence
atttttaaaaaaagacaataggc

SEQ ID NO: 163011 - DNA, 23 bp, Artificial sequence
  SiRNA target sequence
tttttaaaaaaagacaataggcc

SEQ ID NO: 163012 - DNA, 23 bp, Artificial sequence
  SiRNA target sequence
ttttaaaaaaagacaataggcct

SEQ ID NO: 163013 - DNA, 23 bp, Artificial sequence
  SiRNA target sequence
tttaaaaaaagacaataggcctg

SEQ ID NO: 163014 - DNA, 23 bp, Artificial sequence
  SiRNA target sequence
ttaaaaaaagacaataggcctgt

SEQ ID NO: 163015 - DNA, 23 bp, Artificial sequence
  SiRNA target sequence
taaaaaaagacaataggcctgtt

SEQ ID NO: 163016 - DNA, 23 bp, Artificial sequence
  SiRNA target sequence
aaaaaaagacaataggcctgttc

SEQ ID NO: 163017 - DNA, 23 bp, Artificial sequence
  SiRNA target sequence
aaaaaagacaataggcctgttca

SEQ ID NO: 163018 - DNA, 23 bp, Artificial sequence
  SiRNA target sequence
aaaaagacaataggcctgttcat

SEQ ID NO: 163019 - DNA, 23 bp, Artificial sequence
  SiRNA target sequence
aaaagacaataggcctgttcata

SEQ ID NO: 163020 - DNA, 23 bp, Artificial sequence
  SiRNA target sequence
aaagacaataggcctgttcatat

SEQ ID NO: 163021 - DNA, 23 bp, Artificial sequence
  SiRNA target sequence
aagacaataggcctgttcatatc

SEQ ID NO: 163022 - DNA, 23 bp, Artificial sequence
  SiRNA target sequence
agacaataggcctgttcatatca

SEQ ID NO: 163023 - DNA, 23 bp, Artificial sequence
  SiRNA target sequence
gacaataggcctgttcatatcat

SEQ ID NO: 163024 - DNA, 23 bp, Artificial sequence
  SiRNA target sequence
acaataggcctgttcatatcatt

SEQ ID NO: 163025 - DNA, 23 bp, Artificial sequence
  SiRNA target sequence
caataggcctgttcatatcatta

SEQ ID NO: 163026 - DNA, 23 bp, Artificial sequence
  SiRNA target sequence
aataggcctgttcatatcattac

SEQ ID NO: 163027 - DNA, 23 bp, Artificial sequence
  SiRNA target sequence
ataggcctgttcatatcattacc

SEQ ID NO: 163028 - DNA, 23 bp, Artificial sequence
  SiRNA target sequence
taggcctgttcatatcattacca

SEQ ID NO: 163029 - DNA, 23 bp, Artificial sequence
  SiRNA target sequence
aggcctgttcatatcattaccac

SEQ ID NO: 163030 - DNA, 23 bp, Artificial sequence
  SiRNA target sequence
ggcctgttcatatcattaccaca

SEQ ID NO: 163031 - DNA, 23 bp, Artificial sequence
  SiRNA target sequence
gcctgttcatatcattaccacac

SEQ ID NO: 163032 - DNA, 23 bp, Artificial sequence
  SiRNA target sequence
cctgttcatatcattaccacaca

SEQ ID NO: 163033 - DNA, 23 bp, Artificial sequence
  SiRNA target sequence
ctgttcatatcattaccacacaa

SEQ ID NO: 163034 - DNA, 23 bp, Artificial sequence
  SiRNA target sequence
tgttcatatcattaccacacaaa

SEQ ID NO: 163035 - DNA, 23 bp, Artificial sequence
  SiRNA target sequence
gttcatatcattaccacacaaat

SEQ ID NO: 163036 - DNA, 23 bp, Artificial sequence
  SiRNA target sequence
ttcatatcattaccacacaaatt

SEQ ID NO: 163037 - DNA, 23 bp, Artificial sequence
  SiRNA target sequence
tcatatcattaccacacaaattg

SEQ ID NO: 163038 - DNA, 23 bp, Artificial sequence
  SiRNA target sequence
catatcattaccacacaaattga

SEQ ID NO: 163039 - DNA, 23 bp, Artificial sequence
  SiRNA target sequence
atatcattaccacacaaattgaa

SEQ ID NO: 163040 - DNA, 23 bp, Artificial sequence
  SiRNA target sequence
tatcattaccacacaaattgaac

SEQ ID NO: 163041 - DNA, 23 bp, Artificial sequence
  SiRNA target sequence
atcattaccacacaaattgaaca

SEQ ID NO: 163042 - DNA, 23 bp, Artificial sequence
  SiRNA target sequence
tcattaccacacaaattgaacat

SEQ ID NO: 163043 - DNA, 23 bp, Artificial sequence
  SiRNA target sequence
cattaccacacaaattgaacata

SEQ ID NO: 163044 - DNA, 23 bp, Artificial sequence
  SiRNA target sequence
attaccacacaaattgaacataa

SEQ ID NO: 163045 - DNA, 23 bp, Artificial sequence
  SiRNA target sequence
ttaccacacaaattgaacataaa

SEQ ID NO: 163046 - DNA, 23 bp, Artificial sequence
  SiRNA target sequence
taccacacaaattgaacataaat

SEQ ID NO: 163047 - DNA, 23 bp, Artificial sequence
  SiRNA target sequence
accacacaaattgaacataaatg

SEQ ID NO: 163048 - DNA, 23 bp, Artificial sequence
  SiRNA target sequence
ccacacaaattgaacataaatgt

SEQ ID NO: 163049 - DNA, 23 bp, Artificial sequence
  SiRNA target sequence
cacacaaattgaacataaatgtg

SEQ ID NO: 163050 - DNA, 23 bp, Artificial sequence
  SiRNA target sequence
acacaaattgaacataaatgtgt

SEQ ID NO: 163051 - DNA, 23 bp, Artificial sequence
  SiRNA target sequence
cacaaattgaacataaatgtgta

SEQ ID NO: 163052 - DNA, 23 bp, Artificial sequence
  SiRNA target sequence
acaaattgaacataaatgtgtat

SEQ ID NO: 163053 - DNA, 23 bp, Artificial sequence
  SiRNA target sequence
caaattgaacataaatgtgtatt

SEQ ID NO: 163054 - DNA, 23 bp, Artificial sequence
  SiRNA target sequence
aaattgaacataaatgtgtattg

SEQ ID NO: 163055 - DNA, 23 bp, Artificial sequence
  SiRNA target sequence
aattgaacataaatgtgtattgg

SEQ ID NO: 163056 - DNA, 23 bp, Artificial sequence
  SiRNA target sequence
attgaacataaatgtgtattgga

SEQ ID NO: 163057 - DNA, 23 bp, Artificial sequence
  SiRNA target sequence
ttgaacataaatgtgtattggac

SEQ ID NO: 163058 - DNA, 23 bp, Artificial sequence
  SiRNA target sequence
tgaacataaatgtgtattggaca

SEQ ID NO: 163059 - DNA, 23 bp, Artificial sequence
  SiRNA target sequence
gaacataaatgtgtattggacac

SEQ ID NO: 163060 - DNA, 23 bp, Artificial sequence
  SiRNA target sequence
aacataaatgtgtattggacaca

SEQ ID NO: 163061 - DNA, 23 bp, Artificial sequence
  SiRNA target sequence
acataaatgtgtattggacacat

SEQ ID NO: 163062 - DNA, 23 bp, Artificial sequence
  SiRNA target sequence
cataaatgtgtattggacacatg

SEQ ID NO: 163063 - DNA, 23 bp, Artificial sequence
  SiRNA target sequence
ataaatgtgtattggacacatgt

SEQ ID NO: 163064 - DNA, 23 bp, Artificial sequence
  SiRNA target sequence
taaatgtgtattggacacatgta

SEQ ID NO: 163065 - DNA, 23 bp, Artificial sequence
  SiRNA target sequence
aaatgtgtattggacacatgtag

SEQ ID NO: 163066 - DNA, 23 bp, Artificial sequence
  SiRNA target sequence
aatgtgtattggacacatgtaga

SEQ ID NO: 163067 - DNA, 23 bp, Artificial sequence
  SiRNA target sequence
atgtgtattggacacatgtagaa

SEQ ID NO: 163068 - DNA, 23 bp, Artificial sequence
  SiRNA target sequence
tgtgtattggacacatgtagaag

SEQ ID NO: 163069 - DNA, 23 bp, Artificial sequence
  SiRNA target sequence
gtgtattggacacatgtagaaga

SEQ ID NO: 163070 - DNA, 23 bp, Artificial sequence
  SiRNA target sequence
tgtattggacacatgtagaagat

SEQ ID NO: 163071 - DNA, 23 bp, Artificial sequence
  SiRNA target sequence
gtattggacacatgtagaagatt

SEQ ID NO: 163072 - DNA, 23 bp, Artificial sequence
  SiRNA target sequence
tattggacacatgtagaagatta

SEQ ID NO: 163073 - DNA, 23 bp, Artificial sequence
  SiRNA target sequence
attggacacatgtagaagattag

SEQ ID NO: 163074 - DNA, 23 bp, Artificial sequence
  SiRNA target sequence
ttggacacatgtagaagattaga

SEQ ID NO: 163075 - DNA, 23 bp, Artificial sequence
  SiRNA target sequence
tggacacatgtagaagattagaa

SEQ ID NO: 163076 - DNA, 23 bp, Artificial sequence
  SiRNA target sequence
ggacacatgtagaagattagaag

SEQ ID NO: 163077 - DNA, 23 bp, Artificial sequence
  SiRNA target sequence
gacacatgtagaagattagaaga

SEQ ID NO: 163078 - DNA, 23 bp, Artificial sequence
  SiRNA target sequence
acacatgtagaagattagaagaa

SEQ ID NO: 163079 - DNA, 23 bp, Artificial sequence
  SiRNA target sequence
cacatgtagaagattagaagaag

SEQ ID NO: 163080 - DNA, 23 bp, Artificial sequence
  SiRNA target sequence
acatgtagaagattagaagaaga

SEQ ID NO: 163081 - DNA, 23 bp, Artificial sequence
  SiRNA target sequence
catgtagaagattagaagaagaa

SEQ ID NO: 163082 - DNA, 23 bp, Artificial sequence
  SiRNA target sequence
atgtagaagattagaagaagaag

SEQ ID NO: 163083 - DNA, 23 bp, Artificial sequence
  SiRNA target sequence
tgtagaagattagaagaagaagg

SEQ ID NO: 163084 - DNA, 23 bp, Artificial sequence
  SiRNA target sequence
gtagaagattagaagaagaagga

SEQ ID NO: 163085 - DNA, 23 bp, Artificial sequence
  SiRNA target sequence
tagaagattagaagaagaaggag

SEQ ID NO: 163086 - DNA, 23 bp, Artificial sequence
  SiRNA target sequence
agaagattagaagaagaaggagc

SEQ ID NO: 163087 - DNA, 23 bp, Artificial sequence
  SiRNA target sequence
gaagattagaagaagaaggagct

SEQ ID NO: 163088 - DNA, 23 bp, Artificial sequence
  SiRNA target sequence
aagattagaagaagaaggagcta

SEQ ID NO: 163089 - DNA, 23 bp, Artificial sequence
  SiRNA target sequence
agattagaagaagaaggagctac

SEQ ID NO: 163090 - DNA, 23 bp, Artificial sequence
  SiRNA target sequence
gattagaagaagaaggagctaca

SEQ ID NO: 163091 - DNA, 23 bp, Artificial sequence
  SiRNA target sequence
attagaagaagaaggagctacag

SEQ ID NO: 163092 - DNA, 23 bp, Artificial sequence
  SiRNA target sequence
ttagaagaagaaggagctacagt

SEQ ID NO: 163093 - DNA, 23 bp, Artificial sequence
  SiRNA target sequence
tagaagaagaaggagctacagtg

SEQ ID NO: 163094 - DNA, 23 bp, Artificial sequence
  SiRNA target sequence
agaagaagaaggagctacagtga

SEQ ID NO: 163095 - DNA, 23 bp, Artificial sequence
  SiRNA target sequence
gaagaagaaggagctacagtgac

SEQ ID NO: 163096 - DNA, 23 bp, Artificial sequence
  SiRNA target sequence
aagaagaaggagctacagtgact

SEQ ID NO: 163097 - DNA, 23 bp, Artificial sequence
  SiRNA target sequence
agaagaaggagctacagtgactt

SEQ ID NO: 163098 - DNA, 23 bp, Artificial sequence
  SiRNA target sequence
gaagaaggagctacagtgactta

SEQ ID NO: 163099 - DNA, 23 bp, Artificial sequence
  SiRNA target sequence
aagaaggagctacagtgacttat

SEQ ID NO: 163100 - DNA, 23 bp, Artificial sequence
  SiRNA target sequence
agaaggagctacagtgacttatt

SEQ ID NO: 163101 - DNA, 23 bp, Artificial sequence
  SiRNA target sequence
gaaggagctacagtgacttattt

SEQ ID NO: 163102 - DNA, 23 bp, Artificial sequence
  SiRNA target sequence
aaggagctacagtgacttatttg

SEQ ID NO: 163103 - DNA, 23 bp, Artificial sequence
  SiRNA target sequence
aggagctacagtgacttatttgc

SEQ ID NO: 163104 - DNA, 23 bp, Artificial sequence
  SiRNA target sequence
ggagctacagtgacttatttgcc

SEQ ID NO: 163105 - DNA, 23 bp, Artificial sequence
  SiRNA target sequence
gagctacagtgacttatttgcct

SEQ ID NO: 163106 - DNA, 23 bp, Artificial sequence
  SiRNA target sequence
agctacagtgacttatttgcctg

SEQ ID NO: 163107 - DNA, 23 bp, Artificial sequence
  SiRNA target sequence
gctacagtgacttatttgcctgt

SEQ ID NO: 163108 - DNA, 23 bp, Artificial sequence
  SiRNA target sequence
ctacagtgacttatttgcctgta

SEQ ID NO: 163109 - DNA, 23 bp, Artificial sequence
  SiRNA target sequence
tacagtgacttatttgcctgtag

SEQ ID NO: 163110 - DNA, 23 bp, Artificial sequence
  SiRNA target sequence
acagtgacttatttgcctgtaga

SEQ ID NO: 163111 - DNA, 23 bp, Artificial sequence
  SiRNA target sequence
cagtgacttatttgcctgtagat

SEQ ID NO: 163112 - DNA, 23 bp, Artificial sequence
  SiRNA target sequence
agtgacttatttgcctgtagata

SEQ ID NO: 163113 - DNA, 23 bp, Artificial sequence
  SiRNA target sequence
gtgacttatttgcctgtagataa

SEQ ID NO: 163114 - DNA, 23 bp, Artificial sequence
  SiRNA target sequence
tgacttatttgcctgtagataaa

SEQ ID NO: 163115 - DNA, 23 bp, Artificial sequence
  SiRNA target sequence
gacttatttgcctgtagataaaa

SEQ ID NO: 163116 - DNA, 23 bp, Artificial sequence
  SiRNA target sequence
acttatttgcctgtagataaaaa

SEQ ID NO: 163117 - DNA, 23 bp, Artificial sequence
  SiRNA target sequence
cttatttgcctgtagataaaaat

SEQ ID NO: 163118 - DNA, 23 bp, Artificial sequence
  SiRNA target sequence
ttatttgcctgtagataaaaatg

SEQ ID NO: 163119 - DNA, 23 bp, Artificial sequence
  SiRNA target sequence
tatttgcctgtagataaaaatgg

SEQ ID NO: 163120 - DNA, 23 bp, Artificial sequence
  SiRNA target sequence
atttgcctgtagataaaaatgga

SEQ ID NO: 163121 - DNA, 23 bp, Artificial sequence
  SiRNA target sequence
tttgcctgtagataaaaatggaa

SEQ ID NO: 163122 - DNA, 23 bp, Artificial sequence
  SiRNA target sequence
ttgcctgtagataaaaatggaat

SEQ ID NO: 163123 - DNA, 23 bp, Artificial sequence
  SiRNA target sequence
tgcctgtagataaaaatggaata

SEQ ID NO: 163124 - DNA, 23 bp, Artificial sequence
  SiRNA target sequence
gcctgtagataaaaatggaatag

SEQ ID NO: 163125 - DNA, 23 bp, Artificial sequence
  SiRNA target sequence
cctgtagataaaaatggaatagt

SEQ ID NO: 163126 - DNA, 23 bp, Artificial sequence
  SiRNA target sequence
ctgtagataaaaatggaatagta

SEQ ID NO: 163127 - DNA, 23 bp, Artificial sequence
  SiRNA target sequence
tgtagataaaaatggaatagtag

SEQ ID NO: 163128 - DNA, 23 bp, Artificial sequence
  SiRNA target sequence
gtagataaaaatggaatagtaga

SEQ ID NO: 163129 - DNA, 23 bp, Artificial sequence
  SiRNA target sequence
tagataaaaatggaatagtagat

SEQ ID NO: 163130 - DNA, 23 bp, Artificial sequence
  SiRNA target sequence
agataaaaatggaatagtagatc

SEQ ID NO: 163131 - DNA, 23 bp, Artificial sequence
  SiRNA target sequence
gataaaaatggaatagtagatcc

SEQ ID NO: 163132 - DNA, 23 bp, Artificial sequence
  SiRNA target sequence
ataaaaatggaatagtagatccg

SEQ ID NO: 163133 - DNA, 23 bp, Artificial sequence
  SiRNA target sequence
taaaaatggaatagtagatccgc

SEQ ID NO: 163134 - DNA, 23 bp, Artificial sequence
  SiRNA target sequence
aaaaatggaatagtagatccgca

SEQ ID NO: 163135 - DNA, 23 bp, Artificial sequence
  SiRNA target sequence
aaaatggaatagtagatccgcaa

SEQ ID NO: 163136 - DNA, 23 bp, Artificial sequence
  SiRNA target sequence
aaatggaatagtagatccgcaat

SEQ ID NO: 163137 - DNA, 23 bp, Artificial sequence
  SiRNA target sequence
aatggaatagtagatccgcaatt

SEQ ID NO: 163138 - DNA, 23 bp, Artificial sequence
  SiRNA target sequence
atggaatagtagatccgcaatta

SEQ ID NO: 163139 - DNA, 23 bp, Artificial sequence
  SiRNA target sequence
tggaatagtagatccgcaattaa

SEQ ID NO: 163140 - DNA, 23 bp, Artificial sequence
  SiRNA target sequence
ggaatagtagatccgcaattaat

SEQ ID NO: 163141 - DNA, 23 bp, Artificial sequence
  SiRNA target sequence
gaatagtagatccgcaattaata

SEQ ID NO: 163142 - DNA, 23 bp, Artificial sequence
  SiRNA target sequence
aatagtagatccgcaattaataa

SEQ ID NO: 163143 - DNA, 23 bp, Artificial sequence
  SiRNA target sequence
atagtagatccgcaattaataaa

SEQ ID NO: 163144 - DNA, 23 bp, Artificial sequence
  SiRNA target sequence
tagtagatccgcaattaataaaa

SEQ ID NO: 163145 - DNA, 23 bp, Artificial sequence
  SiRNA target sequence
agtagatccgcaattaataaaaa

SEQ ID NO: 163146 - DNA, 23 bp, Artificial sequence
  SiRNA target sequence
gtagatccgcaattaataaaaaa

SEQ ID NO: 163147 - DNA, 23 bp, Artificial sequence
  SiRNA target sequence
tagatccgcaattaataaaaaac

SEQ ID NO: 163148 - DNA, 23 bp, Artificial sequence
  SiRNA target sequence
agatccgcaattaataaaaaaca

SEQ ID NO: 163149 - DNA, 23 bp, Artificial sequence
  SiRNA target sequence
gatccgcaattaataaaaaacag

SEQ ID NO: 163150 - DNA, 23 bp, Artificial sequence
  SiRNA target sequence
atccgcaattaataaaaaacagt

SEQ ID NO: 163151 - DNA, 23 bp, Artificial sequence
  SiRNA target sequence
tccgcaattaataaaaaacagta

SEQ ID NO: 163152 - DNA, 23 bp, Artificial sequence
  SiRNA target sequence
ccgcaattaataaaaaacagtat

SEQ ID NO: 163153 - DNA, 23 bp, Artificial sequence
  SiRNA target sequence
cgcaattaataaaaaacagtatt

SEQ ID NO: 163154 - DNA, 23 bp, Artificial sequence
  SiRNA target sequence
gcaattaataaaaaacagtatta

SEQ ID NO: 163155 - DNA, 23 bp, Artificial sequence
  SiRNA target sequence
caattaataaaaaacagtattac

SEQ ID NO: 163156 - DNA, 23 bp, Artificial sequence
  SiRNA target sequence
aattaataaaaaacagtattact

SEQ ID NO: 163157 - DNA, 23 bp, Artificial sequence
  SiRNA target sequence
attaataaaaaacagtattacta

SEQ ID NO: 163158 - DNA, 23 bp, Artificial sequence
  SiRNA target sequence
ttaataaaaaacagtattactaa

SEQ ID NO: 163159 - DNA, 23 bp, Artificial sequence
  SiRNA target sequence
taataaaaaacagtattactaaa

SEQ ID NO: 163160 - DNA, 23 bp, Artificial sequence
  SiRNA target sequence
aataaaaaacagtattactaaag

SEQ ID NO: 163161 - DNA, 23 bp, Artificial sequence
  SiRNA target sequence
ataaaaaacagtattactaaaga

SEQ ID NO: 163162 - DNA, 23 bp, Artificial sequence
  SiRNA target sequence
taaaaaacagtattactaaagat

SEQ ID NO: 163163 - DNA, 23 bp, Artificial sequence
  SiRNA target sequence
aaaaaacagtattactaaagata

SEQ ID NO: 163164 - DNA, 23 bp, Artificial sequence
  SiRNA target sequence
aaaaacagtattactaaagatac

SEQ ID NO: 163165 - DNA, 23 bp, Artificial sequence
  SiRNA target sequence
aaaacagtattactaaagatacc

SEQ ID NO: 163166 - DNA, 23 bp, Artificial sequence
  SiRNA target sequence
aaacagtattactaaagataccg

SEQ ID NO: 163167 - DNA, 23 bp, Artificial sequence
  SiRNA target sequence
aacagtattactaaagataccgc

SEQ ID NO: 163168 - DNA, 23 bp, Artificial sequence
  SiRNA target sequence
acagtattactaaagataccgct

SEQ ID NO: 163169 - DNA, 23 bp, Artificial sequence
  SiRNA target sequence
cagtattactaaagataccgctt

SEQ ID NO: 163170 - DNA, 23 bp, Artificial sequence
  SiRNA target sequence
agtattactaaagataccgcttt

SEQ ID NO: 163171 - DNA, 23 bp, Artificial sequence
  SiRNA target sequence
gtattactaaagataccgctttg

SEQ ID NO: 163172 - DNA, 23 bp, Artificial sequence
  SiRNA target sequence
tattactaaagataccgctttgg

SEQ ID NO: 163173 - DNA, 23 bp, Artificial sequence
  SiRNA target sequence
attactaaagataccgctttggt

SEQ ID NO: 163174 - DNA, 23 bp, Artificial sequence
  SiRNA target sequence
ttactaaagataccgctttggtg

SEQ ID NO: 163175 - DNA, 23 bp, Artificial sequence
  SiRNA target sequence
tactaaagataccgctttggtgt

SEQ ID NO: 163176 - DNA, 23 bp, Artificial sequence
  SiRNA target sequence
actaaagataccgctttggtgtc

SEQ ID NO: 163177 - DNA, 23 bp, Artificial sequence
  SiRNA target sequence
ctaaagataccgctttggtgtct

SEQ ID NO: 163178 - DNA, 23 bp, Artificial sequence
  SiRNA target sequence
taaagataccgctttggtgtctg

SEQ ID NO: 163179 - DNA, 23 bp, Artificial sequence
  SiRNA target sequence
aaagataccgctttggtgtctgt

SEQ ID NO: 163180 - DNA, 23 bp, Artificial sequence
  SiRNA target sequence
aagataccgctttggtgtctgtt

SEQ ID NO: 163181 - DNA, 23 bp, Artificial sequence
  SiRNA target sequence
agataccgctttggtgtctgtta

SEQ ID NO: 163182 - DNA, 23 bp, Artificial sequence
  SiRNA target sequence
gataccgctttggtgtctgttat

SEQ ID NO: 163183 - DNA, 23 bp, Artificial sequence
  SiRNA target sequence
ataccgctttggtgtctgttatg

SEQ ID NO: 163184 - DNA, 23 bp, Artificial sequence
  SiRNA target sequence
taccgctttggtgtctgttatgg

SEQ ID NO: 163185 - DNA, 23 bp, Artificial sequence
  SiRNA target sequence
accgctttggtgtctgttatggc

SEQ ID NO: 163186 - DNA, 23 bp, Artificial sequence
  SiRNA target sequence
ccgctttggtgtctgttatggct

SEQ ID NO: 163187 - DNA, 23 bp, Artificial sequence
  SiRNA target sequence
cgctttggtgtctgttatggctg

SEQ ID NO: 163188 - DNA, 23 bp, Artificial sequence
  SiRNA target sequence
gctttggtgtctgttatggctgt

SEQ ID NO: 163189 - DNA, 23 bp, Artificial sequence
  SiRNA target sequence
ctttggtgtctgttatggctgtt

SEQ ID NO: 163190 - DNA, 23 bp, Artificial sequence
  SiRNA target sequence
tttggtgtctgttatggctgtta

SEQ ID NO: 163191 - DNA, 23 bp, Artificial sequence
  SiRNA target sequence
ttggtgtctgttatggctgttaa

SEQ ID NO: 163192 - DNA, 23 bp, Artificial sequence
  SiRNA target sequence
tggtgtctgttatggctgttaac

SEQ ID NO: 163193 - DNA, 23 bp, Artificial sequence
  SiRNA target sequence
ggtgtctgttatggctgttaaca

SEQ ID NO: 163194 - DNA, 23 bp, Artificial sequence
  SiRNA target sequence
gtgtctgttatggctgttaacaa

SEQ ID NO: 163195 - DNA, 23 bp, Artificial sequence
  SiRNA target sequence
tgtctgttatggctgttaacaac

SEQ ID NO: 163196 - DNA, 23 bp, Artificial sequence
  SiRNA target sequence
gtctgttatggctgttaacaacg

SEQ ID NO: 163197 - DNA, 23 bp, Artificial sequence
  SiRNA target sequence
tctgttatggctgttaacaacga

SEQ ID NO: 163198 - DNA, 23 bp, Artificial sequence
  SiRNA target sequence
ctgttatggctgttaacaacgaa

SEQ ID NO: 163199 - DNA, 23 bp, Artificial sequence
  SiRNA target sequence
tgttatggctgttaacaacgaaa

SEQ ID NO: 163200 - DNA, 23 bp, Artificial sequence
  SiRNA target sequence
gttatggctgttaacaacgaaat

SEQ ID NO: 163201 - DNA, 23 bp, Artificial sequence
  SiRNA target sequence
ttatggctgttaacaacgaaatg

SEQ ID NO: 163202 - DNA, 23 bp, Artificial sequence
  SiRNA target sequence
tatggctgttaacaacgaaatgg

SEQ ID NO: 163203 - DNA, 23 bp, Artificial sequence
  SiRNA target sequence
atggctgttaacaacgaaatggg

SEQ ID NO: 163204 - DNA, 23 bp, Artificial sequence
  SiRNA target sequence
tggctgttaacaacgaaatggga

SEQ ID NO: 163205 - DNA, 23 bp, Artificial sequence
  SiRNA target sequence
ggctgttaacaacgaaatgggag

SEQ ID NO: 163206 - DNA, 23 bp, Artificial sequence
  SiRNA target sequence
gctgttaacaacgaaatgggagc

SEQ ID NO: 163207 - DNA, 23 bp, Artificial sequence
  SiRNA target sequence
ctgttaacaacgaaatgggagca

SEQ ID NO: 163208 - DNA, 23 bp, Artificial sequence
  SiRNA target sequence
tgttaacaacgaaatgggagcaa

SEQ ID NO: 163209 - DNA, 23 bp, Artificial sequence
  SiRNA target sequence
gttaacaacgaaatgggagcaat

SEQ ID NO: 163210 - DNA, 23 bp, Artificial sequence
  SiRNA target sequence
ttaacaacgaaatgggagcaata

SEQ ID NO: 163211 - DNA, 23 bp, Artificial sequence
  SiRNA target sequence
taacaacgaaatgggagcaatac

SEQ ID NO: 163212 - DNA, 23 bp, Artificial sequence
  SiRNA target sequence
aacaacgaaatgggagcaataca

SEQ ID NO: 163213 - DNA, 23 bp, Artificial sequence
  SiRNA target sequence
acaacgaaatgggagcaatacaa

SEQ ID NO: 163214 - DNA, 23 bp, Artificial sequence
  SiRNA target sequence
caacgaaatgggagcaatacaac

SEQ ID NO: 163215 - DNA, 23 bp, Artificial sequence
  SiRNA target sequence
aacgaaatgggagcaatacaacc

SEQ ID NO: 163216 - DNA, 23 bp, Artificial sequence
  SiRNA target sequence
acgaaatgggagcaatacaaccg

SEQ ID NO: 163217 - DNA, 23 bp, Artificial sequence
  SiRNA target sequence
cgaaatgggagcaatacaaccgc

SEQ ID NO: 163218 - DNA, 23 bp, Artificial sequence
  SiRNA target sequence
gaaatgggagcaatacaaccgct

SEQ ID NO: 163219 - DNA, 23 bp, Artificial sequence
  SiRNA target sequence
aaatgggagcaatacaaccgctt

SEQ ID NO: 163220 - DNA, 23 bp, Artificial sequence
  SiRNA target sequence
aatgggagcaatacaaccgctta

SEQ ID NO: 163221 - DNA, 23 bp, Artificial sequence
  SiRNA target sequence
atgggagcaatacaaccgcttaa

SEQ ID NO: 163222 - DNA, 23 bp, Artificial sequence
  SiRNA target sequence
tgggagcaatacaaccgcttaaa

SEQ ID NO: 163223 - DNA, 23 bp, Artificial sequence
  SiRNA target sequence
gggagcaatacaaccgcttaaag

SEQ ID NO: 163224 - DNA, 23 bp, Artificial sequence
  SiRNA target sequence
ggagcaatacaaccgcttaaaga

SEQ ID NO: 163225 - DNA, 23 bp, Artificial sequence
  SiRNA target sequence
gagcaatacaaccgcttaaagaa

SEQ ID NO: 163226 - DNA, 23 bp, Artificial sequence
  SiRNA target sequence
agcaatacaaccgcttaaagaaa

SEQ ID NO: 163227 - DNA, 23 bp, Artificial sequence
  SiRNA target sequence
gcaatacaaccgcttaaagaaat

SEQ ID NO: 163228 - DNA, 23 bp, Artificial sequence
  SiRNA target sequence
caatacaaccgcttaaagaaata

SEQ ID NO: 163229 - DNA, 23 bp, Artificial sequence
  SiRNA target sequence
aatacaaccgcttaaagaaatag

SEQ ID NO: 163230 - DNA, 23 bp, Artificial sequence
  SiRNA target sequence
atacaaccgcttaaagaaatagg

SEQ ID NO: 163231 - DNA, 23 bp, Artificial sequence
  SiRNA target sequence
tacaaccgcttaaagaaatagga

SEQ ID NO: 163232 - DNA, 23 bp, Artificial sequence
  SiRNA target sequence
acaaccgcttaaagaaataggaa

SEQ ID NO: 163233 - DNA, 23 bp, Artificial sequence
  SiRNA target sequence
caaccgcttaaagaaataggaag

SEQ ID NO: 163234 - DNA, 23 bp, Artificial sequence
  SiRNA target sequence
aaccgcttaaagaaataggaaga

SEQ ID NO: 163235 - DNA, 23 bp, Artificial sequence
  SiRNA target sequence
accgcttaaagaaataggaagaa

SEQ ID NO: 163236 - DNA, 23 bp, Artificial sequence
  SiRNA target sequence
ccgcttaaagaaataggaagaat

SEQ ID NO: 163237 - DNA, 23 bp, Artificial sequence
  SiRNA target sequence
cgcttaaagaaataggaagaata

SEQ ID NO: 163238 - DNA, 23 bp, Artificial sequence
  SiRNA target sequence
gcttaaagaaataggaagaatat
